United States Patent 7,888,497 (BIOINFORMATICALLY DETECTABLE GROUP OF NOVEL REGULATORY OLIGONUCLEOTIDES AND USES THEREOF) - sequence listing, part 50

SEQ ID NO: 2095668 - DNA, 17 bp, Homo sapiens
cctttaagtttagaaat

SEQ ID NO: 2095669 - DNA, 19 bp, Homo sapiens
cctttaggcagcctgccgc

SEQ ID NO: 2095670 - DNA, 22 bp, Homo sapiens
cctttagggcttatggccaggg

SEQ ID NO: 2095671 - DNA, 15 bp, Homo sapiens
cctttaggtctggtt

SEQ ID NO: 2095672 - DNA, 17 bp, Homo sapiens
cctttattgctcctgta

SEQ ID NO: 2095673 - DNA, 15 bp, Homo sapiens
cctttcaaatttcac

SEQ ID NO: 2095674 - DNA, 15 bp, Homo sapiens
cctttcaaggaaagt

SEQ ID NO: 2095675 - DNA, 21 bp, Homo sapiens
cctttcacaaaattttattcc

SEQ ID NO: 2095676 - DNA, 15 bp, Homo sapiens
cctttcagctgtgaa

SEQ ID NO: 2095677 - DNA, 21 bp, Homo sapiens
cctttcaggagggtccccagc

SEQ ID NO: 2095678 - DNA, 18 bp, Homo sapiens
cctttccacctgctttct

SEQ ID NO: 2095679 - DNA, 22 bp, Homo sapiens
cctttccacctgctttctcctg

SEQ ID NO: 2095680 - DNA, 17 bp, Homo sapiens
cctttcccatgatccag

SEQ ID NO: 2095681 - DNA, 18 bp, Homo sapiens
cctttcccatgatccaga

SEQ ID NO: 2095682 - DNA, 14 bp, Homo sapiens
cctttcccatgctg

SEQ ID NO: 2095683 - DNA, 16 bp, Homo sapiens
cctttcccatgctgaa

SEQ ID NO: 2095684 - DNA, 19 bp, Homo sapiens
cctttcccccaccccagag

SEQ ID NO: 2095685 - DNA, 16 bp, Homo sapiens
cctttccctcaccccc

SEQ ID NO: 2095686 - DNA, 17 bp, Homo sapiens
cctttccctcaccccct

SEQ ID NO: 2095687 - DNA, 16 bp, Homo sapiens
cctttccgctgtcgcc

SEQ ID NO: 2095688 - DNA, 21 bp, Homo sapiens
cctttccgctgtcgccccagg

SEQ ID NO: 2095689 - DNA, 16 bp, Homo sapiens
cctttcctccccacct

SEQ ID NO: 2095690 - DNA, 15 bp, Homo sapiens
cctttctagttgaaa

SEQ ID NO: 2095691 - DNA, 16 bp, Homo sapiens
cctttctccagccagc

SEQ ID NO: 2095692 - DNA, 18 bp, Homo sapiens
cctttctccagccagcaa

SEQ ID NO: 2095693 - DNA, 20 bp, Homo sapiens
cctttctccagccagcaatg

SEQ ID NO: 2095694 - DNA, 22 bp, Homo sapiens
cctttctcgtggtagaagccag

SEQ ID NO: 2095695 - DNA, 19 bp, Homo sapiens
cctttctctggctccagaa

SEQ ID NO: 2095696 - DNA, 21 bp, Homo sapiens
cctttctgagtgacatgggtg

SEQ ID NO: 2095697 - DNA, 23 bp, Homo sapiens
cctttctgagtgacatgggtgtg

SEQ ID NO: 2095698 - DNA, 11 bp, Homo sapiens
cctttctgtgg

SEQ ID NO: 2095699 - DNA, 13 bp, Homo sapiens
cctttctgtgtgc

SEQ ID NO: 2095700 - DNA, 22 bp, Homo sapiens
cctttgaaattcccccacttgg

SEQ ID NO: 2095701 - DNA, 16 bp, Homo sapiens
cctttgagaaagaaat

SEQ ID NO: 2095702 - DNA, 15 bp, Homo sapiens
cctttgattccattt

SEQ ID NO: 2095703 - DNA, 14 bp, Homo sapiens
cctttgcactgagg

SEQ ID NO: 2095704 - DNA, 16 bp, Homo sapiens
cctttgcactgagggc

SEQ ID NO: 2095705 - DNA, 17 bp, Homo sapiens
cctttgcactgagggcc

SEQ ID NO: 2095706 - DNA, 14 bp, Homo sapiens
cctttgccccaagg

SEQ ID NO: 2095707 - DNA, 19 bp, Homo sapiens
cctttgccccaaggctgct

SEQ ID NO: 2095708 - DNA, 21 bp, Homo sapiens
cctttgccccaaggctgctca

SEQ ID NO: 2095709 - DNA, 14 bp, Homo sapiens
cctttgccccctgt

SEQ ID NO: 2095710 - DNA, 18 bp, Homo sapiens
cctttggaaaaatcttgg

SEQ ID NO: 2095711 - DNA, 19 bp, Homo sapiens
cctttggatgaccagaaca

SEQ ID NO: 2095712 - DNA, 14 bp, Homo sapiens
cctttgggaagggg

SEQ ID NO: 2095713 - DNA, 18 bp, Homo sapiens
cctttgggatcagcctcc

SEQ ID NO: 2095714 - DNA, 19 bp, Homo sapiens
cctttgttttgcactgaca

SEQ ID NO: 2095715 - DNA, 14 bp, Homo sapiens
ccttttaggctcag

SEQ ID NO: 2095716 - DNA, 19 bp, Homo sapiens
ccttttataccagagacct

SEQ ID NO: 2095717 - DNA, 15 bp, Homo sapiens
ccttttatgttattt

SEQ ID NO: 2095718 - DNA, 13 bp, Homo sapiens
ccttttcacggga

SEQ ID NO: 2095719 - DNA, 18 bp, Homo sapiens
ccttttcatctccagtgt

SEQ ID NO: 2095720 - DNA, 15 bp, Homo sapiens
ccttttctctcccat

SEQ ID NO: 2095721 - DNA, 12 bp, Homo sapiens
ccttttctgacc

SEQ ID NO: 2095722 - DNA, 18 bp, Homo sapiens
ccttttctgaccaaagag

SEQ ID NO: 2095723 - DNA, 12 bp, Homo sapiens
ccttttcttata

SEQ ID NO: 2095724 - DNA, 15 bp, Homo sapiens
ccttttcttccttct

SEQ ID NO: 2095725 - DNA, 22 bp, Homo sapiens
ccttttctttttcccttgaact

SEQ ID NO: 2095726 - DNA, 22 bp, Homo sapiens
ccttttgatggggagaaagggc

SEQ ID NO: 2095727 - DNA, 14 bp, Homo sapiens
ccttttgcctggct

SEQ ID NO: 2095728 - DNA, 15 bp, Homo sapiens
ccttttgcctggctg

SEQ ID NO: 2095729 - DNA, 18 bp, Homo sapiens
ccttttgcctggctgtgg

SEQ ID NO: 2095730 - DNA, 18 bp, Homo sapiens
ccttttgtccccagggcc

SEQ ID NO: 2095731 - DNA, 22 bp, Homo sapiens
cggcaactaagcagtccctgag

SEQ ID NO: 2095732 - DNA, 22 bp, Homo sapiens
cggcacagaggcagctgtgtgg

SEQ ID NO: 2095733 - DNA, 20 bp, Homo sapiens
cggcacctgggccctggggc

SEQ ID NO: 2095734 - DNA, 16 bp, Homo sapiens
cggcagcctcaggggc

SEQ ID NO: 2095735 - DNA, 22 bp, Homo sapiens
cggcagcctcaggggcctcagg

SEQ ID NO: 2095736 - DNA, 10 bp, Homo sapiens
cggcagctgt

SEQ ID NO: 2095737 - DNA, 14 bp, Homo sapiens
cggcagctgtagct

SEQ ID NO: 2095738 - DNA, 18 bp, Homo sapiens
cggcagcttgagcctgtc

SEQ ID NO: 2095739 - DNA, 19 bp, Homo sapiens
cggcaggagcaggaacaga

SEQ ID NO: 2095740 - DNA, 20 bp, Homo sapiens
cggcaggctgggttcattcc

SEQ ID NO: 2095741 - DNA, 18 bp, Homo sapiens
cggcagtcatactggggt

SEQ ID NO: 2095742 - DNA, 15 bp, Homo sapiens
cggcatgctggcctg

SEQ ID NO: 2095743 - DNA, 20 bp, Homo sapiens
cggcatgctggcctgtggca

SEQ ID NO: 2095744 - DNA, 11 bp, Homo sapiens
cggccaggcca

SEQ ID NO: 2095745 - DNA, 15 bp, Homo sapiens
cggccaggcgggaga

SEQ ID NO: 2095746 - DNA, 15 bp, Homo sapiens
cggcccacagctccc

SEQ ID NO: 2095747 - DNA, 19 bp, Homo sapiens
cggcccacagctcccaccc

SEQ ID NO: 2095748 - DNA, 21 bp, Homo sapiens
cggcccagaagtttccctcaa

SEQ ID NO: 2095749 - DNA, 21 bp, Homo sapiens
cggcccagagaccccttcctt

SEQ ID NO: 2095750 - DNA, 15 bp, Homo sapiens
cggcccaggcctcca

SEQ ID NO: 2095751 - DNA, 17 bp, Homo sapiens
cggccccatcagaggct

SEQ ID NO: 2095752 - DNA, 18 bp, Homo sapiens
cggccccatcagaggctg

SEQ ID NO: 2095753 - DNA, 20 bp, Homo sapiens
cggccccatcagaggctggg

SEQ ID NO: 2095754 - DNA, 22 bp, Homo sapiens
cggcccctgcatccccttggct

SEQ ID NO: 2095755 - DNA, 16 bp, Homo sapiens
cggccctgccccatcc

SEQ ID NO: 2095756 - DNA, 13 bp, Homo sapiens
cggccgcattccc

SEQ ID NO: 2095757 - DNA, 18 bp, Homo sapiens
cggcctatgacttgggca

SEQ ID NO: 2095758 - DNA, 21 bp, Homo sapiens
cggcctccactcccccacctg

SEQ ID NO: 2095759 - DNA, 21 bp, Homo sapiens
cggcctccgtccaggagcctg

SEQ ID NO: 2095760 - DNA, 22 bp, Homo sapiens
cggcctccgtccaggagcctgg

SEQ ID NO: 2095761 - DNA, 13 bp, Homo sapiens
cggcctcttccac

SEQ ID NO: 2095762 - DNA, 21 bp, Homo sapiens
cggcggccctcaaaagcactt

SEQ ID NO: 2095763 - DNA, 21 bp, Homo sapiens
cggcggtggactgcgctggac

SEQ ID NO: 2095764 - DNA, 12 bp, Homo sapiens
cggctactcagc

SEQ ID NO: 2095765 - DNA, 14 bp, Homo sapiens
cggctcactgcagc

SEQ ID NO: 2095766 - DNA, 15 bp, Homo sapiens
cggctcactgcagcc

SEQ ID NO: 2095767 - DNA, 16 bp, Homo sapiens
cggctcactgcagcct

SEQ ID NO: 2095768 - DNA, 18 bp, Homo sapiens
cggctcactgcagcctca

SEQ ID NO: 2095769 - DNA, 12 bp, Homo sapiens
cggctgcctgcc

SEQ ID NO: 2095770 - DNA, 22 bp, Homo sapiens
cggctgcctgccgcccaaagag

SEQ ID NO: 2095771 - DNA, 23 bp, Homo sapiens
cggcttagacttcgactcaggat

SEQ ID NO: 2095772 - DNA, 14 bp, Homo sapiens
cggcttcctgtcca

SEQ ID NO: 2095773 - DNA, 16 bp, Homo sapiens
cggcttcctgtccact

SEQ ID NO: 2095774 - DNA, 15 bp, Homo sapiens
cggcttggccgccat

SEQ ID NO: 2095775 - DNA, 17 bp, Homo sapiens
cggcttggccgccatcc

SEQ ID NO: 2095776 - DNA, 13 bp, Homo sapiens
cgggaacagtgtt

SEQ ID NO: 2095777 - DNA, 12 bp, Homo sapiens
cgggaagcggag

SEQ ID NO: 2095778 - DNA, 14 bp, Homo sapiens
cgggaaggagggtt

SEQ ID NO: 2095779 - DNA, 23 bp, Homo sapiens
cgggaaggagggttagggagggg

SEQ ID NO: 2095780 - DNA, 14 bp, Homo sapiens
cgggacagacctgg

SEQ ID NO: 2095781 - DNA, 15 bp, Homo sapiens
cgggacagagaggag

SEQ ID NO: 2095782 - DNA, 17 bp, Homo sapiens
cgggaccattgacctca

SEQ ID NO: 2095783 - DNA, 18 bp, Homo sapiens
cgggaccattgacctcag

SEQ ID NO: 2095784 - DNA, 22 bp, Homo sapiens
cgggaccattgacctcagctgc

SEQ ID NO: 2095785 - DNA, 14 bp, Homo sapiens
cgggacgcttccag

SEQ ID NO: 2095786 - DNA, 15 bp, Homo sapiens
cgggacgcttccaga

SEQ ID NO: 2095787 - DNA, 17 bp, Homo sapiens
cgggacgcttccagacc

SEQ ID NO: 2095788 - DNA, 22 bp, Homo sapiens
cgggacgcttccagaccacctg

SEQ ID NO: 2095789 - DNA, 21 bp, Homo sapiens
cgggagatggacccctccctt

SEQ ID NO: 2095790 - DNA, 14 bp, Homo sapiens
cgggagcagtgtct

SEQ ID NO: 2095791 - DNA, 13 bp, Homo sapiens
cgggagcctcctc

SEQ ID NO: 2095792 - DNA, 15 bp, Homo sapiens
cgggagcctcctctg

SEQ ID NO: 2095793 - DNA, 21 bp, Homo sapiens
cgggaggatgttctgggacac

SEQ ID NO: 2095794 - DNA, 23 bp, Homo sapiens
cgggaggatgttctgggacacag

SEQ ID NO: 2095795 - DNA, 18 bp, Homo sapiens
cgggaggcaccagctctg

SEQ ID NO: 2095796 - DNA, 15 bp, Homo sapiens
cgggaggcctcagtt

SEQ ID NO: 2095797 - DNA, 21 bp, Homo sapiens
cgggaggcggaggttccagtg

SEQ ID NO: 2095798 - DNA, 23 bp, Homo sapiens
cgggaggctgagacaggagaatc

SEQ ID NO: 2095799 - DNA, 20 bp, Homo sapiens
cgggaggtggaggttgcagt

SEQ ID NO: 2095800 - DNA, 22 bp, Homo sapiens
cgggagtgacgggagcctcctc

SEQ ID NO: 2095801 - DNA, 14 bp, Homo sapiens
cgggcactcagaag

SEQ ID NO: 2095802 - DNA, 16 bp, Homo sapiens
cgggcagcccagcctc

SEQ ID NO: 2095803 - DNA, 21 bp, Homo sapiens
cgggcaggtcctgcccatgtg

SEQ ID NO: 2095804 - DNA, 23 bp, Homo sapiens
cgggcaggtcctgcccatgtgtc

SEQ ID NO: 2095805 - DNA, 18 bp, Homo sapiens
cgggcatgtattatcaca

SEQ ID NO: 2095806 - DNA, 17 bp, Homo sapiens
cgggccacagagaaagt

SEQ ID NO: 2095807 - DNA, 12 bp, Homo sapiens
cgggcctcagtt

SEQ ID NO: 2095808 - DNA, 14 bp, Homo sapiens
cgggcctcttccct

SEQ ID NO: 2095809 - DNA, 17 bp, Homo sapiens
cgggcctcttccctcag

SEQ ID NO: 2095810 - DNA, 16 bp, Homo sapiens
cgggcctggagaacta

SEQ ID NO: 2095811 - DNA, 20 bp, Homo sapiens
cgggcctggagaactagaga

SEQ ID NO: 2095812 - DNA, 18 bp, Homo sapiens
cgggcgctgtggctcctg

SEQ ID NO: 2095813 - DNA, 21 bp, Homo sapiens
cgggcgctgtggctcctgcct

SEQ ID NO: 2095814 - DNA, 22 bp, Homo sapiens
cgggcgctgtggctcctgcctt

SEQ ID NO: 2095815 - DNA, 15 bp, Homo sapiens
cgggcggaggcggct

SEQ ID NO: 2095816 - DNA, 17 bp, Homo sapiens
cgggctctggccaccct

SEQ ID NO: 2095817 - DNA, 14 bp, Homo sapiens
cgggctgccctgcc

SEQ ID NO: 2095818 - DNA, 19 bp, Homo sapiens
cgggctgcccttcgctgcc

SEQ ID NO: 2095819 - DNA, 21 bp, Homo sapiens
cgggctgcccttcgctgccag

SEQ ID NO: 2095820 - DNA, 14 bp, Homo sapiens
cgggctgtgcctta

SEQ ID NO: 2095821 - DNA, 14 bp, Homo sapiens
cggggaactcctgg

SEQ ID NO: 2095822 - DNA, 15 bp, Homo sapiens
cggggaactcctgga

SEQ ID NO: 2095823 - DNA, 20 bp, Homo sapiens
cggggaactggccaagctga

SEQ ID NO: 2095824 - DNA, 15 bp, Homo sapiens
cggggacagctcctt

SEQ ID NO: 2095825 - DNA, 16 bp, Homo sapiens
cggggaggaggagctg

SEQ ID NO: 2095826 - DNA, 18 bp, Homo sapiens
cggggaggaggagctgcc

SEQ ID NO: 2095827 - DNA, 15 bp, Homo sapiens
cggggagggggacgc

SEQ ID NO: 2095828 - DNA, 15 bp, Homo sapiens
cggggcactgcaggg

SEQ ID NO: 2095829 - DNA, 19 bp, Homo sapiens
cggggcaggaggcctggcc

SEQ ID NO: 2095830 - DNA, 16 bp, Homo sapiens
cggggcatgctggggc

SEQ ID NO: 2095831 - DNA, 14 bp, Homo sapiens
cggggccccagggc

SEQ ID NO: 2095832 - DNA, 19 bp, Homo sapiens
cggggcgacccctcagtgc

SEQ ID NO: 2095833 - DNA, 22 bp, Homo sapiens
cggggcttctgggtggctcctg

SEQ ID NO: 2095834 - DNA, 19 bp, Homo sapiens
cgggggagccaacagcagc

SEQ ID NO: 2095835 - DNA, 18 bp, Homo sapiens
cgggggcccgaaagctga

SEQ ID NO: 2095836 - DNA, 18 bp, Homo sapiens
cgggggtgcggcaggagc

SEQ ID NO: 2095837 - DNA, 21 bp, Homo sapiens
cgggggtgcggcaggagcagg

SEQ ID NO: 2095838 - DNA, 19 bp, Homo sapiens
cgggggtggcaagggggcg

SEQ ID NO: 2095839 - DNA, 23 bp, Homo sapiens
cgggggtggcaagggggcggggc

SEQ ID NO: 2095840 - DNA, 13 bp, Homo sapiens
cggggtctgtgct

SEQ ID NO: 2095841 - DNA, 20 bp, Homo sapiens
cggggtctgtgctgtgcctg

SEQ ID NO: 2095842 - DNA, 22 bp, Homo sapiens
cggggtctgtgctgtgcctgct

SEQ ID NO: 2095843 - DNA, 23 bp, Homo sapiens
cggggtctgtgctgtgcctgcta

SEQ ID NO: 2095844 - DNA, 17 bp, Homo sapiens
cggggtgcacaggaggg

SEQ ID NO: 2095845 - DNA, 14 bp, Homo sapiens
ctaccaccccttcc

SEQ ID NO: 2095846 - DNA, 18 bp, Homo sapiens
ctaccaccccttcctgtc

SEQ ID NO: 2095847 - DNA, 14 bp, Homo sapiens
ctaccaccttccct

SEQ ID NO: 2095848 - DNA, 22 bp, Homo sapiens
ctaccaggtcaaaatagtgcca

SEQ ID NO: 2095849 - DNA, 16 bp, Homo sapiens
ctacccaaccactcaa

SEQ ID NO: 2095850 - DNA, 21 bp, Homo sapiens
ctacccactctttgctacaat

SEQ ID NO: 2095851 - DNA, 16 bp, Homo sapiens
ctacccacttctaaat

SEQ ID NO: 2095852 - DNA, 13 bp, Homo sapiens
ctacccagagcct

SEQ ID NO: 2095853 - DNA, 20 bp, Homo sapiens
ctacccagagccttctcctg

SEQ ID NO: 2095854 - DNA, 20 bp, Homo sapiens
ctacccagcgagccctggtg

SEQ ID NO: 2095855 - DNA, 18 bp, Homo sapiens
ctaccccccctcctgctg

SEQ ID NO: 2095856 - DNA, 13 bp, Homo sapiens
ctaccccctgaaa

SEQ ID NO: 2095857 - DNA, 14 bp, Homo sapiens
ctacccgagcccag

SEQ ID NO: 2095858 - DNA, 14 bp, Homo sapiens
ctacccggcccaga

SEQ ID NO: 2095859 - DNA, 15 bp, Homo sapiens
ctacccggcccagag

SEQ ID NO: 2095860 - DNA, 14 bp, Homo sapiens
ctaccctccagagt

SEQ ID NO: 2095861 - DNA, 15 bp, Homo sapiens
ctaccctccagagtg

SEQ ID NO: 2095862 - DNA, 22 bp, Homo sapiens
ctacccttgtaccccatccctt

SEQ ID NO: 2095863 - DNA, 23 bp, Homo sapiens
ctacccttgtaccccatcccttc

SEQ ID NO: 2095864 - DNA, 17 bp, Homo sapiens
ctacctcacagaaatgt

SEQ ID NO: 2095865 - DNA, 22 bp, Homo sapiens
ctacctcactattcaagtatta

SEQ ID NO: 2095866 - DNA, 11 bp, Homo sapiens
ctacctcagcc

SEQ ID NO: 2095867 - DNA, 14 bp, Homo sapiens
ctacctcagcctag

SEQ ID NO: 2095868 - DNA, 15 bp, Homo sapiens
ctacctcagcctaga

SEQ ID NO: 2095869 - DNA, 16 bp, Homo sapiens
ctacctgctgctgcta

SEQ ID NO: 2095870 - DNA, 16 bp, Homo sapiens
ctacctggtctctcct

SEQ ID NO: 2095871 - DNA, 15 bp, Homo sapiens
ctaccttctctaccc

SEQ ID NO: 2095872 - DNA, 16 bp, Homo sapiens
ctaccttctgacctcc

SEQ ID NO: 2095873 - DNA, 19 bp, Homo sapiens
ctacctttttttctctcct

SEQ ID NO: 2095874 - DNA, 13 bp, Homo sapiens
ctacgtataaata

SEQ ID NO: 2095875 - DNA, 16 bp, Homo sapiens
ctacgttaagggaagg

SEQ ID NO: 2095876 - DNA, 14 bp, Homo sapiens
ctacgttctccagc

SEQ ID NO: 2095877 - DNA, 15 bp, Homo sapiens
ctactactttgtgtt

SEQ ID NO: 2095878 - DNA, 23 bp, Homo sapiens
ctactagttttccttgaaaaaaa

SEQ ID NO: 2095879 - DNA, 20 bp, Homo sapiens
ctactcaagaggctgaggca

SEQ ID NO: 2095880 - DNA, 15 bp, Homo sapiens
ctactcacagtctct

SEQ ID NO: 2095881 - DNA, 17 bp, Homo sapiens
ctactcacagtctcttt

SEQ ID NO: 2095882 - DNA, 13 bp, Homo sapiens
ctactcagaagcc

SEQ ID NO: 2095883 - DNA, 15 bp, Homo sapiens
ctactcagcagccct

SEQ ID NO: 2095884 - DNA, 20 bp, Homo sapiens
ctactcagcagccctcctca

SEQ ID NO: 2095885 - DNA, 20 bp, Homo sapiens
ctactcagctctcctgctgc

SEQ ID NO: 2095886 - DNA, 20 bp, Homo sapiens
ctactcatacttaagcaaaa

SEQ ID NO: 2095887 - DNA, 16 bp, Homo sapiens
ctactcattgtctcag

SEQ ID NO: 2095888 - DNA, 13 bp, Homo sapiens
ctactcccctggg

SEQ ID NO: 2095889 - DNA, 13 bp, Homo sapiens
ctactcctgtgct

SEQ ID NO: 2095890 - DNA, 17 bp, Homo sapiens
ctactctcttgccagca

SEQ ID NO: 2095891 - DNA, 15 bp, Homo sapiens
ctactctgtccaggc

SEQ ID NO: 2095892 - DNA, 16 bp, Homo sapiens
ctactctgtccaggcc

SEQ ID NO: 2095893 - DNA, 17 bp, Homo sapiens
ctactctgtgccagagc

SEQ ID NO: 2095894 - DNA, 16 bp, Homo sapiens
ctactgaatttattgc

SEQ ID NO: 2095895 - DNA, 14 bp, Homo sapiens
ctactgagaaactt

SEQ ID NO: 2095896 - DNA, 16 bp, Homo sapiens
ctactgatttttgtga

SEQ ID NO: 2095897 - DNA, 14 bp, Homo sapiens
ctactgcagcttta

SEQ ID NO: 2095898 - DNA, 17 bp, Homo sapiens
ctactgcagctttacat

SEQ ID NO: 2095899 - DNA, 11 bp, Homo sapiens
ctactggcagc

SEQ ID NO: 2095900 - DNA, 14 bp, Homo sapiens
ctactggcagctcc

SEQ ID NO: 2095901 - DNA, 16 bp, Homo sapiens
ctactggcagctcctc

SEQ ID NO: 2095902 - DNA, 22 bp, Homo sapiens
ctactggcagctcctctccttg

SEQ ID NO: 2095903 - DNA, 21 bp, Homo sapiens
ctactgtaagcaagaaaaata

SEQ ID NO: 2095904 - DNA, 14 bp, Homo sapiens
ctactgtggaaaaa

SEQ ID NO: 2095905 - DNA, 21 bp, Homo sapiens
ctactgtggaaaaatatttaa

SEQ ID NO: 2095906 - DNA, 22 bp, Homo sapiens
ctactgtggaaaaatatttaag

SEQ ID NO: 2095907 - DNA, 19 bp, Homo sapiens
ctacttcattttcagagtg

SEQ ID NO: 2095908 - DNA, 15 bp, Homo sapiens
ctacttcctgcactg

SEQ ID NO: 2095909 - DNA, 17 bp, Homo sapiens
ctacttcggggctggga

SEQ ID NO: 2095910 - DNA, 13 bp, Homo sapiens
ctacttcttggaa

SEQ ID NO: 2095911 - DNA, 18 bp, Homo sapiens
ctacttcttggaaaaaaa

SEQ ID NO: 2095912 - DNA, 18 bp, Homo sapiens
ctacttgtgactgaaggg

SEQ ID NO: 2095913 - DNA, 17 bp, Homo sapiens
ctacttttgcatgaaaa

SEQ ID NO: 2095914 - DNA, 16 bp, Homo sapiens
ctagaaacagatcttg

SEQ ID NO: 2095915 - DNA, 22 bp, Homo sapiens
ctagaaagaaaagaccctgaga

SEQ ID NO: 2095916 - DNA, 23 bp, Homo sapiens
ctagaaagaaaagaccctgagac

SEQ ID NO: 2095917 - DNA, 21 bp, Homo sapiens
ctagaaagctctgcatgtgtg

SEQ ID NO: 2095918 - DNA, 15 bp, Homo sapiens
ctagaaatatgattt

SEQ ID NO: 2095919 - DNA, 14 bp, Homo sapiens
ctagaacacaggca

SEQ ID NO: 2095920 - DNA, 21 bp, Homo sapiens
ctagaacacaggcaaaatcct

SEQ ID NO: 2095921 - DNA, 22 bp, Homo sapiens
ctagaacacaggcaaaatcctt

SEQ ID NO: 2095922 - DNA, 18 bp, Homo sapiens
ctagaaccaagcttcaga

SEQ ID NO: 2095923 - DNA, 19 bp, Homo sapiens
ctagaaccaagcttcagag

SEQ ID NO: 2095924 - DNA, 18 bp, Homo sapiens
ctagaacctggaagggct

SEQ ID NO: 2095925 - DNA, 14 bp, Homo sapiens
ctagaacctggaga

SEQ ID NO: 2095926 - DNA, 16 bp, Homo sapiens
ctagaacctggagggc

SEQ ID NO: 2095927 - DNA, 18 bp, Homo sapiens
ctagaacctggagggctg

SEQ ID NO: 2095928 - DNA, 20 bp, Homo sapiens
ctagaagaaagggcaagaag

SEQ ID NO: 2095929 - DNA, 13 bp, Homo sapiens
ctagaaggccaca

SEQ ID NO: 2095930 - DNA, 16 bp, Homo sapiens
ctagaattgagtgttt

SEQ ID NO: 2095931 - DNA, 15 bp, Homo sapiens
ctagaatttattcaa

SEQ ID NO: 2095932 - DNA, 16 bp, Homo sapiens
ctagaatttgtatttt

SEQ ID NO: 2095933 - DNA, 19 bp, Homo sapiens
ctagaatttgtattttgct

SEQ ID NO: 2095934 - DNA, 13 bp, Homo sapiens
ctagacattacca

SEQ ID NO: 2095935 - DNA, 12 bp, Homo sapiens
ctagacctgggc

SEQ ID NO: 2095936 - DNA, 23 bp, Homo sapiens
ctagacctgggccaaaagggcag

SEQ ID NO: 2095937 - DNA, 12 bp, Homo sapiens
ctagagaagagg

SEQ ID NO: 2095938 - DNA, 19 bp, Homo sapiens
ctagagaagaggctggtgc

SEQ ID NO: 2095939 - DNA, 18 bp, Homo sapiens
ctagagacctctcaacag

SEQ ID NO: 2095940 - DNA, 17 bp, Homo sapiens
ctagagatatggcagcg

SEQ ID NO: 2095941 - DNA, 18 bp, Homo sapiens
ctagagattttcttggca

SEQ ID NO: 2095942 - DNA, 14 bp, Homo sapiens
ctagagcaacccct

SEQ ID NO: 2095943 - DNA, 21 bp, Homo sapiens
ctagagcagcccaaatttttc

SEQ ID NO: 2095944 - DNA, 13 bp, Homo sapiens
ctagagctcctgt

SEQ ID NO: 2095945 - DNA, 14 bp, Homo sapiens
ctagagctcctgtc

SEQ ID NO: 2095946 - DNA, 16 bp, Homo sapiens
ctagagctcctgtccc

SEQ ID NO: 2095947 - DNA, 17 bp, Homo sapiens
ctagagctgagagtctg

SEQ ID NO: 2095948 - DNA, 13 bp, Homo sapiens
ctagagctgggaa

SEQ ID NO: 2095949 - DNA, 22 bp, Homo sapiens
ctagagctgggaaacagggagc

SEQ ID NO: 2095950 - DNA, 18 bp, Homo sapiens
ctagaggcagggagggga

SEQ ID NO: 2095951 - DNA, 19 bp, Homo sapiens
ctagaggcagggaggggac

SEQ ID NO: 2095952 - DNA, 18 bp, Homo sapiens
ctagaggcttccttcatt

SEQ ID NO: 2095953 - DNA, 14 bp, Homo sapiens
ctagaggtgggcag

SEQ ID NO: 2095954 - DNA, 16 bp, Homo sapiens
ctagaggtgggcagct

SEQ ID NO: 2095955 - DNA, 18 bp, Homo sapiens
ctagaggtgggcagctgg

SEQ ID NO: 2095956 - DNA, 23 bp, Homo sapiens
ctagaggtgggcagctgggcccc

SEQ ID NO: 2095957 - DNA, 21 bp, Homo sapiens
ctagagtgactctacctgcaa

SEQ ID NO: 2095958 - DNA, 18 bp, Homo sapiens
ctagatcaattaattctt

SEQ ID NO: 2095959 - DNA, 21 bp, Homo sapiens
ctagatccacacacagaggaa

SEQ ID NO: 2095960 - DNA, 14 bp, Homo sapiens
ctccacagtgctgc

SEQ ID NO: 2095961 - DNA, 22 bp, Homo sapiens
ctccacagttcgacctgcggct

SEQ ID NO: 2095962 - DNA, 13 bp, Homo sapiens
ctccaccaaccca

SEQ ID NO: 2095963 - DNA, 12 bp, Homo sapiens
ctccaccaccca

SEQ ID NO: 2095964 - DNA, 12 bp, Homo sapiens
ctccaccccagg

SEQ ID NO: 2095965 - DNA, 22 bp, Homo sapiens
ctccaccccaggacgccactca

SEQ ID NO: 2095966 - DNA, 18 bp, Homo sapiens
ctccacccccgccacggc

SEQ ID NO: 2095967 - DNA, 19 bp, Homo sapiens
ctccacccccgccacggcc

SEQ ID NO: 2095968 - DNA, 23 bp, Homo sapiens
ctccacccccgccacggccaccc

SEQ ID NO: 2095969 - DNA, 17 bp, Homo sapiens
ctccaccccctccagct

SEQ ID NO: 2095970 - DNA, 15 bp, Homo sapiens
ctccaccctgagcct

SEQ ID NO: 2095971 - DNA, 11 bp, Homo sapiens
ctccaccctgc

SEQ ID NO: 2095972 - DNA, 15 bp, Homo sapiens
ctccaccgctgccta

SEQ ID NO: 2095973 - DNA, 13 bp, Homo sapiens
ctccacctcagcc

SEQ ID NO: 2095974 - DNA, 14 bp, Homo sapiens
ctccacctcagcct

SEQ ID NO: 2095975 - DNA, 16 bp, Homo sapiens
ctccacctcagccttg

SEQ ID NO: 2095976 - DNA, 18 bp, Homo sapiens
ctccacctctccttggaa

SEQ ID NO: 2095977 - DNA, 22 bp, Homo sapiens
ctccacctcttcaccccccact

SEQ ID NO: 2095978 - DNA, 14 bp, Homo sapiens
ctccacgcctcctg

SEQ ID NO: 2095979 - DNA, 15 bp, Homo sapiens
ctccacgcctcctgg

SEQ ID NO: 2095980 - DNA, 16 bp, Homo sapiens
ctccacgcctcctggc

SEQ ID NO: 2095981 - DNA, 21 bp, Homo sapiens
ctccacggtagcacttgacct

SEQ ID NO: 2095982 - DNA, 22 bp, Homo sapiens
ctccacggtgcgtggctgtggc

SEQ ID NO: 2095983 - DNA, 20 bp, Homo sapiens
ctccactaaatgagctcctg

SEQ ID NO: 2095984 - DNA, 15 bp, Homo sapiens
ctccactcactccag

SEQ ID NO: 2095985 - DNA, 13 bp, Homo sapiens
ctccactccaagg

SEQ ID NO: 2095986 - DNA, 15 bp, Homo sapiens
ctccactccacctcc

SEQ ID NO: 2095987 - DNA, 18 bp, Homo sapiens
ctccactcccccacctga

SEQ ID NO: 2095988 - DNA, 21 bp, Homo sapiens
ctccactctccttcgtgtctc

SEQ ID NO: 2095989 - DNA, 11 bp, Homo sapiens
ctccactgcct

SEQ ID NO: 2095990 - DNA, 13 bp, Homo sapiens
ctccactgccttc

SEQ ID NO: 2095991 - DNA, 14 bp, Homo sapiens
ctccactgccttcg

SEQ ID NO: 2095992 - DNA, 13 bp, Homo sapiens
ctccactggctcc

SEQ ID NO: 2095993 - DNA, 11 bp, Homo sapiens
ctccactgtca

SEQ ID NO: 2095994 - DNA, 18 bp, Homo sapiens
ctccactgtcaccctcca

SEQ ID NO: 2095995 - DNA, 15 bp, Homo sapiens
ctccactttgttgga

SEQ ID NO: 2095996 - DNA, 18 bp, Homo sapiens
ctccagaataccttcttc

SEQ ID NO: 2095997 - DNA, 14 bp, Homo sapiens
ctccagaatctgct

SEQ ID NO: 2095998 - DNA, 13 bp, Homo sapiens
ctccagacagata

SEQ ID NO: 2095999 - DNA, 17 bp, Homo sapiens
ctccagacccctggctt

SEQ ID NO: 2096000 - DNA, 18 bp, Homo sapiens
ctccagacccctggcttt

SEQ ID NO: 2096001 - DNA, 21 bp, Homo sapiens
ctccagacccctggcttttca

SEQ ID NO: 2096002 - DNA, 22 bp, Homo sapiens
ctccagacccctgtggcagacc

SEQ ID NO: 2096003 - DNA, 15 bp, Homo sapiens
ctccagaccctgcct

SEQ ID NO: 2096004 - DNA, 21 bp, Homo sapiens
ctccagaccctgcctgagccc

SEQ ID NO: 2096005 - DNA, 18 bp, Homo sapiens
ctccagagaagtttcgag

SEQ ID NO: 2096006 - DNA, 16 bp, Homo sapiens
ctccagagacaggaaa

SEQ ID NO: 2096007 - DNA, 16 bp, Homo sapiens
ctccagagccagcctg

SEQ ID NO: 2096008 - DNA, 18 bp, Homo sapiens
ctccagagccagcctggg

SEQ ID NO: 2096009 - DNA, 15 bp, Homo sapiens
ctccagagtctgagc

SEQ ID NO: 2096010 - DNA, 17 bp, Homo sapiens
ctccagagtctgagccc

SEQ ID NO: 2096011 - DNA, 20 bp, Homo sapiens
ctccagagtgtgcagactga

SEQ ID NO: 2096012 - DNA, 19 bp, Homo sapiens
ctccagatctgcactgggt

SEQ ID NO: 2096013 - DNA, 21 bp, Homo sapiens
ctccagatctgcactgggtgt

SEQ ID NO: 2096014 - DNA, 13 bp, Homo sapiens
ctccagcatccag

SEQ ID NO: 2096015 - DNA, 14 bp, Homo sapiens
ctccagcatccagc

SEQ ID NO: 2096016 - DNA, 15 bp, Homo sapiens
ctccagcatccagcc

SEQ ID NO: 2096017 - DNA, 20 bp, Homo sapiens
ctccagcatccagcctgtgt

SEQ ID NO: 2096018 - DNA, 19 bp, Homo sapiens
ctccagccagcgcctccct

SEQ ID NO: 2096019 - DNA, 20 bp, Homo sapiens
ctccagccatcaagagactg

SEQ ID NO: 2096020 - DNA, 19 bp, Homo sapiens
ctccagcccacacccctcc

SEQ ID NO: 2096021 - DNA, 22 bp, Homo sapiens
ctccagcccacacccctccaaa

SEQ ID NO: 2096022 - DNA, 15 bp, Homo sapiens
ctccagcctctcccg

SEQ ID NO: 2096023 - DNA, 18 bp, Homo sapiens
ctccagcctctcccggct

SEQ ID NO: 2096024 - DNA, 19 bp, Homo sapiens
ctccagcctctcccggctg

SEQ ID NO: 2096025 - DNA, 14 bp, Homo sapiens
ctccagcctgccct

SEQ ID NO: 2096026 - DNA, 14 bp, Homo sapiens
ctccagccttctct

SEQ ID NO: 2096027 - DNA, 19 bp, Homo sapiens
ctccagccttctctctctg

SEQ ID NO: 2096028 - DNA, 17 bp, Homo sapiens
ctccagcggctgggtgg

SEQ ID NO: 2096029 - DNA, 13 bp, Homo sapiens
ctccagctccagt

SEQ ID NO: 2096030 - DNA, 22 bp, Homo sapiens
ctccaggaaggtagcccagcac

SEQ ID NO: 2096031 - DNA, 20 bp, Homo sapiens
ctccaggaatgcctcctccc

SEQ ID NO: 2096032 - DNA, 17 bp, Homo sapiens
ctccaggcaccatctcc

SEQ ID NO: 2096033 - DNA, 20 bp, Homo sapiens
ctccaggcacccttctttcc

SEQ ID NO: 2096034 - DNA, 15 bp, Homo sapiens
ctccaggcatgctgg

SEQ ID NO: 2096035 - DNA, 17 bp, Homo sapiens
ctccaggcatgctggcc

SEQ ID NO: 2096036 - DNA, 23 bp, Homo sapiens
ctccaggctgtatcccatgagcc

SEQ ID NO: 2096037 - DNA, 19 bp, Homo sapiens
ctccagggccacgtgccag

SEQ ID NO: 2096038 - DNA, 23 bp, Homo sapiens
ctccagggccacgtgccaggccc

SEQ ID NO: 2096039 - DNA, 15 bp, Homo sapiens
ctccagggctgcccc

SEQ ID NO: 2096040 - DNA, 21 bp, Homo sapiens
ctccagggtcttgggctactg

SEQ ID NO: 2096041 - DNA, 23 bp, Homo sapiens
ctccagggtcttgggctactggc

SEQ ID NO: 2096042 - DNA, 23 bp, Homo sapiens
ctccagtagtggacaacaggttt

SEQ ID NO: 2096043 - DNA, 14 bp, Homo sapiens
ctccagtattcttg

SEQ ID NO: 2096044 - DNA, 15 bp, Homo sapiens
ctccagtggttgctg

SEQ ID NO: 2096045 - DNA, 14 bp, Homo sapiens
ctccagtgtgcgtt

SEQ ID NO: 2096046 - DNA, 22 bp, Homo sapiens
ctccagtttccaagttcctgca

SEQ ID NO: 2096047 - DNA, 15 bp, Homo sapiens
ctccagtttccccat

SEQ ID NO: 2096048 - DNA, 15 bp, Homo sapiens
ctccataatgccact

SEQ ID NO: 2096049 - DNA, 21 bp, Homo sapiens
ctccatccggctcctgtcatc

SEQ ID NO: 2096050 - DNA, 14 bp, Homo sapiens
ctccatctccactc

SEQ ID NO: 2096051 - DNA, 13 bp, Homo sapiens
ctccatgcccaac

SEQ ID NO: 2096052 - DNA, 15 bp, Homo sapiens
ctccatgcccaacct

SEQ ID NO: 2096053 - DNA, 11 bp, Homo sapiens
ctccatggagg

SEQ ID NO: 2096054 - DNA, 14 bp, Homo sapiens
ctccatggaggagg

SEQ ID NO: 2096055 - DNA, 21 bp, Homo sapiens
ctccatggaggaggtgtccca

SEQ ID NO: 2096056 - DNA, 22 bp, Homo sapiens
ctccatggaggaggtgtcccaa

SEQ ID NO: 2096057 - DNA, 13 bp, Homo sapiens
ctccatggccacc

SEQ ID NO: 2096058 - DNA, 17 bp, Homo sapiens
ctccatgggctagtgtg

SEQ ID NO: 2096059 - DNA, 20 bp, Homo sapiens
ctccatggggaagtgctccc

SEQ ID NO: 2096060 - DNA, 22 bp, Homo sapiens
ctccatggggaagtgctcccca

SEQ ID NO: 2096061 - DNA, 21 bp, Homo sapiens
ctccatgtagaataaatgaag

SEQ ID NO: 2096062 - DNA, 15 bp, Homo sapiens
ctccatttagttctt

SEQ ID NO: 2096063 - DNA, 16 bp, Homo sapiens
ctccatttcaactcca

SEQ ID NO: 2096064 - DNA, 17 bp, Homo sapiens
ctccatttcaactccag

SEQ ID NO: 2096065 - DNA, 21 bp, Homo sapiens
ctccatttcaactccagaagt

SEQ ID NO: 2096066 - DNA, 21 bp, Homo sapiens
ctccatttcacacaggtcctg

SEQ ID NO: 2096067 - DNA, 11 bp, Homo sapiens
ctccatttctg

SEQ ID NO: 2096068 - DNA, 13 bp, Homo sapiens
ctcccaaaatact

SEQ ID NO: 2096069 - DNA, 17 bp, Homo sapiens
ctcccaaagctcagact

SEQ ID NO: 2096070 - DNA, 23 bp, Homo sapiens
ctcccaaagctcagacttgccag

SEQ ID NO: 2096071 - DNA, 21 bp, Homo sapiens
ctcccaacctcaatgccctgc

SEQ ID NO: 2096072 - DNA, 23 bp, Homo sapiens
ctcccaacctcaatgccctgcca

SEQ ID NO: 2096073 - DNA, 17 bp, Homo sapiens
ctcccaataaagctgga

SEQ ID NO: 2096074 - DNA, 20 bp, Homo sapiens
ctcccacaggcccttcctct

SEQ ID NO: 2096075 - DNA, 18 bp, Homo sapiens
ctcgtccccaagtgacct

SEQ ID NO: 2096076 - DNA, 15 bp, Homo sapiens
ctcgtcctccccctg

SEQ ID NO: 2096077 - DNA, 18 bp, Homo sapiens
ctcgtcctccccctgcca

SEQ ID NO: 2096078 - DNA, 17 bp, Homo sapiens
ctcgtggacacctgccc

SEQ ID NO: 2096079 - DNA, 21 bp, Homo sapiens
ctcgtggacacctgccctgcc

SEQ ID NO: 2096080 - DNA, 11 bp, Homo sapiens
ctcgtggcctt

SEQ ID NO: 2096081 - DNA, 12 bp, Homo sapiens
ctcgtgtgattt

SEQ ID NO: 2096082 - DNA, 13 bp, Homo sapiens
ctctaaatatttc

SEQ ID NO: 2096083 - DNA, 22 bp, Homo sapiens
ctctaacccccagtgccacaga

SEQ ID NO: 2096084 - DNA, 15 bp, Homo sapiens
ctctaacgcctgagc

SEQ ID NO: 2096085 - DNA, 15 bp, Homo sapiens
ctctaagctggagct

SEQ ID NO: 2096086 - DNA, 15 bp, Homo sapiens
ctctaagtttagaag

SEQ ID NO: 2096087 - DNA, 20 bp, Homo sapiens
ctctaattcccattttgcaa

SEQ ID NO: 2096088 - DNA, 22 bp, Homo sapiens
ctctaattggaagaaattcctg

SEQ ID NO: 2096089 - DNA, 16 bp, Homo sapiens
ctctacaaactcccac

SEQ ID NO: 2096090 - DNA, 17 bp, Homo sapiens
ctctacaaactcccact

SEQ ID NO: 2096091 - DNA, 14 bp, Homo sapiens
ctctacagaggcca

SEQ ID NO: 2096092 - DNA, 16 bp, Homo sapiens
ctctacccatattaca

SEQ ID NO: 2096093 - DNA, 19 bp, Homo sapiens
ctctacccatattacagat

SEQ ID NO: 2096094 - DNA, 23 bp, Homo sapiens
ctctaccccaaagaattcctgaa

SEQ ID NO: 2096095 - DNA, 16 bp, Homo sapiens
ctctacttagcatgtc

SEQ ID NO: 2096096 - DNA, 20 bp, Homo sapiens
ctctagaacacccactggcc

SEQ ID NO: 2096097 - DNA, 21 bp, Homo sapiens
ctctagaacacccactggcca

SEQ ID NO: 2096098 - DNA, 16 bp, Homo sapiens
ctctagacactgccac

SEQ ID NO: 2096099 - DNA, 15 bp, Homo sapiens
ctctagccaggagtc

SEQ ID NO: 2096100 - DNA, 22 bp, Homo sapiens
ctctagccaggagtctgtgctc

SEQ ID NO: 2096101 - DNA, 12 bp, Homo sapiens
ctctagctggca

SEQ ID NO: 2096102 - DNA, 17 bp, Homo sapiens
ctctagctggcaggaca

SEQ ID NO: 2096103 - DNA, 17 bp, Homo sapiens
ctctaggggtcaggctc

SEQ ID NO: 2096104 - DNA, 14 bp, Homo sapiens
ctctagtcttgctt

SEQ ID NO: 2096105 - DNA, 21 bp, Homo sapiens
ctctagtcttgctttgctgtc

SEQ ID NO: 2096106 - DNA, 19 bp, Homo sapiens
ctctagtgacttcctggtg

SEQ ID NO: 2096107 - DNA, 14 bp, Homo sapiens
ctctagtgccctcc

SEQ ID NO: 2096108 - DNA, 17 bp, Homo sapiens
ctctagtgctactgcta

SEQ ID NO: 2096109 - DNA, 12 bp, Homo sapiens
ctctagttcaaa

SEQ ID NO: 2096110 - DNA, 20 bp, Homo sapiens
ctctatatatacatgtatag

SEQ ID NO: 2096111 - DNA, 11 bp, Homo sapiens
ctctatattta

SEQ ID NO: 2096112 - DNA, 15 bp, Homo sapiens
ctctatcccaagcca

SEQ ID NO: 2096113 - DNA, 17 bp, Homo sapiens
ctctatgccagctcagt

SEQ ID NO: 2096114 - DNA, 19 bp, Homo sapiens
ctctatgccccaaatatag

SEQ ID NO: 2096115 - DNA, 20 bp, Homo sapiens
ctctattaagatttccaagt

SEQ ID NO: 2096116 - DNA, 12 bp, Homo sapiens
ctctattcctga

SEQ ID NO: 2096117 - DNA, 16 bp, Homo sapiens
ctctattcctgaccct

SEQ ID NO: 2096118 - DNA, 20 bp, Homo sapiens
ctctattcctgaccctccct

SEQ ID NO: 2096119 - DNA, 20 bp, Homo sapiens
ctctattgtagcatttcttg

SEQ ID NO: 2096120 - DNA, 12 bp, Homo sapiens
ctctatttaata

SEQ ID NO: 2096121 - DNA, 15 bp, Homo sapiens
ctctcaagctagcca

SEQ ID NO: 2096122 - DNA, 12 bp, Homo sapiens
ctctcacacaca

SEQ ID NO: 2096123 - DNA, 21 bp, Homo sapiens
ctctcacacacatagattaat

SEQ ID NO: 2096124 - DNA, 21 bp, Homo sapiens
ctctcactaaactttacccaa

SEQ ID NO: 2096125 - DNA, 18 bp, Homo sapiens
ctctcaggagcacaggca

SEQ ID NO: 2096126 - DNA, 13 bp, Homo sapiens
ctctcaggcgcat

SEQ ID NO: 2096127 - DNA, 15 bp, Homo sapiens
ctctcattccccagg

SEQ ID NO: 2096128 - DNA, 23 bp, Homo sapiens
ctctccaaatattattcaagtgc

SEQ ID NO: 2096129 - DNA, 16 bp, Homo sapiens
ctctccacctcagcct

SEQ ID NO: 2096130 - DNA, 13 bp, Homo sapiens
ctctccactccat

SEQ ID NO: 2096131 - DNA, 12 bp, Homo sapiens
ctctccactgcc

SEQ ID NO: 2096132 - DNA, 12 bp, Homo sapiens
ctctccactttg

SEQ ID NO: 2096133 - DNA, 21 bp, Homo sapiens
ctctccaggaaggtagcccag

SEQ ID NO: 2096134 - DNA, 22 bp, Homo sapiens
ctctccaggaaggtagcccagc

SEQ ID NO: 2096135 - DNA, 19 bp, Homo sapiens
ctctccaggcacccttctt

SEQ ID NO: 2096136 - DNA, 15 bp, Homo sapiens
ctctccatatctcct

SEQ ID NO: 2096137 - DNA, 18 bp, Homo sapiens
ctctccatgcccaaccta

SEQ ID NO: 2096138 - DNA, 22 bp, Homo sapiens
ctctcccaccccggcctccact

SEQ ID NO: 2096139 - DNA, 21 bp, Homo sapiens
ctctcccacgatgtcaaggac

SEQ ID NO: 2096140 - DNA, 14 bp, Homo sapiens
ctctcccaggcccc

SEQ ID NO: 2096141 - DNA, 16 bp, Homo sapiens
ctctcccaggccccat

SEQ ID NO: 2096142 - DNA, 13 bp, Homo sapiens
ctctcccatacca

SEQ ID NO: 2096143 - DNA, 20 bp, Homo sapiens
ctctcccataccatcactga

SEQ ID NO: 2096144 - DNA, 13 bp, Homo sapiens
ctctccccagcaa

SEQ ID NO: 2096145 - DNA, 19 bp, Homo sapiens
ctctccccctttcaaggaa

SEQ ID NO: 2096146 - DNA, 16 bp, Homo sapiens
ctctcccctgccctgc

SEQ ID NO: 2096147 - DNA, 18 bp, Homo sapiens
ctctcccctgccctgctg

SEQ ID NO: 2096148 - DNA, 21 bp, Homo sapiens
ctctcccctggaactgtctct

SEQ ID NO: 2096149 - DNA, 14 bp, Homo sapiens
ctctcccggctgcc

SEQ ID NO: 2096150 - DNA, 15 bp, Homo sapiens
ctctcccggctgcct

SEQ ID NO: 2096151 - DNA, 19 bp, Homo sapiens
ctctccctctggccctgcc

SEQ ID NO: 2096152 - DNA, 22 bp, Homo sapiens
ctctccctctggccctgccttc

SEQ ID NO: 2096153 - DNA, 15 bp, Homo sapiens
ctctcctagcccctg

SEQ ID NO: 2096154 - DNA, 16 bp, Homo sapiens
ctctcctcttgccact

SEQ ID NO: 2096155 - DNA, 17 bp, Homo sapiens
ctctcctgagaggtgct

SEQ ID NO: 2096156 - DNA, 18 bp, Homo sapiens
ctctcctgagaggtgctg

SEQ ID NO: 2096157 - DNA, 21 bp, Homo sapiens
ctctcctgagaggtgctgcag

SEQ ID NO: 2096158 - DNA, 12 bp, Homo sapiens
ctctcctgccta

SEQ ID NO: 2096159 - DNA, 13 bp, Homo sapiens
ctctcctggcttc

SEQ ID NO: 2096160 - DNA, 20 bp, Homo sapiens
ctctcctgtataatctctct

SEQ ID NO: 2096161 - DNA, 15 bp, Homo sapiens
ctctccttgggctcc

SEQ ID NO: 2096162 - DNA, 19 bp, Homo sapiens
ctctccttgggctcctggc

SEQ ID NO: 2096163 - DNA, 22 bp, Homo sapiens
ctctccttgggctcctggctgc

SEQ ID NO: 2096164 - DNA, 16 bp, Homo sapiens
ctctcggaaggctggc

SEQ ID NO: 2096165 - DNA, 18 bp, Homo sapiens
ctctcggaaggctggctg

SEQ ID NO: 2096166 - DNA, 19 bp, Homo sapiens
ctctcggaaggctggctgg

SEQ ID NO: 2096167 - DNA, 16 bp, Homo sapiens
ctctcgggccccccac

SEQ ID NO: 2096168 - DNA, 23 bp, Homo sapiens
ctctcggggcccttggggcctgg

SEQ ID NO: 2096169 - DNA, 19 bp, Homo sapiens
ctctcggggcgacccctca

SEQ ID NO: 2096170 - DNA, 19 bp, Homo sapiens
ctctcgggttgtgtgtctg

SEQ ID NO: 2096171 - DNA, 16 bp, Homo sapiens
ctctcgtaactggttt

SEQ ID NO: 2096172 - DNA, 17 bp, Homo sapiens
ctctcgtaactggtttc

SEQ ID NO: 2096173 - DNA, 16 bp, Homo sapiens
ctctctaaaaataaaa

SEQ ID NO: 2096174 - DNA, 24 bp, Homo sapiens
ctctctaaaaataaaatgatgtat

SEQ ID NO: 2096175 - DNA, 20 bp, Homo sapiens
ctctctaaacccaaataaat

SEQ ID NO: 2096176 - DNA, 15 bp, Homo sapiens
ctctctaagccacag

SEQ ID NO: 2096177 - DNA, 23 bp, Homo sapiens
ctctctaagccacagcttcttca

SEQ ID NO: 2096178 - DNA, 18 bp, Homo sapiens
ctctctacccggcccaga

SEQ ID NO: 2096179 - DNA, 21 bp, Homo sapiens
ctctctacccggcccagagac

SEQ ID NO: 2096180 - DNA, 15 bp, Homo sapiens
ctctctatatataca

SEQ ID NO: 2096181 - DNA, 14 bp, Homo sapiens
ctctctccacccta

SEQ ID NO: 2096182 - DNA, 15 bp, Homo sapiens
ctctctccttctggc

SEQ ID NO: 2096183 - DNA, 13 bp, Homo sapiens
ctctctctatata

SEQ ID NO: 2096184 - DNA, 14 bp, Homo sapiens
ctctctctatatat

SEQ ID NO: 2096185 - DNA, 17 bp, Homo sapiens
ctctctctatatataca

SEQ ID NO: 2096186 - DNA, 15 bp, Homo sapiens
ctctctctctttcct

SEQ ID NO: 2096187 - DNA, 14 bp, Homo sapiens
ctctctgagggaga

SEQ ID NO: 2096188 - DNA, 18 bp, Homo sapiens
ctctctgagggagaggct

SEQ ID NO: 2096189 - DNA, 16 bp, Homo sapiens
ctctctgcagccagcc

SEQ ID NO: 2096190 - DNA, 14 bp, Homo sapiens
ctgaggactggaga

SEQ ID NO: 2096191 - DNA, 16 bp, Homo sapiens
ctgaggagtagctgag

SEQ ID NO: 2096192 - DNA, 19 bp, Homo sapiens
ctgaggagtctgaggtcct

SEQ ID NO: 2096193 - DNA, 18 bp, Homo sapiens
ctgaggatttcaagcctg

SEQ ID NO: 2096194 - DNA, 16 bp, Homo sapiens
ctgaggcaagagaatt

SEQ ID NO: 2096195 - DNA, 13 bp, Homo sapiens
ctgaggcagacag

SEQ ID NO: 2096196 - DNA, 15 bp, Homo sapiens
ctgaggcagacagca

SEQ ID NO: 2096197 - DNA, 16 bp, Homo sapiens
ctgaggcagacagcag

SEQ ID NO: 2096198 - DNA, 18 bp, Homo sapiens
ctgaggcagacagcagct

SEQ ID NO: 2096199 - DNA, 15 bp, Homo sapiens
ctgaggcaggaggat

SEQ ID NO: 2096200 - DNA, 18 bp, Homo sapiens
ctgaggccccaggcccta

SEQ ID NO: 2096201 - DNA, 23 bp, Homo sapiens
ctgaggcctaaaagtaaacatta

SEQ ID NO: 2096202 - DNA, 18 bp, Homo sapiens
ctgaggcgggtggatcac

SEQ ID NO: 2096203 - DNA, 17 bp, Homo sapiens
ctgaggctcaagaggcc

SEQ ID NO: 2096204 - DNA, 20 bp, Homo sapiens
ctgaggctcaagaggcccag

SEQ ID NO: 2096205 - DNA, 21 bp, Homo sapiens
ctgaggctcaagaggcccagg

SEQ ID NO: 2096206 - DNA, 22 bp, Homo sapiens
ctgaggctcaagaggcccaggg

SEQ ID NO: 2096207 - DNA, 23 bp, Homo sapiens
ctgaggctcaagaggcccaggga

SEQ ID NO: 2096208 - DNA, 16 bp, Homo sapiens
ctgaggctctttctgg

SEQ ID NO: 2096209 - DNA, 15 bp, Homo sapiens
ctgaggctgaggcag

SEQ ID NO: 2096210 - DNA, 22 bp, Homo sapiens
ctgagggcagttcgcagccacc

SEQ ID NO: 2096211 - DNA, 23 bp, Homo sapiens
ctgaggggaggatcactggagcc

SEQ ID NO: 2096212 - DNA, 21 bp, Homo sapiens
ctgaggggggccgtgcccagg

SEQ ID NO: 2096213 - DNA, 15 bp, Homo sapiens
ctgagggtccccacc

SEQ ID NO: 2096214 - DNA, 20 bp, Homo sapiens
ctgagggtggagactaagcc

SEQ ID NO: 2096215 - DNA, 14 bp, Homo sapiens
ctgaggtcacctgg

SEQ ID NO: 2096216 - DNA, 15 bp, Homo sapiens
ctgaggtcacctgga

SEQ ID NO: 2096217 - DNA, 18 bp, Homo sapiens
ctgaggtcctgagcactg

SEQ ID NO: 2096218 - DNA, 19 bp, Homo sapiens
ctgaggtcctgagcactgc

SEQ ID NO: 2096219 - DNA, 24 bp, Homo sapiens
ctgaggtcctgagcactgccagga

SEQ ID NO: 2096220 - DNA, 17 bp, Homo sapiens
ctgaggtctagaaatag

SEQ ID NO: 2096221 - DNA, 14 bp, Homo sapiens
ctgagtaccttcta

SEQ ID NO: 2096222 - DNA, 15 bp, Homo sapiens
ctgagtcaagttgtt

SEQ ID NO: 2096223 - DNA, 14 bp, Homo sapiens
ctgagtcaccagga

SEQ ID NO: 2096224 - DNA, 17 bp, Homo sapiens
ctgagtcaccaggaatg

SEQ ID NO: 2096225 - DNA, 20 bp, Homo sapiens
ctgagtcacccatgaagaca

SEQ ID NO: 2096226 - DNA, 19 bp, Homo sapiens
ctgagtcacctcctccact

SEQ ID NO: 2096227 - DNA, 19 bp, Homo sapiens
ctgagtcatgatctccctg

SEQ ID NO: 2096228 - DNA, 22 bp, Homo sapiens
ctgagtcatgatctccctgccg

SEQ ID NO: 2096229 - DNA, 15 bp, Homo sapiens
ctgagtctcctgtgc

SEQ ID NO: 2096230 - DNA, 17 bp, Homo sapiens
ctgagtctgctatattt

SEQ ID NO: 2096231 - DNA, 13 bp, Homo sapiens
ctgagtgaaaaat

SEQ ID NO: 2096232 - DNA, 22 bp, Homo sapiens
ctgagtgacatgggtgtgccag

SEQ ID NO: 2096233 - DNA, 21 bp, Homo sapiens
ctgagtgactctatatagctg

SEQ ID NO: 2096234 - DNA, 21 bp, Homo sapiens
ctgagtgactgtaggcaggga

SEQ ID NO: 2096235 - DNA, 12 bp, Homo sapiens
ctgagtgagagg

SEQ ID NO: 2096236 - DNA, 18 bp, Homo sapiens
ctgagtgtgggcttctga

SEQ ID NO: 2096237 - DNA, 19 bp, Homo sapiens
ctgagttacttgtctgagg

SEQ ID NO: 2096238 - DNA, 20 bp, Homo sapiens
ctgagttacttgtctgaggc

SEQ ID NO: 2096239 - DNA, 22 bp, Homo sapiens
ctgagttacttgtctgaggcct

SEQ ID NO: 2096240 - DNA, 19 bp, Homo sapiens
ctgataaaattgtgatgtt

SEQ ID NO: 2096241 - DNA, 16 bp, Homo sapiens
ctgataacaacctgga

SEQ ID NO: 2096242 - DNA, 17 bp, Homo sapiens
ctgatactatctcttgt

SEQ ID NO: 2096243 - DNA, 12 bp, Homo sapiens
ctgatactgggt

SEQ ID NO: 2096244 - DNA, 14 bp, Homo sapiens
ctgataggaaaaga

SEQ ID NO: 2096245 - DNA, 13 bp, Homo sapiens
ctgatatgggact

SEQ ID NO: 2096246 - DNA, 15 bp, Homo sapiens
ctgatatgggactga

SEQ ID NO: 2096247 - DNA, 16 bp, Homo sapiens
ctgatattatggcaag

SEQ ID NO: 2096248 - DNA, 19 bp, Homo sapiens
ctgatattatggcaagtga

SEQ ID NO: 2096249 - DNA, 17 bp, Homo sapiens
ctgatcaaaaataaact

SEQ ID NO: 2096250 - DNA, 20 bp, Homo sapiens
ctgatcaaaaataaactagt

SEQ ID NO: 2096251 - DNA, 23 bp, Homo sapiens
ctgatcacctctggctttgtctc

SEQ ID NO: 2096252 - DNA, 19 bp, Homo sapiens
ctgatcgggataacaaaat

SEQ ID NO: 2096253 - DNA, 24 bp, Homo sapiens
ctgatgacaaacccaggagtttgt

SEQ ID NO: 2096254 - DNA, 14 bp, Homo sapiens
ctgatgacttgctt

SEQ ID NO: 2096255 - DNA, 19 bp, Homo sapiens
ctgatgagtgattgacaca

SEQ ID NO: 2096256 - DNA, 23 bp, Homo sapiens
ctgatgagtgattgacacacagc

SEQ ID NO: 2096257 - DNA, 22 bp, Homo sapiens
ctgatgatgtctcttgtagaag

SEQ ID NO: 2096258 - DNA, 23 bp, Homo sapiens
ctgatgcatcagaaagggagggc

SEQ ID NO: 2096259 - DNA, 14 bp, Homo sapiens
ctgatgccatgttt

SEQ ID NO: 2096260 - DNA, 19 bp, Homo sapiens
ctgatgccccttccccaag

SEQ ID NO: 2096261 - DNA, 18 bp, Homo sapiens
ctgatgcgaaaacttgaa

SEQ ID NO: 2096262 - DNA, 21 bp, Homo sapiens
ctgatgcgaaaacttgaatct

SEQ ID NO: 2096263 - DNA, 12 bp, Homo sapiens
ctgatgctgccc

SEQ ID NO: 2096264 - DNA, 13 bp, Homo sapiens
ctgatgctgcccc

SEQ ID NO: 2096265 - DNA, 14 bp, Homo sapiens
ctgatgctgccccg

SEQ ID NO: 2096266 - DNA, 22 bp, Homo sapiens
ctgatggaccgggtgggcctgg

SEQ ID NO: 2096267 - DNA, 23 bp, Homo sapiens
ctgatggaccgggtgggcctggc

SEQ ID NO: 2096268 - DNA, 15 bp, Homo sapiens
ctgatggagaaggaa

SEQ ID NO: 2096269 - DNA, 22 bp, Homo sapiens
ctgatggcacttagctatcaga

SEQ ID NO: 2096270 - DNA, 13 bp, Homo sapiens
ctgatggccaaga

SEQ ID NO: 2096271 - DNA, 15 bp, Homo sapiens
ctgatggccaagagc

SEQ ID NO: 2096272 - DNA, 15 bp, Homo sapiens
ctgatggccaagggg

SEQ ID NO: 2096273 - DNA, 18 bp, Homo sapiens
ctgatggccaagggggtg

SEQ ID NO: 2096274 - DNA, 21 bp, Homo sapiens
ctgatggccaagggggtggac

SEQ ID NO: 2096275 - DNA, 16 bp, Homo sapiens
ctgatgggacatcaaa

SEQ ID NO: 2096276 - DNA, 21 bp, Homo sapiens
ctgatgggcaacccccagcct

SEQ ID NO: 2096277 - DNA, 23 bp, Homo sapiens
ctgatgggcaacccccagcctgc

SEQ ID NO: 2096278 - DNA, 16 bp, Homo sapiens
ctgatggtacaggaaa

SEQ ID NO: 2096279 - DNA, 14 bp, Homo sapiens
ctgatggtgagctg

SEQ ID NO: 2096280 - DNA, 20 bp, Homo sapiens
ctgatgttacatcacagtgt

SEQ ID NO: 2096281 - DNA, 18 bp, Homo sapiens
ctgatgttcctagtgaaa

SEQ ID NO: 2096282 - DNA, 21 bp, Homo sapiens
ctgatgttcctagtgaaagag

SEQ ID NO: 2096283 - DNA, 22 bp, Homo sapiens
ctgatgttcctttggaagaaaa

SEQ ID NO: 2096284 - DNA, 15 bp, Homo sapiens
ctgatgttgagctga

SEQ ID NO: 2096285 - DNA, 17 bp, Homo sapiens
ctgatgttgagctgagt

SEQ ID NO: 2096286 - DNA, 18 bp, Homo sapiens
ctgattagtattcaggca

SEQ ID NO: 2096287 - DNA, 22 bp, Homo sapiens
ctgattagtattcaggcactga

SEQ ID NO: 2096288 - DNA, 12 bp, Homo sapiens
ctgattatcagg

SEQ ID NO: 2096289 - DNA, 22 bp, Homo sapiens
ctgattatcctataggcagacg

SEQ ID NO: 2096290 - DNA, 23 bp, Homo sapiens
ctgattcaaaagtgaacttgatt

SEQ ID NO: 2096291 - DNA, 17 bp, Homo sapiens
ctgattcaagaaacaga

SEQ ID NO: 2096292 - DNA, 17 bp, Homo sapiens
ctgattcccaagctctg

SEQ ID NO: 2096293 - DNA, 19 bp, Homo sapiens
ctgattcccaagctctgct

SEQ ID NO: 2096294 - DNA, 17 bp, Homo sapiens
ctgattcgaatgacact

SEQ ID NO: 2096295 - DNA, 14 bp, Homo sapiens
ctgattggctcacc

SEQ ID NO: 2096296 - DNA, 15 bp, Homo sapiens
ctgattgggtgccat

SEQ ID NO: 2096297 - DNA, 23 bp, Homo sapiens
ctgattgggtgccatgtggagtg

SEQ ID NO: 2096298 - DNA, 14 bp, Homo sapiens
ctgatttcagggaa

SEQ ID NO: 2096299 - DNA, 13 bp, Homo sapiens
ctgatttccaggc

SEQ ID NO: 2096300 - DNA, 18 bp, Homo sapiens
ctgatttccaggcccctg

SEQ ID NO: 2096301 - DNA, 19 bp, Homo sapiens
ctgatttccaggcccctga

SEQ ID NO: 2096302 - DNA, 22 bp, Homo sapiens
ctgatttccaggcccctgagga

SEQ ID NO: 2096303 - DNA, 12 bp, Homo sapiens
ctgatttctagg

SEQ ID NO: 2096304 - DNA, 18 bp, Homo sapiens
ctgcttacccttcacctt

SEQ ID NO: 2096305 - DNA, 19 bp, Homo sapiens
ctgcttactaatgtgcccc

SEQ ID NO: 2096306 - DNA, 13 bp, Homo sapiens
ctgcttcagcctc

SEQ ID NO: 2096307 - DNA, 23 bp, Homo sapiens
ctgcttcagcctcccgagtagct

SEQ ID NO: 2096308 - DNA, 24 bp, Homo sapiens
ctgcttccaattttctggaataca

SEQ ID NO: 2096309 - DNA, 22 bp, Homo sapiens
ctgcttctcagccccgggcctg

SEQ ID NO: 2096310 - DNA, 15 bp, Homo sapiens
ctgcttctccctggc

SEQ ID NO: 2096311 - DNA, 14 bp, Homo sapiens
ctgcttctgaactc

SEQ ID NO: 2096312 - DNA, 21 bp, Homo sapiens
ctgcttcttcaagcacctgca

SEQ ID NO: 2096313 - DNA, 22 bp, Homo sapiens
ctgcttcttcaagcacctgcag

SEQ ID NO: 2096314 - DNA, 14 bp, Homo sapiens
ctgcttcttcatct

SEQ ID NO: 2096315 - DNA, 14 bp, Homo sapiens
ctgcttgaaggaac

SEQ ID NO: 2096316 - DNA, 16 bp, Homo sapiens
ctgcttgactatcaca

SEQ ID NO: 2096317 - DNA, 20 bp, Homo sapiens
ctgcttgactatcacataca

SEQ ID NO: 2096318 - DNA, 21 bp, Homo sapiens
ctgcttgactatcacatacaa

SEQ ID NO: 2096319 - DNA, 22 bp, Homo sapiens
ctgcttgactatcacatacaat

SEQ ID NO: 2096320 - DNA, 16 bp, Homo sapiens
ctgcttgaggaggggc

SEQ ID NO: 2096321 - DNA, 22 bp, Homo sapiens
ctgcttgaggaggggcacctgc

SEQ ID NO: 2096322 - DNA, 23 bp, Homo sapiens
ctgcttgggttcctttttcaact

SEQ ID NO: 2096323 - DNA, 15 bp, Homo sapiens
ctgcttggtcaaatc

SEQ ID NO: 2096324 - DNA, 17 bp, Homo sapiens
ctgcttgtccctgccca

SEQ ID NO: 2096325 - DNA, 19 bp, Homo sapiens
ctgctttcaacttaaatca

SEQ ID NO: 2096326 - DNA, 18 bp, Homo sapiens
ctgctttccagcctgggc

SEQ ID NO: 2096327 - DNA, 16 bp, Homo sapiens
ctgctttgggctgccc

SEQ ID NO: 2096328 - DNA, 19 bp, Homo sapiens
ctgctttgggctgccctgg

SEQ ID NO: 2096329 - DNA, 20 bp, Homo sapiens
ctgctttgggctgccctggt

SEQ ID NO: 2096330 - DNA, 13 bp, Homo sapiens
ctgcttttccagg

SEQ ID NO: 2096331 - DNA, 14 bp, Homo sapiens
ctgcttttccagga

SEQ ID NO: 2096332 - DNA, 16 bp, Homo sapiens
ctgcttttccaggatc

SEQ ID NO: 2096333 - DNA, 19 bp, Homo sapiens
ctgcttttccaggatcctg

SEQ ID NO: 2096334 - DNA, 24 bp, Homo sapiens
ctgcttttccaggatcctgcagga

SEQ ID NO: 2096335 - DNA, 15 bp, Homo sapiens
ctgcttttgctgggg

SEQ ID NO: 2096336 - DNA, 16 bp, Homo sapiens
ctgcttttgctggggt

SEQ ID NO: 2096337 - DNA, 17 bp, Homo sapiens
ctgcttttggtctgtgt

SEQ ID NO: 2096338 - DNA, 20 bp, Homo sapiens
ctgcttttgtctatgggact

SEQ ID NO: 2096339 - DNA, 22 bp, Homo sapiens
ctgctttttccagattcttcca

SEQ ID NO: 2096340 - DNA, 14 bp, Homo sapiens
ctgctttttgacat

SEQ ID NO: 2096341 - DNA, 17 bp, Homo sapiens
ctggaaaaaaaatatat

SEQ ID NO: 2096342 - DNA, 15 bp, Homo sapiens
ctggaaaactcagga

SEQ ID NO: 2096343 - DNA, 17 bp, Homo sapiens
ctggaaaagtcacacag

SEQ ID NO: 2096344 - DNA, 22 bp, Homo sapiens
ctggaaaagtcacacagacaca

SEQ ID NO: 2096345 - DNA, 20 bp, Homo sapiens
ctggaaaattcctattgatt

SEQ ID NO: 2096346 - DNA, 14 bp, Homo sapiens
ctggaaaggctcag

SEQ ID NO: 2096347 - DNA, 22 bp, Homo sapiens
ctggaaaggctcagtctcagga

SEQ ID NO: 2096348 - DNA, 23 bp, Homo sapiens
ctggaaatatcagttactcagcc

SEQ ID NO: 2096349 - DNA, 15 bp, Homo sapiens
ctggaaatctggatt

SEQ ID NO: 2096350 - DNA, 19 bp, Homo sapiens
ctggaaatctgttttgtat

SEQ ID NO: 2096351 - DNA, 20 bp, Homo sapiens
ctggaaatctgttttgtata

SEQ ID NO: 2096352 - DNA, 14 bp, Homo sapiens
ctggaaccagggag

SEQ ID NO: 2096353 - DNA, 21 bp, Homo sapiens
ctggaagacgcaagggcctga

SEQ ID NO: 2096354 - DNA, 13 bp, Homo sapiens
ctggaagagagga

SEQ ID NO: 2096355 - DNA, 13 bp, Homo sapiens
ctggaaggcaggg

SEQ ID NO: 2096356 - DNA, 15 bp, Homo sapiens
ctggaaggcagggca

SEQ ID NO: 2096357 - DNA, 18 bp, Homo sapiens
ctggaaggcagggcagag

SEQ ID NO: 2096358 - DNA, 19 bp, Homo sapiens
ctggaaggctggctgagtg

SEQ ID NO: 2096359 - DNA, 15 bp, Homo sapiens
ctggaagggctagaa

SEQ ID NO: 2096360 - DNA, 17 bp, Homo sapiens
ctggaagttttgcattt

SEQ ID NO: 2096361 - DNA, 19 bp, Homo sapiens
ctggaataagaagcaaata

SEQ ID NO: 2096362 - DNA, 18 bp, Homo sapiens
ctggaatacatgaaatat

SEQ ID NO: 2096363 - DNA, 16 bp, Homo sapiens
ctggaatcaaggaatc

SEQ ID NO: 2096364 - DNA, 19 bp, Homo sapiens
ctggaatcgatctgtactg

SEQ ID NO: 2096365 - DNA, 16 bp, Homo sapiens
ctggaatgaagcatgt

SEQ ID NO: 2096366 - DNA, 15 bp, Homo sapiens
ctggaatgtaatcaa

SEQ ID NO: 2096367 - DNA, 21 bp, Homo sapiens
ctggaatgtaatcaatgtttc

SEQ ID NO: 2096368 - DNA, 14 bp, Homo sapiens
ctggacaagaagct

SEQ ID NO: 2096369 - DNA, 16 bp, Homo sapiens
ctggacaagaagctgc

SEQ ID NO: 2096370 - DNA, 19 bp, Homo sapiens
ctggacaagaagctgctat

SEQ ID NO: 2096371 - DNA, 15 bp, Homo sapiens
ctggacaagcagagg

SEQ ID NO: 2096372 - DNA, 22 bp, Homo sapiens
ctggacactagggtcaggcggg

SEQ ID NO: 2096373 - DNA, 13 bp, Homo sapiens
ctggacagctgtg

SEQ ID NO: 2096374 - DNA, 19 bp, Homo sapiens
ctggacagctgtgcctcgc

SEQ ID NO: 2096375 - DNA, 20 bp, Homo sapiens
ctggacagctgtgcctcgct

SEQ ID NO: 2096376 - DNA, 16 bp, Homo sapiens
ctggacatcacagcag

SEQ ID NO: 2096377 - DNA, 18 bp, Homo sapiens
ctggacatcacagcagaa

SEQ ID NO: 2096378 - DNA, 23 bp, Homo sapiens
ctggacatcacagcagaatgaag

SEQ ID NO: 2096379 - DNA, 18 bp, Homo sapiens
ctggacatttgccttgct

SEQ ID NO: 2096380 - DNA, 21 bp, Homo sapiens
ctggaccaaccctgtttcctg

SEQ ID NO: 2096381 - DNA, 19 bp, Homo sapiens
ctggaccagatcctactct

SEQ ID NO: 2096382 - DNA, 20 bp, Homo sapiens
ctggacctccccctcttggt

SEQ ID NO: 2096383 - DNA, 13 bp, Homo sapiens
ctggacctgagtc

SEQ ID NO: 2096384 - DNA, 15 bp, Homo sapiens
ctggacctgagtcgg

SEQ ID NO: 2096385 - DNA, 20 bp, Homo sapiens
ctggaccttgaactgggtac

SEQ ID NO: 2096386 - DNA, 17 bp, Homo sapiens
ctggacgcccagctgag

SEQ ID NO: 2096387 - DNA, 19 bp, Homo sapiens
ctggacggcattcctgctt

SEQ ID NO: 2096388 - DNA, 15 bp, Homo sapiens
ctggactgaggacca

SEQ ID NO: 2096389 - DNA, 23 bp, Homo sapiens
ctggactgggttttgtctctgca

SEQ ID NO: 2096390 - DNA, 20 bp, Homo sapiens
ctggacttgagcttggcagc

SEQ ID NO: 2096391 - DNA, 18 bp, Homo sapiens
ctggagaagctcacccaa

SEQ ID NO: 2096392 - DNA, 19 bp, Homo sapiens
ctggagaagctcacccaat

SEQ ID NO: 2096393 - DNA, 15 bp, Homo sapiens
ctggagaagctgatg

SEQ ID NO: 2096394 - DNA, 17 bp, Homo sapiens
ctggagaagctgatgct

SEQ ID NO: 2096395 - DNA, 23 bp, Homo sapiens
ctggagaccgcttcacccctgca

SEQ ID NO: 2096396 - DNA, 12 bp, Homo sapiens
ctggagagaagt

SEQ ID NO: 2096397 - DNA, 20 bp, Homo sapiens
ctggagagcatagggtctgg

SEQ ID NO: 2096398 - DNA, 22 bp, Homo sapiens
ctggagagccagaacctggagg

SEQ ID NO: 2096399 - DNA, 23 bp, Homo sapiens
ctggagagctagaacctggaggg

SEQ ID NO: 2096400 - DNA, 23 bp, Homo sapiens
ctggagaggagggatgctgcctg

SEQ ID NO: 2096401 - DNA, 18 bp, Homo sapiens
ctggagaggggcctggga

SEQ ID NO: 2096402 - DNA, 14 bp, Homo sapiens
ctggagcaagaagg

SEQ ID NO: 2096403 - DNA, 16 bp, Homo sapiens
ctggagcaagagagag

SEQ ID NO: 2096404 - DNA, 12 bp, Homo sapiens
ctggagcatctg

SEQ ID NO: 2096405 - DNA, 17 bp, Homo sapiens
ctggagcatctgactca

SEQ ID NO: 2096406 - DNA, 22 bp, Homo sapiens
ctggagcatctgactcacaaga

SEQ ID NO: 2096407 - DNA, 15 bp, Homo sapiens
ctggagcccaggagt

SEQ ID NO: 2096408 - DNA, 17 bp, Homo sapiens
ctggagcccgagggcct

SEQ ID NO: 2096409 - DNA, 22 bp, Homo sapiens
ctggagcctcggtggccatgct

SEQ ID NO: 2096410 - DNA, 16 bp, Homo sapiens
ctggagcggctctcct

SEQ ID NO: 2096411 - DNA, 17 bp, Homo sapiens
ctggagcggctctcctg

SEQ ID NO: 2096412 - DNA, 22 bp, Homo sapiens
ctggagcggctctcctgagagg

SEQ ID NO: 2096413 - DNA, 13 bp, Homo sapiens
ctggagctcttgg

SEQ ID NO: 2096414 - DNA, 22 bp, Homo sapiens
ctggagctcttggaagagctct

SEQ ID NO: 2096415 - DNA, 14 bp, Homo sapiens
ctggaggacctgag

SEQ ID NO: 2096416 - DNA, 15 bp, Homo sapiens
ctggaggacctgagc

SEQ ID NO: 2096417 - DNA, 16 bp, Homo sapiens
ctggaggacctgagcc

SEQ ID NO: 2096418 - DNA, 22 bp, Homo sapiens
ctgggcttcagggtatcccaga

SEQ ID NO: 2096419 - DNA, 18 bp, Homo sapiens
ctgggcttcagtggcagc

SEQ ID NO: 2096420 - DNA, 21 bp, Homo sapiens
ctgggcttcagtggcagctgc

SEQ ID NO: 2096421 - DNA, 24 bp, Homo sapiens
ctgggcttcagtggcagctgcttt

SEQ ID NO: 2096422 - DNA, 22 bp, Homo sapiens
ctggggaacagagcgggcctct

SEQ ID NO: 2096423 - DNA, 14 bp, Homo sapiens
ctggggagaaagta

SEQ ID NO: 2096424 - DNA, 20 bp, Homo sapiens
ctggggagaaataattgttg

SEQ ID NO: 2096425 - DNA, 20 bp, Homo sapiens
ctggggagcgaaagtttctt

SEQ ID NO: 2096426 - DNA, 13 bp, Homo sapiens
ctggggaggaagg

SEQ ID NO: 2096427 - DNA, 18 bp, Homo sapiens
ctggggaggaagggccag

SEQ ID NO: 2096428 - DNA, 22 bp, Homo sapiens
ctggggaggaagggccaggaga

SEQ ID NO: 2096429 - DNA, 18 bp, Homo sapiens
ctggggagggagagcacc

SEQ ID NO: 2096430 - DNA, 21 bp, Homo sapiens
ctggggattgggagggacagg

SEQ ID NO: 2096431 - DNA, 22 bp, Homo sapiens
ctggggattgggagggacaggg

SEQ ID NO: 2096432 - DNA, 20 bp, Homo sapiens
ctggggcatgtgtgcctgtg

SEQ ID NO: 2096433 - DNA, 23 bp, Homo sapiens
ctggggcatgtgtgcctgtggca

SEQ ID NO: 2096434 - DNA, 15 bp, Homo sapiens
ctggggccctgggcc

SEQ ID NO: 2096435 - DNA, 20 bp, Homo sapiens
ctggggccctgggcctcagt

SEQ ID NO: 2096436 - DNA, 19 bp, Homo sapiens
ctggggcctcggagcctca

SEQ ID NO: 2096437 - DNA, 23 bp, Homo sapiens
ctggggcctcggagcctcatccg

SEQ ID NO: 2096438 - DNA, 15 bp, Homo sapiens
ctggggcctggagag

SEQ ID NO: 2096439 - DNA, 19 bp, Homo sapiens
ctggggcctggagaggggc

SEQ ID NO: 2096440 - DNA, 17 bp, Homo sapiens
ctggggcctgtactgcc

SEQ ID NO: 2096441 - DNA, 21 bp, Homo sapiens
ctggggcctgtactgcctgct

SEQ ID NO: 2096442 - DNA, 23 bp, Homo sapiens
ctggggcctgtactgcctgcttg

SEQ ID NO: 2096443 - DNA, 20 bp, Homo sapiens
ctggggctcctttctccagc

SEQ ID NO: 2096444 - DNA, 23 bp, Homo sapiens
ctggggctcctttctccagccag

SEQ ID NO: 2096445 - DNA, 21 bp, Homo sapiens
ctggggctctaacgcctgagc

SEQ ID NO: 2096446 - DNA, 15 bp, Homo sapiens
ctggggctctgggat

SEQ ID NO: 2096447 - DNA, 16 bp, Homo sapiens
ctggggcttctcctga

SEQ ID NO: 2096448 - DNA, 19 bp, Homo sapiens
ctggggcttctcctgaccc

SEQ ID NO: 2096449 - DNA, 12 bp, Homo sapiens
ctgggggcagtg

SEQ ID NO: 2096450 - DNA, 16 bp, Homo sapiens
ctgggggcagtgactg

SEQ ID NO: 2096451 - DNA, 12 bp, Homo sapiens
ctgggggccagc

SEQ ID NO: 2096452 - DNA, 15 bp, Homo sapiens
ctgggggccagctgg

SEQ ID NO: 2096453 - DNA, 18 bp, Homo sapiens
ctgggggcctcagtgcca

SEQ ID NO: 2096454 - DNA, 18 bp, Homo sapiens
ctgggggcgggggagcca

SEQ ID NO: 2096455 - DNA, 17 bp, Homo sapiens
ctgggggtggcaggcac

SEQ ID NO: 2096456 - DNA, 20 bp, Homo sapiens
ctgggggttctttcttcctc

SEQ ID NO: 2096457 - DNA, 23 bp, Homo sapiens
ctgggggttctttcttcctctgc

SEQ ID NO: 2096458 - DNA, 15 bp, Homo sapiens
ctggggtcctggggc

SEQ ID NO: 2096459 - DNA, 18 bp, Homo sapiens
ctggggtcctggggcctc

SEQ ID NO: 2096460 - DNA, 19 bp, Homo sapiens
ctggggtcctggggcctcg

SEQ ID NO: 2096461 - DNA, 21 bp, Homo sapiens
ctggggtgacccggcaccccc

SEQ ID NO: 2096462 - DNA, 17 bp, Homo sapiens
ctggggttcagcccctc

SEQ ID NO: 2096463 - DNA, 23 bp, Homo sapiens
ctggggttcagcccctcctctgc

SEQ ID NO: 2096464 - DNA, 16 bp, Homo sapiens
ctgggtacttgtggac

SEQ ID NO: 2096465 - DNA, 18 bp, Homo sapiens
ctgggtacttgtggacac

SEQ ID NO: 2096466 - DNA, 15 bp, Homo sapiens
ctgggtccctcggag

SEQ ID NO: 2096467 - DNA, 18 bp, Homo sapiens
ctgggtccctcggagctg

SEQ ID NO: 2096468 - DNA, 14 bp, Homo sapiens
ctgggtctgggttt

SEQ ID NO: 2096469 - DNA, 13 bp, Homo sapiens
ctgggtgacagag

SEQ ID NO: 2096470 - DNA, 19 bp, Homo sapiens
ctgggtgagaatcctgcct

SEQ ID NO: 2096471 - DNA, 22 bp, Homo sapiens
ctgggtgagaatcctgcctctc

SEQ ID NO: 2096472 - DNA, 15 bp, Homo sapiens
ctgggtgccattccc

SEQ ID NO: 2096473 - DNA, 20 bp, Homo sapiens
ctgggtggctactctgtgcc

SEQ ID NO: 2096474 - DNA, 13 bp, Homo sapiens
ctgggtggctcct

SEQ ID NO: 2096475 - DNA, 17 bp, Homo sapiens
ctgggtggctcctgcca

SEQ ID NO: 2096476 - DNA, 20 bp, Homo sapiens
ctgggtggctcctgccactg

SEQ ID NO: 2096477 - DNA, 18 bp, Homo sapiens
ctgggtggggctgctcct

SEQ ID NO: 2096478 - DNA, 22 bp, Homo sapiens
ctgggtgtggccccgcagtgcc

SEQ ID NO: 2096479 - DNA, 15 bp, Homo sapiens
ctgggtgttgcattt

SEQ ID NO: 2096480 - DNA, 23 bp, Homo sapiens
ctgggttatttttgtccctgctc

SEQ ID NO: 2096481 - DNA, 18 bp, Homo sapiens
ctgggttcactgcaacct

SEQ ID NO: 2096482 - DNA, 14 bp, Homo sapiens
ctgggttctagaac

SEQ ID NO: 2096483 - DNA, 23 bp, Homo sapiens
ctgggtttgtttttcaaagcctg

SEQ ID NO: 2096484 - DNA, 12 bp, Homo sapiens
ctgggttttcta

SEQ ID NO: 2096485 - DNA, 23 bp, Homo sapiens
ctgggttttctaactgtaaatca

SEQ ID NO: 2096486 - DNA, 21 bp, Homo sapiens
ctgggttttgtctctgcatct

SEQ ID NO: 2096487 - DNA, 19 bp, Homo sapiens
ctggtaaactatttgtctt

SEQ ID NO: 2096488 - DNA, 18 bp, Homo sapiens
ctggtaatttgtatctga

SEQ ID NO: 2096489 - DNA, 14 bp, Homo sapiens
ctggtaggaaagca

SEQ ID NO: 2096490 - DNA, 18 bp, Homo sapiens
ctggtatgaacttgagga

SEQ ID NO: 2096491 - DNA, 22 bp, Homo sapiens
ctggtatgaacttgaggacaca

SEQ ID NO: 2096492 - DNA, 20 bp, Homo sapiens
ctggtcacaggactctgcct

SEQ ID NO: 2096493 - DNA, 22 bp, Homo sapiens
ctggtcacaggactctgcctcc

SEQ ID NO: 2096494 - DNA, 23 bp, Homo sapiens
ctggtcacaggactctgcctcct

SEQ ID NO: 2096495 - DNA, 16 bp, Homo sapiens
ctggtcaggcccactg

SEQ ID NO: 2096496 - DNA, 21 bp, Homo sapiens
ctggtcaggcccactgcagag

SEQ ID NO: 2096497 - DNA, 18 bp, Homo sapiens
ctggtcccactcagtcca

SEQ ID NO: 2096498 - DNA, 21 bp, Homo sapiens
ctggtcctgagggtccccacc

SEQ ID NO: 2096499 - DNA, 19 bp, Homo sapiens
ctggtccttccaggccccc

SEQ ID NO: 2096500 - DNA, 14 bp, Homo sapiens
ctggtctaggagct

SEQ ID NO: 2096501 - DNA, 17 bp, Homo sapiens
ctggtctattttgattt

SEQ ID NO: 2096502 - DNA, 17 bp, Homo sapiens
ctggtctccctccagct

SEQ ID NO: 2096503 - DNA, 18 bp, Homo sapiens
ctggtctccctccagctg

SEQ ID NO: 2096504 - DNA, 20 bp, Homo sapiens
ctggtctccctccagctgga

SEQ ID NO: 2096505 - DNA, 22 bp, Homo sapiens
ctggtctcctcccaaaatacta

SEQ ID NO: 2096506 - DNA, 14 bp, Homo sapiens
ctggtctctccttg

SEQ ID NO: 2096507 - DNA, 15 bp, Homo sapiens
ctggtctgctcagga

SEQ ID NO: 2096508 - DNA, 14 bp, Homo sapiens
ctggtcttgagatg

SEQ ID NO: 2096509 - DNA, 15 bp, Homo sapiens
ctggtcttgagatgt

SEQ ID NO: 2096510 - DNA, 15 bp, Homo sapiens
ctggtctttcctctg

SEQ ID NO: 2096511 - DNA, 20 bp, Homo sapiens
ctggtgaggcccagcctgtc

SEQ ID NO: 2096512 - DNA, 20 bp, Homo sapiens
ctggtgcagaggtgagcaga

SEQ ID NO: 2096513 - DNA, 23 bp, Homo sapiens
ctggtgcagaggtgagcagagga

SEQ ID NO: 2096514 - DNA, 16 bp, Homo sapiens
ctggtgcctatttatt

SEQ ID NO: 2096515 - DNA, 23 bp, Homo sapiens
ctggtgctataggctggagaagc

SEQ ID NO: 2096516 - DNA, 21 bp, Homo sapiens
ctggtgcttctcctctcctag

SEQ ID NO: 2096517 - DNA, 17 bp, Homo sapiens
ctggtggacagtcctgg

SEQ ID NO: 2096518 - DNA, 12 bp, Homo sapiens
ctggtggcacca

SEQ ID NO: 2096519 - DNA, 14 bp, Homo sapiens
ctggtggcaccaga

SEQ ID NO: 2096520 - DNA, 18 bp, Homo sapiens
ctggtggcaccagatgca

SEQ ID NO: 2096521 - DNA, 18 bp, Homo sapiens
ctggtggcagtgggagct

SEQ ID NO: 2096522 - DNA, 19 bp, Homo sapiens
ctggtggcagtgggagctg

SEQ ID NO: 2096523 - DNA, 16 bp, Homo sapiens
ctggtggggcagctcc

SEQ ID NO: 2096524 - DNA, 17 bp, Homo sapiens
ctggtggggcagctcct

SEQ ID NO: 2096525 - DNA, 20 bp, Homo sapiens
ctggtgtagctcctctgctg

SEQ ID NO: 2096526 - DNA, 14 bp, Homo sapiens
ctggtgtcaggcag

SEQ ID NO: 2096527 - DNA, 23 bp, Homo sapiens
ctggtgtgaggctgggccagcct

SEQ ID NO: 2096528 - DNA, 23 bp, Homo sapiens
ctggtgttaagatatattttgag

SEQ ID NO: 2096529 - DNA, 22 bp, Homo sapiens
ctggtgttctcaatgcttttct

SEQ ID NO: 2096530 - DNA, 19 bp, Homo sapiens
ctggttggccgtggtccag

SEQ ID NO: 2096531 - DNA, 16 bp, Homo sapiens
ctgttaaaagatgaaa

SEQ ID NO: 2096532 - DNA, 16 bp, Homo sapiens
ctgttaaaatgtacac

SEQ ID NO: 2096533 - DNA, 20 bp, Homo sapiens
ctgttacataacaagaaaat

SEQ ID NO: 2096534 - DNA, 23 bp, Homo sapiens
ctgttacataacaagaaaatcaa

SEQ ID NO: 2096535 - DNA, 14 bp, Homo sapiens
ctgttactccacag

SEQ ID NO: 2096536 - DNA, 15 bp, Homo sapiens
ctgttactccacagc

SEQ ID NO: 2096537 - DNA, 17 bp, Homo sapiens
ctgttactccacagcgg

SEQ ID NO: 2096538 - DNA, 16 bp, Homo sapiens
ctgttagctgttattt

SEQ ID NO: 2096539 - DNA, 16 bp, Homo sapiens
ctgttatttctatttt

SEQ ID NO: 2096540 - DNA, 17 bp, Homo sapiens
ctgttatttctattttt

SEQ ID NO: 2096541 - DNA, 21 bp, Homo sapiens
ctgttattttttatttccaca

SEQ ID NO: 2096542 - DNA, 22 bp, Homo sapiens
ctgttcacagccagactggcac

SEQ ID NO: 2096543 - DNA, 14 bp, Homo sapiens
ctgttcacccacag

SEQ ID NO: 2096544 - DNA, 17 bp, Homo sapiens
ctgttcaccttatgtat

SEQ ID NO: 2096545 - DNA, 13 bp, Homo sapiens
ctgttcactctac

SEQ ID NO: 2096546 - DNA, 17 bp, Homo sapiens
ctgttcacttttcctcc

SEQ ID NO: 2096547 - DNA, 14 bp, Homo sapiens
ctgttcagctccag

SEQ ID NO: 2096548 - DNA, 15 bp, Homo sapiens
ctgttcaggagctga

SEQ ID NO: 2096549 - DNA, 23 bp, Homo sapiens
ctgttcatggcagatgtaggagg

SEQ ID NO: 2096550 - DNA, 14 bp, Homo sapiens
ctgttcatttcctc

SEQ ID NO: 2096551 - DNA, 17 bp, Homo sapiens
ctgttcatttcctcaaa

SEQ ID NO: 2096552 - DNA, 22 bp, Homo sapiens
ctgttcccccgctggcagccac

SEQ ID NO: 2096553 - DNA, 15 bp, Homo sapiens
ctgttccctctttct

SEQ ID NO: 2096554 - DNA, 15 bp, Homo sapiens
ctgttctcaaatgct

SEQ ID NO: 2096555 - DNA, 16 bp, Homo sapiens
ctgttctcagctccgt

SEQ ID NO: 2096556 - DNA, 13 bp, Homo sapiens
ctgttctgcactg

SEQ ID NO: 2096557 - DNA, 15 bp, Homo sapiens
ctgttctgcactgaa

SEQ ID NO: 2096558 - DNA, 17 bp, Homo sapiens
ctgttctgcactgaaaa

SEQ ID NO: 2096559 - DNA, 18 bp, Homo sapiens
ctgttctgcactgaaaag

SEQ ID NO: 2096560 - DNA, 18 bp, Homo sapiens
ctgttctggagctgctgt

SEQ ID NO: 2096561 - DNA, 21 bp, Homo sapiens
ctgttctggagctgctgttcc

SEQ ID NO: 2096562 - DNA, 16 bp, Homo sapiens
ctgttctggcctcaga

SEQ ID NO: 2096563 - DNA, 19 bp, Homo sapiens
ctgttctggcctcagacca

SEQ ID NO: 2096564 - DNA, 22 bp, Homo sapiens
ctgttgaaaattattttaaaca

SEQ ID NO: 2096565 - DNA, 14 bp, Homo sapiens
ctgttgagacttag

SEQ ID NO: 2096566 - DNA, 20 bp, Homo sapiens
ctgttgagctgttttccctg

SEQ ID NO: 2096567 - DNA, 21 bp, Homo sapiens
ctgttgatcccacttcactgt

SEQ ID NO: 2096568 - DNA, 20 bp, Homo sapiens
ctgttgatgaggcctcttgg

SEQ ID NO: 2096569 - DNA, 21 bp, Homo sapiens
ctgttgatgaggcctcttgga

SEQ ID NO: 2096570 - DNA, 18 bp, Homo sapiens
ctgttgcacctcaggcag

SEQ ID NO: 2096571 - DNA, 13 bp, Homo sapiens
ctgttgcccaggc

SEQ ID NO: 2096572 - DNA, 16 bp, Homo sapiens
ctgttgcccaggctgg

SEQ ID NO: 2096573 - DNA, 18 bp, Homo sapiens
ctgttgcccaggctggcg

SEQ ID NO: 2096574 - DNA, 12 bp, Homo sapiens
ctgttgcctcat

SEQ ID NO: 2096575 - DNA, 14 bp, Homo sapiens
ctgttgctagaagt

SEQ ID NO: 2096576 - DNA, 13 bp, Homo sapiens
ctgttggacagct

SEQ ID NO: 2096577 - DNA, 16 bp, Homo sapiens
ctgttggacagctgct

SEQ ID NO: 2096578 - DNA, 22 bp, Homo sapiens
ctgttggacccgctctggacca

SEQ ID NO: 2096579 - DNA, 15 bp, Homo sapiens
ctgttggccagtgtg

SEQ ID NO: 2096580 - DNA, 12 bp, Homo sapiens
ctgttggcctcg

SEQ ID NO: 2096581 - DNA, 20 bp, Homo sapiens
ctgttggcctcgcctgggcc

SEQ ID NO: 2096582 - DNA, 22 bp, Homo sapiens
ctgttggcctcgcctgggccca

SEQ ID NO: 2096583 - DNA, 19 bp, Homo sapiens
ctgttggctgggggcctca

SEQ ID NO: 2096584 - DNA, 22 bp, Homo sapiens
ctgttggctgggggcctcagtg

SEQ ID NO: 2096585 - DNA, 19 bp, Homo sapiens
ctgttgtaaatgaccaaga

SEQ ID NO: 2096586 - DNA, 12 bp, Homo sapiens
ctgttgtaatag

SEQ ID NO: 2096587 - DNA, 17 bp, Homo sapiens
ctgttgtaatagtccat

SEQ ID NO: 2096588 - DNA, 21 bp, Homo sapiens
ctgttgtagaataataataaa

SEQ ID NO: 2096589 - DNA, 21 bp, Homo sapiens
ctgttgtgtatagatgcaaga

SEQ ID NO: 2096590 - DNA, 17 bp, Homo sapiens
ctgttgttcccatctgc

SEQ ID NO: 2096591 - DNA, 16 bp, Homo sapiens
ctgttgttccttcaca

SEQ ID NO: 2096592 - DNA, 18 bp, Homo sapiens
ctgttgttgcagggaagt

SEQ ID NO: 2096593 - DNA, 17 bp, Homo sapiens
ctgttgttgttaatgaa

SEQ ID NO: 2096594 - DNA, 21 bp, Homo sapiens
ctgtttaaaaaaagtatatat

SEQ ID NO: 2096595 - DNA, 20 bp, Homo sapiens
ctgtttagtagcagtgattg

SEQ ID NO: 2096596 - DNA, 18 bp, Homo sapiens
ctgtttatggtattttcg

SEQ ID NO: 2096597 - DNA, 15 bp, Homo sapiens
ctgtttatttattca

SEQ ID NO: 2096598 - DNA, 22 bp, Homo sapiens
ctgtttcgtgtagtggaagagc

SEQ ID NO: 2096599 - DNA, 19 bp, Homo sapiens
ctgtttgagatgtgatgct

SEQ ID NO: 2096600 - DNA, 22 bp, Homo sapiens
ctgtttgagatgtgatgctggt

SEQ ID NO: 2096601 - DNA, 13 bp, Homo sapiens
ctgttttaaatta

SEQ ID NO: 2096602 - DNA, 13 bp, Homo sapiens
ctgttttccctga

SEQ ID NO: 2096603 - DNA, 15 bp, Homo sapiens
ctgtttttaagctgt

SEQ ID NO: 2096604 - DNA, 19 bp, Homo sapiens
ctgtttttaagctgtttcc

SEQ ID NO: 2096605 - DNA, 22 bp, Homo sapiens
ctgtttttcggacagtttattt

SEQ ID NO: 2096606 - DNA, 21 bp, Homo sapiens
ctgtttttctgggtggcctcg

SEQ ID NO: 2096607 - DNA, 14 bp, Homo sapiens
ctgtttttgaagaa

SEQ ID NO: 2096608 - DNA, 17 bp, Homo sapiens
cttaaaaaaatgacaga

SEQ ID NO: 2096609 - DNA, 14 bp, Homo sapiens
cttaaaaaatgtcc

SEQ ID NO: 2096610 - DNA, 12 bp, Homo sapiens
cttaaaacaagg

SEQ ID NO: 2096611 - DNA, 20 bp, Homo sapiens
cttaaaacaaggcttaaaag

SEQ ID NO: 2096612 - DNA, 14 bp, Homo sapiens
cttaaaagagtaga

SEQ ID NO: 2096613 - DNA, 16 bp, Homo sapiens
cttaaaagagtagaat

SEQ ID NO: 2096614 - DNA, 22 bp, Homo sapiens
cttaaaaggagagaagaaagtg

SEQ ID NO: 2096615 - DNA, 19 bp, Homo sapiens
cttaaaataacttatatca

SEQ ID NO: 2096616 - DNA, 16 bp, Homo sapiens
cttaaaataatgattt

SEQ ID NO: 2096617 - DNA, 17 bp, Homo sapiens
cttaaaataatgattta

SEQ ID NO: 2096618 - DNA, 22 bp, Homo sapiens
cttaaaatagcaacactctata

SEQ ID NO: 2096619 - DNA, 20 bp, Homo sapiens
cttaaaatattcctgcattt

SEQ ID NO: 2096620 - DNA, 21 bp, Homo sapiens
cttaaaattggtaattgaatg

SEQ ID NO: 2096621 - DNA, 23 bp, Homo sapiens
cttaaaattggtaattgaatgga

SEQ ID NO: 2096622 - DNA, 14 bp, Homo sapiens
cttaaacaaatgta

SEQ ID NO: 2096623 - DNA, 12 bp, Homo sapiens
cttaaagaaagt

SEQ ID NO: 2096624 - DNA, 13 bp, Homo sapiens
cttaaagcacccg

SEQ ID NO: 2096625 - DNA, 23 bp, Homo sapiens
cttaaagctgcctgtagttagga

SEQ ID NO: 2096626 - DNA, 23 bp, Homo sapiens
cttaaaggctgtggtagtactcc

SEQ ID NO: 2096627 - DNA, 17 bp, Homo sapiens
cttaaataaattcaaac

SEQ ID NO: 2096628 - DNA, 13 bp, Homo sapiens
cttaaataagaaa

SEQ ID NO: 2096629 - DNA, 23 bp, Homo sapiens
cttaaatcactgaggcattttta

SEQ ID NO: 2096630 - DNA, 21 bp, Homo sapiens
cttaaatgaaagcatgtggca

SEQ ID NO: 2096631 - DNA, 13 bp, Homo sapiens
cttaaatgcaata

SEQ ID NO: 2096632 - DNA, 15 bp, Homo sapiens
cttaaatttttgtca

SEQ ID NO: 2096633 - DNA, 16 bp, Homo sapiens
cttaaatttttgtcat

SEQ ID NO: 2096634 - DNA, 17 bp, Homo sapiens
cttaacatatttactaa

SEQ ID NO: 2096635 - DNA, 17 bp, Homo sapiens
cttaacattctgtaaaa

SEQ ID NO: 2096636 - DNA, 17 bp, Homo sapiens
cttaactcatctgttat

SEQ ID NO: 2096637 - DNA, 13 bp, Homo sapiens
cttaactggctgt

SEQ ID NO: 2096638 - DNA, 18 bp, Homo sapiens
cttaactgtgtgaagaaa

SEQ ID NO: 2096639 - DNA, 16 bp, Homo sapiens
cttaagagaaatggca

SEQ ID NO: 2096640 - DNA, 20 bp, Homo sapiens
cttaagccttttgctcacaa

SEQ ID NO: 2096641 - DNA, 21 bp, Homo sapiens
cttaaggatggagccagctct

SEQ ID NO: 2096642 - DNA, 20 bp, Homo sapiens
cttaaggattgtgatatttt

SEQ ID NO: 2096643 - DNA, 18 bp, Homo sapiens
cttaagggttgaaggcag

SEQ ID NO: 2096644 - DNA, 16 bp, Homo sapiens
cttaagtgctgcaatt

SEQ ID NO: 2096645 - DNA, 17 bp, Homo sapiens
cttctctactctggaag

SEQ ID NO: 2096646 - DNA, 17 bp, Homo sapiens
cttctctattcctgacc

SEQ ID NO: 2096647 - DNA, 23 bp, Homo sapiens
cttctctattcctgaccctccct

SEQ ID NO: 2096648 - DNA, 21 bp, Homo sapiens
cttctctccttccctctttcc

SEQ ID NO: 2096649 - DNA, 23 bp, Homo sapiens
cttctctcggggcgacccctcag

SEQ ID NO: 2096650 - DNA, 12 bp, Homo sapiens
cttctctctctg

SEQ ID NO: 2096651 - DNA, 21 bp, Homo sapiens
cttctctgtgaacgatttaga

SEQ ID NO: 2096652 - DNA, 21 bp, Homo sapiens
cttctctgtgcccctgtaaat

SEQ ID NO: 2096653 - DNA, 21 bp, Homo sapiens
cttctctttcttattttgtaa

SEQ ID NO: 2096654 - DNA, 16 bp, Homo sapiens
cttctctttgcctcaa

SEQ ID NO: 2096655 - DNA, 12 bp, Homo sapiens
cttctgaactca

SEQ ID NO: 2096656 - DNA, 14 bp, Homo sapiens
cttctgacctcccc

SEQ ID NO: 2096657 - DNA, 19 bp, Homo sapiens
cttctgcaattgcttagga

SEQ ID NO: 2096658 - DNA, 19 bp, Homo sapiens
cttctgcagcaactcccac

SEQ ID NO: 2096659 - DNA, 20 bp, Homo sapiens
cttctgcagcaactcccacg

SEQ ID NO: 2096660 - DNA, 17 bp, Homo sapiens
cttctgccatattctgt

SEQ ID NO: 2096661 - DNA, 21 bp, Homo sapiens
cttctgccatattctgttggc

SEQ ID NO: 2096662 - DNA, 19 bp, Homo sapiens
cttctgctggataaaatga

SEQ ID NO: 2096663 - DNA, 16 bp, Homo sapiens
cttctgcttcagcctc

SEQ ID NO: 2096664 - DNA, 14 bp, Homo sapiens
cttctggaaggctg

SEQ ID NO: 2096665 - DNA, 13 bp, Homo sapiens
cttctggagccct

SEQ ID NO: 2096666 - DNA, 20 bp, Homo sapiens
cttctggcttccttctctca

SEQ ID NO: 2096667 - DNA, 14 bp, Homo sapiens
cttctgggtggctc

SEQ ID NO: 2096668 - DNA, 15 bp, Homo sapiens
cttctgtacgtctga

SEQ ID NO: 2096669 - DNA, 23 bp, Homo sapiens
cttctgtcatcccgctcctgctg

SEQ ID NO: 2096670 - DNA, 14 bp, Homo sapiens
cttctgtccaggac

SEQ ID NO: 2096671 - DNA, 18 bp, Homo sapiens
cttctgtccaggacatga

SEQ ID NO: 2096672 - DNA, 19 bp, Homo sapiens
cttctgtcctactctgtgt

SEQ ID NO: 2096673 - DNA, 17 bp, Homo sapiens
cttctgttgcgccactg

SEQ ID NO: 2096674 - DNA, 13 bp, Homo sapiens
cttcttaaagagt

SEQ ID NO: 2096675 - DNA, 17 bp, Homo sapiens
cttcttaatgctttcct

SEQ ID NO: 2096676 - DNA, 22 bp, Homo sapiens
cttcttaatgctttcctccctg

SEQ ID NO: 2096677 - DNA, 21 bp, Homo sapiens
cttcttacttggaactgaagg

SEQ ID NO: 2096678 - DNA, 15 bp, Homo sapiens
cttcttatgtttgct

SEQ ID NO: 2096679 - DNA, 20 bp, Homo sapiens
cttcttattctcactccacc

SEQ ID NO: 2096680 - DNA, 22 bp, Homo sapiens
cttcttcacccagctaatctgt

SEQ ID NO: 2096681 - DNA, 23 bp, Homo sapiens
cttcttcacccagctaatctgta

SEQ ID NO: 2096682 - DNA, 20 bp, Homo sapiens
cttcttccccaggtccttcc

SEQ ID NO: 2096683 - DNA, 20 bp, Homo sapiens
cttcttcggggaactcctgg

SEQ ID NO: 2096684 - DNA, 21 bp, Homo sapiens
cttcttcggggaactcctgga

SEQ ID NO: 2096685 - DNA, 14 bp, Homo sapiens
cttcttcttcagaa

SEQ ID NO: 2096686 - DNA, 17 bp, Homo sapiens
cttcttgaaacagcctg

SEQ ID NO: 2096687 - DNA, 15 bp, Homo sapiens
cttcttgccccttgg

SEQ ID NO: 2096688 - DNA, 19 bp, Homo sapiens
cttcttgccccttgggcct

SEQ ID NO: 2096689 - DNA, 20 bp, Homo sapiens
cttcttgccccttgggcctc

SEQ ID NO: 2096690 - DNA, 22 bp, Homo sapiens
cttcttgccccttgggcctccc

SEQ ID NO: 2096691 - DNA, 14 bp, Homo sapiens
cttcttggaaaaaa

SEQ ID NO: 2096692 - DNA, 13 bp, Homo sapiens
cttcttggcttct

SEQ ID NO: 2096693 - DNA, 19 bp, Homo sapiens
cttcttggcttctgggacc

SEQ ID NO: 2096694 - DNA, 17 bp, Homo sapiens
cttcttggtttggggag

SEQ ID NO: 2096695 - DNA, 18 bp, Homo sapiens
cttcttggtttggggaga

SEQ ID NO: 2096696 - DNA, 18 bp, Homo sapiens
cttctttaaatcaaaagc

SEQ ID NO: 2096697 - DNA, 19 bp, Homo sapiens
cttctttaaatcaaaagct

SEQ ID NO: 2096698 - DNA, 11 bp, Homo sapiens
cttctttcctc

SEQ ID NO: 2096699 - DNA, 14 bp, Homo sapiens
cttctttcctcttc

SEQ ID NO: 2096700 - DNA, 14 bp, Homo sapiens
cttctttctcttcc

SEQ ID NO: 2096701 - DNA, 15 bp, Homo sapiens
cttctttctcttccc

SEQ ID NO: 2096702 - DNA, 16 bp, Homo sapiens
cttctttgtcttagct

SEQ ID NO: 2096703 - DNA, 15 bp, Homo sapiens
cttctttttattttc

SEQ ID NO: 2096704 - DNA, 18 bp, Homo sapiens
cttctttttctttgagaa

SEQ ID NO: 2096705 - DNA, 23 bp, Homo sapiens
cttcttttttgtctcaagattat

SEQ ID NO: 2096706 - DNA, 17 bp, Homo sapiens
cttctttttttgtgatg

SEQ ID NO: 2096707 - DNA, 12 bp, Homo sapiens
cttgaaaaacaa

SEQ ID NO: 2096708 - DNA, 14 bp, Homo sapiens
cttgaaaaagtaga

SEQ ID NO: 2096709 - DNA, 19 bp, Homo sapiens
cttgaaaacctcatttacc

SEQ ID NO: 2096710 - DNA, 20 bp, Homo sapiens
cttgaaaattttattaaaaa

SEQ ID NO: 2096711 - DNA, 14 bp, Homo sapiens
cttgaaacagcctg

SEQ ID NO: 2096712 - DNA, 17 bp, Homo sapiens
cttgaaacagcctgggt

SEQ ID NO: 2096713 - DNA, 13 bp, Homo sapiens
cttgaaagctgtg

SEQ ID NO: 2096714 - DNA, 22 bp, Homo sapiens
cttgaaataccagtgaaccaaa

SEQ ID NO: 2096715 - DNA, 14 bp, Homo sapiens
cttgaactgattca

SEQ ID NO: 2096716 - DNA, 16 bp, Homo sapiens
cttgaactgggtactt

SEQ ID NO: 2096717 - DNA, 18 bp, Homo sapiens
cttgaactgggtacttgt

SEQ ID NO: 2096718 - DNA, 13 bp, Homo sapiens
cttgaactgtcag

SEQ ID NO: 2096719 - DNA, 21 bp, Homo sapiens
cttgaactgttctggcctcag

SEQ ID NO: 2096720 - DNA, 16 bp, Homo sapiens
cttgaagccactgaag

SEQ ID NO: 2096721 - DNA, 17 bp, Homo sapiens
cttgaagccactgaagc

SEQ ID NO: 2096722 - DNA, 18 bp, Homo sapiens
cttgaagccactgaagct

SEQ ID NO: 2096723 - DNA, 14 bp, Homo sapiens
cttgaaggaacagt

SEQ ID NO: 2096724 - DNA, 22 bp, Homo sapiens
cttgaaggaacagtgctgttct

SEQ ID NO: 2096725 - DNA, 23 bp, Homo sapiens
cttgaaggaacagtgctgttctg

SEQ ID NO: 2096726 - DNA, 20 bp, Homo sapiens
cttgaatctgttactgaaat

SEQ ID NO: 2096727 - DNA, 16 bp, Homo sapiens
cttgaatttcatgctt

SEQ ID NO: 2096728 - DNA, 16 bp, Homo sapiens
cttgacaacagactga

SEQ ID NO: 2096729 - DNA, 17 bp, Homo sapiens
cttgacagaacactgtc

SEQ ID NO: 2096730 - DNA, 12 bp, Homo sapiens
cttgacagggca

SEQ ID NO: 2096731 - DNA, 20 bp, Homo sapiens
cttgacagtggaactacatt

SEQ ID NO: 2096732 - DNA, 13 bp, Homo sapiens
cttgacattcctt

SEQ ID NO: 2096733 - DNA, 22 bp, Homo sapiens
cttgacattccttgtcaccagc

SEQ ID NO: 2096734 - DNA, 13 bp, Homo sapiens
cttgacccatctc

SEQ ID NO: 2096735 - DNA, 13 bp, Homo sapiens
cttgacctcaggt

SEQ ID NO: 2096736 - DNA, 17 bp, Homo sapiens
cttgactaataccttgt

SEQ ID NO: 2096737 - DNA, 20 bp, Homo sapiens
cttgactatcacatacaatt

SEQ ID NO: 2096738 - DNA, 21 bp, Homo sapiens
cttgactatcacatacaattt

SEQ ID NO: 2096739 - DNA, 22 bp, Homo sapiens
cttgactatcacatacaatttg

SEQ ID NO: 2096740 - DNA, 17 bp, Homo sapiens
cttgacttcacagcagc

SEQ ID NO: 2096741 - DNA, 12 bp, Homo sapiens
cttgagaaacct

SEQ ID NO: 2096742 - DNA, 14 bp, Homo sapiens
cttgagacctcagc

SEQ ID NO: 2096743 - DNA, 16 bp, Homo sapiens
cttgagacctcagcca

SEQ ID NO: 2096744 - DNA, 21 bp, Homo sapiens
cttgagagaaaaagtgcccct

SEQ ID NO: 2096745 - DNA, 22 bp, Homo sapiens
cttgagagtatcaggtctccca

SEQ ID NO: 2096746 - DNA, 16 bp, Homo sapiens
cttgagccagtaattg

SEQ ID NO: 2096747 - DNA, 14 bp, Homo sapiens
cttgagcccaggag

SEQ ID NO: 2096748 - DNA, 15 bp, Homo sapiens
cttgagcccaggagt

SEQ ID NO: 2096749 - DNA, 12 bp, Homo sapiens
cttgagcttggc

SEQ ID NO: 2096750 - DNA, 12 bp, Homo sapiens
cttgaggacaca

SEQ ID NO: 2096751 - DNA, 14 bp, Homo sapiens
cttgaggacacatg

SEQ ID NO: 2096752 - DNA, 17 bp, Homo sapiens
cttgaggacacatgtcc

SEQ ID NO: 2096753 - DNA, 13 bp, Homo sapiens
cttgaggaggggc

SEQ ID NO: 2096754 - DNA, 15 bp, Homo sapiens
cttgaggaggggcac

SEQ ID NO: 2096755 - DNA, 17 bp, Homo sapiens
cttgaggaggggcacct

SEQ ID NO: 2096756 - DNA, 18 bp, Homo sapiens
cttgaggaggggcacctg

SEQ ID NO: 2096757 - DNA, 19 bp, Homo sapiens
cttgaggaggggcacctgc

SEQ ID NO: 2096758 - DNA, 20 bp, Homo sapiens
cttgaggaggggcacctgcc

SEQ ID NO: 2096759 - DNA, 21 bp, Homo sapiens
cttgaggaggggcacctgcca

SEQ ID NO: 2096760 - DNA, 21 bp, Homo sapiens
gacagctggctgctgacagga

SEQ ID NO: 2096761 - DNA, 14 bp, Homo sapiens
gacagctgtccctg

SEQ ID NO: 2096762 - DNA, 16 bp, Homo sapiens
gacagctgtccctgtc

SEQ ID NO: 2096763 - DNA, 19 bp, Homo sapiens
gacagctgtccctgtcacc

SEQ ID NO: 2096764 - DNA, 22 bp, Homo sapiens
gacagctgtccctgtcaccaag

SEQ ID NO: 2096765 - DNA, 19 bp, Homo sapiens
gacagctgtgcctcgctcc

SEQ ID NO: 2096766 - DNA, 19 bp, Homo sapiens
gacaggaaaatcctctggc

SEQ ID NO: 2096767 - DNA, 14 bp, Homo sapiens
gacaggacagtgct

SEQ ID NO: 2096768 - DNA, 22 bp, Homo sapiens
gacaggacagtgcttcagcctg

SEQ ID NO: 2096769 - DNA, 12 bp, Homo sapiens
gacaggagaaat

SEQ ID NO: 2096770 - DNA, 19 bp, Homo sapiens
gacaggaggggcccacaat

SEQ ID NO: 2096771 - DNA, 13 bp, Homo sapiens
gacaggatgtggc

SEQ ID NO: 2096772 - DNA, 17 bp, Homo sapiens
gacaggatgtggcactg

SEQ ID NO: 2096773 - DNA, 20 bp, Homo sapiens
gacaggatgtggcactgctt

SEQ ID NO: 2096774 - DNA, 21 bp, Homo sapiens
gacaggatgtggcactgcttg

SEQ ID NO: 2096775 - DNA, 13 bp, Homo sapiens
gacaggcaagcac

SEQ ID NO: 2096776 - DNA, 17 bp, Homo sapiens
gacaggcaagcacctcc

SEQ ID NO: 2096777 - DNA, 21 bp, Homo sapiens
gacaggcaagcacctcctgcc

SEQ ID NO: 2096778 - DNA, 16 bp, Homo sapiens
gacaggcaatgctggc

SEQ ID NO: 2096779 - DNA, 22 bp, Homo sapiens
gacaggcatgttctctgaggac

SEQ ID NO: 2096780 - DNA, 15 bp, Homo sapiens
gacagggaagagcag

SEQ ID NO: 2096781 - DNA, 19 bp, Homo sapiens
gacagggacccacttcaca

SEQ ID NO: 2096782 - DNA, 23 bp, Homo sapiens
gacagggcacaccgggcactcag

SEQ ID NO: 2096783 - DNA, 14 bp, Homo sapiens
gacagggcatggcc

SEQ ID NO: 2096784 - DNA, 15 bp, Homo sapiens
gacagggcatggcca

SEQ ID NO: 2096785 - DNA, 22 bp, Homo sapiens
gacagggcatggccaggtggcc

SEQ ID NO: 2096786 - DNA, 22 bp, Homo sapiens
gacagggttttgccatgttggc

SEQ ID NO: 2096787 - DNA, 16 bp, Homo sapiens
gacaggtaaatgggca

SEQ ID NO: 2096788 - DNA, 14 bp, Homo sapiens
gacaggtaaattaa

SEQ ID NO: 2096789 - DNA, 15 bp, Homo sapiens
gacaggttcccagca

SEQ ID NO: 2096790 - DNA, 16 bp, Homo sapiens
gacaggttcccagcag

SEQ ID NO: 2096791 - DNA, 18 bp, Homo sapiens
gacagtcctgggagaacc

SEQ ID NO: 2096792 - DNA, 14 bp, Homo sapiens
gacagtgcccatgc

SEQ ID NO: 2096793 - DNA, 16 bp, Homo sapiens
gacagtgcccatgcaa

SEQ ID NO: 2096794 - DNA, 23 bp, Homo sapiens
gacagtgttgaaaatgttcagaa

SEQ ID NO: 2096795 - DNA, 15 bp, Homo sapiens
gacagttcatatgta

SEQ ID NO: 2096796 - DNA, 23 bp, Homo sapiens
gacagttggcagagaaggcctct

SEQ ID NO: 2096797 - DNA, 19 bp, Homo sapiens
gacataaagttgataaaga

SEQ ID NO: 2096798 - DNA, 20 bp, Homo sapiens
gacataaagttgataaagat

SEQ ID NO: 2096799 - DNA, 22 bp, Homo sapiens
gacataaagttgataaagattt

SEQ ID NO: 2096800 - DNA, 14 bp, Homo sapiens
gacatatatttatg

SEQ ID NO: 2096801 - DNA, 19 bp, Homo sapiens
gacatcaaatttgccacca

SEQ ID NO: 2096802 - DNA, 21 bp, Homo sapiens
gacatcaaatttgccaccact

SEQ ID NO: 2096803 - DNA, 16 bp, Homo sapiens
gacatcacagcagaat

SEQ ID NO: 2096804 - DNA, 18 bp, Homo sapiens
gacatcacagcagaatga

SEQ ID NO: 2096805 - DNA, 22 bp, Homo sapiens
gacatcacttgtacaaaataaa

SEQ ID NO: 2096806 - DNA, 22 bp, Homo sapiens
gacatccatgtttgtaaaacta

SEQ ID NO: 2096807 - DNA, 16 bp, Homo sapiens
gacatcttatttactt

SEQ ID NO: 2096808 - DNA, 16 bp, Homo sapiens
gacatgaaaactattt

SEQ ID NO: 2096809 - DNA, 18 bp, Homo sapiens
gacatgaaaactatttta

SEQ ID NO: 2096810 - DNA, 14 bp, Homo sapiens
gacatgacaatgca

SEQ ID NO: 2096811 - DNA, 22 bp, Homo sapiens
gacatgacttttctggaagaca

SEQ ID NO: 2096812 - DNA, 23 bp, Homo sapiens
gacatgatactgatgccatgttt

SEQ ID NO: 2096813 - DNA, 23 bp, Homo sapiens
gacatgatttagggaagcaggga

SEQ ID NO: 2096814 - DNA, 15 bp, Homo sapiens
gacatgcactgaccc

SEQ ID NO: 2096815 - DNA, 16 bp, Homo sapiens
gacatgccaccctctc

SEQ ID NO: 2096816 - DNA, 18 bp, Homo sapiens
gacatgccaccctctcca

SEQ ID NO: 2096817 - DNA, 20 bp, Homo sapiens
gacatggagactcctgccct

SEQ ID NO: 2096818 - DNA, 22 bp, Homo sapiens
gacatggagactcctgccctgt

SEQ ID NO: 2096819 - DNA, 14 bp, Homo sapiens
gacatggggcatag

SEQ ID NO: 2096820 - DNA, 14 bp, Homo sapiens
gacatgtgcctgta

SEQ ID NO: 2096821 - DNA, 16 bp, Homo sapiens
gacatgtggtgggaca

SEQ ID NO: 2096822 - DNA, 15 bp, Homo sapiens
gacatgttgtaaatt

SEQ ID NO: 2096823 - DNA, 15 bp, Homo sapiens
gacatgtttcacaac

SEQ ID NO: 2096824 - DNA, 14 bp, Homo sapiens
gacattaactcatt

SEQ ID NO: 2096825 - DNA, 17 bp, Homo sapiens
gacattccttgtcacca

SEQ ID NO: 2096826 - DNA, 20 bp, Homo sapiens
gacattccttgtcaccagca

SEQ ID NO: 2096827 - DNA, 13 bp, Homo sapiens
gacattctgattc

SEQ ID NO: 2096828 - DNA, 22 bp, Homo sapiens
gacattctgattcgaatgacac

SEQ ID NO: 2096829 - DNA, 23 bp, Homo sapiens
gacattgcggacagccacggcca

SEQ ID NO: 2096830 - DNA, 24 bp, Homo sapiens
gacatttccctcctgggagagaag

SEQ ID NO: 2096831 - DNA, 22 bp, Homo sapiens
gacatttctatcttgaatttca

SEQ ID NO: 2096832 - DNA, 18 bp, Homo sapiens
gacatttgacagtgtggg

SEQ ID NO: 2096833 - DNA, 19 bp, Homo sapiens
gaccaaaagttacatgttt

SEQ ID NO: 2096834 - DNA, 21 bp, Homo sapiens
gaccaaaggatccagagactt

SEQ ID NO: 2096835 - DNA, 14 bp, Homo sapiens
gaccaaattgcttc

SEQ ID NO: 2096836 - DNA, 16 bp, Homo sapiens
gaccaaattgcttcta

SEQ ID NO: 2096837 - DNA, 18 bp, Homo sapiens
gaccaaattgcttctagg

SEQ ID NO: 2096838 - DNA, 18 bp, Homo sapiens
gaccaaccctgtttcctg

SEQ ID NO: 2096839 - DNA, 12 bp, Homo sapiens
gaccaactggct

SEQ ID NO: 2096840 - DNA, 18 bp, Homo sapiens
gaccaactggcttctgtg

SEQ ID NO: 2096841 - DNA, 19 bp, Homo sapiens
gaccaactggcttctgtgc

SEQ ID NO: 2096842 - DNA, 16 bp, Homo sapiens
gaccaagagagaaaga

SEQ ID NO: 2096843 - DNA, 18 bp, Homo sapiens
gaccaagagagaaagaag

SEQ ID NO: 2096844 - DNA, 19 bp, Homo sapiens
gaccaagatgggcacatga

SEQ ID NO: 2096845 - DNA, 18 bp, Homo sapiens
gaccaaggttccagctca

SEQ ID NO: 2096846 - DNA, 13 bp, Homo sapiens
gaccaatctctgt

SEQ ID NO: 2096847 - DNA, 15 bp, Homo sapiens
gaccaatctctgtga

SEQ ID NO: 2096848 - DNA, 12 bp, Homo sapiens
gaccacacctcc

SEQ ID NO: 2096849 - DNA, 20 bp, Homo sapiens
gaccacacctccctgaacca

SEQ ID NO: 2096850 - DNA, 21 bp, Homo sapiens
gaccacaggcatctacacagc

SEQ ID NO: 2096851 - DNA, 17 bp, Homo sapiens
gaccacagtgggtggca

SEQ ID NO: 2096852 - DNA, 13 bp, Homo sapiens
gaccacatgtgtt

SEQ ID NO: 2096853 - DNA, 23 bp, Homo sapiens
gaccacctccctgccctgtcctc

SEQ ID NO: 2096854 - DNA, 12 bp, Homo sapiens
gaccacctgcca

SEQ ID NO: 2096855 - DNA, 15 bp, Homo sapiens
gaccacctgccagcc

SEQ ID NO: 2096856 - DNA, 15 bp, Homo sapiens
gaccacctgcttctg

SEQ ID NO: 2096857 - DNA, 19 bp, Homo sapiens
gaccacctgcttctgaact

SEQ ID NO: 2096858 - DNA, 16 bp, Homo sapiens
gaccacgggcctcagt

SEQ ID NO: 2096859 - DNA, 18 bp, Homo sapiens
gaccacgggcctcagttt

SEQ ID NO: 2096860 - DNA, 23 bp, Homo sapiens
gaccacgggcctcagtttcccca

SEQ ID NO: 2096861 - DNA, 14 bp, Homo sapiens
gaccactccagaga

SEQ ID NO: 2096862 - DNA, 15 bp, Homo sapiens
gaccactccagagaa

SEQ ID NO: 2096863 - DNA, 17 bp, Homo sapiens
gaccagaaacagggaca

SEQ ID NO: 2096864 - DNA, 22 bp, Homo sapiens
gaccagaaacagggacaaagaa

SEQ ID NO: 2096865 - DNA, 21 bp, Homo sapiens
gaccagagccccacacggagg

SEQ ID NO: 2096866 - DNA, 22 bp, Homo sapiens
gaccagcctccatgctgcctcc

SEQ ID NO: 2096867 - DNA, 17 bp, Homo sapiens
gaccagcctgggcagca

SEQ ID NO: 2096868 - DNA, 21 bp, Homo sapiens
gaccagctcagaggcccagga

SEQ ID NO: 2096869 - DNA, 17 bp, Homo sapiens
gaccaggctcacaactg

SEQ ID NO: 2096870 - DNA, 16 bp, Homo sapiens
gaccagttctggccag

SEQ ID NO: 2096871 - DNA, 15 bp, Homo sapiens
gaccagttgggagca

SEQ ID NO: 2096872 - DNA, 16 bp, Homo sapiens
gaccataacagccaac

SEQ ID NO: 2096873 - DNA, 19 bp, Homo sapiens
gaccataacagccaacagg

SEQ ID NO: 2096874 - DNA, 23 bp, Homo sapiens
gactggagtgaggcttccaggct

SEQ ID NO: 2096875 - DNA, 14 bp, Homo sapiens
gactggcaggtgca

SEQ ID NO: 2096876 - DNA, 20 bp, Homo sapiens
gactgggaccaggcaccagg

SEQ ID NO: 2096877 - DNA, 22 bp, Homo sapiens
gactgggggcacctgaccagaa

SEQ ID NO: 2096878 - DNA, 17 bp, Homo sapiens
gactgggttttgtctct

SEQ ID NO: 2096879 - DNA, 19 bp, Homo sapiens
gactggtgctataggctgg

SEQ ID NO: 2096880 - DNA, 18 bp, Homo sapiens
gactgtacttattttcca

SEQ ID NO: 2096881 - DNA, 11 bp, Homo sapiens
gactgtgaaag

SEQ ID NO: 2096882 - DNA, 14 bp, Homo sapiens
gactgtggctgcta

SEQ ID NO: 2096883 - DNA, 18 bp, Homo sapiens
gactgttgtacaagctca

SEQ ID NO: 2096884 - DNA, 14 bp, Homo sapiens
gacttacatgattc

SEQ ID NO: 2096885 - DNA, 15 bp, Homo sapiens
gacttactgtttctt

SEQ ID NO: 2096886 - DNA, 12 bp, Homo sapiens
gacttcacaaaa

SEQ ID NO: 2096887 - DNA, 17 bp, Homo sapiens
gacttcagaacatgctg

SEQ ID NO: 2096888 - DNA, 19 bp, Homo sapiens
gacttcagaacatgctgga

SEQ ID NO: 2096889 - DNA, 24 bp, Homo sapiens
gacttcaggtggagagcactagaa

SEQ ID NO: 2096890 - DNA, 12 bp, Homo sapiens
gacttcatccca

SEQ ID NO: 2096891 - DNA, 19 bp, Homo sapiens
gacttcctcgcctctccca

SEQ ID NO: 2096892 - DNA, 23 bp, Homo sapiens
gacttcctggtgaggcccagcct

SEQ ID NO: 2096893 - DNA, 16 bp, Homo sapiens
gacttctaagtaaaac

SEQ ID NO: 2096894 - DNA, 18 bp, Homo sapiens
gacttctaagtaaaacca

SEQ ID NO: 2096895 - DNA, 23 bp, Homo sapiens
gacttctaagtaaaaccacagca

SEQ ID NO: 2096896 - DNA, 14 bp, Homo sapiens
gacttctctttctt

SEQ ID NO: 2096897 - DNA, 19 bp, Homo sapiens
gacttctggaaggctggct

SEQ ID NO: 2096898 - DNA, 23 bp, Homo sapiens
gacttctgtcttcacaacagatt

SEQ ID NO: 2096899 - DNA, 20 bp, Homo sapiens
gacttcttggtttggggaga

SEQ ID NO: 2096900 - DNA, 22 bp, Homo sapiens
gacttcttggtttggggagaaa

SEQ ID NO: 2096901 - DNA, 16 bp, Homo sapiens
gacttgacagtggaac

SEQ ID NO: 2096902 - DNA, 20 bp, Homo sapiens
gacttgagcctccatttctg

SEQ ID NO: 2096903 - DNA, 17 bp, Homo sapiens
gacttggcaacagaagc

SEQ ID NO: 2096904 - DNA, 14 bp, Homo sapiens
gacttgggcacccc

SEQ ID NO: 2096905 - DNA, 15 bp, Homo sapiens
gacttggggaccaga

SEQ ID NO: 2096906 - DNA, 12 bp, Homo sapiens
gacttgtgccag

SEQ ID NO: 2096907 - DNA, 23 bp, Homo sapiens
gactttacaggaggttgtggatg

SEQ ID NO: 2096908 - DNA, 13 bp, Homo sapiens
gactttctgttgg

SEQ ID NO: 2096909 - DNA, 22 bp, Homo sapiens
gactttgttgccttatcttgaa

SEQ ID NO: 2096910 - DNA, 17 bp, Homo sapiens
gacttttccatgtatct

SEQ ID NO: 2096911 - DNA, 16 bp, Homo sapiens
gacttttctaaagctc

SEQ ID NO: 2096912 - DNA, 21 bp, Homo sapiens
gacttttctttgtggcttcct

SEQ ID NO: 2096913 - DNA, 17 bp, Homo sapiens
gactttttagccagtga

SEQ ID NO: 2096914 - DNA, 13 bp, Homo sapiens
gactttttataat

SEQ ID NO: 2096915 - DNA, 22 bp, Homo sapiens
gactttttataatgtggatttc

SEQ ID NO: 2096916 - DNA, 23 bp, Homo sapiens
gactttttttctgattcaaaagt

SEQ ID NO: 2096917 - DNA, 17 bp, Homo sapiens
gagaaaaaccaatgatt

SEQ ID NO: 2096918 - DNA, 14 bp, Homo sapiens
gagaaaaagaaatg

SEQ ID NO: 2096919 - DNA, 17 bp, Homo sapiens
gagaaaaagctcctgtc

SEQ ID NO: 2096920 - DNA, 14 bp, Homo sapiens
gagaaacagagaca

SEQ ID NO: 2096921 - DNA, 13 bp, Homo sapiens
gagaaacctccgg

SEQ ID NO: 2096922 - DNA, 24 bp, Homo sapiens
gagaaacctccggtgtgagatata

SEQ ID NO: 2096923 - DNA, 14 bp, Homo sapiens
gagaaaggagccgg

SEQ ID NO: 2096924 - DNA, 20 bp, Homo sapiens
gagaaaggattaagatacac

SEQ ID NO: 2096925 - DNA, 22 bp, Homo sapiens
gagaaataattgttgattaatt

SEQ ID NO: 2096926 - DNA, 13 bp, Homo sapiens
gagaaatatttat

SEQ ID NO: 2096927 - DNA, 16 bp, Homo sapiens
gagaaatcacaggggc

SEQ ID NO: 2096928 - DNA, 19 bp, Homo sapiens
gagaaatgaatgctgagac

SEQ ID NO: 2096929 - DNA, 20 bp, Homo sapiens
gagaaatgaatgctgagacc

SEQ ID NO: 2096930 - DNA, 19 bp, Homo sapiens
gagaaatttttatttttga

SEQ ID NO: 2096931 - DNA, 23 bp, Homo sapiens
gagaacatttacacattctcaca

SEQ ID NO: 2096932 - DNA, 18 bp, Homo sapiens
gagaactcgaagcccttc

SEQ ID NO: 2096933 - DNA, 23 bp, Homo sapiens
gagaactcgaagcccttccagtg

SEQ ID NO: 2096934 - DNA, 20 bp, Homo sapiens
gagaactgggatttgaaccc

SEQ ID NO: 2096935 - DNA, 20 bp, Homo sapiens
gagaagaattttcagacccc

SEQ ID NO: 2096936 - DNA, 21 bp, Homo sapiens
gagaagaggctggtgctgtgg

SEQ ID NO: 2096937 - DNA, 14 bp, Homo sapiens
gagaagcagcctcc

SEQ ID NO: 2096938 - DNA, 19 bp, Homo sapiens
gagaagccggctcttcaaa

SEQ ID NO: 2096939 - DNA, 22 bp, Homo sapiens
gagaaggacccggaggggcctg

SEQ ID NO: 2096940 - DNA, 17 bp, Homo sapiens
gagaaggatctagaatg

SEQ ID NO: 2096941 - DNA, 13 bp, Homo sapiens
gagaaggcaggaa

SEQ ID NO: 2096942 - DNA, 23 bp, Homo sapiens
gagaaggcaggaatgtgtggcag

SEQ ID NO: 2096943 - DNA, 14 bp, Homo sapiens
gagaaggccgctgc

SEQ ID NO: 2096944 - DNA, 20 bp, Homo sapiens
gagaagggccagccctacat

SEQ ID NO: 2096945 - DNA, 15 bp, Homo sapiens
gagaagggggattgg

SEQ ID NO: 2096946 - DNA, 23 bp, Homo sapiens
gagaagtatccaattatgtgaca

SEQ ID NO: 2096947 - DNA, 18 bp, Homo sapiens
gagaagttcatatttctt

SEQ ID NO: 2096948 - DNA, 16 bp, Homo sapiens
gagaagtttctggccc

SEQ ID NO: 2096949 - DNA, 17 bp, Homo sapiens
gagaagtttctggccct

SEQ ID NO: 2096950 - DNA, 16 bp, Homo sapiens
gagaagttttgttttt

SEQ ID NO: 2096951 - DNA, 14 bp, Homo sapiens
gagaatatatacat

SEQ ID NO: 2096952 - DNA, 13 bp, Homo sapiens
gagaatcagggca

SEQ ID NO: 2096953 - DNA, 14 bp, Homo sapiens
gagaatcagggcag

SEQ ID NO: 2096954 - DNA, 21 bp, Homo sapiens
gagaatcatacttagcaaagt

SEQ ID NO: 2096955 - DNA, 20 bp, Homo sapiens
gagaatcccactttctatag

SEQ ID NO: 2096956 - DNA, 14 bp, Homo sapiens
gagaatcctgcctc

SEQ ID NO: 2096957 - DNA, 18 bp, Homo sapiens
gagaatctggctcctgtt

SEQ ID NO: 2096958 - DNA, 15 bp, Homo sapiens
gagaatgaaagggcc

SEQ ID NO: 2096959 - DNA, 23 bp, Homo sapiens
gagaatgaaagggcccagagagg

SEQ ID NO: 2096960 - DNA, 13 bp, Homo sapiens
gagaatgagcctc

SEQ ID NO: 2096961 - DNA, 16 bp, Homo sapiens
gagaatgggtttactc

SEQ ID NO: 2096962 - DNA, 20 bp, Homo sapiens
gagaatgggtttactctcaa

SEQ ID NO: 2096963 - DNA, 13 bp, Homo sapiens
gagaattctaaga

SEQ ID NO: 2096964 - DNA, 21 bp, Homo sapiens
gagaattgtatcatttgaaca

SEQ ID NO: 2096965 - DNA, 15 bp, Homo sapiens
gagaattttaaatta

SEQ ID NO: 2096966 - DNA, 17 bp, Homo sapiens
gagacaagccctggcaa

SEQ ID NO: 2096967 - DNA, 17 bp, Homo sapiens
gagacaatcacagctcc

SEQ ID NO: 2096968 - DNA, 23 bp, Homo sapiens
gagacaccgcgcatctcttcctg

SEQ ID NO: 2096969 - DNA, 15 bp, Homo sapiens
gagacacctgcacct

SEQ ID NO: 2096970 - DNA, 16 bp, Homo sapiens
gagacagagcccccaa

SEQ ID NO: 2096971 - DNA, 22 bp, Homo sapiens
gagacagagcccccaagcctct

SEQ ID NO: 2096972 - DNA, 19 bp, Homo sapiens
gagacagagttttcactct

SEQ ID NO: 2096973 - DNA, 19 bp, Homo sapiens
gagacaggaaaatcctctg

SEQ ID NO: 2096974 - DNA, 15 bp, Homo sapiens
gagacaggagggcaa

SEQ ID NO: 2096975 - DNA, 19 bp, Homo sapiens
gagacagggcaatcttgtc

SEQ ID NO: 2096976 - DNA, 16 bp, Homo sapiens
gagacagggtctcact

SEQ ID NO: 2096977 - DNA, 16 bp, Homo sapiens
gagacagtagaggcat

SEQ ID NO: 2096978 - DNA, 17 bp, Homo sapiens
gagacagtgatctccat

SEQ ID NO: 2096979 - DNA, 17 bp, Homo sapiens
gagacagttatttatag

SEQ ID NO: 2096980 - DNA, 18 bp, Homo sapiens
gagacagttcaagaaagc

SEQ ID NO: 2096981 - DNA, 18 bp, Homo sapiens
gagacatgtaccttgacc

SEQ ID NO: 2096982 - DNA, 23 bp, Homo sapiens
gagacattgcctccacctctcct

SEQ ID NO: 2096983 - DNA, 17 bp, Homo sapiens
gagaccaacctgaccaa

SEQ ID NO: 2096984 - DNA, 22 bp, Homo sapiens
gagaccaagactctgaaatctc

SEQ ID NO: 2096985 - DNA, 12 bp, Homo sapiens
gagaccacctct

SEQ ID NO: 2096986 - DNA, 13 bp, Homo sapiens
gagaccagcctgg

SEQ ID NO: 2096987 - DNA, 14 bp, Homo sapiens
gagaccagcctggc

SEQ ID NO: 2096988 - DNA, 16 bp, Homo sapiens
gagctttagcttctct

SEQ ID NO: 2096989 - DNA, 15 bp, Homo sapiens
gagctttcaaagaag

SEQ ID NO: 2096990 - DNA, 18 bp, Homo sapiens
gagctttcaaagaaggaa

SEQ ID NO: 2096991 - DNA, 23 bp, Homo sapiens
gagctttggggacagttggcaga

SEQ ID NO: 2096992 - DNA, 22 bp, Homo sapiens
gagctttgttttatatatttat

SEQ ID NO: 2096993 - DNA, 15 bp, Homo sapiens
gaggaaattaaagtc

SEQ ID NO: 2096994 - DNA, 21 bp, Homo sapiens
gaggaagatgaagagaagctg

SEQ ID NO: 2096995 - DNA, 12 bp, Homo sapiens
gaggaagcaaga

SEQ ID NO: 2096996 - DNA, 15 bp, Homo sapiens
gaggaagggccagga

SEQ ID NO: 2096997 - DNA, 20 bp, Homo sapiens
gaggaagggccaggagagag

SEQ ID NO: 2096998 - DNA, 13 bp, Homo sapiens
gaggaaggtgctg

SEQ ID NO: 2096999 - DNA, 22 bp, Homo sapiens
gaggaataagaatggagcagta

SEQ ID NO: 2097000 - DNA, 18 bp, Homo sapiens
gaggaataattatttatt

SEQ ID NO: 2097001 - DNA, 18 bp, Homo sapiens
gaggaatatgactgtttt

SEQ ID NO: 2097002 - DNA, 19 bp, Homo sapiens
gaggaatatgactgttttt

SEQ ID NO: 2097003 - DNA, 21 bp, Homo sapiens
gaggaatcatgtcaggcctgt

SEQ ID NO: 2097004 - DNA, 14 bp, Homo sapiens
gaggaatccagacc

SEQ ID NO: 2097005 - DNA, 12 bp, Homo sapiens
gaggacaagtga

SEQ ID NO: 2097006 - DNA, 12 bp, Homo sapiens
gaggacacatgt

SEQ ID NO: 2097007 - DNA, 14 bp, Homo sapiens
gaggacacatgtcc

SEQ ID NO: 2097008 - DNA, 18 bp, Homo sapiens
gaggacatgatggagcgc

SEQ ID NO: 2097009 - DNA, 22 bp, Homo sapiens
gaggaccacactttgagaacct

SEQ ID NO: 2097010 - DNA, 17 bp, Homo sapiens
gaggaccctggttactc

SEQ ID NO: 2097011 - DNA, 21 bp, Homo sapiens
gaggactactatttgaagcaa

SEQ ID NO: 2097012 - DNA, 16 bp, Homo sapiens
gaggactagaacctgg

SEQ ID NO: 2097013 - DNA, 13 bp, Homo sapiens
gaggactccctcc

SEQ ID NO: 2097014 - DNA, 18 bp, Homo sapiens
gaggactccctccatgtg

SEQ ID NO: 2097015 - DNA, 13 bp, Homo sapiens
gaggactgagact

SEQ ID NO: 2097016 - DNA, 17 bp, Homo sapiens
gaggacttgtgtctctg

SEQ ID NO: 2097017 - DNA, 18 bp, Homo sapiens
gaggacttgtgtctctgt

SEQ ID NO: 2097018 - DNA, 9 bp, Homo sapiens
gaggagaaa

SEQ ID NO: 2097019 - DNA, 15 bp, Homo sapiens
gaggagaaataaact

SEQ ID NO: 2097020 - DNA, 20 bp, Homo sapiens
gaggagaggggaagggccag

SEQ ID NO: 2097021 - DNA, 13 bp, Homo sapiens
gaggagcacctga

SEQ ID NO: 2097022 - DNA, 17 bp, Homo sapiens
gaggagcacctgaaccc

SEQ ID NO: 2097023 - DNA, 21 bp, Homo sapiens
gaggagctgccgcaaggccct

SEQ ID NO: 2097024 - DNA, 14 bp, Homo sapiens
gaggaggaaggcaa

SEQ ID NO: 2097025 - DNA, 17 bp, Homo sapiens
gaggaggaaggcaaagc

SEQ ID NO: 2097026 - DNA, 14 bp, Homo sapiens
gaggaggagctgcc

SEQ ID NO: 2097027 - DNA, 13 bp, Homo sapiens
gaggaggaggaag

SEQ ID NO: 2097028 - DNA, 21 bp, Homo sapiens
gaggaggattgcttcttgtga

SEQ ID NO: 2097029 - DNA, 20 bp, Homo sapiens
gaggagggcgtgactcaccc

SEQ ID NO: 2097030 - DNA, 15 bp, Homo sapiens
gaggaggggcacctg

SEQ ID NO: 2097031 - DNA, 19 bp, Homo sapiens
gaggaggggcacctgccac

SEQ ID NO: 2097032 - DNA, 20 bp, Homo sapiens
gaggaggtggcagccctgta

SEQ ID NO: 2097033 - DNA, 22 bp, Homo sapiens
gaggaggtgtcccaagctttga

SEQ ID NO: 2097034 - DNA, 20 bp, Homo sapiens
gaggaggtttggggtctgcc

SEQ ID NO: 2097035 - DNA, 23 bp, Homo sapiens
gaggagtagctgagaggaagatg

SEQ ID NO: 2097036 - DNA, 19 bp, Homo sapiens
gaggagtccagggcgggag

SEQ ID NO: 2097037 - DNA, 18 bp, Homo sapiens
gaggagtctgaggtcctg

SEQ ID NO: 2097038 - DNA, 19 bp, Homo sapiens
gaggagtctgaggtcctga

SEQ ID NO: 2097039 - DNA, 21 bp, Homo sapiens
gaggagtctgaggtcctgagc

SEQ ID NO: 2097040 - DNA, 16 bp, Homo sapiens
gaggagtttcgaggta

SEQ ID NO: 2097041 - DNA, 19 bp, Homo sapiens
gaggatcacagtgctgaga

SEQ ID NO: 2097042 - DNA, 18 bp, Homo sapiens
gaggatcctcacaggagc

SEQ ID NO: 2097043 - DNA, 19 bp, Homo sapiens
gaggatcctcacaggagca

SEQ ID NO: 2097044 - DNA, 21 bp, Homo sapiens
gaggatgatttcagaaggaga

SEQ ID NO: 2097045 - DNA, 16 bp, Homo sapiens
gaggatgccacagccc

SEQ ID NO: 2097046 - DNA, 18 bp, Homo sapiens
gaggatgccacagcccca

SEQ ID NO: 2097047 - DNA, 19 bp, Homo sapiens
gaggatgccacagccccac

SEQ ID NO: 2097048 - DNA, 21 bp, Homo sapiens
gaggatgccacagccccacag

SEQ ID NO: 2097049 - DNA, 12 bp, Homo sapiens
gaggatggagag

SEQ ID NO: 2097050 - DNA, 22 bp, Homo sapiens
gaggatgtgttttgcacgtctt

SEQ ID NO: 2097051 - DNA, 17 bp, Homo sapiens
gaggatgttctgggaca

SEQ ID NO: 2097052 - DNA, 20 bp, Homo sapiens
gaggatgttctgggacacag

SEQ ID NO: 2097053 - DNA, 19 bp, Homo sapiens
gaggattatgggtcctgca

SEQ ID NO: 2097054 - DNA, 23 bp, Homo sapiens
gaggattgcttcttgtgaaacca

SEQ ID NO: 2097055 - DNA, 19 bp, Homo sapiens
gaggattgcttgagcccag

SEQ ID NO: 2097056 - DNA, 17 bp, Homo sapiens
gaggcaaaggccagcag

SEQ ID NO: 2097057 - DNA, 18 bp, Homo sapiens
gaggcaaggttatatgca

SEQ ID NO: 2097058 - DNA, 13 bp, Homo sapiens
gaggcaccagctc

SEQ ID NO: 2097059 - DNA, 16 bp, Homo sapiens
gaggcaccagctctgt

SEQ ID NO: 2097060 - DNA, 23 bp, Homo sapiens
gaggcaccagctctgtggcctgt

SEQ ID NO: 2097061 - DNA, 16 bp, Homo sapiens
gaggcaccggcgctgc

SEQ ID NO: 2097062 - DNA, 17 bp, Homo sapiens
gaggcaccggcgctgca

SEQ ID NO: 2097063 - DNA, 19 bp, Homo sapiens
gaggcagacagcagctcag

SEQ ID NO: 2097064 - DNA, 13 bp, Homo sapiens
gaggcagccccat

SEQ ID NO: 2097065 - DNA, 18 bp, Homo sapiens
gaggcagccccattctgc

SEQ ID NO: 2097066 - DNA, 20 bp, Homo sapiens
gaggcagccccattctgcct

SEQ ID NO: 2097067 - DNA, 23 bp, Homo sapiens
gaggcagcgtgaaagcagatgag

SEQ ID NO: 2097068 - DNA, 15 bp, Homo sapiens
gaggcagctccaaca

SEQ ID NO: 2097069 - DNA, 21 bp, Homo sapiens
gaggcagctccaacagcttga

SEQ ID NO: 2097070 - DNA, 17 bp, Homo sapiens
gaggcagggaggggact

SEQ ID NO: 2097071 - DNA, 20 bp, Homo sapiens
gaggcagggccttgcccaga

SEQ ID NO: 2097072 - DNA, 21 bp, Homo sapiens
gaggcagggccttgcccagag

SEQ ID NO: 2097073 - DNA, 14 bp, Homo sapiens
gaggcaggggcgga

SEQ ID NO: 2097074 - DNA, 20 bp, Homo sapiens
gaggcagggtctcactctgt

SEQ ID NO: 2097075 - DNA, 14 bp, Homo sapiens
gaggcatggccctg

SEQ ID NO: 2097076 - DNA, 15 bp, Homo sapiens
gaggcatggccctgg

SEQ ID NO: 2097077 - DNA, 13 bp, Homo sapiens
gaggccaaggtgg

SEQ ID NO: 2097078 - DNA, 21 bp, Homo sapiens
gaggccaccgggacagacctg

SEQ ID NO: 2097079 - DNA, 22 bp, Homo sapiens
gaggccaccgggacagacctgg

SEQ ID NO: 2097080 - DNA, 23 bp, Homo sapiens
gaggccaccgggacagacctgga

SEQ ID NO: 2097081 - DNA, 11 bp, Homo sapiens
gaggccagcct

SEQ ID NO: 2097082 - DNA, 13 bp, Homo sapiens
gaggccagcctgg

SEQ ID NO: 2097083 - DNA, 18 bp, Homo sapiens
gaggccagcctggcctcc

SEQ ID NO: 2097084 - DNA, 14 bp, Homo sapiens
gaggccatgggcct

SEQ ID NO: 2097085 - DNA, 23 bp, Homo sapiens
gaggccatgggcctcctgtgtgt

SEQ ID NO: 2097086 - DNA, 13 bp, Homo sapiens
gaggcccctggac

SEQ ID NO: 2097087 - DNA, 14 bp, Homo sapiens
gaggccctggatca

SEQ ID NO: 2097088 - DNA, 24 bp, Homo sapiens
gaggcctcttggacctctgctctg

SEQ ID NO: 2097089 - DNA, 12 bp, Homo sapiens
gaggcctggcct

SEQ ID NO: 2097090 - DNA, 15 bp, Homo sapiens
gaggccttgagaggc

SEQ ID NO: 2097091 - DNA, 17 bp, Homo sapiens
gaggcctttccccagtg

SEQ ID NO: 2097092 - DNA, 15 bp, Homo sapiens
gaggcgaataaatgt

SEQ ID NO: 2097093 - DNA, 16 bp, Homo sapiens
gaggcgaataaatgtt

SEQ ID NO: 2097094 - DNA, 15 bp, Homo sapiens
gaggcggaaaccttg

SEQ ID NO: 2097095 - DNA, 16 bp, Homo sapiens
gaggcggaaaccttgc

SEQ ID NO: 2097096 - DNA, 14 bp, Homo sapiens
gaggcggaagaatc

SEQ ID NO: 2097097 - DNA, 19 bp, Homo sapiens
gaggcggagagtacagtga

SEQ ID NO: 2097098 - DNA, 20 bp, Homo sapiens
gaggcggcacattggcagtg

SEQ ID NO: 2097099 - DNA, 20 bp, Homo sapiens
gaggcggctccaggtccgga

SEQ ID NO: 2097100 - DNA, 21 bp, Homo sapiens
gaggctagaaccaagaagggc

SEQ ID NO: 2097101 - DNA, 17 bp, Homo sapiens
gaggctcaagaggccca

SEQ ID NO: 2097102 - DNA, 18 bp, Homo sapiens
gatcctgctgtggcctca

SEQ ID NO: 2097103 - DNA, 20 bp, Homo sapiens
gatcctgtctttaaggaaaa

SEQ ID NO: 2097104 - DNA, 23 bp, Homo sapiens
gatcgcgccactacactccagcc

SEQ ID NO: 2097105 - DNA, 16 bp, Homo sapiens
gatcgctggcagagaa

SEQ ID NO: 2097106 - DNA, 19 bp, Homo sapiens
gatcgctttgtactttgtg

SEQ ID NO: 2097107 - DNA, 18 bp, Homo sapiens
gatcgggataacaaaatc

SEQ ID NO: 2097108 - DNA, 21 bp, Homo sapiens
gatcgtattaattatctgatc

SEQ ID NO: 2097109 - DNA, 23 bp, Homo sapiens
gatcgtgccgttactctccaacc

SEQ ID NO: 2097110 - DNA, 13 bp, Homo sapiens
gatctagcttcat

SEQ ID NO: 2097111 - DNA, 22 bp, Homo sapiens
gatctagcttcatgcctcagtt

SEQ ID NO: 2097112 - DNA, 15 bp, Homo sapiens
gatctatgcaatttt

SEQ ID NO: 2097113 - DNA, 22 bp, Homo sapiens
gatctcaggagcttgcaagaag

SEQ ID NO: 2097114 - DNA, 21 bp, Homo sapiens
gatctcatggaaactggccag

SEQ ID NO: 2097115 - DNA, 22 bp, Homo sapiens
gatctcatggaaactggccagg

SEQ ID NO: 2097116 - DNA, 15 bp, Homo sapiens
gatctccctccaggg

SEQ ID NO: 2097117 - DNA, 14 bp, Homo sapiens
gatctccctgccgc

SEQ ID NO: 2097118 - DNA, 20 bp, Homo sapiens
gatctcctgtaattttgtag

SEQ ID NO: 2097119 - DNA, 12 bp, Homo sapiens
gatctctcagga

SEQ ID NO: 2097120 - DNA, 17 bp, Homo sapiens
gatctctcaggagcaca

SEQ ID NO: 2097121 - DNA, 18 bp, Homo sapiens
gatctctcaggagcacag

SEQ ID NO: 2097122 - DNA, 22 bp, Homo sapiens
gatctctcaggagcacaggcag

SEQ ID NO: 2097123 - DNA, 15 bp, Homo sapiens
gatctgatggtgagc

SEQ ID NO: 2097124 - DNA, 20 bp, Homo sapiens
gatctgcagggggtgtgtct

SEQ ID NO: 2097125 - DNA, 11 bp, Homo sapiens
gatctgcctgg

SEQ ID NO: 2097126 - DNA, 12 bp, Homo sapiens
gatctgcctggg

SEQ ID NO: 2097127 - DNA, 16 bp, Homo sapiens
gatctgcctgggcctg

SEQ ID NO: 2097128 - DNA, 15 bp, Homo sapiens
gatctgcttcttcat

SEQ ID NO: 2097129 - DNA, 17 bp, Homo sapiens
gatctgggaccctttcc

SEQ ID NO: 2097130 - DNA, 21 bp, Homo sapiens
gatctgggaggtctccactga

SEQ ID NO: 2097131 - DNA, 21 bp, Homo sapiens
gatctggggactgagtgtggg

SEQ ID NO: 2097132 - DNA, 18 bp, Homo sapiens
gatctggggctctgggat

SEQ ID NO: 2097133 - DNA, 18 bp, Homo sapiens
gatctgggttcactgcaa

SEQ ID NO: 2097134 - DNA, 17 bp, Homo sapiens
gatctgtactgtaattt

SEQ ID NO: 2097135 - DNA, 20 bp, Homo sapiens
gatctgtatatacaataaca

SEQ ID NO: 2097136 - DNA, 17 bp, Homo sapiens
gatctgtcccctctccc

SEQ ID NO: 2097137 - DNA, 19 bp, Homo sapiens
gatctgtcccctctcccct

SEQ ID NO: 2097138 - DNA, 23 bp, Homo sapiens
gatctgtttttaaaaatcataaa

SEQ ID NO: 2097139 - DNA, 15 bp, Homo sapiens
gatcttctgaaatga

SEQ ID NO: 2097140 - DNA, 16 bp, Homo sapiens
gatcttgtctccacta

SEQ ID NO: 2097141 - DNA, 13 bp, Homo sapiens
gatctttaaaata

SEQ ID NO: 2097142 - DNA, 17 bp, Homo sapiens
gatctttgcagacaggc

SEQ ID NO: 2097143 - DNA, 14 bp, Homo sapiens
gatgaaagaggagg

SEQ ID NO: 2097144 - DNA, 13 bp, Homo sapiens
gatgaagagaagc

SEQ ID NO: 2097145 - DNA, 16 bp, Homo sapiens
gatgaagagaagctga

SEQ ID NO: 2097146 - DNA, 21 bp, Homo sapiens
gatgaagagtgagagggcatg

SEQ ID NO: 2097147 - DNA, 20 bp, Homo sapiens
gatgacacctccatttctct

SEQ ID NO: 2097148 - DNA, 17 bp, Homo sapiens
gatgaccaatctctgtg

SEQ ID NO: 2097149 - DNA, 18 bp, Homo sapiens
gatgaccaatctctgtga

SEQ ID NO: 2097150 - DNA, 19 bp, Homo sapiens
gatgacctaacctaagcaa

SEQ ID NO: 2097151 - DNA, 12 bp, Homo sapiens
gatgactaaaat

SEQ ID NO: 2097152 - DNA, 16 bp, Homo sapiens
gatgactagaggcagg

SEQ ID NO: 2097153 - DNA, 18 bp, Homo sapiens
gatgactttttttctgat

SEQ ID NO: 2097154 - DNA, 12 bp, Homo sapiens
gatgagaagtta

SEQ ID NO: 2097155 - DNA, 19 bp, Homo sapiens
gatgagaagttaagcagcc

SEQ ID NO: 2097156 - DNA, 17 bp, Homo sapiens
gatgagagagtgctgag

SEQ ID NO: 2097157 - DNA, 15 bp, Homo sapiens
gatgagattccctct

SEQ ID NO: 2097158 - DNA, 20 bp, Homo sapiens
gatgagattccctctcctcc

SEQ ID NO: 2097159 - DNA, 22 bp, Homo sapiens
gatgaggcctcttggacctctg

SEQ ID NO: 2097160 - DNA, 13 bp, Homo sapiens
gatgagggcagca

SEQ ID NO: 2097161 - DNA, 18 bp, Homo sapiens
gatgaggtaattctccct

SEQ ID NO: 2097162 - DNA, 20 bp, Homo sapiens
gatgagtgattgacacacag

SEQ ID NO: 2097163 - DNA, 22 bp, Homo sapiens
gatgataaatatttatgcttaa

SEQ ID NO: 2097164 - DNA, 13 bp, Homo sapiens
gatgatcgtgcct

SEQ ID NO: 2097165 - DNA, 13 bp, Homo sapiens
gatgatctctcca

SEQ ID NO: 2097166 - DNA, 20 bp, Homo sapiens
gatgatctttgcagacaggc

SEQ ID NO: 2097167 - DNA, 17 bp, Homo sapiens
gatgatgatgatgatga

SEQ ID NO: 2097168 - DNA, 20 bp, Homo sapiens
gatgatgtctcttgtagaag

SEQ ID NO: 2097169 - DNA, 14 bp, Homo sapiens
gatgattaaacacc

SEQ ID NO: 2097170 - DNA, 16 bp, Homo sapiens
gatgattaaacacctg

SEQ ID NO: 2097171 - DNA, 17 bp, Homo sapiens
gatgattaaacacctga

SEQ ID NO: 2097172 - DNA, 18 bp, Homo sapiens
gatgcaacctcactatgg

SEQ ID NO: 2097173 - DNA, 14 bp, Homo sapiens
gatgcacagagata

SEQ ID NO: 2097174 - DNA, 14 bp, Homo sapiens
gatgcaccagccct

SEQ ID NO: 2097175 - DNA, 15 bp, Homo sapiens
gatgcaccagccctt

SEQ ID NO: 2097176 - DNA, 23 bp, Homo sapiens
gatgcaccagcccttagcaggga

SEQ ID NO: 2097177 - DNA, 11 bp, Homo sapiens
gatgcagaggg

SEQ ID NO: 2097178 - DNA, 12 bp, Homo sapiens
gatgcagagggg

SEQ ID NO: 2097179 - DNA, 23 bp, Homo sapiens
gatgcagaggtaaaagtgtgagc

SEQ ID NO: 2097180 - DNA, 20 bp, Homo sapiens
gatgcatcagaaagggaggg

SEQ ID NO: 2097181 - DNA, 18 bp, Homo sapiens
gatgcatttccacactgt

SEQ ID NO: 2097182 - DNA, 19 bp, Homo sapiens
gatgccacagccccacagc

SEQ ID NO: 2097183 - DNA, 21 bp, Homo sapiens
gatgccacagccccacagcac

SEQ ID NO: 2097184 - DNA, 22 bp, Homo sapiens
gatgcccagagggcccaggcag

SEQ ID NO: 2097185 - DNA, 23 bp, Homo sapiens
gatgcccagagggcccaggcagg

SEQ ID NO: 2097186 - DNA, 17 bp, Homo sapiens
gatgccctaagtgttga

SEQ ID NO: 2097187 - DNA, 15 bp, Homo sapiens
gatgccgctcttctg

SEQ ID NO: 2097188 - DNA, 16 bp, Homo sapiens
gatgcctccaccgctg

SEQ ID NO: 2097189 - DNA, 14 bp, Homo sapiens
gatgcctggtggca

SEQ ID NO: 2097190 - DNA, 14 bp, Homo sapiens
gatgctcaggcttg

SEQ ID NO: 2097191 - DNA, 16 bp, Homo sapiens
gatgctccagggcagc

SEQ ID NO: 2097192 - DNA, 19 bp, Homo sapiens
gatgctccagggcagcctc

SEQ ID NO: 2097193 - DNA, 20 bp, Homo sapiens
gatgctgactgtactcctcc

SEQ ID NO: 2097194 - DNA, 23 bp, Homo sapiens
gatgctttgtttctttcatatga

SEQ ID NO: 2097195 - DNA, 17 bp, Homo sapiens
gatggaaatatgttcta

SEQ ID NO: 2097196 - DNA, 16 bp, Homo sapiens
gatggaccagtagaca

SEQ ID NO: 2097197 - DNA, 15 bp, Homo sapiens
gatggaccctcgcag

SEQ ID NO: 2097198 - DNA, 15 bp, Homo sapiens
gatggaccgggtggg

SEQ ID NO: 2097199 - DNA, 19 bp, Homo sapiens
gatggaccgggtgggcctg

SEQ ID NO: 2097200 - DNA, 19 bp, Homo sapiens
gatggacgaacaggggcca

SEQ ID NO: 2097201 - DNA, 17 bp, Homo sapiens
gatggacttttgggggt

SEQ ID NO: 2097202 - DNA, 19 bp, Homo sapiens
gatggacttttgggggttg

SEQ ID NO: 2097203 - DNA, 15 bp, Homo sapiens
gatggagaaggaagg

SEQ ID NO: 2097204 - DNA, 23 bp, Homo sapiens
gatggagacttcaggttgttctg

SEQ ID NO: 2097205 - DNA, 21 bp, Homo sapiens
gatggagaggcggcctcgtgc

SEQ ID NO: 2097206 - DNA, 18 bp, Homo sapiens
gatggataacctatatga

SEQ ID NO: 2097207 - DNA, 14 bp, Homo sapiens
gatggatgctgggg

SEQ ID NO: 2097208 - DNA, 15 bp, Homo sapiens
gatggcaccagaggc

SEQ ID NO: 2097209 - DNA, 18 bp, Homo sapiens
gatggccaagggggtgga

SEQ ID NO: 2097210 - DNA, 22 bp, Homo sapiens
gatggcccttcccactggaggt

SEQ ID NO: 2097211 - DNA, 21 bp, Homo sapiens
gatggcgattccctctcaccc

SEQ ID NO: 2097212 - DNA, 16 bp, Homo sapiens
gatggcgcgggaggca

SEQ ID NO: 2097213 - DNA, 22 bp, Homo sapiens
gatggcgcgggaggcaccagct

SEQ ID NO: 2097214 - DNA, 13 bp, Homo sapiens
gatggctgtgcct

SEQ ID NO: 2097215 - DNA, 17 bp, Homo sapiens
gatggctgtgcctctgc

SEQ ID NO: 2097216 - DNA, 19 bp, Homo sapiens
gcacatagagatatgcaca

SEQ ID NO: 2097217 - DNA, 18 bp, Homo sapiens
gcacatatggactctgca

SEQ ID NO: 2097218 - DNA, 18 bp, Homo sapiens
gcacatatgggtgctggc

SEQ ID NO: 2097219 - DNA, 14 bp, Homo sapiens
gcacatattgagca

SEQ ID NO: 2097220 - DNA, 12 bp, Homo sapiens
gcacatctggga

SEQ ID NO: 2097221 - DNA, 20 bp, Homo sapiens
gcacatgtcttgtacatgtg

SEQ ID NO: 2097222 - DNA, 13 bp, Homo sapiens
gcacattcctggc

SEQ ID NO: 2097223 - DNA, 15 bp, Homo sapiens
gcacattcctggccc

SEQ ID NO: 2097224 - DNA, 17 bp, Homo sapiens
gcacattcctggccccg

SEQ ID NO: 2097225 - DNA, 16 bp, Homo sapiens
gcacattggcagtgtg

SEQ ID NO: 2097226 - DNA, 14 bp, Homo sapiens
gcacatttatatat

SEQ ID NO: 2097227 - DNA, 21 bp, Homo sapiens
gcaccaattgtacattccctg

SEQ ID NO: 2097228 - DNA, 20 bp, Homo sapiens
gcaccacggcgtttttttac

SEQ ID NO: 2097229 - DNA, 20 bp, Homo sapiens
gcaccagatgcaacctcact

SEQ ID NO: 2097230 - DNA, 16 bp, Homo sapiens
gcaccagccccctgga

SEQ ID NO: 2097231 - DNA, 19 bp, Homo sapiens
gcaccagccccctggatgg

SEQ ID NO: 2097232 - DNA, 18 bp, Homo sapiens
gcaccagcccttccctgc

SEQ ID NO: 2097233 - DNA, 19 bp, Homo sapiens
gcaccagcccttccctgct

SEQ ID NO: 2097234 - DNA, 20 bp, Homo sapiens
gcaccagcccttccctgctt

SEQ ID NO: 2097235 - DNA, 14 bp, Homo sapiens
gcaccagctctgtg

SEQ ID NO: 2097236 - DNA, 20 bp, Homo sapiens
gcaccagctctgtggcctgt

SEQ ID NO: 2097237 - DNA, 15 bp, Homo sapiens
gcaccagctgctctg

SEQ ID NO: 2097238 - DNA, 18 bp, Homo sapiens
gcaccagctgctctgccc

SEQ ID NO: 2097239 - DNA, 19 bp, Homo sapiens
gcaccagcttctccaggct

SEQ ID NO: 2097240 - DNA, 23 bp, Homo sapiens
gcaccaggcacgaacccacctgc

SEQ ID NO: 2097241 - DNA, 16 bp, Homo sapiens
gcaccagtgccgcctg

SEQ ID NO: 2097242 - DNA, 20 bp, Homo sapiens
gcaccagtgccgcctgtgcc

SEQ ID NO: 2097243 - DNA, 22 bp, Homo sapiens
gcacccaccatcatgtctggct

SEQ ID NO: 2097244 - DNA, 18 bp, Homo sapiens
gcacccacctccaccccc

SEQ ID NO: 2097245 - DNA, 19 bp, Homo sapiens
gcacccactcaccagggtc

SEQ ID NO: 2097246 - DNA, 21 bp, Homo sapiens
gcacccagaaattccttccca

SEQ ID NO: 2097247 - DNA, 19 bp, Homo sapiens
gcacccaggctccatgggg

SEQ ID NO: 2097248 - DNA, 19 bp, Homo sapiens
gcacccccagcctgggcct

SEQ ID NO: 2097249 - DNA, 23 bp, Homo sapiens
gcacccccagcctgggcctatgg

SEQ ID NO: 2097250 - DNA, 17 bp, Homo sapiens
gcaccccctcattcccc

SEQ ID NO: 2097251 - DNA, 13 bp, Homo sapiens
gcacccctgtctc

SEQ ID NO: 2097252 - DNA, 14 bp, Homo sapiens
gcacccgtaccccc

SEQ ID NO: 2097253 - DNA, 20 bp, Homo sapiens
gcacccgtacccccgtggtc

SEQ ID NO: 2097254 - DNA, 16 bp, Homo sapiens
gcaccctcccccgcag

SEQ ID NO: 2097255 - DNA, 13 bp, Homo sapiens
gcaccctgggtgc

SEQ ID NO: 2097256 - DNA, 15 bp, Homo sapiens
gcaccctgggtgcca

SEQ ID NO: 2097257 - DNA, 16 bp, Homo sapiens
gcaccctgttccctct

SEQ ID NO: 2097258 - DNA, 18 bp, Homo sapiens
gcacccttctttcctctt

SEQ ID NO: 2097259 - DNA, 19 bp, Homo sapiens
gcacccttctttcctcttc

SEQ ID NO: 2097260 - DNA, 12 bp, Homo sapiens
gcaccggcgctg

SEQ ID NO: 2097261 - DNA, 16 bp, Homo sapiens
gcaccggcgctgcagg

SEQ ID NO: 2097262 - DNA, 14 bp, Homo sapiens
gcacctaaagaaaa

SEQ ID NO: 2097263 - DNA, 19 bp, Homo sapiens
gcacctacatccccaggtc

SEQ ID NO: 2097264 - DNA, 20 bp, Homo sapiens
gcacctacatccccaggtct

SEQ ID NO: 2097265 - DNA, 21 bp, Homo sapiens
gcacctacatccccaggtctc

SEQ ID NO: 2097266 - DNA, 17 bp, Homo sapiens
gcacctccccccactgc

SEQ ID NO: 2097267 - DNA, 14 bp, Homo sapiens
gcacctcctgcctc

SEQ ID NO: 2097268 - DNA, 12 bp, Homo sapiens
gcacctgccacc

SEQ ID NO: 2097269 - DNA, 14 bp, Homo sapiens
gcacctgccaccgc

SEQ ID NO: 2097270 - DNA, 13 bp, Homo sapiens
gcacctgccagcc

SEQ ID NO: 2097271 - DNA, 14 bp, Homo sapiens
gcacctgccagcct

SEQ ID NO: 2097272 - DNA, 16 bp, Homo sapiens
gcacctgccagcctgg

SEQ ID NO: 2097273 - DNA, 17 bp, Homo sapiens
gcacctgccagcctggc

SEQ ID NO: 2097274 - DNA, 15 bp, Homo sapiens
gcacctgccccctgg

SEQ ID NO: 2097275 - DNA, 16 bp, Homo sapiens
gcacctgccccctggt

SEQ ID NO: 2097276 - DNA, 23 bp, Homo sapiens
gcacctgcgagaggtccctgctt

SEQ ID NO: 2097277 - DNA, 18 bp, Homo sapiens
  misc_feature (9)..(9): n is a, c, g or t
gcacctgcnttgtccctg

SEQ ID NO: 2097278 - DNA, 11 bp, Homo sapiens
gcacctgctgg

SEQ ID NO: 2097279 - DNA, 18 bp, Homo sapiens
gcacctggcctgctggga

SEQ ID NO: 2097280 - DNA, 21 bp, Homo sapiens
gcacctgggaaaacagaggaa

SEQ ID NO: 2097281 - DNA, 15 bp, Homo sapiens
gcacctgggccctgg

SEQ ID NO: 2097282 - DNA, 19 bp, Homo sapiens
gcacctgggccctggggcc

SEQ ID NO: 2097283 - DNA, 23 bp, Homo sapiens
gcacctgggccctggggcctgta

SEQ ID NO: 2097284 - DNA, 19 bp, Homo sapiens
gcacctgtactcaggaggc

SEQ ID NO: 2097285 - DNA, 21 bp, Homo sapiens
gcacctgtactcaggaggctg

SEQ ID NO: 2097286 - DNA, 21 bp, Homo sapiens
gcaccttaatattattggggt

SEQ ID NO: 2097287 - DNA, 14 bp, Homo sapiens
gcaccttgtgtctg

SEQ ID NO: 2097288 - DNA, 22 bp, Homo sapiens
gcaccttgtgtctgtacacgtg

SEQ ID NO: 2097289 - DNA, 20 bp, Homo sapiens
gcaccttttataccagagac

SEQ ID NO: 2097290 - DNA, 15 bp, Homo sapiens
gcacgaaatgttatt

SEQ ID NO: 2097291 - DNA, 16 bp, Homo sapiens
gcacgattttgcacaa

SEQ ID NO: 2097292 - DNA, 14 bp, Homo sapiens
gcacggcggcaggg

SEQ ID NO: 2097293 - DNA, 16 bp, Homo sapiens
gcacgtcttgctattt

SEQ ID NO: 2097294 - DNA, 20 bp, Homo sapiens
gcacgttctatattgtgcca

SEQ ID NO: 2097295 - DNA, 21 bp, Homo sapiens
gcacgttctatattgtgccaa

SEQ ID NO: 2097296 - DNA, 19 bp, Homo sapiens
gcacgtttgtgagaagaaa

SEQ ID NO: 2097297 - DNA, 19 bp, Homo sapiens
gcactaaagtatgtaaagt

SEQ ID NO: 2097298 - DNA, 22 bp, Homo sapiens
gcactaaagtatgtaaagtatg

SEQ ID NO: 2097299 - DNA, 14 bp, Homo sapiens
gcactaaggccgtg

SEQ ID NO: 2097300 - DNA, 20 bp, Homo sapiens
gcactaaggccgtgtctctg

SEQ ID NO: 2097301 - DNA, 20 bp, Homo sapiens
gcactaaggtgtgctctgat

SEQ ID NO: 2097302 - DNA, 13 bp, Homo sapiens
gcactacatgtgg

SEQ ID NO: 2097303 - DNA, 20 bp, Homo sapiens
gcactagcattttcttgaac

SEQ ID NO: 2097304 - DNA, 22 bp, Homo sapiens
gcactatagcctaggtgacaga

SEQ ID NO: 2097305 - DNA, 15 bp, Homo sapiens
gcactatgaaaatca

SEQ ID NO: 2097306 - DNA, 20 bp, Homo sapiens
gcactcacccatgtgccaag

SEQ ID NO: 2097307 - DNA, 22 bp, Homo sapiens
gcactcagaaaagaaaaccatt

SEQ ID NO: 2097308 - DNA, 13 bp, Homo sapiens
gcactcagaagac

SEQ ID NO: 2097309 - DNA, 16 bp, Homo sapiens
gcactcagaagacact

SEQ ID NO: 2097310 - DNA, 17 bp, Homo sapiens
gcactcagaagacactg

SEQ ID NO: 2097311 - DNA, 20 bp, Homo sapiens
gcactcagaagacactgatg

SEQ ID NO: 2097312 - DNA, 23 bp, Homo sapiens
gcactcagtgaggccgcccggca

SEQ ID NO: 2097313 - DNA, 11 bp, Homo sapiens
gcactccagaa

SEQ ID NO: 2097314 - DNA, 15 bp, Homo sapiens
gcactccagcctggg

SEQ ID NO: 2097315 - DNA, 15 bp, Homo sapiens
gcactccatggccac

SEQ ID NO: 2097316 - DNA, 17 bp, Homo sapiens
gcactccatggccaccc

SEQ ID NO: 2097317 - DNA, 19 bp, Homo sapiens
gcactcctcggtactccca

SEQ ID NO: 2097318 - DNA, 20 bp, Homo sapiens
gcactcctcggtactcccat

SEQ ID NO: 2097319 - DNA, 13 bp, Homo sapiens
gcactcctctgtc

SEQ ID NO: 2097320 - DNA, 16 bp, Homo sapiens
gcactcgagaccatcc

SEQ ID NO: 2097321 - DNA, 20 bp, Homo sapiens
gcactcgagaccatcctggc

SEQ ID NO: 2097322 - DNA, 20 bp, Homo sapiens
gcactctctaaatcttcctt

SEQ ID NO: 2097323 - DNA, 15 bp, Homo sapiens
gcactgacccttcca

SEQ ID NO: 2097324 - DNA, 17 bp, Homo sapiens
gcactgaggaccagcca

SEQ ID NO: 2097325 - DNA, 16 bp, Homo sapiens
gcactgagggccacac

SEQ ID NO: 2097326 - DNA, 13 bp, Homo sapiens
gcactgcaggggc

SEQ ID NO: 2097327 - DNA, 15 bp, Homo sapiens
gcactgccaggaggg

SEQ ID NO: 2097328 - DNA, 18 bp, Homo sapiens
gcactgccaggagggaca

SEQ ID NO: 2097329 - DNA, 23 bp, Homo sapiens
gcactgccaggagggacaaagga

SEQ ID NO: 2097330 - DNA, 14 bp, Homo sapiens
gcactgctgcccag

SEQ ID NO: 2097331 - DNA, 18 bp, Homo sapiens
gcatctcttgaggccagg

SEQ ID NO: 2097332 - DNA, 17 bp, Homo sapiens
gcatctgactcacaaga

SEQ ID NO: 2097333 - DNA, 14 bp, Homo sapiens
gcatctgctcttct

SEQ ID NO: 2097334 - DNA, 20 bp, Homo sapiens
gcatctgggattcccaccaa

SEQ ID NO: 2097335 - DNA, 15 bp, Homo sapiens
gcatgaaagagaaag

SEQ ID NO: 2097336 - DNA, 16 bp, Homo sapiens
gcatgaccatcctgtc

SEQ ID NO: 2097337 - DNA, 23 bp, Homo sapiens
gcatgagtgctggatattttact

SEQ ID NO: 2097338 - DNA, 16 bp, Homo sapiens
gcatgatctgaaaaat

SEQ ID NO: 2097339 - DNA, 18 bp, Homo sapiens
gcatgatctgaaaaatac

SEQ ID NO: 2097340 - DNA, 15 bp, Homo sapiens
gcatgatttatatat

SEQ ID NO: 2097341 - DNA, 16 bp, Homo sapiens
gcatgatttatatatg

SEQ ID NO: 2097342 - DNA, 17 bp, Homo sapiens
gcatgatttatatatgg

SEQ ID NO: 2097343 - DNA, 15 bp, Homo sapiens
gcatgcacagctgct

SEQ ID NO: 2097344 - DNA, 15 bp, Homo sapiens
gcatgcattttgcag

SEQ ID NO: 2097345 - DNA, 15 bp, Homo sapiens
gcatgccagagcctg

SEQ ID NO: 2097346 - DNA, 17 bp, Homo sapiens
gcatgccatctccaccc

SEQ ID NO: 2097347 - DNA, 19 bp, Homo sapiens
gcatgcctctgatatggga

SEQ ID NO: 2097348 - DNA, 21 bp, Homo sapiens
gcatgcgcacaaggctgacca

SEQ ID NO: 2097349 - DNA, 22 bp, Homo sapiens
gcatgctcagcccttcctagaa

SEQ ID NO: 2097350 - DNA, 13 bp, Homo sapiens
gcatgctctctgc

SEQ ID NO: 2097351 - DNA, 14 bp, Homo sapiens
gcatgctctctgca

SEQ ID NO: 2097352 - DNA, 15 bp, Homo sapiens
gcatgctctggaagc

SEQ ID NO: 2097353 - DNA, 20 bp, Homo sapiens
gcatgctctggaagcctgga

SEQ ID NO: 2097354 - DNA, 12 bp, Homo sapiens
gcatgctggcct

SEQ ID NO: 2097355 - DNA, 24 bp, Homo sapiens
gcatgctggcctcccaataaagct

SEQ ID NO: 2097356 - DNA, 19 bp, Homo sapiens
gcatgctggcctgtggcag

SEQ ID NO: 2097357 - DNA, 13 bp, Homo sapiens
gcatgctggggca

SEQ ID NO: 2097358 - DNA, 15 bp, Homo sapiens
gcatggactctgggt

SEQ ID NO: 2097359 - DNA, 21 bp, Homo sapiens
gcatggagagcctcttagtga

SEQ ID NO: 2097360 - DNA, 13 bp, Homo sapiens
gcatggccctggg

SEQ ID NO: 2097361 - DNA, 22 bp, Homo sapiens
gcatggccctggggtcccacga

SEQ ID NO: 2097362 - DNA, 13 bp, Homo sapiens
gcatggctggggt

SEQ ID NO: 2097363 - DNA, 16 bp, Homo sapiens
gcatggcttggggagc

SEQ ID NO: 2097364 - DNA, 20 bp, Homo sapiens
gcatggcttggggagcagag

SEQ ID NO: 2097365 - DNA, 21 bp, Homo sapiens
gcatggcttggggagcagagt

SEQ ID NO: 2097366 - DNA, 19 bp, Homo sapiens
gcatgggagggagggagag

SEQ ID NO: 2097367 - DNA, 22 bp, Homo sapiens
gcatggggataaaggagaaggc

SEQ ID NO: 2097368 - DNA, 23 bp, Homo sapiens
gcatggggataaaggagaaggca

SEQ ID NO: 2097369 - DNA, 20 bp, Homo sapiens
gcatggtcctggaggatgac

SEQ ID NO: 2097370 - DNA, 18 bp, Homo sapiens
gcatggttccttccctgg

SEQ ID NO: 2097371 - DNA, 14 bp, Homo sapiens
gcatgtaaaatgca

SEQ ID NO: 2097372 - DNA, 16 bp, Homo sapiens
gcatgtaaaatgcagt

SEQ ID NO: 2097373 - DNA, 17 bp, Homo sapiens
gcatgtaaaatgcagtc

SEQ ID NO: 2097374 - DNA, 19 bp, Homo sapiens
gcatgtaatcccagctact

SEQ ID NO: 2097375 - DNA, 23 bp, Homo sapiens
gcatgtattgtaaacagaaggag

SEQ ID NO: 2097376 - DNA, 16 bp, Homo sapiens
gcatgtgccagttggg

SEQ ID NO: 2097377 - DNA, 11 bp, Homo sapiens
gcatgtggaga

SEQ ID NO: 2097378 - DNA, 13 bp, Homo sapiens
gcatgtgtgcctg

SEQ ID NO: 2097379 - DNA, 16 bp, Homo sapiens
gcatgtgtgcctgtgg

SEQ ID NO: 2097380 - DNA, 17 bp, Homo sapiens
gcatgtgtgcctgtggc

SEQ ID NO: 2097381 - DNA, 11 bp, Homo sapiens
gcatgtgtgta

SEQ ID NO: 2097382 - DNA, 19 bp, Homo sapiens
gcatgtgtgtgtctgtctt

SEQ ID NO: 2097383 - DNA, 22 bp, Homo sapiens
gcatgttctctgaggacactaa

SEQ ID NO: 2097384 - DNA, 12 bp, Homo sapiens
gcatgtttactt

SEQ ID NO: 2097385 - DNA, 20 bp, Homo sapiens
gcattaaattttaaggtaga

SEQ ID NO: 2097386 - DNA, 18 bp, Homo sapiens
gcattacgtgagccaggt

SEQ ID NO: 2097387 - DNA, 14 bp, Homo sapiens
gcattactgcatgc

SEQ ID NO: 2097388 - DNA, 17 bp, Homo sapiens
gcattactgcatgcact

SEQ ID NO: 2097389 - DNA, 21 bp, Homo sapiens
gcattagaaatagacagtata

SEQ ID NO: 2097390 - DNA, 13 bp, Homo sapiens
gcattagaaatta

SEQ ID NO: 2097391 - DNA, 21 bp, Homo sapiens
gcattaggcttttaagaaaca

SEQ ID NO: 2097392 - DNA, 18 bp, Homo sapiens
gcattatttaatgtttga

SEQ ID NO: 2097393 - DNA, 23 bp, Homo sapiens
gcattcagtccgcctggccggct

SEQ ID NO: 2097394 - DNA, 13 bp, Homo sapiens
gcattccatgatt

SEQ ID NO: 2097395 - DNA, 15 bp, Homo sapiens
gcattccatgatttt

SEQ ID NO: 2097396 - DNA, 15 bp, Homo sapiens
gcattctcactccta

SEQ ID NO: 2097397 - DNA, 18 bp, Homo sapiens
gcattctcactcctacct

SEQ ID NO: 2097398 - DNA, 16 bp, Homo sapiens
gcattctgagctgggc

SEQ ID NO: 2097399 - DNA, 19 bp, Homo sapiens
gcattgaatggctatgttt

SEQ ID NO: 2097400 - DNA, 16 bp, Homo sapiens
gcattggggggccggg

SEQ ID NO: 2097401 - DNA, 13 bp, Homo sapiens
gcattggtctgct

SEQ ID NO: 2097402 - DNA, 15 bp, Homo sapiens
gcattggtctgctga

SEQ ID NO: 2097403 - DNA, 13 bp, Homo sapiens
gcatttaataaat

SEQ ID NO: 2097404 - DNA, 15 bp, Homo sapiens
gcatttactttgtgt

SEQ ID NO: 2097405 - DNA, 20 bp, Homo sapiens
gcatttagttttatggcatg

SEQ ID NO: 2097406 - DNA, 21 bp, Homo sapiens
gcatttagttttatggcatga

SEQ ID NO: 2097407 - DNA, 17 bp, Homo sapiens
gcatttataaatgtgtg

SEQ ID NO: 2097408 - DNA, 22 bp, Homo sapiens
gcatttccacactgtcagagct

SEQ ID NO: 2097409 - DNA, 17 bp, Homo sapiens
gcatttcccccagggaa

SEQ ID NO: 2097410 - DNA, 16 bp, Homo sapiens
gcatttgccattcctg

SEQ ID NO: 2097411 - DNA, 12 bp, Homo sapiens
gcatttgtgaaa

SEQ ID NO: 2097412 - DNA, 15 bp, Homo sapiens
gcattttaaaagcaa

SEQ ID NO: 2097413 - DNA, 13 bp, Homo sapiens
gcattttcaagat

SEQ ID NO: 2097414 - DNA, 23 bp, Homo sapiens
gcattttcaagatacatttcatc

SEQ ID NO: 2097415 - DNA, 15 bp, Homo sapiens
gcattttctctagct

SEQ ID NO: 2097416 - DNA, 22 bp, Homo sapiens
gcattttgtaagttgaagcaaa

SEQ ID NO: 2097417 - DNA, 21 bp, Homo sapiens
gcatttttactactattctgt

SEQ ID NO: 2097418 - DNA, 13 bp, Homo sapiens
gccaaaaaggacc

SEQ ID NO: 2097419 - DNA, 13 bp, Homo sapiens
gccaaaaatagct

SEQ ID NO: 2097420 - DNA, 14 bp, Homo sapiens
gccaaaagggcagc

SEQ ID NO: 2097421 - DNA, 19 bp, Homo sapiens
gccaaaaggtttcatgtag

SEQ ID NO: 2097422 - DNA, 15 bp, Homo sapiens
gccaaacagagcctt

SEQ ID NO: 2097423 - DNA, 19 bp, Homo sapiens
gccaaagacttagtatatt

SEQ ID NO: 2097424 - DNA, 16 bp, Homo sapiens
gccaaagcaaaagaag

SEQ ID NO: 2097425 - DNA, 13 bp, Homo sapiens
gccaaagccaaag

SEQ ID NO: 2097426 - DNA, 18 bp, Homo sapiens
gccaaattatttgtgtaa

SEQ ID NO: 2097427 - DNA, 19 bp, Homo sapiens
gccaaattatttgtgtaat

SEQ ID NO: 2097428 - DNA, 14 bp, Homo sapiens
gccaaattttggcc

SEQ ID NO: 2097429 - DNA, 22 bp, Homo sapiens
gccaaattttttgtatattaaa

SEQ ID NO: 2097430 - DNA, 13 bp, Homo sapiens
gccaacagccccc

SEQ ID NO: 2097431 - DNA, 20 bp, Homo sapiens
gccaacagtcaaaacagaga

SEQ ID NO: 2097432 - DNA, 20 bp, Homo sapiens
gccaacatggtgaaaccctg

SEQ ID NO: 2097433 - DNA, 17 bp, Homo sapiens
gccaacctgatgcccct

SEQ ID NO: 2097434 - DNA, 16 bp, Homo sapiens
gccaactaagccctcg

SEQ ID NO: 2097435 - DNA, 23 bp, Homo sapiens
gccaactaagccctcgaaccaag

SEQ ID NO: 2097436 - DNA, 14 bp, Homo sapiens
gccaactcctcctt

SEQ ID NO: 2097437 - DNA, 13 bp, Homo sapiens
gccaactgccccg

SEQ ID NO: 2097438 - DNA, 14 bp, Homo sapiens
gccaacttgtaaat

SEQ ID NO: 2097439 - DNA, 15 bp, Homo sapiens
gccaacttgtaaata

SEQ ID NO: 2097440 - DNA, 20 bp, Homo sapiens
gccaacttgtaaatacacca

SEQ ID NO: 2097441 - DNA, 22 bp, Homo sapiens
gccaagacttggcaacagaagc

SEQ ID NO: 2097442 - DNA, 23 bp, Homo sapiens
gccaagacttggcaacagaagca

SEQ ID NO: 2097443 - DNA, 16 bp, Homo sapiens
gccaagagcagaggca

SEQ ID NO: 2097444 - DNA, 22 bp, Homo sapiens
gccaagcacctagcctcgctct

SEQ ID NO: 2097445 - DNA, 20 bp, Homo sapiens
gccaagctgaagtgaaggag

SEQ ID NO: 2097446 - DNA, 15 bp, Homo sapiens
gcccaggctctggga

SEQ ID NO: 2097447 - DNA, 17 bp, Homo sapiens
gcccaggctctgggaag

SEQ ID NO: 2097448 - DNA, 21 bp, Homo sapiens
gcccaggctctgggaaggggt

SEQ ID NO: 2097449 - DNA, 15 bp, Homo sapiens
gcccaggctggcctg

SEQ ID NO: 2097450 - DNA, 14 bp, Homo sapiens
gcccaggctggcgt

SEQ ID NO: 2097451 - DNA, 19 bp, Homo sapiens
gcccaggctggcgtgcagt

SEQ ID NO: 2097452 - DNA, 20 bp, Homo sapiens
gcccaggctggcgtgcagtg

SEQ ID NO: 2097453 - DNA, 22 bp, Homo sapiens
gcccaggctggcgtgcagtggt

SEQ ID NO: 2097454 - DNA, 12 bp, Homo sapiens
gcccagggaggc

SEQ ID NO: 2097455 - DNA, 13 bp, Homo sapiens
gcccagggaggcc

SEQ ID NO: 2097456 - DNA, 17 bp, Homo sapiens
gcccagggcatcccatg

SEQ ID NO: 2097457 - DNA, 13 bp, Homo sapiens
gcccagggctcag

SEQ ID NO: 2097458 - DNA, 20 bp, Homo sapiens
gcccaggggcccacagggaa

SEQ ID NO: 2097459 - DNA, 12 bp, Homo sapiens
gcccaggtcctc

SEQ ID NO: 2097460 - DNA, 19 bp, Homo sapiens
gcccagtctggaatgcagt

SEQ ID NO: 2097461 - DNA, 19 bp, Homo sapiens
gcccataatagttagccct

SEQ ID NO: 2097462 - DNA, 17 bp, Homo sapiens
gcccatacccctgcctg

SEQ ID NO: 2097463 - DNA, 22 bp, Homo sapiens
gcccatagaaacatgacactga

SEQ ID NO: 2097464 - DNA, 23 bp, Homo sapiens
gcccatcatacgcatggtcctgg

SEQ ID NO: 2097465 - DNA, 22 bp, Homo sapiens
gcccatctatgtcccttgctgt

SEQ ID NO: 2097466 - DNA, 16 bp, Homo sapiens
gcccatctcaggtgcc

SEQ ID NO: 2097467 - DNA, 23 bp, Homo sapiens
gcccatctcaggtgccactccct

SEQ ID NO: 2097468 - DNA, 14 bp, Homo sapiens
gcccatggcctctg

SEQ ID NO: 2097469 - DNA, 20 bp, Homo sapiens
gcccatgggagctggttaga

SEQ ID NO: 2097470 - DNA, 14 bp, Homo sapiens
gcccatgtgtcccc

SEQ ID NO: 2097471 - DNA, 19 bp, Homo sapiens
gcccatgtgtcccctcact

SEQ ID NO: 2097472 - DNA, 22 bp, Homo sapiens
gcccatgtgtcccctcactctg

SEQ ID NO: 2097473 - DNA, 23 bp, Homo sapiens
gcccatgtgtcccctcactctgt

SEQ ID NO: 2097474 - DNA, 14 bp, Homo sapiens
gcccattctctctc

SEQ ID NO: 2097475 - DNA, 21 bp, Homo sapiens
gcccattctctctcctgtcca

SEQ ID NO: 2097476 - DNA, 19 bp, Homo sapiens
gcccatttcaattctcaaa

SEQ ID NO: 2097477 - DNA, 20 bp, Homo sapiens
gcccatttcaattctcaaaa

SEQ ID NO: 2097478 - DNA, 19 bp, Homo sapiens
gcccatttcgaagatatac

SEQ ID NO: 2097479 - DNA, 17 bp, Homo sapiens
gccccaaaccagggtgc

SEQ ID NO: 2097480 - DNA, 18 bp, Homo sapiens
gccccaaaccagggtgca

SEQ ID NO: 2097481 - DNA, 23 bp, Homo sapiens
gccccaaaccagggtgcatggct

SEQ ID NO: 2097482 - DNA, 17 bp, Homo sapiens
gccccaacccccaccga

SEQ ID NO: 2097483 - DNA, 23 bp, Homo sapiens
gccccaacccccaccgaagagcc

SEQ ID NO: 2097484 - DNA, 23 bp, Homo sapiens
gccccaacccgtggaggctgctc

SEQ ID NO: 2097485 - DNA, 18 bp, Homo sapiens
gccccaactcctggaagc

SEQ ID NO: 2097486 - DNA, 17 bp, Homo sapiens
gccccaactccttccag

SEQ ID NO: 2097487 - DNA, 19 bp, Homo sapiens
gccccaactccttccagct

SEQ ID NO: 2097488 - DNA, 20 bp, Homo sapiens
gccccaactccttccagcta

SEQ ID NO: 2097489 - DNA, 15 bp, Homo sapiens
gccccaagcagccag

SEQ ID NO: 2097490 - DNA, 14 bp, Homo sapiens
gccccaaggctgct

SEQ ID NO: 2097491 - DNA, 21 bp, Homo sapiens
gccccaaggggtttctgtttc

SEQ ID NO: 2097492 - DNA, 14 bp, Homo sapiens
gccccaccacctag

SEQ ID NO: 2097493 - DNA, 23 bp, Homo sapiens
gccccaccacctaggccactcct

SEQ ID NO: 2097494 - DNA, 13 bp, Homo sapiens
gccccaccagcca

SEQ ID NO: 2097495 - DNA, 23 bp, Homo sapiens
gccccaccagccacctcttgggc

SEQ ID NO: 2097496 - DNA, 21 bp, Homo sapiens
gccccaccctcgtggacacct

SEQ ID NO: 2097497 - DNA, 22 bp, Homo sapiens
gccccaccctcgtggacacctg

SEQ ID NO: 2097498 - DNA, 17 bp, Homo sapiens
gccccacctacttgtga

SEQ ID NO: 2097499 - DNA, 20 bp, Homo sapiens
gccccacctacttgtgactg

SEQ ID NO: 2097500 - DNA, 12 bp, Homo sapiens
gccccagagagg

SEQ ID NO: 2097501 - DNA, 13 bp, Homo sapiens
gccccagagcccc

SEQ ID NO: 2097502 - DNA, 12 bp, Homo sapiens
gccccagaggcc

SEQ ID NO: 2097503 - DNA, 22 bp, Homo sapiens
gccccagatctgcctgggcctg

SEQ ID NO: 2097504 - DNA, 21 bp, Homo sapiens
gccccagcaagagcacaagag

SEQ ID NO: 2097505 - DNA, 19 bp, Homo sapiens
gccccagcactaacgtaaa

SEQ ID NO: 2097506 - DNA, 13 bp, Homo sapiens
gccccagccccca

SEQ ID NO: 2097507 - DNA, 21 bp, Homo sapiens
gccccagccccgttccttccg

SEQ ID NO: 2097508 - DNA, 20 bp, Homo sapiens
gccccagcccgacaggcatg

SEQ ID NO: 2097509 - DNA, 19 bp, Homo sapiens
gccccagcgcggcttggcc

SEQ ID NO: 2097510 - DNA, 14 bp, Homo sapiens
gccccagctctggc

SEQ ID NO: 2097511 - DNA, 14 bp, Homo sapiens
gccccaggccctcc

SEQ ID NO: 2097512 - DNA, 20 bp, Homo sapiens
gccccaggccctccctgact

SEQ ID NO: 2097513 - DNA, 14 bp, Homo sapiens
gccccaggcctctg

SEQ ID NO: 2097514 - DNA, 23 bp, Homo sapiens
gccccaggcttgtcactagcagc

SEQ ID NO: 2097515 - DNA, 12 bp, Homo sapiens
gccccagggcct

SEQ ID NO: 2097516 - DNA, 14 bp, Homo sapiens
gccccagggcctgg

SEQ ID NO: 2097517 - DNA, 15 bp, Homo sapiens
gccccagggcctggg

SEQ ID NO: 2097518 - DNA, 20 bp, Homo sapiens
gccccaggggtgcctgtggg

SEQ ID NO: 2097519 - DNA, 14 bp, Homo sapiens
gccccagggttgaa

SEQ ID NO: 2097520 - DNA, 23 bp, Homo sapiens
gccccaggtgccaccaataaaaa

SEQ ID NO: 2097521 - DNA, 15 bp, Homo sapiens
gccccagtgcccaca

SEQ ID NO: 2097522 - DNA, 13 bp, Homo sapiens
gccccatctcctc

SEQ ID NO: 2097523 - DNA, 21 bp, Homo sapiens
gccccatcttggtcctgtcac

SEQ ID NO: 2097524 - DNA, 18 bp, Homo sapiens
gccccatgacctccagct

SEQ ID NO: 2097525 - DNA, 16 bp, Homo sapiens
gccccatgtctctcag

SEQ ID NO: 2097526 - DNA, 22 bp, Homo sapiens
gccccattctgcctgcccaggc

SEQ ID NO: 2097527 - DNA, 23 bp, Homo sapiens
gccccattctgcctgcccaggcc

SEQ ID NO: 2097528 - DNA, 23 bp, Homo sapiens
gcccccaaccccgcggtgctctg

SEQ ID NO: 2097529 - DNA, 12 bp, Homo sapiens
gcccccacccag

SEQ ID NO: 2097530 - DNA, 20 bp, Homo sapiens
gcccccacctccgccccaga

SEQ ID NO: 2097531 - DNA, 16 bp, Homo sapiens
gcccccacttctctcc

SEQ ID NO: 2097532 - DNA, 21 bp, Homo sapiens
gcccccacttctctccaggct

SEQ ID NO: 2097533 - DNA, 22 bp, Homo sapiens
gcccccagccatggtgaggaag

SEQ ID NO: 2097534 - DNA, 14 bp, Homo sapiens
gcccccatccctcg

SEQ ID NO: 2097535 - DNA, 12 bp, Homo sapiens
gccccccagcac

SEQ ID NO: 2097536 - DNA, 20 bp, Homo sapiens
gccccccctcttttggcctt

SEQ ID NO: 2097537 - DNA, 16 bp, Homo sapiens
gccccccgcagcaccc

SEQ ID NO: 2097538 - DNA, 19 bp, Homo sapiens
gccccccgcagcaccctgc

SEQ ID NO: 2097539 - DNA, 15 bp, Homo sapiens
gcccccctccaggca

SEQ ID NO: 2097540 - DNA, 20 bp, Homo sapiens
gccccctcatctcactgccc

SEQ ID NO: 2097541 - DNA, 13 bp, Homo sapiens
gccccctggatgg

SEQ ID NO: 2097542 - DNA, 23 bp, Homo sapiens
gccccctggtggacagtcctggg

SEQ ID NO: 2097543 - DNA, 17 bp, Homo sapiens
gccccctgtgccagctc

SEQ ID NO: 2097544 - DNA, 19 bp, Homo sapiens
gccccctgtgccagctcag

SEQ ID NO: 2097545 - DNA, 13 bp, Homo sapiens
gccccgactccag

SEQ ID NO: 2097546 - DNA, 16 bp, Homo sapiens
gccccgactccagcca

SEQ ID NO: 2097547 - DNA, 19 bp, Homo sapiens
gccccgactccagccagcg

SEQ ID NO: 2097548 - DNA, 14 bp, Homo sapiens
gccccgcctccccg

SEQ ID NO: 2097549 - DNA, 13 bp, Homo sapiens
gccccgctgggat

SEQ ID NO: 2097550 - DNA, 16 bp, Homo sapiens
gccccgcttccccaca

SEQ ID NO: 2097551 - DNA, 21 bp, Homo sapiens
gccccgcttccccacagaact

SEQ ID NO: 2097552 - DNA, 14 bp, Homo sapiens
gccccgcttgtcca

SEQ ID NO: 2097553 - DNA, 19 bp, Homo sapiens
gccccgcttgtccagcgcc

SEQ ID NO: 2097554 - DNA, 23 bp, Homo sapiens
gccccggggctggcaagcaggga

SEQ ID NO: 2097555 - DNA, 20 bp, Homo sapiens
gccccgggtccccagctccc

SEQ ID NO: 2097556 - DNA, 19 bp, Homo sapiens
gccccgggtgcctcagagc

SEQ ID NO: 2097557 - DNA, 19 bp, Homo sapiens
gccccggtcctggccccag

SEQ ID NO: 2097558 - DNA, 21 bp, Homo sapiens
gccccggtcctggccccagcc

SEQ ID NO: 2097559 - DNA, 14 bp, Homo sapiens
gcccctcaccccaa

SEQ ID NO: 2097560 - DNA, 18 bp, Homo sapiens
gcctcgcctgggcccagg

SEQ ID NO: 2097561 - DNA, 21 bp, Homo sapiens
gcctcgcctgggcccaggctc

SEQ ID NO: 2097562 - DNA, 22 bp, Homo sapiens
gcctcgcctgggcccaggctct

SEQ ID NO: 2097563 - DNA, 23 bp, Homo sapiens
gcctcgctccccactctgctctg

SEQ ID NO: 2097564 - DNA, 21 bp, Homo sapiens
gcctcgggacacctgccctgc

SEQ ID NO: 2097565 - DNA, 14 bp, Homo sapiens
gcctcggtggccat

SEQ ID NO: 2097566 - DNA, 15 bp, Homo sapiens
gcctcggtggccatg

SEQ ID NO: 2097567 - DNA, 16 bp, Homo sapiens
gcctcggtggccatgc

SEQ ID NO: 2097568 - DNA, 18 bp, Homo sapiens
gcctcggtggccatgctt

SEQ ID NO: 2097569 - DNA, 14 bp, Homo sapiens
gcctcgtgccatga

SEQ ID NO: 2097570 - DNA, 19 bp, Homo sapiens
gcctcgtgccatgatctgt

SEQ ID NO: 2097571 - DNA, 16 bp, Homo sapiens
gcctctactgggaagg

SEQ ID NO: 2097572 - DNA, 16 bp, Homo sapiens
gcctctccaggcacca

SEQ ID NO: 2097573 - DNA, 14 bp, Homo sapiens
gcctctcccacgat

SEQ ID NO: 2097574 - DNA, 13 bp, Homo sapiens
gcctctcccgcac

SEQ ID NO: 2097575 - DNA, 16 bp, Homo sapiens
gcctctcccggctgcc

SEQ ID NO: 2097576 - DNA, 20 bp, Homo sapiens
gcctctctcaggagtatctt

SEQ ID NO: 2097577 - DNA, 14 bp, Homo sapiens
gcctctctgctata

SEQ ID NO: 2097578 - DNA, 15 bp, Homo sapiens
gcctctctgctccag

SEQ ID NO: 2097579 - DNA, 16 bp, Homo sapiens
gcctctctgctccaga

SEQ ID NO: 2097580 - DNA, 17 bp, Homo sapiens
gcctctctgctccagag

SEQ ID NO: 2097581 - DNA, 18 bp, Homo sapiens
gcctctctgctccagaga

SEQ ID NO: 2097582 - DNA, 16 bp, Homo sapiens
gcctctgaaatttccc

SEQ ID NO: 2097583 - DNA, 15 bp, Homo sapiens
gcctctgacacacag

SEQ ID NO: 2097584 - DNA, 15 bp, Homo sapiens
gcctctgaggccagc

SEQ ID NO: 2097585 - DNA, 16 bp, Homo sapiens
gcctctgaggccagcc

SEQ ID NO: 2097586 - DNA, 20 bp, Homo sapiens
gcctctgaggccagcctggc

SEQ ID NO: 2097587 - DNA, 21 bp, Homo sapiens
gcctctgaggccagcctggcc

SEQ ID NO: 2097588 - DNA, 13 bp, Homo sapiens
gcctctgatatgg

SEQ ID NO: 2097589 - DNA, 18 bp, Homo sapiens
gcctctgatatgggactg

SEQ ID NO: 2097590 - DNA, 12 bp, Homo sapiens
gcctctgcattc

SEQ ID NO: 2097591 - DNA, 21 bp, Homo sapiens
gcctctgccatgcccagagaa

SEQ ID NO: 2097592 - DNA, 12 bp, Homo sapiens
gcctctgcccca

SEQ ID NO: 2097593 - DNA, 14 bp, Homo sapiens
gcctctgccccaag

SEQ ID NO: 2097594 - DNA, 13 bp, Homo sapiens
gcctctgcccgca

SEQ ID NO: 2097595 - DNA, 16 bp, Homo sapiens
gcctctgcccgcagag

SEQ ID NO: 2097596 - DNA, 18 bp, Homo sapiens
gcctctgcccgcagagcc

SEQ ID NO: 2097597 - DNA, 18 bp, Homo sapiens
gcctctgcctctgacaca

SEQ ID NO: 2097598 - DNA, 13 bp, Homo sapiens
gcctctgcctgtg

SEQ ID NO: 2097599 - DNA, 12 bp, Homo sapiens
gcctctggccag

SEQ ID NO: 2097600 - DNA, 19 bp, Homo sapiens
gcctctggccaggcatggc

SEQ ID NO: 2097601 - DNA, 16 bp, Homo sapiens
gcctctggctgctgta

SEQ ID NO: 2097602 - DNA, 18 bp, Homo sapiens
gcctctgtgtccttccct

SEQ ID NO: 2097603 - DNA, 15 bp, Homo sapiens
gcctcttccctcagt

SEQ ID NO: 2097604 - DNA, 16 bp, Homo sapiens
gcctcttgcaggctga

SEQ ID NO: 2097605 - DNA, 18 bp, Homo sapiens
gcctcttggacctctgct

SEQ ID NO: 2097606 - DNA, 21 bp, Homo sapiens
gcctcttggacctctgctctg

SEQ ID NO: 2097607 - DNA, 17 bp, Homo sapiens
gcctcttggcagccctt

SEQ ID NO: 2097608 - DNA, 16 bp, Homo sapiens
gcctcttgtacagtta

SEQ ID NO: 2097609 - DNA, 14 bp, Homo sapiens
gcctcttgtgctca

SEQ ID NO: 2097610 - DNA, 22 bp, Homo sapiens
gcctcttgtgctcacgctcccc

SEQ ID NO: 2097611 - DNA, 18 bp, Homo sapiens
gcctcttttccctctcta

SEQ ID NO: 2097612 - DNA, 18 bp, Homo sapiens
gcctcttttctctgtgct

SEQ ID NO: 2097613 - DNA, 20 bp, Homo sapiens
gcctgaatccatcaggactt

SEQ ID NO: 2097614 - DNA, 20 bp, Homo sapiens
gcctgacaggttcccagcag

SEQ ID NO: 2097615 - DNA, 21 bp, Homo sapiens
gcctgacaggttcccagcagc

SEQ ID NO: 2097616 - DNA, 14 bp, Homo sapiens
gcctgagcccagga

SEQ ID NO: 2097617 - DNA, 16 bp, Homo sapiens
gcctgagcccagggag

SEQ ID NO: 2097618 - DNA, 17 bp, Homo sapiens
gcctgagcccagggagg

SEQ ID NO: 2097619 - DNA, 13 bp, Homo sapiens
gcctgagctgggg

SEQ ID NO: 2097620 - DNA, 14 bp, Homo sapiens
gcctgagctggggc

SEQ ID NO: 2097621 - DNA, 18 bp, Homo sapiens
gcctgagctggggccaca

SEQ ID NO: 2097622 - DNA, 18 bp, Homo sapiens
gcctgagctggggcctgg

SEQ ID NO: 2097623 - DNA, 21 bp, Homo sapiens
gcctgagctggggcctggaga

SEQ ID NO: 2097624 - DNA, 22 bp, Homo sapiens
gcctgaggctcaagaggcccag

SEQ ID NO: 2097625 - DNA, 23 bp, Homo sapiens
gcctgaggctcaagaggcccagg

SEQ ID NO: 2097626 - DNA, 13 bp, Homo sapiens
gcctgaggctgag

SEQ ID NO: 2097627 - DNA, 14 bp, Homo sapiens
gcctgaggctgaga

SEQ ID NO: 2097628 - DNA, 13 bp, Homo sapiens
gcctgaggctggg

SEQ ID NO: 2097629 - DNA, 13 bp, Homo sapiens
gcctgagtctcct

SEQ ID NO: 2097630 - DNA, 15 bp, Homo sapiens
gcctgataagcttca

SEQ ID NO: 2097631 - DNA, 13 bp, Homo sapiens
gcctgatgctgcc

SEQ ID NO: 2097632 - DNA, 14 bp, Homo sapiens
gcctgatgctgccc

SEQ ID NO: 2097633 - DNA, 15 bp, Homo sapiens
gcctgatgctgcccc

SEQ ID NO: 2097634 - DNA, 17 bp, Homo sapiens
gcctgatgctgccccgt

SEQ ID NO: 2097635 - DNA, 17 bp, Homo sapiens
gcctgatggccaagggg

SEQ ID NO: 2097636 - DNA, 15 bp, Homo sapiens
gcctgcacccttcct

SEQ ID NO: 2097637 - DNA, 14 bp, Homo sapiens
gcctgcagagagaa

SEQ ID NO: 2097638 - DNA, 21 bp, Homo sapiens
gcctgcagaggacagagctgg

SEQ ID NO: 2097639 - DNA, 18 bp, Homo sapiens
gcctgcagcggcacaaat

SEQ ID NO: 2097640 - DNA, 18 bp, Homo sapiens
gcctgccagggcccctgt

SEQ ID NO: 2097641 - DNA, 17 bp, Homo sapiens
gcctgccataccgctgg

SEQ ID NO: 2097642 - DNA, 15 bp, Homo sapiens
gcctgcccaggcccc

SEQ ID NO: 2097643 - DNA, 19 bp, Homo sapiens
gcctgcccaggcccctgcc

SEQ ID NO: 2097644 - DNA, 18 bp, Homo sapiens
gcctgcccccagcactcc

SEQ ID NO: 2097645 - DNA, 14 bp, Homo sapiens
gcctgccctcaggg

SEQ ID NO: 2097646 - DNA, 12 bp, Homo sapiens
gcctgccctccc

SEQ ID NO: 2097647 - DNA, 12 bp, Homo sapiens
gcctgccctgga

SEQ ID NO: 2097648 - DNA, 13 bp, Homo sapiens
gcctgccctggag

SEQ ID NO: 2097649 - DNA, 12 bp, Homo sapiens
gcctgccgagca

SEQ ID NO: 2097650 - DNA, 14 bp, Homo sapiens
gcctgccgagcaac

SEQ ID NO: 2097651 - DNA, 19 bp, Homo sapiens
gcctgccgagcaaccgtgg

SEQ ID NO: 2097652 - DNA, 22 bp, Homo sapiens
gcctgcctcccagccctgccag

SEQ ID NO: 2097653 - DNA, 22 bp, Homo sapiens
gcctgcctctgccatgcccaga

SEQ ID NO: 2097654 - DNA, 17 bp, Homo sapiens
gcctgcggccgggctgc

SEQ ID NO: 2097655 - DNA, 18 bp, Homo sapiens
gcctgcggccgggctgcc

SEQ ID NO: 2097656 - DNA, 20 bp, Homo sapiens
gcctgcggccgggctgccct

SEQ ID NO: 2097657 - DNA, 21 bp, Homo sapiens
gcctgcggccgggctgccctt

SEQ ID NO: 2097658 - DNA, 15 bp, Homo sapiens
gcctgctaatagctg

SEQ ID NO: 2097659 - DNA, 17 bp, Homo sapiens
gcctgctaattccccag

SEQ ID NO: 2097660 - DNA, 23 bp, Homo sapiens
gcctgctaattccccagattgca

SEQ ID NO: 2097661 - DNA, 16 bp, Homo sapiens
gcctgctagagcaacc

SEQ ID NO: 2097662 - DNA, 15 bp, Homo sapiens
gcctgctcccagcag

SEQ ID NO: 2097663 - DNA, 22 bp, Homo sapiens
gcctgctcccagcagccctaag

SEQ ID NO: 2097664 - DNA, 16 bp, Homo sapiens
gcctgctcccccaccc

SEQ ID NO: 2097665 - DNA, 19 bp, Homo sapiens
gcctgctcccccaccccct

SEQ ID NO: 2097666 - DNA, 21 bp, Homo sapiens
gcctgctgctgagaacctggc

SEQ ID NO: 2097667 - DNA, 23 bp, Homo sapiens
gcctgctgctgagaacctggcct

SEQ ID NO: 2097668 - DNA, 17 bp, Homo sapiens
gcctgctgggctctcca

SEQ ID NO: 2097669 - DNA, 16 bp, Homo sapiens
gcctgcttttccagga

SEQ ID NO: 2097670 - DNA, 15 bp, Homo sapiens
gcctggaaattaaac

SEQ ID NO: 2097671 - DNA, 17 bp, Homo sapiens
gcctggaaccagggagg

SEQ ID NO: 2097672 - DNA, 20 bp, Homo sapiens
gcctggaaccagggaggaga

SEQ ID NO: 2097673 - DNA, 21 bp, Homo sapiens
gcctggaagggaagtgagaaa

SEQ ID NO: 2097674 - DNA, 12 bp, Homo sapiens
gcctggagaagc

SEQ ID NO: 2097675 - DNA, 17 bp, Homo sapiens
gctcagcggggacagct

SEQ ID NO: 2097676 - DNA, 21 bp, Homo sapiens
gctcagcggggacagctcctt

SEQ ID NO: 2097677 - DNA, 23 bp, Homo sapiens
gctcagcggggacagctccttct

SEQ ID NO: 2097678 - DNA, 21 bp, Homo sapiens
gctcaggaattgaagatgtaa

SEQ ID NO: 2097679 - DNA, 12 bp, Homo sapiens
gctcaggaccca

SEQ ID NO: 2097680 - DNA, 13 bp, Homo sapiens
gctcaggaggcga

SEQ ID NO: 2097681 - DNA, 22 bp, Homo sapiens
gctcaggaggcgaataaatgtt

SEQ ID NO: 2097682 - DNA, 23 bp, Homo sapiens
gctcaggaggcgaataaatgttc

SEQ ID NO: 2097683 - DNA, 15 bp, Homo sapiens
gctcaggaggcttgg

SEQ ID NO: 2097684 - DNA, 12 bp, Homo sapiens
gctcaggcaagc

SEQ ID NO: 2097685 - DNA, 20 bp, Homo sapiens
gctcaggcaagcccctcagc

SEQ ID NO: 2097686 - DNA, 22 bp, Homo sapiens
gctcaggcagacaagagctgct

SEQ ID NO: 2097687 - DNA, 20 bp, Homo sapiens
gctcaggcctataaccccag

SEQ ID NO: 2097688 - DNA, 16 bp, Homo sapiens
gctcaggctgagccca

SEQ ID NO: 2097689 - DNA, 17 bp, Homo sapiens
gctcaggctgagcccag

SEQ ID NO: 2097690 - DNA, 18 bp, Homo sapiens
gctcaggctgagcccagc

SEQ ID NO: 2097691 - DNA, 13 bp, Homo sapiens
gctcagggctgga

SEQ ID NO: 2097692 - DNA, 19 bp, Homo sapiens
gctcaggtgtccctgcact

SEQ ID NO: 2097693 - DNA, 14 bp, Homo sapiens
gctcagtctcagga

SEQ ID NO: 2097694 - DNA, 17 bp, Homo sapiens
gctcagtgcctcctggc

SEQ ID NO: 2097695 - DNA, 18 bp, Homo sapiens
gctcataacatctttgaa

SEQ ID NO: 2097696 - DNA, 14 bp, Homo sapiens
gctcatcacccagt

SEQ ID NO: 2097697 - DNA, 15 bp, Homo sapiens
gctcatcacccagtc

SEQ ID NO: 2097698 - DNA, 22 bp, Homo sapiens
gctcatcacccagtcctggcca

SEQ ID NO: 2097699 - DNA, 15 bp, Homo sapiens
gctcatccagggtgt

SEQ ID NO: 2097700 - DNA, 20 bp, Homo sapiens
gctcatggcgtaatgggcct

SEQ ID NO: 2097701 - DNA, 21 bp, Homo sapiens
gctcatggcgtaatgggcctg

SEQ ID NO: 2097702 - DNA, 18 bp, Homo sapiens
gctcattttaggcctcct

SEQ ID NO: 2097703 - DNA, 21 bp, Homo sapiens
gctccaccctcaccaggatga

SEQ ID NO: 2097704 - DNA, 12 bp, Homo sapiens
gctccacctgtt

SEQ ID NO: 2097705 - DNA, 20 bp, Homo sapiens
gctccacggtgcgtggctgt

SEQ ID NO: 2097706 - DNA, 23 bp, Homo sapiens
gctccacggtgcgtggctgtggc

SEQ ID NO: 2097707 - DNA, 16 bp, Homo sapiens
gctccagcatccagcc

SEQ ID NO: 2097708 - DNA, 18 bp, Homo sapiens
gctccagcatccagcctg

SEQ ID NO: 2097709 - DNA, 22 bp, Homo sapiens
gctccagcatccagcctgtgtg

SEQ ID NO: 2097710 - DNA, 14 bp, Homo sapiens
gctccagctcacca

SEQ ID NO: 2097711 - DNA, 17 bp, Homo sapiens
gctccagctcaccagcc

SEQ ID NO: 2097712 - DNA, 18 bp, Homo sapiens
gctccagctcaccagccc

SEQ ID NO: 2097713 - DNA, 21 bp, Homo sapiens
gctccagctcaccagccccag

SEQ ID NO: 2097714 - DNA, 13 bp, Homo sapiens
gctccaggctcct

SEQ ID NO: 2097715 - DNA, 23 bp, Homo sapiens
gctccaggctcctttagcgccca

SEQ ID NO: 2097716 - DNA, 24 bp, Homo sapiens
gctccagggtcttgggctactggc

SEQ ID NO: 2097717 - DNA, 18 bp, Homo sapiens
gctccaggtccggagggg

SEQ ID NO: 2097718 - DNA, 21 bp, Homo sapiens
gctccaggtccggaggggttg

SEQ ID NO: 2097719 - DNA, 19 bp, Homo sapiens
gctccagtttccccatggg

SEQ ID NO: 2097720 - DNA, 14 bp, Homo sapiens
gctccatctccact

SEQ ID NO: 2097721 - DNA, 14 bp, Homo sapiens
gctccatggaggag

SEQ ID NO: 2097722 - DNA, 15 bp, Homo sapiens
gctccatggggaagt

SEQ ID NO: 2097723 - DNA, 16 bp, Homo sapiens
gctccatggggaagtg

SEQ ID NO: 2097724 - DNA, 23 bp, Homo sapiens
gctccatggggaagtgctcccca

SEQ ID NO: 2097725 - DNA, 16 bp, Homo sapiens
gctcccacaggccctt

SEQ ID NO: 2097726 - DNA, 20 bp, Homo sapiens
gctcccacaggcccttcctc

SEQ ID NO: 2097727 - DNA, 18 bp, Homo sapiens
gctcccaccccaccccct

SEQ ID NO: 2097728 - DNA, 21 bp, Homo sapiens
gctcccaccccacccccttca

SEQ ID NO: 2097729 - DNA, 14 bp, Homo sapiens
gctcccagatgctg

SEQ ID NO: 2097730 - DNA, 17 bp, Homo sapiens
gctcccagatgctgggg

SEQ ID NO: 2097731 - DNA, 23 bp, Homo sapiens
gctcccagcagccctaaggatct

SEQ ID NO: 2097732 - DNA, 13 bp, Homo sapiens
gctcccatctcct

SEQ ID NO: 2097733 - DNA, 15 bp, Homo sapiens
gctcccatctcctga

SEQ ID NO: 2097734 - DNA, 24 bp, Homo sapiens
gctccccacgagtcacctgcaagc

SEQ ID NO: 2097735 - DNA, 19 bp, Homo sapiens
gctccccactctgctctga

SEQ ID NO: 2097736 - DNA, 22 bp, Homo sapiens
gctccccactctgctctgatgc

SEQ ID NO: 2097737 - DNA, 15 bp, Homo sapiens
gctccccagccctgg

SEQ ID NO: 2097738 - DNA, 16 bp, Homo sapiens
gctccccagccctggc

SEQ ID NO: 2097739 - DNA, 19 bp, Homo sapiens
gctccccagccctggctct

SEQ ID NO: 2097740 - DNA, 21 bp, Homo sapiens
gctccccagccctggctctgc

SEQ ID NO: 2097741 - DNA, 12 bp, Homo sapiens
gctccccaggac

SEQ ID NO: 2097742 - DNA, 22 bp, Homo sapiens
gctcccccaccccctccccagg

SEQ ID NO: 2097743 - DNA, 16 bp, Homo sapiens
gctcccccgcagtccc

SEQ ID NO: 2097744 - DNA, 18 bp, Homo sapiens
gctcccctcggagaagag

SEQ ID NO: 2097745 - DNA, 21 bp, Homo sapiens
gctcccctcggagaagagctg

SEQ ID NO: 2097746 - DNA, 18 bp, Homo sapiens
gctcccctgggggctagc

SEQ ID NO: 2097747 - DNA, 17 bp, Homo sapiens
gctcccgagctactctc

SEQ ID NO: 2097748 - DNA, 20 bp, Homo sapiens
gctcccgagctactctcttg

SEQ ID NO: 2097749 - DNA, 20 bp, Homo sapiens
gctccctagtggcttcctcc

SEQ ID NO: 2097750 - DNA, 22 bp, Homo sapiens
gctccctgtgacaaaattttat

SEQ ID NO: 2097751 - DNA, 24 bp, Homo sapiens
gctccgctttctacccagcgagcc

SEQ ID NO: 2097752 - DNA, 13 bp, Homo sapiens
gctccgtcatctg

SEQ ID NO: 2097753 - DNA, 23 bp, Homo sapiens
gctccgtccaggagcctgtgcct

SEQ ID NO: 2097754 - DNA, 22 bp, Homo sapiens
gctccgtgagtgaaccatcatt

SEQ ID NO: 2097755 - DNA, 15 bp, Homo sapiens
gctcctaagcttcaa

SEQ ID NO: 2097756 - DNA, 14 bp, Homo sapiens
gctcctccagggcc

SEQ ID NO: 2097757 - DNA, 12 bp, Homo sapiens
gctcctcccatt

SEQ ID NO: 2097758 - DNA, 16 bp, Homo sapiens
gctcctcccctcttga

SEQ ID NO: 2097759 - DNA, 19 bp, Homo sapiens
gctcctcccggtgcccaag

SEQ ID NO: 2097760 - DNA, 17 bp, Homo sapiens
gctcctccttctgctgc

SEQ ID NO: 2097761 - DNA, 17 bp, Homo sapiens
gctcctctccaggcacc

SEQ ID NO: 2097762 - DNA, 17 bp, Homo sapiens
gctcctctccttgggct

SEQ ID NO: 2097763 - DNA, 18 bp, Homo sapiens
gctcctctccttgggctc

SEQ ID NO: 2097764 - DNA, 19 bp, Homo sapiens
gctcctctccttgggctcc

SEQ ID NO: 2097765 - DNA, 20 bp, Homo sapiens
gctcctctccttgggctcct

SEQ ID NO: 2097766 - DNA, 22 bp, Homo sapiens
gctcctctccttgggctcctgg

SEQ ID NO: 2097767 - DNA, 17 bp, Homo sapiens
gctcctctgtctcgagc

SEQ ID NO: 2097768 - DNA, 21 bp, Homo sapiens
gctcctctgtctcgagcgccc

SEQ ID NO: 2097769 - DNA, 13 bp, Homo sapiens
gctcctgccttga

SEQ ID NO: 2097770 - DNA, 20 bp, Homo sapiens
gctcctgccttgatgaagcc

SEQ ID NO: 2097771 - DNA, 21 bp, Homo sapiens
gctcctgccttgatgaagccc

SEQ ID NO: 2097772 - DNA, 21 bp, Homo sapiens
gctcctggaaaggctcagtct

SEQ ID NO: 2097773 - DNA, 23 bp, Homo sapiens
gctcctggaaaggctcagtctca

SEQ ID NO: 2097774 - DNA, 22 bp, Homo sapiens
gctcctggaaccaatcccgtga

SEQ ID NO: 2097775 - DNA, 11 bp, Homo sapiens
gctcctggctg

SEQ ID NO: 2097776 - DNA, 14 bp, Homo sapiens
gctcctggctgcca

SEQ ID NO: 2097777 - DNA, 16 bp, Homo sapiens
gctcctggctgccagg

SEQ ID NO: 2097778 - DNA, 19 bp, Homo sapiens
gctcctggctgccaggcgt

SEQ ID NO: 2097779 - DNA, 12 bp, Homo sapiens
gctcctgtccct

SEQ ID NO: 2097780 - DNA, 23 bp, Homo sapiens
gctcctgtccctacccactcttt

SEQ ID NO: 2097781 - DNA, 12 bp, Homo sapiens
gctcctgtgtct

SEQ ID NO: 2097782 - DNA, 13 bp, Homo sapiens
gctcctgtgtctt

SEQ ID NO: 2097783 - DNA, 13 bp, Homo sapiens
gctcctgtttcca

SEQ ID NO: 2097784 - DNA, 23 bp, Homo sapiens
gctccttcccaggagtggaggag

SEQ ID NO: 2097785 - DNA, 14 bp, Homo sapiens
gctcctttctccag

SEQ ID NO: 2097786 - DNA, 18 bp, Homo sapiens
gctcctttctccagccag

SEQ ID NO: 2097787 - DNA, 20 bp, Homo sapiens
gctccttttgtccccagggc

SEQ ID NO: 2097788 - DNA, 23 bp, Homo sapiens
gctccttttgtccccagggcccc

SEQ ID NO: 2097789 - DNA, 18 bp, Homo sapiens
gcttcagtggcagctgct

SEQ ID NO: 2097790 - DNA, 19 bp, Homo sapiens
gcttcagtggcagctgctt

SEQ ID NO: 2097791 - DNA, 18 bp, Homo sapiens
gcttcagttgttttcccg

SEQ ID NO: 2097792 - DNA, 17 bp, Homo sapiens
gcttcatcaatttttat

SEQ ID NO: 2097793 - DNA, 19 bp, Homo sapiens
gcttcatcaatttttatac

SEQ ID NO: 2097794 - DNA, 20 bp, Homo sapiens
gcttcatcaatttttataca

SEQ ID NO: 2097795 - DNA, 21 bp, Homo sapiens
gcttcatcaatttttatacat

SEQ ID NO: 2097796 - DNA, 14 bp, Homo sapiens
gcttcatgcctcag

SEQ ID NO: 2097797 - DNA, 22 bp, Homo sapiens
gcttcatgcctcagtttcccca

SEQ ID NO: 2097798 - DNA, 14 bp, Homo sapiens
gcttcatgctcagc

SEQ ID NO: 2097799 - DNA, 11 bp, Homo sapiens
gcttccagacc

SEQ ID NO: 2097800 - DNA, 14 bp, Homo sapiens
gcttccagaccacc

SEQ ID NO: 2097801 - DNA, 17 bp, Homo sapiens
gcttccagaccacctgc

SEQ ID NO: 2097802 - DNA, 20 bp, Homo sapiens
gcttccagaccacctgccag

SEQ ID NO: 2097803 - DNA, 22 bp, Homo sapiens
gcttccagaccacctgccagcc

SEQ ID NO: 2097804 - DNA, 19 bp, Homo sapiens
gcttccagagagtcctctg

SEQ ID NO: 2097805 - DNA, 20 bp, Homo sapiens
gcttccagagagtcctctgg

SEQ ID NO: 2097806 - DNA, 13 bp, Homo sapiens
gcttccaggctct

SEQ ID NO: 2097807 - DNA, 18 bp, Homo sapiens
gcttccaggctcttcctg

SEQ ID NO: 2097808 - DNA, 19 bp, Homo sapiens
gcttccaggtatctccagg

SEQ ID NO: 2097809 - DNA, 21 bp, Homo sapiens
gcttccaggtatctccaggat

SEQ ID NO: 2097810 - DNA, 22 bp, Homo sapiens
gcttccaggtatctccaggatt

SEQ ID NO: 2097811 - DNA, 14 bp, Homo sapiens
gcttccagtgcatg

SEQ ID NO: 2097812 - DNA, 12 bp, Homo sapiens
gcttcccagagg

SEQ ID NO: 2097813 - DNA, 12 bp, Homo sapiens
gcttcccaggat

SEQ ID NO: 2097814 - DNA, 13 bp, Homo sapiens
gcttcccatcccc

SEQ ID NO: 2097815 - DNA, 16 bp, Homo sapiens
gcttcccatccccagc

SEQ ID NO: 2097816 - DNA, 17 bp, Homo sapiens
gcttcccatccccagcg

SEQ ID NO: 2097817 - DNA, 13 bp, Homo sapiens
gcttccccacaga

SEQ ID NO: 2097818 - DNA, 15 bp, Homo sapiens
gcttccccacagaac

SEQ ID NO: 2097819 - DNA, 15 bp, Homo sapiens
gcttcccctcgctgt

SEQ ID NO: 2097820 - DNA, 19 bp, Homo sapiens
gcttcccctcgctgtcctg

SEQ ID NO: 2097821 - DNA, 22 bp, Homo sapiens
gcttcccctcgctgtcctgctg

SEQ ID NO: 2097822 - DNA, 17 bp, Homo sapiens
gcttcccgctcagccct

SEQ ID NO: 2097823 - DNA, 23 bp, Homo sapiens
gcttcctccgtccacccaggctg

SEQ ID NO: 2097824 - DNA, 19 bp, Homo sapiens
gcttcctccgtctgcaatg

SEQ ID NO: 2097825 - DNA, 14 bp, Homo sapiens
gcttcctgactgac

SEQ ID NO: 2097826 - DNA, 23 bp, Homo sapiens
gcttcctgactgacacaggccag

SEQ ID NO: 2097827 - DNA, 11 bp, Homo sapiens
gcttcctgggt

SEQ ID NO: 2097828 - DNA, 14 bp, Homo sapiens
gcttcctgtccact

SEQ ID NO: 2097829 - DNA, 19 bp, Homo sapiens
gcttcctgtccactctcgg

SEQ ID NO: 2097830 - DNA, 14 bp, Homo sapiens
gcttccttcatttc

SEQ ID NO: 2097831 - DNA, 17 bp, Homo sapiens
gcttccttcatttcctc

SEQ ID NO: 2097832 - DNA, 18 bp, Homo sapiens
gcttccttctgcacccag

SEQ ID NO: 2097833 - DNA, 22 bp, Homo sapiens
gcttcgcttccttagccttgct

SEQ ID NO: 2097834 - DNA, 12 bp, Homo sapiens
gcttcggacagt

SEQ ID NO: 2097835 - DNA, 17 bp, Homo sapiens
gcttctaaatgcccagt

SEQ ID NO: 2097836 - DNA, 18 bp, Homo sapiens
gcttctatcccaggaggt

SEQ ID NO: 2097837 - DNA, 13 bp, Homo sapiens
gcttctcagcccc

SEQ ID NO: 2097838 - DNA, 14 bp, Homo sapiens
gcttctcatcccca

SEQ ID NO: 2097839 - DNA, 12 bp, Homo sapiens
gcttctcctgac

SEQ ID NO: 2097840 - DNA, 14 bp, Homo sapiens
gcttctcctgaccc

SEQ ID NO: 2097841 - DNA, 14 bp, Homo sapiens
gcttctcctgtgac

SEQ ID NO: 2097842 - DNA, 16 bp, Homo sapiens
gcttctgaactcaagc

SEQ ID NO: 2097843 - DNA, 23 bp, Homo sapiens
gcttctgaactcaagctgcgttt

SEQ ID NO: 2097844 - DNA, 12 bp, Homo sapiens
gcttctgcagca

SEQ ID NO: 2097845 - DNA, 15 bp, Homo sapiens
gcttctgcagcaact

SEQ ID NO: 2097846 - DNA, 19 bp, Homo sapiens
gcttctgggtggctcctgc

SEQ ID NO: 2097847 - DNA, 20 bp, Homo sapiens
gcttctgggtggctcctgcc

SEQ ID NO: 2097848 - DNA, 16 bp, Homo sapiens
gcttctgtccaaggca

SEQ ID NO: 2097849 - DNA, 18 bp, Homo sapiens
gcttctgtgcactagcct

SEQ ID NO: 2097850 - DNA, 20 bp, Homo sapiens
gcttctgtgcactagcctgt

SEQ ID NO: 2097851 - DNA, 13 bp, Homo sapiens
gcttcttgcccct

SEQ ID NO: 2097852 - DNA, 16 bp, Homo sapiens
gcttcttgccccttgg

SEQ ID NO: 2097853 - DNA, 23 bp, Homo sapiens
gcttcttgccccttgggcctccc

SEQ ID NO: 2097854 - DNA, 21 bp, Homo sapiens
gcttgaagatcgttagtatct

SEQ ID NO: 2097855 - DNA, 17 bp, Homo sapiens
gcttgaagtaaccttat

SEQ ID NO: 2097856 - DNA, 12 bp, Homo sapiens
gcttgaccagac

SEQ ID NO: 2097857 - DNA, 21 bp, Homo sapiens
gcttgaccagacctagacctg

SEQ ID NO: 2097858 - DNA, 19 bp, Homo sapiens
gcttgactatcacatacaa

SEQ ID NO: 2097859 - DNA, 20 bp, Homo sapiens
gcttgactatcacatacaat

SEQ ID NO: 2097860 - DNA, 13 bp, Homo sapiens
gcttgagcccagg

SEQ ID NO: 2097861 - DNA, 15 bp, Homo sapiens
gcttgagcccaggag

SEQ ID NO: 2097862 - DNA, 23 bp, Homo sapiens
gcttgaggaggggcacctgccac

SEQ ID NO: 2097863 - DNA, 20 bp, Homo sapiens
gcttgagggttgggctggtg

SEQ ID NO: 2097864 - DNA, 22 bp, Homo sapiens
gcttgagggttgggctggtgtc

SEQ ID NO: 2097865 - DNA, 19 bp, Homo sapiens
gcttgagtttggggaatgc

SEQ ID NO: 2097866 - DNA, 12 bp, Homo sapiens
gcttgcaagaag

SEQ ID NO: 2097867 - DNA, 22 bp, Homo sapiens
gcttgcactttgtaacatgttt

SEQ ID NO: 2097868 - DNA, 16 bp, Homo sapiens
gcttgccaccggggaa

SEQ ID NO: 2097869 - DNA, 13 bp, Homo sapiens
gcttgctccaggg

SEQ ID NO: 2097870 - DNA, 14 bp, Homo sapiens
gcttgcttctgcag

SEQ ID NO: 2097871 - DNA, 18 bp, Homo sapiens
gcttggaaactggatgag

SEQ ID NO: 2097872 - DNA, 19 bp, Homo sapiens
gcttggaaagcatcacctc

SEQ ID NO: 2097873 - DNA, 15 bp, Homo sapiens
gcttggccttgtgtc

SEQ ID NO: 2097874 - DNA, 14 bp, Homo sapiens
gcttgggccctgca

SEQ ID NO: 2097875 - DNA, 21 bp, Homo sapiens
gcttgggccctgcacagatat

SEQ ID NO: 2097876 - DNA, 20 bp, Homo sapiens
gcttgggtggtgggtgctgg

SEQ ID NO: 2097877 - DNA, 23 bp, Homo sapiens
gcttgggtgtaacaggtctcctc

SEQ ID NO: 2097878 - DNA, 16 bp, Homo sapiens
gcttggtggggctcgt

SEQ ID NO: 2097879 - DNA, 19 bp, Homo sapiens
gcttggtggggctcgtggc

SEQ ID NO: 2097880 - DNA, 20 bp, Homo sapiens
gcttggtggggctcgtggcc

SEQ ID NO: 2097881 - DNA, 13 bp, Homo sapiens
gcttggttggctg

SEQ ID NO: 2097882 - DNA, 19 bp, Homo sapiens
gcttgtagaccactgtcct

SEQ ID NO: 2097883 - DNA, 13 bp, Homo sapiens
gcttgtagccagc

SEQ ID NO: 2097884 - DNA, 14 bp, Homo sapiens
gcttgtagccagcc

SEQ ID NO: 2097885 - DNA, 22 bp, Homo sapiens
gcttgtagccagccggggcgag

SEQ ID NO: 2097886 - DNA, 14 bp, Homo sapiens
gcttgtatatacat

SEQ ID NO: 2097887 - DNA, 13 bp, Homo sapiens
gcttgtattttcc

SEQ ID NO: 2097888 - DNA, 14 bp, Homo sapiens
gcttgtattttcca

SEQ ID NO: 2097889 - DNA, 21 bp, Homo sapiens
gcttgtcactagcagctgcag

SEQ ID NO: 2097890 - DNA, 17 bp, Homo sapiens
gcttgtcatctgccact

SEQ ID NO: 2097891 - DNA, 18 bp, Homo sapiens
gcttgtgagagctggttg

SEQ ID NO: 2097892 - DNA, 13 bp, Homo sapiens
gcttgttaatgct

SEQ ID NO: 2097893 - DNA, 22 bp, Homo sapiens
gcttgttgtttttaagtcctgt

SEQ ID NO: 2097894 - DNA, 16 bp, Homo sapiens
gctttaaacacccttc

SEQ ID NO: 2097895 - DNA, 22 bp, Homo sapiens
gctttaaactaccctccagagt

SEQ ID NO: 2097896 - DNA, 17 bp, Homo sapiens
gctttaacaaaacaaga

SEQ ID NO: 2097897 - DNA, 21 bp, Homo sapiens
gctttaacaaaacaagaaaga

SEQ ID NO: 2097898 - DNA, 20 bp, Homo sapiens
gctttaatatagctatcatt

SEQ ID NO: 2097899 - DNA, 12 bp, Homo sapiens
gctttacatgca

SEQ ID NO: 2097900 - DNA, 17 bp, Homo sapiens
gctttacatgctgtgct

SEQ ID NO: 2097901 - DNA, 23 bp, Homo sapiens
gctttagtcctagaggacctgag

SEQ ID NO: 2097902 - DNA, 13 bp, Homo sapiens
gctttatttatgg

SEQ ID NO: 2097903 - DNA, 23 bp, Homo sapiens
gctttatttatggcttataaatg

SEQ ID NO: 2097904 - DNA, 23 bp, Homo sapiens
ggagctggaaataaacctggaga

SEQ ID NO: 2097905 - DNA, 18 bp, Homo sapiens
ggagctggttagaaatgc

SEQ ID NO: 2097906 - DNA, 23 bp, Homo sapiens
ggagcttgcaagaagcaggaagg

SEQ ID NO: 2097907 - DNA, 19 bp, Homo sapiens
ggaggaagcaggttgaggg

SEQ ID NO: 2097908 - DNA, 17 bp, Homo sapiens
ggaggaagggccaggag

SEQ ID NO: 2097909 - DNA, 20 bp, Homo sapiens
ggaggaagggccaggagaga

SEQ ID NO: 2097910 - DNA, 22 bp, Homo sapiens
ggaggaagggccaggagagaga

SEQ ID NO: 2097911 - DNA, 23 bp, Homo sapiens
ggaggaagggccaggagagagat

SEQ ID NO: 2097912 - DNA, 23 bp, Homo sapiens
ggaggaataagctcccagggcct

SEQ ID NO: 2097913 - DNA, 22 bp, Homo sapiens
ggaggacagtgggaactggagg

SEQ ID NO: 2097914 - DNA, 16 bp, Homo sapiens
ggaggactagaacctg

SEQ ID NO: 2097915 - DNA, 14 bp, Homo sapiens
ggaggagaccagct

SEQ ID NO: 2097916 - DNA, 17 bp, Homo sapiens
ggaggagaccagctcag

SEQ ID NO: 2097917 - DNA, 17 bp, Homo sapiens
ggaggagcttgggggat

SEQ ID NO: 2097918 - DNA, 14 bp, Homo sapiens
ggaggaggagctgc

SEQ ID NO: 2097919 - DNA, 12 bp, Homo sapiens
ggaggaggcctg

SEQ ID NO: 2097920 - DNA, 22 bp, Homo sapiens
ggaggaggcctgggggcaggga

SEQ ID NO: 2097921 - DNA, 17 bp, Homo sapiens
ggaggatcactggagcc

SEQ ID NO: 2097922 - DNA, 14 bp, Homo sapiens
ggaggatccctcca

SEQ ID NO: 2097923 - DNA, 17 bp, Homo sapiens
ggaggatgccacagccc

SEQ ID NO: 2097924 - DNA, 22 bp, Homo sapiens
ggaggattgcttgagcccagga

SEQ ID NO: 2097925 - DNA, 12 bp, Homo sapiens
ggaggcaagaac

SEQ ID NO: 2097926 - DNA, 12 bp, Homo sapiens
ggaggcaccagc

SEQ ID NO: 2097927 - DNA, 14 bp, Homo sapiens
ggaggcaccagctc

SEQ ID NO: 2097928 - DNA, 17 bp, Homo sapiens
ggaggcaccagctctgt

SEQ ID NO: 2097929 - DNA, 15 bp, Homo sapiens
ggaggcagagaagaa

SEQ ID NO: 2097930 - DNA, 19 bp, Homo sapiens
ggaggcagagaagaaagaa

SEQ ID NO: 2097931 - DNA, 14 bp, Homo sapiens
ggaggcagaggtgg

SEQ ID NO: 2097932 - DNA, 18 bp, Homo sapiens
ggaggcagctccaacagc

SEQ ID NO: 2097933 - DNA, 18 bp, Homo sapiens
ggaggcagggccttgccc

SEQ ID NO: 2097934 - DNA, 16 bp, Homo sapiens
ggaggcatggccctgg

SEQ ID NO: 2097935 - DNA, 18 bp, Homo sapiens
ggaggccaaggcaggtag

SEQ ID NO: 2097936 - DNA, 22 bp, Homo sapiens
ggaggccaccgggacagacctg

SEQ ID NO: 2097937 - DNA, 23 bp, Homo sapiens
ggaggccaccgggacagacctgg

SEQ ID NO: 2097938 - DNA, 12 bp, Homo sapiens
ggaggccgaagc

SEQ ID NO: 2097939 - DNA, 19 bp, Homo sapiens
ggaggcctcgtaccagcca

SEQ ID NO: 2097940 - DNA, 21 bp, Homo sapiens
ggaggcctcgtaccagccagg

SEQ ID NO: 2097941 - DNA, 17 bp, Homo sapiens
ggaggcgaataaatgtt

SEQ ID NO: 2097942 - DNA, 14 bp, Homo sapiens
ggaggcggctccag

SEQ ID NO: 2097943 - DNA, 18 bp, Homo sapiens
ggaggctgagacaggaga

SEQ ID NO: 2097944 - DNA, 19 bp, Homo sapiens
ggaggctgagacaggagaa

SEQ ID NO: 2097945 - DNA, 14 bp, Homo sapiens
ggaggctgaggcag

SEQ ID NO: 2097946 - DNA, 16 bp, Homo sapiens
ggaggctgaggcagaa

SEQ ID NO: 2097947 - DNA, 16 bp, Homo sapiens
ggaggctgaggcagga

SEQ ID NO: 2097948 - DNA, 17 bp, Homo sapiens
ggaggctgaggcaggag

SEQ ID NO: 2097949 - DNA, 18 bp, Homo sapiens
ggaggctgcatgctctgg

SEQ ID NO: 2097950 - DNA, 19 bp, Homo sapiens
ggaggctgcatgctctgga

SEQ ID NO: 2097951 - DNA, 22 bp, Homo sapiens
ggaggctgcatgctctggaagc

SEQ ID NO: 2097952 - DNA, 14 bp, Homo sapiens
ggaggctgctcggg

SEQ ID NO: 2097953 - DNA, 23 bp, Homo sapiens
ggaggctgggcccctgggatggg

SEQ ID NO: 2097954 - DNA, 19 bp, Homo sapiens
ggaggctggtctccctcca

SEQ ID NO: 2097955 - DNA, 16 bp, Homo sapiens
ggaggcttcctgactg

SEQ ID NO: 2097956 - DNA, 22 bp, Homo sapiens
ggaggcttcctgactgacacag

SEQ ID NO: 2097957 - DNA, 18 bp, Homo sapiens
ggagggacaaaggagcct

SEQ ID NO: 2097958 - DNA, 14 bp, Homo sapiens
ggagggacaagaat

SEQ ID NO: 2097959 - DNA, 12 bp, Homo sapiens
ggagggagagaa

SEQ ID NO: 2097960 - DNA, 16 bp, Homo sapiens
ggagggagcagacagg

SEQ ID NO: 2097961 - DNA, 21 bp, Homo sapiens
ggagggcaagggccatgctga

SEQ ID NO: 2097962 - DNA, 23 bp, Homo sapiens
ggagggcaagggccatgctgaag

SEQ ID NO: 2097963 - DNA, 12 bp, Homo sapiens
ggagggcagagc

SEQ ID NO: 2097964 - DNA, 13 bp, Homo sapiens
ggagggcagagcc

SEQ ID NO: 2097965 - DNA, 15 bp, Homo sapiens
ggagggcagagccat

SEQ ID NO: 2097966 - DNA, 18 bp, Homo sapiens
ggagggcagagccatggg

SEQ ID NO: 2097967 - DNA, 19 bp, Homo sapiens
ggagggcagagtgggctgc

SEQ ID NO: 2097968 - DNA, 20 bp, Homo sapiens
ggagggctagaacctagaag

SEQ ID NO: 2097969 - DNA, 21 bp, Homo sapiens
ggagggctagaacctggaagg

SEQ ID NO: 2097970 - DNA, 19 bp, Homo sapiens
ggagggctagaacctggag

SEQ ID NO: 2097971 - DNA, 20 bp, Homo sapiens
ggagggctagaacctggcag

SEQ ID NO: 2097972 - DNA, 22 bp, Homo sapiens
ggagggctagaatctggagagc

SEQ ID NO: 2097973 - DNA, 13 bp, Homo sapiens
ggagggctctgag

SEQ ID NO: 2097974 - DNA, 21 bp, Homo sapiens
ggagggctctgaggcgcccca

SEQ ID NO: 2097975 - DNA, 22 bp, Homo sapiens
ggagggcttggtaaaacacaga

SEQ ID NO: 2097976 - DNA, 20 bp, Homo sapiens
ggaggggactatttatgaag

SEQ ID NO: 2097977 - DNA, 13 bp, Homo sapiens
ggaggggcacctg

SEQ ID NO: 2097978 - DNA, 14 bp, Homo sapiens
ggaggggcacctgc

SEQ ID NO: 2097979 - DNA, 16 bp, Homo sapiens
ggaggggcacctgcca

SEQ ID NO: 2097980 - DNA, 19 bp, Homo sapiens
ggaggggcacctgccaccg

SEQ ID NO: 2097981 - DNA, 14 bp, Homo sapiens
ggaggggcctggca

SEQ ID NO: 2097982 - DNA, 18 bp, Homo sapiens
ggagggggaatgtagtga

SEQ ID NO: 2097983 - DNA, 16 bp, Homo sapiens
ggagggggcgctcagg

SEQ ID NO: 2097984 - DNA, 23 bp, Homo sapiens
ggagggggtgtctggaagctgag

SEQ ID NO: 2097985 - DNA, 23 bp, Homo sapiens
ggaggggttgcgggggagctgga

SEQ ID NO: 2097986 - DNA, 19 bp, Homo sapiens
ggagggtgggagagcccag

SEQ ID NO: 2097987 - DNA, 18 bp, Homo sapiens
ggagggtggggccgggtg

SEQ ID NO: 2097988 - DNA, 20 bp, Homo sapiens
ggaggtcacattcaggaaga

SEQ ID NO: 2097989 - DNA, 23 bp, Homo sapiens
ggaggtcacattcaggaagatga

SEQ ID NO: 2097990 - DNA, 18 bp, Homo sapiens
ggaggtccctgccagtgt

SEQ ID NO: 2097991 - DNA, 13 bp, Homo sapiens
ggaggtcctcctc

SEQ ID NO: 2097992 - DNA, 22 bp, Homo sapiens
ggaggtcgaccccaaagcccct

SEQ ID NO: 2097993 - DNA, 22 bp, Homo sapiens
ggaggtcttggccgactcaggg

SEQ ID NO: 2097994 - DNA, 14 bp, Homo sapiens
ggaggtgaccccag

SEQ ID NO: 2097995 - DNA, 21 bp, Homo sapiens
ggaggtgcctgagctggggcc

SEQ ID NO: 2097996 - DNA, 19 bp, Homo sapiens
ggaggtggaggttgcagtg

SEQ ID NO: 2097997 - DNA, 15 bp, Homo sapiens
ggaggtggcagccct

SEQ ID NO: 2097998 - DNA, 12 bp, Homo sapiens
ggaggtggtgga

SEQ ID NO: 2097999 - DNA, 15 bp, Homo sapiens
ggaggtggtggagga

SEQ ID NO: 2098000 - DNA, 18 bp, Homo sapiens
ggaggtggtggaggagga

SEQ ID NO: 2098001 - DNA, 12 bp, Homo sapiens
ggaggttgcagg

SEQ ID NO: 2098002 - DNA, 14 bp, Homo sapiens
ggaggttgcaggga

SEQ ID NO: 2098003 - DNA, 21 bp, Homo sapiens
ggaggttgcagtgagctgaga

SEQ ID NO: 2098004 - DNA, 18 bp, Homo sapiens
ggagtaatcaggcagcct

SEQ ID NO: 2098005 - DNA, 16 bp, Homo sapiens
ggagtcccaaggaaag

SEQ ID NO: 2098006 - DNA, 13 bp, Homo sapiens
ggagtctgaggtc

SEQ ID NO: 2098007 - DNA, 18 bp, Homo sapiens
ggagtctgaggtcctgag

SEQ ID NO: 2098008 - DNA, 19 bp, Homo sapiens
ggagtctgaggtcctgagc

SEQ ID NO: 2098009 - DNA, 21 bp, Homo sapiens
ggagtctgaggtcctgagcac

SEQ ID NO: 2098010 - DNA, 12 bp, Homo sapiens
ggagtctgagtc

SEQ ID NO: 2098011 - DNA, 18 bp, Homo sapiens
ggagtctgagtctgagtc

SEQ ID NO: 2098012 - DNA, 11 bp, Homo sapiens
ggagtgacaga

SEQ ID NO: 2098013 - DNA, 19 bp, Homo sapiens
ggagtgacagaggcagccc

SEQ ID NO: 2098014 - DNA, 20 bp, Homo sapiens
ggagtgacgggagcctcctc

SEQ ID NO: 2098015 - DNA, 18 bp, Homo sapiens
ggagtgaggcttccaggc

SEQ ID NO: 2098016 - DNA, 20 bp, Homo sapiens
ggagtgaggcttccaggctc

SEQ ID NO: 2098017 - DNA, 23 bp, Homo sapiens
ggagtgcgctcttggtccctggt

SEQ ID NO: 2098018 - DNA, 19 bp, Homo sapiens
ggccatgcttcttgcccct

SEQ ID NO: 2098019 - DNA, 21 bp, Homo sapiens
ggccatgcttcttgccccttg

SEQ ID NO: 2098020 - DNA, 22 bp, Homo sapiens
ggccatgcttcttgccccttgg

SEQ ID NO: 2098021 - DNA, 19 bp, Homo sapiens
ggccatgctttccttttct

SEQ ID NO: 2098022 - DNA, 23 bp, Homo sapiens
ggccattttcttgcctgaggctc

SEQ ID NO: 2098023 - DNA, 18 bp, Homo sapiens
ggcccaaagcccagctct

SEQ ID NO: 2098024 - DNA, 20 bp, Homo sapiens
ggcccaaatccagtgtgcac

SEQ ID NO: 2098025 - DNA, 23 bp, Homo sapiens
ggcccaaatccagtgtgcacccc

SEQ ID NO: 2098026 - DNA, 19 bp, Homo sapiens
ggcccaagagatgaagagt

SEQ ID NO: 2098027 - DNA, 15 bp, Homo sapiens
ggcccactgcagaga

SEQ ID NO: 2098028 - DNA, 16 bp, Homo sapiens
ggcccagaattgcatt

SEQ ID NO: 2098029 - DNA, 15 bp, Homo sapiens
ggcccagagaagcaa

SEQ ID NO: 2098030 - DNA, 17 bp, Homo sapiens
ggcccagagaccccttc

SEQ ID NO: 2098031 - DNA, 18 bp, Homo sapiens
ggcccagagaccccttcc

SEQ ID NO: 2098032 - DNA, 17 bp, Homo sapiens
ggcccagagctggaaca

SEQ ID NO: 2098033 - DNA, 12 bp, Homo sapiens
ggcccagcctgt

SEQ ID NO: 2098034 - DNA, 21 bp, Homo sapiens
ggcccagctgtagccatggct

SEQ ID NO: 2098035 - DNA, 19 bp, Homo sapiens
ggcccaggctctgggaagg

SEQ ID NO: 2098036 - DNA, 12 bp, Homo sapiens
ggcccagggagc

SEQ ID NO: 2098037 - DNA, 17 bp, Homo sapiens
ggcccagtatgagccct

SEQ ID NO: 2098038 - DNA, 22 bp, Homo sapiens
ggcccagtatgagccctagaag

SEQ ID NO: 2098039 - DNA, 19 bp, Homo sapiens
ggcccatagaaacatgaca

SEQ ID NO: 2098040 - DNA, 23 bp, Homo sapiens
ggcccatagaaacatgacactga

SEQ ID NO: 2098041 - DNA, 13 bp, Homo sapiens
ggcccatctcagg

SEQ ID NO: 2098042 - DNA, 16 bp, Homo sapiens
ggccccacatgggaac

SEQ ID NO: 2098043 - DNA, 15 bp, Homo sapiens
ggccccaccacctag

SEQ ID NO: 2098044 - DNA, 19 bp, Homo sapiens
ggccccagaaggcagggaa

SEQ ID NO: 2098045 - DNA, 14 bp, Homo sapiens
ggccccagagaggg

SEQ ID NO: 2098046 - DNA, 13 bp, Homo sapiens
ggccccagatctg

SEQ ID NO: 2098047 - DNA, 22 bp, Homo sapiens
ggccccagatctgcctgggcct

SEQ ID NO: 2098048 - DNA, 13 bp, Homo sapiens
ggccccagcacta

SEQ ID NO: 2098049 - DNA, 21 bp, Homo sapiens
ggccccagcactaaagcagtg

SEQ ID NO: 2098050 - DNA, 17 bp, Homo sapiens
ggccccagggctaccct

SEQ ID NO: 2098051 - DNA, 18 bp, Homo sapiens
ggccccagggctaccctc

SEQ ID NO: 2098052 - DNA, 14 bp, Homo sapiens
ggccccagggttga

SEQ ID NO: 2098053 - DNA, 17 bp, Homo sapiens
ggccccaggtgccacca

SEQ ID NO: 2098054 - DNA, 21 bp, Homo sapiens
ggccccatcagaggctggggg

SEQ ID NO: 2098055 - DNA, 13 bp, Homo sapiens
ggccccatgctct

SEQ ID NO: 2098056 - DNA, 19 bp, Homo sapiens
ggccccatgctctgcccca

SEQ ID NO: 2098057 - DNA, 11 bp, Homo sapiens
ggcccccacag

SEQ ID NO: 2098058 - DNA, 23 bp, Homo sapiens
ggccccccacacgcgtgtgtaca

SEQ ID NO: 2098059 - DNA, 22 bp, Homo sapiens
ggccccccctcttttggccttg

SEQ ID NO: 2098060 - DNA, 16 bp, Homo sapiens
ggccccccgcagcacc

SEQ ID NO: 2098061 - DNA, 15 bp, Homo sapiens
ggcccccctccaggc

SEQ ID NO: 2098062 - DNA, 15 bp, Homo sapiens
ggccccctgtgccag

SEQ ID NO: 2098063 - DNA, 17 bp, Homo sapiens
ggccccgggctctggcc

SEQ ID NO: 2098064 - DNA, 13 bp, Homo sapiens
ggccccggggctg

SEQ ID NO: 2098065 - DNA, 16 bp, Homo sapiens
ggccccggggctggca

SEQ ID NO: 2098066 - DNA, 18 bp, Homo sapiens
ggccccggggctggcaag

SEQ ID NO: 2098067 - DNA, 18 bp, Homo sapiens
ggccccgtcagccacacc

SEQ ID NO: 2098068 - DNA, 20 bp, Homo sapiens
ggccccgtcagccacacctg

SEQ ID NO: 2098069 - DNA, 19 bp, Homo sapiens
ggcccctcacctgggcctt

SEQ ID NO: 2098070 - DNA, 18 bp, Homo sapiens
ggcccctccacgcctcct

SEQ ID NO: 2098071 - DNA, 23 bp, Homo sapiens
ggcccctccacgcctcctggcca

SEQ ID NO: 2098072 - DNA, 19 bp, Homo sapiens
ggcccctccagaccctgcc

SEQ ID NO: 2098073 - DNA, 14 bp, Homo sapiens
ggcccctccctctg

SEQ ID NO: 2098074 - DNA, 16 bp, Homo sapiens
ggcccctccctctgcc

SEQ ID NO: 2098075 - DNA, 19 bp, Homo sapiens
ggcccctgaggactggaga

SEQ ID NO: 2098076 - DNA, 12 bp, Homo sapiens
ggcccctgccac

SEQ ID NO: 2098077 - DNA, 13 bp, Homo sapiens
ggcccctgccacc

SEQ ID NO: 2098078 - DNA, 16 bp, Homo sapiens
ggcccctgccaccctg

SEQ ID NO: 2098079 - DNA, 17 bp, Homo sapiens
ggcccctgccaccctgg

SEQ ID NO: 2098080 - DNA, 16 bp, Homo sapiens
ggcccctgcccggctg

SEQ ID NO: 2098081 - DNA, 17 bp, Homo sapiens
ggcccctgcccggctgc

SEQ ID NO: 2098082 - DNA, 14 bp, Homo sapiens
ggcccctgctggtt

SEQ ID NO: 2098083 - DNA, 22 bp, Homo sapiens
ggcccctgggatgggaccaggg

SEQ ID NO: 2098084 - DNA, 17 bp, Homo sapiens
ggcccctggtctgccct

SEQ ID NO: 2098085 - DNA, 13 bp, Homo sapiens
ggcccctgtgtga

SEQ ID NO: 2098086 - DNA, 23 bp, Homo sapiens
ggccccttggcgggcagcccagc

SEQ ID NO: 2098087 - DNA, 15 bp, Homo sapiens
ggcccgacagagaga

SEQ ID NO: 2098088 - DNA, 16 bp, Homo sapiens
ggcccgacagagagat

SEQ ID NO: 2098089 - DNA, 13 bp, Homo sapiens
ggcccgagcagct

SEQ ID NO: 2098090 - DNA, 13 bp, Homo sapiens
ggcccgctttgcc

SEQ ID NO: 2098091 - DNA, 16 bp, Homo sapiens
ggcccgctttgcctgc

SEQ ID NO: 2098092 - DNA, 18 bp, Homo sapiens
ggcccgctttgcctgctt

SEQ ID NO: 2098093 - DNA, 20 bp, Homo sapiens
ggcccggagtaatcaggcag

SEQ ID NO: 2098094 - DNA, 23 bp, Homo sapiens
ggcccggcgcggtggctcacgcc

SEQ ID NO: 2098095 - DNA, 13 bp, Homo sapiens
ggcccggctccag

SEQ ID NO: 2098096 - DNA, 13 bp, Homo sapiens
ggcccggggctgg

SEQ ID NO: 2098097 - DNA, 21 bp, Homo sapiens
ggccctaggattcctccccca

SEQ ID NO: 2098098 - DNA, 23 bp, Homo sapiens
ggccctccctgactccctgtggg

SEQ ID NO: 2098099 - DNA, 21 bp, Homo sapiens
ggccctcccttgcaggtcggt

SEQ ID NO: 2098100 - DNA, 16 bp, Homo sapiens
ggccctctatttctct

SEQ ID NO: 2098101 - DNA, 18 bp, Homo sapiens
ggccctgcacctgtgcag

SEQ ID NO: 2098102 - DNA, 14 bp, Homo sapiens
ggccctgccccatc

SEQ ID NO: 2098103 - DNA, 15 bp, Homo sapiens
ggccctgccccatcc

SEQ ID NO: 2098104 - DNA, 19 bp, Homo sapiens
ggccctgcccctcttcccg

SEQ ID NO: 2098105 - DNA, 20 bp, Homo sapiens
ggccctggatcagcgtggcc

SEQ ID NO: 2098106 - DNA, 22 bp, Homo sapiens
ggccctggatcagcgtggcctt

SEQ ID NO: 2098107 - DNA, 23 bp, Homo sapiens
ggccctggatgtgcccacaggga

SEQ ID NO: 2098108 - DNA, 16 bp, Homo sapiens
ggccctggcctgctgg

SEQ ID NO: 2098109 - DNA, 22 bp, Homo sapiens
ggccctggctcccacaggccct

SEQ ID NO: 2098110 - DNA, 15 bp, Homo sapiens
ggccctggggtccca

SEQ ID NO: 2098111 - DNA, 15 bp, Homo sapiens
ggccctggtgtcagg

SEQ ID NO: 2098112 - DNA, 16 bp, Homo sapiens
ggcccttcctggacag

SEQ ID NO: 2098113 - DNA, 17 bp, Homo sapiens
ggcccttcctggacagc

SEQ ID NO: 2098114 - DNA, 22 bp, Homo sapiens
ggcccttcctggacagctgtgc

SEQ ID NO: 2098115 - DNA, 23 bp, Homo sapiens
ggcccttcctggacagctgtgcc

SEQ ID NO: 2098116 - DNA, 17 bp, Homo sapiens
ggcccttggggcctggc

SEQ ID NO: 2098117 - DNA, 21 bp, Homo sapiens
ggcccttggggcctggcttgc

SEQ ID NO: 2098118 - DNA, 14 bp, Homo sapiens
ggcccttgtcctgc

SEQ ID NO: 2098119 - DNA, 15 bp, Homo sapiens
ggcccttgtcctgcc

SEQ ID NO: 2098120 - DNA, 23 bp, Homo sapiens
ggcccttgtcctgccagctgcct

SEQ ID NO: 2098121 - DNA, 17 bp, Homo sapiens
ggccgacggcggcggcc

SEQ ID NO: 2098122 - DNA, 17 bp, Homo sapiens
ggccgagggaaatgctg

SEQ ID NO: 2098123 - DNA, 19 bp, Homo sapiens
ggccgatcggggcactgca

SEQ ID NO: 2098124 - DNA, 16 bp, Homo sapiens
ggccgcaagcgcaggg

SEQ ID NO: 2098125 - DNA, 17 bp, Homo sapiens
ggccgcaagcgcaggga

SEQ ID NO: 2098126 - DNA, 22 bp, Homo sapiens
ggccgcaagcgcagggaggatg

SEQ ID NO: 2098127 - DNA, 20 bp, Homo sapiens
ggccgccatccgggacgctt

SEQ ID NO: 2098128 - DNA, 18 bp, Homo sapiens
ggccgctgccccagcccc

SEQ ID NO: 2098129 - DNA, 20 bp, Homo sapiens
ggccgctgctttgcgctggt

SEQ ID NO: 2098130 - DNA, 12 bp, Homo sapiens
ggccgctggccc

SEQ ID NO: 2098131 - DNA, 20 bp, Homo sapiens
ggccgctggcccagggtagg

SEQ ID NO: 2098132 - DNA, 15 bp, Homo sapiens
gggaaacagggagcc

SEQ ID NO: 2098133 - DNA, 14 bp, Homo sapiens
gggaaactggctga

SEQ ID NO: 2098134 - DNA, 13 bp, Homo sapiens
gggaaagctccac

SEQ ID NO: 2098135 - DNA, 16 bp, Homo sapiens
gggaaaggacccaccc

SEQ ID NO: 2098136 - DNA, 15 bp, Homo sapiens
gggaaaggatatttt

SEQ ID NO: 2098137 - DNA, 14 bp, Homo sapiens
gggaaataagagag

SEQ ID NO: 2098138 - DNA, 13 bp, Homo sapiens
gggaaatggaggg

SEQ ID NO: 2098139 - DNA, 22 bp, Homo sapiens
gggaacaaatcacacctctggg

SEQ ID NO: 2098140 - DNA, 23 bp, Homo sapiens
gggaacaaatcacacctctgggc

SEQ ID NO: 2098141 - DNA, 14 bp, Homo sapiens
gggaacagacagga

SEQ ID NO: 2098142 - DNA, 15 bp, Homo sapiens
gggaacagacaggag

SEQ ID NO: 2098143 - DNA, 12 bp, Homo sapiens
gggaacagtgtt

SEQ ID NO: 2098144 - DNA, 16 bp, Homo sapiens
gggaaccatgaagctg

SEQ ID NO: 2098145 - DNA, 19 bp, Homo sapiens
gggaaccatgaagctggaa

SEQ ID NO: 2098146 - DNA, 15 bp, Homo sapiens
gggaacccagccctg

SEQ ID NO: 2098147 - DNA, 18 bp, Homo sapiens
gggaaccccgcagcccgt

SEQ ID NO: 2098148 - DNA, 20 bp, Homo sapiens
gggaacccgactgtgaaagt

SEQ ID NO: 2098149 - DNA, 12 bp, Homo sapiens
gggaaccctccc

SEQ ID NO: 2098150 - DNA, 12 bp, Homo sapiens
gggaaccctgct

SEQ ID NO: 2098151 - DNA, 14 bp, Homo sapiens
gggaacgcagaggc

SEQ ID NO: 2098152 - DNA, 21 bp, Homo sapiens
gggaacgcagaggcggaaacc

SEQ ID NO: 2098153 - DNA, 18 bp, Homo sapiens
gggaacgtgactgcccca

SEQ ID NO: 2098154 - DNA, 13 bp, Homo sapiens
gggaactcctgga

SEQ ID NO: 2098155 - DNA, 13 bp, Homo sapiens
gggaactctgaca

SEQ ID NO: 2098156 - DNA, 19 bp, Homo sapiens
gggaactctgacaagggct

SEQ ID NO: 2098157 - DNA, 21 bp, Homo sapiens
gggaactctgacaagggctga

SEQ ID NO: 2098158 - DNA, 22 bp, Homo sapiens
gggaactgcatatcggaggtgg

SEQ ID NO: 2098159 - DNA, 20 bp, Homo sapiens
gggaactggccaagctgagg

SEQ ID NO: 2098160 - DNA, 21 bp, Homo sapiens
gggaactggccaagctgaggt

SEQ ID NO: 2098161 - DNA, 15 bp, Homo sapiens
gggaagcaggcagag

SEQ ID NO: 2098162 - DNA, 21 bp, Homo sapiens
gggaagcctccgtcaggagag

SEQ ID NO: 2098163 - DNA, 20 bp, Homo sapiens
gggaagcctcttcagggtga

SEQ ID NO: 2098164 - DNA, 23 bp, Homo sapiens
gggaagcggaggttgcagggagc

SEQ ID NO: 2098165 - DNA, 16 bp, Homo sapiens
gggaagctggcagcac

SEQ ID NO: 2098166 - DNA, 15 bp, Homo sapiens
gggaaggaagggaca

SEQ ID NO: 2098167 - DNA, 20 bp, Homo sapiens
gggaaggaagggacacacac

SEQ ID NO: 2098168 - DNA, 20 bp, Homo sapiens
gggaaggagggttagggagg

SEQ ID NO: 2098169 - DNA, 21 bp, Homo sapiens
gggaaggcaggcagggctctc

SEQ ID NO: 2098170 - DNA, 21 bp, Homo sapiens
gggaagtcttacttaaaaaaa

SEQ ID NO: 2098171 - DNA, 20 bp, Homo sapiens
gggaagtgctccccacacgt

SEQ ID NO: 2098172 - DNA, 12 bp, Homo sapiens
gggaatccgcct

SEQ ID NO: 2098173 - DNA, 13 bp, Homo sapiens
gggaatccgcctg

SEQ ID NO: 2098174 - DNA, 18 bp, Homo sapiens
gggaatggatggggagaa

SEQ ID NO: 2098175 - DNA, 16 bp, Homo sapiens
gggaatgttccctgca

SEQ ID NO: 2098176 - DNA, 22 bp, Homo sapiens
gggaatgttccctgcaccctgg

SEQ ID NO: 2098177 - DNA, 15 bp, Homo sapiens
gggacaaagaggcct

SEQ ID NO: 2098178 - DNA, 17 bp, Homo sapiens
gggacagagacacctgc

SEQ ID NO: 2098179 - DNA, 20 bp, Homo sapiens
gggacagagacacctgcacc

SEQ ID NO: 2098180 - DNA, 14 bp, Homo sapiens
gggacagccccagg

SEQ ID NO: 2098181 - DNA, 16 bp, Homo sapiens
gggacagccccagggc

SEQ ID NO: 2098182 - DNA, 15 bp, Homo sapiens
gggacagctccttct

SEQ ID NO: 2098183 - DNA, 16 bp, Homo sapiens
gggacagctccttctg

SEQ ID NO: 2098184 - DNA, 21 bp, Homo sapiens
gggacagctccttctgtccta

SEQ ID NO: 2098185 - DNA, 18 bp, Homo sapiens
gggacagggcttggggag

SEQ ID NO: 2098186 - DNA, 17 bp, Homo sapiens
gggacaggtcctcagtg

SEQ ID NO: 2098187 - DNA, 15 bp, Homo sapiens
gggacagttggcaga

SEQ ID NO: 2098188 - DNA, 20 bp, Homo sapiens
gggacagttggcagagaagg

SEQ ID NO: 2098189 - DNA, 18 bp, Homo sapiens
gggacatttccctcctgg

SEQ ID NO: 2098190 - DNA, 17 bp, Homo sapiens
gggaccattgacctcag

SEQ ID NO: 2098191 - DNA, 14 bp, Homo sapiens
gggacccagctact

SEQ ID NO: 2098192 - DNA, 24 bp, Homo sapiens
gggacccagctactctgtccaggc

SEQ ID NO: 2098193 - DNA, 20 bp, Homo sapiens
gggacccatagatcttctga

SEQ ID NO: 2098194 - DNA, 18 bp, Homo sapiens
gggaccccctggccctgc

SEQ ID NO: 2098195 - DNA, 16 bp, Homo sapiens
gggacccgaagcccag

SEQ ID NO: 2098196 - DNA, 21 bp, Homo sapiens
gggaccgctacaccactctgg

SEQ ID NO: 2098197 - DNA, 13 bp, Homo sapiens
gggaccttagaaa

SEQ ID NO: 2098198 - DNA, 17 bp, Homo sapiens
gggacgcgcacacacac

SEQ ID NO: 2098199 - DNA, 13 bp, Homo sapiens
gggacgcgggctg

SEQ ID NO: 2098200 - DNA, 23 bp, Homo sapiens
gggacgcttccagaccacctgcc

SEQ ID NO: 2098201 - DNA, 20 bp, Homo sapiens
gggactcaagggtccagaag

SEQ ID NO: 2098202 - DNA, 15 bp, Homo sapiens
gggactgtcgctgct

SEQ ID NO: 2098203 - DNA, 17 bp, Homo sapiens
gggactgtcgctgcttc

SEQ ID NO: 2098204 - DNA, 14 bp, Homo sapiens
gggacttgtgccag

SEQ ID NO: 2098205 - DNA, 14 bp, Homo sapiens
gggagaacctcagg

SEQ ID NO: 2098206 - DNA, 13 bp, Homo sapiens
gggagaagggcca

SEQ ID NO: 2098207 - DNA, 23 bp, Homo sapiens
gggagacatattcttggagaact

SEQ ID NO: 2098208 - DNA, 9 bp, Homo sapiens
gggagacct

SEQ ID NO: 2098209 - DNA, 13 bp, Homo sapiens
gggagagaccctt

SEQ ID NO: 2098210 - DNA, 15 bp, Homo sapiens
gggagagccagctct

SEQ ID NO: 2098211 - DNA, 13 bp, Homo sapiens
gggagaggggaga

SEQ ID NO: 2098212 - DNA, 15 bp, Homo sapiens
gggagagggtctgga

SEQ ID NO: 2098213 - DNA, 21 bp, Homo sapiens
gggagagttgaccgttttcat

SEQ ID NO: 2098214 - DNA, 13 bp, Homo sapiens
gggagatactctc

SEQ ID NO: 2098215 - DNA, 14 bp, Homo sapiens
gggagatggtcagt

SEQ ID NO: 2098216 - DNA, 15 bp, Homo sapiens
gggagatggtcagtg

SEQ ID NO: 2098217 - DNA, 16 bp, Homo sapiens
gggagcactggagtgc

SEQ ID NO: 2098218 - DNA, 21 bp, Homo sapiens
gggagcagagtataggatgga

SEQ ID NO: 2098219 - DNA, 14 bp, Homo sapiens
gggagcaggtctct

SEQ ID NO: 2098220 - DNA, 19 bp, Homo sapiens
gggagcaggtctctggcag

SEQ ID NO: 2098221 - DNA, 11 bp, Homo sapiens
gggagcagtgt

SEQ ID NO: 2098222 - DNA, 14 bp, Homo sapiens
gggagccaacagca

SEQ ID NO: 2098223 - DNA, 12 bp, Homo sapiens
gggagctctgca

SEQ ID NO: 2098224 - DNA, 14 bp, Homo sapiens
gggagctggaaata

SEQ ID NO: 2098225 - DNA, 15 bp, Homo sapiens
gggagctggaaataa

SEQ ID NO: 2098226 - DNA, 11 bp, Homo sapiens
gggaggaaggg

SEQ ID NO: 2098227 - DNA, 15 bp, Homo sapiens
gggaggaagggccag

SEQ ID NO: 2098228 - DNA, 15 bp, Homo sapiens
gggaggacatcataa

SEQ ID NO: 2098229 - DNA, 22 bp, Homo sapiens
gggaggatcactggagcccagg

SEQ ID NO: 2098230 - DNA, 23 bp, Homo sapiens
gggaggatcactggagcccagga

SEQ ID NO: 2098231 - DNA, 16 bp, Homo sapiens
gggaggatgccacagc

SEQ ID NO: 2098232 - DNA, 20 bp, Homo sapiens
gggaggatgccacagcccca

SEQ ID NO: 2098233 - DNA, 14 bp, Homo sapiens
gggaggcagctcca

SEQ ID NO: 2098234 - DNA, 14 bp, Homo sapiens
gggaggccaaggca

SEQ ID NO: 2098235 - DNA, 16 bp, Homo sapiens
gggaggccaaggcagg

SEQ ID NO: 2098236 - DNA, 19 bp, Homo sapiens
gggaggcccctcctgccca

SEQ ID NO: 2098237 - DNA, 21 bp, Homo sapiens
gggaggcctcgtaccagccag

SEQ ID NO: 2098238 - DNA, 17 bp, Homo sapiens
gggaggctgaggcagga

SEQ ID NO: 2098239 - DNA, 18 bp, Homo sapiens
gggaggctgaggcggaag

SEQ ID NO: 2098240 - DNA, 16 bp, Homo sapiens
gggagggggctccatg

SEQ ID NO: 2098241 - DNA, 13 bp, Homo sapiens
gggaggggtcctg

SEQ ID NO: 2098242 - DNA, 18 bp, Homo sapiens
gggaggtgagaccacctc

SEQ ID NO: 2098243 - DNA, 19 bp, Homo sapiens
gggaggttcctcgcaggtc

SEQ ID NO: 2098244 - DNA, 19 bp, Homo sapiens
gggagtgagacagaagtaa

SEQ ID NO: 2098245 - DNA, 14 bp, Homo sapiens
gggagtgagctggt

SEQ ID NO: 2098246 - DNA, 18 bp, Homo sapiens
gggagttgctcactcagg

SEQ ID NO: 2098247 - DNA, 17 bp, Homo sapiens
gggataacagaggcagg

SEQ ID NO: 2098248 - DNA, 13 bp, Homo sapiens
ggggttggatggg

SEQ ID NO: 2098249 - DNA, 14 bp, Homo sapiens
ggggttggatggga

SEQ ID NO: 2098250 - DNA, 17 bp, Homo sapiens
ggggttgtgaggcctgg

SEQ ID NO: 2098251 - DNA, 18 bp, Homo sapiens
gggtaagccagagcctgg

SEQ ID NO: 2098252 - DNA, 19 bp, Homo sapiens
gggtacatttctctgagca

SEQ ID NO: 2098253 - DNA, 19 bp, Homo sapiens
gggtaccatggacggcccc

SEQ ID NO: 2098254 - DNA, 22 bp, Homo sapiens
gggtacttgtggacacagctct

SEQ ID NO: 2098255 - DNA, 16 bp, Homo sapiens
gggtcaccaccctccc

SEQ ID NO: 2098256 - DNA, 14 bp, Homo sapiens
gggtcagggcagta

SEQ ID NO: 2098257 - DNA, 20 bp, Homo sapiens
gggtccaggaaggcagctgc

SEQ ID NO: 2098258 - DNA, 17 bp, Homo sapiens
gggtccccagctcccca

SEQ ID NO: 2098259 - DNA, 18 bp, Homo sapiens
gggtccccagctccccag

SEQ ID NO: 2098260 - DNA, 19 bp, Homo sapiens
gggtccccagctccccagg

SEQ ID NO: 2098261 - DNA, 22 bp, Homo sapiens
gggtccccatcatcccagctgc

SEQ ID NO: 2098262 - DNA, 22 bp, Homo sapiens
gggtccgcaccagctgctctgc

SEQ ID NO: 2098263 - DNA, 14 bp, Homo sapiens
gggtcctagcccag

SEQ ID NO: 2098264 - DNA, 13 bp, Homo sapiens
gggtcctgcaatt

SEQ ID NO: 2098265 - DNA, 20 bp, Homo sapiens
gggtcgccacacccggctcc

SEQ ID NO: 2098266 - DNA, 18 bp, Homo sapiens
gggtcgtggagagctagg

SEQ ID NO: 2098267 - DNA, 12 bp, Homo sapiens
gggtctcactct

SEQ ID NO: 2098268 - DNA, 15 bp, Homo sapiens
gggtctccctctcct

SEQ ID NO: 2098269 - DNA, 15 bp, Homo sapiens
gggtctgtgctgtgc

SEQ ID NO: 2098270 - DNA, 17 bp, Homo sapiens
gggtcttgggctactgg

SEQ ID NO: 2098271 - DNA, 21 bp, Homo sapiens
gggtcttgggctactggcagc

SEQ ID NO: 2098272 - DNA, 18 bp, Homo sapiens
gggtgatatggacagcag

SEQ ID NO: 2098273 - DNA, 14 bp, Homo sapiens
gggtgatgagggca

SEQ ID NO: 2098274 - DNA, 19 bp, Homo sapiens
gggtgatgagggcagcagc

SEQ ID NO: 2098275 - DNA, 16 bp, Homo sapiens
gggtgatttcagagag

SEQ ID NO: 2098276 - DNA, 22 bp, Homo sapiens
gggtgatttcagagagggcaga

SEQ ID NO: 2098277 - DNA, 15 bp, Homo sapiens
gggtgcatggcttgg

SEQ ID NO: 2098278 - DNA, 19 bp, Homo sapiens
gggtgccatgtggagtgga

SEQ ID NO: 2098279 - DNA, 21 bp, Homo sapiens
gggtgccccccttgccagaca

SEQ ID NO: 2098280 - DNA, 19 bp, Homo sapiens
gggtgcctcagagcaggct

SEQ ID NO: 2098281 - DNA, 23 bp, Homo sapiens
gggtgcgagagaggtgggcagca

SEQ ID NO: 2098282 - DNA, 22 bp, Homo sapiens
gggtggaggaaggtgctgagct

SEQ ID NO: 2098283 - DNA, 15 bp, Homo sapiens
gggtggcaagggggc

SEQ ID NO: 2098284 - DNA, 18 bp, Homo sapiens
gggtggcacctcctgaga

SEQ ID NO: 2098285 - DNA, 23 bp, Homo sapiens
gggtggcaggcacacagcagccc

SEQ ID NO: 2098286 - DNA, 13 bp, Homo sapiens
gggtggccatccc

SEQ ID NO: 2098287 - DNA, 11 bp, Homo sapiens
gggtggctcct

SEQ ID NO: 2098288 - DNA, 14 bp, Homo sapiens
gggtggctcctgcc

SEQ ID NO: 2098289 - DNA, 15 bp, Homo sapiens
gggtggctcctgcca

SEQ ID NO: 2098290 - DNA, 20 bp, Homo sapiens
gggtggctcctgccactgac

SEQ ID NO: 2098291 - DNA, 19 bp, Homo sapiens
gggtgggagagcccagcca

SEQ ID NO: 2098292 - DNA, 17 bp, Homo sapiens
gggtgggatggaggaga

SEQ ID NO: 2098293 - DNA, 19 bp, Homo sapiens
gggtgggcctggcctgagc

SEQ ID NO: 2098294 - DNA, 23 bp, Homo sapiens
gggtgggcctggcctgagctggg

SEQ ID NO: 2098295 - DNA, 22 bp, Homo sapiens
gggtggggaatgtttgggcaga

SEQ ID NO: 2098296 - DNA, 21 bp, Homo sapiens
gggtggtctgagcaccccctc

SEQ ID NO: 2098297 - DNA, 12 bp, Homo sapiens
gggtggtgacct

SEQ ID NO: 2098298 - DNA, 16 bp, Homo sapiens
gggtggtgggtgctgg

SEQ ID NO: 2098299 - DNA, 13 bp, Homo sapiens
gggtgtgcccttg

SEQ ID NO: 2098300 - DNA, 16 bp, Homo sapiens
gggtgtgcctgccctg

SEQ ID NO: 2098301 - DNA, 11 bp, Homo sapiens
gggtgtggcct

SEQ ID NO: 2098302 - DNA, 18 bp, Homo sapiens
gggtgtggcctcagccct

SEQ ID NO: 2098303 - DNA, 23 bp, Homo sapiens
gggttatttttgtccctgctcct

SEQ ID NO: 2098304 - DNA, 22 bp, Homo sapiens
gggttcaagcgattcttctgct

SEQ ID NO: 2098305 - DNA, 18 bp, Homo sapiens
gggttcactagagctggg

SEQ ID NO: 2098306 - DNA, 19 bp, Homo sapiens
gggttcactagagctggga

SEQ ID NO: 2098307 - DNA, 19 bp, Homo sapiens
gggttcagagactcagggc

SEQ ID NO: 2098308 - DNA, 13 bp, Homo sapiens
gggttcagcccct

SEQ ID NO: 2098309 - DNA, 19 bp, Homo sapiens
gggttcagcccctcctctg

SEQ ID NO: 2098310 - DNA, 14 bp, Homo sapiens
gggttcctcttccc

SEQ ID NO: 2098311 - DNA, 14 bp, Homo sapiens
gggttctttcttcc

SEQ ID NO: 2098312 - DNA, 19 bp, Homo sapiens
gggttctttggaaggagtg

SEQ ID NO: 2098313 - DNA, 18 bp, Homo sapiens
gggttgaaggcagtctga

SEQ ID NO: 2098314 - DNA, 22 bp, Homo sapiens
gggttgaaggcagtctgaaccc

SEQ ID NO: 2098315 - DNA, 15 bp, Homo sapiens
gggttgcgggggagc

SEQ ID NO: 2098316 - DNA, 20 bp, Homo sapiens
gggttgcgggggagctggaa

SEQ ID NO: 2098317 - DNA, 20 bp, Homo sapiens
gggttggtgggctggcccag

SEQ ID NO: 2098318 - DNA, 15 bp, Homo sapiens
gggttgtactattgt

SEQ ID NO: 2098319 - DNA, 23 bp, Homo sapiens
gggttgtgaggcctggccaggca

SEQ ID NO: 2098320 - DNA, 20 bp, Homo sapiens
gggtttacccagtgggacag

SEQ ID NO: 2098321 - DNA, 21 bp, Homo sapiens
gggtttcattgtgtgttagca

SEQ ID NO: 2098322 - DNA, 13 bp, Homo sapiens
gggttttatcagt

SEQ ID NO: 2098323 - DNA, 23 bp, Homo sapiens
gggtttttaatctttgtgacagg

SEQ ID NO: 2098324 - DNA, 20 bp, Homo sapiens
ggtaaataccaagtatttat

SEQ ID NO: 2098325 - DNA, 13 bp, Homo sapiens
ggtaacaggcaga

SEQ ID NO: 2098326 - DNA, 20 bp, Homo sapiens
ggtaacaggcagatacagga

SEQ ID NO: 2098327 - DNA, 11 bp, Homo sapiens
ggtaagggaga

SEQ ID NO: 2098328 - DNA, 17 bp, Homo sapiens
ggtaagggagagggagg

SEQ ID NO: 2098329 - DNA, 13 bp, Homo sapiens
ggtaaggtgcctt

SEQ ID NO: 2098330 - DNA, 15 bp, Homo sapiens
ggtaataaacttaga

SEQ ID NO: 2098331 - DNA, 12 bp, Homo sapiens
ggtaattgaatg

SEQ ID NO: 2098332 - DNA, 22 bp, Homo sapiens
ggtacagcaacaggaatctcag

SEQ ID NO: 2098333 - DNA, 11 bp, Homo sapiens
ggtacagcagg

SEQ ID NO: 2098334 - DNA, 13 bp, Homo sapiens
ggtacagcagggt

SEQ ID NO: 2098335 - DNA, 14 bp, Homo sapiens
ggtacatttctctg

SEQ ID NO: 2098336 - DNA, 17 bp, Homo sapiens
ggtaccagctcactccc

SEQ ID NO: 2098337 - DNA, 19 bp, Homo sapiens
ggtaccagctcactccctg

SEQ ID NO: 2098338 - DNA, 14 bp, Homo sapiens
ggtacctcagtttc

SEQ ID NO: 2098339 - DNA, 20 bp, Homo sapiens
ggtacctcagtttctccttt

SEQ ID NO: 2098340 - DNA, 23 bp, Homo sapiens
ggtactactgctgcaaagtgcaa

SEQ ID NO: 2098341 - DNA, 21 bp, Homo sapiens
ggtacttcctcctgatggcca

SEQ ID NO: 2098342 - DNA, 16 bp, Homo sapiens
ggtacttgtggacaca

SEQ ID NO: 2098343 - DNA, 22 bp, Homo sapiens
ggtacttgtggacacagctctt

SEQ ID NO: 2098344 - DNA, 18 bp, Homo sapiens
ggtagaattgggaagctg

SEQ ID NO: 2098345 - DNA, 23 bp, Homo sapiens
ggtagaattgggaagctggggga

SEQ ID NO: 2098346 - DNA, 11 bp, Homo sapiens
ggtagagatgt

SEQ ID NO: 2098347 - DNA, 14 bp, Homo sapiens
ggtagagatgtgtg

SEQ ID NO: 2098348 - DNA, 20 bp, Homo sapiens
ggtagatcgcttgagcccag

SEQ ID NO: 2098349 - DNA, 22 bp, Homo sapiens
ggtagatcgcttgagcccagga

SEQ ID NO: 2098350 - DNA, 15 bp, Homo sapiens
ggtagcgagctgctc

SEQ ID NO: 2098351 - DNA, 19 bp, Homo sapiens
ggtagcgagctgctctgct

SEQ ID NO: 2098352 - DNA, 14 bp, Homo sapiens
ggtagcttttccct

SEQ ID NO: 2098353 - DNA, 14 bp, Homo sapiens
ggtaggcagagcct

SEQ ID NO: 2098354 - DNA, 22 bp, Homo sapiens
ggtaggccaagctgaagtgaag

SEQ ID NO: 2098355 - DNA, 23 bp, Homo sapiens
ggtaggccaagctgaagtgaagg

SEQ ID NO: 2098356 - DNA, 20 bp, Homo sapiens
ggtaggcccttgtcctgcca

SEQ ID NO: 2098357 - DNA, 22 bp, Homo sapiens
ggtaggcccttgtcctgccagc

SEQ ID NO: 2098358 - DNA, 19 bp, Homo sapiens
ggtaggggagggtggggca

SEQ ID NO: 2098359 - DNA, 22 bp, Homo sapiens
ggtatatcattataactgaagg

SEQ ID NO: 2098360 - DNA, 15 bp, Homo sapiens
ggtatcaagaaagtc

SEQ ID NO: 2098361 - DNA, 15 bp, Homo sapiens
ggtatcaggcacagg

SEQ ID NO: 2098362 - DNA, 13 bp, Homo sapiens
ggtgtttatacag

SEQ ID NO: 2098363 - DNA, 19 bp, Homo sapiens
ggttaaaatataaattaag

SEQ ID NO: 2098364 - DNA, 16 bp, Homo sapiens
ggttaagccctgaggg

SEQ ID NO: 2098365 - DNA, 15 bp, Homo sapiens
ggttagggaggggta

SEQ ID NO: 2098366 - DNA, 13 bp, Homo sapiens
ggttatctgcctg

SEQ ID NO: 2098367 - DNA, 14 bp, Homo sapiens
ggttatctgcctgg

SEQ ID NO: 2098368 - DNA, 17 bp, Homo sapiens
ggttatttttgtccctg

SEQ ID NO: 2098369 - DNA, 19 bp, Homo sapiens
ggttatttttgtccctgct

SEQ ID NO: 2098370 - DNA, 14 bp, Homo sapiens
ggttcaccttgccg

SEQ ID NO: 2098371 - DNA, 17 bp, Homo sapiens
ggttcactagagctggg

SEQ ID NO: 2098372 - DNA, 14 bp, Homo sapiens
ggttcagcccctcc

SEQ ID NO: 2098373 - DNA, 21 bp, Homo sapiens
ggttcagcccctcctctgcca

SEQ ID NO: 2098374 - DNA, 22 bp, Homo sapiens
ggttcagcccctcctctgccac

SEQ ID NO: 2098375 - DNA, 21 bp, Homo sapiens
ggttcagggttggcccctgcc

SEQ ID NO: 2098376 - DNA, 22 bp, Homo sapiens
ggttcagggttggcccctgccc

SEQ ID NO: 2098377 - DNA, 15 bp, Homo sapiens
ggttcatctgagcaa

SEQ ID NO: 2098378 - DNA, 17 bp, Homo sapiens
ggttcccccagacagag

SEQ ID NO: 2098379 - DNA, 13 bp, Homo sapiens
ggttccctctgag

SEQ ID NO: 2098380 - DNA, 14 bp, Homo sapiens
ggttctggggagga

SEQ ID NO: 2098381 - DNA, 17 bp, Homo sapiens
ggttctttcttcctctg

SEQ ID NO: 2098382 - DNA, 17 bp, Homo sapiens
ggttctttggaaggagt

SEQ ID NO: 2098383 - DNA, 14 bp, Homo sapiens
ggttgaagcaccaa

SEQ ID NO: 2098384 - DNA, 21 bp, Homo sapiens
ggttgcgggggagctggaaat

SEQ ID NO: 2098385 - DNA, 19 bp, Homo sapiens
ggttgcttaaaagggacag

SEQ ID NO: 2098386 - DNA, 19 bp, Homo sapiens
ggttgcttcaccttggagc

SEQ ID NO: 2098387 - DNA, 22 bp, Homo sapiens
ggttggccgtggtccagctctt

SEQ ID NO: 2098388 - DNA, 15 bp, Homo sapiens
ggttggtgggctggc

SEQ ID NO: 2098389 - DNA, 19 bp, Homo sapiens
ggttggtgggctggcccag

SEQ ID NO: 2098390 - DNA, 20 bp, Homo sapiens
ggttgtaaatgctcgtgtga

SEQ ID NO: 2098391 - DNA, 10 bp, Homo sapiens
ggttgtcaat

SEQ ID NO: 2098392 - DNA, 14 bp, Homo sapiens
ggttgtgaggcctg

SEQ ID NO: 2098393 - DNA, 13 bp, Homo sapiens
ggtttaatgtttt

SEQ ID NO: 2098394 - DNA, 18 bp, Homo sapiens
ggtttagtgttctgtatt

SEQ ID NO: 2098395 - DNA, 20 bp, Homo sapiens
ggtttctcagaatccaaaga

SEQ ID NO: 2098396 - DNA, 22 bp, Homo sapiens
ggtttcttggggtcccagggaa

SEQ ID NO: 2098397 - DNA, 12 bp, Homo sapiens
ggtttgaaagcc

SEQ ID NO: 2098398 - DNA, 11 bp, Homo sapiens
ggtttgcagtt

SEQ ID NO: 2098399 - DNA, 13 bp, Homo sapiens
ggtttgccctgcc

SEQ ID NO: 2098400 - DNA, 17 bp, Homo sapiens
ggtttgtcatatattca

SEQ ID NO: 2098401 - DNA, 14 bp, Homo sapiens
ggtttgtgtggatg

SEQ ID NO: 2098402 - DNA, 19 bp, Homo sapiens
ggttttattgtttaaaatc

SEQ ID NO: 2098403 - DNA, 16 bp, Homo sapiens
ggttttctaactgtaa

SEQ ID NO: 2098404 - DNA, 17 bp, Homo sapiens
ggttttctaactgtaaa

SEQ ID NO: 2098405 - DNA, 20 bp, Homo sapiens
ggttttctaactgtaaatca

SEQ ID NO: 2098406 - DNA, 23 bp, Homo sapiens
ggttttgccatgttggccaggct

SEQ ID NO: 2098407 - DNA, 17 bp, Homo sapiens
ggttttggagtcagtag

SEQ ID NO: 2098408 - DNA, 21 bp, Homo sapiens
ggtttttaatctttgtgacag

SEQ ID NO: 2098409 - DNA, 21 bp, Homo sapiens
ggtttttatttctcgggtgca

SEQ ID NO: 2098410 - DNA, 17 bp, Homo sapiens
gtaaaaaattaaagccc

SEQ ID NO: 2098411 - DNA, 13 bp, Homo sapiens
gtaaaaacaaaaa

SEQ ID NO: 2098412 - DNA, 19 bp, Homo sapiens
gtaaaaacaaaaagacagt

SEQ ID NO: 2098413 - DNA, 20 bp, Homo sapiens
gtaaaacaaaaatgtaatga

SEQ ID NO: 2098414 - DNA, 18 bp, Homo sapiens
gtaaaacatttattttga

SEQ ID NO: 2098415 - DNA, 23 bp, Homo sapiens
gtaaaaccacagcagttgaaaag

SEQ ID NO: 2098416 - DNA, 12 bp, Homo sapiens
gtaaaagcaaaa

SEQ ID NO: 2098417 - DNA, 20 bp, Homo sapiens
gtaaaatatctacctgccct

SEQ ID NO: 2098418 - DNA, 18 bp, Homo sapiens
gtaaaatgcagtccagaa

SEQ ID NO: 2098419 - DNA, 15 bp, Homo sapiens
gtaaaattgtataga

SEQ ID NO: 2098420 - DNA, 13 bp, Homo sapiens
gtaaacagtgcct

SEQ ID NO: 2098421 - DNA, 17 bp, Homo sapiens
gtaaacagtgcctgctg

SEQ ID NO: 2098422 - DNA, 18 bp, Homo sapiens
gtaaacagtgcctgctga

SEQ ID NO: 2098423 - DNA, 20 bp, Homo sapiens
gtaaaccctatctgtgattc

SEQ ID NO: 2098424 - DNA, 15 bp, Homo sapiens
gtaaactataaacta

SEQ ID NO: 2098425 - DNA, 15 bp, Homo sapiens
gtaaactcaaaactt

SEQ ID NO: 2098426 - DNA, 15 bp, Homo sapiens
gtaaagaataaatga

SEQ ID NO: 2098427 - DNA, 16 bp, Homo sapiens
gtaaagcttgtctgat

SEQ ID NO: 2098428 - DNA, 21 bp, Homo sapiens
gtaaagtatgtaaacaggaga

SEQ ID NO: 2098429 - DNA, 20 bp, Homo sapiens
gtaaagtttaaaaaatacac

SEQ ID NO: 2098430 - DNA, 16 bp, Homo sapiens
gtaaagtttatttcat

SEQ ID NO: 2098431 - DNA, 20 bp, Homo sapiens
gtaaagtttcccctctattt

SEQ ID NO: 2098432 - DNA, 14 bp, Homo sapiens
gtaaatacaaaata

SEQ ID NO: 2098433 - DNA, 22 bp, Homo sapiens
gtaaatacaaaataaaattatg

SEQ ID NO: 2098434 - DNA, 12 bp, Homo sapiens
gtaaatacacca

SEQ ID NO: 2098435 - DNA, 14 bp, Homo sapiens
gtaaatacatgtgt

SEQ ID NO: 2098436 - DNA, 13 bp, Homo sapiens
gtaaatatagtag

SEQ ID NO: 2098437 - DNA, 19 bp, Homo sapiens
gtaaatatgtttgtgcctt

SEQ ID NO: 2098438 - DNA, 11 bp, Homo sapiens
gtaaatattta

SEQ ID NO: 2098439 - DNA, 21 bp, Homo sapiens
gtaaatcacgctttttgaaaa

SEQ ID NO: 2098440 - DNA, 13 bp, Homo sapiens
gtaaatcacttgt

SEQ ID NO: 2098441 - DNA, 14 bp, Homo sapiens
gtaaatcacttgta

SEQ ID NO: 2098442 - DNA, 16 bp, Homo sapiens
gtaaatcacttgtaaa

SEQ ID NO: 2098443 - DNA, 17 bp, Homo sapiens
gtaaatcacttgtaaat

SEQ ID NO: 2098444 - DNA, 23 bp, Homo sapiens
gtaaatcacttgtaaataaatag

SEQ ID NO: 2098445 - DNA, 15 bp, Homo sapiens
gtaaatcctttttct

SEQ ID NO: 2098446 - DNA, 22 bp, Homo sapiens
gtaaatcctttttctttataaa

SEQ ID NO: 2098447 - DNA, 23 bp, Homo sapiens
gtaaatgcagccttcttttcaaa

SEQ ID NO: 2098448 - DNA, 19 bp, Homo sapiens
gtaaatgctcgtgtgattt

SEQ ID NO: 2098449 - DNA, 14 bp, Homo sapiens
gtaaattggaaaca

SEQ ID NO: 2098450 - DNA, 16 bp, Homo sapiens
gtaaattggaaacatt

SEQ ID NO: 2098451 - DNA, 14 bp, Homo sapiens
gtaaatttggattt

SEQ ID NO: 2098452 - DNA, 12 bp, Homo sapiens
gtaaattttaga

SEQ ID NO: 2098453 - DNA, 18 bp, Homo sapiens
gtaaattttgtatgaaaa

SEQ ID NO: 2098454 - DNA, 23 bp, Homo sapiens
gtaacaagccagattttttaaaa

SEQ ID NO: 2098455 - DNA, 15 bp, Homo sapiens
gtaacaaggtgtctt

SEQ ID NO: 2098456 - DNA, 22 bp, Homo sapiens
gtaacacagctgagagactttt

SEQ ID NO: 2098457 - DNA, 12 bp, Homo sapiens
gtaacaggcaga

SEQ ID NO: 2098458 - DNA, 11 bp, Homo sapiens
gtaacatcctt

SEQ ID NO: 2098459 - DNA, 13 bp, Homo sapiens
gtaacatcctttc

SEQ ID NO: 2098460 - DNA, 17 bp, Homo sapiens
gtaacatcctttctatt

SEQ ID NO: 2098461 - DNA, 18 bp, Homo sapiens
gtaacatgccagcttcct

SEQ ID NO: 2098462 - DNA, 15 bp, Homo sapiens
gtaaccaagagtatt

SEQ ID NO: 2098463 - DNA, 18 bp, Homo sapiens
gtaactactttttatact

SEQ ID NO: 2098464 - DNA, 20 bp, Homo sapiens
gtaactactttttatactcc

SEQ ID NO: 2098465 - DNA, 23 bp, Homo sapiens
gtaactactttttatactccata

SEQ ID NO: 2098466 - DNA, 15 bp, Homo sapiens
gtaactcatctgtca

SEQ ID NO: 2098467 - DNA, 12 bp, Homo sapiens
gtaactccacca

SEQ ID NO: 2098468 - DNA, 17 bp, Homo sapiens
gtaactccaccaaccca

SEQ ID NO: 2098469 - DNA, 19 bp, Homo sapiens
gtaactctaattcccattt

SEQ ID NO: 2098470 - DNA, 14 bp, Homo sapiens
gtaactgctgagcc

SEQ ID NO: 2098471 - DNA, 15 bp, Homo sapiens
gtaactgctgagcca

SEQ ID NO: 2098472 - DNA, 18 bp, Homo sapiens
gtaactgctgagccactc

SEQ ID NO: 2098473 - DNA, 18 bp, Homo sapiens
gtaacttttacaaaacat

SEQ ID NO: 2098474 - DNA, 15 bp, Homo sapiens
gtaagacaaaggttt

SEQ ID NO: 2098475 - DNA, 21 bp, Homo sapiens
gtaagcattctgagctgggct

SEQ ID NO: 2098476 - DNA, 15 bp, Homo sapiens
gtaagccagagcctg

SEQ ID NO: 2098477 - DNA, 16 bp, Homo sapiens
gtatatatgtgtgttt

SEQ ID NO: 2098478 - DNA, 14 bp, Homo sapiens
gtatatattctaca

SEQ ID NO: 2098479 - DNA, 18 bp, Homo sapiens
gtatatgatctaatacaa

SEQ ID NO: 2098480 - DNA, 14 bp, Homo sapiens
gtatatgtatatat

SEQ ID NO: 2098481 - DNA, 13 bp, Homo sapiens
gtatatgtctcag

SEQ ID NO: 2098482 - DNA, 15 bp, Homo sapiens
gtatatgttgtaata

SEQ ID NO: 2098483 - DNA, 18 bp, Homo sapiens
gtatatgttgtaataaaa

SEQ ID NO: 2098484 - DNA, 23 bp, Homo sapiens
gtatattatgtatttatattttg

SEQ ID NO: 2098485 - DNA, 13 bp, Homo sapiens
gtatattctggaa

SEQ ID NO: 2098486 - DNA, 13 bp, Homo sapiens
gtatatttatagt

SEQ ID NO: 2098487 - DNA, 19 bp, Homo sapiens
gtatatttgtgtatgtgta

SEQ ID NO: 2098488 - DNA, 13 bp, Homo sapiens
gtatcaaatctgt

SEQ ID NO: 2098489 - DNA, 19 bp, Homo sapiens
gtatcaataccaaatagct

SEQ ID NO: 2098490 - DNA, 18 bp, Homo sapiens
gtatcaatccttgttcag

SEQ ID NO: 2098491 - DNA, 17 bp, Homo sapiens
gtatcatttctaatttt

SEQ ID NO: 2098492 - DNA, 15 bp, Homo sapiens
gtatccaattatgtg

SEQ ID NO: 2098493 - DNA, 19 bp, Homo sapiens
gtatccactttgcacagct

SEQ ID NO: 2098494 - DNA, 20 bp, Homo sapiens
gtatccagtgatgtgctgga

SEQ ID NO: 2098495 - DNA, 19 bp, Homo sapiens
gtatcccaactcctataat

SEQ ID NO: 2098496 - DNA, 15 bp, Homo sapiens
gtatcggagacagtg

SEQ ID NO: 2098497 - DNA, 17 bp, Homo sapiens
gtatcggagacagtgat

SEQ ID NO: 2098498 - DNA, 14 bp, Homo sapiens
gtatctccaggatt

SEQ ID NO: 2098499 - DNA, 17 bp, Homo sapiens
gtatctctgaagcatgt

SEQ ID NO: 2098500 - DNA, 19 bp, Homo sapiens
gtatctctgaagcatgttt

SEQ ID NO: 2098501 - DNA, 14 bp, Homo sapiens
gtatctgaaggaga

SEQ ID NO: 2098502 - DNA, 20 bp, Homo sapiens
gtatcttacctgtaaagtct

SEQ ID NO: 2098503 - DNA, 18 bp, Homo sapiens
gtatcttatttatatatg

SEQ ID NO: 2098504 - DNA, 23 bp, Homo sapiens
gtatgaacttgaggacacatgtc

SEQ ID NO: 2098505 - DNA, 14 bp, Homo sapiens
gtatgagctgaggg

SEQ ID NO: 2098506 - DNA, 16 bp, Homo sapiens
gtatgagtaggtttgg

SEQ ID NO: 2098507 - DNA, 21 bp, Homo sapiens
gtatgatcacggctcactgca

SEQ ID NO: 2098508 - DNA, 16 bp, Homo sapiens
gtatgatgtgttgtga

SEQ ID NO: 2098509 - DNA, 17 bp, Homo sapiens
gtatgatgtgttgtgat

SEQ ID NO: 2098510 - DNA, 20 bp, Homo sapiens
gtatgcaagaagaatataaa

SEQ ID NO: 2098511 - DNA, 13 bp, Homo sapiens
gtatgctggccag

SEQ ID NO: 2098512 - DNA, 15 bp, Homo sapiens
gtatgctggccagca

SEQ ID NO: 2098513 - DNA, 18 bp, Homo sapiens
gtatgctggccagcaccc

SEQ ID NO: 2098514 - DNA, 19 bp, Homo sapiens
gtatgctggccagcaccct

SEQ ID NO: 2098515 - DNA, 20 bp, Homo sapiens
gtatgctggccagcaccctc

SEQ ID NO: 2098516 - DNA, 23 bp, Homo sapiens
gtatgctggccagcaccctctcc

SEQ ID NO: 2098517 - DNA, 17 bp, Homo sapiens
gtatgctgttttaataa

SEQ ID NO: 2098518 - DNA, 17 bp, Homo sapiens
gtatggaagggaggggt

SEQ ID NO: 2098519 - DNA, 18 bp, Homo sapiens
gtatggaagggaggggtc

SEQ ID NO: 2098520 - DNA, 14 bp, Homo sapiens
gtatgggaagccat

SEQ ID NO: 2098521 - DNA, 23 bp, Homo sapiens
gtatgggaagccatattcacacc

SEQ ID NO: 2098522 - DNA, 13 bp, Homo sapiens
gtatgtatctatt

SEQ ID NO: 2098523 - DNA, 23 bp, Homo sapiens
gtatgtgaaagtgtaaaatagaa

SEQ ID NO: 2098524 - DNA, 20 bp, Homo sapiens
gtatgtgatatctgaacaca

SEQ ID NO: 2098525 - DNA, 16 bp, Homo sapiens
gtatgtgcacatgtgt

SEQ ID NO: 2098526 - DNA, 14 bp, Homo sapiens
gtatgtgtgtatgg

SEQ ID NO: 2098527 - DNA, 15 bp, Homo sapiens
gtatgtgtgtgtatg

SEQ ID NO: 2098528 - DNA, 18 bp, Homo sapiens
gtatgtgtgtgtatgcta

SEQ ID NO: 2098529 - DNA, 19 bp, Homo sapiens
gtatgtttttgtgtatttg

SEQ ID NO: 2098530 - DNA, 15 bp, Homo sapiens
gtattaaagatgtgt

SEQ ID NO: 2098531 - DNA, 16 bp, Homo sapiens
gtattaaagatgtgtt

SEQ ID NO: 2098532 - DNA, 14 bp, Homo sapiens
gtattaaatattta

SEQ ID NO: 2098533 - DNA, 19 bp, Homo sapiens
gtattaagggcattttaaa

SEQ ID NO: 2098534 - DNA, 16 bp, Homo sapiens
gtattaatactaaaat

SEQ ID NO: 2098535 - DNA, 22 bp, Homo sapiens
gtattaatactaaaatatgtct

SEQ ID NO: 2098536 - DNA, 18 bp, Homo sapiens
gtattacatctaatgctt

SEQ ID NO: 2098537 - DNA, 13 bp, Homo sapiens
gtattacttctgc

SEQ ID NO: 2098538 - DNA, 22 bp, Homo sapiens
gtattaggggtaatatattgct

SEQ ID NO: 2098539 - DNA, 23 bp, Homo sapiens
gtattatcacatcaagcatgcaa

SEQ ID NO: 2098540 - DNA, 19 bp, Homo sapiens
gtattatttacaatgcaga

SEQ ID NO: 2098541 - DNA, 21 bp, Homo sapiens
gtattcccttttatttccaaa

SEQ ID NO: 2098542 - DNA, 20 bp, Homo sapiens
gtattccttttgtgtacagt

SEQ ID NO: 2098543 - DNA, 19 bp, Homo sapiens
gtattctaaagctttctga

SEQ ID NO: 2098544 - DNA, 23 bp, Homo sapiens
gtattgcgaatgtgcagaaagca

SEQ ID NO: 2098545 - DNA, 14 bp, Homo sapiens
gtattgtaatgaat

SEQ ID NO: 2098546 - DNA, 23 bp, Homo sapiens
gtattgtccatatcagacctctg

SEQ ID NO: 2098547 - DNA, 19 bp, Homo sapiens
gtatttaaaaccttgattt

SEQ ID NO: 2098548 - DNA, 12 bp, Homo sapiens
gtatttatatat

SEQ ID NO: 2098549 - DNA, 15 bp, Homo sapiens
gtatttatatattta

SEQ ID NO: 2098550 - DNA, 16 bp, Homo sapiens
gtatttatatatttat

SEQ ID NO: 2098551 - DNA, 13 bp, Homo sapiens
gtatttatattag

SEQ ID NO: 2098552 - DNA, 21 bp, Homo sapiens
gtatttatatttggaaagaga

SEQ ID NO: 2098553 - DNA, 23 bp, Homo sapiens
gtatttatatttggaaagagacc

SEQ ID NO: 2098554 - DNA, 18 bp, Homo sapiens
gtatttattgaagaaaca

SEQ ID NO: 2098555 - DNA, 12 bp, Homo sapiens
gtatttattgtc

SEQ ID NO: 2098556 - DNA, 12 bp, Homo sapiens
gtatttcctgct

SEQ ID NO: 2098557 - DNA, 13 bp, Homo sapiens
gtatttcctgcta

SEQ ID NO: 2098558 - DNA, 18 bp, Homo sapiens
gtatttgttaatttagaa

SEQ ID NO: 2098559 - DNA, 22 bp, Homo sapiens
gtattttatctgtgttgtctct

SEQ ID NO: 2098560 - DNA, 12 bp, Homo sapiens
gtattttgagat

SEQ ID NO: 2098561 - DNA, 14 bp, Homo sapiens
gtattttggagaaa

SEQ ID NO: 2098562 - DNA, 13 bp, Homo sapiens
gtcaaaacagatt

SEQ ID NO: 2098563 - DNA, 20 bp, Homo sapiens
gtcaaaacagattgtttgca

SEQ ID NO: 2098564 - DNA, 13 bp, Homo sapiens
gtcaaaagcctgg

SEQ ID NO: 2098565 - DNA, 15 bp, Homo sapiens
gtcaaaagctggatt

SEQ ID NO: 2098566 - DNA, 17 bp, Homo sapiens
gtcaaaatcatgaatat

SEQ ID NO: 2098567 - DNA, 15 bp, Homo sapiens
gtcaaacatgaagtg

SEQ ID NO: 2098568 - DNA, 16 bp, Homo sapiens
gtcaaagaaatgctga

SEQ ID NO: 2098569 - DNA, 13 bp, Homo sapiens
gtcaaagtaaaac

SEQ ID NO: 2098570 - DNA, 14 bp, Homo sapiens
gtcaacactcttct

SEQ ID NO: 2098571 - DNA, 19 bp, Homo sapiens
gtcaacagagaaggcagga

SEQ ID NO: 2098572 - DNA, 17 bp, Homo sapiens
gtcaacagttcaaagaa

SEQ ID NO: 2098573 - DNA, 11 bp, Homo sapiens
gtcaacatctt

SEQ ID NO: 2098574 - DNA, 14 bp, Homo sapiens
gtcaaccaggaaca

SEQ ID NO: 2098575 - DNA, 17 bp, Homo sapiens
gtcaacggccctgttta

SEQ ID NO: 2098576 - DNA, 19 bp, Homo sapiens
gtcaagagggtctgaggaa

SEQ ID NO: 2098577 - DNA, 22 bp, Homo sapiens
gtcaagattttttttgtaactt

SEQ ID NO: 2098578 - DNA, 14 bp, Homo sapiens
gtcaagtataaagt

SEQ ID NO: 2098579 - DNA, 15 bp, Homo sapiens
gtcaatattaaatac

SEQ ID NO: 2098580 - DNA, 18 bp, Homo sapiens
gtcaatattaaatacaga

SEQ ID NO: 2098581 - DNA, 23 bp, Homo sapiens
gtcaatattaaatacagacacta

SEQ ID NO: 2098582 - DNA, 20 bp, Homo sapiens
gtcaatgaaatatttgctta

SEQ ID NO: 2098583 - DNA, 16 bp, Homo sapiens
gtcacacactttggct

SEQ ID NO: 2098584 - DNA, 21 bp, Homo sapiens
gtcacacagtattacttctgc

SEQ ID NO: 2098585 - DNA, 18 bp, Homo sapiens
gtcacactgagctgggca

SEQ ID NO: 2098586 - DNA, 19 bp, Homo sapiens
gtcacactgagctgggcac

SEQ ID NO: 2098587 - DNA, 22 bp, Homo sapiens
gtcacactgttactccacagcg

SEQ ID NO: 2098588 - DNA, 11 bp, Homo sapiens
gtcacagctgc

SEQ ID NO: 2098589 - DNA, 14 bp, Homo sapiens
gtcacagctgcagc

SEQ ID NO: 2098590 - DNA, 16 bp, Homo sapiens
gtcacagctgcagctg

SEQ ID NO: 2098591 - DNA, 21 bp, Homo sapiens
gtcacagctgcagctgggccc

SEQ ID NO: 2098592 - DNA, 16 bp, Homo sapiens
gtctctatttcatttt

SEQ ID NO: 2098593 - DNA, 15 bp, Homo sapiens
gtctctcatgaacct

SEQ ID NO: 2098594 - DNA, 14 bp, Homo sapiens
gtctctccactgct

SEQ ID NO: 2098595 - DNA, 22 bp, Homo sapiens
gtctctcccaccccggcctcca

SEQ ID NO: 2098596 - DNA, 17 bp, Homo sapiens
gtctctctttctccctc

SEQ ID NO: 2098597 - DNA, 19 bp, Homo sapiens
gtctctctttctccctcac

SEQ ID NO: 2098598 - DNA, 20 bp, Homo sapiens
gtctctctttctccctcacc

SEQ ID NO: 2098599 - DNA, 16 bp, Homo sapiens
gtctctgactcttgcc

SEQ ID NO: 2098600 - DNA, 20 bp, Homo sapiens
gtctctgactcttgcctttc

SEQ ID NO: 2098601 - DNA, 15 bp, Homo sapiens
gtctctgctcttgcc

SEQ ID NO: 2098602 - DNA, 16 bp, Homo sapiens
gtctctgctcttgcct

SEQ ID NO: 2098603 - DNA, 12 bp, Homo sapiens
gtctctgctgaa

SEQ ID NO: 2098604 - DNA, 22 bp, Homo sapiens
gtctctgctgcatttgtgtcat

SEQ ID NO: 2098605 - DNA, 17 bp, Homo sapiens
gtctctggcagagaagg

SEQ ID NO: 2098606 - DNA, 20 bp, Homo sapiens
gtctcttgtagaagatggac

SEQ ID NO: 2098607 - DNA, 20 bp, Homo sapiens
gtctctttaatgtcacaggc

SEQ ID NO: 2098608 - DNA, 23 bp, Homo sapiens
gtctctttaatgtcacaggcagg

SEQ ID NO: 2098609 - DNA, 14 bp, Homo sapiens
gtctcttttgttcc

SEQ ID NO: 2098610 - DNA, 22 bp, Homo sapiens
gtctcttttttattctgttttc

SEQ ID NO: 2098611 - DNA, 14 bp, Homo sapiens
gtctgaaaatgttg

SEQ ID NO: 2098612 - DNA, 15 bp, Homo sapiens
gtctgaacccttgtg

SEQ ID NO: 2098613 - DNA, 19 bp, Homo sapiens
gtctgaacccttgtgcttg

SEQ ID NO: 2098614 - DNA, 19 bp, Homo sapiens
gtctgaaggaatagccaga

SEQ ID NO: 2098615 - DNA, 22 bp, Homo sapiens
gtctgaaggaatagccagagag

SEQ ID NO: 2098616 - DNA, 23 bp, Homo sapiens
gtctgaaggaatagccagagagg

SEQ ID NO: 2098617 - DNA, 16 bp, Homo sapiens
gtctgaagtcactgca

SEQ ID NO: 2098618 - DNA, 12 bp, Homo sapiens
gtctgacaggca

SEQ ID NO: 2098619 - DNA, 14 bp, Homo sapiens
gtctgacaggcaat

SEQ ID NO: 2098620 - DNA, 18 bp, Homo sapiens
gtctgacaggcaatgctg

SEQ ID NO: 2098621 - DNA, 22 bp, Homo sapiens
gtctgacaggcaatgctggctg

SEQ ID NO: 2098622 - DNA, 20 bp, Homo sapiens
gtctgactccagagtctgag

SEQ ID NO: 2098623 - DNA, 23 bp, Homo sapiens
gtctgactccagagtctgagccc

SEQ ID NO: 2098624 - DNA, 20 bp, Homo sapiens
gtctgagaatgcccaactct

SEQ ID NO: 2098625 - DNA, 21 bp, Homo sapiens
gtctgaggaatccagacccgg

SEQ ID NO: 2098626 - DNA, 14 bp, Homo sapiens
gtctgaggcctcat

SEQ ID NO: 2098627 - DNA, 18 bp, Homo sapiens
gtctgagtcctgtctctg

SEQ ID NO: 2098628 - DNA, 19 bp, Homo sapiens
gtctgagtcctgtctctgc

SEQ ID NO: 2098629 - DNA, 18 bp, Homo sapiens
gtctgagtctgagtcctg

SEQ ID NO: 2098630 - DNA, 12 bp, Homo sapiens
gtctgatgtttg

SEQ ID NO: 2098631 - DNA, 18 bp, Homo sapiens
gtctgattcccaagctct

SEQ ID NO: 2098632 - DNA, 21 bp, Homo sapiens
gtctgattcccaagctctgct

SEQ ID NO: 2098633 - DNA, 13 bp, Homo sapiens
gtctgcacccagg

SEQ ID NO: 2098634 - DNA, 19 bp, Homo sapiens
gtctgcagcccggcgccac

SEQ ID NO: 2098635 - DNA, 14 bp, Homo sapiens
gtctgcataaactt

SEQ ID NO: 2098636 - DNA, 17 bp, Homo sapiens
gtctgcataaacttcat

SEQ ID NO: 2098637 - DNA, 15 bp, Homo sapiens
gtctgccacagagag

SEQ ID NO: 2098638 - DNA, 18 bp, Homo sapiens
gtctgccaccatcctgct

SEQ ID NO: 2098639 - DNA, 14 bp, Homo sapiens
gtctgccagccagc

SEQ ID NO: 2098640 - DNA, 16 bp, Homo sapiens
gtctgccagccagcag

SEQ ID NO: 2098641 - DNA, 17 bp, Homo sapiens
gtctgccaggcccatct

SEQ ID NO: 2098642 - DNA, 21 bp, Homo sapiens
gtctgccaggcccatctcagg

SEQ ID NO: 2098643 - DNA, 22 bp, Homo sapiens
gtctgccaggcccatctcaggt

SEQ ID NO: 2098644 - DNA, 20 bp, Homo sapiens
gtctgcccccgtcttctctc

SEQ ID NO: 2098645 - DNA, 15 bp, Homo sapiens
gtctgctatattttc

SEQ ID NO: 2098646 - DNA, 18 bp, Homo sapiens
gtctgctatattttcatg

SEQ ID NO: 2098647 - DNA, 12 bp, Homo sapiens
gtctgcttctgt

SEQ ID NO: 2098648 - DNA, 17 bp, Homo sapiens
gtctgcttctgtccagg

SEQ ID NO: 2098649 - DNA, 15 bp, Homo sapiens
gtctggaagctgagc

SEQ ID NO: 2098650 - DNA, 23 bp, Homo sapiens
gtctggataccagatatttgaat

SEQ ID NO: 2098651 - DNA, 19 bp, Homo sapiens
gtctggcagtttatattta

SEQ ID NO: 2098652 - DNA, 21 bp, Homo sapiens
gtctgggagtgttctgtttcc

SEQ ID NO: 2098653 - DNA, 17 bp, Homo sapiens
gtctgggatgtagaact

SEQ ID NO: 2098654 - DNA, 18 bp, Homo sapiens
gtctggggttcagcccct

SEQ ID NO: 2098655 - DNA, 20 bp, Homo sapiens
gtctggggttcagcccctcc

SEQ ID NO: 2098656 - DNA, 11 bp, Homo sapiens
gtctggtgtag

SEQ ID NO: 2098657 - DNA, 19 bp, Homo sapiens
gtctggtgtagctcctctg

SEQ ID NO: 2098658 - DNA, 13 bp, Homo sapiens
gtctggtgttctg

SEQ ID NO: 2098659 - DNA, 13 bp, Homo sapiens
gtctggtttctag

SEQ ID NO: 2098660 - DNA, 21 bp, Homo sapiens
gtctggttttaacaatttcct

SEQ ID NO: 2098661 - DNA, 20 bp, Homo sapiens
gtctgtcaccagctatctgt

SEQ ID NO: 2098662 - DNA, 14 bp, Homo sapiens
gtctgtcctggagg

SEQ ID NO: 2098663 - DNA, 18 bp, Homo sapiens
gtctgtcctggaggtggg

SEQ ID NO: 2098664 - DNA, 12 bp, Homo sapiens
gtctgtgctctt

SEQ ID NO: 2098665 - DNA, 14 bp, Homo sapiens
gtctgtgctgccct

SEQ ID NO: 2098666 - DNA, 15 bp, Homo sapiens
gtctgttgtaaatga

SEQ ID NO: 2098667 - DNA, 12 bp, Homo sapiens
gtcttaaaataa

SEQ ID NO: 2098668 - DNA, 15 bp, Homo sapiens
gtcttaaaataactt

SEQ ID NO: 2098669 - DNA, 23 bp, Homo sapiens
gtcttaagccttttgctcacaaa

SEQ ID NO: 2098670 - DNA, 17 bp, Homo sapiens
gtcttatatagcagcaa

SEQ ID NO: 2098671 - DNA, 17 bp, Homo sapiens
gtcttcactgccatgcc

SEQ ID NO: 2098672 - DNA, 23 bp, Homo sapiens
gtcttcagcctagccgacctcag

SEQ ID NO: 2098673 - DNA, 21 bp, Homo sapiens
gtcttccaaccccagctggcc

SEQ ID NO: 2098674 - DNA, 17 bp, Homo sapiens
gtcttccataatgtata

SEQ ID NO: 2098675 - DNA, 20 bp, Homo sapiens
gtcttcttacttggaactga

SEQ ID NO: 2098676 - DNA, 15 bp, Homo sapiens
gtcttcttggcagct

SEQ ID NO: 2098677 - DNA, 21 bp, Homo sapiens
gtcttgaactcctggcctcaa

SEQ ID NO: 2098678 - DNA, 21 bp, Homo sapiens
gtcttgcaatggcagccttgg

SEQ ID NO: 2098679 - DNA, 23 bp, Homo sapiens
gtcttgcaatggcagccttggca

SEQ ID NO: 2098680 - DNA, 14 bp, Homo sapiens
gtcttgccagccag

SEQ ID NO: 2098681 - DNA, 14 bp, Homo sapiens
gtcttgcctaggcc

SEQ ID NO: 2098682 - DNA, 18 bp, Homo sapiens
gtcttgcctgccagggcc

SEQ ID NO: 2098683 - DNA, 13 bp, Homo sapiens
gtcttgctttgct

SEQ ID NO: 2098684 - DNA, 17 bp, Homo sapiens
gtcttgctttgctgtct

SEQ ID NO: 2098685 - DNA, 15 bp, Homo sapiens
gtcttggacactgta

SEQ ID NO: 2098686 - DNA, 15 bp, Homo sapiens
gtcttggtattctta

SEQ ID NO: 2098687 - DNA, 14 bp, Homo sapiens
gtctttcagcattc

SEQ ID NO: 2098688 - DNA, 21 bp, Homo sapiens
gtctttcaggaccttttgaag

SEQ ID NO: 2098689 - DNA, 22 bp, Homo sapiens
gtctttctattcataataaact

SEQ ID NO: 2098690 - DNA, 23 bp, Homo sapiens
gtctttctattcataataaacta

SEQ ID NO: 2098691 - DNA, 17 bp, Homo sapiens
gtctttgaataaagtct

SEQ ID NO: 2098692 - DNA, 23 bp, Homo sapiens
gtctttgaataaagtctgagtgg

SEQ ID NO: 2098693 - DNA, 13 bp, Homo sapiens
gtctttgcacatg

SEQ ID NO: 2098694 - DNA, 15 bp, Homo sapiens
gtctttggttcagct

SEQ ID NO: 2098695 - DNA, 16 bp, Homo sapiens
gtctttgtaatgtcac

SEQ ID NO: 2098696 - DNA, 23 bp, Homo sapiens
gtctttgtgggagggtaagacaa

SEQ ID NO: 2098697 - DNA, 19 bp, Homo sapiens
gtgaaaataggtatacagt

SEQ ID NO: 2098698 - DNA, 16 bp, Homo sapiens
gtgaaaatgaggagga

SEQ ID NO: 2098699 - DNA, 21 bp, Homo sapiens
gtgaaagagagtaccatgctg

SEQ ID NO: 2098700 - DNA, 20 bp, Homo sapiens
gtgaaagcatcacttgggat

SEQ ID NO: 2098701 - DNA, 12 bp, Homo sapiens
gtgaaagggcta

SEQ ID NO: 2098702 - DNA, 23 bp, Homo sapiens
gtgaaagtatgtgatatctgaac

SEQ ID NO: 2098703 - DNA, 21 bp, Homo sapiens
gtgaaagtcagatgcccagag

SEQ ID NO: 2098704 - DNA, 18 bp, Homo sapiens
gtgaaagtgtaaaataga

SEQ ID NO: 2098705 - DNA, 18 bp, Homo sapiens
gtgaaatcagaagtgcaa

SEQ ID NO: 2098706 - DNA, 22 bp, Homo sapiens
gtgtaaagaataaatgaatctt

SEQ ID NO: 2098707 - DNA, 14 bp, Homo sapiens
gtgtaatgcacaat

SEQ ID NO: 2098708 - DNA, 16 bp, Homo sapiens
gtgtaatgcacaattt

SEQ ID NO: 2098709 - DNA, 12 bp, Homo sapiens
gtgtacagtgtg

SEQ ID NO: 2098710 - DNA, 20 bp, Homo sapiens
gtgtactatggctgtatttt

SEQ ID NO: 2098711 - DNA, 14 bp, Homo sapiens
gtgtagccaaggtc

SEQ ID NO: 2098712 - DNA, 15 bp, Homo sapiens
gtgtagctgtgacct

SEQ ID NO: 2098713 - DNA, 18 bp, Homo sapiens
gtgtagctgtgacctgct

SEQ ID NO: 2098714 - DNA, 21 bp, Homo sapiens
gtgtagctgtgacctgctgag

SEQ ID NO: 2098715 - DNA, 17 bp, Homo sapiens
gtgtagtggaagagcag

SEQ ID NO: 2098716 - DNA, 20 bp, Homo sapiens
gtgtagtggaagagcagcct

SEQ ID NO: 2098717 - DNA, 22 bp, Homo sapiens
gtgtagtggaagagcagcctga

SEQ ID NO: 2098718 - DNA, 16 bp, Homo sapiens
gtgtatatatacatac

SEQ ID NO: 2098719 - DNA, 18 bp, Homo sapiens
gtgtatatatgtgtatat

SEQ ID NO: 2098720 - DNA, 22 bp, Homo sapiens
gtgtatatatgtgtatatatac

SEQ ID NO: 2098721 - DNA, 14 bp, Homo sapiens
gtgtatatgtatgt

SEQ ID NO: 2098722 - DNA, 21 bp, Homo sapiens
gtgtatcccccccctgtatag

SEQ ID NO: 2098723 - DNA, 14 bp, Homo sapiens
gtgtatgatccaag

SEQ ID NO: 2098724 - DNA, 20 bp, Homo sapiens
gtgtatgtatacacacatat

SEQ ID NO: 2098725 - DNA, 20 bp, Homo sapiens
gtgtatttattgaagaaaca

SEQ ID NO: 2098726 - DNA, 19 bp, Homo sapiens
gtgtatttttgtttaatca

SEQ ID NO: 2098727 - DNA, 18 bp, Homo sapiens
gtgtcacactgagctggg

SEQ ID NO: 2098728 - DNA, 14 bp, Homo sapiens
gtgtcaccctgcag

SEQ ID NO: 2098729 - DNA, 17 bp, Homo sapiens
gtgtcaccctgcagagc

SEQ ID NO: 2098730 - DNA, 23 bp, Homo sapiens
gtgtcactactcacagtctcttt

SEQ ID NO: 2098731 - DNA, 14 bp, Homo sapiens
gtgtcaggcaggtt

SEQ ID NO: 2098732 - DNA, 21 bp, Homo sapiens
gtgtcaggcaggtttgccagt

SEQ ID NO: 2098733 - DNA, 14 bp, Homo sapiens
gtgtcaggtggggc

SEQ ID NO: 2098734 - DNA, 19 bp, Homo sapiens
gtgtcatattaaacttctg

SEQ ID NO: 2098735 - DNA, 13 bp, Homo sapiens
gtgtccagcagct

SEQ ID NO: 2098736 - DNA, 19 bp, Homo sapiens
gtgtccagcagctgcgggt

SEQ ID NO: 2098737 - DNA, 20 bp, Homo sapiens
gtgtcccaaaaagaaaggag

SEQ ID NO: 2098738 - DNA, 15 bp, Homo sapiens
gtgtcccaaggagct

SEQ ID NO: 2098739 - DNA, 17 bp, Homo sapiens
gtgtcccaaggagctga

SEQ ID NO: 2098740 - DNA, 18 bp, Homo sapiens
gtgtcccaaggagctgat

SEQ ID NO: 2098741 - DNA, 18 bp, Homo sapiens
gtgtccctgcacttgcag

SEQ ID NO: 2098742 - DNA, 14 bp, Homo sapiens
gtgtcctacagcct

SEQ ID NO: 2098743 - DNA, 15 bp, Homo sapiens
gtgtcctctcccctc

SEQ ID NO: 2098744 - DNA, 12 bp, Homo sapiens
gtgtcctgcctt

SEQ ID NO: 2098745 - DNA, 12 bp, Homo sapiens
gtgtccttccct

SEQ ID NO: 2098746 - DNA, 18 bp, Homo sapiens
gtgtccttgcacctgcat

SEQ ID NO: 2098747 - DNA, 15 bp, Homo sapiens
gtgtcgtagccaagg

SEQ ID NO: 2098748 - DNA, 14 bp, Homo sapiens
gtgtctaaaaacac

SEQ ID NO: 2098749 - DNA, 13 bp, Homo sapiens
gtgtctgaagact

SEQ ID NO: 2098750 - DNA, 15 bp, Homo sapiens
gtgtctgatgtttgt

SEQ ID NO: 2098751 - DNA, 18 bp, Homo sapiens
gtgtctggaaaagcactt

SEQ ID NO: 2098752 - DNA, 20 bp, Homo sapiens
gtgtctggaagctgagcagg

SEQ ID NO: 2098753 - DNA, 16 bp, Homo sapiens
gtgtctgtacacgtgt

SEQ ID NO: 2098754 - DNA, 22 bp, Homo sapiens
gtgtctgtacacgtgtcctgta

SEQ ID NO: 2098755 - DNA, 15 bp, Homo sapiens
gtgtctgtctttgtg

SEQ ID NO: 2098756 - DNA, 13 bp, Homo sapiens
gtgtctgtgtggt

SEQ ID NO: 2098757 - DNA, 22 bp, Homo sapiens
gtgtcttaattaaaagaatatt

SEQ ID NO: 2098758 - DNA, 13 bp, Homo sapiens
gtgtcttccataa

SEQ ID NO: 2098759 - DNA, 19 bp, Homo sapiens
gtgtcttgcaatggcagcc

SEQ ID NO: 2098760 - DNA, 16 bp, Homo sapiens
gtgtcttttataaaaa

SEQ ID NO: 2098761 - DNA, 11 bp, Homo sapiens
gtgtgaagaaa

SEQ ID NO: 2098762 - DNA, 14 bp, Homo sapiens
gtgtgaattcccag

SEQ ID NO: 2098763 - DNA, 17 bp, Homo sapiens
gtgtgaattctgcaact

SEQ ID NO: 2098764 - DNA, 22 bp, Homo sapiens
gtgtgacaaggattgctactgt

SEQ ID NO: 2098765 - DNA, 13 bp, Homo sapiens
gtgtgagcagtga

SEQ ID NO: 2098766 - DNA, 20 bp, Homo sapiens
gtgtgagtggcagccatgcc

SEQ ID NO: 2098767 - DNA, 17 bp, Homo sapiens
gtgtgatcccaagtgcc

SEQ ID NO: 2098768 - DNA, 19 bp, Homo sapiens
gtgtgatcccaagtgccag

SEQ ID NO: 2098769 - DNA, 18 bp, Homo sapiens
gtgtgcacccctccccat

SEQ ID NO: 2098770 - DNA, 13 bp, Homo sapiens
gtgtgcagactga

SEQ ID NO: 2098771 - DNA, 14 bp, Homo sapiens
gtgtgcatgtatgt

SEQ ID NO: 2098772 - DNA, 17 bp, Homo sapiens
gtgtgcatgtgtgtata

SEQ ID NO: 2098773 - DNA, 19 bp, Homo sapiens
gtgtgcatgtgtgtgtctg

SEQ ID NO: 2098774 - DNA, 13 bp, Homo sapiens
gtgtgcctgcagc

SEQ ID NO: 2098775 - DNA, 14 bp, Homo sapiens
gtgtgcctgtggca

SEQ ID NO: 2098776 - DNA, 14 bp, Homo sapiens
gtgtgcgtgcgtgt

SEQ ID NO: 2098777 - DNA, 19 bp, Homo sapiens
gtgtgcgtgcgtgtgcgtg

SEQ ID NO: 2098778 - DNA, 15 bp, Homo sapiens
gtgtgctctgatcat

SEQ ID NO: 2098779 - DNA, 14 bp, Homo sapiens
gtgtggacaggact

SEQ ID NO: 2098780 - DNA, 14 bp, Homo sapiens
gtgtggagaggggt

SEQ ID NO: 2098781 - DNA, 11 bp, Homo sapiens
gtgtggcctca

SEQ ID NO: 2098782 - DNA, 16 bp, Homo sapiens
gtgtggcctcagccct

SEQ ID NO: 2098783 - DNA, 16 bp, Homo sapiens
gtgtggctgtattcag

SEQ ID NO: 2098784 - DNA, 13 bp, Homo sapiens
gtgtgggctgcag

SEQ ID NO: 2098785 - DNA, 12 bp, Homo sapiens
gtgtggggaggc

SEQ ID NO: 2098786 - DNA, 13 bp, Homo sapiens
gtgtggtggctca

SEQ ID NO: 2098787 - DNA, 20 bp, Homo sapiens
gtgtgtcaagattgcaaagt

SEQ ID NO: 2098788 - DNA, 18 bp, Homo sapiens
gtgtgtcacactgagctg

SEQ ID NO: 2098789 - DNA, 15 bp, Homo sapiens
gtgtgtctgctcagt

SEQ ID NO: 2098790 - DNA, 13 bp, Homo sapiens
gtgtgtctgtctt

SEQ ID NO: 2098791 - DNA, 17 bp, Homo sapiens
gtgtgtctgtctttgtg

SEQ ID NO: 2098792 - DNA, 15 bp, Homo sapiens
gtgtgtctgttcact

SEQ ID NO: 2098793 - DNA, 18 bp, Homo sapiens
gtgtgtctgttgagtgca

SEQ ID NO: 2098794 - DNA, 13 bp, Homo sapiens
gtgtgtgatggga

SEQ ID NO: 2098795 - DNA, 13 bp, Homo sapiens
gtgtgtgcatgta

SEQ ID NO: 2098796 - DNA, 15 bp, Homo sapiens
gtgtgtgtgcatgtg

SEQ ID NO: 2098797 - DNA, 11 bp, Homo sapiens
gtgtgtgtgtg

SEQ ID NO: 2098798 - DNA, 14 bp, Homo sapiens
gtgtgtgtgtgtgt

SEQ ID NO: 2098799 - DNA, 15 bp, Homo sapiens
gtgtgtgtgtgtgtg

SEQ ID NO: 2098800 - DNA, 16 bp, Homo sapiens
gtgtgtttaaataaag

SEQ ID NO: 2098801 - DNA, 20 bp, Homo sapiens
gtgtgttttgagagtatatt

SEQ ID NO: 2098802 - DNA, 12 bp, Homo sapiens
gtgttaattttt

SEQ ID NO: 2098803 - DNA, 15 bp, Homo sapiens
gtgttactcatgtac

SEQ ID NO: 2098804 - DNA, 19 bp, Homo sapiens
gtgttaggaggctgcatgc

SEQ ID NO: 2098805 - DNA, 17 bp, Homo sapiens
gtgttagtgtgtgtgca

SEQ ID NO: 2098806 - DNA, 17 bp, Homo sapiens
gtgttatttaaatgagt

SEQ ID NO: 2098807 - DNA, 19 bp, Homo sapiens
gtgttcacactgtaaacat

SEQ ID NO: 2098808 - DNA, 17 bp, Homo sapiens
gtgttcagtgccttgga

SEQ ID NO: 2098809 - DNA, 17 bp, Homo sapiens
gtgttccagctgcctgg

SEQ ID NO: 2098810 - DNA, 19 bp, Homo sapiens
gtgttctgtgggcttggcc

SEQ ID NO: 2098811 - DNA, 16 bp, Homo sapiens
gtgttgaaaatgttca

SEQ ID NO: 2098812 - DNA, 17 bp, Homo sapiens
gtgttgaaaatgttcag

SEQ ID NO: 2098813 - DNA, 18 bp, Homo sapiens
gtgttgaacacaattgat

SEQ ID NO: 2098814 - DNA, 19 bp, Homo sapiens
gtgttgaccactccagaga

SEQ ID NO: 2098815 - DNA, 15 bp, Homo sapiens
gtgttgatcccaaga

SEQ ID NO: 2098816 - DNA, 19 bp, Homo sapiens
gtgttggctgtgtgacaga

SEQ ID NO: 2098817 - DNA, 18 bp, Homo sapiens
gtgttgggaattgcatgc

SEQ ID NO: 2098818 - DNA, 13 bp, Homo sapiens
gtgttgtctgtgc

SEQ ID NO: 2098819 - DNA, 20 bp, Homo sapiens
gtgttgtgatagctaacatt

SEQ ID NO: 2098820 - DNA, 16 bp, Homo sapiens
gtgtttaaataaagta

SEQ ID NO: 2098821 - DNA, 12 bp, Homo sapiens
gtgtttcccata

SEQ ID NO: 2098822 - DNA, 20 bp, Homo sapiens
gttggccgtggtccagctct

SEQ ID NO: 2098823 - DNA, 22 bp, Homo sapiens
gttggccgtggtccagctcttg

SEQ ID NO: 2098824 - DNA, 20 bp, Homo sapiens
gttggctgacttccacacct

SEQ ID NO: 2098825 - DNA, 23 bp, Homo sapiens
gttggctgggggcctcagtgcca

SEQ ID NO: 2098826 - DNA, 14 bp, Homo sapiens
gttgggagcactgg

SEQ ID NO: 2098827 - DNA, 18 bp, Homo sapiens
gttgggatttatatctat

SEQ ID NO: 2098828 - DNA, 16 bp, Homo sapiens
gttgggcgtgctacct

SEQ ID NO: 2098829 - DNA, 13 bp, Homo sapiens
gttgggctggtgt

SEQ ID NO: 2098830 - DNA, 13 bp, Homo sapiens
gttgggtggatgc

SEQ ID NO: 2098831 - DNA, 15 bp, Homo sapiens
gttgggttcatctga

SEQ ID NO: 2098832 - DNA, 20 bp, Homo sapiens
gttgtaaatatttatgtaaa

SEQ ID NO: 2098833 - DNA, 16 bp, Homo sapiens
gttgtaaatgaccaag

SEQ ID NO: 2098834 - DNA, 19 bp, Homo sapiens
gttgtaaatgctcgtgtga

SEQ ID NO: 2098835 - DNA, 14 bp, Homo sapiens
gttgtacaagctca

SEQ ID NO: 2098836 - DNA, 18 bp, Homo sapiens
gttgtacaagctcaggag

SEQ ID NO: 2098837 - DNA, 19 bp, Homo sapiens
gttgtactattgtttaaaa

SEQ ID NO: 2098838 - DNA, 19 bp, Homo sapiens
gttgtagttcttgtgcatg

SEQ ID NO: 2098839 - DNA, 17 bp, Homo sapiens
gttgtcaatattaaata

SEQ ID NO: 2098840 - DNA, 22 bp, Homo sapiens
gttgtctattctgagccttgag

SEQ ID NO: 2098841 - DNA, 13 bp, Homo sapiens
gttgtctctctaa

SEQ ID NO: 2098842 - DNA, 19 bp, Homo sapiens
gttgtctgaagtcactgca

SEQ ID NO: 2098843 - DNA, 22 bp, Homo sapiens
gttgtgaggcctggccaggcac

SEQ ID NO: 2098844 - DNA, 21 bp, Homo sapiens
gttgtgatcatcccatctaag

SEQ ID NO: 2098845 - DNA, 22 bp, Homo sapiens
gttgtgcttgctggtactaaga

SEQ ID NO: 2098846 - DNA, 15 bp, Homo sapiens
gttgtgggtgggaga

SEQ ID NO: 2098847 - DNA, 16 bp, Homo sapiens
gttgtgggtgggagag

SEQ ID NO: 2098848 - DNA, 19 bp, Homo sapiens
gttgttaatgaaaatgtca

SEQ ID NO: 2098849 - DNA, 19 bp, Homo sapiens
gttgttccttcacatttaa

SEQ ID NO: 2098850 - DNA, 19 bp, Homo sapiens
gttgttgcaccatctgctt

SEQ ID NO: 2098851 - DNA, 20 bp, Homo sapiens
gttgttgccaactaagccct

SEQ ID NO: 2098852 - DNA, 19 bp, Homo sapiens
gttgtttttaagtcctgta

SEQ ID NO: 2098853 - DNA, 17 bp, Homo sapiens
gtttaaaaaaagtatat

SEQ ID NO: 2098854 - DNA, 22 bp, Homo sapiens
gtttaaaaaaagtatatattct

SEQ ID NO: 2098855 - DNA, 17 bp, Homo sapiens
gtttaaaaacaggaaaa

SEQ ID NO: 2098856 - DNA, 16 bp, Homo sapiens
gtttaaaatcatttct

SEQ ID NO: 2098857 - DNA, 12 bp, Homo sapiens
gtttaaattgta

SEQ ID NO: 2098858 - DNA, 20 bp, Homo sapiens
gtttaagccaaaacaatgtt

SEQ ID NO: 2098859 - DNA, 14 bp, Homo sapiens
gtttaagtctctga

SEQ ID NO: 2098860 - DNA, 13 bp, Homo sapiens
gtttaatgttttg

SEQ ID NO: 2098861 - DNA, 14 bp, Homo sapiens
gtttaatttaaagc

SEQ ID NO: 2098862 - DNA, 15 bp, Homo sapiens
gtttacatgaacaca

SEQ ID NO: 2098863 - DNA, 19 bp, Homo sapiens
gtttacatgaacacagctg

SEQ ID NO: 2098864 - DNA, 13 bp, Homo sapiens
gtttacatgcaga

SEQ ID NO: 2098865 - DNA, 19 bp, Homo sapiens
gtttacttttcagggcatc

SEQ ID NO: 2098866 - DNA, 15 bp, Homo sapiens
gtttagaagcgctca

SEQ ID NO: 2098867 - DNA, 14 bp, Homo sapiens
gtttagatttcaag

SEQ ID NO: 2098868 - DNA, 14 bp, Homo sapiens
gtttagattttatg

SEQ ID NO: 2098869 - DNA, 16 bp, Homo sapiens
gtttagtgttctgtat

SEQ ID NO: 2098870 - DNA, 17 bp, Homo sapiens
gtttataagcccaaatg

SEQ ID NO: 2098871 - DNA, 21 bp, Homo sapiens
gtttatagagggccaagactt

SEQ ID NO: 2098872 - DNA, 17 bp, Homo sapiens
gtttatgcaaggaagga

SEQ ID NO: 2098873 - DNA, 18 bp, Homo sapiens
gtttattaacaaattatg

SEQ ID NO: 2098874 - DNA, 23 bp, Homo sapiens
gtttattaacaaattatgttaca

SEQ ID NO: 2098875 - DNA, 22 bp, Homo sapiens
gtttattaatgcctctcccgca

SEQ ID NO: 2098876 - DNA, 17 bp, Homo sapiens
gtttattgcttaatccc

SEQ ID NO: 2098877 - DNA, 19 bp, Homo sapiens
gtttatttatcagtgacag

SEQ ID NO: 2098878 - DNA, 11 bp, Homo sapiens
gtttatttcat

SEQ ID NO: 2098879 - DNA, 14 bp, Homo sapiens
gtttatttttcata

SEQ ID NO: 2098880 - DNA, 13 bp, Homo sapiens
gtttattttttct

SEQ ID NO: 2098881 - DNA, 20 bp, Homo sapiens
gtttcacaacaggcattcca

SEQ ID NO: 2098882 - DNA, 23 bp, Homo sapiens
gtttcactgtgttggccaggctg

SEQ ID NO: 2098883 - DNA, 16 bp, Homo sapiens
gtttcagatatatatc

SEQ ID NO: 2098884 - DNA, 21 bp, Homo sapiens
gtttcagatatatatcatatt

SEQ ID NO: 2098885 - DNA, 23 bp, Homo sapiens
gtttcagggggcctttaaagact

SEQ ID NO: 2098886 - DNA, 14 bp, Homo sapiens
gtttcagtaaataa

SEQ ID NO: 2098887 - DNA, 11 bp, Homo sapiens
gtttcattgac

SEQ ID NO: 2098888 - DNA, 16 bp, Homo sapiens
gtttccaacctggagt

SEQ ID NO: 2098889 - DNA, 14 bp, Homo sapiens
gtttccagaaaata

SEQ ID NO: 2098890 - DNA, 23 bp, Homo sapiens
gtttccagaaaatataaatgcat

SEQ ID NO: 2098891 - DNA, 13 bp, Homo sapiens
gtttccaggaaga

SEQ ID NO: 2098892 - DNA, 22 bp, Homo sapiens
gtttccatgggtcaaagccggt

SEQ ID NO: 2098893 - DNA, 21 bp, Homo sapiens
gtttccatttctcaatcagtg

SEQ ID NO: 2098894 - DNA, 16 bp, Homo sapiens
gtttcccaagagctac

SEQ ID NO: 2098895 - DNA, 14 bp, Homo sapiens
gtttcccaccacct

SEQ ID NO: 2098896 - DNA, 13 bp, Homo sapiens
gtttcccataatt

SEQ ID NO: 2098897 - DNA, 15 bp, Homo sapiens
gtttcccataatttt

SEQ ID NO: 2098898 - DNA, 22 bp, Homo sapiens
gtttcccgccaggaggtcctcc

SEQ ID NO: 2098899 - DNA, 18 bp, Homo sapiens
gtttccctcccaacagag

SEQ ID NO: 2098900 - DNA, 15 bp, Homo sapiens
gtttctagaggcctc

SEQ ID NO: 2098901 - DNA, 18 bp, Homo sapiens
gtttctagctagaaatat

SEQ ID NO: 2098902 - DNA, 23 bp, Homo sapiens
gtttctagctagaaatatgattt

SEQ ID NO: 2098903 - DNA, 19 bp, Homo sapiens
gtttctatgtgtagggcgg

SEQ ID NO: 2098904 - DNA, 19 bp, Homo sapiens
gtttctcagaatccaaaga

SEQ ID NO: 2098905 - DNA, 20 bp, Homo sapiens
gtttctcagaatccaaagat

SEQ ID NO: 2098906 - DNA, 14 bp, Homo sapiens
gtttctccccctgg

SEQ ID NO: 2098907 - DNA, 23 bp, Homo sapiens
gtttctccccctgggctctgccc

SEQ ID NO: 2098908 - DNA, 13 bp, Homo sapiens
gtttctgagaaaa

SEQ ID NO: 2098909 - DNA, 20 bp, Homo sapiens
gtttctgagttcctgcatgc

SEQ ID NO: 2098910 - DNA, 18 bp, Homo sapiens
gtttctgcggccttccac

SEQ ID NO: 2098911 - DNA, 13 bp, Homo sapiens
gtttctgcgtgct

SEQ ID NO: 2098912 - DNA, 21 bp, Homo sapiens
gtttcttaaataagaaacttt

SEQ ID NO: 2098913 - DNA, 11 bp, Homo sapiens
gtttcttccaa

SEQ ID NO: 2098914 - DNA, 13 bp, Homo sapiens
gtttcttccaaag

SEQ ID NO: 2098915 - DNA, 17 bp, Homo sapiens
gtttcttggtctcagct

SEQ ID NO: 2098916 - DNA, 17 bp, Homo sapiens
gtttctttaagaaagta

SEQ ID NO: 2098917 - DNA, 17 bp, Homo sapiens
gtttgagacaagccctg

SEQ ID NO: 2098918 - DNA, 16 bp, Homo sapiens
gtttgatagattttct

SEQ ID NO: 2098919 - DNA, 14 bp, Homo sapiens
gtttgcaaggaagc

SEQ ID NO: 2098920 - DNA, 17 bp, Homo sapiens
gtttgcaaggaagccac

SEQ ID NO: 2098921 - DNA, 22 bp, Homo sapiens
gtttgcaaggaagccacagctg

SEQ ID NO: 2098922 - DNA, 22 bp, Homo sapiens
gtttgcactgtatgctggacgg

SEQ ID NO: 2098923 - DNA, 19 bp, Homo sapiens
gtttgcagaaaagcacctg

SEQ ID NO: 2098924 - DNA, 22 bp, Homo sapiens
gtttgcagaaaagcacctgccg

SEQ ID NO: 2098925 - DNA, 17 bp, Homo sapiens
gtttgccagtgaagact

SEQ ID NO: 2098926 - DNA, 13 bp, Homo sapiens
gtttgcctctgcc

SEQ ID NO: 2098927 - DNA, 17 bp, Homo sapiens
gtttgcctctgcctctg

SEQ ID NO: 2098928 - DNA, 16 bp, Homo sapiens
gtttggacacagtgtt

SEQ ID NO: 2098929 - DNA, 14 bp, Homo sapiens
gtttggcttcctcc

SEQ ID NO: 2098930 - DNA, 18 bp, Homo sapiens
gtttggggatgagaaagg

SEQ ID NO: 2098931 - DNA, 17 bp, Homo sapiens
gtttggggcaggagtag

SEQ ID NO: 2098932 - DNA, 13 bp, Homo sapiens
gtttgtaaaacta

SEQ ID NO: 2098933 - DNA, 17 bp, Homo sapiens
gtttgtaaattctggaa

SEQ ID NO: 2098934 - DNA, 22 bp, Homo sapiens
gtttgtaccttccttaagccag

SEQ ID NO: 2098935 - DNA, 14 bp, Homo sapiens
gtttgtattttaaa

SEQ ID NO: 2098936 - DNA, 15 bp, Homo sapiens
gtttgtcatatattc

SEQ ID NO: 2098937 - DNA, 18 bp, Homo sapiens
taagcaaaggaaaccaaa

SEQ ID NO: 2098938 - DNA, 20 bp, Homo sapiens
taagcaaaggaaaccaaagg

SEQ ID NO: 2098939 - DNA, 20 bp, Homo sapiens
taagcaaatttcaaaagaca

SEQ ID NO: 2098940 - DNA, 18 bp, Homo sapiens
taagcaatggtaattgtg

SEQ ID NO: 2098941 - DNA, 16 bp, Homo sapiens
taagcagcctttctgt

SEQ ID NO: 2098942 - DNA, 17 bp, Homo sapiens
taagcagcctttctgtg

SEQ ID NO: 2098943 - DNA, 18 bp, Homo sapiens
taagcagcctttctgtgg

SEQ ID NO: 2098944 - DNA, 20 bp, Homo sapiens
taagcagcctttctgtggag

SEQ ID NO: 2098945 - DNA, 16 bp, Homo sapiens
taagccaaaacaatgt

SEQ ID NO: 2098946 - DNA, 13 bp, Homo sapiens
taagccagagcct

SEQ ID NO: 2098947 - DNA, 15 bp, Homo sapiens
taagccagagcctgg

SEQ ID NO: 2098948 - DNA, 16 bp, Homo sapiens
taagccagagcctggg

SEQ ID NO: 2098949 - DNA, 14 bp, Homo sapiens
taagcccaaatggc

SEQ ID NO: 2098950 - DNA, 22 bp, Homo sapiens
taagccctcgaaccaaggcagc

SEQ ID NO: 2098951 - DNA, 11 bp, Homo sapiens
taagccctgtc

SEQ ID NO: 2098952 - DNA, 20 bp, Homo sapiens
taagcctcatatttaaagac

SEQ ID NO: 2098953 - DNA, 15 bp, Homo sapiens
taagcctgttgagac

SEQ ID NO: 2098954 - DNA, 16 bp, Homo sapiens
taagcctttccataag

SEQ ID NO: 2098955 - DNA, 23 bp, Homo sapiens
taagcgaatgtgtacaaagtgta

SEQ ID NO: 2098956 - DNA, 16 bp, Homo sapiens
taagctaacccccttc

SEQ ID NO: 2098957 - DNA, 12 bp, Homo sapiens
taagctgcagct

SEQ ID NO: 2098958 - DNA, 16 bp, Homo sapiens
taagctggagctcttg

SEQ ID NO: 2098959 - DNA, 13 bp, Homo sapiens
taagctgtaaaaa

SEQ ID NO: 2098960 - DNA, 14 bp, Homo sapiens
taagcttatttaat

SEQ ID NO: 2098961 - DNA, 22 bp, Homo sapiens
taagctttatttatttctttgt

SEQ ID NO: 2098962 - DNA, 14 bp, Homo sapiens
taagctttctcctt

SEQ ID NO: 2098963 - DNA, 15 bp, Homo sapiens
taagctttctccttt

SEQ ID NO: 2098964 - DNA, 15 bp, Homo sapiens
taaggaactggaaca

SEQ ID NO: 2098965 - DNA, 23 bp, Homo sapiens
taaggaactggaacacacatgtc

SEQ ID NO: 2098966 - DNA, 15 bp, Homo sapiens
taaggaagttattaa

SEQ ID NO: 2098967 - DNA, 22 bp, Homo sapiens
taaggaatctgaaagtatattt

SEQ ID NO: 2098968 - DNA, 15 bp, Homo sapiens
taaggaattgaagat

SEQ ID NO: 2098969 - DNA, 14 bp, Homo sapiens
taaggacacactaa

SEQ ID NO: 2098970 - DNA, 22 bp, Homo sapiens
taaggacttagctggccacagt

SEQ ID NO: 2098971 - DNA, 17 bp, Homo sapiens
taaggacttctgcagct

SEQ ID NO: 2098972 - DNA, 12 bp, Homo sapiens
taaggaggaaaa

SEQ ID NO: 2098973 - DNA, 13 bp, Homo sapiens
taaggaggaaaac

SEQ ID NO: 2098974 - DNA, 15 bp, Homo sapiens
taaggagggacaaga

SEQ ID NO: 2098975 - DNA, 16 bp, Homo sapiens
taaggatctctcagga

SEQ ID NO: 2098976 - DNA, 20 bp, Homo sapiens
taaggatggagccagctctg

SEQ ID NO: 2098977 - DNA, 19 bp, Homo sapiens
taaggccagaaactccttt

SEQ ID NO: 2098978 - DNA, 16 bp, Homo sapiens
taaggccgtgtctctg

SEQ ID NO: 2098979 - DNA, 12 bp, Homo sapiens
taaggcctgccc

SEQ ID NO: 2098980 - DNA, 17 bp, Homo sapiens
taaggctccttcatgtg

SEQ ID NO: 2098981 - DNA, 11 bp, Homo sapiens
taagggaaaaa

SEQ ID NO: 2098982 - DNA, 19 bp, Homo sapiens
taaggtaatttctgtgtat

SEQ ID NO: 2098983 - DNA, 23 bp, Homo sapiens
taaggtaatttctgtgtattttg

SEQ ID NO: 2098984 - DNA, 17 bp, Homo sapiens
taaggtcttcttgtgtc

SEQ ID NO: 2098985 - DNA, 22 bp, Homo sapiens
taaggtgggtccaggaaggcag

SEQ ID NO: 2098986 - DNA, 16 bp, Homo sapiens
taaggttctcatagga

SEQ ID NO: 2098987 - DNA, 13 bp, Homo sapiens
taagtaaaaccac

SEQ ID NO: 2098988 - DNA, 16 bp, Homo sapiens
taagtaaaaccacagc

SEQ ID NO: 2098989 - DNA, 21 bp, Homo sapiens
taagtaattatcgggaacagt

SEQ ID NO: 2098990 - DNA, 14 bp, Homo sapiens
taagtactgtgtac

SEQ ID NO: 2098991 - DNA, 17 bp, Homo sapiens
taagtataattaataga

SEQ ID NO: 2098992 - DNA, 12 bp, Homo sapiens
taagtatatagt

SEQ ID NO: 2098993 - DNA, 15 bp, Homo sapiens
taagtatttatatat

SEQ ID NO: 2098994 - DNA, 17 bp, Homo sapiens
taagtatttatatattt

SEQ ID NO: 2098995 - DNA, 12 bp, Homo sapiens
taagtatttcca

SEQ ID NO: 2098996 - DNA, 17 bp, Homo sapiens
taagtatttgaaactga

SEQ ID NO: 2098997 - DNA, 18 bp, Homo sapiens
taagtccacatcttctca

SEQ ID NO: 2098998 - DNA, 11 bp, Homo sapiens
taagtctctga

SEQ ID NO: 2098999 - DNA, 19 bp, Homo sapiens
taagtctgggatgtagaac

SEQ ID NO: 2099000 - DNA, 20 bp, Homo sapiens
taagtgaaaataatttgttg

SEQ ID NO: 2099001 - DNA, 14 bp, Homo sapiens
taagtgaataataa

SEQ ID NO: 2099002 - DNA, 18 bp, Homo sapiens
taagtgcacacagaaata

SEQ ID NO: 2099003 - DNA, 13 bp, Homo sapiens
taagtgctttgta

SEQ ID NO: 2099004 - DNA, 17 bp, Homo sapiens
taagtggaaaaaagaga

SEQ ID NO: 2099005 - DNA, 20 bp, Homo sapiens
taagtggaaaaaagagaaaa

SEQ ID NO: 2099006 - DNA, 14 bp, Homo sapiens
taagttatagtata

SEQ ID NO: 2099007 - DNA, 16 bp, Homo sapiens
taagttgttatttcag

SEQ ID NO: 2099008 - DNA, 16 bp, Homo sapiens
taagtttagaagcgct

SEQ ID NO: 2099009 - DNA, 17 bp, Homo sapiens
taagtttattttttcta

SEQ ID NO: 2099010 - DNA, 14 bp, Homo sapiens
taagtttctgggac

SEQ ID NO: 2099011 - DNA, 13 bp, Homo sapiens
taagtttgatcaa

SEQ ID NO: 2099012 - DNA, 16 bp, Homo sapiens
taagtttgatcaaatc

SEQ ID NO: 2099013 - DNA, 16 bp, Homo sapiens
taagtttgatttcatt

SEQ ID NO: 2099014 - DNA, 17 bp, Homo sapiens
taataaaaatttgttta

SEQ ID NO: 2099015 - DNA, 22 bp, Homo sapiens
taataaaacccagcatgtacaa

SEQ ID NO: 2099016 - DNA, 20 bp, Homo sapiens
taataaaagtactgaagacc

SEQ ID NO: 2099017 - DNA, 20 bp, Homo sapiens
taataaacgaagataaatca

SEQ ID NO: 2099018 - DNA, 14 bp, Homo sapiens
taataaactctcta

SEQ ID NO: 2099019 - DNA, 13 bp, Homo sapiens
taataaattcaga

SEQ ID NO: 2099020 - DNA, 15 bp, Homo sapiens
taataaattcagata

SEQ ID NO: 2099021 - DNA, 15 bp, Homo sapiens
taataactagatctc

SEQ ID NO: 2099022 - DNA, 19 bp, Homo sapiens
taataataagataatgatg

SEQ ID NO: 2099023 - DNA, 15 bp, Homo sapiens
taataatttcatccc

SEQ ID NO: 2099024 - DNA, 22 bp, Homo sapiens
taatacactaattcctttctat

SEQ ID NO: 2099025 - DNA, 14 bp, Homo sapiens
taatacctctgtgt

SEQ ID NO: 2099026 - DNA, 18 bp, Homo sapiens
taatacctctgtgtgctc

SEQ ID NO: 2099027 - DNA, 21 bp, Homo sapiens
taatacctttggaaaaatctt

SEQ ID NO: 2099028 - DNA, 13 bp, Homo sapiens
taatactaaaata

SEQ ID NO: 2099029 - DNA, 17 bp, Homo sapiens
taatactaaaatatgtc

SEQ ID NO: 2099030 - DNA, 16 bp, Homo sapiens
taatactaaagtgtct

SEQ ID NO: 2099031 - DNA, 19 bp, Homo sapiens
taatacttcatttggtgct

SEQ ID NO: 2099032 - DNA, 16 bp, Homo sapiens
taatagaaaactgaaa

SEQ ID NO: 2099033 - DNA, 12 bp, Homo sapiens
taatagaagaac

SEQ ID NO: 2099034 - DNA, 14 bp, Homo sapiens
taatagatgtttga

SEQ ID NO: 2099035 - DNA, 21 bp, Homo sapiens
taatagatgtttgatagattt

SEQ ID NO: 2099036 - DNA, 13 bp, Homo sapiens
taatagcaaagaa

SEQ ID NO: 2099037 - DNA, 15 bp, Homo sapiens
taatagcaaagaatt

SEQ ID NO: 2099038 - DNA, 19 bp, Homo sapiens
taatagcgggttactttca

SEQ ID NO: 2099039 - DNA, 19 bp, Homo sapiens
taatataaagttggatgcg

SEQ ID NO: 2099040 - DNA, 13 bp, Homo sapiens
taatataatggaa

SEQ ID NO: 2099041 - DNA, 12 bp, Homo sapiens
taatatattgct

SEQ ID NO: 2099042 - DNA, 15 bp, Homo sapiens
taatatcaatgaaga

SEQ ID NO: 2099043 - DNA, 19 bp, Homo sapiens
taatatccactgcaatact

SEQ ID NO: 2099044 - DNA, 12 bp, Homo sapiens
taatatcctaaa

SEQ ID NO: 2099045 - DNA, 15 bp, Homo sapiens
taatatctgtgaggt

SEQ ID NO: 2099046 - DNA, 21 bp, Homo sapiens
taatatctgtgaggtgctgat

SEQ ID NO: 2099047 - DNA, 16 bp, Homo sapiens
taatatcttgaagaat

SEQ ID NO: 2099048 - DNA, 17 bp, Homo sapiens
taatatcttgaagaata

SEQ ID NO: 2099049 - DNA, 15 bp, Homo sapiens
taatatgctacagta

SEQ ID NO: 2099050 - DNA, 22 bp, Homo sapiens
taatatgctacagtactatgta

SEQ ID NO: 2099051 - DNA, 16 bp, Homo sapiens
taatatgctgccaaat

SEQ ID NO: 2099052 - DNA, 18 bp, Homo sapiens
taatatggaaccttccct

SEQ ID NO: 2099053 - DNA, 14 bp, Homo sapiens
taccgtagcctccg

SEQ ID NO: 2099054 - DNA, 15 bp, Homo sapiens
tacctaaacagatat

SEQ ID NO: 2099055 - DNA, 19 bp, Homo sapiens
tacctaaacagatataaat

SEQ ID NO: 2099056 - DNA, 22 bp, Homo sapiens
tacctacataggcaaattggaa

SEQ ID NO: 2099057 - DNA, 16 bp, Homo sapiens
tacctaccaccttccc

SEQ ID NO: 2099058 - DNA, 16 bp, Homo sapiens
tacctagatttacagc

SEQ ID NO: 2099059 - DNA, 23 bp, Homo sapiens
tacctaggatgcatgacaattgt

SEQ ID NO: 2099060 - DNA, 23 bp, Homo sapiens
tacctataatgtgtgtatgtgta

SEQ ID NO: 2099061 - DNA, 20 bp, Homo sapiens
tacctatgtgacagacattt

SEQ ID NO: 2099062 - DNA, 22 bp, Homo sapiens
tacctcaacccccatttctatt

SEQ ID NO: 2099063 - DNA, 11 bp, Homo sapiens
tacctcagcct

SEQ ID NO: 2099064 - DNA, 10 bp, Homo sapiens
tacctcagtt

SEQ ID NO: 2099065 - DNA, 19 bp, Homo sapiens
tacctcattcgcctgtggg

SEQ ID NO: 2099066 - DNA, 13 bp, Homo sapiens
tacctcccctgcc

SEQ ID NO: 2099067 - DNA, 11 bp, Homo sapiens
tacctcctgcc

SEQ ID NO: 2099068 - DNA, 14 bp, Homo sapiens
tacctctgatacct

SEQ ID NO: 2099069 - DNA, 12 bp, Homo sapiens
tacctctgtgtg

SEQ ID NO: 2099070 - DNA, 19 bp, Homo sapiens
tacctctttattttttgat

SEQ ID NO: 2099071 - DNA, 20 bp, Homo sapiens
tacctgacggacgtcctgct

SEQ ID NO: 2099072 - DNA, 12 bp, Homo sapiens
tacctgagacca

SEQ ID NO: 2099073 - DNA, 18 bp, Homo sapiens
tacctgccctctctcagt

SEQ ID NO: 2099074 - DNA, 13 bp, Homo sapiens
tacctgctgctgc

SEQ ID NO: 2099075 - DNA, 18 bp, Homo sapiens
tacctgtggtgactgaac

SEQ ID NO: 2099076 - DNA, 17 bp, Homo sapiens
tacctgtgtttcttgcc

SEQ ID NO: 2099077 - DNA, 16 bp, Homo sapiens
taccttagattagctc

SEQ ID NO: 2099078 - DNA, 14 bp, Homo sapiens
taccttcaataaag

SEQ ID NO: 2099079 - DNA, 16 bp, Homo sapiens
taccttcaataaagta

SEQ ID NO: 2099080 - DNA, 17 bp, Homo sapiens
taccttcaataaagtat

SEQ ID NO: 2099081 - DNA, 20 bp, Homo sapiens
taccttctggttgcttcaga

SEQ ID NO: 2099082 - DNA, 18 bp, Homo sapiens
taccttgaacactggggg

SEQ ID NO: 2099083 - DNA, 23 bp, Homo sapiens
tacctttgttcccaaatttcata

SEQ ID NO: 2099084 - DNA, 15 bp, Homo sapiens
tacgaaacacaaacc

SEQ ID NO: 2099085 - DNA, 21 bp, Homo sapiens
tacgaacccctcccctccccc

SEQ ID NO: 2099086 - DNA, 22 bp, Homo sapiens
tacgaacccctcccctcccccc

SEQ ID NO: 2099087 - DNA, 22 bp, Homo sapiens
tacgacaaagcatcattgtaaa

SEQ ID NO: 2099088 - DNA, 21 bp, Homo sapiens
tacgccaaagtgcagcccttc

SEQ ID NO: 2099089 - DNA, 21 bp, Homo sapiens
tacgctctcctttctttctaa

SEQ ID NO: 2099090 - DNA, 13 bp, Homo sapiens
tacgcttgcttgt

SEQ ID NO: 2099091 - DNA, 17 bp, Homo sapiens
tacgtataaatatgaaa

SEQ ID NO: 2099092 - DNA, 15 bp, Homo sapiens
tacgtatcatttcta

SEQ ID NO: 2099093 - DNA, 15 bp, Homo sapiens
tacgtctgacaggca

SEQ ID NO: 2099094 - DNA, 22 bp, Homo sapiens
tacgtgttaggaggctgcatgc

SEQ ID NO: 2099095 - DNA, 14 bp, Homo sapiens
tacgttatatattg

SEQ ID NO: 2099096 - DNA, 20 bp, Homo sapiens
tacgttctccagcccacacc

SEQ ID NO: 2099097 - DNA, 18 bp, Homo sapiens
tactaaacattttgttat

SEQ ID NO: 2099098 - DNA, 20 bp, Homo sapiens
tactaaagatatcagagctc

SEQ ID NO: 2099099 - DNA, 13 bp, Homo sapiens
tactaaagcagtg

SEQ ID NO: 2099100 - DNA, 14 bp, Homo sapiens
tactaaagcagtgt

SEQ ID NO: 2099101 - DNA, 19 bp, Homo sapiens
tactaaagcagtgttttca

SEQ ID NO: 2099102 - DNA, 16 bp, Homo sapiens
tactacaaaaaagttg

SEQ ID NO: 2099103 - DNA, 13 bp, Homo sapiens
tactacaaaattt

SEQ ID NO: 2099104 - DNA, 18 bp, Homo sapiens
tactacaaaatttgaaat

SEQ ID NO: 2099105 - DNA, 18 bp, Homo sapiens
tactaccggctacatcaa

SEQ ID NO: 2099106 - DNA, 17 bp, Homo sapiens
tactactagatgtcttt

SEQ ID NO: 2099107 - DNA, 18 bp, Homo sapiens
tactactagatgtcttta

SEQ ID NO: 2099108 - DNA, 14 bp, Homo sapiens
tactactattctgt

SEQ ID NO: 2099109 - DNA, 15 bp, Homo sapiens
tactactgctgcaaa

SEQ ID NO: 2099110 - DNA, 21 bp, Homo sapiens
tactactgctgcaaagtgcaa

SEQ ID NO: 2099111 - DNA, 16 bp, Homo sapiens
tactactgtaaatgta

SEQ ID NO: 2099112 - DNA, 14 bp, Homo sapiens
tactacttcttgga

SEQ ID NO: 2099113 - DNA, 21 bp, Homo sapiens
tactagaaagctctgcatgtg

SEQ ID NO: 2099114 - DNA, 18 bp, Homo sapiens
tactagaatggtagcact

SEQ ID NO: 2099115 - DNA, 19 bp, Homo sapiens
tactagaatttgtattttg

SEQ ID NO: 2099116 - DNA, 23 bp, Homo sapiens
tactagcttttcaaacaagaatg

SEQ ID NO: 2099117 - DNA, 16 bp, Homo sapiens
tactatgatctcagga

SEQ ID NO: 2099118 - DNA, 22 bp, Homo sapiens
tactatgatctcaggagcttgc

SEQ ID NO: 2099119 - DNA, 18 bp, Homo sapiens
tactattttacttctaga

SEQ ID NO: 2099120 - DNA, 19 bp, Homo sapiens
tactattttacttctagag

SEQ ID NO: 2099121 - DNA, 15 bp, Homo sapiens
tactcaagaggctga

SEQ ID NO: 2099122 - DNA, 14 bp, Homo sapiens
tactcacacaggca

SEQ ID NO: 2099123 - DNA, 21 bp, Homo sapiens
tactcacacaggcatttcctg

SEQ ID NO: 2099124 - DNA, 16 bp, Homo sapiens
tactcagaagcctgag

SEQ ID NO: 2099125 - DNA, 15 bp, Homo sapiens
tactcagagcagagc

SEQ ID NO: 2099126 - DNA, 21 bp, Homo sapiens
tactcagagcagagcaaatga

SEQ ID NO: 2099127 - DNA, 21 bp, Homo sapiens
tactcagcagcagagagccct

SEQ ID NO: 2099128 - DNA, 14 bp, Homo sapiens
tactcagcagccct

SEQ ID NO: 2099129 - DNA, 23 bp, Homo sapiens
tactcagcagccctcctcacccc

SEQ ID NO: 2099130 - DNA, 16 bp, Homo sapiens
tactcagccctgggcc

SEQ ID NO: 2099131 - DNA, 23 bp, Homo sapiens
tactcagccctgggccccaccac

SEQ ID NO: 2099132 - DNA, 12 bp, Homo sapiens
tactcaggaggc

SEQ ID NO: 2099133 - DNA, 17 bp, Homo sapiens
tactcatgtacattggt

SEQ ID NO: 2099134 - DNA, 11 bp, Homo sapiens
tactcattttt

SEQ ID NO: 2099135 - DNA, 14 bp, Homo sapiens
tactcatttttcat

SEQ ID NO: 2099136 - DNA, 19 bp, Homo sapiens
tactccaagcttcaagtga

SEQ ID NO: 2099137 - DNA, 12 bp, Homo sapiens
tactccacagcg

SEQ ID NO: 2099138 - DNA, 18 bp, Homo sapiens
tactccatacataacttg

SEQ ID NO: 2099139 - DNA, 23 bp, Homo sapiens
tactcccctgatcccccaggttc

SEQ ID NO: 2099140 - DNA, 21 bp, Homo sapiens
tactcccctgggcatcttctg

SEQ ID NO: 2099141 - DNA, 16 bp, Homo sapiens
tactcccttcctggcc

SEQ ID NO: 2099142 - DNA, 16 bp, Homo sapiens
tactcctacctcagcc

SEQ ID NO: 2099143 - DNA, 17 bp, Homo sapiens
tactcctacctcagcct

SEQ ID NO: 2099144 - DNA, 22 bp, Homo sapiens
tactcctgcaaaattttatagc

SEQ ID NO: 2099145 - DNA, 11 bp, Homo sapiens
tactcctgtgg

SEQ ID NO: 2099146 - DNA, 14 bp, Homo sapiens
tactctagaacatg

SEQ ID NO: 2099147 - DNA, 21 bp, Homo sapiens
tactctagaacatgcacattt

SEQ ID NO: 2099148 - DNA, 20 bp, Homo sapiens
tactctatgccccaaatata

SEQ ID NO: 2099149 - DNA, 14 bp, Homo sapiens
tactctcaatgcat

SEQ ID NO: 2099150 - DNA, 20 bp, Homo sapiens
tactctcaatgcattttcaa

SEQ ID NO: 2099151 - DNA, 20 bp, Homo sapiens
tactctcctcggccccctcc

SEQ ID NO: 2099152 - DNA, 16 bp, Homo sapiens
tactctctgctctagc

SEQ ID NO: 2099153 - DNA, 12 bp, Homo sapiens
tactctgagccc

SEQ ID NO: 2099154 - DNA, 14 bp, Homo sapiens
tactctgagcccag

SEQ ID NO: 2099155 - DNA, 15 bp, Homo sapiens
tactctgagcccagg

SEQ ID NO: 2099156 - DNA, 17 bp, Homo sapiens
tactctgagcccaggcc

SEQ ID NO: 2099157 - DNA, 15 bp, Homo sapiens
tactctgtcagatgg

SEQ ID NO: 2099158 - DNA, 15 bp, Homo sapiens
tactctgtccaggcc

SEQ ID NO: 2099159 - DNA, 14 bp, Homo sapiens
tactctgtgccaga

SEQ ID NO: 2099160 - DNA, 18 bp, Homo sapiens
tactctgtgccagagcct

SEQ ID NO: 2099161 - DNA, 19 bp, Homo sapiens
tactctgtgccagagcctg

SEQ ID NO: 2099162 - DNA, 21 bp, Homo sapiens
tactctgtgccagagcctggg

SEQ ID NO: 2099163 - DNA, 23 bp, Homo sapiens
tactctgtgccagagcctggggc

SEQ ID NO: 2099164 - DNA, 22 bp, Homo sapiens
tactcttcagaatatggacaaa

SEQ ID NO: 2099165 - DNA, 13 bp, Homo sapiens
tactcttcctttc

SEQ ID NO: 2099166 - DNA, 21 bp, Homo sapiens
tactgaaatgaggagagaagg

SEQ ID NO: 2099167 - DNA, 15 bp, Homo sapiens
tactgagccttgtaa

SEQ ID NO: 2099168 - DNA, 19 bp, Homo sapiens
tagtgtgagtggcagccat

SEQ ID NO: 2099169 - DNA, 15 bp, Homo sapiens
tagtgtgtgtgcatg

SEQ ID NO: 2099170 - DNA, 16 bp, Homo sapiens
tagtgtgtgtgcatgt

SEQ ID NO: 2099171 - DNA, 18 bp, Homo sapiens
tagtgtgttgtctgtgca

SEQ ID NO: 2099172 - DNA, 19 bp, Homo sapiens
tagttaaaagactgcagct

SEQ ID NO: 2099173 - DNA, 21 bp, Homo sapiens
tagttaagtatttacagatgt

SEQ ID NO: 2099174 - DNA, 15 bp, Homo sapiens
tagttagccctcagt

SEQ ID NO: 2099175 - DNA, 15 bp, Homo sapiens
tagttagctgcttta

SEQ ID NO: 2099176 - DNA, 18 bp, Homo sapiens
tagttaggaaataaaacc

SEQ ID NO: 2099177 - DNA, 21 bp, Homo sapiens
tagttaggaaataaaaccttt

SEQ ID NO: 2099178 - DNA, 15 bp, Homo sapiens
tagttattgttttat

SEQ ID NO: 2099179 - DNA, 17 bp, Homo sapiens
tagttcctttatttaat

SEQ ID NO: 2099180 - DNA, 22 bp, Homo sapiens
tagttctcaatcactgctcccc

SEQ ID NO: 2099181 - DNA, 14 bp, Homo sapiens
tagttcttgtgcat

SEQ ID NO: 2099182 - DNA, 21 bp, Homo sapiens
tagttcttgtgcatgtttact

SEQ ID NO: 2099183 - DNA, 19 bp, Homo sapiens
tagttgaaacgcagacact

SEQ ID NO: 2099184 - DNA, 14 bp, Homo sapiens
tagttgatgaccaa

SEQ ID NO: 2099185 - DNA, 22 bp, Homo sapiens
tagttgcgtggactctgcacat

SEQ ID NO: 2099186 - DNA, 15 bp, Homo sapiens
tagttggtgttcaaa

SEQ ID NO: 2099187 - DNA, 21 bp, Homo sapiens
tagttgtccatattttcacag

SEQ ID NO: 2099188 - DNA, 17 bp, Homo sapiens
tagttgtgggtgggaga

SEQ ID NO: 2099189 - DNA, 15 bp, Homo sapiens
tagtttactatttta

SEQ ID NO: 2099190 - DNA, 21 bp, Homo sapiens
tagtttacttcctaaatttca

SEQ ID NO: 2099191 - DNA, 20 bp, Homo sapiens
tagtttcatataaagtatca

SEQ ID NO: 2099192 - DNA, 12 bp, Homo sapiens
tagtttcttgtg

SEQ ID NO: 2099193 - DNA, 20 bp, Homo sapiens
tagtttgatttaatatctga

SEQ ID NO: 2099194 - DNA, 14 bp, Homo sapiens
tagtttgtataact

SEQ ID NO: 2099195 - DNA, 13 bp, Homo sapiens
tagttttaaatat

SEQ ID NO: 2099196 - DNA, 16 bp, Homo sapiens
tagttttaaatatgaa

SEQ ID NO: 2099197 - DNA, 23 bp, Homo sapiens
tagttttaacagaaccagagggt

SEQ ID NO: 2099198 - DNA, 15 bp, Homo sapiens
tataaaacacatcaa

SEQ ID NO: 2099199 - DNA, 21 bp, Homo sapiens
tataaaactcagttaaaatgt

SEQ ID NO: 2099200 - DNA, 17 bp, Homo sapiens
tataaaatctagatcaa

SEQ ID NO: 2099201 - DNA, 19 bp, Homo sapiens
tataaaatctagatcaatt

SEQ ID NO: 2099202 - DNA, 23 bp, Homo sapiens
tataaaatgcaaaataaatgttt

SEQ ID NO: 2099203 - DNA, 18 bp, Homo sapiens
tataaactactgtaatta

SEQ ID NO: 2099204 - DNA, 11 bp, Homo sapiens
tataaactgaa

SEQ ID NO: 2099205 - DNA, 20 bp, Homo sapiens
tataaactgaaaaatgtcag

SEQ ID NO: 2099206 - DNA, 22 bp, Homo sapiens
tataaagaacaaggtagttttt

SEQ ID NO: 2099207 - DNA, 17 bp, Homo sapiens
tataaagatggctgact

SEQ ID NO: 2099208 - DNA, 15 bp, Homo sapiens
tataaagcagtagac

SEQ ID NO: 2099209 - DNA, 12 bp, Homo sapiens
tataaataaatg

SEQ ID NO: 2099210 - DNA, 15 bp, Homo sapiens
tataaataaatgcca

SEQ ID NO: 2099211 - DNA, 16 bp, Homo sapiens
tataaataaatgccaa

SEQ ID NO: 2099212 - DNA, 15 bp, Homo sapiens
tataaatatatattt

SEQ ID NO: 2099213 - DNA, 23 bp, Homo sapiens
tataaatatatatttttcaacca

SEQ ID NO: 2099214 - DNA, 14 bp, Homo sapiens
tataaatgcatgat

SEQ ID NO: 2099215 - DNA, 23 bp, Homo sapiens
tataaatgcatgattttatacat

SEQ ID NO: 2099216 - DNA, 18 bp, Homo sapiens
tataaatgtatatacaca

SEQ ID NO: 2099217 - DNA, 13 bp, Homo sapiens
tataaatgtgtgg

SEQ ID NO: 2099218 - DNA, 11 bp, Homo sapiens
tataaattaag

SEQ ID NO: 2099219 - DNA, 16 bp, Homo sapiens
tataaattaagacttt

SEQ ID NO: 2099220 - DNA, 18 bp, Homo sapiens
tataaattaagactttaa

SEQ ID NO: 2099221 - DNA, 22 bp, Homo sapiens
tataacatgtctttcagcatta

SEQ ID NO: 2099222 - DNA, 13 bp, Homo sapiens
tataaccattaca

SEQ ID NO: 2099223 - DNA, 16 bp, Homo sapiens
tataactcatcataaa

SEQ ID NO: 2099224 - DNA, 20 bp, Homo sapiens
tataactcatcataaaataa

SEQ ID NO: 2099225 - DNA, 22 bp, Homo sapiens
tataacttaaaaaaatgacaga

SEQ ID NO: 2099226 - DNA, 12 bp, Homo sapiens
tataagaatcat

SEQ ID NO: 2099227 - DNA, 15 bp, Homo sapiens
tataagaatcatagt

SEQ ID NO: 2099228 - DNA, 22 bp, Homo sapiens
tataagcaaatttcaaaagaca

SEQ ID NO: 2099229 - DNA, 21 bp, Homo sapiens
tataagcccaaatggctctgt

SEQ ID NO: 2099230 - DNA, 23 bp, Homo sapiens
tataagcccaaatggctctgtga

SEQ ID NO: 2099231 - DNA, 17 bp, Homo sapiens
tataagtgcacacagaa

SEQ ID NO: 2099232 - DNA, 21 bp, Homo sapiens
tataagtgcacacagaaatat

SEQ ID NO: 2099233 - DNA, 18 bp, Homo sapiens
tataatactaaagtgtct

SEQ ID NO: 2099234 - DNA, 17 bp, Homo sapiens
tataatatactatattt

SEQ ID NO: 2099235 - DNA, 13 bp, Homo sapiens
tataatctattta

SEQ ID NO: 2099236 - DNA, 18 bp, Homo sapiens
tataatctatttacataa

SEQ ID NO: 2099237 - DNA, 21 bp, Homo sapiens
tataatggaagagaaatctca

SEQ ID NO: 2099238 - DNA, 11 bp, Homo sapiens
tataattggga

SEQ ID NO: 2099239 - DNA, 22 bp, Homo sapiens
tataattgttttatctgaattt

SEQ ID NO: 2099240 - DNA, 22 bp, Homo sapiens
tataatttaacttcagagggaa

SEQ ID NO: 2099241 - DNA, 16 bp, Homo sapiens
tataatttaatgcatg

SEQ ID NO: 2099242 - DNA, 22 bp, Homo sapiens
tataattttatgaatgtctttg

SEQ ID NO: 2099243 - DNA, 21 bp, Homo sapiens
tataatttttttcaatattta

SEQ ID NO: 2099244 - DNA, 18 bp, Homo sapiens
tatacaaaataatttaac

SEQ ID NO: 2099245 - DNA, 23 bp, Homo sapiens
tatacaaaataatttaactaatt

SEQ ID NO: 2099246 - DNA, 13 bp, Homo sapiens
tatacaatatata

SEQ ID NO: 2099247 - DNA, 15 bp, Homo sapiens
tatacaatatataaa

SEQ ID NO: 2099248 - DNA, 20 bp, Homo sapiens
tatacaatgttctgttgtaa

SEQ ID NO: 2099249 - DNA, 12 bp, Homo sapiens
tatacacacata

SEQ ID NO: 2099250 - DNA, 22 bp, Homo sapiens
tatacacacatatacatatata

SEQ ID NO: 2099251 - DNA, 15 bp, Homo sapiens
tatacacatacatac

SEQ ID NO: 2099252 - DNA, 16 bp, Homo sapiens
tatacacatacataca

SEQ ID NO: 2099253 - DNA, 17 bp, Homo sapiens
tatacacatatacctat

SEQ ID NO: 2099254 - DNA, 19 bp, Homo sapiens
tatacatacacttgtataa

SEQ ID NO: 2099255 - DNA, 18 bp, Homo sapiens
tatacatacctctctcta

SEQ ID NO: 2099256 - DNA, 16 bp, Homo sapiens
tatacatagtcacaaa

SEQ ID NO: 2099257 - DNA, 19 bp, Homo sapiens
tatacatagtcacaaaaat

SEQ ID NO: 2099258 - DNA, 14 bp, Homo sapiens
tatacatatcagaa

SEQ ID NO: 2099259 - DNA, 18 bp, Homo sapiens
tatacatatcagaaaagt

SEQ ID NO: 2099260 - DNA, 23 bp, Homo sapiens
tatacatatcagaaaagtagaat

SEQ ID NO: 2099261 - DNA, 19 bp, Homo sapiens
tatacatatgtagactata

SEQ ID NO: 2099262 - DNA, 17 bp, Homo sapiens
tatacatattataaata

SEQ ID NO: 2099263 - DNA, 12 bp, Homo sapiens
tatacatgtgtg

SEQ ID NO: 2099264 - DNA, 16 bp, Homo sapiens
tatacatgtgtgtata

SEQ ID NO: 2099265 - DNA, 18 bp, Homo sapiens
tatacatgtgtgtatata

SEQ ID NO: 2099266 - DNA, 22 bp, Homo sapiens
tatacatgtgtgtatatatgtg

SEQ ID NO: 2099267 - DNA, 23 bp, Homo sapiens
tatacatttcataaggcctgccc

SEQ ID NO: 2099268 - DNA, 13 bp, Homo sapiens
tatacattttgtt

SEQ ID NO: 2099269 - DNA, 17 bp, Homo sapiens
tataccatatgtctgct

SEQ ID NO: 2099270 - DNA, 15 bp, Homo sapiens
tatacctataatgtg

SEQ ID NO: 2099271 - DNA, 21 bp, Homo sapiens
tatacctataatgtgtgtatg

SEQ ID NO: 2099272 - DNA, 21 bp, Homo sapiens
tatacttttttcttatttaac

SEQ ID NO: 2099273 - DNA, 19 bp, Homo sapiens
tatagaaagctgtttattt

SEQ ID NO: 2099274 - DNA, 13 bp, Homo sapiens
tatagacagcact

SEQ ID NO: 2099275 - DNA, 17 bp, Homo sapiens
tatagagatatgcagaa

SEQ ID NO: 2099276 - DNA, 17 bp, Homo sapiens
tatagagttcatcccag

SEQ ID NO: 2099277 - DNA, 13 bp, Homo sapiens
tatagcaatccat

SEQ ID NO: 2099278 - DNA, 23 bp, Homo sapiens
tatagcaatccatgttagttttt

SEQ ID NO: 2099279 - DNA, 19 bp, Homo sapiens
tatagcaatgtaacattaa

SEQ ID NO: 2099280 - DNA, 21 bp, Homo sapiens
tatagcagcaaaaatataaaa

SEQ ID NO: 2099281 - DNA, 22 bp, Homo sapiens
tatagccaaaaatagctaaata

SEQ ID NO: 2099282 - DNA, 12 bp, Homo sapiens
tattaaacttct

SEQ ID NO: 2099283 - DNA, 17 bp, Homo sapiens
tattaaacttgtcagaa

SEQ ID NO: 2099284 - DNA, 13 bp, Homo sapiens
tattaaaggcttt

SEQ ID NO: 2099285 - DNA, 14 bp, Homo sapiens
tattaaagtgccat

SEQ ID NO: 2099286 - DNA, 13 bp, Homo sapiens
tattaaatacaga

SEQ ID NO: 2099287 - DNA, 15 bp, Homo sapiens
tattaaatatttaac

SEQ ID NO: 2099288 - DNA, 21 bp, Homo sapiens
tattaaatatttaacataggt

SEQ ID NO: 2099289 - DNA, 14 bp, Homo sapiens
tattaaatcttttt

SEQ ID NO: 2099290 - DNA, 22 bp, Homo sapiens
tattaactggctactgggaaat

SEQ ID NO: 2099291 - DNA, 21 bp, Homo sapiens
tattaagtctgggatgtagaa

SEQ ID NO: 2099292 - DNA, 20 bp, Homo sapiens
tattaataaattttaacatt

SEQ ID NO: 2099293 - DNA, 22 bp, Homo sapiens
tattaataaattttaacatttt

SEQ ID NO: 2099294 - DNA, 16 bp, Homo sapiens
tattaataccaaatat

SEQ ID NO: 2099295 - DNA, 17 bp, Homo sapiens
tattaatattcattgta

SEQ ID NO: 2099296 - DNA, 19 bp, Homo sapiens
tattaatcaactttcctta

SEQ ID NO: 2099297 - DNA, 15 bp, Homo sapiens
tattaatcttatgtg

SEQ ID NO: 2099298 - DNA, 17 bp, Homo sapiens
tattacactgtatttgt

SEQ ID NO: 2099299 - DNA, 19 bp, Homo sapiens
tattacactgtatttgtat

SEQ ID NO: 2099300 - DNA, 17 bp, Homo sapiens
tattacatctaatgctt

SEQ ID NO: 2099301 - DNA, 20 bp, Homo sapiens
tattaccaaaaaagtatttt

SEQ ID NO: 2099302 - DNA, 21 bp, Homo sapiens
tattaccaaaaaagtattttt

SEQ ID NO: 2099303 - DNA, 14 bp, Homo sapiens
tattacctcaaatt

SEQ ID NO: 2099304 - DNA, 23 bp, Homo sapiens
tattactgtctggttttaacaat

SEQ ID NO: 2099305 - DNA, 13 bp, Homo sapiens
tattagttaatat

SEQ ID NO: 2099306 - DNA, 21 bp, Homo sapiens
tattagtttgatttaatatct

SEQ ID NO: 2099307 - DNA, 22 bp, Homo sapiens
tattagtttgatttaatatctg

SEQ ID NO: 2099308 - DNA, 13 bp, Homo sapiens
tattataaataaa

SEQ ID NO: 2099309 - DNA, 13 bp, Homo sapiens
tattataactgca

SEQ ID NO: 2099310 - DNA, 17 bp, Homo sapiens
tattataataatgttct

SEQ ID NO: 2099311 - DNA, 15 bp, Homo sapiens
tattataatttaatg

SEQ ID NO: 2099312 - DNA, 21 bp, Homo sapiens
tattatgactcaataaaagaa

SEQ ID NO: 2099313 - DNA, 15 bp, Homo sapiens
tattatggcaagtga

SEQ ID NO: 2099314 - DNA, 15 bp, Homo sapiens
tattatggtgtaatg

SEQ ID NO: 2099315 - DNA, 18 bp, Homo sapiens
tattatggtgtaatgcac

SEQ ID NO: 2099316 - DNA, 22 bp, Homo sapiens
tattatggtgtaatgcacaatt

SEQ ID NO: 2099317 - DNA, 20 bp, Homo sapiens
tattatgtaacatccagaag

SEQ ID NO: 2099318 - DNA, 14 bp, Homo sapiens
tattattaataaat

SEQ ID NO: 2099319 - DNA, 11 bp, Homo sapiens
tattattgggg

SEQ ID NO: 2099320 - DNA, 15 bp, Homo sapiens
tattattgtgtgtta

SEQ ID NO: 2099321 - DNA, 19 bp, Homo sapiens
tattatttaaatgttgaaa

SEQ ID NO: 2099322 - DNA, 16 bp, Homo sapiens
tattattttcacctgt

SEQ ID NO: 2099323 - DNA, 20 bp, Homo sapiens
tattattttctatagctctt

SEQ ID NO: 2099324 - DNA, 17 bp, Homo sapiens
tattattttttccacat

SEQ ID NO: 2099325 - DNA, 15 bp, Homo sapiens
tattcaagtgcctct

SEQ ID NO: 2099326 - DNA, 11 bp, Homo sapiens
tattcaataaa

SEQ ID NO: 2099327 - DNA, 20 bp, Homo sapiens
tattcaataaaaaaaagaaa

SEQ ID NO: 2099328 - DNA, 22 bp, Homo sapiens
tattcaataaaaaaaagaaatg

SEQ ID NO: 2099329 - DNA, 12 bp, Homo sapiens
tattcaataaag

SEQ ID NO: 2099330 - DNA, 20 bp, Homo sapiens
tattcactgtaagtttattt

SEQ ID NO: 2099331 - DNA, 14 bp, Homo sapiens
tattcagacaagca

SEQ ID NO: 2099332 - DNA, 22 bp, Homo sapiens
tattcagacaagcaacaggttt

SEQ ID NO: 2099333 - DNA, 17 bp, Homo sapiens
tattcagagaatatcaa

SEQ ID NO: 2099334 - DNA, 17 bp, Homo sapiens
tattcagagatgtacca

SEQ ID NO: 2099335 - DNA, 20 bp, Homo sapiens
tattcagagatgtaccatgt

SEQ ID NO: 2099336 - DNA, 21 bp, Homo sapiens
tattcagatcgtattaattat

SEQ ID NO: 2099337 - DNA, 21 bp, Homo sapiens
tattcagcttcatttgtgtca

SEQ ID NO: 2099338 - DNA, 14 bp, Homo sapiens
tattcagtaaaaaa

SEQ ID NO: 2099339 - DNA, 18 bp, Homo sapiens
tattcagtgctgtggcct

SEQ ID NO: 2099340 - DNA, 21 bp, Homo sapiens
tattcagtgctgtggcctggg

SEQ ID NO: 2099341 - DNA, 16 bp, Homo sapiens
tattcataataaacta

SEQ ID NO: 2099342 - DNA, 14 bp, Homo sapiens
tattcatgcttctt

SEQ ID NO: 2099343 - DNA, 19 bp, Homo sapiens
tattcatgctttctccttt

SEQ ID NO: 2099344 - DNA, 14 bp, Homo sapiens
tattcatgtaataa

SEQ ID NO: 2099345 - DNA, 20 bp, Homo sapiens
tattcattcagtgagacaca

SEQ ID NO: 2099346 - DNA, 14 bp, Homo sapiens
tattcatttaaaat

SEQ ID NO: 2099347 - DNA, 17 bp, Homo sapiens
tattccaccattcacat

SEQ ID NO: 2099348 - DNA, 19 bp, Homo sapiens
tattccaccattcacattt

SEQ ID NO: 2099349 - DNA, 14 bp, Homo sapiens
tattccatatatta

SEQ ID NO: 2099350 - DNA, 18 bp, Homo sapiens
tattccatccatatactt

SEQ ID NO: 2099351 - DNA, 19 bp, Homo sapiens
tattccatccatatacttt

SEQ ID NO: 2099352 - DNA, 22 bp, Homo sapiens
tattccatttttactaaagcag

SEQ ID NO: 2099353 - DNA, 23 bp, Homo sapiens
tattccatttttactaaagcagt

SEQ ID NO: 2099354 - DNA, 20 bp, Homo sapiens
tattcccatgtgtgactcca

SEQ ID NO: 2099355 - DNA, 20 bp, Homo sapiens
tattcccctatctctagaat

SEQ ID NO: 2099356 - DNA, 21 bp, Homo sapiens
tattccctgtacaatatttaa

SEQ ID NO: 2099357 - DNA, 18 bp, Homo sapiens
tattccctgttaaaattt

SEQ ID NO: 2099358 - DNA, 20 bp, Homo sapiens
tattcctatatagtttattg

SEQ ID NO: 2099359 - DNA, 20 bp, Homo sapiens
tattcctgaatgaaatatca

SEQ ID NO: 2099360 - DNA, 22 bp, Homo sapiens
tattcctgaccctccctacctg

SEQ ID NO: 2099361 - DNA, 20 bp, Homo sapiens
tattcctgcatttgtgaaat

SEQ ID NO: 2099362 - DNA, 20 bp, Homo sapiens
tattccttttgtgtacagtg

SEQ ID NO: 2099363 - DNA, 15 bp, Homo sapiens
tattctaattttata

SEQ ID NO: 2099364 - DNA, 22 bp, Homo sapiens
tattctacacatatatgtatat

SEQ ID NO: 2099365 - DNA, 16 bp, Homo sapiens
tattctatgagaacaa

SEQ ID NO: 2099366 - DNA, 14 bp, Homo sapiens
tattctcaccagga

SEQ ID NO: 2099367 - DNA, 16 bp, Homo sapiens
tattctcactccacca

SEQ ID NO: 2099368 - DNA, 11 bp, Homo sapiens
tattctccatg

SEQ ID NO: 2099369 - DNA, 11 bp, Homo sapiens
tattctgagcc

SEQ ID NO: 2099370 - DNA, 14 bp, Homo sapiens
tattctgattccac

SEQ ID NO: 2099371 - DNA, 12 bp, Homo sapiens
tattctggaaaa

SEQ ID NO: 2099372 - DNA, 14 bp, Homo sapiens
tattctggaaaaaa

SEQ ID NO: 2099373 - DNA, 20 bp, Homo sapiens
tattctgggctcctggaacc

SEQ ID NO: 2099374 - DNA, 22 bp, Homo sapiens
tattctgggctcctggaaccaa

SEQ ID NO: 2099375 - DNA, 18 bp, Homo sapiens
tattctgtgttgaacaca

SEQ ID NO: 2099376 - DNA, 16 bp, Homo sapiens
tattcttatgcagggt

SEQ ID NO: 2099377 - DNA, 16 bp, Homo sapiens
tattgaaattactgaa

SEQ ID NO: 2099378 - DNA, 19 bp, Homo sapiens
tattgaaattactgaaaac

SEQ ID NO: 2099379 - DNA, 16 bp, Homo sapiens
tattgaagaaaagcac

SEQ ID NO: 2099380 - DNA, 14 bp, Homo sapiens
tattgaatcttaat

SEQ ID NO: 2099381 - DNA, 12 bp, Homo sapiens
tattgaatgttt

SEQ ID NO: 2099382 - DNA, 17 bp, Homo sapiens
tattgacaataatttca

SEQ ID NO: 2099383 - DNA, 18 bp, Homo sapiens
tattgacaataatttcag

SEQ ID NO: 2099384 - DNA, 16 bp, Homo sapiens
tattgatgtttccaga

SEQ ID NO: 2099385 - DNA, 19 bp, Homo sapiens
tattgatgtttccagaaaa

SEQ ID NO: 2099386 - DNA, 15 bp, Homo sapiens
tattgcatatgcata

SEQ ID NO: 2099387 - DNA, 14 bp, Homo sapiens
tattgcccacgctg

SEQ ID NO: 2099388 - DNA, 15 bp, Homo sapiens
tattgcccacgctgg

SEQ ID NO: 2099389 - DNA, 19 bp, Homo sapiens
tattgcgaatgtgcagaaa

SEQ ID NO: 2099390 - DNA, 17 bp, Homo sapiens
tattgggagggatgaga

SEQ ID NO: 2099391 - DNA, 18 bp, Homo sapiens
tattgtaaacagaaggag

SEQ ID NO: 2099392 - DNA, 15 bp, Homo sapiens
tattgtaaacatgtg

SEQ ID NO: 2099393 - DNA, 18 bp, Homo sapiens
tattgtaaacatgtgttt

SEQ ID NO: 2099394 - DNA, 23 bp, Homo sapiens
tattgtaaatttggatttacgac

SEQ ID NO: 2099395 - DNA, 16 bp, Homo sapiens
tattgtaatgaatatc

SEQ ID NO: 2099396 - DNA, 13 bp, Homo sapiens
tattgtacctctc

SEQ ID NO: 2099397 - DNA, 15 bp, Homo sapiens
tcactgcacagtgca

SEQ ID NO: 2099398 - DNA, 12 bp, Homo sapiens
tcactgcagcct

SEQ ID NO: 2099399 - DNA, 14 bp, Homo sapiens
tcactgccatgcct

SEQ ID NO: 2099400 - DNA, 20 bp, Homo sapiens
tcactgccccaccagccacc

SEQ ID NO: 2099401 - DNA, 15 bp, Homo sapiens
tcactgccttccagg

SEQ ID NO: 2099402 - DNA, 22 bp, Homo sapiens
tcactgctacaccttagcagct

SEQ ID NO: 2099403 - DNA, 12 bp, Homo sapiens
tcactgctggct

SEQ ID NO: 2099404 - DNA, 18 bp, Homo sapiens
tcactggaccactgggca

SEQ ID NO: 2099405 - DNA, 12 bp, Homo sapiens
tcactggagccc

SEQ ID NO: 2099406 - DNA, 17 bp, Homo sapiens
tcactggagcccaggag

SEQ ID NO: 2099407 - DNA, 20 bp, Homo sapiens
tcactggagtagttgctact

SEQ ID NO: 2099408 - DNA, 15 bp, Homo sapiens
tcactggcaatattt

SEQ ID NO: 2099409 - DNA, 16 bp, Homo sapiens
tcactggcaatgaaaa

SEQ ID NO: 2099410 - DNA, 11 bp, Homo sapiens
tcactggctgg

SEQ ID NO: 2099411 - DNA, 21 bp, Homo sapiens
tcactggggtcctggggcctc

SEQ ID NO: 2099412 - DNA, 23 bp, Homo sapiens
tcactgtaagactcattccctag

SEQ ID NO: 2099413 - DNA, 14 bp, Homo sapiens
tcactgtcttcaca

SEQ ID NO: 2099414 - DNA, 15 bp, Homo sapiens
tcactgttgaaaatt

SEQ ID NO: 2099415 - DNA, 18 bp, Homo sapiens
tcactgttgaaaattatt

SEQ ID NO: 2099416 - DNA, 19 bp, Homo sapiens
tcactgttgaaaattattt

SEQ ID NO: 2099417 - DNA, 18 bp, Homo sapiens
tcactgttgcccaggctg

SEQ ID NO: 2099418 - DNA, 19 bp, Homo sapiens
tcactgttgcccaggctgg

SEQ ID NO: 2099419 - DNA, 20 bp, Homo sapiens
tcacttccagtgttggctgt

SEQ ID NO: 2099420 - DNA, 13 bp, Homo sapiens
tcacttccctggg

SEQ ID NO: 2099421 - DNA, 15 bp, Homo sapiens
tcacttccctgggaa

SEQ ID NO: 2099422 - DNA, 19 bp, Homo sapiens
tcacttccctgggaactca

SEQ ID NO: 2099423 - DNA, 18 bp, Homo sapiens
tcacttgaacccgggagg

SEQ ID NO: 2099424 - DNA, 13 bp, Homo sapiens
tcacttgaatgtg

SEQ ID NO: 2099425 - DNA, 22 bp, Homo sapiens
tcacttgaggtcaggagttcct

SEQ ID NO: 2099426 - DNA, 21 bp, Homo sapiens
tcactttaccttcagcagtta

SEQ ID NO: 2099427 - DNA, 12 bp, Homo sapiens
tcacttttcctc

SEQ ID NO: 2099428 - DNA, 13 bp, Homo sapiens
tcacttttcctcc

SEQ ID NO: 2099429 - DNA, 19 bp, Homo sapiens
tcagaaaacataatataag

SEQ ID NO: 2099430 - DNA, 15 bp, Homo sapiens
tcagaaaagaaaacc

SEQ ID NO: 2099431 - DNA, 18 bp, Homo sapiens
tcagaaaagaaaaccatt

SEQ ID NO: 2099432 - DNA, 10 bp, Homo sapiens
tcagaaaagt

SEQ ID NO: 2099433 - DNA, 22 bp, Homo sapiens
tcagaaaccagttatgtgaatg

SEQ ID NO: 2099434 - DNA, 17 bp, Homo sapiens
tcagaaagggagggctc

SEQ ID NO: 2099435 - DNA, 22 bp, Homo sapiens
tcagaaataaaatgaaatgtct

SEQ ID NO: 2099436 - DNA, 12 bp, Homo sapiens
tcagaaatatgt

SEQ ID NO: 2099437 - DNA, 21 bp, Homo sapiens
tcagaacagaggcatttaaaa

SEQ ID NO: 2099438 - DNA, 14 bp, Homo sapiens
tcagaacatgctgg

SEQ ID NO: 2099439 - DNA, 13 bp, Homo sapiens
tcagaagacactg

SEQ ID NO: 2099440 - DNA, 20 bp, Homo sapiens
tcagaagcctgaggctggga

SEQ ID NO: 2099441 - DNA, 12 bp, Homo sapiens
tcagaagcctgg

SEQ ID NO: 2099442 - DNA, 14 bp, Homo sapiens
tcagaagcctttgg

SEQ ID NO: 2099443 - DNA, 13 bp, Homo sapiens
tcagaaggagaag

SEQ ID NO: 2099444 - DNA, 15 bp, Homo sapiens
tcagaaggagaagga

SEQ ID NO: 2099445 - DNA, 19 bp, Homo sapiens
tcagaaggagaaggaagga

SEQ ID NO: 2099446 - DNA, 23 bp, Homo sapiens
tcagaaggagaaggaaggagact

SEQ ID NO: 2099447 - DNA, 15 bp, Homo sapiens
tcagaaggggacctg

SEQ ID NO: 2099448 - DNA, 18 bp, Homo sapiens
tcagacaataccactggt

SEQ ID NO: 2099449 - DNA, 18 bp, Homo sapiens
tcagacaatccactctca

SEQ ID NO: 2099450 - DNA, 22 bp, Homo sapiens
tcagacaatccactctcaggag

SEQ ID NO: 2099451 - DNA, 23 bp, Homo sapiens
tcagacaatccactctcaggagg

SEQ ID NO: 2099452 - DNA, 17 bp, Homo sapiens
tcagacaattcagaagc

SEQ ID NO: 2099453 - DNA, 22 bp, Homo sapiens
tcagacagcttatggggtattt

SEQ ID NO: 2099454 - DNA, 19 bp, Homo sapiens
tcagacaggtaaatgggca

SEQ ID NO: 2099455 - DNA, 21 bp, Homo sapiens
tcagacatccatgtttgtaaa

SEQ ID NO: 2099456 - DNA, 15 bp, Homo sapiens
tcagacattccaagg

SEQ ID NO: 2099457 - DNA, 12 bp, Homo sapiens
tcagaccccagc

SEQ ID NO: 2099458 - DNA, 22 bp, Homo sapiens
tcagacccccactctcattccc

SEQ ID NO: 2099459 - DNA, 12 bp, Homo sapiens
tcagacctctga

SEQ ID NO: 2099460 - DNA, 11 bp, Homo sapiens
tcagactctgg

SEQ ID NO: 2099461 - DNA, 15 bp, Homo sapiens
tcagactgctgggac

SEQ ID NO: 2099462 - DNA, 16 bp, Homo sapiens
tcagactgctgggact

SEQ ID NO: 2099463 - DNA, 23 bp, Homo sapiens
tcagactgctgggactggccagg

SEQ ID NO: 2099464 - DNA, 13 bp, Homo sapiens
tcagactggctgg

SEQ ID NO: 2099465 - DNA, 14 bp, Homo sapiens
tcagactggctggc

SEQ ID NO: 2099466 - DNA, 21 bp, Homo sapiens
tcagactggctggctgcagtg

SEQ ID NO: 2099467 - DNA, 16 bp, Homo sapiens
tcagactttaaagaat

SEQ ID NO: 2099468 - DNA, 13 bp, Homo sapiens
tcagagaatttct

SEQ ID NO: 2099469 - DNA, 17 bp, Homo sapiens
tcagagactcagggccc

SEQ ID NO: 2099470 - DNA, 22 bp, Homo sapiens
tcagagagcgagcgctacccac

SEQ ID NO: 2099471 - DNA, 21 bp, Homo sapiens
tcagagaggccttttggaatg

SEQ ID NO: 2099472 - DNA, 15 bp, Homo sapiens
tcagagatgggctga

SEQ ID NO: 2099473 - DNA, 14 bp, Homo sapiens
tcagagatgtacca

SEQ ID NO: 2099474 - DNA, 21 bp, Homo sapiens
tcagagccacccctaaagaga

SEQ ID NO: 2099475 - DNA, 19 bp, Homo sapiens
tcagagccaggctctgcct

SEQ ID NO: 2099476 - DNA, 15 bp, Homo sapiens
tcagagccagtgaag

SEQ ID NO: 2099477 - DNA, 18 bp, Homo sapiens
tcagagccagtgaaggag

SEQ ID NO: 2099478 - DNA, 21 bp, Homo sapiens
tcagagccagtgaaggagcca

SEQ ID NO: 2099479 - DNA, 14 bp, Homo sapiens
tcagagcctagcca

SEQ ID NO: 2099480 - DNA, 18 bp, Homo sapiens
tcagagcctagccacctc

SEQ ID NO: 2099481 - DNA, 22 bp, Homo sapiens
tcagagcctagccacctcccac

SEQ ID NO: 2099482 - DNA, 12 bp, Homo sapiens
tcagagcctgca

SEQ ID NO: 2099483 - DNA, 15 bp, Homo sapiens
tcagagcctgcagtt

SEQ ID NO: 2099484 - DNA, 17 bp, Homo sapiens
tcagagctcttcaagct

SEQ ID NO: 2099485 - DNA, 22 bp, Homo sapiens
tcagagctcttcaagctgtccc

SEQ ID NO: 2099486 - DNA, 18 bp, Homo sapiens
tcagagctgttggcctcg

SEQ ID NO: 2099487 - DNA, 23 bp, Homo sapiens
tcagagctgttggcctcgcctgg

SEQ ID NO: 2099488 - DNA, 13 bp, Homo sapiens
tcagaggagaaga

SEQ ID NO: 2099489 - DNA, 18 bp, Homo sapiens
tcagaggctaagatgaga

SEQ ID NO: 2099490 - DNA, 13 bp, Homo sapiens
tcagaggctgcag

SEQ ID NO: 2099491 - DNA, 19 bp, Homo sapiens
tcagagttgcttttctaat

SEQ ID NO: 2099492 - DNA, 20 bp, Homo sapiens
tcagagttgtacactgtgta

SEQ ID NO: 2099493 - DNA, 18 bp, Homo sapiens
tcagatatatatcatatt

SEQ ID NO: 2099494 - DNA, 13 bp, Homo sapiens
tcagatcagtgct

SEQ ID NO: 2099495 - DNA, 17 bp, Homo sapiens
tcagatcgtattaatta

SEQ ID NO: 2099496 - DNA, 18 bp, Homo sapiens
tcagatcgtattaattat

SEQ ID NO: 2099497 - DNA, 22 bp, Homo sapiens
tcagatcgtattaattatctga

SEQ ID NO: 2099498 - DNA, 19 bp, Homo sapiens
tcagattccacacaaaatg

SEQ ID NO: 2099499 - DNA, 21 bp, Homo sapiens
tcagattcccagagcaaaata

SEQ ID NO: 2099500 - DNA, 16 bp, Homo sapiens
tcagattgacaaggta

SEQ ID NO: 2099501 - DNA, 19 bp, Homo sapiens
tcagcaagacttctctttg

SEQ ID NO: 2099502 - DNA, 17 bp, Homo sapiens
tcagcaatagggtgcag

SEQ ID NO: 2099503 - DNA, 17 bp, Homo sapiens
tcagcacaccccaaggg

SEQ ID NO: 2099504 - DNA, 14 bp, Homo sapiens
tcagcaccatggag

SEQ ID NO: 2099505 - DNA, 12 bp, Homo sapiens
tcagcactgaaa

SEQ ID NO: 2099506 - DNA, 15 bp, Homo sapiens
tcagcactgaaaata

SEQ ID NO: 2099507 - DNA, 17 bp, Homo sapiens
tcagcagcagagagccc

SEQ ID NO: 2099508 - DNA, 17 bp, Homo sapiens
tcagcagccccctgccc

SEQ ID NO: 2099509 - DNA, 12 bp, Homo sapiens
tcagcagccctc

SEQ ID NO: 2099510 - DNA, 15 bp, Homo sapiens
tcagcagccctcctc

SEQ ID NO: 2099511 - DNA, 15 bp, Homo sapiens
tcagcatcctggcac

SEQ ID NO: 2099512 - DNA, 13 bp, Homo sapiens
tcattgtaaatta

SEQ ID NO: 2099513 - DNA, 15 bp, Homo sapiens
tcattgtataaaaat

SEQ ID NO: 2099514 - DNA, 16 bp, Homo sapiens
tcattgtatatatgtg

SEQ ID NO: 2099515 - DNA, 17 bp, Homo sapiens
tcattgtatatatgtgt

SEQ ID NO: 2099516 - DNA, 14 bp, Homo sapiens
tcattgtatgatgt

SEQ ID NO: 2099517 - DNA, 15 bp, Homo sapiens
tcatttaagggaaaa

SEQ ID NO: 2099518 - DNA, 17 bp, Homo sapiens
tcatttaagggaaaaat

SEQ ID NO: 2099519 - DNA, 18 bp, Homo sapiens
tcatttcactttaaagtc

SEQ ID NO: 2099520 - DNA, 11 bp, Homo sapiens
tcatttcatct

SEQ ID NO: 2099521 - DNA, 20 bp, Homo sapiens
tcatttcatctcatttaagg

SEQ ID NO: 2099522 - DNA, 12 bp, Homo sapiens
tcatttccgtga

SEQ ID NO: 2099523 - DNA, 22 bp, Homo sapiens
tcatttctaattttaagttatt

SEQ ID NO: 2099524 - DNA, 19 bp, Homo sapiens
tcatttcttttccaaaatt

SEQ ID NO: 2099525 - DNA, 19 bp, Homo sapiens
tcatttgagcagggctcag

SEQ ID NO: 2099526 - DNA, 21 bp, Homo sapiens
tcatttgagcagggctcagcg

SEQ ID NO: 2099527 - DNA, 20 bp, Homo sapiens
tcatttgctaactagcttgg

SEQ ID NO: 2099528 - DNA, 13 bp, Homo sapiens
tcatttgcttttt

SEQ ID NO: 2099529 - DNA, 13 bp, Homo sapiens
tcatttgtgtcaa

SEQ ID NO: 2099530 - DNA, 15 bp, Homo sapiens
tcatttgttggaatg

SEQ ID NO: 2099531 - DNA, 13 bp, Homo sapiens
tcattttaattat

SEQ ID NO: 2099532 - DNA, 13 bp, Homo sapiens
tcattttaattta

SEQ ID NO: 2099533 - DNA, 12 bp, Homo sapiens
tcattttctatt

SEQ ID NO: 2099534 - DNA, 14 bp, Homo sapiens
tcattttggtactt

SEQ ID NO: 2099535 - DNA, 19 bp, Homo sapiens
tcatttttagtagagacag

SEQ ID NO: 2099536 - DNA, 23 bp, Homo sapiens
tccaaaatttgaaatattaaaat

SEQ ID NO: 2099537 - DNA, 12 bp, Homo sapiens
tccaaacaccgg

SEQ ID NO: 2099538 - DNA, 17 bp, Homo sapiens
tccaaactcctgcctgt

SEQ ID NO: 2099539 - DNA, 15 bp, Homo sapiens
tccaaacttctaaat

SEQ ID NO: 2099540 - DNA, 22 bp, Homo sapiens
tccaaacttctaaatgttggaa

SEQ ID NO: 2099541 - DNA, 12 bp, Homo sapiens
tccaaagaaatg

SEQ ID NO: 2099542 - DNA, 17 bp, Homo sapiens
tccaaagaaatgtaagg

SEQ ID NO: 2099543 - DNA, 16 bp, Homo sapiens
tccaaagccccacctt

SEQ ID NO: 2099544 - DNA, 16 bp, Homo sapiens
tccaaaggggctgctg

SEQ ID NO: 2099545 - DNA, 18 bp, Homo sapiens
tccaaaggggctgctggg

SEQ ID NO: 2099546 - DNA, 20 bp, Homo sapiens
tccaaatgagacacattaaa

SEQ ID NO: 2099547 - DNA, 22 bp, Homo sapiens
tccaaatgtgatcaactgttca

SEQ ID NO: 2099548 - DNA, 19 bp, Homo sapiens
tccaacaactccaggaaaa

SEQ ID NO: 2099549 - DNA, 15 bp, Homo sapiens
tccaacaagttgcct

SEQ ID NO: 2099550 - DNA, 18 bp, Homo sapiens
tccaacactgaagtgctt

SEQ ID NO: 2099551 - DNA, 23 bp, Homo sapiens
tccaacactgaagtgcttgcaga

SEQ ID NO: 2099552 - DNA, 13 bp, Homo sapiens
tccaacagtgagt

SEQ ID NO: 2099553 - DNA, 22 bp, Homo sapiens
tccaacccatgatgagctcctc

SEQ ID NO: 2099554 - DNA, 12 bp, Homo sapiens
tccaaccccagc

SEQ ID NO: 2099555 - DNA, 14 bp, Homo sapiens
tccaaccccagctg

SEQ ID NO: 2099556 - DNA, 18 bp, Homo sapiens
tccaacctaacccctttc

SEQ ID NO: 2099557 - DNA, 23 bp, Homo sapiens
tccaacctaacccctttcctgcg

SEQ ID NO: 2099558 - DNA, 19 bp, Homo sapiens
tccaacgttaaaagacagt

SEQ ID NO: 2099559 - DNA, 20 bp, Homo sapiens
tccaacgttaaaagacagtg

SEQ ID NO: 2099560 - DNA, 20 bp, Homo sapiens
tccaactcctggagatttca

SEQ ID NO: 2099561 - DNA, 18 bp, Homo sapiens
tccaactgtgttcattag

SEQ ID NO: 2099562 - DNA, 19 bp, Homo sapiens
tccaagaatacagaaaatg

SEQ ID NO: 2099563 - DNA, 15 bp, Homo sapiens
tccaagatttcagaa

SEQ ID NO: 2099564 - DNA, 23 bp, Homo sapiens
tccaagcataccaacacgagcag

SEQ ID NO: 2099565 - DNA, 23 bp, Homo sapiens
tccaagcgaggtcaacagagaag

SEQ ID NO: 2099566 - DNA, 18 bp, Homo sapiens
tccaagctccatctccac

SEQ ID NO: 2099567 - DNA, 23 bp, Homo sapiens
tccaagcttcaagtgatatatgt

SEQ ID NO: 2099568 - DNA, 12 bp, Homo sapiens
tccaagcttttg

SEQ ID NO: 2099569 - DNA, 19 bp, Homo sapiens
tccaaggagaaacagagac

SEQ ID NO: 2099570 - DNA, 22 bp, Homo sapiens
tccaaggagaaacagagacagg

SEQ ID NO: 2099571 - DNA, 12 bp, Homo sapiens
tccaaggagttc

SEQ ID NO: 2099572 - DNA, 22 bp, Homo sapiens
tccaagggtatgggaagccata

SEQ ID NO: 2099573 - DNA, 15 bp, Homo sapiens
tccaagtgccaatat

SEQ ID NO: 2099574 - DNA, 13 bp, Homo sapiens
tccaatcctcagg

SEQ ID NO: 2099575 - DNA, 18 bp, Homo sapiens
tccaatggagttcagaga

SEQ ID NO: 2099576 - DNA, 16 bp, Homo sapiens
tccaattatgtgacaa

SEQ ID NO: 2099577 - DNA, 21 bp, Homo sapiens
tccaattccacagtctctggg

SEQ ID NO: 2099578 - DNA, 20 bp, Homo sapiens
tccacaaagccgtgcctttc

SEQ ID NO: 2099579 - DNA, 23 bp, Homo sapiens
tccacaaagccgtgcctttctct

SEQ ID NO: 2099580 - DNA, 16 bp, Homo sapiens
tccacaagattcccag

SEQ ID NO: 2099581 - DNA, 17 bp, Homo sapiens
tccacaagattcccaga

SEQ ID NO: 2099582 - DNA, 20 bp, Homo sapiens
tccacaagattcccagagac

SEQ ID NO: 2099583 - DNA, 15 bp, Homo sapiens
tccacacaaaatgtc

SEQ ID NO: 2099584 - DNA, 12 bp, Homo sapiens
tccacacacaga

SEQ ID NO: 2099585 - DNA, 22 bp, Homo sapiens
tccacacacagaggaagagcag

SEQ ID NO: 2099586 - DNA, 23 bp, Homo sapiens
tccacacacagaggaagagcagg

SEQ ID NO: 2099587 - DNA, 19 bp, Homo sapiens
tccacacacgcaggaactc

SEQ ID NO: 2099588 - DNA, 20 bp, Homo sapiens
tccacagaaacattttcatt

SEQ ID NO: 2099589 - DNA, 18 bp, Homo sapiens
tccacagccaacaaacat

SEQ ID NO: 2099590 - DNA, 17 bp, Homo sapiens
tccacagccgcagcctc

SEQ ID NO: 2099591 - DNA, 17 bp, Homo sapiens
tccacaggggcaggcct

SEQ ID NO: 2099592 - DNA, 19 bp, Homo sapiens
tccacaggggcaggcctgg

SEQ ID NO: 2099593 - DNA, 16 bp, Homo sapiens
tccacagtagcatttc

SEQ ID NO: 2099594 - DNA, 18 bp, Homo sapiens
tccacagtctcccattct

SEQ ID NO: 2099595 - DNA, 13 bp, Homo sapiens
tccacagtgctgc

SEQ ID NO: 2099596 - DNA, 14 bp, Homo sapiens
tccacagtgctgct

SEQ ID NO: 2099597 - DNA, 15 bp, Homo sapiens
tccacatcttctcag

SEQ ID NO: 2099598 - DNA, 18 bp, Homo sapiens
tccacatctttaagtatt

SEQ ID NO: 2099599 - DNA, 22 bp, Homo sapiens
tccacattaattagattttctt

SEQ ID NO: 2099600 - DNA, 13 bp, Homo sapiens
tccaccaatctct

SEQ ID NO: 2099601 - DNA, 17 bp, Homo sapiens
tccacccacctcagcct

SEQ ID NO: 2099602 - DNA, 12 bp, Homo sapiens
tccacccagccc

SEQ ID NO: 2099603 - DNA, 15 bp, Homo sapiens
tccacccagcccatt

SEQ ID NO: 2099604 - DNA, 14 bp, Homo sapiens
tccacccaggagcc

SEQ ID NO: 2099605 - DNA, 15 bp, Homo sapiens
tccacccaggagccc

SEQ ID NO: 2099606 - DNA, 20 bp, Homo sapiens
tccacccaggagccccgagg

SEQ ID NO: 2099607 - DNA, 12 bp, Homo sapiens
tccacccaggct

SEQ ID NO: 2099608 - DNA, 14 bp, Homo sapiens
tccacccaggctgc

SEQ ID NO: 2099609 - DNA, 15 bp, Homo sapiens
tccacccaggctgca

SEQ ID NO: 2099610 - DNA, 14 bp, Homo sapiens
tccacccagtgctg

SEQ ID NO: 2099611 - DNA, 12 bp, Homo sapiens
tccaccccagga

SEQ ID NO: 2099612 - DNA, 21 bp, Homo sapiens
tccacccccgccacggccacc

SEQ ID NO: 2099613 - DNA, 18 bp, Homo sapiens
tccaccccctccagctcc

SEQ ID NO: 2099614 - DNA, 15 bp, Homo sapiens
tccaccgcagaagga

SEQ ID NO: 2099615 - DNA, 17 bp, Homo sapiens
tccaccgcagaaggaag

SEQ ID NO: 2099616 - DNA, 18 bp, Homo sapiens
tccaccgcagaaggaagg

SEQ ID NO: 2099617 - DNA, 15 bp, Homo sapiens
tccaccgggcctgaa

SEQ ID NO: 2099618 - DNA, 12 bp, Homo sapiens
tccacctcagcc

SEQ ID NO: 2099619 - DNA, 16 bp, Homo sapiens
tccacctcagccttgg

SEQ ID NO: 2099620 - DNA, 15 bp, Homo sapiens
tccacctccacccac

SEQ ID NO: 2099621 - DNA, 18 bp, Homo sapiens
tccacctcttcacccccc

SEQ ID NO: 2099622 - DNA, 23 bp, Homo sapiens
tccacctgcctatccatcctgcg

SEQ ID NO: 2099623 - DNA, 18 bp, Homo sapiens
tccacctgctttctcctg

SEQ ID NO: 2099624 - DNA, 20 bp, Homo sapiens
tccacctgctttctcctggg

SEQ ID NO: 2099625 - DNA, 15 bp, Homo sapiens
tccacgcacacatgg

SEQ ID NO: 2099626 - DNA, 16 bp, Homo sapiens
tccacgcacacatgga

SEQ ID NO: 2099627 - DNA, 22 bp, Homo sapiens
tccccctgggctctgccccagc

SEQ ID NO: 2099628 - DNA, 21 bp, Homo sapiens
tccccctggggcttctcctga

SEQ ID NO: 2099629 - DNA, 21 bp, Homo sapiens
tccccgcaccccccaagctgt

SEQ ID NO: 2099630 - DNA, 11 bp, Homo sapiens
tccccgcctgt

SEQ ID NO: 2099631 - DNA, 16 bp, Homo sapiens
tccccggactcaagcc

SEQ ID NO: 2099632 - DNA, 14 bp, Homo sapiens
tcccctaacctcat

SEQ ID NO: 2099633 - DNA, 16 bp, Homo sapiens
tcccctatccacccag

SEQ ID NO: 2099634 - DNA, 16 bp, Homo sapiens
tcccctcactctgtca

SEQ ID NO: 2099635 - DNA, 21 bp, Homo sapiens
tcccctcactctgtcagccag

SEQ ID NO: 2099636 - DNA, 14 bp, Homo sapiens
tcccctcagagctc

SEQ ID NO: 2099637 - DNA, 16 bp, Homo sapiens
tcccctcagagctctt

SEQ ID NO: 2099638 - DNA, 12 bp, Homo sapiens
tcccctccactg

SEQ ID NO: 2099639 - DNA, 15 bp, Homo sapiens
tcccctccactgtca

SEQ ID NO: 2099640 - DNA, 12 bp, Homo sapiens
tcccctccctct

SEQ ID NO: 2099641 - DNA, 15 bp, Homo sapiens
tcccctcgctgtcct

SEQ ID NO: 2099642 - DNA, 18 bp, Homo sapiens
tcccctcgctgtcctgct

SEQ ID NO: 2099643 - DNA, 17 bp, Homo sapiens
tcccctcggagaagagc

SEQ ID NO: 2099644 - DNA, 19 bp, Homo sapiens
tcccctcgtcctgtcccag

SEQ ID NO: 2099645 - DNA, 19 bp, Homo sapiens
tcccctcgtgtgactctct

SEQ ID NO: 2099646 - DNA, 13 bp, Homo sapiens
tcccctctatttt

SEQ ID NO: 2099647 - DNA, 13 bp, Homo sapiens
tcccctctgccct

SEQ ID NO: 2099648 - DNA, 16 bp, Homo sapiens
tcccctctgccctgta

SEQ ID NO: 2099649 - DNA, 19 bp, Homo sapiens
tcccctctgccctgtatat

SEQ ID NO: 2099650 - DNA, 21 bp, Homo sapiens
tcccctctgtgtcctctcccc

SEQ ID NO: 2099651 - DNA, 16 bp, Homo sapiens
tcccctgccagggctc

SEQ ID NO: 2099652 - DNA, 22 bp, Homo sapiens
tcccctgcccccatcccacatg

SEQ ID NO: 2099653 - DNA, 16 bp, Homo sapiens
tcccctgccctgctgc

SEQ ID NO: 2099654 - DNA, 23 bp, Homo sapiens
tcccctgccctgctgccgcctcc

SEQ ID NO: 2099655 - DNA, 11 bp, Homo sapiens
tcccctgcctc

SEQ ID NO: 2099656 - DNA, 20 bp, Homo sapiens
tcccctgctactcctgtgct

SEQ ID NO: 2099657 - DNA, 23 bp, Homo sapiens
tcccctgctactcctgtgctctg

SEQ ID NO: 2099658 - DNA, 20 bp, Homo sapiens
tcccctggaactgtctctca

SEQ ID NO: 2099659 - DNA, 15 bp, Homo sapiens
tcccctggactggga

SEQ ID NO: 2099660 - DNA, 22 bp, Homo sapiens
tcccctgggcatcttctggctt

SEQ ID NO: 2099661 - DNA, 12 bp, Homo sapiens
tcccctgtccca

SEQ ID NO: 2099662 - DNA, 14 bp, Homo sapiens
tcccctgtcccacc

SEQ ID NO: 2099663 - DNA, 19 bp, Homo sapiens
tcccctgtcccaccaactc

SEQ ID NO: 2099664 - DNA, 19 bp, Homo sapiens
tcccctgtcttctctcaaa

SEQ ID NO: 2099665 - DNA, 13 bp, Homo sapiens
tccccttgcccag

SEQ ID NO: 2099666 - DNA, 16 bp, Homo sapiens
tccccttgcccagggc

SEQ ID NO: 2099667 - DNA, 13 bp, Homo sapiens
tcccctttattaa

SEQ ID NO: 2099668 - DNA, 15 bp, Homo sapiens
tcccgaatagctggg

SEQ ID NO: 2099669 - DNA, 16 bp, Homo sapiens
tcccgaatagctggga

SEQ ID NO: 2099670 - DNA, 21 bp, Homo sapiens
tcccgccaggaggtcctcctc

SEQ ID NO: 2099671 - DNA, 22 bp, Homo sapiens
tcccgccaggaggtcctcctct

SEQ ID NO: 2099672 - DNA, 16 bp, Homo sapiens
tcccgccgcccgaccc

SEQ ID NO: 2099673 - DNA, 21 bp, Homo sapiens
tcccgcctcttcttcttcaga

SEQ ID NO: 2099674 - DNA, 15 bp, Homo sapiens
tcccgctcagccctc

SEQ ID NO: 2099675 - DNA, 12 bp, Homo sapiens
tcccgctcctgc

SEQ ID NO: 2099676 - DNA, 13 bp, Homo sapiens
tcccgctcctgct

SEQ ID NO: 2099677 - DNA, 19 bp, Homo sapiens
tcccggagcacagccctgg

SEQ ID NO: 2099678 - DNA, 13 bp, Homo sapiens
tcccggcctcttc

SEQ ID NO: 2099679 - DNA, 12 bp, Homo sapiens
tcccggctgcct

SEQ ID NO: 2099680 - DNA, 15 bp, Homo sapiens
tcccggctgcctgcc

SEQ ID NO: 2099681 - DNA, 18 bp, Homo sapiens
tcccggctgcctgccgcc

SEQ ID NO: 2099682 - DNA, 18 bp, Homo sapiens
tcccgggagaggagatca

SEQ ID NO: 2099683 - DNA, 16 bp, Homo sapiens
tcccggttcaccttgc

SEQ ID NO: 2099684 - DNA, 23 bp, Homo sapiens
tcccgtgaaagaattatttttgt

SEQ ID NO: 2099685 - DNA, 17 bp, Homo sapiens
tcccgtgaaattgatgc

SEQ ID NO: 2099686 - DNA, 13 bp, Homo sapiens
tccctaaactgta

SEQ ID NO: 2099687 - DNA, 20 bp, Homo sapiens
tccctaacatcatgcattca

SEQ ID NO: 2099688 - DNA, 22 bp, Homo sapiens
tccctaacatcatgcattcaca

SEQ ID NO: 2099689 - DNA, 19 bp, Homo sapiens
tccctaagaaaccccaggg

SEQ ID NO: 2099690 - DNA, 12 bp, Homo sapiens
tccctacccact

SEQ ID NO: 2099691 - DNA, 17 bp, Homo sapiens
tccctactcccctgggc

SEQ ID NO: 2099692 - DNA, 16 bp, Homo sapiens
tccctacttcctgtga

SEQ ID NO: 2099693 - DNA, 15 bp, Homo sapiens
tccctagcagtgaac

SEQ ID NO: 2099694 - DNA, 18 bp, Homo sapiens
tccctagctgtgacctct

SEQ ID NO: 2099695 - DNA, 15 bp, Homo sapiens
tccctatcaaaacat

SEQ ID NO: 2099696 - DNA, 22 bp, Homo sapiens
tccctatcaaaacatatcaatt

SEQ ID NO: 2099697 - DNA, 20 bp, Homo sapiens
tccctcaaatgacccaaaga

SEQ ID NO: 2099698 - DNA, 21 bp, Homo sapiens
tccctcaaatgcgcgtgtgca

SEQ ID NO: 2099699 - DNA, 20 bp, Homo sapiens
tccctcaccccctcccaccc

SEQ ID NO: 2099700 - DNA, 16 bp, Homo sapiens
tccctcactgccttcc

SEQ ID NO: 2099701 - DNA, 17 bp, Homo sapiens
tccctcactgccttcca

SEQ ID NO: 2099702 - DNA, 23 bp, Homo sapiens
tccctcattccaccttcccatgc

SEQ ID NO: 2099703 - DNA, 19 bp, Homo sapiens
tccctccatccggctcctg

SEQ ID NO: 2099704 - DNA, 21 bp, Homo sapiens
tccctcccaacagagctgggc

SEQ ID NO: 2099705 - DNA, 13 bp, Homo sapiens
tccctcccctgcc

SEQ ID NO: 2099706 - DNA, 12 bp, Homo sapiens
tccctcctggga

SEQ ID NO: 2099707 - DNA, 12 bp, Homo sapiens
tccctccttccc

SEQ ID NO: 2099708 - DNA, 18 bp, Homo sapiens
tccctccttcccttctct

SEQ ID NO: 2099709 - DNA, 24 bp, Homo sapiens
tccctcggaagccgtctgactcca

SEQ ID NO: 2099710 - DNA, 18 bp, Homo sapiens
tccctcggagctgccagc

SEQ ID NO: 2099711 - DNA, 18 bp, Homo sapiens
tccctcgtccacaggggc

SEQ ID NO: 2099712 - DNA, 19 bp, Homo sapiens
tccctctactgagtaaacc

SEQ ID NO: 2099713 - DNA, 14 bp, Homo sapiens
tccctctcccaggc

SEQ ID NO: 2099714 - DNA, 12 bp, Homo sapiens
tccctctcggaa

SEQ ID NO: 2099715 - DNA, 14 bp, Homo sapiens
tccctctcttgcct

SEQ ID NO: 2099716 - DNA, 17 bp, Homo sapiens
tccctctgacctgcagg

SEQ ID NO: 2099717 - DNA, 21 bp, Homo sapiens
tccctctgagaattccaagga

SEQ ID NO: 2099718 - DNA, 16 bp, Homo sapiens
tccctctgccccaagc

SEQ ID NO: 2099719 - DNA, 11 bp, Homo sapiens
tccctctttcc

SEQ ID NO: 2099720 - DNA, 19 bp, Homo sapiens
tccctctttctttcttttg

SEQ ID NO: 2099721 - DNA, 16 bp, Homo sapiens
tccctgaaaacccaga

SEQ ID NO: 2099722 - DNA, 19 bp, Homo sapiens
tccctgaaaacccagagag

SEQ ID NO: 2099723 - DNA, 16 bp, Homo sapiens
tccctgaacctcagtt

SEQ ID NO: 2099724 - DNA, 17 bp, Homo sapiens
tccctgactccctgtgg

SEQ ID NO: 2099725 - DNA, 16 bp, Homo sapiens
tccctgactctctgtg

SEQ ID NO: 2099726 - DNA, 11 bp, Homo sapiens
tccctgagcag

SEQ ID NO: 2099727 - DNA, 15 bp, Homo sapiens
tccctgagtcaccag

SEQ ID NO: 2099728 - DNA, 14 bp, Homo sapiens
tccctgccagtgtt

SEQ ID NO: 2099729 - DNA, 14 bp, Homo sapiens
tccctgcccctccc

SEQ ID NO: 2099730 - DNA, 22 bp, Homo sapiens
tccctgctaccaaggcccagct

SEQ ID NO: 2099731 - DNA, 23 bp, Homo sapiens
tccctgctaccaaggcccagcta

SEQ ID NO: 2099732 - DNA, 11 bp, Homo sapiens
tccctgctcct

SEQ ID NO: 2099733 - DNA, 21 bp, Homo sapiens
tccctggatgtgtggggcatg

SEQ ID NO: 2099734 - DNA, 12 bp, Homo sapiens
tccctggcctca

SEQ ID NO: 2099735 - DNA, 14 bp, Homo sapiens
tccctggcctggct

SEQ ID NO: 2099736 - DNA, 11 bp, Homo sapiens
tccctggcttg

SEQ ID NO: 2099737 - DNA, 21 bp, Homo sapiens
tccctgggaaaggggttgtca

SEQ ID NO: 2099738 - DNA, 13 bp, Homo sapiens
tccctgggcctgc

SEQ ID NO: 2099739 - DNA, 15 bp, Homo sapiens
tccctgggcctgctg

SEQ ID NO: 2099740 - DNA, 17 bp, Homo sapiens
tccctgggcctgctgct

SEQ ID NO: 2099741 - DNA, 21 bp, Homo sapiens
tccctgggcctgctgctgaga

SEQ ID NO: 2099742 - DNA, 19 bp, Homo sapiens
tccctgggggaagccctgg

SEQ ID NO: 2099743 - DNA, 19 bp, Homo sapiens
tcgctgccaggacacctgc

SEQ ID NO: 2099744 - DNA, 23 bp, Homo sapiens
tcgctgccaggacacctgcccca

SEQ ID NO: 2099745 - DNA, 19 bp, Homo sapiens
tcgctgctctagctggcag

SEQ ID NO: 2099746 - DNA, 15 bp, Homo sapiens
tcgctggacaaccca

SEQ ID NO: 2099747 - DNA, 16 bp, Homo sapiens
tcgctggcagagaagg

SEQ ID NO: 2099748 - DNA, 23 bp, Homo sapiens
tcgctgggtgccgggctgcacag

SEQ ID NO: 2099749 - DNA, 14 bp, Homo sapiens
tcgctgtcctgctg

SEQ ID NO: 2099750 - DNA, 16 bp, Homo sapiens
tcgctgtggttgtttt

SEQ ID NO: 2099751 - DNA, 16 bp, Homo sapiens
tcgcttctcctccagg

SEQ ID NO: 2099752 - DNA, 13 bp, Homo sapiens
tcgcttgagccca

SEQ ID NO: 2099753 - DNA, 13 bp, Homo sapiens
tcgcttgcttctg

SEQ ID NO: 2099754 - DNA, 19 bp, Homo sapiens
tcgcttgcttctgcagcaa

SEQ ID NO: 2099755 - DNA, 15 bp, Homo sapiens
tcggaagcagtgcct

SEQ ID NO: 2099756 - DNA, 17 bp, Homo sapiens
tcggacctttcagctgt

SEQ ID NO: 2099757 - DNA, 19 bp, Homo sapiens
tcggagcgaagcagagagg

SEQ ID NO: 2099758 - DNA, 14 bp, Homo sapiens
tcggaggctgggcc

SEQ ID NO: 2099759 - DNA, 15 bp, Homo sapiens
tcggaggctgggccc

SEQ ID NO: 2099760 - DNA, 18 bp, Homo sapiens
tcggaggctgggcccctg

SEQ ID NO: 2099761 - DNA, 20 bp, Homo sapiens
tcggaggtggtggaggagga

SEQ ID NO: 2099762 - DNA, 19 bp, Homo sapiens
tcggcccacagctcccacc

SEQ ID NO: 2099763 - DNA, 16 bp, Homo sapiens
tcggccccacatggga

SEQ ID NO: 2099764 - DNA, 16 bp, Homo sapiens
tcgggacacctgccct

SEQ ID NO: 2099765 - DNA, 14 bp, Homo sapiens
tcgggagcagtgtc

SEQ ID NO: 2099766 - DNA, 16 bp, Homo sapiens
tcgggagcagtgtctt

SEQ ID NO: 2099767 - DNA, 19 bp, Homo sapiens
tcgggagcagtgtcttcca

SEQ ID NO: 2099768 - DNA, 13 bp, Homo sapiens
tcgggaggctgag

SEQ ID NO: 2099769 - DNA, 18 bp, Homo sapiens
tcgggataacaaaatcac

SEQ ID NO: 2099770 - DNA, 19 bp, Homo sapiens
tcgggataacaaaatcaca

SEQ ID NO: 2099771 - DNA, 20 bp, Homo sapiens
tcggggcccttggggcctgg

SEQ ID NO: 2099772 - DNA, 16 bp, Homo sapiens
tcggggcgacccctca

SEQ ID NO: 2099773 - DNA, 16 bp, Homo sapiens
tcgggggtggcaaggg

SEQ ID NO: 2099774 - DNA, 16 bp, Homo sapiens
tcggggtgcacaggag

SEQ ID NO: 2099775 - DNA, 15 bp, Homo sapiens
tcggtggccatgctt

SEQ ID NO: 2099776 - DNA, 17 bp, Homo sapiens
tcggtgggacagcccca

SEQ ID NO: 2099777 - DNA, 15 bp, Homo sapiens
tcggttccacgtccc

SEQ ID NO: 2099778 - DNA, 23 bp, Homo sapiens
tcggttccacgtccccctggggc

SEQ ID NO: 2099779 - DNA, 12 bp, Homo sapiens
tcgtagctttcc

SEQ ID NO: 2099780 - DNA, 14 bp, Homo sapiens
tcgtccccaagtga

SEQ ID NO: 2099781 - DNA, 14 bp, Homo sapiens
tcgtcccctgcctc

SEQ ID NO: 2099782 - DNA, 14 bp, Homo sapiens
tcgtcctgtcccag

SEQ ID NO: 2099783 - DNA, 16 bp, Homo sapiens
tcgtccttactcctgt

SEQ ID NO: 2099784 - DNA, 13 bp, Homo sapiens
tcgtctgtcccag

SEQ ID NO: 2099785 - DNA, 14 bp, Homo sapiens
tcgtgaactcctga

SEQ ID NO: 2099786 - DNA, 19 bp, Homo sapiens
tcgtgacccttcagggcca

SEQ ID NO: 2099787 - DNA, 13 bp, Homo sapiens
tcgtgcatttgtg

SEQ ID NO: 2099788 - DNA, 17 bp, Homo sapiens
tcgtgcatttgtgagcc

SEQ ID NO: 2099789 - DNA, 20 bp, Homo sapiens
tcgtgccgttactctccaac

SEQ ID NO: 2099790 - DNA, 19 bp, Homo sapiens
tcgtgcgcaacaacaagga

SEQ ID NO: 2099791 - DNA, 18 bp, Homo sapiens
tcgtgctaaattttcagt

SEQ ID NO: 2099792 - DNA, 19 bp, Homo sapiens
tcgtggacacctgccctgc

SEQ ID NO: 2099793 - DNA, 20 bp, Homo sapiens
tcgtggacacctgccctgcc

SEQ ID NO: 2099794 - DNA, 16 bp, Homo sapiens
tcgtggagagctagga

SEQ ID NO: 2099795 - DNA, 18 bp, Homo sapiens
tcgtggagagctaggagc

SEQ ID NO: 2099796 - DNA, 23 bp, Homo sapiens
tcgtggcagataatcagcctctt

SEQ ID NO: 2099797 - DNA, 11 bp, Homo sapiens
tcgtggccttc

SEQ ID NO: 2099798 - DNA, 19 bp, Homo sapiens
tcgtgtagtggaagagcag

SEQ ID NO: 2099799 - DNA, 23 bp, Homo sapiens
tcgtgtagtggaagagcagcctg

SEQ ID NO: 2099800 - DNA, 14 bp, Homo sapiens
tcgtgtctctccca

SEQ ID NO: 2099801 - DNA, 14 bp, Homo sapiens
tcgtgtttacaaaa

SEQ ID NO: 2099802 - DNA, 15 bp, Homo sapiens
tcgttcaaagcatga

SEQ ID NO: 2099803 - DNA, 19 bp, Homo sapiens
tcgtttattgcttaatccc

SEQ ID NO: 2099804 - DNA, 21 bp, Homo sapiens
tcgtttcaggacatggggcat

SEQ ID NO: 2099805 - DNA, 19 bp, Homo sapiens
tctaaaaataaaatgatgt

SEQ ID NO: 2099806 - DNA, 23 bp, Homo sapiens
tctaaaactatggttcccaataa

SEQ ID NO: 2099807 - DNA, 13 bp, Homo sapiens
tctaaacattaat

SEQ ID NO: 2099808 - DNA, 15 bp, Homo sapiens
tctaaagctttctga

SEQ ID NO: 2099809 - DNA, 15 bp, Homo sapiens
tctaaagtttacagt

SEQ ID NO: 2099810 - DNA, 17 bp, Homo sapiens
tctaaagtttacagtaa

SEQ ID NO: 2099811 - DNA, 18 bp, Homo sapiens
tctaaagtttacagtaaa

SEQ ID NO: 2099812 - DNA, 19 bp, Homo sapiens
tctaaagtttacagtaaat

SEQ ID NO: 2099813 - DNA, 15 bp, Homo sapiens
tctaaatgcccagtt

SEQ ID NO: 2099814 - DNA, 21 bp, Homo sapiens
tctaaatgttggaattttcaa

SEQ ID NO: 2099815 - DNA, 13 bp, Homo sapiens
tctaacatatgta

SEQ ID NO: 2099816 - DNA, 21 bp, Homo sapiens
tctaacgcctgagcccaggga

SEQ ID NO: 2099817 - DNA, 23 bp, Homo sapiens
tctaacgcctgagcccagggagg

SEQ ID NO: 2099818 - DNA, 16 bp, Homo sapiens
tctaactacaaggaca

SEQ ID NO: 2099819 - DNA, 16 bp, Homo sapiens
tctaactgtaaatcac

SEQ ID NO: 2099820 - DNA, 18 bp, Homo sapiens
tctaactgtaaatcactt

SEQ ID NO: 2099821 - DNA, 22 bp, Homo sapiens
tctaactgtaaatcacttgtaa

SEQ ID NO: 2099822 - DNA, 22 bp, Homo sapiens
tctaagccaactttaattgctt

SEQ ID NO: 2099823 - DNA, 17 bp, Homo sapiens
tctaagcctttccataa

SEQ ID NO: 2099824 - DNA, 18 bp, Homo sapiens
tctaagcctttccataag

SEQ ID NO: 2099825 - DNA, 19 bp, Homo sapiens
tctaagctgcagcttcctg

SEQ ID NO: 2099826 - DNA, 19 bp, Homo sapiens
tctaagctggagctcttgg

SEQ ID NO: 2099827 - DNA, 23 bp, Homo sapiens
tctaaggaaatggagaagctctg

SEQ ID NO: 2099828 - DNA, 20 bp, Homo sapiens
tctaagtagatagaaagcaa

SEQ ID NO: 2099829 - DNA, 18 bp, Homo sapiens
tctaagtctccaagaata

SEQ ID NO: 2099830 - DNA, 16 bp, Homo sapiens
tctaagttctattgaa

SEQ ID NO: 2099831 - DNA, 16 bp, Homo sapiens
tctaatacctctgtgt

SEQ ID NO: 2099832 - DNA, 17 bp, Homo sapiens
tctaatattaaaaatat

SEQ ID NO: 2099833 - DNA, 15 bp, Homo sapiens
tctaatcaggttgtt

SEQ ID NO: 2099834 - DNA, 19 bp, Homo sapiens
tctaatgtctcttcctctg

SEQ ID NO: 2099835 - DNA, 15 bp, Homo sapiens
tctaatgtcttcatt

SEQ ID NO: 2099836 - DNA, 18 bp, Homo sapiens
tctaattcccattttgca

SEQ ID NO: 2099837 - DNA, 22 bp, Homo sapiens
tctaattcccattttgcaaaat

SEQ ID NO: 2099838 - DNA, 20 bp, Homo sapiens
tctaatttatacaaaataat

SEQ ID NO: 2099839 - DNA, 23 bp, Homo sapiens
tctaatttatcttgtctctgggc

SEQ ID NO: 2099840 - DNA, 15 bp, Homo sapiens
tctacaaccagagcc

SEQ ID NO: 2099841 - DNA, 17 bp, Homo sapiens
tctacaaccagagcccc

SEQ ID NO: 2099842 - DNA, 20 bp, Homo sapiens
tctacaagcatatttgagaa

SEQ ID NO: 2099843 - DNA, 21 bp, Homo sapiens
tctacacagcagtatgaatga

SEQ ID NO: 2099844 - DNA, 22 bp, Homo sapiens
tctacacagcagtatgaatgat

SEQ ID NO: 2099845 - DNA, 21 bp, Homo sapiens
tctacacatatatgtatatgt

SEQ ID NO: 2099846 - DNA, 16 bp, Homo sapiens
tctacagaacaaagaa

SEQ ID NO: 2099847 - DNA, 21 bp, Homo sapiens
tctacaggatggggacactaa

SEQ ID NO: 2099848 - DNA, 16 bp, Homo sapiens
tctacatactatggaa

SEQ ID NO: 2099849 - DNA, 18 bp, Homo sapiens
tctaccatttcagagagg

SEQ ID NO: 2099850 - DNA, 19 bp, Homo sapiens
tctacccagcgagccctgg

SEQ ID NO: 2099851 - DNA, 14 bp, Homo sapiens
tctacccatctccc

SEQ ID NO: 2099852 - DNA, 19 bp, Homo sapiens
tctacccatctcccccatc

SEQ ID NO: 2099853 - DNA, 22 bp, Homo sapiens
tctacccggcccagagacccct

SEQ ID NO: 2099854 - DNA, 12 bp, Homo sapiens
tctaccctggga

SEQ ID NO: 2099855 - DNA, 22 bp, Homo sapiens
tctaccgacctgtctccctggg

SEQ ID NO: 2099856 - DNA, 23 bp, Homo sapiens
tctaccgacctgtctccctgggg

SEQ ID NO: 2099857 - DNA, 17 bp, Homo sapiens
tctgaaaattaacactg

SEQ ID NO: 2099858 - DNA, 18 bp, Homo sapiens
tctgaaaattaacactgc

SEQ ID NO: 2099859 - DNA, 17 bp, Homo sapiens
tctgaaagacagaatgt

SEQ ID NO: 2099860 - DNA, 14 bp, Homo sapiens
tctgaaagccacgt

SEQ ID NO: 2099861 - DNA, 18 bp, Homo sapiens
tctgaaatcgccgtgtta

SEQ ID NO: 2099862 - DNA, 15 bp, Homo sapiens
tctgaaatttcccac

SEQ ID NO: 2099863 - DNA, 13 bp, Homo sapiens
tctgaacaaacac

SEQ ID NO: 2099864 - DNA, 14 bp, Homo sapiens
tctgaacaaacact

SEQ ID NO: 2099865 - DNA, 21 bp, Homo sapiens
tctgaacaaacactgaatcat

SEQ ID NO: 2099866 - DNA, 13 bp, Homo sapiens
tctgaagatctca

SEQ ID NO: 2099867 - DNA, 12 bp, Homo sapiens
tctgaagcatgt

SEQ ID NO: 2099868 - DNA, 14 bp, Homo sapiens
tctgaagcatgttt

SEQ ID NO: 2099869 - DNA, 16 bp, Homo sapiens
tctgaagctattgatg

SEQ ID NO: 2099870 - DNA, 21 bp, Homo sapiens
tctgaagctttaccagctgaa

SEQ ID NO: 2099871 - DNA, 21 bp, Homo sapiens
tctgaaggacattgcggacag

SEQ ID NO: 2099872 - DNA, 17 bp, Homo sapiens
tctgaaggcaaatataa

SEQ ID NO: 2099873 - DNA, 23 bp, Homo sapiens
tctgaagtcacatcacaggacac

SEQ ID NO: 2099874 - DNA, 18 bp, Homo sapiens
tctgaagtcactgcacag

SEQ ID NO: 2099875 - DNA, 15 bp, Homo sapiens
tctgaataatttctt

SEQ ID NO: 2099876 - DNA, 15 bp, Homo sapiens
tctgaatgaataaag

SEQ ID NO: 2099877 - DNA, 16 bp, Homo sapiens
tctgaatttttaaaca

SEQ ID NO: 2099878 - DNA, 13 bp, Homo sapiens
tctgacaagggct

SEQ ID NO: 2099879 - DNA, 18 bp, Homo sapiens
tctgacacacagctctgt

SEQ ID NO: 2099880 - DNA, 19 bp, Homo sapiens
tctgacacacagctctgtc

SEQ ID NO: 2099881 - DNA, 23 bp, Homo sapiens
tctgacagttactcttcagtttt

SEQ ID NO: 2099882 - DNA, 18 bp, Homo sapiens
tctgaccatttcaggggt

SEQ ID NO: 2099883 - DNA, 21 bp, Homo sapiens
tctgacccagtgagattacag

SEQ ID NO: 2099884 - DNA, 12 bp, Homo sapiens
tctgacctgcag

SEQ ID NO: 2099885 - DNA, 13 bp, Homo sapiens
tctgactccagag

SEQ ID NO: 2099886 - DNA, 15 bp, Homo sapiens
tctgactccagagtc

SEQ ID NO: 2099887 - DNA, 19 bp, Homo sapiens
tctgactccagagtctgag

SEQ ID NO: 2099888 - DNA, 21 bp, Homo sapiens
tctgactccagagtctgagcc

SEQ ID NO: 2099889 - DNA, 13 bp, Homo sapiens
tctgactcttgcc

SEQ ID NO: 2099890 - DNA, 23 bp, Homo sapiens
tctgactcttgcctttccacctg

SEQ ID NO: 2099891 - DNA, 18 bp, Homo sapiens
tctgactttaattgtgtg

SEQ ID NO: 2099892 - DNA, 19 bp, Homo sapiens
tctgagaaagactattcaa

SEQ ID NO: 2099893 - DNA, 21 bp, Homo sapiens
tctgagaacagacgttaccaa

SEQ ID NO: 2099894 - DNA, 18 bp, Homo sapiens
tctgagaaggtccttaat

SEQ ID NO: 2099895 - DNA, 20 bp, Homo sapiens
tctgagaaggtccttaatga

SEQ ID NO: 2099896 - DNA, 18 bp, Homo sapiens
tctgagaattccaaggag

SEQ ID NO: 2099897 - DNA, 20 bp, Homo sapiens
tctgagaattccaaggagtt

SEQ ID NO: 2099898 - DNA, 16 bp, Homo sapiens
tctgagaggccctgga

SEQ ID NO: 2099899 - DNA, 14 bp, Homo sapiens
tctgagatgtgttc

SEQ ID NO: 2099900 - DNA, 19 bp, Homo sapiens
tctgagcaccccctcattc

SEQ ID NO: 2099901 - DNA, 16 bp, Homo sapiens
tctgagcataatgctc

SEQ ID NO: 2099902 - DNA, 15 bp, Homo sapiens
tctgagcccaggccg

SEQ ID NO: 2099903 - DNA, 15 bp, Homo sapiens
tctgagccctggtgt

SEQ ID NO: 2099904 - DNA, 13 bp, Homo sapiens
tctgagctggccc

SEQ ID NO: 2099905 - DNA, 15 bp, Homo sapiens
tctgagcttcagtat

SEQ ID NO: 2099906 - DNA, 23 bp, Homo sapiens
tctgaggaatccagacccggctg

SEQ ID NO: 2099907 - DNA, 20 bp, Homo sapiens
tctgaggacatggagagaga

SEQ ID NO: 2099908 - DNA, 22 bp, Homo sapiens
tctgaggagaaacaaataagac

SEQ ID NO: 2099909 - DNA, 12 bp, Homo sapiens
tctgaggccagc

SEQ ID NO: 2099910 - DNA, 13 bp, Homo sapiens
tctgaggccagcc

SEQ ID NO: 2099911 - DNA, 14 bp, Homo sapiens
tctgaggccagcct

SEQ ID NO: 2099912 - DNA, 16 bp, Homo sapiens
tctgaggccagcctgg

SEQ ID NO: 2099913 - DNA, 19 bp, Homo sapiens
tctgaggccagcctggcct

SEQ ID NO: 2099914 - DNA, 20 bp, Homo sapiens
tctgaggccagcctggcctc

SEQ ID NO: 2099915 - DNA, 14 bp, Homo sapiens
tctgaggcctcatc

SEQ ID NO: 2099916 - DNA, 15 bp, Homo sapiens
tctgaggcttccaga

SEQ ID NO: 2099917 - DNA, 16 bp, Homo sapiens
tctgaggcttccagag

SEQ ID NO: 2099918 - DNA, 19 bp, Homo sapiens
tctgaggcttccagagagt

SEQ ID NO: 2099919 - DNA, 13 bp, Homo sapiens
tctgagggagagg

SEQ ID NO: 2099920 - DNA, 16 bp, Homo sapiens
tctgagggagaggctg

SEQ ID NO: 2099921 - DNA, 19 bp, Homo sapiens
tctgaggggcaactgagtc

SEQ ID NO: 2099922 - DNA, 14 bp, Homo sapiens
tctgaggtcctgag

SEQ ID NO: 2099923 - DNA, 18 bp, Homo sapiens
tctgagtcctgtctctgc

SEQ ID NO: 2099924 - DNA, 21 bp, Homo sapiens
tctgagtcctgtctctgcctg

SEQ ID NO: 2099925 - DNA, 13 bp, Homo sapiens
tctgagtctgagt

SEQ ID NO: 2099926 - DNA, 17 bp, Homo sapiens
tctgagtctgagtcctg

SEQ ID NO: 2099927 - DNA, 17 bp, Homo sapiens
tctgagttcctgcatgc

SEQ ID NO: 2099928 - DNA, 15 bp, Homo sapiens
tctgagtttcattct

SEQ ID NO: 2099929 - DNA, 22 bp, Homo sapiens
tctgagtttcattctcctgcct

SEQ ID NO: 2099930 - DNA, 24 bp, Homo sapiens
tctgagtttcattctcctgcctgt

SEQ ID NO: 2099931 - DNA, 15 bp, Homo sapiens
tctgataaaattgtg

SEQ ID NO: 2099932 - DNA, 23 bp, Homo sapiens
tctgataaaattgtgatgttttg

SEQ ID NO: 2099933 - DNA, 14 bp, Homo sapiens
tctgatacccagag

SEQ ID NO: 2099934 - DNA, 21 bp, Homo sapiens
tctgatatgggactgagcctg

SEQ ID NO: 2099935 - DNA, 17 bp, Homo sapiens
tctgatcatccactgtg

SEQ ID NO: 2099936 - DNA, 21 bp, Homo sapiens
tctgatcatccactgtgccat

SEQ ID NO: 2099937 - DNA, 18 bp, Homo sapiens
tctgatcgggataacaaa

SEQ ID NO: 2099938 - DNA, 19 bp, Homo sapiens
tctgatcgggataacaaaa

SEQ ID NO: 2099939 - DNA, 16 bp, Homo sapiens
tctgatggtgagctgg

SEQ ID NO: 2099940 - DNA, 18 bp, Homo sapiens
tctgattcactattagag

SEQ ID NO: 2099941 - DNA, 21 bp, Homo sapiens
tctgattcccaagctctgctc

SEQ ID NO: 2099942 - DNA, 23 bp, Homo sapiens
tctgattcccaagctctgctcct

SEQ ID NO: 2099943 - DNA, 15 bp, Homo sapiens
tctgattggacattt

SEQ ID NO: 2099944 - DNA, 19 bp, Homo sapiens
tctgattggacattttctt

SEQ ID NO: 2099945 - DNA, 21 bp, Homo sapiens
tctgattggacattttcttca

SEQ ID NO: 2099946 - DNA, 13 bp, Homo sapiens
tctgattggctca

SEQ ID NO: 2099947 - DNA, 14 bp, Homo sapiens
tctgatttaatgtt

SEQ ID NO: 2099948 - DNA, 18 bp, Homo sapiens
tctgatttaatgttttct

SEQ ID NO: 2099949 - DNA, 19 bp, Homo sapiens
tctgatttaatgttttctg

SEQ ID NO: 2099950 - DNA, 19 bp, Homo sapiens
tctgatttttttgttgttg

SEQ ID NO: 2099951 - DNA, 18 bp, Homo sapiens
tctgcaaagaatgagaag

SEQ ID NO: 2099952 - DNA, 16 bp, Homo sapiens
tctgcaactagccaag

SEQ ID NO: 2099953 - DNA, 17 bp, Homo sapiens
tctgcaactagccaagg

SEQ ID NO: 2099954 - DNA, 19 bp, Homo sapiens
tctgcaatgggcactggga

SEQ ID NO: 2099955 - DNA, 15 bp, Homo sapiens
tctgcacatgtcttg

SEQ ID NO: 2099956 - DNA, 16 bp, Homo sapiens
tctgcacatgtcttgt

SEQ ID NO: 2099957 - DNA, 21 bp, Homo sapiens
tctgcacatgtcttgtacatg

SEQ ID NO: 2099958 - DNA, 20 bp, Homo sapiens
tctgcactccatggccaccc

SEQ ID NO: 2099959 - DNA, 21 bp, Homo sapiens
tctgcactccatggccacccc

SEQ ID NO: 2099960 - DNA, 13 bp, Homo sapiens
tctgcactgaaaa

SEQ ID NO: 2099961 - DNA, 13 bp, Homo sapiens
tctgcactgggtg

SEQ ID NO: 2099962 - DNA, 12 bp, Homo sapiens
tctgcagagcag

SEQ ID NO: 2099963 - DNA, 16 bp, Homo sapiens
tctgcagcaactccca

SEQ ID NO: 2099964 - DNA, 19 bp, Homo sapiens
tctgcagcaactcccacga

SEQ ID NO: 2099965 - DNA, 20 bp, Homo sapiens
tctgcagcactttaaccctc

SEQ ID NO: 2099966 - DNA, 21 bp, Homo sapiens
tctgcagcactttaaccctct

SEQ ID NO: 2099967 - DNA, 14 bp, Homo sapiens
tctgcagccagccc

SEQ ID NO: 2099968 - DNA, 16 bp, Homo sapiens
tctgcagccagcccag

SEQ ID NO: 2099969 - DNA, 23 bp, Homo sapiens
tctgcagcccggcgccaccatcc

SEQ ID NO: 2099970 - DNA, 22 bp, Homo sapiens
tctgcagctatgcgcaatgtgg

SEQ ID NO: 2099971 - DNA, 16 bp, Homo sapiens
tctgcataaacttcat

SEQ ID NO: 2099972 - DNA, 13 bp, Homo sapiens
tgaaaatgttcat

SEQ ID NO: 2099973 - DNA, 15 bp, Homo sapiens
tgaaaattaacactg

SEQ ID NO: 2099974 - DNA, 17 bp, Homo sapiens
tgaaaattatttaaacc

SEQ ID NO: 2099975 - DNA, 16 bp, Homo sapiens
tgaaaattattttaaa

SEQ ID NO: 2099976 - DNA, 21 bp, Homo sapiens
tgaaacacacaggccatttca

SEQ ID NO: 2099977 - DNA, 14 bp, Homo sapiens
tgaaacagaaacaa

SEQ ID NO: 2099978 - DNA, 13 bp, Homo sapiens
tgaaacagcctgg

SEQ ID NO: 2099979 - DNA, 20 bp, Homo sapiens
tgaaacattccgaagaggga

SEQ ID NO: 2099980 - DNA, 21 bp, Homo sapiens
tgaaaccacaggcccttgggg

SEQ ID NO: 2099981 - DNA, 23 bp, Homo sapiens
tgaaacccattaggcatgcctaa

SEQ ID NO: 2099982 - DNA, 19 bp, Homo sapiens
tgaaactagaagtcaaaaa

SEQ ID NO: 2099983 - DNA, 20 bp, Homo sapiens
tgaaactcctgattttgtag

SEQ ID NO: 2099984 - DNA, 23 bp, Homo sapiens
tgaaactggggcttgcaagagga

SEQ ID NO: 2099985 - DNA, 17 bp, Homo sapiens
tgaaacttaattacatc

SEQ ID NO: 2099986 - DNA, 22 bp, Homo sapiens
tgaaagaaacagttaactttca

SEQ ID NO: 2099987 - DNA, 18 bp, Homo sapiens
tgaaagaattatttttgt

SEQ ID NO: 2099988 - DNA, 20 bp, Homo sapiens
tgaaagaattatttttgtgt

SEQ ID NO: 2099989 - DNA, 15 bp, Homo sapiens
tgaaagacagaatgt

SEQ ID NO: 2099990 - DNA, 19 bp, Homo sapiens
tgaaagaccttctccaaat

SEQ ID NO: 2099991 - DNA, 18 bp, Homo sapiens
tgaaagagaaccagtttc

SEQ ID NO: 2099992 - DNA, 14 bp, Homo sapiens
tgaaagcagcagct

SEQ ID NO: 2099993 - DNA, 21 bp, Homo sapiens
tgaaagcagcagctaggactg

SEQ ID NO: 2099994 - DNA, 14 bp, Homo sapiens
tgaaagccatttgt

SEQ ID NO: 2099995 - DNA, 13 bp, Homo sapiens
tgaaagctagaga

SEQ ID NO: 2099996 - DNA, 12 bp, Homo sapiens
tgaaagctgaat

SEQ ID NO: 2099997 - DNA, 11 bp, Homo sapiens
tgaaagctgtg

SEQ ID NO: 2099998 - DNA, 16 bp, Homo sapiens
tgaaagggctatggca

SEQ ID NO: 2099999 - DNA, 19 bp, Homo sapiens
tgaaaggttaccctgtaac

SEQ ID NO: 2100000 - DNA, 18 bp, Homo sapiens
tgaaagtgaataaacttc

SEQ ID NO: 2100001 - DNA, 21 bp, Homo sapiens
tgaaataaattggtgataagt

SEQ ID NO: 2100002 - DNA, 17 bp, Homo sapiens
tgaaataatgttctgtc

SEQ ID NO: 2100003 - DNA, 23 bp, Homo sapiens
tgaaataccagtgaaccaaagag

SEQ ID NO: 2100004 - DNA, 19 bp, Homo sapiens
tgaaatatttaagtatata

SEQ ID NO: 2100005 - DNA, 14 bp, Homo sapiens
tgaaatatttgctt

SEQ ID NO: 2100006 - DNA, 16 bp, Homo sapiens
tgaaatatttgcttat

SEQ ID NO: 2100007 - DNA, 17 bp, Homo sapiens
tgaaatatttgcttatt

SEQ ID NO: 2100008 - DNA, 19 bp, Homo sapiens
tgaaatatttgcttattta

SEQ ID NO: 2100009 - DNA, 14 bp, Homo sapiens
tgaaatccaggtct

SEQ ID NO: 2100010 - DNA, 18 bp, Homo sapiens
tgaaatcttaaaaacctg

SEQ ID NO: 2100011 - DNA, 17 bp, Homo sapiens
tgaaatgacagaatgct

SEQ ID NO: 2100012 - DNA, 19 bp, Homo sapiens
tgaaatgaggtcagagcct

SEQ ID NO: 2100013 - DNA, 17 bp, Homo sapiens
tgaaatgctctcctttc

SEQ ID NO: 2100014 - DNA, 16 bp, Homo sapiens
tgaaatggaggtcctt

SEQ ID NO: 2100015 - DNA, 22 bp, Homo sapiens
tgaaattaactgggtaatgaaa

SEQ ID NO: 2100016 - DNA, 20 bp, Homo sapiens
tgaaattactacaaaatttg

SEQ ID NO: 2100017 - DNA, 14 bp, Homo sapiens
tgaaattactgaaa

SEQ ID NO: 2100018 - DNA, 15 bp, Homo sapiens
tgaaattatatctgt

SEQ ID NO: 2100019 - DNA, 21 bp, Homo sapiens
tgaaattatgtatgtttacat

SEQ ID NO: 2100020 - DNA, 17 bp, Homo sapiens
tgaaattcaacctgtgt

SEQ ID NO: 2100021 - DNA, 17 bp, Homo sapiens
tgaaattcccccacttg

SEQ ID NO: 2100022 - DNA, 22 bp, Homo sapiens
tgaaattcccccacttgggagc

SEQ ID NO: 2100023 - DNA, 15 bp, Homo sapiens
tgaaattgaacctgg

SEQ ID NO: 2100024 - DNA, 13 bp, Homo sapiens
tgaaattgagaag

SEQ ID NO: 2100025 - DNA, 17 bp, Homo sapiens
tgaaatttaaaaataaa

SEQ ID NO: 2100026 - DNA, 18 bp, Homo sapiens
tgaaatttaaaaataaag

SEQ ID NO: 2100027 - DNA, 23 bp, Homo sapiens
tgaaatttaaaaataaagctact

SEQ ID NO: 2100028 - DNA, 18 bp, Homo sapiens
tgaaattttatttagttc

SEQ ID NO: 2100029 - DNA, 12 bp, Homo sapiens
tgaacaaaagct

SEQ ID NO: 2100030 - DNA, 17 bp, Homo sapiens
tgaacaaaagcttttct

SEQ ID NO: 2100031 - DNA, 20 bp, Homo sapiens
tgaacaagttgtttcattga

SEQ ID NO: 2100032 - DNA, 13 bp, Homo sapiens
tgaacaattctct

SEQ ID NO: 2100033 - DNA, 21 bp, Homo sapiens
tgaacacaattgatacttcag

SEQ ID NO: 2100034 - DNA, 22 bp, Homo sapiens
tgaacacaattgatacttcagg

SEQ ID NO: 2100035 - DNA, 16 bp, Homo sapiens
tgaacacactcagcag

SEQ ID NO: 2100036 - DNA, 16 bp, Homo sapiens
tgaacacagctgctga

SEQ ID NO: 2100037 - DNA, 17 bp, Homo sapiens
tgaacacatactagaaa

SEQ ID NO: 2100038 - DNA, 14 bp, Homo sapiens
tgaacacatcagct

SEQ ID NO: 2100039 - DNA, 23 bp, Homo sapiens
tgaacaccactttgtctctgaga

SEQ ID NO: 2100040 - DNA, 22 bp, Homo sapiens
tgaacatggagaggacttttgg

SEQ ID NO: 2100041 - DNA, 12 bp, Homo sapiens
tgaacccaggac

SEQ ID NO: 2100042 - DNA, 13 bp, Homo sapiens
tgaacccaggagg

SEQ ID NO: 2100043 - DNA, 14 bp, Homo sapiens
tgaacccaggaggt

SEQ ID NO: 2100044 - DNA, 13 bp, Homo sapiens
tgaacccctgtgt

SEQ ID NO: 2100045 - DNA, 15 bp, Homo sapiens
tgaaccgacttttct

SEQ ID NO: 2100046 - DNA, 12 bp, Homo sapiens
tgaacctcagtt

SEQ ID NO: 2100047 - DNA, 13 bp, Homo sapiens
tgaacctcagttt

SEQ ID NO: 2100048 - DNA, 16 bp, Homo sapiens
tgaacctcagtttcct

SEQ ID NO: 2100049 - DNA, 19 bp, Homo sapiens
tgaacctcagtttcctcat

SEQ ID NO: 2100050 - DNA, 20 bp, Homo sapiens
tgaacgatatgtagcagaaa

SEQ ID NO: 2100051 - DNA, 21 bp, Homo sapiens
tgaacgatatgtagcagaaag

SEQ ID NO: 2100052 - DNA, 17 bp, Homo sapiens
tgaactcaactttgaca

SEQ ID NO: 2100053 - DNA, 13 bp, Homo sapiens
tgaactcaagctg

SEQ ID NO: 2100054 - DNA, 18 bp, Homo sapiens
tgaactcaagctgcgttt

SEQ ID NO: 2100055 - DNA, 16 bp, Homo sapiens
tgaactcaatgtgcaa

SEQ ID NO: 2100056 - DNA, 19 bp, Homo sapiens
tgaactcagagcccctccc

SEQ ID NO: 2100057 - DNA, 15 bp, Homo sapiens
tgaactcctggcctc

SEQ ID NO: 2100058 - DNA, 16 bp, Homo sapiens
tgaactcctggcctca

SEQ ID NO: 2100059 - DNA, 17 bp, Homo sapiens
tgaactcctggcctcaa

SEQ ID NO: 2100060 - DNA, 12 bp, Homo sapiens
tgaactgattca

SEQ ID NO: 2100061 - DNA, 22 bp, Homo sapiens
tgaactgccaagaaaaggcatg

SEQ ID NO: 2100062 - DNA, 16 bp, Homo sapiens
tgaactgcgtgccagt

SEQ ID NO: 2100063 - DNA, 19 bp, Homo sapiens
tgaactgggtacttgtgga

SEQ ID NO: 2100064 - DNA, 11 bp, Homo sapiens
tgaactgtgac

SEQ ID NO: 2100065 - DNA, 12 bp, Homo sapiens
tgaactgtgaca

SEQ ID NO: 2100066 - DNA, 15 bp, Homo sapiens
tgaactgtgacagga

SEQ ID NO: 2100067 - DNA, 17 bp, Homo sapiens
tgaacttaaataaatgt

SEQ ID NO: 2100068 - DNA, 21 bp, Homo sapiens
tgaacttatttacacatagtt

SEQ ID NO: 2100069 - DNA, 20 bp, Homo sapiens
tgaacttgaggacacatgtc

SEQ ID NO: 2100070 - DNA, 21 bp, Homo sapiens
tgaacttgaggacacatgtcc

SEQ ID NO: 2100071 - DNA, 22 bp, Homo sapiens
tgaacttgaggacacatgtcca

SEQ ID NO: 2100072 - DNA, 17 bp, Homo sapiens
tgaactttccaaaacct

SEQ ID NO: 2100073 - DNA, 11 bp, Homo sapiens
tgaactttctc

SEQ ID NO: 2100074 - DNA, 21 bp, Homo sapiens
tgaactttctcttcatacttt

SEQ ID NO: 2100075 - DNA, 19 bp, Homo sapiens
tgaagaaaaaggctggctg

SEQ ID NO: 2100076 - DNA, 15 bp, Homo sapiens
tgaagaaaatgaagc

SEQ ID NO: 2100077 - DNA, 15 bp, Homo sapiens
tgaagaagggaaatt

SEQ ID NO: 2100078 - DNA, 16 bp, Homo sapiens
tgaagaatacttctca

SEQ ID NO: 2100079 - DNA, 19 bp, Homo sapiens
tgaagaatacttctcattt

SEQ ID NO: 2100080 - DNA, 14 bp, Homo sapiens
tgaagacaggacag

SEQ ID NO: 2100081 - DNA, 22 bp, Homo sapiens
tgaagacctaaatgacctcagc

SEQ ID NO: 2100082 - DNA, 14 bp, Homo sapiens
tgaagagaagctga

SEQ ID NO: 2100083 - DNA, 23 bp, Homo sapiens
tgaagagacagttatttatagtc

SEQ ID NO: 2100084 - DNA, 15 bp, Homo sapiens
tgaagagagatatat

SEQ ID NO: 2100085 - DNA, 21 bp, Homo sapiens
tgaagagatttcaacaagaat

SEQ ID NO: 2100086 - DNA, 18 bp, Homo sapiens
tgaagaggcaagagacag

SEQ ID NO: 2100087 - DNA, 17 bp, Homo sapiens
tgagctctgagaggccc

SEQ ID NO: 2100088 - DNA, 17 bp, Homo sapiens
tgagctgcagaaacgaa

SEQ ID NO: 2100089 - DNA, 22 bp, Homo sapiens
tgagctggcattggtctgctga

SEQ ID NO: 2100090 - DNA, 19 bp, Homo sapiens
tgagctggccctttccagc

SEQ ID NO: 2100091 - DNA, 12 bp, Homo sapiens
tgagctgggaag

SEQ ID NO: 2100092 - DNA, 21 bp, Homo sapiens
tgagctgggaagctgtactca

SEQ ID NO: 2100093 - DNA, 22 bp, Homo sapiens
tgagctgtatatatatatgtgt

SEQ ID NO: 2100094 - DNA, 12 bp, Homo sapiens
tgagctgtcact

SEQ ID NO: 2100095 - DNA, 11 bp, Homo sapiens
tgagctgtttt

SEQ ID NO: 2100096 - DNA, 21 bp, Homo sapiens
tgagcttagccttgtgccctg

SEQ ID NO: 2100097 - DNA, 22 bp, Homo sapiens
tgagcttagccttgtgccctgc

SEQ ID NO: 2100098 - DNA, 15 bp, Homo sapiens
tgagcttctctgtga

SEQ ID NO: 2100099 - DNA, 21 bp, Homo sapiens
tgagctttggggacagttggc

SEQ ID NO: 2100100 - DNA, 18 bp, Homo sapiens
tgagcttttcatggaagt

SEQ ID NO: 2100101 - DNA, 14 bp, Homo sapiens
tgaggaaagcacac

SEQ ID NO: 2100102 - DNA, 19 bp, Homo sapiens
tgaggaataattatttatt

SEQ ID NO: 2100103 - DNA, 22 bp, Homo sapiens
tgaggaatccagacccggctgc

SEQ ID NO: 2100104 - DNA, 14 bp, Homo sapiens
tgaggaattttctt

SEQ ID NO: 2100105 - DNA, 15 bp, Homo sapiens
tgaggacaaagagaa

SEQ ID NO: 2100106 - DNA, 12 bp, Homo sapiens
tgaggacacatg

SEQ ID NO: 2100107 - DNA, 13 bp, Homo sapiens
tgaggacacatgt

SEQ ID NO: 2100108 - DNA, 16 bp, Homo sapiens
tgaggacacatgtcca

SEQ ID NO: 2100109 - DNA, 20 bp, Homo sapiens
tgaggactcatatatttaag

SEQ ID NO: 2100110 - DNA, 23 bp, Homo sapiens
tgaggacttaaaatattcctgca

SEQ ID NO: 2100111 - DNA, 14 bp, Homo sapiens
tgaggagagaagga

SEQ ID NO: 2100112 - DNA, 20 bp, Homo sapiens
tgaggagcagcttcagttgt

SEQ ID NO: 2100113 - DNA, 23 bp, Homo sapiens
tgaggaggattgcttcttgtgaa

SEQ ID NO: 2100114 - DNA, 21 bp, Homo sapiens
tgaggaggggcacctgccacc

SEQ ID NO: 2100115 - DNA, 20 bp, Homo sapiens
tgaggagtagctgagaggaa

SEQ ID NO: 2100116 - DNA, 22 bp, Homo sapiens
tgaggagtagctgagaggaaga

SEQ ID NO: 2100117 - DNA, 23 bp, Homo sapiens
tgaggagtagctgagaggaagat

SEQ ID NO: 2100118 - DNA, 22 bp, Homo sapiens
tgaggagtctgaggtcctgagc

SEQ ID NO: 2100119 - DNA, 22 bp, Homo sapiens
tgaggatcctcacaggagcaga

SEQ ID NO: 2100120 - DNA, 15 bp, Homo sapiens
tgaggatctagcttc

SEQ ID NO: 2100121 - DNA, 17 bp, Homo sapiens
tgaggatctagcttcat

SEQ ID NO: 2100122 - DNA, 23 bp, Homo sapiens
tgaggattatgggtcctgcaatt

SEQ ID NO: 2100123 - DNA, 13 bp, Homo sapiens
tgaggattcctga

SEQ ID NO: 2100124 - DNA, 16 bp, Homo sapiens
tgaggattttgagtat

SEQ ID NO: 2100125 - DNA, 21 bp, Homo sapiens
tgaggcaaaggccagcagcag

SEQ ID NO: 2100126 - DNA, 17 bp, Homo sapiens
tgaggcaatgtcaggaa

SEQ ID NO: 2100127 - DNA, 18 bp, Homo sapiens
tgaggcagaagaattgaa

SEQ ID NO: 2100128 - DNA, 12 bp, Homo sapiens
tgaggcagacag

SEQ ID NO: 2100129 - DNA, 15 bp, Homo sapiens
tgaggcagacagcag

SEQ ID NO: 2100130 - DNA, 16 bp, Homo sapiens
tgaggcagacagcagc

SEQ ID NO: 2100131 - DNA, 16 bp, Homo sapiens
tgaggcaggagaattg

SEQ ID NO: 2100132 - DNA, 14 bp, Homo sapiens
tgaggccagcctgg

SEQ ID NO: 2100133 - DNA, 15 bp, Homo sapiens
tgaggccagcctggc

SEQ ID NO: 2100134 - DNA, 16 bp, Homo sapiens
tgaggccagcctggcc

SEQ ID NO: 2100135 - DNA, 22 bp, Homo sapiens
tgaggccagcctggcctcctgc

SEQ ID NO: 2100136 - DNA, 12 bp, Homo sapiens
tgaggccaggag

SEQ ID NO: 2100137 - DNA, 15 bp, Homo sapiens
tgaggccccaggccc

SEQ ID NO: 2100138 - DNA, 16 bp, Homo sapiens
tgaggccccaggccct

SEQ ID NO: 2100139 - DNA, 18 bp, Homo sapiens
tgaggcctcatccctcgg

SEQ ID NO: 2100140 - DNA, 14 bp, Homo sapiens
tgaggcctcttgga

SEQ ID NO: 2100141 - DNA, 23 bp, Homo sapiens
tgaggcctcttggacctctgctc

SEQ ID NO: 2100142 - DNA, 21 bp, Homo sapiens
tgaggcctgccctcagggatc

SEQ ID NO: 2100143 - DNA, 15 bp, Homo sapiens
tgaggcctggccagg

SEQ ID NO: 2100144 - DNA, 18 bp, Homo sapiens
tgaggcctttccccagtg

SEQ ID NO: 2100145 - DNA, 19 bp, Homo sapiens
tgaggcctttccccagtgt

SEQ ID NO: 2100146 - DNA, 18 bp, Homo sapiens
tgaggctcaagaggccca

SEQ ID NO: 2100147 - DNA, 20 bp, Homo sapiens
tgaggctcaagaggcccagg

SEQ ID NO: 2100148 - DNA, 21 bp, Homo sapiens
tgaggctcaagaggcccaggg

SEQ ID NO: 2100149 - DNA, 15 bp, Homo sapiens
tgaggctcctgtgct

SEQ ID NO: 2100150 - DNA, 16 bp, Homo sapiens
tgaggctcctgtgcta

SEQ ID NO: 2100151 - DNA, 13 bp, Homo sapiens
tgaggctgcagcg

SEQ ID NO: 2100152 - DNA, 14 bp, Homo sapiens
tgaggctgggccag

SEQ ID NO: 2100153 - DNA, 21 bp, Homo sapiens
tgaggctgggggcgggggagc

SEQ ID NO: 2100154 - DNA, 16 bp, Homo sapiens
tgaggcttccagagag

SEQ ID NO: 2100155 - DNA, 13 bp, Homo sapiens
tgaggcttccagg

SEQ ID NO: 2100156 - DNA, 16 bp, Homo sapiens
tgagggaacagacagg

SEQ ID NO: 2100157 - DNA, 19 bp, Homo sapiens
tgagggagggggcgctcag

SEQ ID NO: 2100158 - DNA, 21 bp, Homo sapiens
tgagggagggggcgctcagga

SEQ ID NO: 2100159 - DNA, 22 bp, Homo sapiens
tgagggagggggcgctcaggac

SEQ ID NO: 2100160 - DNA, 12 bp, Homo sapiens
tgagggcagcag

SEQ ID NO: 2100161 - DNA, 13 bp, Homo sapiens
tgagggcagcagc

SEQ ID NO: 2100162 - DNA, 14 bp, Homo sapiens
tgagggcagcagcc

SEQ ID NO: 2100163 - DNA, 17 bp, Homo sapiens
tgagggcagcagccagc

SEQ ID NO: 2100164 - DNA, 18 bp, Homo sapiens
tgagggcagcagccagcc

SEQ ID NO: 2100165 - DNA, 20 bp, Homo sapiens
tgagggcagcagccagccct

SEQ ID NO: 2100166 - DNA, 17 bp, Homo sapiens
tgagggcattaaaaata

SEQ ID NO: 2100167 - DNA, 22 bp, Homo sapiens
tgaggggaggatcactggagcc

SEQ ID NO: 2100168 - DNA, 15 bp, Homo sapiens
tgaggggctcctgga

SEQ ID NO: 2100169 - DNA, 17 bp, Homo sapiens
tgaggggcttcctgggt

SEQ ID NO: 2100170 - DNA, 22 bp, Homo sapiens
tgaggggggccgtgcccagggg

SEQ ID NO: 2100171 - DNA, 14 bp, Homo sapiens
tgaggggtccctga

SEQ ID NO: 2100172 - DNA, 21 bp, Homo sapiens
tgagggtaataaacttagaat

SEQ ID NO: 2100173 - DNA, 20 bp, Homo sapiens
tgagggttgggctggtgtca

SEQ ID NO: 2100174 - DNA, 21 bp, Homo sapiens
tgagggtttcattgtgtgtta

SEQ ID NO: 2100175 - DNA, 13 bp, Homo sapiens
tgaggtcacctgg

SEQ ID NO: 2100176 - DNA, 16 bp, Homo sapiens
tgaggtcagagcctgc

SEQ ID NO: 2100177 - DNA, 18 bp, Homo sapiens
tgaggtcatagcagtgct

SEQ ID NO: 2100178 - DNA, 13 bp, Homo sapiens
tgaggtcctgagc

SEQ ID NO: 2100179 - DNA, 23 bp, Homo sapiens
tgaggtcctgagcactgccagga

SEQ ID NO: 2100180 - DNA, 15 bp, Homo sapiens
tgaggtctgaaatgg

SEQ ID NO: 2100181 - DNA, 17 bp, Homo sapiens
tgaggtgaaatgggaga

SEQ ID NO: 2100182 - DNA, 12 bp, Homo sapiens
tgaggtgcccag

SEQ ID NO: 2100183 - DNA, 15 bp, Homo sapiens
tgaggtgcccaggag

SEQ ID NO: 2100184 - DNA, 18 bp, Homo sapiens
tgaggtgctgatgagtga

SEQ ID NO: 2100185 - DNA, 21 bp, Homo sapiens
tgaggtggaagccctccttcc

SEQ ID NO: 2100186 - DNA, 21 bp, Homo sapiens
tgaggtgggttttcttcccat

SEQ ID NO: 2100187 - DNA, 18 bp, Homo sapiens
tgaggtgtcttaagcctt

SEQ ID NO: 2100188 - DNA, 16 bp, Homo sapiens
tgaggttaaaatataa

SEQ ID NO: 2100189 - DNA, 22 bp, Homo sapiens
tgaggttaaaatataaattaag

SEQ ID NO: 2100190 - DNA, 12 bp, Homo sapiens
tgaggttaggag

SEQ ID NO: 2100191 - DNA, 15 bp, Homo sapiens
tgaggttgctttgtt

SEQ ID NO: 2100192 - DNA, 18 bp, Homo sapiens
tgagtaaattggaaacat

SEQ ID NO: 2100193 - DNA, 22 bp, Homo sapiens
tgagtaaattggaaacattttc

SEQ ID NO: 2100194 - DNA, 18 bp, Homo sapiens
tgagtacagtgaggaggg

SEQ ID NO: 2100195 - DNA, 22 bp, Homo sapiens
tgagtaccaaatccacaagcca

SEQ ID NO: 2100196 - DNA, 15 bp, Homo sapiens
tgagtagatctgctt

SEQ ID NO: 2100197 - DNA, 15 bp, Homo sapiens
tgagtcaactggagc

SEQ ID NO: 2100198 - DNA, 16 bp, Homo sapiens
tgagtcaactggagca

SEQ ID NO: 2100199 - DNA, 16 bp, Homo sapiens
tgagtcacccatgaag

SEQ ID NO: 2100200 - DNA, 22 bp, Homo sapiens
tgagtcaccctacctgtgcctg

SEQ ID NO: 2100201 - DNA, 18 bp, Homo sapiens
tgcaagatttaacactaa

SEQ ID NO: 2100202 - DNA, 15 bp, Homo sapiens
tgcaagccactatgt

SEQ ID NO: 2100203 - DNA, 17 bp, Homo sapiens
tgcaagccactatgtcc

SEQ ID NO: 2100204 - DNA, 16 bp, Homo sapiens
tgcaagccccagggcc

SEQ ID NO: 2100205 - DNA, 23 bp, Homo sapiens
tgcaagccccagggcctgggggc

SEQ ID NO: 2100206 - DNA, 12 bp, Homo sapiens
tgcaaggaagga

SEQ ID NO: 2100207 - DNA, 15 bp, Homo sapiens
tgcaaggaaggaaag

SEQ ID NO: 2100208 - DNA, 16 bp, Homo sapiens
tgcaaggaaggaaaga

SEQ ID NO: 2100209 - DNA, 19 bp, Homo sapiens
tgcaaggaaggaaagaaag

SEQ ID NO: 2100210 - DNA, 23 bp, Homo sapiens
tgcaaggccgctgttcacccaca

SEQ ID NO: 2100211 - DNA, 19 bp, Homo sapiens
tgcaagtactgctgtaaat

SEQ ID NO: 2100212 - DNA, 23 bp, Homo sapiens
tgcaagtgcccgccctgcccctg

SEQ ID NO: 2100213 - DNA, 15 bp, Homo sapiens
tgcaataaaatagta

SEQ ID NO: 2100214 - DNA, 15 bp, Homo sapiens
tgcaataatgtgcaa

SEQ ID NO: 2100215 - DNA, 15 bp, Homo sapiens
tgcaatcccttaata

SEQ ID NO: 2100216 - DNA, 22 bp, Homo sapiens
tgcaatctccagggctgcccct

SEQ ID NO: 2100217 - DNA, 13 bp, Homo sapiens
tgcaatgaaacag

SEQ ID NO: 2100218 - DNA, 16 bp, Homo sapiens
tgcaatgacatcttca

SEQ ID NO: 2100219 - DNA, 13 bp, Homo sapiens
tgcaatggcagcc

SEQ ID NO: 2100220 - DNA, 22 bp, Homo sapiens
tgcaatgtaaatattttaaaga

SEQ ID NO: 2100221 - DNA, 23 bp, Homo sapiens
tgcaattattctaattttatata

SEQ ID NO: 2100222 - DNA, 21 bp, Homo sapiens
tgcaatttttaaactagtaat

SEQ ID NO: 2100223 - DNA, 17 bp, Homo sapiens
tgcacaaagcccttcca

SEQ ID NO: 2100224 - DNA, 14 bp, Homo sapiens
tgcacaagctcaga

SEQ ID NO: 2100225 - DNA, 21 bp, Homo sapiens
tgcacaagcttgtatatacat

SEQ ID NO: 2100226 - DNA, 13 bp, Homo sapiens
tgcacaatgggca

SEQ ID NO: 2100227 - DNA, 17 bp, Homo sapiens
tgcacaatttagaaaac

SEQ ID NO: 2100228 - DNA, 18 bp, Homo sapiens
tgcacaatttagaaaaca

SEQ ID NO: 2100229 - DNA, 11 bp, Homo sapiens
tgcacaatttg

SEQ ID NO: 2100230 - DNA, 12 bp, Homo sapiens
tgcacaatttga

SEQ ID NO: 2100231 - DNA, 15 bp, Homo sapiens
tgcacaatttgagca

SEQ ID NO: 2100232 - DNA, 18 bp, Homo sapiens
tgcacaatttgagcaatt

SEQ ID NO: 2100233 - DNA, 19 bp, Homo sapiens
tgcacaatttgagcaattc

SEQ ID NO: 2100234 - DNA, 18 bp, Homo sapiens
tgcacacaaacacctcct

SEQ ID NO: 2100235 - DNA, 18 bp, Homo sapiens
tgcacacacagatgcaca

SEQ ID NO: 2100236 - DNA, 16 bp, Homo sapiens
tgcacacacagctcct

SEQ ID NO: 2100237 - DNA, 14 bp, Homo sapiens
tgcacacacatgga

SEQ ID NO: 2100238 - DNA, 21 bp, Homo sapiens
tgcacacacatggatgagcac

SEQ ID NO: 2100239 - DNA, 16 bp, Homo sapiens
tgcacacggatgcaca

SEQ ID NO: 2100240 - DNA, 16 bp, Homo sapiens
tgcacactatttccct

SEQ ID NO: 2100241 - DNA, 16 bp, Homo sapiens
tgcacagcggcccctg

SEQ ID NO: 2100242 - DNA, 12 bp, Homo sapiens
tgcacaggaggg

SEQ ID NO: 2100243 - DNA, 18 bp, Homo sapiens
tgcacagtgcatctcagc

SEQ ID NO: 2100244 - DNA, 19 bp, Homo sapiens
tgcacatatgggtgctggc

SEQ ID NO: 2100245 - DNA, 20 bp, Homo sapiens
tgcacatatgggtgctggca

SEQ ID NO: 2100246 - DNA, 23 bp, Homo sapiens
tgcacatgaatcccacccacatg

SEQ ID NO: 2100247 - DNA, 21 bp, Homo sapiens
tgcacatgtaacatagattta

SEQ ID NO: 2100248 - DNA, 22 bp, Homo sapiens
tgcacatgtcttgtacatgtgt

SEQ ID NO: 2100249 - DNA, 15 bp, Homo sapiens
tgcacatgtgtctgt

SEQ ID NO: 2100250 - DNA, 18 bp, Homo sapiens
tgcacattcctggccccg

SEQ ID NO: 2100251 - DNA, 13 bp, Homo sapiens
tgcacatttatat

SEQ ID NO: 2100252 - DNA, 23 bp, Homo sapiens
tgcacattttgtacaaagatatg

SEQ ID NO: 2100253 - DNA, 14 bp, Homo sapiens
tgcaccaccatgcc

SEQ ID NO: 2100254 - DNA, 20 bp, Homo sapiens
tgcaccaccatgccaggcta

SEQ ID NO: 2100255 - DNA, 21 bp, Homo sapiens
tgcaccagagtgaaagggcta

SEQ ID NO: 2100256 - DNA, 19 bp, Homo sapiens
tgcaccagtgccgcctgtg

SEQ ID NO: 2100257 - DNA, 22 bp, Homo sapiens
tgcacccctccccattcacaga

SEQ ID NO: 2100258 - DNA, 22 bp, Homo sapiens
tgcacccgtacccccgtggtct

SEQ ID NO: 2100259 - DNA, 16 bp, Homo sapiens
tgcaccctccgccttc

SEQ ID NO: 2100260 - DNA, 12 bp, Homo sapiens
tgcaccctggaa

SEQ ID NO: 2100261 - DNA, 14 bp, Homo sapiens
tgcaccgggccaca

SEQ ID NO: 2100262 - DNA, 15 bp, Homo sapiens
tgcaccgggccacag

SEQ ID NO: 2100263 - DNA, 19 bp, Homo sapiens
tgcacctaaagaaaaacaa

SEQ ID NO: 2100264 - DNA, 18 bp, Homo sapiens
tgcacctccccccactgc

SEQ ID NO: 2100265 - DNA, 19 bp, Homo sapiens
tgcacctccccccactgca

SEQ ID NO: 2100266 - DNA, 20 bp, Homo sapiens
tgcacctccccccactgcag

SEQ ID NO: 2100267 - DNA, 18 bp, Homo sapiens
tgcacctgcatccgtagt

SEQ ID NO: 2100268 - DNA, 20 bp, Homo sapiens
tgcacctgccagcctggctt

SEQ ID NO: 2100269 - DNA, 22 bp, Homo sapiens
tgcacctgccagcctggcttct

SEQ ID NO: 2100270 - DNA, 12 bp, Homo sapiens
tgcacctgtgca

SEQ ID NO: 2100271 - DNA, 18 bp, Homo sapiens
tgcaccttaccaactttc

SEQ ID NO: 2100272 - DNA, 21 bp, Homo sapiens
tgcaccttaccaactttctgt

SEQ ID NO: 2100273 - DNA, 16 bp, Homo sapiens
tgcaccttgtgtctgt

SEQ ID NO: 2100274 - DNA, 15 bp, Homo sapiens
tgcacgaccttggga

SEQ ID NO: 2100275 - DNA, 12 bp, Homo sapiens
tgcacgccgtgg

SEQ ID NO: 2100276 - DNA, 15 bp, Homo sapiens
tgcacggcagcttga

SEQ ID NO: 2100277 - DNA, 17 bp, Homo sapiens
tgcacggcggcagggtg

SEQ ID NO: 2100278 - DNA, 20 bp, Homo sapiens
tgcacggcggcagggtgggg

SEQ ID NO: 2100279 - DNA, 21 bp, Homo sapiens
tgcacggcggcagggtggggg

SEQ ID NO: 2100280 - DNA, 23 bp, Homo sapiens
tgcacgtgctcttctgttctcaa

SEQ ID NO: 2100281 - DNA, 22 bp, Homo sapiens
tgcactaaaacccatcttcccc

SEQ ID NO: 2100282 - DNA, 18 bp, Homo sapiens
tgcactagcctgtgatta

SEQ ID NO: 2100283 - DNA, 16 bp, Homo sapiens
tgcactatgaaaatca

SEQ ID NO: 2100284 - DNA, 15 bp, Homo sapiens
tgcactcagcttttt

SEQ ID NO: 2100285 - DNA, 11 bp, Homo sapiens
tgcactccaga

SEQ ID NO: 2100286 - DNA, 12 bp, Homo sapiens
tgcactccagaa

SEQ ID NO: 2100287 - DNA, 13 bp, Homo sapiens
tgcactccagaat

SEQ ID NO: 2100288 - DNA, 20 bp, Homo sapiens
tgcactccagcctgggcaac

SEQ ID NO: 2100289 - DNA, 18 bp, Homo sapiens
tgcactccagcctgggcg

SEQ ID NO: 2100290 - DNA, 18 bp, Homo sapiens
tgcactccatggccaccc

SEQ ID NO: 2100291 - DNA, 19 bp, Homo sapiens
tgcactccatggccacccc

SEQ ID NO: 2100292 - DNA, 13 bp, Homo sapiens
tgcactgacaaga

SEQ ID NO: 2100293 - DNA, 18 bp, Homo sapiens
tgcactgacaagatggaa

SEQ ID NO: 2100294 - DNA, 21 bp, Homo sapiens
tgcactgacatgtttcacaac

SEQ ID NO: 2100295 - DNA, 22 bp, Homo sapiens
tgcactgacccacagcctctgc

SEQ ID NO: 2100296 - DNA, 20 bp, Homo sapiens
tgcactgacccttccagaca

SEQ ID NO: 2100297 - DNA, 12 bp, Homo sapiens
tgcactgagggc

SEQ ID NO: 2100298 - DNA, 12 bp, Homo sapiens
tgcactggccac

SEQ ID NO: 2100299 - DNA, 15 bp, Homo sapiens
tgcactggccaccca

SEQ ID NO: 2100300 - DNA, 17 bp, Homo sapiens
tgcactggccccaccct

SEQ ID NO: 2100301 - DNA, 19 bp, Homo sapiens
tgcactggtcccaagtagt

SEQ ID NO: 2100302 - DNA, 16 bp, Homo sapiens
tgcactgtatgctgga

SEQ ID NO: 2100303 - DNA, 16 bp, Homo sapiens
tgcactgtcaagatga

SEQ ID NO: 2100304 - DNA, 16 bp, Homo sapiens
tgcactgttacttttt

SEQ ID NO: 2100305 - DNA, 15 bp, Homo sapiens
tgcacttcagacacc

SEQ ID NO: 2100306 - DNA, 14 bp, Homo sapiens
tgcacttcttacaa

SEQ ID NO: 2100307 - DNA, 16 bp, Homo sapiens
tgcacttggctgcata

SEQ ID NO: 2100308 - DNA, 17 bp, Homo sapiens
tgcagaaaagcacctgc

SEQ ID NO: 2100309 - DNA, 18 bp, Homo sapiens
tgcagaagcagtgtttct

SEQ ID NO: 2100310 - DNA, 21 bp, Homo sapiens
tgcagaatacagtaagctgct

SEQ ID NO: 2100311 - DNA, 18 bp, Homo sapiens
tgcagaattttttgagta

SEQ ID NO: 2100312 - DNA, 21 bp, Homo sapiens
tgcagacaggcaagcacctcc

SEQ ID NO: 2100313 - DNA, 22 bp, Homo sapiens
tgcagacaggcaagcacctcct

SEQ ID NO: 2100314 - DNA, 14 bp, Homo sapiens
tgcagactgtggct

SEQ ID NO: 2100315 - DNA, 17 bp, Homo sapiens
tgcagagatttcctcca

SEQ ID NO: 2100316 - DNA, 21 bp, Homo sapiens
tgccctggtgctgccacactt

SEQ ID NO: 2100317 - DNA, 17 bp, Homo sapiens
tgccctgtatataatac

SEQ ID NO: 2100318 - DNA, 20 bp, Homo sapiens
tgccctgtatataatactaa

SEQ ID NO: 2100319 - DNA, 24 bp, Homo sapiens
tgccctgtatataatactaaagtg

SEQ ID NO: 2100320 - DNA, 19 bp, Homo sapiens
tgccctgttaaaagatgaa

SEQ ID NO: 2100321 - DNA, 20 bp, Homo sapiens
tgccctgttaaaagatgaaa

SEQ ID NO: 2100322 - DNA, 19 bp, Homo sapiens
tgccctgttgtgtatagat

SEQ ID NO: 2100323 - DNA, 20 bp, Homo sapiens
tgccctgttgtgtatagatg

SEQ ID NO: 2100324 - DNA, 14 bp, Homo sapiens
tgcccttcgctgcc

SEQ ID NO: 2100325 - DNA, 19 bp, Homo sapiens
tgcccttcgctgccaggac

SEQ ID NO: 2100326 - DNA, 22 bp, Homo sapiens
tgcccttcgctgccaggacacc

SEQ ID NO: 2100327 - DNA, 14 bp, Homo sapiens
tgcccttctttcta

SEQ ID NO: 2100328 - DNA, 16 bp, Homo sapiens
tgcccttctttctacc

SEQ ID NO: 2100329 - DNA, 18 bp, Homo sapiens
tgcccttgccctgacctc

SEQ ID NO: 2100330 - DNA, 24 bp, Homo sapiens
tgcccttgtttggggcaggagtag

SEQ ID NO: 2100331 - DNA, 15 bp, Homo sapiens
tgccgaccagagccc

SEQ ID NO: 2100332 - DNA, 21 bp, Homo sapiens
tgccgaccagagccccacacg

SEQ ID NO: 2100333 - DNA, 14 bp, Homo sapiens
tgccgacctcgtcc

SEQ ID NO: 2100334 - DNA, 17 bp, Homo sapiens
tgccgacctcgtcctcc

SEQ ID NO: 2100335 - DNA, 21 bp, Homo sapiens
tgccgacctcgtcctccccct

SEQ ID NO: 2100336 - DNA, 15 bp, Homo sapiens
tgccgcaaggccctg

SEQ ID NO: 2100337 - DNA, 17 bp, Homo sapiens
tgccgcaaggccctgtc

SEQ ID NO: 2100338 - DNA, 20 bp, Homo sapiens
tgccgcaaggccctgtccca

SEQ ID NO: 2100339 - DNA, 22 bp, Homo sapiens
tgccgcaaggccctgtcccagc

SEQ ID NO: 2100340 - DNA, 13 bp, Homo sapiens
tgccgcaccccag

SEQ ID NO: 2100341 - DNA, 15 bp, Homo sapiens
tgccgcaccccagag

SEQ ID NO: 2100342 - DNA, 18 bp, Homo sapiens
tgccgcaccccagagtgt

SEQ ID NO: 2100343 - DNA, 14 bp, Homo sapiens
tgccgcctcccagc

SEQ ID NO: 2100344 - DNA, 18 bp, Homo sapiens
tgccgcctcccagcctgg

SEQ ID NO: 2100345 - DNA, 12 bp, Homo sapiens
tgccgctcttct

SEQ ID NO: 2100346 - DNA, 13 bp, Homo sapiens
tgccgctcttctg

SEQ ID NO: 2100347 - DNA, 15 bp, Homo sapiens
tgccgctcttctgtc

SEQ ID NO: 2100348 - DNA, 17 bp, Homo sapiens
tgccgctcttctgtcat

SEQ ID NO: 2100349 - DNA, 21 bp, Homo sapiens
tgccgctcttctgtcatcccg

SEQ ID NO: 2100350 - DNA, 14 bp, Homo sapiens
tgccgggttttata

SEQ ID NO: 2100351 - DNA, 22 bp, Homo sapiens
tgccgttactctccaacctgga

SEQ ID NO: 2100352 - DNA, 15 bp, Homo sapiens
tgcctaagtggctgc

SEQ ID NO: 2100353 - DNA, 18 bp, Homo sapiens
tgcctaataaacatcctt

SEQ ID NO: 2100354 - DNA, 21 bp, Homo sapiens
tgcctaataaacatccttcaa

SEQ ID NO: 2100355 - DNA, 17 bp, Homo sapiens
tgcctaataaagagact

SEQ ID NO: 2100356 - DNA, 14 bp, Homo sapiens
tgcctaattcctgg

SEQ ID NO: 2100357 - DNA, 23 bp, Homo sapiens
tgcctacagataatttattttgt

SEQ ID NO: 2100358 - DNA, 19 bp, Homo sapiens
tgcctacattccctggcct

SEQ ID NO: 2100359 - DNA, 20 bp, Homo sapiens
tgcctataaaatgcccattt

SEQ ID NO: 2100360 - DNA, 17 bp, Homo sapiens
tgcctatccatcctgcg

SEQ ID NO: 2100361 - DNA, 16 bp, Homo sapiens
tgcctatgataaattc

SEQ ID NO: 2100362 - DNA, 17 bp, Homo sapiens
tgcctatttattcattc

SEQ ID NO: 2100363 - DNA, 23 bp, Homo sapiens
tgcctatttattggggatctgca

SEQ ID NO: 2100364 - DNA, 22 bp, Homo sapiens
tgcctcaaataaaaagtgcttt

SEQ ID NO: 2100365 - DNA, 22 bp, Homo sapiens
tgcctcaatgtgaatcagaccc

SEQ ID NO: 2100366 - DNA, 13 bp, Homo sapiens
tgcctcagcctcc

SEQ ID NO: 2100367 - DNA, 20 bp, Homo sapiens
tgcctcatctataacatgca

SEQ ID NO: 2100368 - DNA, 14 bp, Homo sapiens
tgcctcatgaccct

SEQ ID NO: 2100369 - DNA, 18 bp, Homo sapiens
tgcctcatgctgacttgc

SEQ ID NO: 2100370 - DNA, 15 bp, Homo sapiens
tgcctccaagatttc

SEQ ID NO: 2100371 - DNA, 17 bp, Homo sapiens
tgcctccaagccattca

SEQ ID NO: 2100372 - DNA, 11 bp, Homo sapiens
tgcctccacct

SEQ ID NO: 2100373 - DNA, 23 bp, Homo sapiens
tgcctcccagccctgccaggagg

SEQ ID NO: 2100374 - DNA, 15 bp, Homo sapiens
tgcctccctttctgg

SEQ ID NO: 2100375 - DNA, 17 bp, Homo sapiens
tgcctccctttctggga

SEQ ID NO: 2100376 - DNA, 24 bp, Homo sapiens
tgcctcctcacccccagctttgct

SEQ ID NO: 2100377 - DNA, 14 bp, Homo sapiens
tgcctcctcttcaa

SEQ ID NO: 2100378 - DNA, 13 bp, Homo sapiens
tgcctcctgggac

SEQ ID NO: 2100379 - DNA, 20 bp, Homo sapiens
tgcctcgaactggctgcaaa

SEQ ID NO: 2100380 - DNA, 14 bp, Homo sapiens
tgcctcgaggcacc

SEQ ID NO: 2100381 - DNA, 21 bp, Homo sapiens
tgcctcgaggcaccggcgctg

SEQ ID NO: 2100382 - DNA, 23 bp, Homo sapiens
tgcctcgaggcaccggcgctgca

SEQ ID NO: 2100383 - DNA, 19 bp, Homo sapiens
tgcctctcacacacataga

SEQ ID NO: 2100384 - DNA, 20 bp, Homo sapiens
tgcctctcccacgatgtcaa

SEQ ID NO: 2100385 - DNA, 17 bp, Homo sapiens
tgcctctctgctccaga

SEQ ID NO: 2100386 - DNA, 21 bp, Homo sapiens
tgcctctgacacacagctctg

SEQ ID NO: 2100387 - DNA, 22 bp, Homo sapiens
tgcctctgacacacagctctgt

SEQ ID NO: 2100388 - DNA, 14 bp, Homo sapiens
tgcctctgactcac

SEQ ID NO: 2100389 - DNA, 19 bp, Homo sapiens
tgcctctgaggccagcctg

SEQ ID NO: 2100390 - DNA, 16 bp, Homo sapiens
tgcctctgccatgccc

SEQ ID NO: 2100391 - DNA, 11 bp, Homo sapiens
tgcctctgcct

SEQ ID NO: 2100392 - DNA, 12 bp, Homo sapiens
tgcctctgcctc

SEQ ID NO: 2100393 - DNA, 18 bp, Homo sapiens
tgcctctgcctctgacac

SEQ ID NO: 2100394 - DNA, 18 bp, Homo sapiens
tgcctctgcctgtctccc

SEQ ID NO: 2100395 - DNA, 13 bp, Homo sapiens
tgcctgaagaaca

SEQ ID NO: 2100396 - DNA, 18 bp, Homo sapiens
tgcctgaagtcacacagt

SEQ ID NO: 2100397 - DNA, 22 bp, Homo sapiens
tgcctgaagtcacacagtgagt

SEQ ID NO: 2100398 - DNA, 22 bp, Homo sapiens
tgcctgaatccatcaggacttg

SEQ ID NO: 2100399 - DNA, 23 bp, Homo sapiens
tgcctgaccctacttcttttgct

SEQ ID NO: 2100400 - DNA, 23 bp, Homo sapiens
tgcctgagctggggcctggagag

SEQ ID NO: 2100401 - DNA, 23 bp, Homo sapiens
tgcctgaggctcaagaggcccag

SEQ ID NO: 2100402 - DNA, 14 bp, Homo sapiens
tgcctgagggtgga

SEQ ID NO: 2100403 - DNA, 17 bp, Homo sapiens
tgcctgcacccttcctc

SEQ ID NO: 2100404 - DNA, 11 bp, Homo sapiens
tgcctgcagcc

SEQ ID NO: 2100405 - DNA, 14 bp, Homo sapiens
tgcctgcagcctcc

SEQ ID NO: 2100406 - DNA, 20 bp, Homo sapiens
tgcctgcagcctcccccaca

SEQ ID NO: 2100407 - DNA, 20 bp, Homo sapiens
tgcctgcccaggcccctgcc

SEQ ID NO: 2100408 - DNA, 22 bp, Homo sapiens
tgcctgcccaggcccctgccac

SEQ ID NO: 2100409 - DNA, 14 bp, Homo sapiens
tgcctgccctggag

SEQ ID NO: 2100410 - DNA, 14 bp, Homo sapiens
tgcctgctagagca

SEQ ID NO: 2100411 - DNA, 10 bp, Homo sapiens
tgcctgctga

SEQ ID NO: 2100412 - DNA, 22 bp, Homo sapiens
tgcctggaggacctgagcctgc

SEQ ID NO: 2100413 - DNA, 16 bp, Homo sapiens
tgcctggcccccctcc

SEQ ID NO: 2100414 - DNA, 20 bp, Homo sapiens
tgcctggcccccctccaggc

SEQ ID NO: 2100415 - DNA, 13 bp, Homo sapiens
tgcctggcctggc

SEQ ID NO: 2100416 - DNA, 15 bp, Homo sapiens
tgcctggcctggctc

SEQ ID NO: 2100417 - DNA, 16 bp, Homo sapiens
tgcctggcctggctcc

SEQ ID NO: 2100418 - DNA, 14 bp, Homo sapiens
tgcctggctgtgga

SEQ ID NO: 2100419 - DNA, 17 bp, Homo sapiens
tgcctggctgtggaggc

SEQ ID NO: 2100420 - DNA, 19 bp, Homo sapiens
tgcctggctgtggaggcct

SEQ ID NO: 2100421 - DNA, 21 bp, Homo sapiens
tgcctggctgtggaggcctga

SEQ ID NO: 2100422 - DNA, 15 bp, Homo sapiens
tgcctgggcctgtgc

SEQ ID NO: 2100423 - DNA, 16 bp, Homo sapiens
tgcctgggcctgtgca

SEQ ID NO: 2100424 - DNA, 20 bp, Homo sapiens
tgcctgggcctgtgcagcag

SEQ ID NO: 2100425 - DNA, 18 bp, Homo sapiens
tgcctggggattgggagg

SEQ ID NO: 2100426 - DNA, 21 bp, Homo sapiens
tgcctgggttttctaactgta

SEQ ID NO: 2100427 - DNA, 22 bp, Homo sapiens
tgcctgggttttctaactgtaa

SEQ ID NO: 2100428 - DNA, 14 bp, Homo sapiens
tgcctggtggcagc

SEQ ID NO: 2100429 - DNA, 16 bp, Homo sapiens
tgcctggtgggccacg

SEQ ID NO: 2100430 - DNA, 13 bp, Homo sapiens
tgcttttccagga

SEQ ID NO: 2100431 - DNA, 23 bp, Homo sapiens
tgcttttccaggatcctgcagga

SEQ ID NO: 2100432 - DNA, 15 bp, Homo sapiens
tgcttttgctggggt

SEQ ID NO: 2100433 - DNA, 17 bp, Homo sapiens
tgcttttgttgtgactt

SEQ ID NO: 2100434 - DNA, 19 bp, Homo sapiens
tgcttttgttgtgactttt

SEQ ID NO: 2100435 - DNA, 15 bp, Homo sapiens
tggaaaaaagagaaa

SEQ ID NO: 2100436 - DNA, 23 bp, Homo sapiens
tggaaaaaagagaaaaaccaatg

SEQ ID NO: 2100437 - DNA, 15 bp, Homo sapiens
tggaaaaagaaagaa

SEQ ID NO: 2100438 - DNA, 18 bp, Homo sapiens
tggaaaaatccagaaaga

SEQ ID NO: 2100439 - DNA, 19 bp, Homo sapiens
tggaaaaatccagaaagaa

SEQ ID NO: 2100440 - DNA, 23 bp, Homo sapiens
tggaaaagcccagtgacctgacc

SEQ ID NO: 2100441 - DNA, 17 bp, Homo sapiens
tggaaaagtcacacaga

SEQ ID NO: 2100442 - DNA, 16 bp, Homo sapiens
tggaaaataaattata

SEQ ID NO: 2100443 - DNA, 19 bp, Homo sapiens
tggaaaccacacttcttga

SEQ ID NO: 2100444 - DNA, 15 bp, Homo sapiens
tggaaacctgaaaaa

SEQ ID NO: 2100445 - DNA, 16 bp, Homo sapiens
tggaaagaatctaata

SEQ ID NO: 2100446 - DNA, 20 bp, Homo sapiens
tggaaagactgattgtttta

SEQ ID NO: 2100447 - DNA, 12 bp, Homo sapiens
tggaaagagacc

SEQ ID NO: 2100448 - DNA, 18 bp, Homo sapiens
tggaaagcagcagcttgt

SEQ ID NO: 2100449 - DNA, 19 bp, Homo sapiens
tggaaagcatcacctcagg

SEQ ID NO: 2100450 - DNA, 15 bp, Homo sapiens
tggaaagcctctgct

SEQ ID NO: 2100451 - DNA, 16 bp, Homo sapiens
tggaaagcctctgctg

SEQ ID NO: 2100452 - DNA, 18 bp, Homo sapiens
tggaaagcctctgctgcc

SEQ ID NO: 2100453 - DNA, 21 bp, Homo sapiens
tggaaaggctcagtctcagga

SEQ ID NO: 2100454 - DNA, 23 bp, Homo sapiens
tggaaaggctcagtctcaggagc

SEQ ID NO: 2100455 - DNA, 19 bp, Homo sapiens
tggaaaggtcattgtggct

SEQ ID NO: 2100456 - DNA, 22 bp, Homo sapiens
tggaaaggtttcaagacttgat

SEQ ID NO: 2100457 - DNA, 23 bp, Homo sapiens
tggaaaggtttcaagacttgata

SEQ ID NO: 2100458 - DNA, 17 bp, Homo sapiens
tggaaagttcagccaga

SEQ ID NO: 2100459 - DNA, 17 bp, Homo sapiens
tggaaataaacctggag

SEQ ID NO: 2100460 - DNA, 19 bp, Homo sapiens
tggaaataaacctggagat

SEQ ID NO: 2100461 - DNA, 21 bp, Homo sapiens
tggaaatactttatctgtgac

SEQ ID NO: 2100462 - DNA, 20 bp, Homo sapiens
tggaaatctggattttcagc

SEQ ID NO: 2100463 - DNA, 14 bp, Homo sapiens
tggaacaccaggct

SEQ ID NO: 2100464 - DNA, 19 bp, Homo sapiens
tggaaccagggaggagagg

SEQ ID NO: 2100465 - DNA, 20 bp, Homo sapiens
tggaaccgtgtccagcacag

SEQ ID NO: 2100466 - DNA, 21 bp, Homo sapiens
tggaaccgtgtccagcacaga

SEQ ID NO: 2100467 - DNA, 13 bp, Homo sapiens
tggaaccttccct

SEQ ID NO: 2100468 - DNA, 17 bp, Homo sapiens
tggaaccttccctccaa

SEQ ID NO: 2100469 - DNA, 23 bp, Homo sapiens
tggaactcagctgtctgtggctt

SEQ ID NO: 2100470 - DNA, 20 bp, Homo sapiens
tggaactgaagggggcggcc

SEQ ID NO: 2100471 - DNA, 22 bp, Homo sapiens
tggaactgaagggggcggccta

SEQ ID NO: 2100472 - DNA, 13 bp, Homo sapiens
tggaactgacccc

SEQ ID NO: 2100473 - DNA, 21 bp, Homo sapiens
tggaactgaccccctcccctg

SEQ ID NO: 2100474 - DNA, 13 bp, Homo sapiens
tggaacttctaat

SEQ ID NO: 2100475 - DNA, 13 bp, Homo sapiens
tggaacttgaact

SEQ ID NO: 2100476 - DNA, 16 bp, Homo sapiens
tggaacttgaactgat

SEQ ID NO: 2100477 - DNA, 13 bp, Homo sapiens
tggaagaaacagg

SEQ ID NO: 2100478 - DNA, 17 bp, Homo sapiens
tggaagaaattcctgta

SEQ ID NO: 2100479 - DNA, 17 bp, Homo sapiens
tggaagaaatttaggaa

SEQ ID NO: 2100480 - DNA, 13 bp, Homo sapiens
tggaagagaaatc

SEQ ID NO: 2100481 - DNA, 12 bp, Homo sapiens
tggaagagaggc

SEQ ID NO: 2100482 - DNA, 15 bp, Homo sapiens
tggaagagaggcacc

SEQ ID NO: 2100483 - DNA, 18 bp, Homo sapiens
tggaagagaggcacctgc

SEQ ID NO: 2100484 - DNA, 21 bp, Homo sapiens
tggaagagaggcacctgctgg

SEQ ID NO: 2100485 - DNA, 13 bp, Homo sapiens
tggaagagcagcc

SEQ ID NO: 2100486 - DNA, 18 bp, Homo sapiens
tggaagagcagcctgatg

SEQ ID NO: 2100487 - DNA, 16 bp, Homo sapiens
tggaagcacagcttca

SEQ ID NO: 2100488 - DNA, 17 bp, Homo sapiens
tggaagccctccttcca

SEQ ID NO: 2100489 - DNA, 11 bp, Homo sapiens
tggaagctgag

SEQ ID NO: 2100490 - DNA, 16 bp, Homo sapiens
tggaaggcagggcaga

SEQ ID NO: 2100491 - DNA, 17 bp, Homo sapiens
tggaaggcagggcagag

SEQ ID NO: 2100492 - DNA, 18 bp, Homo sapiens
tggaaggcagggcagagg

SEQ ID NO: 2100493 - DNA, 14 bp, Homo sapiens
tggaaggctttgcc

SEQ ID NO: 2100494 - DNA, 20 bp, Homo sapiens
tggaaggtttggtgtgtgga

SEQ ID NO: 2100495 - DNA, 19 bp, Homo sapiens
tggaagtcgtttcaggaca

SEQ ID NO: 2100496 - DNA, 19 bp, Homo sapiens
tggaagtgtgtggaaggca

SEQ ID NO: 2100497 - DNA, 21 bp, Homo sapiens
tggaagtgttccctgagaaac

SEQ ID NO: 2100498 - DNA, 21 bp, Homo sapiens
tggaataataattttcctcct

SEQ ID NO: 2100499 - DNA, 14 bp, Homo sapiens
tggaatacatgaaa

SEQ ID NO: 2100500 - DNA, 15 bp, Homo sapiens
tggaatacatgaaat

SEQ ID NO: 2100501 - DNA, 20 bp, Homo sapiens
tggaatactaaaaatcatga

SEQ ID NO: 2100502 - DNA, 13 bp, Homo sapiens
tggaatataaaga

SEQ ID NO: 2100503 - DNA, 23 bp, Homo sapiens
tggaatattcccctatctctaga

SEQ ID NO: 2100504 - DNA, 18 bp, Homo sapiens
tggaatcaatttcccaga

SEQ ID NO: 2100505 - DNA, 19 bp, Homo sapiens
tggaatcgatctgtactgt

SEQ ID NO: 2100506 - DNA, 22 bp, Homo sapiens
tggaatcgatctgtactgtaat

SEQ ID NO: 2100507 - DNA, 15 bp, Homo sapiens
tggaatctggagagc

SEQ ID NO: 2100508 - DNA, 15 bp, Homo sapiens
tggaatgaagcatgt

SEQ ID NO: 2100509 - DNA, 22 bp, Homo sapiens
tggaatgactataaacattaaa

SEQ ID NO: 2100510 - DNA, 21 bp, Homo sapiens
tggaattcagcaccctgggtg

SEQ ID NO: 2100511 - DNA, 14 bp, Homo sapiens
tggaatttgtaagt

SEQ ID NO: 2100512 - DNA, 12 bp, Homo sapiens
tggaatttttca

SEQ ID NO: 2100513 - DNA, 15 bp, Homo sapiens
tggacaagaagctgc

SEQ ID NO: 2100514 - DNA, 17 bp, Homo sapiens
tggacaagaagctgcta

SEQ ID NO: 2100515 - DNA, 16 bp, Homo sapiens
tggacaagtttcccaa

SEQ ID NO: 2100516 - DNA, 17 bp, Homo sapiens
tggacaatataaactga

SEQ ID NO: 2100517 - DNA, 17 bp, Homo sapiens
tggacacacaaggtgca

SEQ ID NO: 2100518 - DNA, 15 bp, Homo sapiens
tggacacactgtaaa

SEQ ID NO: 2100519 - DNA, 21 bp, Homo sapiens
tggacacactgtaaacccctg

SEQ ID NO: 2100520 - DNA, 22 bp, Homo sapiens
tggacacactgtaaacccctgg

SEQ ID NO: 2100521 - DNA, 14 bp, Homo sapiens
tggacacagctctt

SEQ ID NO: 2100522 - DNA, 18 bp, Homo sapiens
tggacacagctcttctcc

SEQ ID NO: 2100523 - DNA, 23 bp, Homo sapiens
tggacacagctcttctccaggct

SEQ ID NO: 2100524 - DNA, 13 bp, Homo sapiens
tggacacagtgtt

SEQ ID NO: 2100525 - DNA, 18 bp, Homo sapiens
tggacaccaggagtccct

SEQ ID NO: 2100526 - DNA, 21 bp, Homo sapiens
tggacaccaggagtccctggt

SEQ ID NO: 2100527 - DNA, 20 bp, Homo sapiens
tggacaccccttatccagga

SEQ ID NO: 2100528 - DNA, 22 bp, Homo sapiens
tggacaccccttatccaggact

SEQ ID NO: 2100529 - DNA, 12 bp, Homo sapiens
tggacacctgcc

SEQ ID NO: 2100530 - DNA, 15 bp, Homo sapiens
tggacacctgccctg

SEQ ID NO: 2100531 - DNA, 16 bp, Homo sapiens
tggacacctgccctgc

SEQ ID NO: 2100532 - DNA, 14 bp, Homo sapiens
tggacactgtacaa

SEQ ID NO: 2100533 - DNA, 12 bp, Homo sapiens
tggacagaagaa

SEQ ID NO: 2100534 - DNA, 12 bp, Homo sapiens
tggacagctgct

SEQ ID NO: 2100535 - DNA, 13 bp, Homo sapiens
tggacagctgctt

SEQ ID NO: 2100536 - DNA, 12 bp, Homo sapiens
tggacaggcatg

SEQ ID NO: 2100537 - DNA, 17 bp, Homo sapiens
tggacaggcatgttctc

SEQ ID NO: 2100538 - DNA, 18 bp, Homo sapiens
tggacaggcatgttctct

SEQ ID NO: 2100539 - DNA, 15 bp, Homo sapiens
tggacagtcctggga

SEQ ID NO: 2100540 - DNA, 16 bp, Homo sapiens
tggacagtcctgggag

SEQ ID NO: 2100541 - DNA, 18 bp, Homo sapiens
tggacatcacagcagaat

SEQ ID NO: 2100542 - DNA, 19 bp, Homo sapiens
tggacatcacagcagaatg

SEQ ID NO: 2100543 - DNA, 16 bp, Homo sapiens
tggacatggtctcctc

SEQ ID NO: 2100544 - DNA, 17 bp, Homo sapiens
tggacatttgccttgct

SEQ ID NO: 2100545 - DNA, 21 bp, Homo sapiens
tggctgagtggaatgcaggga

SEQ ID NO: 2100546 - DNA, 12 bp, Homo sapiens
tggctgcaaagg

SEQ ID NO: 2100547 - DNA, 15 bp, Homo sapiens
tggctgcagagacct

SEQ ID NO: 2100548 - DNA, 13 bp, Homo sapiens
tggctgcagggag

SEQ ID NO: 2100549 - DNA, 19 bp, Homo sapiens
tggctgcataaatgtggta

SEQ ID NO: 2100550 - DNA, 11 bp, Homo sapiens
tggctgccagg

SEQ ID NO: 2100551 - DNA, 18 bp, Homo sapiens
tggctgcgctaaccccca

SEQ ID NO: 2100552 - DNA, 19 bp, Homo sapiens
tggctgcgctaacccccag

SEQ ID NO: 2100553 - DNA, 15 bp, Homo sapiens
tggctgctctcatgc

SEQ ID NO: 2100554 - DNA, 19 bp, Homo sapiens
tggctgctgacaggatgtg

SEQ ID NO: 2100555 - DNA, 14 bp, Homo sapiens
tggctgctgactga

SEQ ID NO: 2100556 - DNA, 22 bp, Homo sapiens
tggctggatgaaattttctaga

SEQ ID NO: 2100557 - DNA, 12 bp, Homo sapiens
tggctggctgag

SEQ ID NO: 2100558 - DNA, 17 bp, Homo sapiens
tggctggctgagggcag

SEQ ID NO: 2100559 - DNA, 20 bp, Homo sapiens
tggctggggcagaggggcag

SEQ ID NO: 2100560 - DNA, 16 bp, Homo sapiens
tggctgggggcctcag

SEQ ID NO: 2100561 - DNA, 21 bp, Homo sapiens
tggctgggggcctcagtgcca

SEQ ID NO: 2100562 - DNA, 21 bp, Homo sapiens
tggctggggtgggggtgggga

SEQ ID NO: 2100563 - DNA, 12 bp, Homo sapiens
tggctgtaaact

SEQ ID NO: 2100564 - DNA, 14 bp, Homo sapiens
tggctgtattcaga

SEQ ID NO: 2100565 - DNA, 18 bp, Homo sapiens
tggctgtatttttagaga

SEQ ID NO: 2100566 - DNA, 12 bp, Homo sapiens
tggctgtctctg

SEQ ID NO: 2100567 - DNA, 22 bp, Homo sapiens
tggctgtctctgtccctcactg

SEQ ID NO: 2100568 - DNA, 17 bp, Homo sapiens
tggctgtgcctctgcct

SEQ ID NO: 2100569 - DNA, 13 bp, Homo sapiens
tggctgtggaggc

SEQ ID NO: 2100570 - DNA, 16 bp, Homo sapiens
tggctgtggaggcctg

SEQ ID NO: 2100571 - DNA, 20 bp, Homo sapiens
tggctgtggaggcctgatgc

SEQ ID NO: 2100572 - DNA, 14 bp, Homo sapiens
tggctgtggcacag

SEQ ID NO: 2100573 - DNA, 23 bp, Homo sapiens
tggctgtggcacagacttctgga

SEQ ID NO: 2100574 - DNA, 22 bp, Homo sapiens
tggctgtggttcctaagcctgt

SEQ ID NO: 2100575 - DNA, 13 bp, Homo sapiens
tggctgttggctg

SEQ ID NO: 2100576 - DNA, 23 bp, Homo sapiens
tggcttaaaaacttccatcccta

SEQ ID NO: 2100577 - DNA, 17 bp, Homo sapiens
tggcttaaaacaacact

SEQ ID NO: 2100578 - DNA, 13 bp, Homo sapiens
tggcttagaaatc

SEQ ID NO: 2100579 - DNA, 22 bp, Homo sapiens
tggcttccagaaaaccccagca

SEQ ID NO: 2100580 - DNA, 14 bp, Homo sapiens
tggcttccaggtat

SEQ ID NO: 2100581 - DNA, 20 bp, Homo sapiens
tggcttccaggtatctccag

SEQ ID NO: 2100582 - DNA, 23 bp, Homo sapiens
tggcttccaggtatctccaggat

SEQ ID NO: 2100583 - DNA, 14 bp, Homo sapiens
tggcttcccatccc

SEQ ID NO: 2100584 - DNA, 15 bp, Homo sapiens
tggcttcccatcccc

SEQ ID NO: 2100585 - DNA, 16 bp, Homo sapiens
tggcttcccgctcagc

SEQ ID NO: 2100586 - DNA, 15 bp, Homo sapiens
tggcttcctccgtcc

SEQ ID NO: 2100587 - DNA, 16 bp, Homo sapiens
tggcttcctccgtcca

SEQ ID NO: 2100588 - DNA, 21 bp, Homo sapiens
tggcttcctccgtccacccag

SEQ ID NO: 2100589 - DNA, 16 bp, Homo sapiens
tggcttcctccgtctg

SEQ ID NO: 2100590 - DNA, 19 bp, Homo sapiens
tggcttctagatctggaac

SEQ ID NO: 2100591 - DNA, 16 bp, Homo sapiens
tggcttctcctgtgac

SEQ ID NO: 2100592 - DNA, 15 bp, Homo sapiens
tggcttctgggagat

SEQ ID NO: 2100593 - DNA, 20 bp, Homo sapiens
tggcttctgttgcgccactg

SEQ ID NO: 2100594 - DNA, 17 bp, Homo sapiens
tggcttgctccagggtc

SEQ ID NO: 2100595 - DNA, 17 bp, Homo sapiens
tggcttgtaactccacc

SEQ ID NO: 2100596 - DNA, 21 bp, Homo sapiens
tggctttaaccgtttttcaag

SEQ ID NO: 2100597 - DNA, 17 bp, Homo sapiens
tggctttaggagcagtg

SEQ ID NO: 2100598 - DNA, 20 bp, Homo sapiens
tggctttaggagcagtggga

SEQ ID NO: 2100599 - DNA, 12 bp, Homo sapiens
tggctttcccgg

SEQ ID NO: 2100600 - DNA, 21 bp, Homo sapiens
tggctttcccggactgcaagc

SEQ ID NO: 2100601 - DNA, 20 bp, Homo sapiens
tggctttctcccactgagtt

SEQ ID NO: 2100602 - DNA, 23 bp, Homo sapiens
tggctttctccgactgctaggga

SEQ ID NO: 2100603 - DNA, 15 bp, Homo sapiens
tggcttttcactgct

SEQ ID NO: 2100604 - DNA, 19 bp, Homo sapiens
tggcttttcactgctggct

SEQ ID NO: 2100605 - DNA, 21 bp, Homo sapiens
tggcttttcactgctggctgc

SEQ ID NO: 2100606 - DNA, 22 bp, Homo sapiens
tggcttttcactgctggctgcc

SEQ ID NO: 2100607 - DNA, 20 bp, Homo sapiens
tggcttttgcggttcaggaa

SEQ ID NO: 2100608 - DNA, 20 bp, Homo sapiens
tgggaaaaaagttttgatga

SEQ ID NO: 2100609 - DNA, 15 bp, Homo sapiens
tgggaaaacagagga

SEQ ID NO: 2100610 - DNA, 14 bp, Homo sapiens
tgggaaacagggag

SEQ ID NO: 2100611 - DNA, 21 bp, Homo sapiens
tgggaaagaaggcaaagtccc

SEQ ID NO: 2100612 - DNA, 14 bp, Homo sapiens
tgggaaagcattgt

SEQ ID NO: 2100613 - DNA, 17 bp, Homo sapiens
tgggaaagcattgtaaa

SEQ ID NO: 2100614 - DNA, 21 bp, Homo sapiens
tgggaaaggaggcatgcctct

SEQ ID NO: 2100615 - DNA, 12 bp, Homo sapiens
tgggaaagtgca

SEQ ID NO: 2100616 - DNA, 14 bp, Homo sapiens
tgggaaccccgcag

SEQ ID NO: 2100617 - DNA, 13 bp, Homo sapiens
tgggaaccctccc

SEQ ID NO: 2100618 - DNA, 16 bp, Homo sapiens
tgggaaccctccccaa

SEQ ID NO: 2100619 - DNA, 14 bp, Homo sapiens
tgggaactggaggg

SEQ ID NO: 2100620 - DNA, 15 bp, Homo sapiens
tgggaagagaaggga

SEQ ID NO: 2100621 - DNA, 16 bp, Homo sapiens
tgggaagagaagggaa

SEQ ID NO: 2100622 - DNA, 11 bp, Homo sapiens
tgggaagccat

SEQ ID NO: 2100623 - DNA, 12 bp, Homo sapiens
tgggaagctggg

SEQ ID NO: 2100624 - DNA, 21 bp, Homo sapiens
tgggaagctgtactcagagca

SEQ ID NO: 2100625 - DNA, 23 bp, Homo sapiens
tgggaagctgtactcagagcaga

SEQ ID NO: 2100626 - DNA, 20 bp, Homo sapiens
tgggaaggggtgccctctgg

SEQ ID NO: 2100627 - DNA, 23 bp, Homo sapiens
tgggaagtcgtccttactcctgt

SEQ ID NO: 2100628 - DNA, 16 bp, Homo sapiens
tgggaagtgaagcccc

SEQ ID NO: 2100629 - DNA, 20 bp, Homo sapiens
tgggaatgttacattgtttg

SEQ ID NO: 2100630 - DNA, 20 bp, Homo sapiens
tgggaattctttacaataaa

SEQ ID NO: 2100631 - DNA, 14 bp, Homo sapiens
tgggaattgcatgc

SEQ ID NO: 2100632 - DNA, 22 bp, Homo sapiens
tgggacagaggagcaaggttta

SEQ ID NO: 2100633 - DNA, 16 bp, Homo sapiens
tgggacagggcatggc

SEQ ID NO: 2100634 - DNA, 13 bp, Homo sapiens
tgggaccaggcac

SEQ ID NO: 2100635 - DNA, 20 bp, Homo sapiens
tgggacccagctactctgtc

SEQ ID NO: 2100636 - DNA, 20 bp, Homo sapiens
tgggacccatagatcttctg

SEQ ID NO: 2100637 - DNA, 14 bp, Homo sapiens
tgggacccctccca

SEQ ID NO: 2100638 - DNA, 20 bp, Homo sapiens
tgggacccctcccaacctca

SEQ ID NO: 2100639 - DNA, 13 bp, Homo sapiens
tgggaccctttcc

SEQ ID NO: 2100640 - DNA, 14 bp, Homo sapiens
tgggaccctttcct

SEQ ID NO: 2100641 - DNA, 18 bp, Homo sapiens
tgggaccctttccttcct

SEQ ID NO: 2100642 - DNA, 21 bp, Homo sapiens
tgggaccgctacaccactctg

SEQ ID NO: 2100643 - DNA, 16 bp, Homo sapiens
tgggactacaggtgtg

SEQ ID NO: 2100644 - DNA, 20 bp, Homo sapiens
tgggactgagcctggcccat

SEQ ID NO: 2100645 - DNA, 23 bp, Homo sapiens
tgggactggccaggtttctgccc

SEQ ID NO: 2100646 - DNA, 23 bp, Homo sapiens
tgggagaacctcaggcttccttg

SEQ ID NO: 2100647 - DNA, 14 bp, Homo sapiens
tgggagaagccgca

SEQ ID NO: 2100648 - DNA, 22 bp, Homo sapiens
tgggagaagccgcagggacaga

SEQ ID NO: 2100649 - DNA, 18 bp, Homo sapiens
tgggagacctgtaatcat

SEQ ID NO: 2100650 - DNA, 22 bp, Homo sapiens
tgggagacgaacggaagggttg

SEQ ID NO: 2100651 - DNA, 21 bp, Homo sapiens
tgggagagagacgtgtacata

SEQ ID NO: 2100652 - DNA, 18 bp, Homo sapiens
tgggagagcccagccatt

SEQ ID NO: 2100653 - DNA, 16 bp, Homo sapiens
tgggagcctaaggaag

SEQ ID NO: 2100654 - DNA, 17 bp, Homo sapiens
tgggagctgcctgttca

SEQ ID NO: 2100655 - DNA, 23 bp, Homo sapiens
tgggagctgcctgttcagctcca

SEQ ID NO: 2100656 - DNA, 24 bp, Homo sapiens
tgggaggaagcaggttgaggggct

SEQ ID NO: 2100657 - DNA, 16 bp, Homo sapiens
tgggaggcatggccct

SEQ ID NO: 2100658 - DNA, 19 bp, Homo sapiens
tgggaggccaaggcaggta

SEQ ID NO: 2100659 - DNA, 14 bp, Homo sapiens
tggtatgctggcca

SEQ ID NO: 2100660 - DNA, 21 bp, Homo sapiens
tggtatgctggccagcaccct

SEQ ID NO: 2100661 - DNA, 12 bp, Homo sapiens
tggtatgtgtgt

SEQ ID NO: 2100662 - DNA, 15 bp, Homo sapiens
tggtatgtgtgtgta

SEQ ID NO: 2100663 - DNA, 17 bp, Homo sapiens
tggtatgtgtgtgtatg

SEQ ID NO: 2100664 - DNA, 19 bp, Homo sapiens
tggtatgtgtgtgtatgct

SEQ ID NO: 2100665 - DNA, 21 bp, Homo sapiens
tggtatgtgtgtgtatgctac

SEQ ID NO: 2100666 - DNA, 20 bp, Homo sapiens
tggtattttcgtgcatttgt

SEQ ID NO: 2100667 - DNA, 17 bp, Homo sapiens
tggtcaaaagctggatt

SEQ ID NO: 2100668 - DNA, 21 bp, Homo sapiens
tggtcaaaccgcactcaccca

SEQ ID NO: 2100669 - DNA, 14 bp, Homo sapiens
tggtcaacacttaa

SEQ ID NO: 2100670 - DNA, 19 bp, Homo sapiens
tggtcaaggcccggcccca

SEQ ID NO: 2100671 - DNA, 22 bp, Homo sapiens
tggtcacaggactctgcctcct

SEQ ID NO: 2100672 - DNA, 14 bp, Homo sapiens
tggtcaccatgaaa

SEQ ID NO: 2100673 - DNA, 16 bp, Homo sapiens
tggtcacccttaatat

SEQ ID NO: 2100674 - DNA, 14 bp, Homo sapiens
tggtcagctcacac

SEQ ID NO: 2100675 - DNA, 15 bp, Homo sapiens
tggtccagctcttgg

SEQ ID NO: 2100676 - DNA, 22 bp, Homo sapiens
tggtccagctcttggcccctgt

SEQ ID NO: 2100677 - DNA, 16 bp, Homo sapiens
tggtcccacatccctg

SEQ ID NO: 2100678 - DNA, 19 bp, Homo sapiens
tggtcccacatccctgggc

SEQ ID NO: 2100679 - DNA, 23 bp, Homo sapiens
tggtcctccatttcaactccaga

SEQ ID NO: 2100680 - DNA, 20 bp, Homo sapiens
tggtcctgagggtccccacc

SEQ ID NO: 2100681 - DNA, 19 bp, Homo sapiens
tggtcctggggctctgtgc

SEQ ID NO: 2100682 - DNA, 20 bp, Homo sapiens
tggtcctgtgtgcagtgaag

SEQ ID NO: 2100683 - DNA, 18 bp, Homo sapiens
tggtctaaaaataaacca

SEQ ID NO: 2100684 - DNA, 23 bp, Homo sapiens
tggtctaggagctgtctccagga

SEQ ID NO: 2100685 - DNA, 23 bp, Homo sapiens
tggtctcaaactcttgacctcag

SEQ ID NO: 2100686 - DNA, 21 bp, Homo sapiens
tggtctcctctgattatcagg

SEQ ID NO: 2100687 - DNA, 21 bp, Homo sapiens
tggtctccttgcactttctca

SEQ ID NO: 2100688 - DNA, 18 bp, Homo sapiens
tggtctcgaactcctgac

SEQ ID NO: 2100689 - DNA, 16 bp, Homo sapiens
tggtctgatttcagga

SEQ ID NO: 2100690 - DNA, 12 bp, Homo sapiens
tggtctgccctg

SEQ ID NO: 2100691 - DNA, 22 bp, Homo sapiens
tggtctgctggtgtcattgctg

SEQ ID NO: 2100692 - DNA, 19 bp, Homo sapiens
tggtcttcaaattgtcttt

SEQ ID NO: 2100693 - DNA, 11 bp, Homo sapiens
tggtcttggaa

SEQ ID NO: 2100694 - DNA, 12 bp, Homo sapiens
tggtctttgaat

SEQ ID NO: 2100695 - DNA, 13 bp, Homo sapiens
tggtctttgaata

SEQ ID NO: 2100696 - DNA, 16 bp, Homo sapiens
tggtctttgaataaag

SEQ ID NO: 2100697 - DNA, 17 bp, Homo sapiens
tggtctttgaataaagt

SEQ ID NO: 2100698 - DNA, 16 bp, Homo sapiens
tggtgacctctgcctg

SEQ ID NO: 2100699 - DNA, 14 bp, Homo sapiens
tggtgactgaacga

SEQ ID NO: 2100700 - DNA, 13 bp, Homo sapiens
tggtgactgtccc

SEQ ID NO: 2100701 - DNA, 12 bp, Homo sapiens
tggtgacttcct

SEQ ID NO: 2100702 - DNA, 23 bp, Homo sapiens
tggtgacttcctcgcctctccca

SEQ ID NO: 2100703 - DNA, 13 bp, Homo sapiens
tggtgagctggga

SEQ ID NO: 2100704 - DNA, 15 bp, Homo sapiens
tggtgagctgggaag

SEQ ID NO: 2100705 - DNA, 12 bp, Homo sapiens
tggtgaggaagc

SEQ ID NO: 2100706 - DNA, 23 bp, Homo sapiens
tggtgaggcccagcctgtcctgg

SEQ ID NO: 2100707 - DNA, 14 bp, Homo sapiens
tggtgcaaatccta

SEQ ID NO: 2100708 - DNA, 18 bp, Homo sapiens
tggtgcagaggtgagcag

SEQ ID NO: 2100709 - DNA, 20 bp, Homo sapiens
tggtgcagaggtgagcagag

SEQ ID NO: 2100710 - DNA, 20 bp, Homo sapiens
tggtgcagaggtttcttgaa

SEQ ID NO: 2100711 - DNA, 13 bp, Homo sapiens
tggtgcctgcctc

SEQ ID NO: 2100712 - DNA, 12 bp, Homo sapiens
tggtgcctggcc

SEQ ID NO: 2100713 - DNA, 13 bp, Homo sapiens
tggtgcctggcct

SEQ ID NO: 2100714 - DNA, 14 bp, Homo sapiens
tggtgcctggcctg

SEQ ID NO: 2100715 - DNA, 23 bp, Homo sapiens
tggtgcctggcctggcacacatc

SEQ ID NO: 2100716 - DNA, 24 bp, Homo sapiens
tggtgcctggcctggcacacatca

SEQ ID NO: 2100717 - DNA, 12 bp, Homo sapiens
tggtgccttcat

SEQ ID NO: 2100718 - DNA, 16 bp, Homo sapiens
tggtgcgatctgggtt

SEQ ID NO: 2100719 - DNA, 17 bp, Homo sapiens
tggtgcgatctgggttc

SEQ ID NO: 2100720 - DNA, 22 bp, Homo sapiens
tggtgctaactgtatgtgtctt

SEQ ID NO: 2100721 - DNA, 22 bp, Homo sapiens
tggtgctataggctggagaagc

SEQ ID NO: 2100722 - DNA, 20 bp, Homo sapiens
tggtgctccccttcctgcca

SEQ ID NO: 2100723 - DNA, 13 bp, Homo sapiens
tggtgctgacctc

SEQ ID NO: 2100724 - DNA, 17 bp, Homo sapiens
tggtgctgtggccaggg

SEQ ID NO: 2100725 - DNA, 13 bp, Homo sapiens
tggtggaggagga

SEQ ID NO: 2100726 - DNA, 16 bp, Homo sapiens
tggtggaggaggagga

SEQ ID NO: 2100727 - DNA, 17 bp, Homo sapiens
tggtggcagctgggcag

SEQ ID NO: 2100728 - DNA, 20 bp, Homo sapiens
tggtggccatgtcgcctgcc

SEQ ID NO: 2100729 - DNA, 16 bp, Homo sapiens
tggtggcgcaagcctg

SEQ ID NO: 2100730 - DNA, 17 bp, Homo sapiens
tggtggctgtctctgtc

SEQ ID NO: 2100731 - DNA, 23 bp, Homo sapiens
tggtggctgtctctgtccctcac

SEQ ID NO: 2100732 - DNA, 21 bp, Homo sapiens
tggtgggaagcgtctgtccgt

SEQ ID NO: 2100733 - DNA, 23 bp, Homo sapiens
tggtgggagacgaacggaagggt

SEQ ID NO: 2100734 - DNA, 16 bp, Homo sapiens
tggtggggagaggcat

SEQ ID NO: 2100735 - DNA, 15 bp, Homo sapiens
tggtggtatctgagt

SEQ ID NO: 2100736 - DNA, 16 bp, Homo sapiens
tggtgtaatgcacaat

SEQ ID NO: 2100737 - DNA, 13 bp, Homo sapiens
tggtgtaatttat

SEQ ID NO: 2100738 - DNA, 23 bp, Homo sapiens
tggtgtatcccccccctgtatag

SEQ ID NO: 2100739 - DNA, 13 bp, Homo sapiens
tggtgtcaggcag

SEQ ID NO: 2100740 - DNA, 13 bp, Homo sapiens
tggtgtccacctg

SEQ ID NO: 2100741 - DNA, 16 bp, Homo sapiens
tggtgttactaaagtc

SEQ ID NO: 2100742 - DNA, 11 bp, Homo sapiens
tggtgttgccc

SEQ ID NO: 2100743 - DNA, 17 bp, Homo sapiens
tggtgttgtatacttca

SEQ ID NO: 2100744 - DNA, 15 bp, Homo sapiens
tggttactctggtgc

SEQ ID NO: 2100745 - DNA, 16 bp, Homo sapiens
tggttcagctaagcta

SEQ ID NO: 2100746 - DNA, 22 bp, Homo sapiens
tggttcagggttggcccctgcc

SEQ ID NO: 2100747 - DNA, 14 bp, Homo sapiens
tggttccaagaaag

SEQ ID NO: 2100748 - DNA, 20 bp, Homo sapiens
tggttccaagaaagatccac

SEQ ID NO: 2100749 - DNA, 15 bp, Homo sapiens
tggttcccaataaaa

SEQ ID NO: 2100750 - DNA, 16 bp, Homo sapiens
tggttcccaataaaag

SEQ ID NO: 2100751 - DNA, 11 bp, Homo sapiens
tggttcccctg

SEQ ID NO: 2100752 - DNA, 23 bp, Homo sapiens
tggttcccctgttcactctactt

SEQ ID NO: 2100753 - DNA, 16 bp, Homo sapiens
tggttcctaagcctgt

SEQ ID NO: 2100754 - DNA, 17 bp, Homo sapiens
tggttcctttctcagcc

SEQ ID NO: 2100755 - DNA, 20 bp, Homo sapiens
tggttctcagatcttgacag

SEQ ID NO: 2100756 - DNA, 22 bp, Homo sapiens
tggttgaggtggaagccctcct

SEQ ID NO: 2100757 - DNA, 18 bp, Homo sapiens
tggttgatgccaaaaaaa

SEQ ID NO: 2100758 - DNA, 17 bp, Homo sapiens
tggttgattcccagcat

SEQ ID NO: 2100759 - DNA, 17 bp, Homo sapiens
tggttgccttaaagaaa

SEQ ID NO: 2100760 - DNA, 18 bp, Homo sapiens
tggttgccttaaagaaag

SEQ ID NO: 2100761 - DNA, 16 bp, Homo sapiens
tggttggagagctaga

SEQ ID NO: 2100762 - DNA, 13 bp, Homo sapiens
tggttggggtggg

SEQ ID NO: 2100763 - DNA, 15 bp, Homo sapiens
tggttggggtggggc

SEQ ID NO: 2100764 - DNA, 18 bp, Homo sapiens
tggttggggtggggcagg

SEQ ID NO: 2100765 - DNA, 22 bp, Homo sapiens
tggttggtaacacaaattttca

SEQ ID NO: 2100766 - DNA, 15 bp, Homo sapiens
tggtttaatttaaag

SEQ ID NO: 2100767 - DNA, 11 bp, Homo sapiens
tggtttacatg

SEQ ID NO: 2100768 - DNA, 17 bp, Homo sapiens
tggtttacatgaacaca

SEQ ID NO: 2100769 - DNA, 14 bp, Homo sapiens
tggtttactgctgt

SEQ ID NO: 2100770 - DNA, 15 bp, Homo sapiens
tggtttactgctgtc

SEQ ID NO: 2100771 - DNA, 11 bp, Homo sapiens
tggtttatgtc

SEQ ID NO: 2100772 - DNA, 13 bp, Homo sapiens
tggtttcccaaga

SEQ ID NO: 2100773 - DNA, 18 bp, Homo sapiens
tggtttcccaagagctac

SEQ ID NO: 2100774 - DNA, 17 bp, Homo sapiens
tgtatgtgcacatgtgt

SEQ ID NO: 2100775 - DNA, 23 bp, Homo sapiens
tgtatgtgcacatgtgtctgtgt

SEQ ID NO: 2100776 - DNA, 14 bp, Homo sapiens
tgtatgttaaagca

SEQ ID NO: 2100777 - DNA, 15 bp, Homo sapiens
tgtatgtttacatat

SEQ ID NO: 2100778 - DNA, 18 bp, Homo sapiens
tgtattaagccaaacatg

SEQ ID NO: 2100779 - DNA, 17 bp, Homo sapiens
tgtattaagggcatttt

SEQ ID NO: 2100780 - DNA, 16 bp, Homo sapiens
tgtattaccattactt

SEQ ID NO: 2100781 - DNA, 21 bp, Homo sapiens
tgtattatcacatcaagcatg

SEQ ID NO: 2100782 - DNA, 23 bp, Homo sapiens
tgtattcccttttatttccaaaa

SEQ ID NO: 2100783 - DNA, 17 bp, Homo sapiens
tgtattctttactaaag

SEQ ID NO: 2100784 - DNA, 22 bp, Homo sapiens
tgtattgaacttggaaagaaat

SEQ ID NO: 2100785 - DNA, 19 bp, Homo sapiens
tgtattgcatatatacata

SEQ ID NO: 2100786 - DNA, 15 bp, Homo sapiens
tgtatttatatgtta

SEQ ID NO: 2100787 - DNA, 20 bp, Homo sapiens
tgtattttaaatgttttaca

SEQ ID NO: 2100788 - DNA, 13 bp, Homo sapiens
tgtattttaaggt

SEQ ID NO: 2100789 - DNA, 16 bp, Homo sapiens
tgtattttagcagaga

SEQ ID NO: 2100790 - DNA, 22 bp, Homo sapiens
tgtattttcatttaactacaaa

SEQ ID NO: 2100791 - DNA, 23 bp, Homo sapiens
tgtatttttagagattaatttgt

SEQ ID NO: 2100792 - DNA, 17 bp, Homo sapiens
tgtatttttgaataaaa

SEQ ID NO: 2100793 - DNA, 17 bp, Homo sapiens
tgtattttttaaagcta

SEQ ID NO: 2100794 - DNA, 21 bp, Homo sapiens
tgtcaaacaaatagtctatca

SEQ ID NO: 2100795 - DNA, 15 bp, Homo sapiens
tgtcaaatcatggcc

SEQ ID NO: 2100796 - DNA, 15 bp, Homo sapiens
tgtcaagagagagtc

SEQ ID NO: 2100797 - DNA, 15 bp, Homo sapiens
tgtcaagtacaagca

SEQ ID NO: 2100798 - DNA, 17 bp, Homo sapiens
tgtcaagtataaagtca

SEQ ID NO: 2100799 - DNA, 20 bp, Homo sapiens
tgtcaagtataaagtcagga

SEQ ID NO: 2100800 - DNA, 17 bp, Homo sapiens
tgtcaatacccctgtta

SEQ ID NO: 2100801 - DNA, 13 bp, Homo sapiens
tgtcaatattaaa

SEQ ID NO: 2100802 - DNA, 19 bp, Homo sapiens
tgtcaatttccctgactcc

SEQ ID NO: 2100803 - DNA, 23 bp, Homo sapiens
tgtcaatttccctgactcctcta

SEQ ID NO: 2100804 - DNA, 16 bp, Homo sapiens
tgtcaatttgtatatc

SEQ ID NO: 2100805 - DNA, 18 bp, Homo sapiens
tgtcaatttgtatatcat

SEQ ID NO: 2100806 - DNA, 17 bp, Homo sapiens
tgtcacacactttggct

SEQ ID NO: 2100807 - DNA, 16 bp, Homo sapiens
tgtcacacttgtttct

SEQ ID NO: 2100808 - DNA, 14 bp, Homo sapiens
tgtcacaggcaggt

SEQ ID NO: 2100809 - DNA, 15 bp, Homo sapiens
tgtcacaggcaggtc

SEQ ID NO: 2100810 - DNA, 17 bp, Homo sapiens
tgtcacaggcaggtcca

SEQ ID NO: 2100811 - DNA, 21 bp, Homo sapiens
tgtcacaggcaggtccagggt

SEQ ID NO: 2100812 - DNA, 18 bp, Homo sapiens
tgtcaccaccttcccagc

SEQ ID NO: 2100813 - DNA, 17 bp, Homo sapiens
tgtcaccagctgccaaa

SEQ ID NO: 2100814 - DNA, 22 bp, Homo sapiens
tgtcaccctccacctcttcacc

SEQ ID NO: 2100815 - DNA, 16 bp, Homo sapiens
tgtcaccgtgagcagc

SEQ ID NO: 2100816 - DNA, 22 bp, Homo sapiens
tgtcaccgtgagcagctttgga

SEQ ID NO: 2100817 - DNA, 19 bp, Homo sapiens
tgtcaccgtggaccttcct

SEQ ID NO: 2100818 - DNA, 21 bp, Homo sapiens
tgtcaccgtggaccttcctgc

SEQ ID NO: 2100819 - DNA, 19 bp, Homo sapiens
tgtcacctcagctgatatt

SEQ ID NO: 2100820 - DNA, 13 bp, Homo sapiens
tgtcacctgaaga

SEQ ID NO: 2100821 - DNA, 21 bp, Homo sapiens
tgtcactgtcttcacaacctc

SEQ ID NO: 2100822 - DNA, 16 bp, Homo sapiens
tgtcagaaaccagtta

SEQ ID NO: 2100823 - DNA, 16 bp, Homo sapiens
tgtcagacatgaaaac

SEQ ID NO: 2100824 - DNA, 20 bp, Homo sapiens
tgtcagacctatttgacata

SEQ ID NO: 2100825 - DNA, 14 bp, Homo sapiens
tgtcagactttaaa

SEQ ID NO: 2100826 - DNA, 18 bp, Homo sapiens
tgtcagagatctgggagg

SEQ ID NO: 2100827 - DNA, 17 bp, Homo sapiens
tgtcagagccaggctct

SEQ ID NO: 2100828 - DNA, 18 bp, Homo sapiens
tgtcagagccaggctctg

SEQ ID NO: 2100829 - DNA, 19 bp, Homo sapiens
tgtcagagccaggctctgc

SEQ ID NO: 2100830 - DNA, 11 bp, Homo sapiens
tgtcagagcta

SEQ ID NO: 2100831 - DNA, 15 bp, Homo sapiens
tgtcagatatgatat

SEQ ID NO: 2100832 - DNA, 21 bp, Homo sapiens
tgtcagatattttttcagaaa

SEQ ID NO: 2100833 - DNA, 13 bp, Homo sapiens
tgtcagccagccg

SEQ ID NO: 2100834 - DNA, 18 bp, Homo sapiens
tgtcagccagccgccctg

SEQ ID NO: 2100835 - DNA, 21 bp, Homo sapiens
tgtcagccgagccgggcctgg

SEQ ID NO: 2100836 - DNA, 23 bp, Homo sapiens
tgtcagccgagccgggcctgggg

SEQ ID NO: 2100837 - DNA, 13 bp, Homo sapiens
tgtcagccttgca

SEQ ID NO: 2100838 - DNA, 13 bp, Homo sapiens
tgtcagcgtttct

SEQ ID NO: 2100839 - DNA, 20 bp, Homo sapiens
tgtcagctcccctcggagaa

SEQ ID NO: 2100840 - DNA, 21 bp, Homo sapiens
tgtcagctcccctcggagaag

SEQ ID NO: 2100841 - DNA, 23 bp, Homo sapiens
tgtcagctcccctcggagaagag

SEQ ID NO: 2100842 - DNA, 12 bp, Homo sapiens
tgtcaggcaggt

SEQ ID NO: 2100843 - DNA, 14 bp, Homo sapiens
tgtcataagaatga

SEQ ID NO: 2100844 - DNA, 15 bp, Homo sapiens
tgtcataagaatgaa

SEQ ID NO: 2100845 - DNA, 15 bp, Homo sapiens
tgtcatatattcatg

SEQ ID NO: 2100846 - DNA, 15 bp, Homo sapiens
tgtcatcactccctg

SEQ ID NO: 2100847 - DNA, 20 bp, Homo sapiens
tgtcatcactccctggatgt

SEQ ID NO: 2100848 - DNA, 19 bp, Homo sapiens
tgtcatcattgtatatatg

SEQ ID NO: 2100849 - DNA, 14 bp, Homo sapiens
tgtcatccagaaaa

SEQ ID NO: 2100850 - DNA, 16 bp, Homo sapiens
tgtcatctctctgggg

SEQ ID NO: 2100851 - DNA, 23 bp, Homo sapiens
tgtcatctctctggggccctggg

SEQ ID NO: 2100852 - DNA, 16 bp, Homo sapiens
tgtcatgaattcttat

SEQ ID NO: 2100853 - DNA, 19 bp, Homo sapiens
tgtcatgaattcttatgct

SEQ ID NO: 2100854 - DNA, 15 bp, Homo sapiens
tgtcatggaaaagcc

SEQ ID NO: 2100855 - DNA, 18 bp, Homo sapiens
tgtcatggaaaagcccag

SEQ ID NO: 2100856 - DNA, 19 bp, Homo sapiens
tgtcatgtacttcctgtgt

SEQ ID NO: 2100857 - DNA, 13 bp, Homo sapiens
tgtcattaaaata

SEQ ID NO: 2100858 - DNA, 15 bp, Homo sapiens
tgtcattaatgtgtt

SEQ ID NO: 2100859 - DNA, 20 bp, Homo sapiens
tgtcattactgcctttggaa

SEQ ID NO: 2100860 - DNA, 12 bp, Homo sapiens
tgtcattatgta

SEQ ID NO: 2100861 - DNA, 14 bp, Homo sapiens
tgtcattgtccatg

SEQ ID NO: 2100862 - DNA, 20 bp, Homo sapiens
tgtcattgtccatgcctaca

SEQ ID NO: 2100863 - DNA, 21 bp, Homo sapiens
tgtcatttgagcagggctcag

SEQ ID NO: 2100864 - DNA, 14 bp, Homo sapiens
tgtccaaggaaact

SEQ ID NO: 2100865 - DNA, 20 bp, Homo sapiens
tgtccaatggctgtaaacta

SEQ ID NO: 2100866 - DNA, 15 bp, Homo sapiens
tgtccaattatgcac

SEQ ID NO: 2100867 - DNA, 19 bp, Homo sapiens
tgtccaattatgcactggc

SEQ ID NO: 2100868 - DNA, 15 bp, Homo sapiens
tgtccacagtctccc

SEQ ID NO: 2100869 - DNA, 20 bp, Homo sapiens
tgtccacagtctcccattct

SEQ ID NO: 2100870 - DNA, 13 bp, Homo sapiens
tgtccacctggcc

SEQ ID NO: 2100871 - DNA, 21 bp, Homo sapiens
tgtccactctcggggcccttg

SEQ ID NO: 2100872 - DNA, 21 bp, Homo sapiens
tgtccagacagagccctgtga

SEQ ID NO: 2100873 - DNA, 21 bp, Homo sapiens
tgtccagaccattgtcttcca

SEQ ID NO: 2100874 - DNA, 19 bp, Homo sapiens
tgtccagctagccaactcc

SEQ ID NO: 2100875 - DNA, 21 bp, Homo sapiens
tgtccaggcactgctgcccag

SEQ ID NO: 2100876 - DNA, 19 bp, Homo sapiens
tgtccaggccactgtggcc

SEQ ID NO: 2100877 - DNA, 21 bp, Homo sapiens
tgtccaggccactgtggccag

SEQ ID NO: 2100878 - DNA, 13 bp, Homo sapiens
tgtccagtttcca

SEQ ID NO: 2100879 - DNA, 13 bp, Homo sapiens
tgtccataaagta

SEQ ID NO: 2100880 - DNA, 20 bp, Homo sapiens
tgtccatatcagacctctga

SEQ ID NO: 2100881 - DNA, 16 bp, Homo sapiens
tgtccatattttcaca

SEQ ID NO: 2100882 - DNA, 21 bp, Homo sapiens
tgtccatgcctacagataatt

SEQ ID NO: 2100883 - DNA, 20 bp, Homo sapiens
tgtccatgtggttcttcaaa

SEQ ID NO: 2100884 - DNA, 13 bp, Homo sapiens
tgtcccaccaact

SEQ ID NO: 2100885 - DNA, 23 bp, Homo sapiens
tgtcccaccaactctgcactcca

SEQ ID NO: 2100886 - DNA, 16 bp, Homo sapiens
tgtcccaccgggagcc

SEQ ID NO: 2100887 - DNA, 18 bp, Homo sapiens
tgtcccaccgggagcctc

SEQ ID NO: 2100888 - DNA, 13 bp, Homo sapiens
tgtgctgtgggca

SEQ ID NO: 2100889 - DNA, 15 bp, Homo sapiens
tgtgctgtgggcagc

SEQ ID NO: 2100890 - DNA, 16 bp, Homo sapiens
tgtgctgtgggcagca

SEQ ID NO: 2100891 - DNA, 17 bp, Homo sapiens
tgtgctgtgggcagcac

SEQ ID NO: 2100892 - DNA, 22 bp, Homo sapiens
tgtgctgtgggcagcaccctcc

SEQ ID NO: 2100893 - DNA, 17 bp, Homo sapiens
tgtgctgtgtctgcacc

SEQ ID NO: 2100894 - DNA, 14 bp, Homo sapiens
tgtgcttacagtga

SEQ ID NO: 2100895 - DNA, 17 bp, Homo sapiens
tgtgcttacagtgactg

SEQ ID NO: 2100896 - DNA, 12 bp, Homo sapiens
tgtggaaagcct

SEQ ID NO: 2100897 - DNA, 14 bp, Homo sapiens
tgtggaaagcctct

SEQ ID NO: 2100898 - DNA, 19 bp, Homo sapiens
tgtggaaggcagggacaga

SEQ ID NO: 2100899 - DNA, 13 bp, Homo sapiens
tgtggacacagct

SEQ ID NO: 2100900 - DNA, 14 bp, Homo sapiens
tgtggacacagctc

SEQ ID NO: 2100901 - DNA, 18 bp, Homo sapiens
tgtggacacagctcttct

SEQ ID NO: 2100902 - DNA, 19 bp, Homo sapiens
tgtggacacagctcttctc

SEQ ID NO: 2100903 - DNA, 14 bp, Homo sapiens
tgtggacaggacta

SEQ ID NO: 2100904 - DNA, 23 bp, Homo sapiens
tgtggagaaataaaaatacctct

SEQ ID NO: 2100905 - DNA, 21 bp, Homo sapiens
tgtggagaggggtgcacccac

SEQ ID NO: 2100906 - DNA, 21 bp, Homo sapiens
tgtggagagtgagaataattg

SEQ ID NO: 2100907 - DNA, 19 bp, Homo sapiens
tgtggagtggacattcaaa

SEQ ID NO: 2100908 - DNA, 16 bp, Homo sapiens
tgtggatgctccaggg

SEQ ID NO: 2100909 - DNA, 19 bp, Homo sapiens
tgtggatgctccagggcag

SEQ ID NO: 2100910 - DNA, 23 bp, Homo sapiens
tgtggatgtgtaaatggagcttg

SEQ ID NO: 2100911 - DNA, 18 bp, Homo sapiens
tgtggattccagcatttg

SEQ ID NO: 2100912 - DNA, 18 bp, Homo sapiens
tgtggatttcctatttta

SEQ ID NO: 2100913 - DNA, 22 bp, Homo sapiens
tgtggattttttccttcaaagt

SEQ ID NO: 2100914 - DNA, 15 bp, Homo sapiens
tgtggcaaagtgctg

SEQ ID NO: 2100915 - DNA, 14 bp, Homo sapiens
tgtggcaagtgaat

SEQ ID NO: 2100916 - DNA, 15 bp, Homo sapiens
tgtggcaagtgaatt

SEQ ID NO: 2100917 - DNA, 22 bp, Homo sapiens
tgtggcacagacttctggaagg

SEQ ID NO: 2100918 - DNA, 19 bp, Homo sapiens
tgtggcactgcttgaggag

SEQ ID NO: 2100919 - DNA, 13 bp, Homo sapiens
tgtggcaggccta

SEQ ID NO: 2100920 - DNA, 22 bp, Homo sapiens
tgtggccagagctggaaggcag

SEQ ID NO: 2100921 - DNA, 13 bp, Homo sapiens
tgtggccccagcc

SEQ ID NO: 2100922 - DNA, 16 bp, Homo sapiens
tgtggccccaggtgcc

SEQ ID NO: 2100923 - DNA, 21 bp, Homo sapiens
tgtggcctcacttccctggga

SEQ ID NO: 2100924 - DNA, 23 bp, Homo sapiens
tgtggcctcacttccctgggaac

SEQ ID NO: 2100925 - DNA, 24 bp, Homo sapiens
tgtggcctcacttccctgggaact

SEQ ID NO: 2100926 - DNA, 18 bp, Homo sapiens
tgtggcctcagccctcag

SEQ ID NO: 2100927 - DNA, 15 bp, Homo sapiens
tgtggcctgtgtcca

SEQ ID NO: 2100928 - DNA, 23 bp, Homo sapiens
tgtggcgttctgctgcccctgca

SEQ ID NO: 2100929 - DNA, 10 bp, Homo sapiens
tgtggctcac

SEQ ID NO: 2100930 - DNA, 11 bp, Homo sapiens
tgtggctcctg

SEQ ID NO: 2100931 - DNA, 21 bp, Homo sapiens
tgtggctcctgggggttcttt

SEQ ID NO: 2100932 - DNA, 14 bp, Homo sapiens
tgtggctgtattca

SEQ ID NO: 2100933 - DNA, 17 bp, Homo sapiens
tgtggctgtattcagat

SEQ ID NO: 2100934 - DNA, 11 bp, Homo sapiens
tgtgggaagag

SEQ ID NO: 2100935 - DNA, 21 bp, Homo sapiens
tgtgggagggagcagacagga

SEQ ID NO: 2100936 - DNA, 13 bp, Homo sapiens
tgtgggagtagaa

SEQ ID NO: 2100937 - DNA, 18 bp, Homo sapiens
tgtgggagtgcagagaaa

SEQ ID NO: 2100938 - DNA, 15 bp, Homo sapiens
tgtgggcagcaccct

SEQ ID NO: 2100939 - DNA, 22 bp, Homo sapiens
tgtgggctagttgggcttcctc

SEQ ID NO: 2100940 - DNA, 23 bp, Homo sapiens
tgtggggaaccaattgctttgtc

SEQ ID NO: 2100941 - DNA, 12 bp, Homo sapiens
tgtggggccttg

SEQ ID NO: 2100942 - DNA, 18 bp, Homo sapiens
tgtgggggaggtccctgc

SEQ ID NO: 2100943 - DNA, 21 bp, Homo sapiens
tgtgggggtggccatccctgg

SEQ ID NO: 2100944 - DNA, 15 bp, Homo sapiens
tgtgggtacatgtga

SEQ ID NO: 2100945 - DNA, 20 bp, Homo sapiens
tgtgggtgatcagaaggctg

SEQ ID NO: 2100946 - DNA, 21 bp, Homo sapiens
tgtggtacaagcattctgtct

SEQ ID NO: 2100947 - DNA, 16 bp, Homo sapiens
tgtggtgagggaagac

SEQ ID NO: 2100948 - DNA, 14 bp, Homo sapiens
tgtggtggggagag

SEQ ID NO: 2100949 - DNA, 13 bp, Homo sapiens
tgtggtgtaattt

SEQ ID NO: 2100950 - DNA, 15 bp, Homo sapiens
tgtggtgtgtgtgct

SEQ ID NO: 2100951 - DNA, 14 bp, Homo sapiens
tgtggttaatgcca

SEQ ID NO: 2100952 - DNA, 18 bp, Homo sapiens
tgtggtttactagcagga

SEQ ID NO: 2100953 - DNA, 20 bp, Homo sapiens
tgtgtaaatggagcttgtac

SEQ ID NO: 2100954 - DNA, 21 bp, Homo sapiens
tgtgtaacaattttaatgcta

SEQ ID NO: 2100955 - DNA, 13 bp, Homo sapiens
tgtgtacccactc

SEQ ID NO: 2100956 - DNA, 16 bp, Homo sapiens
tgtgtagcctgtgcat

SEQ ID NO: 2100957 - DNA, 17 bp, Homo sapiens
tgtgtagctctgtccac

SEQ ID NO: 2100958 - DNA, 22 bp, Homo sapiens
tgtgtagctgtgacctgctgag

SEQ ID NO: 2100959 - DNA, 20 bp, Homo sapiens
tgtgtagggcttttttttga

SEQ ID NO: 2100960 - DNA, 21 bp, Homo sapiens
tgtgtaggtattaaagatgtg

SEQ ID NO: 2100961 - DNA, 14 bp, Homo sapiens
tgtgtatatataca

SEQ ID NO: 2100962 - DNA, 21 bp, Homo sapiens
tgtgtatatatatatatatgt

SEQ ID NO: 2100963 - DNA, 18 bp, Homo sapiens
tgtgtatatatgtgtata

SEQ ID NO: 2100964 - DNA, 16 bp, Homo sapiens
tgtgtatgtatacaca

SEQ ID NO: 2100965 - DNA, 18 bp, Homo sapiens
tgtgtatgtatacacaca

SEQ ID NO: 2100966 - DNA, 14 bp, Homo sapiens
tgtgtattctggct

SEQ ID NO: 2100967 - DNA, 19 bp, Homo sapiens
tgtgtatttgtatgtactg

SEQ ID NO: 2100968 - DNA, 14 bp, Homo sapiens
tgtgtcacagctct

SEQ ID NO: 2100969 - DNA, 15 bp, Homo sapiens
tgtgtcacagctctg

SEQ ID NO: 2100970 - DNA, 17 bp, Homo sapiens
tgtgtcacagctctgta

SEQ ID NO: 2100971 - DNA, 16 bp, Homo sapiens
tgtgtcagagacagac

SEQ ID NO: 2100972 - DNA, 14 bp, Homo sapiens
tgtgtcagcatgca

SEQ ID NO: 2100973 - DNA, 19 bp, Homo sapiens
tgtgtcaggtggggcagct

SEQ ID NO: 2100974 - DNA, 14 bp, Homo sapiens
tgtgtccagcagct

SEQ ID NO: 2100975 - DNA, 13 bp, Homo sapiens
tgtgtcccctcac

SEQ ID NO: 2100976 - DNA, 15 bp, Homo sapiens
tgtgtcccctcactc

SEQ ID NO: 2100977 - DNA, 17 bp, Homo sapiens
tgtgtcccctcactctg

SEQ ID NO: 2100978 - DNA, 21 bp, Homo sapiens
tgtgtcctctcccctctgccc

SEQ ID NO: 2100979 - DNA, 18 bp, Homo sapiens
tgtgtccttggggcacag

SEQ ID NO: 2100980 - DNA, 16 bp, Homo sapiens
tgtgtctcgtctcctg

SEQ ID NO: 2100981 - DNA, 19 bp, Homo sapiens
tgtgtctgcgtctgtgttg

SEQ ID NO: 2100982 - DNA, 13 bp, Homo sapiens
tgtgtctgtacac

SEQ ID NO: 2100983 - DNA, 21 bp, Homo sapiens
tgtgtctgtacacgtgtcctg

SEQ ID NO: 2100984 - DNA, 22 bp, Homo sapiens
tgtgtgaaaggaagctccactg

SEQ ID NO: 2100985 - DNA, 12 bp, Homo sapiens
tgtgtgaagaaa

SEQ ID NO: 2100986 - DNA, 14 bp, Homo sapiens
tgtgtgaagaaatg

SEQ ID NO: 2100987 - DNA, 18 bp, Homo sapiens
tgtgtgaattctgcaact

SEQ ID NO: 2100988 - DNA, 17 bp, Homo sapiens
tgtgtgagcaagcattt

SEQ ID NO: 2100989 - DNA, 13 bp, Homo sapiens
tgtgtgagttgag

SEQ ID NO: 2100990 - DNA, 17 bp, Homo sapiens
tgtgtgcaccttaccaa

SEQ ID NO: 2100991 - DNA, 23 bp, Homo sapiens
tgtgtgcaccttaccaactttct

SEQ ID NO: 2100992 - DNA, 12 bp, Homo sapiens
tgtgtgcatgtg

SEQ ID NO: 2100993 - DNA, 13 bp, Homo sapiens
tgtgtgcctgtgg

SEQ ID NO: 2100994 - DNA, 16 bp, Homo sapiens
tgtgtgcctgtggcag

SEQ ID NO: 2100995 - DNA, 14 bp, Homo sapiens
tgtgtgcgcgtgca

SEQ ID NO: 2100996 - DNA, 14 bp, Homo sapiens
tgtgtggacaggac

SEQ ID NO: 2100997 - DNA, 22 bp, Homo sapiens
tgtgtggagctcgctaaagtca

SEQ ID NO: 2100998 - DNA, 15 bp, Homo sapiens
tgtgtggatgtgtaa

SEQ ID NO: 2100999 - DNA, 20 bp, Homo sapiens
tgtgtgggtctggggaggga

SEQ ID NO: 2101000 - DNA, 18 bp, Homo sapiens
tgtgtgtatgtatacaca

SEQ ID NO: 2101001 - DNA, 13 bp, Homo sapiens
tgtgtgtgcatgt

SEQ ID NO: 2101002 - DNA, 9 bp, Homo sapiens
tgtgtgtgt

SEQ ID NO: 2101003 - DNA, 17 bp, Homo sapiens
tgttgtaaagagtggag

SEQ ID NO: 2101004 - DNA, 13 bp, Homo sapiens
tgttgtaaattag

SEQ ID NO: 2101005 - DNA, 18 bp, Homo sapiens
tgttgtaataaaacttat

SEQ ID NO: 2101006 - DNA, 15 bp, Homo sapiens
tgttgtaatagtcca

SEQ ID NO: 2101007 - DNA, 13 bp, Homo sapiens
tgttgtacaagct

SEQ ID NO: 2101008 - DNA, 17 bp, Homo sapiens
tgttgtatacttcatta

SEQ ID NO: 2101009 - DNA, 14 bp, Homo sapiens
tgttgtcaagtata

SEQ ID NO: 2101010 - DNA, 13 bp, Homo sapiens
tgttgtgaatgtc

SEQ ID NO: 2101011 - DNA, 13 bp, Homo sapiens
tgttgtgattttg

SEQ ID NO: 2101012 - DNA, 20 bp, Homo sapiens
tgttgtgattttgtacagaa

SEQ ID NO: 2101013 - DNA, 21 bp, Homo sapiens
tgttgttaatgaaaatgtcag

SEQ ID NO: 2101014 - DNA, 15 bp, Homo sapiens
tgttgttcccacaca

SEQ ID NO: 2101015 - DNA, 14 bp, Homo sapiens
tgttgttccttttg

SEQ ID NO: 2101016 - DNA, 15 bp, Homo sapiens
tgttgtttcttaaat

SEQ ID NO: 2101017 - DNA, 18 bp, Homo sapiens
tgttgtttttaagtcctg

SEQ ID NO: 2101018 - DNA, 18 bp, Homo sapiens
tgtttaaaaacaggaaaa

SEQ ID NO: 2101019 - DNA, 13 bp, Homo sapiens
tgtttaaaatcat

SEQ ID NO: 2101020 - DNA, 14 bp, Homo sapiens
tgtttaaaatcatt

SEQ ID NO: 2101021 - DNA, 17 bp, Homo sapiens
tgtttaaaatcatttct

SEQ ID NO: 2101022 - DNA, 14 bp, Homo sapiens
tgtttaaattgtaa

SEQ ID NO: 2101023 - DNA, 13 bp, Homo sapiens
tgtttacaaaagg

SEQ ID NO: 2101024 - DNA, 21 bp, Homo sapiens
tgtttacaaaaggcagccctt

SEQ ID NO: 2101025 - DNA, 16 bp, Homo sapiens
tgtttacactctttgt

SEQ ID NO: 2101026 - DNA, 14 bp, Homo sapiens
tgtttacagaactg

SEQ ID NO: 2101027 - DNA, 22 bp, Homo sapiens
tgtttactttatccaatcctca

SEQ ID NO: 2101028 - DNA, 22 bp, Homo sapiens
tgtttagaacactggtttaaag

SEQ ID NO: 2101029 - DNA, 23 bp, Homo sapiens
tgtttagaagtacgtttttgcat

SEQ ID NO: 2101030 - DNA, 17 bp, Homo sapiens
tgtttagattccaggat

SEQ ID NO: 2101031 - DNA, 14 bp, Homo sapiens
tgtttagttgcaga

SEQ ID NO: 2101032 - DNA, 18 bp, Homo sapiens
tgtttatataattttgca

SEQ ID NO: 2101033 - DNA, 20 bp, Homo sapiens
tgtttatgtaggtacttcac

SEQ ID NO: 2101034 - DNA, 16 bp, Homo sapiens
tgtttattaacaaatt

SEQ ID NO: 2101035 - DNA, 18 bp, Homo sapiens
tgtttattcctgataata

SEQ ID NO: 2101036 - DNA, 13 bp, Homo sapiens
tgtttattccttg

SEQ ID NO: 2101037 - DNA, 15 bp, Homo sapiens
tgtttatttatcagt

SEQ ID NO: 2101038 - DNA, 20 bp, Homo sapiens
tgtttatttattcactgtaa

SEQ ID NO: 2101039 - DNA, 19 bp, Homo sapiens
tgtttatttttcatattgt

SEQ ID NO: 2101040 - DNA, 18 bp, Homo sapiens
tgtttcacgaagtttgtt

SEQ ID NO: 2101041 - DNA, 21 bp, Homo sapiens
tgtttcatgttttgtgactat

SEQ ID NO: 2101042 - DNA, 18 bp, Homo sapiens
tgtttccaacctggagta

SEQ ID NO: 2101043 - DNA, 19 bp, Homo sapiens
tgtttccagaaaatataaa

SEQ ID NO: 2101044 - DNA, 21 bp, Homo sapiens
tgtttccagaaaatataaatg

SEQ ID NO: 2101045 - DNA, 14 bp, Homo sapiens
tgtttcccataatt

SEQ ID NO: 2101046 - DNA, 11 bp, Homo sapiens
tgtttcctttt

SEQ ID NO: 2101047 - DNA, 20 bp, Homo sapiens
tgtttctaaaggtagatcat

SEQ ID NO: 2101048 - DNA, 17 bp, Homo sapiens
tgtttctgagaaaagaa

SEQ ID NO: 2101049 - DNA, 22 bp, Homo sapiens
tgtttctgcagtagtctctgtg

SEQ ID NO: 2101050 - DNA, 14 bp, Homo sapiens
tgtttcttgcctca

SEQ ID NO: 2101051 - DNA, 18 bp, Homo sapiens
tgtttgaactgccaagaa

SEQ ID NO: 2101052 - DNA, 19 bp, Homo sapiens
tgtttgaactgccaagaaa

SEQ ID NO: 2101053 - DNA, 18 bp, Homo sapiens
tgtttgagatgtgatgct

SEQ ID NO: 2101054 - DNA, 13 bp, Homo sapiens
tgtttgagctcag

SEQ ID NO: 2101055 - DNA, 14 bp, Homo sapiens
tgtttgagctcaga

SEQ ID NO: 2101056 - DNA, 13 bp, Homo sapiens
tgtttgatagatt

SEQ ID NO: 2101057 - DNA, 22 bp, Homo sapiens
tgtttgcacctttctagttgaa

SEQ ID NO: 2101058 - DNA, 23 bp, Homo sapiens
tgtttgcacctttctagttgaaa

SEQ ID NO: 2101059 - DNA, 16 bp, Homo sapiens
tgtttgggcagaaggg

SEQ ID NO: 2101060 - DNA, 15 bp, Homo sapiens
tgtttggggatgaga

SEQ ID NO: 2101061 - DNA, 15 bp, Homo sapiens
tgtttggtcactgct

SEQ ID NO: 2101062 - DNA, 22 bp, Homo sapiens
tgtttggttgtaaatgctcgtg

SEQ ID NO: 2101063 - DNA, 17 bp, Homo sapiens
tgtttgtaagtgaagtg

SEQ ID NO: 2101064 - DNA, 17 bp, Homo sapiens
tgtttgtctgtcttcat

SEQ ID NO: 2101065 - DNA, 22 bp, Homo sapiens
tgttttaaatacgcactacatg

SEQ ID NO: 2101066 - DNA, 16 bp, Homo sapiens
tgttttaagaggcagg

SEQ ID NO: 2101067 - DNA, 17 bp, Homo sapiens
tgttttaagaggcaggg

SEQ ID NO: 2101068 - DNA, 20 bp, Homo sapiens
tgttttaagaggcagggtct

SEQ ID NO: 2101069 - DNA, 23 bp, Homo sapiens
tgttttacaaatttttcctgcaa

SEQ ID NO: 2101070 - DNA, 20 bp, Homo sapiens
tgttttacaagaattgtcca

SEQ ID NO: 2101071 - DNA, 23 bp, Homo sapiens
tgttttatcatgacatgttatat

SEQ ID NO: 2101072 - DNA, 15 bp, Homo sapiens
tgttttcagactcag

SEQ ID NO: 2101073 - DNA, 19 bp, Homo sapiens
tgttttcattatctcaaaa

SEQ ID NO: 2101074 - DNA, 22 bp, Homo sapiens
tgttttcccgagcaaagtctaa

SEQ ID NO: 2101075 - DNA, 20 bp, Homo sapiens
tgttttctcagaacagctga

SEQ ID NO: 2101076 - DNA, 20 bp, Homo sapiens
tgttttctgatgacataata

SEQ ID NO: 2101077 - DNA, 11 bp, Homo sapiens
tgttttcttct

SEQ ID NO: 2101078 - DNA, 17 bp, Homo sapiens
tgttttgacggatgatt

SEQ ID NO: 2101079 - DNA, 20 bp, Homo sapiens
tgttttgcacgtcttgctat

SEQ ID NO: 2101080 - DNA, 14 bp, Homo sapiens
tgttttgcactgac

SEQ ID NO: 2101081 - DNA, 13 bp, Homo sapiens
tgttttgtacaat

SEQ ID NO: 2101082 - DNA, 17 bp, Homo sapiens
tgttttgtacaattact

SEQ ID NO: 2101083 - DNA, 22 bp, Homo sapiens
tgttttgtacaattactaaatt

SEQ ID NO: 2101084 - DNA, 20 bp, Homo sapiens
tgttttgtcctttgagaaag

SEQ ID NO: 2101085 - DNA, 17 bp, Homo sapiens
tgttttgtcttacaaag

SEQ ID NO: 2101086 - DNA, 20 bp, Homo sapiens
tgtttttaaaaatcataaac

SEQ ID NO: 2101087 - DNA, 17 bp, Homo sapiens
tgtttttaagctgtttc

SEQ ID NO: 2101088 - DNA, 20 bp, Homo sapiens
tgtttttaagctgtttccat

SEQ ID NO: 2101089 - DNA, 22 bp, Homo sapiens
tgtttttaagctgtttccatag

SEQ ID NO: 2101090 - DNA, 20 bp, Homo sapiens
tgtttttaatgctttgatat

SEQ ID NO: 2101091 - DNA, 14 bp, Homo sapiens
tgtttttcatgaaa

SEQ ID NO: 2101092 - DNA, 12 bp, Homo sapiens
tgtttttctggg

SEQ ID NO: 2101093 - DNA, 14 bp, Homo sapiens
tgtttttgaagaag

SEQ ID NO: 2101094 - DNA, 12 bp, Homo sapiens
tgttttttctaa

SEQ ID NO: 2101095 - DNA, 12 bp, Homo sapiens
ttaaaaaaatca

SEQ ID NO: 2101096 - DNA, 11 bp, Homo sapiens
ttaaaaaacaa

SEQ ID NO: 2101097 - DNA, 13 bp, Homo sapiens
ttaaaaaacttgt

SEQ ID NO: 2101098 - DNA, 12 bp, Homo sapiens
ttaaaaaataaa

SEQ ID NO: 2101099 - DNA, 20 bp, Homo sapiens
ttaaaaaataaaaaaataca

SEQ ID NO: 2101100 - DNA, 16 bp, Homo sapiens
ttaaaaaataaatata

SEQ ID NO: 2101101 - DNA, 18 bp, Homo sapiens
ttaaaaaataaatataat

SEQ ID NO: 2101102 - DNA, 12 bp, Homo sapiens
ttaaaaaatgtc

SEQ ID NO: 2101103 - DNA, 14 bp, Homo sapiens
ttaaaaacaggaaa

SEQ ID NO: 2101104 - DNA, 17 bp, Homo sapiens
ttaaaaacatgagaaat

SEQ ID NO: 2101105 - DNA, 19 bp, Homo sapiens
ttaaaaacatgagaaatgt

SEQ ID NO: 2101106 - DNA, 14 bp, Homo sapiens
ttaaaaactgagtg

SEQ ID NO: 2101107 - DNA, 20 bp, Homo sapiens
ttaaaaatatggaacttcta

SEQ ID NO: 2101108 - DNA, 22 bp, Homo sapiens
ttaaaaatatggaacttctaat

SEQ ID NO: 2101109 - DNA, 23 bp, Homo sapiens
ttaaaaatatggaacttctaata

SEQ ID NO: 2101110 - DNA, 20 bp, Homo sapiens
ttaaaacaaggcttaaaaga

SEQ ID NO: 2101111 - DNA, 20 bp, Homo sapiens
ttaaaaccatgcagcttcat

SEQ ID NO: 2101112 - DNA, 18 bp, Homo sapiens
ttaaaacctagaacttca

SEQ ID NO: 2101113 - DNA, 20 bp, Homo sapiens
ttaaaacctagaacttcaaa

SEQ ID NO: 2101114 - DNA, 12 bp, Homo sapiens
ttaaaagaaatt

SEQ ID NO: 2101115 - DNA, 18 bp, Homo sapiens
ttaaaagaagactggaag

SEQ ID NO: 2101116 - DNA, 11 bp, Homo sapiens
ttaaaagacag

SEQ ID NO: 2101117 - DNA, 13 bp, Homo sapiens
ttaaaagacagtg

SEQ ID NO: 2101118 - DNA, 14 bp, Homo sapiens
ttagggagagaaga

SEQ ID NO: 2101119 - DNA, 22 bp, Homo sapiens
ttagggcatcctgcccctcgcc

SEQ ID NO: 2101120 - DNA, 16 bp, Homo sapiens
ttaggggaaaatagta

SEQ ID NO: 2101121 - DNA, 12 bp, Homo sapiens
ttaggtctggtt

SEQ ID NO: 2101122 - DNA, 14 bp, Homo sapiens
ttaggttttgtaca

SEQ ID NO: 2101123 - DNA, 16 bp, Homo sapiens
ttaggttttgtacaat

SEQ ID NO: 2101124 - DNA, 16 bp, Homo sapiens
ttagtaaatccttatt

SEQ ID NO: 2101125 - DNA, 22 bp, Homo sapiens
ttagtaataaaacccagcatgt

SEQ ID NO: 2101126 - DNA, 21 bp, Homo sapiens
ttagtaatagtccaatatttg

SEQ ID NO: 2101127 - DNA, 23 bp, Homo sapiens
ttagtacagtagcttaaataaat

SEQ ID NO: 2101128 - DNA, 13 bp, Homo sapiens
ttagtagagacag

SEQ ID NO: 2101129 - DNA, 17 bp, Homo sapiens
ttagtatctaacatgta

SEQ ID NO: 2101130 - DNA, 23 bp, Homo sapiens
ttagtatctaacatgtatcccaa

SEQ ID NO: 2101131 - DNA, 20 bp, Homo sapiens
ttagtcacaccatcttaaat

SEQ ID NO: 2101132 - DNA, 17 bp, Homo sapiens
ttagtgagatttgtatt

SEQ ID NO: 2101133 - DNA, 14 bp, Homo sapiens
ttagtgctttacat

SEQ ID NO: 2101134 - DNA, 19 bp, Homo sapiens
ttagtggggtaattctgct

SEQ ID NO: 2101135 - DNA, 23 bp, Homo sapiens
ttagtgtcacttacctagattta

SEQ ID NO: 2101136 - DNA, 14 bp, Homo sapiens
ttagtgtgtgtgca

SEQ ID NO: 2101137 - DNA, 19 bp, Homo sapiens
ttagtgtgtgtgcatgtgt

SEQ ID NO: 2101138 - DNA, 19 bp, Homo sapiens
ttagtgtgttgtctgtgca

SEQ ID NO: 2101139 - DNA, 17 bp, Homo sapiens
ttagtgttctgtatttt

SEQ ID NO: 2101140 - DNA, 20 bp, Homo sapiens
ttagttgtatctcttttgaa

SEQ ID NO: 2101141 - DNA, 21 bp, Homo sapiens
ttagttttctttgtaaaggtc

SEQ ID NO: 2101142 - DNA, 17 bp, Homo sapiens
ttataaaattagaaagc

SEQ ID NO: 2101143 - DNA, 19 bp, Homo sapiens
ttataaaattatttttatt

SEQ ID NO: 2101144 - DNA, 22 bp, Homo sapiens
ttataaaattatttttattaaa

SEQ ID NO: 2101145 - DNA, 17 bp, Homo sapiens
ttataaactagatctcc

SEQ ID NO: 2101146 - DNA, 22 bp, Homo sapiens
ttataaagataaaatatcctca

SEQ ID NO: 2101147 - DNA, 13 bp, Homo sapiens
ttataaataaatg

SEQ ID NO: 2101148 - DNA, 18 bp, Homo sapiens
ttataaataaatgccaac

SEQ ID NO: 2101149 - DNA, 12 bp, Homo sapiens
ttataaatgtgt

SEQ ID NO: 2101150 - DNA, 14 bp, Homo sapiens
ttataaatgtgtgg

SEQ ID NO: 2101151 - DNA, 20 bp, Homo sapiens
ttataactcatcataaaata

SEQ ID NO: 2101152 - DNA, 18 bp, Homo sapiens
ttataactgaaggagaag

SEQ ID NO: 2101153 - DNA, 13 bp, Homo sapiens
ttataacttaaaa

SEQ ID NO: 2101154 - DNA, 16 bp, Homo sapiens
ttataagcagatttaa

SEQ ID NO: 2101155 - DNA, 19 bp, Homo sapiens
ttataataatgttctctgg

SEQ ID NO: 2101156 - DNA, 21 bp, Homo sapiens
ttataatataatatggaacct

SEQ ID NO: 2101157 - DNA, 19 bp, Homo sapiens
ttataatgtggatttccta

SEQ ID NO: 2101158 - DNA, 20 bp, Homo sapiens
ttataatgtggatttcctat

SEQ ID NO: 2101159 - DNA, 14 bp, Homo sapiens
ttatacaaaataat

SEQ ID NO: 2101160 - DNA, 15 bp, Homo sapiens
ttatacaaaataatt

SEQ ID NO: 2101161 - DNA, 21 bp, Homo sapiens
ttatacaaaataatttaacta

SEQ ID NO: 2101162 - DNA, 16 bp, Homo sapiens
ttatacacaacattta

SEQ ID NO: 2101163 - DNA, 17 bp, Homo sapiens
ttatacacaacatttat

SEQ ID NO: 2101164 - DNA, 19 bp, Homo sapiens
ttatacatagtcacaaaaa

SEQ ID NO: 2101165 - DNA, 14 bp, Homo sapiens
ttatacatatcaga

SEQ ID NO: 2101166 - DNA, 21 bp, Homo sapiens
ttatacatatcagaaaagtag

SEQ ID NO: 2101167 - DNA, 22 bp, Homo sapiens
ttatacatatcagaaaagtaga

SEQ ID NO: 2101168 - DNA, 21 bp, Homo sapiens
ttatacctgtgtattttttaa

SEQ ID NO: 2101169 - DNA, 22 bp, Homo sapiens
ttatactgtacttaataaattc

SEQ ID NO: 2101170 - DNA, 15 bp, Homo sapiens
ttatagaatatttat

SEQ ID NO: 2101171 - DNA, 22 bp, Homo sapiens
ttatagccacatccctttgaaa

SEQ ID NO: 2101172 - DNA, 16 bp, Homo sapiens
ttatagccgaaatgat

SEQ ID NO: 2101173 - DNA, 18 bp, Homo sapiens
ttatagtatatctggaca

SEQ ID NO: 2101174 - DNA, 18 bp, Homo sapiens
ttatataggttgtgcaaa

SEQ ID NO: 2101175 - DNA, 16 bp, Homo sapiens
ttatatatatatgtat

SEQ ID NO: 2101176 - DNA, 18 bp, Homo sapiens
ttatatatatatgtatat

SEQ ID NO: 2101177 - DNA, 16 bp, Homo sapiens
ttatatatcagttata

SEQ ID NO: 2101178 - DNA, 13 bp, Homo sapiens
ttatatatcataa

SEQ ID NO: 2101179 - DNA, 20 bp, Homo sapiens
ttatatatcataaagtatgc

SEQ ID NO: 2101180 - DNA, 20 bp, Homo sapiens
ttatatatttataactcatc

SEQ ID NO: 2101181 - DNA, 13 bp, Homo sapiens
ttatatctaattt

SEQ ID NO: 2101182 - DNA, 21 bp, Homo sapiens
ttatatctaatttatacaaaa

SEQ ID NO: 2101183 - DNA, 14 bp, Homo sapiens
ttatatggaaattc

SEQ ID NO: 2101184 - DNA, 16 bp, Homo sapiens
ttatatgttaatttgt

SEQ ID NO: 2101185 - DNA, 21 bp, Homo sapiens
ttatatgttaatttgttatgt

SEQ ID NO: 2101186 - DNA, 14 bp, Homo sapiens
ttatattccatata

SEQ ID NO: 2101187 - DNA, 16 bp, Homo sapiens
ttatattgtatattct

SEQ ID NO: 2101188 - DNA, 12 bp, Homo sapiens
ttatattgtcct

SEQ ID NO: 2101189 - DNA, 13 bp, Homo sapiens
ttatatttggaaa

SEQ ID NO: 2101190 - DNA, 16 bp, Homo sapiens
ttatcaaaactttctt

SEQ ID NO: 2101191 - DNA, 15 bp, Homo sapiens
ttatcaacaatagtg

SEQ ID NO: 2101192 - DNA, 22 bp, Homo sapiens
ttatcacatcaagcatgcaata

SEQ ID NO: 2101193 - DNA, 19 bp, Homo sapiens
ttatcatgacatgttatat

SEQ ID NO: 2101194 - DNA, 18 bp, Homo sapiens
ttatcattgggagaagcc

SEQ ID NO: 2101195 - DNA, 17 bp, Homo sapiens
ttatccaatcctcagga

SEQ ID NO: 2101196 - DNA, 14 bp, Homo sapiens
ttatccctgaggtc

SEQ ID NO: 2101197 - DNA, 20 bp, Homo sapiens
ttatccttaggaaaatgctt

SEQ ID NO: 2101198 - DNA, 16 bp, Homo sapiens
ttatcgggaacagtgt

SEQ ID NO: 2101199 - DNA, 17 bp, Homo sapiens
ttatcgggaacagtgtt

SEQ ID NO: 2101200 - DNA, 14 bp, Homo sapiens
ttatctaaaagaat

SEQ ID NO: 2101201 - DNA, 17 bp, Homo sapiens
ttatctgaatttttaaa

SEQ ID NO: 2101202 - DNA, 18 bp, Homo sapiens
ttatctgaatttttaaac

SEQ ID NO: 2101203 - DNA, 21 bp, Homo sapiens
ttatctgaatttttaaacaag

SEQ ID NO: 2101204 - DNA, 22 bp, Homo sapiens
ttatctgatcgggataacaaaa

SEQ ID NO: 2101205 - DNA, 14 bp, Homo sapiens
ttatctgcctggcc

SEQ ID NO: 2101206 - DNA, 18 bp, Homo sapiens
ttatctgcctggcctggc

SEQ ID NO: 2101207 - DNA, 16 bp, Homo sapiens
ttatctgtgaccacac

SEQ ID NO: 2101208 - DNA, 19 bp, Homo sapiens
ttatctgtgaccacacgct

SEQ ID NO: 2101209 - DNA, 15 bp, Homo sapiens
ttatctgtgttgtct

SEQ ID NO: 2101210 - DNA, 17 bp, Homo sapiens
ttatcttgtctctgggc

SEQ ID NO: 2101211 - DNA, 18 bp, Homo sapiens
ttatgaaaaagaagaatc

SEQ ID NO: 2101212 - DNA, 18 bp, Homo sapiens
ttatgaagaaaaaataca

SEQ ID NO: 2101213 - DNA, 14 bp, Homo sapiens
ttatgaatgtgcat

SEQ ID NO: 2101214 - DNA, 20 bp, Homo sapiens
ttatgaatgtgcatttcttg

SEQ ID NO: 2101215 - DNA, 18 bp, Homo sapiens
ttatgacatcacttgtac

SEQ ID NO: 2101216 - DNA, 20 bp, Homo sapiens
ttatgactgtaaacatagat

SEQ ID NO: 2101217 - DNA, 23 bp, Homo sapiens
ttatgagatgatgaaaataataa

SEQ ID NO: 2101218 - DNA, 15 bp, Homo sapiens
ttatgagtttgctta

SEQ ID NO: 2101219 - DNA, 23 bp, Homo sapiens
ttatgagtttttgatagctttat

SEQ ID NO: 2101220 - DNA, 20 bp, Homo sapiens
ttatgatgtgggtcaaggaa

SEQ ID NO: 2101221 - DNA, 14 bp, Homo sapiens
ttatgcactggcca

SEQ ID NO: 2101222 - DNA, 13 bp, Homo sapiens
ttatgccactgct

SEQ ID NO: 2101223 - DNA, 16 bp, Homo sapiens
ttatgctaactgtaga

SEQ ID NO: 2101224 - DNA, 19 bp, Homo sapiens
ttatgcttaaaatatgtat

SEQ ID NO: 2101225 - DNA, 17 bp, Homo sapiens
ttatggctataggtgct

SEQ ID NO: 2101226 - DNA, 16 bp, Homo sapiens
ttatggcttataaatg

SEQ ID NO: 2101227 - DNA, 18 bp, Homo sapiens
ttatggcttataaatgtg

SEQ ID NO: 2101228 - DNA, 18 bp, Homo sapiens
ttatgggaatgccttttc

SEQ ID NO: 2101229 - DNA, 17 bp, Homo sapiens
ttatgggtcctgcaatt

SEQ ID NO: 2101230 - DNA, 13 bp, Homo sapiens
ttatggtattttc

SEQ ID NO: 2101231 - DNA, 14 bp, Homo sapiens
ttatggtattttcg

SEQ ID NO: 2101232 - DNA, 16 bp, Homo sapiens
ttcccatgatccagaa

SEQ ID NO: 2101233 - DNA, 14 bp, Homo sapiens
ttcccatgctgaat

SEQ ID NO: 2101234 - DNA, 17 bp, Homo sapiens
ttcccatgctgaattat

SEQ ID NO: 2101235 - DNA, 22 bp, Homo sapiens
ttcccatgtgtgactccagcct

SEQ ID NO: 2101236 - DNA, 13 bp, Homo sapiens
ttcccatgttaaa

SEQ ID NO: 2101237 - DNA, 13 bp, Homo sapiens
ttcccatttgtaa

SEQ ID NO: 2101238 - DNA, 15 bp, Homo sapiens
ttcccatttgtaatg

SEQ ID NO: 2101239 - DNA, 18 bp, Homo sapiens
ttcccatttgtaatgtat

SEQ ID NO: 2101240 - DNA, 14 bp, Homo sapiens
ttcccattttgcaa

SEQ ID NO: 2101241 - DNA, 11 bp, Homo sapiens
ttccccacaga

SEQ ID NO: 2101242 - DNA, 18 bp, Homo sapiens
ttccccatctccatttca

SEQ ID NO: 2101243 - DNA, 11 bp, Homo sapiens
ttccccatggg

SEQ ID NO: 2101244 - DNA, 16 bp, Homo sapiens
ttcccccaccccagag

SEQ ID NO: 2101245 - DNA, 20 bp, Homo sapiens
ttcccccatcccctttcctc

SEQ ID NO: 2101246 - DNA, 20 bp, Homo sapiens
ttcccccgctggcagccacc

SEQ ID NO: 2101247 - DNA, 19 bp, Homo sapiens
ttcccctaacctcattccc

SEQ ID NO: 2101248 - DNA, 19 bp, Homo sapiens
ttcccctacacctccctcc

SEQ ID NO: 2101249 - DNA, 18 bp, Homo sapiens
ttcccctctgtgtcctct

SEQ ID NO: 2101250 - DNA, 22 bp, Homo sapiens
ttcccctctgtgtcctctcccc

SEQ ID NO: 2101251 - DNA, 19 bp, Homo sapiens
ttccccttctgtgtcacag

SEQ ID NO: 2101252 - DNA, 23 bp, Homo sapiens
ttccccttgcccagggctcagcc

SEQ ID NO: 2101253 - DNA, 14 bp, Homo sapiens
ttccccttgccctt

SEQ ID NO: 2101254 - DNA, 23 bp, Homo sapiens
ttccccttgcccttgccctgacc

SEQ ID NO: 2101255 - DNA, 14 bp, Homo sapiens
ttcccctttcccca

SEQ ID NO: 2101256 - DNA, 13 bp, Homo sapiens
ttcccctttcctg

SEQ ID NO: 2101257 - DNA, 20 bp, Homo sapiens
ttccccttttgcctggctgt

SEQ ID NO: 2101258 - DNA, 21 bp, Homo sapiens
ttcccgagcaaagtctaaagt

SEQ ID NO: 2101259 - DNA, 23 bp, Homo sapiens
ttcccgagcaaagtctaaagttt

SEQ ID NO: 2101260 - DNA, 22 bp, Homo sapiens
ttcccgccaggaggtcctcctc

SEQ ID NO: 2101261 - DNA, 22 bp, Homo sapiens
ttcccgctcagccctccctgcc

SEQ ID NO: 2101262 - DNA, 23 bp, Homo sapiens
ttcccggagcacagccctgggag

SEQ ID NO: 2101263 - DNA, 17 bp, Homo sapiens
ttccctacttcctgtga

SEQ ID NO: 2101264 - DNA, 12 bp, Homo sapiens
ttccctcacccc

SEQ ID NO: 2101265 - DNA, 14 bp, Homo sapiens
ttccctcaccccct

SEQ ID NO: 2101266 - DNA, 13 bp, Homo sapiens
ttccctcccggga

SEQ ID NO: 2101267 - DNA, 14 bp, Homo sapiens
ttccctccttccct

SEQ ID NO: 2101268 - DNA, 18 bp, Homo sapiens
ttccctccttcccttctc

SEQ ID NO: 2101269 - DNA, 16 bp, Homo sapiens
ttccctctcccaggcc

SEQ ID NO: 2101270 - DNA, 16 bp, Homo sapiens
ttccctgaacatctgt

SEQ ID NO: 2101271 - DNA, 12 bp, Homo sapiens
ttccctgctttg

SEQ ID NO: 2101272 - DNA, 12 bp, Homo sapiens
ttccctgggaac

SEQ ID NO: 2101273 - DNA, 14 bp, Homo sapiens
ttccctgtcagagg

SEQ ID NO: 2101274 - DNA, 11 bp, Homo sapiens
ttccctgtgct

SEQ ID NO: 2101275 - DNA, 19 bp, Homo sapiens
ttccctgttttaaattata

SEQ ID NO: 2101276 - DNA, 15 bp, Homo sapiens
ttcccttctatgcag

SEQ ID NO: 2101277 - DNA, 23 bp, Homo sapiens
ttcccttgaaattttaaactata

SEQ ID NO: 2101278 - DNA, 23 bp, Homo sapiens
ttccgaagagggaatggatgggg

SEQ ID NO: 2101279 - DNA, 15 bp, Homo sapiens
ttccgctcctttacc

SEQ ID NO: 2101280 - DNA, 18 bp, Homo sapiens
ttccgtgacgtcactgga

SEQ ID NO: 2101281 - DNA, 19 bp, Homo sapiens
ttcctaaagtctctgctgc

SEQ ID NO: 2101282 - DNA, 20 bp, Homo sapiens
ttcctaaagtctctgctgct

SEQ ID NO: 2101283 - DNA, 17 bp, Homo sapiens
ttcctaagtataaatgg

SEQ ID NO: 2101284 - DNA, 16 bp, Homo sapiens
ttcctacaaagatgtt

SEQ ID NO: 2101285 - DNA, 23 bp, Homo sapiens
ttcctacagaaatactgctctga

SEQ ID NO: 2101286 - DNA, 18 bp, Homo sapiens
ttcctacagatagtcaaa

SEQ ID NO: 2101287 - DNA, 17 bp, Homo sapiens
ttcctacccaaccactc

SEQ ID NO: 2101288 - DNA, 19 bp, Homo sapiens
ttcctagagagcagaaata

SEQ ID NO: 2101289 - DNA, 21 bp, Homo sapiens
ttcctagagagcagaaataaa

SEQ ID NO: 2101290 - DNA, 18 bp, Homo sapiens
ttcctagttttctcctcc

SEQ ID NO: 2101291 - DNA, 21 bp, Homo sapiens
ttcctatatagtttattgaca

SEQ ID NO: 2101292 - DNA, 22 bp, Homo sapiens
ttcctatatagtttattgacaa

SEQ ID NO: 2101293 - DNA, 16 bp, Homo sapiens
ttcctattttaaaacc

SEQ ID NO: 2101294 - DNA, 21 bp, Homo sapiens
ttcctattttaaaaccatgca

SEQ ID NO: 2101295 - DNA, 23 bp, Homo sapiens
ttcctattttaaaaccatgcagc

SEQ ID NO: 2101296 - DNA, 16 bp, Homo sapiens
ttcctcaccaataact

SEQ ID NO: 2101297 - DNA, 15 bp, Homo sapiens
ttcctcagctgccaa

SEQ ID NO: 2101298 - DNA, 23 bp, Homo sapiens
ttcctcatagtatggtggctggg

SEQ ID NO: 2101299 - DNA, 13 bp, Homo sapiens
ttcctcatcagta

SEQ ID NO: 2101300 - DNA, 20 bp, Homo sapiens
ttcctcatcccctcgtcctg

SEQ ID NO: 2101301 - DNA, 16 bp, Homo sapiens
ttcctccaaactcctg

SEQ ID NO: 2101302 - DNA, 15 bp, Homo sapiens
ttcctccagacagat

SEQ ID NO: 2101303 - DNA, 13 bp, Homo sapiens
ttcctccccagtc

SEQ ID NO: 2101304 - DNA, 16 bp, Homo sapiens
ttcctcccccagagcc

SEQ ID NO: 2101305 - DNA, 13 bp, Homo sapiens
ttcctccctggca

SEQ ID NO: 2101306 - DNA, 22 bp, Homo sapiens
ttcctccgtccacccaggctgc

SEQ ID NO: 2101307 - DNA, 19 bp, Homo sapiens
ttcctcctccacagtgctg

SEQ ID NO: 2101308 - DNA, 21 bp, Homo sapiens
ttcctcctccacagtgctgct

SEQ ID NO: 2101309 - DNA, 16 bp, Homo sapiens
ttcctcgcctaggcct

SEQ ID NO: 2101310 - DNA, 15 bp, Homo sapiens
ttcctcgcctctccc

SEQ ID NO: 2101311 - DNA, 17 bp, Homo sapiens
ttcctcgcctctcccac

SEQ ID NO: 2101312 - DNA, 19 bp, Homo sapiens
ttcctctcactaaacttta

SEQ ID NO: 2101313 - DNA, 18 bp, Homo sapiens
ttcctctccaattgtaaa

SEQ ID NO: 2101314 - DNA, 19 bp, Homo sapiens
ttcctctccactgccttcg

SEQ ID NO: 2101315 - DNA, 12 bp, Homo sapiens
ttcctctccagc

SEQ ID NO: 2101316 - DNA, 16 bp, Homo sapiens
ttcctctgcagcactt

SEQ ID NO: 2101317 - DNA, 12 bp, Homo sapiens
ttcctctgggaa

SEQ ID NO: 2101318 - DNA, 13 bp, Homo sapiens
ttcctctgttcta

SEQ ID NO: 2101319 - DNA, 18 bp, Homo sapiens
ttcctcttgcctctctca

SEQ ID NO: 2101320 - DNA, 12 bp, Homo sapiens
ttcctctttgca

SEQ ID NO: 2101321 - DNA, 18 bp, Homo sapiens
ttcctgaaagaaacagtt

SEQ ID NO: 2101322 - DNA, 15 bp, Homo sapiens
ttcctgaagccagat

SEQ ID NO: 2101323 - DNA, 23 bp, Homo sapiens
ttcctgaagccagatccacccta

SEQ ID NO: 2101324 - DNA, 15 bp, Homo sapiens
ttcctgaccctccct

SEQ ID NO: 2101325 - DNA, 21 bp, Homo sapiens
ttcctgaccctccctacctga

SEQ ID NO: 2101326 - DNA, 19 bp, Homo sapiens
ttcctgatactgggtacaa

SEQ ID NO: 2101327 - DNA, 21 bp, Homo sapiens
ttcctgatactgggtacaaga

SEQ ID NO: 2101328 - DNA, 14 bp, Homo sapiens
ttcctgcacccgta

SEQ ID NO: 2101329 - DNA, 13 bp, Homo sapiens
ttcctgcactcca

SEQ ID NO: 2101330 - DNA, 14 bp, Homo sapiens
ttcctgcactccag

SEQ ID NO: 2101331 - DNA, 15 bp, Homo sapiens
ttcctgcactccaga

SEQ ID NO: 2101332 - DNA, 11 bp, Homo sapiens
ttcctgctgct

SEQ ID NO: 2101333 - DNA, 19 bp, Homo sapiens
ttcctgcttaaacttgacc

SEQ ID NO: 2101334 - DNA, 21 bp, Homo sapiens
ttcctggacagctgtgcctcg

SEQ ID NO: 2101335 - DNA, 24 bp, Homo sapiens
ttcctggacagctgtgcctcgctc

SEQ ID NO: 2101336 - DNA, 17 bp, Homo sapiens
ttcctggacctgagtcg

SEQ ID NO: 2101337 - DNA, 14 bp, Homo sapiens
ttcctgggcctgtc

SEQ ID NO: 2101338 - DNA, 16 bp, Homo sapiens
ttcctgggcctgtccc

SEQ ID NO: 2101339 - DNA, 16 bp, Homo sapiens
ttcctggggccccgct

SEQ ID NO: 2101340 - DNA, 22 bp, Homo sapiens
ttcctgggtggctactctgtgc

SEQ ID NO: 2101341 - DNA, 23 bp, Homo sapiens
ttcctgggtggctactctgtgcc

SEQ ID NO: 2101342 - DNA, 22 bp, Homo sapiens
ttcctggtgaggcccagcctgt

SEQ ID NO: 2101343 - DNA, 21 bp, Homo sapiens
ttcctgtaacacaagccacag

SEQ ID NO: 2101344 - DNA, 23 bp, Homo sapiens
ttcctgtaacacaagccacagaa

SEQ ID NO: 2101345 - DNA, 15 bp, Homo sapiens
ttcctgtagcatctt

SEQ ID NO: 2101346 - DNA, 17 bp, Homo sapiens
ttcctgtagcatcttct

SEQ ID NO: 2101347 - DNA, 20 bp, Homo sapiens
ttcttcaagcacctgcagat

SEQ ID NO: 2101348 - DNA, 14 bp, Homo sapiens
ttcttcacccagct

SEQ ID NO: 2101349 - DNA, 17 bp, Homo sapiens
ttcttcagaagacactg

SEQ ID NO: 2101350 - DNA, 17 bp, Homo sapiens
ttcttcagatcagtgct

SEQ ID NO: 2101351 - DNA, 15 bp, Homo sapiens
ttcttcagtgcctag

SEQ ID NO: 2101352 - DNA, 17 bp, Homo sapiens
ttcttcatgcaatgaca

SEQ ID NO: 2101353 - DNA, 16 bp, Homo sapiens
ttcttccagtgcaaca

SEQ ID NO: 2101354 - DNA, 13 bp, Homo sapiens
ttcttccatctga

SEQ ID NO: 2101355 - DNA, 14 bp, Homo sapiens
ttcttccatctgat

SEQ ID NO: 2101356 - DNA, 11 bp, Homo sapiens
ttcttcctctg

SEQ ID NO: 2101357 - DNA, 12 bp, Homo sapiens
ttcttcctctgc

SEQ ID NO: 2101358 - DNA, 16 bp, Homo sapiens
ttcttcgctgctctag

SEQ ID NO: 2101359 - DNA, 23 bp, Homo sapiens
ttcttcgctgctctagctggcag

SEQ ID NO: 2101360 - DNA, 18 bp, Homo sapiens
ttcttctaaaatgctttt

SEQ ID NO: 2101361 - DNA, 17 bp, Homo sapiens
ttcttctacaaccagag

SEQ ID NO: 2101362 - DNA, 21 bp, Homo sapiens
ttcttctaggttctaaaaatt

SEQ ID NO: 2101363 - DNA, 13 bp, Homo sapiens
ttcttctgcttca

SEQ ID NO: 2101364 - DNA, 18 bp, Homo sapiens
ttcttgacttcacagcag

SEQ ID NO: 2101365 - DNA, 15 bp, Homo sapiens
ttcttgcctgaggct

SEQ ID NO: 2101366 - DNA, 15 bp, Homo sapiens
ttcttggacccctga

SEQ ID NO: 2101367 - DNA, 19 bp, Homo sapiens
ttcttggggtcccagggaa

SEQ ID NO: 2101368 - DNA, 15 bp, Homo sapiens
ttcttggtttgggga

SEQ ID NO: 2101369 - DNA, 14 bp, Homo sapiens
ttcttgtcaaaaaa

SEQ ID NO: 2101370 - DNA, 19 bp, Homo sapiens
ttcttgtctgattggctca

SEQ ID NO: 2101371 - DNA, 20 bp, Homo sapiens
ttcttgtgaaaccacaggcc

SEQ ID NO: 2101372 - DNA, 14 bp, Homo sapiens
ttcttgtgcctcag

SEQ ID NO: 2101373 - DNA, 12 bp, Homo sapiens
ttctttaaatca

SEQ ID NO: 2101374 - DNA, 16 bp, Homo sapiens
ttctttaaatcaaaag

SEQ ID NO: 2101375 - DNA, 17 bp, Homo sapiens
ttctttaaatcaaaagc

SEQ ID NO: 2101376 - DNA, 20 bp, Homo sapiens
ttctttacctgagaccagtt

SEQ ID NO: 2101377 - DNA, 14 bp, Homo sapiens
ttctttataaactt

SEQ ID NO: 2101378 - DNA, 10 bp, Homo sapiens
ttctttcaag

SEQ ID NO: 2101379 - DNA, 17 bp, Homo sapiens
ttctttccatgcagact

SEQ ID NO: 2101380 - DNA, 15 bp, Homo sapiens
ttctttctcactaaa

SEQ ID NO: 2101381 - DNA, 13 bp, Homo sapiens
ttctttctcttcc

SEQ ID NO: 2101382 - DNA, 22 bp, Homo sapiens
ttctttggtttcccaagagcta

SEQ ID NO: 2101383 - DNA, 15 bp, Homo sapiens
ttctttgtaaaggtc

SEQ ID NO: 2101384 - DNA, 19 bp, Homo sapiens
ttctttgtgtagctttgct

SEQ ID NO: 2101385 - DNA, 14 bp, Homo sapiens
ttcttttaaagaag

SEQ ID NO: 2101386 - DNA, 15 bp, Homo sapiens
ttcttttactgtaat

SEQ ID NO: 2101387 - DNA, 12 bp, Homo sapiens
ttcttttatcac

SEQ ID NO: 2101388 - DNA, 21 bp, Homo sapiens
ttcttttgcccttcacagtgt

SEQ ID NO: 2101389 - DNA, 22 bp, Homo sapiens
ttcttttgcccttcacagtgtt

SEQ ID NO: 2101390 - DNA, 23 bp, Homo sapiens
ttcttttgcccttcacagtgttt

SEQ ID NO: 2101391 - DNA, 16 bp, Homo sapiens
ttctttttattttctt

SEQ ID NO: 2101392 - DNA, 12 bp, Homo sapiens
ttctttttcaaa

SEQ ID NO: 2101393 - DNA, 15 bp, Homo sapiens
ttctttttcaaaaat

SEQ ID NO: 2101394 - DNA, 14 bp, Homo sapiens
ttctttttctggaa

SEQ ID NO: 2101395 - DNA, 17 bp, Homo sapiens
ttcttttttgtctcaag

SEQ ID NO: 2101396 - DNA, 15 bp, Homo sapiens
ttctttttttatgac

SEQ ID NO: 2101397 - DNA, 18 bp, Homo sapiens
ttctttttttgctttgtt

SEQ ID NO: 2101398 - DNA, 15 bp, Homo sapiens
ttgaaaaaatgttct

SEQ ID NO: 2101399 - DNA, 14 bp, Homo sapiens
ttgaaaagaatcta

SEQ ID NO: 2101400 - DNA, 22 bp, Homo sapiens
ttgaaaattattttaaacaaaa

SEQ ID NO: 2101401 - DNA, 14 bp, Homo sapiens
ttgaaacagcctgg

SEQ ID NO: 2101402 - DNA, 20 bp, Homo sapiens
ttgaaagagaaccagtttca

SEQ ID NO: 2101403 - DNA, 22 bp, Homo sapiens
ttgaaagctgtggccagcttgt

SEQ ID NO: 2101404 - DNA, 18 bp, Homo sapiens
ttgaaagtgaataaactt

SEQ ID NO: 2101405 - DNA, 22 bp, Homo sapiens
ttgaaagtgaataaacttcagc

SEQ ID NO: 2101406 - DNA, 17 bp, Homo sapiens
ttgaaattatatctgtg

SEQ ID NO: 2101407 - DNA, 19 bp, Homo sapiens
ttgaaattatatctgtggt

SEQ ID NO: 2101408 - DNA, 19 bp, Homo sapiens
ttgaaattatgtatgttta

SEQ ID NO: 2101409 - DNA, 21 bp, Homo sapiens
ttgaaatttaaaaataaagct

SEQ ID NO: 2101410 - DNA, 20 bp, Homo sapiens
ttgaacaagttgtttcattg

SEQ ID NO: 2101411 - DNA, 22 bp, Homo sapiens
ttgaacacaattgatacttcag

SEQ ID NO: 2101412 - DNA, 13 bp, Homo sapiens
ttgaacactgggg

SEQ ID NO: 2101413 - DNA, 12 bp, Homo sapiens
ttgaacccagga

SEQ ID NO: 2101414 - DNA, 13 bp, Homo sapiens
ttgaacccaggag

SEQ ID NO: 2101415 - DNA, 14 bp, Homo sapiens
ttgaacccctgtgt

SEQ ID NO: 2101416 - DNA, 22 bp, Homo sapiens
ttgaactgagccaaacacactg

SEQ ID NO: 2101417 - DNA, 13 bp, Homo sapiens
ttgaactgattca

SEQ ID NO: 2101418 - DNA, 18 bp, Homo sapiens
ttgaactgggtacttgtg

SEQ ID NO: 2101419 - DNA, 22 bp, Homo sapiens
ttgaacttaaataaatgtcatt

SEQ ID NO: 2101420 - DNA, 18 bp, Homo sapiens
ttgaagaatattgttaaa

SEQ ID NO: 2101421 - DNA, 23 bp, Homo sapiens
ttgaagaatgttaagacttgaca

SEQ ID NO: 2101422 - DNA, 17 bp, Homo sapiens
ttgaagccactgaagct

SEQ ID NO: 2101423 - DNA, 21 bp, Homo sapiens
ttgaagccactgaagctggga

SEQ ID NO: 2101424 - DNA, 18 bp, Homo sapiens
ttgaaggaggtgagggat

SEQ ID NO: 2101425 - DNA, 18 bp, Homo sapiens
ttgaagggtaaagaagtt

SEQ ID NO: 2101426 - DNA, 19 bp, Homo sapiens
ttgaagggtaaagaagttt

SEQ ID NO: 2101427 - DNA, 20 bp, Homo sapiens
ttgaagtcatcttagctttc

SEQ ID NO: 2101428 - DNA, 23 bp, Homo sapiens
ttgaagttagctttaacttaaat

SEQ ID NO: 2101429 - DNA, 21 bp, Homo sapiens
ttgaagttcatggtgatcagt

SEQ ID NO: 2101430 - DNA, 22 bp, Homo sapiens
ttgaataaaaaacatttgtaca

SEQ ID NO: 2101431 - DNA, 23 bp, Homo sapiens
ttgaataaaaaacatttgtacat

SEQ ID NO: 2101432 - DNA, 14 bp, Homo sapiens
ttgaataaagtctg

SEQ ID NO: 2101433 - DNA, 19 bp, Homo sapiens
ttgaataaagttgaagcta

SEQ ID NO: 2101434 - DNA, 19 bp, Homo sapiens
ttgaatacccccagagacc

SEQ ID NO: 2101435 - DNA, 15 bp, Homo sapiens
ttgaatataaacact

SEQ ID NO: 2101436 - DNA, 21 bp, Homo sapiens
ttgaatatttgcttaaaattg

SEQ ID NO: 2101437 - DNA, 17 bp, Homo sapiens
ttgaatccatgcttggg

SEQ ID NO: 2101438 - DNA, 24 bp, Homo sapiens
ttgaatctgattggacattttctt

SEQ ID NO: 2101439 - DNA, 15 bp, Homo sapiens
ttgaatgcaaaccat

SEQ ID NO: 2101440 - DNA, 17 bp, Homo sapiens
ttgaatgctttttgaat

SEQ ID NO: 2101441 - DNA, 18 bp, Homo sapiens
ttgaatgtaagaacatga

SEQ ID NO: 2101442 - DNA, 16 bp, Homo sapiens
ttgacaaaatttgttg

SEQ ID NO: 2101443 - DNA, 15 bp, Homo sapiens
ttgacaacagactga

SEQ ID NO: 2101444 - DNA, 16 bp, Homo sapiens
ttgacaacattttatt

SEQ ID NO: 2101445 - DNA, 16 bp, Homo sapiens
ttgacaaccatgagac

SEQ ID NO: 2101446 - DNA, 22 bp, Homo sapiens
ttgacaagtcattttaacttta

SEQ ID NO: 2101447 - DNA, 14 bp, Homo sapiens
ttgacacggtgaaa

SEQ ID NO: 2101448 - DNA, 18 bp, Homo sapiens
ttgacacggtgaaatcca

SEQ ID NO: 2101449 - DNA, 20 bp, Homo sapiens
ttgacacggtgaaatccagg

SEQ ID NO: 2101450 - DNA, 17 bp, Homo sapiens
ttgacagaacactgtct

SEQ ID NO: 2101451 - DNA, 19 bp, Homo sapiens
ttgacagggcacaccgggc

SEQ ID NO: 2101452 - DNA, 16 bp, Homo sapiens
ttgacatcatgtaaac

SEQ ID NO: 2101453 - DNA, 22 bp, Homo sapiens
ttgacattgtatgtatctattt

SEQ ID NO: 2101454 - DNA, 19 bp, Homo sapiens
ttgaccaagatgatcacat

SEQ ID NO: 2101455 - DNA, 15 bp, Homo sapiens
ttgaccagacctaga

SEQ ID NO: 2101456 - DNA, 21 bp, Homo sapiens
ttgaccagacctagacctggg

SEQ ID NO: 2101457 - DNA, 15 bp, Homo sapiens
ttgaccattggctgc

SEQ ID NO: 2101458 - DNA, 21 bp, Homo sapiens
ttgacccactcacacttggag

SEQ ID NO: 2101459 - DNA, 18 bp, Homo sapiens
ttgacccaggtggctagc

SEQ ID NO: 2101460 - DNA, 14 bp, Homo sapiens
ttgacccctttccc

SEQ ID NO: 2101461 - DNA, 18 bp, Homo sapiens
ttgacctcagctgcacat

SEQ ID NO: 2101462 - DNA, 22 bp, Homo sapiens
ttggccactgggtctcactcct

SEQ ID NO: 2101463 - DNA, 16 bp, Homo sapiens
ttggcccctgtgtgag

SEQ ID NO: 2101464 - DNA, 11 bp, Homo sapiens
ttggccgccat

SEQ ID NO: 2101465 - DNA, 17 bp, Homo sapiens
ttggccgccatccggga

SEQ ID NO: 2101466 - DNA, 23 bp, Homo sapiens
ttggccgtggccatcagggtggg

SEQ ID NO: 2101467 - DNA, 16 bp, Homo sapiens
ttggcctcgcctgggc

SEQ ID NO: 2101468 - DNA, 21 bp, Homo sapiens
ttggcctgcctcccagccctg

SEQ ID NO: 2101469 - DNA, 20 bp, Homo sapiens
ttggcgggcagcccagcctc

SEQ ID NO: 2101470 - DNA, 22 bp, Homo sapiens
ttggctaggacccctccatgtg

SEQ ID NO: 2101471 - DNA, 13 bp, Homo sapiens
ttggctcaatcct

SEQ ID NO: 2101472 - DNA, 16 bp, Homo sapiens
ttggctcttaaggctt

SEQ ID NO: 2101473 - DNA, 14 bp, Homo sapiens
ttggctgcagggag

SEQ ID NO: 2101474 - DNA, 16 bp, Homo sapiens
ttggctgctcattcct

SEQ ID NO: 2101475 - DNA, 19 bp, Homo sapiens
ttggctgctcattccttct

SEQ ID NO: 2101476 - DNA, 21 bp, Homo sapiens
ttggctggatgaaattttcta

SEQ ID NO: 2101477 - DNA, 20 bp, Homo sapiens
ttggctggttaattccataa

SEQ ID NO: 2101478 - DNA, 17 bp, Homo sapiens
ttggctgtgaggcccct

SEQ ID NO: 2101479 - DNA, 22 bp, Homo sapiens
ttggcttattttttaaaataat

SEQ ID NO: 2101480 - DNA, 17 bp, Homo sapiens
ttggctttaaacaccct

SEQ ID NO: 2101481 - DNA, 17 bp, Homo sapiens
ttgggaattgcatgcca

SEQ ID NO: 2101482 - DNA, 15 bp, Homo sapiens
ttgggaggccaaggc

SEQ ID NO: 2101483 - DNA, 12 bp, Homo sapiens
ttgggaggctga

SEQ ID NO: 2101484 - DNA, 17 bp, Homo sapiens
ttgggagggacagggct

SEQ ID NO: 2101485 - DNA, 22 bp, Homo sapiens
ttgggatgagaatgaaagctta

SEQ ID NO: 2101486 - DNA, 22 bp, Homo sapiens
ttgggatttatatctatagtag

SEQ ID NO: 2101487 - DNA, 22 bp, Homo sapiens
ttgggcacccccagcctgggcc

SEQ ID NO: 2101488 - DNA, 17 bp, Homo sapiens
ttgggccaaggtgtttc

SEQ ID NO: 2101489 - DNA, 23 bp, Homo sapiens
ttgggccactgcactctagcctg

SEQ ID NO: 2101490 - DNA, 22 bp, Homo sapiens
ttgggcctccccccagcccctc

SEQ ID NO: 2101491 - DNA, 17 bp, Homo sapiens
ttgggctactggcagct

SEQ ID NO: 2101492 - DNA, 19 bp, Homo sapiens
ttgggctactggcagctcc

SEQ ID NO: 2101493 - DNA, 24 bp, Homo sapiens
ttgggctactggcagctcctctcc

SEQ ID NO: 2101494 - DNA, 15 bp, Homo sapiens
ttgggctcctggctg

SEQ ID NO: 2101495 - DNA, 16 bp, Homo sapiens
ttgggctgacacctac

SEQ ID NO: 2101496 - DNA, 23 bp, Homo sapiens
ttggggagggggaagagaaattt

SEQ ID NO: 2101497 - DNA, 20 bp, Homo sapiens
ttggggcaggagtagctgag

SEQ ID NO: 2101498 - DNA, 11 bp, Homo sapiens
ttggggcctgg

SEQ ID NO: 2101499 - DNA, 16 bp, Homo sapiens
ttggggcctggcttgc

SEQ ID NO: 2101500 - DNA, 21 bp, Homo sapiens
ttggggcctggcttgctccag

SEQ ID NO: 2101501 - DNA, 16 bp, Homo sapiens
ttgggggctgtgggga

SEQ ID NO: 2101502 - DNA, 13 bp, Homo sapiens
ttggggggccggg

SEQ ID NO: 2101503 - DNA, 15 bp, Homo sapiens
ttgggggtttttaat

SEQ ID NO: 2101504 - DNA, 15 bp, Homo sapiens
ttggggtcagccagg

SEQ ID NO: 2101505 - DNA, 16 bp, Homo sapiens
ttggggtctgccacca

SEQ ID NO: 2101506 - DNA, 21 bp, Homo sapiens
ttggggtgtttcaaaagtgga

SEQ ID NO: 2101507 - DNA, 22 bp, Homo sapiens
ttggggttcccccagacagagc

SEQ ID NO: 2101508 - DNA, 16 bp, Homo sapiens
ttgggtactactgctg

SEQ ID NO: 2101509 - DNA, 20 bp, Homo sapiens
ttgggtgtaacaggtctcct

SEQ ID NO: 2101510 - DNA, 23 bp, Homo sapiens
ttgggtgtaacaggtctcctctt

SEQ ID NO: 2101511 - DNA, 16 bp, Homo sapiens
ttgggttaagtatgag

SEQ ID NO: 2101512 - DNA, 15 bp, Homo sapiens
ttgggttttatcagt

SEQ ID NO: 2101513 - DNA, 16 bp, Homo sapiens
ttggtaacatcctttc

SEQ ID NO: 2101514 - DNA, 19 bp, Homo sapiens
ttggtaacatcctttctat

SEQ ID NO: 2101515 - DNA, 22 bp, Homo sapiens
ttggtactactagatgtcttta

SEQ ID NO: 2101516 - DNA, 21 bp, Homo sapiens
ttggtaggcttatcaaaatct

SEQ ID NO: 2101517 - DNA, 23 bp, Homo sapiens
ttggtcccgtgcagcttctgtcc

SEQ ID NO: 2101518 - DNA, 13 bp, Homo sapiens
ttggtcctgtcac

SEQ ID NO: 2101519 - DNA, 14 bp, Homo sapiens
ttggtctgctggtg

SEQ ID NO: 2101520 - DNA, 13 bp, Homo sapiens
ttggtctgtgtga

SEQ ID NO: 2101521 - DNA, 15 bp, Homo sapiens
ttggtctttctacat

SEQ ID NO: 2101522 - DNA, 14 bp, Homo sapiens
ttggtgactgtccc

SEQ ID NO: 2101523 - DNA, 15 bp, Homo sapiens
ttggtgactgtccca

SEQ ID NO: 2101524 - DNA, 14 bp, Homo sapiens
ttggtgataagtgg

SEQ ID NO: 2101525 - DNA, 23 bp, Homo sapiens
ttggtgataagtggaaaaaagag

SEQ ID NO: 2101526 - DNA, 14 bp, Homo sapiens
ttggtgcctgcctc

SEQ ID NO: 2101527 - DNA, 14 bp, Homo sapiens
ttggtggccacata

SEQ ID NO: 2101528 - DNA, 14 bp, Homo sapiens
ttggttggggtggg

SEQ ID NO: 2101529 - DNA, 15 bp, Homo sapiens
ttggttggggtgggg

SEQ ID NO: 2101530 - DNA, 22 bp, Homo sapiens
ttggttgtcaatattaaataca

SEQ ID NO: 2101531 - DNA, 16 bp, Homo sapiens
ttggttttgctacata

SEQ ID NO: 2101532 - DNA, 23 bp, Homo sapiens
ttgtaaaacctgtcaatgataca

SEQ ID NO: 2101533 - DNA, 15 bp, Homo sapiens
ttgtaaaatagcttg

SEQ ID NO: 2101534 - DNA, 19 bp, Homo sapiens
ttgtaaacagctaataatg

SEQ ID NO: 2101535 - DNA, 14 bp, Homo sapiens
ttgtaaacatgtgt

SEQ ID NO: 2101536 - DNA, 15 bp, Homo sapiens
ttgtaaacatgtgtt

SEQ ID NO: 2101537 - DNA, 22 bp, Homo sapiens
ttgtaaactgtatcaaatctgt

SEQ ID NO: 2101538 - DNA, 18 bp, Homo sapiens
ttgtaaaggtcagagtca

SEQ ID NO: 2101539 - DNA, 19 bp, Homo sapiens
ttgtaaatatttatgtaaa

SEQ ID NO: 2101540 - DNA, 14 bp, Homo sapiens
ttgtaaatgctcgt

SEQ ID NO: 2101541 - DNA, 21 bp, Homo sapiens
ttgtaaatgctcgtgtgattt

SEQ ID NO: 2101542 - DNA, 11 bp, Homo sapiens
ttgtaaatgtg

SEQ ID NO: 2101543 - DNA, 14 bp, Homo sapiens
ttgtaaatgtgctt

SEQ ID NO: 2101544 - DNA, 18 bp, Homo sapiens
ttgtaaatgtgcttttaa

SEQ ID NO: 2101545 - DNA, 22 bp, Homo sapiens
ttgtaaattctggaaatgtctt

SEQ ID NO: 2101546 - DNA, 15 bp, Homo sapiens
ttgtaaatttggatt

SEQ ID NO: 2101547 - DNA, 14 bp, Homo sapiens
ttgtaactccacca

SEQ ID NO: 2101548 - DNA, 13 bp, Homo sapiens
ttgtaacttcaaa

SEQ ID NO: 2101549 - DNA, 14 bp, Homo sapiens
ttgtaacttcaaat

SEQ ID NO: 2101550 - DNA, 14 bp, Homo sapiens
ttgtaagtttatgt

SEQ ID NO: 2101551 - DNA, 13 bp, Homo sapiens
ttgtaataaactc

SEQ ID NO: 2101552 - DNA, 15 bp, Homo sapiens
ttgtaataaactctc

SEQ ID NO: 2101553 - DNA, 16 bp, Homo sapiens
ttgtaataaactctct

SEQ ID NO: 2101554 - DNA, 14 bp, Homo sapiens
ttgtaatgtatctt

SEQ ID NO: 2101555 - DNA, 17 bp, Homo sapiens
ttgtaattctaaatgaa

SEQ ID NO: 2101556 - DNA, 23 bp, Homo sapiens
ttgtaattctaaatgaatgttta

SEQ ID NO: 2101557 - DNA, 12 bp, Homo sapiens
ttgtacaaaata

SEQ ID NO: 2101558 - DNA, 14 bp, Homo sapiens
ttgtacaaatactg

SEQ ID NO: 2101559 - DNA, 14 bp, Homo sapiens
ttgtacaagctcag

SEQ ID NO: 2101560 - DNA, 16 bp, Homo sapiens
ttgtacagaattttta

SEQ ID NO: 2101561 - DNA, 22 bp, Homo sapiens
ttgtacagttaactctcccagg

SEQ ID NO: 2101562 - DNA, 18 bp, Homo sapiens
ttgtacatatgtaaaata

SEQ ID NO: 2101563 - DNA, 16 bp, Homo sapiens
ttgtacatattggaaa

SEQ ID NO: 2101564 - DNA, 20 bp, Homo sapiens
ttgtacatgtgtagcctgtg

SEQ ID NO: 2101565 - DNA, 21 bp, Homo sapiens
ttgtacatgtgtagcctgtgc

SEQ ID NO: 2101566 - DNA, 13 bp, Homo sapiens
ttgtacattcctg

SEQ ID NO: 2101567 - DNA, 11 bp, Homo sapiens
ttgtaccccat

SEQ ID NO: 2101568 - DNA, 15 bp, Homo sapiens
ttgtaccccatccct

SEQ ID NO: 2101569 - DNA, 11 bp, Homo sapiens
ttgtacctctc

SEQ ID NO: 2101570 - DNA, 13 bp, Homo sapiens
ttgtactatgtta

SEQ ID NO: 2101571 - DNA, 19 bp, Homo sapiens
ttgtactcttgctttttca

SEQ ID NO: 2101572 - DNA, 12 bp, Homo sapiens
ttgtagaaacac

SEQ ID NO: 2101573 - DNA, 22 bp, Homo sapiens
ttgtagaaacacagttttgaaa

SEQ ID NO: 2101574 - DNA, 22 bp, Homo sapiens
ttgtagaagtaggaagtgaaaa

SEQ ID NO: 2101575 - DNA, 14 bp, Homo sapiens
ttgtagagccaggg

SEQ ID NO: 2101576 - DNA, 21 bp, Homo sapiens
ttgtagagtggcccagaattg

SEQ ID NO: 2101577 - DNA, 14 bp, Homo sapiens
tttattttgacata

SEQ ID NO: 2101578 - DNA, 18 bp, Homo sapiens
tttattttgtatttttga

SEQ ID NO: 2101579 - DNA, 20 bp, Homo sapiens
tttatttttcatattgtgcc

SEQ ID NO: 2101580 - DNA, 17 bp, Homo sapiens
tttattttttaatcatt

SEQ ID NO: 2101581 - DNA, 14 bp, Homo sapiens
tttcaaagaaggaa

SEQ ID NO: 2101582 - DNA, 17 bp, Homo sapiens
tttcaaagctttttcca

SEQ ID NO: 2101583 - DNA, 14 bp, Homo sapiens
tttcaaatttcaca

SEQ ID NO: 2101584 - DNA, 16 bp, Homo sapiens
tttcaacatatcattt

SEQ ID NO: 2101585 - DNA, 13 bp, Homo sapiens
tttcaactccaga

SEQ ID NO: 2101586 - DNA, 14 bp, Homo sapiens
tttcaactggctgg

SEQ ID NO: 2101587 - DNA, 23 bp, Homo sapiens
tttcaacttaaatcactgaggca

SEQ ID NO: 2101588 - DNA, 13 bp, Homo sapiens
tttcaagaaaact

SEQ ID NO: 2101589 - DNA, 23 bp, Homo sapiens
tttcaagagaagaaaaaattaag

SEQ ID NO: 2101590 - DNA, 24 bp, Homo sapiens
tttcaagagtgcagttgattctga

SEQ ID NO: 2101591 - DNA, 13 bp, Homo sapiens
tttcaatgtgatt

SEQ ID NO: 2101592 - DNA, 14 bp, Homo sapiens
tttcaattatttca

SEQ ID NO: 2101593 - DNA, 15 bp, Homo sapiens
tttcaattatttcaa

SEQ ID NO: 2101594 - DNA, 22 bp, Homo sapiens
tttcaattccacctgcaatcaa

SEQ ID NO: 2101595 - DNA, 17 bp, Homo sapiens
tttcaattgtattttat

SEQ ID NO: 2101596 - DNA, 21 bp, Homo sapiens
tttcaattgtattttatatga

SEQ ID NO: 2101597 - DNA, 23 bp, Homo sapiens
tttcacaacagcctgacaacatt

SEQ ID NO: 2101598 - DNA, 13 bp, Homo sapiens
tttcacagttttt

SEQ ID NO: 2101599 - DNA, 15 bp, Homo sapiens
tttcaccacattcgt

SEQ ID NO: 2101600 - DNA, 17 bp, Homo sapiens
tttcaccagatttgcta

SEQ ID NO: 2101601 - DNA, 18 bp, Homo sapiens
tttcacctggaagcattt

SEQ ID NO: 2101602 - DNA, 22 bp, Homo sapiens
tttcacctgtttttaagctgtt

SEQ ID NO: 2101603 - DNA, 18 bp, Homo sapiens
tttcactatgattttcta

SEQ ID NO: 2101604 - DNA, 24 bp, Homo sapiens
tttcactgctggctgccttagaac

SEQ ID NO: 2101605 - DNA, 13 bp, Homo sapiens
tttcactttagct

SEQ ID NO: 2101606 - DNA, 16 bp, Homo sapiens
tttcagaaatatgtgg

SEQ ID NO: 2101607 - DNA, 15 bp, Homo sapiens
tttcagaattttgta

SEQ ID NO: 2101608 - DNA, 14 bp, Homo sapiens
tttcagaccccagc

SEQ ID NO: 2101609 - DNA, 23 bp, Homo sapiens
tttcagagtgacacccaagaggg

SEQ ID NO: 2101610 - DNA, 16 bp, Homo sapiens
tttcagcactcagaaa

SEQ ID NO: 2101611 - DNA, 11 bp, Homo sapiens
tttcagctctc

SEQ ID NO: 2101612 - DNA, 21 bp, Homo sapiens
tttcagctctctgtataaaca

SEQ ID NO: 2101613 - DNA, 21 bp, Homo sapiens
tttcagctgtgaacatggact

SEQ ID NO: 2101614 - DNA, 22 bp, Homo sapiens
tttcaggagagagttgaaccta

SEQ ID NO: 2101615 - DNA, 22 bp, Homo sapiens
tttcaggagggtccccagctgg

SEQ ID NO: 2101616 - DNA, 13 bp, Homo sapiens
tttcaggatactc

SEQ ID NO: 2101617 - DNA, 17 bp, Homo sapiens
tttcaggcattttgttc

SEQ ID NO: 2101618 - DNA, 23 bp, Homo sapiens
tttcagggggcctttaaagactt

SEQ ID NO: 2101619 - DNA, 21 bp, Homo sapiens
tttcagtattttggagaaatt

SEQ ID NO: 2101620 - DNA, 15 bp, Homo sapiens
tttcagttacttacc

SEQ ID NO: 2101621 - DNA, 14 bp, Homo sapiens
tttcagtttgttta

SEQ ID NO: 2101622 - DNA, 17 bp, Homo sapiens
tttcagtttgtttactt

SEQ ID NO: 2101623 - DNA, 14 bp, Homo sapiens
tttcatattgtgcc

SEQ ID NO: 2101624 - DNA, 21 bp, Homo sapiens
tttcatccagtttgttctccg

SEQ ID NO: 2101625 - DNA, 22 bp, Homo sapiens
tttcatccagtttgttctccgg

SEQ ID NO: 2101626 - DNA, 13 bp, Homo sapiens
tttcatctatttc

SEQ ID NO: 2101627 - DNA, 16 bp, Homo sapiens
tttcatctatttctga

SEQ ID NO: 2101628 - DNA, 21 bp, Homo sapiens
tttcatctgctgctgaaactg

SEQ ID NO: 2101629 - DNA, 20 bp, Homo sapiens
tttcatgtagattttagttc

SEQ ID NO: 2101630 - DNA, 17 bp, Homo sapiens
tttcatgttttgtgact

SEQ ID NO: 2101631 - DNA, 14 bp, Homo sapiens
tttcattaaagcat

SEQ ID NO: 2101632 - DNA, 16 bp, Homo sapiens
tttcattacaatggaa

SEQ ID NO: 2101633 - DNA, 21 bp, Homo sapiens
tttcattacaatggaaacaat

SEQ ID NO: 2101634 - DNA, 22 bp, Homo sapiens
tttcattgactatcaaactgaa

SEQ ID NO: 2101635 - DNA, 16 bp, Homo sapiens
tttcattgagggaaaa

SEQ ID NO: 2101636 - DNA, 23 bp, Homo sapiens
tttcattgagggaaaacataata

SEQ ID NO: 2101637 - DNA, 23 bp, Homo sapiens
tttcattgtatgatgtgttgtga

SEQ ID NO: 2101638 - DNA, 18 bp, Homo sapiens
tttccaaaataaaatgaa

SEQ ID NO: 2101639 - DNA, 15 bp, Homo sapiens
tttccaaataaaatg

SEQ ID NO: 2101640 - DNA, 14 bp, Homo sapiens
tttccaagtaatat

SEQ ID NO: 2101641 - DNA, 21 bp, Homo sapiens
tttccaagtaatataatggaa

SEQ ID NO: 2101642 - DNA, 19 bp, Homo sapiens
tttccaagttcctgcactc

SEQ ID NO: 2101643 - DNA, 21 bp, Homo sapiens
tttccaagttcctgcactcca

SEQ ID NO: 2101644 - DNA, 23 bp, Homo sapiens
tttccaagttcctgcactccaga

SEQ ID NO: 2101645 - DNA, 20 bp, Homo sapiens
tttccacagttgctgctcct

SEQ ID NO: 2101646 - DNA, 15 bp, Homo sapiens
tttccactgccaaaa

SEQ ID NO: 2101647 - DNA, 14 bp, Homo sapiens
tttccagaaaatat

SEQ ID NO: 2101648 - DNA, 16 bp, Homo sapiens
tttccagaaaatataa

SEQ ID NO: 2101649 - DNA, 19 bp, Homo sapiens
tttccagaaaatataaatg

SEQ ID NO: 2101650 - DNA, 21 bp, Homo sapiens
tttccagaaaatataaatgca

SEQ ID NO: 2101651 - DNA, 19 bp, Homo sapiens
tttccagtgagcttatcat

SEQ ID NO: 2101652 - DNA, 16 bp, Homo sapiens
tttccagttaaggacc

SEQ ID NO: 2101653 - DNA, 15 bp, Homo sapiens
tttccataaggaatg

SEQ ID NO: 2101654 - DNA, 17 bp, Homo sapiens
tttccatgaaaatgcaa

SEQ ID NO: 2101655 - DNA, 22 bp, Homo sapiens
tttccattcatgccaaagcaaa

SEQ ID NO: 2101656 - DNA, 18 bp, Homo sapiens
tttccatttcttcctcac

SEQ ID NO: 2101657 - DNA, 14 bp, Homo sapiens
tttcccaggaatat

SEQ ID NO: 2101658 - DNA, 18 bp, Homo sapiens
tttcccatgctgaattat

SEQ ID NO: 2101659 - DNA, 21 bp, Homo sapiens
tttccccaggggaaaatgaag

SEQ ID NO: 2101660 - DNA, 19 bp, Homo sapiens
tttcccccaccccagagtt

SEQ ID NO: 2101661 - DNA, 16 bp, Homo sapiens
tttcccctcagagctc

SEQ ID NO: 2101662 - DNA, 22 bp, Homo sapiens
tttccctcccaacagagctggg

SEQ ID NO: 2101663 - DNA, 12 bp, Homo sapiens
tttccctcccca

SEQ ID NO: 2101664 - DNA, 18 bp, Homo sapiens
tttccctggaatttaatt

SEQ ID NO: 2101665 - DNA, 13 bp, Homo sapiens
tttccctgtgctg

SEQ ID NO: 2101666 - DNA, 22 bp, Homo sapiens
tttccgctgtcgccccaggccc

SEQ ID NO: 2101667 - DNA, 22 bp, Homo sapiens
tttccgtaaaaatgatttcagt

SEQ ID NO: 2101668 - DNA, 15 bp, Homo sapiens
tttccgtctccctaa

SEQ ID NO: 2101669 - DNA, 17 bp, Homo sapiens
tttcctaaatgcagtga

SEQ ID NO: 2101670 - DNA, 24 bp, Homo sapiens
tttcctactctcaggatcaagaaa

SEQ ID NO: 2101671 - DNA, 17 bp, Homo sapiens
tttcctatctgtatgtc

SEQ ID NO: 2101672 - DNA, 14 bp, Homo sapiens
tttcctattttaaa

SEQ ID NO: 2101673 - DNA, 20 bp, Homo sapiens
tttcctcaatggacttcaaa

SEQ ID NO: 2101674 - DNA, 19 bp, Homo sapiens
tttcctccccaccttcccc

SEQ ID NO: 2101675 - DNA, 22 bp, Homo sapiens
tttcctccgtcacctcagagac

SEQ ID NO: 2101676 - DNA, 19 bp, Homo sapiens
tttcctcgcctaggcctgt

SEQ ID NO: 2101677 - DNA, 21 bp, Homo sapiens
tttcctcttctattttgtaaa

SEQ ID NO: 2101678 - DNA, 20 bp, Homo sapiens
tttcctgagaccacagagag

SEQ ID NO: 2101679 - DNA, 15 bp, Homo sapiens
tttccttgaaaaaaa

SEQ ID NO: 2101680 - DNA, 18 bp, Homo sapiens
tttccttttcttccttct

SEQ ID NO: 2101681 - DNA, 16 bp, Homo sapiens
tttccttttttgttat

SEQ ID NO: 2101682 - DNA, 12 bp, Homo sapiens
tttcgcttgctt

SEQ ID NO: 2101683 - DNA, 15 bp, Homo sapiens
tttcgctttcctctg

SEQ ID NO: 2101684 - DNA, 18 bp, Homo sapiens
tttcggacagtttatttg

SEQ ID NO: 2101685 - DNA, 13 bp, Homo sapiens
tttctaaaactat

SEQ ID NO: 2101686 - DNA, 15 bp, Homo sapiens
tttctaaaagaatat

SEQ ID NO: 2101687 - DNA, 20 bp, Homo sapiens
tttctaaaagaatattcaga

SEQ ID NO: 2101688 - DNA, 15 bp, Homo sapiens
tttctaaatctgaga

SEQ ID NO: 2101689 - DNA, 22 bp, Homo sapiens
tttctaacagtatttgtacaaa

SEQ ID NO: 2101690 - DNA, 16 bp, Homo sapiens
tttctaacatatgtat

SEQ ID NO: 2101691 - DNA, 22 bp, Homo sapiens
ttttgcattgtgtgagcttcta

SEQ ID NO: 2101692 - DNA, 15 bp, Homo sapiens
ttttgcatttagttt

SEQ ID NO: 2101693 - DNA, 15 bp, Homo sapiens
ttttgcctcttttct

SEQ ID NO: 2101694 - DNA, 15 bp, Homo sapiens
ttttgcctttaaatt

SEQ ID NO: 2101695 - DNA, 21 bp, Homo sapiens
ttttgcggttcaggaaaattg

SEQ ID NO: 2101696 - DNA, 17 bp, Homo sapiens
ttttgctgtctttctct

SEQ ID NO: 2101697 - DNA, 18 bp, Homo sapiens
ttttgctgtttcctttta

SEQ ID NO: 2101698 - DNA, 23 bp, Homo sapiens
ttttggggggcccccctccttgc

SEQ ID NO: 2101699 - DNA, 19 bp, Homo sapiens
ttttgggggtttttaatct

SEQ ID NO: 2101700 - DNA, 22 bp, Homo sapiens
ttttggttgtcaatattaaata

SEQ ID NO: 2101701 - DNA, 12 bp, Homo sapiens
ttttgtaaataa

SEQ ID NO: 2101702 - DNA, 19 bp, Homo sapiens
ttttgtaagttgaagcaaa

SEQ ID NO: 2101703 - DNA, 16 bp, Homo sapiens
ttttgtaataaaaggt

SEQ ID NO: 2101704 - DNA, 13 bp, Homo sapiens
ttttgtaataaac

SEQ ID NO: 2101705 - DNA, 20 bp, Homo sapiens
ttttgtacagaatttttaat

SEQ ID NO: 2101706 - DNA, 23 bp, Homo sapiens
ttttgtaggggtcaaagaaatgc

SEQ ID NO: 2101707 - DNA, 16 bp, Homo sapiens
ttttgtatagtaaagt

SEQ ID NO: 2101708 - DNA, 22 bp, Homo sapiens
ttttgtcctttgagaaagaaat

SEQ ID NO: 2101709 - DNA, 13 bp, Homo sapiens
ttttgtgtttcta

SEQ ID NO: 2101710 - DNA, 15 bp, Homo sapiens
ttttgtgtttctaaa

SEQ ID NO: 2101711 - DNA, 12 bp, Homo sapiens
ttttgttataga

SEQ ID NO: 2101712 - DNA, 15 bp, Homo sapiens
ttttgttctacatga

SEQ ID NO: 2101713 - DNA, 16 bp, Homo sapiens
ttttgtttgtaatcct

SEQ ID NO: 2101714 - DNA, 15 bp, Homo sapiens
ttttgttttcattat

SEQ ID NO: 2101715 - DNA, 22 bp, Homo sapiens
tttttaaaaaagcttaaaactt

SEQ ID NO: 2101716 - DNA, 18 bp, Homo sapiens
tttttaaaaagtactctt

SEQ ID NO: 2101717 - DNA, 19 bp, Homo sapiens
tttttaaaaagttgcacat

SEQ ID NO: 2101718 - DNA, 11 bp, Homo sapiens
tttttaaaagt

SEQ ID NO: 2101719 - DNA, 22 bp, Homo sapiens
tttttaaaagtttcaatgtgat

SEQ ID NO: 2101720 - DNA, 12 bp, Homo sapiens
tttttaaagtct

SEQ ID NO: 2101721 - DNA, 23 bp, Homo sapiens
tttttaagctgtaaaaagagaga

SEQ ID NO: 2101722 - DNA, 16 bp, Homo sapiens
tttttaataatttcat

SEQ ID NO: 2101723 - DNA, 18 bp, Homo sapiens
tttttaatgtatagtaaa

SEQ ID NO: 2101724 - DNA, 12 bp, Homo sapiens
tttttaattatt

SEQ ID NO: 2101725 - DNA, 12 bp, Homo sapiens
tttttacaaaat

SEQ ID NO: 2101726 - DNA, 22 bp, Homo sapiens
tttttacctaccacagtgtctg

SEQ ID NO: 2101727 - DNA, 12 bp, Homo sapiens
tttttactaaag

SEQ ID NO: 2101728 - DNA, 20 bp, Homo sapiens
tttttaggaagcaagcttaa

SEQ ID NO: 2101729 - DNA, 22 bp, Homo sapiens
tttttataatgtggatttccta

SEQ ID NO: 2101730 - DNA, 12 bp, Homo sapiens
tttttatacata

SEQ ID NO: 2101731 - DNA, 22 bp, Homo sapiens
tttttatacatatcagaaaagt

SEQ ID NO: 2101732 - DNA, 13 bp, Homo sapiens
tttttcaaaaatt

SEQ ID NO: 2101733 - DNA, 14 bp, Homo sapiens
tttttcaaccagca

SEQ ID NO: 2101734 - DNA, 22 bp, Homo sapiens
tttttcaaccagcattttacta

SEQ ID NO: 2101735 - DNA, 15 bp, Homo sapiens
tttttcataaactga

SEQ ID NO: 2101736 - DNA, 13 bp, Homo sapiens
tttttcatattgt

SEQ ID NO: 2101737 - DNA, 16 bp, Homo sapiens
tttttcatgataatga

SEQ ID NO: 2101738 - DNA, 15 bp, Homo sapiens
tttttccccaaagtc

SEQ ID NO: 2101739 - DNA, 15 bp, Homo sapiens
tttttccgtaaaaat

SEQ ID NO: 2101740 - DNA, 18 bp, Homo sapiens
tttttccttcaaagttta

SEQ ID NO: 2101741 - DNA, 11 bp, Homo sapiens
tttttcctttt

SEQ ID NO: 2101742 - DNA, 16 bp, Homo sapiens
tttttctgattcaaaa

SEQ ID NO: 2101743 - DNA, 13 bp, Homo sapiens
tttttcttatcca

SEQ ID NO: 2101744 - DNA, 23 bp, Homo sapiens
tttttgaaaaagcgaaaaaatca

SEQ ID NO: 2101745 - DNA, 16 bp, Homo sapiens
tttttgagacagggtc

SEQ ID NO: 2101746 - DNA, 15 bp, Homo sapiens
tttttgatactaagc

SEQ ID NO: 2101747 - DNA, 16 bp, Homo sapiens
tttttgcattattcat

SEQ ID NO: 2101748 - DNA, 22 bp, Homo sapiens
tttttggaagaggactccttaa

SEQ ID NO: 2101749 - DNA, 13 bp, Homo sapiens
tttttgtaaactg

SEQ ID NO: 2101750 - DNA, 14 bp, Homo sapiens
tttttgtaaactgt

SEQ ID NO: 2101751 - DNA, 20 bp, Homo sapiens
tttttgtagagccagggtct

SEQ ID NO: 2101752 - DNA, 22 bp, Homo sapiens
tttttgtccctgctcctcccaa

SEQ ID NO: 2101753 - DNA, 15 bp, Homo sapiens
tttttgtgtatttgt

SEQ ID NO: 2101754 - DNA, 9 bp, Homo sapiens
ttttttgag

SEQ ID NO: 2101755 - DNA, 12 bp, Homo sapiens
tttttttgagat

SEQ ID NO: 2101756 - DNA, 13 bp, Homo sapiens
tttttttgtaaac

SEQ ID NO: 2101757 - DNA, 14 bp, Homo sapiens
tttttttgtaactt

SEQ ID NO: 2101758 - DNA, 17 bp, Homo sapiens
ggaaggcaggcagggct

SEQ ID NO: 2101759 - DNA, 16 bp, Homo sapiens
ggaaggcagggacaga

SEQ ID NO: 2101760 - DNA, 13 bp, Homo sapiens
ggaaggcagggca

SEQ ID NO: 2101761 - DNA, 14 bp, Homo sapiens
ggaaggcagggcag

SEQ ID NO: 2101762 - DNA, 20 bp, Homo sapiens
ggaaggcagggcagagggaa

SEQ ID NO: 2101763 - DNA, 19 bp, Homo sapiens
ggaaggctactggcattaa

SEQ ID NO: 2101764 - DNA, 15 bp, Homo sapiens
ggaaggctgctgtgt

SEQ ID NO: 2101765 - DNA, 18 bp, Homo sapiens
ggaaggctgctgtgtagc

SEQ ID NO: 2101766 - DNA, 13 bp, Homo sapiens
ggaaggctggctg

SEQ ID NO: 2101767 - DNA, 14 bp, Homo sapiens
ggaaggctggctgg

SEQ ID NO: 2101768 - DNA, 17 bp, Homo sapiens
ggaaggctggctgggca

SEQ ID NO: 2101769 - DNA, 17 bp, Homo sapiens
ggaagggcatccttctg

SEQ ID NO: 2101770 - DNA, 14 bp, Homo sapiens
ggaagggccaggag

SEQ ID NO: 2101771 - DNA, 17 bp, Homo sapiens
ggaagggccaggagaga

SEQ ID NO: 2101772 - DNA, 20 bp, Homo sapiens
ggaagggccaggagagagat

SEQ ID NO: 2101773 - DNA, 16 bp, Homo sapiens
ggaagggggtccaccc

SEQ ID NO: 2101774 - DNA, 18 bp, Homo sapiens
ggaagggttggtgggctg

SEQ ID NO: 2101775 - DNA, 16 bp, Homo sapiens
ggaaggtgctgagctt

SEQ ID NO: 2101776 - DNA, 19 bp, Homo sapiens
ggaaggtttggtgtgtgga

SEQ ID NO: 2101777 - DNA, 22 bp, Homo sapiens
ggaagtcgtccttactcctgtg

SEQ ID NO: 2101778 - DNA, 23 bp, Homo sapiens
ggaagtcgtccttactcctgtgg

SEQ ID NO: 2101779 - DNA, 20 bp, Homo sapiens
ggaagtcgtttcaggacatg

SEQ ID NO: 2101780 - DNA, 14 bp, Homo sapiens
ggaagtctaggagc

SEQ ID NO: 2101781 - DNA, 15 bp, Homo sapiens
ggaagtgagaaacca

SEQ ID NO: 2101782 - DNA, 15 bp, Homo sapiens
ggaagtgctccccac

SEQ ID NO: 2101783 - DNA, 19 bp, Homo sapiens
ggaagtgctccccacacgt

SEQ ID NO: 2101784 - DNA, 18 bp, Homo sapiens
ggaagtggcagtgaaaaa

SEQ ID NO: 2101785 - DNA, 16 bp, Homo sapiens
ggaagtgggggccgct

SEQ ID NO: 2101786 - DNA, 17 bp, Homo sapiens
ggaagtgggggccgctg

SEQ ID NO: 2101787 - DNA, 18 bp, Homo sapiens
ggaagtgggggccgctgg

SEQ ID NO: 2101788 - DNA, 20 bp, Homo sapiens
ggaagtgggggccgctggcc

SEQ ID NO: 2101789 - DNA, 22 bp, Homo sapiens
ggaagtgggggccgctggccca

SEQ ID NO: 2101790 - DNA, 23 bp, Homo sapiens
ggaagttattaacgggcatgtat

SEQ ID NO: 2101791 - DNA, 18 bp, Homo sapiens
ggaagtttcatatattgt

SEQ ID NO: 2101792 - DNA, 21 bp, Homo sapiens
ggaagttttgtggaggagctc

SEQ ID NO: 2101793 - DNA, 21 bp, Homo sapiens
ggaataagaagcaaataaata

SEQ ID NO: 2101794 - DNA, 18 bp, Homo sapiens
ggaataagctcccagggc

SEQ ID NO: 2101795 - DNA, 15 bp, Homo sapiens
ggaataatagaagaa

SEQ ID NO: 2101796 - DNA, 21 bp, Homo sapiens
ggaataattatttatttaata

SEQ ID NO: 2101797 - DNA, 18 bp, Homo sapiens
ggaatagaaaagatgaga

SEQ ID NO: 2101798 - DNA, 22 bp, Homo sapiens
ggaatagaaaagatgagaggca

SEQ ID NO: 2101799 - DNA, 15 bp, Homo sapiens
ggaatagccagagag

SEQ ID NO: 2101800 - DNA, 16 bp, Homo sapiens
ggaatagccagagagg

SEQ ID NO: 2101801 - DNA, 20 bp, Homo sapiens
ggaatagccagagaggagca

SEQ ID NO: 2101802 - DNA, 16 bp, Homo sapiens
ggaatatgactgtttt

SEQ ID NO: 2101803 - DNA, 22 bp, Homo sapiens
ggaatatgttcaatgcaaagta

SEQ ID NO: 2101804 - DNA, 16 bp, Homo sapiens
ggaatcacctggaggg

SEQ ID NO: 2101805 - DNA, 17 bp, Homo sapiens
ggaatcacctggagggc

SEQ ID NO: 2101806 - DNA, 21 bp, Homo sapiens
ggaatcacctggagggcttgg

SEQ ID NO: 2101807 - DNA, 21 bp, Homo sapiens
ggaatcagacttcacactgca

SEQ ID NO: 2101808 - DNA, 17 bp, Homo sapiens
ggaatcagcttttaata

SEQ ID NO: 2101809 - DNA, 20 bp, Homo sapiens
ggaatcgatctgtactgtaa

SEQ ID NO: 2101810 - DNA, 17 bp, Homo sapiens
ggaatgaagcatgtagc

SEQ ID NO: 2101811 - DNA, 18 bp, Homo sapiens
ggcccctgccaccctggg

SEQ ID NO: 2101812 - DNA, 13 bp, Homo sapiens
ggcccctgcccgg

SEQ ID NO: 2101813 - DNA, 20 bp, Homo sapiens
ggcccctgcccggctgcgga

SEQ ID NO: 2101814 - DNA, 23 bp, Homo sapiens
ggcccctgctggttcagggttgg

SEQ ID NO: 2101815 - DNA, 18 bp, Homo sapiens
ggcccctgtgtgagttga

SEQ ID NO: 2101816 - DNA, 19 bp, Homo sapiens
ggccccttggcgggcagcc

SEQ ID NO: 2101817 - DNA, 21 bp, Homo sapiens
ggccccttggcgggcagccca

SEQ ID NO: 2101818 - DNA, 14 bp, Homo sapiens
ggcccgaaagctga

SEQ ID NO: 2101819 - DNA, 14 bp, Homo sapiens
ggcccgagcagctg

SEQ ID NO: 2101820 - DNA, 15 bp, Homo sapiens
ggcccgagcagctga

SEQ ID NO: 2101821 - DNA, 16 bp, Homo sapiens
ggcccgagcagctgag

SEQ ID NO: 2101822 - DNA, 23 bp, Homo sapiens
ggcccgagcagctgagcagggcc

SEQ ID NO: 2101823 - DNA, 17 bp, Homo sapiens
ggcccgctttgcctgct

SEQ ID NO: 2101824 - DNA, 21 bp, Homo sapiens
ggcccggagtaatcaggcagc

SEQ ID NO: 2101825 - DNA, 22 bp, Homo sapiens
ggcccggagtaatcaggcagcc

SEQ ID NO: 2101826 - DNA, 19 bp, Homo sapiens
ggcccggggctggcggcta

SEQ ID NO: 2101827 - DNA, 21 bp, Homo sapiens
ggcccggggggaccaggatga

SEQ ID NO: 2101828 - DNA, 15 bp, Homo sapiens
ggcccgtcatgttcc

SEQ ID NO: 2101829 - DNA, 15 bp, Homo sapiens
ggccctaccagaggg

SEQ ID NO: 2101830 - DNA, 15 bp, Homo sapiens
ggccctctatttctc

SEQ ID NO: 2101831 - DNA, 14 bp, Homo sapiens
ggccctgagctcgg

SEQ ID NO: 2101832 - DNA, 21 bp, Homo sapiens
ggccctgagctcggtggaccc

SEQ ID NO: 2101833 - DNA, 17 bp, Homo sapiens
ggccctgcaaaaatata

SEQ ID NO: 2101834 - DNA, 19 bp, Homo sapiens
ggccctgccccatcctggg

SEQ ID NO: 2101835 - DNA, 23 bp, Homo sapiens
ggccctgccccatcctgggcctt

SEQ ID NO: 2101836 - DNA, 10 bp, Homo sapiens
ggccctgcct

SEQ ID NO: 2101837 - DNA, 17 bp, Homo sapiens
ggccctggatcagcgtg

SEQ ID NO: 2101838 - DNA, 17 bp, Homo sapiens
ggcgaatctacagaaca

SEQ ID NO: 2101839 - DNA, 15 bp, Homo sapiens
ggcgacccctcagtg

SEQ ID NO: 2101840 - DNA, 12 bp, Homo sapiens
ggcgacttcctc

SEQ ID NO: 2101841 - DNA, 17 bp, Homo sapiens
ggcgatcaagtccagag

SEQ ID NO: 2101842 - DNA, 18 bp, Homo sapiens
ggcgcagcccgaagccca

SEQ ID NO: 2101843 - DNA, 20 bp, Homo sapiens
ggcgcagcccgaagcccagt

SEQ ID NO: 2101844 - DNA, 15 bp, Homo sapiens
ggcgccaccatcctg

SEQ ID NO: 2101845 - DNA, 21 bp, Homo sapiens
ggcgcccattcgtctgtccca

SEQ ID NO: 2101846 - DNA, 19 bp, Homo sapiens
ggcgccccaacccgtggag

SEQ ID NO: 2101847 - DNA, 22 bp, Homo sapiens
ggcgcgcacctgtaatcccagc

SEQ ID NO: 2101848 - DNA, 17 bp, Homo sapiens
ggcgcgtctgccccacc

SEQ ID NO: 2101849 - DNA, 19 bp, Homo sapiens
ggcgctcaggacccaggcc

SEQ ID NO: 2101850 - DNA, 20 bp, Homo sapiens
ggcgctctgccctccctggc

SEQ ID NO: 2101851 - DNA, 23 bp, Homo sapiens
ggcgctctgccctccctggcctc

SEQ ID NO: 2101852 - DNA, 15 bp, Homo sapiens
ggcgctgtggctcct

SEQ ID NO: 2101853 - DNA, 14 bp, Homo sapiens
ggcggaaaccttgc

SEQ ID NO: 2101854 - DNA, 20 bp, Homo sapiens
ggcggagagtacagtgagcc

SEQ ID NO: 2101855 - DNA, 20 bp, Homo sapiens
ggcggaggttccagtgagcc

SEQ ID NO: 2101856 - DNA, 21 bp, Homo sapiens
ggcggaggttccagtgagccg

SEQ ID NO: 2101857 - DNA, 17 bp, Homo sapiens
ggcggccatgatggtgc

SEQ ID NO: 2101858 - DNA, 14 bp, Homo sapiens
ggcggctccaggtc

SEQ ID NO: 2101859 - DNA, 18 bp, Homo sapiens
ggcggcttcctgtccact

SEQ ID NO: 2101860 - DNA, 15 bp, Homo sapiens
ggcgggagtgggggc

SEQ ID NO: 2101861 - DNA, 17 bp, Homo sapiens
ggcgggagtgggggctg

SEQ ID NO: 2101862 - DNA, 22 bp, Homo sapiens
ggcgggcacctatagtcccagc

SEQ ID NO: 2101863 - DNA, 15 bp, Homo sapiens
ggcggggcaggaggc

SEQ ID NO: 2101864 - DNA, 17 bp, Homo sapiens
ggcggggcaggaggcct

SEQ ID NO: 2101865 - DNA, 18 bp, Homo sapiens
ggcgtaatgggcctgccc

SEQ ID NO: 2101866 - DNA, 20 bp, Homo sapiens
ggcgtcgctggacaacccag

SEQ ID NO: 2101867 - DNA, 22 bp, Homo sapiens
ggcgtcgctggacaacccagaa

SEQ ID NO: 2101868 - DNA, 15 bp, Homo sapiens
ggcgtgactcaccca

SEQ ID NO: 2101869 - DNA, 16 bp, Homo sapiens
ggcgtggcaaatataa

SEQ ID NO: 2101870 - DNA, 14 bp, Homo sapiens
ggctaactggaagc

SEQ ID NO: 2101871 - DNA, 12 bp, Homo sapiens
ggctaccctccc

SEQ ID NO: 2101872 - DNA, 16 bp, Homo sapiens
ggctactcagcagccc

SEQ ID NO: 2101873 - DNA, 17 bp, Homo sapiens
ggctactcagcagccct

SEQ ID NO: 2101874 - DNA, 20 bp, Homo sapiens
ggctactctgtgccagagcc

SEQ ID NO: 2101875 - DNA, 21 bp, Homo sapiens
ggctactctgtgccagagcct

SEQ ID NO: 2101876 - DNA, 15 bp, Homo sapiens
ggctactggcagctc

SEQ ID NO: 2101877 - DNA, 16 bp, Homo sapiens
ggctactggcagctcc

SEQ ID NO: 2101878 - DNA, 23 bp, Homo sapiens
ggctacttcggggctgggaagtc

SEQ ID NO: 2101879 - DNA, 22 bp, Homo sapiens
ggctagaacctgtagagctaga

SEQ ID NO: 2101880 - DNA, 13 bp, Homo sapiens
ggctaggtacaca

SEQ ID NO: 2101881 - DNA, 20 bp, Homo sapiens
ggctagtgtgagtggcagcc

SEQ ID NO: 2101882 - DNA, 23 bp, Homo sapiens
ggctagtgtgagtggcagccatg

SEQ ID NO: 2101883 - DNA, 24 bp, Homo sapiens
ggctagtgtgagtggcagccatgc

SEQ ID NO: 2101884 - DNA, 18 bp, Homo sapiens
ggctagttctaattccct

SEQ ID NO: 2101885 - DNA, 18 bp, Homo sapiens
ggctatggcaagggggtg

SEQ ID NO: 2101886 - DNA, 14 bp, Homo sapiens
ggctcaagaggccc

SEQ ID NO: 2101887 - DNA, 20 bp, Homo sapiens
ggctcaagaggcccagggag

SEQ ID NO: 2101888 - DNA, 22 bp, Homo sapiens
ggctcacgcctgtaatcccagc

SEQ ID NO: 2101889 - DNA, 12 bp, Homo sapiens
ggctcagcctgg

SEQ ID NO: 2101890 - DNA, 19 bp, Homo sapiens
ggctcagcggggacagctc

SEQ ID NO: 2101891 - DNA, 20 bp, Homo sapiens
ggctcagcggggacagctcc

SEQ ID NO: 2101892 - DNA, 22 bp, Homo sapiens
ggctcaggaagaaaccccaagc

SEQ ID NO: 2101893 - DNA, 23 bp, Homo sapiens
ggctcaggaagaaaccccaagca

SEQ ID NO: 2101894 - DNA, 20 bp, Homo sapiens
ggctcaggcaagcccctcag

SEQ ID NO: 2101895 - DNA, 12 bp, Homo sapiens
ggctcaggcaga

SEQ ID NO: 2101896 - DNA, 14 bp, Homo sapiens
ggctcagtctcagg

SEQ ID NO: 2101897 - DNA, 15 bp, Homo sapiens
ggctcagtctcagga

SEQ ID NO: 2101898 - DNA, 17 bp, Homo sapiens
ggctcagtctcaggagc

SEQ ID NO: 2101899 - DNA, 21 bp, Homo sapiens
ggctcatggcgtaatgggcct

SEQ ID NO: 2101900 - DNA, 11 bp, Homo sapiens
ggctccaggct

SEQ ID NO: 2101901 - DNA, 13 bp, Homo sapiens
ggctccaggctcc

SEQ ID NO: 2101902 - DNA, 18 bp, Homo sapiens
ggctccagtttccccatg

SEQ ID NO: 2101903 - DNA, 23 bp, Homo sapiens
ggctccatggggaagtgctcccc

SEQ ID NO: 2101904 - DNA, 20 bp, Homo sapiens
ggctcccacaggcccttcct

SEQ ID NO: 2101905 - DNA, 22 bp, Homo sapiens
ggctccccacgagtcacctgca

SEQ ID NO: 2101906 - DNA, 23 bp, Homo sapiens
ggctccccacgagtcacctgcaa

SEQ ID NO: 2101907 - DNA, 23 bp, Homo sapiens
ggctccccctgcttctcagcccc

SEQ ID NO: 2101908 - DNA, 21 bp, Homo sapiens
ggctccccgggggcagacacc

SEQ ID NO: 2101909 - DNA, 17 bp, Homo sapiens
ggctcctcccggtgccc

SEQ ID NO: 2101910 - DNA, 12 bp, Homo sapiens
ggctcctggctg

SEQ ID NO: 2101911 - DNA, 14 bp, Homo sapiens
ggctcctggctgcc

SEQ ID NO: 2101912 - DNA, 15 bp, Homo sapiens
ggctcctggctgcca

SEQ ID NO: 2101913 - DNA, 11 bp, Homo sapiens
ggctcctgtcc

SEQ ID NO: 2101914 - DNA, 12 bp, Homo sapiens
ggctcctgtgct

SEQ ID NO: 2101915 - DNA, 20 bp, Homo sapiens
ggctcctgtgctactttgcc

SEQ ID NO: 2101916 - DNA, 14 bp, Homo sapiens
ggctcgccccaccc

SEQ ID NO: 2101917 - DNA, 18 bp, Homo sapiens
ggctcgccccacccaggg

SEQ ID NO: 2101918 - DNA, 20 bp, Homo sapiens
ggctcgccccacccagggct

SEQ ID NO: 2101919 - DNA, 18 bp, Homo sapiens
ggctcgggcgctgtggct

SEQ ID NO: 2101920 - DNA, 14 bp, Homo sapiens
ggctcgtggccttc

SEQ ID NO: 2101921 - DNA, 15 bp, Homo sapiens
ggctctaacgcctga

SEQ ID NO: 2101922 - DNA, 22 bp, Homo sapiens
ggctctaacgcctgagcccagg

SEQ ID NO: 2101923 - DNA, 22 bp, Homo sapiens
ggctctccaaaggggctgctgg

SEQ ID NO: 2101924 - DNA, 12 bp, Homo sapiens
ggctctccacct

SEQ ID NO: 2101925 - DNA, 13 bp, Homo sapiens
ggctctccacctc

SEQ ID NO: 2101926 - DNA, 13 bp, Homo sapiens
ggctctccagtta

SEQ ID NO: 2101927 - DNA, 20 bp, Homo sapiens
ggctctcctcagaagaaaga

SEQ ID NO: 2101928 - DNA, 12 bp, Homo sapiens
ggctctcctgag

SEQ ID NO: 2101929 - DNA, 14 bp, Homo sapiens
ggctctgaaagcca

SEQ ID NO: 2101930 - DNA, 12 bp, Homo sapiens
ggctctgcccca

SEQ ID NO: 2101931 - DNA, 16 bp, Homo sapiens
ggctctgccccagagg

SEQ ID NO: 2101932 - DNA, 14 bp, Homo sapiens
ggctctgccccagc

SEQ ID NO: 2101933 - DNA, 23 bp, Homo sapiens
ggctctgccccagctctggcttc

SEQ ID NO: 2101934 - DNA, 15 bp, Homo sapiens
ggctctggccaccct

SEQ ID NO: 2101935 - DNA, 22 bp, Homo sapiens
ggctctgggaaggggtgccctc

SEQ ID NO: 2101936 - DNA, 12 bp, Homo sapiens
ggctctgggctc

SEQ ID NO: 2101937 - DNA, 20 bp, Homo sapiens
ggctctgggctcagggctgg

SEQ ID NO: 2101938 - DNA, 15 bp, Homo sapiens
ggctcttcctggacc

SEQ ID NO: 2101939 - DNA, 12 bp, Homo sapiens
ggctcttctcct

SEQ ID NO: 2101940 - DNA, 21 bp, Homo sapiens
ggctcttctccttggaggaca

SEQ ID NO: 2101941 - DNA, 23 bp, Homo sapiens
ggctcttctccttggaggacagt

SEQ ID NO: 2101942 - DNA, 19 bp, Homo sapiens
ggctgaaataaaagcctct

SEQ ID NO: 2101943 - DNA, 20 bp, Homo sapiens
ggctgaaataaaagcctctg

SEQ ID NO: 2101944 - DNA, 17 bp, Homo sapiens
ggctgaacggggagaaa

SEQ ID NO: 2101945 - DNA, 20 bp, Homo sapiens
ggctgaacggggagaaaagg

SEQ ID NO: 2101946 - DNA, 21 bp, Homo sapiens
ggctgaatccgtggtggcacc

SEQ ID NO: 2101947 - DNA, 23 bp, Homo sapiens
ggctgacacctaccatgctgctt

SEQ ID NO: 2101948 - DNA, 18 bp, Homo sapiens
ggctgacccagtccctgg

SEQ ID NO: 2101949 - DNA, 17 bp, Homo sapiens
ggctgacctgcctctca

SEQ ID NO: 2101950 - DNA, 17 bp, Homo sapiens
ggctgagcccagccacc

SEQ ID NO: 2101951 - DNA, 20 bp, Homo sapiens
ggctgagcccagccacctcc

SEQ ID NO: 2101952 - DNA, 12 bp, Homo sapiens
ggctgagccctg

SEQ ID NO: 2101953 - DNA, 13 bp, Homo sapiens
ggctgagccctgg

SEQ ID NO: 2101954 - DNA, 15 bp, Homo sapiens
ggctgagccctggca

SEQ ID NO: 2101955 - DNA, 21 bp, Homo sapiens
ggctgaggaagcacagcagca

SEQ ID NO: 2101956 - DNA, 21 bp, Homo sapiens
ggctgaggatttcaagcctgc

SEQ ID NO: 2101957 - DNA, 13 bp, Homo sapiens
ggctgagggcagt

SEQ ID NO: 2101958 - DNA, 16 bp, Homo sapiens
ggctgaggggatacca

SEQ ID NO: 2101959 - DNA, 22 bp, Homo sapiens
ggctgagtcatgatctccctgc

SEQ ID NO: 2101960 - DNA, 22 bp, Homo sapiens
ggctgcaaagggtatcaggtgc

SEQ ID NO: 2101961 - DNA, 12 bp, Homo sapiens
ggctgcactgca

SEQ ID NO: 2101962 - DNA, 13 bp, Homo sapiens
ggctgcactgcag

SEQ ID NO: 2101963 - DNA, 14 bp, Homo sapiens
ggctgcagagacct

SEQ ID NO: 2101964 - DNA, 18 bp, Homo sapiens
ggctgcagagctgaccca

SEQ ID NO: 2101965 - DNA, 12 bp, Homo sapiens
ggctgcagggag

SEQ ID NO: 2101966 - DNA, 21 bp, Homo sapiens
ggctgcatgctctggaagcct

SEQ ID NO: 2101967 - DNA, 11 bp, Homo sapiens
ggctgccaggc

SEQ ID NO: 2101968 - DNA, 18 bp, Homo sapiens
ggctgcccactatggtca

SEQ ID NO: 2101969 - DNA, 13 bp, Homo sapiens
ggctgccctgcca

SEQ ID NO: 2101970 - DNA, 16 bp, Homo sapiens
ggctgccctggtgctg

SEQ ID NO: 2101971 - DNA, 19 bp, Homo sapiens
ggctgccctggtgctgcca

SEQ ID NO: 2101972 - DNA, 20 bp, Homo sapiens
ggctgcccttcgctgccagg

SEQ ID NO: 2101973 - DNA, 10 bp, Homo sapiens
ggctgcctgc

SEQ ID NO: 2101974 - DNA, 15 bp, Homo sapiens
ggctgcgaaaacgtt

SEQ ID NO: 2101975 - DNA, 21 bp, Homo sapiens
ggctgcgaaaacgttgacccc

SEQ ID NO: 2101976 - DNA, 20 bp, Homo sapiens
ggctgcgtcgaactgtcctg

SEQ ID NO: 2101977 - DNA, 24 bp, Homo sapiens
ggctgctcatcacccagtcctggc

SEQ ID NO: 2101978 - DNA, 21 bp, Homo sapiens
ggctgctcggggtgcacagga

SEQ ID NO: 2101979 - DNA, 22 bp, Homo sapiens
ggctgctcggggtgcacaggag

SEQ ID NO: 2101980 - DNA, 21 bp, Homo sapiens
ggctgctctcatgcctgcctg

SEQ ID NO: 2101981 - DNA, 17 bp, Homo sapiens
ggctgctgacaggatgt

SEQ ID NO: 2101982 - DNA, 23 bp, Homo sapiens
ggctgctggggcatgtgtgcctg

SEQ ID NO: 2101983 - DNA, 23 bp, Homo sapiens
ggctgctgtgtagctctgtccac

SEQ ID NO: 2101984 - DNA, 13 bp, Homo sapiens
ggctggaatctgg

SEQ ID NO: 2101985 - DNA, 14 bp, Homo sapiens
ggctggaatctgga

SEQ ID NO: 2101986 - DNA, 18 bp, Homo sapiens
ggctggaatctggagagc

SEQ ID NO: 2101987 - DNA, 23 bp, Homo sapiens
ggctggaggcagggccttgccca

SEQ ID NO: 2101988 - DNA, 20 bp, Homo sapiens
ggctggagtgcagtggtgcg

SEQ ID NO: 2101989 - DNA, 16 bp, Homo sapiens
ggctggagtgcgctct

SEQ ID NO: 2101990 - DNA, 20 bp, Homo sapiens
ggctggagtggagtggcacg

SEQ ID NO: 2101991 - DNA, 14 bp, Homo sapiens
ggctggcagtgctg

SEQ ID NO: 2101992 - DNA, 20 bp, Homo sapiens
ggctggcggctactcagcag

SEQ ID NO: 2101993 - DNA, 17 bp, Homo sapiens
ggctggctaactggaag

SEQ ID NO: 2101994 - DNA, 10 bp, Homo sapiens
ggctggctga

SEQ ID NO: 2101995 - DNA, 13 bp, Homo sapiens
ggctggctgagtg

SEQ ID NO: 2101996 - DNA, 15 bp, Homo sapiens
ggctgggagctctgc

SEQ ID NO: 2101997 - DNA, 22 bp, Homo sapiens
ggctgggccagcctcagctcag

SEQ ID NO: 2101998 - DNA, 12 bp, Homo sapiens
ggctgggcttca

SEQ ID NO: 2101999 - DNA, 13 bp, Homo sapiens
ggctgggcttcag

SEQ ID NO: 2102000 - DNA, 17 bp, Homo sapiens
ggctgggcttcagtggc

SEQ ID NO: 2102001 - DNA, 12 bp, Homo sapiens
ggctggggcaga

SEQ ID NO: 2102002 - DNA, 16 bp, Homo sapiens
ggctggggcagagggg

SEQ ID NO: 2102003 - DNA, 14 bp, Homo sapiens
ggctgggggcctca

SEQ ID NO: 2102004 - DNA, 19 bp, Homo sapiens
ggctgggggcctcagtgcc

SEQ ID NO: 2102005 - DNA, 18 bp, Homo sapiens
ggctgggggcgggggagc

SEQ ID NO: 2102006 - DNA, 17 bp, Homo sapiens
ggctgtaaacagctctg

SEQ ID NO: 2102007 - DNA, 21 bp, Homo sapiens
ggctgtaagcattctgagctg

SEQ ID NO: 2102008 - DNA, 18 bp, Homo sapiens
ggctgtatcccatgagcc

SEQ ID NO: 2102009 - DNA, 19 bp, Homo sapiens
ggctgtatcccatgagcct

SEQ ID NO: 2102010 - DNA, 16 bp, Homo sapiens
ggctgtgcctctgcct

SEQ ID NO: 2102011 - DNA, 14 bp, Homo sapiens
ggctgtggaggcct

SEQ ID NO: 2102012 - DNA, 17 bp, Homo sapiens
ggctgtggaggcctgat

SEQ ID NO: 2102013 - DNA, 22 bp, Homo sapiens
ggctgtggtggctgtctctgtc

SEQ ID NO: 2102014 - DNA, 14 bp, Homo sapiens
ggctgtgtgacaga

SEQ ID NO: 2102015 - DNA, 19 bp, Homo sapiens
ggctgttctgcactgaaaa

SEQ ID NO: 2102016 - DNA, 15 bp, Homo sapiens
ggcttaaaacaacac

SEQ ID NO: 2102017 - DNA, 14 bp, Homo sapiens
ggcttaatgtttat

SEQ ID NO: 2102018 - DNA, 17 bp, Homo sapiens
ggcttaggtgccaggct

SEQ ID NO: 2102019 - DNA, 20 bp, Homo sapiens
ggcttagttaagtcatccac

SEQ ID NO: 2102020 - DNA, 13 bp, Homo sapiens
ggcttatggccag

SEQ ID NO: 2102021 - DNA, 15 bp, Homo sapiens
ggcttatggccaggg

SEQ ID NO: 2102022 - DNA, 16 bp, Homo sapiens
ggcttcagtggcagct

SEQ ID NO: 2102023 - DNA, 22 bp, Homo sapiens
ggcttccagagagtcctctgga

SEQ ID NO: 2102024 - DNA, 12 bp, Homo sapiens
ggcttccaggct

SEQ ID NO: 2102025 - DNA, 14 bp, Homo sapiens
ggcttcccgctcag

SEQ ID NO: 2102026 - DNA, 16 bp, Homo sapiens
ggcttcccgctcagcc

SEQ ID NO: 2102027 - DNA, 17 bp, Homo sapiens
ggcttcccgctcagccc

SEQ ID NO: 2102028 - DNA, 16 bp, Homo sapiens
ggcttcctcatagtat

SEQ ID NO: 2102029 - DNA, 14 bp, Homo sapiens
ggcttcctgactga

SEQ ID NO: 2102030 - DNA, 23 bp, Homo sapiens
ggcttcctgactgacacaggcca

SEQ ID NO: 2102031 - DNA, 11 bp, Homo sapiens
ggcttcctggg

SEQ ID NO: 2102032 - DNA, 12 bp, Homo sapiens
ggcttcctgtcc

SEQ ID NO: 2102033 - DNA, 14 bp, Homo sapiens
ggcttcctgtccac

SEQ ID NO: 2102034 - DNA, 12 bp, Homo sapiens
ggcttctcctga

SEQ ID NO: 2102035 - DNA, 13 bp, Homo sapiens
ggcttctcctgac

SEQ ID NO: 2102036 - DNA, 16 bp, Homo sapiens
ggcttctggagccctt

SEQ ID NO: 2102037 - DNA, 20 bp, Homo sapiens
ggcttctggagcccttgggt

SEQ ID NO: 2102038 - DNA, 17 bp, Homo sapiens
ggcttctgggtggctcc

SEQ ID NO: 2102039 - DNA, 18 bp, Homo sapiens
ggcttctgggtggctcct

SEQ ID NO: 2102040 - DNA, 21 bp, Homo sapiens
ggcttctgggtggctcctgcc

SEQ ID NO: 2102041 - DNA, 22 bp, Homo sapiens
ggcttctgggtggctcctgcca

SEQ ID NO: 2102042 - DNA, 20 bp, Homo sapiens
ggcttcttcagatcagtgct

SEQ ID NO: 2102043 - DNA, 13 bp, Homo sapiens
ggcttcttcttat

SEQ ID NO: 2102044 - DNA, 16 bp, Homo sapiens
ggcttgcaagaggagg

SEQ ID NO: 2102045 - DNA, 15 bp, Homo sapiens
ggcttgctccagggt

SEQ ID NO: 2102046 - DNA, 22 bp, Homo sapiens
ggcttggacttcctggggcccc

SEQ ID NO: 2102047 - DNA, 12 bp, Homo sapiens
ggcttggccttg

SEQ ID NO: 2102048 - DNA, 16 bp, Homo sapiens
ggcttggggagcagag

SEQ ID NO: 2102049 - DNA, 19 bp, Homo sapiens
ggcttggggagcaggtctc

SEQ ID NO: 2102050 - DNA, 21 bp, Homo sapiens
ggcttggggagcaggtctctg

SEQ ID NO: 2102051 - DNA, 17 bp, Homo sapiens
ggcttgtaactccacca

SEQ ID NO: 2102052 - DNA, 21 bp, Homo sapiens
ggcttgtcactagcagctgca

SEQ ID NO: 2102053 - DNA, 23 bp, Homo sapiens
ggctttaaactaccctccagagt

SEQ ID NO: 2102054 - DNA, 19 bp, Homo sapiens
ggctttaaccgtttttcaa

SEQ ID NO: 2102055 - DNA, 23 bp, Homo sapiens
ggctttctccggggtctgtgctg

SEQ ID NO: 2102056 - DNA, 15 bp, Homo sapiens
ggctttgcaggctct

SEQ ID NO: 2102057 - DNA, 17 bp, Homo sapiens
ggctttgcaggctctgg

SEQ ID NO: 2102058 - DNA, 17 bp, Homo sapiens
ggcttttcactgctggc

SEQ ID NO: 2102059 - DNA, 19 bp, Homo sapiens
ggcttttcgcttgcttctg

SEQ ID NO: 2102060 - DNA, 21 bp, Homo sapiens
ggcttttcgcttgcttctgca

SEQ ID NO: 2102061 - DNA, 22 bp, Homo sapiens
ggcttttcgcttgcttctgcag

SEQ ID NO: 2102062 - DNA, 13 bp, Homo sapiens
gggaaaacagagg

SEQ ID NO: 2102063 - DNA, 16 bp, Homo sapiens
gggaaaacagaggaat

SEQ ID NO: 2102064 - DNA, 17 bp, Homo sapiens
gggaaaagaccagggct

SEQ ID NO: 2102065 - DNA, 21 bp, Homo sapiens
gggaaacctatcaatcctgcc

SEQ ID NO: 2102066 - DNA, 12 bp, Homo sapiens
gggaaactggct

SEQ ID NO: 2102067 - DNA, 16 bp, Homo sapiens
gggcctggcctgagct

SEQ ID NO: 2102068 - DNA, 17 bp, Homo sapiens
gggcctggcctgagctg

SEQ ID NO: 2102069 - DNA, 13 bp, Homo sapiens
gggcctggctggc

SEQ ID NO: 2102070 - DNA, 15 bp, Homo sapiens
gggcctgtactgcct

SEQ ID NO: 2102071 - DNA, 12 bp, Homo sapiens
gggcctgtgcag

SEQ ID NO: 2102072 - DNA, 16 bp, Homo sapiens
gggcctgtgcagcagc

SEQ ID NO: 2102073 - DNA, 18 bp, Homo sapiens
gggcctgtgcagcagccc

SEQ ID NO: 2102074 - DNA, 20 bp, Homo sapiens
gggcctgtgcagcagcccag

SEQ ID NO: 2102075 - DNA, 19 bp, Homo sapiens
gggccttacctcccctgcc

SEQ ID NO: 2102076 - DNA, 20 bp, Homo sapiens
gggccttacctcccctgcca

SEQ ID NO: 2102077 - DNA, 23 bp, Homo sapiens
gggccttacctcccctgccaggg

SEQ ID NO: 2102078 - DNA, 12 bp, Homo sapiens
gggccttgccca

SEQ ID NO: 2102079 - DNA, 19 bp, Homo sapiens
gggcctttaaagacttaag

SEQ ID NO: 2102080 - DNA, 16 bp, Homo sapiens
gggcctttcctgtgcc

SEQ ID NO: 2102081 - DNA, 18 bp, Homo sapiens
gggcgatcaagtccagag

SEQ ID NO: 2102082 - DNA, 20 bp, Homo sapiens
gggcgatcaagtccagagcc

SEQ ID NO: 2102083 - DNA, 22 bp, Homo sapiens
gggcgcctgtagtcccagccac

SEQ ID NO: 2102084 - DNA, 17 bp, Homo sapiens
gggcgctgtggctcctg

SEQ ID NO: 2102085 - DNA, 15 bp, Homo sapiens
gggcgggagtggggg

SEQ ID NO: 2102086 - DNA, 20 bp, Homo sapiens
gggcgggggagccaacagca

SEQ ID NO: 2102087 - DNA, 21 bp, Homo sapiens
gggcggtgagaggggaacaga

SEQ ID NO: 2102088 - DNA, 20 bp, Homo sapiens
gggcgtcgctggacaaccca

SEQ ID NO: 2102089 - DNA, 22 bp, Homo sapiens
gggcgtcgctggacaacccaga

SEQ ID NO: 2102090 - DNA, 14 bp, Homo sapiens
gggcgtgttgtttt

SEQ ID NO: 2102091 - DNA, 15 bp, Homo sapiens
gggctactggcagct

SEQ ID NO: 2102092 - DNA, 15 bp, Homo sapiens
gggctagaacctgga

SEQ ID NO: 2102093 - DNA, 17 bp, Homo sapiens
gggctagaacctggaga

SEQ ID NO: 2102094 - DNA, 18 bp, Homo sapiens
gggctaggggctggtcct

SEQ ID NO: 2102095 - DNA, 23 bp, Homo sapiens
gggctagtgtgagtggcagccat

SEQ ID NO: 2102096 - DNA, 17 bp, Homo sapiens
gggctatggcaaggggg

SEQ ID NO: 2102097 - DNA, 22 bp, Homo sapiens
gggctatttctctccccactga

SEQ ID NO: 2102098 - DNA, 17 bp, Homo sapiens
gggctcagcaaggtgtg

SEQ ID NO: 2102099 - DNA, 15 bp, Homo sapiens
gggctcagggctgga

SEQ ID NO: 2102100 - DNA, 21 bp, Homo sapiens
gggctccagcatccagcctgt

SEQ ID NO: 2102101 - DNA, 23 bp, Homo sapiens
gggctccagcatccagcctgtgt

SEQ ID NO: 2102102 - DNA, 13 bp, Homo sapiens
gggctccatggag

SEQ ID NO: 2102103 - DNA, 17 bp, Homo sapiens
gggctccatggaggagg

SEQ ID NO: 2102104 - DNA, 12 bp, Homo sapiens
gggctccctcct

SEQ ID NO: 2102105 - DNA, 21 bp, Homo sapiens
gggctccctcctggagcatcc

SEQ ID NO: 2102106 - DNA, 11 bp, Homo sapiens
gggctcctgga

SEQ ID NO: 2102107 - DNA, 12 bp, Homo sapiens
gggctcctggaa

SEQ ID NO: 2102108 - DNA, 19 bp, Homo sapiens
gggctcctggctgccaggc

SEQ ID NO: 2102109 - DNA, 20 bp, Homo sapiens
gggctcctggctgccaggcg

SEQ ID NO: 2102110 - DNA, 22 bp, Homo sapiens
gggctcctttctccagccagca

SEQ ID NO: 2102111 - DNA, 18 bp, Homo sapiens
gggctcgccccacccagg

SEQ ID NO: 2102112 - DNA, 21 bp, Homo sapiens
gggctcgggcgctgtggctcc

SEQ ID NO: 2102113 - DNA, 17 bp, Homo sapiens
gggctcgtggccttccc

SEQ ID NO: 2102114 - DNA, 17 bp, Homo sapiens
gggctctaacgcctgag

SEQ ID NO: 2102115 - DNA, 20 bp, Homo sapiens
gggctctaacgcctgagccc

SEQ ID NO: 2102116 - DNA, 16 bp, Homo sapiens
gggctctccaaagggg

SEQ ID NO: 2102117 - DNA, 23 bp, Homo sapiens
gggctctgacagccctgcggaga

SEQ ID NO: 2102118 - DNA, 15 bp, Homo sapiens
gggctctgaggcgcc

SEQ ID NO: 2102119 - DNA, 11 bp, Homo sapiens
gggctctgccc

SEQ ID NO: 2102120 - DNA, 12 bp, Homo sapiens
gggctctgcccc

SEQ ID NO: 2102121 - DNA, 20 bp, Homo sapiens
gggctctgccccagctctgg

SEQ ID NO: 2102122 - DNA, 21 bp, Homo sapiens
gggctctgccccagctctggc

SEQ ID NO: 2102123 - DNA, 13 bp, Homo sapiens
gggctctggccac

SEQ ID NO: 2102124 - DNA, 14 bp, Homo sapiens
gggctctggccacc

SEQ ID NO: 2102125 - DNA, 15 bp, Homo sapiens
gggctctggccaccc

SEQ ID NO: 2102126 - DNA, 18 bp, Homo sapiens
gggctgaacggggagaaa

SEQ ID NO: 2102127 - DNA, 22 bp, Homo sapiens
gggctgacacctaccatgctgc

SEQ ID NO: 2102128 - DNA, 22 bp, Homo sapiens
gggctgcccctgtaggttgctt

SEQ ID NO: 2102129 - DNA, 13 bp, Homo sapiens
gggctgccctgcc

SEQ ID NO: 2102130 - DNA, 14 bp, Homo sapiens
gggctgcctgggga

SEQ ID NO: 2102131 - DNA, 15 bp, Homo sapiens
gggctgctcctccag

SEQ ID NO: 2102132 - DNA, 17 bp, Homo sapiens
gggctggagtgcgctct

SEQ ID NO: 2102133 - DNA, 13 bp, Homo sapiens
gggctgggaagtc

SEQ ID NO: 2102134 - DNA, 12 bp, Homo sapiens
gggctgggccca

SEQ ID NO: 2102135 - DNA, 22 bp, Homo sapiens
gggctgggcccacagagatgca

SEQ ID NO: 2102136 - DNA, 15 bp, Homo sapiens
gggctggtccttctc

SEQ ID NO: 2102137 - DNA, 17 bp, Homo sapiens
gggcttcagtggcagct

SEQ ID NO: 2102138 - DNA, 16 bp, Homo sapiens
gggcttctcctgaccc

SEQ ID NO: 2102139 - DNA, 13 bp, Homo sapiens
gggcttctgggtg

SEQ ID NO: 2102140 - DNA, 18 bp, Homo sapiens
gggcttgcaagaggaggt

SEQ ID NO: 2102141 - DNA, 16 bp, Homo sapiens
gggcttgggccctgca

SEQ ID NO: 2102142 - DNA, 19 bp, Homo sapiens
gggcttggggagcaggtct

SEQ ID NO: 2102143 - DNA, 20 bp, Homo sapiens
gggcttggggagcaggtctc

SEQ ID NO: 2102144 - DNA, 20 bp, Homo sapiens
gggcttgtagaccactgtcc

SEQ ID NO: 2102145 - DNA, 22 bp, Homo sapiens
gggcttgtagaccactgtcctg

SEQ ID NO: 2102146 - DNA, 17 bp, Homo sapiens
gggctttgcaggctctg

SEQ ID NO: 2102147 - DNA, 18 bp, Homo sapiens
gggctttgcaggctctgg

SEQ ID NO: 2102148 - DNA, 19 bp, Homo sapiens
gggctttgcaggctctggg

SEQ ID NO: 2102149 - DNA, 22 bp, Homo sapiens
gggctttgtttgggccactgcc

SEQ ID NO: 2102150 - DNA, 14 bp, Homo sapiens
ggggaacccagccc

SEQ ID NO: 2102151 - DNA, 18 bp, Homo sapiens
ggggaacccagccctggg

SEQ ID NO: 2102152 - DNA, 14 bp, Homo sapiens
ggggaagctggcag

SEQ ID NO: 2102153 - DNA, 16 bp, Homo sapiens
ggggaagctggcagca

SEQ ID NO: 2102154 - DNA, 22 bp, Homo sapiens
ggggaagggccagtctgggctg

SEQ ID NO: 2102155 - DNA, 16 bp, Homo sapiens
ggggaagtgctcccca

SEQ ID NO: 2102156 - DNA, 19 bp, Homo sapiens
ggggaagtgctccccacac

SEQ ID NO: 2102157 - DNA, 18 bp, Homo sapiens
ggggacagttggcagaga

SEQ ID NO: 2102158 - DNA, 20 bp, Homo sapiens
ggggacagttggcagagaag

SEQ ID NO: 2102159 - DNA, 20 bp, Homo sapiens
ggggaccatgaagagactct

SEQ ID NO: 2102160 - DNA, 22 bp, Homo sapiens
ggggacctggtttgaatggaga

SEQ ID NO: 2102161 - DNA, 18 bp, Homo sapiens
ggggacgcgcacacacac

SEQ ID NO: 2102162 - DNA, 11 bp, Homo sapiens
ggggacttgtg

SEQ ID NO: 2102163 - DNA, 15 bp, Homo sapiens
ggggacttgtgccag

SEQ ID NO: 2102164 - DNA, 10 bp, Homo sapiens
ggggagaaat

SEQ ID NO: 2102165 - DNA, 19 bp, Homo sapiens
ggggagcacttgcgtcctg

SEQ ID NO: 2102166 - DNA, 15 bp, Homo sapiens
ggagagccagctctc

SEQ ID NO: 2102167 - DNA, 14 bp, Homo sapiens
ggagagccctggga

SEQ ID NO: 2102168 - DNA, 22 bp, Homo sapiens
ggagagctagaacccggcaggc

SEQ ID NO: 2102169 - DNA, 22 bp, Homo sapiens
ggagagctagaacctggagggc

SEQ ID NO: 2102170 - DNA, 12 bp, Homo sapiens
ggagagctagga

SEQ ID NO: 2102171 - DNA, 13 bp, Homo sapiens
ggagagctaggag

SEQ ID NO: 2102172 - DNA, 22 bp, Homo sapiens
ggagagctaggagcaaagcctg

SEQ ID NO: 2102173 - DNA, 13 bp, Homo sapiens
ggagaggactctg

SEQ ID NO: 2102174 - DNA, 19 bp, Homo sapiens
ggagaggcaaatgcagttt

SEQ ID NO: 2102175 - DNA, 17 bp, Homo sapiens
ggagagggagggagccg

SEQ ID NO: 2102176 - DNA, 17 bp, Homo sapiens
ggagaggggcctgggaa

SEQ ID NO: 2102177 - DNA, 21 bp, Homo sapiens
ggagaggggtgcacccactca

SEQ ID NO: 2102178 - DNA, 14 bp, Homo sapiens
ggagagtgcttggg

SEQ ID NO: 2102179 - DNA, 23 bp, Homo sapiens
ggagatatttatggggggagaac

SEQ ID NO: 2102180 - DNA, 19 bp, Homo sapiens
ggagatggaggaaagtgat

SEQ ID NO: 2102181 - DNA, 13 bp, Homo sapiens
ggagatggagttc

SEQ ID NO: 2102182 - DNA, 21 bp, Homo sapiens
ggagatttcagttacttacct

SEQ ID NO: 2102183 - DNA, 17 bp, Homo sapiens
ggagattttccttccta

SEQ ID NO: 2102184 - DNA, 13 bp, Homo sapiens
ggagcaaagcctg

SEQ ID NO: 2102185 - DNA, 14 bp, Homo sapiens
ggagcaaagcctgt

SEQ ID NO: 2102186 - DNA, 22 bp, Homo sapiens
ggagcaaagcctgttcatggca

SEQ ID NO: 2102187 - DNA, 24 bp, Homo sapiens
ggagcaaagcctgttcatggcaga

SEQ ID NO: 2102188 - DNA, 15 bp, Homo sapiens
ggagcaaatgtttct

SEQ ID NO: 2102189 - DNA, 18 bp, Homo sapiens
ggagcaaatgtttctgca

SEQ ID NO: 2102190 - DNA, 23 bp, Homo sapiens
ggagcaagaaggaaggaggcaga

SEQ ID NO: 2102191 - DNA, 13 bp, Homo sapiens
ggagcaaggttta

SEQ ID NO: 2102192 - DNA, 15 bp, Homo sapiens
ggagcaatgggaggg

SEQ ID NO: 2102193 - DNA, 22 bp, Homo sapiens
ggagcaatgggagggggctcca

SEQ ID NO: 2102194 - DNA, 13 bp, Homo sapiens
ggagcaatttgca

SEQ ID NO: 2102195 - DNA, 15 bp, Homo sapiens
ggagcacacggccct

SEQ ID NO: 2102196 - DNA, 17 bp, Homo sapiens
ggagcacacggccctgc

SEQ ID NO: 2102197 - DNA, 24 bp, Homo sapiens
ggagcacacggccctgccccatcc

SEQ ID NO: 2102198 - DNA, 16 bp, Homo sapiens
ggagcacagccctggg

SEQ ID NO: 2102199 - DNA, 17 bp, Homo sapiens
ggagcacagccctggga

SEQ ID NO: 2102200 - DNA, 18 bp, Homo sapiens
ggagcacagccctgggag

SEQ ID NO: 2102201 - DNA, 13 bp, Homo sapiens
ggagcacaggcag

SEQ ID NO: 2102202 - DNA, 14 bp, Homo sapiens
ggagcacctgaacc

SEQ ID NO: 2102203 - DNA, 22 bp, Homo sapiens
ggagcacctgaaccccatgggc

SEQ ID NO: 2102204 - DNA, 18 bp, Homo sapiens
ggagcacttgcgtcctgc

SEQ ID NO: 2102205 - DNA, 22 bp, Homo sapiens
ggagcacttgcgtcctgcagag

SEQ ID NO: 2102206 - DNA, 15 bp, Homo sapiens
ggagcagacagagaa

SEQ ID NO: 2102207 - DNA, 20 bp, Homo sapiens
ggagcagagtataggatgga

SEQ ID NO: 2102208 - DNA, 22 bp, Homo sapiens
ggagcagcacgattttgcacaa

SEQ ID NO: 2102209 - DNA, 17 bp, Homo sapiens
ggagcaggaacagagac

SEQ ID NO: 2102210 - DNA, 18 bp, Homo sapiens
ggagcaggaacagagact

SEQ ID NO: 2102211 - DNA, 14 bp, Homo sapiens
ggaggcgcagcccg

SEQ ID NO: 2102212 - DNA, 12 bp, Homo sapiens
ggaggcggagag

SEQ ID NO: 2102213 - DNA, 16 bp, Homo sapiens
ggaggcggctccaggt

SEQ ID NO: 2102214 - DNA, 12 bp, Homo sapiens
ggaggctgaggc

SEQ ID NO: 2102215 - DNA, 15 bp, Homo sapiens
ggaggctgaggcaga

SEQ ID NO: 2102216 - DNA, 13 bp, Homo sapiens
ggaggctgcagag

SEQ ID NO: 2102217 - DNA, 13 bp, Homo sapiens
ggaggctgggccc

SEQ ID NO: 2102218 - DNA, 14 bp, Homo sapiens
ggaggctgggcccc

SEQ ID NO: 2102219 - DNA, 20 bp, Homo sapiens
ggagggacaaaggagcctgt

SEQ ID NO: 2102220 - DNA, 14 bp, Homo sapiens
ggagggacagggct

SEQ ID NO: 2102221 - DNA, 15 bp, Homo sapiens
ggagggacagggctt

SEQ ID NO: 2102222 - DNA, 14 bp, Homo sapiens
ggagggcagagcca

SEQ ID NO: 2102223 - DNA, 17 bp, Homo sapiens
ggagggcagagccatgg

SEQ ID NO: 2102224 - DNA, 14 bp, Homo sapiens
ggagggcagagtgg

SEQ ID NO: 2102225 - DNA, 23 bp, Homo sapiens
ggagggcagagtgggctgcctgg

SEQ ID NO: 2102226 - DNA, 17 bp, Homo sapiens
ggagggcgtgactcacc

SEQ ID NO: 2102227 - DNA, 16 bp, Homo sapiens
ggagggctagaaccta

SEQ ID NO: 2102228 - DNA, 12 bp, Homo sapiens
ggagggctctga

SEQ ID NO: 2102229 - DNA, 14 bp, Homo sapiens
ggagggctctgagg

SEQ ID NO: 2102230 - DNA, 21 bp, Homo sapiens
ggaggggactatttatgaagg

SEQ ID NO: 2102231 - DNA, 21 bp, Homo sapiens
ggagggggacgcgcacacaca

SEQ ID NO: 2102232 - DNA, 18 bp, Homo sapiens
ggagggggcgctcaggac

SEQ ID NO: 2102233 - DNA, 21 bp, Homo sapiens
ggagggggctatttctctccc

SEQ ID NO: 2102234 - DNA, 22 bp, Homo sapiens
ggagggggtcgtggagagctag

SEQ ID NO: 2102235 - DNA, 22 bp, Homo sapiens
ggaggggttgcgggggagctgg

SEQ ID NO: 2102236 - DNA, 12 bp, Homo sapiens
ggagggtagggg

SEQ ID NO: 2102237 - DNA, 22 bp, Homo sapiens
ggagggtcgccacacccggctc

SEQ ID NO: 2102238 - DNA, 22 bp, Homo sapiens
ggagggtggggcaatggggaga

SEQ ID NO: 2102239 - DNA, 23 bp, Homo sapiens
ggagggtggggcaatggggagag

SEQ ID NO: 2102240 - DNA, 17 bp, Homo sapiens
ggaggtagctcccagca

SEQ ID NO: 2102241 - DNA, 21 bp, Homo sapiens
ggaggtctccactgaggatgt

SEQ ID NO: 2102242 - DNA, 17 bp, Homo sapiens
ggaggtgagaccacctc

SEQ ID NO: 2102243 - DNA, 16 bp, Homo sapiens
ggaggtgcctgagctg

SEQ ID NO: 2102244 - DNA, 22 bp, Homo sapiens
ggaggtgcctgagctggggcct

SEQ ID NO: 2102245 - DNA, 17 bp, Homo sapiens
ggaggtggcagccctgt

SEQ ID NO: 2102246 - DNA, 15 bp, Homo sapiens
ggaggtgtcccaagc

SEQ ID NO: 2102247 - DNA, 14 bp, Homo sapiens
ggaggttgcagtga

SEQ ID NO: 2102248 - DNA, 20 bp, Homo sapiens
ggaggttgcagtgagctgag

SEQ ID NO: 2102249 - DNA, 16 bp, Homo sapiens
ggagtagctgagagga

SEQ ID NO: 2102250 - DNA, 14 bp, Homo sapiens
ggagtagctgagct

SEQ ID NO: 2102251 - DNA, 15 bp, Homo sapiens
ggagtagctgagctc

SEQ ID NO: 2102252 - DNA, 13 bp, Homo sapiens
ggagtcaggacct

SEQ ID NO: 2102253 - DNA, 21 bp, Homo sapiens
ggagtcagtaggtccaagggc

SEQ ID NO: 2102254 - DNA, 22 bp, Homo sapiens
ggagtcccaccttggctgcagg

SEQ ID NO: 2102255 - DNA, 21 bp, Homo sapiens
ggagtctccagtggttgctgt

SEQ ID NO: 2102256 - DNA, 16 bp, Homo sapiens
ggagtctgagtctgag

SEQ ID NO: 2102257 - DNA, 21 bp, Homo sapiens
ggagtgacagaggcagcccca

SEQ ID NO: 2102258 - DNA, 19 bp, Homo sapiens
ggagtgagaggtctctctt

SEQ ID NO: 2102259 - DNA, 14 bp, Homo sapiens
ggagtgagctggtt

SEQ ID NO: 2102260 - DNA, 19 bp, Homo sapiens
ggagtgaggcttccaggct

SEQ ID NO: 2102261 - DNA, 21 bp, Homo sapiens
ggagtgaggcttccaggctct

SEQ ID NO: 2102262 - DNA, 22 bp, Homo sapiens
ggagtgaggcttccaggctctt

SEQ ID NO: 2102263 - DNA, 15 bp, Homo sapiens
ggagtgcagtgagcc

SEQ ID NO: 2102264 - DNA, 12 bp, Homo sapiens
ggagtgcagtgg

SEQ ID NO: 2102265 - DNA, 21 bp, Homo sapiens
ggagtgggggctgtgccgtga

SEQ ID NO: 2102266 - DNA, 18 bp, Homo sapiens
ggagtgtgggtgatcaga

SEQ ID NO: 2102267 - DNA, 21 bp, Homo sapiens
ggagtgtgggtgatcagaagg

SEQ ID NO: 2102268 - DNA, 19 bp, Homo sapiens
ggagtgttctgtgggcttg

SEQ ID NO: 2102269 - DNA, 17 bp, Homo sapiens
ggagtgttctgtttccc

SEQ ID NO: 2102270 - DNA, 18 bp, Homo sapiens
ggagttcaagaccagcct

SEQ ID NO: 2102271 - DNA, 14 bp, Homo sapiens
ggagttccatgaag

SEQ ID NO: 2102272 - DNA, 18 bp, Homo sapiens
ggagttcgagaccagcct

SEQ ID NO: 2102273 - DNA, 15 bp, Homo sapiens
ggagttcgaggctgc

SEQ ID NO: 2102274 - DNA, 14 bp, Homo sapiens
ggagttgagtacag

SEQ ID NO: 2102275 - DNA, 20 bp, Homo sapiens
ggagtttgagacaagccctg

SEQ ID NO: 2102276 - DNA, 20 bp, Homo sapiens
ggagtttgaggctgcagcga

SEQ ID NO: 2102277 - DNA, 15 bp, Homo sapiens
ggagtttgtgtgtct

SEQ ID NO: 2102278 - DNA, 14 bp, Homo sapiens
ggataacctatatg

SEQ ID NO: 2102279 - DNA, 20 bp, Homo sapiens
ggatcacaagaatcacctca

SEQ ID NO: 2102280 - DNA, 22 bp, Homo sapiens
ggatcagcctccgccattccaa

SEQ ID NO: 2102281 - DNA, 19 bp, Homo sapiens
ggatcagcgtggccttgtt

SEQ ID NO: 2102282 - DNA, 19 bp, Homo sapiens
ggatccagagacttgggga

SEQ ID NO: 2102283 - DNA, 20 bp, Homo sapiens
ggatccagagacttggggac

SEQ ID NO: 2102284 - DNA, 12 bp, Homo sapiens
ggatccctccca

SEQ ID NO: 2102285 - DNA, 15 bp, Homo sapiens
ggatcctcacaggag

SEQ ID NO: 2102286 - DNA, 16 bp, Homo sapiens
ggatcctcacaggagc

SEQ ID NO: 2102287 - DNA, 17 bp, Homo sapiens
ggatcctcacaggagca

SEQ ID NO: 2102288 - DNA, 23 bp, Homo sapiens
ggatcctcacaggagcagacaga

SEQ ID NO: 2102289 - DNA, 21 bp, Homo sapiens
ggatcctgctgtggcctcact

SEQ ID NO: 2102290 - DNA, 23 bp, Homo sapiens
ggatctagcttcatgcctcagtt

SEQ ID NO: 2102291 - DNA, 23 bp, Homo sapiens
ggatctatgcaatttttaaacta

SEQ ID NO: 2102292 - DNA, 21 bp, Homo sapiens
ggatctccaaggaccaggtta

SEQ ID NO: 2102293 - DNA, 14 bp, Homo sapiens
ggatctccccactc

SEQ ID NO: 2102294 - DNA, 16 bp, Homo sapiens
ggatctctcaggagca

SEQ ID NO: 2102295 - DNA, 22 bp, Homo sapiens
ggatctgcattccccgctgccc

SEQ ID NO: 2102296 - DNA, 19 bp, Homo sapiens
ggatctgggaccctttcct

SEQ ID NO: 2102297 - DNA, 20 bp, Homo sapiens
ggatctgtaaggaactggaa

SEQ ID NO: 2102298 - DNA, 15 bp, Homo sapiens
ggatctgtccaagga

SEQ ID NO: 2102299 - DNA, 22 bp, Homo sapiens
ggatgaatgaggtcccaggcag

SEQ ID NO: 2102300 - DNA, 16 bp, Homo sapiens
ggatgacatgtcccta

SEQ ID NO: 2102301 - DNA, 19 bp, Homo sapiens
ggatgactagaggcaggga

SEQ ID NO: 2102302 - DNA, 14 bp, Homo sapiens
ggatgagagtggct

SEQ ID NO: 2102303 - DNA, 20 bp, Homo sapiens
ggatgaggggcttcctgggt

SEQ ID NO: 2102304 - DNA, 21 bp, Homo sapiens
ggatgatttcagaaggagaag

SEQ ID NO: 2102305 - DNA, 20 bp, Homo sapiens
ggatgcacggcggcagggtg

SEQ ID NO: 2102306 - DNA, 23 bp, Homo sapiens
ggatgccaacaccttcttggctt

SEQ ID NO: 2102307 - DNA, 14 bp, Homo sapiens
ggatgccacagccc

SEQ ID NO: 2102308 - DNA, 21 bp, Homo sapiens
ggatgccacagccccacagca

SEQ ID NO: 2102309 - DNA, 20 bp, Homo sapiens
ggatgcctggtggcagctgc

SEQ ID NO: 2102310 - DNA, 21 bp, Homo sapiens
ggatgcctggtggcagctgcg

SEQ ID NO: 2102311 - DNA, 15 bp, Homo sapiens
ggatgctccagggca

SEQ ID NO: 2102312 - DNA, 17 bp, Homo sapiens
ggatgctccagggcagc

SEQ ID NO: 2102313 - DNA, 15 bp, Homo sapiens
ggatggaaggagact

SEQ ID NO: 2102314 - DNA, 17 bp, Homo sapiens
ggatggacgaacagggg

SEQ ID NO: 2102315 - DNA, 16 bp, Homo sapiens
ggatggagagagggga

SEQ ID NO: 2102316 - DNA, 16 bp, Homo sapiens
ggatggagaggcggcc

SEQ ID NO: 2102317 - DNA, 17 bp, Homo sapiens
ggatggagaggcggcct

SEQ ID NO: 2102318 - DNA, 14 bp, Homo sapiens
ggatggatggacag

SEQ ID NO: 2102319 - DNA, 15 bp, Homo sapiens
ggatggatggacaga

SEQ ID NO: 2102320 - DNA, 21 bp, Homo sapiens
ggatggattgcagtccccagt

SEQ ID NO: 2102321 - DNA, 19 bp, Homo sapiens
ggatgggggatgggccagg

SEQ ID NO: 2102322 - DNA, 21 bp, Homo sapiens
ggatgggggatgggccagggt

SEQ ID NO: 2102323 - DNA, 20 bp, Homo sapiens
ggatgtaaacagtgcctgct

SEQ ID NO: 2102324 - DNA, 11 bp, Homo sapiens
ggatgtagaac

SEQ ID NO: 2102325 - DNA, 21 bp, Homo sapiens
ggatgtcccctgtcccaccaa

SEQ ID NO: 2102326 - DNA, 15 bp, Homo sapiens
ggatgtgggagggag

SEQ ID NO: 2102327 - DNA, 16 bp, Homo sapiens
ggcaagagacagaatg

SEQ ID NO: 2102328 - DNA, 14 bp, Homo sapiens
ggcaagagtgagac

SEQ ID NO: 2102329 - DNA, 15 bp, Homo sapiens
ggcaagcccctcagc

SEQ ID NO: 2102330 - DNA, 17 bp, Homo sapiens
ggcaagcccctcagccc

SEQ ID NO: 2102331 - DNA, 20 bp, Homo sapiens
ggcaagcccctcagcccttg

SEQ ID NO: 2102332 - DNA, 18 bp, Homo sapiens
ggcaagctagaacctgga

SEQ ID NO: 2102333 - DNA, 19 bp, Homo sapiens
ggcaagggccatgctgaag

SEQ ID NO: 2102334 - DNA, 21 bp, Homo sapiens
ggcaagggccatgctgaaggg

SEQ ID NO: 2102335 - DNA, 15 bp, Homo sapiens
ggcaaggggtttcca

SEQ ID NO: 2102336 - DNA, 16 bp, Homo sapiens
ggcaaggtctccttac

SEQ ID NO: 2102337 - DNA, 23 bp, Homo sapiens
ggcaagtccctgactctctgtga

SEQ ID NO: 2102338 - DNA, 19 bp, Homo sapiens
ggcaagtgatatcacctct

SEQ ID NO: 2102339 - DNA, 15 bp, Homo sapiens
ggcaatcaatgttca

SEQ ID NO: 2102340 - DNA, 15 bp, Homo sapiens
ggcaatgctggctgt

SEQ ID NO: 2102341 - DNA, 17 bp, Homo sapiens
ggcaatggggagaggca

SEQ ID NO: 2102342 - DNA, 18 bp, Homo sapiens
ggcaatgtcaggaacaga

SEQ ID NO: 2102343 - DNA, 19 bp, Homo sapiens
ggcaattctgacttctccc

SEQ ID NO: 2102344 - DNA, 22 bp, Homo sapiens
ggcacaatggctaattcccaga

SEQ ID NO: 2102345 - DNA, 13 bp, Homo sapiens
ggcacaccactgc

SEQ ID NO: 2102346 - DNA, 17 bp, Homo sapiens
ggcacaccactgccctg

SEQ ID NO: 2102347 - DNA, 19 bp, Homo sapiens
ggcacaccactgccctgcc

SEQ ID NO: 2102348 - DNA, 21 bp, Homo sapiens
ggcacaccactgccctgcctg

SEQ ID NO: 2102349 - DNA, 23 bp, Homo sapiens
ggcacaccactgccctgcctgcc

SEQ ID NO: 2102350 - DNA, 21 bp, Homo sapiens
ggcacagaaacacaatatttt

SEQ ID NO: 2102351 - DNA, 22 bp, Homo sapiens
ggcacagacttctggaaggctg

SEQ ID NO: 2102352 - DNA, 18 bp, Homo sapiens
ggcacagcggggccccag

SEQ ID NO: 2102353 - DNA, 13 bp, Homo sapiens
ggcacaggactga

SEQ ID NO: 2102354 - DNA, 20 bp, Homo sapiens
ggcacaggagctacctgtgt

SEQ ID NO: 2102355 - DNA, 13 bp, Homo sapiens
ggcacaggcagga

SEQ ID NO: 2102356 - DNA, 14 bp, Homo sapiens
ggcacaggcaggaa

SEQ ID NO: 2102357 - DNA, 16 bp, Homo sapiens
ggcacaggcaggaaga

SEQ ID NO: 2102358 - DNA, 23 bp, Homo sapiens
ggcacagttgtctattctgagcc

SEQ ID NO: 2102359 - DNA, 21 bp, Homo sapiens
ggcacatgaggagggtgccct

SEQ ID NO: 2102360 - DNA, 15 bp, Homo sapiens
ggcaccagccccctg

SEQ ID NO: 2102361 - DNA, 14 bp, Homo sapiens
ggcaccagctctgt

SEQ ID NO: 2102362 - DNA, 20 bp, Homo sapiens
ggcacccaccatcatgtctg

SEQ ID NO: 2102363 - DNA, 13 bp, Homo sapiens
ggcacccccagcc

SEQ ID NO: 2102364 - DNA, 16 bp, Homo sapiens
ggcacccccagcctgg

SEQ ID NO: 2102365 - DNA, 17 bp, Homo sapiens
ggcacccccagcctggg

SEQ ID NO: 2102366 - DNA, 20 bp, Homo sapiens
ggcacccccagcctgggcct

SEQ ID NO: 2102367 - DNA, 14 bp, Homo sapiens
ggcaccccctgcag

SEQ ID NO: 2102368 - DNA, 18 bp, Homo sapiens
ggcaccccctgcagcttg

SEQ ID NO: 2102369 - DNA, 15 bp, Homo sapiens
ggcaccccctggaga

SEQ ID NO: 2102370 - DNA, 16 bp, Homo sapiens
ggcaccccctggagag

SEQ ID NO: 2102371 - DNA, 18 bp, Homo sapiens
ggcaccccctggagagaa

SEQ ID NO: 2102372 - DNA, 21 bp, Homo sapiens
ggcaccccggatcgaggacaa

SEQ ID NO: 2102373 - DNA, 15 bp, Homo sapiens
ggcacccggcccctg

SEQ ID NO: 2102374 - DNA, 18 bp, Homo sapiens
ggcacccggcccctgctg

SEQ ID NO: 2102375 - DNA, 19 bp, Homo sapiens
ggcacccggcccctgctgg

SEQ ID NO: 2102376 - DNA, 19 bp, Homo sapiens
ggcaccggcgctgcaggta

SEQ ID NO: 2102377 - DNA, 21 bp, Homo sapiens
ggcacctacatccccaggtct

SEQ ID NO: 2102378 - DNA, 19 bp, Homo sapiens
ggcacctatagtcccagct

SEQ ID NO: 2102379 - DNA, 23 bp, Homo sapiens
ggcacctcagacaatccactctc

SEQ ID NO: 2102380 - DNA, 18 bp, Homo sapiens
ggcacctgaccagaatgc

SEQ ID NO: 2102381 - DNA, 11 bp, Homo sapiens
ggcacctgcca

SEQ ID NO: 2102382 - DNA, 18 bp, Homo sapiens
ggcacctgccaccgccag

SEQ ID NO: 2102383 - DNA, 23 bp, Homo sapiens
ggcacctgccaccgccagaggac

SEQ ID NO: 2102384 - DNA, 13 bp, Homo sapiens
ggcacctgggccc

SEQ ID NO: 2102385 - DNA, 16 bp, Homo sapiens
ggcacctgggccctgg

SEQ ID NO: 2102386 - DNA, 22 bp, Homo sapiens
ggcacctgggccctggggcctg

SEQ ID NO: 2102387 - DNA, 14 bp, Homo sapiens
ggcacgcctgccca

SEQ ID NO: 2102388 - DNA, 19 bp, Homo sapiens
ggcactcagaagacactga

SEQ ID NO: 2102389 - DNA, 19 bp, Homo sapiens
ggcactgggatgagccgct

SEQ ID NO: 2102390 - DNA, 15 bp, Homo sapiens
ggcactggtggcccg

SEQ ID NO: 2102391 - DNA, 23 bp, Homo sapiens
ggcacttgtcactatgctatttc

SEQ ID NO: 2102392 - DNA, 23 bp, Homo sapiens
ggcagaaaacggagagtgcttgg

SEQ ID NO: 2102393 - DNA, 17 bp, Homo sapiens
ggcagaaaagaggagac

SEQ ID NO: 2102394 - DNA, 14 bp, Homo sapiens
ggcagaaagtggcc

SEQ ID NO: 2102395 - DNA, 14 bp, Homo sapiens
ggcagaacagccgc

SEQ ID NO: 2102396 - DNA, 18 bp, Homo sapiens
ggcagaacagccgctcct

SEQ ID NO: 2102397 - DNA, 20 bp, Homo sapiens
ggcagaacagccgctcctgt

SEQ ID NO: 2102398 - DNA, 22 bp, Homo sapiens
ggcagaagaattgaacccagga

SEQ ID NO: 2102399 - DNA, 23 bp, Homo sapiens
ggcagaagaattgaacccaggag

SEQ ID NO: 2102400 - DNA, 16 bp, Homo sapiens
ggcagaaggggaagat

SEQ ID NO: 2102401 - DNA, 15 bp, Homo sapiens
ggcagaagtcagccc

SEQ ID NO: 2102402 - DNA, 18 bp, Homo sapiens
ggcagaataagaaaacaa

SEQ ID NO: 2102403 - DNA, 19 bp, Homo sapiens
ggcagaataatctttgggt

SEQ ID NO: 2102404 - DNA, 22 bp, Homo sapiens
gccatttaaagcttattaaaac

SEQ ID NO: 2102405 - DNA, 20 bp, Homo sapiens
gccatttgcaccctccgcct

SEQ ID NO: 2102406 - DNA, 15 bp, Homo sapiens
gccatttgctttttc

SEQ ID NO: 2102407 - DNA, 14 bp, Homo sapiens
gccattttcttgcc

SEQ ID NO: 2102408 - DNA, 17 bp, Homo sapiens
gccattttttgaggaga

SEQ ID NO: 2102409 - DNA, 16 bp, Homo sapiens
gcccaaatggctctgt

SEQ ID NO: 2102410 - DNA, 23 bp, Homo sapiens
gcccaaatggctctgtgaaatca

SEQ ID NO: 2102411 - DNA, 12 bp, Homo sapiens
gcctcagtttcc

SEQ ID NO: 2102412 - DNA, 16 bp, Homo sapiens
gcctcagtttctccat

SEQ ID NO: 2102413 - DNA, 19 bp, Homo sapiens
gcctcagtttctccatcag

SEQ ID NO: 2102414 - DNA, 22 bp, Homo sapiens
gcctcagtttctccatcagctt

SEQ ID NO: 2102415 - DNA, 12 bp, Homo sapiens
gcctcatccctc

SEQ ID NO: 2102416 - DNA, 14 bp, Homo sapiens
gcctcatccctcgg

SEQ ID NO: 2102417 - DNA, 18 bp, Homo sapiens
gcctcatccgaggcaggg

SEQ ID NO: 2102418 - DNA, 19 bp, Homo sapiens
gcctcatccgaggcagggt

SEQ ID NO: 2102419 - DNA, 22 bp, Homo sapiens
gcctcatctataacatgcattt

SEQ ID NO: 2102420 - DNA, 12 bp, Homo sapiens
gcctcatctcct

SEQ ID NO: 2102421 - DNA, 19 bp, Homo sapiens
gcctcatgctgacttgcag

SEQ ID NO: 2102422 - DNA, 12 bp, Homo sapiens
gcctccaccgct

SEQ ID NO: 2102423 - DNA, 13 bp, Homo sapiens
gcctccactcccc

SEQ ID NO: 2102424 - DNA, 15 bp, Homo sapiens
gcctccactccccca

SEQ ID NO: 2102425 - DNA, 19 bp, Homo sapiens
gcctccactcccccacctg

SEQ ID NO: 2102426 - DNA, 21 bp, Homo sapiens
gcctccactcccccacctgac

SEQ ID NO: 2102427 - DNA, 13 bp, Homo sapiens
gcctccagagcca

SEQ ID NO: 2102428 - DNA, 14 bp, Homo sapiens
gcctccagagccag

SEQ ID NO: 2102429 - DNA, 22 bp, Homo sapiens
gcctccagagccagcctgggac

SEQ ID NO: 2102430 - DNA, 24 bp, Homo sapiens
gcctccagagccagcctgggactc

SEQ ID NO: 2102431 - DNA, 13 bp, Homo sapiens
gcctccagcctct

SEQ ID NO: 2102432 - DNA, 14 bp, Homo sapiens
gcctccagcctctc

SEQ ID NO: 2102433 - DNA, 19 bp, Homo sapiens
gcctccagcctctcccggc

SEQ ID NO: 2102434 - DNA, 12 bp, Homo sapiens
gcctccaggagc

SEQ ID NO: 2102435 - DNA, 13 bp, Homo sapiens
gcctccaggagcc

SEQ ID NO: 2102436 - DNA, 20 bp, Homo sapiens
gcctccaggagcctaccccc

SEQ ID NO: 2102437 - DNA, 16 bp, Homo sapiens
gcctccattctgacca

SEQ ID NO: 2102438 - DNA, 18 bp, Homo sapiens
gcctcccaaccccagggc

SEQ ID NO: 2102439 - DNA, 15 bp, Homo sapiens
gcctcccaataaagc

SEQ ID NO: 2102440 - DNA, 19 bp, Homo sapiens
gcctcccaataaagctgga

SEQ ID NO: 2102441 - DNA, 12 bp, Homo sapiens
gcctcccagagt

SEQ ID NO: 2102442 - DNA, 18 bp, Homo sapiens
gcctcccagccctgccag

SEQ ID NO: 2102443 - DNA, 15 bp, Homo sapiens
gcctccccccagccc

SEQ ID NO: 2102444 - DNA, 19 bp, Homo sapiens
gcctccccccagcccctcc

SEQ ID NO: 2102445 - DNA, 21 bp, Homo sapiens
gcctccccccagcccctcctc

SEQ ID NO: 2102446 - DNA, 15 bp, Homo sapiens
gcctccccccgctgg

SEQ ID NO: 2102447 - DNA, 15 bp, Homo sapiens
gcctccccctgctgc

SEQ ID NO: 2102448 - DNA, 18 bp, Homo sapiens
gcctcccgaatagctggg

SEQ ID NO: 2102449 - DNA, 18 bp, Homo sapiens
gcctccctccaccccagg

SEQ ID NO: 2102450 - DNA, 20 bp, Homo sapiens
gcctccctccaccccaggac

SEQ ID NO: 2102451 - DNA, 13 bp, Homo sapiens
gcctccctcctcg

SEQ ID NO: 2102452 - DNA, 23 bp, Homo sapiens
gcctccctctccatatctccttc

SEQ ID NO: 2102453 - DNA, 20 bp, Homo sapiens
gcctccctctgacctgcagg

SEQ ID NO: 2102454 - DNA, 14 bp, Homo sapiens
gcctccctttctgg

SEQ ID NO: 2102455 - DNA, 15 bp, Homo sapiens
gcctccctttctggg

SEQ ID NO: 2102456 - DNA, 14 bp, Homo sapiens
gcctccgtcaggag

SEQ ID NO: 2102457 - DNA, 21 bp, Homo sapiens
gcctccgtttatgggccttgc

SEQ ID NO: 2102458 - DNA, 14 bp, Homo sapiens
gcctcctcccacca

SEQ ID NO: 2102459 - DNA, 16 bp, Homo sapiens
gcctcctctgtccagg

SEQ ID NO: 2102460 - DNA, 12 bp, Homo sapiens
gcctcctgcctc

SEQ ID NO: 2102461 - DNA, 13 bp, Homo sapiens
gcctcctgcctct

SEQ ID NO: 2102462 - DNA, 11 bp, Homo sapiens
gcctcctggcc

SEQ ID NO: 2102463 - DNA, 13 bp, Homo sapiens
gcctcctggccag

SEQ ID NO: 2102464 - DNA, 20 bp, Homo sapiens
gcctcctgggaccatggaca

SEQ ID NO: 2102465 - DNA, 19 bp, Homo sapiens
gcctcctgtgtgtgcgcct

SEQ ID NO: 2102466 - DNA, 23 bp, Homo sapiens
gcctcctgtgtgtgcgcctacag

SEQ ID NO: 2102467 - DNA, 13 bp, Homo sapiens
gcctcgaggcacc

SEQ ID NO: 2102468 - DNA, 15 bp, Homo sapiens
gcctcgaggcaccgg

SEQ ID NO: 2102469 - DNA, 18 bp, Homo sapiens
gcctcgcaacccgtgcca

SEQ ID NO: 2102470 - DNA, 13 bp, Homo sapiens
gcctcgcatgcca

SEQ ID NO: 2102471 - DNA, 13 bp, Homo sapiens
gcctcgcctgggc

SEQ ID NO: 2102472 - DNA, 16 bp, Homo sapiens
gcctcgcctgggccca

SEQ ID NO: 2102473 - DNA, 19 bp, Homo sapiens
gcctcgcctgggcccaggc

SEQ ID NO: 2102474 - DNA, 14 bp, Homo sapiens
gcctcgctccccac

SEQ ID NO: 2102475 - DNA, 24 bp, Homo sapiens
gcctcgctccccactctgctctga

SEQ ID NO: 2102476 - DNA, 15 bp, Homo sapiens
gcctcggagcctcat

SEQ ID NO: 2102477 - DNA, 23 bp, Homo sapiens
gcctcggagcctcatccgaggca

SEQ ID NO: 2102478 - DNA, 19 bp, Homo sapiens
gcctcggtggccatgcttc

SEQ ID NO: 2102479 - DNA, 23 bp, Homo sapiens
gcctcggtggccatgcttcttgc

SEQ ID NO: 2102480 - DNA, 14 bp, Homo sapiens
gcctcgtaccagcc

SEQ ID NO: 2102481 - DNA, 16 bp, Homo sapiens
gcctcgtaccagccag

SEQ ID NO: 2102482 - DNA, 17 bp, Homo sapiens
gcctcgtaccagccagg

SEQ ID NO: 2102483 - DNA, 17 bp, Homo sapiens
gcctctactgggaaggc

SEQ ID NO: 2102484 - DNA, 18 bp, Homo sapiens
gcctctactgggaaggct

SEQ ID NO: 2102485 - DNA, 15 bp, Homo sapiens
gcctctagaacaccc

SEQ ID NO: 2102486 - DNA, 18 bp, Homo sapiens
gcctctagaacacccact

SEQ ID NO: 2102487 - DNA, 20 bp, Homo sapiens
gcctctagaacacccactgg

SEQ ID NO: 2102488 - DNA, 22 bp, Homo sapiens
gcctctagaacacccactggcc

SEQ ID NO: 2102489 - DNA, 13 bp, Homo sapiens
gcctctcccaccc

SEQ ID NO: 2102490 - DNA, 16 bp, Homo sapiens
gcctctcccgcaccag

SEQ ID NO: 2102491 - DNA, 13 bp, Homo sapiens
gcctctcccggct

SEQ ID NO: 2102492 - DNA, 14 bp, Homo sapiens
gcctctcccggctg

SEQ ID NO: 2102493 - DNA, 17 bp, Homo sapiens
gcctctcccggctgcct

SEQ ID NO: 2102494 - DNA, 20 bp, Homo sapiens
gcctctcccggctgcctgcc

SEQ ID NO: 2102495 - DNA, 22 bp, Homo sapiens
gcctctcccggctgcctgccgc

SEQ ID NO: 2102496 - DNA, 12 bp, Homo sapiens
gcctctccctta

SEQ ID NO: 2102497 - DNA, 16 bp, Homo sapiens
gcctctccttgcctgg

SEQ ID NO: 2102498 - DNA, 19 bp, Homo sapiens
gcctctgaaatttcccaca

SEQ ID NO: 2102499 - DNA, 20 bp, Homo sapiens
gcctctgacacacagctctg

SEQ ID NO: 2102500 - DNA, 21 bp, Homo sapiens
gcctctgacacacagctctgt

SEQ ID NO: 2102501 - DNA, 15 bp, Homo sapiens
gcctctgatatggga

SEQ ID NO: 2102502 - DNA, 17 bp, Homo sapiens
gcctctgatatgggact

SEQ ID NO: 2102503 - DNA, 14 bp, Homo sapiens
gcgacccctcagtg

SEQ ID NO: 2102504 - DNA, 16 bp, Homo sapiens
gcgagagtctgtctca

SEQ ID NO: 2102505 - DNA, 19 bp, Homo sapiens
gcgagatcgctggcagaga

SEQ ID NO: 2102506 - DNA, 16 bp, Homo sapiens
gcgagattgggcctcc

SEQ ID NO: 2102507 - DNA, 13 bp, Homo sapiens
gcgagcacccacg

SEQ ID NO: 2102508 - DNA, 17 bp, Homo sapiens
gcgagccctggtggcag

SEQ ID NO: 2102509 - DNA, 17 bp, Homo sapiens
gcgagttgtggaaagcc

SEQ ID NO: 2102510 - DNA, 22 bp, Homo sapiens
gcgataaaactaaatatatgtc

SEQ ID NO: 2102511 - DNA, 15 bp, Homo sapiens
gcgatcaagtccaga

SEQ ID NO: 2102512 - DNA, 19 bp, Homo sapiens
gcgatgaatttggagactc

SEQ ID NO: 2102513 - DNA, 17 bp, Homo sapiens
gcgatgaggtaattctc

SEQ ID NO: 2102514 - DNA, 16 bp, Homo sapiens
gcgattccctctcacc

SEQ ID NO: 2102515 - DNA, 22 bp, Homo sapiens
gcgattccctctcccaggcccc

SEQ ID NO: 2102516 - DNA, 14 bp, Homo sapiens
gcgattcttctgct

SEQ ID NO: 2102517 - DNA, 22 bp, Homo sapiens
gcgattcttctgcttcagcctc

SEQ ID NO: 2102518 - DNA, 13 bp, Homo sapiens
gcgcaagcctgta

SEQ ID NO: 2102519 - DNA, 18 bp, Homo sapiens
gcgcacaaggctgaccaa

SEQ ID NO: 2102520 - DNA, 19 bp, Homo sapiens
gcgcacctgccccctggtg

SEQ ID NO: 2102521 - DNA, 17 bp, Homo sapiens
gcgcagagtaaaataag

SEQ ID NO: 2102522 - DNA, 16 bp, Homo sapiens
gcgcagcccgaagccc

SEQ ID NO: 2102523 - DNA, 19 bp, Homo sapiens
gcgcagcccgaagcccagt

SEQ ID NO: 2102524 - DNA, 19 bp, Homo sapiens
gcgcagggaggatgccaca

SEQ ID NO: 2102525 - DNA, 18 bp, Homo sapiens
gcgcagtgcttctctaca

SEQ ID NO: 2102526 - DNA, 21 bp, Homo sapiens
gcgcatgtaatcccagctact

SEQ ID NO: 2102527 - DNA, 14 bp, Homo sapiens
gcgccaccatcctg

SEQ ID NO: 2102528 - DNA, 22 bp, Homo sapiens
gcgccactacactccagcctga

SEQ ID NO: 2102529 - DNA, 18 bp, Homo sapiens
gcgccccaacccgtggag

SEQ ID NO: 2102530 - DNA, 12 bp, Homo sapiens
gcgccctgcaga

SEQ ID NO: 2102531 - DNA, 18 bp, Homo sapiens
gcgccctgcagaccctgc

SEQ ID NO: 2102532 - DNA, 21 bp, Homo sapiens
gcgcctacaggagtgagcact

SEQ ID NO: 2102533 - DNA, 12 bp, Homo sapiens
gcgcctccctcc

SEQ ID NO: 2102534 - DNA, 14 bp, Homo sapiens
gcgcctccctccac

SEQ ID NO: 2102535 - DNA, 19 bp, Homo sapiens
gcgcctccctccaccccag

SEQ ID NO: 2102536 - DNA, 22 bp, Homo sapiens
gcgcctccctccaccccaggac

SEQ ID NO: 2102537 - DNA, 22 bp, Homo sapiens
gcgcctccttccttgctgtcct

SEQ ID NO: 2102538 - DNA, 21 bp, Homo sapiens
gcgcctgccctccctggggtc

SEQ ID NO: 2102539 - DNA, 20 bp, Homo sapiens
gcgcggcttggccgccatcc

SEQ ID NO: 2102540 - DNA, 18 bp, Homo sapiens
gcgcgggcggaggcggct

SEQ ID NO: 2102541 - DNA, 13 bp, Homo sapiens
gcgctcaggaccc

SEQ ID NO: 2102542 - DNA, 14 bp, Homo sapiens
gcgctcaggaccca

SEQ ID NO: 2102543 - DNA, 17 bp, Homo sapiens
gcgctcaggacccaggc

SEQ ID NO: 2102544 - DNA, 15 bp, Homo sapiens
gcgctcatctggctt

SEQ ID NO: 2102545 - DNA, 22 bp, Homo sapiens
gcgctctgccctccctggcctc

SEQ ID NO: 2102546 - DNA, 16 bp, Homo sapiens
gcgctgccgcacccca

SEQ ID NO: 2102547 - DNA, 13 bp, Homo sapiens
gcgctgctcaacc

SEQ ID NO: 2102548 - DNA, 18 bp, Homo sapiens
gcgctgctcaacctctct

SEQ ID NO: 2102549 - DNA, 14 bp, Homo sapiens
gcgctggctcagga

SEQ ID NO: 2102550 - DNA, 13 bp, Homo sapiens
gcgctggtggacc

SEQ ID NO: 2102551 - DNA, 15 bp, Homo sapiens
gcgctgtggctcctg

SEQ ID NO: 2102552 - DNA, 21 bp, Homo sapiens
gcgctgtggctcctgccttga

SEQ ID NO: 2102553 - DNA, 15 bp, Homo sapiens
gcgctttctggaaaa

SEQ ID NO: 2102554 - DNA, 22 bp, Homo sapiens
gcgctttctggaaaagaggagt

SEQ ID NO: 2102555 - DNA, 16 bp, Homo sapiens
gcggacagccacggcc

SEQ ID NO: 2102556 - DNA, 22 bp, Homo sapiens
gcggagagtacagtgagccaag

SEQ ID NO: 2102557 - DNA, 16 bp, Homo sapiens
gcggagcttgcagtga

SEQ ID NO: 2102558 - DNA, 20 bp, Homo sapiens
gcggagcttgcagtgagccg

SEQ ID NO: 2102559 - DNA, 15 bp, Homo sapiens
gcggaggagaccagc

SEQ ID NO: 2102560 - DNA, 22 bp, Homo sapiens
gcggaggagaccagctcagagg

SEQ ID NO: 2102561 - DNA, 16 bp, Homo sapiens
gcggaggagagagagg

SEQ ID NO: 2102562 - DNA, 16 bp, Homo sapiens
gcggaggagctccgct

SEQ ID NO: 2102563 - DNA, 17 bp, Homo sapiens
gcggaggcggctccagg

SEQ ID NO: 2102564 - DNA, 15 bp, Homo sapiens
gcggaggttgcaggg

SEQ ID NO: 2102565 - DNA, 16 bp, Homo sapiens
gcggcacagaggcagc

SEQ ID NO: 2102566 - DNA, 15 bp, Homo sapiens
gcggcacattggcag

SEQ ID NO: 2102567 - DNA, 20 bp, Homo sapiens
gcggcacgccaacagccccc

SEQ ID NO: 2102568 - DNA, 13 bp, Homo sapiens
gcggcaggagcag

SEQ ID NO: 2102569 - DNA, 20 bp, Homo sapiens
gcggcaggagcaggaacaga

SEQ ID NO: 2102570 - DNA, 23 bp, Homo sapiens
gcggcaggagcaggaacagagac

SEQ ID NO: 2102571 - DNA, 21 bp, Homo sapiens
gcggcagggtgggggagggag

SEQ ID NO: 2102572 - DNA, 19 bp, Homo sapiens
gcggcccagaagtttccct

SEQ ID NO: 2102573 - DNA, 19 bp, Homo sapiens
gcggccgcattccctgagt

SEQ ID NO: 2102574 - DNA, 16 bp, Homo sapiens
gcggccgggctgccct

SEQ ID NO: 2102575 - DNA, 22 bp, Homo sapiens
gcggcctcgtgccatgatctgt

SEQ ID NO: 2102576 - DNA, 12 bp, Homo sapiens
gcggcgcagagg

SEQ ID NO: 2102577 - DNA, 22 bp, Homo sapiens
gcggctactcagcagccctcct

SEQ ID NO: 2102578 - DNA, 13 bp, Homo sapiens
gcggctccaggtc

SEQ ID NO: 2102579 - DNA, 13 bp, Homo sapiens
gcggctctcctga

SEQ ID NO: 2102580 - DNA, 20 bp, Homo sapiens
gcgggaccggtacagaaagg

SEQ ID NO: 2102581 - DNA, 13 bp, Homo sapiens
gcgggaggcacca

SEQ ID NO: 2102582 - DNA, 15 bp, Homo sapiens
gcgggaggcaccagc

SEQ ID NO: 2102583 - DNA, 20 bp, Homo sapiens
gcgggcacctatagtcccag

SEQ ID NO: 2102584 - DNA, 11 bp, Homo sapiens
gcgggcctctt

SEQ ID NO: 2102585 - DNA, 13 bp, Homo sapiens
gcggggacagctc

SEQ ID NO: 2102586 - DNA, 17 bp, Homo sapiens
gcggggacagctccttc

SEQ ID NO: 2102587 - DNA, 16 bp, Homo sapiens
gcggggaggaggagct

SEQ ID NO: 2102588 - DNA, 13 bp, Homo sapiens
gcggggcagagcc

SEQ ID NO: 2102589 - DNA, 15 bp, Homo sapiens
gcggggcagagccac

SEQ ID NO: 2102590 - DNA, 18 bp, Homo sapiens
gcggggcaggaggcctgg

SEQ ID NO: 2102591 - DNA, 20 bp, Homo sapiens
gcggggcaggaggcctggcc

SEQ ID NO: 2102592 - DNA, 16 bp, Homo sapiens
gcggggcccaccttag

SEQ ID NO: 2102593 - DNA, 13 bp, Homo sapiens
gcggggtgcagaa

SEQ ID NO: 2102594 - DNA, 14 bp, Homo sapiens
gcggggtgctgtgg

SEQ ID NO: 2102595 - DNA, 14 bp, Homo sapiens
gcgggtctgaagga

SEQ ID NO: 2102596 - DNA, 18 bp, Homo sapiens
gcggtccacccaggagcc

SEQ ID NO: 2102597 - DNA, 19 bp, Homo sapiens
gcggtgagaggggaacaga

SEQ ID NO: 2102598 - DNA, 13 bp, Homo sapiens
gcggttgcttctg

SEQ ID NO: 2102599 - DNA, 15 bp, Homo sapiens
gcggtttccaggcca

SEQ ID NO: 2102600 - DNA, 17 bp, Homo sapiens
gcgtaatgggcctgccc

SEQ ID NO: 2102601 - DNA, 17 bp, Homo sapiens
gcgtcagaggccctgga

SEQ ID NO: 2102602 - DNA, 16 bp, Homo sapiens
gcgtcccaagcagccg

SEQ ID NO: 2102603 - DNA, 13 bp, Homo sapiens
gcgtcccccagcc

SEQ ID NO: 2102604 - DNA, 18 bp, Homo sapiens
gcgtcccccagccctcag

SEQ ID NO: 2102605 - DNA, 19 bp, Homo sapiens
gcgtcccccagccctcagg

SEQ ID NO: 2102606 - DNA, 22 bp, Homo sapiens
gcgtcccccagccctcaggcca

SEQ ID NO: 2102607 - DNA, 19 bp, Homo sapiens
gcgtccctagcagtgaact

SEQ ID NO: 2102608 - DNA, 20 bp, Homo sapiens
gcgtcctgcagaggaccaca

SEQ ID NO: 2102609 - DNA, 20 bp, Homo sapiens
gcgtcgctggacaacccaga

SEQ ID NO: 2102610 - DNA, 23 bp, Homo sapiens
gcgtgcacatatgggtgctggca

SEQ ID NO: 2102611 - DNA, 22 bp, Homo sapiens
gcgtggaccacccgccctggca

SEQ ID NO: 2102612 - DNA, 23 bp, Homo sapiens
gcgtggaccacccgccctggcag

SEQ ID NO: 2102613 - DNA, 17 bp, Homo sapiens
gcgtggcaaatataaaa

SEQ ID NO: 2102614 - DNA, 15 bp, Homo sapiens
gcgtggctgtggcac

SEQ ID NO: 2102615 - DNA, 18 bp, Homo sapiens
gcgtgggtggaggaagat

SEQ ID NO: 2102616 - DNA, 23 bp, Homo sapiens
gcgtggtggcgggcacctgtagt

SEQ ID NO: 2102617 - DNA, 16 bp, Homo sapiens
gcgtgtgtacacacgg

SEQ ID NO: 2102618 - DNA, 16 bp, Homo sapiens
gcgttactaattggcc

SEQ ID NO: 2102619 - DNA, 14 bp, Homo sapiens
gcgttggagccact

SEQ ID NO: 2102620 - DNA, 15 bp, Homo sapiens
gcgttggtgccactt

SEQ ID NO: 2102621 - DNA, 23 bp, Homo sapiens
gcgtttagtttctagaggcctca

SEQ ID NO: 2102622 - DNA, 15 bp, Homo sapiens
gcgtttgtaaattct

SEQ ID NO: 2102623 - DNA, 20 bp, Homo sapiens
gcgtttttttacaacattca

SEQ ID NO: 2102624 - DNA, 20 bp, Homo sapiens
gctaaacgactccgagaaca

SEQ ID NO: 2102625 - DNA, 18 bp, Homo sapiens
gctaaatactgtacatag

SEQ ID NO: 2102626 - DNA, 19 bp, Homo sapiens
gctaaatcctttactgtta

SEQ ID NO: 2102627 - DNA, 12 bp, Homo sapiens
gctaaatgaagt

SEQ ID NO: 2102628 - DNA, 21 bp, Homo sapiens
gctaaatgcaaacactgtgta

SEQ ID NO: 2102629 - DNA, 23 bp, Homo sapiens
gctaaatggtcgcccaggagaca

SEQ ID NO: 2102630 - DNA, 18 bp, Homo sapiens
gctaacagggaaggcagg

SEQ ID NO: 2102631 - DNA, 20 bp, Homo sapiens
gctaacagggaaggcaggca

SEQ ID NO: 2102632 - DNA, 13 bp, Homo sapiens
gctaacattttaa

SEQ ID NO: 2102633 - DNA, 19 bp, Homo sapiens
gctaacccccagcccacag

SEQ ID NO: 2102634 - DNA, 22 bp, Homo sapiens
gctaacccccagcccacagagc

SEQ ID NO: 2102635 - DNA, 22 bp, Homo sapiens
gctaacccccttctactgagcc

SEQ ID NO: 2102636 - DNA, 21 bp, Homo sapiens
gctaactccagtctcctgaca

SEQ ID NO: 2102637 - DNA, 15 bp, Homo sapiens
gctaactgtatgtgt

SEQ ID NO: 2102638 - DNA, 13 bp, Homo sapiens
gctaagagaagta

SEQ ID NO: 2102639 - DNA, 21 bp, Homo sapiens
gctaagatgagatttgccagc

SEQ ID NO: 2102640 - DNA, 23 bp, Homo sapiens
gctaagatgagatttgccagcac

SEQ ID NO: 2102641 - DNA, 13 bp, Homo sapiens
gctaagttctaag

SEQ ID NO: 2102642 - DNA, 17 bp, Homo sapiens
gctaatctgtagggctg

SEQ ID NO: 2102643 - DNA, 19 bp, Homo sapiens
gctaatctgtagggctgga

SEQ ID NO: 2102644 - DNA, 21 bp, Homo sapiens
gctaatctgtagggctggacc

SEQ ID NO: 2102645 - DNA, 16 bp, Homo sapiens
gctaatgaaattgaga

SEQ ID NO: 2102646 - DNA, 13 bp, Homo sapiens
gctaatgggacac

SEQ ID NO: 2102647 - DNA, 15 bp, Homo sapiens
gctaatgggacacta

SEQ ID NO: 2102648 - DNA, 21 bp, Homo sapiens
gctaattaaggtttgccctgc

SEQ ID NO: 2102649 - DNA, 14 bp, Homo sapiens
gctaattcaattta

SEQ ID NO: 2102650 - DNA, 20 bp, Homo sapiens
gctaattcccagagtgtgaa

SEQ ID NO: 2102651 - DNA, 15 bp, Homo sapiens
gctaatttttatatt

SEQ ID NO: 2102652 - DNA, 16 bp, Homo sapiens
gctacaccactctggc

SEQ ID NO: 2102653 - DNA, 21 bp, Homo sapiens
gctacaccactctggcagcca

SEQ ID NO: 2102654 - DNA, 22 bp, Homo sapiens
gctacaccactctggcagccac

SEQ ID NO: 2102655 - DNA, 17 bp, Homo sapiens
gctacaccttagcagct

SEQ ID NO: 2102656 - DNA, 20 bp, Homo sapiens
gctacaccttagcagctctt

SEQ ID NO: 2102657 - DNA, 13 bp, Homo sapiens
gctacattcctca

SEQ ID NO: 2102658 - DNA, 17 bp, Homo sapiens
gctacattcctcagctg

SEQ ID NO: 2102659 - DNA, 14 bp, Homo sapiens
gctacctcactggg

SEQ ID NO: 2102660 - DNA, 14 bp, Homo sapiens
gctacctgtgtgga

SEQ ID NO: 2102661 - DNA, 20 bp, Homo sapiens
gctacctgtgtggacaggac

SEQ ID NO: 2102662 - DNA, 15 bp, Homo sapiens
gctactaattatata

SEQ ID NO: 2102663 - DNA, 15 bp, Homo sapiens
gctactcagaagcct

SEQ ID NO: 2102664 - DNA, 21 bp, Homo sapiens
gctactcagaagcctgaggct

SEQ ID NO: 2102665 - DNA, 17 bp, Homo sapiens
gctactcagcagccctc

SEQ ID NO: 2102666 - DNA, 19 bp, Homo sapiens
gctactcagcagccctcct

SEQ ID NO: 2102667 - DNA, 16 bp, Homo sapiens
gctactcctgtgctct

SEQ ID NO: 2102668 - DNA, 20 bp, Homo sapiens
gctactctagtattccagac

SEQ ID NO: 2102669 - DNA, 21 bp, Homo sapiens
gctactctagtattccagacc

SEQ ID NO: 2102670 - DNA, 12 bp, Homo sapiens
gctactctgtcc

SEQ ID NO: 2102671 - DNA, 15 bp, Homo sapiens
gctactctgtccagg

SEQ ID NO: 2102672 - DNA, 20 bp, Homo sapiens
gctactctgtccaggccact

SEQ ID NO: 2102673 - DNA, 17 bp, Homo sapiens
gctactctgtgccagag

SEQ ID NO: 2102674 - DNA, 12 bp, Homo sapiens
gctactgaattt

SEQ ID NO: 2102675 - DNA, 19 bp, Homo sapiens
gctactgcagctttacatg

SEQ ID NO: 2102676 - DNA, 13 bp, Homo sapiens
gctactggcagct

SEQ ID NO: 2102677 - DNA, 15 bp, Homo sapiens
gctactggcagctcc

SEQ ID NO: 2102678 - DNA, 17 bp, Homo sapiens
gctactggcagctcctc

SEQ ID NO: 2102679 - DNA, 13 bp, Homo sapiens
gctacttaagaga

SEQ ID NO: 2102680 - DNA, 21 bp, Homo sapiens
gctacttaagagaaatggcaa

SEQ ID NO: 2102681 - DNA, 13 bp, Homo sapiens
gctacttgggagg

SEQ ID NO: 2102682 - DNA, 16 bp, Homo sapiens
gctactttgccttttg

SEQ ID NO: 2102683 - DNA, 18 bp, Homo sapiens
gctagaaccaagaagggc

SEQ ID NO: 2102684 - DNA, 20 bp, Homo sapiens
gctagaacctagaagggcta

SEQ ID NO: 2102685 - DNA, 15 bp, Homo sapiens
gctagaacctggaga

SEQ ID NO: 2102686 - DNA, 20 bp, Homo sapiens
gctagaagttgggttgttct

SEQ ID NO: 2102687 - DNA, 16 bp, Homo sapiens
gctagactggagtgag

SEQ ID NO: 2102688 - DNA, 20 bp, Homo sapiens
gctagagatatggcagcgaa

SEQ ID NO: 2102689 - DNA, 20 bp, Homo sapiens
gctagagcaacccctgtacc

SEQ ID NO: 2102690 - DNA, 18 bp, Homo sapiens
gctagccaactcctcctt

SEQ ID NO: 2102691 - DNA, 19 bp, Homo sapiens
gctagccaactcctccttg

SEQ ID NO: 2102692 - DNA, 13 bp, Homo sapiens
gctagccagaggg

SEQ ID NO: 2102693 - DNA, 20 bp, Homo sapiens
gctaggacccctccatgtgg

SEQ ID NO: 2102694 - DNA, 15 bp, Homo sapiens
gctaggactgaggag

SEQ ID NO: 2102695 - DNA, 19 bp, Homo sapiens
gctaggagagactgaaagc

SEQ ID NO: 2102696 - DNA, 18 bp, Homo sapiens
gctaggagcaaagcctgt

SEQ ID NO: 2102697 - DNA, 18 bp, Homo sapiens
gctaggattacaggcctt

SEQ ID NO: 2102698 - DNA, 15 bp, Homo sapiens
gctaggcctggccag

SEQ ID NO: 2102699 - DNA, 16 bp, Homo sapiens
gctaggcctggccaga

SEQ ID NO: 2102700 - DNA, 16 bp, Homo sapiens
gctaggcgagtgccag

SEQ ID NO: 2102701 - DNA, 18 bp, Homo sapiens
gctagggagaatgcagag

SEQ ID NO: 2102702 - DNA, 12 bp, Homo sapiens
gctagggctgga

SEQ ID NO: 2102703 - DNA, 13 bp, Homo sapiens
gctagggctggac

SEQ ID NO: 2102704 - DNA, 17 bp, Homo sapiens
gctagtgatgtttttat

SEQ ID NO: 2102705 - DNA, 15 bp, Homo sapiens
gctagtgatttcatt

SEQ ID NO: 2102706 - DNA, 20 bp, Homo sapiens
gctagtgtgagtggcagcca

SEQ ID NO: 2102707 - DNA, 22 bp, Homo sapiens
gctagtgtgagtggcagccatg

SEQ ID NO: 2102708 - DNA, 16 bp, Homo sapiens
gctagttgggcttcct

SEQ ID NO: 2102709 - DNA, 13 bp, Homo sapiens
gctataaatatat

SEQ ID NO: 2102710 - DNA, 16 bp, Homo sapiens
gctataggctggagaa

SEQ ID NO: 2102711 - DNA, 18 bp, Homo sapiens
gctataggtgctacaaaa

SEQ ID NO: 2102712 - DNA, 19 bp, Homo sapiens
gctataggtgctacaaaaa

SEQ ID NO: 2102713 - DNA, 19 bp, Homo sapiens
gctatatgccttaagccaa

SEQ ID NO: 2102714 - DNA, 14 bp, Homo sapiens
gctatattttcatg

SEQ ID NO: 2102715 - DNA, 23 bp, Homo sapiens
gctatattttcatgacttttcca

SEQ ID NO: 2102716 - DNA, 20 bp, Homo sapiens
gctatcaaaataaattgaaa

SEQ ID NO: 2102717 - DNA, 19 bp, Homo sapiens
gctatccagctatttttat

SEQ ID NO: 2102718 - DNA, 17 bp, Homo sapiens
gctatgatcgcgccact

SEQ ID NO: 2102719 - DNA, 18 bp, Homo sapiens
gctatgattatgccactg

SEQ ID NO: 2102720 - DNA, 21 bp, Homo sapiens
gctatggcaagggggtgtcat

SEQ ID NO: 2102721 - DNA, 18 bp, Homo sapiens
gctatgtttttaatgtat

SEQ ID NO: 2102722 - DNA, 18 bp, Homo sapiens
gctattaaaagaatccaa

SEQ ID NO: 2102723 - DNA, 22 bp, Homo sapiens
gctattatgtaacatccagaag

SEQ ID NO: 2102724 - DNA, 18 bp, Homo sapiens
gctattattttcactgta

SEQ ID NO: 2102725 - DNA, 12 bp, Homo sapiens
gctattctgtgt

SEQ ID NO: 2102726 - DNA, 20 bp, Homo sapiens
gctattctgtgttgaacaca

SEQ ID NO: 2102727 - DNA, 16 bp, Homo sapiens
gctattgaaattactg

SEQ ID NO: 2102728 - DNA, 14 bp, Homo sapiens
gctattgagaaaga

SEQ ID NO: 2102729 - DNA, 13 bp, Homo sapiens
gctattgatgttt

SEQ ID NO: 2102730 - DNA, 21 bp, Homo sapiens
gctattgatgtttccagaaaa

SEQ ID NO: 2102731 - DNA, 22 bp, Homo sapiens
gctattgatgtttccagaaaat

SEQ ID NO: 2102732 - DNA, 18 bp, Homo sapiens
gctattgcatgtaaaatg

SEQ ID NO: 2102733 - DNA, 15 bp, Homo sapiens
gctattgttgtgggc

SEQ ID NO: 2102734 - DNA, 16 bp, Homo sapiens
gctattgttgtgggct

SEQ ID NO: 2102735 - DNA, 15 bp, Homo sapiens
gctatttctctcccc

SEQ ID NO: 2102736 - DNA, 23 bp, Homo sapiens
gcctgaccctacttcttttgctc

SEQ ID NO: 2102737 - DNA, 12 bp, Homo sapiens
gcctgagcccag

SEQ ID NO: 2102738 - DNA, 14 bp, Homo sapiens
gcctgagcccaggg

SEQ ID NO: 2102739 - DNA, 15 bp, Homo sapiens
gcctgagcccaggga

SEQ ID NO: 2102740 - DNA, 20 bp, Homo sapiens
gcctgagcccagggaggccg

SEQ ID NO: 2102741 - DNA, 21 bp, Homo sapiens
gcctgaggctcaagaggccca

SEQ ID NO: 2102742 - DNA, 17 bp, Homo sapiens
gcctgaggctgagactg

SEQ ID NO: 2102743 - DNA, 15 bp, Homo sapiens
gcctgagggtggaga

SEQ ID NO: 2102744 - DNA, 16 bp, Homo sapiens
gcctgagtctcctgtg

SEQ ID NO: 2102745 - DNA, 13 bp, Homo sapiens
gcctgatggccaa

SEQ ID NO: 2102746 - DNA, 16 bp, Homo sapiens
gcctgatggccaaggg

SEQ ID NO: 2102747 - DNA, 19 bp, Homo sapiens
gcctgatggccaagggggt

SEQ ID NO: 2102748 - DNA, 18 bp, Homo sapiens
gcctgcacccttcctcct

SEQ ID NO: 2102749 - DNA, 16 bp, Homo sapiens
gcctgcagactcactg

SEQ ID NO: 2102750 - DNA, 18 bp, Homo sapiens
gcctgcagagagaagcct

SEQ ID NO: 2102751 - DNA, 10 bp, Homo sapiens
gcctgcagcc

SEQ ID NO: 2102752 - DNA, 15 bp, Homo sapiens
gcctgcagcctcccc

SEQ ID NO: 2102753 - DNA, 23 bp, Homo sapiens
gcctgcagcctcccccacaaata

SEQ ID NO: 2102754 - DNA, 14 bp, Homo sapiens
gcctgccagggccc

SEQ ID NO: 2102755 - DNA, 15 bp, Homo sapiens
gcctgccagggcccc

SEQ ID NO: 2102756 - DNA, 21 bp, Homo sapiens
gcctgccataccgctggggaa

SEQ ID NO: 2102757 - DNA, 18 bp, Homo sapiens
gcctgcccaatgctttgg

SEQ ID NO: 2102758 - DNA, 14 bp, Homo sapiens
gcctgcccagcctc

SEQ ID NO: 2102759 - DNA, 11 bp, Homo sapiens
gcctgcccagg

SEQ ID NO: 2102760 - DNA, 22 bp, Homo sapiens
gcctgcccaggcccctgccacc

SEQ ID NO: 2102761 - DNA, 23 bp, Homo sapiens
gcctgcccccagcactcctctgt

SEQ ID NO: 2102762 - DNA, 13 bp, Homo sapiens
gcctgccctccca

SEQ ID NO: 2102763 - DNA, 14 bp, Homo sapiens
gcctgccctcccct

SEQ ID NO: 2102764 - DNA, 19 bp, Homo sapiens
gcctgccctccctggggtc

SEQ ID NO: 2102765 - DNA, 21 bp, Homo sapiens
gcctgccgccgtctctgtccc

SEQ ID NO: 2102766 - DNA, 20 bp, Homo sapiens
gcctgcctcagctgctcgca

SEQ ID NO: 2102767 - DNA, 15 bp, Homo sapiens
gcctgcctcccagcc

SEQ ID NO: 2102768 - DNA, 17 bp, Homo sapiens
gcctgcctcccagccct

SEQ ID NO: 2102769 - DNA, 12 bp, Homo sapiens
gcctgcctctga

SEQ ID NO: 2102770 - DNA, 20 bp, Homo sapiens
gcctgcctctgactcacact

SEQ ID NO: 2102771 - DNA, 17 bp, Homo sapiens
gcctgcctgttcccatt

SEQ ID NO: 2102772 - DNA, 16 bp, Homo sapiens
gcctgcggccgggctg

SEQ ID NO: 2102773 - DNA, 19 bp, Homo sapiens
gcctgcggccgggctgccc

SEQ ID NO: 2102774 - DNA, 20 bp, Homo sapiens
gcctgcgttttggaagctct

SEQ ID NO: 2102775 - DNA, 23 bp, Homo sapiens
gcctgctagagcaacccctgtac

SEQ ID NO: 2102776 - DNA, 17 bp, Homo sapiens
gcctgctcccccacccc

SEQ ID NO: 2102777 - DNA, 23 bp, Homo sapiens
gcctgctgaatgatttccaaaga

SEQ ID NO: 2102778 - DNA, 14 bp, Homo sapiens
gcctgctgctgaga

SEQ ID NO: 2102779 - DNA, 19 bp, Homo sapiens
gcctgctgctgagaacctg

SEQ ID NO: 2102780 - DNA, 20 bp, Homo sapiens
gcctgctgctgagaacctgg

SEQ ID NO: 2102781 - DNA, 22 bp, Homo sapiens
gcctgctgctgagaacctggcc

SEQ ID NO: 2102782 - DNA, 13 bp, Homo sapiens
gcctgctgggaac

SEQ ID NO: 2102783 - DNA, 23 bp, Homo sapiens
gcctgctgggaaccccgcagccc

SEQ ID NO: 2102784 - DNA, 20 bp, Homo sapiens
gcctgctgggctctccacct

SEQ ID NO: 2102785 - DNA, 21 bp, Homo sapiens
gcctgctgggctctccacctc

SEQ ID NO: 2102786 - DNA, 15 bp, Homo sapiens
gcctgcttttccagg

SEQ ID NO: 2102787 - DNA, 19 bp, Homo sapiens
gcctgcttttccaggatcc

SEQ ID NO: 2102788 - DNA, 23 bp, Homo sapiens
gcctgcttttccaggatcctgca

SEQ ID NO: 2102789 - DNA, 12 bp, Homo sapiens
gcctggaaccag

SEQ ID NO: 2102790 - DNA, 15 bp, Homo sapiens
gcctggaaccaggga

SEQ ID NO: 2102791 - DNA, 18 bp, Homo sapiens
gcctggaccgcttcccag

SEQ ID NO: 2102792 - DNA, 21 bp, Homo sapiens
gcctggaccgcttcccagagg

SEQ ID NO: 2102793 - DNA, 15 bp, Homo sapiens
gcctggactctaagc

SEQ ID NO: 2102794 - DNA, 19 bp, Homo sapiens
gcctggactctaagctgga

SEQ ID NO: 2102795 - DNA, 22 bp, Homo sapiens
gcctggactctaagctggagct

SEQ ID NO: 2102796 - DNA, 12 bp, Homo sapiens
gcctggagaggg

SEQ ID NO: 2102797 - DNA, 13 bp, Homo sapiens
gcctggagagggg

SEQ ID NO: 2102798 - DNA, 16 bp, Homo sapiens
gcctggagaggggcct

SEQ ID NO: 2102799 - DNA, 19 bp, Homo sapiens
gcctggagaggggcctggg

SEQ ID NO: 2102800 - DNA, 21 bp, Homo sapiens
gcctggagaggggcctgggaa

SEQ ID NO: 2102801 - DNA, 21 bp, Homo sapiens
gcctggagatgacttgaggcc

SEQ ID NO: 2102802 - DNA, 12 bp, Homo sapiens
gcctggatctcc

SEQ ID NO: 2102803 - DNA, 20 bp, Homo sapiens
gcctggatgttgctgtgcac

SEQ ID NO: 2102804 - DNA, 14 bp, Homo sapiens
gcctggcacacatc

SEQ ID NO: 2102805 - DNA, 14 bp, Homo sapiens
gcctggcacagggc

SEQ ID NO: 2102806 - DNA, 19 bp, Homo sapiens
gcctggcacagggcagtgg

SEQ ID NO: 2102807 - DNA, 12 bp, Homo sapiens
gcctggcagccg

SEQ ID NO: 2102808 - DNA, 21 bp, Homo sapiens
gcctggccagatgcaccagcc

SEQ ID NO: 2102809 - DNA, 12 bp, Homo sapiens
gcctggccaggc

SEQ ID NO: 2102810 - DNA, 18 bp, Homo sapiens
gcctggcccccctccagg

SEQ ID NO: 2102811 - DNA, 15 bp, Homo sapiens
gcctggccggcaacc

SEQ ID NO: 2102812 - DNA, 14 bp, Homo sapiens
gcctggccggctcc

SEQ ID NO: 2102813 - DNA, 15 bp, Homo sapiens
gcctggccggctcca

SEQ ID NO: 2102814 - DNA, 19 bp, Homo sapiens
gcctggcctcctgcctcta

SEQ ID NO: 2102815 - DNA, 22 bp, Homo sapiens
gcctggcctcctgcctctactg

SEQ ID NO: 2102816 - DNA, 17 bp, Homo sapiens
gcctggcctgagctggg

SEQ ID NO: 2102817 - DNA, 20 bp, Homo sapiens
gcctggcctgagctggggcc

SEQ ID NO: 2102818 - DNA, 14 bp, Homo sapiens
gcctggcctggctc

SEQ ID NO: 2102819 - DNA, 12 bp, Homo sapiens
gcctggccttgt

SEQ ID NO: 2102820 - DNA, 23 bp, Homo sapiens
gcctggccttgtcaggacccagg

SEQ ID NO: 2102821 - DNA, 19 bp, Homo sapiens
gcctggcggggcaggaggc

SEQ ID NO: 2102822 - DNA, 22 bp, Homo sapiens
gctgagcttagccttgtgccct

SEQ ID NO: 2102823 - DNA, 23 bp, Homo sapiens
gctgagcttagccttgtgccctg

SEQ ID NO: 2102824 - DNA, 13 bp, Homo sapiens
gctgaggactccc

SEQ ID NO: 2102825 - DNA, 18 bp, Homo sapiens
gctgaggatcctcacagg

SEQ ID NO: 2102826 - DNA, 21 bp, Homo sapiens
gctgaggatcctcacaggagc

SEQ ID NO: 2102827 - DNA, 22 bp, Homo sapiens
gctgaggatcctcacaggagca

SEQ ID NO: 2102828 - DNA, 12 bp, Homo sapiens
gctgaggcagga

SEQ ID NO: 2102829 - DNA, 23 bp, Homo sapiens
gctgaggggggccgtgcccaggg

SEQ ID NO: 2102830 - DNA, 16 bp, Homo sapiens
gctgaggtgcccagga

SEQ ID NO: 2102831 - DNA, 18 bp, Homo sapiens
gctgaggtgcccaggaga

SEQ ID NO: 2102832 - DNA, 17 bp, Homo sapiens
gctgagtcacctcctcc

SEQ ID NO: 2102833 - DNA, 22 bp, Homo sapiens
gctgagtcacctcctccactca

SEQ ID NO: 2102834 - DNA, 22 bp, Homo sapiens
gctgagtcatgatctccctgcc

SEQ ID NO: 2102835 - DNA, 22 bp, Homo sapiens
gctgagtgaaaaatctgtggaa

SEQ ID NO: 2102836 - DNA, 21 bp, Homo sapiens
gctgagtgactgtaggcaggg

SEQ ID NO: 2102837 - DNA, 20 bp, Homo sapiens
gctgagtggaatgcagggaa

SEQ ID NO: 2102838 - DNA, 13 bp, Homo sapiens
gctgataatttta

SEQ ID NO: 2102839 - DNA, 20 bp, Homo sapiens
gctgatattatggcaagtga

SEQ ID NO: 2102840 - DNA, 16 bp, Homo sapiens
gctgatcaatgaaatg

SEQ ID NO: 2102841 - DNA, 16 bp, Homo sapiens
gctgatcgtgctaaat

SEQ ID NO: 2102842 - DNA, 17 bp, Homo sapiens
gctgatggagaaggaag

SEQ ID NO: 2102843 - DNA, 16 bp, Homo sapiens
gctgatgtgagtgtgt

SEQ ID NO: 2102844 - DNA, 21 bp, Homo sapiens
gctgatttccaggcccctgag

SEQ ID NO: 2102845 - DNA, 23 bp, Homo sapiens
gctgatttccaggcccctgagga

SEQ ID NO: 2102846 - DNA, 19 bp, Homo sapiens
gctgcaaagtgcaaatact

SEQ ID NO: 2102847 - DNA, 17 bp, Homo sapiens
gctgcaagggccagagt

SEQ ID NO: 2102848 - DNA, 20 bp, Homo sapiens
gctgcaagtgacatctcttt

SEQ ID NO: 2102849 - DNA, 20 bp, Homo sapiens
gctgcaccacggcgtttttt

SEQ ID NO: 2102850 - DNA, 12 bp, Homo sapiens
gctgcaccagag

SEQ ID NO: 2102851 - DNA, 13 bp, Homo sapiens
gctgcaccagagt

SEQ ID NO: 2102852 - DNA, 22 bp, Homo sapiens
gctgcaccagagtgaaagggct

SEQ ID NO: 2102853 - DNA, 17 bp, Homo sapiens
gctgcagagctgaccca

SEQ ID NO: 2102854 - DNA, 19 bp, Homo sapiens
gctgcagatttcctgtgtg

SEQ ID NO: 2102855 - DNA, 18 bp, Homo sapiens
gctgcagcatgaaggcag

SEQ ID NO: 2102856 - DNA, 12 bp, Homo sapiens
gctgcagctggg

SEQ ID NO: 2102857 - DNA, 13 bp, Homo sapiens
gctgcagctgggc

SEQ ID NO: 2102858 - DNA, 16 bp, Homo sapiens
gctgcagctgggcccc

SEQ ID NO: 2102859 - DNA, 16 bp, Homo sapiens
gctgcaggaatcaaaa

SEQ ID NO: 2102860 - DNA, 19 bp, Homo sapiens
gctgcagtcaacagttcaa

SEQ ID NO: 2102861 - DNA, 20 bp, Homo sapiens
gctgcagtcaacagttcaaa

SEQ ID NO: 2102862 - DNA, 17 bp, Homo sapiens
gctgcatatgagtcttt

SEQ ID NO: 2102863 - DNA, 22 bp, Homo sapiens
gctgcatctgggattcccacca

SEQ ID NO: 2102864 - DNA, 14 bp, Homo sapiens
gctgcatgcctggt

SEQ ID NO: 2102865 - DNA, 20 bp, Homo sapiens
gctgcatgcctggtctttcc

SEQ ID NO: 2102866 - DNA, 18 bp, Homo sapiens
gctgctgaagttctgagc

SEQ ID NO: 2102867 - DNA, 20 bp, Homo sapiens
gctgctgaagttctgagccg

SEQ ID NO: 2102868 - DNA, 13 bp, Homo sapiens
gctgctgacagga

SEQ ID NO: 2102869 - DNA, 15 bp, Homo sapiens
gctgctgacaggatg

SEQ ID NO: 2102870 - DNA, 18 bp, Homo sapiens
gctgctgacaggatgtgg

SEQ ID NO: 2102871 - DNA, 21 bp, Homo sapiens
gctgctgacaggatgtggcac

SEQ ID NO: 2102872 - DNA, 15 bp, Homo sapiens
gctgctgagaacctg

SEQ ID NO: 2102873 - DNA, 21 bp, Homo sapiens
gctgctgagaacctggccttc

SEQ ID NO: 2102874 - DNA, 22 bp, Homo sapiens
gctgctgagaacctggccttca

SEQ ID NO: 2102875 - DNA, 12 bp, Homo sapiens
gctgctgctctg

SEQ ID NO: 2102876 - DNA, 15 bp, Homo sapiens
gctgctggggcatgt

SEQ ID NO: 2102877 - DNA, 23 bp, Homo sapiens
gctgctggggcatgtgtgcctgt

SEQ ID NO: 2102878 - DNA, 17 bp, Homo sapiens
gctgctgtaactgctga

SEQ ID NO: 2102879 - DNA, 22 bp, Homo sapiens
gctgctgtaactgctgagccac

SEQ ID NO: 2102880 - DNA, 12 bp, Homo sapiens
gctgctgtcctt

SEQ ID NO: 2102881 - DNA, 22 bp, Homo sapiens
gctgctgttgctggactgagga

SEQ ID NO: 2102882 - DNA, 22 bp, Homo sapiens
gctgcttgactatcacatacaa

SEQ ID NO: 2102883 - DNA, 14 bp, Homo sapiens
gctgcttgtcctgc

SEQ ID NO: 2102884 - DNA, 18 bp, Homo sapiens
gctgcttgtcctgctctc

SEQ ID NO: 2102885 - DNA, 19 bp, Homo sapiens
gctgcttgtcctgctctct

SEQ ID NO: 2102886 - DNA, 15 bp, Homo sapiens
gctgcttgtgggccc

SEQ ID NO: 2102887 - DNA, 11 bp, Homo sapiens
gctggaaataa

SEQ ID NO: 2102888 - DNA, 14 bp, Homo sapiens
gctggaaataaacc

SEQ ID NO: 2102889 - DNA, 15 bp, Homo sapiens
gctggaaggcagggc

SEQ ID NO: 2102890 - DNA, 16 bp, Homo sapiens
gctggaaggcagggca

SEQ ID NO: 2102891 - DNA, 17 bp, Homo sapiens
gctggaaggcagggcag

SEQ ID NO: 2102892 - DNA, 23 bp, Homo sapiens
gctggaaggcagggcagagggaa

SEQ ID NO: 2102893 - DNA, 21 bp, Homo sapiens
gctggaatctggagagctaga

SEQ ID NO: 2102894 - DNA, 22 bp, Homo sapiens
gctggaattctaaatgctggtc

SEQ ID NO: 2102895 - DNA, 18 bp, Homo sapiens
gctggacaagaagctgct

SEQ ID NO: 2102896 - DNA, 13 bp, Homo sapiens
gctggacctgcac

SEQ ID NO: 2102897 - DNA, 15 bp, Homo sapiens
gctggaccttgaact

SEQ ID NO: 2102898 - DNA, 18 bp, Homo sapiens
gctggaccttgaactggg

SEQ ID NO: 2102899 - DNA, 13 bp, Homo sapiens
gctggactgagga

SEQ ID NO: 2102900 - DNA, 20 bp, Homo sapiens
gctggagagcatagggtctg

SEQ ID NO: 2102901 - DNA, 21 bp, Homo sapiens
gctggagcctcggtggccatg

SEQ ID NO: 2102902 - DNA, 13 bp, Homo sapiens
gctggagctcttg

SEQ ID NO: 2102903 - DNA, 12 bp, Homo sapiens
gctggagctggc

SEQ ID NO: 2102904 - DNA, 13 bp, Homo sapiens
gctggagctggct

SEQ ID NO: 2102905 - DNA, 13 bp, Homo sapiens
gctggaggcaggg

SEQ ID NO: 2102906 - DNA, 14 bp, Homo sapiens
gctggaggcagggc

SEQ ID NO: 2102907 - DNA, 15 bp, Homo sapiens
gctggaggcagggcc

SEQ ID NO: 2102908 - DNA, 21 bp, Homo sapiens
gctggaggcagggccttgccc

SEQ ID NO: 2102909 - DNA, 14 bp, Homo sapiens
gctggagtgcagtg

SEQ ID NO: 2102910 - DNA, 15 bp, Homo sapiens
gctggagtgcagtga

SEQ ID NO: 2102911 - DNA, 22 bp, Homo sapiens
gctggagtgcagtgagccgaga

SEQ ID NO: 2102912 - DNA, 14 bp, Homo sapiens
gctggataaaatga

SEQ ID NO: 2102913 - DNA, 15 bp, Homo sapiens
gctggcaaaggtggc

SEQ ID NO: 2102914 - DNA, 12 bp, Homo sapiens
gctggcacctca

SEQ ID NO: 2102915 - DNA, 22 bp, Homo sapiens
ggaactagagggatacactgaa

SEQ ID NO: 2102916 - DNA, 13 bp, Homo sapiens
ggaactcatcctg

SEQ ID NO: 2102917 - DNA, 21 bp, Homo sapiens
ggaactcatcctgtgtgggga

SEQ ID NO: 2102918 - DNA, 13 bp, Homo sapiens
ggaactccactct

SEQ ID NO: 2102919 - DNA, 19 bp, Homo sapiens
ggaactccactctccttcg

SEQ ID NO: 2102920 - DNA, 15 bp, Homo sapiens
ggaactcctggaaat

SEQ ID NO: 2102921 - DNA, 21 bp, Homo sapiens
ggaactctgacaagggctgac

SEQ ID NO: 2102922 - DNA, 21 bp, Homo sapiens
ggaactgaagggggcggccta

SEQ ID NO: 2102923 - DNA, 12 bp, Homo sapiens
ggaactggaaca

SEQ ID NO: 2102924 - DNA, 17 bp, Homo sapiens
ggaactggaatcctttc

SEQ ID NO: 2102925 - DNA, 14 bp, Homo sapiens
ggaactggccaagc

SEQ ID NO: 2102926 - DNA, 17 bp, Homo sapiens
ggaactggccaagctga

SEQ ID NO: 2102927 - DNA, 18 bp, Homo sapiens
ggaacttgaactgattca

SEQ ID NO: 2102928 - DNA, 16 bp, Homo sapiens
ggaagaaaactatcct

SEQ ID NO: 2102929 - DNA, 17 bp, Homo sapiens
ggaagaaaaggtacatg

SEQ ID NO: 2102930 - DNA, 11 bp, Homo sapiens
ggaagaaacag

SEQ ID NO: 2102931 - DNA, 18 bp, Homo sapiens
ggaagaaaccccaagcag

SEQ ID NO: 2102932 - DNA, 19 bp, Homo sapiens
ggaagaaaccccaagcagc

SEQ ID NO: 2102933 - DNA, 20 bp, Homo sapiens
ggaagaagagatcaggaaga

SEQ ID NO: 2102934 - DNA, 21 bp, Homo sapiens
ggaagaagagatcaggaagag

SEQ ID NO: 2102935 - DNA, 20 bp, Homo sapiens
ggaagaagccccgtttccag

SEQ ID NO: 2102936 - DNA, 17 bp, Homo sapiens
ggaagacaaaatgtttt

SEQ ID NO: 2102937 - DNA, 13 bp, Homo sapiens
ggaagacaggtct

SEQ ID NO: 2102938 - DNA, 19 bp, Homo sapiens
ggaagacaggtctagactt

SEQ ID NO: 2102939 - DNA, 13 bp, Homo sapiens
ggaagagaaacca

SEQ ID NO: 2102940 - DNA, 15 bp, Homo sapiens
ggaagagaaattttt

SEQ ID NO: 2102941 - DNA, 11 bp, Homo sapiens
ggaagagagag

SEQ ID NO: 2102942 - DNA, 14 bp, Homo sapiens
ggaagagagagaga

SEQ ID NO: 2102943 - DNA, 19 bp, Homo sapiens
ggaagagagagagagaggt

SEQ ID NO: 2102944 - DNA, 12 bp, Homo sapiens
ggaagagaggca

SEQ ID NO: 2102945 - DNA, 17 bp, Homo sapiens
ggaagagaggcacctgc

SEQ ID NO: 2102946 - DNA, 18 bp, Homo sapiens
ggaagagaggcacctgct

SEQ ID NO: 2102947 - DNA, 21 bp, Homo sapiens
ggaagagaggcacctgctgga

SEQ ID NO: 2102948 - DNA, 21 bp, Homo sapiens
ggaagagggcagtacctggga

SEQ ID NO: 2102949 - DNA, 15 bp, Homo sapiens
ggaagatgaagagaa

SEQ ID NO: 2102950 - DNA, 20 bp, Homo sapiens
ggaagatgaagagaagctga

SEQ ID NO: 2102951 - DNA, 15 bp, Homo sapiens
ggaagatggtagcag

SEQ ID NO: 2102952 - DNA, 18 bp, Homo sapiens
ggaagatggtagcagata

SEQ ID NO: 2102953 - DNA, 18 bp, Homo sapiens
ggaagattttaaattcac

SEQ ID NO: 2102954 - DNA, 15 bp, Homo sapiens
ggaagcaagaaagcc

SEQ ID NO: 2102955 - DNA, 23 bp, Homo sapiens
ggaagcaagacgtcctggaatga

SEQ ID NO: 2102956 - DNA, 23 bp, Homo sapiens
ggaagcacatgtttatttattct

SEQ ID NO: 2102957 - DNA, 16 bp, Homo sapiens
ggaagcccaaggcagt

SEQ ID NO: 2102958 - DNA, 18 bp, Homo sapiens
ggaagccccccacctttc

SEQ ID NO: 2102959 - DNA, 12 bp, Homo sapiens
ggaagccctcct

SEQ ID NO: 2102960 - DNA, 15 bp, Homo sapiens
ggaagccctccttcc

SEQ ID NO: 2102961 - DNA, 16 bp, Homo sapiens
ggaagccctccttcca

SEQ ID NO: 2102962 - DNA, 23 bp, Homo sapiens
ggaagccctggatttcagaaaga

SEQ ID NO: 2102963 - DNA, 15 bp, Homo sapiens
ggaagccgtctgact

SEQ ID NO: 2102964 - DNA, 15 bp, Homo sapiens
ggaagcctcttcagg

SEQ ID NO: 2102965 - DNA, 20 bp, Homo sapiens
ggaagcggaggttgcaggga

SEQ ID NO: 2102966 - DNA, 15 bp, Homo sapiens
ggaagctgagcaggc

SEQ ID NO: 2102967 - DNA, 18 bp, Homo sapiens
ggaagctgagcaggcccg

SEQ ID NO: 2102968 - DNA, 17 bp, Homo sapiens
ggaagctgccctgccca

SEQ ID NO: 2102969 - DNA, 17 bp, Homo sapiens
ggaagctgtactcagag

SEQ ID NO: 2102970 - DNA, 21 bp, Homo sapiens
ggaaggagactcacctctgcc

SEQ ID NO: 2102971 - DNA, 13 bp, Homo sapiens
ggaaggcagctgc

SEQ ID NO: 2102972 - DNA, 14 bp, Homo sapiens
ggaaggcagctgct

SEQ ID NO: 2102973 - DNA, 15 bp, Homo sapiens
ggaaggcagctgctc

SEQ ID NO: 2102974 - DNA, 14 bp, Homo sapiens
ggaaggcaggcagg

SEQ ID NO: 2102975 - DNA, 17 bp, Homo sapiens
ctgagtttcattctcct

SEQ ID NO: 2102976 - DNA, 18 bp, Homo sapiens
ctgagtttcattctcctg

SEQ ID NO: 2102977 - DNA, 19 bp, Homo sapiens
ctgagtttcattctcctgc

SEQ ID NO: 2102978 - DNA, 22 bp, Homo sapiens
ctgataaacattaaacactgta

SEQ ID NO: 2102979 - DNA, 14 bp, Homo sapiens
ctgataaagaaaga

SEQ ID NO: 2102980 - DNA, 14 bp, Homo sapiens
ctgataataattga

SEQ ID NO: 2102981 - DNA, 12 bp, Homo sapiens
ctgatacctcaa

SEQ ID NO: 2102982 - DNA, 16 bp, Homo sapiens
ctgatatattttccag

SEQ ID NO: 2102983 - DNA, 16 bp, Homo sapiens
ctgatatgggactgag

SEQ ID NO: 2102984 - DNA, 14 bp, Homo sapiens
ctgatcaaaaataa

SEQ ID NO: 2102985 - DNA, 16 bp, Homo sapiens
ctgatcaaaaataaac

SEQ ID NO: 2102986 - DNA, 17 bp, Homo sapiens
ctgatcacctctggctt

SEQ ID NO: 2102987 - DNA, 19 bp, Homo sapiens
ctgatcgtgctaaattttc

SEQ ID NO: 2102988 - DNA, 14 bp, Homo sapiens
ctgatgaaaatgaa

SEQ ID NO: 2102989 - DNA, 16 bp, Homo sapiens
ctgatgacagagcgag

SEQ ID NO: 2102990 - DNA, 17 bp, Homo sapiens
ctgatgacagagcgaga

SEQ ID NO: 2102991 - DNA, 22 bp, Homo sapiens
ctgatgagtgattgacacacag

SEQ ID NO: 2102992 - DNA, 18 bp, Homo sapiens
ctgatgcatcagaaaggg

SEQ ID NO: 2102993 - DNA, 14 bp, Homo sapiens
ctgatgccccttcc

SEQ ID NO: 2102994 - DNA, 15 bp, Homo sapiens
ctgatgccccttccc

SEQ ID NO: 2102995 - DNA, 11 bp, Homo sapiens
ctgatgctgcc

SEQ ID NO: 2102996 - DNA, 17 bp, Homo sapiens
ctgatgctttgcttcaa

SEQ ID NO: 2102997 - DNA, 14 bp, Homo sapiens
ctgatggagaagga

SEQ ID NO: 2102998 - DNA, 11 bp, Homo sapiens
ctgatggccaa

SEQ ID NO: 2102999 - DNA, 16 bp, Homo sapiens
ctgatggccaagagca

SEQ ID NO: 2103000 - DNA, 24 bp, Homo sapiens
ctgatgggcaacccccagcctgct

SEQ ID NO: 2103001 - DNA, 18 bp, Homo sapiens
ctgatggtgagctgggaa

SEQ ID NO: 2103002 - DNA, 16 bp, Homo sapiens
ctgatggtgctcacga

SEQ ID NO: 2103003 - DNA, 20 bp, Homo sapiens
ctgatgttcctagtgaaaga

SEQ ID NO: 2103004 - DNA, 21 bp, Homo sapiens
ctgattatcctataggcagac

SEQ ID NO: 2103005 - DNA, 21 bp, Homo sapiens
ctgattcacatctcatttttc

SEQ ID NO: 2103006 - DNA, 15 bp, Homo sapiens
ctgattcccaagctc

SEQ ID NO: 2103007 - DNA, 13 bp, Homo sapiens
ctgattccccact

SEQ ID NO: 2103008 - DNA, 18 bp, Homo sapiens
ctgattctcctgtcagag

SEQ ID NO: 2103009 - DNA, 13 bp, Homo sapiens
ctgattctgggat

SEQ ID NO: 2103010 - DNA, 14 bp, Homo sapiens
ctgattctgggatg

SEQ ID NO: 2103011 - DNA, 16 bp, Homo sapiens
ctgattggctcaccca

SEQ ID NO: 2103012 - DNA, 12 bp, Homo sapiens
ctgatttaatgt

SEQ ID NO: 2103013 - DNA, 12 bp, Homo sapiens
ctgatttcagga

SEQ ID NO: 2103014 - DNA, 14 bp, Homo sapiens
ctgatttccaggcc

SEQ ID NO: 2103015 - DNA, 23 bp, Homo sapiens
ctgattttaaaaggttgactcaa

SEQ ID NO: 2103016 - DNA, 18 bp, Homo sapiens
ctgattttgtcactgtct

SEQ ID NO: 2103017 - DNA, 16 bp, Homo sapiens
ctgcaaactcactgct

SEQ ID NO: 2103018 - DNA, 19 bp, Homo sapiens
ctgcaaagggaactgaaga

SEQ ID NO: 2103019 - DNA, 21 bp, Homo sapiens
ctgcaaagggtatcaggtgct

SEQ ID NO: 2103020 - DNA, 19 bp, Homo sapiens
ctgcaacctcttcctcctg

SEQ ID NO: 2103021 - DNA, 17 bp, Homo sapiens
ctgcaaccttgcatcca

SEQ ID NO: 2103022 - DNA, 15 bp, Homo sapiens
ctgcaactagccaag

SEQ ID NO: 2103023 - DNA, 21 bp, Homo sapiens
ctgcaagagccttggtgtcca

SEQ ID NO: 2103024 - DNA, 16 bp, Homo sapiens
ctgcaagaggctcctg

SEQ ID NO: 2103025 - DNA, 14 bp, Homo sapiens
ctgcaagatttcac

SEQ ID NO: 2103026 - DNA, 18 bp, Homo sapiens
ctgcaagcagggctctgc

SEQ ID NO: 2103027 - DNA, 17 bp, Homo sapiens
ctgcaagccccagggcc

SEQ ID NO: 2103028 - DNA, 21 bp, Homo sapiens
ctgcaagccccagggcctggg

SEQ ID NO: 2103029 - DNA, 15 bp, Homo sapiens
ctgcaagggccagag

SEQ ID NO: 2103030 - DNA, 17 bp, Homo sapiens
ctgcaagggccagagtt

SEQ ID NO: 2103031 - DNA, 19 bp, Homo sapiens
ctgcaagtgacatctcttt

SEQ ID NO: 2103032 - DNA, 13 bp, Homo sapiens
ctgcaagtgcccg

SEQ ID NO: 2103033 - DNA, 15 bp, Homo sapiens
ctgcaagtgcccgcc

SEQ ID NO: 2103034 - DNA, 15 bp, Homo sapiens
ctgcaatctccaggg

SEQ ID NO: 2103035 - DNA, 21 bp, Homo sapiens
ctgcaatctccagggctgccc

SEQ ID NO: 2103036 - DNA, 16 bp, Homo sapiens
ctgcaatgttttcctt

SEQ ID NO: 2103037 - DNA, 18 bp, Homo sapiens
ctgcacaaagcccttcca

SEQ ID NO: 2103038 - DNA, 18 bp, Homo sapiens
ctgcacagtgcatctcag

SEQ ID NO: 2103039 - DNA, 15 bp, Homo sapiens
ctgcacagtttagaa

SEQ ID NO: 2103040 - DNA, 16 bp, Homo sapiens
ctgcacagtttagaac

SEQ ID NO: 2103041 - DNA, 22 bp, Homo sapiens
ctgcacatgaatcccacccaca

SEQ ID NO: 2103042 - DNA, 23 bp, Homo sapiens
ctgcacatgaatcccacccacat

SEQ ID NO: 2103043 - DNA, 21 bp, Homo sapiens
ctgcacatgtcttgtacatgt

SEQ ID NO: 2103044 - DNA, 23 bp, Homo sapiens
ctgcacatgtcttgtacatgtgt

SEQ ID NO: 2103045 - DNA, 15 bp, Homo sapiens
ctgcacattcctggc

SEQ ID NO: 2103046 - DNA, 16 bp, Homo sapiens
ctgcacattcctggcc

SEQ ID NO: 2103047 - DNA, 22 bp, Homo sapiens
ctgcacattcctggccccgggc

SEQ ID NO: 2103048 - DNA, 23 bp, Homo sapiens
ctgcaccagcccttccctgcttt

SEQ ID NO: 2103049 - DNA, 12 bp, Homo sapiens
ctgcaccctgga

SEQ ID NO: 2103050 - DNA, 18 bp, Homo sapiens
ctgcaccctggaaagggg

SEQ ID NO: 2103051 - DNA, 17 bp, Homo sapiens
ctgcacccttcctcctc

SEQ ID NO: 2103052 - DNA, 12 bp, Homo sapiens
ctgcaccgggcc

SEQ ID NO: 2103053 - DNA, 14 bp, Homo sapiens
ctgcaccgggccac

SEQ ID NO: 2103054 - DNA, 20 bp, Homo sapiens
ctgcaccgggccacagagaa

SEQ ID NO: 2103055 - DNA, 17 bp, Homo sapiens
ctgcacctccccccact

SEQ ID NO: 2103056 - DNA, 21 bp, Homo sapiens
ctgcacctccccccactgcag

SEQ ID NO: 2103057 - DNA, 14 bp, Homo sapiens
ctgcacctgtgcag

SEQ ID NO: 2103058 - DNA, 21 bp, Homo sapiens
ctgcacgccaccgctgccttt

SEQ ID NO: 2103059 - DNA, 21 bp, Homo sapiens
ctgcactaaaacccatcttcc

SEQ ID NO: 2103060 - DNA, 17 bp, Homo sapiens
ctgcactatagcctagg

SEQ ID NO: 2103061 - DNA, 22 bp, Homo sapiens
ctgcactatagcctaggtgaca

SEQ ID NO: 2103062 - DNA, 23 bp, Homo sapiens
ctgcactatagcctaggtgacag

SEQ ID NO: 2103063 - DNA, 13 bp, Homo sapiens
ctgcactccagaa

SEQ ID NO: 2103064 - DNA, 14 bp, Homo sapiens
ctgcactccagaat

SEQ ID NO: 2103065 - DNA, 14 bp, Homo sapiens
ctgcactccatggc

SEQ ID NO: 2103066 - DNA, 21 bp, Homo sapiens
ctgcactccatggccaccccg

SEQ ID NO: 2103067 - DNA, 15 bp, Homo sapiens
ctgcactctagcctg

SEQ ID NO: 2103068 - DNA, 18 bp, Homo sapiens
ctgcactctagcctggca

SEQ ID NO: 2103069 - DNA, 18 bp, Homo sapiens
ctgcactgaaaaggttct

SEQ ID NO: 2103070 - DNA, 12 bp, Homo sapiens
ctgcactgtcaa

SEQ ID NO: 2103071 - DNA, 16 bp, Homo sapiens
ctgcacttgcagactc

SEQ ID NO: 2103072 - DNA, 16 bp, Homo sapiens
ctgcagaaggccaaga

SEQ ID NO: 2103073 - DNA, 19 bp, Homo sapiens
ctgcagaaggccaagaatc

SEQ ID NO: 2103074 - DNA, 13 bp, Homo sapiens
ctgcagaccctgc

SEQ ID NO: 2103075 - DNA, 15 bp, Homo sapiens
ctgcagaccctgccc

SEQ ID NO: 2103076 - DNA, 16 bp, Homo sapiens
ctgcagaccctgccct

SEQ ID NO: 2103077 - DNA, 17 bp, Homo sapiens
ctgcagaccctgccctt

SEQ ID NO: 2103078 - DNA, 13 bp, Homo sapiens
ctgcagagacctt

SEQ ID NO: 2103079 - DNA, 14 bp, Homo sapiens
ctttttttctctcc

SEQ ID NO: 2103080 - DNA, 21 bp, Homo sapiens
gaaaaaaaaagtcagactgct

SEQ ID NO: 2103081 - DNA, 20 bp, Homo sapiens
gaaaaaaaatgttctttggg

SEQ ID NO: 2103082 - DNA, 21 bp, Homo sapiens
gaaaaaataattgatttcaag

SEQ ID NO: 2103083 - DNA, 10 bp, Homo sapiens
gaaaaaatac

SEQ ID NO: 2103084 - DNA, 13 bp, Homo sapiens
gaaaaaatacatt

SEQ ID NO: 2103085 - DNA, 23 bp, Homo sapiens
gaaaaaatgttctatatgcattt

SEQ ID NO: 2103086 - DNA, 21 bp, Homo sapiens
gaaaaacaaactcgtttttta

SEQ ID NO: 2103087 - DNA, 23 bp, Homo sapiens
gaaaaactcttctactttcatct

SEQ ID NO: 2103088 - DNA, 20 bp, Homo sapiens
gaaaaactgatcaaaaataa

SEQ ID NO: 2103089 - DNA, 14 bp, Homo sapiens
gaaaaagaaatgca

SEQ ID NO: 2103090 - DNA, 21 bp, Homo sapiens
gaaaaagctcctgtcctccca

SEQ ID NO: 2103091 - DNA, 16 bp, Homo sapiens
gaaaaagttgcagtct

SEQ ID NO: 2103092 - DNA, 11 bp, Homo sapiens
gaaaaatggag

SEQ ID NO: 2103093 - DNA, 15 bp, Homo sapiens
gaaaaatgtcagtct

SEQ ID NO: 2103094 - DNA, 17 bp, Homo sapiens
gaaaacagatgcccccg

SEQ ID NO: 2103095 - DNA, 20 bp, Homo sapiens
gaaaacaggacttaaaatga

SEQ ID NO: 2103096 - DNA, 19 bp, Homo sapiens
gaaaacagtcgatcaaggg

SEQ ID NO: 2103097 - DNA, 19 bp, Homo sapiens
gaaaacataatataagaat

SEQ ID NO: 2103098 - DNA, 17 bp, Homo sapiens
gaaaacattcatccagt

SEQ ID NO: 2103099 - DNA, 13 bp, Homo sapiens
gaaaacccagaga

SEQ ID NO: 2103100 - DNA, 14 bp, Homo sapiens
gaaaacccagagag

SEQ ID NO: 2103101 - DNA, 11 bp, Homo sapiens
gaaaacctttc

SEQ ID NO: 2103102 - DNA, 15 bp, Homo sapiens
gaaaacctttcttca

SEQ ID NO: 2103103 - DNA, 20 bp, Homo sapiens
gaaaacgggaaagaatataa

SEQ ID NO: 2103104 - DNA, 22 bp, Homo sapiens
gaaaactatcctgcgggtttta

SEQ ID NO: 2103105 - DNA, 16 bp, Homo sapiens
gaaaactgacagagga

SEQ ID NO: 2103106 - DNA, 12 bp, Homo sapiens
gaaaactggaaa

SEQ ID NO: 2103107 - DNA, 17 bp, Homo sapiens
gaaaactggaataagaa

SEQ ID NO: 2103108 - DNA, 14 bp, Homo sapiens
gaaaacttatttga

SEQ ID NO: 2103109 - DNA, 16 bp, Homo sapiens
gaaaacttatttgagt

SEQ ID NO: 2103110 - DNA, 15 bp, Homo sapiens
gaaaacttgaatctg

SEQ ID NO: 2103111 - DNA, 16 bp, Homo sapiens
gaaaagactccaaaga

SEQ ID NO: 2103112 - DNA, 20 bp, Homo sapiens
gaaaagactccaaagaaatg

SEQ ID NO: 2103113 - DNA, 18 bp, Homo sapiens
gaaaagcaattgccctgt

SEQ ID NO: 2103114 - DNA, 19 bp, Homo sapiens
gaaaagcaattgccctgta

SEQ ID NO: 2103115 - DNA, 14 bp, Homo sapiens
gaaaagcacctgcc

SEQ ID NO: 2103116 - DNA, 11 bp, Homo sapiens
gaaaagcccag

SEQ ID NO: 2103117 - DNA, 13 bp, Homo sapiens
gaaaagctgctga

SEQ ID NO: 2103118 - DNA, 13 bp, Homo sapiens
gaaaaggcctggg

SEQ ID NO: 2103119 - DNA, 19 bp, Homo sapiens
gaaaagggaagttgtgcct

SEQ ID NO: 2103120 - DNA, 14 bp, Homo sapiens
gaaaaggtacatgt

SEQ ID NO: 2103121 - DNA, 17 bp, Homo sapiens
gaaaaggtttatgaaaa

SEQ ID NO: 2103122 - DNA, 13 bp, Homo sapiens
gaaaagtagaatt

SEQ ID NO: 2103123 - DNA, 14 bp, Homo sapiens
gaaaagtagaatta

SEQ ID NO: 2103124 - DNA, 22 bp, Homo sapiens
gaaaagtagaattatatctaat

SEQ ID NO: 2103125 - DNA, 20 bp, Homo sapiens
gaaaagtcacacagacacac

SEQ ID NO: 2103126 - DNA, 14 bp, Homo sapiens
gaaaagtgttatta

SEQ ID NO: 2103127 - DNA, 18 bp, Homo sapiens
gaaaataatagccatcct

SEQ ID NO: 2103128 - DNA, 20 bp, Homo sapiens
gaaaatataaatgcatgatt

SEQ ID NO: 2103129 - DNA, 21 bp, Homo sapiens
gaaaatataaatgcatgattt

SEQ ID NO: 2103130 - DNA, 22 bp, Homo sapiens
gaaaatatatttaatacctttg

SEQ ID NO: 2103131 - DNA, 14 bp, Homo sapiens
gaaaatctaatatt

SEQ ID NO: 2103132 - DNA, 23 bp, Homo sapiens
gatgttacatcacagtgtttgca

SEQ ID NO: 2103133 - DNA, 20 bp, Homo sapiens
gatgtttccagaaaatataa

SEQ ID NO: 2103134 - DNA, 10 bp, Homo sapiens
gatgtttgtt

SEQ ID NO: 2103135 - DNA, 18 bp, Homo sapiens
gatgtttttaaaagtttc

SEQ ID NO: 2103136 - DNA, 22 bp, Homo sapiens
gatgtttttaaaagtttcaatg

SEQ ID NO: 2103137 - DNA, 13 bp, Homo sapiens
gattaaacacctg

SEQ ID NO: 2103138 - DNA, 16 bp, Homo sapiens
gattaaacacctgaca

SEQ ID NO: 2103139 - DNA, 13 bp, Homo sapiens
gattaaaggaagg

SEQ ID NO: 2103140 - DNA, 14 bp, Homo sapiens
gattaaaggaagga

SEQ ID NO: 2103141 - DNA, 15 bp, Homo sapiens
gattaaaggaaggaa

SEQ ID NO: 2103142 - DNA, 17 bp, Homo sapiens
gattaaggtgatgtgat

SEQ ID NO: 2103143 - DNA, 18 bp, Homo sapiens
gattaatatggggatgca

SEQ ID NO: 2103144 - DNA, 14 bp, Homo sapiens
gattaatggcactg

SEQ ID NO: 2103145 - DNA, 16 bp, Homo sapiens
gattaatggcactgat

SEQ ID NO: 2103146 - DNA, 15 bp, Homo sapiens
gattaattaaatgca

SEQ ID NO: 2103147 - DNA, 14 bp, Homo sapiens
gattaatttatggt

SEQ ID NO: 2103148 - DNA, 16 bp, Homo sapiens
gattaatttatggttt

SEQ ID NO: 2103149 - DNA, 14 bp, Homo sapiens
gattaatttgtgta

SEQ ID NO: 2103150 - DNA, 16 bp, Homo sapiens
gattaatttgtgtaga

SEQ ID NO: 2103151 - DNA, 21 bp, Homo sapiens
gattacaagcgtgagccactg

SEQ ID NO: 2103152 - DNA, 22 bp, Homo sapiens
gattacaagcgtgagccactgc

SEQ ID NO: 2103153 - DNA, 23 bp, Homo sapiens
gattacaagcgtgagccactgca

SEQ ID NO: 2103154 - DNA, 20 bp, Homo sapiens
gattacataatcaaagctac

SEQ ID NO: 2103155 - DNA, 22 bp, Homo sapiens
gattacataatcaaagctacct

SEQ ID NO: 2103156 - DNA, 22 bp, Homo sapiens
gattactgtttggctgacatga

SEQ ID NO: 2103157 - DNA, 14 bp, Homo sapiens
gattagctctggac

SEQ ID NO: 2103158 - DNA, 16 bp, Homo sapiens
gattagctctggacca

SEQ ID NO: 2103159 - DNA, 22 bp, Homo sapiens
gattagtattcaggcactgaga

SEQ ID NO: 2103160 - DNA, 16 bp, Homo sapiens
gattataaaattattt

SEQ ID NO: 2103161 - DNA, 19 bp, Homo sapiens
gattatatatcataaagta

SEQ ID NO: 2103162 - DNA, 10 bp, Homo sapiens
gattatcagg

SEQ ID NO: 2103163 - DNA, 13 bp, Homo sapiens
gattatgggtcct

SEQ ID NO: 2103164 - DNA, 17 bp, Homo sapiens
gattatgggtcctgcaa

SEQ ID NO: 2103165 - DNA, 18 bp, Homo sapiens
gattattttagtctgtca

SEQ ID NO: 2103166 - DNA, 21 bp, Homo sapiens
gattattttagtctgtcatcc

SEQ ID NO: 2103167 - DNA, 19 bp, Homo sapiens
gattcaaactgctccaagt

SEQ ID NO: 2103168 - DNA, 22 bp, Homo sapiens
gattcacaatgaaatgctctcc

SEQ ID NO: 2103169 - DNA, 16 bp, Homo sapiens
gattcactattagaga

SEQ ID NO: 2103170 - DNA, 20 bp, Homo sapiens
gattcaggaaaaggcctggg

SEQ ID NO: 2103171 - DNA, 21 bp, Homo sapiens
gattcaggaaaaggcctgggg

SEQ ID NO: 2103172 - DNA, 16 bp, Homo sapiens
gattcaggggctcccc

SEQ ID NO: 2103173 - DNA, 19 bp, Homo sapiens
gattcatctatggagggca

SEQ ID NO: 2103174 - DNA, 19 bp, Homo sapiens
gattcattttaacatctga

SEQ ID NO: 2103175 - DNA, 16 bp, Homo sapiens
gattccacacaaaatg

SEQ ID NO: 2103176 - DNA, 17 bp, Homo sapiens
gattccacacaaaatgt

SEQ ID NO: 2103177 - DNA, 18 bp, Homo sapiens
gattccacacaaaatgtc

SEQ ID NO: 2103178 - DNA, 22 bp, Homo sapiens
gattccagagagtggctcctcc

SEQ ID NO: 2103179 - DNA, 19 bp, Homo sapiens
gattccagagcactgctcc

SEQ ID NO: 2103180 - DNA, 20 bp, Homo sapiens
gattcccaagctctgctcct

SEQ ID NO: 2103181 - DNA, 22 bp, Homo sapiens
gattcccaccaaggtcttcagc

SEQ ID NO: 2103182 - DNA, 14 bp, Homo sapiens
gattcccagagaca

SEQ ID NO: 2103183 - DNA, 13 bp, Homo sapiens
gattcccagagca

SEQ ID NO: 2103184 - DNA, 21 bp, Homo sapiens
gattcccctaacctcattccc

SEQ ID NO: 2103185 - DNA, 23 bp, Homo sapiens
gattcctaagcagtgcttgtaaa

SEQ ID NO: 2103186 - DNA, 17 bp, Homo sapiens
gattcctcccccagagc

SEQ ID NO: 2103187 - DNA, 16 bp, Homo sapiens
gattcctgggcaagaa

SEQ ID NO: 2103188 - DNA, 12 bp, Homo sapiens
gattccttttga

SEQ ID NO: 2103189 - DNA, 11 bp, Homo sapiens
gattctcatgt

SEQ ID NO: 2103190 - DNA, 14 bp, Homo sapiens
gattctcctgcctc

SEQ ID NO: 2103191 - DNA, 17 bp, Homo sapiens
gattctcctgcctcagc

SEQ ID NO: 2103192 - DNA, 14 bp, Homo sapiens
gattctcctgtgct

SEQ ID NO: 2103193 - DNA, 22 bp, Homo sapiens
gattctgggaggaagcaggttg

SEQ ID NO: 2103194 - DNA, 11 bp, Homo sapiens
gattctgggat

SEQ ID NO: 2103195 - DNA, 21 bp, Homo sapiens
gattcttctgcttcagcctcc

SEQ ID NO: 2103196 - DNA, 17 bp, Homo sapiens
gattcttgtgcctcagc

SEQ ID NO: 2103197 - DNA, 16 bp, Homo sapiens
gattgacacacagcac

SEQ ID NO: 2103198 - DNA, 22 bp, Homo sapiens
gattgatcggagcctcctctct

SEQ ID NO: 2103199 - DNA, 18 bp, Homo sapiens
gattgcaacaggctgggc

SEQ ID NO: 2103200 - DNA, 16 bp, Homo sapiens
gattgccccagagccc

SEQ ID NO: 2103201 - DNA, 15 bp, Homo sapiens
gattgctatgaatga

SEQ ID NO: 2103202 - DNA, 18 bp, Homo sapiens
gattgctgataataaatt

SEQ ID NO: 2103203 - DNA, 18 bp, Homo sapiens
gattgcttaaaatagcaa

SEQ ID NO: 2103204 - DNA, 14 bp, Homo sapiens
gattggattattca

SEQ ID NO: 2103205 - DNA, 15 bp, Homo sapiens
gattggattattcat

SEQ ID NO: 2103206 - DNA, 17 bp, Homo sapiens
gattgggtgccatgtgg

SEQ ID NO: 2103207 - DNA, 19 bp, Homo sapiens
gattgggtgccatgtggag

SEQ ID NO: 2103208 - DNA, 14 bp, Homo sapiens
gattgtaaaaacaa

SEQ ID NO: 2103209 - DNA, 16 bp, Homo sapiens
gattgttacagaagct

SEQ ID NO: 2103210 - DNA, 21 bp, Homo sapiens
gattgttctgtccagtttcca

SEQ ID NO: 2103211 - DNA, 12 bp, Homo sapiens
gattgttttatc

SEQ ID NO: 2103212 - DNA, 19 bp, Homo sapiens
gatttacagcctcacttga

SEQ ID NO: 2103213 - DNA, 20 bp, Homo sapiens
gatttagtaatagtccaata

SEQ ID NO: 2103214 - DNA, 17 bp, Homo sapiens
gatttatagtttgtaca

SEQ ID NO: 2103215 - DNA, 20 bp, Homo sapiens
gatttatagtttgtacatgc

SEQ ID NO: 2103216 - DNA, 13 bp, Homo sapiens
gatttcatgattt

SEQ ID NO: 2103217 - DNA, 22 bp, Homo sapiens
gatttcatgtaaccaagagtat

SEQ ID NO: 2103218 - DNA, 18 bp, Homo sapiens
gatttccaagtaatataa

SEQ ID NO: 2103219 - DNA, 19 bp, Homo sapiens
gatttcttcgctgctctag

SEQ ID NO: 2103220 - DNA, 16 bp, Homo sapiens
gatttgaagcaaagca

SEQ ID NO: 2103221 - DNA, 22 bp, Homo sapiens
gatttgaggagcagcttcagtt

SEQ ID NO: 2103222 - DNA, 23 bp, Homo sapiens
gatttgaggagcagcttcagttg

SEQ ID NO: 2103223 - DNA, 12 bp, Homo sapiens
gatttgccagca

SEQ ID NO: 2103224 - DNA, 14 bp, Homo sapiens
gatttgccagcaca

SEQ ID NO: 2103225 - DNA, 15 bp, Homo sapiens
gattttaattttgaa

SEQ ID NO: 2103226 - DNA, 15 bp, Homo sapiens
gattttacagagaat

SEQ ID NO: 2103227 - DNA, 21 bp, Homo sapiens
gattttacctgggatatgaca

SEQ ID NO: 2103228 - DNA, 14 bp, Homo sapiens
gattttagttcact

SEQ ID NO: 2103229 - DNA, 18 bp, Homo sapiens
gattttcaaagctttttc

SEQ ID NO: 2103230 - DNA, 18 bp, Homo sapiens
gattttcctgaatattaa

SEQ ID NO: 2103231 - DNA, 13 bp, Homo sapiens
gattttgtacaga

SEQ ID NO: 2103232 - DNA, 14 bp, Homo sapiens
gattttgtacagaa

SEQ ID NO: 2103233 - DNA, 16 bp, Homo sapiens
gattttgtcactgtct

SEQ ID NO: 2103234 - DNA, 14 bp, Homo sapiens
gatttttaaattat

SEQ ID NO: 2103235 - DNA, 15 bp, Homo sapiens
gatttttacaataat

SEQ ID NO: 2103236 - DNA, 18 bp, Homo sapiens
gatttttgtaataaaagg

SEQ ID NO: 2103237 - DNA, 14 bp, Homo sapiens
gatttttgttgatt

SEQ ID NO: 2103238 - DNA, 17 bp, Homo sapiens
gattttttaataattta

SEQ ID NO: 2103239 - DNA, 14 bp, Homo sapiens
gcaaaaatataaaa

SEQ ID NO: 2103240 - DNA, 20 bp, Homo sapiens
gcaaaacctgcagttcctga

SEQ ID NO: 2103241 - DNA, 16 bp, Homo sapiens
gcaaaagaagtaaaag

SEQ ID NO: 2103242 - DNA, 21 bp, Homo sapiens
gcaaaagtggggctaaatgaa

SEQ ID NO: 2103243 - DNA, 15 bp, Homo sapiens
gcaaaataattttaa

SEQ ID NO: 2103244 - DNA, 16 bp, Homo sapiens
gcaaaattttatagct

SEQ ID NO: 2103245 - DNA, 17 bp, Homo sapiens
gcaaacacacaaaggta

SEQ ID NO: 2103246 - DNA, 19 bp, Homo sapiens
gcaaacactgtgtatttat

SEQ ID NO: 2103247 - DNA, 17 bp, Homo sapiens
gcaaaccatttcaaatg

SEQ ID NO: 2103248 - DNA, 23 bp, Homo sapiens
gcaaacccttctcttctcccccc

SEQ ID NO: 2103249 - DNA, 16 bp, Homo sapiens
gcaaacttgtatctga

SEQ ID NO: 2103250 - DNA, 20 bp, Homo sapiens
gcaaacttgtatctgaagac

SEQ ID NO: 2103251 - DNA, 15 bp, Homo sapiens
gcaaagaagcttcat

SEQ ID NO: 2103252 - DNA, 13 bp, Homo sapiens
gcaaagcaccagc

SEQ ID NO: 2103253 - DNA, 23 bp, Homo sapiens
gcaaagcaccagcttctccaggc

SEQ ID NO: 2103254 - DNA, 11 bp, Homo sapiens
gcaaagcctgt

SEQ ID NO: 2103255 - DNA, 17 bp, Homo sapiens
gcaaaggaaaccaaagg

SEQ ID NO: 2103256 - DNA, 18 bp, Homo sapiens
gcaaagggagcactgggt

SEQ ID NO: 2103257 - DNA, 20 bp, Homo sapiens
gcaaagggagcactgggttg

SEQ ID NO: 2103258 - DNA, 20 bp, Homo sapiens
gcaaagtaaaaaaatatgaa

SEQ ID NO: 2103259 - DNA, 13 bp, Homo sapiens
gcaaagtgcaaat

SEQ ID NO: 2103260 - DNA, 16 bp, Homo sapiens
gcaaagtgctgtaccc

SEQ ID NO: 2103261 - DNA, 23 bp, Homo sapiens
gcaaagtgttttctcagaacagc

SEQ ID NO: 2103262 - DNA, 22 bp, Homo sapiens
gcaaagttacagatgcacccca

SEQ ID NO: 2103263 - DNA, 14 bp, Homo sapiens
gcaaagttatattt

SEQ ID NO: 2103264 - DNA, 22 bp, Homo sapiens
gcaaatactccaagcttcaagt

SEQ ID NO: 2103265 - DNA, 17 bp, Homo sapiens
gcaaatattagcaaaga

SEQ ID NO: 2103266 - DNA, 15 bp, Homo sapiens
gcaaatcaaccccag

SEQ ID NO: 2103267 - DNA, 16 bp, Homo sapiens
gcaaatcaaccccaga

SEQ ID NO: 2103268 - DNA, 15 bp, Homo sapiens
gcaaatcctcttcta

SEQ ID NO: 2103269 - DNA, 14 bp, Homo sapiens
gcaaatgcttaaaa

SEQ ID NO: 2103270 - DNA, 15 bp, Homo sapiens
gcaaattagaaacac

SEQ ID NO: 2103271 - DNA, 16 bp, Homo sapiens
gcaaatttcaaaagac

SEQ ID NO: 2103272 - DNA, 20 bp, Homo sapiens
gcaaatttcaaaagacatgt

SEQ ID NO: 2103273 - DNA, 12 bp, Homo sapiens
gcaacaagagca

SEQ ID NO: 2103274 - DNA, 23 bp, Homo sapiens
gcaacacaagctggaagcacatg

SEQ ID NO: 2103275 - DNA, 18 bp, Homo sapiens
gcaacacctccttgcttt

SEQ ID NO: 2103276 - DNA, 15 bp, Homo sapiens
gcaacagaaaaatgg

SEQ ID NO: 2103277 - DNA, 13 bp, Homo sapiens
gcaacaggctggg

SEQ ID NO: 2103278 - DNA, 15 bp, Homo sapiens
gcaacaggctgggct

SEQ ID NO: 2103279 - DNA, 13 bp, Homo sapiens
gcaacaggtttta

SEQ ID NO: 2103280 - DNA, 15 bp, Homo sapiens
gcaacataaaacaat

SEQ ID NO: 2103281 - DNA, 20 bp, Homo sapiens
gcaaccccagttctgctcct

SEQ ID NO: 2103282 - DNA, 22 bp, Homo sapiens
gcaaccccagttctgctcctct

SEQ ID NO: 2103283 - DNA, 17 bp, Homo sapiens
gcaacccccagcctgct

SEQ ID NO: 2103284 - DNA, 13 bp, Homo sapiens
gcaacccctgtac

SEQ ID NO: 2103285 - DNA, 14 bp, Homo sapiens
gcaacccctgtacc

SEQ ID NO: 2103286 - DNA, 19 bp, Homo sapiens
gcaacccctgtacccagct

SEQ ID NO: 2103287 - DNA, 15 bp, Homo sapiens
gcaacccgtgccaag

SEQ ID NO: 2103288 - DNA, 18 bp, Homo sapiens
gcaacccgtgccaagtcc

SEQ ID NO: 2103289 - DNA, 19 bp, Homo sapiens
gcaaccgtggcccttcctg

SEQ ID NO: 2103290 - DNA, 23 bp, Homo sapiens
gcaaccgtggcccttcctggaca

SEQ ID NO: 2103291 - DNA, 18 bp, Homo sapiens
gcaacctccacctcctga

SEQ ID NO: 2103292 - DNA, 18 bp, Homo sapiens
gcaacctccgcctcttgg

SEQ ID NO: 2103293 - DNA, 20 bp, Homo sapiens
gcaacctccgcctcttgggt

SEQ ID NO: 2103294 - DNA, 22 bp, Homo sapiens
gcaaccttgcatccatctgggc

SEQ ID NO: 2103295 - DNA, 12 bp, Homo sapiens
gcaactcagaat

SEQ ID NO: 2103296 - DNA, 13 bp, Homo sapiens
gcaactgaggcag

SEQ ID NO: 2103297 - DNA, 19 bp, Homo sapiens
gcaagacgtcctggaatga

SEQ ID NO: 2103298 - DNA, 18 bp, Homo sapiens
gcaagactgttgctcaaa

SEQ ID NO: 2103299 - DNA, 19 bp, Homo sapiens
gcaagacttctctttgcct

SEQ ID NO: 2103300 - DNA, 20 bp, Homo sapiens
gcaagagaacatttctagaa

SEQ ID NO: 2103301 - DNA, 13 bp, Homo sapiens
gcaagagacagaa

SEQ ID NO: 2103302 - DNA, 19 bp, Homo sapiens
gcaagagacagagccccca

SEQ ID NO: 2103303 - DNA, 23 bp, Homo sapiens
gcaagagagagctcgctcttggg

SEQ ID NO: 2103304 - DNA, 13 bp, Homo sapiens
gcaagagccttgg

SEQ ID NO: 2103305 - DNA, 23 bp, Homo sapiens
gcaagagccttggtgtccacctg

SEQ ID NO: 2103306 - DNA, 13 bp, Homo sapiens
gcaagatatttat

SEQ ID NO: 2103307 - DNA, 13 bp, Homo sapiens
gcaagatgaattt

SEQ ID NO: 2103308 - DNA, 14 bp, Homo sapiens
gcaagattgcttaa

SEQ ID NO: 2103309 - DNA, 18 bp, Homo sapiens
gcaagcacctcctgcctc

SEQ ID NO: 2103310 - DNA, 18 bp, Homo sapiens
gcaagcacgggacaggag

SEQ ID NO: 2103311 - DNA, 13 bp, Homo sapiens
gcaagcagggaaa

SEQ ID NO: 2103312 - DNA, 14 bp, Homo sapiens
gcaagcccctcagc

SEQ ID NO: 2103313 - DNA, 16 bp, Homo sapiens
gcaagcccctcagccc

SEQ ID NO: 2103314 - DNA, 19 bp, Homo sapiens
gcaagcctgtaatcccagc

SEQ ID NO: 2103315 - DNA, 13 bp, Homo sapiens
gcaaggaaggaaa

SEQ ID NO: 2103316 - DNA, 14 bp, Homo sapiens
gcaaggaaggaaag

SEQ ID NO: 2103317 - DNA, 15 bp, Homo sapiens
gcaaggaaggaaaga

SEQ ID NO: 2103318 - DNA, 20 bp, Homo sapiens
gcaaggatatcagagctggg

SEQ ID NO: 2103319 - DNA, 16 bp, Homo sapiens
gcaaggcccgagcagc

SEQ ID NO: 2103320 - DNA, 20 bp, Homo sapiens
gcaaggcccgagcagctgag

SEQ ID NO: 2103321 - DNA, 23 bp, Homo sapiens
gcaaggcccgagcagctgagcag

SEQ ID NO: 2103322 - DNA, 12 bp, Homo sapiens
gcaaggccctgt

SEQ ID NO: 2103323 - DNA, 17 bp, Homo sapiens
gcaaggccctgtcccag

SEQ ID NO: 2103324 - DNA, 20 bp, Homo sapiens
gcaaggccctgtcccagcag

SEQ ID NO: 2103325 - DNA, 21 bp, Homo sapiens
gcaaggccgctgttcacccac

SEQ ID NO: 2103326 - DNA, 15 bp, Homo sapiens
gcaagggagaagaaa

SEQ ID NO: 2103327 - DNA, 19 bp, Homo sapiens
gcaagggcatcaggcactg

SEQ ID NO: 2103328 - DNA, 20 bp, Homo sapiens
gcaagggcatcaggcactgg

SEQ ID NO: 2103329 - DNA, 10 bp, Homo sapiens
gcaagggctc

SEQ ID NO: 2103330 - DNA, 11 bp, Homo sapiens
gcaagggctcc

SEQ ID NO: 2103331 - DNA, 14 bp, Homo sapiens
gcaagggctccagc

SEQ ID NO: 2103332 - DNA, 20 bp, Homo sapiens
gcaaggggctcagcaaggtg

SEQ ID NO: 2103333 - DNA, 13 bp, Homo sapiens
gcaagggggcggg

SEQ ID NO: 2103334 - DNA, 21 bp, Homo sapiens
gcaagggggtgtcatctgagg

SEQ ID NO: 2103335 - DNA, 23 bp, Homo sapiens
gcaagggggtgtcatctgaggag

SEQ ID NO: 2103336 - DNA, 22 bp, Homo sapiens
gcaaggtctccttactctgagc

SEQ ID NO: 2103337 - DNA, 21 bp, Homo sapiens
gcaagtctgcagcccggcgcc

SEQ ID NO: 2103338 - DNA, 13 bp, Homo sapiens
gcaagtgaagaaa

SEQ ID NO: 2103339 - DNA, 18 bp, Homo sapiens
gcaagtgacatgccatcc

SEQ ID NO: 2103340 - DNA, 18 bp, Homo sapiens
gcaagtgagagctgggtg

SEQ ID NO: 2103341 - DNA, 19 bp, Homo sapiens
gcaagtgagagctgggtgt

SEQ ID NO: 2103342 - DNA, 17 bp, Homo sapiens
gcaagtgcccgccctgc

SEQ ID NO: 2103343 - DNA, 19 bp, Homo sapiens
gcaagtgcccgccctgccc

SEQ ID NO: 2103344 - DNA, 21 bp, Homo sapiens
gcaagttcagggaagcaggca

SEQ ID NO: 2103345 - DNA, 22 bp, Homo sapiens
gcaagttcagggaagcaggcag

SEQ ID NO: 2103346 - DNA, 23 bp, Homo sapiens
gcaagttcagggaagcaggcaga

SEQ ID NO: 2103347 - DNA, 24 bp, Homo sapiens
gcaagttcagggaagcaggcagag

SEQ ID NO: 2103348 - DNA, 17 bp, Homo sapiens
gcaataaaatagtattg

SEQ ID NO: 2103349 - DNA, 21 bp, Homo sapiens
gcaataaagtgtagcaccctg

SEQ ID NO: 2103350 - DNA, 21 bp, Homo sapiens
gcaataacgtttaagccaaaa

SEQ ID NO: 2103351 - DNA, 17 bp, Homo sapiens
gcaataatgtgcaaatt

SEQ ID NO: 2103352 - DNA, 14 bp, Homo sapiens
gcaatatctttaat

SEQ ID NO: 2103353 - DNA, 22 bp, Homo sapiens
gcaatatctttaataggttaat

SEQ ID NO: 2103354 - DNA, 14 bp, Homo sapiens
gcaatatgtaaata

SEQ ID NO: 2103355 - DNA, 23 bp, Homo sapiens
gcaatatttccctggaatttaat

SEQ ID NO: 2103356 - DNA, 12 bp, Homo sapiens
gcaatcaaagca

SEQ ID NO: 2103357 - DNA, 15 bp, Homo sapiens
gcaatgaaaaattct

SEQ ID NO: 2103358 - DNA, 14 bp, Homo sapiens
gcaatgaaaccaaa

SEQ ID NO: 2103359 - DNA, 15 bp, Homo sapiens
gcaatgaaaccaaag

SEQ ID NO: 2103360 - DNA, 19 bp, Homo sapiens
gcaatgacaggtaaattaa

SEQ ID NO: 2103361 - DNA, 15 bp, Homo sapiens
gcaatgatgtccaga

SEQ ID NO: 2103362 - DNA, 18 bp, Homo sapiens
gcaatgggagggggctcc

SEQ ID NO: 2103363 - DNA, 13 bp, Homo sapiens
gcaatggggagag

SEQ ID NO: 2103364 - DNA, 17 bp, Homo sapiens
gcaatggggagaggcaa

SEQ ID NO: 2103365 - DNA, 20 bp, Homo sapiens
gcaatgtcaggaacagaagg

SEQ ID NO: 2103366 - DNA, 22 bp, Homo sapiens
gcaatgtcaggaacagaaggat

SEQ ID NO: 2103367 - DNA, 14 bp, Homo sapiens
gcaatgttttcctt

SEQ ID NO: 2103368 - DNA, 16 bp, Homo sapiens
gcaattatattgtcct

SEQ ID NO: 2103369 - DNA, 13 bp, Homo sapiens
gcaattgccctgt

SEQ ID NO: 2103370 - DNA, 15 bp, Homo sapiens
gcaattgcttaggat

SEQ ID NO: 2103371 - DNA, 15 bp, Homo sapiens
gcaatttttttatac

SEQ ID NO: 2103372 - DNA, 17 bp, Homo sapiens
gcacaaagctcaagatg

SEQ ID NO: 2103373 - DNA, 12 bp, Homo sapiens
gcacaagctcag

SEQ ID NO: 2103374 - DNA, 19 bp, Homo sapiens
gcacaagcttgtatataca

SEQ ID NO: 2103375 - DNA, 19 bp, Homo sapiens
gcacaaggctgaccaagag

SEQ ID NO: 2103376 - DNA, 17 bp, Homo sapiens
gcacaagttatttaaat

SEQ ID NO: 2103377 - DNA, 14 bp, Homo sapiens
gcacaatttatatt

SEQ ID NO: 2103378 - DNA, 18 bp, Homo sapiens
gcacaatttatattttcc

SEQ ID NO: 2103379 - DNA, 11 bp, Homo sapiens
gcacaatttga

SEQ ID NO: 2103380 - DNA, 18 bp, Homo sapiens
gcacacaaacacctccta

SEQ ID NO: 2103381 - DNA, 22 bp, Homo sapiens
gcacacaatgctattgaaatta

SEQ ID NO: 2103382 - DNA, 22 bp, Homo sapiens
gcacacacacaccaatgcgcac

SEQ ID NO: 2103383 - DNA, 20 bp, Homo sapiens
gcacacacaccggtcaccga

SEQ ID NO: 2103384 - DNA, 17 bp, Homo sapiens
gcacacacacggatgca

SEQ ID NO: 2103385 - DNA, 20 bp, Homo sapiens
gcacacacagatatgcacac

SEQ ID NO: 2103386 - DNA, 16 bp, Homo sapiens
gcacacacagctcctc

SEQ ID NO: 2103387 - DNA, 21 bp, Homo sapiens
gcacacacatggatgagcaca

SEQ ID NO: 2103388 - DNA, 14 bp, Homo sapiens
gcacacaccagagc

SEQ ID NO: 2103389 - DNA, 15 bp, Homo sapiens
gcacacaccagagcc

SEQ ID NO: 2103390 - DNA, 14 bp, Homo sapiens
gcacacagaaatat

SEQ ID NO: 2103391 - DNA, 15 bp, Homo sapiens
gcacacagaaatata

SEQ ID NO: 2103392 - DNA, 12 bp, Homo sapiens
gcacacagcagc

SEQ ID NO: 2103393 - DNA, 13 bp, Homo sapiens
gcacacagcagcc

SEQ ID NO: 2103394 - DNA, 15 bp, Homo sapiens
gcacacagcagcccc

SEQ ID NO: 2103395 - DNA, 16 bp, Homo sapiens
gcacacagcagccccc

SEQ ID NO: 2103396 - DNA, 19 bp, Homo sapiens
gcacacagcagccccccag

SEQ ID NO: 2103397 - DNA, 22 bp, Homo sapiens
gcacacaggtacagcaacagga

SEQ ID NO: 2103398 - DNA, 14 bp, Homo sapiens
gcacacagtcacct

SEQ ID NO: 2103399 - DNA, 16 bp, Homo sapiens
gcacaccactgccctg

SEQ ID NO: 2103400 - DNA, 18 bp, Homo sapiens
gcacaccactgccctgcc

SEQ ID NO: 2103401 - DNA, 14 bp, Homo sapiens
gcacaccccaaggg

SEQ ID NO: 2103402 - DNA, 14 bp, Homo sapiens
gcacaccgggcact

SEQ ID NO: 2103403 - DNA, 12 bp, Homo sapiens
gcacacctgtgg

SEQ ID NO: 2103404 - DNA, 18 bp, Homo sapiens
gcacacgcctgtaatccc

SEQ ID NO: 2103405 - DNA, 21 bp, Homo sapiens
gcacacgcctgtaatcccagc

SEQ ID NO: 2103406 - DNA, 14 bp, Homo sapiens
gcacacggccctgc

SEQ ID NO: 2103407 - DNA, 18 bp, Homo sapiens
gcacacggccctgcccca

SEQ ID NO: 2103408 - DNA, 23 bp, Homo sapiens
gcacacggccctgccccatcctg

SEQ ID NO: 2103409 - DNA, 18 bp, Homo sapiens
gcacagacttctggaagg

SEQ ID NO: 2103410 - DNA, 19 bp, Homo sapiens
gcacagacttctggaaggc

SEQ ID NO: 2103411 - DNA, 18 bp, Homo sapiens
gcacagaggcagctgtgt

SEQ ID NO: 2103412 - DNA, 13 bp, Homo sapiens
gcacagcagcatc

SEQ ID NO: 2103413 - DNA, 22 bp, Homo sapiens
gcacagcagtggagagtgttcc

SEQ ID NO: 2103414 - DNA, 17 bp, Homo sapiens
gcacagcccaaagaagg

SEQ ID NO: 2103415 - DNA, 16 bp, Homo sapiens
gcacagctatgaaggc

SEQ ID NO: 2103416 - DNA, 13 bp, Homo sapiens
gcacagctgcttg

SEQ ID NO: 2103417 - DNA, 16 bp, Homo sapiens
gcacaggactgattct

SEQ ID NO: 2103418 - DNA, 21 bp, Homo sapiens
gcacaggagctacctgtgtgg

SEQ ID NO: 2103419 - DNA, 12 bp, Homo sapiens
gcacaggagggg

SEQ ID NO: 2103420 - DNA, 17 bp, Homo sapiens
gcacaggcaggaagaga

SEQ ID NO: 2103421 - DNA, 16 bp, Homo sapiens
gcacaggctaattttt

SEQ ID NO: 2103422 - DNA, 20 bp, Homo sapiens
gcacaggggccccagatctg

SEQ ID NO: 2103423 - DNA, 17 bp, Homo sapiens
gcacagtgttaaatgaa

SEQ ID NO: 2103424 - DNA, 21 bp, Homo sapiens
gcacagtttagaacagaggga

SEQ ID NO: 2103425 - DNA, 18 bp, Homo sapiens
gcacagttttctgagaaa

SEQ ID NO: 2103426 - DNA, 22 bp, Homo sapiens
gcacagttttctgagaaagact

SEQ ID NO: 2103427 - DNA, 20 bp, Homo sapiens
gcacatatgggtgctggcag

SEQ ID NO: 2103428 - DNA, 15 bp, Homo sapiens
gcacatccattccca

SEQ ID NO: 2103429 - DNA, 15 bp, Homo sapiens
gcacatccctgccct

SEQ ID NO: 2103430 - DNA, 23 bp, Homo sapiens
gcacatctgggaggctggtctcc

SEQ ID NO: 2103431 - DNA, 19 bp, Homo sapiens
gcacatgaggagggtgccc

SEQ ID NO: 2103432 - DNA, 17 bp, Homo sapiens
gcacatggtgttgtata

SEQ ID NO: 2103433 - DNA, 21 bp, Homo sapiens
gcacatgtcttgtacatgtgt

SEQ ID NO: 2103434 - DNA, 21 bp, Homo sapiens
gcacattaggaacagagtata

SEQ ID NO: 2103435 - DNA, 12 bp, Homo sapiens
gcacattcttaa

SEQ ID NO: 2103436 - DNA, 17 bp, Homo sapiens
gcacattggcagtgtgt

SEQ ID NO: 2103437 - DNA, 14 bp, Homo sapiens
gcaccaaaagaagt

SEQ ID NO: 2103438 - DNA, 16 bp, Homo sapiens
gcaccaaaagaagtaa

SEQ ID NO: 2103439 - DNA, 17 bp, Homo sapiens
gcaccacaggctgcctc

SEQ ID NO: 2103440 - DNA, 19 bp, Homo sapiens
gcaccaccatgccaggcta

SEQ ID NO: 2103441 - DNA, 12 bp, Homo sapiens
gcaccagaatgc

SEQ ID NO: 2103442 - DNA, 21 bp, Homo sapiens
gcaccagaggctgcagaaggc

SEQ ID NO: 2103443 - DNA, 17 bp, Homo sapiens
gcaccagatgcaacctc

SEQ ID NO: 2103444 - DNA, 14 bp, Homo sapiens
gcaccagccccctg

SEQ ID NO: 2103445 - DNA, 15 bp, Homo sapiens
gcaccagcccttccc

SEQ ID NO: 2103446 - DNA, 17 bp, Homo sapiens
gcaccagcccttccctg

SEQ ID NO: 2103447 - DNA, 12 bp, Homo sapiens
gcaccagctctg

SEQ ID NO: 2103448 - DNA, 13 bp, Homo sapiens
gcaccagctctgt

SEQ ID NO: 2103449 - DNA, 23 bp, Homo sapiens
gcaccagctctgtggcctgtgtc

SEQ ID NO: 2103450 - DNA, 11 bp, Homo sapiens
gcaccagctgc

SEQ ID NO: 2103451 - DNA, 14 bp, Homo sapiens
gcaccagctgctct

SEQ ID NO: 2103452 - DNA, 19 bp, Homo sapiens
gcaccagctgctctgcccc

SEQ ID NO: 2103453 - DNA, 21 bp, Homo sapiens
gcaccagctgctctgcccctt

SEQ ID NO: 2103454 - DNA, 17 bp, Homo sapiens
gcaccagcttctccagg

SEQ ID NO: 2103455 - DNA, 18 bp, Homo sapiens
gcaccagcttctccaggc

SEQ ID NO: 2103456 - DNA, 14 bp, Homo sapiens
gcacccactcacca

SEQ ID NO: 2103457 - DNA, 17 bp, Homo sapiens
gcacccaggctccatgg

SEQ ID NO: 2103458 - DNA, 17 bp, Homo sapiens
gcaccccatgagtagtg

SEQ ID NO: 2103459 - DNA, 18 bp, Homo sapiens
gcaccccctcattcccct

SEQ ID NO: 2103460 - DNA, 15 bp, Homo sapiens
gcaccccctgcagct

SEQ ID NO: 2103461 - DNA, 14 bp, Homo sapiens
gcaccccctggaga

SEQ ID NO: 2103462 - DNA, 21 bp, Homo sapiens
gcaccccggatcgaggacaag

SEQ ID NO: 2103463 - DNA, 17 bp, Homo sapiens
gcacccggcccctgctg

SEQ ID NO: 2103464 - DNA, 22 bp, Homo sapiens
gcacccgtacccccgtggtctt

SEQ ID NO: 2103465 - DNA, 16 bp, Homo sapiens
gcaccctctcctgggg

SEQ ID NO: 2103466 - DNA, 22 bp, Homo sapiens
gcaccctctcctgggggtggca

SEQ ID NO: 2103467 - DNA, 20 bp, Homo sapiens
gcaccctgcagagcacacag

SEQ ID NO: 2103468 - DNA, 23 bp, Homo sapiens
gcaccctggaaaggggagttgag

SEQ ID NO: 2103469 - DNA, 22 bp, Homo sapiens
gcaccctgggtgccattcccag

SEQ ID NO: 2103470 - DNA, 16 bp, Homo sapiens
gcacccttctttcctc

SEQ ID NO: 2103471 - DNA, 15 bp, Homo sapiens
gcaccggcgctgcag

SEQ ID NO: 2103472 - DNA, 23 bp, Homo sapiens
gcacctaaaccaccagtgcccaa

SEQ ID NO: 2103473 - DNA, 17 bp, Homo sapiens
gcacctaaagaaaaaca

SEQ ID NO: 2103474 - DNA, 18 bp, Homo sapiens
gcacctacatccccaggt

SEQ ID NO: 2103475 - DNA, 16 bp, Homo sapiens
gcacctagtccagtga

SEQ ID NO: 2103476 - DNA, 19 bp, Homo sapiens
gcacctatcacccaggctg

SEQ ID NO: 2103477 - DNA, 12 bp, Homo sapiens
gcacctcagaca

SEQ ID NO: 2103478 - DNA, 14 bp, Homo sapiens
gcacctcagacaat

SEQ ID NO: 2103479 - DNA, 20 bp, Homo sapiens
gcacctcagacaatccactc

SEQ ID NO: 2103480 - DNA, 21 bp, Homo sapiens
gcacctcagacaatccactct

SEQ ID NO: 2103481 - DNA, 13 bp, Homo sapiens
gcacctcccccca

SEQ ID NO: 2103482 - DNA, 18 bp, Homo sapiens
gcacctccccccactgca

SEQ ID NO: 2103483 - DNA, 16 bp, Homo sapiens
gcacctcctgagaagg

SEQ ID NO: 2103484 - DNA, 12 bp, Homo sapiens
gcacctcctgcc

SEQ ID NO: 2103485 - DNA, 17 bp, Homo sapiens
gcacctgaccagaatgc

SEQ ID NO: 2103486 - DNA, 11 bp, Homo sapiens
gcacctgccac

SEQ ID NO: 2103487 - DNA, 17 bp, Homo sapiens
gcacctgccaccgccag

SEQ ID NO: 2103488 - DNA, 15 bp, Homo sapiens
gcacctgccagcctg

SEQ ID NO: 2103489 - DNA, 22 bp, Homo sapiens
gcacctgccagcctggcttctg

SEQ ID NO: 2103490 - DNA, 20 bp, Homo sapiens
gcacctgcttcatgctcagc

SEQ ID NO: 2103491 - DNA, 14 bp, Homo sapiens
gcacctggcctgct

SEQ ID NO: 2103492 - DNA, 15 bp, Homo sapiens
gcacctggcctgctg

SEQ ID NO: 2103493 - DNA, 22 bp, Homo sapiens
gcacctgggccctggggcctgt

SEQ ID NO: 2103494 - DNA, 19 bp, Homo sapiens
gcaccttaatattattggg

SEQ ID NO: 2103495 - DNA, 17 bp, Homo sapiens
gcaccttacattcctag

SEQ ID NO: 2103496 - DNA, 16 bp, Homo sapiens
gcaccttagtggcttt

SEQ ID NO: 2103497 - DNA, 18 bp, Homo sapiens
gcaccttgtcatgtacca

SEQ ID NO: 2103498 - DNA, 21 bp, Homo sapiens
gcaccttttataccagagacc

SEQ ID NO: 2103499 - DNA, 15 bp, Homo sapiens
gcacgaacccacctg

SEQ ID NO: 2103500 - DNA, 20 bp, Homo sapiens
gcacgcaacccttgctgctg

SEQ ID NO: 2103501 - DNA, 12 bp, Homo sapiens
gcacgcctgccc

SEQ ID NO: 2103502 - DNA, 13 bp, Homo sapiens
gcacggcagcttg

SEQ ID NO: 2103503 - DNA, 20 bp, Homo sapiens
gcacggtggacccagacaca

SEQ ID NO: 2103504 - DNA, 20 bp, Homo sapiens
gcacgtttggcatttctctt

SEQ ID NO: 2103505 - DNA, 14 bp, Homo sapiens
gcactaaagcagtg

SEQ ID NO: 2103506 - DNA, 19 bp, Homo sapiens
gcactaaggccgtgtctct

SEQ ID NO: 2103507 - DNA, 17 bp, Homo sapiens
gcactaattgacccaaa

SEQ ID NO: 2103508 - DNA, 21 bp, Homo sapiens
gcactacatgtggtttataga

SEQ ID NO: 2103509 - DNA, 20 bp, Homo sapiens
gcactagaagtggtttcctg

SEQ ID NO: 2103510 - DNA, 19 bp, Homo sapiens
gcactaggttcaattccct

SEQ ID NO: 2103511 - DNA, 22 bp, Homo sapiens
gcactatgaggaataattattt

SEQ ID NO: 2103512 - DNA, 19 bp, Homo sapiens
gcactcacccatgtgccaa

SEQ ID NO: 2103513 - DNA, 12 bp, Homo sapiens
gcactccagcct

SEQ ID NO: 2103514 - DNA, 16 bp, Homo sapiens
gcactccagcctgggc

SEQ ID NO: 2103515 - DNA, 21 bp, Homo sapiens
gcactccctaagaaaccccag

SEQ ID NO: 2103516 - DNA, 20 bp, Homo sapiens
gcactcccttaggcattatt

SEQ ID NO: 2103517 - DNA, 14 bp, Homo sapiens
gcactccggaggta

SEQ ID NO: 2103518 - DNA, 14 bp, Homo sapiens
gcactcctctgtct

SEQ ID NO: 2103519 - DNA, 18 bp, Homo sapiens
gcactcgagaccatcctg

SEQ ID NO: 2103520 - DNA, 21 bp, Homo sapiens
gcactctagcctggcaacaga

SEQ ID NO: 2103521 - DNA, 22 bp, Homo sapiens
gcactctctaaatcttccttgt

SEQ ID NO: 2103522 - DNA, 12 bp, Homo sapiens
gcactgacattg

SEQ ID NO: 2103523 - DNA, 17 bp, Homo sapiens
gcactgacccttccaga

SEQ ID NO: 2103524 - DNA, 18 bp, Homo sapiens
gcactgacttctaagtaa

SEQ ID NO: 2103525 - DNA, 15 bp, Homo sapiens
gcactgagatattta

SEQ ID NO: 2103526 - DNA, 21 bp, Homo sapiens
gcactgagatatttattgttt

SEQ ID NO: 2103527 - DNA, 11 bp, Homo sapiens
gcactgagggc

SEQ ID NO: 2103528 - DNA, 12 bp, Homo sapiens
gcactgagggcc

SEQ ID NO: 2103529 - DNA, 15 bp, Homo sapiens
gcactgagggccaca

SEQ ID NO: 2103530 - DNA, 24 bp, Homo sapiens
gcactgagggccacactattacca

SEQ ID NO: 2103531 - DNA, 17 bp, Homo sapiens
gcactgatcaatccttc

SEQ ID NO: 2103532 - DNA, 12 bp, Homo sapiens
gcactgatttca

SEQ ID NO: 2103533 - DNA, 22 bp, Homo sapiens
gcactgcagatagccagacaca

SEQ ID NO: 2103534 - DNA, 14 bp, Homo sapiens
gcactgcagtgatg

SEQ ID NO: 2103535 - DNA, 14 bp, Homo sapiens
gcactgccaggagg

SEQ ID NO: 2103536 - DNA, 16 bp, Homo sapiens
gcactgccaggaggga

SEQ ID NO: 2103537 - DNA, 17 bp, Homo sapiens
gcactgccaggagggac

SEQ ID NO: 2103538 - DNA, 22 bp, Homo sapiens
gcactgcgtagagcctggaagg

SEQ ID NO: 2103539 - DNA, 20 bp, Homo sapiens
gcactgctaggcgagtgcca

SEQ ID NO: 2103540 - DNA, 12 bp, Homo sapiens
gcactgctgccc

SEQ ID NO: 2103541 - DNA, 20 bp, Homo sapiens
gcactgctgcccagcctcca

SEQ ID NO: 2103542 - DNA, 13 bp, Homo sapiens
gcactgctgtgtc

SEQ ID NO: 2103543 - DNA, 20 bp, Homo sapiens
gcactgcttgaggaggggca

SEQ ID NO: 2103544 - DNA, 23 bp, Homo sapiens
gcactgcttgaggaggggcacct

SEQ ID NO: 2103545 - DNA, 13 bp, Homo sapiens
gcactggccaccc

SEQ ID NO: 2103546 - DNA, 12 bp, Homo sapiens
gcactggccaga

SEQ ID NO: 2103547 - DNA, 15 bp, Homo sapiens
gcactggccagagag

SEQ ID NO: 2103548 - DNA, 20 bp, Homo sapiens
gcactggccagagagggccc

SEQ ID NO: 2103549 - DNA, 23 bp, Homo sapiens
gcactggccagagagggcccagc

SEQ ID NO: 2103550 - DNA, 23 bp, Homo sapiens
gcactggtggcccgacagcctgg

SEQ ID NO: 2103551 - DNA, 15 bp, Homo sapiens
gcactgtatgctgga

SEQ ID NO: 2103552 - DNA, 16 bp, Homo sapiens
gcactgttacttttta

SEQ ID NO: 2103553 - DNA, 21 bp, Homo sapiens
gcacttagcccaagaggtctg

SEQ ID NO: 2103554 - DNA, 17 bp, Homo sapiens
gcacttagctatcagaa

SEQ ID NO: 2103555 - DNA, 16 bp, Homo sapiens
gcacttgcgtcctgca

SEQ ID NO: 2103556 - DNA, 20 bp, Homo sapiens
gcacttgcgtcctgcagagg

SEQ ID NO: 2103557 - DNA, 15 bp, Homo sapiens
gcacttgctggaaga

SEQ ID NO: 2103558 - DNA, 18 bp, Homo sapiens
gcacttggagacttgtat

SEQ ID NO: 2103559 - DNA, 16 bp, Homo sapiens
gcacttggagccaagg

SEQ ID NO: 2103560 - DNA, 17 bp, Homo sapiens
gcacttgtcactatgct

SEQ ID NO: 2103561 - DNA, 16 bp, Homo sapiens
gcactttaaccctctc

SEQ ID NO: 2103562 - DNA, 20 bp, Homo sapiens
gcactttaaccctctcttcc

SEQ ID NO: 2103563 - DNA, 22 bp, Homo sapiens
gcactttaaccctctcttccct

SEQ ID NO: 2103564 - DNA, 16 bp, Homo sapiens
gcactttgggaggctg

SEQ ID NO: 2103565 - DNA, 20 bp, Homo sapiens
gcactttgggaggctgaagt

SEQ ID NO: 2103566 - DNA, 20 bp, Homo sapiens
gcactttgggaggctgaggc

SEQ ID NO: 2103567 - DNA, 21 bp, Homo sapiens
gcactttgggaggctgaggcg

SEQ ID NO: 2103568 - DNA, 14 bp, Homo sapiens
gcacttttctgtgt

SEQ ID NO: 2103569 - DNA, 21 bp, Homo sapiens
gcagaaaagaggagaccctgg

SEQ ID NO: 2103570 - DNA, 16 bp, Homo sapiens
gcagaaaagcacctgc

SEQ ID NO: 2103571 - DNA, 20 bp, Homo sapiens
gcagaaaagcacctgccgac

SEQ ID NO: 2103572 - DNA, 12 bp, Homo sapiens
gcagaaaagtgc

SEQ ID NO: 2103573 - DNA, 16 bp, Homo sapiens
gcagaaaagtgcttag

SEQ ID NO: 2103574 - DNA, 17 bp, Homo sapiens
gcagaaacgaagccatc

SEQ ID NO: 2103575 - DNA, 23 bp, Homo sapiens
gcagaaacgaagccatctttctt

SEQ ID NO: 2103576 - DNA, 21 bp, Homo sapiens
gcagaacagccgctcctgtct

SEQ ID NO: 2103577 - DNA, 21 bp, Homo sapiens
gcagaagagggaggcttcctg

SEQ ID NO: 2103578 - DNA, 16 bp, Homo sapiens
gcagaaggaaggcagg

SEQ ID NO: 2103579 - DNA, 15 bp, Homo sapiens
gcagaaggccaagaa

SEQ ID NO: 2103580 - DNA, 13 bp, Homo sapiens
gcagaagggagaa

SEQ ID NO: 2103581 - DNA, 18 bp, Homo sapiens
gcagaataatctttgggt

SEQ ID NO: 2103582 - DNA, 12 bp, Homo sapiens
gcagaatgaaga

SEQ ID NO: 2103583 - DNA, 17 bp, Homo sapiens
gcagaatgtttttaaaa

SEQ ID NO: 2103584 - DNA, 14 bp, Homo sapiens
gcagacaagagctg

SEQ ID NO: 2103585 - DNA, 16 bp, Homo sapiens
gcagacaagagctgct

SEQ ID NO: 2103586 - DNA, 20 bp, Homo sapiens
gcagacacctgtgcacccca

SEQ ID NO: 2103587 - DNA, 14 bp, Homo sapiens
gcagacagagaaat

SEQ ID NO: 2103588 - DNA, 13 bp, Homo sapiens
gcagacagcagct

SEQ ID NO: 2103589 - DNA, 17 bp, Homo sapiens
gcagacagcagctcagg

SEQ ID NO: 2103590 - DNA, 23 bp, Homo sapiens
gcagacaggcaagcacctcctgc

SEQ ID NO: 2103591 - DNA, 15 bp, Homo sapiens
gcagaccctgccctt

SEQ ID NO: 2103592 - DNA, 20 bp, Homo sapiens
gcagaccgggggccagacac

SEQ ID NO: 2103593 - DNA, 23 bp, Homo sapiens
gcagaccgggggccagacacaga

SEQ ID NO: 2103594 - DNA, 20 bp, Homo sapiens
gcagactcaataaaatcatg

SEQ ID NO: 2103595 - DNA, 19 bp, Homo sapiens
gcagactctacagaggcca

SEQ ID NO: 2103596 - DNA, 23 bp, Homo sapiens
gcagagaaagaaagggaaactgg

SEQ ID NO: 2103597 - DNA, 23 bp, Homo sapiens
gcagagaaagaagagacaggagg

SEQ ID NO: 2103598 - DNA, 23 bp, Homo sapiens
gcagagaaggatgtccgttccag

SEQ ID NO: 2103599 - DNA, 21 bp, Homo sapiens
gcagagaatgaaagggcccag

SEQ ID NO: 2103600 - DNA, 15 bp, Homo sapiens
gcagagaccccagga

SEQ ID NO: 2103601 - DNA, 16 bp, Homo sapiens
gcagagaccccaggat

SEQ ID NO: 2103602 - DNA, 13 bp, Homo sapiens
gcagagagaagcc

SEQ ID NO: 2103603 - DNA, 22 bp, Homo sapiens
gcagagagcaggacaggagaca

SEQ ID NO: 2103604 - DNA, 20 bp, Homo sapiens
gcagagaggaccccactgga

SEQ ID NO: 2103605 - DNA, 18 bp, Homo sapiens
gcagagaggtggagaact

SEQ ID NO: 2103606 - DNA, 18 bp, Homo sapiens
gcagagcaaatgagggag

SEQ ID NO: 2103607 - DNA, 20 bp, Homo sapiens
gcagagcaggggcagggtga

SEQ ID NO: 2103608 - DNA, 19 bp, Homo sapiens
gcagagccaccagggcact

SEQ ID NO: 2103609 - DNA, 18 bp, Homo sapiens
gcagagccatgggcctgg

SEQ ID NO: 2103610 - DNA, 21 bp, Homo sapiens
gcagagccatgggcctgggcc

SEQ ID NO: 2103611 - DNA, 22 bp, Homo sapiens
gcagagccatgggcctgggcct

SEQ ID NO: 2103612 - DNA, 14 bp, Homo sapiens
gcagagctctgccg

SEQ ID NO: 2103613 - DNA, 22 bp, Homo sapiens
gcagagctgatggagaaggaag

SEQ ID NO: 2103614 - DNA, 18 bp, Homo sapiens
gcagaggagtccagggcg

SEQ ID NO: 2103615 - DNA, 15 bp, Homo sapiens
gcagaggcagacagg

SEQ ID NO: 2103616 - DNA, 17 bp, Homo sapiens
gcagaggcggaaacctt

SEQ ID NO: 2103617 - DNA, 20 bp, Homo sapiens
gcagaggcggaaaccttgca

SEQ ID NO: 2103618 - DNA, 22 bp, Homo sapiens
gcagaggcggaaaccttgcagc

SEQ ID NO: 2103619 - DNA, 21 bp, Homo sapiens
gcagaggctggaggcagggcc

SEQ ID NO: 2103620 - DNA, 22 bp, Homo sapiens
gcagaggctggaggcagggcct

SEQ ID NO: 2103621 - DNA, 22 bp, Homo sapiens
gcagagggaatgttccctgcac

SEQ ID NO: 2103622 - DNA, 18 bp, Homo sapiens
gcagaggggctttctgga

SEQ ID NO: 2103623 - DNA, 20 bp, Homo sapiens
gcagaggggctttctggaga

SEQ ID NO: 2103624 - DNA, 21 bp, Homo sapiens
gcagaggtaaaagtgtgagca

SEQ ID NO: 2103625 - DNA, 16 bp, Homo sapiens
gcagaggtgagcagag

SEQ ID NO: 2103626 - DNA, 14 bp, Homo sapiens
gcagaggtggccag

SEQ ID NO: 2103627 - DNA, 19 bp, Homo sapiens
gcagagtgggctgcctggg

SEQ ID NO: 2103628 - DNA, 21 bp, Homo sapiens
gcagataaagacagctgacag

SEQ ID NO: 2103629 - DNA, 18 bp, Homo sapiens
gcagataatcagcctctt

SEQ ID NO: 2103630 - DNA, 19 bp, Homo sapiens
gcagataatcagcctctta

SEQ ID NO: 2103631 - DNA, 23 bp, Homo sapiens
gcagatctttttgtgaaattcaa

SEQ ID NO: 2103632 - DNA, 17 bp, Homo sapiens
gcagatgtaggagggac

SEQ ID NO: 2103633 - DNA, 20 bp, Homo sapiens
gcagattcatttttctttct

SEQ ID NO: 2103634 - DNA, 16 bp, Homo sapiens
gcagattcctgggcct

SEQ ID NO: 2103635 - DNA, 17 bp, Homo sapiens
gcagattcctgggcctg

SEQ ID NO: 2103636 - DNA, 20 bp, Homo sapiens
gcagattgtgtaacaatttt

SEQ ID NO: 2103637 - DNA, 20 bp, Homo sapiens
gcagatttagtgaaagctag

SEQ ID NO: 2103638 - DNA, 14 bp, Homo sapiens
gcagcaaaaatata

SEQ ID NO: 2103639 - DNA, 15 bp, Homo sapiens
gcagcaaaaatataa

SEQ ID NO: 2103640 - DNA, 18 bp, Homo sapiens
gcagcaaaaatataaaat

SEQ ID NO: 2103641 - DNA, 19 bp, Homo sapiens
gcagcaaaaatataaaata

SEQ ID NO: 2103642 - DNA, 15 bp, Homo sapiens
gcagcaactcccacg

SEQ ID NO: 2103643 - DNA, 16 bp, Homo sapiens
gcagcaactcccacga

SEQ ID NO: 2103644 - DNA, 16 bp, Homo sapiens
gcagcaaggcccgagc

SEQ ID NO: 2103645 - DNA, 20 bp, Homo sapiens
ctaagccactcttccaaagg

SEQ ID NO: 2103646 - DNA, 18 bp, Homo sapiens
ctaagccctcgaaccaag

SEQ ID NO: 2103647 - DNA, 21 bp, Homo sapiens
ctaagccctcgaaccaaggca

SEQ ID NO: 2103648 - DNA, 22 bp, Homo sapiens
ctaagccctcgaaccaaggcag

SEQ ID NO: 2103649 - DNA, 14 bp, Homo sapiens
ctaagcctgttgct

SEQ ID NO: 2103650 - DNA, 23 bp, Homo sapiens
ctaagcctgttgctgaagtcatt

SEQ ID NO: 2103651 - DNA, 16 bp, Homo sapiens
ctaagcctttccataa

SEQ ID NO: 2103652 - DNA, 12 bp, Homo sapiens
ctaagctgcagc

SEQ ID NO: 2103653 - DNA, 16 bp, Homo sapiens
ctaagctgcagcttcc

SEQ ID NO: 2103654 - DNA, 13 bp, Homo sapiens
ctaagctggagct

SEQ ID NO: 2103655 - DNA, 22 bp, Homo sapiens
ctaagctggagctcttggaaga

SEQ ID NO: 2103656 - DNA, 16 bp, Homo sapiens
ctaagctttctccttt

SEQ ID NO: 2103657 - DNA, 17 bp, Homo sapiens
ctaagctttctcctttg

SEQ ID NO: 2103658 - DNA, 14 bp, Homo sapiens
ctaaggacacacta

SEQ ID NO: 2103659 - DNA, 16 bp, Homo sapiens
ctaaggacacactaat

SEQ ID NO: 2103660 - DNA, 15 bp, Homo sapiens
ctaaggtaatcctat

SEQ ID NO: 2103661 - DNA, 14 bp, Homo sapiens
ctaaggttctcata

SEQ ID NO: 2103662 - DNA, 18 bp, Homo sapiens
ctaagtaaaaccacagca

SEQ ID NO: 2103663 - DNA, 21 bp, Homo sapiens
ctaagtagatagaaagcaata

SEQ ID NO: 2103664 - DNA, 20 bp, Homo sapiens
ctaagtgatcctcccacctc

SEQ ID NO: 2103665 - DNA, 22 bp, Homo sapiens
ctaagtgatcctcccacctcag

SEQ ID NO: 2103666 - DNA, 17 bp, Homo sapiens
ctaagtgggaagtgaag

SEQ ID NO: 2103667 - DNA, 21 bp, Homo sapiens
ctaagttaatttaaagttgtt

SEQ ID NO: 2103668 - DNA, 22 bp, Homo sapiens
ctaataaatgccaactggtcac

SEQ ID NO: 2103669 - DNA, 12 bp, Homo sapiens
ctaatatatttt

SEQ ID NO: 2103670 - DNA, 15 bp, Homo sapiens
ctaatatatttttat

SEQ ID NO: 2103671 - DNA, 21 bp, Homo sapiens
ctaatatatttttatatttag

SEQ ID NO: 2103672 - DNA, 13 bp, Homo sapiens
ctaatatggcaaa

SEQ ID NO: 2103673 - DNA, 18 bp, Homo sapiens
ctaatatgtaacaagcca

SEQ ID NO: 2103674 - DNA, 18 bp, Homo sapiens
ctaatattaaaaatatgg

SEQ ID NO: 2103675 - DNA, 19 bp, Homo sapiens
ctaatcagcattctcactc

SEQ ID NO: 2103676 - DNA, 18 bp, Homo sapiens
ctaatcagctcccttccc

SEQ ID NO: 2103677 - DNA, 15 bp, Homo sapiens
ctaatccaacccatg

SEQ ID NO: 2103678 - DNA, 15 bp, Homo sapiens
ctaatctcatacctc

SEQ ID NO: 2103679 - DNA, 21 bp, Homo sapiens
ctaatctgtagggctggacct

SEQ ID NO: 2103680 - DNA, 14 bp, Homo sapiens
ctaatgctaagaaa

SEQ ID NO: 2103681 - DNA, 15 bp, Homo sapiens
ctaatgctaagaaat

SEQ ID NO: 2103682 - DNA, 13 bp, Homo sapiens
ctaatgggacact

SEQ ID NO: 2103683 - DNA, 16 bp, Homo sapiens
ctaattaaaaagttaa

SEQ ID NO: 2103684 - DNA, 15 bp, Homo sapiens
ctaattcaattcaaa

SEQ ID NO: 2103685 - DNA, 13 bp, Homo sapiens
ctaattcatttat

SEQ ID NO: 2103686 - DNA, 14 bp, Homo sapiens
ctaattcccagagt

SEQ ID NO: 2103687 - DNA, 20 bp, Homo sapiens
ctaattctcttacccagaat

SEQ ID NO: 2103688 - DNA, 13 bp, Homo sapiens
ctaattgaaattt

SEQ ID NO: 2103689 - DNA, 15 bp, Homo sapiens
ctaattgaaatttaa

SEQ ID NO: 2103690 - DNA, 12 bp, Homo sapiens
ctaatttaaaaa

SEQ ID NO: 2103691 - DNA, 15 bp, Homo sapiens
ctaatttaaaccagc

SEQ ID NO: 2103692 - DNA, 12 bp, Homo sapiens
ctaatttataca

SEQ ID NO: 2103693 - DNA, 15 bp, Homo sapiens
ctaatttatacaaaa

SEQ ID NO: 2103694 - DNA, 16 bp, Homo sapiens
ctaatttatacaaaat

SEQ ID NO: 2103695 - DNA, 23 bp, Homo sapiens
ctaatttatacaaaataatttaa

SEQ ID NO: 2103696 - DNA, 15 bp, Homo sapiens
ctaatttatttttag

SEQ ID NO: 2103697 - DNA, 17 bp, Homo sapiens
ctaattttaagttattt

SEQ ID NO: 2103698 - DNA, 14 bp, Homo sapiens
ctaattttttgttg

SEQ ID NO: 2103699 - DNA, 16 bp, Homo sapiens
ctaattttttgttgtt

SEQ ID NO: 2103700 - DNA, 16 bp, Homo sapiens
ctaatttttttgtatt

SEQ ID NO: 2103701 - DNA, 18 bp, Homo sapiens
ctacaaaaacacagcaag

SEQ ID NO: 2103702 - DNA, 17 bp, Homo sapiens
ctacaaaatttgaaatt

SEQ ID NO: 2103703 - DNA, 23 bp, Homo sapiens
ctacaaagctgaagaaaatgaag

SEQ ID NO: 2103704 - DNA, 13 bp, Homo sapiens
ctacaaccagagc

SEQ ID NO: 2103705 - DNA, 14 bp, Homo sapiens
ctacaaccagagcc

SEQ ID NO: 2103706 - DNA, 22 bp, Homo sapiens
ctacaaccagagccccccacaa

SEQ ID NO: 2103707 - DNA, 19 bp, Homo sapiens
ctacaagctaaaattagat

SEQ ID NO: 2103708 - DNA, 11 bp, Homo sapiens
ctacaataaat

SEQ ID NO: 2103709 - DNA, 21 bp, Homo sapiens
gcagcccgtgaagcagtgcct

SEQ ID NO: 2103710 - DNA, 13 bp, Homo sapiens
gcagccctcctca

SEQ ID NO: 2103711 - DNA, 15 bp, Homo sapiens
gcagccctcctcacc

SEQ ID NO: 2103712 - DNA, 21 bp, Homo sapiens
gcagccctggcctgtggagag

SEQ ID NO: 2103713 - DNA, 19 bp, Homo sapiens
gcagccctgggggccagct

SEQ ID NO: 2103714 - DNA, 16 bp, Homo sapiens
gcagcccttcctcctg

SEQ ID NO: 2103715 - DNA, 17 bp, Homo sapiens
gcagccgccgggcaggc

SEQ ID NO: 2103716 - DNA, 18 bp, Homo sapiens
gcagccgtgccttcagct

SEQ ID NO: 2103717 - DNA, 19 bp, Homo sapiens
gcagcctcaacctcctggg

SEQ ID NO: 2103718 - DNA, 22 bp, Homo sapiens
gcagcctcaacctcctgggcta

SEQ ID NO: 2103719 - DNA, 16 bp, Homo sapiens
gcagcctccagagcca

SEQ ID NO: 2103720 - DNA, 18 bp, Homo sapiens
gcagcctccagagccagc

SEQ ID NO: 2103721 - DNA, 22 bp, Homo sapiens
gcagcctccagagccagcctgg

SEQ ID NO: 2103722 - DNA, 23 bp, Homo sapiens
gcagcctccagagccagcctggg

SEQ ID NO: 2103723 - DNA, 16 bp, Homo sapiens
gcagcctccctctgac

SEQ ID NO: 2103724 - DNA, 23 bp, Homo sapiens
gcagcctccctctgacctgcagg

SEQ ID NO: 2103725 - DNA, 18 bp, Homo sapiens
gcagcctcctcctgacca

SEQ ID NO: 2103726 - DNA, 13 bp, Homo sapiens
gcagcctcctggg

SEQ ID NO: 2103727 - DNA, 12 bp, Homo sapiens
gcagcctgatgg

SEQ ID NO: 2103728 - DNA, 13 bp, Homo sapiens
gcagcctgatggc

SEQ ID NO: 2103729 - DNA, 14 bp, Homo sapiens
gcagcctgatggcc

SEQ ID NO: 2103730 - DNA, 18 bp, Homo sapiens
gcagcctgatggccaagg

SEQ ID NO: 2103731 - DNA, 20 bp, Homo sapiens
gcagcctgatggccaagggg

SEQ ID NO: 2103732 - DNA, 22 bp, Homo sapiens
gcagcctggtagaattgggaag

SEQ ID NO: 2103733 - DNA, 14 bp, Homo sapiens
gcagcctttctgtg

SEQ ID NO: 2103734 - DNA, 24 bp, Homo sapiens
gcagcgagttgtggaaagcctctg

SEQ ID NO: 2103735 - DNA, 14 bp, Homo sapiens
gcagcgcgtgcaca

SEQ ID NO: 2103736 - DNA, 22 bp, Homo sapiens
gcagctagactggagtgaggct

SEQ ID NO: 2103737 - DNA, 17 bp, Homo sapiens
gcagctaggactgagga

SEQ ID NO: 2103738 - DNA, 19 bp, Homo sapiens
gcagctatgcgcaatgtgg

SEQ ID NO: 2103739 - DNA, 12 bp, Homo sapiens
gcagctccaaca

SEQ ID NO: 2103740 - DNA, 15 bp, Homo sapiens
gcagctccaacagct

SEQ ID NO: 2103741 - DNA, 16 bp, Homo sapiens
gcagctcctctgtctc

SEQ ID NO: 2103742 - DNA, 20 bp, Homo sapiens
gcagctcctctgtctcgagc

SEQ ID NO: 2103743 - DNA, 22 bp, Homo sapiens
gcagctcttcccctttcctggg

SEQ ID NO: 2103744 - DNA, 17 bp, Homo sapiens
gcagctctttcttcttt

SEQ ID NO: 2103745 - DNA, 14 bp, Homo sapiens
gcagctgagagccc

SEQ ID NO: 2103746 - DNA, 12 bp, Homo sapiens
gcagctgagcag

SEQ ID NO: 2103747 - DNA, 15 bp, Homo sapiens
gcagctgagcagggc

SEQ ID NO: 2103748 - DNA, 18 bp, Homo sapiens
gcagctgagcagggccgg

SEQ ID NO: 2103749 - DNA, 20 bp, Homo sapiens
gcagctgagcagggccgggg

SEQ ID NO: 2103750 - DNA, 19 bp, Homo sapiens
gcagctgcgggtctgaagg

SEQ ID NO: 2103751 - DNA, 17 bp, Homo sapiens
gcagctgcggtccaccc

SEQ ID NO: 2103752 - DNA, 18 bp, Homo sapiens
gcagctggctctccacct

SEQ ID NO: 2103753 - DNA, 12 bp, Homo sapiens
gcagctgggccc

SEQ ID NO: 2103754 - DNA, 13 bp, Homo sapiens
gcagctgggcccc

SEQ ID NO: 2103755 - DNA, 14 bp, Homo sapiens
gcagctgggcccca

SEQ ID NO: 2103756 - DNA, 20 bp, Homo sapiens
gcagctgggccccatgctct

SEQ ID NO: 2103757 - DNA, 16 bp, Homo sapiens
gcagctgggccggcca

SEQ ID NO: 2103758 - DNA, 18 bp, Homo sapiens
gcagctgggccggccagc

SEQ ID NO: 2103759 - DNA, 22 bp, Homo sapiens
gcagctgggccggccagccttg

SEQ ID NO: 2103760 - DNA, 23 bp, Homo sapiens
gcagctgggccggccagccttgc

SEQ ID NO: 2103761 - DNA, 20 bp, Homo sapiens
gcagctggtctttattcctc

SEQ ID NO: 2103762 - DNA, 20 bp, Homo sapiens
gcagctgtcatggaaaagcc

SEQ ID NO: 2103763 - DNA, 23 bp, Homo sapiens
gcagctgtcatggaaaagcccag

SEQ ID NO: 2103764 - DNA, 17 bp, Homo sapiens
gcagctgtcattcagga

SEQ ID NO: 2103765 - DNA, 17 bp, Homo sapiens
gcagctgtcccctctcc

SEQ ID NO: 2103766 - DNA, 17 bp, Homo sapiens
gcagctgtttctggaaa

SEQ ID NO: 2103767 - DNA, 15 bp, Homo sapiens
gcagcttaacattga

SEQ ID NO: 2103768 - DNA, 22 bp, Homo sapiens
gcagcttcatcaatttttatac

SEQ ID NO: 2103769 - DNA, 23 bp, Homo sapiens
gcagcttcatcaatttttataca

SEQ ID NO: 2103770 - DNA, 14 bp, Homo sapiens
gcagcttcctgtca

SEQ ID NO: 2103771 - DNA, 23 bp, Homo sapiens
gcagcttgagagggcaaacccaa

SEQ ID NO: 2103772 - DNA, 21 bp, Homo sapiens
gcagcttgagggttgggctgg

SEQ ID NO: 2103773 - DNA, 16 bp, Homo sapiens
gcagcttgtagccagc

SEQ ID NO: 2103774 - DNA, 19 bp, Homo sapiens
gcagcttgtagccagccgg

SEQ ID NO: 2103775 - DNA, 22 bp, Homo sapiens
gcagcttgtagccagccggggc

SEQ ID NO: 2103776 - DNA, 23 bp, Homo sapiens
gcagcttgtagccagccggggcg

SEQ ID NO: 2103777 - DNA, 11 bp, Homo sapiens
gcaggaaatag

SEQ ID NO: 2103778 - DNA, 15 bp, Homo sapiens
gcaggaacgagcact

SEQ ID NO: 2103779 - DNA, 17 bp, Homo sapiens
gcaggaacgagcactgg

SEQ ID NO: 2103780 - DNA, 17 bp, Homo sapiens
gccaaaagggcagccag

SEQ ID NO: 2103781 - DNA, 19 bp, Homo sapiens
gccaaaagggcagccaggg

SEQ ID NO: 2103782 - DNA, 20 bp, Homo sapiens
gccaaaatattgcttatgtc

SEQ ID NO: 2103783 - DNA, 22 bp, Homo sapiens
gccaaaatattgcttatgtctc

SEQ ID NO: 2103784 - DNA, 14 bp, Homo sapiens
gccaaacacagagc

SEQ ID NO: 2103785 - DNA, 14 bp, Homo sapiens
gccaaacactccac

SEQ ID NO: 2103786 - DNA, 22 bp, Homo sapiens
gccaaacccatgaggcaatgtc

SEQ ID NO: 2103787 - DNA, 18 bp, Homo sapiens
gccaaactctgccagcca

SEQ ID NO: 2103788 - DNA, 17 bp, Homo sapiens
gccaaagtgcagccctt

SEQ ID NO: 2103789 - DNA, 18 bp, Homo sapiens
gccaaagtgcagcccttc

SEQ ID NO: 2103790 - DNA, 20 bp, Homo sapiens
gccaaagtgcagcccttcct

SEQ ID NO: 2103791 - DNA, 16 bp, Homo sapiens
gccaaatgtaattgaa

SEQ ID NO: 2103792 - DNA, 11 bp, Homo sapiens
gccaaattatt

SEQ ID NO: 2103793 - DNA, 19 bp, Homo sapiens
gccaacaggtggcaggacc

SEQ ID NO: 2103794 - DNA, 22 bp, Homo sapiens
gccaacaggtggcaggaccagg

SEQ ID NO: 2103795 - DNA, 21 bp, Homo sapiens
gccaacctgatgccccttccc

SEQ ID NO: 2103796 - DNA, 14 bp, Homo sapiens
gccaacgacaaagc

SEQ ID NO: 2103797 - DNA, 23 bp, Homo sapiens
gccaacgacaaagccaaactctg

SEQ ID NO: 2103798 - DNA, 15 bp, Homo sapiens
gccaactaagccctc

SEQ ID NO: 2103799 - DNA, 13 bp, Homo sapiens
gccaacttgtaaa

SEQ ID NO: 2103800 - DNA, 12 bp, Homo sapiens
gccaagacttgg

SEQ ID NO: 2103801 - DNA, 18 bp, Homo sapiens
gccaagacttggcaacag

SEQ ID NO: 2103802 - DNA, 20 bp, Homo sapiens
gccaagagcagaggcagcga

SEQ ID NO: 2103803 - DNA, 20 bp, Homo sapiens
gccaagagcatcgtgaccct

SEQ ID NO: 2103804 - DNA, 21 bp, Homo sapiens
gccaagccctccccatcccat

SEQ ID NO: 2103805 - DNA, 21 bp, Homo sapiens
gccaagctgaggtgcccagga

SEQ ID NO: 2103806 - DNA, 22 bp, Homo sapiens
gccaagctgaggtgcccaggag

SEQ ID NO: 2103807 - DNA, 21 bp, Homo sapiens
gccaagcttcaaccctcagcc

SEQ ID NO: 2103808 - DNA, 15 bp, Homo sapiens
gccaaggcaggtaga

SEQ ID NO: 2103809 - DNA, 16 bp, Homo sapiens
gccaaggtgggctgag

SEQ ID NO: 2103810 - DNA, 19 bp, Homo sapiens
gccaaggtgggctgagccc

SEQ ID NO: 2103811 - DNA, 21 bp, Homo sapiens
gccaaggtgggctgagccctg

SEQ ID NO: 2103812 - DNA, 23 bp, Homo sapiens
gccaaggtgggctgagccctggc

SEQ ID NO: 2103813 - DNA, 15 bp, Homo sapiens
gccaaggttgtcctg

SEQ ID NO: 2103814 - DNA, 18 bp, Homo sapiens
gccaaggttgtcctggag

SEQ ID NO: 2103815 - DNA, 19 bp, Homo sapiens
gccaagtccaggtcctggt

SEQ ID NO: 2103816 - DNA, 22 bp, Homo sapiens
gccaagtccaggtcctggtggg

SEQ ID NO: 2103817 - DNA, 15 bp, Homo sapiens
gccaagttcctctag

SEQ ID NO: 2103818 - DNA, 12 bp, Homo sapiens
gccaatgaggtc

SEQ ID NO: 2103819 - DNA, 21 bp, Homo sapiens
gccaatgcacctaaagaaaaa

SEQ ID NO: 2103820 - DNA, 21 bp, Homo sapiens
gccaatggagactgtctcaag

SEQ ID NO: 2103821 - DNA, 16 bp, Homo sapiens
gccaattaaaatatat

SEQ ID NO: 2103822 - DNA, 17 bp, Homo sapiens
gccaattaaaatatata

SEQ ID NO: 2103823 - DNA, 23 bp, Homo sapiens
gccaattaaaatatatataaata

SEQ ID NO: 2103824 - DNA, 23 bp, Homo sapiens
gccacaaatcaaagcaagggctc

SEQ ID NO: 2103825 - DNA, 16 bp, Homo sapiens
gccacaagaaatttga

SEQ ID NO: 2103826 - DNA, 20 bp, Homo sapiens
gccacacattgtgcttggcc

SEQ ID NO: 2103827 - DNA, 20 bp, Homo sapiens
gccacacccggctccccctg

SEQ ID NO: 2103828 - DNA, 20 bp, Homo sapiens
gccacacttcaggctcttct

SEQ ID NO: 2103829 - DNA, 22 bp, Homo sapiens
gccacacttcaggctcttctcc

SEQ ID NO: 2103830 - DNA, 23 bp, Homo sapiens
gccacacttcaggctcttctcct

SEQ ID NO: 2103831 - DNA, 16 bp, Homo sapiens
gccacacttctcagga

SEQ ID NO: 2103832 - DNA, 23 bp, Homo sapiens
gccacacttctcaggacacaggc

SEQ ID NO: 2103833 - DNA, 19 bp, Homo sapiens
gccacagaagccaggagca

SEQ ID NO: 2103834 - DNA, 21 bp, Homo sapiens
gccacagaccacctgcttctg

SEQ ID NO: 2103835 - DNA, 14 bp, Homo sapiens
gccacagagaaagt

SEQ ID NO: 2103836 - DNA, 20 bp, Homo sapiens
gccacagagaaagtacttct

SEQ ID NO: 2103837 - DNA, 12 bp, Homo sapiens
gccaccaataaa

SEQ ID NO: 2103838 - DNA, 18 bp, Homo sapiens
gccaccaataaaaatcct

SEQ ID NO: 2103839 - DNA, 19 bp, Homo sapiens
gccaccaccagatgagaag

SEQ ID NO: 2103840 - DNA, 17 bp, Homo sapiens
gccaccacgtctgccag

SEQ ID NO: 2103841 - DNA, 22 bp, Homo sapiens
gccaccacgtctgccaggccca

SEQ ID NO: 2103842 - DNA, 12 bp, Homo sapiens
gccaccaggatg

SEQ ID NO: 2103843 - DNA, 17 bp, Homo sapiens
gccaccaggatggccct

SEQ ID NO: 2103844 - DNA, 16 bp, Homo sapiens
gccaccagggcactgt

SEQ ID NO: 2103845 - DNA, 16 bp, Homo sapiens
gccaccaggtcatctc

SEQ ID NO: 2103846 - DNA, 12 bp, Homo sapiens
gccaccatcctg

SEQ ID NO: 2103847 - DNA, 22 bp, Homo sapiens
gccacccaggcaggccctgcct

SEQ ID NO: 2103848 - DNA, 21 bp, Homo sapiens
gccacccgtaggcagcctctc

SEQ ID NO: 2103849 - DNA, 22 bp, Homo sapiens
gccacccgtaggcagcctctct

SEQ ID NO: 2103850 - DNA, 14 bp, Homo sapiens
gccaccctgaggag

SEQ ID NO: 2103851 - DNA, 20 bp, Homo sapiens
gccaccctgaggagtctgag

SEQ ID NO: 2103852 - DNA, 13 bp, Homo sapiens
gccaccctgggga

SEQ ID NO: 2103853 - DNA, 18 bp, Homo sapiens
gccaccgctctcctgcct

SEQ ID NO: 2103854 - DNA, 23 bp, Homo sapiens
gccaccgctgccttttgctgctg

SEQ ID NO: 2103855 - DNA, 18 bp, Homo sapiens
gccaccgggacagacctg

SEQ ID NO: 2103856 - DNA, 23 bp, Homo sapiens
gccaccgggacagacctggacac

SEQ ID NO: 2103857 - DNA, 18 bp, Homo sapiens
gccacctcccaaggactt

SEQ ID NO: 2103858 - DNA, 16 bp, Homo sapiens
gccacctcccacccca

SEQ ID NO: 2103859 - DNA, 23 bp, Homo sapiens
gccacctcccaccccactccagc

SEQ ID NO: 2103860 - DNA, 17 bp, Homo sapiens
gccacctcccctatcca

SEQ ID NO: 2103861 - DNA, 21 bp, Homo sapiens
gccacctcccctatccaccca

SEQ ID NO: 2103862 - DNA, 15 bp, Homo sapiens
gccacctcttgggca

SEQ ID NO: 2103863 - DNA, 17 bp, Homo sapiens
gccacctcttgggcatg

SEQ ID NO: 2103864 - DNA, 14 bp, Homo sapiens
gcagggatttgagg

SEQ ID NO: 2103865 - DNA, 18 bp, Homo sapiens
gcagggccttgcccagag

SEQ ID NO: 2103866 - DNA, 21 bp, Homo sapiens
gcagggccttgcccagagatg

SEQ ID NO: 2103867 - DNA, 12 bp, Homo sapiens
gcagggctcagc

SEQ ID NO: 2103868 - DNA, 19 bp, Homo sapiens
gcagggctctgccccagag

SEQ ID NO: 2103869 - DNA, 13 bp, Homo sapiens
gcaggggagtgcc

SEQ ID NO: 2103870 - DNA, 15 bp, Homo sapiens
gcaggggtctgagcc

SEQ ID NO: 2103871 - DNA, 19 bp, Homo sapiens
gcaggggtgggagagccag

SEQ ID NO: 2103872 - DNA, 14 bp, Homo sapiens
gcagggtcaggaga

SEQ ID NO: 2103873 - DNA, 15 bp, Homo sapiens
gcagggtcaggagag

SEQ ID NO: 2103874 - DNA, 17 bp, Homo sapiens
gcagggtctagaaggct

SEQ ID NO: 2103875 - DNA, 16 bp, Homo sapiens
gcagggtctcactctg

SEQ ID NO: 2103876 - DNA, 18 bp, Homo sapiens
gcaggtacttcctcctga

SEQ ID NO: 2103877 - DNA, 22 bp, Homo sapiens
gcaggtagatcgcttgagccca

SEQ ID NO: 2103878 - DNA, 22 bp, Homo sapiens
gcaggtccagggtttgagttca

SEQ ID NO: 2103879 - DNA, 18 bp, Homo sapiens
gcaggtctcagcccggga

SEQ ID NO: 2103880 - DNA, 17 bp, Homo sapiens
gcaggtctcctctggga

SEQ ID NO: 2103881 - DNA, 16 bp, Homo sapiens
gcaggtctctggcaga

SEQ ID NO: 2103882 - DNA, 18 bp, Homo sapiens
gcaggtctctggcagaga

SEQ ID NO: 2103883 - DNA, 22 bp, Homo sapiens
gcaggtgcaagagacagagccc

SEQ ID NO: 2103884 - DNA, 23 bp, Homo sapiens
gcaggtgcaagagacagagcccc

SEQ ID NO: 2103885 - DNA, 15 bp, Homo sapiens
gcaggtgcagatggg

SEQ ID NO: 2103886 - DNA, 16 bp, Homo sapiens
gcaggtggtcctgaga

SEQ ID NO: 2103887 - DNA, 11 bp, Homo sapiens
gcaggtgtcta

SEQ ID NO: 2103888 - DNA, 13 bp, Homo sapiens
gcaggtgtggtgg

SEQ ID NO: 2103889 - DNA, 18 bp, Homo sapiens
gcaggtgtggtggctcat

SEQ ID NO: 2103890 - DNA, 20 bp, Homo sapiens
gcaggtgtggtggctcatgg

SEQ ID NO: 2103891 - DNA, 16 bp, Homo sapiens
gcaggttagaacctag

SEQ ID NO: 2103892 - DNA, 12 bp, Homo sapiens
gcaggttcttga

SEQ ID NO: 2103893 - DNA, 14 bp, Homo sapiens
gcaggttcttgatg

SEQ ID NO: 2103894 - DNA, 15 bp, Homo sapiens
gcaggttcttgatgt

SEQ ID NO: 2103895 - DNA, 13 bp, Homo sapiens
gcagtacatggga

SEQ ID NO: 2103896 - DNA, 14 bp, Homo sapiens
gcagtacctgggaa

SEQ ID NO: 2103897 - DNA, 16 bp, Homo sapiens
gcagtatctctctgcc

SEQ ID NO: 2103898 - DNA, 17 bp, Homo sapiens
gcagtatgaatgatgtt

SEQ ID NO: 2103899 - DNA, 13 bp, Homo sapiens
gcagtattgagca

SEQ ID NO: 2103900 - DNA, 13 bp, Homo sapiens
gcagtccagaata

SEQ ID NO: 2103901 - DNA, 15 bp, Homo sapiens
gcagtccagccagct

SEQ ID NO: 2103902 - DNA, 16 bp, Homo sapiens
gcagtccagccagctc

SEQ ID NO: 2103903 - DNA, 13 bp, Homo sapiens
gcagtccccagcc

SEQ ID NO: 2103904 - DNA, 15 bp, Homo sapiens
gcagtccccagccct

SEQ ID NO: 2103905 - DNA, 21 bp, Homo sapiens
gcagtcccgtggagggtaggg

SEQ ID NO: 2103906 - DNA, 23 bp, Homo sapiens
gcagtccctgagaccatttaaca

SEQ ID NO: 2103907 - DNA, 12 bp, Homo sapiens
gcagtccgcagt

SEQ ID NO: 2103908 - DNA, 17 bp, Homo sapiens
gcagtcctcccacccta

SEQ ID NO: 2103909 - DNA, 16 bp, Homo sapiens
gcagtctcagaaagcc

SEQ ID NO: 2103910 - DNA, 19 bp, Homo sapiens
gcagtctcagaaagccttc

SEQ ID NO: 2103911 - DNA, 22 bp, Homo sapiens
gcagtctgaacccttgtgcttg

SEQ ID NO: 2103912 - DNA, 16 bp, Homo sapiens
gcagtctggcctgggc

SEQ ID NO: 2103913 - DNA, 14 bp, Homo sapiens
gcagtgaactattt

SEQ ID NO: 2103914 - DNA, 14 bp, Homo sapiens
gcagtgaattgtga

SEQ ID NO: 2103915 - DNA, 17 bp, Homo sapiens
gcagtgacaagtggagg

SEQ ID NO: 2103916 - DNA, 18 bp, Homo sapiens
gcagtgacaagtggaggg

SEQ ID NO: 2103917 - DNA, 14 bp, Homo sapiens
gcagtgactggcag

SEQ ID NO: 2103918 - DNA, 20 bp, Homo sapiens
gcagtgagttacagcgagag

SEQ ID NO: 2103919 - DNA, 17 bp, Homo sapiens
gcagtgcccccacccag

SEQ ID NO: 2103920 - DNA, 12 bp, Homo sapiens
gcagtgcctcct

SEQ ID NO: 2103921 - DNA, 16 bp, Homo sapiens
gcagtgcctcctggga

SEQ ID NO: 2103922 - DNA, 18 bp, Homo sapiens
gcagtgcctcctgggacc

SEQ ID NO: 2103923 - DNA, 17 bp, Homo sapiens
gcagtgcctcgaggcac

SEQ ID NO: 2103924 - DNA, 21 bp, Homo sapiens
gcagtgcctcgaggcaccggc

SEQ ID NO: 2103925 - DNA, 16 bp, Homo sapiens
gcagtgccttccataa

SEQ ID NO: 2103926 - DNA, 22 bp, Homo sapiens
gcagtgccttccataattatga

SEQ ID NO: 2103927 - DNA, 11 bp, Homo sapiens
gcagtgggagc

SEQ ID NO: 2103928 - DNA, 13 bp, Homo sapiens
gcagtgggagctg

SEQ ID NO: 2103929 - DNA, 15 bp, Homo sapiens
gcagtgggagctgcc

SEQ ID NO: 2103930 - DNA, 16 bp, Homo sapiens
gcagtgggagctgcct

SEQ ID NO: 2103931 - DNA, 16 bp, Homo sapiens
gcagtgggtgggagct

SEQ ID NO: 2103932 - DNA, 19 bp, Homo sapiens
gcagtggtgcgatctgggt

SEQ ID NO: 2103933 - DNA, 11 bp, Homo sapiens
gcagtgtcttc

SEQ ID NO: 2103934 - DNA, 16 bp, Homo sapiens
gcagtgtcttccataa

SEQ ID NO: 2103935 - DNA, 20 bp, Homo sapiens
gcagtgtgtcacactgagct

SEQ ID NO: 2103936 - DNA, 21 bp, Homo sapiens
gcagtgtgtcacactgagctg

SEQ ID NO: 2103937 - DNA, 21 bp, Homo sapiens
gcagtgttcctatttggggct

SEQ ID NO: 2103938 - DNA, 18 bp, Homo sapiens
gcagttaatggggtagag

SEQ ID NO: 2103939 - DNA, 14 bp, Homo sapiens
gcagttaccgagga

SEQ ID NO: 2103940 - DNA, 21 bp, Homo sapiens
gcagttaccgaggagctaaac

SEQ ID NO: 2103941 - DNA, 17 bp, Homo sapiens
gccacctgcaagtgccc

SEQ ID NO: 2103942 - DNA, 10 bp, Homo sapiens
gccacctgtc

SEQ ID NO: 2103943 - DNA, 15 bp, Homo sapiens
gccacctgtctgtct

SEQ ID NO: 2103944 - DNA, 13 bp, Homo sapiens
gccacgctgtcct

SEQ ID NO: 2103945 - DNA, 19 bp, Homo sapiens
gccacgctgtcctctcgag

SEQ ID NO: 2103946 - DNA, 13 bp, Homo sapiens
gccacggccaccc

SEQ ID NO: 2103947 - DNA, 17 bp, Homo sapiens
gccacggccaggccaga

SEQ ID NO: 2103948 - DNA, 13 bp, Homo sapiens
gccacgtgccagg

SEQ ID NO: 2103949 - DNA, 16 bp, Homo sapiens
gccacgtgccaggccc

SEQ ID NO: 2103950 - DNA, 18 bp, Homo sapiens
gccacgtgccaggcccgg

SEQ ID NO: 2103951 - DNA, 22 bp, Homo sapiens
gccactacactccagcctgagc

SEQ ID NO: 2103952 - DNA, 23 bp, Homo sapiens
gccactacactccagcctgagca

SEQ ID NO: 2103953 - DNA, 22 bp, Homo sapiens
gccactacctttgtccaggcct

SEQ ID NO: 2103954 - DNA, 16 bp, Homo sapiens
gccactcattcctgta

SEQ ID NO: 2103955 - DNA, 15 bp, Homo sapiens
gccactcatttcatc

SEQ ID NO: 2103956 - DNA, 16 bp, Homo sapiens
gccactcatttcatct

SEQ ID NO: 2103957 - DNA, 18 bp, Homo sapiens
gccactccagacccctgg

SEQ ID NO: 2103958 - DNA, 16 bp, Homo sapiens
gccactccctgagctt

SEQ ID NO: 2103959 - DNA, 19 bp, Homo sapiens
gccactccctgagctttgg

SEQ ID NO: 2103960 - DNA, 13 bp, Homo sapiens
gccactccttcct

SEQ ID NO: 2103961 - DNA, 14 bp, Homo sapiens
gccactccttcctg

SEQ ID NO: 2103962 - DNA, 19 bp, Homo sapiens
gccactcgcagtcgcagga

SEQ ID NO: 2103963 - DNA, 22 bp, Homo sapiens
gccactcgcagtcgcaggatcc

SEQ ID NO: 2103964 - DNA, 23 bp, Homo sapiens
gccactcgggaggctgagacagg

SEQ ID NO: 2103965 - DNA, 15 bp, Homo sapiens
gccactgaagctggg

SEQ ID NO: 2103966 - DNA, 14 bp, Homo sapiens
gccactgacctcac

SEQ ID NO: 2103967 - DNA, 18 bp, Homo sapiens
gccactgcaccgggccac

SEQ ID NO: 2103968 - DNA, 18 bp, Homo sapiens
gccactgcactccagcct

SEQ ID NO: 2103969 - DNA, 20 bp, Homo sapiens
gccactgcactccagcctgg

SEQ ID NO: 2103970 - DNA, 19 bp, Homo sapiens
gccactgcactccagtctg

SEQ ID NO: 2103971 - DNA, 17 bp, Homo sapiens
gccactgccaggcacct

SEQ ID NO: 2103972 - DNA, 23 bp, Homo sapiens
gccactgccaggcacctggcctg

SEQ ID NO: 2103973 - DNA, 13 bp, Homo sapiens
gccactgcctctt

SEQ ID NO: 2103974 - DNA, 18 bp, Homo sapiens
gccactgggtctcactcc

SEQ ID NO: 2103975 - DNA, 19 bp, Homo sapiens
gccactgggtctcactcct

SEQ ID NO: 2103976 - DNA, 16 bp, Homo sapiens
gccactggtttctcag

SEQ ID NO: 2103977 - DNA, 18 bp, Homo sapiens
gccactggtttctcagaa

SEQ ID NO: 2103978 - DNA, 13 bp, Homo sapiens
gccactgtggcca

SEQ ID NO: 2103979 - DNA, 15 bp, Homo sapiens
gccactgtggccaga

SEQ ID NO: 2103980 - DNA, 19 bp, Homo sapiens
gccactgtggccagagctg

SEQ ID NO: 2103981 - DNA, 20 bp, Homo sapiens
gccactgtggccagagctgg

SEQ ID NO: 2103982 - DNA, 21 bp, Homo sapiens
gccacttaccttcaataaagt

SEQ ID NO: 2103983 - DNA, 14 bp, Homo sapiens
gccacttccaggag

SEQ ID NO: 2103984 - DNA, 21 bp, Homo sapiens
gccacttgatgacccccaacc

SEQ ID NO: 2103985 - DNA, 17 bp, Homo sapiens
gccactttaagagagaa

SEQ ID NO: 2103986 - DNA, 19 bp, Homo sapiens
gccactttaagagagaaat

SEQ ID NO: 2103987 - DNA, 19 bp, Homo sapiens
gccactttcgggagggtgg

SEQ ID NO: 2103988 - DNA, 21 bp, Homo sapiens
gccactttcgggagggtggat

SEQ ID NO: 2103989 - DNA, 16 bp, Homo sapiens
gccactttggcttctc

SEQ ID NO: 2103990 - DNA, 20 bp, Homo sapiens
gccactttggcttctcctgt

SEQ ID NO: 2103991 - DNA, 21 bp, Homo sapiens
gccactttggtacatggccag

SEQ ID NO: 2103992 - DNA, 14 bp, Homo sapiens
gccagaagcccatg

SEQ ID NO: 2103993 - DNA, 14 bp, Homo sapiens
gccagaaggagggc

SEQ ID NO: 2103994 - DNA, 19 bp, Homo sapiens
gccagaaggagggcagagc

SEQ ID NO: 2103995 - DNA, 18 bp, Homo sapiens
gccagacgctgccgctgc

SEQ ID NO: 2103996 - DNA, 18 bp, Homo sapiens
gccagactggcacagttt

SEQ ID NO: 2103997 - DNA, 12 bp, Homo sapiens
gccagagaggag

SEQ ID NO: 2103998 - DNA, 15 bp, Homo sapiens
gccagagaggagcac

SEQ ID NO: 2103999 - DNA, 17 bp, Homo sapiens
gccagagaggagcacct

SEQ ID NO: 2104000 - DNA, 23 bp, Homo sapiens
gccagagaggagcacctgaaccc

SEQ ID NO: 2104001 - DNA, 14 bp, Homo sapiens
gccagagagggccc

SEQ ID NO: 2104002 - DNA, 17 bp, Homo sapiens
gccagagagggcccagc

SEQ ID NO: 2104003 - DNA, 24 bp, Homo sapiens
gccagagagggcccagctgtagcc

SEQ ID NO: 2104004 - DNA, 18 bp, Homo sapiens
gccagagcccaagtgcca

SEQ ID NO: 2104005 - DNA, 14 bp, Homo sapiens
gccagagcctgggg

SEQ ID NO: 2104006 - DNA, 19 bp, Homo sapiens
gccagagcctggggcatcc

SEQ ID NO: 2104007 - DNA, 18 bp, Homo sapiens
gccagagcctggggctct

SEQ ID NO: 2104008 - DNA, 19 bp, Homo sapiens
gccagagcctggggctcta

SEQ ID NO: 2104009 - DNA, 16 bp, Homo sapiens
gccagagcctggggtg

SEQ ID NO: 2104010 - DNA, 17 bp, Homo sapiens
gccagagctggaaggca

SEQ ID NO: 2104011 - DNA, 18 bp, Homo sapiens
gccagagctggaaggcag

SEQ ID NO: 2104012 - DNA, 20 bp, Homo sapiens
gccagagctggaaggcaggg

SEQ ID NO: 2104013 - DNA, 21 bp, Homo sapiens
gccagagctggaaggcagggc

SEQ ID NO: 2104014 - DNA, 22 bp, Homo sapiens
gccagagctggaaggcagggca

SEQ ID NO: 2104015 - DNA, 23 bp, Homo sapiens
gccagagggagtgacagaggcag

SEQ ID NO: 2104016 - DNA, 14 bp, Homo sapiens
gccagatgcaccag

SEQ ID NO: 2104017 - DNA, 23 bp, Homo sapiens
gccagattttttaaaatttatat

SEQ ID NO: 2104018 - DNA, 17 bp, Homo sapiens
gccagcaacacagagca

SEQ ID NO: 2104019 - DNA, 15 bp, Homo sapiens
gccagcacaggggcc

SEQ ID NO: 2104020 - DNA, 14 bp, Homo sapiens
gccagcaccctctc

SEQ ID NO: 2104021 - DNA, 16 bp, Homo sapiens
gccagcaccctctcct

SEQ ID NO: 2104022 - DNA, 18 bp, Homo sapiens
gccagcaccctctcctgg

SEQ ID NO: 2104023 - DNA, 19 bp, Homo sapiens
gccagcaccctctcctggg

SEQ ID NO: 2104024 - DNA, 12 bp, Homo sapiens
gccagcagccag

SEQ ID NO: 2104025 - DNA, 13 bp, Homo sapiens
gccagcagccagc

SEQ ID NO: 2104026 - DNA, 15 bp, Homo sapiens
gccagcagccagctc

SEQ ID NO: 2104027 - DNA, 23 bp, Homo sapiens
gccagcagccagctctcagccaa

SEQ ID NO: 2104028 - DNA, 13 bp, Homo sapiens
gccagccagaagc

SEQ ID NO: 2104029 - DNA, 13 bp, Homo sapiens
gccagccagcagc

SEQ ID NO: 2104030 - DNA, 17 bp, Homo sapiens
gccagccatcacaaggg

SEQ ID NO: 2104031 - DNA, 15 bp, Homo sapiens
gccagccccatcttg

SEQ ID NO: 2104032 - DNA, 20 bp, Homo sapiens
gccagccccatcttggtcct

SEQ ID NO: 2104033 - DNA, 10 bp, Homo sapiens
gccagccctc

SEQ ID NO: 2104034 - DNA, 13 bp, Homo sapiens
gccagccctccct

SEQ ID NO: 2104035 - DNA, 17 bp, Homo sapiens
gccagccctccctgtcc

SEQ ID NO: 2104036 - DNA, 15 bp, Homo sapiens
gccagccctgcctgg

SEQ ID NO: 2104037 - DNA, 21 bp, Homo sapiens
gccagccgtgatgctcaggct

SEQ ID NO: 2104038 - DNA, 23 bp, Homo sapiens
gccagcctcagctcagcctcccc

SEQ ID NO: 2104039 - DNA, 19 bp, Homo sapiens
gccagcctcagtgccactt

SEQ ID NO: 2104040 - DNA, 23 bp, Homo sapiens
gccagcctcagtgccacttgaca

SEQ ID NO: 2104041 - DNA, 15 bp, Homo sapiens
gccagcctggcctcc

SEQ ID NO: 2104042 - DNA, 19 bp, Homo sapiens
gccagcctggcctcctgcc

SEQ ID NO: 2104043 - DNA, 23 bp, Homo sapiens
gccagcctggcctcctgcctcta

SEQ ID NO: 2104044 - DNA, 12 bp, Homo sapiens
gccagcctggct

SEQ ID NO: 2104045 - DNA, 16 bp, Homo sapiens
gccagcctggcttctg

SEQ ID NO: 2104046 - DNA, 22 bp, Homo sapiens
gccagcctggcttctggagccc

SEQ ID NO: 2104047 - DNA, 14 bp, Homo sapiens
gccagcgcctccct

SEQ ID NO: 2104048 - DNA, 18 bp, Homo sapiens
gccagcgcctccctccac

SEQ ID NO: 2104049 - DNA, 22 bp, Homo sapiens
gccagctcaggtgactggagcc

SEQ ID NO: 2104050 - DNA, 16 bp, Homo sapiens
gccagctcagtcccat

SEQ ID NO: 2104051 - DNA, 21 bp, Homo sapiens
gccagctcctgggcagcttga

SEQ ID NO: 2104052 - DNA, 16 bp, Homo sapiens
gccagctctagttttc

SEQ ID NO: 2104053 - DNA, 13 bp, Homo sapiens
gccagctctcagc

SEQ ID NO: 2104054 - DNA, 20 bp, Homo sapiens
gccagctgcaggaatcaaaa

SEQ ID NO: 2104055 - DNA, 18 bp, Homo sapiens
gccagctgcatctactca

SEQ ID NO: 2104056 - DNA, 22 bp, Homo sapiens
gccagctgcatctactcaggcc

SEQ ID NO: 2104057 - DNA, 15 bp, Homo sapiens
gccagctgccgacca

SEQ ID NO: 2104058 - DNA, 20 bp, Homo sapiens
gccagctgccgaccagagcc

SEQ ID NO: 2104059 - DNA, 15 bp, Homo sapiens
gccagctgccttcct

SEQ ID NO: 2104060 - DNA, 15 bp, Homo sapiens
gccagctggtgctgc

SEQ ID NO: 2104061 - DNA, 12 bp, Homo sapiens
gccaggacacct

SEQ ID NO: 2104062 - DNA, 14 bp, Homo sapiens
gccaggacacctgc

SEQ ID NO: 2104063 - DNA, 15 bp, Homo sapiens
gccaggacacctgcc

SEQ ID NO: 2104064 - DNA, 16 bp, Homo sapiens
gccaggacacctgccc

SEQ ID NO: 2104065 - DNA, 22 bp, Homo sapiens
gccaggacacctgccccagcgc

SEQ ID NO: 2104066 - DNA, 17 bp, Homo sapiens
gccaggacagctggctg

SEQ ID NO: 2104067 - DNA, 15 bp, Homo sapiens
gccaggactccccag

SEQ ID NO: 2104068 - DNA, 19 bp, Homo sapiens
gccaggactccccaggcca

SEQ ID NO: 2104069 - DNA, 11 bp, Homo sapiens
gccaggagaga

SEQ ID NO: 2104070 - DNA, 22 bp, Homo sapiens
gccaggagcaaatgtttctgca

SEQ ID NO: 2104071 - DNA, 16 bp, Homo sapiens
gccaggagctggagga

SEQ ID NO: 2104072 - DNA, 21 bp, Homo sapiens
gccaggaggctgcggcctagg

SEQ ID NO: 2104073 - DNA, 21 bp, Homo sapiens
gccaggagggacaaaggagcc

SEQ ID NO: 2104074 - DNA, 20 bp, Homo sapiens
aactccctgaacctcagttt

SEQ ID NO: 2104075 - DNA, 19 bp, Homo sapiens
aactcctgattttgtagtt

SEQ ID NO: 2104076 - DNA, 10 bp, Homo sapiens
aactcctgcc

SEQ ID NO: 2104077 - DNA, 17 bp, Homo sapiens
aactccttattttgtat

SEQ ID NO: 2104078 - DNA, 19 bp, Homo sapiens
aactccttttgctgtcttt

SEQ ID NO: 2104079 - DNA, 17 bp, Homo sapiens
aactcgaagcccttcca

SEQ ID NO: 2104080 - DNA, 23 bp, Homo sapiens
aactcgatgaatgtgttgatttg

SEQ ID NO: 2104081 - DNA, 11 bp, Homo sapiens
aactctagcct

SEQ ID NO: 2104082 - DNA, 19 bp, Homo sapiens
aactctgaattttaaagca

SEQ ID NO: 2104083 - DNA, 17 bp, Homo sapiens
aactctgacaagggctg

SEQ ID NO: 2104084 - DNA, 21 bp, Homo sapiens
aactctgacaagggctgacct

SEQ ID NO: 2104085 - DNA, 16 bp, Homo sapiens
aactctgcactccatg

SEQ ID NO: 2104086 - DNA, 20 bp, Homo sapiens
aactctgcactccatggcca

SEQ ID NO: 2104087 - DNA, 20 bp, Homo sapiens
aactctggcttccaggtatc

SEQ ID NO: 2104088 - DNA, 20 bp, Homo sapiens
aactctgtgttgtgaatgtc

SEQ ID NO: 2104089 - DNA, 13 bp, Homo sapiens
aactcttcatttt

SEQ ID NO: 2104090 - DNA, 20 bp, Homo sapiens
aactcttccatttattgcac

SEQ ID NO: 2104091 - DNA, 19 bp, Homo sapiens
aactgaaaatctaatatta

SEQ ID NO: 2104092 - DNA, 13 bp, Homo sapiens
aactgaaaattat

SEQ ID NO: 2104093 - DNA, 14 bp, Homo sapiens
aactgaagaaggat

SEQ ID NO: 2104094 - DNA, 15 bp, Homo sapiens
aactgaaggagaagg

SEQ ID NO: 2104095 - DNA, 21 bp, Homo sapiens
aactgacaacctgtgcagtcc

SEQ ID NO: 2104096 - DNA, 12 bp, Homo sapiens
aactgacacagg

SEQ ID NO: 2104097 - DNA, 14 bp, Homo sapiens
aactgaccagcctc

SEQ ID NO: 2104098 - DNA, 23 bp, Homo sapiens
aagccggccccccctcttttggc

SEQ ID NO: 2104099 - DNA, 14 bp, Homo sapiens
aagccgtctgactc

SEQ ID NO: 2104100 - DNA, 18 bp, Homo sapiens
aagccgtctgactccaga

SEQ ID NO: 2104101 - DNA, 14 bp, Homo sapiens
aagccgtgcctttc

SEQ ID NO: 2104102 - DNA, 15 bp, Homo sapiens
aagccgtggcttccc

SEQ ID NO: 2104103 - DNA, 19 bp, Homo sapiens
aagcctccatttagttctt

SEQ ID NO: 2104104 - DNA, 22 bp, Homo sapiens
aagcctccatttagttctttgt

SEQ ID NO: 2104105 - DNA, 17 bp, Homo sapiens
aagcctccgtcaggaga

SEQ ID NO: 2104106 - DNA, 13 bp, Homo sapiens
aagcctctgccct

SEQ ID NO: 2104107 - DNA, 21 bp, Homo sapiens
aagcctctgccctgcctccct

SEQ ID NO: 2104108 - DNA, 15 bp, Homo sapiens
aagcctgaggctggg

SEQ ID NO: 2104109 - DNA, 19 bp, Homo sapiens
aagcctgctttttaagtgt

SEQ ID NO: 2104110 - DNA, 16 bp, Homo sapiens
aagcctgggggcctgg

SEQ ID NO: 2104111 - DNA, 17 bp, Homo sapiens
aagcctgggggcctggc

SEQ ID NO: 2104112 - DNA, 18 bp, Homo sapiens
aagcctggtctcctccca

SEQ ID NO: 2104113 - DNA, 22 bp, Homo sapiens
aagcctggtctcctcccaaaat

SEQ ID NO: 2104114 - DNA, 15 bp, Homo sapiens
aagcctgtgccacct

SEQ ID NO: 2104115 - DNA, 19 bp, Homo sapiens
aagcctgttttgttggaag

SEQ ID NO: 2104116 - DNA, 17 bp, Homo sapiens
aagccttactcacctct

SEQ ID NO: 2104117 - DNA, 15 bp, Homo sapiens
aagcctttccataag

SEQ ID NO: 2104118 - DNA, 21 bp, Homo sapiens
aagcgatgaatttggagactc

SEQ ID NO: 2104119 - DNA, 16 bp, Homo sapiens
aagcgattcttctgct

SEQ ID NO: 2104120 - DNA, 21 bp, Homo sapiens
aagcggaggttgcagggagcc

SEQ ID NO: 2104121 - DNA, 20 bp, Homo sapiens
aagcgtgagccactgcaccg

SEQ ID NO: 2104122 - DNA, 20 bp, Homo sapiens
aagcgtgggtggaggaagat

SEQ ID NO: 2104123 - DNA, 21 bp, Homo sapiens
aagctaaatcctttactgtta

SEQ ID NO: 2104124 - DNA, 20 bp, Homo sapiens
aagctaacagggaaggcagg

SEQ ID NO: 2104125 - DNA, 23 bp, Homo sapiens
aagctaacagggaaggcaggcag

SEQ ID NO: 2104126 - DNA, 19 bp, Homo sapiens
aagctactgaatttattgc

SEQ ID NO: 2104127 - DNA, 17 bp, Homo sapiens
aagctagaaggccacat

SEQ ID NO: 2104128 - DNA, 12 bp, Homo sapiens
aagctaggcctg

SEQ ID NO: 2104129 - DNA, 19 bp, Homo sapiens
aagctagtggcttcaaaat

SEQ ID NO: 2104130 - DNA, 18 bp, Homo sapiens
aagctattgatgtttcca

SEQ ID NO: 2104131 - DNA, 19 bp, Homo sapiens
aagctcacagttcctcgcc

SEQ ID NO: 2104132 - DNA, 12 bp, Homo sapiens
aagctcatattt

SEQ ID NO: 2104133 - DNA, 21 bp, Homo sapiens
aagctcatattttgtatatat

SEQ ID NO: 2104134 - DNA, 20 bp, Homo sapiens
aagctcatttagttagaaaa

SEQ ID NO: 2104135 - DNA, 20 bp, Homo sapiens
aagctccatctccactccag

SEQ ID NO: 2104136 - DNA, 19 bp, Homo sapiens
aagctctgaacaaaagctt

SEQ ID NO: 2104137 - DNA, 12 bp, Homo sapiens
aagctcttcctt

SEQ ID NO: 2104138 - DNA, 13 bp, Homo sapiens
aagctgaagaaaa

SEQ ID NO: 2104139 - DNA, 19 bp, Homo sapiens
aagctgaagtgaaggagaa

SEQ ID NO: 2104140 - DNA, 13 bp, Homo sapiens
aagctgagaagaa

SEQ ID NO: 2104141 - DNA, 14 bp, Homo sapiens
aagctgagaagaag

SEQ ID NO: 2104142 - DNA, 22 bp, Homo sapiens
aagctgagaagaagctgaggat

SEQ ID NO: 2104143 - DNA, 14 bp, Homo sapiens
aagctgagcaggcc

SEQ ID NO: 2104144 - DNA, 22 bp, Homo sapiens
aagctgaggatcctcacaggag

SEQ ID NO: 2104145 - DNA, 17 bp, Homo sapiens
aagctgaggtgcccagg

SEQ ID NO: 2104146 - DNA, 12 bp, Homo sapiens
aagctgcagctt

SEQ ID NO: 2104147 - DNA, 13 bp, Homo sapiens
aagctgcagcttc

SEQ ID NO: 2104148 - DNA, 15 bp, Homo sapiens
aagctgcagcttcct

SEQ ID NO: 2104149 - DNA, 16 bp, Homo sapiens
aagctgcagcttcctg

SEQ ID NO: 2104150 - DNA, 19 bp, Homo sapiens
aagctgcctgtagttagga

SEQ ID NO: 2104151 - DNA, 21 bp, Homo sapiens
aagctgcctgtagttaggaaa

SEQ ID NO: 2104152 - DNA, 22 bp, Homo sapiens
aagctgcctgtagttaggaaat

SEQ ID NO: 2104153 - DNA, 15 bp, Homo sapiens
aagctgcttgactat

SEQ ID NO: 2104154 - DNA, 14 bp, Homo sapiens
aagctggaagcaca

SEQ ID NO: 2104155 - DNA, 18 bp, Homo sapiens
aagctggagctcttggaa

SEQ ID NO: 2104156 - DNA, 20 bp, Homo sapiens
aagctggagctcttggaaga

SEQ ID NO: 2104157 - DNA, 19 bp, Homo sapiens
aagctggcagctgtcattc

SEQ ID NO: 2104158 - DNA, 18 bp, Homo sapiens
aagctgtaaaaagagaga

SEQ ID NO: 2104159 - DNA, 19 bp, Homo sapiens
aagctgtactcagagcaga

SEQ ID NO: 2104160 - DNA, 12 bp, Homo sapiens
aagctgtcccct

SEQ ID NO: 2104161 - DNA, 23 bp, Homo sapiens
aagctgtgaactcagagcccctc

SEQ ID NO: 2104162 - DNA, 12 bp, Homo sapiens
aagctgttccac

SEQ ID NO: 2104163 - DNA, 23 bp, Homo sapiens
aagctgtttccatagggtgacac

SEQ ID NO: 2104164 - DNA, 13 bp, Homo sapiens
aagcttaaaactt

SEQ ID NO: 2104165 - DNA, 14 bp, Homo sapiens
aagcttaaaacttt

SEQ ID NO: 2104166 - DNA, 19 bp, Homo sapiens
aagcttaatggctgataat

SEQ ID NO: 2104167 - DNA, 14 bp, Homo sapiens
aagcttcaagtgat

SEQ ID NO: 2104168 - DNA, 19 bp, Homo sapiens
aagcttcaagtgatatatg

SEQ ID NO: 2104169 - DNA, 21 bp, Homo sapiens
aagcttcagagcctagccacc

SEQ ID NO: 2104170 - DNA, 14 bp, Homo sapiens
aagcttgtatatac

SEQ ID NO: 2104171 - DNA, 15 bp, Homo sapiens
aagcttgtatataca

SEQ ID NO: 2104172 - DNA, 19 bp, Homo sapiens
aagcttgtatatacatatt

SEQ ID NO: 2104173 - DNA, 15 bp, Homo sapiens
aagctttaccagctg

SEQ ID NO: 2104174 - DNA, 12 bp, Homo sapiens
aagctttctcct

SEQ ID NO: 2104175 - DNA, 23 bp, Homo sapiens
aagctttgaatacccccagagac

SEQ ID NO: 2104176 - DNA, 14 bp, Homo sapiens
aaggaaaccaaagg

SEQ ID NO: 2104177 - DNA, 21 bp, Homo sapiens
aaggaaacttgaatcaaagca

SEQ ID NO: 2104178 - DNA, 15 bp, Homo sapiens
aaggaacactggaaa

SEQ ID NO: 2104179 - DNA, 19 bp, Homo sapiens
aaggaacagtgctgttctg

SEQ ID NO: 2104180 - DNA, 16 bp, Homo sapiens
aaggaaccaccgaaga

SEQ ID NO: 2104181 - DNA, 21 bp, Homo sapiens
aaggaacctaattgaaattta

SEQ ID NO: 2104182 - DNA, 22 bp, Homo sapiens
aaggaactctggcttccaggta

SEQ ID NO: 2104183 - DNA, 12 bp, Homo sapiens
aaggaaggaaaa

SEQ ID NO: 2104184 - DNA, 22 bp, Homo sapiens
aaggaaggagactcacctctgc

SEQ ID NO: 2104185 - DNA, 17 bp, Homo sapiens
aaggaaggcagggagga

SEQ ID NO: 2104186 - DNA, 17 bp, Homo sapiens
aaggaaggctccatctc

SEQ ID NO: 2104187 - DNA, 17 bp, Homo sapiens
aaggaagggacacacac

SEQ ID NO: 2104188 - DNA, 14 bp, Homo sapiens
aaggaagtctagga

SEQ ID NO: 2104189 - DNA, 17 bp, Homo sapiens
aaggaagtgggggccgc

SEQ ID NO: 2104190 - DNA, 19 bp, Homo sapiens
aaggaagtgggggccgctg

SEQ ID NO: 2104191 - DNA, 21 bp, Homo sapiens
aaggaataaattgctccttga

SEQ ID NO: 2104192 - DNA, 14 bp, Homo sapiens
aaggaatctgaaag

SEQ ID NO: 2104193 - DNA, 14 bp, Homo sapiens
aaggaatctgtgca

SEQ ID NO: 2104194 - DNA, 21 bp, Homo sapiens
aaggaatctgtgcagatgagc

SEQ ID NO: 2104195 - DNA, 12 bp, Homo sapiens
aaggacacttgt

SEQ ID NO: 2104196 - DNA, 18 bp, Homo sapiens
aaggacattgcggacagc

SEQ ID NO: 2104197 - DNA, 20 bp, Homo sapiens
aaggaccaactggcttctgt

SEQ ID NO: 2104198 - DNA, 23 bp, Homo sapiens
aaggaccaactggcttctgtgca

SEQ ID NO: 2104199 - DNA, 13 bp, Homo sapiens
aaggacccaccca

SEQ ID NO: 2104200 - DNA, 24 bp, Homo sapiens
aaggacccacccatcttcctgctg

SEQ ID NO: 2104201 - DNA, 14 bp, Homo sapiens
aacagtgcctgctg

SEQ ID NO: 2104202 - DNA, 15 bp, Homo sapiens
aacagtgctgttctg

SEQ ID NO: 2104203 - DNA, 19 bp, Homo sapiens
aacagtgtttcccataatt

SEQ ID NO: 2104204 - DNA, 18 bp, Homo sapiens
aacagttaactttcagaa

SEQ ID NO: 2104205 - DNA, 15 bp, Homo sapiens
aacagttcaaagaag

SEQ ID NO: 2104206 - DNA, 17 bp, Homo sapiens
aacagttcaaagaagtc

SEQ ID NO: 2104207 - DNA, 14 bp, Homo sapiens
aacataaagcaaat

SEQ ID NO: 2104208 - DNA, 19 bp, Homo sapiens
aacataaagcaaatagaca

SEQ ID NO: 2104209 - DNA, 14 bp, Homo sapiens
aacataatataaga

SEQ ID NO: 2104210 - DNA, 19 bp, Homo sapiens
aacataatataagaatcat

SEQ ID NO: 2104211 - DNA, 16 bp, Homo sapiens
aacataatatcttgaa

SEQ ID NO: 2104212 - DNA, 22 bp, Homo sapiens
aacataatatcttgaagaatat

SEQ ID NO: 2104213 - DNA, 17 bp, Homo sapiens
aacataattcttgtata

SEQ ID NO: 2104214 - DNA, 18 bp, Homo sapiens
aacataattcttgtatat

SEQ ID NO: 2104215 - DNA, 18 bp, Homo sapiens
aacatacccttctttaaa

SEQ ID NO: 2104216 - DNA, 14 bp, Homo sapiens
aacatacttcaaaa

SEQ ID NO: 2104217 - DNA, 19 bp, Homo sapiens
aacatagacagaagaaaca

SEQ ID NO: 2104218 - DNA, 16 bp, Homo sapiens
aacataggttttgatt

SEQ ID NO: 2104219 - DNA, 13 bp, Homo sapiens
aacatataatgtt

SEQ ID NO: 2104220 - DNA, 14 bp, Homo sapiens
aacatatcaattca

SEQ ID NO: 2104221 - DNA, 15 bp, Homo sapiens
aacatatcaattcaa

SEQ ID NO: 2104222 - DNA, 13 bp, Homo sapiens
aacatatttgtta

SEQ ID NO: 2104223 - DNA, 20 bp, Homo sapiens
aacatatttgttaaatattt

SEQ ID NO: 2104224 - DNA, 11 bp, Homo sapiens
aacatccagaa

SEQ ID NO: 2104225 - DNA, 17 bp, Homo sapiens
aacatccatgtcctatg

SEQ ID NO: 2104226 - DNA, 22 bp, Homo sapiens
aacatccatgtcctatgtgtga

SEQ ID NO: 2104227 - DNA, 16 bp, Homo sapiens
aacatcccattgccct

SEQ ID NO: 2104228 - DNA, 18 bp, Homo sapiens
aacatcccattgccctgg

SEQ ID NO: 2104229 - DNA, 22 bp, Homo sapiens
aacatcctttctattgaaaaat

SEQ ID NO: 2104230 - DNA, 21 bp, Homo sapiens
aacatctattataaaaccatg

SEQ ID NO: 2104231 - DNA, 21 bp, Homo sapiens
aacatctgagaaaagctttga

SEQ ID NO: 2104232 - DNA, 11 bp, Homo sapiens
aacatctgtgt

SEQ ID NO: 2104233 - DNA, 13 bp, Homo sapiens
aacatgacactga

SEQ ID NO: 2104234 - DNA, 14 bp, Homo sapiens
aacatgacactgac

SEQ ID NO: 2104235 - DNA, 14 bp, Homo sapiens
aacatgagaaatgt

SEQ ID NO: 2104236 - DNA, 23 bp, Homo sapiens
aacatgagaaatgtgaactgtga

SEQ ID NO: 2104237 - DNA, 19 bp, Homo sapiens
aacatgcaattttgcattt

SEQ ID NO: 2104238 - DNA, 12 bp, Homo sapiens
aacatgcacatt

SEQ ID NO: 2104239 - DNA, 20 bp, Homo sapiens
aacatgttatttgtaataga

SEQ ID NO: 2104240 - DNA, 14 bp, Homo sapiens
aacattaaaagaag

SEQ ID NO: 2104241 - DNA, 11 bp, Homo sapiens
aacattaaaca

SEQ ID NO: 2104242 - DNA, 13 bp, Homo sapiens
aacattaaacact

SEQ ID NO: 2104243 - DNA, 18 bp, Homo sapiens
aacattaacatctattat

SEQ ID NO: 2104244 - DNA, 21 bp, Homo sapiens
aacattaagattgaggcctgc

SEQ ID NO: 2104245 - DNA, 23 bp, Homo sapiens
aacattatttattcagcttcatt

SEQ ID NO: 2104246 - DNA, 22 bp, Homo sapiens
aacattcacacagggctctttg

SEQ ID NO: 2104247 - DNA, 18 bp, Homo sapiens
aacattcatcaagctgta

SEQ ID NO: 2104248 - DNA, 11 bp, Homo sapiens
aacattcatcc

SEQ ID NO: 2104249 - DNA, 19 bp, Homo sapiens
aacatttacaataaatatt

SEQ ID NO: 2104250 - DNA, 21 bp, Homo sapiens
aacatttacaataaatattct

SEQ ID NO: 2104251 - DNA, 17 bp, Homo sapiens
aacatttattttgacat

SEQ ID NO: 2104252 - DNA, 15 bp, Homo sapiens
aacattttaaataaa

SEQ ID NO: 2104253 - DNA, 22 bp, Homo sapiens
aacattttctttctttttctgg

SEQ ID NO: 2104254 - DNA, 22 bp, Homo sapiens
aacattttgtggtcattaagca

SEQ ID NO: 2104255 - DNA, 21 bp, Homo sapiens
aaccaaaagaacaagaatttc

SEQ ID NO: 2104256 - DNA, 16 bp, Homo sapiens
aaccaaaggacattat

SEQ ID NO: 2104257 - DNA, 18 bp, Homo sapiens
aaccaaaggacattatgt

SEQ ID NO: 2104258 - DNA, 13 bp, Homo sapiens
aaccaacacccaa

SEQ ID NO: 2104259 - DNA, 15 bp, Homo sapiens
aaccaagcttcagag

SEQ ID NO: 2104260 - DNA, 17 bp, Homo sapiens
aaccaagcttcagagcc

SEQ ID NO: 2104261 - DNA, 22 bp, Homo sapiens
aaccaaggcagcctccagagcc

SEQ ID NO: 2104262 - DNA, 18 bp, Homo sapiens
aaccaatcattttaagaa

SEQ ID NO: 2104263 - DNA, 18 bp, Homo sapiens
aaccaatcccgtgaaaga

SEQ ID NO: 2104264 - DNA, 14 bp, Homo sapiens
aaccaatgagctgt

SEQ ID NO: 2104265 - DNA, 22 bp, Homo sapiens
aaccaatgattcataacaatgt

SEQ ID NO: 2104266 - DNA, 19 bp, Homo sapiens
aaccacaaccaggaagaac

SEQ ID NO: 2104267 - DNA, 20 bp, Homo sapiens
aaccacaactgacacaggaa

SEQ ID NO: 2104268 - DNA, 14 bp, Homo sapiens
aaccacggaaaaga

SEQ ID NO: 2104269 - DNA, 14 bp, Homo sapiens
aaccactgaacatt

SEQ ID NO: 2104270 - DNA, 16 bp, Homo sapiens
aaccactgtaaaatga

SEQ ID NO: 2104271 - DNA, 15 bp, Homo sapiens
aaccagaatcataat

SEQ ID NO: 2104272 - DNA, 17 bp, Homo sapiens
aaccagagccccccaca

SEQ ID NO: 2104273 - DNA, 13 bp, Homo sapiens
aaccagagggttg

SEQ ID NO: 2104274 - DNA, 17 bp, Homo sapiens
aaccagcacatttctcc

SEQ ID NO: 2104275 - DNA, 15 bp, Homo sapiens
aaccagcattttact

SEQ ID NO: 2104276 - DNA, 13 bp, Homo sapiens
aaccagccacaca

SEQ ID NO: 2104277 - DNA, 14 bp, Homo sapiens
aaccagccacacag

SEQ ID NO: 2104278 - DNA, 17 bp, Homo sapiens
aaccagggaggagagga

SEQ ID NO: 2104279 - DNA, 17 bp, Homo sapiens
aaccagtatggaaggga

SEQ ID NO: 2104280 - DNA, 19 bp, Homo sapiens
aaccagtatggaagggagg

SEQ ID NO: 2104281 - DNA, 22 bp, Homo sapiens
aaccatagttatttacttgaaa

SEQ ID NO: 2104282 - DNA, 23 bp, Homo sapiens
aaccatagttatttacttgaaag

SEQ ID NO: 2104283 - DNA, 17 bp, Homo sapiens
aaccatcagttactggt

SEQ ID NO: 2104284 - DNA, 16 bp, Homo sapiens
aaccatcattataaac

SEQ ID NO: 2104285 - DNA, 20 bp, Homo sapiens
aaccatctgtccctgcctca

SEQ ID NO: 2104286 - DNA, 19 bp, Homo sapiens
aaccatgcaaatgctatga

SEQ ID NO: 2104287 - DNA, 16 bp, Homo sapiens
aaccatgcagcttcat

SEQ ID NO: 2104288 - DNA, 20 bp, Homo sapiens
aaccatgcagcttcatcaat

SEQ ID NO: 2104289 - DNA, 22 bp, Homo sapiens
aaccatgcagcttcatcaattt

SEQ ID NO: 2104290 - DNA, 23 bp, Homo sapiens
aaccatgcagcttcatcaatttt

SEQ ID NO: 2104291 - DNA, 16 bp, Homo sapiens
aaccatggtgcttgtt

SEQ ID NO: 2104292 - DNA, 13 bp, Homo sapiens
aaccattaagaaa

SEQ ID NO: 2104293 - DNA, 19 bp, Homo sapiens
aaccatttaattcataatt

SEQ ID NO: 2104294 - DNA, 20 bp, Homo sapiens
aaccatttaattcataatta

SEQ ID NO: 2104295 - DNA, 21 bp, Homo sapiens
aaccatttaattcataattag

SEQ ID NO: 2104296 - DNA, 22 bp, Homo sapiens
aacccaaattacgtgtactaca

SEQ ID NO: 2104297 - DNA, 18 bp, Homo sapiens
aacccaagtccaagcata

SEQ ID NO: 2104298 - DNA, 20 bp, Homo sapiens
aacccaattcaggactggct

SEQ ID NO: 2104299 - DNA, 23 bp, Homo sapiens
aacccactgtgcttacagtgact

SEQ ID NO: 2104300 - DNA, 18 bp, Homo sapiens
aacccagaactggacgcc

SEQ ID NO: 2104301 - DNA, 11 bp, Homo sapiens
aacccagagag

SEQ ID NO: 2104302 - DNA, 16 bp, Homo sapiens
aacccagcaacagaaa

SEQ ID NO: 2104303 - DNA, 16 bp, Homo sapiens
aacccaggacctctgg

SEQ ID NO: 2104304 - DNA, 12 bp, Homo sapiens
aacccaggaggt

SEQ ID NO: 2104305 - DNA, 15 bp, Homo sapiens
aaccccagctggcct

SEQ ID NO: 2104306 - DNA, 20 bp, Homo sapiens
aaccccagggcccccacagg

SEQ ID NO: 2104307 - DNA, 16 bp, Homo sapiens
aaccccagttctgctc

SEQ ID NO: 2104308 - DNA, 22 bp, Homo sapiens
aaccccagttctgctcctctcc

SEQ ID NO: 2104309 - DNA, 22 bp, Homo sapiens
aaccccatcatatgacatgcca

SEQ ID NO: 2104310 - DNA, 15 bp, Homo sapiens
aacccccagcctgct

SEQ ID NO: 2104311 - DNA, 18 bp, Homo sapiens
aacccccagtgccacaga

SEQ ID NO: 2104312 - DNA, 14 bp, Homo sapiens
aacccccgctccag

SEQ ID NO: 2104313 - DNA, 12 bp, Homo sapiens
aacccctgggta

SEQ ID NO: 2104314 - DNA, 11 bp, Homo sapiens
aacccctttcc

SEQ ID NO: 2104315 - DNA, 13 bp, Homo sapiens
aacccgtggaggc

SEQ ID NO: 2104316 - DNA, 18 bp, Homo sapiens
aacccgtggaggctgctc

SEQ ID NO: 2104317 - DNA, 16 bp, Homo sapiens
aaccctctcttcccta

SEQ ID NO: 2104318 - DNA, 17 bp, Homo sapiens
aaattttatctcttatt

SEQ ID NO: 2104319 - DNA, 16 bp, Homo sapiens
aaattttatttagttc

SEQ ID NO: 2104320 - DNA, 20 bp, Homo sapiens
aaattttatttagttcttga

SEQ ID NO: 2104321 - DNA, 19 bp, Homo sapiens
aaattttctagactttctg

SEQ ID NO: 2104322 - DNA, 12 bp, Homo sapiens
aaattttgcatt

SEQ ID NO: 2104323 - DNA, 13 bp, Homo sapiens
aaattttgcattt

SEQ ID NO: 2104324 - DNA, 17 bp, Homo sapiens
aaattttgcatttagtt

SEQ ID NO: 2104325 - DNA, 13 bp, Homo sapiens
aaattttgtttca

SEQ ID NO: 2104326 - DNA, 13 bp, Homo sapiens
aaatttttcctgc

SEQ ID NO: 2104327 - DNA, 19 bp, Homo sapiens
aacaaaaacactaaaaata

SEQ ID NO: 2104328 - DNA, 17 bp, Homo sapiens
aacaaaacaaaaaactt

SEQ ID NO: 2104329 - DNA, 20 bp, Homo sapiens
aacaaaacaacaacaataca

SEQ ID NO: 2104330 - DNA, 15 bp, Homo sapiens
aacaaaagagagaat

SEQ ID NO: 2104331 - DNA, 12 bp, Homo sapiens
aacaaaatagaa

SEQ ID NO: 2104332 - DNA, 22 bp, Homo sapiens
aacaaaatcacaagcaataatt

SEQ ID NO: 2104333 - DNA, 24 bp, Homo sapiens
aacaaacactgaatcatgttaata

SEQ ID NO: 2104334 - DNA, 16 bp, Homo sapiens
aacaaactcgtttttt

SEQ ID NO: 2104335 - DNA, 18 bp, Homo sapiens
aacaaatatttatatatt

SEQ ID NO: 2104336 - DNA, 15 bp, Homo sapiens
aacaaatcactgtat

SEQ ID NO: 2104337 - DNA, 22 bp, Homo sapiens
aacaaatcttcaaggtgtaaaa

SEQ ID NO: 2104338 - DNA, 19 bp, Homo sapiens
aacaaattaggttttgtac

SEQ ID NO: 2104339 - DNA, 21 bp, Homo sapiens
aacaaattaggttttgtacaa

SEQ ID NO: 2104340 - DNA, 16 bp, Homo sapiens
aacaacaacaataaca

SEQ ID NO: 2104341 - DNA, 14 bp, Homo sapiens
aacaacaacaatac

SEQ ID NO: 2104342 - DNA, 17 bp, Homo sapiens
aacaacaacaatacaac

SEQ ID NO: 2104343 - DNA, 23 bp, Homo sapiens
aacaacaatggtttacatgaaca

SEQ ID NO: 2104344 - DNA, 18 bp, Homo sapiens
aacaactatttataaact

SEQ ID NO: 2104345 - DNA, 21 bp, Homo sapiens
aacaactccaggaaaactgtt

SEQ ID NO: 2104346 - DNA, 17 bp, Homo sapiens
aacaagaaagaaacgta

SEQ ID NO: 2104347 - DNA, 19 bp, Homo sapiens
aacaagagcgaaactccgt

SEQ ID NO: 2104348 - DNA, 17 bp, Homo sapiens
aacaagatctttcagga

SEQ ID NO: 2104349 - DNA, 21 bp, Homo sapiens
aacaagcatttcccccaggga

SEQ ID NO: 2104350 - DNA, 22 bp, Homo sapiens
aacaaggttcttctaaaattga

SEQ ID NO: 2104351 - DNA, 16 bp, Homo sapiens
aacaagtcacagctgc

SEQ ID NO: 2104352 - DNA, 15 bp, Homo sapiens
aacaataaaacatta

SEQ ID NO: 2104353 - DNA, 13 bp, Homo sapiens
aacaatacaacaa

SEQ ID NO: 2104354 - DNA, 15 bp, Homo sapiens
aattttgcagcagaa

SEQ ID NO: 2104355 - DNA, 12 bp, Homo sapiens
aattttgcattt

SEQ ID NO: 2104356 - DNA, 15 bp, Homo sapiens
aattttgtaacgaag

SEQ ID NO: 2104357 - DNA, 13 bp, Homo sapiens
aattttgtatatt

SEQ ID NO: 2104358 - DNA, 21 bp, Homo sapiens
aattttgtatattgtaggaat

SEQ ID NO: 2104359 - DNA, 22 bp, Homo sapiens
aattttgtttcagaattttgta

SEQ ID NO: 2104360 - DNA, 14 bp, Homo sapiens
aattttgtttgtaa

SEQ ID NO: 2104361 - DNA, 13 bp, Homo sapiens
aatttttaaagta

SEQ ID NO: 2104362 - DNA, 13 bp, Homo sapiens
aatttttaatgac

SEQ ID NO: 2104363 - DNA, 14 bp, Homo sapiens
aatttttaatgact

SEQ ID NO: 2104364 - DNA, 13 bp, Homo sapiens
aatttttatacat

SEQ ID NO: 2104365 - DNA, 20 bp, Homo sapiens
aatttttatacatatcagaa

SEQ ID NO: 2104366 - DNA, 22 bp, Homo sapiens
aatttttatacatatcagaaaa

SEQ ID NO: 2104367 - DNA, 15 bp, Homo sapiens
aatttttatttttct

SEQ ID NO: 2104368 - DNA, 16 bp, Homo sapiens
aatttttatttttcta

SEQ ID NO: 2104369 - DNA, 20 bp, Homo sapiens
aatttttcattgatatgaaa

SEQ ID NO: 2104370 - DNA, 20 bp, Homo sapiens
aatttttctcagtttgtata

SEQ ID NO: 2104371 - DNA, 13 bp, Homo sapiens
aatttttgcaatt

SEQ ID NO: 2104372 - DNA, 13 bp, Homo sapiens
aattttttgagta

SEQ ID NO: 2104373 - DNA, 15 bp, Homo sapiens
aatttttttcaatat

SEQ ID NO: 2104374 - DNA, 17 bp, Homo sapiens
aatttttttgagacaga

SEQ ID NO: 2104375 - DNA, 13 bp, Homo sapiens
acaaaaacacagc

SEQ ID NO: 2104376 - DNA, 14 bp, Homo sapiens
acaaaaacacagca

SEQ ID NO: 2104377 - DNA, 15 bp, Homo sapiens
acaaaaaccagcagg

SEQ ID NO: 2104378 - DNA, 21 bp, Homo sapiens
acaaaaatgtaatgatcataa

SEQ ID NO: 2104379 - DNA, 17 bp, Homo sapiens
acaaaacaaaacaacaa

SEQ ID NO: 2104380 - DNA, 12 bp, Homo sapiens
acaaaacaacaa

SEQ ID NO: 2104381 - DNA, 12 bp, Homo sapiens
acaaaaccagct

SEQ ID NO: 2104382 - DNA, 14 bp, Homo sapiens
acaaaaccagctgc

SEQ ID NO: 2104383 - DNA, 16 bp, Homo sapiens
acaaaagaagattaaa

SEQ ID NO: 2104384 - DNA, 13 bp, Homo sapiens
acaaaataattta

SEQ ID NO: 2104385 - DNA, 16 bp, Homo sapiens
acaaaataatttaact

SEQ ID NO: 2104386 - DNA, 12 bp, Homo sapiens
acaaaatagaag

SEQ ID NO: 2104387 - DNA, 13 bp, Homo sapiens
acaaaatcacaag

SEQ ID NO: 2104388 - DNA, 15 bp, Homo sapiens
acaaaatcacaagca

SEQ ID NO: 2104389 - DNA, 23 bp, Homo sapiens
acaaaatcacaagcaataattag

SEQ ID NO: 2104390 - DNA, 15 bp, Homo sapiens
acaaaatgataatca

SEQ ID NO: 2104391 - DNA, 20 bp, Homo sapiens
acaaaatgtcacacttgttt

SEQ ID NO: 2104392 - DNA, 13 bp, Homo sapiens
acaaacacctcct

SEQ ID NO: 2104393 - DNA, 14 bp, Homo sapiens
acaaacacctccta

SEQ ID NO: 2104394 - DNA, 14 bp, Homo sapiens
acaaacataagtgc

SEQ ID NO: 2104395 - DNA, 19 bp, Homo sapiens
acaaacatgtggttaatgc

SEQ ID NO: 2104396 - DNA, 19 bp, Homo sapiens
acaaaccacaactgacaca

SEQ ID NO: 2104397 - DNA, 20 bp, Homo sapiens
acaaaccacaactgacacag

SEQ ID NO: 2104398 - DNA, 16 bp, Homo sapiens
acaaaccactgtacat

SEQ ID NO: 2104399 - DNA, 18 bp, Homo sapiens
acaaaccactgtacatat

SEQ ID NO: 2104400 - DNA, 16 bp, Homo sapiens
acaaactacatgtaat

SEQ ID NO: 2104401 - DNA, 20 bp, Homo sapiens
acaaactcgttttttacaaa

SEQ ID NO: 2104402 - DNA, 16 bp, Homo sapiens
acaaactgatttctca

SEQ ID NO: 2104403 - DNA, 17 bp, Homo sapiens
acaaactgatttctcac

SEQ ID NO: 2104404 - DNA, 21 bp, Homo sapiens
acaaagaacggcatgtgaatt

SEQ ID NO: 2104405 - DNA, 22 bp, Homo sapiens
acaaagatgtttgtcagatatg

SEQ ID NO: 2104406 - DNA, 15 bp, Homo sapiens
acaaagcacagtgtt

SEQ ID NO: 2104407 - DNA, 19 bp, Homo sapiens
acaaagccaaactctgcca

SEQ ID NO: 2104408 - DNA, 18 bp, Homo sapiens
acaaagcccttccatgtc

SEQ ID NO: 2104409 - DNA, 20 bp, Homo sapiens
acaaagcgagatcccatctc

SEQ ID NO: 2104410 - DNA, 22 bp, Homo sapiens
acaaagctcaagatgacagctc

SEQ ID NO: 2104411 - DNA, 20 bp, Homo sapiens
acaaagcttctatcccagga

SEQ ID NO: 2104412 - DNA, 23 bp, Homo sapiens
acaaagcttctatcccaggaggt

SEQ ID NO: 2104413 - DNA, 14 bp, Homo sapiens
acaaaggagcctgt

SEQ ID NO: 2104414 - DNA, 16 bp, Homo sapiens
acaaaggagcctgtga

SEQ ID NO: 2104415 - DNA, 24 bp, Homo sapiens
acaaaggggagaagggccagccct

SEQ ID NO: 2104416 - DNA, 22 bp, Homo sapiens
acaaaggtgaaaattgtttgta

SEQ ID NO: 2104417 - DNA, 14 bp, Homo sapiens
acaaagtaattcct

SEQ ID NO: 2104418 - DNA, 15 bp, Homo sapiens
acaaatactcttagg

SEQ ID NO: 2104419 - DNA, 17 bp, Homo sapiens
acaaatatatttaattg

SEQ ID NO: 2104420 - DNA, 18 bp, Homo sapiens
acaaatatatttaattgt

SEQ ID NO: 2104421 - DNA, 20 bp, Homo sapiens
acaaatatatttaattgtgt

SEQ ID NO: 2104422 - DNA, 22 bp, Homo sapiens
acaaatattgttaccatgaaga

SEQ ID NO: 2104423 - DNA, 18 bp, Homo sapiens
acaaatatttattttctt

SEQ ID NO: 2104424 - DNA, 20 bp, Homo sapiens
acaaatctatattaaagtgt

SEQ ID NO: 2104425 - DNA, 16 bp, Homo sapiens
acaaatcttcaaggtg

SEQ ID NO: 2104426 - DNA, 22 bp, Homo sapiens
acaaattatgttacatctgttt

SEQ ID NO: 2104427 - DNA, 16 bp, Homo sapiens
acaaatttttatttct

SEQ ID NO: 2104428 - DNA, 15 bp, Homo sapiens
acaaatttttcctgc

SEQ ID NO: 2104429 - DNA, 14 bp, Homo sapiens
acaacaacaacaat

SEQ ID NO: 2104430 - DNA, 13 bp, Homo sapiens
acaacaacaataa

SEQ ID NO: 2104431 - DNA, 13 bp, Homo sapiens
acaacaacaatac

SEQ ID NO: 2104432 - DNA, 13 bp, Homo sapiens
acaacaagaacaa

SEQ ID NO: 2104433 - DNA, 15 bp, Homo sapiens
acaacaaggaccctg

SEQ ID NO: 2104434 - DNA, 17 bp, Homo sapiens
acaacaatacaacaaga

SEQ ID NO: 2104435 - DNA, 18 bp, Homo sapiens
acaacaatggtttacatg

SEQ ID NO: 2104436 - DNA, 14 bp, Homo sapiens
acaacacaaagaga

SEQ ID NO: 2104437 - DNA, 14 bp, Homo sapiens
acaacacacacact

SEQ ID NO: 2104438 - DNA, 12 bp, Homo sapiens
acaacagactga

SEQ ID NO: 2104439 - DNA, 12 bp, Homo sapiens
acaacagtaaca

SEQ ID NO: 2104440 - DNA, 14 bp, Homo sapiens
acaacagtaacaca

SEQ ID NO: 2104441 - DNA, 23 bp, Homo sapiens
acaacatccatgtcctatgtgtg

SEQ ID NO: 2104442 - DNA, 13 bp, Homo sapiens
acaacatttattt

SEQ ID NO: 2104443 - DNA, 23 bp, Homo sapiens
acaacatttatttcaaactattg

SEQ ID NO: 2104444 - DNA, 13 bp, Homo sapiens
acaacattttatt

SEQ ID NO: 2104445 - DNA, 18 bp, Homo sapiens
acaaccacatacaacaca

SEQ ID NO: 2104446 - DNA, 11 bp, Homo sapiens
aataaatgttc

SEQ ID NO: 2104447 - DNA, 12 bp, Homo sapiens
aataaatgttca

SEQ ID NO: 2104448 - DNA, 18 bp, Homo sapiens
aataaatgttcaaactgt

SEQ ID NO: 2104449 - DNA, 14 bp, Homo sapiens
aataaattaagttt

SEQ ID NO: 2104450 - DNA, 13 bp, Homo sapiens
aataaattcaaac

SEQ ID NO: 2104451 - DNA, 19 bp, Homo sapiens
aataaattggtgataagtg

SEQ ID NO: 2104452 - DNA, 20 bp, Homo sapiens
aataaattggtgataagtgg

SEQ ID NO: 2104453 - DNA, 21 bp, Homo sapiens
aataaattggtgataagtgga

SEQ ID NO: 2104454 - DNA, 23 bp, Homo sapiens
aataacaacaatggtttacatga

SEQ ID NO: 2104455 - DNA, 13 bp, Homo sapiens
aataacaatgtgc

SEQ ID NO: 2104456 - DNA, 20 bp, Homo sapiens
aataacataatttgtacata

SEQ ID NO: 2104457 - DNA, 13 bp, Homo sapiens
aataacatttgtg

SEQ ID NO: 2104458 - DNA, 15 bp, Homo sapiens
aataactagatctcc

SEQ ID NO: 2104459 - DNA, 18 bp, Homo sapiens
aataactagatctcctgt

SEQ ID NO: 2104460 - DNA, 19 bp, Homo sapiens
aataactagtgttgcttgg

SEQ ID NO: 2104461 - DNA, 21 bp, Homo sapiens
aataacttgtcctatgtcaat

SEQ ID NO: 2104462 - DNA, 15 bp, Homo sapiens
aataagagaaagaaa

SEQ ID NO: 2104463 - DNA, 17 bp, Homo sapiens
aataaggccttaatatg

SEQ ID NO: 2104464 - DNA, 15 bp, Homo sapiens
aataaggtacaagaa

SEQ ID NO: 2104465 - DNA, 19 bp, Homo sapiens
aataaggtacaagaagcat

SEQ ID NO: 2104466 - DNA, 16 bp, Homo sapiens
aataaggtcaatgcca

SEQ ID NO: 2104467 - DNA, 11 bp, Homo sapiens
aataataatta

SEQ ID NO: 2104468 - DNA, 14 bp, Homo sapiens
aataatacactaat

SEQ ID NO: 2104469 - DNA, 13 bp, Homo sapiens
aataatatgattt

SEQ ID NO: 2104470 - DNA, 17 bp, Homo sapiens
aataatcacattgactt

SEQ ID NO: 2104471 - DNA, 16 bp, Homo sapiens
aataatcggcccacag

SEQ ID NO: 2104472 - DNA, 21 bp, Homo sapiens
aataatgagtctgcataaact

SEQ ID NO: 2104473 - DNA, 17 bp, Homo sapiens
aataatgtaagggtctg

SEQ ID NO: 2104474 - DNA, 12 bp, Homo sapiens
aataatgtgcaa

SEQ ID NO: 2104475 - DNA, 13 bp, Homo sapiens
aataatgtgcaaa

SEQ ID NO: 2104476 - DNA, 14 bp, Homo sapiens
aataatgtgcaaat

SEQ ID NO: 2104477 - DNA, 14 bp, Homo sapiens
aataatgttctgtc

SEQ ID NO: 2104478 - DNA, 21 bp, Homo sapiens
aataattaggatctatgcaat

SEQ ID NO: 2104479 - DNA, 23 bp, Homo sapiens
aataattaggatctatgcaattt

SEQ ID NO: 2104480 - DNA, 18 bp, Homo sapiens
aataattatccagagttt

SEQ ID NO: 2104481 - DNA, 18 bp, Homo sapiens
aataattatttatttaat

SEQ ID NO: 2104482 - DNA, 13 bp, Homo sapiens
aataattgtgtac

SEQ ID NO: 2104483 - DNA, 14 bp, Homo sapiens
aataattgtgtaca

SEQ ID NO: 2104484 - DNA, 16 bp, Homo sapiens
aataattgtgtacaaa

SEQ ID NO: 2104485 - DNA, 20 bp, Homo sapiens
aataattgtgtacaaagtag

SEQ ID NO: 2104486 - DNA, 20 bp, Homo sapiens
aataatttaactaatttaaa

SEQ ID NO: 2104487 - DNA, 21 bp, Homo sapiens
aataatttagacttcaagcat

SEQ ID NO: 2104488 - DNA, 20 bp, Homo sapiens
aataattttaaaagttggga

SEQ ID NO: 2104489 - DNA, 23 bp, Homo sapiens
aatacaaaaatgagctaggcatg

SEQ ID NO: 2104490 - DNA, 17 bp, Homo sapiens
aatacaaacatatttgt

SEQ ID NO: 2104491 - DNA, 19 bp, Homo sapiens
aatacaacaagaacaacaa

SEQ ID NO: 2104492 - DNA, 15 bp, Homo sapiens
aatacacaagtaaac

SEQ ID NO: 2104493 - DNA, 17 bp, Homo sapiens
aatacacaagtaaacat

SEQ ID NO: 2104494 - DNA, 16 bp, Homo sapiens
aatacaccacgaattt

SEQ ID NO: 2104495 - DNA, 20 bp, Homo sapiens
aatacactaattcctttcta

SEQ ID NO: 2104496 - DNA, 15 bp, Homo sapiens
aatacagacactaag

SEQ ID NO: 2104497 - DNA, 18 bp, Homo sapiens
aatacagtaaagtttaaa

SEQ ID NO: 2104498 - DNA, 22 bp, Homo sapiens
aatacagtaaagtttaaaaaat

SEQ ID NO: 2104499 - DNA, 21 bp, Homo sapiens
aatacataactagtttaatta

SEQ ID NO: 2104500 - DNA, 21 bp, Homo sapiens
aatacatgctaagagaagtag

SEQ ID NO: 2104501 - DNA, 12 bp, Homo sapiens
aatacattttat

SEQ ID NO: 2104502 - DNA, 13 bp, Homo sapiens
aatacccccagag

SEQ ID NO: 2104503 - DNA, 13 bp, Homo sapiens
aatacctctgtgt

SEQ ID NO: 2104504 - DNA, 14 bp, Homo sapiens
aatacctctgtgtg

SEQ ID NO: 2104505 - DNA, 20 bp, Homo sapiens
aatacctttggaaaaatctt

SEQ ID NO: 2104506 - DNA, 18 bp, Homo sapiens
aatactaattgagaaaca

SEQ ID NO: 2104507 - DNA, 17 bp, Homo sapiens
aatactactgtaaatgt

SEQ ID NO: 2104508 - DNA, 21 bp, Homo sapiens
aatactagaatggtagcacta

SEQ ID NO: 2104509 - DNA, 16 bp, Homo sapiens
aatactcacctcctcc

SEQ ID NO: 2104510 - DNA, 16 bp, Homo sapiens
aatactccaagcttca

SEQ ID NO: 2104511 - DNA, 22 bp, Homo sapiens
aatactccaagcttcaagtgat

SEQ ID NO: 2104512 - DNA, 22 bp, Homo sapiens
aatactgcctagaaaatgcaaa

SEQ ID NO: 2104513 - DNA, 22 bp, Homo sapiens
aatactgctctgaatattttgt

SEQ ID NO: 2104514 - DNA, 20 bp, Homo sapiens
aatacttaacattgatttat

SEQ ID NO: 2104515 - DNA, 15 bp, Homo sapiens
aatacttttttctag

SEQ ID NO: 2104516 - DNA, 17 bp, Homo sapiens
aatacttttttctagtt

SEQ ID NO: 2104517 - DNA, 18 bp, Homo sapiens
aatagaaaactgaaaatc

SEQ ID NO: 2104518 - DNA, 19 bp, Homo sapiens
aatagaaaactgaaaatct

SEQ ID NO: 2104519 - DNA, 13 bp, Homo sapiens
aatagaaactcac

SEQ ID NO: 2104520 - DNA, 15 bp, Homo sapiens
aatagaagaacatcc

SEQ ID NO: 2104521 - DNA, 20 bp, Homo sapiens
aatagaatataattatcgga

SEQ ID NO: 2104522 - DNA, 15 bp, Homo sapiens
aatagacagtatatt

SEQ ID NO: 2104523 - DNA, 23 bp, Homo sapiens
aatagactgaagagaccacagca

SEQ ID NO: 2104524 - DNA, 23 bp, Homo sapiens
aatagactgtacttattttccaa

SEQ ID NO: 2104525 - DNA, 16 bp, Homo sapiens
aatagagacacagaga

SEQ ID NO: 2104526 - DNA, 18 bp, Homo sapiens
aatagatacagcagaggc

SEQ ID NO: 2104527 - DNA, 19 bp, Homo sapiens
aatagatcacggcatgttt

SEQ ID NO: 2104528 - DNA, 16 bp, Homo sapiens
aatagcaaaagaagaa

SEQ ID NO: 2104529 - DNA, 14 bp, Homo sapiens
aatagcaaagaatt

SEQ ID NO: 2104530 - DNA, 15 bp, Homo sapiens
aatagcaaagaattg

SEQ ID NO: 2104531 - DNA, 20 bp, Homo sapiens
aatagctattgcatgtaaaa

SEQ ID NO: 2104532 - DNA, 19 bp, Homo sapiens
aatagctctttcagggggg

SEQ ID NO: 2104533 - DNA, 15 bp, Homo sapiens
aataggttaatatca

SEQ ID NO: 2104534 - DNA, 13 bp, Homo sapiens
aatagtatttatg

SEQ ID NO: 2104535 - DNA, 18 bp, Homo sapiens
aatagtatttatgaaatg

SEQ ID NO: 2104536 - DNA, 15 bp, Homo sapiens
aatagtatttcccat

SEQ ID NO: 2104537 - DNA, 16 bp, Homo sapiens
aatagtatttcccatt

SEQ ID NO: 2104538 - DNA, 13 bp, Homo sapiens
aatagtcaagaaa

SEQ ID NO: 2104539 - DNA, 17 bp, Homo sapiens
aatagtccaatatttgg

SEQ ID NO: 2104540 - DNA, 19 bp, Homo sapiens
aatagtgcagaatctcata

SEQ ID NO: 2104541 - DNA, 15 bp, Homo sapiens
aatagttagccctca

SEQ ID NO: 2104542 - DNA, 22 bp, Homo sapiens
aatagttttaaatatgaacaaa

SEQ ID NO: 2104543 - DNA, 22 bp, Homo sapiens
aatataaaatagttgtccatat

SEQ ID NO: 2104544 - DNA, 13 bp, Homo sapiens
aatataaactgaa

SEQ ID NO: 2104545 - DNA, 13 bp, Homo sapiens
aatataaatgcat

SEQ ID NO: 2104546 - DNA, 15 bp, Homo sapiens
aatataaattaagac

SEQ ID NO: 2104547 - DNA, 15 bp, Homo sapiens
aatataaccattaca

SEQ ID NO: 2104548 - DNA, 16 bp, Homo sapiens
aatataaccattacat

SEQ ID NO: 2104549 - DNA, 20 bp, Homo sapiens
aatataagaacttgatatat

SEQ ID NO: 2104550 - DNA, 12 bp, Homo sapiens
aatataagaatc

SEQ ID NO: 2104551 - DNA, 11 bp, Homo sapiens
aatataattat

SEQ ID NO: 2104552 - DNA, 15 bp, Homo sapiens
aatataattgggatt

SEQ ID NO: 2104553 - DNA, 16 bp, Homo sapiens
aatatacaaacatgtg

SEQ ID NO: 2104554 - DNA, 20 bp, Homo sapiens
aatatacaaacatgtggcaa

SEQ ID NO: 2104555 - DNA, 14 bp, Homo sapiens
aatatagagatatt

SEQ ID NO: 2104556 - DNA, 21 bp, Homo sapiens
aatatagagatatttttgtac

SEQ ID NO: 2104557 - DNA, 13 bp, Homo sapiens
aatatagctattt

SEQ ID NO: 2104558 - DNA, 14 bp, Homo sapiens
aatatagttctgat

SEQ ID NO: 2104559 - DNA, 18 bp, Homo sapiens
aatatataaaaagaaaag

SEQ ID NO: 2104560 - DNA, 21 bp, Homo sapiens
aatatataaaaagaaaagata

SEQ ID NO: 2104561 - DNA, 23 bp, Homo sapiens
aatccctgtttaatatttaaaca

SEQ ID NO: 2104562 - DNA, 23 bp, Homo sapiens
aatcccttgtacctatggctgcc

SEQ ID NO: 2104563 - DNA, 16 bp, Homo sapiens
aatccgagtgtttgcc

SEQ ID NO: 2104564 - DNA, 20 bp, Homo sapiens
aatcctagaaccaagcttca

SEQ ID NO: 2104565 - DNA, 15 bp, Homo sapiens
aatcctagaagcaaa

SEQ ID NO: 2104566 - DNA, 19 bp, Homo sapiens
aatcctgtcgattagactg

SEQ ID NO: 2104567 - DNA, 23 bp, Homo sapiens
aatgttctgttgtaaagagtgga

SEQ ID NO: 2104568 - DNA, 22 bp, Homo sapiens
aatgttgaaatatgatgttaaa

SEQ ID NO: 2104569 - DNA, 16 bp, Homo sapiens
aatgttgggatttata

SEQ ID NO: 2104570 - DNA, 15 bp, Homo sapiens
aatgttgttatttaa

SEQ ID NO: 2104571 - DNA, 15 bp, Homo sapiens
aatgtttaaaccttt

SEQ ID NO: 2104572 - DNA, 15 bp, Homo sapiens
aatgtttatgttctc

SEQ ID NO: 2104573 - DNA, 18 bp, Homo sapiens
aatgtttatgttctcaga

SEQ ID NO: 2104574 - DNA, 21 bp, Homo sapiens
aatgtttatgttctcagaatc

SEQ ID NO: 2104575 - DNA, 13 bp, Homo sapiens
aatgtttcaaatc

SEQ ID NO: 2104576 - DNA, 15 bp, Homo sapiens
aatgtttcattttca

SEQ ID NO: 2104577 - DNA, 22 bp, Homo sapiens
aatgtttcttctaggttctaaa

SEQ ID NO: 2104578 - DNA, 12 bp, Homo sapiens
aatgtttgctat

SEQ ID NO: 2104579 - DNA, 10 bp, Homo sapiens
aatgttttct

SEQ ID NO: 2104580 - DNA, 14 bp, Homo sapiens
aatgttttgtacaa

SEQ ID NO: 2104581 - DNA, 18 bp, Homo sapiens
aatgttttgtacaattac

SEQ ID NO: 2104582 - DNA, 12 bp, Homo sapiens
aattaaaatata

SEQ ID NO: 2104583 - DNA, 16 bp, Homo sapiens
aattaaaatatatata

SEQ ID NO: 2104584 - DNA, 19 bp, Homo sapiens
aattaaactgaagaaggat

SEQ ID NO: 2104585 - DNA, 15 bp, Homo sapiens
aattaaagctgttat

SEQ ID NO: 2104586 - DNA, 12 bp, Homo sapiens
aattaaagtctt

SEQ ID NO: 2104587 - DNA, 12 bp, Homo sapiens
aattaaatgtag

SEQ ID NO: 2104588 - DNA, 20 bp, Homo sapiens
aattaactatgtgatgttaa

SEQ ID NO: 2104589 - DNA, 12 bp, Homo sapiens
aattaagacttt

SEQ ID NO: 2104590 - DNA, 16 bp, Homo sapiens
aattaaggcataagaa

SEQ ID NO: 2104591 - DNA, 17 bp, Homo sapiens
aattaaggtttgccctg

SEQ ID NO: 2104592 - DNA, 13 bp, Homo sapiens
aattaagtgcaat

SEQ ID NO: 2104593 - DNA, 15 bp, Homo sapiens
aattaagtgcaattt

SEQ ID NO: 2104594 - DNA, 22 bp, Homo sapiens
aattaagttagggaatggcaca

SEQ ID NO: 2104595 - DNA, 23 bp, Homo sapiens
aattaataaaaaatggaaagaat

SEQ ID NO: 2104596 - DNA, 13 bp, Homo sapiens
aattaatagcttt

SEQ ID NO: 2104597 - DNA, 14 bp, Homo sapiens
aattaatcttaatt

SEQ ID NO: 2104598 - DNA, 14 bp, Homo sapiens
aattaatgtgtgtc

SEQ ID NO: 2104599 - DNA, 14 bp, Homo sapiens
aattacaattgtca

SEQ ID NO: 2104600 - DNA, 15 bp, Homo sapiens
aattacatccagaaa

SEQ ID NO: 2104601 - DNA, 23 bp, Homo sapiens
aattaccttagattagctctgga

SEQ ID NO: 2104602 - DNA, 16 bp, Homo sapiens
aattactaaattgtat

SEQ ID NO: 2104603 - DNA, 16 bp, Homo sapiens
aattactatattttag

SEQ ID NO: 2104604 - DNA, 16 bp, Homo sapiens
aattacttctctctat

SEQ ID NO: 2104605 - DNA, 15 bp, Homo sapiens
aattaggatctatgc

SEQ ID NO: 2104606 - DNA, 14 bp, Homo sapiens
aattaggttaacat

SEQ ID NO: 2104607 - DNA, 15 bp, Homo sapiens
aattaggttaacatt

SEQ ID NO: 2104608 - DNA, 17 bp, Homo sapiens
aattaggttttgtacaa

SEQ ID NO: 2104609 - DNA, 19 bp, Homo sapiens
aattagtacagtagcttaa

SEQ ID NO: 2104610 - DNA, 20 bp, Homo sapiens
aattagtacagtagcttaaa

SEQ ID NO: 2104611 - DNA, 17 bp, Homo sapiens
aattagtatttatttaa

SEQ ID NO: 2104612 - DNA, 18 bp, Homo sapiens
aattagtgagatttgtat

SEQ ID NO: 2104613 - DNA, 12 bp, Homo sapiens
aattataagatg

SEQ ID NO: 2104614 - DNA, 14 bp, Homo sapiens
aattataagatgtc

SEQ ID NO: 2104615 - DNA, 16 bp, Homo sapiens
aattataatatactat

SEQ ID NO: 2104616 - DNA, 15 bp, Homo sapiens
aattatatctaattt

SEQ ID NO: 2104617 - DNA, 16 bp, Homo sapiens
aattatatctaattta

SEQ ID NO: 2104618 - DNA, 22 bp, Homo sapiens
aattatatctaatttatacaaa

SEQ ID NO: 2104619 - DNA, 16 bp, Homo sapiens
aattatcatgggaaaa

SEQ ID NO: 2104620 - DNA, 12 bp, Homo sapiens
aattatgacagt

SEQ ID NO: 2104621 - DNA, 15 bp, Homo sapiens
aattatgaggcattg

SEQ ID NO: 2104622 - DNA, 21 bp, Homo sapiens
aattatgaggtgaaacaatta

SEQ ID NO: 2104623 - DNA, 13 bp, Homo sapiens
aattatgcactgg

SEQ ID NO: 2104624 - DNA, 12 bp, Homo sapiens
aattatggtgaa

SEQ ID NO: 2104625 - DNA, 15 bp, Homo sapiens
aattatgtatgttta

SEQ ID NO: 2104626 - DNA, 19 bp, Homo sapiens
aattattaataccaaatat

SEQ ID NO: 2104627 - DNA, 13 bp, Homo sapiens
aattattattctt

SEQ ID NO: 2104628 - DNA, 21 bp, Homo sapiens
aattattatttatatatgtat

SEQ ID NO: 2104629 - DNA, 22 bp, Homo sapiens
aattattatttatatatgtatt

SEQ ID NO: 2104630 - DNA, 23 bp, Homo sapiens
aattattcctttcctagactaat

SEQ ID NO: 2104631 - DNA, 21 bp, Homo sapiens
aattattctaattttatatat

SEQ ID NO: 2104632 - DNA, 14 bp, Homo sapiens
aattatttaataaa

SEQ ID NO: 2104633 - DNA, 19 bp, Homo sapiens
aattatttatttaataaca

SEQ ID NO: 2104634 - DNA, 19 bp, Homo sapiens
aattattttaatattttgt

SEQ ID NO: 2104635 - DNA, 20 bp, Homo sapiens
aattattttaatattttgta

SEQ ID NO: 2104636 - DNA, 23 bp, Homo sapiens
aattattttgttgtgattttgta

SEQ ID NO: 2104637 - DNA, 17 bp, Homo sapiens
aattatttttaagaaat

SEQ ID NO: 2104638 - DNA, 12 bp, Homo sapiens
aattatttttgt

SEQ ID NO: 2104639 - DNA, 14 bp, Homo sapiens
aattcaaaaagtgt

SEQ ID NO: 2104640 - DNA, 16 bp, Homo sapiens
aattcaaaaagtgttt

SEQ ID NO: 2104641 - DNA, 15 bp, Homo sapiens
aattcaaaccattta

SEQ ID NO: 2104642 - DNA, 17 bp, Homo sapiens
aattcaaaccatttaat

SEQ ID NO: 2104643 - DNA, 14 bp, Homo sapiens
aattcaaagctcta

SEQ ID NO: 2104644 - DNA, 16 bp, Homo sapiens
aattcaacacattact

SEQ ID NO: 2104645 - DNA, 19 bp, Homo sapiens
aattcaacacattacttgc

SEQ ID NO: 2104646 - DNA, 19 bp, Homo sapiens
aattcaaggagatataaaa

SEQ ID NO: 2104647 - DNA, 21 bp, Homo sapiens
aattcaaggagatataaaatc

SEQ ID NO: 2104648 - DNA, 15 bp, Homo sapiens
aattcagcaccctgg

SEQ ID NO: 2104649 - DNA, 17 bp, Homo sapiens
aattcagcaccctgggt

SEQ ID NO: 2104650 - DNA, 23 bp, Homo sapiens
aattcagcactgatttcacaaca

SEQ ID NO: 2104651 - DNA, 16 bp, Homo sapiens
aattcaggactggctc

SEQ ID NO: 2104652 - DNA, 16 bp, Homo sapiens
aattcagtgctgtact

SEQ ID NO: 2104653 - DNA, 13 bp, Homo sapiens
aattcataattag

SEQ ID NO: 2104654 - DNA, 18 bp, Homo sapiens
aattcataattagaacaa

SEQ ID NO: 2104655 - DNA, 22 bp, Homo sapiens
aattcatcatatgaatgttctt

SEQ ID NO: 2104656 - DNA, 23 bp, Homo sapiens
aattcattaaatttctggatttg

SEQ ID NO: 2104657 - DNA, 17 bp, Homo sapiens
aattcatttcactttaa

SEQ ID NO: 2104658 - DNA, 18 bp, Homo sapiens
aattcatttcactttaaa

SEQ ID NO: 2104659 - DNA, 20 bp, Homo sapiens
aattcatttcactttaaagt

SEQ ID NO: 2104660 - DNA, 21 bp, Homo sapiens
aattcatttcactttaaagtc

SEQ ID NO: 2104661 - DNA, 17 bp, Homo sapiens
aattccacagtctctgg

SEQ ID NO: 2104662 - DNA, 16 bp, Homo sapiens
aattcccattttgcaa

SEQ ID NO: 2104663 - DNA, 19 bp, Homo sapiens
aattcccattttgcaaaat

SEQ ID NO: 2104664 - DNA, 10 bp, Homo sapiens
aattccctat

SEQ ID NO: 2104665 - DNA, 22 bp, Homo sapiens
aattccctatcttttagtttta

SEQ ID NO: 2104666 - DNA, 20 bp, Homo sapiens
aatcctgttacttaaatagc

SEQ ID NO: 2104667 - DNA, 13 bp, Homo sapiens
aatccttgcttat

SEQ ID NO: 2104668 - DNA, 14 bp, Homo sapiens
aatcgagtctacct

SEQ ID NO: 2104669 - DNA, 16 bp, Homo sapiens
aatcgagtctacctct

SEQ ID NO: 2104670 - DNA, 14 bp, Homo sapiens
aatcgatctgtact

SEQ ID NO: 2104671 - DNA, 20 bp, Homo sapiens
aatcgatctgtactgtaatt

SEQ ID NO: 2104672 - DNA, 14 bp, Homo sapiens
aatcgattggcttt

SEQ ID NO: 2104673 - DNA, 22 bp, Homo sapiens
aatcggatctggggctctggga

SEQ ID NO: 2104674 - DNA, 18 bp, Homo sapiens
aatcggcccacagctccc

SEQ ID NO: 2104675 - DNA, 22 bp, Homo sapiens
aatcggcccacagctcccaccc

SEQ ID NO: 2104676 - DNA, 16 bp, Homo sapiens
aatctaatattaaaaa

SEQ ID NO: 2104677 - DNA, 17 bp, Homo sapiens
aatctaatattaaaaat

SEQ ID NO: 2104678 - DNA, 18 bp, Homo sapiens
aatctatattaaagtgtt

SEQ ID NO: 2104679 - DNA, 13 bp, Homo sapiens
aatctatctatat

SEQ ID NO: 2104680 - DNA, 13 bp, Homo sapiens
aatctattcagac

SEQ ID NO: 2104681 - DNA, 23 bp, Homo sapiens
aatctatttacataaaatgggtg

SEQ ID NO: 2104682 - DNA, 13 bp, Homo sapiens
aatctcagagaca

SEQ ID NO: 2104683 - DNA, 16 bp, Homo sapiens
aatctcatacctctga

SEQ ID NO: 2104684 - DNA, 18 bp, Homo sapiens
aatctcatacctctgacc

SEQ ID NO: 2104685 - DNA, 12 bp, Homo sapiens
aatctcattccc

SEQ ID NO: 2104686 - DNA, 19 bp, Homo sapiens
aatctccagggctgcccct

SEQ ID NO: 2104687 - DNA, 22 bp, Homo sapiens
aatctccagggctgcccctgta

SEQ ID NO: 2104688 - DNA, 18 bp, Homo sapiens
aatctcctcttttatctt

SEQ ID NO: 2104689 - DNA, 14 bp, Homo sapiens
aatctgaaagcccg

SEQ ID NO: 2104690 - DNA, 20 bp, Homo sapiens
aatctgagatctccctccag

SEQ ID NO: 2104691 - DNA, 21 bp, Homo sapiens
aatctgataggaaaagaaggc

SEQ ID NO: 2104692 - DNA, 15 bp, Homo sapiens
aatctgatctgagtg

SEQ ID NO: 2104693 - DNA, 18 bp, Homo sapiens
aatctgattggacatttt

SEQ ID NO: 2104694 - DNA, 19 bp, Homo sapiens
aatctgattggacattttc

SEQ ID NO: 2104695 - DNA, 12 bp, Homo sapiens
aatctgatttaa

SEQ ID NO: 2104696 - DNA, 17 bp, Homo sapiens
aatctgatttaatgttt

SEQ ID NO: 2104697 - DNA, 19 bp, Homo sapiens
aatctgatttaatgttttc

SEQ ID NO: 2104698 - DNA, 20 bp, Homo sapiens
aatctgatttaatgttttct

SEQ ID NO: 2104699 - DNA, 11 bp, Homo sapiens
aatctgccttt

SEQ ID NO: 2104700 - DNA, 19 bp, Homo sapiens
aatctggcaaagttatatt

SEQ ID NO: 2104701 - DNA, 14 bp, Homo sapiens
aatctggctcctgt

SEQ ID NO: 2104702 - DNA, 16 bp, Homo sapiens
aatctgggaagggaag

SEQ ID NO: 2104703 - DNA, 18 bp, Homo sapiens
aatctgggcatctcgtgc

SEQ ID NO: 2104704 - DNA, 13 bp, Homo sapiens
aatctgtaattct

SEQ ID NO: 2104705 - DNA, 18 bp, Homo sapiens
aatctgtatatgttgtaa

SEQ ID NO: 2104706 - DNA, 22 bp, Homo sapiens
aatctgtatatgttgtaataaa

SEQ ID NO: 2104707 - DNA, 16 bp, Homo sapiens
aatctgtttttctaac

SEQ ID NO: 2104708 - DNA, 23 bp, Homo sapiens
aatcttaattttgtattttttcc

SEQ ID NO: 2104709 - DNA, 21 bp, Homo sapiens
aatcttcaaggtgtaaaatat

SEQ ID NO: 2104710 - DNA, 19 bp, Homo sapiens
aatcttcaatatgaaggac

SEQ ID NO: 2104711 - DNA, 15 bp, Homo sapiens
aatcttccttgtgag

SEQ ID NO: 2104712 - DNA, 19 bp, Homo sapiens
aatcttcggggtgtgatga

SEQ ID NO: 2104713 - DNA, 22 bp, Homo sapiens
aatcttgacacggtgaaatcca

SEQ ID NO: 2104714 - DNA, 15 bp, Homo sapiens
aatcttgttaaattg

SEQ ID NO: 2104715 - DNA, 20 bp, Homo sapiens
aatctttccttgtctctcat

SEQ ID NO: 2104716 - DNA, 17 bp, Homo sapiens
aatctttgattcagaca

SEQ ID NO: 2104717 - DNA, 13 bp, Homo sapiens
aatctttgctgta

SEQ ID NO: 2104718 - DNA, 22 bp, Homo sapiens
aatctttgtgacaggaaagccc

SEQ ID NO: 2104719 - DNA, 23 bp, Homo sapiens
aatctttttttaataatttcatc

SEQ ID NO: 2104720 - DNA, 12 bp, Homo sapiens
aatgaaaatgtc

SEQ ID NO: 2104721 - DNA, 23 bp, Homo sapiens
aatgaaaatgtcagaaaccagtt

SEQ ID NO: 2104722 - DNA, 14 bp, Homo sapiens
aatgaaacagatga

SEQ ID NO: 2104723 - DNA, 21 bp, Homo sapiens
aatgaaagggaaagtcagctt

SEQ ID NO: 2104724 - DNA, 15 bp, Homo sapiens
aatgaaagtttgcac

SEQ ID NO: 2104725 - DNA, 14 bp, Homo sapiens
aatgaaatacacaa

SEQ ID NO: 2104726 - DNA, 21 bp, Homo sapiens
aatgaaatatttgcttattta

SEQ ID NO: 2104727 - DNA, 17 bp, Homo sapiens
aatgaaatgctctcctt

SEQ ID NO: 2104728 - DNA, 23 bp, Homo sapiens
aatgaaattactacaaaatttga

SEQ ID NO: 2104729 - DNA, 14 bp, Homo sapiens
aatgaaattgtaaa

SEQ ID NO: 2104730 - DNA, 12 bp, Homo sapiens
aatgaacaaatg

SEQ ID NO: 2104731 - DNA, 19 bp, Homo sapiens
aatgaactgtgacaggaag

SEQ ID NO: 2104732 - DNA, 16 bp, Homo sapiens
aatgaatatctgcttt

SEQ ID NO: 2104733 - DNA, 14 bp, Homo sapiens
aatgaatttatctg

SEQ ID NO: 2104734 - DNA, 13 bp, Homo sapiens
aatgacaacagaa

SEQ ID NO: 2104735 - DNA, 19 bp, Homo sapiens
aatgacacggtaggccaag

SEQ ID NO: 2104736 - DNA, 16 bp, Homo sapiens
aatgacatgcactgac

SEQ ID NO: 2104737 - DNA, 22 bp, Homo sapiens
aatgactgtctaagagatctgg

SEQ ID NO: 2104738 - DNA, 15 bp, Homo sapiens
aatgagaacttcaat

SEQ ID NO: 2104739 - DNA, 22 bp, Homo sapiens
aatgagcattgagacggtgctc

SEQ ID NO: 2104740 - DNA, 14 bp, Homo sapiens
aatgagctcctgcg

SEQ ID NO: 2104741 - DNA, 21 bp, Homo sapiens
aatgagctggtttgtcaaaca

SEQ ID NO: 2104742 - DNA, 19 bp, Homo sapiens
aatgagctgtatctgtaat

SEQ ID NO: 2104743 - DNA, 16 bp, Homo sapiens
aatgaggacatgtttt

SEQ ID NO: 2104744 - DNA, 24 bp, Homo sapiens
aatgaggcttggggctggagagga

SEQ ID NO: 2104745 - DNA, 14 bp, Homo sapiens
aatgagggactgga

SEQ ID NO: 2104746 - DNA, 18 bp, Homo sapiens
aatgaggtcagagcctgc

SEQ ID NO: 2104747 - DNA, 16 bp, Homo sapiens
aatgaggtctgaaatg

SEQ ID NO: 2104748 - DNA, 23 bp, Homo sapiens
aatgataagcaggaaggatggca

SEQ ID NO: 2104749 - DNA, 18 bp, Homo sapiens
aatgataccctgaatttg

SEQ ID NO: 2104750 - DNA, 15 bp, Homo sapiens
aatgatgattaaaca

SEQ ID NO: 2104751 - DNA, 15 bp, Homo sapiens
aatgatgtatgattt

SEQ ID NO: 2104752 - DNA, 15 bp, Homo sapiens
aatgatgtccagaag

SEQ ID NO: 2104753 - DNA, 19 bp, Homo sapiens
aatgatgttttagaatgat

SEQ ID NO: 2104754 - DNA, 18 bp, Homo sapiens
aatgattattttcattac

SEQ ID NO: 2104755 - DNA, 13 bp, Homo sapiens
aatgattcataac

SEQ ID NO: 2104756 - DNA, 16 bp, Homo sapiens
aatgattcataacaat

SEQ ID NO: 2104757 - DNA, 18 bp, Homo sapiens
aatgattcataacaatgt

SEQ ID NO: 2104758 - DNA, 19 bp, Homo sapiens
aatgattcataacaatgta

SEQ ID NO: 2104759 - DNA, 13 bp, Homo sapiens
aatgattgtaaaa

SEQ ID NO: 2104760 - DNA, 15 bp, Homo sapiens
aatgattgtagtaat

SEQ ID NO: 2104761 - DNA, 20 bp, Homo sapiens
aatgatttaagcattttact

SEQ ID NO: 2104762 - DNA, 11 bp, Homo sapiens
aatgatttcag

SEQ ID NO: 2104763 - DNA, 22 bp, Homo sapiens
aatgatttcatgctatctctgt

SEQ ID NO: 2104764 - DNA, 20 bp, Homo sapiens
aatgatttccaaagagaaaa

SEQ ID NO: 2104765 - DNA, 18 bp, Homo sapiens
aatgattttcatcaattt

SEQ ID NO: 2104766 - DNA, 14 bp, Homo sapiens
aatgatttttagat

SEQ ID NO: 2104767 - DNA, 13 bp, Homo sapiens
aatgcaaaaatct

SEQ ID NO: 2104768 - DNA, 18 bp, Homo sapiens
aatgcaacaacatgtata

SEQ ID NO: 2104769 - DNA, 17 bp, Homo sapiens
aatgcaagctagtggct

SEQ ID NO: 2104770 - DNA, 14 bp, Homo sapiens
aatgcaatatgtat

SEQ ID NO: 2104771 - DNA, 16 bp, Homo sapiens
aatgcacaatttagaa

SEQ ID NO: 2104772 - DNA, 19 bp, Homo sapiens
aatgcacaatttagaaaac

SEQ ID NO: 2104773 - DNA, 20 bp, Homo sapiens
aatgtggatttcctatttta

SEQ ID NO: 2104774 - DNA, 17 bp, Homo sapiens
aatgtggcctaaaaatg

SEQ ID NO: 2104775 - DNA, 14 bp, Homo sapiens
aatgtggctcctgg

SEQ ID NO: 2104776 - DNA, 23 bp, Homo sapiens
aatgtgggcgtttgtaaattctg

SEQ ID NO: 2104777 - DNA, 19 bp, Homo sapiens
aatgtgtgccatagagttt

SEQ ID NO: 2104778 - DNA, 17 bp, Homo sapiens
aatgtgtggtgctaact

SEQ ID NO: 2104779 - DNA, 15 bp, Homo sapiens
aatgttaaagtcagt

SEQ ID NO: 2104780 - DNA, 21 bp, Homo sapiens
aatgttaaggacttctgcagc

SEQ ID NO: 2104781 - DNA, 22 bp, Homo sapiens
aatgttaaggacttctgcagct

SEQ ID NO: 2104782 - DNA, 15 bp, Homo sapiens
aatgttacattgttt

SEQ ID NO: 2104783 - DNA, 23 bp, Homo sapiens
aatgttatttgttattttcagta

SEQ ID NO: 2104784 - DNA, 20 bp, Homo sapiens
aatgttattttttaattatt

SEQ ID NO: 2104785 - DNA, 12 bp, Homo sapiens
aatgttctctgg

SEQ ID NO: 2104786 - DNA, 21 bp, Homo sapiens
aatgttctgaataatttctta

SEQ ID NO: 2104787 - DNA, 15 bp, Homo sapiens
aaggagcagggtcct

SEQ ID NO: 2104788 - DNA, 20 bp, Homo sapiens
aaggagctgatttccaggcc

SEQ ID NO: 2104789 - DNA, 11 bp, Homo sapiens
aaggaggaaaa

SEQ ID NO: 2104790 - DNA, 16 bp, Homo sapiens
aaggaggcatgcctct

SEQ ID NO: 2104791 - DNA, 16 bp, Homo sapiens
aaggagggacaagaat

SEQ ID NO: 2104792 - DNA, 14 bp, Homo sapiens
aaggagggcagagc

SEQ ID NO: 2104793 - DNA, 19 bp, Homo sapiens
aaggagggcagagccatgg

SEQ ID NO: 2104794 - DNA, 20 bp, Homo sapiens
aaggaggggatagagagaga

SEQ ID NO: 2104795 - DNA, 15 bp, Homo sapiens
aaggaggtgagggat

SEQ ID NO: 2104796 - DNA, 17 bp, Homo sapiens
aaggagtaagtacaaat

SEQ ID NO: 2104797 - DNA, 20 bp, Homo sapiens
aaggagttcgtggctgcaaa

SEQ ID NO: 2104798 - DNA, 13 bp, Homo sapiens
aaggatcagaatg

SEQ ID NO: 2104799 - DNA, 23 bp, Homo sapiens
aaggatccagagacttggggacc

SEQ ID NO: 2104800 - DNA, 21 bp, Homo sapiens
aaggatctctcaggagcacag

SEQ ID NO: 2104801 - DNA, 15 bp, Homo sapiens
aaggatctgttttta

SEQ ID NO: 2104802 - DNA, 23 bp, Homo sapiens
aaggatctgtttttaaaaatcat

SEQ ID NO: 2104803 - DNA, 23 bp, Homo sapiens
aaggatgaatgaggtcccaggca

SEQ ID NO: 2104804 - DNA, 19 bp, Homo sapiens
aaggatgtaaacagtgcct

SEQ ID NO: 2104805 - DNA, 18 bp, Homo sapiens
aaggattaagatacactc

SEQ ID NO: 2104806 - DNA, 20 bp, Homo sapiens
aaggattaagatacactcct

SEQ ID NO: 2104807 - DNA, 21 bp, Homo sapiens
aaggattgatcactttgttaa

SEQ ID NO: 2104808 - DNA, 15 bp, Homo sapiens
aaggattgctactgt

SEQ ID NO: 2104809 - DNA, 22 bp, Homo sapiens
aaggattgttgggcttggggga

SEQ ID NO: 2104810 - DNA, 9 bp, Homo sapiens
aaggcaaag

SEQ ID NO: 2104811 - DNA, 17 bp, Homo sapiens
aaggcaaagcccctgga

SEQ ID NO: 2104812 - DNA, 20 bp, Homo sapiens
aaggcacaaaccttactatg

SEQ ID NO: 2104813 - DNA, 16 bp, Homo sapiens
aaggcagcaaggcccg

SEQ ID NO: 2104814 - DNA, 11 bp, Homo sapiens
aaggcagcctc

SEQ ID NO: 2104815 - DNA, 13 bp, Homo sapiens
aaggcagcctcca

SEQ ID NO: 2104816 - DNA, 21 bp, Homo sapiens
aaggcagcctccagagccagc

SEQ ID NO: 2104817 - DNA, 14 bp, Homo sapiens
aaggcagctgctct

SEQ ID NO: 2104818 - DNA, 14 bp, Homo sapiens
aaggcagggaggag

SEQ ID NO: 2104819 - DNA, 12 bp, Homo sapiens
aaggcagggcag

SEQ ID NO: 2104820 - DNA, 17 bp, Homo sapiens
aaggcatggcggccccc

SEQ ID NO: 2104821 - DNA, 21 bp, Homo sapiens
aaggccagtggaaattcaggt

SEQ ID NO: 2104822 - DNA, 12 bp, Homo sapiens
aaggcccctccc

SEQ ID NO: 2104823 - DNA, 14 bp, Homo sapiens
aaggcccgagcagc

SEQ ID NO: 2104824 - DNA, 16 bp, Homo sapiens
aaggcccgagcagctg

SEQ ID NO: 2104825 - DNA, 17 bp, Homo sapiens
aaggcccgagcagctga

SEQ ID NO: 2104826 - DNA, 23 bp, Homo sapiens
aaggcccggccccatcagaggct

SEQ ID NO: 2104827 - DNA, 11 bp, Homo sapiens
aaggccctcta

SEQ ID NO: 2104828 - DNA, 14 bp, Homo sapiens
aaggccgctgcccc

SEQ ID NO: 2104829 - DNA, 16 bp, Homo sapiens
aaggccgtgtctctga

SEQ ID NO: 2104830 - DNA, 18 bp, Homo sapiens
aaggcctgccctcccatg

SEQ ID NO: 2104831 - DNA, 15 bp, Homo sapiens
aaggccttaatatgt

SEQ ID NO: 2104832 - DNA, 18 bp, Homo sapiens
aaggcgggagcatctctt

SEQ ID NO: 2104833 - DNA, 17 bp, Homo sapiens
aaggcgtgcaaggggct

SEQ ID NO: 2104834 - DNA, 16 bp, Homo sapiens
aaggctactggcatta

SEQ ID NO: 2104835 - DNA, 21 bp, Homo sapiens
aaggctagtttattttgttac

SEQ ID NO: 2104836 - DNA, 23 bp, Homo sapiens
aaggctctgagcaaatgtggctc

SEQ ID NO: 2104837 - DNA, 21 bp, Homo sapiens
aaggctcttctccttggagga

SEQ ID NO: 2104838 - DNA, 17 bp, Homo sapiens
aaggctgctgtgtagct

SEQ ID NO: 2104839 - DNA, 16 bp, Homo sapiens
aaggctggctgagtgg

SEQ ID NO: 2104840 - DNA, 23 bp, Homo sapiens
aaggctggggccagtgtaaggca

SEQ ID NO: 2104841 - DNA, 21 bp, Homo sapiens
aaggctttgccatgggcctgc

SEQ ID NO: 2104842 - DNA, 15 bp, Homo sapiens
aagggaaaaatatat

SEQ ID NO: 2104843 - DNA, 16 bp, Homo sapiens
aagggaaactgccagc

SEQ ID NO: 2104844 - DNA, 23 bp, Homo sapiens
aagggaaactgccagcaacgcag

SEQ ID NO: 2104845 - DNA, 14 bp, Homo sapiens
aagggaaactggct

SEQ ID NO: 2104846 - DNA, 15 bp, Homo sapiens
aagggaaactggctg

SEQ ID NO: 2104847 - DNA, 14 bp, Homo sapiens
aagggacacacaca

SEQ ID NO: 2104848 - DNA, 17 bp, Homo sapiens
aagggagaagaaatcca

SEQ ID NO: 2104849 - DNA, 19 bp, Homo sapiens
aagggagaagaaatccata

SEQ ID NO: 2104850 - DNA, 17 bp, Homo sapiens
aagggagagggagggag

SEQ ID NO: 2104851 - DNA, 19 bp, Homo sapiens
aagggaggcccagccgcag

SEQ ID NO: 2104852 - DNA, 13 bp, Homo sapiens
aagggagggctct

SEQ ID NO: 2104853 - DNA, 17 bp, Homo sapiens
aagggatggcaagatgt

SEQ ID NO: 2104854 - DNA, 17 bp, Homo sapiens
aagggcagccaggggct

SEQ ID NO: 2104855 - DNA, 9 bp, Homo sapiens
aagggccag

SEQ ID NO: 2104856 - DNA, 13 bp, Homo sapiens
aagggccagccct

SEQ ID NO: 2104857 - DNA, 12 bp, Homo sapiens
aagggccaggag

SEQ ID NO: 2104858 - DNA, 14 bp, Homo sapiens
aagggccaggagag

SEQ ID NO: 2104859 - DNA, 16 bp, Homo sapiens
aagggccaggagagag

SEQ ID NO: 2104860 - DNA, 17 bp, Homo sapiens
aagggccaggagagaga

SEQ ID NO: 2104861 - DNA, 18 bp, Homo sapiens
aagggccaggagagagat

SEQ ID NO: 2104862 - DNA, 16 bp, Homo sapiens
aagggccatgctgaag

SEQ ID NO: 2104863 - DNA, 17 bp, Homo sapiens
aagggccatgctgaagg

SEQ ID NO: 2104864 - DNA, 13 bp, Homo sapiens
aagggcccagaga

SEQ ID NO: 2104865 - DNA, 22 bp, Homo sapiens
aagggcggggctatgccttgtc

SEQ ID NO: 2104866 - DNA, 17 bp, Homo sapiens
aagggctagaacctgga

SEQ ID NO: 2104867 - DNA, 12 bp, Homo sapiens
aagggctccagc

SEQ ID NO: 2104868 - DNA, 22 bp, Homo sapiens
aaggggaatgtttgcctctgcc

SEQ ID NO: 2104869 - DNA, 19 bp, Homo sapiens
aaggggacgcgggctgtgc

SEQ ID NO: 2104870 - DNA, 22 bp, Homo sapiens
aaggggagaagggccagcccta

SEQ ID NO: 2104871 - DNA, 21 bp, Homo sapiens
aaggggcacaccactgccctg

SEQ ID NO: 2104872 - DNA, 23 bp, Homo sapiens
aaggggcacaccactgccctgcc

SEQ ID NO: 2104873 - DNA, 21 bp, Homo sapiens
aaggggcacctgggaaaacag

SEQ ID NO: 2104874 - DNA, 16 bp, Homo sapiens
aaggggccccggggct

SEQ ID NO: 2104875 - DNA, 12 bp, Homo sapiens
aaggggctgctg

SEQ ID NO: 2104876 - DNA, 22 bp, Homo sapiens
aagggggcggcctatgacttgg

SEQ ID NO: 2104877 - DNA, 15 bp, Homo sapiens
aaggggtgccctctg

SEQ ID NO: 2104878 - DNA, 17 bp, Homo sapiens
aagggtaagggagaggg

SEQ ID NO: 2104879 - DNA, 16 bp, Homo sapiens
aagggtctagggagag

SEQ ID NO: 2104880 - DNA, 19 bp, Homo sapiens
aagggtgatgggaaagcat

SEQ ID NO: 2104881 - DNA, 23 bp, Homo sapiens
aagggtggggttttatgtgtggg

SEQ ID NO: 2104882 - DNA, 18 bp, Homo sapiens
aagggttggtgggctggc

SEQ ID NO: 2104883 - DNA, 20 bp, Homo sapiens
aagggttggtgggctggccc

SEQ ID NO: 2104884 - DNA, 18 bp, Homo sapiens
aaggtacaagaagcattt

SEQ ID NO: 2104885 - DNA, 17 bp, Homo sapiens
aaggtagaacctcacct

SEQ ID NO: 2104886 - DNA, 22 bp, Homo sapiens
aaggtattaaattgatgttgct

SEQ ID NO: 2104887 - DNA, 20 bp, Homo sapiens
aaggtatttagaatatatta

SEQ ID NO: 2104888 - DNA, 19 bp, Homo sapiens
aaggtcagttgccatggtt

SEQ ID NO: 2104889 - DNA, 13 bp, Homo sapiens
aaggtcatcatcg

SEQ ID NO: 2104890 - DNA, 17 bp, Homo sapiens
aaggtcattgtggctat

SEQ ID NO: 2104891 - DNA, 19 bp, Homo sapiens
aaggtctccttactctgag

SEQ ID NO: 2104892 - DNA, 20 bp, Homo sapiens
aaggtctgggagtgttctgt

SEQ ID NO: 2104893 - DNA, 23 bp, Homo sapiens
aaggtcttcttgtgtcctgatga

SEQ ID NO: 2104894 - DNA, 13 bp, Homo sapiens
aaggtctttggtt

SEQ ID NO: 2104895 - DNA, 11 bp, Homo sapiens
aaggtgcctgt

SEQ ID NO: 2104896 - DNA, 20 bp, Homo sapiens
aaggtgcctgtgaggcaggg

SEQ ID NO: 2104897 - DNA, 18 bp, Homo sapiens
aaggtgggctgagccctg

SEQ ID NO: 2104898 - DNA, 19 bp, Homo sapiens
aaggtgggctgagccctgg

SEQ ID NO: 2104899 - DNA, 15 bp, Homo sapiens
aaggtgggtccagga

SEQ ID NO: 2104900 - DNA, 22 bp, Homo sapiens
aaggtgggtccaggaaggcagc

SEQ ID NO: 2104901 - DNA, 20 bp, Homo sapiens
aaggtggtatgtgtgtgtat

SEQ ID NO: 2104902 - DNA, 18 bp, Homo sapiens
aagtgggaagtgaagccc

SEQ ID NO: 2104903 - DNA, 18 bp, Homo sapiens
aagtggggctaaatgaag

SEQ ID NO: 2104904 - DNA, 19 bp, Homo sapiens
aagtggggctaaatgaagt

SEQ ID NO: 2104905 - DNA, 16 bp, Homo sapiens
aagtgggggccgctgg

SEQ ID NO: 2104906 - DNA, 15 bp, Homo sapiens
aagtggggtgcatcc

SEQ ID NO: 2104907 - DNA, 17 bp, Homo sapiens
aagtgggttcactagag

SEQ ID NO: 2104908 - DNA, 15 bp, Homo sapiens
aagtgtaagcacttc

SEQ ID NO: 2104909 - DNA, 14 bp, Homo sapiens
aagtgtaattgaga

SEQ ID NO: 2104910 - DNA, 23 bp, Homo sapiens
aagtgtatatcagaaaagggaag

SEQ ID NO: 2104911 - DNA, 19 bp, Homo sapiens
aagtgttcaagaaataaaa

SEQ ID NO: 2104912 - DNA, 19 bp, Homo sapiens
aagtgttgaagaagagttt

SEQ ID NO: 2104913 - DNA, 16 bp, Homo sapiens
aagtgttgctcttgga

SEQ ID NO: 2104914 - DNA, 23 bp, Homo sapiens
aagtgttggctaatgaagggaaa

SEQ ID NO: 2104915 - DNA, 18 bp, Homo sapiens
aagtgttgtaaatattta

SEQ ID NO: 2104916 - DNA, 16 bp, Homo sapiens
aagtgtttatttttca

SEQ ID NO: 2104917 - DNA, 19 bp, Homo sapiens
aagtgtttatttttcatat

SEQ ID NO: 2104918 - DNA, 21 bp, Homo sapiens
aagtgtttatttttcatattg

SEQ ID NO: 2104919 - DNA, 22 bp, Homo sapiens
aagttaaaagtgttgattacat

SEQ ID NO: 2104920 - DNA, 15 bp, Homo sapiens
aagttaatttaaagt

SEQ ID NO: 2104921 - DNA, 16 bp, Homo sapiens
aagttaatttaaagtt

SEQ ID NO: 2104922 - DNA, 17 bp, Homo sapiens
aagttaatttaaagttg

SEQ ID NO: 2104923 - DNA, 15 bp, Homo sapiens
aagttacttattcta

SEQ ID NO: 2104924 - DNA, 16 bp, Homo sapiens
aagttacttattctag

SEQ ID NO: 2104925 - DNA, 23 bp, Homo sapiens
aagttacttcactttaattctca

SEQ ID NO: 2104926 - DNA, 17 bp, Homo sapiens
aagttagagaatatatt

SEQ ID NO: 2104927 - DNA, 15 bp, Homo sapiens
aagttagctcaggag

SEQ ID NO: 2104928 - DNA, 16 bp, Homo sapiens
aagttaggttataaga

SEQ ID NO: 2104929 - DNA, 20 bp, Homo sapiens
aagttaggttataagaaaca

SEQ ID NO: 2104930 - DNA, 16 bp, Homo sapiens
aagttatagtatatct

SEQ ID NO: 2104931 - DNA, 19 bp, Homo sapiens
aagttatattgaatatatc

SEQ ID NO: 2104932 - DNA, 11 bp, Homo sapiens
aagttattgta

SEQ ID NO: 2104933 - DNA, 20 bp, Homo sapiens
aagttattgtacagctgttt

SEQ ID NO: 2104934 - DNA, 18 bp, Homo sapiens
aagttattgtgttgcctt

SEQ ID NO: 2104935 - DNA, 24 bp, Homo sapiens
aagttattgtgttgccttagcact

SEQ ID NO: 2104936 - DNA, 16 bp, Homo sapiens
aagttatttaaatctg

SEQ ID NO: 2104937 - DNA, 17 bp, Homo sapiens
aagttccagctggtctt

SEQ ID NO: 2104938 - DNA, 19 bp, Homo sapiens
aagttccagtgttctctct

SEQ ID NO: 2104939 - DNA, 14 bp, Homo sapiens
aagttcctctagtg

SEQ ID NO: 2104940 - DNA, 13 bp, Homo sapiens
aagttcctgcact

SEQ ID NO: 2104941 - DNA, 17 bp, Homo sapiens
aagttcctgttcacctt

SEQ ID NO: 2104942 - DNA, 23 bp, Homo sapiens
aagttcctgttcaccttatgtat

SEQ ID NO: 2104943 - DNA, 16 bp, Homo sapiens
aagttctcaatgtgaa

SEQ ID NO: 2104944 - DNA, 15 bp, Homo sapiens
aagttctgagtgttt

SEQ ID NO: 2104945 - DNA, 17 bp, Homo sapiens
aagttgaaatcagaagc

SEQ ID NO: 2104946 - DNA, 14 bp, Homo sapiens
aagttgccaagagt

SEQ ID NO: 2104947 - DNA, 16 bp, Homo sapiens
aagttgggactctgga

SEQ ID NO: 2104948 - DNA, 14 bp, Homo sapiens
aagttgtactgtat

SEQ ID NO: 2104949 - DNA, 18 bp, Homo sapiens
aagttgttcacatatatg

SEQ ID NO: 2104950 - DNA, 13 bp, Homo sapiens
aagtttaaaaaat

SEQ ID NO: 2104951 - DNA, 16 bp, Homo sapiens
aagtttaaaaaataca

SEQ ID NO: 2104952 - DNA, 12 bp, Homo sapiens
aagtttacagta

SEQ ID NO: 2104953 - DNA, 17 bp, Homo sapiens
aagtttattttttctac

SEQ ID NO: 2104954 - DNA, 22 bp, Homo sapiens
aagtttattttttctacacagt

SEQ ID NO: 2104955 - DNA, 22 bp, Homo sapiens
aagtttcccgccaggaggtcct

SEQ ID NO: 2104956 - DNA, 19 bp, Homo sapiens
aagtttctagctagaaata

SEQ ID NO: 2104957 - DNA, 23 bp, Homo sapiens
aagtttctagctagaaatatgat

SEQ ID NO: 2104958 - DNA, 21 bp, Homo sapiens
aagtttgcactgtatgctgga

SEQ ID NO: 2104959 - DNA, 16 bp, Homo sapiens
aagtttgccctggatg

SEQ ID NO: 2104960 - DNA, 14 bp, Homo sapiens
aagtttgtttttaa

SEQ ID NO: 2104961 - DNA, 12 bp, Homo sapiens
aagttttgtata

SEQ ID NO: 2104962 - DNA, 20 bp, Homo sapiens
aagttttgtataaataataa

SEQ ID NO: 2104963 - DNA, 12 bp, Homo sapiens
aagtttttacaa

SEQ ID NO: 2104964 - DNA, 17 bp, Homo sapiens
aagtttttctaacagta

SEQ ID NO: 2104965 - DNA, 20 bp, Homo sapiens
aataaaaaaaagaaatgaaa

SEQ ID NO: 2104966 - DNA, 15 bp, Homo sapiens
aataaaaaaatacag

SEQ ID NO: 2104967 - DNA, 18 bp, Homo sapiens
aataaaaaacatttgtac

SEQ ID NO: 2104968 - DNA, 19 bp, Homo sapiens
aataaaaaacatttgtaca

SEQ ID NO: 2104969 - DNA, 16 bp, Homo sapiens
aataaaaaccagaatc

SEQ ID NO: 2104970 - DNA, 20 bp, Homo sapiens
aataaaaacttcagaaaaac

SEQ ID NO: 2104971 - DNA, 13 bp, Homo sapiens
aataaaaatttgt

SEQ ID NO: 2104972 - DNA, 12 bp, Homo sapiens
aataaaacattc

SEQ ID NO: 2104973 - DNA, 16 bp, Homo sapiens
aataaaacctttcaaa

SEQ ID NO: 2104974 - DNA, 21 bp, Homo sapiens
aataaaacctttcaaatttca

SEQ ID NO: 2104975 - DNA, 12 bp, Homo sapiens
aataaaagtgac

SEQ ID NO: 2104976 - DNA, 13 bp, Homo sapiens
aataaaagtgact

SEQ ID NO: 2104977 - DNA, 21 bp, Homo sapiens
aataaaatagtattgaaagtg

SEQ ID NO: 2104978 - DNA, 14 bp, Homo sapiens
aataaaatgaaaaa

SEQ ID NO: 2104979 - DNA, 13 bp, Homo sapiens
aataaaatgatgt

SEQ ID NO: 2104980 - DNA, 14 bp, Homo sapiens
aataaaatgatgta

SEQ ID NO: 2104981 - DNA, 14 bp, Homo sapiens
aataaaattgtaaa

SEQ ID NO: 2104982 - DNA, 18 bp, Homo sapiens
aataaaattttcaaactt

SEQ ID NO: 2104983 - DNA, 19 bp, Homo sapiens
aataaaattttcaaacttt

SEQ ID NO: 2104984 - DNA, 15 bp, Homo sapiens
aataaacctggagat

SEQ ID NO: 2104985 - DNA, 16 bp, Homo sapiens
aataaactagtttcca

SEQ ID NO: 2104986 - DNA, 11 bp, Homo sapiens
aataaactctc

SEQ ID NO: 2104987 - DNA, 14 bp, Homo sapiens
aataaactctctag

SEQ ID NO: 2104988 - DNA, 19 bp, Homo sapiens
aataaacttagaataaaat

SEQ ID NO: 2104989 - DNA, 21 bp, Homo sapiens
aataaacttagaataaaattg

SEQ ID NO: 2104990 - DNA, 14 bp, Homo sapiens
aataaacttcagca

SEQ ID NO: 2104991 - DNA, 20 bp, Homo sapiens
aataaagaactccttatttt

SEQ ID NO: 2104992 - DNA, 23 bp, Homo sapiens
aataaagaactccttattttgta

SEQ ID NO: 2104993 - DNA, 17 bp, Homo sapiens
aataaagacttcatgtt

SEQ ID NO: 2104994 - DNA, 15 bp, Homo sapiens
aataaagagttagaa

SEQ ID NO: 2104995 - DNA, 19 bp, Homo sapiens
aataaagcctatttttcaa

SEQ ID NO: 2104996 - DNA, 11 bp, Homo sapiens
aataaagctac

SEQ ID NO: 2104997 - DNA, 22 bp, Homo sapiens
aataaagctactgaatttattg

SEQ ID NO: 2104998 - DNA, 14 bp, Homo sapiens
aataaagctgctga

SEQ ID NO: 2104999 - DNA, 23 bp, Homo sapiens
aataaagctggacaagaagctgc

SEQ ID NO: 2105000 - DNA, 16 bp, Homo sapiens
aataaaggtctttgca

SEQ ID NO: 2105001 - DNA, 18 bp, Homo sapiens
aataaaggttgttttgaa

SEQ ID NO: 2105002 - DNA, 17 bp, Homo sapiens
aataaagtatcatgcat

SEQ ID NO: 2105003 - DNA, 19 bp, Homo sapiens
aataaagtatcatgcattc

SEQ ID NO: 2105004 - DNA, 14 bp, Homo sapiens
aataaagtatctac

SEQ ID NO: 2105005 - DNA, 15 bp, Homo sapiens
aataaagtatctaca

SEQ ID NO: 2105006 - DNA, 13 bp, Homo sapiens
aataaagtctgag

SEQ ID NO: 2105007 - DNA, 14 bp, Homo sapiens
aataaagtctgagt

SEQ ID NO: 2105008 - DNA, 19 bp, Homo sapiens
aataaagttggtcttttga

SEQ ID NO: 2105009 - DNA, 13 bp, Homo sapiens
aataaatagattt

SEQ ID NO: 2105010 - DNA, 15 bp, Homo sapiens
aataaatagcctctt

SEQ ID NO: 2105011 - DNA, 17 bp, Homo sapiens
aataaatgcaatatgta

SEQ ID NO: 2105012 - DNA, 19 bp, Homo sapiens
aataaatgcaatatgtatt

SEQ ID NO: 2105013 - DNA, 13 bp, Homo sapiens
aataaatgtcatt

SEQ ID NO: 2105014 - DNA, 21 bp, Homo sapiens
aataaatgtgccttcattttt

SEQ ID NO: 2105015 - DNA, 16 bp, Homo sapiens
acatggagagagactc

SEQ ID NO: 2105016 - DNA, 14 bp, Homo sapiens
acatggatgcacac

SEQ ID NO: 2105017 - DNA, 18 bp, Homo sapiens
acatggatgcacgcacat

SEQ ID NO: 2105018 - DNA, 14 bp, Homo sapiens
acatggccagtgtg

SEQ ID NO: 2105019 - DNA, 17 bp, Homo sapiens
acatggcctatgcacat

SEQ ID NO: 2105020 - DNA, 11 bp, Homo sapiens
acatggggcat

SEQ ID NO: 2105021 - DNA, 19 bp, Homo sapiens
acatggggcatagaaactg

SEQ ID NO: 2105022 - DNA, 16 bp, Homo sapiens
acatggggttttcaat

SEQ ID NO: 2105023 - DNA, 13 bp, Homo sapiens
acatggtattgta

SEQ ID NO: 2105024 - DNA, 22 bp, Homo sapiens
acatggtgttgtatacttcatt

SEQ ID NO: 2105025 - DNA, 17 bp, Homo sapiens
acatgtaacatagattt

SEQ ID NO: 2105026 - DNA, 13 bp, Homo sapiens
acatgtactccag

SEQ ID NO: 2105027 - DNA, 15 bp, Homo sapiens
acatgtactccagag

SEQ ID NO: 2105028 - DNA, 19 bp, Homo sapiens
acatgtataatatttttaa

SEQ ID NO: 2105029 - DNA, 21 bp, Homo sapiens
acatgtcctatccaaaggaat

SEQ ID NO: 2105030 - DNA, 21 bp, Homo sapiens
acatgtgacacatatgcacct

SEQ ID NO: 2105031 - DNA, 23 bp, Homo sapiens
acatgtgagcatggtcacaagca

SEQ ID NO: 2105032 - DNA, 18 bp, Homo sapiens
acatgtgcacatgcacgt

SEQ ID NO: 2105033 - DNA, 13 bp, Homo sapiens
acatgtggtttat

SEQ ID NO: 2105034 - DNA, 18 bp, Homo sapiens
acatgtgtagcctgtgca

SEQ ID NO: 2105035 - DNA, 23 bp, Homo sapiens
acatgtgtctgtgtggtatattt

SEQ ID NO: 2105036 - DNA, 14 bp, Homo sapiens
acatgtgtgtatat

SEQ ID NO: 2105037 - DNA, 15 bp, Homo sapiens
acatgtgtgtatata

SEQ ID NO: 2105038 - DNA, 17 bp, Homo sapiens
acatgtgtgtatatatg

SEQ ID NO: 2105039 - DNA, 12 bp, Homo sapiens
acatgtgtttta

SEQ ID NO: 2105040 - DNA, 19 bp, Homo sapiens
acatgtttaaattgtaaat

SEQ ID NO: 2105041 - DNA, 21 bp, Homo sapiens
acatgtttacttttcagggca

SEQ ID NO: 2105042 - DNA, 20 bp, Homo sapiens
acatgtttcacaacaggcat

SEQ ID NO: 2105043 - DNA, 18 bp, Homo sapiens
acattaaaagaagactgg

SEQ ID NO: 2105044 - DNA, 20 bp, Homo sapiens
acattaaaagaagactggaa

SEQ ID NO: 2105045 - DNA, 18 bp, Homo sapiens
acattaaacactgtaatc

SEQ ID NO: 2105046 - DNA, 17 bp, Homo sapiens
acattaaatgtcttata

SEQ ID NO: 2105047 - DNA, 15 bp, Homo sapiens
acattaactcattag

SEQ ID NO: 2105048 - DNA, 22 bp, Homo sapiens
acattaactcattagactggaa

SEQ ID NO: 2105049 - DNA, 20 bp, Homo sapiens
acattaagattgaggcctgc

SEQ ID NO: 2105050 - DNA, 15 bp, Homo sapiens
acattaagtggcttt

SEQ ID NO: 2105051 - DNA, 17 bp, Homo sapiens
acattaatggtctaaaa

SEQ ID NO: 2105052 - DNA, 20 bp, Homo sapiens
acattaatggtctaaaaata

SEQ ID NO: 2105053 - DNA, 14 bp, Homo sapiens
acattacttgcaca

SEQ ID NO: 2105054 - DNA, 16 bp, Homo sapiens
acattacttgcacaag

SEQ ID NO: 2105055 - DNA, 22 bp, Homo sapiens
acattagcagtttgctttgtat

SEQ ID NO: 2105056 - DNA, 19 bp, Homo sapiens
acattaggaacagagtata

SEQ ID NO: 2105057 - DNA, 18 bp, Homo sapiens
acattatcgggagcagtg

SEQ ID NO: 2105058 - DNA, 21 bp, Homo sapiens
acattatcgggagcagtgtct

SEQ ID NO: 2105059 - DNA, 14 bp, Homo sapiens
acattatgtgtgca

SEQ ID NO: 2105060 - DNA, 19 bp, Homo sapiens
acattatgtgtgcatgtgt

SEQ ID NO: 2105061 - DNA, 20 bp, Homo sapiens
acattatgtgtgcatgtgtg

SEQ ID NO: 2105062 - DNA, 21 bp, Homo sapiens
acattatgtgtgcatgtgtgt

SEQ ID NO: 2105063 - DNA, 22 bp, Homo sapiens
acattatgtgtgcatgtgtgta

SEQ ID NO: 2105064 - DNA, 22 bp, Homo sapiens
acaagcaacataaaacaatgaa

SEQ ID NO: 2105065 - DNA, 14 bp, Homo sapiens
acaagcaataatta

SEQ ID NO: 2105066 - DNA, 19 bp, Homo sapiens
acaagcacagttttaagag

SEQ ID NO: 2105067 - DNA, 17 bp, Homo sapiens
acaagcatatttgagaa

SEQ ID NO: 2105068 - DNA, 20 bp, Homo sapiens
acaagcatttcccccaggga

SEQ ID NO: 2105069 - DNA, 12 bp, Homo sapiens
acaagccacaga

SEQ ID NO: 2105070 - DNA, 11 bp, Homo sapiens
acaagccctgg

SEQ ID NO: 2105071 - DNA, 13 bp, Homo sapiens
acaagccctggca

SEQ ID NO: 2105072 - DNA, 20 bp, Homo sapiens
acaagccttactcacctctc

SEQ ID NO: 2105073 - DNA, 17 bp, Homo sapiens
acaagcgtgagccactg

SEQ ID NO: 2105074 - DNA, 18 bp, Homo sapiens
acaagcttgtatatacat

SEQ ID NO: 2105075 - DNA, 24 bp, Homo sapiens
acaaggaaccaccgaagaggaagc

SEQ ID NO: 2105076 - DNA, 22 bp, Homo sapiens
acaaggaccctgttttccacac

SEQ ID NO: 2105077 - DNA, 17 bp, Homo sapiens
acaaggattgctactgt

SEQ ID NO: 2105078 - DNA, 13 bp, Homo sapiens
acaaggctgggca

SEQ ID NO: 2105079 - DNA, 21 bp, Homo sapiens
acaaggggctgttacataaca

SEQ ID NO: 2105080 - DNA, 20 bp, Homo sapiens
acaagggtctagggagagac

SEQ ID NO: 2105081 - DNA, 21 bp, Homo sapiens
acaaggtacccctttctggct

SEQ ID NO: 2105082 - DNA, 13 bp, Homo sapiens
acaaggtagacat

SEQ ID NO: 2105083 - DNA, 19 bp, Homo sapiens
acaaggttccctctgagaa

SEQ ID NO: 2105084 - DNA, 18 bp, Homo sapiens
acaaggttcttctaaaat

SEQ ID NO: 2105085 - DNA, 14 bp, Homo sapiens
acaagtatttgtta

SEQ ID NO: 2105086 - DNA, 20 bp, Homo sapiens
acaagtatttgttaatttag

SEQ ID NO: 2105087 - DNA, 14 bp, Homo sapiens
acaagtcacagctg

SEQ ID NO: 2105088 - DNA, 16 bp, Homo sapiens
acaagtcacagctgca

SEQ ID NO: 2105089 - DNA, 23 bp, Homo sapiens
acaagtcattttaactttatcac

SEQ ID NO: 2105090 - DNA, 19 bp, Homo sapiens
acaagtgtatatcagaaaa

SEQ ID NO: 2105091 - DNA, 17 bp, Homo sapiens
acaagttatttaaatct

SEQ ID NO: 2105092 - DNA, 22 bp, Homo sapiens
acaagttatttaaatctgtttt

SEQ ID NO: 2105093 - DNA, 12 bp, Homo sapiens
acaagttttgta

SEQ ID NO: 2105094 - DNA, 13 bp, Homo sapiens
acaagttttgtat

SEQ ID NO: 2105095 - DNA, 13 bp, Homo sapiens
acaataaaacatt

SEQ ID NO: 2105096 - DNA, 13 bp, Homo sapiens
acaataaagagct

SEQ ID NO: 2105097 - DNA, 16 bp, Homo sapiens
acaataaagagctcaa

SEQ ID NO: 2105098 - DNA, 13 bp, Homo sapiens
acaataaatattc

SEQ ID NO: 2105099 - DNA, 16 bp, Homo sapiens
acaataaatattctgc

SEQ ID NO: 2105100 - DNA, 22 bp, Homo sapiens
acaataaatattctgcatggaa

SEQ ID NO: 2105101 - DNA, 18 bp, Homo sapiens
acaataataaatcctcag

SEQ ID NO: 2105102 - DNA, 17 bp, Homo sapiens
acaataatgagttcact

SEQ ID NO: 2105103 - DNA, 19 bp, Homo sapiens
acaataattaatgtgtgtc

SEQ ID NO: 2105104 - DNA, 13 bp, Homo sapiens
acaataatttcag

SEQ ID NO: 2105105 - DNA, 17 bp, Homo sapiens
acaatacaacaagaaca

SEQ ID NO: 2105106 - DNA, 12 bp, Homo sapiens
acaatagctatt

SEQ ID NO: 2105107 - DNA, 18 bp, Homo sapiens
acaatagctattgcatgt

SEQ ID NO: 2105108 - DNA, 20 bp, Homo sapiens
acaatagctattgcatgtaa

SEQ ID NO: 2105109 - DNA, 10 bp, Homo sapiens
acaatatata

SEQ ID NO: 2105110 - DNA, 16 bp, Homo sapiens
acaatatataaaaata

SEQ ID NO: 2105111 - DNA, 18 bp, Homo sapiens
acaatatataaaaatata

SEQ ID NO: 2105112 - DNA, 15 bp, Homo sapiens
acaatatgaatacag

SEQ ID NO: 2105113 - DNA, 18 bp, Homo sapiens
acaatatttaaaatttat

SEQ ID NO: 2105114 - DNA, 17 bp, Homo sapiens
acaatattttgtggctt

SEQ ID NO: 2105115 - DNA, 13 bp, Homo sapiens
acaatccactctc

SEQ ID NO: 2105116 - DNA, 14 bp, Homo sapiens
acaatccactctca

SEQ ID NO: 2105117 - DNA, 15 bp, Homo sapiens
acaatccactctcag

SEQ ID NO: 2105118 - DNA, 13 bp, Homo sapiens
acaatcctgaaga

SEQ ID NO: 2105119 - DNA, 12 bp, Homo sapiens
acaatctcaaat

SEQ ID NO: 2105120 - DNA, 16 bp, Homo sapiens
acaatctgggactttc

SEQ ID NO: 2105121 - DNA, 21 bp, Homo sapiens
acaatgaaggaaaacctcact

SEQ ID NO: 2105122 - DNA, 18 bp, Homo sapiens
acaatgcaatgaaacaga

SEQ ID NO: 2105123 - DNA, 14 bp, Homo sapiens
acaatgcagaattt

SEQ ID NO: 2105124 - DNA, 14 bp, Homo sapiens
acaatgcctctccc

SEQ ID NO: 2105125 - DNA, 15 bp, Homo sapiens
acaatgcctctccca

SEQ ID NO: 2105126 - DNA, 15 bp, Homo sapiens
acaatggtttacatg

SEQ ID NO: 2105127 - DNA, 20 bp, Homo sapiens
acaatgtatgtgaaagtgta

SEQ ID NO: 2105128 - DNA, 21 bp, Homo sapiens
acaatgtgggcgtttgtaaat

SEQ ID NO: 2105129 - DNA, 16 bp, Homo sapiens
acaatgttctgttgta

SEQ ID NO: 2105130 - DNA, 17 bp, Homo sapiens
acaatgttctgttgtaa

SEQ ID NO: 2105131 - DNA, 22 bp, Homo sapiens
acaatgttctgttgtaaagagt

SEQ ID NO: 2105132 - DNA, 17 bp, Homo sapiens
acaatgtttaaaccttt

SEQ ID NO: 2105133 - DNA, 20 bp, Homo sapiens
acaattaaacagccaaataa

SEQ ID NO: 2105134 - DNA, 17 bp, Homo sapiens
acaattattgtacacta

SEQ ID NO: 2105135 - DNA, 20 bp, Homo sapiens
acaattcacttcattgacca

SEQ ID NO: 2105136 - DNA, 18 bp, Homo sapiens
acaattccaaaggaatct

SEQ ID NO: 2105137 - DNA, 19 bp, Homo sapiens
acaattgaacttaaataaa

SEQ ID NO: 2105138 - DNA, 16 bp, Homo sapiens
acaattgatacttcag

SEQ ID NO: 2105139 - DNA, 17 bp, Homo sapiens
acaattgatacttcagg

SEQ ID NO: 2105140 - DNA, 18 bp, Homo sapiens
acaattgatacttcaggt

SEQ ID NO: 2105141 - DNA, 22 bp, Homo sapiens
acaattgatacttcaggtgctt

SEQ ID NO: 2105142 - DNA, 21 bp, Homo sapiens
acaattgtttggggttgaaaa

SEQ ID NO: 2105143 - DNA, 17 bp, Homo sapiens
acaatttagaaaacatt

SEQ ID NO: 2105144 - DNA, 23 bp, Homo sapiens
acaatttagaaaacattcatcca

SEQ ID NO: 2105145 - DNA, 23 bp, Homo sapiens
acaatttcctttatatttagtga

SEQ ID NO: 2105146 - DNA, 16 bp, Homo sapiens
acaatttgagcaattc

SEQ ID NO: 2105147 - DNA, 15 bp, Homo sapiens
acaatttgcactgtt

SEQ ID NO: 2105148 - DNA, 19 bp, Homo sapiens
acacaaaagtttctctttt

SEQ ID NO: 2105149 - DNA, 20 bp, Homo sapiens
acacaaaccacaactgacac

SEQ ID NO: 2105150 - DNA, 22 bp, Homo sapiens
acacaaagagaaaaagaaatgc

SEQ ID NO: 2105151 - DNA, 19 bp, Homo sapiens
acagccgctcctgtctgcc

SEQ ID NO: 2105152 - DNA, 20 bp, Homo sapiens
acagccgctcctgtctgcca

SEQ ID NO: 2105153 - DNA, 19 bp, Homo sapiens
acagccgtcagccaaatgt

SEQ ID NO: 2105154 - DNA, 18 bp, Homo sapiens
acagcctcacttgaatgt

SEQ ID NO: 2105155 - DNA, 12 bp, Homo sapiens
acagcctcagaa

SEQ ID NO: 2105156 - DNA, 14 bp, Homo sapiens
acagcctggcacag

SEQ ID NO: 2105157 - DNA, 19 bp, Homo sapiens
acagcctgggaccagggca

SEQ ID NO: 2105158 - DNA, 20 bp, Homo sapiens
acagcctgggaccagggcat

SEQ ID NO: 2105159 - DNA, 20 bp, Homo sapiens
acagcctgtggcggtgcctg

SEQ ID NO: 2105160 - DNA, 15 bp, Homo sapiens
acagcgagaggcaga

SEQ ID NO: 2105161 - DNA, 14 bp, Homo sapiens
acagcgcgggcgga

SEQ ID NO: 2105162 - DNA, 17 bp, Homo sapiens
acagcgcgggcggaggc

SEQ ID NO: 2105163 - DNA, 22 bp, Homo sapiens
acagcggaggagaccagctcag

SEQ ID NO: 2105164 - DNA, 15 bp, Homo sapiens
acagctaatgggaca

SEQ ID NO: 2105165 - DNA, 17 bp, Homo sapiens
acagctcacctctgaag

SEQ ID NO: 2105166 - DNA, 15 bp, Homo sapiens
acagctcccacccca

SEQ ID NO: 2105167 - DNA, 16 bp, Homo sapiens
acagctcccaccccac

SEQ ID NO: 2105168 - DNA, 18 bp, Homo sapiens
acagctcccaccccaccc

SEQ ID NO: 2105169 - DNA, 12 bp, Homo sapiens
acagctccttct

SEQ ID NO: 2105170 - DNA, 18 bp, Homo sapiens
acagctcttctccaggct

SEQ ID NO: 2105171 - DNA, 20 bp, Homo sapiens
acagctcttggcattttcct

SEQ ID NO: 2105172 - DNA, 18 bp, Homo sapiens
acagctgcagctgggccc

SEQ ID NO: 2105173 - DNA, 14 bp, Homo sapiens
acagctgctgaaga

SEQ ID NO: 2105174 - DNA, 18 bp, Homo sapiens
acagctgctgaagaggca

SEQ ID NO: 2105175 - DNA, 18 bp, Homo sapiens
acagctgcttgtcctgct

SEQ ID NO: 2105176 - DNA, 13 bp, Homo sapiens
acagctggctgct

SEQ ID NO: 2105177 - DNA, 16 bp, Homo sapiens
acagctggctgctgac

SEQ ID NO: 2105178 - DNA, 17 bp, Homo sapiens
acagctggctgctgaca

SEQ ID NO: 2105179 - DNA, 14 bp, Homo sapiens
acagctgtccctgt

SEQ ID NO: 2105180 - DNA, 13 bp, Homo sapiens
acagctgtgcctc

SEQ ID NO: 2105181 - DNA, 16 bp, Homo sapiens
acagctgtgcctcgct

SEQ ID NO: 2105182 - DNA, 14 bp, Homo sapiens
acagctgtttaaga

SEQ ID NO: 2105183 - DNA, 15 bp, Homo sapiens
acagctgtttaagat

SEQ ID NO: 2105184 - DNA, 14 bp, Homo sapiens
acagcttgaccaga

SEQ ID NO: 2105185 - DNA, 19 bp, Homo sapiens
acagctttacaacttccat

SEQ ID NO: 2105186 - DNA, 14 bp, Homo sapiens
acaggaaaaaaaat

SEQ ID NO: 2105187 - DNA, 17 bp, Homo sapiens
acaggaaaagctgctga

SEQ ID NO: 2105188 - DNA, 16 bp, Homo sapiens
acaggaaaatcctctg

SEQ ID NO: 2105189 - DNA, 18 bp, Homo sapiens
acaggaaagccctccccc

SEQ ID NO: 2105190 - DNA, 23 bp, Homo sapiens
acaggaagcccaaggcagtgttc

SEQ ID NO: 2105191 - DNA, 14 bp, Homo sapiens
acaggaatctcaga

SEQ ID NO: 2105192 - DNA, 19 bp, Homo sapiens
acaggacacctggccgcct

SEQ ID NO: 2105193 - DNA, 20 bp, Homo sapiens
acaggacagtgcttcagcct

SEQ ID NO: 2105194 - DNA, 14 bp, Homo sapiens
acaggaccagattt

SEQ ID NO: 2105195 - DNA, 18 bp, Homo sapiens
acaggactaacactcaga

SEQ ID NO: 2105196 - DNA, 21 bp, Homo sapiens
acaggactaacactcagaagc

SEQ ID NO: 2105197 - DNA, 22 bp, Homo sapiens
acaggactaacactcagaagcc

SEQ ID NO: 2105198 - DNA, 23 bp, Homo sapiens
acaggactaacactcagaagcct

SEQ ID NO: 2105199 - DNA, 14 bp, Homo sapiens
acaggactctgcct

SEQ ID NO: 2105200 - DNA, 13 bp, Homo sapiens
acaggagcagaca

SEQ ID NO: 2105201 - DNA, 19 bp, Homo sapiens
acaggagcagacagagaaa

SEQ ID NO: 2105202 - DNA, 20 bp, Homo sapiens
acaggagggggtcgtggaga

SEQ ID NO: 2105203 - DNA, 17 bp, Homo sapiens
acaggaggttgtggatg

SEQ ID NO: 2105204 - DNA, 21 bp, Homo sapiens
acaggatcctattctcaccag

SEQ ID NO: 2105205 - DNA, 18 bp, Homo sapiens
acaggcaactgaggcaga

SEQ ID NO: 2105206 - DNA, 12 bp, Homo sapiens
acaggcaagcac

SEQ ID NO: 2105207 - DNA, 20 bp, Homo sapiens
acaggcaagcacctcctgcc

SEQ ID NO: 2105208 - DNA, 15 bp, Homo sapiens
acaggcaatgctggc

SEQ ID NO: 2105209 - DNA, 16 bp, Homo sapiens
acaggcaatgctggct

SEQ ID NO: 2105210 - DNA, 12 bp, Homo sapiens
acaggcaattcc

SEQ ID NO: 2105211 - DNA, 13 bp, Homo sapiens
acaggcaattccg

SEQ ID NO: 2105212 - DNA, 15 bp, Homo sapiens
acaggcaggaagaga

SEQ ID NO: 2105213 - DNA, 17 bp, Homo sapiens
acaggcaggaagagaga

SEQ ID NO: 2105214 - DNA, 18 bp, Homo sapiens
acaggcaggaagagagag

SEQ ID NO: 2105215 - DNA, 19 bp, Homo sapiens
acaggcaggaagagagaga

SEQ ID NO: 2105216 - DNA, 14 bp, Homo sapiens
acaggcaggtccag

SEQ ID NO: 2105217 - DNA, 16 bp, Homo sapiens
acaggcaggtccaggg

SEQ ID NO: 2105218 - DNA, 21 bp, Homo sapiens
acaggcatctacacagcctgg

SEQ ID NO: 2105219 - DNA, 22 bp, Homo sapiens
acaggcatctacacagcctgga

SEQ ID NO: 2105220 - DNA, 14 bp, Homo sapiens
acaggcatgttctc

SEQ ID NO: 2105221 - DNA, 17 bp, Homo sapiens
acaggcatttcctgggt

SEQ ID NO: 2105222 - DNA, 12 bp, Homo sapiens
acaggccagccc

SEQ ID NO: 2105223 - DNA, 14 bp, Homo sapiens
acaggccagcccca

SEQ ID NO: 2105224 - DNA, 15 bp, Homo sapiens
acaggccagccccat

SEQ ID NO: 2105225 - DNA, 17 bp, Homo sapiens
acaggccagccccatct

SEQ ID NO: 2105226 - DNA, 18 bp, Homo sapiens
acaggcccaagagatgaa

SEQ ID NO: 2105227 - DNA, 12 bp, Homo sapiens
acataacaagaa

SEQ ID NO: 2105228 - DNA, 15 bp, Homo sapiens
acataacaagaaaat

SEQ ID NO: 2105229 - DNA, 16 bp, Homo sapiens
acataactagtttaat

SEQ ID NO: 2105230 - DNA, 20 bp, Homo sapiens
acataactagtttaattaac

SEQ ID NO: 2105231 - DNA, 18 bp, Homo sapiens
acataacttgatatagaa

SEQ ID NO: 2105232 - DNA, 16 bp, Homo sapiens
acataatataagaatc

SEQ ID NO: 2105233 - DNA, 17 bp, Homo sapiens
acataatataagaatca

SEQ ID NO: 2105234 - DNA, 17 bp, Homo sapiens
acataatatcttgaaga

SEQ ID NO: 2105235 - DNA, 22 bp, Homo sapiens
acataatatcttgaagaatatt

SEQ ID NO: 2105236 - DNA, 17 bp, Homo sapiens
acataattatccaggaa

SEQ ID NO: 2105237 - DNA, 18 bp, Homo sapiens
acatacaacacaaagaga

SEQ ID NO: 2105238 - DNA, 12 bp, Homo sapiens
acatacaatttg

SEQ ID NO: 2105239 - DNA, 13 bp, Homo sapiens
acatacacataca

SEQ ID NO: 2105240 - DNA, 19 bp, Homo sapiens
acatacacttgtataaatg

SEQ ID NO: 2105241 - DNA, 12 bp, Homo sapiens
acatacatacat

SEQ ID NO: 2105242 - DNA, 17 bp, Homo sapiens
acatacatacatacata

SEQ ID NO: 2105243 - DNA, 18 bp, Homo sapiens
acatacatacatatatat

SEQ ID NO: 2105244 - DNA, 12 bp, Homo sapiens
acatacatatat

SEQ ID NO: 2105245 - DNA, 17 bp, Homo sapiens
acatacatatatatctg

SEQ ID NO: 2105246 - DNA, 14 bp, Homo sapiens
acatactagaaagc

SEQ ID NO: 2105247 - DNA, 12 bp, Homo sapiens
acatactcattt

SEQ ID NO: 2105248 - DNA, 13 bp, Homo sapiens
acatactcatttt

SEQ ID NO: 2105249 - DNA, 17 bp, Homo sapiens
acatacttcaaaaatgt

SEQ ID NO: 2105250 - DNA, 16 bp, Homo sapiens
acatagaaattgcctg

SEQ ID NO: 2105251 - DNA, 16 bp, Homo sapiens
acatagacagaagaaa

SEQ ID NO: 2105252 - DNA, 15 bp, Homo sapiens
acatagatggaccag

SEQ ID NO: 2105253 - DNA, 23 bp, Homo sapiens
acatagatgtatcattaatgtag

SEQ ID NO: 2105254 - DNA, 14 bp, Homo sapiens
acatagattaatgg

SEQ ID NO: 2105255 - DNA, 20 bp, Homo sapiens
acataggcaatatctttaat

SEQ ID NO: 2105256 - DNA, 16 bp, Homo sapiens
acatagtcacaaaaat

SEQ ID NO: 2105257 - DNA, 21 bp, Homo sapiens
acatagtgatggttcccctgt

SEQ ID NO: 2105258 - DNA, 15 bp, Homo sapiens
acatagttatttatt

SEQ ID NO: 2105259 - DNA, 22 bp, Homo sapiens
acatataaaagttaaactactt

SEQ ID NO: 2105260 - DNA, 14 bp, Homo sapiens
acatatacatatat

SEQ ID NO: 2105261 - DNA, 16 bp, Homo sapiens
acatatacatatatat

SEQ ID NO: 2105262 - DNA, 21 bp, Homo sapiens
acatatacctataatgtgtgt

SEQ ID NO: 2105263 - DNA, 15 bp, Homo sapiens
acatatatatataca

SEQ ID NO: 2105264 - DNA, 13 bp, Homo sapiens
acatatatatgcc

SEQ ID NO: 2105265 - DNA, 17 bp, Homo sapiens
acatatcaattcaacac

SEQ ID NO: 2105266 - DNA, 14 bp, Homo sapiens
acatatcagaaaag

SEQ ID NO: 2105267 - DNA, 19 bp, Homo sapiens
acatatcagaaaagtagaa

SEQ ID NO: 2105268 - DNA, 20 bp, Homo sapiens
acatatcagaaaagtagaat

SEQ ID NO: 2105269 - DNA, 22 bp, Homo sapiens
acatatcagaaaagtagaatta

SEQ ID NO: 2105270 - DNA, 18 bp, Homo sapiens
acatatggaaatcctgtt

SEQ ID NO: 2105271 - DNA, 19 bp, Homo sapiens
acatatggaaatcctgtta

SEQ ID NO: 2105272 - DNA, 20 bp, Homo sapiens
acatatgtagactatataca

SEQ ID NO: 2105273 - DNA, 13 bp, Homo sapiens
acctcccacccca

SEQ ID NO: 2105274 - DNA, 17 bp, Homo sapiens
acctcccaccccactcc

SEQ ID NO: 2105275 - DNA, 20 bp, Homo sapiens
acctcccaccccactccagc

SEQ ID NO: 2105276 - DNA, 21 bp, Homo sapiens
acctcccagccctatggatgt

SEQ ID NO: 2105277 - DNA, 23 bp, Homo sapiens
acctccccacccccgctgggggt

SEQ ID NO: 2105278 - DNA, 16 bp, Homo sapiens
acctccccccactgca

SEQ ID NO: 2105279 - DNA, 20 bp, Homo sapiens
acctcccctatccacccagc

SEQ ID NO: 2105280 - DNA, 13 bp, Homo sapiens
acctcccctgcca

SEQ ID NO: 2105281 - DNA, 15 bp, Homo sapiens
acctcccctgccagg

SEQ ID NO: 2105282 - DNA, 20 bp, Homo sapiens
acctcccctgccagggctcg

SEQ ID NO: 2105283 - DNA, 23 bp, Homo sapiens
acctcccctgccagggctcgggc

SEQ ID NO: 2105284 - DNA, 14 bp, Homo sapiens
acctccctactccc

SEQ ID NO: 2105285 - DNA, 20 bp, Homo sapiens
acctccctgaaccatccctg

SEQ ID NO: 2105286 - DNA, 13 bp, Homo sapiens
acctccctgccct

SEQ ID NO: 2105287 - DNA, 18 bp, Homo sapiens
acctccctgccctgtcct

SEQ ID NO: 2105288 - DNA, 22 bp, Homo sapiens
acctccctgccctgtcctccag

SEQ ID NO: 2105289 - DNA, 19 bp, Homo sapiens
acctccgccccagacacac

SEQ ID NO: 2105290 - DNA, 21 bp, Homo sapiens
acctccgccccagacacaccc

SEQ ID NO: 2105291 - DNA, 19 bp, Homo sapiens
acctccggggagagcagag

SEQ ID NO: 2105292 - DNA, 17 bp, Homo sapiens
acctcctatccttggag

SEQ ID NO: 2105293 - DNA, 13 bp, Homo sapiens
acctcctccactc

SEQ ID NO: 2105294 - DNA, 19 bp, Homo sapiens
acctcctccactcactcca

SEQ ID NO: 2105295 - DNA, 21 bp, Homo sapiens
acctcctgagaaggcgaggag

SEQ ID NO: 2105296 - DNA, 19 bp, Homo sapiens
acctcctgcccaggagagc

SEQ ID NO: 2105297 - DNA, 23 bp, Homo sapiens
acctccttcctcagtcctggaag

SEQ ID NO: 2105298 - DNA, 14 bp, Homo sapiens
acctcgaggctctt

SEQ ID NO: 2105299 - DNA, 18 bp, Homo sapiens
acctcgtcctccccctgc

SEQ ID NO: 2105300 - DNA, 22 bp, Homo sapiens
acctcgtcctccccctgccagt

SEQ ID NO: 2105301 - DNA, 12 bp, Homo sapiens
acctctcaatat

SEQ ID NO: 2105302 - DNA, 20 bp, Homo sapiens
acctctcaatattcaataaa

SEQ ID NO: 2105303 - DNA, 23 bp, Homo sapiens
acctctcaatattcaataaagct

SEQ ID NO: 2105304 - DNA, 17 bp, Homo sapiens
acctctcccctggaact

SEQ ID NO: 2105305 - DNA, 13 bp, Homo sapiens
acctctccttgga

SEQ ID NO: 2105306 - DNA, 14 bp, Homo sapiens
acctctccttggaa

SEQ ID NO: 2105307 - DNA, 20 bp, Homo sapiens
acctctcctttggccattcc

SEQ ID NO: 2105308 - DNA, 15 bp, Homo sapiens
acctctctaagccac

SEQ ID NO: 2105309 - DNA, 20 bp, Homo sapiens
acctctctaagccacagctt

SEQ ID NO: 2105310 - DNA, 17 bp, Homo sapiens
acctctctctatatata

SEQ ID NO: 2105311 - DNA, 13 bp, Homo sapiens
acctctcttcagc

SEQ ID NO: 2105312 - DNA, 14 bp, Homo sapiens
acctctctttttca

SEQ ID NO: 2105313 - DNA, 13 bp, Homo sapiens
acctctgaaggca

SEQ ID NO: 2105314 - DNA, 15 bp, Homo sapiens
acctctgatacctca

SEQ ID NO: 2105315 - DNA, 14 bp, Homo sapiens
acctctgatccctc

SEQ ID NO: 2105316 - DNA, 12 bp, Homo sapiens
acctctgcctca

SEQ ID NO: 2105317 - DNA, 15 bp, Homo sapiens
acctctgcctcaatg

SEQ ID NO: 2105318 - DNA, 23 bp, Homo sapiens
acctctgcctgaagtcacacagt

SEQ ID NO: 2105319 - DNA, 14 bp, Homo sapiens
acctctgctctgag

SEQ ID NO: 2105320 - DNA, 14 bp, Homo sapiens
accttcagaataag

SEQ ID NO: 2105321 - DNA, 13 bp, Homo sapiens
accttcccagctc

SEQ ID NO: 2105322 - DNA, 18 bp, Homo sapiens
accttcccagctctccct

SEQ ID NO: 2105323 - DNA, 14 bp, Homo sapiens
accttccccagact

SEQ ID NO: 2105324 - DNA, 16 bp, Homo sapiens
accttccccagactca

SEQ ID NO: 2105325 - DNA, 20 bp, Homo sapiens
accttccccagactcagctc

SEQ ID NO: 2105326 - DNA, 9 bp, Homo sapiens
accttccct

SEQ ID NO: 2105327 - DNA, 11 bp, Homo sapiens
accttcctgcc

SEQ ID NO: 2105328 - DNA, 14 bp, Homo sapiens
accttctccaaatg

SEQ ID NO: 2105329 - DNA, 16 bp, Homo sapiens
accttctctatatcat

SEQ ID NO: 2105330 - DNA, 16 bp, Homo sapiens
accttctgacctcccc

SEQ ID NO: 2105331 - DNA, 21 bp, Homo sapiens
accttctgacctccccacccc

SEQ ID NO: 2105332 - DNA, 18 bp, Homo sapiens
accttctggttgcttcag

SEQ ID NO: 2105333 - DNA, 19 bp, Homo sapiens
accttcttcagccacctct

SEQ ID NO: 2105334 - DNA, 20 bp, Homo sapiens
accttcttcagccacctctc

SEQ ID NO: 2105335 - DNA, 14 bp, Homo sapiens
accttcttggcttc

SEQ ID NO: 2105336 - DNA, 16 bp, Homo sapiens
accttcttggcttctg

SEQ ID NO: 2105337 - DNA, 19 bp, Homo sapiens
accttcttggcttctggga

SEQ ID NO: 2105338 - DNA, 16 bp, Homo sapiens
accttgacagggcaca

SEQ ID NO: 2105339 - DNA, 11 bp, Homo sapiens
accttgcagca

SEQ ID NO: 2105340 - DNA, 20 bp, Homo sapiens
accttgctcttctttctgag

SEQ ID NO: 2105341 - DNA, 16 bp, Homo sapiens
accttggactcctccc

SEQ ID NO: 2105342 - DNA, 12 bp, Homo sapiens
accttggctgca

SEQ ID NO: 2105343 - DNA, 14 bp, Homo sapiens
accttggctgcagg

SEQ ID NO: 2105344 - DNA, 16 bp, Homo sapiens
accttgtcatgtacca

SEQ ID NO: 2105345 - DNA, 15 bp, Homo sapiens
accttgtgtctgtac

SEQ ID NO: 2105346 - DNA, 18 bp, Homo sapiens
accttgtgtctgtacacg

SEQ ID NO: 2105347 - DNA, 21 bp, Homo sapiens
accttgtgtctgtacacgtgt

SEQ ID NO: 2105348 - DNA, 20 bp, Homo sapiens
acctttaaagtaaaggcctc

SEQ ID NO: 2105349 - DNA, 16 bp, Homo sapiens
acctttaagtcctctc

SEQ ID NO: 2105350 - DNA, 15 bp, Homo sapiens
acctttacataattg

SEQ ID NO: 2105351 - DNA, 16 bp, Homo sapiens
acctttacataattgc

SEQ ID NO: 2105352 - DNA, 15 bp, Homo sapiens
acctttcccatgctg

SEQ ID NO: 2105353 - DNA, 13 bp, Homo sapiens
acctttccctcac

SEQ ID NO: 2105354 - DNA, 17 bp, Homo sapiens
acctttccctcaccccc

SEQ ID NO: 2105355 - DNA, 21 bp, Homo sapiens
acctttccgctgtcgccccag

SEQ ID NO: 2105356 - DNA, 20 bp, Homo sapiens
acctttcttcaccaaatctt

SEQ ID NO: 2105357 - DNA, 17 bp, Homo sapiens
acctttgtccaggcctg

SEQ ID NO: 2105358 - DNA, 18 bp, Homo sapiens
acctttgttttgcactga

SEQ ID NO: 2105359 - DNA, 13 bp, Homo sapiens
accttttatacca

SEQ ID NO: 2105360 - DNA, 15 bp, Homo sapiens
accttttatccactt

SEQ ID NO: 2105361 - DNA, 22 bp, Homo sapiens
accttttccaggagttctgaag

SEQ ID NO: 2105362 - DNA, 16 bp, Homo sapiens
accttttctgttgtac

SEQ ID NO: 2105363 - DNA, 17 bp, Homo sapiens
acctttttttctctcct

SEQ ID NO: 2105364 - DNA, 19 bp, Homo sapiens
acgaaacacaaaccacaac

SEQ ID NO: 2105365 - DNA, 13 bp, Homo sapiens
acgaaatgttatt

SEQ ID NO: 2105366 - DNA, 14 bp, Homo sapiens
acgaacaggggcca

SEQ ID NO: 2105367 - DNA, 15 bp, Homo sapiens
acgaacccacctgct

SEQ ID NO: 2105368 - DNA, 16 bp, Homo sapiens
acgaacccacctgctg

SEQ ID NO: 2105369 - DNA, 21 bp, Homo sapiens
acgaacccctcccctcccccc

SEQ ID NO: 2105370 - DNA, 17 bp, Homo sapiens
acgaagccatctttctt

SEQ ID NO: 2105371 - DNA, 22 bp, Homo sapiens
acgaaggggccccggggctggc

SEQ ID NO: 2105372 - DNA, 22 bp, Homo sapiens
acgacaaagccaaactctgcca

SEQ ID NO: 2105373 - DNA, 17 bp, Homo sapiens
acgactccgagaacaac

SEQ ID NO: 2105374 - DNA, 11 bp, Homo sapiens
acgactcttcc

SEQ ID NO: 2105375 - DNA, 13 bp, Homo sapiens
acgactcttcctg

SEQ ID NO: 2105376 - DNA, 19 bp, Homo sapiens
acgactgttgtacaagctc

SEQ ID NO: 2105377 - DNA, 20 bp, Homo sapiens
acgagaccctacaggagagg

SEQ ID NO: 2105378 - DNA, 20 bp, Homo sapiens
acgagagagtcttccaggta

SEQ ID NO: 2105379 - DNA, 16 bp, Homo sapiens
acgagcactggccaga

SEQ ID NO: 2105380 - DNA, 20 bp, Homo sapiens
acgagggatgggatttcatg

SEQ ID NO: 2105381 - DNA, 16 bp, Homo sapiens
acgagtaatttattgt

SEQ ID NO: 2105382 - DNA, 17 bp, Homo sapiens
acgagtcaatcccctca

SEQ ID NO: 2105383 - DNA, 18 bp, Homo sapiens
acgagtcacctgcaagcc

SEQ ID NO: 2105384 - DNA, 20 bp, Homo sapiens
acgagtcacctgcaagcccc

SEQ ID NO: 2105385 - DNA, 14 bp, Homo sapiens
acgatgtggccctg

SEQ ID NO: 2105386 - DNA, 17 bp, Homo sapiens
acgattatttatttctg

SEQ ID NO: 2105387 - DNA, 18 bp, Homo sapiens
acgatttagaaagaagcc

SEQ ID NO: 2105388 - DNA, 13 bp, Homo sapiens
acgattttgcaca

SEQ ID NO: 2105389 - DNA, 17 bp, Homo sapiens
acgcaacccttgctgct

SEQ ID NO: 2105390 - DNA, 18 bp, Homo sapiens
acgcaagggcatcaggca

SEQ ID NO: 2105391 - DNA, 15 bp, Homo sapiens
acgcacacatggaca

SEQ ID NO: 2105392 - DNA, 22 bp, Homo sapiens
acgcacacgtacttaaatgaaa

SEQ ID NO: 2105393 - DNA, 21 bp, Homo sapiens
acgcacatagagatatgcaca

SEQ ID NO: 2105394 - DNA, 13 bp, Homo sapiens
accacctgcttct

SEQ ID NO: 2105395 - DNA, 21 bp, Homo sapiens
accaccttcccagctctccct

SEQ ID NO: 2105396 - DNA, 14 bp, Homo sapiens
accaccttccctct

SEQ ID NO: 2105397 - DNA, 22 bp, Homo sapiens
accacgatgtggccctggcctg

SEQ ID NO: 2105398 - DNA, 18 bp, Homo sapiens
accacgccttgaccttcc

SEQ ID NO: 2105399 - DNA, 18 bp, Homo sapiens
accacgctggaccttgaa

SEQ ID NO: 2105400 - DNA, 14 bp, Homo sapiens
accacggaaaagag

SEQ ID NO: 2105401 - DNA, 20 bp, Homo sapiens
accacggacgtttccatcag

SEQ ID NO: 2105402 - DNA, 14 bp, Homo sapiens
accacgggcctcag

SEQ ID NO: 2105403 - DNA, 15 bp, Homo sapiens
accacgggcctcagt

SEQ ID NO: 2105404 - DNA, 16 bp, Homo sapiens
accacgtctgccaggc

SEQ ID NO: 2105405 - DNA, 22 bp, Homo sapiens
accacgtctgccaggcccatct

SEQ ID NO: 2105406 - DNA, 23 bp, Homo sapiens
accacgtctgccaggcccatctc

SEQ ID NO: 2105407 - DNA, 16 bp, Homo sapiens
accactagagctgaga

SEQ ID NO: 2105408 - DNA, 20 bp, Homo sapiens
accactcaaattaatctttc

SEQ ID NO: 2105409 - DNA, 13 bp, Homo sapiens
accactccagaga

SEQ ID NO: 2105410 - DNA, 16 bp, Homo sapiens
accactctggcagcca

SEQ ID NO: 2105411 - DNA, 17 bp, Homo sapiens
accactctggcagccac

SEQ ID NO: 2105412 - DNA, 18 bp, Homo sapiens
accactgcactccagcct

SEQ ID NO: 2105413 - DNA, 18 bp, Homo sapiens
accactgccctgcctgcc

SEQ ID NO: 2105414 - DNA, 19 bp, Homo sapiens
accactgccctgcctgccc

SEQ ID NO: 2105415 - DNA, 22 bp, Homo sapiens
accactgccctgcctgcccact

SEQ ID NO: 2105416 - DNA, 13 bp, Homo sapiens
accactgtacata

SEQ ID NO: 2105417 - DNA, 21 bp, Homo sapiens
accactgtcctggctgctctc

SEQ ID NO: 2105418 - DNA, 12 bp, Homo sapiens
accactgtggcg

SEQ ID NO: 2105419 - DNA, 13 bp, Homo sapiens
accacttcattct

SEQ ID NO: 2105420 - DNA, 17 bp, Homo sapiens
accacttcttttataac

SEQ ID NO: 2105421 - DNA, 17 bp, Homo sapiens
accagaaaacaaatctt

SEQ ID NO: 2105422 - DNA, 20 bp, Homo sapiens
accagaaaacaaatcttcaa

SEQ ID NO: 2105423 - DNA, 21 bp, Homo sapiens
accagaattgtgcaaatggaa

SEQ ID NO: 2105424 - DNA, 22 bp, Homo sapiens
accagacaccttgacagggcac

SEQ ID NO: 2105425 - DNA, 18 bp, Homo sapiens
accagactgtggagaaat

SEQ ID NO: 2105426 - DNA, 20 bp, Homo sapiens
accagactgtggagaaataa

SEQ ID NO: 2105427 - DNA, 14 bp, Homo sapiens
accagagcccatgc

SEQ ID NO: 2105428 - DNA, 19 bp, Homo sapiens
accagagccccccacaatg

SEQ ID NO: 2105429 - DNA, 21 bp, Homo sapiens
accagaggctgcagaaggcca

SEQ ID NO: 2105430 - DNA, 17 bp, Homo sapiens
accagcaatatgtaaat

SEQ ID NO: 2105431 - DNA, 16 bp, Homo sapiens
accagcacatttctcc

SEQ ID NO: 2105432 - DNA, 13 bp, Homo sapiens
accagcaggtgtg

SEQ ID NO: 2105433 - DNA, 18 bp, Homo sapiens
accagcaggtgtggtggc

SEQ ID NO: 2105434 - DNA, 17 bp, Homo sapiens
accagcattttactact

SEQ ID NO: 2105435 - DNA, 19 bp, Homo sapiens
accagcattttactacttg

SEQ ID NO: 2105436 - DNA, 14 bp, Homo sapiens
accagccacacaga

SEQ ID NO: 2105437 - DNA, 18 bp, Homo sapiens
accagccacacagagcct

SEQ ID NO: 2105438 - DNA, 21 bp, Homo sapiens
accagccacacagagcctgcc

SEQ ID NO: 2105439 - DNA, 22 bp, Homo sapiens
accagccacacagagcctgcct

SEQ ID NO: 2105440 - DNA, 20 bp, Homo sapiens
accagccatcatgtgcctgg

SEQ ID NO: 2105441 - DNA, 15 bp, Homo sapiens
accagccccagcaag

SEQ ID NO: 2105442 - DNA, 17 bp, Homo sapiens
accagccccagtgccca

SEQ ID NO: 2105443 - DNA, 17 bp, Homo sapiens
accagcccttccctgct

SEQ ID NO: 2105444 - DNA, 14 bp, Homo sapiens
accagcctccatgc

SEQ ID NO: 2105445 - DNA, 20 bp, Homo sapiens
accagcctgaccaacatggt

SEQ ID NO: 2105446 - DNA, 15 bp, Homo sapiens
accagcctggccaac

SEQ ID NO: 2105447 - DNA, 20 bp, Homo sapiens
accagcctggccaacatggt

SEQ ID NO: 2105448 - DNA, 14 bp, Homo sapiens
accagcctgttgga

SEQ ID NO: 2105449 - DNA, 15 bp, Homo sapiens
accagctaactccag

SEQ ID NO: 2105450 - DNA, 14 bp, Homo sapiens
accagctcactccc

SEQ ID NO: 2105451 - DNA, 21 bp, Homo sapiens
accagctcagaggcccaggaa

SEQ ID NO: 2105452 - DNA, 17 bp, Homo sapiens
accagctctgtggcctg

SEQ ID NO: 2105453 - DNA, 23 bp, Homo sapiens
accagctctgtggcctgtgtcca

SEQ ID NO: 2105454 - DNA, 14 bp, Homo sapiens
accctaaaatttta

SEQ ID NO: 2105455 - DNA, 22 bp, Homo sapiens
accctacttcattttcagagtg

SEQ ID NO: 2105456 - DNA, 14 bp, Homo sapiens
accctacttctttt

SEQ ID NO: 2105457 - DNA, 13 bp, Homo sapiens
accctattcccta

SEQ ID NO: 2105458 - DNA, 17 bp, Homo sapiens
accctcaaaccctgtgg

SEQ ID NO: 2105459 - DNA, 9 bp, Homo sapiens
accctcact

SEQ ID NO: 2105460 - DNA, 11 bp, Homo sapiens
accctcagagc

SEQ ID NO: 2105461 - DNA, 18 bp, Homo sapiens
accctcagagccacccct

SEQ ID NO: 2105462 - DNA, 16 bp, Homo sapiens
accctcataccatctg

SEQ ID NO: 2105463 - DNA, 21 bp, Homo sapiens
accctccaccgcagaaggaag

SEQ ID NO: 2105464 - DNA, 12 bp, Homo sapiens
accctcccacca

SEQ ID NO: 2105465 - DNA, 20 bp, Homo sapiens
accctcccaccatgcgctgc

SEQ ID NO: 2105466 - DNA, 21 bp, Homo sapiens
accctcccaccatgcgctgct

SEQ ID NO: 2105467 - DNA, 23 bp, Homo sapiens
accctccccgcaccccccaagct

SEQ ID NO: 2105468 - DNA, 20 bp, Homo sapiens
accctcccctgtcttctctc

SEQ ID NO: 2105469 - DNA, 22 bp, Homo sapiens
accctccgccttcactccggtg

SEQ ID NO: 2105470 - DNA, 18 bp, Homo sapiens
accctcgtggacacctgc

SEQ ID NO: 2105471 - DNA, 20 bp, Homo sapiens
accctcgtggacacctgccc

SEQ ID NO: 2105472 - DNA, 15 bp, Homo sapiens
accctctcctggggg

SEQ ID NO: 2105473 - DNA, 21 bp, Homo sapiens
accctctcctgggggtggcag

SEQ ID NO: 2105474 - DNA, 23 bp, Homo sapiens
accctctcctgggggtggcaggc

SEQ ID NO: 2105475 - DNA, 12 bp, Homo sapiens
accctctcttcc

SEQ ID NO: 2105476 - DNA, 21 bp, Homo sapiens
accctgaagatttcagaggct

SEQ ID NO: 2105477 - DNA, 21 bp, Homo sapiens
accctgaatggttccatgcct

SEQ ID NO: 2105478 - DNA, 21 bp, Homo sapiens
accctgaatttggcctgcact

SEQ ID NO: 2105479 - DNA, 13 bp, Homo sapiens
accctgagcctga

SEQ ID NO: 2105480 - DNA, 14 bp, Homo sapiens
accctgaggagtct

SEQ ID NO: 2105481 - DNA, 23 bp, Homo sapiens
accctgaggagtctgaggtcctg

SEQ ID NO: 2105482 - DNA, 19 bp, Homo sapiens
accctgcagagcacacagg

SEQ ID NO: 2105483 - DNA, 23 bp, Homo sapiens
accctgcagagcacacaggtaca

SEQ ID NO: 2105484 - DNA, 21 bp, Homo sapiens
accctgcccacttcagcccag

SEQ ID NO: 2105485 - DNA, 20 bp, Homo sapiens
accctgcccatacccctgcc

SEQ ID NO: 2105486 - DNA, 17 bp, Homo sapiens
accctgcctgagcccag

SEQ ID NO: 2105487 - DNA, 23 bp, Homo sapiens
accctgcctgagcccaggagctg

SEQ ID NO: 2105488 - DNA, 18 bp, Homo sapiens
accctgcgaaggggccct

SEQ ID NO: 2105489 - DNA, 21 bp, Homo sapiens
accctggcccgcccctcgctg

SEQ ID NO: 2105490 - DNA, 18 bp, Homo sapiens
accctgttccctctttct

SEQ ID NO: 2105491 - DNA, 15 bp, Homo sapiens
accctgtttcctgag

SEQ ID NO: 2105492 - DNA, 15 bp, Homo sapiens
accctgttttccaca

SEQ ID NO: 2105493 - DNA, 19 bp, Homo sapiens
acccttagagattgcccca

SEQ ID NO: 2105494 - DNA, 16 bp, Homo sapiens
acccttcagggccaga

SEQ ID NO: 2105495 - DNA, 17 bp, Homo sapiens
acccttcagggccagaa

SEQ ID NO: 2105496 - DNA, 16 bp, Homo sapiens
acccttccagacatac

SEQ ID NO: 2105497 - DNA, 13 bp, Homo sapiens
acccttcccaatc

SEQ ID NO: 2105498 - DNA, 15 bp, Homo sapiens
acccttcctcctcct

SEQ ID NO: 2105499 - DNA, 14 bp, Homo sapiens
acccttctcttctc

SEQ ID NO: 2105500 - DNA, 12 bp, Homo sapiens
acccttctgggc

SEQ ID NO: 2105501 - DNA, 19 bp, Homo sapiens
acccttctttaaatcaaaa

SEQ ID NO: 2105502 - DNA, 23 bp, Homo sapiens
acccttctttaaatcaaaagctg

SEQ ID NO: 2105503 - DNA, 15 bp, Homo sapiens
acccttgcattagaa

SEQ ID NO: 2105504 - DNA, 18 bp, Homo sapiens
acccttgctgctgcccgc

SEQ ID NO: 2105505 - DNA, 21 bp, Homo sapiens
accctttccttccttccctgg

SEQ ID NO: 2105506 - DNA, 22 bp, Homo sapiens
accctttccttccttccctggc

SEQ ID NO: 2105507 - DNA, 20 bp, Homo sapiens
acccttttcctccagacaga

SEQ ID NO: 2105508 - DNA, 13 bp, Homo sapiens
accgaagagccct

SEQ ID NO: 2105509 - DNA, 15 bp, Homo sapiens
accgaagagccctga

SEQ ID NO: 2105510 - DNA, 20 bp, Homo sapiens
accgaagagccctgagctca

SEQ ID NO: 2105511 - DNA, 22 bp, Homo sapiens
accgaattttattttacagagc

SEQ ID NO: 2105512 - DNA, 16 bp, Homo sapiens
accgacgcgtctcctg

SEQ ID NO: 2105513 - DNA, 17 bp, Homo sapiens
accgacgcgtctcctgt

SEQ ID NO: 2105514 - DNA, 15 bp, Homo sapiens
accgagaccaaactc

SEQ ID NO: 2105515 - DNA, 21 bp, Homo sapiens
accgagacggctggacctgca

SEQ ID NO: 2105516 - DNA, 16 bp, Homo sapiens
actcaggaggctgagg

SEQ ID NO: 2105517 - DNA, 17 bp, Homo sapiens
actcaggaggctgaggc

SEQ ID NO: 2105518 - DNA, 12 bp, Homo sapiens
actcagggacct

SEQ ID NO: 2105519 - DNA, 22 bp, Homo sapiens
actcagggccccagcactaaag

SEQ ID NO: 2105520 - DNA, 16 bp, Homo sapiens
actcagtcccccacca

SEQ ID NO: 2105521 - DNA, 22 bp, Homo sapiens
actcagtcccccaccacactga

SEQ ID NO: 2105522 - DNA, 13 bp, Homo sapiens
actcagtttgtca

SEQ ID NO: 2105523 - DNA, 15 bp, Homo sapiens
actcagttttaacta

SEQ ID NO: 2105524 - DNA, 20 bp, Homo sapiens
actcatattctgggctcctg

SEQ ID NO: 2105525 - DNA, 16 bp, Homo sapiens
actcatcataaaataa

SEQ ID NO: 2105526 - DNA, 23 bp, Homo sapiens
actcatcctgtgtggggaggcag

SEQ ID NO: 2105527 - DNA, 13 bp, Homo sapiens
actcatctgttat

SEQ ID NO: 2105528 - DNA, 17 bp, Homo sapiens
actcatgggtacccaga

SEQ ID NO: 2105529 - DNA, 22 bp, Homo sapiens
actcatgttgttcccacacaca

SEQ ID NO: 2105530 - DNA, 21 bp, Homo sapiens
actcattagactggaacttga

SEQ ID NO: 2105531 - DNA, 13 bp, Homo sapiens
actcattcctgta

SEQ ID NO: 2105532 - DNA, 14 bp, Homo sapiens
actcatttcatctc

SEQ ID NO: 2105533 - DNA, 15 bp, Homo sapiens
actcatttctaaaag

SEQ ID NO: 2105534 - DNA, 17 bp, Homo sapiens
actcatttctaaaagaa

SEQ ID NO: 2105535 - DNA, 19 bp, Homo sapiens
actcatttttcatgataat

SEQ ID NO: 2105536 - DNA, 15 bp, Homo sapiens
actccaaagaaatgt

SEQ ID NO: 2105537 - DNA, 17 bp, Homo sapiens
actccaagaacaattgt

SEQ ID NO: 2105538 - DNA, 13 bp, Homo sapiens
actccaagcttca

SEQ ID NO: 2105539 - DNA, 20 bp, Homo sapiens
actccacagcggaggagacc

SEQ ID NO: 2105540 - DNA, 21 bp, Homo sapiens
actccacagcggaggagacca

SEQ ID NO: 2105541 - DNA, 15 bp, Homo sapiens
actccaccaacccat

SEQ ID NO: 2105542 - DNA, 18 bp, Homo sapiens
actccaccccctccagct

SEQ ID NO: 2105543 - DNA, 21 bp, Homo sapiens
actccaccccctccagctcca

SEQ ID NO: 2105544 - DNA, 22 bp, Homo sapiens
actccaccccctccagctccag

SEQ ID NO: 2105545 - DNA, 23 bp, Homo sapiens
actccaccccctccagctccagt

SEQ ID NO: 2105546 - DNA, 15 bp, Homo sapiens
actccacctccaccc

SEQ ID NO: 2105547 - DNA, 22 bp, Homo sapiens
actccactctccttcgtgtctc

SEQ ID NO: 2105548 - DNA, 22 bp, Homo sapiens
actccagaatctgctgttgcca

SEQ ID NO: 2105549 - DNA, 19 bp, Homo sapiens
actccagacccctggcttt

SEQ ID NO: 2105550 - DNA, 16 bp, Homo sapiens
actccagagggacagg

SEQ ID NO: 2105551 - DNA, 18 bp, Homo sapiens
actccagagtctgagccc

SEQ ID NO: 2105552 - DNA, 13 bp, Homo sapiens
actccagccagcg

SEQ ID NO: 2105553 - DNA, 14 bp, Homo sapiens
actccagccagcgc

SEQ ID NO: 2105554 - DNA, 17 bp, Homo sapiens
actccagccagcgcctc

SEQ ID NO: 2105555 - DNA, 18 bp, Homo sapiens
actccagccagcgcctcc

SEQ ID NO: 2105556 - DNA, 14 bp, Homo sapiens
actccagcccaaca

SEQ ID NO: 2105557 - DNA, 13 bp, Homo sapiens
actccagccctgt

SEQ ID NO: 2105558 - DNA, 13 bp, Homo sapiens
actccagcctgag

SEQ ID NO: 2105559 - DNA, 20 bp, Homo sapiens
actccagcctgagcaacaga

SEQ ID NO: 2105560 - DNA, 13 bp, Homo sapiens
actccagcctggg

SEQ ID NO: 2105561 - DNA, 15 bp, Homo sapiens
actccagcctgggcg

SEQ ID NO: 2105562 - DNA, 20 bp, Homo sapiens
actccagcctgggcgacaga

SEQ ID NO: 2105563 - DNA, 17 bp, Homo sapiens
actccagcgcctgccct

SEQ ID NO: 2105564 - DNA, 20 bp, Homo sapiens
actccagcgcctgccctccc

SEQ ID NO: 2105565 - DNA, 21 bp, Homo sapiens
actccaggaaaactgtttttc

SEQ ID NO: 2105566 - DNA, 20 bp, Homo sapiens
actccagtctcctgacatta

SEQ ID NO: 2105567 - DNA, 16 bp, Homo sapiens
actccagtggtgaaga

SEQ ID NO: 2105568 - DNA, 15 bp, Homo sapiens
actccatatggaggc

SEQ ID NO: 2105569 - DNA, 19 bp, Homo sapiens
actccatctcaaaaaataa

SEQ ID NO: 2105570 - DNA, 16 bp, Homo sapiens
actccatggccacccc

SEQ ID NO: 2105571 - DNA, 18 bp, Homo sapiens
actccattactaaagaca

SEQ ID NO: 2105572 - DNA, 12 bp, Homo sapiens
actccccaggcc

SEQ ID NO: 2105573 - DNA, 13 bp, Homo sapiens
actccccaggcca

SEQ ID NO: 2105574 - DNA, 13 bp, Homo sapiens
actcccccacctg

SEQ ID NO: 2105575 - DNA, 14 bp, Homo sapiens
actccccgcctgtc

SEQ ID NO: 2105576 - DNA, 20 bp, Homo sapiens
actccccgcctgtcctgcct

SEQ ID NO: 2105577 - DNA, 21 bp, Homo sapiens
actccccgcctgtcctgcctc

SEQ ID NO: 2105578 - DNA, 10 bp, Homo sapiens
actccctccc

SEQ ID NO: 2105579 - DNA, 18 bp, Homo sapiens
actccctcctaacctaga

SEQ ID NO: 2105580 - DNA, 18 bp, Homo sapiens
actccctgaacctcagtt

SEQ ID NO: 2105581 - DNA, 19 bp, Homo sapiens
actccctgaacctcagttt

SEQ ID NO: 2105582 - DNA, 21 bp, Homo sapiens
actccctggatgtgtggggca

SEQ ID NO: 2105583 - DNA, 18 bp, Homo sapiens
actccctggctctcagaa

SEQ ID NO: 2105584 - DNA, 17 bp, Homo sapiens
actcccttcctggcctc

SEQ ID NO: 2105585 - DNA, 14 bp, Homo sapiens
actccgagaacaac

SEQ ID NO: 2105586 - DNA, 15 bp, Homo sapiens
actccggtgtgcctg

SEQ ID NO: 2105587 - DNA, 16 bp, Homo sapiens
actccggtgtgcctgc

SEQ ID NO: 2105588 - DNA, 14 bp, Homo sapiens
actcctacctcagc

SEQ ID NO: 2105589 - DNA, 15 bp, Homo sapiens
actcctcactgcccc

SEQ ID NO: 2105590 - DNA, 19 bp, Homo sapiens
actcctcagatctgaacac

SEQ ID NO: 2105591 - DNA, 12 bp, Homo sapiens
actcctctgtct

SEQ ID NO: 2105592 - DNA, 16 bp, Homo sapiens
actcctctgtctctgc

SEQ ID NO: 2105593 - DNA, 14 bp, Homo sapiens
actcctcttatttg

SEQ ID NO: 2105594 - DNA, 19 bp, Homo sapiens
actcctgacagtcttgtgc

SEQ ID NO: 2105595 - DNA, 20 bp, Homo sapiens
actcctgattttgtagttaa

SEQ ID NO: 2105596 - DNA, 15 bp, Homo sapiens
actcctgcaaaattt

SEQ ID NO: 2105597 - DNA, 14 bp, Homo sapiens
actcctgccctgtt

SEQ ID NO: 2105598 - DNA, 22 bp, Homo sapiens
actcctgccctgttgtgtatag

SEQ ID NO: 2105599 - DNA, 15 bp, Homo sapiens
actcctgcctgtgtt

SEQ ID NO: 2105600 - DNA, 11 bp, Homo sapiens
actcctggcct

SEQ ID NO: 2105601 - DNA, 12 bp, Homo sapiens
actcctggcctc

SEQ ID NO: 2105602 - DNA, 21 bp, Homo sapiens
actcctggtctgaaaatgttg

SEQ ID NO: 2105603 - DNA, 12 bp, Homo sapiens
actcctgtcccg

SEQ ID NO: 2105604 - DNA, 19 bp, Homo sapiens
actcctgtcccgccttcct

SEQ ID NO: 2105605 - DNA, 21 bp, Homo sapiens
actcctgtcccgccttcctcc

SEQ ID NO: 2105606 - DNA, 16 bp, Homo sapiens
actcctgtgctctgga

SEQ ID NO: 2105607 - DNA, 17 bp, Homo sapiens
actctcattccccaggt

SEQ ID NO: 2105608 - DNA, 17 bp, Homo sapiens
actctccaacctggaca

SEQ ID NO: 2105609 - DNA, 18 bp, Homo sapiens
actctccccctttcaagg

SEQ ID NO: 2105610 - DNA, 11 bp, Homo sapiens
actctcccctc

SEQ ID NO: 2105611 - DNA, 16 bp, Homo sapiens
actctcccctccctct

SEQ ID NO: 2105612 - DNA, 17 bp, Homo sapiens
actctcccctccctctt

SEQ ID NO: 2105613 - DNA, 13 bp, Homo sapiens
actctcggggccc

SEQ ID NO: 2105614 - DNA, 14 bp, Homo sapiens
actctcggggccct

SEQ ID NO: 2105615 - DNA, 17 bp, Homo sapiens
actctcggggcccttgg

SEQ ID NO: 2105616 - DNA, 22 bp, Homo sapiens
actctcggggcccttggggcct

SEQ ID NO: 2105617 - DNA, 18 bp, Homo sapiens
actctctaaatcttcctt

SEQ ID NO: 2105618 - DNA, 21 bp, Homo sapiens
actctctccaccctatatgta

SEQ ID NO: 2105619 - DNA, 19 bp, Homo sapiens
actctctgctctagccagg

SEQ ID NO: 2105620 - DNA, 23 bp, Homo sapiens
actctctgctctagccaggagtc

SEQ ID NO: 2105621 - DNA, 15 bp, Homo sapiens
actctctgtacaaaa

SEQ ID NO: 2105622 - DNA, 20 bp, Homo sapiens
actctgacaagggctgacct

SEQ ID NO: 2105623 - DNA, 12 bp, Homo sapiens
actctgactctt

SEQ ID NO: 2105624 - DNA, 14 bp, Homo sapiens
actctgagcccagg

SEQ ID NO: 2105625 - DNA, 16 bp, Homo sapiens
actctgagcccaggcc

SEQ ID NO: 2105626 - DNA, 18 bp, Homo sapiens
actctgagcccaggccgt

SEQ ID NO: 2105627 - DNA, 14 bp, Homo sapiens
actctgcacagcaa

SEQ ID NO: 2105628 - DNA, 14 bp, Homo sapiens
actctgcactccat

SEQ ID NO: 2105629 - DNA, 18 bp, Homo sapiens
actctgcactccatggcc

SEQ ID NO: 2105630 - DNA, 19 bp, Homo sapiens
actctgcactccatggcca

SEQ ID NO: 2105631 - DNA, 15 bp, Homo sapiens
actctgccccttctg

SEQ ID NO: 2105632 - DNA, 21 bp, Homo sapiens
actctgccttttttcacagcc

SEQ ID NO: 2105633 - DNA, 22 bp, Homo sapiens
actctgcggtggtgccagaggt

SEQ ID NO: 2105634 - DNA, 11 bp, Homo sapiens
actctgctctg

SEQ ID NO: 2105635 - DNA, 12 bp, Homo sapiens
actctgctctga

SEQ ID NO: 2105636 - DNA, 15 bp, Homo sapiens
actctgctctgatgc

SEQ ID NO: 2105637 - DNA, 11 bp, Homo sapiens
actctggcctc

SEQ ID NO: 2105638 - DNA, 15 bp, Homo sapiens
actctggcttccagg

SEQ ID NO: 2105639 - DNA, 17 bp, Homo sapiens
actctggcttccaggta

SEQ ID NO: 2105640 - DNA, 19 bp, Homo sapiens
actctgggtccctcggagc

SEQ ID NO: 2105641 - DNA, 17 bp, Homo sapiens
actctgtcagccagccg

SEQ ID NO: 2105642 - DNA, 14 bp, Homo sapiens
actctgtccaggcc

SEQ ID NO: 2105643 - DNA, 15 bp, Homo sapiens
actctgtccaggcca

SEQ ID NO: 2105644 - DNA, 21 bp, Homo sapiens
actctgtccaggccactgtgg

SEQ ID NO: 2105645 - DNA, 19 bp, Homo sapiens
actctgtcgcccagtctgg

SEQ ID NO: 2105646 - DNA, 11 bp, Homo sapiens
actctgtgcca

SEQ ID NO: 2105647 - DNA, 17 bp, Homo sapiens
actctgtgccagagcct

SEQ ID NO: 2105648 - DNA, 18 bp, Homo sapiens
actctgtgccagagcctg

SEQ ID NO: 2105649 - DNA, 21 bp, Homo sapiens
actctgtgccagagcctgggg

SEQ ID NO: 2105650 - DNA, 22 bp, Homo sapiens
actctgtgccagagcctggggc

SEQ ID NO: 2105651 - DNA, 16 bp, Homo sapiens
actctgtgtcaggtgg

SEQ ID NO: 2105652 - DNA, 14 bp, Homo sapiens
actcttaatcaaat

SEQ ID NO: 2105653 - DNA, 17 bp, Homo sapiens
actcttaggaagagaaa

SEQ ID NO: 2105654 - DNA, 19 bp, Homo sapiens
actcttaggaagagaaacc

SEQ ID NO: 2105655 - DNA, 15 bp, Homo sapiens
actcttatcattttt

SEQ ID NO: 2105656 - DNA, 19 bp, Homo sapiens
actcttattgcccacgctg

SEQ ID NO: 2105657 - DNA, 21 bp, Homo sapiens
actcttatttggtataaaggg

SEQ ID NO: 2105658 - DNA, 15 bp, Homo sapiens
actcttgacctcagg

SEQ ID NO: 2105659 - DNA, 21 bp, Homo sapiens
actctttgctacaataaatgc

SEQ ID NO: 2105660 - DNA, 14 bp, Homo sapiens
actctttttagggc

SEQ ID NO: 2105661 - DNA, 15 bp, Homo sapiens
actgaaaaatgtcag

SEQ ID NO: 2105662 - DNA, 22 bp, Homo sapiens
actgaaaacatttcaaagctga

SEQ ID NO: 2105663 - DNA, 15 bp, Homo sapiens
actgaaaactgtaaa

SEQ ID NO: 2105664 - DNA, 20 bp, Homo sapiens
actgaaaactgtaaatacaa

SEQ ID NO: 2105665 - DNA, 14 bp, Homo sapiens
actgaaagcagcag

SEQ ID NO: 2105666 - DNA, 16 bp, Homo sapiens
actgaacatttgcttt

SEQ ID NO: 2105667 - DNA, 21 bp, Homo sapiens
actgaaccgacttttctaaag

SEQ ID NO: 2105668 - DNA, 13 bp, Homo sapiens
actgaacttcagg

SEQ ID NO: 2105669 - DNA, 13 bp, Homo sapiens
actgaagaaggat

SEQ ID NO: 2105670 - DNA, 16 bp, Homo sapiens
actgaagtgcttgcag

SEQ ID NO: 2105671 - DNA, 20 bp, Homo sapiens
actgaagtgcttgcagatca

SEQ ID NO: 2105672 - DNA, 15 bp, Homo sapiens
actgaatcatgttaa

SEQ ID NO: 2105673 - DNA, 21 bp, Homo sapiens
actgaatgcctcaatgtgacc

SEQ ID NO: 2105674 - DNA, 15 bp, Homo sapiens
actgaatttattgcc

SEQ ID NO: 2105675 - DNA, 12 bp, Homo sapiens
actgacaagatg

SEQ ID NO: 2105676 - DNA, 12 bp, Homo sapiens
actgacacaggc

SEQ ID NO: 2105677 - DNA, 15 bp, Homo sapiens
actgacacaggccag

SEQ ID NO: 2105678 - DNA, 17 bp, Homo sapiens
actgacacaggccagcc

SEQ ID NO: 2105679 - DNA, 17 bp, Homo sapiens
actgacacctcactgag

SEQ ID NO: 2105680 - DNA, 23 bp, Homo sapiens
actgacattgttggccaaagcca

SEQ ID NO: 2105681 - DNA, 22 bp, Homo sapiens
actgaccctggagcggctctcc

SEQ ID NO: 2105682 - DNA, 24 bp, Homo sapiens
actgaccctggagcggctctcctg

SEQ ID NO: 2105683 - DNA, 12 bp, Homo sapiens
actgacccttcc

SEQ ID NO: 2105684 - DNA, 13 bp, Homo sapiens
actgacccttcca

SEQ ID NO: 2105685 - DNA, 17 bp, Homo sapiens
actgacccttccagaca

SEQ ID NO: 2105686 - DNA, 22 bp, Homo sapiens
actgaccttggagagacacagc

SEQ ID NO: 2105687 - DNA, 16 bp, Homo sapiens
actgacttctaagtaa

SEQ ID NO: 2105688 - DNA, 15 bp, Homo sapiens
actgagaaatgaatg

SEQ ID NO: 2105689 - DNA, 14 bp, Homo sapiens
actgagacggcaga

SEQ ID NO: 2105690 - DNA, 22 bp, Homo sapiens
actgagatgtgaacacatcagc

SEQ ID NO: 2105691 - DNA, 18 bp, Homo sapiens
actgagccaaacacactg

SEQ ID NO: 2105692 - DNA, 23 bp, Homo sapiens
actgagcctcttttcaattattt

SEQ ID NO: 2105693 - DNA, 18 bp, Homo sapiens
actgagcttctctgtgaa

SEQ ID NO: 2105694 - DNA, 17 bp, Homo sapiens
actgaggaagggagaca

SEQ ID NO: 2105695 - DNA, 19 bp, Homo sapiens
actgaggcagacagcagct

SEQ ID NO: 2105696 - DNA, 20 bp, Homo sapiens
actgaggcatttttactact

SEQ ID NO: 2105697 - DNA, 22 bp, Homo sapiens
actgaggcatttttactactat

SEQ ID NO: 2105698 - DNA, 22 bp, Homo sapiens
actgaggccaaaagaggcctga

SEQ ID NO: 2105699 - DNA, 12 bp, Homo sapiens
actgagggccac

SEQ ID NO: 2105700 - DNA, 22 bp, Homo sapiens
actgagggccacactattacca

SEQ ID NO: 2105701 - DNA, 15 bp, Homo sapiens
agctgcagcttcctg

SEQ ID NO: 2105702 - DNA, 20 bp, Homo sapiens
agctgcaggaatcaaaaatt

SEQ ID NO: 2105703 - DNA, 17 bp, Homo sapiens
agctgccaaaatcgtag

SEQ ID NO: 2105704 - DNA, 13 bp, Homo sapiens
agctgccagccgg

SEQ ID NO: 2105705 - DNA, 17 bp, Homo sapiens
agctgccgaccagagcc

SEQ ID NO: 2105706 - DNA, 17 bp, Homo sapiens
agctgccgcaaggccct

SEQ ID NO: 2105707 - DNA, 19 bp, Homo sapiens
agctgccgcaaggccctgt

SEQ ID NO: 2105708 - DNA, 20 bp, Homo sapiens
agctgccgcaaggccctgtc

SEQ ID NO: 2105709 - DNA, 11 bp, Homo sapiens
agctgcctggg

SEQ ID NO: 2105710 - DNA, 14 bp, Homo sapiens
agctgcctgtagtt

SEQ ID NO: 2105711 - DNA, 20 bp, Homo sapiens
agctgcctgtagttaggaaa

SEQ ID NO: 2105712 - DNA, 14 bp, Homo sapiens
agctgcctgttcag

SEQ ID NO: 2105713 - DNA, 21 bp, Homo sapiens
agctgcctgttcagctccagc

SEQ ID NO: 2105714 - DNA, 12 bp, Homo sapiens
agctgccttttt

SEQ ID NO: 2105715 - DNA, 16 bp, Homo sapiens
agctgcggtccaccca

SEQ ID NO: 2105716 - DNA, 21 bp, Homo sapiens
agctgcggtccacccaggagc

SEQ ID NO: 2105717 - DNA, 23 bp, Homo sapiens
agctgcggtccacccaggagccc

SEQ ID NO: 2105718 - DNA, 14 bp, Homo sapiens
agctgctcaaatca

SEQ ID NO: 2105719 - DNA, 16 bp, Homo sapiens
agctgctcgcacagat

SEQ ID NO: 2105720 - DNA, 14 bp, Homo sapiens
agctgctctattgt

SEQ ID NO: 2105721 - DNA, 15 bp, Homo sapiens
agctgctctggaaaa

SEQ ID NO: 2105722 - DNA, 20 bp, Homo sapiens
agctgctcttagtgcccgcc

SEQ ID NO: 2105723 - DNA, 23 bp, Homo sapiens
agctgctgaagaggcaagagaca

SEQ ID NO: 2105724 - DNA, 13 bp, Homo sapiens
agctgctgctctg

SEQ ID NO: 2105725 - DNA, 24 bp, Homo sapiens
agctgcttgtcctgctctcttcag

SEQ ID NO: 2105726 - DNA, 16 bp, Homo sapiens
agctgctttaaatcta

SEQ ID NO: 2105727 - DNA, 21 bp, Homo sapiens
agctgcttttgtctatgggac

SEQ ID NO: 2105728 - DNA, 22 bp, Homo sapiens
agctggaaggcagggcagaggg

SEQ ID NO: 2105729 - DNA, 14 bp, Homo sapiens
agctggaatttaag

SEQ ID NO: 2105730 - DNA, 20 bp, Homo sapiens
agctggacaagaagctgcta

SEQ ID NO: 2105731 - DNA, 16 bp, Homo sapiens
agctggacatgctttg

SEQ ID NO: 2105732 - DNA, 19 bp, Homo sapiens
agctggacatgctttggca

SEQ ID NO: 2105733 - DNA, 13 bp, Homo sapiens
agctggcagcact

SEQ ID NO: 2105734 - DNA, 15 bp, Homo sapiens
agctggcaggacaca

SEQ ID NO: 2105735 - DNA, 19 bp, Homo sapiens
agctggcaggacacatccc

SEQ ID NO: 2105736 - DNA, 23 bp, Homo sapiens
agctggcaggacacatcccggcc

SEQ ID NO: 2105737 - DNA, 15 bp, Homo sapiens
agctggcattacagc

SEQ ID NO: 2105738 - DNA, 20 bp, Homo sapiens
agctggcctctagaacaccc

SEQ ID NO: 2105739 - DNA, 16 bp, Homo sapiens
agctggcgactgcagc

SEQ ID NO: 2105740 - DNA, 18 bp, Homo sapiens
agctggctgctgacagga

SEQ ID NO: 2105741 - DNA, 15 bp, Homo sapiens
agctggctgtcttcc

SEQ ID NO: 2105742 - DNA, 22 bp, Homo sapiens
agctgggaaaaaagttttgatg

SEQ ID NO: 2105743 - DNA, 15 bp, Homo sapiens
agctgggaaacaggg

SEQ ID NO: 2105744 - DNA, 15 bp, Homo sapiens
agctgggacccctcc

SEQ ID NO: 2105745 - DNA, 17 bp, Homo sapiens
agctgggactacaggtg

SEQ ID NO: 2105746 - DNA, 12 bp, Homo sapiens
agctgggaggaa

SEQ ID NO: 2105747 - DNA, 15 bp, Homo sapiens
agctgggaggaaaag

SEQ ID NO: 2105748 - DNA, 17 bp, Homo sapiens
agctgggatgtttctgt

SEQ ID NO: 2105749 - DNA, 19 bp, Homo sapiens
agctgggccccatgctctg

SEQ ID NO: 2105750 - DNA, 20 bp, Homo sapiens
agctgggccccatgctctgc

SEQ ID NO: 2105751 - DNA, 17 bp, Homo sapiens
agctgggccggccagcc

SEQ ID NO: 2105752 - DNA, 16 bp, Homo sapiens
agctggggcctggaga

SEQ ID NO: 2105753 - DNA, 18 bp, Homo sapiens
agctggggcctggagagg

SEQ ID NO: 2105754 - DNA, 15 bp, Homo sapiens
agctgggggaagggt

SEQ ID NO: 2105755 - DNA, 14 bp, Homo sapiens
agctggggtacagg

SEQ ID NO: 2105756 - DNA, 17 bp, Homo sapiens
agctggtccagggcctg

SEQ ID NO: 2105757 - DNA, 16 bp, Homo sapiens
agctggtgctgcaagg

SEQ ID NO: 2105758 - DNA, 15 bp, Homo sapiens
agctggttgctacat

SEQ ID NO: 2105759 - DNA, 15 bp, Homo sapiens
agctggttggagagc

SEQ ID NO: 2105760 - DNA, 17 bp, Homo sapiens
agctgtaaatacatgtg

SEQ ID NO: 2105761 - DNA, 19 bp, Homo sapiens
agctgtaaatacatgtgtg

SEQ ID NO: 2105762 - DNA, 16 bp, Homo sapiens
agctgtaactaactca

SEQ ID NO: 2105763 - DNA, 16 bp, Homo sapiens
agctgtactcagagca

SEQ ID NO: 2105764 - DNA, 18 bp, Homo sapiens
agctgtactcagagcaga

SEQ ID NO: 2105765 - DNA, 19 bp, Homo sapiens
agctgtactcagagcagag

SEQ ID NO: 2105766 - DNA, 22 bp, Homo sapiens
agctgtatatatatatgtgtgt

SEQ ID NO: 2105767 - DNA, 23 bp, Homo sapiens
agctgtatatatatatgtgtgtg

SEQ ID NO: 2105768 - DNA, 21 bp, Homo sapiens
agctgtcatggaaaagcccag

SEQ ID NO: 2105769 - DNA, 14 bp, Homo sapiens
agctgtcattcagg

SEQ ID NO: 2105770 - DNA, 15 bp, Homo sapiens
agctgtcccctctcc

SEQ ID NO: 2105771 - DNA, 17 bp, Homo sapiens
agctgtcccctctgtca

SEQ ID NO: 2105772 - DNA, 20 bp, Homo sapiens
agctgtccctgtcaccaagc

SEQ ID NO: 2105773 - DNA, 17 bp, Homo sapiens
agctgtctgctcagaca

SEQ ID NO: 2105774 - DNA, 20 bp, Homo sapiens
agctgtgaactcagagcccc

SEQ ID NO: 2105775 - DNA, 14 bp, Homo sapiens
agctgtgacctgct

SEQ ID NO: 2105776 - DNA, 16 bp, Homo sapiens
agctgtgacctgctga

SEQ ID NO: 2105777 - DNA, 17 bp, Homo sapiens
agctgtgacctgctgag

SEQ ID NO: 2105778 - DNA, 18 bp, Homo sapiens
agctgtgacctgctgagc

SEQ ID NO: 2105779 - DNA, 20 bp, Homo sapiens
agctgtgacctgctgagctc

SEQ ID NO: 2105780 - DNA, 17 bp, Homo sapiens
agctgtgctctggacag

SEQ ID NO: 2105781 - DNA, 23 bp, Homo sapiens
agctgtgctctggacaggcatgt

SEQ ID NO: 2105782 - DNA, 19 bp, Homo sapiens
agctgtggactttgttcac

SEQ ID NO: 2105783 - DNA, 20 bp, Homo sapiens
agctgtgtccttgcacctgc

SEQ ID NO: 2105784 - DNA, 14 bp, Homo sapiens
agctgttcacagcc

SEQ ID NO: 2105785 - DNA, 19 bp, Homo sapiens
agctgttggcctcgcctgg

SEQ ID NO: 2105786 - DNA, 21 bp, Homo sapiens
agctgttggcctcgcctgggc

SEQ ID NO: 2105787 - DNA, 16 bp, Homo sapiens
agctgtttaagatggg

SEQ ID NO: 2105788 - DNA, 17 bp, Homo sapiens
agctgtttatttattca

SEQ ID NO: 2105789 - DNA, 18 bp, Homo sapiens
agctgtttatttattcac

SEQ ID NO: 2105790 - DNA, 18 bp, Homo sapiens
agctgttttccctgacct

SEQ ID NO: 2105791 - DNA, 14 bp, Homo sapiens
agctgttttcttct

SEQ ID NO: 2105792 - DNA, 12 bp, Homo sapiens
agcttaaaactt

SEQ ID NO: 2105793 - DNA, 14 bp, Homo sapiens
agcttaaaactttg

SEQ ID NO: 2105794 - DNA, 22 bp, Homo sapiens
agctattgcatgtaaaatgcag

SEQ ID NO: 2105795 - DNA, 22 bp, Homo sapiens
agctatttttatttgtttgtgc

SEQ ID NO: 2105796 - DNA, 18 bp, Homo sapiens
agctcaagatgacagctc

SEQ ID NO: 2105797 - DNA, 17 bp, Homo sapiens
agctcacaagcccaggc

SEQ ID NO: 2105798 - DNA, 18 bp, Homo sapiens
agctcacaaggcagcaag

SEQ ID NO: 2105799 - DNA, 20 bp, Homo sapiens
agctcacaaggcagcaaggc

SEQ ID NO: 2105800 - DNA, 13 bp, Homo sapiens
agctcaccagccc

SEQ ID NO: 2105801 - DNA, 21 bp, Homo sapiens
agctcaccagccccagtgccc

SEQ ID NO: 2105802 - DNA, 23 bp, Homo sapiens
agctcaccagccccagtgcccac

SEQ ID NO: 2105803 - DNA, 21 bp, Homo sapiens
agctcagaatagatctgatgg

SEQ ID NO: 2105804 - DNA, 17 bp, Homo sapiens
agctcagaggcccagga

SEQ ID NO: 2105805 - DNA, 16 bp, Homo sapiens
agctcagcctcccccc

SEQ ID NO: 2105806 - DNA, 22 bp, Homo sapiens
agctcagctttttgtcttttct

SEQ ID NO: 2105807 - DNA, 21 bp, Homo sapiens
agctcaggcatttgaggctgt

SEQ ID NO: 2105808 - DNA, 22 bp, Homo sapiens
agctcaggctgagcccagccac

SEQ ID NO: 2105809 - DNA, 22 bp, Homo sapiens
agctcaggtgtccctgcacttg

SEQ ID NO: 2105810 - DNA, 18 bp, Homo sapiens
agctcatattttgtatat

SEQ ID NO: 2105811 - DNA, 22 bp, Homo sapiens
agctccacggtgcgtggctgtg

SEQ ID NO: 2105812 - DNA, 23 bp, Homo sapiens
agctccacggtgcgtggctgtgg

SEQ ID NO: 2105813 - DNA, 18 bp, Homo sapiens
agctccactgtcaccctc

SEQ ID NO: 2105814 - DNA, 19 bp, Homo sapiens
agctccagaataccttctt

SEQ ID NO: 2105815 - DNA, 17 bp, Homo sapiens
agctccagctcaccagc

SEQ ID NO: 2105816 - DNA, 21 bp, Homo sapiens
agctccagctcaccagcccca

SEQ ID NO: 2105817 - DNA, 13 bp, Homo sapiens
agctccatctcca

SEQ ID NO: 2105818 - DNA, 16 bp, Homo sapiens
agctccatctccactc

SEQ ID NO: 2105819 - DNA, 15 bp, Homo sapiens
agctcccaccccacc

SEQ ID NO: 2105820 - DNA, 19 bp, Homo sapiens
agctcccatagcgctggct

SEQ ID NO: 2105821 - DNA, 22 bp, Homo sapiens
agctccccaaaaacctcacccg

SEQ ID NO: 2105822 - DNA, 15 bp, Homo sapiens
agctccccaggactc

SEQ ID NO: 2105823 - DNA, 22 bp, Homo sapiens
agctcccccttcccagtagctc

SEQ ID NO: 2105824 - DNA, 15 bp, Homo sapiens
agctccctagtggct

SEQ ID NO: 2105825 - DNA, 21 bp, Homo sapiens
agctcccttcccctgcctggt

SEQ ID NO: 2105826 - DNA, 16 bp, Homo sapiens
agctccgcctctgtcc

SEQ ID NO: 2105827 - DNA, 21 bp, Homo sapiens
agctccgctttctacccagcg

SEQ ID NO: 2105828 - DNA, 23 bp, Homo sapiens
agctccgctttctacccagcgag

SEQ ID NO: 2105829 - DNA, 21 bp, Homo sapiens
agctccgtcatctgcggggct

SEQ ID NO: 2105830 - DNA, 13 bp, Homo sapiens
agctcctctcctt

SEQ ID NO: 2105831 - DNA, 15 bp, Homo sapiens
agctcctctccttgg

SEQ ID NO: 2105832 - DNA, 22 bp, Homo sapiens
agctcctctccttgggctcctg

SEQ ID NO: 2105833 - DNA, 20 bp, Homo sapiens
agctcctcttaccgtagcct

SEQ ID NO: 2105834 - DNA, 13 bp, Homo sapiens
agctcctcttcct

SEQ ID NO: 2105835 - DNA, 14 bp, Homo sapiens
agctcctgggcagc

SEQ ID NO: 2105836 - DNA, 16 bp, Homo sapiens
agctcctgggcagctt

SEQ ID NO: 2105837 - DNA, 16 bp, Homo sapiens
agctcctgtccctacc

SEQ ID NO: 2105838 - DNA, 17 bp, Homo sapiens
agctcctgtccctaccc

SEQ ID NO: 2105839 - DNA, 22 bp, Homo sapiens
agctcctgtccctacccactct

SEQ ID NO: 2105840 - DNA, 16 bp, Homo sapiens
agctcctgtcctccca

SEQ ID NO: 2105841 - DNA, 21 bp, Homo sapiens
agctcctgtcctcccatcccc

SEQ ID NO: 2105842 - DNA, 13 bp, Homo sapiens
agctccttctgtc

SEQ ID NO: 2105843 - DNA, 16 bp, Homo sapiens
agctccttctgtccta

SEQ ID NO: 2105844 - DNA, 22 bp, Homo sapiens
agctccttctgtcctactctgt

SEQ ID NO: 2105845 - DNA, 23 bp, Homo sapiens
agctccttctgtcctactctgtg

SEQ ID NO: 2105846 - DNA, 17 bp, Homo sapiens
agctccttttgtcccca

SEQ ID NO: 2105847 - DNA, 18 bp, Homo sapiens
agctccttttgtccccag

SEQ ID NO: 2105848 - DNA, 22 bp, Homo sapiens
agctccttttgtccccagggcc

SEQ ID NO: 2105849 - DNA, 13 bp, Homo sapiens
agctcgctcttgg

SEQ ID NO: 2105850 - DNA, 19 bp, Homo sapiens
agctcggtggacccaggga

SEQ ID NO: 2105851 - DNA, 19 bp, Homo sapiens
agctctagttttcagcctt

SEQ ID NO: 2105852 - DNA, 20 bp, Homo sapiens
agctctagttttcagccttg

SEQ ID NO: 2105853 - DNA, 20 bp, Homo sapiens
agctctattaagatttccaa

SEQ ID NO: 2105854 - DNA, 11 bp, Homo sapiens
agctctccctc

SEQ ID NO: 2105855 - DNA, 13 bp, Homo sapiens
agctctccctctg

SEQ ID NO: 2105856 - DNA, 15 bp, Homo sapiens
agctctccctctggc

SEQ ID NO: 2105857 - DNA, 19 bp, Homo sapiens
agctctccctctggccctg

SEQ ID NO: 2105858 - DNA, 18 bp, Homo sapiens
agctctccggtctctctc

SEQ ID NO: 2105859 - DNA, 17 bp, Homo sapiens
agctctctgtataaaca

SEQ ID NO: 2105860 - DNA, 19 bp, Homo sapiens
agctctctttggaatgaac

SEQ ID NO: 2105861 - DNA, 16 bp, Homo sapiens
agctctgagaggccct

SEQ ID NO: 2105862 - DNA, 17 bp, Homo sapiens
agctctgagaggccctg

SEQ ID NO: 2105863 - DNA, 23 bp, Homo sapiens
agctctgagaggccctggatcag

SEQ ID NO: 2105864 - DNA, 16 bp, Homo sapiens
agctctgcatgtgtgt

SEQ ID NO: 2105865 - DNA, 17 bp, Homo sapiens
agctctgccgcaatggc

SEQ ID NO: 2105866 - DNA, 15 bp, Homo sapiens
agctctggccccagg

SEQ ID NO: 2105867 - DNA, 18 bp, Homo sapiens
agctctggccccaggctt

SEQ ID NO: 2105868 - DNA, 20 bp, Homo sapiens
agctctggcttccagaaaac

SEQ ID NO: 2105869 - DNA, 21 bp, Homo sapiens
agctctgtcctgggagtgagc

SEQ ID NO: 2105870 - DNA, 17 bp, Homo sapiens
agctctgtggcctgtgt

SEQ ID NO: 2105871 - DNA, 18 bp, Homo sapiens
agctctgtggcctgtgtc

SEQ ID NO: 2105872 - DNA, 17 bp, Homo sapiens
agctctgtttataaaaa

SEQ ID NO: 2105873 - DNA, 23 bp, Homo sapiens
agctcttctatttaaaaaataaa

SEQ ID NO: 2105874 - DNA, 17 bp, Homo sapiens
agctcttggcccctgtg

SEQ ID NO: 2105875 - DNA, 15 bp, Homo sapiens
agctctttcttcttt

SEQ ID NO: 2105876 - DNA, 21 bp, Homo sapiens
agctgaaacattccgaagagg

SEQ ID NO: 2105877 - DNA, 19 bp, Homo sapiens
agctgaacccattttgagt

SEQ ID NO: 2105878 - DNA, 18 bp, Homo sapiens
agctgaagtgaaggagaa

SEQ ID NO: 2105879 - DNA, 20 bp, Homo sapiens
agctgaagtgaaggagaaag

SEQ ID NO: 2105880 - DNA, 20 bp, Homo sapiens
agctgacacataatttgaat

SEQ ID NO: 2105881 - DNA, 21 bp, Homo sapiens
agctgacccagagtggagtct

SEQ ID NO: 2105882 - DNA, 18 bp, Homo sapiens
agcctggtttagcctgga

SEQ ID NO: 2105883 - DNA, 15 bp, Homo sapiens
agcctgtaatcccag

SEQ ID NO: 2105884 - DNA, 16 bp, Homo sapiens
agcctgtaatcccagc

SEQ ID NO: 2105885 - DNA, 18 bp, Homo sapiens
agcctgtgaacccaggac

SEQ ID NO: 2105886 - DNA, 20 bp, Homo sapiens
agcctgtgaacccaggacaa

SEQ ID NO: 2105887 - DNA, 22 bp, Homo sapiens
agcctgtgaacccaggacaagc

SEQ ID NO: 2105888 - DNA, 22 bp, Homo sapiens
agcctgtgattaacttgcttag

SEQ ID NO: 2105889 - DNA, 22 bp, Homo sapiens
agcctgtggcggtgcctgggtg

SEQ ID NO: 2105890 - DNA, 17 bp, Homo sapiens
agcctgtgggagtagaa

SEQ ID NO: 2105891 - DNA, 16 bp, Homo sapiens
agcctgttcatggcag

SEQ ID NO: 2105892 - DNA, 15 bp, Homo sapiens
agcctgttgctgaag

SEQ ID NO: 2105893 - DNA, 22 bp, Homo sapiens
agcctgttggacccgctctgga

SEQ ID NO: 2105894 - DNA, 16 bp, Homo sapiens
agccttaaatttttgt

SEQ ID NO: 2105895 - DNA, 18 bp, Homo sapiens
agccttaatcaggtcctc

SEQ ID NO: 2105896 - DNA, 16 bp, Homo sapiens
agccttactcacctct

SEQ ID NO: 2105897 - DNA, 20 bp, Homo sapiens
agccttagaagtcacacagt

SEQ ID NO: 2105898 - DNA, 23 bp, Homo sapiens
agccttcagtcttgaatttctaa

SEQ ID NO: 2105899 - DNA, 15 bp, Homo sapiens
agccttctctctctg

SEQ ID NO: 2105900 - DNA, 17 bp, Homo sapiens
agccttcttttcaaaac

SEQ ID NO: 2105901 - DNA, 15 bp, Homo sapiens
agccttgaaaaacaa

SEQ ID NO: 2105902 - DNA, 18 bp, Homo sapiens
agccttgcatcaagggct

SEQ ID NO: 2105903 - DNA, 12 bp, Homo sapiens
agccttgctcag

SEQ ID NO: 2105904 - DNA, 16 bp, Homo sapiens
agccttgctcaggtgc

SEQ ID NO: 2105905 - DNA, 23 bp, Homo sapiens
agccttggggattcttccatctg

SEQ ID NO: 2105906 - DNA, 19 bp, Homo sapiens
agccttggtgtccacctgg

SEQ ID NO: 2105907 - DNA, 21 bp, Homo sapiens
agccttggtgtccacctggcc

SEQ ID NO: 2105908 - DNA, 22 bp, Homo sapiens
agccttggtgtccacctggccc

SEQ ID NO: 2105909 - DNA, 13 bp, Homo sapiens
agccttgtgccct

SEQ ID NO: 2105910 - DNA, 15 bp, Homo sapiens
agccttgtgccctgc

SEQ ID NO: 2105911 - DNA, 21 bp, Homo sapiens
agccttgtgccctgcccccat

SEQ ID NO: 2105912 - DNA, 17 bp, Homo sapiens
agccttgtgtttctgtg

SEQ ID NO: 2105913 - DNA, 23 bp, Homo sapiens
agcctttctgtggagagtgagaa

SEQ ID NO: 2105914 - DNA, 13 bp, Homo sapiens
agcctttgccctg

SEQ ID NO: 2105915 - DNA, 18 bp, Homo sapiens
agcctttggatgaccaga

SEQ ID NO: 2105916 - DNA, 14 bp, Homo sapiens
agcgaaagtttctt

SEQ ID NO: 2105917 - DNA, 16 bp, Homo sapiens
agcgagagtctgtctc

SEQ ID NO: 2105918 - DNA, 13 bp, Homo sapiens
agcgagccctggt

SEQ ID NO: 2105919 - DNA, 19 bp, Homo sapiens
agcgagccctggtggcagt

SEQ ID NO: 2105920 - DNA, 14 bp, Homo sapiens
agcgagctgctctg

SEQ ID NO: 2105921 - DNA, 23 bp, Homo sapiens
agcgaggtcaacagagaaggcag

SEQ ID NO: 2105922 - DNA, 14 bp, Homo sapiens
agcgagttgtggaa

SEQ ID NO: 2105923 - DNA, 22 bp, Homo sapiens
agcgattcttctgcttcagcct

SEQ ID NO: 2105924 - DNA, 14 bp, Homo sapiens
agcgcacctgcccc

SEQ ID NO: 2105925 - DNA, 21 bp, Homo sapiens
agcgcagccgccgggcaggcc

SEQ ID NO: 2105926 - DNA, 22 bp, Homo sapiens
agcgcagccgccgggcaggcct

SEQ ID NO: 2105927 - DNA, 12 bp, Homo sapiens
agcgcagggagg

SEQ ID NO: 2105928 - DNA, 23 bp, Homo sapiens
agcgcagggaggatgccacagcc

SEQ ID NO: 2105929 - DNA, 14 bp, Homo sapiens
agcgcccagttggg

SEQ ID NO: 2105930 - DNA, 21 bp, Homo sapiens
agcgccctgcagaccctgccc

SEQ ID NO: 2105931 - DNA, 23 bp, Homo sapiens
agcgccctgcagaccctgccctt

SEQ ID NO: 2105932 - DNA, 22 bp, Homo sapiens
agcgcctagtggggtctccctc

SEQ ID NO: 2105933 - DNA, 23 bp, Homo sapiens
agcgcctagtggggtctccctct

SEQ ID NO: 2105934 - DNA, 22 bp, Homo sapiens
agcgcctccctccaccccagga

SEQ ID NO: 2105935 - DNA, 23 bp, Homo sapiens
agcgcctccctccaccccaggac

SEQ ID NO: 2105936 - DNA, 17 bp, Homo sapiens
agcgctatcttcacata

SEQ ID NO: 2105937 - DNA, 20 bp, Homo sapiens
agcgctctcttccagaagat

SEQ ID NO: 2105938 - DNA, 18 bp, Homo sapiens
agcgctgccgcaccccag

SEQ ID NO: 2105939 - DNA, 19 bp, Homo sapiens
agcgctgccgcaccccaga

SEQ ID NO: 2105940 - DNA, 21 bp, Homo sapiens
agcgctgccgcaccccagagt

SEQ ID NO: 2105941 - DNA, 16 bp, Homo sapiens
agcgctggctcaggaa

SEQ ID NO: 2105942 - DNA, 21 bp, Homo sapiens
agcgctttctggaaaagagga

SEQ ID NO: 2105943 - DNA, 15 bp, Homo sapiens
agcggaggagaccag

SEQ ID NO: 2105944 - DNA, 21 bp, Homo sapiens
agcggaggagaccagctcaga

SEQ ID NO: 2105945 - DNA, 23 bp, Homo sapiens
agcggaggttgcagggagccgag

SEQ ID NO: 2105946 - DNA, 17 bp, Homo sapiens
agcgggcctcttccctc

SEQ ID NO: 2105947 - DNA, 21 bp, Homo sapiens
agcggttgcttctggctcctc

SEQ ID NO: 2105948 - DNA, 16 bp, Homo sapiens
agcggtttccaggcca

SEQ ID NO: 2105949 - DNA, 19 bp, Homo sapiens
agcggtttccaggccaccg

SEQ ID NO: 2105950 - DNA, 17 bp, Homo sapiens
agcgtcagaggccctgg

SEQ ID NO: 2105951 - DNA, 20 bp, Homo sapiens
agcgtcccctgctactcctg

SEQ ID NO: 2105952 - DNA, 18 bp, Homo sapiens
agcgtccctagcagtgaa

SEQ ID NO: 2105953 - DNA, 13 bp, Homo sapiens
agcgtgagccact

SEQ ID NO: 2105954 - DNA, 22 bp, Homo sapiens
agcgtgagccactgcaccgggc

SEQ ID NO: 2105955 - DNA, 18 bp, Homo sapiens
agcgtggccttgttctgt

SEQ ID NO: 2105956 - DNA, 16 bp, Homo sapiens
agcgtggggtagcaga

SEQ ID NO: 2105957 - DNA, 13 bp, Homo sapiens
agctaaatccttt

SEQ ID NO: 2105958 - DNA, 17 bp, Homo sapiens
agctaatgaaattgaga

SEQ ID NO: 2105959 - DNA, 17 bp, Homo sapiens
agctaattaaggtttgc

SEQ ID NO: 2105960 - DNA, 18 bp, Homo sapiens
agctacacctgaggctga

SEQ ID NO: 2105961 - DNA, 15 bp, Homo sapiens
agctacataatttag

SEQ ID NO: 2105962 - DNA, 17 bp, Homo sapiens
agctacccaaaagagaa

SEQ ID NO: 2105963 - DNA, 20 bp, Homo sapiens
agctacccaaaagagaaaaa

SEQ ID NO: 2105964 - DNA, 19 bp, Homo sapiens
agctacctgtgtggacagg

SEQ ID NO: 2105965 - DNA, 18 bp, Homo sapiens
agctactcagaagcctga

SEQ ID NO: 2105966 - DNA, 13 bp, Homo sapiens
agcttaaataaat

SEQ ID NO: 2105967 - DNA, 17 bp, Homo sapiens
agcttaaataaattcaa

SEQ ID NO: 2105968 - DNA, 16 bp, Homo sapiens
agcttaacattgactt

SEQ ID NO: 2105969 - DNA, 18 bp, Homo sapiens
agcttagacctcagcctg

SEQ ID NO: 2105970 - DNA, 16 bp, Homo sapiens
agcttagccttgtgcc

SEQ ID NO: 2105971 - DNA, 15 bp, Homo sapiens
agcttatcatgctgt

SEQ ID NO: 2105972 - DNA, 20 bp, Homo sapiens
agcttatgggatccttgtct

SEQ ID NO: 2105973 - DNA, 22 bp, Homo sapiens
agcttatgggatccttgtcttt

SEQ ID NO: 2105974 - DNA, 20 bp, Homo sapiens
agcttattaaaactcatttt

SEQ ID NO: 2105975 - DNA, 14 bp, Homo sapiens
agcttattggccac

SEQ ID NO: 2105976 - DNA, 18 bp, Homo sapiens
agcttcaaccctcagcct

SEQ ID NO: 2105977 - DNA, 21 bp, Homo sapiens
agcttcaaccctcagccttga

SEQ ID NO: 2105978 - DNA, 15 bp, Homo sapiens
agcttcaagtgatat

SEQ ID NO: 2105979 - DNA, 20 bp, Homo sapiens
agcttcaagtgatatatgta

SEQ ID NO: 2105980 - DNA, 21 bp, Homo sapiens
agcttcagaagtttggcaata

SEQ ID NO: 2105981 - DNA, 15 bp, Homo sapiens
agcttcagagcctag

SEQ ID NO: 2105982 - DNA, 17 bp, Homo sapiens
agcttcatcaattttta

SEQ ID NO: 2105983 - DNA, 23 bp, Homo sapiens
agcttcatcaatttttatacata

SEQ ID NO: 2105984 - DNA, 15 bp, Homo sapiens
agcttcatgcctcag

SEQ ID NO: 2105985 - DNA, 17 bp, Homo sapiens
agcttcatgcctcagtt

SEQ ID NO: 2105986 - DNA, 19 bp, Homo sapiens
agcttcatttgtgtcaatg

SEQ ID NO: 2105987 - DNA, 18 bp, Homo sapiens
agcttctctgccaagccc

SEQ ID NO: 2105988 - DNA, 15 bp, Homo sapiens
agcttgaccagacct

SEQ ID NO: 2105989 - DNA, 23 bp, Homo sapiens
agcttgaccagacctagacctgg

SEQ ID NO: 2105990 - DNA, 18 bp, Homo sapiens
agcttgagggttgggctg

SEQ ID NO: 2105991 - DNA, 22 bp, Homo sapiens
agcttgatgttggatctcaaga

SEQ ID NO: 2105992 - DNA, 21 bp, Homo sapiens
agcttgcaagaagcaggaagg

SEQ ID NO: 2105993 - DNA, 19 bp, Homo sapiens
agcttgccctgttaaaaga

SEQ ID NO: 2105994 - DNA, 14 bp, Homo sapiens
agcttgctcttcag

SEQ ID NO: 2105995 - DNA, 22 bp, Homo sapiens
agcttgctcttcagtgggagaa

SEQ ID NO: 2105996 - DNA, 19 bp, Homo sapiens
agcttgtaaatagctcagg

SEQ ID NO: 2105997 - DNA, 20 bp, Homo sapiens
agcttgtaaatagctcaggt

SEQ ID NO: 2105998 - DNA, 18 bp, Homo sapiens
agcttgtatagtgtaaaa

SEQ ID NO: 2105999 - DNA, 21 bp, Homo sapiens
agcttgtatagtgtaaaataa

SEQ ID NO: 2106000 - DNA, 15 bp, Homo sapiens
agcttgtatatacat

SEQ ID NO: 2106001 - DNA, 23 bp, Homo sapiens
agcttgtatatacatattataaa

SEQ ID NO: 2106002 - DNA, 16 bp, Homo sapiens
agcttgtgagagctgg

SEQ ID NO: 2106003 - DNA, 13 bp, Homo sapiens
agctttacacaca

SEQ ID NO: 2106004 - DNA, 19 bp, Homo sapiens
agctttacatgcaatttat

SEQ ID NO: 2106005 - DNA, 21 bp, Homo sapiens
agctttacatgcaatttatta

SEQ ID NO: 2106006 - DNA, 16 bp, Homo sapiens
agctttatctgtcaca

SEQ ID NO: 2106007 - DNA, 19 bp, Homo sapiens
agctttatttatttctttg

SEQ ID NO: 2106008 - DNA, 22 bp, Homo sapiens
agctttattttttaagtattta

SEQ ID NO: 2106009 - DNA, 13 bp, Homo sapiens
agctttcagagcc

SEQ ID NO: 2106010 - DNA, 16 bp, Homo sapiens
agctttcagagccagt

SEQ ID NO: 2106011 - DNA, 22 bp, Homo sapiens
agctttcatcacacccttttaa

SEQ ID NO: 2106012 - DNA, 20 bp, Homo sapiens
agctttcatttgacacacag

SEQ ID NO: 2106013 - DNA, 16 bp, Homo sapiens
agctttccacaggagg

SEQ ID NO: 2106014 - DNA, 16 bp, Homo sapiens
agctttctcagggggt

SEQ ID NO: 2106015 - DNA, 12 bp, Homo sapiens
agctttctcctt

SEQ ID NO: 2106016 - DNA, 14 bp, Homo sapiens
agctttctttcaca

SEQ ID NO: 2106017 - DNA, 20 bp, Homo sapiens
agctttctttcacaaaaaag

SEQ ID NO: 2106018 - DNA, 19 bp, Homo sapiens
agctttgaaggccgaaggc

SEQ ID NO: 2106019 - DNA, 18 bp, Homo sapiens
agctttgaatacccccag

SEQ ID NO: 2106020 - DNA, 20 bp, Homo sapiens
agctttgaatacccccagag

SEQ ID NO: 2106021 - DNA, 23 bp, Homo sapiens
agctttgaatacccccagagacc

SEQ ID NO: 2106022 - DNA, 10 bp, Homo sapiens
agctttgcta

SEQ ID NO: 2106023 - DNA, 18 bp, Homo sapiens
agctttgctctttggtag

SEQ ID NO: 2106024 - DNA, 20 bp, Homo sapiens
agctttgggttggagctgtt

SEQ ID NO: 2106025 - DNA, 17 bp, Homo sapiens
agctttggtgcaatggc

SEQ ID NO: 2106026 - DNA, 19 bp, Homo sapiens
agcttttaataaaattgac

SEQ ID NO: 2106027 - DNA, 15 bp, Homo sapiens
agcttttattgtata

SEQ ID NO: 2106028 - DNA, 16 bp, Homo sapiens
agcttttcatggaagt

SEQ ID NO: 2106029 - DNA, 23 bp, Homo sapiens
agcttttcatggaagtggcagtg

SEQ ID NO: 2106030 - DNA, 13 bp, Homo sapiens
agcttttgctttt

SEQ ID NO: 2106031 - DNA, 18 bp, Homo sapiens
aggaaaaaaaataatgta

SEQ ID NO: 2106032 - DNA, 18 bp, Homo sapiens
aggaaaacaaatcactgt

SEQ ID NO: 2106033 - DNA, 19 bp, Homo sapiens
aggaaaaccaagccgtggc

SEQ ID NO: 2106034 - DNA, 14 bp, Homo sapiens
aggaaaaccaggga

SEQ ID NO: 2106035 - DNA, 17 bp, Homo sapiens
aggaaaaccagggatag

SEQ ID NO: 2106036 - DNA, 18 bp, Homo sapiens
aggaaaaccagggatagc

SEQ ID NO: 2106037 - DNA, 13 bp, Homo sapiens
aggaaaagaaaag

SEQ ID NO: 2106038 - DNA, 14 bp, Homo sapiens
aggaaaagctgctg

SEQ ID NO: 2106039 - DNA, 16 bp, Homo sapiens
aggaaaagctgctgac

SEQ ID NO: 2106040 - DNA, 14 bp, Homo sapiens
aggaaaaggcctgg

SEQ ID NO: 2106041 - DNA, 16 bp, Homo sapiens
aggaaaagtacattta

SEQ ID NO: 2106042 - DNA, 22 bp, Homo sapiens
aggaaaagtacatttaatacag

SEQ ID NO: 2106043 - DNA, 18 bp, Homo sapiens
aggaaaagtgcaatgcgt

SEQ ID NO: 2106044 - DNA, 19 bp, Homo sapiens
aggaaaagtgcaatgcgtg

SEQ ID NO: 2106045 - DNA, 21 bp, Homo sapiens
aggaaaattttagcgtgctca

SEQ ID NO: 2106046 - DNA, 12 bp, Homo sapiens
aggaaaccaaag

SEQ ID NO: 2106047 - DNA, 22 bp, Homo sapiens
aggaaacccaaggaacaagaga

SEQ ID NO: 2106048 - DNA, 12 bp, Homo sapiens
aggaaacctggc

SEQ ID NO: 2106049 - DNA, 20 bp, Homo sapiens
aggaaactcctgacagtctt

SEQ ID NO: 2106050 - DNA, 18 bp, Homo sapiens
aggaaagaaaactaacaa

SEQ ID NO: 2106051 - DNA, 11 bp, Homo sapiens
aggaaagcacc

SEQ ID NO: 2106052 - DNA, 21 bp, Homo sapiens
aggaaagcaccgcagcatgtg

SEQ ID NO: 2106053 - DNA, 20 bp, Homo sapiens
aggaaagccccagcactaac

SEQ ID NO: 2106054 - DNA, 14 bp, Homo sapiens
aggaaataaaacct

SEQ ID NO: 2106055 - DNA, 16 bp, Homo sapiens
aggaaatagtgttctt

SEQ ID NO: 2106056 - DNA, 23 bp, Homo sapiens
aggaaatgtggtagcctcacttt

SEQ ID NO: 2106057 - DNA, 19 bp, Homo sapiens
aggaaattaaagtcttcca

SEQ ID NO: 2106058 - DNA, 19 bp, Homo sapiens
aggaacacccggaaagact

SEQ ID NO: 2106059 - DNA, 20 bp, Homo sapiens
aggaacacccggaaagactg

SEQ ID NO: 2106060 - DNA, 21 bp, Homo sapiens
aggaactctggcttccaggta

SEQ ID NO: 2106061 - DNA, 22 bp, Homo sapiens
aggaactcttaagcaatggtaa

SEQ ID NO: 2106062 - DNA, 12 bp, Homo sapiens
aggaactggaac

SEQ ID NO: 2106063 - DNA, 21 bp, Homo sapiens
aggaagaaaccccaagcagca

SEQ ID NO: 2106064 - DNA, 12 bp, Homo sapiens
aggaagagagag

SEQ ID NO: 2106065 - DNA, 19 bp, Homo sapiens
aggaagagagagagagagg

SEQ ID NO: 2106066 - DNA, 15 bp, Homo sapiens
aggaagatgaagaga

SEQ ID NO: 2106067 - DNA, 18 bp, Homo sapiens
aggaagatgaagagaagc

SEQ ID NO: 2106068 - DNA, 16 bp, Homo sapiens
aggaagcaagaaagcc

SEQ ID NO: 2106069 - DNA, 18 bp, Homo sapiens
aggaagccacagctggtg

SEQ ID NO: 2106070 - DNA, 20 bp, Homo sapiens
aggaagccaggctgagtgag

SEQ ID NO: 2106071 - DNA, 17 bp, Homo sapiens
aggaagcccaaggcagt

SEQ ID NO: 2106072 - DNA, 15 bp, Homo sapiens
aggaagctccactgt

SEQ ID NO: 2106073 - DNA, 16 bp, Homo sapiens
aggaagctctctttcc

SEQ ID NO: 2106074 - DNA, 21 bp, Homo sapiens
aggaaggagactcacctctgc

SEQ ID NO: 2106075 - DNA, 21 bp, Homo sapiens
aggaaggcaaagcccctggaa

SEQ ID NO: 2106076 - DNA, 15 bp, Homo sapiens
aggaaggcagctgct

SEQ ID NO: 2106077 - DNA, 16 bp, Homo sapiens
aggaaggcagctgctc

SEQ ID NO: 2106078 - DNA, 18 bp, Homo sapiens
aggaaggcagctgctctt

SEQ ID NO: 2106079 - DNA, 22 bp, Homo sapiens
aggaaggcagggaggaggcaga

SEQ ID NO: 2106080 - DNA, 14 bp, Homo sapiens
aggaagggactgac

SEQ ID NO: 2106081 - DNA, 14 bp, Homo sapiens
aggaaggtgctgag

SEQ ID NO: 2106082 - DNA, 18 bp, Homo sapiens
aggaaggttttctccact

SEQ ID NO: 2106083 - DNA, 21 bp, Homo sapiens
aggaagtgggggccgctggcc

SEQ ID NO: 2106084 - DNA, 24 bp, Homo sapiens
aggaagtgggggccgctggcccag

SEQ ID NO: 2106085 - DNA, 20 bp, Homo sapiens
aggaagttttgagtttctct

SEQ ID NO: 2106086 - DNA, 20 bp, Homo sapiens
aggaataaattgctccttga

SEQ ID NO: 2106087 - DNA, 12 bp, Homo sapiens
aggaataagaat

SEQ ID NO: 2106088 - DNA, 15 bp, Homo sapiens
aggaatatgttcaat

SEQ ID NO: 2106089 - DNA, 15 bp, Homo sapiens
aggaatcagctgcag

SEQ ID NO: 2106090 - DNA, 22 bp, Homo sapiens
aggaatcatgtcaggcctgtgt

SEQ ID NO: 2106091 - DNA, 20 bp, Homo sapiens
aggaatccagacccggctgc

SEQ ID NO: 2106092 - DNA, 12 bp, Homo sapiens
aggaatcctttg

SEQ ID NO: 2106093 - DNA, 23 bp, Homo sapiens
aggaatcctttgagaatgtgatt

SEQ ID NO: 2106094 - DNA, 15 bp, Homo sapiens
aggaatctcagagac

SEQ ID NO: 2106095 - DNA, 14 bp, Homo sapiens
aggaatgttaaagt

SEQ ID NO: 2106096 - DNA, 23 bp, Homo sapiens
aggaattaagttagggaatggca

SEQ ID NO: 2106097 - DNA, 21 bp, Homo sapiens
aggaattgaagatgtaaggaa

SEQ ID NO: 2106098 - DNA, 14 bp, Homo sapiens
aggaattttctttg

SEQ ID NO: 2106099 - DNA, 18 bp, Homo sapiens
aggacaaagagaataaag

SEQ ID NO: 2106100 - DNA, 15 bp, Homo sapiens
aggacaacctgcccc

SEQ ID NO: 2106101 - DNA, 14 bp, Homo sapiens
aggacaattcactt

SEQ ID NO: 2106102 - DNA, 12 bp, Homo sapiens
aggacacaggcc

SEQ ID NO: 2106103 - DNA, 14 bp, Homo sapiens
aggacacaggcctg

SEQ ID NO: 2106104 - DNA, 16 bp, Homo sapiens
aggacacaggcctgtg

SEQ ID NO: 2106105 - DNA, 21 bp, Homo sapiens
aggacacatcccggcctcttc

SEQ ID NO: 2106106 - DNA, 23 bp, Homo sapiens
aggacacatcccggcctcttcca

SEQ ID NO: 2106107 - DNA, 11 bp, Homo sapiens
aggacacatgt

SEQ ID NO: 2106108 - DNA, 10 bp, Homo sapiens
aggacacctg

SEQ ID NO: 2106109 - DNA, 11 bp, Homo sapiens
aggacacctgc

SEQ ID NO: 2106110 - DNA, 12 bp, Homo sapiens
aggacacctgcc

SEQ ID NO: 2106111 - DNA, 15 bp, Homo sapiens
aggacacctgcccca

SEQ ID NO: 2106112 - DNA, 17 bp, Homo sapiens
aggacacctgccccagc

SEQ ID NO: 2106113 - DNA, 19 bp, Homo sapiens
aggacacctgccccagcgc

SEQ ID NO: 2106114 - DNA, 22 bp, Homo sapiens
aggacacctgccccagcgcggc

SEQ ID NO: 2106115 - DNA, 23 bp, Homo sapiens
aggacacctgccccagcgcggct

SEQ ID NO: 2106116 - DNA, 18 bp, Homo sapiens
aggacactaaccacgctg

SEQ ID NO: 2106117 - DNA, 15 bp, Homo sapiens
aggacagctggctgc

SEQ ID NO: 2106118 - DNA, 22 bp, Homo sapiens
aggacagctggctgctgacagg

SEQ ID NO: 2106119 - DNA, 15 bp, Homo sapiens
aggacagtgcttcag

SEQ ID NO: 2106120 - DNA, 16 bp, Homo sapiens
aggacagtgcttcagc

SEQ ID NO: 2106121 - DNA, 17 bp, Homo sapiens
aggacagtgcttcagcc

SEQ ID NO: 2106122 - DNA, 21 bp, Homo sapiens
aggacatgatggagcgcacct

SEQ ID NO: 2106123 - DNA, 16 bp, Homo sapiens
aggacatggggcatag

SEQ ID NO: 2106124 - DNA, 18 bp, Homo sapiens
aggacatggggcatagaa

SEQ ID NO: 2106125 - DNA, 22 bp, Homo sapiens
aggacatggggcatagaaactg

SEQ ID NO: 2106126 - DNA, 15 bp, Homo sapiens
aggacattatgtgtg

SEQ ID NO: 2106127 - DNA, 15 bp, Homo sapiens
aggacattgcggaca

SEQ ID NO: 2106128 - DNA, 17 bp, Homo sapiens
aggacattgcggacagc

SEQ ID NO: 2106129 - DNA, 21 bp, Homo sapiens
aggaccaactggcttctgtgc

SEQ ID NO: 2106130 - DNA, 14 bp, Homo sapiens
aggaccaatgttgt

SEQ ID NO: 2106131 - DNA, 22 bp, Homo sapiens
aggaccacactttgagaacctg

SEQ ID NO: 2106132 - DNA, 16 bp, Homo sapiens
aggaccacagtgggtg

SEQ ID NO: 2106133 - DNA, 22 bp, Homo sapiens
aggaccaggactatagcccagg

SEQ ID NO: 2106134 - DNA, 16 bp, Homo sapiens
aggacccacccatctt

SEQ ID NO: 2106135 - DNA, 11 bp, Homo sapiens
aggacccaggc

SEQ ID NO: 2106136 - DNA, 13 bp, Homo sapiens
aggacccaggccc

SEQ ID NO: 2106137 - DNA, 15 bp, Homo sapiens
aggacccaggccctc

SEQ ID NO: 2106138 - DNA, 19 bp, Homo sapiens
aggacccaggccctccatg

SEQ ID NO: 2106139 - DNA, 14 bp, Homo sapiens
aggacccaggccgc

SEQ ID NO: 2106140 - DNA, 14 bp, Homo sapiens
aggaccctggctct

SEQ ID NO: 2106141 - DNA, 17 bp, Homo sapiens
aggaccgtggccctgcc

SEQ ID NO: 2106142 - DNA, 19 bp, Homo sapiens
aggaccgtggccctgccct

SEQ ID NO: 2106143 - DNA, 14 bp, Homo sapiens
aggacctcaggcgg

SEQ ID NO: 2106144 - DNA, 22 bp, Homo sapiens
aggacctcatatcttcctcatc

SEQ ID NO: 2106145 - DNA, 14 bp, Homo sapiens
aggacctgagcctg

SEQ ID NO: 2106146 - DNA, 17 bp, Homo sapiens
aggacgccactcatttc

SEQ ID NO: 2106147 - DNA, 18 bp, Homo sapiens
aggacgccactcatttca

SEQ ID NO: 2106148 - DNA, 23 bp, Homo sapiens
aggacgccactcatttcatctca

SEQ ID NO: 2106149 - DNA, 13 bp, Homo sapiens
aggactccctcca

SEQ ID NO: 2106150 - DNA, 20 bp, Homo sapiens
aggactccctccatgtggcc

SEQ ID NO: 2106151 - DNA, 18 bp, Homo sapiens
aggactccgggaccattg

SEQ ID NO: 2106152 - DNA, 14 bp, Homo sapiens
aggactctgaggct

SEQ ID NO: 2106153 - DNA, 17 bp, Homo sapiens
aggactctgccccttct

SEQ ID NO: 2106154 - DNA, 18 bp, Homo sapiens
aggactctgccccttctg

SEQ ID NO: 2106155 - DNA, 16 bp, Homo sapiens
aggactctgcctcctc

SEQ ID NO: 2106156 - DNA, 19 bp, Homo sapiens
aggactctgcctcctcttc

SEQ ID NO: 2106157 - DNA, 13 bp, Homo sapiens
aggactctggcct

SEQ ID NO: 2106158 - DNA, 15 bp, Homo sapiens
aggactctggcctct

SEQ ID NO: 2106159 - DNA, 20 bp, Homo sapiens
aggactgaattgtccccagt

SEQ ID NO: 2106160 - DNA, 14 bp, Homo sapiens
aggactgaggagtg

SEQ ID NO: 2106161 - DNA, 22 bp, Homo sapiens
aggactggagaccgcttcaccc

SEQ ID NO: 2106162 - DNA, 16 bp, Homo sapiens
aggactggctcacccc

SEQ ID NO: 2106163 - DNA, 17 bp, Homo sapiens
aggacttaacggctcca

SEQ ID NO: 2106164 - DNA, 20 bp, Homo sapiens
aggacttaacggctccagga

SEQ ID NO: 2106165 - DNA, 21 bp, Homo sapiens
aggacttaacggctccaggat

SEQ ID NO: 2106166 - DNA, 13 bp, Homo sapiens
aggacttctgcag

SEQ ID NO: 2106167 - DNA, 15 bp, Homo sapiens
aggacttctgcctga

SEQ ID NO: 2106168 - DNA, 16 bp, Homo sapiens
aggacttgagcctcca

SEQ ID NO: 2106169 - DNA, 20 bp, Homo sapiens
aggacttggtctgatttcag

SEQ ID NO: 2106170 - DNA, 13 bp, Homo sapiens
aggacttgtgtct

SEQ ID NO: 2106171 - DNA, 20 bp, Homo sapiens
aggactttgatgcatttcca

SEQ ID NO: 2106172 - DNA, 19 bp, Homo sapiens
aggacttttctttgtggct

SEQ ID NO: 2106173 - DNA, 18 bp, Homo sapiens
aggagaaacagagacagg

SEQ ID NO: 2106174 - DNA, 16 bp, Homo sapiens
aggagaaaggagccgg

SEQ ID NO: 2106175 - DNA, 17 bp, Homo sapiens
aggagaaaggagccgga

SEQ ID NO: 2106176 - DNA, 13 bp, Homo sapiens
aggagaagagaca

SEQ ID NO: 2106177 - DNA, 16 bp, Homo sapiens
aggagaagcagcctcc

SEQ ID NO: 2106178 - DNA, 12 bp, Homo sapiens
aggagaaggaag

SEQ ID NO: 2106179 - DNA, 18 bp, Homo sapiens
aggagacaagaaatccag

SEQ ID NO: 2106180 - DNA, 20 bp, Homo sapiens
aggagacacgtgtggcgggc

SEQ ID NO: 2106181 - DNA, 18 bp, Homo sapiens
aggagacagttcaagaaa

SEQ ID NO: 2106182 - DNA, 14 bp, Homo sapiens
aggagacccacagg

SEQ ID NO: 2106183 - DNA, 13 bp, Homo sapiens
aggagactcacct

SEQ ID NO: 2106184 - DNA, 16 bp, Homo sapiens
aggagactcacctctg

SEQ ID NO: 2106185 - DNA, 18 bp, Homo sapiens
aggagactcacctctgcc

SEQ ID NO: 2106186 - DNA, 16 bp, Homo sapiens
aggagagaagaaagtg

SEQ ID NO: 2106187 - DNA, 17 bp, Homo sapiens
aggagagactgaaagca

SEQ ID NO: 2106188 - DNA, 22 bp, Homo sapiens
aggagagactgaaagcagcagc

SEQ ID NO: 2106189 - DNA, 21 bp, Homo sapiens
aggagagagatctagaaagtg

SEQ ID NO: 2106190 - DNA, 18 bp, Homo sapiens
aggagaggggcagaacag

SEQ ID NO: 2106191 - DNA, 19 bp, Homo sapiens
aggagaggggcagaacagc

SEQ ID NO: 2106192 - DNA, 20 bp, Homo sapiens
aggagatataaaatctagat

SEQ ID NO: 2106193 - DNA, 13 bp, Homo sapiens
aggagatcagggc

SEQ ID NO: 2106194 - DNA, 20 bp, Homo sapiens
aggagatggaagttgcagtg

SEQ ID NO: 2106195 - DNA, 14 bp, Homo sapiens
aggagatgggcctt

SEQ ID NO: 2106196 - DNA, 15 bp, Homo sapiens
aggagattttccttc

SEQ ID NO: 2106197 - DNA, 13 bp, Homo sapiens
aggagcaaagcct

SEQ ID NO: 2106198 - DNA, 15 bp, Homo sapiens
aggagcaaagcctgt

SEQ ID NO: 2106199 - DNA, 17 bp, Homo sapiens
aggagcaaatgtttctg

SEQ ID NO: 2106200 - DNA, 19 bp, Homo sapiens
aggagcaaatgtttctgca

SEQ ID NO: 2106201 - DNA, 22 bp, Homo sapiens
aggagcaaatgtttctgcagta

SEQ ID NO: 2106202 - DNA, 13 bp, Homo sapiens
aggagcacacggc

SEQ ID NO: 2106203 - DNA, 16 bp, Homo sapiens
aggagcacacggccct

SEQ ID NO: 2106204 - DNA, 17 bp, Homo sapiens
aggagcacacggccctg

SEQ ID NO: 2106205 - DNA, 20 bp, Homo sapiens
aggagcacacggccctgccc

SEQ ID NO: 2106206 - DNA, 13 bp, Homo sapiens
aggagcagacaga

SEQ ID NO: 2106207 - DNA, 14 bp, Homo sapiens
aggagcagacagag

SEQ ID NO: 2106208 - DNA, 15 bp, Homo sapiens
aggagcagacagaga

SEQ ID NO: 2106209 - DNA, 16 bp, Homo sapiens
aggagcagacagagaa

SEQ ID NO: 2106210 - DNA, 20 bp, Homo sapiens
aggagcccagagggccaaga

SEQ ID NO: 2106211 - DNA, 15 bp, Homo sapiens
aggccaagctgaagt

SEQ ID NO: 2106212 - DNA, 21 bp, Homo sapiens
aggccacatgtcaccgtggac

SEQ ID NO: 2106213 - DNA, 12 bp, Homo sapiens
aggccaccagga

SEQ ID NO: 2106214 - DNA, 13 bp, Homo sapiens
aggccaccaggat

SEQ ID NO: 2106215 - DNA, 19 bp, Homo sapiens
aggccaccgggacagacct

SEQ ID NO: 2106216 - DNA, 20 bp, Homo sapiens
aggccaccgggacagacctg

SEQ ID NO: 2106217 - DNA, 13 bp, Homo sapiens
aggccactcctcc

SEQ ID NO: 2106218 - DNA, 14 bp, Homo sapiens
aggccactcctcca

SEQ ID NO: 2106219 - DNA, 21 bp, Homo sapiens
aggccactgtggccagagctg

SEQ ID NO: 2106220 - DNA, 14 bp, Homo sapiens
aggccagagggagt

SEQ ID NO: 2106221 - DNA, 22 bp, Homo sapiens
aggccagccccatcttggtcct

SEQ ID NO: 2106222 - DNA, 15 bp, Homo sapiens
aggccagcctggcct

SEQ ID NO: 2106223 - DNA, 17 bp, Homo sapiens
aggccagcctggcctcc

SEQ ID NO: 2106224 - DNA, 21 bp, Homo sapiens
aggccagcctggcctcctgcc

SEQ ID NO: 2106225 - DNA, 23 bp, Homo sapiens
aggccagcctggcctcctgcctc

SEQ ID NO: 2106226 - DNA, 16 bp, Homo sapiens
aggccaggccaccagg

SEQ ID NO: 2106227 - DNA, 18 bp, Homo sapiens
aggccaggccaccaggat

SEQ ID NO: 2106228 - DNA, 14 bp, Homo sapiens
aggccagggaaagc

SEQ ID NO: 2106229 - DNA, 20 bp, Homo sapiens
aggccaggttatgcctcatg

SEQ ID NO: 2106230 - DNA, 18 bp, Homo sapiens
aggccagtgccaggacag

SEQ ID NO: 2106231 - DNA, 24 bp, Homo sapiens
aggccagtgccaggacagctggct

SEQ ID NO: 2106232 - DNA, 18 bp, Homo sapiens
aggccatgggcctcctgt

SEQ ID NO: 2106233 - DNA, 12 bp, Homo sapiens
aggcccaagaga

SEQ ID NO: 2106234 - DNA, 13 bp, Homo sapiens
aggcccagcagac

SEQ ID NO: 2106235 - DNA, 17 bp, Homo sapiens
aggcccagcctgtcctg

SEQ ID NO: 2106236 - DNA, 15 bp, Homo sapiens
aggcccagggagcaa

SEQ ID NO: 2106237 - DNA, 12 bp, Homo sapiens
aggcccatctca

SEQ ID NO: 2106238 - DNA, 21 bp, Homo sapiens
aggccccaaggggtttctgtt

SEQ ID NO: 2106239 - DNA, 14 bp, Homo sapiens
aggccccaggccct

SEQ ID NO: 2106240 - DNA, 16 bp, Homo sapiens
aggccccatgacctcc

SEQ ID NO: 2106241 - DNA, 18 bp, Homo sapiens
aggcccccacctggctca

SEQ ID NO: 2106242 - DNA, 22 bp, Homo sapiens
aggccccccgcagcaccctgca

SEQ ID NO: 2106243 - DNA, 12 bp, Homo sapiens
aggcccctgagg

SEQ ID NO: 2106244 - DNA, 15 bp, Homo sapiens
aggcccctgaggact

SEQ ID NO: 2106245 - DNA, 16 bp, Homo sapiens
aggcccctgaggactg

SEQ ID NO: 2106246 - DNA, 20 bp, Homo sapiens
aggcccctgaggactggaga

SEQ ID NO: 2106247 - DNA, 18 bp, Homo sapiens
aggcccctgccaccctgg

SEQ ID NO: 2106248 - DNA, 18 bp, Homo sapiens
aggcccgacagagagatg

SEQ ID NO: 2106249 - DNA, 21 bp, Homo sapiens
aggcccgacagagagatgaag

SEQ ID NO: 2106250 - DNA, 21 bp, Homo sapiens
aggcccggcccagcctaggcc

SEQ ID NO: 2106251 - DNA, 14 bp, Homo sapiens
aggcccggctccag

SEQ ID NO: 2106252 - DNA, 20 bp, Homo sapiens
aggcccggctccaggctcct

SEQ ID NO: 2106253 - DNA, 17 bp, Homo sapiens
aggccctaggattcctc

SEQ ID NO: 2106254 - DNA, 10 bp, Homo sapiens
aggccctccc

SEQ ID NO: 2106255 - DNA, 17 bp, Homo sapiens
aggccctccctgactcc

SEQ ID NO: 2106256 - DNA, 13 bp, Homo sapiens
aggccctggatca

SEQ ID NO: 2106257 - DNA, 23 bp, Homo sapiens
aggccctggatcagcgtggcctt

SEQ ID NO: 2106258 - DNA, 14 bp, Homo sapiens
aggccctgtctgta

SEQ ID NO: 2106259 - DNA, 17 bp, Homo sapiens
aggcccttcctctccac

SEQ ID NO: 2106260 - DNA, 18 bp, Homo sapiens
aggcccttcctctccact

SEQ ID NO: 2106261 - DNA, 22 bp, Homo sapiens
aggcccttcctctccactgcct

SEQ ID NO: 2106262 - DNA, 23 bp, Homo sapiens
aggcccttggggttcccccagac

SEQ ID NO: 2106263 - DNA, 21 bp, Homo sapiens
aggcccttgtcctgccagctg

SEQ ID NO: 2106264 - DNA, 23 bp, Homo sapiens
aggcccttgtcctgccagctgcc

SEQ ID NO: 2106265 - DNA, 14 bp, Homo sapiens
aggccgcctgccat

SEQ ID NO: 2106266 - DNA, 15 bp, Homo sapiens
aggccgcctgccata

SEQ ID NO: 2106267 - DNA, 20 bp, Homo sapiens
aggccgctgccccagccccg

SEQ ID NO: 2106268 - DNA, 23 bp, Homo sapiens
aggccgggcttgggccctgcaca

SEQ ID NO: 2106269 - DNA, 14 bp, Homo sapiens
aggccgtgtctctg

SEQ ID NO: 2106270 - DNA, 18 bp, Homo sapiens
aggccgttccccttggct

SEQ ID NO: 2106271 - DNA, 21 bp, Homo sapiens
aggccgttccccttggcttcc

SEQ ID NO: 2106272 - DNA, 16 bp, Homo sapiens
aggcctaaaagtaaac

SEQ ID NO: 2106273 - DNA, 11 bp, Homo sapiens
aggcctatcaa

SEQ ID NO: 2106274 - DNA, 11 bp, Homo sapiens
aggcctcagtt

SEQ ID NO: 2106275 - DNA, 13 bp, Homo sapiens
aggcctcagttct

SEQ ID NO: 2106276 - DNA, 15 bp, Homo sapiens
aggcctcatccctcg

SEQ ID NO: 2106277 - DNA, 18 bp, Homo sapiens
aggcctcatctcctttat

SEQ ID NO: 2106278 - DNA, 13 bp, Homo sapiens
aggcctccctcaa

SEQ ID NO: 2106279 - DNA, 15 bp, Homo sapiens
aggcctcctctctgc

SEQ ID NO: 2106280 - DNA, 19 bp, Homo sapiens
aggcctcgtaccagccagg

SEQ ID NO: 2106281 - DNA, 13 bp, Homo sapiens
aggcctctgtgtc

SEQ ID NO: 2106282 - DNA, 18 bp, Homo sapiens
aggcctcttggacctctg

SEQ ID NO: 2106283 - DNA, 22 bp, Homo sapiens
aggcctcttggacctctgctct

SEQ ID NO: 2106284 - DNA, 14 bp, Homo sapiens
aggcctcttgtgct

SEQ ID NO: 2106285 - DNA, 15 bp, Homo sapiens
aggcctcttgtgctc

SEQ ID NO: 2106286 - DNA, 17 bp, Homo sapiens
aggcctgccctcaggga

SEQ ID NO: 2106287 - DNA, 15 bp, Homo sapiens
aggcctgctcaggga

SEQ ID NO: 2106288 - DNA, 18 bp, Homo sapiens
aggcctggaaccagggag

SEQ ID NO: 2106289 - DNA, 22 bp, Homo sapiens
aggcctggaaccagggaggaga

SEQ ID NO: 2106290 - DNA, 12 bp, Homo sapiens
aggcctggccag

SEQ ID NO: 2106291 - DNA, 17 bp, Homo sapiens
aggcctggccagatgca

SEQ ID NO: 2106292 - DNA, 21 bp, Homo sapiens
aggcctggccagatgcaccag

SEQ ID NO: 2106293 - DNA, 22 bp, Homo sapiens
aggcctggccagatgcaccagc

SEQ ID NO: 2106294 - DNA, 11 bp, Homo sapiens
aggcctggggt

SEQ ID NO: 2106295 - DNA, 18 bp, Homo sapiens
aggcctggggtgacccgg

SEQ ID NO: 2106296 - DNA, 20 bp, Homo sapiens
aggcctggggtgacccggca

SEQ ID NO: 2106297 - DNA, 12 bp, Homo sapiens
aggcctgtgtgt

SEQ ID NO: 2106298 - DNA, 18 bp, Homo sapiens
aggccttctctgaaggac

SEQ ID NO: 2106299 - DNA, 14 bp, Homo sapiens
aggcctttaaccat

SEQ ID NO: 2106300 - DNA, 16 bp, Homo sapiens
aggccttttggaatgt

SEQ ID NO: 2106301 - DNA, 12 bp, Homo sapiens
aggcgaataaat

SEQ ID NO: 2106302 - DNA, 13 bp, Homo sapiens
aggcgaataaatg

SEQ ID NO: 2106303 - DNA, 15 bp, Homo sapiens
aggcgaataaatgtt

SEQ ID NO: 2106304 - DNA, 21 bp, Homo sapiens
aggcgaataaatgttcaaact

SEQ ID NO: 2106305 - DNA, 18 bp, Homo sapiens
aggcgacttcctctccag

SEQ ID NO: 2106306 - DNA, 14 bp, Homo sapiens
aggcgagtgccagg

SEQ ID NO: 2106307 - DNA, 15 bp, Homo sapiens
aggcgagtgccagga

SEQ ID NO: 2106308 - DNA, 17 bp, Homo sapiens
aggcgagtgccaggact

SEQ ID NO: 2106309 - DNA, 21 bp, Homo sapiens
aggcgcagcccgaagcccagt

SEQ ID NO: 2106310 - DNA, 14 bp, Homo sapiens
aggcgccccttccc

SEQ ID NO: 2106311 - DNA, 16 bp, Homo sapiens
aggcgcgtctgcccca

SEQ ID NO: 2106312 - DNA, 14 bp, Homo sapiens
aggcggaaaccttg

SEQ ID NO: 2106313 - DNA, 15 bp, Homo sapiens
aggcggagagtacag

SEQ ID NO: 2106314 - DNA, 20 bp, Homo sapiens
aggcggaggttgcagtgagc

SEQ ID NO: 2106315 - DNA, 24 bp, Homo sapiens
aggcggcacattggcagtgtgtca

SEQ ID NO: 2106316 - DNA, 15 bp, Homo sapiens
aggcggctccaggtc

SEQ ID NO: 2106317 - DNA, 15 bp, Homo sapiens
aggcgggaaggaggg

SEQ ID NO: 2106318 - DNA, 18 bp, Homo sapiens
agagccccccgtgtggct

SEQ ID NO: 2106319 - DNA, 11 bp, Homo sapiens
agagccctgag

SEQ ID NO: 2106320 - DNA, 13 bp, Homo sapiens
agagccctgagct

SEQ ID NO: 2106321 - DNA, 15 bp, Homo sapiens
agagccctgagctca

SEQ ID NO: 2106322 - DNA, 16 bp, Homo sapiens
agagccctgagctcag

SEQ ID NO: 2106323 - DNA, 21 bp, Homo sapiens
agagccctgagctcaggctga

SEQ ID NO: 2106324 - DNA, 12 bp, Homo sapiens
agagccctggga

SEQ ID NO: 2106325 - DNA, 13 bp, Homo sapiens
agagccctgggac

SEQ ID NO: 2106326 - DNA, 17 bp, Homo sapiens
agagccctgggaccgct

SEQ ID NO: 2106327 - DNA, 16 bp, Homo sapiens
agagccgggaagcgat

SEQ ID NO: 2106328 - DNA, 20 bp, Homo sapiens
agagccggggcactttcaga

SEQ ID NO: 2106329 - DNA, 14 bp, Homo sapiens
agagcctagccacc

SEQ ID NO: 2106330 - DNA, 18 bp, Homo sapiens
agagcctagccacctccc

SEQ ID NO: 2106331 - DNA, 20 bp, Homo sapiens
agagcctagccacctcccac

SEQ ID NO: 2106332 - DNA, 13 bp, Homo sapiens
agagcctcttagt

SEQ ID NO: 2106333 - DNA, 13 bp, Homo sapiens
agagcctgactgt

SEQ ID NO: 2106334 - DNA, 18 bp, Homo sapiens
agagcctgactgtgttca

SEQ ID NO: 2106335 - DNA, 21 bp, Homo sapiens
agagcctgactgtgttcagtg

SEQ ID NO: 2106336 - DNA, 18 bp, Homo sapiens
agagcctgctcccccacc

SEQ ID NO: 2106337 - DNA, 19 bp, Homo sapiens
agagcctgctcccccaccc

SEQ ID NO: 2106338 - DNA, 20 bp, Homo sapiens
agagcctgctcccccacccc

SEQ ID NO: 2106339 - DNA, 15 bp, Homo sapiens
agagcctggagaagc

SEQ ID NO: 2106340 - DNA, 16 bp, Homo sapiens
agagcctggagaagct

SEQ ID NO: 2106341 - DNA, 10 bp, Homo sapiens
agagcctggg

SEQ ID NO: 2106342 - DNA, 13 bp, Homo sapiens
agagcctggggct

SEQ ID NO: 2106343 - DNA, 18 bp, Homo sapiens
agagcctgtgctaaagaa

SEQ ID NO: 2106344 - DNA, 19 bp, Homo sapiens
agagccttctcctgcctac

SEQ ID NO: 2106345 - DNA, 17 bp, Homo sapiens
agagccttggtgtccac

SEQ ID NO: 2106346 - DNA, 17 bp, Homo sapiens
agagcgagagtctgtct

SEQ ID NO: 2106347 - DNA, 18 bp, Homo sapiens
agagcgggcctcttccct

SEQ ID NO: 2106348 - DNA, 14 bp, Homo sapiens
agagctaatttaag

SEQ ID NO: 2106349 - DNA, 16 bp, Homo sapiens
agagctacgtatttaa

SEQ ID NO: 2106350 - DNA, 18 bp, Homo sapiens
agagctagaacatggaga

SEQ ID NO: 2106351 - DNA, 22 bp, Homo sapiens
agagctagaacatggagagcta

SEQ ID NO: 2106352 - DNA, 23 bp, Homo sapiens
agagctagaacccggcaggctag

SEQ ID NO: 2106353 - DNA, 19 bp, Homo sapiens
agagctagaacctggagag

SEQ ID NO: 2106354 - DNA, 14 bp, Homo sapiens
agagctagcgctgc

SEQ ID NO: 2106355 - DNA, 21 bp, Homo sapiens
agagctagcgctgccgcaccc

SEQ ID NO: 2106356 - DNA, 13 bp, Homo sapiens
agagctaggagca

SEQ ID NO: 2106357 - DNA, 19 bp, Homo sapiens
agagctaggagcaaagcct

SEQ ID NO: 2106358 - DNA, 22 bp, Homo sapiens
agagctcctgtccctacccact

SEQ ID NO: 2106359 - DNA, 23 bp, Homo sapiens
agagctcctgtccctacccactc

SEQ ID NO: 2106360 - DNA, 15 bp, Homo sapiens
agagctcttaatgtt

SEQ ID NO: 2106361 - DNA, 20 bp, Homo sapiens
agagctcttcggtttctgag

SEQ ID NO: 2106362 - DNA, 22 bp, Homo sapiens
agagctcttcggtttctgagca

SEQ ID NO: 2106363 - DNA, 21 bp, Homo sapiens
agagctgagagtctgaaagac

SEQ ID NO: 2106364 - DNA, 23 bp, Homo sapiens
agagctgagagtctgaaagacag

SEQ ID NO: 2106365 - DNA, 18 bp, Homo sapiens
agagctgatggagaagga

SEQ ID NO: 2106366 - DNA, 16 bp, Homo sapiens
agagctgctctggaaa

SEQ ID NO: 2106367 - DNA, 13 bp, Homo sapiens
agagctgctgtcc

SEQ ID NO: 2106368 - DNA, 23 bp, Homo sapiens
agagctggaaggcagggcagagg

SEQ ID NO: 2106369 - DNA, 14 bp, Homo sapiens
agagctggctgtct

SEQ ID NO: 2106370 - DNA, 15 bp, Homo sapiens
agagctgggaaacag

SEQ ID NO: 2106371 - DNA, 16 bp, Homo sapiens
agagctgggaaacagg

SEQ ID NO: 2106372 - DNA, 18 bp, Homo sapiens
agagctgggaaacaggga

SEQ ID NO: 2106373 - DNA, 21 bp, Homo sapiens
agagctgggaaacagggagcc

SEQ ID NO: 2106374 - DNA, 22 bp, Homo sapiens
agagctgggaaattcatgtgga

SEQ ID NO: 2106375 - DNA, 10 bp, Homo sapiens
agagctgggc

SEQ ID NO: 2106376 - DNA, 19 bp, Homo sapiens
agagctgttcacagccaga

SEQ ID NO: 2106377 - DNA, 21 bp, Homo sapiens
agagctgttcacagccagact

SEQ ID NO: 2106378 - DNA, 22 bp, Homo sapiens
agagcttggacagtctgagctg

SEQ ID NO: 2106379 - DNA, 14 bp, Homo sapiens
agagcttggtggct

SEQ ID NO: 2106380 - DNA, 14 bp, Homo sapiens
agagctttctttca

SEQ ID NO: 2106381 - DNA, 23 bp, Homo sapiens
agaggaatcagacttcacactgc

SEQ ID NO: 2106382 - DNA, 20 bp, Homo sapiens
agaggaatctacctgtggtg

SEQ ID NO: 2106383 - DNA, 14 bp, Homo sapiens
agaggacaaggaag

SEQ ID NO: 2106384 - DNA, 16 bp, Homo sapiens
agaggacaaggaagtg

SEQ ID NO: 2106385 - DNA, 14 bp, Homo sapiens
agaggacgggaggc

SEQ ID NO: 2106386 - DNA, 12 bp, Homo sapiens
agaggactctgc

SEQ ID NO: 2106387 - DNA, 21 bp, Homo sapiens
agaggacttttctttgtggct

SEQ ID NO: 2106388 - DNA, 14 bp, Homo sapiens
agaggagaaactga

SEQ ID NO: 2106389 - DNA, 15 bp, Homo sapiens
agaggagaagagaca

SEQ ID NO: 2106390 - DNA, 16 bp, Homo sapiens
agaggagaccctggaa

SEQ ID NO: 2106391 - DNA, 13 bp, Homo sapiens
agaggagatcagg

SEQ ID NO: 2106392 - DNA, 14 bp, Homo sapiens
agaggagcacctga

SEQ ID NO: 2106393 - DNA, 21 bp, Homo sapiens
agaatttcttggtaagaagcc

SEQ ID NO: 2106394 - DNA, 22 bp, Homo sapiens
agaatttcttggtaagaagccg

SEQ ID NO: 2106395 - DNA, 18 bp, Homo sapiens
agaatttgtattttgctt

SEQ ID NO: 2106396 - DNA, 19 bp, Homo sapiens
agaatttgtattttgctta

SEQ ID NO: 2106397 - DNA, 22 bp, Homo sapiens
agaattttaagtgctttgtaat

SEQ ID NO: 2106398 - DNA, 17 bp, Homo sapiens
agaattttaccaaaatt

SEQ ID NO: 2106399 - DNA, 13 bp, Homo sapiens
agaattttgtata

SEQ ID NO: 2106400 - DNA, 22 bp, Homo sapiens
agaattttgtatattgtaggaa

SEQ ID NO: 2106401 - DNA, 17 bp, Homo sapiens
agaatttttaatgactt

SEQ ID NO: 2106402 - DNA, 16 bp, Homo sapiens
agacaaaaacagcctc

SEQ ID NO: 2106403 - DNA, 19 bp, Homo sapiens
agacaaaccactgtacata

SEQ ID NO: 2106404 - DNA, 14 bp, Homo sapiens
agacaacagaagtc

SEQ ID NO: 2106405 - DNA, 14 bp, Homo sapiens
agacaagaatatgt

SEQ ID NO: 2106406 - DNA, 16 bp, Homo sapiens
agacaagaatatgttc

SEQ ID NO: 2106407 - DNA, 18 bp, Homo sapiens
agacaagccctggcaaca

SEQ ID NO: 2106408 - DNA, 19 bp, Homo sapiens
agacaagtaatcactaacc

SEQ ID NO: 2106409 - DNA, 15 bp, Homo sapiens
agacaatccactctc

SEQ ID NO: 2106410 - DNA, 20 bp, Homo sapiens
agacaatccccacataccat

SEQ ID NO: 2106411 - DNA, 16 bp, Homo sapiens
agacacaccccccagt

SEQ ID NO: 2106412 - DNA, 13 bp, Homo sapiens
agacacagataca

SEQ ID NO: 2106413 - DNA, 23 bp, Homo sapiens
agacacaggtgcctcacgcctgt

SEQ ID NO: 2106414 - DNA, 21 bp, Homo sapiens
agacacagtcatactgtcact

SEQ ID NO: 2106415 - DNA, 18 bp, Homo sapiens
agacacattctcctgtgc

SEQ ID NO: 2106416 - DNA, 20 bp, Homo sapiens
agacacattctcctgtgccc

SEQ ID NO: 2106417 - DNA, 18 bp, Homo sapiens
agacacccaagtccaggc

SEQ ID NO: 2106418 - DNA, 21 bp, Homo sapiens
agacacctgcacctcccccca

SEQ ID NO: 2106419 - DNA, 18 bp, Homo sapiens
agacaccttgacagggca

SEQ ID NO: 2106420 - DNA, 22 bp, Homo sapiens
agacaccttgacagggcacacc

SEQ ID NO: 2106421 - DNA, 16 bp, Homo sapiens
agacacgctcttctat

SEQ ID NO: 2106422 - DNA, 15 bp, Homo sapiens
agacactcccaggga

SEQ ID NO: 2106423 - DNA, 17 bp, Homo sapiens
agacactcccagggaca

SEQ ID NO: 2106424 - DNA, 13 bp, Homo sapiens
agacacttgcctt

SEQ ID NO: 2106425 - DNA, 15 bp, Homo sapiens
agacacttgccttct

SEQ ID NO: 2106426 - DNA, 17 bp, Homo sapiens
agacagaaaaaaataaa

SEQ ID NO: 2106427 - DNA, 21 bp, Homo sapiens
agacagaaaaaaataaaaaca

SEQ ID NO: 2106428 - DNA, 20 bp, Homo sapiens
agacagaaacagagagagac

SEQ ID NO: 2106429 - DNA, 23 bp, Homo sapiens
agacagaaacagagagagacaga

SEQ ID NO: 2106430 - DNA, 14 bp, Homo sapiens
agacagaagaaaca

SEQ ID NO: 2106431 - DNA, 16 bp, Homo sapiens
agacagaagaaacaag

SEQ ID NO: 2106432 - DNA, 17 bp, Homo sapiens
agacagaagaaacaagg

SEQ ID NO: 2106433 - DNA, 14 bp, Homo sapiens
agacagaatgtcac

SEQ ID NO: 2106434 - DNA, 19 bp, Homo sapiens
agacagaccccttggcttt

SEQ ID NO: 2106435 - DNA, 19 bp, Homo sapiens
agacagagccctgtgaggc

SEQ ID NO: 2106436 - DNA, 12 bp, Homo sapiens
agacagagctgg

SEQ ID NO: 2106437 - DNA, 21 bp, Homo sapiens
agacagagtctcactgttgcc

SEQ ID NO: 2106438 - DNA, 17 bp, Homo sapiens
agacagatacagcccca

SEQ ID NO: 2106439 - DNA, 14 bp, Homo sapiens
agacagcagctcag

SEQ ID NO: 2106440 - DNA, 14 bp, Homo sapiens
agacaggagggcaa

SEQ ID NO: 2106441 - DNA, 23 bp, Homo sapiens
agacaggagggcaagggccatgc

SEQ ID NO: 2106442 - DNA, 22 bp, Homo sapiens
agacaggcaagcacctcctgcc

SEQ ID NO: 2106443 - DNA, 15 bp, Homo sapiens
agacaggcccaagag

SEQ ID NO: 2106444 - DNA, 18 bp, Homo sapiens
agacaggcccaagagatg

SEQ ID NO: 2106445 - DNA, 22 bp, Homo sapiens
agacaggcccaagagatgaaga

SEQ ID NO: 2106446 - DNA, 15 bp, Homo sapiens
agacagggtctcact

SEQ ID NO: 2106447 - DNA, 16 bp, Homo sapiens
agacaggtggcctagc

SEQ ID NO: 2106448 - DNA, 17 bp, Homo sapiens
agacagtatatttatag

SEQ ID NO: 2106449 - DNA, 16 bp, Homo sapiens
agacagtgctgccctg

SEQ ID NO: 2106450 - DNA, 19 bp, Homo sapiens
agacagtgctgccctgcga

SEQ ID NO: 2106451 - DNA, 18 bp, Homo sapiens
agacatacgaaacacaaa

SEQ ID NO: 2106452 - DNA, 15 bp, Homo sapiens
agacatatatttatg

SEQ ID NO: 2106453 - DNA, 22 bp, Homo sapiens
agacatatatttatgaatgtgc

SEQ ID NO: 2106454 - DNA, 16 bp, Homo sapiens
agacatattcttggag

SEQ ID NO: 2106455 - DNA, 15 bp, Homo sapiens
agacatgaaaactat

SEQ ID NO: 2106456 - DNA, 13 bp, Homo sapiens
agacatggagact

SEQ ID NO: 2106457 - DNA, 19 bp, Homo sapiens
agacatggagactcctgcc

SEQ ID NO: 2106458 - DNA, 22 bp, Homo sapiens
agacatggagactcctgccctg

SEQ ID NO: 2106459 - DNA, 14 bp, Homo sapiens
agacatggatttga

SEQ ID NO: 2106460 - DNA, 17 bp, Homo sapiens
agaccaagactctgaaa

SEQ ID NO: 2106461 - DNA, 14 bp, Homo sapiens
agaccaaggcggga

SEQ ID NO: 2106462 - DNA, 16 bp, Homo sapiens
agaccacaaaaattga

SEQ ID NO: 2106463 - DNA, 21 bp, Homo sapiens
agaccacagcaattggctcct

SEQ ID NO: 2106464 - DNA, 14 bp, Homo sapiens
agaccacctccctg

SEQ ID NO: 2106465 - DNA, 15 bp, Homo sapiens
agaccacctccctgc

SEQ ID NO: 2106466 - DNA, 21 bp, Homo sapiens
agaccacctccctgccctgtc

SEQ ID NO: 2106467 - DNA, 17 bp, Homo sapiens
agaccacctctcaatat

SEQ ID NO: 2106468 - DNA, 11 bp, Homo sapiens
agaccacctgc

SEQ ID NO: 2106469 - DNA, 17 bp, Homo sapiens
agaccacctgccagcca

SEQ ID NO: 2106470 - DNA, 18 bp, Homo sapiens
agaccacctgccagccat

SEQ ID NO: 2106471 - DNA, 15 bp, Homo sapiens
agaccacctgcttct

SEQ ID NO: 2106472 - DNA, 22 bp, Homo sapiens
agaccacctgcttctgaactca

SEQ ID NO: 2106473 - DNA, 19 bp, Homo sapiens
agaccactgtcctggctgc

SEQ ID NO: 2106474 - DNA, 20 bp, Homo sapiens
agaccactgtcctggctgct

SEQ ID NO: 2106475 - DNA, 18 bp, Homo sapiens
agaccagactgtggagaa

SEQ ID NO: 2106476 - DNA, 13 bp, Homo sapiens
agaccagcctggc

SEQ ID NO: 2106477 - DNA, 17 bp, Homo sapiens
agacttctctttgcctc

SEQ ID NO: 2106478 - DNA, 18 bp, Homo sapiens
agacttctctttgcctca

SEQ ID NO: 2106479 - DNA, 13 bp, Homo sapiens
agacttctggaag

SEQ ID NO: 2106480 - DNA, 23 bp, Homo sapiens
agacttctggaaggctggctgag

SEQ ID NO: 2106481 - DNA, 15 bp, Homo sapiens
agacttgaagcacag

SEQ ID NO: 2106482 - DNA, 14 bp, Homo sapiens
agacttgacagtgg

SEQ ID NO: 2106483 - DNA, 14 bp, Homo sapiens
agacttgccaggct

SEQ ID NO: 2106484 - DNA, 13 bp, Homo sapiens
agacttgctctct

SEQ ID NO: 2106485 - DNA, 18 bp, Homo sapiens
agacttggggaccagagg

SEQ ID NO: 2106486 - DNA, 18 bp, Homo sapiens
agactttaaaagatgaaa

SEQ ID NO: 2106487 - DNA, 14 bp, Homo sapiens
agactttctcagtg

SEQ ID NO: 2106488 - DNA, 21 bp, Homo sapiens
agagaaaaaaagtttgccaga

SEQ ID NO: 2106489 - DNA, 16 bp, Homo sapiens
agagaaaaaactagag

SEQ ID NO: 2106490 - DNA, 20 bp, Homo sapiens
agagaaaaagaaatgcaaaa

SEQ ID NO: 2106491 - DNA, 18 bp, Homo sapiens
agagaaaacttatttgag

SEQ ID NO: 2106492 - DNA, 17 bp, Homo sapiens
agagaaaataaaccaag

SEQ ID NO: 2106493 - DNA, 16 bp, Homo sapiens
agagaaagaaaatgaa

SEQ ID NO: 2106494 - DNA, 14 bp, Homo sapiens
agagaaagaagaga

SEQ ID NO: 2106495 - DNA, 14 bp, Homo sapiens
agagaaatcacagg

SEQ ID NO: 2106496 - DNA, 14 bp, Homo sapiens
agagaaatctgaaa

SEQ ID NO: 2106497 - DNA, 20 bp, Homo sapiens
agagaaatttttatttttga

SEQ ID NO: 2106498 - DNA, 13 bp, Homo sapiens
agagaagaaagaa

SEQ ID NO: 2106499 - DNA, 12 bp, Homo sapiens
agagaagaggct

SEQ ID NO: 2106500 - DNA, 20 bp, Homo sapiens
agagaagataatgttcttta

SEQ ID NO: 2106501 - DNA, 17 bp, Homo sapiens
agagaagctgagaagaa

SEQ ID NO: 2106502 - DNA, 12 bp, Homo sapiens
agagaaggcagg

SEQ ID NO: 2106503 - DNA, 23 bp, Homo sapiens
agagaaggcccataccttctggt

SEQ ID NO: 2106504 - DNA, 13 bp, Homo sapiens
agagaaggcctct

SEQ ID NO: 2106505 - DNA, 20 bp, Homo sapiens
agagaaggcctcttgtgctc

SEQ ID NO: 2106506 - DNA, 16 bp, Homo sapiens
agagaagtagaaatca

SEQ ID NO: 2106507 - DNA, 13 bp, Homo sapiens
agagaataaagac

SEQ ID NO: 2106508 - DNA, 17 bp, Homo sapiens
agagaatatatttttga

SEQ ID NO: 2106509 - DNA, 18 bp, Homo sapiens
agagaatgaaagggccca

SEQ ID NO: 2106510 - DNA, 22 bp, Homo sapiens
agagaatttctaccatttcaga

SEQ ID NO: 2106511 - DNA, 19 bp, Homo sapiens
agagacaaacacctcccag

SEQ ID NO: 2106512 - DNA, 21 bp, Homo sapiens
agagacaaacacctcccagga

SEQ ID NO: 2106513 - DNA, 17 bp, Homo sapiens
agaaggagggcagagcc

SEQ ID NO: 2106514 - DNA, 22 bp, Homo sapiens
agaaggatgtccgttccaggag

SEQ ID NO: 2106515 - DNA, 22 bp, Homo sapiens
agaaggcaagtttctagctaga

SEQ ID NO: 2106516 - DNA, 15 bp, Homo sapiens
agaaggcagggaaag

SEQ ID NO: 2106517 - DNA, 23 bp, Homo sapiens
agaaggcccataccttctggttg

SEQ ID NO: 2106518 - DNA, 16 bp, Homo sapiens
agaaggccgctgcccc

SEQ ID NO: 2106519 - DNA, 19 bp, Homo sapiens
agaaggctgcctaaggagg

SEQ ID NO: 2106520 - DNA, 13 bp, Homo sapiens
agaagggaagcct

SEQ ID NO: 2106521 - DNA, 16 bp, Homo sapiens
agaagggagttgctca

SEQ ID NO: 2106522 - DNA, 14 bp, Homo sapiens
agaagggccagccc

SEQ ID NO: 2106523 - DNA, 15 bp, Homo sapiens
agaagggccagccct

SEQ ID NO: 2106524 - DNA, 14 bp, Homo sapiens
agaagggctagaac

SEQ ID NO: 2106525 - DNA, 20 bp, Homo sapiens
agaaggggacagcgccacct

SEQ ID NO: 2106526 - DNA, 19 bp, Homo sapiens
agaaggggcacgcctgccc

SEQ ID NO: 2106527 - DNA, 23 bp, Homo sapiens
agaagggggattggagggaagac

SEQ ID NO: 2106528 - DNA, 22 bp, Homo sapiens
agaagggttttccaccctggaa

SEQ ID NO: 2106529 - DNA, 23 bp, Homo sapiens
agaagggttttccaccctggaat

SEQ ID NO: 2106530 - DNA, 14 bp, Homo sapiens
agaaggtccttaat

SEQ ID NO: 2106531 - DNA, 16 bp, Homo sapiens
agaaggttgctctaga

SEQ ID NO: 2106532 - DNA, 20 bp, Homo sapiens
agaaggttgctctagattga

SEQ ID NO: 2106533 - DNA, 15 bp, Homo sapiens
agaagtaaatttgtc

SEQ ID NO: 2106534 - DNA, 16 bp, Homo sapiens
agaagtaaatttgtcc

SEQ ID NO: 2106535 - DNA, 22 bp, Homo sapiens
agaagtacgtttttgcattatt

SEQ ID NO: 2106536 - DNA, 24 bp, Homo sapiens
agaagtacgtttttgcattattca

SEQ ID NO: 2106537 - DNA, 17 bp, Homo sapiens
agaagtagaaatcatag

SEQ ID NO: 2106538 - DNA, 17 bp, Homo sapiens
agaagtaggcatgaggg

SEQ ID NO: 2106539 - DNA, 23 bp, Homo sapiens
agaagtatccaattatgtgacaa

SEQ ID NO: 2106540 - DNA, 23 bp, Homo sapiens
agaagtcagcccgaatgcctgtc

SEQ ID NO: 2106541 - DNA, 14 bp, Homo sapiens
agaagtcatggccc

SEQ ID NO: 2106542 - DNA, 20 bp, Homo sapiens
agaagtcctatcgactttat

SEQ ID NO: 2106543 - DNA, 18 bp, Homo sapiens
agaagtgaataactgcaa

SEQ ID NO: 2106544 - DNA, 22 bp, Homo sapiens
agaagtgagggctgggcagctg

SEQ ID NO: 2106545 - DNA, 15 bp, Homo sapiens
agaagtggaccagga

SEQ ID NO: 2106546 - DNA, 19 bp, Homo sapiens
agaagtggaccaggacagg

SEQ ID NO: 2106547 - DNA, 17 bp, Homo sapiens
agaagtgggccaggaca

SEQ ID NO: 2106548 - DNA, 17 bp, Homo sapiens
agaagtgtcgttttcat

SEQ ID NO: 2106549 - DNA, 14 bp, Homo sapiens
agaagttaagcagc

SEQ ID NO: 2106550 - DNA, 19 bp, Homo sapiens
agaagtttcatcatttttt

SEQ ID NO: 2106551 - DNA, 21 bp, Homo sapiens
agaagtttcatcattttttac

SEQ ID NO: 2106552 - DNA, 19 bp, Homo sapiens
agaagtttcgaggggtcct

SEQ ID NO: 2106553 - DNA, 22 bp, Homo sapiens
agaagtttctggagcaagagag

SEQ ID NO: 2106554 - DNA, 16 bp, Homo sapiens
agaagtttctggccct

SEQ ID NO: 2106555 - DNA, 16 bp, Homo sapiens
agaagttttgtacaga

SEQ ID NO: 2106556 - DNA, 13 bp, Homo sapiens
agaataaaattgt

SEQ ID NO: 2106557 - DNA, 15 bp, Homo sapiens
agaataaagaaaaac

SEQ ID NO: 2106558 - DNA, 17 bp, Homo sapiens
agaataaagttctgagt

SEQ ID NO: 2106559 - DNA, 14 bp, Homo sapiens
agaataaatccttg

SEQ ID NO: 2106560 - DNA, 13 bp, Homo sapiens
agaataaatgaat

SEQ ID NO: 2106561 - DNA, 14 bp, Homo sapiens
agaataagagaaag

SEQ ID NO: 2106562 - DNA, 20 bp, Homo sapiens
agaataagtgctgtttgaga

SEQ ID NO: 2106563 - DNA, 21 bp, Homo sapiens
agaataagtgctgtttgagat

SEQ ID NO: 2106564 - DNA, 16 bp, Homo sapiens
agaataataataaaaa

SEQ ID NO: 2106565 - DNA, 22 bp, Homo sapiens
agaataattgtgtacaaagtag

SEQ ID NO: 2106566 - DNA, 15 bp, Homo sapiens
agaatacaaacatat

SEQ ID NO: 2106567 - DNA, 16 bp, Homo sapiens
agaatacaaacatatt

SEQ ID NO: 2106568 - DNA, 20 bp, Homo sapiens
agaatacagaaaatgctttt

SEQ ID NO: 2106569 - DNA, 20 bp, Homo sapiens
agaatagatctgatggtgag

SEQ ID NO: 2106570 - DNA, 15 bp, Homo sapiens
agaataggtcatttt

SEQ ID NO: 2106571 - DNA, 13 bp, Homo sapiens
agaatataaagtt

SEQ ID NO: 2106572 - DNA, 23 bp, Homo sapiens
agaatataattatcggaagcagt

SEQ ID NO: 2106573 - DNA, 13 bp, Homo sapiens
agaatatatacat

SEQ ID NO: 2106574 - DNA, 15 bp, Homo sapiens
agaatattgttaaaa

SEQ ID NO: 2106575 - DNA, 16 bp, Homo sapiens
agaatatttattacct

SEQ ID NO: 2106576 - DNA, 19 bp, Homo sapiens
agaatatttattacctctg

SEQ ID NO: 2106577 - DNA, 19 bp, Homo sapiens
agaatatttcaaatgaaca

SEQ ID NO: 2106578 - DNA, 17 bp, Homo sapiens
agaatcagggcaggctt

SEQ ID NO: 2106579 - DNA, 18 bp, Homo sapiens
agaatcataattttcaag

SEQ ID NO: 2106580 - DNA, 18 bp, Homo sapiens
agaatcatagtgccatag

SEQ ID NO: 2106581 - DNA, 12 bp, Homo sapiens
agaatccaaaga

SEQ ID NO: 2106582 - DNA, 13 bp, Homo sapiens
agaatccaaagat

SEQ ID NO: 2106583 - DNA, 12 bp, Homo sapiens
agaatccctgca

SEQ ID NO: 2106584 - DNA, 20 bp, Homo sapiens
agaatcgacctcactgtcag

SEQ ID NO: 2106585 - DNA, 20 bp, Homo sapiens
agaatctgaagctattgatg

SEQ ID NO: 2106586 - DNA, 18 bp, Homo sapiens
agaatctgctgttgccat

SEQ ID NO: 2106587 - DNA, 20 bp, Homo sapiens
agaatctgctgttgccatag

SEQ ID NO: 2106588 - DNA, 16 bp, Homo sapiens
agaatctggctcctgt

SEQ ID NO: 2106589 - DNA, 14 bp, Homo sapiens
agaatcttgtattt

SEQ ID NO: 2106590 - DNA, 22 bp, Homo sapiens
agaatgagggaaattgctattt

SEQ ID NO: 2106591 - DNA, 20 bp, Homo sapiens
agaatgcagattcctgggcc

SEQ ID NO: 2106592 - DNA, 21 bp, Homo sapiens
agaatgcagattcctgggcct

SEQ ID NO: 2106593 - DNA, 18 bp, Homo sapiens
agaatgcccaactcttca

SEQ ID NO: 2106594 - DNA, 23 bp, Homo sapiens
agaatgctctacttctttttctt

SEQ ID NO: 2106595 - DNA, 14 bp, Homo sapiens
agaatgcttaatca

SEQ ID NO: 2106596 - DNA, 14 bp, Homo sapiens
agaatggaatagaa

SEQ ID NO: 2106597 - DNA, 18 bp, Homo sapiens
agaatgggtttactctca

SEQ ID NO: 2106598 - DNA, 19 bp, Homo sapiens
agaatgggtttactctcaa

SEQ ID NO: 2106599 - DNA, 13 bp, Homo sapiens
agaatgtaaagct

SEQ ID NO: 2106600 - DNA, 17 bp, Homo sapiens
agaaagcacctgttttt

SEQ ID NO: 2106601 - DNA, 18 bp, Homo sapiens
agaaagcacctgttttta

SEQ ID NO: 2106602 - DNA, 18 bp, Homo sapiens
agaaagccgtactgtcta

SEQ ID NO: 2106603 - DNA, 19 bp, Homo sapiens
agaaagctctgcatgtgtg

SEQ ID NO: 2106604 - DNA, 21 bp, Homo sapiens
agaaagctctgcatgtgtgtt

SEQ ID NO: 2106605 - DNA, 19 bp, Homo sapiens
agaaaggagctctgaatct

SEQ ID NO: 2106606 - DNA, 16 bp, Homo sapiens
agaaaggattaagata

SEQ ID NO: 2106607 - DNA, 19 bp, Homo sapiens
agaaagggaaactggctga

SEQ ID NO: 2106608 - DNA, 16 bp, Homo sapiens
agaaagggaggcccag

SEQ ID NO: 2106609 - DNA, 20 bp, Homo sapiens
agaaagggagggctctgagg

SEQ ID NO: 2106610 - DNA, 14 bp, Homo sapiens
agaaagggcaagaa

SEQ ID NO: 2106611 - DNA, 23 bp, Homo sapiens
agaaagggtctgataaacacaga

SEQ ID NO: 2106612 - DNA, 16 bp, Homo sapiens
agaaaggttagtatca

SEQ ID NO: 2106613 - DNA, 16 bp, Homo sapiens
agaaagtgcagaatca

SEQ ID NO: 2106614 - DNA, 22 bp, Homo sapiens
agaaataaaaatcaacttgtgt

SEQ ID NO: 2106615 - DNA, 11 bp, Homo sapiens
agaaataaact

SEQ ID NO: 2106616 - DNA, 22 bp, Homo sapiens
agaaataaattttgtttcagaa

SEQ ID NO: 2106617 - DNA, 22 bp, Homo sapiens
agaaataagtggttatttctca

SEQ ID NO: 2106618 - DNA, 19 bp, Homo sapiens
agaaatagctccgtggagc

SEQ ID NO: 2106619 - DNA, 16 bp, Homo sapiens
agaaatatatatacat

SEQ ID NO: 2106620 - DNA, 16 bp, Homo sapiens
agaaatcacaggggcg

SEQ ID NO: 2106621 - DNA, 14 bp, Homo sapiens
agaaatcatagctg

SEQ ID NO: 2106622 - DNA, 17 bp, Homo sapiens
agaggggacatttccct

SEQ ID NO: 2106623 - DNA, 15 bp, Homo sapiens
agaggggcagaacag

SEQ ID NO: 2106624 - DNA, 16 bp, Homo sapiens
agaggggcagaacagc

SEQ ID NO: 2106625 - DNA, 14 bp, Homo sapiens
agaggggcagccgc

SEQ ID NO: 2106626 - DNA, 19 bp, Homo sapiens
agaggggcctgggaaagga

SEQ ID NO: 2106627 - DNA, 18 bp, Homo sapiens
agaggggctttctggaga

SEQ ID NO: 2106628 - DNA, 15 bp, Homo sapiens
agagggggctctcca

SEQ ID NO: 2106629 - DNA, 19 bp, Homo sapiens
agaggggtacatttccctg

SEQ ID NO: 2106630 - DNA, 15 bp, Homo sapiens
agaggggtgcaccca

SEQ ID NO: 2106631 - DNA, 22 bp, Homo sapiens
agaggggtgctgctcctaaacc

SEQ ID NO: 2106632 - DNA, 22 bp, Homo sapiens
agagggtctggagaagcagtga

SEQ ID NO: 2106633 - DNA, 15 bp, Homo sapiens
agaggtagcgagctg

SEQ ID NO: 2106634 - DNA, 19 bp, Homo sapiens
agaggtagcgagctgctct

SEQ ID NO: 2106635 - DNA, 12 bp, Homo sapiens
agaggtccctgc

SEQ ID NO: 2106636 - DNA, 18 bp, Homo sapiens
agaggtccctgcttacct

SEQ ID NO: 2106637 - DNA, 12 bp, Homo sapiens
agaggtctgagc

SEQ ID NO: 2106638 - DNA, 13 bp, Homo sapiens
agaggtctgagcc

SEQ ID NO: 2106639 - DNA, 20 bp, Homo sapiens
agaggtgacccaatgctcct

SEQ ID NO: 2106640 - DNA, 15 bp, Homo sapiens
agaggtgaccccagg

SEQ ID NO: 2106641 - DNA, 22 bp, Homo sapiens
agaggtgagaccaaaggatcca

SEQ ID NO: 2106642 - DNA, 22 bp, Homo sapiens
agaggtggattcctgggcaaga

SEQ ID NO: 2106643 - DNA, 18 bp, Homo sapiens
agaggtggccagagctgg

SEQ ID NO: 2106644 - DNA, 13 bp, Homo sapiens
agaggtgggcagc

SEQ ID NO: 2106645 - DNA, 15 bp, Homo sapiens
agaggtgggcagctg

SEQ ID NO: 2106646 - DNA, 19 bp, Homo sapiens
agaggtgggcagctgggcc

SEQ ID NO: 2106647 - DNA, 19 bp, Homo sapiens
agaggttatctgcctggcc

SEQ ID NO: 2106648 - DNA, 22 bp, Homo sapiens
agaggttatctgcctggcctgg

SEQ ID NO: 2106649 - DNA, 21 bp, Homo sapiens
agaggttcctggggtggattc

SEQ ID NO: 2106650 - DNA, 20 bp, Homo sapiens
agaggttctggggaggaagg

SEQ ID NO: 2106651 - DNA, 21 bp, Homo sapiens
agaggttctggggaggaaggg

SEQ ID NO: 2106652 - DNA, 16 bp, Homo sapiens
agaggttttgttgttt

SEQ ID NO: 2106653 - DNA, 14 bp, Homo sapiens
agagtaccatgctg

SEQ ID NO: 2106654 - DNA, 13 bp, Homo sapiens
agagtagccgaga

SEQ ID NO: 2106655 - DNA, 22 bp, Homo sapiens
agagtatggttgattcccagca

SEQ ID NO: 2106656 - DNA, 15 bp, Homo sapiens
agagtctgagccccc

SEQ ID NO: 2106657 - DNA, 19 bp, Homo sapiens
agagtctgagcccccggct

SEQ ID NO: 2106658 - DNA, 14 bp, Homo sapiens
agagtgaaagggct

SEQ ID NO: 2106659 - DNA, 20 bp, Homo sapiens
agagtgaaataattaaaaac

SEQ ID NO: 2106660 - DNA, 22 bp, Homo sapiens
agagtgaaataattaaaaacca

SEQ ID NO: 2106661 - DNA, 21 bp, Homo sapiens
agagtgacacccaagagggct

SEQ ID NO: 2106662 - DNA, 23 bp, Homo sapiens
agagtgacacccaagagggctgc

SEQ ID NO: 2106663 - DNA, 16 bp, Homo sapiens
agagtgactccaagaa

SEQ ID NO: 2106664 - DNA, 20 bp, Homo sapiens
agagtgagaataattgtgta

SEQ ID NO: 2106665 - DNA, 22 bp, Homo sapiens
agagtgagagacattaactcat

SEQ ID NO: 2106666 - DNA, 21 bp, Homo sapiens
agagtgagagggcatgcgcac

SEQ ID NO: 2106667 - DNA, 21 bp, Homo sapiens
agagtgcccttaaaataatga

SEQ ID NO: 2106668 - DNA, 17 bp, Homo sapiens
agagtggagccctcagt

SEQ ID NO: 2106669 - DNA, 14 bp, Homo sapiens
agagtggctcctcc

SEQ ID NO: 2106670 - DNA, 18 bp, Homo sapiens
agagtgggctgcatctgg

SEQ ID NO: 2106671 - DNA, 20 bp, Homo sapiens
agagtgggctgcctggggat

SEQ ID NO: 2106672 - DNA, 17 bp, Homo sapiens
agagtgtgcagactgat

SEQ ID NO: 2106673 - DNA, 20 bp, Homo sapiens
agagtgtgggaagggagagc

SEQ ID NO: 2106674 - DNA, 14 bp, Homo sapiens
agagtgttcctgtt

SEQ ID NO: 2106675 - DNA, 19 bp, Homo sapiens
agagttagtttctttggga

SEQ ID NO: 2106676 - DNA, 19 bp, Homo sapiens
agagttattcaaatgaagg

SEQ ID NO: 2106677 - DNA, 22 bp, Homo sapiens
agagttattcaaatgaaggtgg

SEQ ID NO: 2106678 - DNA, 15 bp, Homo sapiens
agagttcaagaaata

SEQ ID NO: 2106679 - DNA, 21 bp, Homo sapiens
agagttcaagaaataagtttt

SEQ ID NO: 2106680 - DNA, 22 bp, Homo sapiens
agagttctttaggtgcctcctg

SEQ ID NO: 2106681 - DNA, 21 bp, Homo sapiens
agagttgaccgttttcatcct

SEQ ID NO: 2106682 - DNA, 18 bp, Homo sapiens
agagttggctcaggcaga

SEQ ID NO: 2106683 - DNA, 20 bp, Homo sapiens
agataaagacagctgacaga

SEQ ID NO: 2106684 - DNA, 13 bp, Homo sapiens
agataaagccaga

SEQ ID NO: 2106685 - DNA, 15 bp, Homo sapiens
agataactgaaaatt

SEQ ID NO: 2106686 - DNA, 18 bp, Homo sapiens
agataactgaaaattatt

SEQ ID NO: 2106687 - DNA, 15 bp, Homo sapiens
agataatcagcctct

SEQ ID NO: 2106688 - DNA, 16 bp, Homo sapiens
agataatcagcctctt

SEQ ID NO: 2106689 - DNA, 17 bp, Homo sapiens
agataatcagcctctta

SEQ ID NO: 2106690 - DNA, 16 bp, Homo sapiens
agataatctagaacac

SEQ ID NO: 2106691 - DNA, 23 bp, Homo sapiens
agataatctagaacacaggcaaa

SEQ ID NO: 2106692 - DNA, 16 bp, Homo sapiens
agatgtttttaaaagt

SEQ ID NO: 2106693 - DNA, 17 bp, Homo sapiens
agattaaaggaaggaaa

SEQ ID NO: 2106694 - DNA, 18 bp, Homo sapiens
agattaatttgtgtagat

SEQ ID NO: 2106695 - DNA, 15 bp, Homo sapiens
agattagaagtgttt

SEQ ID NO: 2106696 - DNA, 21 bp, Homo sapiens
agattagaatgaaaattgtat

SEQ ID NO: 2106697 - DNA, 15 bp, Homo sapiens
agattagctctggac

SEQ ID NO: 2106698 - DNA, 22 bp, Homo sapiens
agattatatatcataaagtatg

SEQ ID NO: 2106699 - DNA, 17 bp, Homo sapiens
agattcatttttctttc

SEQ ID NO: 2106700 - DNA, 19 bp, Homo sapiens
agattccagagagtggctc

SEQ ID NO: 2106701 - DNA, 13 bp, Homo sapiens
agattcccagaga

SEQ ID NO: 2106702 - DNA, 14 bp, Homo sapiens
agattcccagagac

SEQ ID NO: 2106703 - DNA, 13 bp, Homo sapiens
agattcccagagc

SEQ ID NO: 2106704 - DNA, 16 bp, Homo sapiens
agattcccagagcaaa

SEQ ID NO: 2106705 - DNA, 15 bp, Homo sapiens
agattccctgagcag

SEQ ID NO: 2106706 - DNA, 20 bp, Homo sapiens
agattcctcttgcctctctc

SEQ ID NO: 2106707 - DNA, 19 bp, Homo sapiens
agattctacatattcttta

SEQ ID NO: 2106708 - DNA, 17 bp, Homo sapiens
agattctccaaatgatt

SEQ ID NO: 2106709 - DNA, 12 bp, Homo sapiens
agattgacaagg

SEQ ID NO: 2106710 - DNA, 22 bp, Homo sapiens
agattgagaagttttgtacaga

SEQ ID NO: 2106711 - DNA, 13 bp, Homo sapiens
agattgaggcctg

SEQ ID NO: 2106712 - DNA, 17 bp, Homo sapiens
agattgcaacaggctgg

SEQ ID NO: 2106713 - DNA, 17 bp, Homo sapiens
agattgccccagagccc

SEQ ID NO: 2106714 - DNA, 18 bp, Homo sapiens
agattgtaattcagaaaa

SEQ ID NO: 2106715 - DNA, 20 bp, Homo sapiens
agattgtaattcagaaaaca

SEQ ID NO: 2106716 - DNA, 20 bp, Homo sapiens
agattgtgtaaattcctgtt

SEQ ID NO: 2106717 - DNA, 13 bp, Homo sapiens
agattgtgtaaca

SEQ ID NO: 2106718 - DNA, 13 bp, Homo sapiens
agatttcaacata

SEQ ID NO: 2106719 - DNA, 14 bp, Homo sapiens
agatttcaacatat

SEQ ID NO: 2106720 - DNA, 17 bp, Homo sapiens
agatttcaagaaaaaat

SEQ ID NO: 2106721 - DNA, 19 bp, Homo sapiens
agatttcagaggctgcagg

SEQ ID NO: 2106722 - DNA, 17 bp, Homo sapiens
agatttcctccatggtg

SEQ ID NO: 2106723 - DNA, 14 bp, Homo sapiens
agatttctcctgac

SEQ ID NO: 2106724 - DNA, 13 bp, Homo sapiens
agatttgattatt

SEQ ID NO: 2106725 - DNA, 15 bp, Homo sapiens
agatttgccagcaca

SEQ ID NO: 2106726 - DNA, 12 bp, Homo sapiens
agatttgtattt

SEQ ID NO: 2106727 - DNA, 15 bp, Homo sapiens
agatttgtatttata

SEQ ID NO: 2106728 - DNA, 17 bp, Homo sapiens
agatttgtatttatatt

SEQ ID NO: 2106729 - DNA, 13 bp, Homo sapiens
agatttgtgttat

SEQ ID NO: 2106730 - DNA, 21 bp, Homo sapiens
agattttacctgggatatgac

SEQ ID NO: 2106731 - DNA, 12 bp, Homo sapiens
agattttagaca

SEQ ID NO: 2106732 - DNA, 12 bp, Homo sapiens
agattttagttc

SEQ ID NO: 2106733 - DNA, 13 bp, Homo sapiens
agattttagttca

SEQ ID NO: 2106734 - DNA, 13 bp, Homo sapiens
agattttccttcc

SEQ ID NO: 2106735 - DNA, 13 bp, Homo sapiens
agattttcttgca

SEQ ID NO: 2106736 - DNA, 15 bp, Homo sapiens
agatttttgggctcc

SEQ ID NO: 2106737 - DNA, 13 bp, Homo sapiens
agattttttaata

SEQ ID NO: 2106738 - DNA, 16 bp, Homo sapiens
agattttttaataatt

SEQ ID NO: 2106739 - DNA, 18 bp, Homo sapiens
agattttttttgtaactt

SEQ ID NO: 2106740 - DNA, 15 bp, Homo sapiens
agcaaaattataaga

SEQ ID NO: 2106741 - DNA, 13 bp, Homo sapiens
agcaaagaagctt

SEQ ID NO: 2106742 - DNA, 12 bp, Homo sapiens
agcaaagagtgg

SEQ ID NO: 2106743 - DNA, 15 bp, Homo sapiens
agcaaagcaccagct

SEQ ID NO: 2106744 - DNA, 19 bp, Homo sapiens
agcacaggggccccagatc

SEQ ID NO: 2106745 - DNA, 21 bp, Homo sapiens
agcacaggggccccagatctg

SEQ ID NO: 2106746 - DNA, 16 bp, Homo sapiens
agcacagtgttaaatg

SEQ ID NO: 2106747 - DNA, 19 bp, Homo sapiens
agcacagtgttaaatgaaa

SEQ ID NO: 2106748 - DNA, 13 bp, Homo sapiens
agcacatcttttt

SEQ ID NO: 2106749 - DNA, 23 bp, Homo sapiens
agcacatgcgtatatgtgcgtct

SEQ ID NO: 2106750 - DNA, 14 bp, Homo sapiens
agcaccagaatgta

SEQ ID NO: 2106751 - DNA, 21 bp, Homo sapiens
agcaccatggaggcaggctcc

SEQ ID NO: 2106752 - DNA, 13 bp, Homo sapiens
agcacccacgtga

SEQ ID NO: 2106753 - DNA, 18 bp, Homo sapiens
agcacccaggctccatgg

SEQ ID NO: 2106754 - DNA, 20 bp, Homo sapiens
agcacccaggctccatgggg

SEQ ID NO: 2106755 - DNA, 23 bp, Homo sapiens
agcacccaggctccatggggaag

SEQ ID NO: 2106756 - DNA, 13 bp, Homo sapiens
agcaccccctcat

SEQ ID NO: 2106757 - DNA, 20 bp, Homo sapiens
agcaccccctcattcccctc

SEQ ID NO: 2106758 - DNA, 13 bp, Homo sapiens
agcaccctctccg

SEQ ID NO: 2106759 - DNA, 18 bp, Homo sapiens
agcaccctctcctggggg

SEQ ID NO: 2106760 - DNA, 14 bp, Homo sapiens
agcaccctgcagag

SEQ ID NO: 2106761 - DNA, 14 bp, Homo sapiens
agcaccgcagcatg

SEQ ID NO: 2106762 - DNA, 17 bp, Homo sapiens
agcacctagcctcgctc

SEQ ID NO: 2106763 - DNA, 13 bp, Homo sapiens
agcacctcctgcc

SEQ ID NO: 2106764 - DNA, 14 bp, Homo sapiens
agcacctcctgcct

SEQ ID NO: 2106765 - DNA, 21 bp, Homo sapiens
agcacctgaaccccatgggct

SEQ ID NO: 2106766 - DNA, 15 bp, Homo sapiens
agcacctgccgacct

SEQ ID NO: 2106767 - DNA, 16 bp, Homo sapiens
agcacctgccgacctc

SEQ ID NO: 2106768 - DNA, 22 bp, Homo sapiens
agcaccttaatattattggggt

SEQ ID NO: 2106769 - DNA, 17 bp, Homo sapiens
agcacgattttgcacaa

SEQ ID NO: 2106770 - DNA, 21 bp, Homo sapiens
agcacgtaaatgcgtccctgt

SEQ ID NO: 2106771 - DNA, 13 bp, Homo sapiens
agcactaaagcag

SEQ ID NO: 2106772 - DNA, 14 bp, Homo sapiens
agcactagaagtgg

SEQ ID NO: 2106773 - DNA, 22 bp, Homo sapiens
agcactcagaaaagaaaaccat

SEQ ID NO: 2106774 - DNA, 22 bp, Homo sapiens
agcactcccttaggcattattt

SEQ ID NO: 2106775 - DNA, 14 bp, Homo sapiens
agcactcctctgtc

SEQ ID NO: 2106776 - DNA, 16 bp, Homo sapiens
agcactcctctgtctc

SEQ ID NO: 2106777 - DNA, 18 bp, Homo sapiens
agcactcctctgtctctg

SEQ ID NO: 2106778 - DNA, 22 bp, Homo sapiens
agcactgaaaataccatcaggc

SEQ ID NO: 2106779 - DNA, 19 bp, Homo sapiens
agcactgacttctaagtaa

SEQ ID NO: 2106780 - DNA, 23 bp, Homo sapiens
agcactgcagatagccagacaca

SEQ ID NO: 2106781 - DNA, 12 bp, Homo sapiens
agcactgccagg

SEQ ID NO: 2106782 - DNA, 13 bp, Homo sapiens
agcactgccagga

SEQ ID NO: 2106783 - DNA, 15 bp, Homo sapiens
agcactgccaggagg

SEQ ID NO: 2106784 - DNA, 21 bp, Homo sapiens
agcactgctaggcgagtgcca

SEQ ID NO: 2106785 - DNA, 23 bp, Homo sapiens
agcactgctaggcgagtgccagg

SEQ ID NO: 2106786 - DNA, 15 bp, Homo sapiens
agcactggccagaga

SEQ ID NO: 2106787 - DNA, 16 bp, Homo sapiens
agcactggccagagag

SEQ ID NO: 2106788 - DNA, 17 bp, Homo sapiens
agcactggccagagagg

SEQ ID NO: 2106789 - DNA, 20 bp, Homo sapiens
agcactggccagagagggcc

SEQ ID NO: 2106790 - DNA, 23 bp, Homo sapiens
agcactggccagagagggcccag

SEQ ID NO: 2106791 - DNA, 23 bp, Homo sapiens
agcacttgaccttttcgacgctt

SEQ ID NO: 2106792 - DNA, 14 bp, Homo sapiens
agcacttgcgtcct

SEQ ID NO: 2106793 - DNA, 18 bp, Homo sapiens
agcacttgcgtcctgcag

SEQ ID NO: 2106794 - DNA, 17 bp, Homo sapiens
agcacttggagccaagg

SEQ ID NO: 2106795 - DNA, 17 bp, Homo sapiens
agcacttgttccttctg

SEQ ID NO: 2106796 - DNA, 15 bp, Homo sapiens
agcactttgggaggc

SEQ ID NO: 2106797 - DNA, 19 bp, Homo sapiens
agcactttgggaggccaag

SEQ ID NO: 2106798 - DNA, 16 bp, Homo sapiens
agcatcattgtaaatt

SEQ ID NO: 2106799 - DNA, 16 bp, Homo sapiens
agcatccagcctgtgt

SEQ ID NO: 2106800 - DNA, 13 bp, Homo sapiens
agcatcctggcac

SEQ ID NO: 2106801 - DNA, 18 bp, Homo sapiens
agcatcgtgacccttcag

SEQ ID NO: 2106802 - DNA, 22 bp, Homo sapiens
agcatcgtgacccttcagggcc

SEQ ID NO: 2106803 - DNA, 14 bp, Homo sapiens
agcatctcatgagt

SEQ ID NO: 2106804 - DNA, 12 bp, Homo sapiens
agcatctctgtg

SEQ ID NO: 2106805 - DNA, 22 bp, Homo sapiens
agcatctcttgaggccaggagt

SEQ ID NO: 2106806 - DNA, 18 bp, Homo sapiens
agcatctgcctctattca

SEQ ID NO: 2106807 - DNA, 13 bp, Homo sapiens
agcatctgctaat

SEQ ID NO: 2106808 - DNA, 13 bp, Homo sapiens
agcatctgctctt

SEQ ID NO: 2106809 - DNA, 15 bp, Homo sapiens
agcatcttctggagt

SEQ ID NO: 2106810 - DNA, 17 bp, Homo sapiens
agcatgatctgaaaaat

SEQ ID NO: 2106811 - DNA, 18 bp, Homo sapiens
agcatgatcttgttaatg

SEQ ID NO: 2106812 - DNA, 21 bp, Homo sapiens
agcatgcctccaaaaattcac

SEQ ID NO: 2106813 - DNA, 15 bp, Homo sapiens
agcatggactctggg

SEQ ID NO: 2106814 - DNA, 17 bp, Homo sapiens
agcatggctattttata

SEQ ID NO: 2106815 - DNA, 18 bp, Homo sapiens
agcatggctattttatat

SEQ ID NO: 2106816 - DNA, 13 bp, Homo sapiens
agcatggctgtga

SEQ ID NO: 2106817 - DNA, 20 bp, Homo sapiens
agcatgggtgtgcccttggg

SEQ ID NO: 2106818 - DNA, 16 bp, Homo sapiens
agcatggtcacaagca

SEQ ID NO: 2106819 - DNA, 23 bp, Homo sapiens
agcatggtcccacatccctgggc

SEQ ID NO: 2106820 - DNA, 21 bp, Homo sapiens
agcatgtacaaaagtaccata

SEQ ID NO: 2106821 - DNA, 16 bp, Homo sapiens
agcatgtcactcccag

SEQ ID NO: 2106822 - DNA, 15 bp, Homo sapiens
agcatgtggggaagc

SEQ ID NO: 2106823 - DNA, 17 bp, Homo sapiens
agcatgtttcatgtttt

SEQ ID NO: 2106824 - DNA, 18 bp, Homo sapiens
agcatgtttcatgttttg

SEQ ID NO: 2106825 - DNA, 21 bp, Homo sapiens
agcatgtttcatgttttgtga

SEQ ID NO: 2106826 - DNA, 17 bp, Homo sapiens
agcattacgtgagccag

SEQ ID NO: 2106827 - DNA, 20 bp, Homo sapiens
agcattacgtgagccaggta

SEQ ID NO: 2106828 - DNA, 21 bp, Homo sapiens
agcattaggcttttaagaaac

SEQ ID NO: 2106829 - DNA, 17 bp, Homo sapiens
agcattattcttcagaa

SEQ ID NO: 2106830 - DNA, 14 bp, Homo sapiens
agcattcagaagaa

SEQ ID NO: 2106831 - DNA, 18 bp, Homo sapiens
agcattctcactcctacc

SEQ ID NO: 2106832 - DNA, 15 bp, Homo sapiens
agcattgaatggcta

SEQ ID NO: 2106833 - DNA, 13 bp, Homo sapiens
agcattgcatgga

SEQ ID NO: 2106834 - DNA, 17 bp, Homo sapiens
agcatttactttgaatt

SEQ ID NO: 2106835 - DNA, 13 bp, Homo sapiens
agcatttatgttt

SEQ ID NO: 2106836 - DNA, 18 bp, Homo sapiens
agcatttgccattcctgg

SEQ ID NO: 2106837 - DNA, 20 bp, Homo sapiens
agcatttgccctgtggattc

SEQ ID NO: 2106838 - DNA, 14 bp, Homo sapiens
agcatttgtttcta

SEQ ID NO: 2106839 - DNA, 17 bp, Homo sapiens
agcatttgtttctactt

SEQ ID NO: 2106840 - DNA, 19 bp, Homo sapiens
agcatttgtttctactttg

SEQ ID NO: 2106841 - DNA, 19 bp, Homo sapiens
agcattttactgtctgtaa

SEQ ID NO: 2106842 - DNA, 17 bp, Homo sapiens
agcattttgtaagttga

SEQ ID NO: 2106843 - DNA, 18 bp, Homo sapiens
agccaaaaatagctaaat

SEQ ID NO: 2106844 - DNA, 20 bp, Homo sapiens
agcagctgggccggccagcc

SEQ ID NO: 2106845 - DNA, 23 bp, Homo sapiens
agcagctgggccggccagccttg

SEQ ID NO: 2106846 - DNA, 13 bp, Homo sapiens
agcagctggtcaa

SEQ ID NO: 2106847 - DNA, 17 bp, Homo sapiens
agcagcttcagttgttt

SEQ ID NO: 2106848 - DNA, 20 bp, Homo sapiens
agcaggaacagagactctgg

SEQ ID NO: 2106849 - DNA, 18 bp, Homo sapiens
agcaggaagccaggctga

SEQ ID NO: 2106850 - DNA, 19 bp, Homo sapiens
agcaggcacatggaggagc

SEQ ID NO: 2106851 - DNA, 20 bp, Homo sapiens
agcaggcacttgattccttg

SEQ ID NO: 2106852 - DNA, 12 bp, Homo sapiens
agcaggcagagc

SEQ ID NO: 2106853 - DNA, 21 bp, Homo sapiens
agcaggcagagcggggaggtg

SEQ ID NO: 2106854 - DNA, 18 bp, Homo sapiens
agcaggccacgctcaggc

SEQ ID NO: 2106855 - DNA, 14 bp, Homo sapiens
agcaggctactgtc

SEQ ID NO: 2106856 - DNA, 17 bp, Homo sapiens
agcaggctactgtcagc

SEQ ID NO: 2106857 - DNA, 20 bp, Homo sapiens
agcaggctactgtcagctcc

SEQ ID NO: 2106858 - DNA, 18 bp, Homo sapiens
agcaggctcagactctgg

SEQ ID NO: 2106859 - DNA, 14 bp, Homo sapiens
agcagggccgggga

SEQ ID NO: 2106860 - DNA, 14 bp, Homo sapiens
agcagggctcagcg

SEQ ID NO: 2106861 - DNA, 22 bp, Homo sapiens
agcagggctcagcggggacagc

SEQ ID NO: 2106862 - DNA, 23 bp, Homo sapiens
agcagggctctgccccagaggcc

SEQ ID NO: 2106863 - DNA, 16 bp, Homo sapiens
agcagggctgctgtga

SEQ ID NO: 2106864 - DNA, 18 bp, Homo sapiens
agcagggtagtctggttt

SEQ ID NO: 2106865 - DNA, 16 bp, Homo sapiens
agcagggtcttgctgt

SEQ ID NO: 2106866 - DNA, 14 bp, Homo sapiens
agcaggtaagagct

SEQ ID NO: 2106867 - DNA, 20 bp, Homo sapiens
agcaggtagtgggtgaatgt

SEQ ID NO: 2106868 - DNA, 12 bp, Homo sapiens
agcaggtctctg

SEQ ID NO: 2106869 - DNA, 17 bp, Homo sapiens
agcaggtggtcctgaga

SEQ ID NO: 2106870 - DNA, 21 bp, Homo sapiens
agcaggtggtcctgagacctg

SEQ ID NO: 2106871 - DNA, 16 bp, Homo sapiens
agcaggtgtggtggct

SEQ ID NO: 2106872 - DNA, 18 bp, Homo sapiens
agcaggtgtggtggctca

SEQ ID NO: 2106873 - DNA, 14 bp, Homo sapiens
agcaggttcttgat

SEQ ID NO: 2106874 - DNA, 16 bp, Homo sapiens
agcaggttcttgatgt

SEQ ID NO: 2106875 - DNA, 22 bp, Homo sapiens
agcaggttgaggggctcctgga

SEQ ID NO: 2106876 - DNA, 14 bp, Homo sapiens
agcagtatgaatga

SEQ ID NO: 2106877 - DNA, 17 bp, Homo sapiens
agcagtatgaatgatgt

SEQ ID NO: 2106878 - DNA, 18 bp, Homo sapiens
agcagtcagggtgggaag

SEQ ID NO: 2106879 - DNA, 16 bp, Homo sapiens
agcagtgagaaaaagc

SEQ ID NO: 2106880 - DNA, 21 bp, Homo sapiens
agcagtgagaaaaagctcctg

SEQ ID NO: 2106881 - DNA, 22 bp, Homo sapiens
agcagtgagccgcatcttctcc

SEQ ID NO: 2106882 - DNA, 23 bp, Homo sapiens
agcagtgagttacagcgagaggc

SEQ ID NO: 2106883 - DNA, 19 bp, Homo sapiens
agcagtgcctcgaggcacc

SEQ ID NO: 2106884 - DNA, 21 bp, Homo sapiens
agcagtgcctcgaggcaccgg

SEQ ID NO: 2106885 - DNA, 16 bp, Homo sapiens
agcagtgccttccata

SEQ ID NO: 2106886 - DNA, 19 bp, Homo sapiens
agcagtggacaccaggagt

SEQ ID NO: 2106887 - DNA, 17 bp, Homo sapiens
agcagtggagagtgttc

SEQ ID NO: 2106888 - DNA, 21 bp, Homo sapiens
agcagtggccgcaagcgcagg

SEQ ID NO: 2106889 - DNA, 16 bp, Homo sapiens
agcagtgtgtccttgg

SEQ ID NO: 2106890 - DNA, 21 bp, Homo sapiens
agcagtgtgtccttggggcac

SEQ ID NO: 2106891 - DNA, 23 bp, Homo sapiens
agcagtgtgtccttggggcacag

SEQ ID NO: 2106892 - DNA, 12 bp, Homo sapiens
agcagtgttttc

SEQ ID NO: 2106893 - DNA, 19 bp, Homo sapiens
agcagttaccgaggagcta

SEQ ID NO: 2106894 - DNA, 16 bp, Homo sapiens
agcagttctgcagagg

SEQ ID NO: 2106895 - DNA, 13 bp, Homo sapiens
agcagttgaaaag

SEQ ID NO: 2106896 - DNA, 13 bp, Homo sapiens
agcataaatgcaa

SEQ ID NO: 2106897 - DNA, 22 bp, Homo sapiens
agcataatgctcccatctcctg

SEQ ID NO: 2106898 - DNA, 14 bp, Homo sapiens
agcatacatttata

SEQ ID NO: 2106899 - DNA, 19 bp, Homo sapiens
agcataccaacacgagcag

SEQ ID NO: 2106900 - DNA, 22 bp, Homo sapiens
agcatatgcctacttgtaattt

SEQ ID NO: 2106901 - DNA, 16 bp, Homo sapiens
agcatcaccatgcatg

SEQ ID NO: 2106902 - DNA, 16 bp, Homo sapiens
agcatcacctcaggcc

SEQ ID NO: 2106903 - DNA, 17 bp, Homo sapiens
agcatcacttgggatta

SEQ ID NO: 2106904 - DNA, 12 bp, Homo sapiens
agcatcagagat

SEQ ID NO: 2106905 - DNA, 21 bp, Homo sapiens
agcatcatgcctctgaggcca

SEQ ID NO: 2106906 - DNA, 14 bp, Homo sapiens
ctggaaggcagggc

SEQ ID NO: 2106907 - DNA, 17 bp, Homo sapiens
ctggaaggcagggcaga

SEQ ID NO: 2106908 - DNA, 13 bp, Homo sapiens
ctggaaggctggc

SEQ ID NO: 2106909 - DNA, 18 bp, Homo sapiens
ctggaaggctggctgagt

SEQ ID NO: 2106910 - DNA, 23 bp, Homo sapiens
ctggaagggaagtgagaaaccag

SEQ ID NO: 2106911 - DNA, 13 bp, Homo sapiens
ctggaataagaag

SEQ ID NO: 2106912 - DNA, 21 bp, Homo sapiens
ctggaataagaagcaaataaa

SEQ ID NO: 2106913 - DNA, 15 bp, Homo sapiens
ctggaatacatgaaa

SEQ ID NO: 2106914 - DNA, 20 bp, Homo sapiens
ctggaatcaaggaatcctga

SEQ ID NO: 2106915 - DNA, 19 bp, Homo sapiens
ctggaatcaatttcccaga

SEQ ID NO: 2106916 - DNA, 20 bp, Homo sapiens
ctggaatctggagagctaga

SEQ ID NO: 2106917 - DNA, 13 bp, Homo sapiens
ctggaatgaagca

SEQ ID NO: 2106918 - DNA, 15 bp, Homo sapiens
ctggaatgcagtggt

SEQ ID NO: 2106919 - DNA, 20 bp, Homo sapiens
ctggaatgtaatcaatgttt

SEQ ID NO: 2106920 - DNA, 16 bp, Homo sapiens
ctggaattcagcaccc

SEQ ID NO: 2106921 - DNA, 21 bp, Homo sapiens
ctggaattcagcaccctgggt

SEQ ID NO: 2106922 - DNA, 23 bp, Homo sapiens
ctggaattcagcaccctgggtgc

SEQ ID NO: 2106923 - DNA, 16 bp, Homo sapiens
ctggaattgctgctct

SEQ ID NO: 2106924 - DNA, 19 bp, Homo sapiens
ctggaattgctgctctctg

SEQ ID NO: 2106925 - DNA, 23 bp, Homo sapiens
ctggaatttaaggagggacaaga

SEQ ID NO: 2106926 - DNA, 19 bp, Homo sapiens
ctggaatttaattcaaagt

SEQ ID NO: 2106927 - DNA, 12 bp, Homo sapiens
ctggacaaccca

SEQ ID NO: 2106928 - DNA, 13 bp, Homo sapiens
ctggacaacccag

SEQ ID NO: 2106929 - DNA, 18 bp, Homo sapiens
ctggacaagaagctgcta

SEQ ID NO: 2106930 - DNA, 18 bp, Homo sapiens
ctggacaagcagaggtgg

SEQ ID NO: 2106931 - DNA, 11 bp, Homo sapiens
ctggacaagcc

SEQ ID NO: 2106932 - DNA, 15 bp, Homo sapiens
ctggacaagccaact

SEQ ID NO: 2106933 - DNA, 23 bp, Homo sapiens
ctggacaagccaacttgtaaata

SEQ ID NO: 2106934 - DNA, 20 bp, Homo sapiens
ctggacactagggtcaggcg

SEQ ID NO: 2106935 - DNA, 17 bp, Homo sapiens
ctggacagctgtgcctc

SEQ ID NO: 2106936 - DNA, 12 bp, Homo sapiens
ctggacagcttg

SEQ ID NO: 2106937 - DNA, 19 bp, Homo sapiens
ctggacatcacagcagaat

SEQ ID NO: 2106938 - DNA, 22 bp, Homo sapiens
ctggacatcacagcagaatgaa

SEQ ID NO: 2106939 - DNA, 22 bp, Homo sapiens
ctggaccaaccctgtttcctga

SEQ ID NO: 2106940 - DNA, 23 bp, Homo sapiens
ctggaccaaccctgtttcctgag

SEQ ID NO: 2106941 - DNA, 20 bp, Homo sapiens
ctggaccaccagccccagca

SEQ ID NO: 2106942 - DNA, 14 bp, Homo sapiens
ctggaccactgggc

SEQ ID NO: 2106943 - DNA, 15 bp, Homo sapiens
ctggaccactgggca

SEQ ID NO: 2106944 - DNA, 13 bp, Homo sapiens
ctggaccccgcct

SEQ ID NO: 2106945 - DNA, 18 bp, Homo sapiens
ctggaccgcttcccagag

SEQ ID NO: 2106946 - DNA, 21 bp, Homo sapiens
ctggaccgcttcccagaggcc

SEQ ID NO: 2106947 - DNA, 16 bp, Homo sapiens
ctggacctctgcttcc

SEQ ID NO: 2106948 - DNA, 17 bp, Homo sapiens
ctggacggcattcctgc

SEQ ID NO: 2106949 - DNA, 20 bp, Homo sapiens
ctggacggcattcctgctta

SEQ ID NO: 2106950 - DNA, 23 bp, Homo sapiens
ctggacggggactggggatgtgg

SEQ ID NO: 2106951 - DNA, 22 bp, Homo sapiens
ctggactctaagctggagctct

SEQ ID NO: 2106952 - DNA, 14 bp, Homo sapiens
ctggactctggcac

SEQ ID NO: 2106953 - DNA, 18 bp, Homo sapiens
ctggactctggcacccag

SEQ ID NO: 2106954 - DNA, 12 bp, Homo sapiens
ctggactgagga

SEQ ID NO: 2106955 - DNA, 19 bp, Homo sapiens
ctggactgtcatagaaatt

SEQ ID NO: 2106956 - DNA, 13 bp, Homo sapiens
ctggacttgagct

SEQ ID NO: 2106957 - DNA, 15 bp, Homo sapiens
ctggacttgagcttg

SEQ ID NO: 2106958 - DNA, 13 bp, Homo sapiens
ctggagaactaga

SEQ ID NO: 2106959 - DNA, 23 bp, Homo sapiens
ctggagaactagaacctggaggg

SEQ ID NO: 2106960 - DNA, 15 bp, Homo sapiens
ctggagaactagaga

SEQ ID NO: 2106961 - DNA, 21 bp, Homo sapiens
ctggagaagcagtgagccgca

SEQ ID NO: 2106962 - DNA, 13 bp, Homo sapiens
ctggagaagctga

SEQ ID NO: 2106963 - DNA, 17 bp, Homo sapiens
ctggagagaagtttctg

SEQ ID NO: 2106964 - DNA, 19 bp, Homo sapiens
ctggagagccagaacctgg

SEQ ID NO: 2106965 - DNA, 13 bp, Homo sapiens
ctggagagctaga

SEQ ID NO: 2106966 - DNA, 22 bp, Homo sapiens
ctggagagctagaacctggaga

SEQ ID NO: 2106967 - DNA, 13 bp, Homo sapiens
ctggagaggggcc

SEQ ID NO: 2106968 - DNA, 21 bp, Homo sapiens
ctggagatcctaactgagaat

SEQ ID NO: 2106969 - DNA, 13 bp, Homo sapiens
ctggagatgatga

SEQ ID NO: 2106970 - DNA, 16 bp, Homo sapiens
ctggagatgatgatga

SEQ ID NO: 2106971 - DNA, 12 bp, Homo sapiens
ctggagcaagag

SEQ ID NO: 2106972 - DNA, 19 bp, Homo sapiens
ctggagcaagagagagctc

SEQ ID NO: 2106973 - DNA, 14 bp, Homo sapiens
ctggagcaccaggc

SEQ ID NO: 2106974 - DNA, 23 bp, Homo sapiens
ctggagcaccaggcacgaaccca

SEQ ID NO: 2106975 - DNA, 17 bp, Homo sapiens
ctggagcatcccaggcg

SEQ ID NO: 2106976 - DNA, 12 bp, Homo sapiens
ctggagcccagg

SEQ ID NO: 2106977 - DNA, 22 bp, Homo sapiens
ctggagcccgagggcctgacag

SEQ ID NO: 2106978 - DNA, 15 bp, Homo sapiens
ctggagcccttgggt

SEQ ID NO: 2106979 - DNA, 19 bp, Homo sapiens
ctggagcctcggtggccat

SEQ ID NO: 2106980 - DNA, 23 bp, Homo sapiens
ctggagcctcggtggccatgctt

SEQ ID NO: 2106981 - DNA, 20 bp, Homo sapiens
ctggagcggctctcctgaga

SEQ ID NO: 2106982 - DNA, 14 bp, Homo sapiens
ctggagctcttgga

SEQ ID NO: 2106983 - DNA, 16 bp, Homo sapiens
ctggagctcttggaag

SEQ ID NO: 2106984 - DNA, 21 bp, Homo sapiens
ctggagctcttggaagagctc

SEQ ID NO: 2106985 - DNA, 14 bp, Homo sapiens
ctggagctggcttt

SEQ ID NO: 2106986 - DNA, 12 bp, Homo sapiens
ctggaggacaca

SEQ ID NO: 2106987 - DNA, 12 bp, Homo sapiens
ctggaggacctg

SEQ ID NO: 2106988 - DNA, 20 bp, Homo sapiens
ctggaggacctgagcctgcc

SEQ ID NO: 2106989 - DNA, 21 bp, Homo sapiens
ctggaggacctgagcctgccg

SEQ ID NO: 2106990 - DNA, 22 bp, Homo sapiens
ctggaggacctgagcctgccga

SEQ ID NO: 2106991 - DNA, 17 bp, Homo sapiens
ctggaggatccctccat

SEQ ID NO: 2106992 - DNA, 23 bp, Homo sapiens
ctggaggctgcagagctgaccca

SEQ ID NO: 2106993 - DNA, 21 bp, Homo sapiens
ctggagggaatgaacctggag

SEQ ID NO: 2106994 - DNA, 19 bp, Homo sapiens
ctggagggctagaacctgg

SEQ ID NO: 2106995 - DNA, 21 bp, Homo sapiens
ctggagggctagaacctggag

SEQ ID NO: 2106996 - DNA, 22 bp, Homo sapiens
ctggagggctagaacctggaga

SEQ ID NO: 2106997 - DNA, 20 bp, Homo sapiens
ctggagggctagaatctgga

SEQ ID NO: 2106998 - DNA, 22 bp, Homo sapiens
ctggagggctggaatctggaga

SEQ ID NO: 2106999 - DNA, 21 bp, Homo sapiens
ctggaggtcacattcaggaag

SEQ ID NO: 2107000 - DNA, 14 bp, Homo sapiens
ctggagtcccctgg

SEQ ID NO: 2107001 - DNA, 18 bp, Homo sapiens
ctggagtgaggcttccag

SEQ ID NO: 2107002 - DNA, 19 bp, Homo sapiens
ctggagtgaggcttccagg

SEQ ID NO: 2107003 - DNA, 22 bp, Homo sapiens
ctggagtgaggcttccaggctc

SEQ ID NO: 2107004 - DNA, 17 bp, Homo sapiens
ctggagtgcagtgagcc

SEQ ID NO: 2107005 - DNA, 23 bp, Homo sapiens
ctggagtgcgctcttggtccctg

SEQ ID NO: 2107006 - DNA, 24 bp, Homo sapiens
ctggagtgcgctcttggtccctgg

SEQ ID NO: 2107007 - DNA, 19 bp, Homo sapiens
ctggatcagcgtggccttg

SEQ ID NO: 2107008 - DNA, 20 bp, Homo sapiens
ctggatcctgctgtggcctc

SEQ ID NO: 2107009 - DNA, 21 bp, Homo sapiens
ctggatcctgctgtggcctca

SEQ ID NO: 2107010 - DNA, 22 bp, Homo sapiens
ctggatcctgctgtggcctcac

SEQ ID NO: 2107011 - DNA, 15 bp, Homo sapiens
ctggatctccccact

SEQ ID NO: 2107012 - DNA, 22 bp, Homo sapiens
ctggatcttcagaaggctagag

SEQ ID NO: 2107013 - DNA, 16 bp, Homo sapiens
ctggatggcaccagag

SEQ ID NO: 2107014 - DNA, 20 bp, Homo sapiens
ctggatgggcattgggctga

SEQ ID NO: 2107015 - DNA, 21 bp, Homo sapiens
ctggatgggcattgggctgac

SEQ ID NO: 2107016 - DNA, 19 bp, Homo sapiens
ctggatgtcatattggcag

SEQ ID NO: 2107017 - DNA, 20 bp, Homo sapiens
ctggatgtcccctgtcccac

SEQ ID NO: 2107018 - DNA, 17 bp, Homo sapiens
ctggatgtgcccacagg

SEQ ID NO: 2107019 - DNA, 21 bp, Homo sapiens
ctggattccagagcactgctc

SEQ ID NO: 2107020 - DNA, 14 bp, Homo sapiens
ctggcgtgcagtgg

SEQ ID NO: 2107021 - DNA, 15 bp, Homo sapiens
ctggcgtgcagtggt

SEQ ID NO: 2107022 - DNA, 16 bp, Homo sapiens
ctggctaactggaagc

SEQ ID NO: 2107023 - DNA, 17 bp, Homo sapiens
ctggctaactggaagca

SEQ ID NO: 2107024 - DNA, 13 bp, Homo sapiens
ctggctcacccct

SEQ ID NO: 2107025 - DNA, 14 bp, Homo sapiens
ctggctcacccctc

SEQ ID NO: 2107026 - DNA, 14 bp, Homo sapiens
ctggctcaggaaga

SEQ ID NO: 2107027 - DNA, 13 bp, Homo sapiens
ctggctccagaat

SEQ ID NO: 2107028 - DNA, 15 bp, Homo sapiens
ctggctcccacaggc

SEQ ID NO: 2107029 - DNA, 21 bp, Homo sapiens
ctggctccccacgagtcacct

SEQ ID NO: 2107030 - DNA, 22 bp, Homo sapiens
ctggctccccacgagtcacctg

SEQ ID NO: 2107031 - DNA, 14 bp, Homo sapiens
ctggctcctccagg

SEQ ID NO: 2107032 - DNA, 14 bp, Homo sapiens
ctggctcctccttc

SEQ ID NO: 2107033 - DNA, 14 bp, Homo sapiens
ctggctctccacct

SEQ ID NO: 2107034 - DNA, 15 bp, Homo sapiens
ctggctctccacctt

SEQ ID NO: 2107035 - DNA, 23 bp, Homo sapiens
ctggctctcctgtagctctcctg

SEQ ID NO: 2107036 - DNA, 18 bp, Homo sapiens
ctggctctgcaatgggca

SEQ ID NO: 2107037 - DNA, 16 bp, Homo sapiens
ctggctgaaaatcact

SEQ ID NO: 2107038 - DNA, 18 bp, Homo sapiens
ctggctgaaaatcactat

SEQ ID NO: 2107039 - DNA, 13 bp, Homo sapiens
ctggctgagctga

SEQ ID NO: 2107040 - DNA, 22 bp, Homo sapiens
ctggctgaggatttcaagcctg

SEQ ID NO: 2107041 - DNA, 15 bp, Homo sapiens
ctggctgagggcagt

SEQ ID NO: 2107042 - DNA, 23 bp, Homo sapiens
ctggctgagggcagttcgcagcc

SEQ ID NO: 2107043 - DNA, 24 bp, Homo sapiens
ctggctgctctcatgcctgcctga

SEQ ID NO: 2107044 - DNA, 12 bp, Homo sapiens
ctggctgctgac

SEQ ID NO: 2107045 - DNA, 14 bp, Homo sapiens
ctggctggggcaga

SEQ ID NO: 2107046 - DNA, 17 bp, Homo sapiens
ctggctggtagagcagg

SEQ ID NO: 2107047 - DNA, 21 bp, Homo sapiens
ctggctgtggaggcctgatgc

SEQ ID NO: 2107048 - DNA, 16 bp, Homo sapiens
ctggctgttggctggg

SEQ ID NO: 2107049 - DNA, 13 bp, Homo sapiens
ctccccaggcctc

SEQ ID NO: 2107050 - DNA, 14 bp, Homo sapiens
ctccccaggcctcc

SEQ ID NO: 2107051 - DNA, 16 bp, Homo sapiens
ctccccaggcctccag

SEQ ID NO: 2107052 - DNA, 11 bp, Homo sapiens
ctccccagggg

SEQ ID NO: 2107053 - DNA, 16 bp, Homo sapiens
ctccccattcacagag

SEQ ID NO: 2107054 - DNA, 18 bp, Homo sapiens
ctccccattcacagagcc

SEQ ID NO: 2107055 - DNA, 19 bp, Homo sapiens
ctccccattcacagagcct

SEQ ID NO: 2107056 - DNA, 17 bp, Homo sapiens
ctccccattcagacact

SEQ ID NO: 2107057 - DNA, 14 bp, Homo sapiens
ctcccccaccccct

SEQ ID NO: 2107058 - DNA, 12 bp, Homo sapiens
ctcccccagagc

SEQ ID NO: 2107059 - DNA, 14 bp, Homo sapiens
ctcccccagagcca

SEQ ID NO: 2107060 - DNA, 15 bp, Homo sapiens
ctcccccgacactgc

SEQ ID NO: 2107061 - DNA, 21 bp, Homo sapiens
ctcccccgacactgctgcacc

SEQ ID NO: 2107062 - DNA, 18 bp, Homo sapiens
ctcccccgcagtccccag

SEQ ID NO: 2107063 - DNA, 21 bp, Homo sapiens
ctcccccgcagtccccagccc

SEQ ID NO: 2107064 - DNA, 22 bp, Homo sapiens
ctcccccgcagtccccagccct

SEQ ID NO: 2107065 - DNA, 13 bp, Homo sapiens
ctccccctgcctt

SEQ ID NO: 2107066 - DNA, 18 bp, Homo sapiens
ctccccctgcctttgaaa

SEQ ID NO: 2107067 - DNA, 12 bp, Homo sapiens
ctccccctgggc

SEQ ID NO: 2107068 - DNA, 13 bp, Homo sapiens
ctccccctgggct

SEQ ID NO: 2107069 - DNA, 15 bp, Homo sapiens
ctccccgcagagctc

SEQ ID NO: 2107070 - DNA, 19 bp, Homo sapiens
ctcccctattttaagacgt

SEQ ID NO: 2107071 - DNA, 13 bp, Homo sapiens
ctcccctcccccc

SEQ ID NO: 2107072 - DNA, 20 bp, Homo sapiens
ctcccctccctcttccttcc

SEQ ID NO: 2107073 - DNA, 22 bp, Homo sapiens
ctcccctgcccccatcccacat

SEQ ID NO: 2107074 - DNA, 16 bp, Homo sapiens
ctcccctgccctgctg

SEQ ID NO: 2107075 - DNA, 20 bp, Homo sapiens
ctcccctgtcttctctcaaa

SEQ ID NO: 2107076 - DNA, 13 bp, Homo sapiens
ctccccttcctgc

SEQ ID NO: 2107077 - DNA, 14 bp, Homo sapiens
ctccccttcctgca

SEQ ID NO: 2107078 - DNA, 18 bp, Homo sapiens
ctcccgcgggcctggaca

SEQ ID NO: 2107079 - DNA, 20 bp, Homo sapiens
ctcccggctatgggggcact

SEQ ID NO: 2107080 - DNA, 15 bp, Homo sapiens
ctcccggctgcctgc

SEQ ID NO: 2107081 - DNA, 18 bp, Homo sapiens
ctcccgggagcacagagg

SEQ ID NO: 2107082 - DNA, 20 bp, Homo sapiens
ctccctaaaataaaaaccag

SEQ ID NO: 2107083 - DNA, 21 bp, Homo sapiens
ctccctaaaataaaaaccaga

SEQ ID NO: 2107084 - DNA, 15 bp, Homo sapiens
ctgccccaactcctt

SEQ ID NO: 2107085 - DNA, 12 bp, Homo sapiens
ctgccccaagca

SEQ ID NO: 2107086 - DNA, 16 bp, Homo sapiens
ctgccccaagcagcca

SEQ ID NO: 2107087 - DNA, 17 bp, Homo sapiens
ctgccccaagcagccag

SEQ ID NO: 2107088 - DNA, 22 bp, Homo sapiens
ctgccccaagcagccagccagt

SEQ ID NO: 2107089 - DNA, 16 bp, Homo sapiens
ctgccccaagccccca

SEQ ID NO: 2107090 - DNA, 20 bp, Homo sapiens
ctgccccaaggggcccacaa

SEQ ID NO: 2107091 - DNA, 16 bp, Homo sapiens
ctgccccaccagccac

SEQ ID NO: 2107092 - DNA, 18 bp, Homo sapiens
ctgccccagctctggctt

SEQ ID NO: 2107093 - DNA, 16 bp, Homo sapiens
ctgccccagctttatc

SEQ ID NO: 2107094 - DNA, 19 bp, Homo sapiens
ctgccccagggctcccggc

SEQ ID NO: 2107095 - DNA, 19 bp, Homo sapiens
ctgccccagtagtcagaag

SEQ ID NO: 2107096 - DNA, 16 bp, Homo sapiens
ctgccccatcctgggc

SEQ ID NO: 2107097 - DNA, 17 bp, Homo sapiens
ctgccccatcctgggcc

SEQ ID NO: 2107098 - DNA, 13 bp, Homo sapiens
ctgccccatctcc

SEQ ID NO: 2107099 - DNA, 16 bp, Homo sapiens
ctgccccatctcctcc

SEQ ID NO: 2107100 - DNA, 21 bp, Homo sapiens
ctgcccccacgagggtcagga

SEQ ID NO: 2107101 - DNA, 17 bp, Homo sapiens
ctgcccccagcactcct

SEQ ID NO: 2107102 - DNA, 13 bp, Homo sapiens
ctgcccccagcca

SEQ ID NO: 2107103 - DNA, 18 bp, Homo sapiens
ctgcccccagcctctgtc

SEQ ID NO: 2107104 - DNA, 12 bp, Homo sapiens
ctgcccccatcc

SEQ ID NO: 2107105 - DNA, 18 bp, Homo sapiens
ctgcccccatctccccag

SEQ ID NO: 2107106 - DNA, 22 bp, Homo sapiens
ctgcccccatctccccaggcct

SEQ ID NO: 2107107 - DNA, 18 bp, Homo sapiens
ctgcccccgacagcccag

SEQ ID NO: 2107108 - DNA, 19 bp, Homo sapiens
ctgcccccgacagcccagc

SEQ ID NO: 2107109 - DNA, 21 bp, Homo sapiens
ctgcccccgtcttctctccat

SEQ ID NO: 2107110 - DNA, 15 bp, Homo sapiens
ctgccccgcccagct

SEQ ID NO: 2107111 - DNA, 20 bp, Homo sapiens
ctgccccgggtccccagctc

SEQ ID NO: 2107112 - DNA, 18 bp, Homo sapiens
ctgccccgttccctgtca

SEQ ID NO: 2107113 - DNA, 15 bp, Homo sapiens
ctgcccctgccccaa

SEQ ID NO: 2107114 - DNA, 13 bp, Homo sapiens
ctgccccttgggc

SEQ ID NO: 2107115 - DNA, 17 bp, Homo sapiens
ctgcccgactcaggtcc

SEQ ID NO: 2107116 - DNA, 11 bp, Homo sapiens
ctgcccggctg

SEQ ID NO: 2107117 - DNA, 17 bp, Homo sapiens
ctgcccgtcttcagcct

SEQ ID NO: 2107118 - DNA, 18 bp, Homo sapiens
ctgcccgtcttcagccta

SEQ ID NO: 2107119 - DNA, 15 bp, Homo sapiens
ctgccctagagcaca

SEQ ID NO: 2107120 - DNA, 23 bp, Homo sapiens
ctgccctcccacctccgctggga

SEQ ID NO: 2107121 - DNA, 14 bp, Homo sapiens
ctgccctcccatgt

SEQ ID NO: 2107122 - DNA, 17 bp, Homo sapiens
ctgccctccctggcctc

SEQ ID NO: 2107123 - DNA, 16 bp, Homo sapiens
ctgccctccctggggt

SEQ ID NO: 2107124 - DNA, 15 bp, Homo sapiens
ctgccctctctcagt

SEQ ID NO: 2107125 - DNA, 16 bp, Homo sapiens
ctgccctgccacctgt

SEQ ID NO: 2107126 - DNA, 21 bp, Homo sapiens
ctgccctgccacctgtctgtc

SEQ ID NO: 2107127 - DNA, 14 bp, Homo sapiens
ctgccctgcctccc

SEQ ID NO: 2107128 - DNA, 15 bp, Homo sapiens
ctgccctgctctggg

SEQ ID NO: 2107129 - DNA, 16 bp, Homo sapiens
ctgccctgctctgggg

SEQ ID NO: 2107130 - DNA, 14 bp, Homo sapiens
ctgccctggaggga

SEQ ID NO: 2107131 - DNA, 13 bp, Homo sapiens
ctgccctggtgct

SEQ ID NO: 2107132 - DNA, 13 bp, Homo sapiens
ctgccctgtaccc

SEQ ID NO: 2107133 - DNA, 14 bp, Homo sapiens
ctgccctgtatata

SEQ ID NO: 2107134 - DNA, 19 bp, Homo sapiens
ctgccctgtatataatact

SEQ ID NO: 2107135 - DNA, 17 bp, Homo sapiens
ctgccctgtcctccagc

SEQ ID NO: 2107136 - DNA, 16 bp, Homo sapiens
ctgcccttcgctgcca

SEQ ID NO: 2107137 - DNA, 21 bp, Homo sapiens
ctgcccttcgctgccaggaca

SEQ ID NO: 2107138 - DNA, 23 bp, Homo sapiens
ctgcccttcgctgccaggacacc

SEQ ID NO: 2107139 - DNA, 12 bp, Homo sapiens
ctgcccttgttt

SEQ ID NO: 2107140 - DNA, 21 bp, Homo sapiens
ctgcccttgtttggggcagga

SEQ ID NO: 2107141 - DNA, 22 bp, Homo sapiens
ctgcccttgtttggggcaggag

SEQ ID NO: 2107142 - DNA, 15 bp, Homo sapiens
ctgccgaccagagcc

SEQ ID NO: 2107143 - DNA, 17 bp, Homo sapiens
ctgccgacctcgtcctc

SEQ ID NO: 2107144 - DNA, 16 bp, Homo sapiens
ctgccgagcaaccgtg

SEQ ID NO: 2107145 - DNA, 23 bp, Homo sapiens
ctgccgcaaggccctgtcccagc

SEQ ID NO: 2107146 - DNA, 17 bp, Homo sapiens
ctgccgcaccccagagt

SEQ ID NO: 2107147 - DNA, 14 bp, Homo sapiens
ctgccgcctcccag

SEQ ID NO: 2107148 - DNA, 19 bp, Homo sapiens
ctgccgcctcccagcctgg

SEQ ID NO: 2107149 - DNA, 18 bp, Homo sapiens
ctgccgctgccgctgcac

SEQ ID NO: 2107150 - DNA, 20 bp, Homo sapiens
ctgccgctgccgctgcacca

SEQ ID NO: 2107151 - DNA, 19 bp, Homo sapiens
ctgccgggttctagtctcc

SEQ ID NO: 2107152 - DNA, 15 bp, Homo sapiens
ctgcctacattccct

SEQ ID NO: 2107153 - DNA, 23 bp, Homo sapiens
ctgcctacattccctggcctggc

SEQ ID NO: 2107154 - DNA, 12 bp, Homo sapiens
ctgcctagaaaa

SEQ ID NO: 2107155 - DNA, 16 bp, Homo sapiens
ctgcctatccatcctg

SEQ ID NO: 2107156 - DNA, 16 bp, Homo sapiens
ctgcctatttattggg

SEQ ID NO: 2107157 - DNA, 24 bp, Homo sapiens
ctgcctcaatgtgaatcagaccct

SEQ ID NO: 2107158 - DNA, 14 bp, Homo sapiens
ctgcctcagcctcc

SEQ ID NO: 2107159 - DNA, 22 bp, Homo sapiens
ctgcctcatgaccctcctgtcc

SEQ ID NO: 2107160 - DNA, 12 bp, Homo sapiens
ctgcctcccagc

SEQ ID NO: 2107161 - DNA, 14 bp, Homo sapiens
ctgcctcctcttca

SEQ ID NO: 2107162 - DNA, 19 bp, Homo sapiens
ctgcctcgaactggctgca

SEQ ID NO: 2107163 - DNA, 19 bp, Homo sapiens
ctgcctctactgggaaggc

SEQ ID NO: 2107164 - DNA, 22 bp, Homo sapiens
ctgcctctactgggaaggctac

SEQ ID NO: 2107165 - DNA, 13 bp, Homo sapiens
ctgcctctcacac

SEQ ID NO: 2107166 - DNA, 15 bp, Homo sapiens
ctgcctctctgctcc

SEQ ID NO: 2107167 - DNA, 18 bp, Homo sapiens
ctgcctctctgctccaga

SEQ ID NO: 2107168 - DNA, 23 bp, Homo sapiens
ctgcctctgacacacagctctgt

SEQ ID NO: 2107169 - DNA, 19 bp, Homo sapiens
ctgcctgaacctggggtca

SEQ ID NO: 2107170 - DNA, 18 bp, Homo sapiens
ctgcctgaagtcacacag

SEQ ID NO: 2107171 - DNA, 12 bp, Homo sapiens
ctgcctgagccc

SEQ ID NO: 2107172 - DNA, 16 bp, Homo sapiens
ctgcctgagcccagga

SEQ ID NO: 2107173 - DNA, 19 bp, Homo sapiens
ctgcctgagcccaggagct

SEQ ID NO: 2107174 - DNA, 13 bp, Homo sapiens
ctgcctgcagcct

SEQ ID NO: 2107175 - DNA, 16 bp, Homo sapiens
ctgcctgcagcctccc

SEQ ID NO: 2107176 - DNA, 20 bp, Homo sapiens
ctgcctgcagtactttacct

SEQ ID NO: 2107177 - DNA, 13 bp, Homo sapiens
ctgcctgcccact

SEQ ID NO: 2107178 - DNA, 13 bp, Homo sapiens
ctgcctgcccagg

SEQ ID NO: 2107179 - DNA, 17 bp, Homo sapiens
ctgcctgcccaggcccc

SEQ ID NO: 2107180 - DNA, 20 bp, Homo sapiens
ctgcctgcccaggcccctgc

SEQ ID NO: 2107181 - DNA, 21 bp, Homo sapiens
ctgcctgcccaggcccctgcc

SEQ ID NO: 2107182 - DNA, 12 bp, Homo sapiens
ctgcctgccctc

SEQ ID NO: 2107183 - DNA, 12 bp, Homo sapiens
ctgcctgcttgg

SEQ ID NO: 2107184 - DNA, 10 bp, Homo sapiens
ctgcctggag

SEQ ID NO: 2107185 - DNA, 11 bp, Homo sapiens
ctgcctggagg

SEQ ID NO: 2107186 - DNA, 15 bp, Homo sapiens
ctgcctggaggacct

SEQ ID NO: 2107187 - DNA, 18 bp, Homo sapiens
ctgcctggaggacctgag

SEQ ID NO: 2107188 - DNA, 11 bp, Homo sapiens
ctgcctggcct

SEQ ID NO: 2107189 - DNA, 14 bp, Homo sapiens
ctgcctggcctggc

SEQ ID NO: 2107190 - DNA, 15 bp, Homo sapiens
ctgcctggcctggct

SEQ ID NO: 2107191 - DNA, 15 bp, Homo sapiens
ctgcctgggcctgtg

SEQ ID NO: 2107192 - DNA, 20 bp, Homo sapiens
ctgcctgggcctgtgcagca

SEQ ID NO: 2107193 - DNA, 23 bp, Homo sapiens
ctgcctgggcctgtgcagcagcc

SEQ ID NO: 2107194 - DNA, 24 bp, Homo sapiens
ctgcctgggcctgtgcagcagccc

SEQ ID NO: 2107195 - DNA, 20 bp, Homo sapiens
ctgcctggggattgggaggg

SEQ ID NO: 2107196 - DNA, 22 bp, Homo sapiens
ctgcctgggttttctaactgta

SEQ ID NO: 2107197 - DNA, 16 bp, Homo sapiens
ctgcctgtagcagtga

SEQ ID NO: 2107198 - DNA, 15 bp, Homo sapiens
ctgcctgtagttagg

SEQ ID NO: 2107199 - DNA, 18 bp, Homo sapiens
cttacacttggagcccgt

SEQ ID NO: 2107200 - DNA, 19 bp, Homo sapiens
cttacaggtatcaggcaca

SEQ ID NO: 2107201 - DNA, 21 bp, Homo sapiens
cttacaggtatcaggcacagg

SEQ ID NO: 2107202 - DNA, 18 bp, Homo sapiens
cttacagttttaaattct

SEQ ID NO: 2107203 - DNA, 22 bp, Homo sapiens
cttacataattttttattcaag

SEQ ID NO: 2107204 - DNA, 12 bp, Homo sapiens
cttacatgattc

SEQ ID NO: 2107205 - DNA, 19 bp, Homo sapiens
cttacatgcattactgcat

SEQ ID NO: 2107206 - DNA, 20 bp, Homo sapiens
cttacattagcagtttgctt

SEQ ID NO: 2107207 - DNA, 11 bp, Homo sapiens
cttacattcct

SEQ ID NO: 2107208 - DNA, 15 bp, Homo sapiens
cttaccaactttctg

SEQ ID NO: 2107209 - DNA, 17 bp, Homo sapiens
cttaccaactttctgta

SEQ ID NO: 2107210 - DNA, 22 bp, Homo sapiens
cttacctaaacagatataaatg

SEQ ID NO: 2107211 - DNA, 16 bp, Homo sapiens
cttacctcccctgcca

SEQ ID NO: 2107212 - DNA, 17 bp, Homo sapiens
cttacctcccctgccag

SEQ ID NO: 2107213 - DNA, 13 bp, Homo sapiens
cttacctcctgcc

SEQ ID NO: 2107214 - DNA, 15 bp, Homo sapiens
cttacctcctgccca

SEQ ID NO: 2107215 - DNA, 19 bp, Homo sapiens
cttacctcctgcccaggag

SEQ ID NO: 2107216 - DNA, 11 bp, Homo sapiens
cttacctgaca

SEQ ID NO: 2107217 - DNA, 12 bp, Homo sapiens
cttacctgacac

SEQ ID NO: 2107218 - DNA, 15 bp, Homo sapiens
cttaccttcaataaa

SEQ ID NO: 2107219 - DNA, 17 bp, Homo sapiens
cttaccttcaataaagt

SEQ ID NO: 2107220 - DNA, 22 bp, Homo sapiens
cttaccttcaataaagtatcta

SEQ ID NO: 2107221 - DNA, 23 bp, Homo sapiens
cttactaatgtgccccatgtcca

SEQ ID NO: 2107222 - DNA, 14 bp, Homo sapiens
cttactagccctgc

SEQ ID NO: 2107223 - DNA, 13 bp, Homo sapiens
cttactcacctct

SEQ ID NO: 2107224 - DNA, 14 bp, Homo sapiens
cttactccaggaga

SEQ ID NO: 2107225 - DNA, 12 bp, Homo sapiens
cttactcctgtg

SEQ ID NO: 2107226 - DNA, 13 bp, Homo sapiens
cttactcctgtgg

SEQ ID NO: 2107227 - DNA, 14 bp, Homo sapiens
cttactcctgtggg

SEQ ID NO: 2107228 - DNA, 15 bp, Homo sapiens
cttactctgagccca

SEQ ID NO: 2107229 - DNA, 16 bp, Homo sapiens
cttactctgagcccag

SEQ ID NO: 2107230 - DNA, 18 bp, Homo sapiens
cttactctgagcccaggc

SEQ ID NO: 2107231 - DNA, 15 bp, Homo sapiens
cttacttattcttcc

SEQ ID NO: 2107232 - DNA, 15 bp, Homo sapiens
cttagaagtcacaca

SEQ ID NO: 2107233 - DNA, 17 bp, Homo sapiens
cttagaagtggaccagg

SEQ ID NO: 2107234 - DNA, 11 bp, Homo sapiens
cttagaataaa

SEQ ID NO: 2107235 - DNA, 13 bp, Homo sapiens
cttagacctcagc

SEQ ID NO: 2107236 - DNA, 16 bp, Homo sapiens
cttagacctcagcctg

SEQ ID NO: 2107237 - DNA, 20 bp, Homo sapiens
cttagacctcagcctgtgct

SEQ ID NO: 2107238 - DNA, 17 bp, Homo sapiens
cttagactagttgaaca

SEQ ID NO: 2107239 - DNA, 20 bp, Homo sapiens
cttagacttcgactcaggat

SEQ ID NO: 2107240 - DNA, 20 bp, Homo sapiens
cttagagaatgttctcctaa

SEQ ID NO: 2107241 - DNA, 20 bp, Homo sapiens
cttagagattgccccagagc

SEQ ID NO: 2107242 - DNA, 17 bp, Homo sapiens
cttagcagctcttcccc

SEQ ID NO: 2107243 - DNA, 18 bp, Homo sapiens
cttagcatgtgttgaaaa

SEQ ID NO: 2107244 - DNA, 15 bp, Homo sapiens
cttagcccaagaggt

SEQ ID NO: 2107245 - DNA, 17 bp, Homo sapiens
cttagccgtccatggca

SEQ ID NO: 2107246 - DNA, 20 bp, Homo sapiens
cttagccgtccatggcacca

SEQ ID NO: 2107247 - DNA, 14 bp, Homo sapiens
cttagcctggagca

SEQ ID NO: 2107248 - DNA, 18 bp, Homo sapiens
cttagccttgtgccctgc

SEQ ID NO: 2107249 - DNA, 19 bp, Homo sapiens
cttagctgaacaatgaatg

SEQ ID NO: 2107250 - DNA, 20 bp, Homo sapiens
cttagctgaacaatgaatgc

SEQ ID NO: 2107251 - DNA, 16 bp, Homo sapiens
cttagcttagacctca

SEQ ID NO: 2107252 - DNA, 20 bp, Homo sapiens
cttagcttagacctcagcct

SEQ ID NO: 2107253 - DNA, 23 bp, Homo sapiens
cttagcttagacctcagcctgtg

SEQ ID NO: 2107254 - DNA, 18 bp, Homo sapiens
ctggttttcctaaatgca

SEQ ID NO: 2107255 - DNA, 21 bp, Homo sapiens
ctgtaaaaagagagaaaactt

SEQ ID NO: 2107256 - DNA, 15 bp, Homo sapiens
ctgtaaaatgaaatt

SEQ ID NO: 2107257 - DNA, 16 bp, Homo sapiens
ctgtaaaatgaaatta

SEQ ID NO: 2107258 - DNA, 14 bp, Homo sapiens
ctgtaaactataaa

SEQ ID NO: 2107259 - DNA, 16 bp, Homo sapiens
ctgtaaactataaact

SEQ ID NO: 2107260 - DNA, 22 bp, Homo sapiens
ctgtaaatacaaaataaaatta

SEQ ID NO: 2107261 - DNA, 16 bp, Homo sapiens
ctgtaaatacatgtgt

SEQ ID NO: 2107262 - DNA, 23 bp, Homo sapiens
ctgtaaatagttttaaatatgaa

SEQ ID NO: 2107263 - DNA, 16 bp, Homo sapiens
ctgtaaatatccacag

SEQ ID NO: 2107264 - DNA, 18 bp, Homo sapiens
ctgtaaatatccacagac

SEQ ID NO: 2107265 - DNA, 13 bp, Homo sapiens
ctgtaaatcactt

SEQ ID NO: 2107266 - DNA, 14 bp, Homo sapiens
ctgtaaatcacttg

SEQ ID NO: 2107267 - DNA, 20 bp, Homo sapiens
ctgtaaatcacttgtaaata

SEQ ID NO: 2107268 - DNA, 17 bp, Homo sapiens
ctgtaacacaagccaca

SEQ ID NO: 2107269 - DNA, 18 bp, Homo sapiens
ctgtaacacaagccacag

SEQ ID NO: 2107270 - DNA, 22 bp, Homo sapiens
ctgtaacacaagccacagaagc

SEQ ID NO: 2107271 - DNA, 15 bp, Homo sapiens
ctgtaactcagacat

SEQ ID NO: 2107272 - DNA, 16 bp, Homo sapiens
ctgtaactgctgagcc

SEQ ID NO: 2107273 - DNA, 18 bp, Homo sapiens
ctgtaactgctgagccac

SEQ ID NO: 2107274 - DNA, 19 bp, Homo sapiens
ctgtaactgctgagccact

SEQ ID NO: 2107275 - DNA, 17 bp, Homo sapiens
ctgtaattttgtttgta

SEQ ID NO: 2107276 - DNA, 18 bp, Homo sapiens
ctgtacaatatttaaaat

SEQ ID NO: 2107277 - DNA, 22 bp, Homo sapiens
ctgtaccaagccccttggccct

SEQ ID NO: 2107278 - DNA, 17 bp, Homo sapiens
ctgtacccaatttaatt

SEQ ID NO: 2107279 - DNA, 13 bp, Homo sapiens
ctgtacccagctc

SEQ ID NO: 2107280 - DNA, 14 bp, Homo sapiens
ctgtacccagctcc

SEQ ID NO: 2107281 - DNA, 21 bp, Homo sapiens
ctgtacccttccacctcctag

SEQ ID NO: 2107282 - DNA, 22 bp, Homo sapiens
ctgtacccttcgggagggcact

SEQ ID NO: 2107283 - DNA, 15 bp, Homo sapiens
ctgtacgtctgacag

SEQ ID NO: 2107284 - DNA, 20 bp, Homo sapiens
ctgtacgtctgacaggcaat

SEQ ID NO: 2107285 - DNA, 18 bp, Homo sapiens
ctgtactaaggagcatga

SEQ ID NO: 2107286 - DNA, 14 bp, Homo sapiens
ctgtactcagagca

SEQ ID NO: 2107287 - DNA, 18 bp, Homo sapiens
ctgtactcagagcagagc

SEQ ID NO: 2107288 - DNA, 19 bp, Homo sapiens
ctgtactcagagcagagca

SEQ ID NO: 2107289 - DNA, 13 bp, Homo sapiens
ctgtactcaggag

SEQ ID NO: 2107290 - DNA, 16 bp, Homo sapiens
ctgtactcctcccagg

SEQ ID NO: 2107291 - DNA, 13 bp, Homo sapiens
ctgtactgcctgc

SEQ ID NO: 2107292 - DNA, 17 bp, Homo sapiens
ctgtactgcctgcttgg

SEQ ID NO: 2107293 - DNA, 18 bp, Homo sapiens
ctgtactgcctgcttggg

SEQ ID NO: 2107294 - DNA, 19 bp, Homo sapiens
ctgtactgggttatttttg

SEQ ID NO: 2107295 - DNA, 15 bp, Homo sapiens
ctgtacttcaagtta

SEQ ID NO: 2107296 - DNA, 17 bp, Homo sapiens
ctgtacttgatgacaga

SEQ ID NO: 2107297 - DNA, 20 bp, Homo sapiens
ctgtagcagtgagaaaaagc

SEQ ID NO: 2107298 - DNA, 21 bp, Homo sapiens
ctgtagcagtgagaaaaagct

SEQ ID NO: 2107299 - DNA, 17 bp, Homo sapiens
ctgtagcatcttctgga

SEQ ID NO: 2107300 - DNA, 19 bp, Homo sapiens
ctgtagcatcttctggagt

SEQ ID NO: 2107301 - DNA, 18 bp, Homo sapiens
ctgtagcattacagtggg

SEQ ID NO: 2107302 - DNA, 17 bp, Homo sapiens
ctgtagccatggctcag

SEQ ID NO: 2107303 - DNA, 19 bp, Homo sapiens
ctgtagccatggctcaggc

SEQ ID NO: 2107304 - DNA, 18 bp, Homo sapiens
ctgtagtagccctttctg

SEQ ID NO: 2107305 - DNA, 21 bp, Homo sapiens
ctgtagtagccctttctgtgt

SEQ ID NO: 2107306 - DNA, 17 bp, Homo sapiens
ctgtagtcccagccact

SEQ ID NO: 2107307 - DNA, 18 bp, Homo sapiens
ctgtagtcccagccactc

SEQ ID NO: 2107308 - DNA, 20 bp, Homo sapiens
ctgtagttgcgtggactctg

SEQ ID NO: 2107309 - DNA, 21 bp, Homo sapiens
ctgtataaaatgcaaaataaa

SEQ ID NO: 2107310 - DNA, 20 bp, Homo sapiens
ctgtataaacattaaatgtc

SEQ ID NO: 2107311 - DNA, 21 bp, Homo sapiens
ctgtataaacattaaatgtct

SEQ ID NO: 2107312 - DNA, 14 bp, Homo sapiens
ctgtataatctatt

SEQ ID NO: 2107313 - DNA, 17 bp, Homo sapiens
ctgtataatttaacagt

SEQ ID NO: 2107314 - DNA, 21 bp, Homo sapiens
ctgtatagttaggatagcatt

SEQ ID NO: 2107315 - DNA, 18 bp, Homo sapiens
ctgtatatacaataacat

SEQ ID NO: 2107316 - DNA, 20 bp, Homo sapiens
ctgtatatatatatgtgtgt

SEQ ID NO: 2107317 - DNA, 19 bp, Homo sapiens
ctgtatatgttgtaataaa

SEQ ID NO: 2107318 - DNA, 15 bp, Homo sapiens
ctgtatcccatgagc

SEQ ID NO: 2107319 - DNA, 22 bp, Homo sapiens
ctgtatcccatgagcctcagca

SEQ ID NO: 2107320 - DNA, 23 bp, Homo sapiens
ctgtatcccatgagcctcagcat

SEQ ID NO: 2107321 - DNA, 21 bp, Homo sapiens
ctgtatctactaaaaatacaa

SEQ ID NO: 2107322 - DNA, 23 bp, Homo sapiens
ctgtatggcacttattatgaggc

SEQ ID NO: 2107323 - DNA, 12 bp, Homo sapiens
ctgtatgtcaga

SEQ ID NO: 2107324 - DNA, 16 bp, Homo sapiens
ctgtatgtctgcctaa

SEQ ID NO: 2107325 - DNA, 20 bp, Homo sapiens
ctgtatttaatggtttttat

SEQ ID NO: 2107326 - DNA, 23 bp, Homo sapiens
ctgtatttgtatctctgaagcat

SEQ ID NO: 2107327 - DNA, 19 bp, Homo sapiens
cttccccttttgcctggct

SEQ ID NO: 2107328 - DNA, 20 bp, Homo sapiens
cttccccttttgcctggctg

SEQ ID NO: 2107329 - DNA, 21 bp, Homo sapiens
cttccccttttgcctggctgt

SEQ ID NO: 2107330 - DNA, 18 bp, Homo sapiens
cttcccgctcagccctcc

SEQ ID NO: 2107331 - DNA, 22 bp, Homo sapiens
cttccctaatcctccaagtctt

SEQ ID NO: 2107332 - DNA, 15 bp, Homo sapiens
cttccctccttccct

SEQ ID NO: 2107333 - DNA, 13 bp, Homo sapiens
cttccctctttcc

SEQ ID NO: 2107334 - DNA, 23 bp, Homo sapiens
cttccctctttccccacctcttc

SEQ ID NO: 2107335 - DNA, 10 bp, Homo sapiens
cttccctggc

SEQ ID NO: 2107336 - DNA, 11 bp, Homo sapiens
cttccctggct

SEQ ID NO: 2107337 - DNA, 16 bp, Homo sapiens
cttccctgggaactca

SEQ ID NO: 2107338 - DNA, 22 bp, Homo sapiens
cttccctgggaactcatcctgt

SEQ ID NO: 2107339 - DNA, 22 bp, Homo sapiens
cttccctgtatgattccttgat

SEQ ID NO: 2107340 - DNA, 18 bp, Homo sapiens
cttccctgttttaaatta

SEQ ID NO: 2107341 - DNA, 16 bp, Homo sapiens
cttcccttctctcctt

SEQ ID NO: 2107342 - DNA, 17 bp, Homo sapiens
cttccgatgacagtgct

SEQ ID NO: 2107343 - DNA, 16 bp, Homo sapiens
cttcctcagtcctgga

SEQ ID NO: 2107344 - DNA, 21 bp, Homo sapiens
cttcctccagacccctgtggc

SEQ ID NO: 2107345 - DNA, 15 bp, Homo sapiens
cttcctccctcattc

SEQ ID NO: 2107346 - DNA, 21 bp, Homo sapiens
cttcctccgtccacccaggct

SEQ ID NO: 2107347 - DNA, 16 bp, Homo sapiens
cttcctcctccacagt

SEQ ID NO: 2107348 - DNA, 18 bp, Homo sapiens
cttcctcctccacagtgc

SEQ ID NO: 2107349 - DNA, 21 bp, Homo sapiens
cttcctcctccacagtgctgc

SEQ ID NO: 2107350 - DNA, 15 bp, Homo sapiens
cttcctcctcctttg

SEQ ID NO: 2107351 - DNA, 10 bp, Homo sapiens
cttcctcctg

SEQ ID NO: 2107352 - DNA, 11 bp, Homo sapiens
cttcctcctga

SEQ ID NO: 2107353 - DNA, 18 bp, Homo sapiens
cttcctcctgaagcctct

SEQ ID NO: 2107354 - DNA, 22 bp, Homo sapiens
cttcctcctgaagcctctgccc

SEQ ID NO: 2107355 - DNA, 21 bp, Homo sapiens
cttcctcctgatggccaagag

SEQ ID NO: 2107356 - DNA, 22 bp, Homo sapiens
cttcctctcaagctagccagag

SEQ ID NO: 2107357 - DNA, 14 bp, Homo sapiens
cttcctctccactg

SEQ ID NO: 2107358 - DNA, 14 bp, Homo sapiens
cttcctctccagcc

SEQ ID NO: 2107359 - DNA, 22 bp, Homo sapiens
cttcctgactgacacaggccag

SEQ ID NO: 2107360 - DNA, 13 bp, Homo sapiens
cttcctgcacccg

SEQ ID NO: 2107361 - DNA, 16 bp, Homo sapiens
cttcctgccaccagtc

SEQ ID NO: 2107362 - DNA, 21 bp, Homo sapiens
cttcctgccaccagtcactgt

SEQ ID NO: 2107363 - DNA, 13 bp, Homo sapiens
cttcctgctgctg

SEQ ID NO: 2107364 - DNA, 22 bp, Homo sapiens
cttcctgctgctgtaactgctg

SEQ ID NO: 2107365 - DNA, 23 bp, Homo sapiens
cttcctgcttaaacttgacccag

SEQ ID NO: 2107366 - DNA, 13 bp, Homo sapiens
cttcctggacctg

SEQ ID NO: 2107367 - DNA, 15 bp, Homo sapiens
cttcctggacctgag

SEQ ID NO: 2107368 - DNA, 16 bp, Homo sapiens
cttcctggacctgagt

SEQ ID NO: 2107369 - DNA, 17 bp, Homo sapiens
cttcctggacctgagtc

SEQ ID NO: 2107370 - DNA, 12 bp, Homo sapiens
cttcctggcctc

SEQ ID NO: 2107371 - DNA, 14 bp, Homo sapiens
cttcctggcctcac

SEQ ID NO: 2107372 - DNA, 20 bp, Homo sapiens
cttcctggggcatctggcga

SEQ ID NO: 2107373 - DNA, 23 bp, Homo sapiens
cttcctggggcatctggcgaatc

SEQ ID NO: 2107374 - DNA, 23 bp, Homo sapiens
cttcctgtaacacaagccacaga

SEQ ID NO: 2107375 - DNA, 13 bp, Homo sapiens
cttcctgtgactt

SEQ ID NO: 2107376 - DNA, 16 bp, Homo sapiens
cttcctgtgacttcag

SEQ ID NO: 2107377 - DNA, 16 bp, Homo sapiens
cttcctgtgggagcag

SEQ ID NO: 2107378 - DNA, 19 bp, Homo sapiens
cttccttaattcactccca

SEQ ID NO: 2107379 - DNA, 21 bp, Homo sapiens
cttccttaattcactcccaca

SEQ ID NO: 2107380 - DNA, 12 bp, Homo sapiens
cttccttccccc

SEQ ID NO: 2107381 - DNA, 17 bp, Homo sapiens
cttccttccctggcttg

SEQ ID NO: 2107382 - DNA, 16 bp, Homo sapiens
cttccttctgcaccca

SEQ ID NO: 2107383 - DNA, 18 bp, Homo sapiens
cttcctttaggtctggtt

SEQ ID NO: 2107384 - DNA, 13 bp, Homo sapiens
cttcctttcctct

SEQ ID NO: 2107385 - DNA, 14 bp, Homo sapiens
cttcctttctaaat

SEQ ID NO: 2107386 - DNA, 18 bp, Homo sapiens
cttcgaccctttctctga

SEQ ID NO: 2107387 - DNA, 23 bp, Homo sapiens
cttcgaggtggatcacagaggct

SEQ ID NO: 2107388 - DNA, 21 bp, Homo sapiens
cttcgatacaccgggcctgga

SEQ ID NO: 2107389 - DNA, 16 bp, Homo sapiens
cttcgctcctgtgtct

SEQ ID NO: 2107390 - DNA, 22 bp, Homo sapiens
cttgacacggtgaaatccaggt

SEQ ID NO: 2107391 - DNA, 14 bp, Homo sapiens
cttgacagggcaca

SEQ ID NO: 2107392 - DNA, 22 bp, Homo sapiens
cttgacagtatatttgaaactg

SEQ ID NO: 2107393 - DNA, 23 bp, Homo sapiens
cttgacattccttgtcaccagca

SEQ ID NO: 2107394 - DNA, 17 bp, Homo sapiens
cttgaccattggctgcg

SEQ ID NO: 2107395 - DNA, 18 bp, Homo sapiens
cttgagacctcagccatg

SEQ ID NO: 2107396 - DNA, 20 bp, Homo sapiens
cttgagagaaaaagtgcccc

SEQ ID NO: 2107397 - DNA, 15 bp, Homo sapiens
cttgagatgtcttct

SEQ ID NO: 2107398 - DNA, 20 bp, Homo sapiens
cttgagcactcagtctagtg

SEQ ID NO: 2107399 - DNA, 13 bp, Homo sapiens
cttgagccagtaa

SEQ ID NO: 2107400 - DNA, 12 bp, Homo sapiens
cttgagcccagg

SEQ ID NO: 2107401 - DNA, 13 bp, Homo sapiens
cttgagcccagga

SEQ ID NO: 2107402 - DNA, 14 bp, Homo sapiens
cttgagcctccatt

SEQ ID NO: 2107403 - DNA, 11 bp, Homo sapiens
cttgagcctgt

SEQ ID NO: 2107404 - DNA, 21 bp, Homo sapiens
cttgagcctgtcacgtggtca

SEQ ID NO: 2107405 - DNA, 20 bp, Homo sapiens
cttgagcttggcagctgaac

SEQ ID NO: 2107406 - DNA, 13 bp, Homo sapiens
cttgaggacacat

SEQ ID NO: 2107407 - DNA, 15 bp, Homo sapiens
cttgaggacacatgt

SEQ ID NO: 2107408 - DNA, 22 bp, Homo sapiens
cttgaggagtgtgagaatcaaa

SEQ ID NO: 2107409 - DNA, 20 bp, Homo sapiens
cttgagggttgggctggtgt

SEQ ID NO: 2107410 - DNA, 21 bp, Homo sapiens
cttgagggttgggctggtgtc

SEQ ID NO: 2107411 - DNA, 17 bp, Homo sapiens
cttgagtagatctgctt

SEQ ID NO: 2107412 - DNA, 17 bp, Homo sapiens
cttgatatagaaagctg

SEQ ID NO: 2107413 - DNA, 16 bp, Homo sapiens
cttgatgaagcccgtg

SEQ ID NO: 2107414 - DNA, 22 bp, Homo sapiens
cttgatgaagcccgtgtcctgc

SEQ ID NO: 2107415 - DNA, 23 bp, Homo sapiens
cttgatgaagcccgtgtcctgcc

SEQ ID NO: 2107416 - DNA, 24 bp, Homo sapiens
cttgatgaagcctgtgccacctgc

SEQ ID NO: 2107417 - DNA, 17 bp, Homo sapiens
cttgatgtcatgtactt

SEQ ID NO: 2107418 - DNA, 21 bp, Homo sapiens
cttgatgtcatgtacttcctg

SEQ ID NO: 2107419 - DNA, 16 bp, Homo sapiens
cttgatgtgtcatcta

SEQ ID NO: 2107420 - DNA, 18 bp, Homo sapiens
cttgattcacaatgaaat

SEQ ID NO: 2107421 - DNA, 20 bp, Homo sapiens
cttgatttcaggtcaataac

SEQ ID NO: 2107422 - DNA, 21 bp, Homo sapiens
cttgattttagccttctctgt

SEQ ID NO: 2107423 - DNA, 18 bp, Homo sapiens
cttgcaatggcagccttg

SEQ ID NO: 2107424 - DNA, 19 bp, Homo sapiens
cttgcacaagcttgtatat

SEQ ID NO: 2107425 - DNA, 19 bp, Homo sapiens
cttgcacagcccacacatg

SEQ ID NO: 2107426 - DNA, 18 bp, Homo sapiens
cttgcacatatttgaatg

SEQ ID NO: 2107427 - DNA, 15 bp, Homo sapiens
cttgcacatctctgc

SEQ ID NO: 2107428 - DNA, 16 bp, Homo sapiens
cttgcacccctcactc

SEQ ID NO: 2107429 - DNA, 13 bp, Homo sapiens
cttgcacctgcat

SEQ ID NO: 2107430 - DNA, 17 bp, Homo sapiens
cttgcactgtgggggct

SEQ ID NO: 2107431 - DNA, 19 bp, Homo sapiens
gatctccaaggaccaggtt

SEQ ID NO: 2107432 - DNA, 17 bp, Homo sapiens
gatctccaattgcctct

SEQ ID NO: 2107433 - DNA, 14 bp, Homo sapiens
gatctccctccagg

SEQ ID NO: 2107434 - DNA, 13 bp, Homo sapiens
gatctcctgtaat

SEQ ID NO: 2107435 - DNA, 13 bp, Homo sapiens
gatctctcaggag

SEQ ID NO: 2107436 - DNA, 20 bp, Homo sapiens
gatctctcaggagcacaggc

SEQ ID NO: 2107437 - DNA, 21 bp, Homo sapiens
gatctctcaggagcacaggca

SEQ ID NO: 2107438 - DNA, 23 bp, Homo sapiens
gatctctcaggagcacaggcagc

SEQ ID NO: 2107439 - DNA, 12 bp, Homo sapiens
gatctctgctta

SEQ ID NO: 2107440 - DNA, 13 bp, Homo sapiens
gatctgcctgggc

SEQ ID NO: 2107441 - DNA, 23 bp, Homo sapiens
gatctgcctgggcctgtgcagca

SEQ ID NO: 2107442 - DNA, 23 bp, Homo sapiens
gatctgggaccctttccttcctt

SEQ ID NO: 2107443 - DNA, 17 bp, Homo sapiens
gatctggggctctggga

SEQ ID NO: 2107444 - DNA, 20 bp, Homo sapiens
gatctgtatttaatggtttt

SEQ ID NO: 2107445 - DNA, 15 bp, Homo sapiens
gatctgtccaaggaa

SEQ ID NO: 2107446 - DNA, 15 bp, Homo sapiens
gatcttcagaaggct

SEQ ID NO: 2107447 - DNA, 12 bp, Homo sapiens
gatcttctgaaa

SEQ ID NO: 2107448 - DNA, 16 bp, Homo sapiens
gatctttgcagacagg

SEQ ID NO: 2107449 - DNA, 18 bp, Homo sapiens
gatctttgcagacaggca

SEQ ID NO: 2107450 - DNA, 19 bp, Homo sapiens
gatctttttgtgaaattca

SEQ ID NO: 2107451 - DNA, 14 bp, Homo sapiens
gatgaaaatatttg

SEQ ID NO: 2107452 - DNA, 23 bp, Homo sapiens
gatgaaagtgcaaagtgccctca

SEQ ID NO: 2107453 - DNA, 15 bp, Homo sapiens
gatgaaatgaggtca

SEQ ID NO: 2107454 - DNA, 21 bp, Homo sapiens
gatgaaatgaggtcagagcct

SEQ ID NO: 2107455 - DNA, 20 bp, Homo sapiens
gatgaaatttatttccatct

SEQ ID NO: 2107456 - DNA, 23 bp, Homo sapiens
gatgaaattttctagactttctg

SEQ ID NO: 2107457 - DNA, 11 bp, Homo sapiens
gatgaagagaa

SEQ ID NO: 2107458 - DNA, 15 bp, Homo sapiens
gatgaagagaagctg

SEQ ID NO: 2107459 - DNA, 21 bp, Homo sapiens
gatgaagagagagagggcctg

SEQ ID NO: 2107460 - DNA, 14 bp, Homo sapiens
gatgaagcctgtgc

SEQ ID NO: 2107461 - DNA, 15 bp, Homo sapiens
gatgaatagatgtga

SEQ ID NO: 2107462 - DNA, 16 bp, Homo sapiens
gatgaattaaatttaa

SEQ ID NO: 2107463 - DNA, 16 bp, Homo sapiens
gatgacaaagaacagt

SEQ ID NO: 2107464 - DNA, 12 bp, Homo sapiens
gatgacagctct

SEQ ID NO: 2107465 - DNA, 13 bp, Homo sapiens
gatgacagctctt

SEQ ID NO: 2107466 - DNA, 22 bp, Homo sapiens
gatgacagtgctctaggctgcc

SEQ ID NO: 2107467 - DNA, 12 bp, Homo sapiens
gatgactgagtc

SEQ ID NO: 2107468 - DNA, 13 bp, Homo sapiens
gatgagagtggct

SEQ ID NO: 2107469 - DNA, 15 bp, Homo sapiens
gatgagagtggctta

SEQ ID NO: 2107470 - DNA, 16 bp, Homo sapiens
gatgagatttgccagc

SEQ ID NO: 2107471 - DNA, 17 bp, Homo sapiens
gatgagatttgccagca

SEQ ID NO: 2107472 - DNA, 20 bp, Homo sapiens
gatgagatttgccagcacag

SEQ ID NO: 2107473 - DNA, 23 bp, Homo sapiens
gatgaggcctcttggacctctgc

SEQ ID NO: 2107474 - DNA, 14 bp, Homo sapiens
gatgagggcagcag

SEQ ID NO: 2107475 - DNA, 21 bp, Homo sapiens
gatgagggcagcagccagccc

SEQ ID NO: 2107476 - DNA, 23 bp, Homo sapiens
gatgaggggcttcctgggtcctg

SEQ ID NO: 2107477 - DNA, 14 bp, Homo sapiens
gatgagggtgactg

SEQ ID NO: 2107478 - DNA, 21 bp, Homo sapiens
gatgataaatatttatgctta

SEQ ID NO: 2107479 - DNA, 16 bp, Homo sapiens
gatgatctttaaaata

SEQ ID NO: 2107480 - DNA, 14 bp, Homo sapiens
gatgatctttgcag

SEQ ID NO: 2107481 - DNA, 21 bp, Homo sapiens
gatgatctttgcagacaggca

SEQ ID NO: 2107482 - DNA, 14 bp, Homo sapiens
gatgatgatgatga

SEQ ID NO: 2107483 - DNA, 15 bp, Homo sapiens
gatgatgatgatgat

SEQ ID NO: 2107484 - DNA, 22 bp, Homo sapiens
gatgatggttgcaaaagactaa

SEQ ID NO: 2107485 - DNA, 19 bp, Homo sapiens
gatgattaaacacctgaca

SEQ ID NO: 2107486 - DNA, 16 bp, Homo sapiens
gatgcacacacagata

SEQ ID NO: 2107487 - DNA, 20 bp, Homo sapiens
gatgcacacgcacatagaga

SEQ ID NO: 2107488 - DNA, 22 bp, Homo sapiens
gatgcacggcggcagggtgggg

SEQ ID NO: 2107489 - DNA, 23 bp, Homo sapiens
gatgcacggcggcagggtggggg

SEQ ID NO: 2107490 - DNA, 16 bp, Homo sapiens
gatgccacagccccac

SEQ ID NO: 2107491 - DNA, 18 bp, Homo sapiens
gatgccacagccccacag

SEQ ID NO: 2107492 - DNA, 24 bp, Homo sapiens
gatgccacttcccagaggcagagc

SEQ ID NO: 2107493 - DNA, 18 bp, Homo sapiens
gatgcccagagggcccag

SEQ ID NO: 2107494 - DNA, 17 bp, Homo sapiens
gatgccccttccccaag

SEQ ID NO: 2107495 - DNA, 20 bp, Homo sapiens
gatgcctccaccgctgccta

SEQ ID NO: 2107496 - DNA, 19 bp, Homo sapiens
gaggcctcttggacctctg

SEQ ID NO: 2107497 - DNA, 13 bp, Homo sapiens
gaggcctgatgct

SEQ ID NO: 2107498 - DNA, 17 bp, Homo sapiens
gaggcctgatgctgccc

SEQ ID NO: 2107499 - DNA, 13 bp, Homo sapiens
gaggcctggccag

SEQ ID NO: 2107500 - DNA, 16 bp, Homo sapiens
gaggcctggccttgtc

SEQ ID NO: 2107501 - DNA, 21 bp, Homo sapiens
gaggcctggccttgtcaggac

SEQ ID NO: 2107502 - DNA, 12 bp, Homo sapiens
gaggccttctcg

SEQ ID NO: 2107503 - DNA, 16 bp, Homo sapiens
gaggccttctctgaag

SEQ ID NO: 2107504 - DNA, 14 bp, Homo sapiens
gaggcctttaacca

SEQ ID NO: 2107505 - DNA, 13 bp, Homo sapiens
gaggcgaataaat

SEQ ID NO: 2107506 - DNA, 17 bp, Homo sapiens
gaggcgaataaatgttc

SEQ ID NO: 2107507 - DNA, 17 bp, Homo sapiens
gaggcgacttcctctcc

SEQ ID NO: 2107508 - DNA, 17 bp, Homo sapiens
gaggcgccccaacccgt

SEQ ID NO: 2107509 - DNA, 22 bp, Homo sapiens
gaggcgccccaacccgtggagg

SEQ ID NO: 2107510 - DNA, 19 bp, Homo sapiens
gaggcggaaaccttgcagc

SEQ ID NO: 2107511 - DNA, 18 bp, Homo sapiens
gaggcggctccaggtccg

SEQ ID NO: 2107512 - DNA, 19 bp, Homo sapiens
gaggcgggtggatcacttg

SEQ ID NO: 2107513 - DNA, 20 bp, Homo sapiens
gaggcggtttccaggaagag

SEQ ID NO: 2107514 - DNA, 16 bp, Homo sapiens
gaggcgtcttgtattt

SEQ ID NO: 2107515 - DNA, 14 bp, Homo sapiens
gaggctagcaaagc

SEQ ID NO: 2107516 - DNA, 16 bp, Homo sapiens
gaggctatagctggga

SEQ ID NO: 2107517 - DNA, 20 bp, Homo sapiens
gaggctattattttcactgt

SEQ ID NO: 2107518 - DNA, 15 bp, Homo sapiens
gaggctcaacaataa

SEQ ID NO: 2107519 - DNA, 18 bp, Homo sapiens
gaggctcaagaggcccag

SEQ ID NO: 2107520 - DNA, 13 bp, Homo sapiens
gaggctcctgtcc

SEQ ID NO: 2107521 - DNA, 16 bp, Homo sapiens
gaggctctttctgggc

SEQ ID NO: 2107522 - DNA, 12 bp, Homo sapiens
gaggctgaggca

SEQ ID NO: 2107523 - DNA, 18 bp, Homo sapiens
gaggctgaggcaggagaa

SEQ ID NO: 2107524 - DNA, 13 bp, Homo sapiens
gaggctgctcggg

SEQ ID NO: 2107525 - DNA, 17 bp, Homo sapiens
gaggctggaggcagggc

SEQ ID NO: 2107526 - DNA, 18 bp, Homo sapiens
gaggctggaggcagggcc

SEQ ID NO: 2107527 - DNA, 14 bp, Homo sapiens
gaggctggcaagga

SEQ ID NO: 2107528 - DNA, 15 bp, Homo sapiens
gaggctgggcccctg

SEQ ID NO: 2107529 - DNA, 13 bp, Homo sapiens
gaggctggtctcc

SEQ ID NO: 2107530 - DNA, 20 bp, Homo sapiens
gaggcttccagagagtcctc

SEQ ID NO: 2107531 - DNA, 15 bp, Homo sapiens
gaggcttccaggctc

SEQ ID NO: 2107532 - DNA, 20 bp, Homo sapiens
gaggcttccaggctcttcct

SEQ ID NO: 2107533 - DNA, 21 bp, Homo sapiens
gaggcttccaggctcttcctg

SEQ ID NO: 2107534 - DNA, 22 bp, Homo sapiens
gaggcttcttcagatcagtgct

SEQ ID NO: 2107535 - DNA, 23 bp, Homo sapiens
gaggctttggggtcctagcccag

SEQ ID NO: 2107536 - DNA, 18 bp, Homo sapiens
gagggaacagacaggaga

SEQ ID NO: 2107537 - DNA, 19 bp, Homo sapiens
gagggaatgttccctgcac

SEQ ID NO: 2107538 - DNA, 12 bp, Homo sapiens
gagggacagggc

SEQ ID NO: 2107539 - DNA, 13 bp, Homo sapiens
gagggacagggct

SEQ ID NO: 2107540 - DNA, 18 bp, Homo sapiens
gagggaccaaattgcttc

SEQ ID NO: 2107541 - DNA, 13 bp, Homo sapiens
gagggagaaggga

SEQ ID NO: 2107542 - DNA, 19 bp, Homo sapiens
gagggagccatcccttccc

SEQ ID NO: 2107543 - DNA, 15 bp, Homo sapiens
gagggaggacatcat

SEQ ID NO: 2107544 - DNA, 14 bp, Homo sapiens
gagggagggagagg

SEQ ID NO: 2107545 - DNA, 20 bp, Homo sapiens
gagggagggggcgctcagga

SEQ ID NO: 2107546 - DNA, 23 bp, Homo sapiens
gagggagggggcgctcaggaccc

SEQ ID NO: 2107547 - DNA, 22 bp, Homo sapiens
gagggaggttcctcgcaggtct

SEQ ID NO: 2107548 - DNA, 16 bp, Homo sapiens
gagggagtgacagagg

SEQ ID NO: 2107549 - DNA, 21 bp, Homo sapiens
gagggagtgacagaggcagcc

SEQ ID NO: 2107550 - DNA, 22 bp, Homo sapiens
gagggagtgacagaggcagccc

SEQ ID NO: 2107551 - DNA, 15 bp, Homo sapiens
gagggatgagagtgg

SEQ ID NO: 2107552 - DNA, 18 bp, Homo sapiens
gagggatgggatttcatg

SEQ ID NO: 2107553 - DNA, 15 bp, Homo sapiens
gagggattttattaa

SEQ ID NO: 2107554 - DNA, 22 bp, Homo sapiens
gagggcaagggccatgctgaag

SEQ ID NO: 2107555 - DNA, 16 bp, Homo sapiens
gagggcactggtggcc

SEQ ID NO: 2107556 - DNA, 13 bp, Homo sapiens
gagggcagagcca

SEQ ID NO: 2107557 - DNA, 14 bp, Homo sapiens
gagggcagagccat

SEQ ID NO: 2107558 - DNA, 16 bp, Homo sapiens
gagggcagagccatgg

SEQ ID NO: 2107559 - DNA, 16 bp, Homo sapiens
gagggcagaggctgga

SEQ ID NO: 2107560 - DNA, 11 bp, Homo sapiens
gagggcagagt

SEQ ID NO: 2107561 - DNA, 22 bp, Homo sapiens
gagggcagagtgggctgcctgg

SEQ ID NO: 2107562 - DNA, 14 bp, Homo sapiens
gagggcagcagcca

SEQ ID NO: 2107563 - DNA, 20 bp, Homo sapiens
gagggcagcagccagccctg

SEQ ID NO: 2107564 - DNA, 23 bp, Homo sapiens
gagggcagcagccagccctgcct

SEQ ID NO: 2107565 - DNA, 15 bp, Homo sapiens
gagggcagtacctgg

SEQ ID NO: 2107566 - DNA, 17 bp, Homo sapiens
gagggcagtggggagca

SEQ ID NO: 2107567 - DNA, 20 bp, Homo sapiens
gagggcagttcgcagccacc

SEQ ID NO: 2107568 - DNA, 20 bp, Homo sapiens
gagggcccagctgtagccat

SEQ ID NO: 2107569 - DNA, 22 bp, Homo sapiens
gagggcccagctgtagccatgg

SEQ ID NO: 2107570 - DNA, 16 bp, Homo sapiens
gagggcccaggcaggc

SEQ ID NO: 2107571 - DNA, 20 bp, Homo sapiens
gagggcgtgactcacccaag

SEQ ID NO: 2107572 - DNA, 19 bp, Homo sapiens
gagggctagaacctggaga

SEQ ID NO: 2107573 - DNA, 18 bp, Homo sapiens
gagggctagaatctggag

SEQ ID NO: 2107574 - DNA, 21 bp, Homo sapiens
gagggctagaatctggagagc

SEQ ID NO: 2107575 - DNA, 12 bp, Homo sapiens
gagggctctgag

SEQ ID NO: 2107576 - DNA, 13 bp, Homo sapiens
gagggctctgagg

SEQ ID NO: 2107577 - DNA, 21 bp, Homo sapiens
gagggctggaatctggagagc

SEQ ID NO: 2107578 - DNA, 14 bp, Homo sapiens
gagggctgggcagc

SEQ ID NO: 2107579 - DNA, 23 bp, Homo sapiens
gagggctgttggacagctgcttg

SEQ ID NO: 2107580 - DNA, 12 bp, Homo sapiens
gagggcttggga

SEQ ID NO: 2107581 - DNA, 14 bp, Homo sapiens
gaggggaagggcca

SEQ ID NO: 2107582 - DNA, 19 bp, Homo sapiens
gaggggaataatagaagaa

SEQ ID NO: 2107583 - DNA, 21 bp, Homo sapiens
gaggggcacctgccaccgcca

SEQ ID NO: 2107584 - DNA, 18 bp, Homo sapiens
gaggggcagaacagccgc

SEQ ID NO: 2107585 - DNA, 13 bp, Homo sapiens
gaggggcagccgc

SEQ ID NO: 2107586 - DNA, 17 bp, Homo sapiens
gaggggcaggggagtgc

SEQ ID NO: 2107587 - DNA, 12 bp, Homo sapiens
gaggggcctagg

SEQ ID NO: 2107588 - DNA, 15 bp, Homo sapiens
gaggggcctagggag

SEQ ID NO: 2107589 - DNA, 17 bp, Homo sapiens
gaggggcctagggagcc

SEQ ID NO: 2107590 - DNA, 14 bp, Homo sapiens
gaggggcctggcag

SEQ ID NO: 2107591 - DNA, 18 bp, Homo sapiens
gaggggcctggcagccgt

SEQ ID NO: 2107592 - DNA, 12 bp, Homo sapiens
gaggggctcctg

SEQ ID NO: 2107593 - DNA, 17 bp, Homo sapiens
gaggggctttctggaga

SEQ ID NO: 2107594 - DNA, 21 bp, Homo sapiens
gagggggacgcgcacacacac

SEQ ID NO: 2107595 - DNA, 16 bp, Homo sapiens
gagggggcgctcagga

SEQ ID NO: 2107596 - DNA, 19 bp, Homo sapiens
gagggggctatttctctcc

SEQ ID NO: 2107597 - DNA, 23 bp, Homo sapiens
gagggggtgtctggaagctgagc

SEQ ID NO: 2107598 - DNA, 14 bp, Homo sapiens
gaggggtaggcaga

SEQ ID NO: 2107599 - DNA, 20 bp, Homo sapiens
gaggggtgacagtggaggaa

SEQ ID NO: 2107600 - DNA, 19 bp, Homo sapiens
gagggtaagacaatatgaa

SEQ ID NO: 2107601 - DNA, 19 bp, Homo sapiens
gagggtcaggactgtgact

SEQ ID NO: 2107602 - DNA, 24 bp, Homo sapiens
gagggtctggagaagcagtgagcc

SEQ ID NO: 2107603 - DNA, 11 bp, Homo sapiens
gagggtgactg

SEQ ID NO: 2107604 - DNA, 20 bp, Homo sapiens
gagggtgagaggaagggtgg

SEQ ID NO: 2107605 - DNA, 19 bp, Homo sapiens
gagggtgggagagcccagc

SEQ ID NO: 2107606 - DNA, 21 bp, Homo sapiens
gagggtggtgacctctgcctg

SEQ ID NO: 2107607 - DNA, 15 bp, Homo sapiens
gagggttagggaggg

SEQ ID NO: 2107608 - DNA, 15 bp, Homo sapiens
gagggttgctatttg

SEQ ID NO: 2107609 - DNA, 21 bp, Homo sapiens
gaggtaactatcaatatttaa

SEQ ID NO: 2107610 - DNA, 18 bp, Homo sapiens
gaggtagagtttgaagga

SEQ ID NO: 2107611 - DNA, 22 bp, Homo sapiens
gatccacccacctcagcctccc

SEQ ID NO: 2107612 - DNA, 13 bp, Homo sapiens
gatccactgtgca

SEQ ID NO: 2107613 - DNA, 16 bp, Homo sapiens
gatccatgtagcagga

SEQ ID NO: 2107614 - DNA, 21 bp, Homo sapiens
gatccatttggacaaaatgga

SEQ ID NO: 2107615 - DNA, 23 bp, Homo sapiens
gatcccaattcatttcatctact

SEQ ID NO: 2107616 - DNA, 16 bp, Homo sapiens
gatcccaggccaggga

SEQ ID NO: 2107617 - DNA, 18 bp, Homo sapiens
gatcccatccatcagctc

SEQ ID NO: 2107618 - DNA, 20 bp, Homo sapiens
gatcccatccatcagctccc

SEQ ID NO: 2107619 - DNA, 12 bp, Homo sapiens
gatcccatctct

SEQ ID NO: 2107620 - DNA, 21 bp, Homo sapiens
gatcccatgtcacctcagctg

SEQ ID NO: 2107621 - DNA, 22 bp, Homo sapiens
gatcccatgtcacctcagctga

SEQ ID NO: 2107622 - DNA, 14 bp, Homo sapiens
gatcccccaggttc

SEQ ID NO: 2107623 - DNA, 20 bp, Homo sapiens
gatccctgttacccagagaa

SEQ ID NO: 2107624 - DNA, 19 bp, Homo sapiens
gatcctaactgaagagaca

SEQ ID NO: 2107625 - DNA, 16 bp, Homo sapiens
gatcctaggtgctgga

SEQ ID NO: 2107626 - DNA, 19 bp, Homo sapiens
gatcctcacaaccacctaa

SEQ ID NO: 2107627 - DNA, 22 bp, Homo sapiens
gatcctcacaggagcagacaga

SEQ ID NO: 2107628 - DNA, 16 bp, Homo sapiens
gatcctcccacctcag

SEQ ID NO: 2107629 - DNA, 21 bp, Homo sapiens
gatcctcccacctcagcctcc

SEQ ID NO: 2107630 - DNA, 22 bp, Homo sapiens
gatcctgcaggaacgagcactg

SEQ ID NO: 2107631 - DNA, 23 bp, Homo sapiens
gatcctgcaggaacgagcactgg

SEQ ID NO: 2107632 - DNA, 20 bp, Homo sapiens
gatcctgctgtggcctcact

SEQ ID NO: 2107633 - DNA, 16 bp, Homo sapiens
gatcctgtctttaagg

SEQ ID NO: 2107634 - DNA, 14 bp, Homo sapiens
gatccttgttttaa

SEQ ID NO: 2107635 - DNA, 14 bp, Homo sapiens
gatccttttatgtt

SEQ ID NO: 2107636 - DNA, 19 bp, Homo sapiens
gatcgagaccatcctggct

SEQ ID NO: 2107637 - DNA, 18 bp, Homo sapiens
gatcgctggcagagaagg

SEQ ID NO: 2107638 - DNA, 14 bp, Homo sapiens
gatcgcttgagccc

SEQ ID NO: 2107639 - DNA, 15 bp, Homo sapiens
gatcgcttgagccca

SEQ ID NO: 2107640 - DNA, 16 bp, Homo sapiens
gatcgcttgagcccag

SEQ ID NO: 2107641 - DNA, 17 bp, Homo sapiens
gatcgcttgagcccagg

SEQ ID NO: 2107642 - DNA, 18 bp, Homo sapiens
gatcgcttgagcccagga

SEQ ID NO: 2107643 - DNA, 17 bp, Homo sapiens
gatcggagcctcctctc

SEQ ID NO: 2107644 - DNA, 20 bp, Homo sapiens
gatcggagcctcctctctca

SEQ ID NO: 2107645 - DNA, 15 bp, Homo sapiens
gatcgtgctaaattt

SEQ ID NO: 2107646 - DNA, 18 bp, Homo sapiens
gatcgtgctaaattttca

SEQ ID NO: 2107647 - DNA, 17 bp, Homo sapiens
gatctaagcctttccat

SEQ ID NO: 2107648 - DNA, 18 bp, Homo sapiens
gatctaagcctttccata

SEQ ID NO: 2107649 - DNA, 12 bp, Homo sapiens
gatctagaaagt

SEQ ID NO: 2107650 - DNA, 16 bp, Homo sapiens
gatctagaatgtgttt

SEQ ID NO: 2107651 - DNA, 20 bp, Homo sapiens
gatctagaatgtgttttctg

SEQ ID NO: 2107652 - DNA, 22 bp, Homo sapiens
gatctagaatgtgttttctgaa

SEQ ID NO: 2107653 - DNA, 19 bp, Homo sapiens
gatctagcttcatgcctca

SEQ ID NO: 2107654 - DNA, 22 bp, Homo sapiens
gatctagttctcaatcactgct

SEQ ID NO: 2107655 - DNA, 12 bp, Homo sapiens
gatctatgcaat

SEQ ID NO: 2107656 - DNA, 22 bp, Homo sapiens
gatctatgcaatttttaaacta

SEQ ID NO: 2107657 - DNA, 12 bp, Homo sapiens
gatctcaggagc

SEQ ID NO: 2107658 - DNA, 22 bp, Homo sapiens
gagaccatttgtattaccatta

SEQ ID NO: 2107659 - DNA, 14 bp, Homo sapiens
gagacccaaggagg

SEQ ID NO: 2107660 - DNA, 19 bp, Homo sapiens
gagacccagatctcatgga

SEQ ID NO: 2107661 - DNA, 12 bp, Homo sapiens
gagaccccttcc

SEQ ID NO: 2107662 - DNA, 22 bp, Homo sapiens
gagaccctcgccacggggaggg

SEQ ID NO: 2107663 - DNA, 18 bp, Homo sapiens
gagaccctggaattcagc

SEQ ID NO: 2107664 - DNA, 17 bp, Homo sapiens
gagaccgcttcacccct

SEQ ID NO: 2107665 - DNA, 19 bp, Homo sapiens
gagaccgcttcacccctgc

SEQ ID NO: 2107666 - DNA, 18 bp, Homo sapiens
gagacctgacaagcactg

SEQ ID NO: 2107667 - DNA, 19 bp, Homo sapiens
gagacctgacaagcactgc

SEQ ID NO: 2107668 - DNA, 21 bp, Homo sapiens
gagaccttttctctcccatac

SEQ ID NO: 2107669 - DNA, 22 bp, Homo sapiens
gagacgcagccctgggggccag

SEQ ID NO: 2107670 - DNA, 16 bp, Homo sapiens
gagacggctggacctg

SEQ ID NO: 2107671 - DNA, 16 bp, Homo sapiens
gagactaagccctgtc

SEQ ID NO: 2107672 - DNA, 20 bp, Homo sapiens
gagactaatagagacacaga

SEQ ID NO: 2107673 - DNA, 21 bp, Homo sapiens
gagactaatagagacacagag

SEQ ID NO: 2107674 - DNA, 22 bp, Homo sapiens
gagactatggagcctggcacag

SEQ ID NO: 2107675 - DNA, 18 bp, Homo sapiens
gagactcaaagagactcc

SEQ ID NO: 2107676 - DNA, 16 bp, Homo sapiens
gagactcacctctgcc

SEQ ID NO: 2107677 - DNA, 17 bp, Homo sapiens
gagactcacctctgcct

SEQ ID NO: 2107678 - DNA, 19 bp, Homo sapiens
gagactccagaatctgctg

SEQ ID NO: 2107679 - DNA, 21 bp, Homo sapiens
gagactccagaatctgctgtt

SEQ ID NO: 2107680 - DNA, 14 bp, Homo sapiens
gagactctggcctc

SEQ ID NO: 2107681 - DNA, 14 bp, Homo sapiens
gagactctgtctca

SEQ ID NO: 2107682 - DNA, 23 bp, Homo sapiens
gagactctgtggggccttggttc

SEQ ID NO: 2107683 - DNA, 15 bp, Homo sapiens
gagactgaaagcagc

SEQ ID NO: 2107684 - DNA, 17 bp, Homo sapiens
gagactgaaagcagcag

SEQ ID NO: 2107685 - DNA, 17 bp, Homo sapiens
gagactgagaggcagaa

SEQ ID NO: 2107686 - DNA, 14 bp, Homo sapiens
gagactgagggaga

SEQ ID NO: 2107687 - DNA, 23 bp, Homo sapiens
gagactgcgggatggtcctgggg

SEQ ID NO: 2107688 - DNA, 14 bp, Homo sapiens
gagactgctaagta

SEQ ID NO: 2107689 - DNA, 12 bp, Homo sapiens
gagactggagca

SEQ ID NO: 2107690 - DNA, 16 bp, Homo sapiens
gagactggagcatctg

SEQ ID NO: 2107691 - DNA, 17 bp, Homo sapiens
gagactggcacttagcc

SEQ ID NO: 2107692 - DNA, 14 bp, Homo sapiens
gagacttgctctct

SEQ ID NO: 2107693 - DNA, 20 bp, Homo sapiens
gagagaaaacttatttgagt

SEQ ID NO: 2107694 - DNA, 15 bp, Homo sapiens
gagagaagaaagtgt

SEQ ID NO: 2107695 - DNA, 16 bp, Homo sapiens
gagagaagccacgctg

SEQ ID NO: 2107696 - DNA, 16 bp, Homo sapiens
gagagaatatttcaaa

SEQ ID NO: 2107697 - DNA, 18 bp, Homo sapiens
gagagacacagcgtccct

SEQ ID NO: 2107698 - DNA, 15 bp, Homo sapiens
gagagacccaaggag

SEQ ID NO: 2107699 - DNA, 14 bp, Homo sapiens
gagagaccctcact

SEQ ID NO: 2107700 - DNA, 21 bp, Homo sapiens
gagagacgcagccctgggggc

SEQ ID NO: 2107701 - DNA, 19 bp, Homo sapiens
gagagacgtgtacatagtg

SEQ ID NO: 2107702 - DNA, 20 bp, Homo sapiens
gagagacgtgtacatagtgt

SEQ ID NO: 2107703 - DNA, 17 bp, Homo sapiens
gagagactgaaagcagc

SEQ ID NO: 2107704 - DNA, 16 bp, Homo sapiens
gagagactgagggaga

SEQ ID NO: 2107705 - DNA, 17 bp, Homo sapiens
gagagactgagggagag

SEQ ID NO: 2107706 - DNA, 14 bp, Homo sapiens
gagagagagagagg

SEQ ID NO: 2107707 - DNA, 19 bp, Homo sapiens
gagagagatctagaaagtg

SEQ ID NO: 2107708 - DNA, 17 bp, Homo sapiens
gagagaggtgggcagca

SEQ ID NO: 2107709 - DNA, 22 bp, Homo sapiens
gagagaggttctggggaggaag

SEQ ID NO: 2107710 - DNA, 16 bp, Homo sapiens
gagagagttgaaccta

SEQ ID NO: 2107711 - DNA, 17 bp, Homo sapiens
gagagataccttgaaaa

SEQ ID NO: 2107712 - DNA, 18 bp, Homo sapiens
gagagataccttgaaaaa

SEQ ID NO: 2107713 - DNA, 14 bp, Homo sapiens
gagagcagaaataa

SEQ ID NO: 2107714 - DNA, 12 bp, Homo sapiens
gagagcagaggg

SEQ ID NO: 2107715 - DNA, 14 bp, Homo sapiens
gagagcagagggtt

SEQ ID NO: 2107716 - DNA, 14 bp, Homo sapiens
gagagcagctggct

SEQ ID NO: 2107717 - DNA, 11 bp, Homo sapiens
gagagccagcc

SEQ ID NO: 2107718 - DNA, 14 bp, Homo sapiens
gagagccagccctc

SEQ ID NO: 2107719 - DNA, 11 bp, Homo sapiens
gagagcccagc

SEQ ID NO: 2107720 - DNA, 14 bp, Homo sapiens
gagagccctgctgt

SEQ ID NO: 2107721 - DNA, 16 bp, Homo sapiens
gagagcccttcatttg

SEQ ID NO: 2107722 - DNA, 20 bp, Homo sapiens
gagagctagaacccggcagg

SEQ ID NO: 2107723 - DNA, 17 bp, Homo sapiens
gagagctagaacctaga

SEQ ID NO: 2107724 - DNA, 12 bp, Homo sapiens
gagaggaagatg

SEQ ID NO: 2107725 - DNA, 18 bp, Homo sapiens
gagaggagcacctgaacc

SEQ ID NO: 2107726 - DNA, 16 bp, Homo sapiens
gagaggatgcagaggg

SEQ ID NO: 2107727 - DNA, 16 bp, Homo sapiens
gagaggcacctgctgg

SEQ ID NO: 2107728 - DNA, 14 bp, Homo sapiens
gagaggcagaggca

SEQ ID NO: 2107729 - DNA, 13 bp, Homo sapiens
gagaggccctgga

SEQ ID NO: 2107730 - DNA, 21 bp, Homo sapiens
gagaggccctggatcagcgtg

SEQ ID NO: 2107731 - DNA, 24 bp, Homo sapiens
gagaggccctggatcagcgtggcc

SEQ ID NO: 2107732 - DNA, 16 bp, Homo sapiens
gagaggcgcgtctgcc

SEQ ID NO: 2107733 - DNA, 23 bp, Homo sapiens
gagaggcgcgtctgccccaccct

SEQ ID NO: 2107734 - DNA, 17 bp, Homo sapiens
gagagggacgaagaaag

SEQ ID NO: 2107735 - DNA, 21 bp, Homo sapiens
gagagggcatgcgcacaaggc

SEQ ID NO: 2107736 - DNA, 14 bp, Homo sapiens
gagagggcccagct

SEQ ID NO: 2107737 - DNA, 15 bp, Homo sapiens
gagagggcccagctg

SEQ ID NO: 2107738 - DNA, 16 bp, Homo sapiens
gagagggcccagctgt

SEQ ID NO: 2107739 - DNA, 21 bp, Homo sapiens
gagagggcccagctgtagcca

SEQ ID NO: 2107740 - DNA, 15 bp, Homo sapiens
gagaggggcctggga

SEQ ID NO: 2107741 - DNA, 20 bp, Homo sapiens
gagaggggcctgggaaagga

SEQ ID NO: 2107742 - DNA, 14 bp, Homo sapiens
gagaggggtttggg

SEQ ID NO: 2107743 - DNA, 16 bp, Homo sapiens
gagaggtggagaactg

SEQ ID NO: 2107744 - DNA, 17 bp, Homo sapiens
gagaggtggagaactgg

SEQ ID NO: 2107745 - DNA, 17 bp, Homo sapiens
gagaggttctggggagg

SEQ ID NO: 2107746 - DNA, 20 bp, Homo sapiens
gagaggttctggggaggaag

SEQ ID NO: 2107747 - DNA, 16 bp, Homo sapiens
gagagtaccatgctgg

SEQ ID NO: 2107748 - DNA, 22 bp, Homo sapiens
gagagtcctttgggattctagg

SEQ ID NO: 2107749 - DNA, 13 bp, Homo sapiens
gagagtgagaata

SEQ ID NO: 2107750 - DNA, 24 bp, Homo sapiens
gagagtgagaataattgtgtacaa

SEQ ID NO: 2107751 - DNA, 13 bp, Homo sapiens
gagagtgctgaga

SEQ ID NO: 2107752 - DNA, 20 bp, Homo sapiens
gagagttcaagcctgtggga

SEQ ID NO: 2107753 - DNA, 23 bp, Homo sapiens
gagagtttatcattgggagaagc

SEQ ID NO: 2107754 - DNA, 18 bp, Homo sapiens
gagatatatctgaaaact

SEQ ID NO: 2107755 - DNA, 12 bp, Homo sapiens
gagatatgcaca

SEQ ID NO: 2107756 - DNA, 11 bp, Homo sapiens
gagatatttac

SEQ ID NO: 2107757 - DNA, 19 bp, Homo sapiens
gagatcacgccactgcact

SEQ ID NO: 2107758 - DNA, 20 bp, Homo sapiens
gagatcaggaagagaaggag

SEQ ID NO: 2107759 - DNA, 17 bp, Homo sapiens
gagatcccgcctcttct

SEQ ID NO: 2107760 - DNA, 19 bp, Homo sapiens
gagatctaagcctttccat

SEQ ID NO: 2107761 - DNA, 21 bp, Homo sapiens
gagatgaagagtgagagggca

SEQ ID NO: 2107762 - DNA, 20 bp, Homo sapiens
gagatgcatgcgcaggctca

SEQ ID NO: 2107763 - DNA, 19 bp, Homo sapiens
gagatgcctccaccgctgc

SEQ ID NO: 2107764 - DNA, 22 bp, Homo sapiens
gagatggcgctattgcactcca

SEQ ID NO: 2107765 - DNA, 21 bp, Homo sapiens
gagatgggctgaactgagcct

SEQ ID NO: 2107766 - DNA, 17 bp, Homo sapiens
gagatgtaaaaggtatt

SEQ ID NO: 2107767 - DNA, 14 bp, Homo sapiens
gagatgtttttaaa

SEQ ID NO: 2107768 - DNA, 19 bp, Homo sapiens
gagatgtttttaaaagttt

SEQ ID NO: 2107769 - DNA, 18 bp, Homo sapiens
gagattgccccagagccc

SEQ ID NO: 2107770 - DNA, 17 bp, Homo sapiens
gagattgcgccactgca

SEQ ID NO: 2107771 - DNA, 19 bp, Homo sapiens
gagatttgccagcacaggg

SEQ ID NO: 2107772 - DNA, 18 bp, Homo sapiens
gagattttcttggcagta

SEQ ID NO: 2107773 - DNA, 18 bp, Homo sapiens
gagcttattggccactgg

SEQ ID NO: 2107774 - DNA, 23 bp, Homo sapiens
gagcttcccaggatccctcccag

SEQ ID NO: 2107775 - DNA, 14 bp, Homo sapiens
gagcttctggcact

SEQ ID NO: 2107776 - DNA, 13 bp, Homo sapiens
gagcttgggaatg

SEQ ID NO: 2107777 - DNA, 20 bp, Homo sapiens
gagcttgggggatgactaga

SEQ ID NO: 2107778 - DNA, 16 bp, Homo sapiens
gagcttggtggctgag

SEQ ID NO: 2107779 - DNA, 16 bp, Homo sapiens
gagcttgtacatattg

SEQ ID NO: 2107780 - DNA, 23 bp, Homo sapiens
gagcttgtatatacttcactcac

SEQ ID NO: 2107781 - DNA, 13 bp, Homo sapiens
gaggaaaaaaagc

SEQ ID NO: 2107782 - DNA, 14 bp, Homo sapiens
gaggaaaagtgcaa

SEQ ID NO: 2107783 - DNA, 16 bp, Homo sapiens
gaggaaaagtgcaatg

SEQ ID NO: 2107784 - DNA, 20 bp, Homo sapiens
gaggaaaagtgcaatgcgtg

SEQ ID NO: 2107785 - DNA, 11 bp, Homo sapiens
gaggaacagct

SEQ ID NO: 2107786 - DNA, 17 bp, Homo sapiens
gaggaacaggtggatgt

SEQ ID NO: 2107787 - DNA, 13 bp, Homo sapiens
gaggaagaatggt

SEQ ID NO: 2107788 - DNA, 12 bp, Homo sapiens
gaggaagagaga

SEQ ID NO: 2107789 - DNA, 13 bp, Homo sapiens
gaggaagagcagg

SEQ ID NO: 2107790 - DNA, 17 bp, Homo sapiens
gaggaagagcaggcaca

SEQ ID NO: 2107791 - DNA, 22 bp, Homo sapiens
gaggaagggccaggagagagat

SEQ ID NO: 2107792 - DNA, 21 bp, Homo sapiens
gaggaataattatttatttaa

SEQ ID NO: 2107793 - DNA, 13 bp, Homo sapiens
gaggaatatcaat

SEQ ID NO: 2107794 - DNA, 22 bp, Homo sapiens
gaggaatcatgtcaggcctgtg

SEQ ID NO: 2107795 - DNA, 22 bp, Homo sapiens
gaggaattttctttgtgtagct

SEQ ID NO: 2107796 - DNA, 20 bp, Homo sapiens
gaggacaaagagaataaaga

SEQ ID NO: 2107797 - DNA, 15 bp, Homo sapiens
gaggacaaccattcc

SEQ ID NO: 2107798 - DNA, 18 bp, Homo sapiens
gaggacacgtggcctgca

SEQ ID NO: 2107799 - DNA, 14 bp, Homo sapiens
gaggacagagctgg

SEQ ID NO: 2107800 - DNA, 13 bp, Homo sapiens
gaggacagggagg

SEQ ID NO: 2107801 - DNA, 23 bp, Homo sapiens
gaggacagggaggtgaccccagg

SEQ ID NO: 2107802 - DNA, 11 bp, Homo sapiens
gaggacatcat

SEQ ID NO: 2107803 - DNA, 16 bp, Homo sapiens
gaggacatggagagag

SEQ ID NO: 2107804 - DNA, 23 bp, Homo sapiens
gaggaccacactttgagaacctg

SEQ ID NO: 2107805 - DNA, 18 bp, Homo sapiens
gaggaccacagtgggtgg

SEQ ID NO: 2107806 - DNA, 20 bp, Homo sapiens
gaggaccctggttactctgg

SEQ ID NO: 2107807 - DNA, 13 bp, Homo sapiens
gaggacctgagcc

SEQ ID NO: 2107808 - DNA, 17 bp, Homo sapiens
gaggacctgagcctgcc

SEQ ID NO: 2107809 - DNA, 15 bp, Homo sapiens
gaaacccaaggaaca

SEQ ID NO: 2107810 - DNA, 17 bp, Homo sapiens
gaaaccccaagcagcat

SEQ ID NO: 2107811 - DNA, 13 bp, Homo sapiens
gaaacctgaaaaa

SEQ ID NO: 2107812 - DNA, 19 bp, Homo sapiens
gaaacctgtccataaagta

SEQ ID NO: 2107813 - DNA, 20 bp, Homo sapiens
gaaacctgtccataaagtaa

SEQ ID NO: 2107814 - DNA, 13 bp, Homo sapiens
gaaaccttaatat

SEQ ID NO: 2107815 - DNA, 22 bp, Homo sapiens
gaaaccttgcagcatttttatt

SEQ ID NO: 2107816 - DNA, 23 bp, Homo sapiens
gaaacgaacccactgtgcttaca

SEQ ID NO: 2107817 - DNA, 14 bp, Homo sapiens
gaaacgcagacact

SEQ ID NO: 2107818 - DNA, 22 bp, Homo sapiens
gaaactcaaccatcaatggaaa

SEQ ID NO: 2107819 - DNA, 19 bp, Homo sapiens
gaaactccttttgctgtct

SEQ ID NO: 2107820 - DNA, 21 bp, Homo sapiens
gaaactccttttgctgtcttt

SEQ ID NO: 2107821 - DNA, 18 bp, Homo sapiens
gaaactgaggaattttct

SEQ ID NO: 2107822 - DNA, 24 bp, Homo sapiens
gaaactgaggagtagctgagagga

SEQ ID NO: 2107823 - DNA, 19 bp, Homo sapiens
gaaactggggcttgcaaga

SEQ ID NO: 2107824 - DNA, 15 bp, Homo sapiens
gaaagaaataattgt

SEQ ID NO: 2107825 - DNA, 11 bp, Homo sapiens
gaaagaagaga

SEQ ID NO: 2107826 - DNA, 15 bp, Homo sapiens
gaaagaatataaagt

SEQ ID NO: 2107827 - DNA, 14 bp, Homo sapiens
gaaagacagagctg

SEQ ID NO: 2107828 - DNA, 15 bp, Homo sapiens
gaaagactattcaaa

SEQ ID NO: 2107829 - DNA, 17 bp, Homo sapiens
gaaagactattcaaaca

SEQ ID NO: 2107830 - DNA, 23 bp, Homo sapiens
gaaagactattcaaacagtctca

SEQ ID NO: 2107831 - DNA, 13 bp, Homo sapiens
gaaagactgaaag

SEQ ID NO: 2107832 - DNA, 19 bp, Homo sapiens
gaagaatattcaggactta

SEQ ID NO: 2107833 - DNA, 21 bp, Homo sapiens
gaagaatctcatctcagtgaa

SEQ ID NO: 2107834 - DNA, 21 bp, Homo sapiens
gaagaattttcagaccccagc

SEQ ID NO: 2107835 - DNA, 16 bp, Homo sapiens
gaagacaaaccactgt

SEQ ID NO: 2107836 - DNA, 18 bp, Homo sapiens
gaagacaaaccactgtac

SEQ ID NO: 2107837 - DNA, 12 bp, Homo sapiens
gaagacacagac

SEQ ID NO: 2107838 - DNA, 21 bp, Homo sapiens
gaagacactgatgggcaaccc

SEQ ID NO: 2107839 - DNA, 18 bp, Homo sapiens
gaagaccagactgtggag

SEQ ID NO: 2107840 - DNA, 17 bp, Homo sapiens
gaagaccgaattttatt

SEQ ID NO: 2107841 - DNA, 20 bp, Homo sapiens
gaagacctaaatgacctcag

SEQ ID NO: 2107842 - DNA, 16 bp, Homo sapiens
gaagaccttctgaaga

SEQ ID NO: 2107843 - DNA, 19 bp, Homo sapiens
gaagactcattcttctgta

SEQ ID NO: 2107844 - DNA, 11 bp, Homo sapiens
gaagactgtgg

SEQ ID NO: 2107845 - DNA, 12 bp, Homo sapiens
gaagactgtggc

SEQ ID NO: 2107846 - DNA, 12 bp, Homo sapiens
gaagagaagctg

SEQ ID NO: 2107847 - DNA, 15 bp, Homo sapiens
gaagagaagctgaga

SEQ ID NO: 2107848 - DNA, 15 bp, Homo sapiens
gaagagaaggagcag

SEQ ID NO: 2107849 - DNA, 18 bp, Homo sapiens
gaagagacaggagggcaa

SEQ ID NO: 2107850 - DNA, 13 bp, Homo sapiens
gaagagagagaga

SEQ ID NO: 2107851 - DNA, 18 bp, Homo sapiens
gaagagagatatatctga

SEQ ID NO: 2107852 - DNA, 23 bp, Homo sapiens
gaagagagatatatctgaaaact

SEQ ID NO: 2107853 - DNA, 19 bp, Homo sapiens
gaagagaggcacctgctgg

SEQ ID NO: 2107854 - DNA, 20 bp, Homo sapiens
gaagagaggcacctgctgga

SEQ ID NO: 2107855 - DNA, 21 bp, Homo sapiens
gaagagagtccatatttcaat

SEQ ID NO: 2107856 - DNA, 16 bp, Homo sapiens
gaagagatcaggaaga

SEQ ID NO: 2107857 - DNA, 22 bp, Homo sapiens
gaagagcagcctgatggccaag

SEQ ID NO: 2107858 - DNA, 23 bp, Homo sapiens
gaagagcaggcacatggaggagc

SEQ ID NO: 2107859 - DNA, 17 bp, Homo sapiens
gaagagccctgagctca

SEQ ID NO: 2107860 - DNA, 23 bp, Homo sapiens
gaagagccctgagctcaggctga

SEQ ID NO: 2107861 - DNA, 21 bp, Homo sapiens
gaagagggaatggatggggag

SEQ ID NO: 2107862 - DNA, 22 bp, Homo sapiens
gaagagtttaactttgggccca

SEQ ID NO: 2107863 - DNA, 23 bp, Homo sapiens
gaagataatgttctttaatgttg

SEQ ID NO: 2107864 - DNA, 18 bp, Homo sapiens
gaagatggactctgaaaa

SEQ ID NO: 2107865 - DNA, 15 bp, Homo sapiens
gaagatggtagcaga

SEQ ID NO: 2107866 - DNA, 12 bp, Homo sapiens
gaagatgtaagg

SEQ ID NO: 2107867 - DNA, 17 bp, Homo sapiens
gaagattctcctgtgct

SEQ ID NO: 2107868 - DNA, 15 bp, Homo sapiens
gaagcaaataaatat

SEQ ID NO: 2107869 - DNA, 17 bp, Homo sapiens
gaagcaaatcgaatgaa

SEQ ID NO: 2107870 - DNA, 20 bp, Homo sapiens
gaagcaacctcagtaattta

SEQ ID NO: 2107871 - DNA, 14 bp, Homo sapiens
gaagcaagaaagcc

SEQ ID NO: 2107872 - DNA, 23 bp, Homo sapiens
gaagcaagacgtcctggaatgaa

SEQ ID NO: 2107873 - DNA, 20 bp, Homo sapiens
gaagcacagagggctaggga

SEQ ID NO: 2107874 - DNA, 13 bp, Homo sapiens
gaagcacagcttc

SEQ ID NO: 2107875 - DNA, 14 bp, Homo sapiens
gaagcacatgttta

SEQ ID NO: 2107876 - DNA, 19 bp, Homo sapiens
gaagcaggttgaggggctc

SEQ ID NO: 2107877 - DNA, 20 bp, Homo sapiens
gaagcagtgcctcgaggcac

SEQ ID NO: 2107878 - DNA, 17 bp, Homo sapiens
gaagcagtgccttccat

SEQ ID NO: 2107879 - DNA, 17 bp, Homo sapiens
gaagcatgtaggagaat

SEQ ID NO: 2107880 - DNA, 16 bp, Homo sapiens
gaagcatgtttcatgt

SEQ ID NO: 2107881 - DNA, 15 bp, Homo sapiens
gaagccaacttggct

SEQ ID NO: 2107882 - DNA, 16 bp, Homo sapiens
gaagccacgctgtcct

SEQ ID NO: 2107883 - DNA, 17 bp, Homo sapiens
gaagccacgctgtcctc

SEQ ID NO: 2107884 - DNA, 18 bp, Homo sapiens
gaagccacgctgtcctct

SEQ ID NO: 2107885 - DNA, 19 bp, Homo sapiens
gaagccacgctgtcctctc

SEQ ID NO: 2107886 - DNA, 15 bp, Homo sapiens
gaagccactgaagct

SEQ ID NO: 2107887 - DNA, 12 bp, Homo sapiens
gaagccaggagc

SEQ ID NO: 2107888 - DNA, 22 bp, Homo sapiens
gaagccaggagcaaatgtttct

SEQ ID NO: 2107889 - DNA, 14 bp, Homo sapiens
gaagcccaggctga

SEQ ID NO: 2107890 - DNA, 16 bp, Homo sapiens
gaagcccaggctgaag

SEQ ID NO: 2107891 - DNA, 17 bp, Homo sapiens
gaagcccaggctgaaga

SEQ ID NO: 2107892 - DNA, 10 bp, Homo sapiens
gaagcccagt

SEQ ID NO: 2107893 - DNA, 18 bp, Homo sapiens
gaagcccatggagcaggg

SEQ ID NO: 2107894 - DNA, 19 bp, Homo sapiens
gaagcccgtgtcctgcctt

SEQ ID NO: 2107895 - DNA, 19 bp, Homo sapiens
gaagccctccttccacgga

SEQ ID NO: 2107896 - DNA, 19 bp, Homo sapiens
gaagccctggatttcagaa

SEQ ID NO: 2107897 - DNA, 21 bp, Homo sapiens
gaagccctggatttcagaaag

SEQ ID NO: 2107898 - DNA, 15 bp, Homo sapiens
gaagcccttccagtg

SEQ ID NO: 2107899 - DNA, 16 bp, Homo sapiens
gaagcccttccagtgg

SEQ ID NO: 2107900 - DNA, 16 bp, Homo sapiens
gaagccgggaacagac

SEQ ID NO: 2107901 - DNA, 15 bp, Homo sapiens
gaagcctctgccctg

SEQ ID NO: 2107902 - DNA, 21 bp, Homo sapiens
gaagcctctgccctgcctccc

SEQ ID NO: 2107903 - DNA, 21 bp, Homo sapiens
gaagcctggactctaagctgg

SEQ ID NO: 2107904 - DNA, 12 bp, Homo sapiens
gaagcctggggg

SEQ ID NO: 2107905 - DNA, 17 bp, Homo sapiens
gaagcctgggggcctgg

SEQ ID NO: 2107906 - DNA, 18 bp, Homo sapiens
gaagcctgggggcctggc

SEQ ID NO: 2107907 - DNA, 22 bp, Homo sapiens
gaagcctgggggcctggctggc

SEQ ID NO: 2107908 - DNA, 19 bp, Homo sapiens
gaagcctgtaccaggtcat

SEQ ID NO: 2107909 - DNA, 17 bp, Homo sapiens
gaagcctgtgccacctg

SEQ ID NO: 2107910 - DNA, 22 bp, Homo sapiens
gaagcctgttttgttggaaggt

SEQ ID NO: 2107911 - DNA, 13 bp, Homo sapiens
gaagcctttggga

SEQ ID NO: 2107912 - DNA, 18 bp, Homo sapiens
gaagcctttgggaagggg

SEQ ID NO: 2107913 - DNA, 14 bp, Homo sapiens
gaagcgctcatctg

SEQ ID NO: 2107914 - DNA, 15 bp, Homo sapiens
gaagctaacagggaa

SEQ ID NO: 2107915 - DNA, 19 bp, Homo sapiens
gaagctccactgtcaccct

SEQ ID NO: 2107916 - DNA, 21 bp, Homo sapiens
gaagctcccagatgctgggga

SEQ ID NO: 2107917 - DNA, 16 bp, Homo sapiens
gaagctgccctgccca

SEQ ID NO: 2107918 - DNA, 18 bp, Homo sapiens
gaagctggaagcactgct

SEQ ID NO: 2107919 - DNA, 21 bp, Homo sapiens
gaagctggcagcactcagtga

SEQ ID NO: 2107920 - DNA, 22 bp, Homo sapiens
gaagctgtacccaatttaattc

SEQ ID NO: 2107921 - DNA, 21 bp, Homo sapiens
gaagctgtactcagagcagag

SEQ ID NO: 2107922 - DNA, 22 bp, Homo sapiens
gaagctgtgtccttgcacctgc

SEQ ID NO: 2107923 - DNA, 24 bp, Homo sapiens
gaagctgtgtccttgcacctgcat

SEQ ID NO: 2107924 - DNA, 20 bp, Homo sapiens
gaaggaaaaggcagggagcg

SEQ ID NO: 2107925 - DNA, 19 bp, Homo sapiens
gaaggaaagaaagaaggaa

SEQ ID NO: 2107926 - DNA, 23 bp, Homo sapiens
gaaggaaggagactcacctctgc

SEQ ID NO: 2107927 - DNA, 16 bp, Homo sapiens
gaaggaagtgaagagg

SEQ ID NO: 2107928 - DNA, 18 bp, Homo sapiens
gaaggaatagccagagag

SEQ ID NO: 2107929 - DNA, 22 bp, Homo sapiens
gaaggacccggaggggcctggc

SEQ ID NO: 2107930 - DNA, 12 bp, Homo sapiens
gaaggagaaagg

SEQ ID NO: 2107931 - DNA, 15 bp, Homo sapiens
gaaggagactcacct

SEQ ID NO: 2107932 - DNA, 14 bp, Homo sapiens
ctttaaatcaaaag

SEQ ID NO: 2107933 - DNA, 19 bp, Homo sapiens
ctttaaatcaaaagctgct

SEQ ID NO: 2107934 - DNA, 20 bp, Homo sapiens
ctttaaatcaaaagctgctt

SEQ ID NO: 2107935 - DNA, 21 bp, Homo sapiens
ctttaacaaaacaagaaagaa

SEQ ID NO: 2107936 - DNA, 17 bp, Homo sapiens
ctttaaccgtttttcaa

SEQ ID NO: 2107937 - DNA, 20 bp, Homo sapiens
ctttaaccgtttttcaagaa

SEQ ID NO: 2107938 - DNA, 23 bp, Homo sapiens
ctttaaccgtttttcaagaaaac

SEQ ID NO: 2107939 - DNA, 15 bp, Homo sapiens
ctttaagactgagca

SEQ ID NO: 2107940 - DNA, 14 bp, Homo sapiens
ctttaatcttcagt

SEQ ID NO: 2107941 - DNA, 21 bp, Homo sapiens
ctttaatcttcagttttatct

SEQ ID NO: 2107942 - DNA, 22 bp, Homo sapiens
ctttaatcttcagttttatctt

SEQ ID NO: 2107943 - DNA, 18 bp, Homo sapiens
ctttaatgtcacaggcag

SEQ ID NO: 2107944 - DNA, 17 bp, Homo sapiens
ctttaattctcatgtga

SEQ ID NO: 2107945 - DNA, 20 bp, Homo sapiens
ctttacagatgagattccct

SEQ ID NO: 2107946 - DNA, 20 bp, Homo sapiens
ctttacatggggttttcaat

SEQ ID NO: 2107947 - DNA, 15 bp, Homo sapiens
ctttacctaccacct

SEQ ID NO: 2107948 - DNA, 12 bp, Homo sapiens
ctttactccctt

SEQ ID NO: 2107949 - DNA, 17 bp, Homo sapiens
ctttactcccttcctgg

SEQ ID NO: 2107950 - DNA, 19 bp, Homo sapiens
ctttactcccttcctggcc

SEQ ID NO: 2107951 - DNA, 13 bp, Homo sapiens
ctttagagtagca

SEQ ID NO: 2107952 - DNA, 14 bp, Homo sapiens
ctttagatttaatg

SEQ ID NO: 2107953 - DNA, 16 bp, Homo sapiens
ctttagctatgtggat

SEQ ID NO: 2107954 - DNA, 19 bp, Homo sapiens
ctttaggcagcctgccgcc

SEQ ID NO: 2107955 - DNA, 20 bp, Homo sapiens
ctttaggcagcctgccgccg

SEQ ID NO: 2107956 - DNA, 23 bp, Homo sapiens
ctttaggcattaaattttagcaa

SEQ ID NO: 2107957 - DNA, 15 bp, Homo sapiens
ctttaggtgcctcct

SEQ ID NO: 2107958 - DNA, 12 bp, Homo sapiens
ctttataaactt

SEQ ID NO: 2107959 - DNA, 14 bp, Homo sapiens
ctttatacagaact

SEQ ID NO: 2107960 - DNA, 19 bp, Homo sapiens
ctttatcacattatttgca

SEQ ID NO: 2107961 - DNA, 13 bp, Homo sapiens
ctttatccaatcc

SEQ ID NO: 2107962 - DNA, 16 bp, Homo sapiens
ctttatccaatcctca

SEQ ID NO: 2107963 - DNA, 23 bp, Homo sapiens
ctttatgactgtttttgtagtgg

SEQ ID NO: 2107964 - DNA, 13 bp, Homo sapiens
ctttatttatggc

SEQ ID NO: 2107965 - DNA, 16 bp, Homo sapiens
ctttatttatggctta

SEQ ID NO: 2107966 - DNA, 20 bp, Homo sapiens
ctttatttctagcagagtga

SEQ ID NO: 2107967 - DNA, 14 bp, Homo sapiens
ctttatttctgtca

SEQ ID NO: 2107968 - DNA, 21 bp, Homo sapiens
cttctgcacccagaaattcct

SEQ ID NO: 2107969 - DNA, 15 bp, Homo sapiens
cttctgcagcaactc

SEQ ID NO: 2107970 - DNA, 18 bp, Homo sapiens
cttctgcagcaactccca

SEQ ID NO: 2107971 - DNA, 21 bp, Homo sapiens
cttctgcagcaactcccacga

SEQ ID NO: 2107972 - DNA, 15 bp, Homo sapiens
cttctgctggataaa

SEQ ID NO: 2107973 - DNA, 17 bp, Homo sapiens
cttctgcttcagcctcc

SEQ ID NO: 2107974 - DNA, 16 bp, Homo sapiens
cttctggaaggctggc

SEQ ID NO: 2107975 - DNA, 19 bp, Homo sapiens
cttctggaaggctggctga

SEQ ID NO: 2107976 - DNA, 11 bp, Homo sapiens
cttctggagcc

SEQ ID NO: 2107977 - DNA, 14 bp, Homo sapiens
cttctggagccctt

SEQ ID NO: 2107978 - DNA, 11 bp, Homo sapiens
cttctggctcc

SEQ ID NO: 2107979 - DNA, 13 bp, Homo sapiens
cttctggctcctc

SEQ ID NO: 2107980 - DNA, 16 bp, Homo sapiens
cttctgggcaaggggg

SEQ ID NO: 2107981 - DNA, 19 bp, Homo sapiens
cttctgggtggctcctgcc

SEQ ID NO: 2107982 - DNA, 20 bp, Homo sapiens
cttctgggtggctcctgcca

SEQ ID NO: 2107983 - DNA, 17 bp, Homo sapiens
cttctggttgcttcaga

SEQ ID NO: 2107984 - DNA, 13 bp, Homo sapiens
cttctgtcatccc

SEQ ID NO: 2107985 - DNA, 14 bp, Homo sapiens
cttctgtcatcccg

SEQ ID NO: 2107986 - DNA, 22 bp, Homo sapiens
cttctgtcatcccgctcctgct

SEQ ID NO: 2107987 - DNA, 23 bp, Homo sapiens
cttctgtccaggacatgatactg

SEQ ID NO: 2107988 - DNA, 16 bp, Homo sapiens
cttctgtcctactctg

SEQ ID NO: 2107989 - DNA, 17 bp, Homo sapiens
cttctgtcctactctgt

SEQ ID NO: 2107990 - DNA, 18 bp, Homo sapiens
cttctgtcttcacaacag

SEQ ID NO: 2107991 - DNA, 21 bp, Homo sapiens
cttctgtcttcacaacagatt

SEQ ID NO: 2107992 - DNA, 22 bp, Homo sapiens
cttctgtgcactagcctgtgat

SEQ ID NO: 2107993 - DNA, 23 bp, Homo sapiens
cttctgtgcactagcctgtgatt

SEQ ID NO: 2107994 - DNA, 15 bp, Homo sapiens
cttctgtggctcaca

SEQ ID NO: 2107995 - DNA, 14 bp, Homo sapiens
cttcttaaaggcct

SEQ ID NO: 2107996 - DNA, 15 bp, Homo sapiens
cttcttaaaggcctg

SEQ ID NO: 2107997 - DNA, 21 bp, Homo sapiens
cttcttacaataattctatga

SEQ ID NO: 2107998 - DNA, 22 bp, Homo sapiens
cttcttacttggaactgaaggg

SEQ ID NO: 2107999 - DNA, 17 bp, Homo sapiens
cttcttattctcactcc

SEQ ID NO: 2108000 - DNA, 16 bp, Homo sapiens
cttcttcacccagcta

SEQ ID NO: 2108001 - DNA, 20 bp, Homo sapiens
cttcttcagaagacactgca

SEQ ID NO: 2108002 - DNA, 17 bp, Homo sapiens
cttcttcagccacctct

SEQ ID NO: 2108003 - DNA, 18 bp, Homo sapiens
cttcttcatctttaaaat

SEQ ID NO: 2108004 - DNA, 19 bp, Homo sapiens
cttcttcgctgctagagaa

SEQ ID NO: 2108005 - DNA, 13 bp, Homo sapiens
cttcttcttcaga

SEQ ID NO: 2108006 - DNA, 20 bp, Homo sapiens
cttcttggtttggggagaaa

SEQ ID NO: 2108007 - DNA, 21 bp, Homo sapiens
cttcttggtttggggagaaat

SEQ ID NO: 2108008 - DNA, 13 bp, Homo sapiens
cttctttaaatca

SEQ ID NO: 2108009 - DNA, 17 bp, Homo sapiens
cttctttctcttccctc

SEQ ID NO: 2108010 - DNA, 18 bp, Homo sapiens
cttctttctcttccctcc

SEQ ID NO: 2108011 - DNA, 22 bp, Homo sapiens
cttctttgaatttcctatctgt

SEQ ID NO: 2108012 - DNA, 23 bp, Homo sapiens
cttctttgaatttcctatctgta

SEQ ID NO: 2108013 - DNA, 19 bp, Homo sapiens
cttcttttaaaccattttc

SEQ ID NO: 2108014 - DNA, 14 bp, Homo sapiens
cttcttttgctctt

SEQ ID NO: 2108015 - DNA, 23 bp, Homo sapiens
cttctttttattttcttttgtaa

SEQ ID NO: 2108016 - DNA, 16 bp, Homo sapiens
cttgaaacagcctggg

SEQ ID NO: 2108017 - DNA, 17 bp, Homo sapiens
cttgaaataccagtgaa

SEQ ID NO: 2108018 - DNA, 21 bp, Homo sapiens
cttgaaattatatctgtggtc

SEQ ID NO: 2108019 - DNA, 18 bp, Homo sapiens
cttgaacatgttttgtat

SEQ ID NO: 2108020 - DNA, 23 bp, Homo sapiens
cttgaacccaggtctccctggat

SEQ ID NO: 2108021 - DNA, 13 bp, Homo sapiens
cttgaactcctgg

SEQ ID NO: 2108022 - DNA, 15 bp, Homo sapiens
cttgaactcctggcc

SEQ ID NO: 2108023 - DNA, 19 bp, Homo sapiens
cttgaactcctggcctcaa

SEQ ID NO: 2108024 - DNA, 20 bp, Homo sapiens
cttgaactgggtacttgtgg

SEQ ID NO: 2108025 - DNA, 15 bp, Homo sapiens
cttgaactttccaaa

SEQ ID NO: 2108026 - DNA, 14 bp, Homo sapiens
cttgaagaatattg

SEQ ID NO: 2108027 - DNA, 13 bp, Homo sapiens
cttgaagatcgtt

SEQ ID NO: 2108028 - DNA, 23 bp, Homo sapiens
cttgaaggatctgtttttaaaaa

SEQ ID NO: 2108029 - DNA, 16 bp, Homo sapiens
cttgaagggtaaagaa

SEQ ID NO: 2108030 - DNA, 24 bp, Homo sapiens
cttgaatatctgccccagtagtca

SEQ ID NO: 2108031 - DNA, 20 bp, Homo sapiens
cttgaatttctaaaaaacag

SEQ ID NO: 2108032 - DNA, 17 bp, Homo sapiens
cttgacaacagactgaa

SEQ ID NO: 2108033 - DNA, 15 bp, Homo sapiens
cttgacaacatccca

SEQ ID NO: 2108034 - DNA, 15 bp, Homo sapiens
cttgacacggtgaaa

SEQ ID NO: 2108035 - DNA, 16 bp, Homo sapiens
cttgacacggtgaaat

SEQ ID NO: 2108036 - DNA, 19 bp, Homo sapiens
cttgacacggtgaaatcca

SEQ ID NO: 2108037 - DNA, 13 bp, Homo sapiens
gaataattattta

SEQ ID NO: 2108038 - DNA, 18 bp, Homo sapiens
gaataattatttatttaa

SEQ ID NO: 2108039 - DNA, 13 bp, Homo sapiens
gaataattgtgta

SEQ ID NO: 2108040 - DNA, 19 bp, Homo sapiens
gaataattgtgtacaaagt

SEQ ID NO: 2108041 - DNA, 23 bp, Homo sapiens
gaatacagggcatgcattttgca

SEQ ID NO: 2108042 - DNA, 13 bp, Homo sapiens
gaatacagtgtta

SEQ ID NO: 2108043 - DNA, 22 bp, Homo sapiens
gaattggaccatcctatttaac

SEQ ID NO: 2108044 - DNA, 16 bp, Homo sapiens
gaattgggaagctggg

SEQ ID NO: 2108045 - DNA, 16 bp, Homo sapiens
gaattgggagcttggg

SEQ ID NO: 2108046 - DNA, 14 bp, Homo sapiens
gaattgtatcattt

SEQ ID NO: 2108047 - DNA, 18 bp, Homo sapiens
gaattgtccatgtgcttc

SEQ ID NO: 2108048 - DNA, 23 bp, Homo sapiens
gaattgtccccagtttgcagaaa

SEQ ID NO: 2108049 - DNA, 18 bp, Homo sapiens
gaattgtgaccaagttat

SEQ ID NO: 2108050 - DNA, 20 bp, Homo sapiens
gaatttaaattctttttcaa

SEQ ID NO: 2108051 - DNA, 21 bp, Homo sapiens
gaatttaaattctttttcaaa

SEQ ID NO: 2108052 - DNA, 17 bp, Homo sapiens
gaatttattcaattcct

SEQ ID NO: 2108053 - DNA, 23 bp, Homo sapiens
gaatttattcaattcctctggga

SEQ ID NO: 2108054 - DNA, 18 bp, Homo sapiens
gaatttcaggcattttgt

SEQ ID NO: 2108055 - DNA, 14 bp, Homo sapiens
gaatttcctatctg

SEQ ID NO: 2108056 - DNA, 19 bp, Homo sapiens
gaatttggagactctgtgg

SEQ ID NO: 2108057 - DNA, 20 bp, Homo sapiens
gaatttggtgtggctgtatt

SEQ ID NO: 2108058 - DNA, 14 bp, Homo sapiens
gaatttgtaagttt

SEQ ID NO: 2108059 - DNA, 22 bp, Homo sapiens
gaatttgtaagtttatgtctaa

SEQ ID NO: 2108060 - DNA, 13 bp, Homo sapiens
gaatttgtatttt

SEQ ID NO: 2108061 - DNA, 14 bp, Homo sapiens
gaatttgtattttg

SEQ ID NO: 2108062 - DNA, 20 bp, Homo sapiens
gacaaaaacagcctcacaga

SEQ ID NO: 2108063 - DNA, 11 bp, Homo sapiens
gacaaaatgga

SEQ ID NO: 2108064 - DNA, 13 bp, Homo sapiens
gacaaaatgtttt

SEQ ID NO: 2108065 - DNA, 16 bp, Homo sapiens
gacaaacacctcccag

SEQ ID NO: 2108066 - DNA, 19 bp, Homo sapiens
gacaaacacctcccaggag

SEQ ID NO: 2108067 - DNA, 17 bp, Homo sapiens
gacaaaccactgtacat

SEQ ID NO: 2108068 - DNA, 19 bp, Homo sapiens
gacaaaccactgtacatat

SEQ ID NO: 2108069 - DNA, 21 bp, Homo sapiens
gacaaaccactgtacatatat

SEQ ID NO: 2108070 - DNA, 23 bp, Homo sapiens
gacaaagcatcattgtaaattat

SEQ ID NO: 2108071 - DNA, 20 bp, Homo sapiens
gacaaagccaaactctgcca

SEQ ID NO: 2108072 - DNA, 14 bp, Homo sapiens
gacaaaggagcctg

SEQ ID NO: 2108073 - DNA, 17 bp, Homo sapiens
gacaaaggagcctgtga

SEQ ID NO: 2108074 - DNA, 21 bp, Homo sapiens
gacaaagggaaggctgctgtg

SEQ ID NO: 2108075 - DNA, 18 bp, Homo sapiens
gacaaaggttttcctctt

SEQ ID NO: 2108076 - DNA, 21 bp, Homo sapiens
gacaacaaattaggttttgta

SEQ ID NO: 2108077 - DNA, 12 bp, Homo sapiens
gacaacagaagc

SEQ ID NO: 2108078 - DNA, 12 bp, Homo sapiens
gacaacagaagt

SEQ ID NO: 2108079 - DNA, 17 bp, Homo sapiens
gacaacagaagtcatga

SEQ ID NO: 2108080 - DNA, 14 bp, Homo sapiens
gacaacattttatt

SEQ ID NO: 2108081 - DNA, 23 bp, Homo sapiens
gacaacctgtgcagtcccgtgga

SEQ ID NO: 2108082 - DNA, 20 bp, Homo sapiens
gacaacctttgtgtaataaa

SEQ ID NO: 2108083 - DNA, 20 bp, Homo sapiens
gacaagaaaagaggaaaaaa

SEQ ID NO: 2108084 - DNA, 17 bp, Homo sapiens
gacaagaagctcccaga

SEQ ID NO: 2108085 - DNA, 18 bp, Homo sapiens
gacaagaagctcccagat

SEQ ID NO: 2108086 - DNA, 17 bp, Homo sapiens
gacaagaaggccactgg

SEQ ID NO: 2108087 - DNA, 23 bp, Homo sapiens
gacaagccaacttgtaaatacac

SEQ ID NO: 2108088 - DNA, 16 bp, Homo sapiens
gacaaggtagacatgg

SEQ ID NO: 2108089 - DNA, 23 bp, Homo sapiens
gacaagtaatcactaacccgttt

SEQ ID NO: 2108090 - DNA, 15 bp, Homo sapiens
gacaagtggaggggg

SEQ ID NO: 2108091 - DNA, 14 bp, Homo sapiens
gacaataaaacatt

SEQ ID NO: 2108092 - DNA, 16 bp, Homo sapiens
gacaatactgctgcct

SEQ ID NO: 2108093 - DNA, 22 bp, Homo sapiens
gacaatcacagctcctcgctgc

SEQ ID NO: 2108094 - DNA, 21 bp, Homo sapiens
gacaatccactctcaggaggc

SEQ ID NO: 2108095 - DNA, 21 bp, Homo sapiens
gacaatccccacataccatct

SEQ ID NO: 2108096 - DNA, 15 bp, Homo sapiens
gacaatcctgaagaa

SEQ ID NO: 2108097 - DNA, 21 bp, Homo sapiens
gacaatcctgaagaaaccaca

SEQ ID NO: 2108098 - DNA, 19 bp, Homo sapiens
gacaatggaaactgtacca

SEQ ID NO: 2108099 - DNA, 15 bp, Homo sapiens
gacaatggcagctag

SEQ ID NO: 2108100 - DNA, 14 bp, Homo sapiens
gacacacacacaca

SEQ ID NO: 2108101 - DNA, 19 bp, Homo sapiens
gacacacagctctgtcctg

SEQ ID NO: 2108102 - DNA, 21 bp, Homo sapiens
gacacacagtctcagtccaga

SEQ ID NO: 2108103 - DNA, 22 bp, Homo sapiens
gacacaccccccagtcgagccc

SEQ ID NO: 2108104 - DNA, 23 bp, Homo sapiens
gacacaccccccagtcgagccct

SEQ ID NO: 2108105 - DNA, 12 bp, Homo sapiens
gacacacctctg

SEQ ID NO: 2108106 - DNA, 22 bp, Homo sapiens
gacacacgtatttatatttgga

SEQ ID NO: 2108107 - DNA, 10 bp, Homo sapiens
gacacactgt

SEQ ID NO: 2108108 - DNA, 21 bp, Homo sapiens
gacacagagtggagccctcag

SEQ ID NO: 2108109 - DNA, 21 bp, Homo sapiens
gacacagcgtccctagcagtg

SEQ ID NO: 2108110 - DNA, 17 bp, Homo sapiens
gacacagctcttctcca

SEQ ID NO: 2108111 - DNA, 20 bp, Homo sapiens
gacacagctcttctccaggc

SEQ ID NO: 2108112 - DNA, 18 bp, Homo sapiens
gacacaggaaaccaacac

SEQ ID NO: 2108113 - DNA, 14 bp, Homo sapiens
gacacaggccagcc

SEQ ID NO: 2108114 - DNA, 20 bp, Homo sapiens
gacacaggcccggctccagg

SEQ ID NO: 2108115 - DNA, 21 bp, Homo sapiens
gacacaggcccggctccaggc

SEQ ID NO: 2108116 - DNA, 22 bp, Homo sapiens
gacacatatgcaccttgtgtct

SEQ ID NO: 2108117 - DNA, 16 bp, Homo sapiens
gacacatcaaatgccc

SEQ ID NO: 2108118 - DNA, 16 bp, Homo sapiens
gacacatcccggcctc

SEQ ID NO: 2108119 - DNA, 21 bp, Homo sapiens
gacacatggctatcctagaga

SEQ ID NO: 2108120 - DNA, 23 bp, Homo sapiens
gacacattctcctgtgcccctca

SEQ ID NO: 2108121 - DNA, 19 bp, Homo sapiens
gacacattttctcctagga

SEQ ID NO: 2108122 - DNA, 18 bp, Homo sapiens
gacacccaagagggctgc

SEQ ID NO: 2108123 - DNA, 21 bp, Homo sapiens
gacacccaccccctctttgtg

SEQ ID NO: 2108124 - DNA, 22 bp, Homo sapiens
gacacccaccccctctttgtgt

SEQ ID NO: 2108125 - DNA, 21 bp, Homo sapiens
gacaccccccgccccccacct

SEQ ID NO: 2108126 - DNA, 17 bp, Homo sapiens
gacaccgtttgtccccc

SEQ ID NO: 2108127 - DNA, 13 bp, Homo sapiens
gacacctaccatg

SEQ ID NO: 2108128 - DNA, 13 bp, Homo sapiens
gacacctcactga

SEQ ID NO: 2108129 - DNA, 13 bp, Homo sapiens
gacacctgcacct

SEQ ID NO: 2108130 - DNA, 17 bp, Homo sapiens
gacacctgcacctcccc

SEQ ID NO: 2108131 - DNA, 11 bp, Homo sapiens
gacacctgccc

SEQ ID NO: 2108132 - DNA, 16 bp, Homo sapiens
gacacctgccctgccc

SEQ ID NO: 2108133 - DNA, 22 bp, Homo sapiens
gacacctgccctgccctgccac

SEQ ID NO: 2108134 - DNA, 21 bp, Homo sapiens
gacacctggccgcctccagga

SEQ ID NO: 2108135 - DNA, 17 bp, Homo sapiens
gacacctgtgcacccca

SEQ ID NO: 2108136 - DNA, 15 bp, Homo sapiens
gacacggggcagtgg

SEQ ID NO: 2108137 - DNA, 20 bp, Homo sapiens
gacacggtaggccaagctga

SEQ ID NO: 2108138 - DNA, 14 bp, Homo sapiens
gacacgtggcctgc

SEQ ID NO: 2108139 - DNA, 16 bp, Homo sapiens
gacactaaccacgctg

SEQ ID NO: 2108140 - DNA, 17 bp, Homo sapiens
gacactaaccacgctgg

SEQ ID NO: 2108141 - DNA, 20 bp, Homo sapiens
gacactaaccacgctggacc

SEQ ID NO: 2108142 - DNA, 21 bp, Homo sapiens
gacactaaccacgctggacct

SEQ ID NO: 2108143 - DNA, 20 bp, Homo sapiens
gacactaagttatagtatat

SEQ ID NO: 2108144 - DNA, 21 bp, Homo sapiens
gacactctagtgacttcctgg

SEQ ID NO: 2108145 - DNA, 13 bp, Homo sapiens
gacactgatgggc

SEQ ID NO: 2108146 - DNA, 15 bp, Homo sapiens
gacactgctgcacca

SEQ ID NO: 2108147 - DNA, 19 bp, Homo sapiens
gacactgctgcaccagagt

SEQ ID NO: 2108148 - DNA, 13 bp, Homo sapiens
gacactgtacaag

SEQ ID NO: 2108149 - DNA, 22 bp, Homo sapiens
gacactgtatgactctcctctc

SEQ ID NO: 2108150 - DNA, 19 bp, Homo sapiens
gacagaaacagagagagac

SEQ ID NO: 2108151 - DNA, 18 bp, Homo sapiens
gacagaaatgcaatctcc

SEQ ID NO: 2108152 - DNA, 13 bp, Homo sapiens
gacagaacactgt

SEQ ID NO: 2108153 - DNA, 20 bp, Homo sapiens
gacagaacccctacatgaaa

SEQ ID NO: 2108154 - DNA, 20 bp, Homo sapiens
gacagaactgaacgtcctgc

SEQ ID NO: 2108155 - DNA, 12 bp, Homo sapiens
gacagacacagg

SEQ ID NO: 2108156 - DNA, 18 bp, Homo sapiens
gaccaatattcaaatgcg

SEQ ID NO: 2108157 - DNA, 14 bp, Homo sapiens
gaccaatctctgtg

SEQ ID NO: 2108158 - DNA, 20 bp, Homo sapiens
gaccacactttgagaacctg

SEQ ID NO: 2108159 - DNA, 19 bp, Homo sapiens
gaccacagtgggtggcacc

SEQ ID NO: 2108160 - DNA, 20 bp, Homo sapiens
gaccaccagccccagcaaga

SEQ ID NO: 2108161 - DNA, 11 bp, Homo sapiens
gaccacctgcc

SEQ ID NO: 2108162 - DNA, 21 bp, Homo sapiens
gacctcaccggcatgctggcc

SEQ ID NO: 2108163 - DNA, 13 bp, Homo sapiens
gacctcacctttg

SEQ ID NO: 2108164 - DNA, 14 bp, Homo sapiens
gacctcagcaaatc

SEQ ID NO: 2108165 - DNA, 16 bp, Homo sapiens
gacctcagcaaatcct

SEQ ID NO: 2108166 - DNA, 10 bp, Homo sapiens
gacctcagcc

SEQ ID NO: 2108167 - DNA, 13 bp, Homo sapiens
gacctcagcctgt

SEQ ID NO: 2108168 - DNA, 16 bp, Homo sapiens
gacctcagcctgtgct

SEQ ID NO: 2108169 - DNA, 13 bp, Homo sapiens
gacctcagccttc

SEQ ID NO: 2108170 - DNA, 19 bp, Homo sapiens
gacctcagctgcacattcc

SEQ ID NO: 2108171 - DNA, 20 bp, Homo sapiens
gacctcagctgcacattcct

SEQ ID NO: 2108172 - DNA, 23 bp, Homo sapiens
gacctcagctgcacattcctggc

SEQ ID NO: 2108173 - DNA, 13 bp, Homo sapiens
cctccagctccag

SEQ ID NO: 2108174 - DNA, 17 bp, Homo sapiens
cctccaggcatgctggc

SEQ ID NO: 2108175 - DNA, 20 bp, Homo sapiens
cctccaggcatgctggcctc

SEQ ID NO: 2108176 - DNA, 16 bp, Homo sapiens
cctccagggccacgtg

SEQ ID NO: 2108177 - DNA, 16 bp, Homo sapiens
cctccatccggctcct

SEQ ID NO: 2108178 - DNA, 14 bp, Homo sapiens
cctccatggtggaa

SEQ ID NO: 2108179 - DNA, 13 bp, Homo sapiens
cctccatgtggcc

SEQ ID NO: 2108180 - DNA, 15 bp, Homo sapiens
cctccatgtgggcta

SEQ ID NO: 2108181 - DNA, 15 bp, Homo sapiens
cctcccaaagtgctg

SEQ ID NO: 2108182 - DNA, 15 bp, Homo sapiens
cctcccaaccccagg

SEQ ID NO: 2108183 - DNA, 21 bp, Homo sapiens
cctcccaacctcaatgccctg

SEQ ID NO: 2108184 - DNA, 18 bp, Homo sapiens
cctcccaataaagctgga

SEQ ID NO: 2108185 - DNA, 22 bp, Homo sapiens
cctcccacaatctgggactttc

SEQ ID NO: 2108186 - DNA, 21 bp, Homo sapiens
cctcccaccaccctcccacca

SEQ ID NO: 2108187 - DNA, 14 bp, Homo sapiens
cctcccaccccact

SEQ ID NO: 2108188 - DNA, 16 bp, Homo sapiens
cctcccaccccactcc

SEQ ID NO: 2108189 - DNA, 17 bp, Homo sapiens
cctcccagccctgccag

SEQ ID NO: 2108190 - DNA, 20 bp, Homo sapiens
cctcccagccctgccaggag

SEQ ID NO: 2108191 - DNA, 14 bp, Homo sapiens
cctcccatcccctg

SEQ ID NO: 2108192 - DNA, 14 bp, Homo sapiens
cctcccattcccct

SEQ ID NO: 2108193 - DNA, 18 bp, Homo sapiens
cctccccaccttccccag

SEQ ID NO: 2108194 - DNA, 23 bp, Homo sapiens
cctccccaccttccccagactca

SEQ ID NO: 2108195 - DNA, 14 bp, Homo sapiens
cctcccccagagcc

SEQ ID NO: 2108196 - DNA, 17 bp, Homo sapiens
cctcccccagagccact

SEQ ID NO: 2108197 - DNA, 15 bp, Homo sapiens
cctcccccagagggg

SEQ ID NO: 2108198 - DNA, 16 bp, Homo sapiens
cctccccccactgcag

SEQ ID NO: 2108199 - DNA, 12 bp, Homo sapiens
cctcccccctgt

SEQ ID NO: 2108200 - DNA, 19 bp, Homo sapiens
cctccccctgccagtgcct

SEQ ID NO: 2108201 - DNA, 20 bp, Homo sapiens
cctccccctgccagtgcctt

SEQ ID NO: 2108202 - DNA, 13 bp, Homo sapiens
cctccccctgctg

SEQ ID NO: 2108203 - DNA, 15 bp, Homo sapiens
cctccccctgctgct

SEQ ID NO: 2108204 - DNA, 17 bp, Homo sapiens
cctcccctatccaccca

SEQ ID NO: 2108205 - DNA, 14 bp, Homo sapiens
cctcccctccccca

SEQ ID NO: 2108206 - DNA, 14 bp, Homo sapiens
cctcccctcccccc

SEQ ID NO: 2108207 - DNA, 14 bp, Homo sapiens
cctcccctcttgag

SEQ ID NO: 2108208 - DNA, 12 bp, Homo sapiens
cctcccctgcca

SEQ ID NO: 2108209 - DNA, 17 bp, Homo sapiens
cctcccctgccagggct

SEQ ID NO: 2108210 - DNA, 20 bp, Homo sapiens
cctcccctgtcttctctcaa

SEQ ID NO: 2108211 - DNA, 13 bp, Homo sapiens
cctccccttcctg

SEQ ID NO: 2108212 - DNA, 17 bp, Homo sapiens
cctccccttcctgcacc

SEQ ID NO: 2108213 - DNA, 17 bp, Homo sapiens
cctcccgaatagctggg

SEQ ID NO: 2108214 - DNA, 18 bp, Homo sapiens
cctcccgaatagctggga

SEQ ID NO: 2108215 - DNA, 24 bp, Homo sapiens
cctccctacctgaggcctatctga

SEQ ID NO: 2108216 - DNA, 11 bp, Homo sapiens
cctccctcctc

SEQ ID NO: 2108217 - DNA, 12 bp, Homo sapiens
cctccctcctcg

SEQ ID NO: 2108218 - DNA, 16 bp, Homo sapiens
cctccctcctctggcc

SEQ ID NO: 2108219 - DNA, 13 bp, Homo sapiens
cctccctctaatt

SEQ ID NO: 2108220 - DNA, 13 bp, Homo sapiens
cctccctctccat

SEQ ID NO: 2108221 - DNA, 18 bp, Homo sapiens
cctccctctgccccaagc

SEQ ID NO: 2108222 - DNA, 23 bp, Homo sapiens
cctccctctgccccaagcagcca

SEQ ID NO: 2108223 - DNA, 21 bp, Homo sapiens
cctccctctgctgtcaccttg

SEQ ID NO: 2108224 - DNA, 12 bp, Homo sapiens
cctccctcttcc

SEQ ID NO: 2108225 - DNA, 13 bp, Homo sapiens
cctccctgaacca

SEQ ID NO: 2108226 - DNA, 19 bp, Homo sapiens
cctccctgactccctgtgg

SEQ ID NO: 2108227 - DNA, 13 bp, Homo sapiens
cctccctgccctg

SEQ ID NO: 2108228 - DNA, 12 bp, Homo sapiens
cctccctgtcct

SEQ ID NO: 2108229 - DNA, 14 bp, Homo sapiens
cctccctgtcctcc

SEQ ID NO: 2108230 - DNA, 15 bp, Homo sapiens
cctccctgtcctcct

SEQ ID NO: 2108231 - DNA, 12 bp, Homo sapiens
cctcccttgctc

SEQ ID NO: 2108232 - DNA, 21 bp, Homo sapiens
cctcccttgctcagtgcctcc

SEQ ID NO: 2108233 - DNA, 17 bp, Homo sapiens
cctccgccccagacaca

SEQ ID NO: 2108234 - DNA, 19 bp, Homo sapiens
cctccgccccagacacacc

SEQ ID NO: 2108235 - DNA, 20 bp, Homo sapiens
cctccgccccagacacaccc

SEQ ID NO: 2108236 - DNA, 14 bp, Homo sapiens
cctccgcctcttgg

SEQ ID NO: 2108237 - DNA, 19 bp, Homo sapiens
cctccgctgggaggaacct

SEQ ID NO: 2108238 - DNA, 13 bp, Homo sapiens
cctccgtccaccc

SEQ ID NO: 2108239 - DNA, 18 bp, Homo sapiens
cctccgtccacccaggct

SEQ ID NO: 2108240 - DNA, 15 bp, Homo sapiens
cctccgtctgcaatg

SEQ ID NO: 2108241 - DNA, 17 bp, Homo sapiens
cctcctaagcagctggg

SEQ ID NO: 2108242 - DNA, 19 bp, Homo sapiens
cctcctaagcagctgggac

SEQ ID NO: 2108243 - DNA, 20 bp, Homo sapiens
cctcctaagcagctgggact

SEQ ID NO: 2108244 - DNA, 21 bp, Homo sapiens
cctcctagaggtgggcagctg

SEQ ID NO: 2108245 - DNA, 23 bp, Homo sapiens
cctcctagaggtgggcagctggg

SEQ ID NO: 2108246 - DNA, 20 bp, Homo sapiens
cctcctagggaaaagttcat

SEQ ID NO: 2108247 - DNA, 19 bp, Homo sapiens
cctcctatcagaagtttct

SEQ ID NO: 2108248 - DNA, 16 bp, Homo sapiens
cctcctatccttggag

SEQ ID NO: 2108249 - DNA, 19 bp, Homo sapiens
cctcctatccttggagagc

SEQ ID NO: 2108250 - DNA, 20 bp, Homo sapiens
cctcctattttaattggaat

SEQ ID NO: 2108251 - DNA, 17 bp, Homo sapiens
cctcctccacagtgctg

SEQ ID NO: 2108252 - DNA, 12 bp, Homo sapiens
cctcctccactc

SEQ ID NO: 2108253 - DNA, 14 bp, Homo sapiens
cctcctccactcac

SEQ ID NO: 2108254 - DNA, 15 bp, Homo sapiens
cctcctccactcact

SEQ ID NO: 2108255 - DNA, 22 bp, Homo sapiens
cctcctccactcactccagccc

SEQ ID NO: 2108256 - DNA, 14 bp, Homo sapiens
cctcctccccttcc

SEQ ID NO: 2108257 - DNA, 14 bp, Homo sapiens
cctcctcctgccct

SEQ ID NO: 2108258 - DNA, 16 bp, Homo sapiens
cctcctgaagcctctg

SEQ ID NO: 2108259 - DNA, 15 bp, Homo sapiens
cctcctgacctgtca

SEQ ID NO: 2108260 - DNA, 16 bp, Homo sapiens
cctcctgatggccaag

SEQ ID NO: 2108261 - DNA, 18 bp, Homo sapiens
cctcctgatggccaagag

SEQ ID NO: 2108262 - DNA, 13 bp, Homo sapiens
cctcctgcccagg

SEQ ID NO: 2108263 - DNA, 14 bp, Homo sapiens
cctcctgcccagga

SEQ ID NO: 2108264 - DNA, 11 bp, Homo sapiens
cctcctgctgc

SEQ ID NO: 2108265 - DNA, 20 bp, Homo sapiens
cctcctggagcatcccaggc

SEQ ID NO: 2108266 - DNA, 22 bp, Homo sapiens
cctcctggccagacgctgccgc

SEQ ID NO: 2108267 - DNA, 16 bp, Homo sapiens
cctcctggccggggcc

SEQ ID NO: 2108268 - DNA, 12 bp, Homo sapiens
cctcctgggcag

SEQ ID NO: 2108269 - DNA, 15 bp, Homo sapiens
cctcctgtgtgtgcg

SEQ ID NO: 2108270 - DNA, 13 bp, Homo sapiens
cctccttcccctg

SEQ ID NO: 2108271 - DNA, 21 bp, Homo sapiens
cctccttcccgccgcccgacc

SEQ ID NO: 2108272 - DNA, 11 bp, Homo sapiens
cctccttccct

SEQ ID NO: 2108273 - DNA, 19 bp, Homo sapiens
cctccttcctcagtcctgg

SEQ ID NO: 2108274 - DNA, 15 bp, Homo sapiens
cctccttgctctgca

SEQ ID NO: 2108275 - DNA, 22 bp, Homo sapiens
cctccttgctctgcaggcacct

SEQ ID NO: 2108276 - DNA, 15 bp, Homo sapiens
cctccttggtgcctg

SEQ ID NO: 2108277 - DNA, 18 bp, Homo sapiens
cctccttttgcttgaaac

SEQ ID NO: 2108278 - DNA, 19 bp, Homo sapiens
cctcgaaccaaggcagcct

SEQ ID NO: 2108279 - DNA, 16 bp, Homo sapiens
cctcgaactggctgca

SEQ ID NO: 2108280 - DNA, 20 bp, Homo sapiens
cctcgaggcaccggcgctgc

SEQ ID NO: 2108281 - DNA, 22 bp, Homo sapiens
cctcgcagcaggtgcaagagac

SEQ ID NO: 2108282 - DNA, 20 bp, Homo sapiens
cctcgcaggtctcagcccgg

SEQ ID NO: 2108283 - DNA, 17 bp, Homo sapiens
cctcgcctaggcctgtg

SEQ ID NO: 2108284 - DNA, 12 bp, Homo sapiens
cctcgcctgggc

SEQ ID NO: 2108285 - DNA, 16 bp, Homo sapiens
cctcgcctgggcccag

SEQ ID NO: 2108286 - DNA, 20 bp, Homo sapiens
cctcgcctgggcccaggctc

SEQ ID NO: 2108287 - DNA, 18 bp, Homo sapiens
cctcgctccccactctgc

SEQ ID NO: 2108288 - DNA, 19 bp, Homo sapiens
cctcgctccccactctgct

SEQ ID NO: 2108289 - DNA, 14 bp, Homo sapiens
cctgtgcccctcag

SEQ ID NO: 2108290 - DNA, 16 bp, Homo sapiens
cctgtgcccctcagag

SEQ ID NO: 2108291 - DNA, 23 bp, Homo sapiens
cctgtgcccctcagagaggcatg

SEQ ID NO: 2108292 - DNA, 15 bp, Homo sapiens
cctgtgctactttgc

SEQ ID NO: 2108293 - DNA, 17 bp, Homo sapiens
cctgtgctactttgcct

SEQ ID NO: 2108294 - DNA, 18 bp, Homo sapiens
cctgtgctgacggaagcc

SEQ ID NO: 2108295 - DNA, 16 bp, Homo sapiens
cctgtgctgaggactc

SEQ ID NO: 2108296 - DNA, 22 bp, Homo sapiens
cctgtgctgcccgtcttcagcc

SEQ ID NO: 2108297 - DNA, 15 bp, Homo sapiens
cctgtggcaggccta

SEQ ID NO: 2108298 - DNA, 12 bp, Homo sapiens
cctgtggccagg

SEQ ID NO: 2108299 - DNA, 19 bp, Homo sapiens
cctgtggccttgcccgcca

SEQ ID NO: 2108300 - DNA, 17 bp, Homo sapiens
cctgtggcggtgcctgg

SEQ ID NO: 2108301 - DNA, 20 bp, Homo sapiens
cctgtggcggtgcctgggtg

SEQ ID NO: 2108302 - DNA, 21 bp, Homo sapiens
cctgtgggaagagaagggaag

SEQ ID NO: 2108303 - DNA, 22 bp, Homo sapiens
cctgtgggaagagaagggaagc

SEQ ID NO: 2108304 - DNA, 13 bp, Homo sapiens
cctgtgggagcct

SEQ ID NO: 2108305 - DNA, 17 bp, Homo sapiens
cctgtggggcctgatgg

SEQ ID NO: 2108306 - DNA, 17 bp, Homo sapiens
cctgtgggggtggccat

SEQ ID NO: 2108307 - DNA, 21 bp, Homo sapiens
cctgtgggggtggccatccct

SEQ ID NO: 2108308 - DNA, 13 bp, Homo sapiens
cctgtgtagctgt

SEQ ID NO: 2108309 - DNA, 17 bp, Homo sapiens
cctgtgtagctgtgacc

SEQ ID NO: 2108310 - DNA, 17 bp, Homo sapiens
cctgtgtccagcagctg

SEQ ID NO: 2108311 - DNA, 22 bp, Homo sapiens
cctgtgtcttgcaatggcagcc

SEQ ID NO: 2108312 - DNA, 22 bp, Homo sapiens
cctgtgtgagcatctctgtgta

SEQ ID NO: 2108313 - DNA, 14 bp, Homo sapiens
cctgtgtggacagg

SEQ ID NO: 2108314 - DNA, 21 bp, Homo sapiens
cctgtgtggggaggcagctcc

SEQ ID NO: 2108315 - DNA, 20 bp, Homo sapiens
cctgttaaaagatgaaaata

SEQ ID NO: 2108316 - DNA, 19 bp, Homo sapiens
cctgttaacgtcatctcag

SEQ ID NO: 2108317 - DNA, 23 bp, Homo sapiens
cctgttacttgaaataccagtga

SEQ ID NO: 2108318 - DNA, 20 bp, Homo sapiens
cctgttaggggaaaatagta

SEQ ID NO: 2108319 - DNA, 20 bp, Homo sapiens
cctgttcaccttatgtatta

SEQ ID NO: 2108320 - DNA, 13 bp, Homo sapiens
cctgttcagctcc

SEQ ID NO: 2108321 - DNA, 16 bp, Homo sapiens
cctgttcagctccagc

SEQ ID NO: 2108322 - DNA, 12 bp, Homo sapiens
cctgttcccatt

SEQ ID NO: 2108323 - DNA, 17 bp, Homo sapiens
cctgttcccccgctggc

SEQ ID NO: 2108324 - DNA, 22 bp, Homo sapiens
cctgttcccccgctggcagcca

SEQ ID NO: 2108325 - DNA, 14 bp, Homo sapiens
cctgttctcagctc

SEQ ID NO: 2108326 - DNA, 20 bp, Homo sapiens
cctgttgttcccatctgcgc

SEQ ID NO: 2108327 - DNA, 16 bp, Homo sapiens
cctgtttaatatttaa

SEQ ID NO: 2108328 - DNA, 21 bp, Homo sapiens
cctgtttaatatttaaacagc

SEQ ID NO: 2108329 - DNA, 17 bp, Homo sapiens
cctgttttgttggaagg

SEQ ID NO: 2108330 - DNA, 14 bp, Homo sapiens
ccttaaaaatgcac

SEQ ID NO: 2108331 - DNA, 17 bp, Homo sapiens
ccttaaaaggagagaag

SEQ ID NO: 2108332 - DNA, 17 bp, Homo sapiens
ccttaaaataatgattt

SEQ ID NO: 2108333 - DNA, 22 bp, Homo sapiens
ccttaaaggcaccatctaatag

SEQ ID NO: 2108334 - DNA, 12 bp, Homo sapiens
ccttaaattttt

SEQ ID NO: 2108335 - DNA, 15 bp, Homo sapiens
ccttaatattattgg

SEQ ID NO: 2108336 - DNA, 17 bp, Homo sapiens
ccttaattcactcccac

SEQ ID NO: 2108337 - DNA, 22 bp, Homo sapiens
ccttacacgtacctctcatcag

SEQ ID NO: 2108338 - DNA, 17 bp, Homo sapiens
ccttaccaactttctgt

SEQ ID NO: 2108339 - DNA, 14 bp, Homo sapiens
ccttacctcccctg

SEQ ID NO: 2108340 - DNA, 13 bp, Homo sapiens
ccttacctcctgc

SEQ ID NO: 2108341 - DNA, 14 bp, Homo sapiens
ccttacctcctgcc

SEQ ID NO: 2108342 - DNA, 17 bp, Homo sapiens
ccttacctcctgcccag

SEQ ID NO: 2108343 - DNA, 18 bp, Homo sapiens
ccttacctcctgcccagg

SEQ ID NO: 2108344 - DNA, 12 bp, Homo sapiens
ccttactcacct

SEQ ID NO: 2108345 - DNA, 21 bp, Homo sapiens
ccttactcacctctctctaag

SEQ ID NO: 2108346 - DNA, 16 bp, Homo sapiens
ccttactcccaggcac

SEQ ID NO: 2108347 - DNA, 15 bp, Homo sapiens
ccttactctgagccc

SEQ ID NO: 2108348 - DNA, 18 bp, Homo sapiens
ccttactctgagcccagg

SEQ ID NO: 2108349 - DNA, 12 bp, Homo sapiens
ccttactgcaga

SEQ ID NO: 2108350 - DNA, 21 bp, Homo sapiens
ccttacttaagtcgggggtgg

SEQ ID NO: 2108351 - DNA, 16 bp, Homo sapiens
ccttagagacatcaaa

SEQ ID NO: 2108352 - DNA, 23 bp, Homo sapiens
ccttagagattgccccagagccc

SEQ ID NO: 2108353 - DNA, 16 bp, Homo sapiens
ccttagattagctctg

SEQ ID NO: 2108354 - DNA, 14 bp, Homo sapiens
ccttagcacttctt

SEQ ID NO: 2108355 - DNA, 21 bp, Homo sapiens
ccttagcacttctttcctctc

SEQ ID NO: 2108356 - DNA, 20 bp, Homo sapiens
ccttagcagggaaacagcta

SEQ ID NO: 2108357 - DNA, 19 bp, Homo sapiens
ccttagcttagacctcagc

SEQ ID NO: 2108358 - DNA, 21 bp, Homo sapiens
ccttagcttagacctcagcct

SEQ ID NO: 2108359 - DNA, 20 bp, Homo sapiens
ccttaggaaaatgcttctgt

SEQ ID NO: 2108360 - DNA, 23 bp, Homo sapiens
ccttaggcattatttaatgtttg

SEQ ID NO: 2108361 - DNA, 20 bp, Homo sapiens
ccttagtggcttttttcctc

SEQ ID NO: 2108362 - DNA, 13 bp, Homo sapiens
ccttatccaggac

SEQ ID NO: 2108363 - DNA, 17 bp, Homo sapiens
ccttatccaggactctg

SEQ ID NO: 2108364 - DNA, 13 bp, Homo sapiens
ccttatcttgaaa

SEQ ID NO: 2108365 - DNA, 14 bp, Homo sapiens
ccttatttatatat

SEQ ID NO: 2108366 - DNA, 16 bp, Homo sapiens
ccttatttatatatca

SEQ ID NO: 2108367 - DNA, 14 bp, Homo sapiens
ccttattttcaaga

SEQ ID NO: 2108368 - DNA, 22 bp, Homo sapiens
ccttcaacaattctaaaatgat

SEQ ID NO: 2108369 - DNA, 14 bp, Homo sapiens
ccttcaaccattcc

SEQ ID NO: 2108370 - DNA, 16 bp, Homo sapiens
ccttcaataaagtatc

SEQ ID NO: 2108371 - DNA, 20 bp, Homo sapiens
ccttcaattcctgggcccca

SEQ ID NO: 2108372 - DNA, 12 bp, Homo sapiens
ccttcacaacca

SEQ ID NO: 2108373 - DNA, 17 bp, Homo sapiens
ccttcacaaccagccac

SEQ ID NO: 2108374 - DNA, 18 bp, Homo sapiens
ccttcacaaccagccaca

SEQ ID NO: 2108375 - DNA, 22 bp, Homo sapiens
ccttcacaaccagccacacaga

SEQ ID NO: 2108376 - DNA, 19 bp, Homo sapiens
ccttcacctttggtgcaga

SEQ ID NO: 2108377 - DNA, 17 bp, Homo sapiens
ccttcagaacagaggca

SEQ ID NO: 2108378 - DNA, 18 bp, Homo sapiens
ccttcagaacagaggcat

SEQ ID NO: 2108379 - DNA, 20 bp, Homo sapiens
ccttcagatcagccacacct

SEQ ID NO: 2108380 - DNA, 20 bp, Homo sapiens
ccttcagtcttgaatttcta

SEQ ID NO: 2108381 - DNA, 14 bp, Homo sapiens
ccttcagtgcccac

SEQ ID NO: 2108382 - DNA, 15 bp, Homo sapiens
ccttcatttcctccg

SEQ ID NO: 2108383 - DNA, 17 bp, Homo sapiens
ccttccacctcctagag

SEQ ID NO: 2108384 - DNA, 20 bp, Homo sapiens
ccttccacggatccatgtag

SEQ ID NO: 2108385 - DNA, 14 bp, Homo sapiens
ccttccagacatac

SEQ ID NO: 2108386 - DNA, 19 bp, Homo sapiens
ccttccagtggtaccagct

SEQ ID NO: 2108387 - DNA, 20 bp, Homo sapiens
ccttccagtggtaccagctc

SEQ ID NO: 2108388 - DNA, 15 bp, Homo sapiens
ccttccataattatg

SEQ ID NO: 2108389 - DNA, 23 bp, Homo sapiens
ccttccatgtcgcctctgcattc

SEQ ID NO: 2108390 - DNA, 21 bp, Homo sapiens
ccttcccaaggttactcagca

SEQ ID NO: 2108391 - DNA, 17 bp, Homo sapiens
ccttcccaatcagcact

SEQ ID NO: 2108392 - DNA, 18 bp, Homo sapiens
ccttcccagctctccctc

SEQ ID NO: 2108393 - DNA, 15 bp, Homo sapiens
ccttcccatctcttc

SEQ ID NO: 2108394 - DNA, 13 bp, Homo sapiens
ccttccccaagaa

SEQ ID NO: 2108395 - DNA, 23 bp, Homo sapiens
ccttccccagactcagctccaga

SEQ ID NO: 2108396 - DNA, 13 bp, Homo sapiens
ccttccccatctc

SEQ ID NO: 2108397 - DNA, 14 bp, Homo sapiens
ccttccccatctcc

SEQ ID NO: 2108398 - DNA, 20 bp, Homo sapiens
cgccacacccggctccccct

SEQ ID NO: 2108399 - DNA, 15 bp, Homo sapiens
cgccaccgctgcctt

SEQ ID NO: 2108400 - DNA, 14 bp, Homo sapiens
cgccacggccaccc

SEQ ID NO: 2108401 - DNA, 18 bp, Homo sapiens
cgccacggccaccctcct

SEQ ID NO: 2108402 - DNA, 21 bp, Homo sapiens
cgccactacactccagcctga

SEQ ID NO: 2108403 - DNA, 14 bp, Homo sapiens
cgccactcatttca

SEQ ID NO: 2108404 - DNA, 16 bp, Homo sapiens
cgccactcatttcatc

SEQ ID NO: 2108405 - DNA, 18 bp, Homo sapiens
cgccactgagacggcaga

SEQ ID NO: 2108406 - DNA, 23 bp, Homo sapiens
cgccactgcactccagcctgggc

SEQ ID NO: 2108407 - DNA, 14 bp, Homo sapiens
cgccagaggacaag

SEQ ID NO: 2108408 - DNA, 17 bp, Homo sapiens
cgccagcctcagtgcca

SEQ ID NO: 2108409 - DNA, 20 bp, Homo sapiens
cgccaggaggtcctcctctc

SEQ ID NO: 2108410 - DNA, 23 bp, Homo sapiens
cgccatccgggacgcttccagac

SEQ ID NO: 2108411 - DNA, 17 bp, Homo sapiens
cgccatccttcaccaga

SEQ ID NO: 2108412 - DNA, 24 bp, Homo sapiens
cgccatccttcaccagagcccatg

SEQ ID NO: 2108413 - DNA, 13 bp, Homo sapiens
cgcccaaggctgc

SEQ ID NO: 2108414 - DNA, 15 bp, Homo sapiens
cgcccagctgcacct

SEQ ID NO: 2108415 - DNA, 15 bp, Homo sapiens
cgcccaggagacatc

SEQ ID NO: 2108416 - DNA, 22 bp, Homo sapiens
cgcccagttgggtggatgcctg

SEQ ID NO: 2108417 - DNA, 23 bp, Homo sapiens
cgcccagttgggtggatgcctgg

SEQ ID NO: 2108418 - DNA, 21 bp, Homo sapiens
cgcccctcatttatccctcaa

SEQ ID NO: 2108419 - DNA, 13 bp, Homo sapiens
cgccccttccccc

SEQ ID NO: 2108420 - DNA, 19 bp, Homo sapiens
cgcccgactagcaggcatg

SEQ ID NO: 2108421 - DNA, 20 bp, Homo sapiens
cgccctctgcgtcccccagc

SEQ ID NO: 2108422 - DNA, 15 bp, Homo sapiens
cgccctgcagaccct

SEQ ID NO: 2108423 - DNA, 14 bp, Homo sapiens
cgccctgcccctgc

SEQ ID NO: 2108424 - DNA, 14 bp, Homo sapiens
cgccctgggctgtc

SEQ ID NO: 2108425 - DNA, 15 bp, Homo sapiens
cgccctgggctgtct

SEQ ID NO: 2108426 - DNA, 13 bp, Homo sapiens
cgccgtggagcat

SEQ ID NO: 2108427 - DNA, 14 bp, Homo sapiens
cgcctacaggagtg

SEQ ID NO: 2108428 - DNA, 20 bp, Homo sapiens
cgcctagtggggtctccctc

SEQ ID NO: 2108429 - DNA, 16 bp, Homo sapiens
cgcctatgatcccagc

SEQ ID NO: 2108430 - DNA, 17 bp, Homo sapiens
cgcctcaatgtggttgc

SEQ ID NO: 2108431 - DNA, 15 bp, Homo sapiens
cgcctccaggagcct

SEQ ID NO: 2108432 - DNA, 18 bp, Homo sapiens
cgcctcccagccccaggg

SEQ ID NO: 2108433 - DNA, 14 bp, Homo sapiens
cgcctcccagcctg

SEQ ID NO: 2108434 - DNA, 12 bp, Homo sapiens
cgcctcctggcc

SEQ ID NO: 2108435 - DNA, 13 bp, Homo sapiens
cgcctctgcattc

SEQ ID NO: 2108436 - DNA, 16 bp, Homo sapiens
cgcctctgcccgcaga

SEQ ID NO: 2108437 - DNA, 13 bp, Homo sapiens
cgcctgagcccag

SEQ ID NO: 2108438 - DNA, 14 bp, Homo sapiens
cgcctgcagaggac

SEQ ID NO: 2108439 - DNA, 23 bp, Homo sapiens
cgcctgcccccagcactcctctg

SEQ ID NO: 2108440 - DNA, 17 bp, Homo sapiens
cgcctgcttgtccctgc

SEQ ID NO: 2108441 - DNA, 16 bp, Homo sapiens
cgcctggccggctcca

SEQ ID NO: 2108442 - DNA, 22 bp, Homo sapiens
cgcctggccggctccagtttcc

SEQ ID NO: 2108443 - DNA, 18 bp, Homo sapiens
cgcctgggcccaggctct

SEQ ID NO: 2108444 - DNA, 20 bp, Homo sapiens
cgcctgggcccaggctctgg

SEQ ID NO: 2108445 - DNA, 18 bp, Homo sapiens
cgcctgtaatcccagcac

SEQ ID NO: 2108446 - DNA, 17 bp, Homo sapiens
cgcctgtaatcccagct

SEQ ID NO: 2108447 - DNA, 15 bp, Homo sapiens
cgcctgtcctgcctc

SEQ ID NO: 2108448 - DNA, 13 bp, Homo sapiens
cgccttcctcctc

SEQ ID NO: 2108449 - DNA, 16 bp, Homo sapiens
cgccttcctcctccac

SEQ ID NO: 2108450 - DNA, 17 bp, Homo sapiens
cgccttcctcctccaca

SEQ ID NO: 2108451 - DNA, 19 bp, Homo sapiens
cgcgcagcgcgtgcacagc

SEQ ID NO: 2108452 - DNA, 18 bp, Homo sapiens
cgcgcatctcttcctgat

SEQ ID NO: 2108453 - DNA, 16 bp, Homo sapiens
cgcgggaggcaccagc

SEQ ID NO: 2108454 - DNA, 14 bp, Homo sapiens
cgcggtgctctggc

SEQ ID NO: 2108455 - DNA, 19 bp, Homo sapiens
cgcggtggctcacacctgt

SEQ ID NO: 2108456 - DNA, 20 bp, Homo sapiens
cgcggtggctcttgcctgta

SEQ ID NO: 2108457 - DNA, 15 bp, Homo sapiens
cgcgtctgccccacc

SEQ ID NO: 2108458 - DNA, 19 bp, Homo sapiens
cgcgtgcacacaccagagc

SEQ ID NO: 2108459 - DNA, 22 bp, Homo sapiens
cgctaacccccagcccacagag

SEQ ID NO: 2108460 - DNA, 15 bp, Homo sapiens
cgctagagcagccca

SEQ ID NO: 2108461 - DNA, 20 bp, Homo sapiens
cgctaggagagactgaaagc

SEQ ID NO: 2108462 - DNA, 14 bp, Homo sapiens
cgctatcttcacat

SEQ ID NO: 2108463 - DNA, 15 bp, Homo sapiens
cgctattgcactcca

SEQ ID NO: 2108464 - DNA, 22 bp, Homo sapiens
cgctcacctttgtttagaacac

SEQ ID NO: 2108465 - DNA, 13 bp, Homo sapiens
cgctcaggaccca

SEQ ID NO: 2108466 - DNA, 16 bp, Homo sapiens
cgctcaggacccaggc

SEQ ID NO: 2108467 - DNA, 11 bp, Homo sapiens
cgctcatctgg

SEQ ID NO: 2108468 - DNA, 13 bp, Homo sapiens
cgctcatctggct

SEQ ID NO: 2108469 - DNA, 24 bp, Homo sapiens
cgctcatctggcttttcgcttgct

SEQ ID NO: 2108470 - DNA, 19 bp, Homo sapiens
cgctcattttaggcctcct

SEQ ID NO: 2108471 - DNA, 22 bp, Homo sapiens
cgctcattttaggcctcctctc

SEQ ID NO: 2108472 - DNA, 15 bp, Homo sapiens
cgctccccactctgc

SEQ ID NO: 2108473 - DNA, 17 bp, Homo sapiens
cgctccccactctgctc

SEQ ID NO: 2108474 - DNA, 20 bp, Homo sapiens
cgctcccccgcagtccccag

SEQ ID NO: 2108475 - DNA, 20 bp, Homo sapiens
cgctccctgtagctctgcct

SEQ ID NO: 2108476 - DNA, 17 bp, Homo sapiens
cgctcctcccctcttga

SEQ ID NO: 2108477 - DNA, 17 bp, Homo sapiens
cgctcctgtctgccagc

SEQ ID NO: 2108478 - DNA, 16 bp, Homo sapiens
cgctcctttacctacc

SEQ ID NO: 2108479 - DNA, 22 bp, Homo sapiens
cgctcctttacctaccaccttc

SEQ ID NO: 2108480 - DNA, 21 bp, Homo sapiens
cgctctgccctccctggcctc

SEQ ID NO: 2108481 - DNA, 21 bp, Homo sapiens
cgctctgctggcctggccggc

SEQ ID NO: 2108482 - DNA, 20 bp, Homo sapiens
cgctgccaccacgtctgcca

SEQ ID NO: 2108483 - DNA, 9 bp, Homo sapiens
cgctgccag

SEQ ID NO: 2108484 - DNA, 19 bp, Homo sapiens
cgctgccaggacacctgcc

SEQ ID NO: 2108485 - DNA, 20 bp, Homo sapiens
cgctgccaggacacctgccc

SEQ ID NO: 2108486 - DNA, 13 bp, Homo sapiens
cgctgccgcaccc

SEQ ID NO: 2108487 - DNA, 15 bp, Homo sapiens
cgctgccttgccatg

SEQ ID NO: 2108488 - DNA, 22 bp, Homo sapiens
cgctgcgtctccatcaacactg

SEQ ID NO: 2108489 - DNA, 17 bp, Homo sapiens
cgctgctctagctggca

SEQ ID NO: 2108490 - DNA, 20 bp, Homo sapiens
cgctgctctagctggcagga

SEQ ID NO: 2108491 - DNA, 18 bp, Homo sapiens
cgctgcttcgtgggatac

SEQ ID NO: 2108492 - DNA, 21 bp, Homo sapiens
cgctggaatcaatttcccaga

SEQ ID NO: 2108493 - DNA, 16 bp, Homo sapiens
cgctggacaacccaga

SEQ ID NO: 2108494 - DNA, 14 bp, Homo sapiens
cgctggcccagggt

SEQ ID NO: 2108495 - DNA, 13 bp, Homo sapiens
cgctggctcagga

SEQ ID NO: 2108496 - DNA, 14 bp, Homo sapiens
cgctggggaacaga

SEQ ID NO: 2108497 - DNA, 23 bp, Homo sapiens
cgctggggaacagagcgggcctc

SEQ ID NO: 2108498 - DNA, 22 bp, Homo sapiens
cgctggggagcgaaagtttctt

SEQ ID NO: 2108499 - DNA, 19 bp, Homo sapiens
cgctgtcctctcgagccca

SEQ ID NO: 2108500 - DNA, 16 bp, Homo sapiens
cgctgtcgccccaggc

SEQ ID NO: 2108501 - DNA, 14 bp, Homo sapiens
cgctgtggctcctg

SEQ ID NO: 2108502 - DNA, 14 bp, Homo sapiens
cgcttcacccctgc

SEQ ID NO: 2108503 - DNA, 20 bp, Homo sapiens
cgcttccagaccacctgcca

SEQ ID NO: 2108504 - DNA, 14 bp, Homo sapiens
cgcttcccagaggc

SEQ ID NO: 2108505 - DNA, 22 bp, Homo sapiens
ctagtgtgagtggcagccatgc

SEQ ID NO: 2108506 - DNA, 18 bp, Homo sapiens
ctagttagctgctttaaa

SEQ ID NO: 2108507 - DNA, 21 bp, Homo sapiens
ctagttccccgtgaacttcct

SEQ ID NO: 2108508 - DNA, 20 bp, Homo sapiens
ctagttctcaatcactgctc

SEQ ID NO: 2108509 - DNA, 18 bp, Homo sapiens
ctagtttcagtaaataat

SEQ ID NO: 2108510 - DNA, 15 bp, Homo sapiens
ctagttttttttgta

SEQ ID NO: 2108511 - DNA, 20 bp, Homo sapiens
ctataaacattaaaagaaga

SEQ ID NO: 2108512 - DNA, 17 bp, Homo sapiens
ctataaactactgtaat

SEQ ID NO: 2108513 - DNA, 16 bp, Homo sapiens
ctataaatggtgtttt

SEQ ID NO: 2108514 - DNA, 18 bp, Homo sapiens
ctataaatggtgtttttt

SEQ ID NO: 2108515 - DNA, 14 bp, Homo sapiens
ctataacatgtctt

SEQ ID NO: 2108516 - DNA, 22 bp, Homo sapiens
ctataaccccagctccctagga

SEQ ID NO: 2108517 - DNA, 14 bp, Homo sapiens
ctataatcccagca

SEQ ID NO: 2108518 - DNA, 20 bp, Homo sapiens
ctataatggaaacatttaca

SEQ ID NO: 2108519 - DNA, 13 bp, Homo sapiens
ctataatgtgtgt

SEQ ID NO: 2108520 - DNA, 14 bp, Homo sapiens
ctatacaacaatgt

SEQ ID NO: 2108521 - DNA, 21 bp, Homo sapiens
ctataccatatgtctgcttct

SEQ ID NO: 2108522 - DNA, 18 bp, Homo sapiens
ctatacccattcttcagt

SEQ ID NO: 2108523 - DNA, 12 bp, Homo sapiens
ctatagactcta

SEQ ID NO: 2108524 - DNA, 15 bp, Homo sapiens
ctatagagaaaaact

SEQ ID NO: 2108525 - DNA, 13 bp, Homo sapiens
ctatagccaaaaa

SEQ ID NO: 2108526 - DNA, 19 bp, Homo sapiens
ctatagctcttctatttaa

SEQ ID NO: 2108527 - DNA, 16 bp, Homo sapiens
ctataggctggagaag

SEQ ID NO: 2108528 - DNA, 17 bp, Homo sapiens
ctataggctggagaagc

SEQ ID NO: 2108529 - DNA, 22 bp, Homo sapiens
ctataggtgctacaaaaacaca

SEQ ID NO: 2108530 - DNA, 19 bp, Homo sapiens
ctatagtagtcaattagta

SEQ ID NO: 2108531 - DNA, 17 bp, Homo sapiens
ctatataaggaggaaaa

SEQ ID NO: 2108532 - DNA, 13 bp, Homo sapiens
ctatatacatgtg

SEQ ID NO: 2108533 - DNA, 19 bp, Homo sapiens
ctatatacatgtgtgtata

SEQ ID NO: 2108534 - DNA, 16 bp, Homo sapiens
ctatatatacatgtat

SEQ ID NO: 2108535 - DNA, 13 bp, Homo sapiens
ctatatatataaa

SEQ ID NO: 2108536 - DNA, 14 bp, Homo sapiens
ctatatctctaaac

SEQ ID NO: 2108537 - DNA, 13 bp, Homo sapiens
ctatatgatttat

SEQ ID NO: 2108538 - DNA, 16 bp, Homo sapiens
ctatatgatttatagt

SEQ ID NO: 2108539 - DNA, 14 bp, Homo sapiens
ctatatgcatttaa

SEQ ID NO: 2108540 - DNA, 19 bp, Homo sapiens
ctatatgtagctttatcct

SEQ ID NO: 2108541 - DNA, 14 bp, Homo sapiens
ctatattgtgccaa

SEQ ID NO: 2108542 - DNA, 22 bp, Homo sapiens
ctatatttagattgttaaaata

SEQ ID NO: 2108543 - DNA, 17 bp, Homo sapiens
ctatcaaccccagacac

SEQ ID NO: 2108544 - DNA, 20 bp, Homo sapiens
ctatcaaccccagacactgg

SEQ ID NO: 2108545 - DNA, 20 bp, Homo sapiens
ctatcaacctaagcaacaga

SEQ ID NO: 2108546 - DNA, 20 bp, Homo sapiens
ctatcaatagtcaagaaaaa

SEQ ID NO: 2108547 - DNA, 18 bp, Homo sapiens
ctatcaatatataaattt

SEQ ID NO: 2108548 - DNA, 21 bp, Homo sapiens
ctatcaatcctgcccccagcc

SEQ ID NO: 2108549 - DNA, 14 bp, Homo sapiens
ctatcacacagtgg

SEQ ID NO: 2108550 - DNA, 13 bp, Homo sapiens
ctatcacatacaa

SEQ ID NO: 2108551 - DNA, 18 bp, Homo sapiens
ctatcactggcaatattt

SEQ ID NO: 2108552 - DNA, 20 bp, Homo sapiens
ctatcactggcaatatttgt

SEQ ID NO: 2108553 - DNA, 12 bp, Homo sapiens
ctatcatttctt

SEQ ID NO: 2108554 - DNA, 19 bp, Homo sapiens
ctatcatttcttttccaaa

SEQ ID NO: 2108555 - DNA, 19 bp, Homo sapiens
ctatccaattaaaattaag

SEQ ID NO: 2108556 - DNA, 12 bp, Homo sapiens
ctatccacccag

SEQ ID NO: 2108557 - DNA, 14 bp, Homo sapiens
ctatccacccagcc

SEQ ID NO: 2108558 - DNA, 16 bp, Homo sapiens
ctatccacccagccca

SEQ ID NO: 2108559 - DNA, 14 bp, Homo sapiens
ctatccatcctgcg

SEQ ID NO: 2108560 - DNA, 18 bp, Homo sapiens
ctatcccacccaacagct

SEQ ID NO: 2108561 - DNA, 23 bp, Homo sapiens
ctatcccacccaacagctcagag

SEQ ID NO: 2108562 - DNA, 15 bp, Homo sapiens
ctatccctgtacaga

SEQ ID NO: 2108563 - DNA, 19 bp, Homo sapiens
ctatcctagagaggctggc

SEQ ID NO: 2108564 - DNA, 17 bp, Homo sapiens
ctatcctgcgggtttta

SEQ ID NO: 2108565 - DNA, 13 bp, Homo sapiens
ctatcgactttat

SEQ ID NO: 2108566 - DNA, 21 bp, Homo sapiens
ctatctctgtgtgcacaaata

SEQ ID NO: 2108567 - DNA, 22 bp, Homo sapiens
ctatctgcatttataaatgtgt

SEQ ID NO: 2108568 - DNA, 17 bp, Homo sapiens
ctatctgtattttcatt

SEQ ID NO: 2108569 - DNA, 21 bp, Homo sapiens
ctatctgtcatctctctgggg

SEQ ID NO: 2108570 - DNA, 18 bp, Homo sapiens
ctatcttactatttcaca

SEQ ID NO: 2108571 - DNA, 12 bp, Homo sapiens
ctatcttctcca

SEQ ID NO: 2108572 - DNA, 14 bp, Homo sapiens
ctatgaaaatcagt

SEQ ID NO: 2108573 - DNA, 13 bp, Homo sapiens
ctatgaactacaa

SEQ ID NO: 2108574 - DNA, 16 bp, Homo sapiens
ctatgacttgggcacc

SEQ ID NO: 2108575 - DNA, 22 bp, Homo sapiens
ctatgaggaataattatttatt

SEQ ID NO: 2108576 - DNA, 22 bp, Homo sapiens
ctatgatcccagcactttggga

SEQ ID NO: 2108577 - DNA, 15 bp, Homo sapiens
ctatgattttctatt

SEQ ID NO: 2108578 - DNA, 11 bp, Homo sapiens
ctatgcaattt

SEQ ID NO: 2108579 - DNA, 13 bp, Homo sapiens
ctatgcacatatg

SEQ ID NO: 2108580 - DNA, 20 bp, Homo sapiens
ctatgcacatatggactctg

SEQ ID NO: 2108581 - DNA, 19 bp, Homo sapiens
ctatgccagctcagtccca

SEQ ID NO: 2108582 - DNA, 13 bp, Homo sapiens
ctatgctatttct

SEQ ID NO: 2108583 - DNA, 20 bp, Homo sapiens
ctatgctatttctggcctca

SEQ ID NO: 2108584 - DNA, 16 bp, Homo sapiens
ctatggagagccctgg

SEQ ID NO: 2108585 - DNA, 17 bp, Homo sapiens
ctatggagagccctggg

SEQ ID NO: 2108586 - DNA, 23 bp, Homo sapiens
ctatggagcctggcacaggactg

SEQ ID NO: 2108587 - DNA, 18 bp, Homo sapiens
ctatggatgtggggtccc

SEQ ID NO: 2108588 - DNA, 24 bp, Homo sapiens
ctatggatgtggggtccccatcat

SEQ ID NO: 2108589 - DNA, 18 bp, Homo sapiens
ctatggcagtccagccag

SEQ ID NO: 2108590 - DNA, 23 bp, Homo sapiens
ctaggctgccccgggtccccagc

SEQ ID NO: 2108591 - DNA, 21 bp, Homo sapiens
ctaggcttcagcatatttata

SEQ ID NO: 2108592 - DNA, 14 bp, Homo sapiens
ctagggagagaccc

SEQ ID NO: 2108593 - DNA, 14 bp, Homo sapiens
ctaggggctggtcc

SEQ ID NO: 2108594 - DNA, 21 bp, Homo sapiens
ctaggggtccacgggaagcct

SEQ ID NO: 2108595 - DNA, 18 bp, Homo sapiens
ctaggtgacagagtgaga

SEQ ID NO: 2108596 - DNA, 15 bp, Homo sapiens
ctaggttcaattccc

SEQ ID NO: 2108597 - DNA, 19 bp, Homo sapiens
ctagtaccctatagagagg

SEQ ID NO: 2108598 - DNA, 15 bp, Homo sapiens
ctagtactctctgct

SEQ ID NO: 2108599 - DNA, 18 bp, Homo sapiens
ctagtactctctgctcta

SEQ ID NO: 2108600 - DNA, 22 bp, Homo sapiens
ctagtactctctgctctagcca

SEQ ID NO: 2108601 - DNA, 23 bp, Homo sapiens
ctagtactggggagaaataattg

SEQ ID NO: 2108602 - DNA, 22 bp, Homo sapiens
ctagtatatgtcagacatgaaa

SEQ ID NO: 2108603 - DNA, 23 bp, Homo sapiens
ctagtcatagaaatacctcattc

SEQ ID NO: 2108604 - DNA, 18 bp, Homo sapiens
ctagtccttggtctgctg

SEQ ID NO: 2108605 - DNA, 15 bp, Homo sapiens
ctagtcctttactaa

SEQ ID NO: 2108606 - DNA, 19 bp, Homo sapiens
ctagtctatggtcagttga

SEQ ID NO: 2108607 - DNA, 15 bp, Homo sapiens
ctagtctcctttgca

SEQ ID NO: 2108608 - DNA, 19 bp, Homo sapiens
ctagtctcctttgcactga

SEQ ID NO: 2108609 - DNA, 20 bp, Homo sapiens
ctagtctcctttgcactgag

SEQ ID NO: 2108610 - DNA, 17 bp, Homo sapiens
ctagtctggtgttctga

SEQ ID NO: 2108611 - DNA, 18 bp, Homo sapiens
ctagtgccctccacagcc

SEQ ID NO: 2108612 - DNA, 18 bp, Homo sapiens
ctagtgctattctgtgtt

SEQ ID NO: 2108613 - DNA, 17 bp, Homo sapiens
ctagtggggtctccctc

SEQ ID NO: 2108614 - DNA, 17 bp, Homo sapiens
ctagtgtattcaacaga

SEQ ID NO: 2108615 - DNA, 19 bp, Homo sapiens
ctagtgtgagtggcagcca

SEQ ID NO: 2108616 - DNA, 19 bp, Homo sapiens
ctattctctcctcagactg

SEQ ID NO: 2108617 - DNA, 15 bp, Homo sapiens
ctattctgagccttg

SEQ ID NO: 2108618 - DNA, 16 bp, Homo sapiens
ctattctgagccttga

SEQ ID NO: 2108619 - DNA, 15 bp, Homo sapiens
ctattctgtgttgaa

SEQ ID NO: 2108620 - DNA, 17 bp, Homo sapiens
ctattctgttaaaatca

SEQ ID NO: 2108621 - DNA, 20 bp, Homo sapiens
ctattgaaaaggttaacaga

SEQ ID NO: 2108622 - DNA, 15 bp, Homo sapiens
ctattgaaattactg

SEQ ID NO: 2108623 - DNA, 16 bp, Homo sapiens
ctattgacaagtcatt

SEQ ID NO: 2108624 - DNA, 20 bp, Homo sapiens
ctattgatgtttccagaaaa

SEQ ID NO: 2108625 - DNA, 21 bp, Homo sapiens
ctattgatgtttccagaaaat

SEQ ID NO: 2108626 - DNA, 23 bp, Homo sapiens
ctattgatgtttccagaaaatat

SEQ ID NO: 2108627 - DNA, 16 bp, Homo sapiens
ctattgcatgtaaaat

SEQ ID NO: 2108628 - DNA, 19 bp, Homo sapiens
ctattgcatgtaaaatgca

SEQ ID NO: 2108629 - DNA, 21 bp, Homo sapiens
ctattgcatgtaaaatgcagt

SEQ ID NO: 2108630 - DNA, 22 bp, Homo sapiens
ctattgcatgtaaaatgcagtc

SEQ ID NO: 2108631 - DNA, 15 bp, Homo sapiens
ctattgtgcctctgg

SEQ ID NO: 2108632 - DNA, 22 bp, Homo sapiens
ctattgtttattctttttaaag

SEQ ID NO: 2108633 - DNA, 16 bp, Homo sapiens
ctatttaaaaaataaa

SEQ ID NO: 2108634 - DNA, 17 bp, Homo sapiens
ctatttaaaaaataaaa

SEQ ID NO: 2108635 - DNA, 19 bp, Homo sapiens
ctatttaaaaaataaaaaa

SEQ ID NO: 2108636 - DNA, 17 bp, Homo sapiens
ctatttaaaagtataaa

SEQ ID NO: 2108637 - DNA, 15 bp, Homo sapiens
ctatttaatatttat

SEQ ID NO: 2108638 - DNA, 13 bp, Homo sapiens
ctatttataaact

SEQ ID NO: 2108639 - DNA, 22 bp, Homo sapiens
ctatttattaagttctcaatgt

SEQ ID NO: 2108640 - DNA, 11 bp, Homo sapiens
ctatttattgg

SEQ ID NO: 2108641 - DNA, 14 bp, Homo sapiens
ctatttattggggt

SEQ ID NO: 2108642 - DNA, 22 bp, Homo sapiens
ctatttatttttgcaaaccctg

SEQ ID NO: 2108643 - DNA, 21 bp, Homo sapiens
ctatttccccaggggaaaatg

SEQ ID NO: 2108644 - DNA, 21 bp, Homo sapiens
ctatttccctctactgagtaa

SEQ ID NO: 2108645 - DNA, 14 bp, Homo sapiens
ctatttctggcctc

SEQ ID NO: 2108646 - DNA, 16 bp, Homo sapiens
ctatttctggcctcag

SEQ ID NO: 2108647 - DNA, 17 bp, Homo sapiens
ctatttctggcctcagc

SEQ ID NO: 2108648 - DNA, 20 bp, Homo sapiens
ctatttgagcatgcacagct

SEQ ID NO: 2108649 - DNA, 23 bp, Homo sapiens
ctatttgagcatgcacagctgct

SEQ ID NO: 2108650 - DNA, 20 bp, Homo sapiens
ctatttgttcagagaggcct

SEQ ID NO: 2108651 - DNA, 15 bp, Homo sapiens
ctattttaaaaccat

SEQ ID NO: 2108652 - DNA, 16 bp, Homo sapiens
ctattttaaaaccatg

SEQ ID NO: 2108653 - DNA, 12 bp, Homo sapiens
ctattttgtaaa

SEQ ID NO: 2108654 - DNA, 19 bp, Homo sapiens
ctattttgtaaactcaaaa

SEQ ID NO: 2108655 - DNA, 15 bp, Homo sapiens
ctatttttcttctaa

SEQ ID NO: 2108656 - DNA, 17 bp, Homo sapiens
ctattttttaaaaaaat

SEQ ID NO: 2108657 - DNA, 14 bp, Homo sapiens
ctattttttaataa

SEQ ID NO: 2108658 - DNA, 16 bp, Homo sapiens
ctattttttaataaaa

SEQ ID NO: 2108659 - DNA, 17 bp, Homo sapiens
ctcaaaagattgtttta

SEQ ID NO: 2108660 - DNA, 13 bp, Homo sapiens
ctcaaaagcactt

SEQ ID NO: 2108661 - DNA, 13 bp, Homo sapiens
ctcaaaatatttg

SEQ ID NO: 2108662 - DNA, 20 bp, Homo sapiens
ctcaaactcctggactcatg

SEQ ID NO: 2108663 - DNA, 14 bp, Homo sapiens
ctcaaagagactcc

SEQ ID NO: 2108664 - DNA, 18 bp, Homo sapiens
ctcaaagagggagtgcat

SEQ ID NO: 2108665 - DNA, 22 bp, Homo sapiens
ctcaaagcccccacttctctcc

SEQ ID NO: 2108666 - DNA, 11 bp, Homo sapiens
ctcaaatacat

SEQ ID NO: 2108667 - DNA, 12 bp, Homo sapiens
ctcaaatccttg

SEQ ID NO: 2108668 - DNA, 15 bp, Homo sapiens
ctcaaatctattcag

SEQ ID NO: 2108669 - DNA, 16 bp, Homo sapiens
ctcaaatctattcaga

SEQ ID NO: 2108670 - DNA, 18 bp, Homo sapiens
ctcaaatgctaaatgcaa

SEQ ID NO: 2108671 - DNA, 11 bp, Homo sapiens
ctcaaatgctg

SEQ ID NO: 2108672 - DNA, 17 bp, Homo sapiens
ctcaaatgtcagagcta

SEQ ID NO: 2108673 - DNA, 13 bp, Homo sapiens
ctcaacagatctg

SEQ ID NO: 2108674 - DNA, 17 bp, Homo sapiens
ctcaaccaacctccccg

SEQ ID NO: 2108675 - DNA, 12 bp, Homo sapiens
ctcaaccactgt

SEQ ID NO: 2108676 - DNA, 18 bp, Homo sapiens
ctcaaccccaccacttct

SEQ ID NO: 2108677 - DNA, 23 bp, Homo sapiens
ctcaacctaccaccccttcctgt

SEQ ID NO: 2108678 - DNA, 13 bp, Homo sapiens
ctcaacctcctgg

SEQ ID NO: 2108679 - DNA, 15 bp, Homo sapiens
ctcaacctcctgggc

SEQ ID NO: 2108680 - DNA, 15 bp, Homo sapiens
ctcaacctctctcct

SEQ ID NO: 2108681 - DNA, 16 bp, Homo sapiens
ctcaacctctctcctt

SEQ ID NO: 2108682 - DNA, 20 bp, Homo sapiens
ctcaacctctctccttctgg

SEQ ID NO: 2108683 - DNA, 19 bp, Homo sapiens
ctcaactaacccttaaaaa

SEQ ID NO: 2108684 - DNA, 15 bp, Homo sapiens
ctcaactactcagct

SEQ ID NO: 2108685 - DNA, 21 bp, Homo sapiens
ctcaactggacatcacagcag

SEQ ID NO: 2108686 - DNA, 19 bp, Homo sapiens
ctcaagaagacatggagac

SEQ ID NO: 2108687 - DNA, 21 bp, Homo sapiens
ctcaagaagacatggagactc

SEQ ID NO: 2108688 - DNA, 16 bp, Homo sapiens
ctcaagaggctgaggc

SEQ ID NO: 2108689 - DNA, 17 bp, Homo sapiens
ctcaagaggctgaggca

SEQ ID NO: 2108690 - DNA, 16 bp, Homo sapiens
ctcaagatgacagctc

SEQ ID NO: 2108691 - DNA, 17 bp, Homo sapiens
ctcaagctagccagagg

SEQ ID NO: 2108692 - DNA, 16 bp, Homo sapiens
ctccatgctgcctcca

SEQ ID NO: 2108693 - DNA, 17 bp, Homo sapiens
ctccatgctgcctccag

SEQ ID NO: 2108694 - DNA, 10 bp, Homo sapiens
ctccatggag

SEQ ID NO: 2108695 - DNA, 13 bp, Homo sapiens
ctccatggaggag

SEQ ID NO: 2108696 - DNA, 16 bp, Homo sapiens
ctccatggaggaggtg

SEQ ID NO: 2108697 - DNA, 16 bp, Homo sapiens
ctccatggccaccccg

SEQ ID NO: 2108698 - DNA, 21 bp, Homo sapiens
ctccatggccaccccgtgcca

SEQ ID NO: 2108699 - DNA, 21 bp, Homo sapiens
ctccatggggaagtgctcccc

SEQ ID NO: 2108700 - DNA, 13 bp, Homo sapiens
ctccatgtggccc

SEQ ID NO: 2108701 - DNA, 21 bp, Homo sapiens
ctccatgtggccccaggtgcc

SEQ ID NO: 2108702 - DNA, 22 bp, Homo sapiens
ctccattaggatttgccccttc

SEQ ID NO: 2108703 - DNA, 15 bp, Homo sapiens
ctccattccagtctc

SEQ ID NO: 2108704 - DNA, 20 bp, Homo sapiens
ctccattctgaccatttcag

SEQ ID NO: 2108705 - DNA, 18 bp, Homo sapiens
ctccatttcaactccaga

SEQ ID NO: 2108706 - DNA, 19 bp, Homo sapiens
ctccatttcaactccagaa

SEQ ID NO: 2108707 - DNA, 13 bp, Homo sapiens
ctccatttcacac

SEQ ID NO: 2108708 - DNA, 17 bp, Homo sapiens
ctccatttctggcttct

SEQ ID NO: 2108709 - DNA, 16 bp, Homo sapiens
ctcccaaagtgctggg

SEQ ID NO: 2108710 - DNA, 18 bp, Homo sapiens
ctcccaaagtgctgggat

SEQ ID NO: 2108711 - DNA, 22 bp, Homo sapiens
ctcccaacccaattcaggactg

SEQ ID NO: 2108712 - DNA, 22 bp, Homo sapiens
ctcccaacctcaatgccctgcc

SEQ ID NO: 2108713 - DNA, 24 bp, Homo sapiens
ctcccaacctcaatgccctgccat

SEQ ID NO: 2108714 - DNA, 18 bp, Homo sapiens
ctcccaaggactttccag

SEQ ID NO: 2108715 - DNA, 20 bp, Homo sapiens
ctcccaaggactttccagtg

SEQ ID NO: 2108716 - DNA, 22 bp, Homo sapiens
ctcccaaggactttccagtgag

SEQ ID NO: 2108717 - DNA, 15 bp, Homo sapiens
ctcccaataaagctg

SEQ ID NO: 2108718 - DNA, 16 bp, Homo sapiens
ctcccaataaagctgg

SEQ ID NO: 2108719 - DNA, 14 bp, Homo sapiens
ctcccacaatctgg

SEQ ID NO: 2108720 - DNA, 23 bp, Homo sapiens
ctcccacaatctgggactttcac

SEQ ID NO: 2108721 - DNA, 18 bp, Homo sapiens
ctcccacagcctggctat

SEQ ID NO: 2108722 - DNA, 22 bp, Homo sapiens
ctcccaccaccctcccaccatg

SEQ ID NO: 2108723 - DNA, 14 bp, Homo sapiens
ctcccaccaggcta

SEQ ID NO: 2108724 - DNA, 11 bp, Homo sapiens
ctcccacccca

SEQ ID NO: 2108725 - DNA, 14 bp, Homo sapiens
ctcccaccccactc

SEQ ID NO: 2108726 - DNA, 18 bp, Homo sapiens
ctcccaccccactccagc

SEQ ID NO: 2108727 - DNA, 11 bp, Homo sapiens
ctcccaccccc

SEQ ID NO: 2108728 - DNA, 14 bp, Homo sapiens
ctcccacccccagc

SEQ ID NO: 2108729 - DNA, 18 bp, Homo sapiens
ctcccaccccggcctcca

SEQ ID NO: 2108730 - DNA, 12 bp, Homo sapiens
ctcccacctcag

SEQ ID NO: 2108731 - DNA, 14 bp, Homo sapiens
ctcccactgagttt

SEQ ID NO: 2108732 - DNA, 17 bp, Homo sapiens
ctcccagagtgctagga

SEQ ID NO: 2108733 - DNA, 16 bp, Homo sapiens
ctcccagatgctgggg

SEQ ID NO: 2108734 - DNA, 19 bp, Homo sapiens
ctcccagcagccctaagga

SEQ ID NO: 2108735 - DNA, 19 bp, Homo sapiens
ctcccagccctatggatgt

SEQ ID NO: 2108736 - DNA, 21 bp, Homo sapiens
ctcccagccctatggatgtgg

SEQ ID NO: 2108737 - DNA, 18 bp, Homo sapiens
ctcccagccctgccagga

SEQ ID NO: 2108738 - DNA, 18 bp, Homo sapiens
ctcccaggaactgggcca

SEQ ID NO: 2108739 - DNA, 12 bp, Homo sapiens
ctcccaggcccc

SEQ ID NO: 2108740 - DNA, 21 bp, Homo sapiens
ctcccaggccccatgacctcc

SEQ ID NO: 2108741 - DNA, 14 bp, Homo sapiens
ctcccaggcgcccc

SEQ ID NO: 2108742 - DNA, 19 bp, Homo sapiens
ctcccaggcgccccttccc

SEQ ID NO: 2108743 - DNA, 16 bp, Homo sapiens
ctcccagggccagggc

SEQ ID NO: 2108744 - DNA, 23 bp, Homo sapiens
ctcccagggccagggccctgcag

SEQ ID NO: 2108745 - DNA, 17 bp, Homo sapiens
ctcccagtcatttaata

SEQ ID NO: 2108746 - DNA, 20 bp, Homo sapiens
ctcccatagcgctggctcag

SEQ ID NO: 2108747 - DNA, 23 bp, Homo sapiens
ctcccatagcgctggctcaggaa

SEQ ID NO: 2108748 - DNA, 13 bp, Homo sapiens
ctcccatcccctg

SEQ ID NO: 2108749 - DNA, 14 bp, Homo sapiens
ctcccatctcctga

SEQ ID NO: 2108750 - DNA, 14 bp, Homo sapiens
ctcccatttcctga

SEQ ID NO: 2108751 - DNA, 22 bp, Homo sapiens
ctccccaaaacctttccccaga

SEQ ID NO: 2108752 - DNA, 17 bp, Homo sapiens
ctccccaaacccatcag

SEQ ID NO: 2108753 - DNA, 21 bp, Homo sapiens
ctccccacagtcctcacagcc

SEQ ID NO: 2108754 - DNA, 13 bp, Homo sapiens
ctccccacccccc

SEQ ID NO: 2108755 - DNA, 16 bp, Homo sapiens
ctccccacccccgctg

SEQ ID NO: 2108756 - DNA, 19 bp, Homo sapiens
ctccccacccccgctgggg

SEQ ID NO: 2108757 - DNA, 23 bp, Homo sapiens
ctccccacccccgctgggggtgg

SEQ ID NO: 2108758 - DNA, 21 bp, Homo sapiens
ctccccaccttcaattcctgg

SEQ ID NO: 2108759 - DNA, 24 bp, Homo sapiens
ctccccacgagtcacctgcaagcc

SEQ ID NO: 2108760 - DNA, 13 bp, Homo sapiens
ctccccactctgc

SEQ ID NO: 2108761 - DNA, 17 bp, Homo sapiens
ctccccactctgctctg

SEQ ID NO: 2108762 - DNA, 20 bp, Homo sapiens
ctccccactctgctctgatg

SEQ ID NO: 2108763 - DNA, 20 bp, Homo sapiens
ctccccactgaaaacatttc

SEQ ID NO: 2108764 - DNA, 13 bp, Homo sapiens
ctccccaggactc

SEQ ID NO: 2108765 - DNA, 15 bp, Homo sapiens
ctccccaggccaggc

SEQ ID NO: 2108766 - DNA, 17 bp, Homo sapiens
ctccccaggccaggcca

SEQ ID NO: 2108767 - DNA, 12 bp, Homo sapiens
ctccccaggcct

SEQ ID NO: 2108768 - DNA, 18 bp, Homo sapiens
ccgctaaaagaaactttc

SEQ ID NO: 2108769 - DNA, 18 bp, Homo sapiens
ccgctaagacctccccac

SEQ ID NO: 2108770 - DNA, 12 bp, Homo sapiens
ccgctcagccct

SEQ ID NO: 2108771 - DNA, 21 bp, Homo sapiens
ccgctcagccctccctgcccc

SEQ ID NO: 2108772 - DNA, 13 bp, Homo sapiens
ccgctccagatct

SEQ ID NO: 2108773 - DNA, 21 bp, Homo sapiens
ccgctcctttacctaccacct

SEQ ID NO: 2108774 - DNA, 13 bp, Homo sapiens
ccgctgcaccacg

SEQ ID NO: 2108775 - DNA, 15 bp, Homo sapiens
ccgctgcaccacggc

SEQ ID NO: 2108776 - DNA, 13 bp, Homo sapiens
ccgctgccccagc

SEQ ID NO: 2108777 - DNA, 18 bp, Homo sapiens
ccgctgccgctgcaccac

SEQ ID NO: 2108778 - DNA, 19 bp, Homo sapiens
ccgctgcctaagtggctgc

SEQ ID NO: 2108779 - DNA, 11 bp, Homo sapiens
ccgctggccca

SEQ ID NO: 2108780 - DNA, 13 bp, Homo sapiens
ccgctggcccagg

SEQ ID NO: 2108781 - DNA, 14 bp, Homo sapiens
ccgctggcccaggg

SEQ ID NO: 2108782 - DNA, 15 bp, Homo sapiens
ccgctggcccagggt

SEQ ID NO: 2108783 - DNA, 17 bp, Homo sapiens
ccgctggcccagggtag

SEQ ID NO: 2108784 - DNA, 16 bp, Homo sapiens
ccgctggctcctccag

SEQ ID NO: 2108785 - DNA, 22 bp, Homo sapiens
ccgctggtgcctcccgggacga

SEQ ID NO: 2108786 - DNA, 22 bp, Homo sapiens
ccgctgtcgccccaggccctcc

SEQ ID NO: 2108787 - DNA, 18 bp, Homo sapiens
ccgctgtgagcccctggt

SEQ ID NO: 2108788 - DNA, 19 bp, Homo sapiens
ccgctgtgagcccctggtc

SEQ ID NO: 2108789 - DNA, 20 bp, Homo sapiens
ccgctgtgagcccctggtcc

SEQ ID NO: 2108790 - DNA, 18 bp, Homo sapiens
ccgctgttcacccacagg

SEQ ID NO: 2108791 - DNA, 17 bp, Homo sapiens
ccgcttcacccctgcac

SEQ ID NO: 2108792 - DNA, 18 bp, Homo sapiens
ccgcttcacccctgcact

SEQ ID NO: 2108793 - DNA, 16 bp, Homo sapiens
ccgcttccccacagaa

SEQ ID NO: 2108794 - DNA, 19 bp, Homo sapiens
ccgcttccccacagaactg

SEQ ID NO: 2108795 - DNA, 13 bp, Homo sapiens
ccgcttcctgttt

SEQ ID NO: 2108796 - DNA, 19 bp, Homo sapiens
ccgcttgtccagcgcctag

SEQ ID NO: 2108797 - DNA, 21 bp, Homo sapiens
ccggacctgtggggccccaga

SEQ ID NO: 2108798 - DNA, 20 bp, Homo sapiens
ccggactcaagccccggact

SEQ ID NO: 2108799 - DNA, 20 bp, Homo sapiens
ccggactgcaagcagggctc

SEQ ID NO: 2108800 - DNA, 16 bp, Homo sapiens
ccggagcacagccctg

SEQ ID NO: 2108801 - DNA, 19 bp, Homo sapiens
ccggagcaggggtctgagc

SEQ ID NO: 2108802 - DNA, 20 bp, Homo sapiens
ccggagcaggggtctgagcc

SEQ ID NO: 2108803 - DNA, 15 bp, Homo sapiens
ccggagctttcaaag

SEQ ID NO: 2108804 - DNA, 15 bp, Homo sapiens
ccggaggggcctggc

SEQ ID NO: 2108805 - DNA, 17 bp, Homo sapiens
ccggaggtagaggttgt

SEQ ID NO: 2108806 - DNA, 18 bp, Homo sapiens
ccggagtaatcaggcagc

SEQ ID NO: 2108807 - DNA, 14 bp, Homo sapiens
ccggcacacaaggc

SEQ ID NO: 2108808 - DNA, 21 bp, Homo sapiens
ccggcaccccctgcagcttgt

SEQ ID NO: 2108809 - DNA, 13 bp, Homo sapiens
ccggcacctgcga

SEQ ID NO: 2108810 - DNA, 15 bp, Homo sapiens
ccggcacctgcgaga

SEQ ID NO: 2108811 - DNA, 13 bp, Homo sapiens
ccggcatgctggc

SEQ ID NO: 2108812 - DNA, 18 bp, Homo sapiens
ccggccagggcctggtgt

SEQ ID NO: 2108813 - DNA, 18 bp, Homo sapiens
ccggccccatcagaggct

SEQ ID NO: 2108814 - DNA, 18 bp, Homo sapiens
ccggcctcttccacccat

SEQ ID NO: 2108815 - DNA, 13 bp, Homo sapiens
ccggctccaggct

SEQ ID NO: 2108816 - DNA, 15 bp, Homo sapiens
ccggctccaggctcc

SEQ ID NO: 2108817 - DNA, 15 bp, Homo sapiens
ccggctccagtttcc

SEQ ID NO: 2108818 - DNA, 12 bp, Homo sapiens
ccggctctgcct

SEQ ID NO: 2108819 - DNA, 13 bp, Homo sapiens
ccggctgcctgcc

SEQ ID NO: 2108820 - DNA, 14 bp, Homo sapiens
ccgggaataacatg

SEQ ID NO: 2108821 - DNA, 16 bp, Homo sapiens
ccgggacagacctgga

SEQ ID NO: 2108822 - DNA, 18 bp, Homo sapiens
ccgggacagacctggaca

SEQ ID NO: 2108823 - DNA, 14 bp, Homo sapiens
ccgggacgcttcca

SEQ ID NO: 2108824 - DNA, 15 bp, Homo sapiens
ccgggacgcttccag

SEQ ID NO: 2108825 - DNA, 18 bp, Homo sapiens
ccgggagcctccccctca

SEQ ID NO: 2108826 - DNA, 19 bp, Homo sapiens
ccgggagcctccccctcag

SEQ ID NO: 2108827 - DNA, 22 bp, Homo sapiens
ccgggagcctccccctcagatg

SEQ ID NO: 2108828 - DNA, 22 bp, Homo sapiens
ccgggcatggtggcgcaagcct

SEQ ID NO: 2108829 - DNA, 13 bp, Homo sapiens
ccgggccacagag

SEQ ID NO: 2108830 - DNA, 19 bp, Homo sapiens
ccgggccactccttcctgc

SEQ ID NO: 2108831 - DNA, 20 bp, Homo sapiens
ccgggccactccttcctgcc

SEQ ID NO: 2108832 - DNA, 21 bp, Homo sapiens
ccgggccctccttgcctgttt

SEQ ID NO: 2108833 - DNA, 13 bp, Homo sapiens
ccgggcctgcctc

SEQ ID NO: 2108834 - DNA, 15 bp, Homo sapiens
ccgggctctggccac

SEQ ID NO: 2108835 - DNA, 19 bp, Homo sapiens
ccgggctgcccttcgctgc

SEQ ID NO: 2108836 - DNA, 22 bp, Homo sapiens
ccgagtctcttctccactggat

SEQ ID NO: 2108837 - DNA, 14 bp, Homo sapiens
ccgattaatttatg

SEQ ID NO: 2108838 - DNA, 13 bp, Homo sapiens
ccgcaaggccctg

SEQ ID NO: 2108839 - DNA, 14 bp, Homo sapiens
ccgcaaggccctgt

SEQ ID NO: 2108840 - DNA, 22 bp, Homo sapiens
ccgcaagttcagggaagcaggc

SEQ ID NO: 2108841 - DNA, 23 bp, Homo sapiens
ccgcaagttcagggaagcaggca

SEQ ID NO: 2108842 - DNA, 15 bp, Homo sapiens
ccgcaccagctgctc

SEQ ID NO: 2108843 - DNA, 13 bp, Homo sapiens
ccgcaccccagag

SEQ ID NO: 2108844 - DNA, 15 bp, Homo sapiens
ccgcagaaggaaggc

SEQ ID NO: 2108845 - DNA, 11 bp, Homo sapiens
ccgcagcaccc

SEQ ID NO: 2108846 - DNA, 21 bp, Homo sapiens
ccgcagccagccggtgcctgg

SEQ ID NO: 2108847 - DNA, 11 bp, Homo sapiens
ccgcagcccag

SEQ ID NO: 2108848 - DNA, 20 bp, Homo sapiens
ccgcagcccgtgaagcagtg

SEQ ID NO: 2108849 - DNA, 23 bp, Homo sapiens
ccgcagcccgtgaagcagtgcct

SEQ ID NO: 2108850 - DNA, 14 bp, Homo sapiens
ccgcagcctccctc

SEQ ID NO: 2108851 - DNA, 14 bp, Homo sapiens
ccgcaggaaggcag

SEQ ID NO: 2108852 - DNA, 17 bp, Homo sapiens
ccgcagggacagaactg

SEQ ID NO: 2108853 - DNA, 16 bp, Homo sapiens
ccgcagtccccagccc

SEQ ID NO: 2108854 - DNA, 19 bp, Homo sapiens
ccgcagtgcccccacccag

SEQ ID NO: 2108855 - DNA, 12 bp, Homo sapiens
ccgcatcttctc

SEQ ID NO: 2108856 - DNA, 19 bp, Homo sapiens
ccgcatcttctccatctgg

SEQ ID NO: 2108857 - DNA, 23 bp, Homo sapiens
ccgcattccctgagtcaccagga

SEQ ID NO: 2108858 - DNA, 12 bp, Homo sapiens
ccgccacggcca

SEQ ID NO: 2108859 - DNA, 12 bp, Homo sapiens
ccgccagcctca

SEQ ID NO: 2108860 - DNA, 18 bp, Homo sapiens
ccgccagcctcagtgcca

SEQ ID NO: 2108861 - DNA, 19 bp, Homo sapiens
ccgccatacattaaggagc

SEQ ID NO: 2108862 - DNA, 18 bp, Homo sapiens
ccgccatccgggacgctt

SEQ ID NO: 2108863 - DNA, 23 bp, Homo sapiens
ccgccatccgggacgcttccaga

SEQ ID NO: 2108864 - DNA, 14 bp, Homo sapiens
ccgccatccttcac

SEQ ID NO: 2108865 - DNA, 23 bp, Homo sapiens
ccgcccaaagagaaatcacaggg

SEQ ID NO: 2108866 - DNA, 16 bp, Homo sapiens
ccgcccaaggctgcag

SEQ ID NO: 2108867 - DNA, 20 bp, Homo sapiens
ccgccctgggctgtctgtca

SEQ ID NO: 2108868 - DNA, 23 bp, Homo sapiens
ccgcctcaatgtggttgcaaggc

SEQ ID NO: 2108869 - DNA, 15 bp, Homo sapiens
ccgcctcccagcccc

SEQ ID NO: 2108870 - DNA, 14 bp, Homo sapiens
ccgcctctgcccgc

SEQ ID NO: 2108871 - DNA, 18 bp, Homo sapiens
ccgcctctgcccgcagag

SEQ ID NO: 2108872 - DNA, 18 bp, Homo sapiens
ccgcctggccggctccag

SEQ ID NO: 2108873 - DNA, 18 bp, Homo sapiens
ccgcctgtcctgcctctc

SEQ ID NO: 2108874 - DNA, 12 bp, Homo sapiens
ccgcctgtgccc

SEQ ID NO: 2108875 - DNA, 16 bp, Homo sapiens
ccgccttcctcctcca

SEQ ID NO: 2108876 - DNA, 16 bp, Homo sapiens
ccgcgcctccttcctt

SEQ ID NO: 2108877 - DNA, 17 bp, Homo sapiens
ccgcggtgctctggcgg

SEQ ID NO: 2108878 - DNA, 17 bp, Homo sapiens
ccgcgtctaccctggga

SEQ ID NO: 2108879 - DNA, 15 bp, Homo sapiens
cccgagcagctgagc

SEQ ID NO: 2108880 - DNA, 22 bp, Homo sapiens
cccgagcagctgagcagggccg

SEQ ID NO: 2108881 - DNA, 13 bp, Homo sapiens
cccgagcccagct

SEQ ID NO: 2108882 - DNA, 14 bp, Homo sapiens
cccgagtagctggg

SEQ ID NO: 2108883 - DNA, 15 bp, Homo sapiens
cccgagtagctggga

SEQ ID NO: 2108884 - DNA, 18 bp, Homo sapiens
cccgagtagctgggacta

SEQ ID NO: 2108885 - DNA, 21 bp, Homo sapiens
cccgagtagctgggactacag

SEQ ID NO: 2108886 - DNA, 19 bp, Homo sapiens
cccgcaccccccaagctgt

SEQ ID NO: 2108887 - DNA, 14 bp, Homo sapiens
cccgcagtccccag

SEQ ID NO: 2108888 - DNA, 11 bp, Homo sapiens
cccgcagtgcc

SEQ ID NO: 2108889 - DNA, 15 bp, Homo sapiens
cccgccacggccacc

SEQ ID NO: 2108890 - DNA, 13 bp, Homo sapiens
cccgcccaaggct

SEQ ID NO: 2108891 - DNA, 19 bp, Homo sapiens
cccgcccctcgctgctgct

SEQ ID NO: 2108892 - DNA, 22 bp, Homo sapiens
cccgcccctcgctgctgctact

SEQ ID NO: 2108893 - DNA, 23 bp, Homo sapiens
cccgccttcctcctccacagtgc

SEQ ID NO: 2108894 - DNA, 15 bp, Homo sapiens
cccgcgcctccttcc

SEQ ID NO: 2108895 - DNA, 16 bp, Homo sapiens
cccgcgggcctggaca

SEQ ID NO: 2108896 - DNA, 15 bp, Homo sapiens
cccgcggtgctctgg

SEQ ID NO: 2108897 - DNA, 12 bp, Homo sapiens
cccgctcagccc

SEQ ID NO: 2108898 - DNA, 13 bp, Homo sapiens
cccgctcagccct

SEQ ID NO: 2108899 - DNA, 20 bp, Homo sapiens
cccgctcctcccctcttgag

SEQ ID NO: 2108900 - DNA, 14 bp, Homo sapiens
cccgctctggacca

SEQ ID NO: 2108901 - DNA, 21 bp, Homo sapiens
cccgctggcagccaccccctc

SEQ ID NO: 2108902 - DNA, 14 bp, Homo sapiens
cccgctggctcctc

SEQ ID NO: 2108903 - DNA, 16 bp, Homo sapiens
cccgctggctcctcca

SEQ ID NO: 2108904 - DNA, 21 bp, Homo sapiens
cccgctgggatttcttcgctg

SEQ ID NO: 2108905 - DNA, 12 bp, Homo sapiens
cccgcttcccca

SEQ ID NO: 2108906 - DNA, 14 bp, Homo sapiens
cctcactctgtcag

SEQ ID NO: 2108907 - DNA, 15 bp, Homo sapiens
cctcactctgtcagc

SEQ ID NO: 2108908 - DNA, 16 bp, Homo sapiens
cctcactctgtcagcc

SEQ ID NO: 2108909 - DNA, 22 bp, Homo sapiens
cctcactctgtcagccagccgc

SEQ ID NO: 2108910 - DNA, 20 bp, Homo sapiens
cctcactgccccaccagcca

SEQ ID NO: 2108911 - DNA, 16 bp, Homo sapiens
cctcactgccttccag

SEQ ID NO: 2108912 - DNA, 14 bp, Homo sapiens
cctcactggctggg

SEQ ID NO: 2108913 - DNA, 15 bp, Homo sapiens
cctcacttccctggg

SEQ ID NO: 2108914 - DNA, 18 bp, Homo sapiens
cctcacttccctgggaac

SEQ ID NO: 2108915 - DNA, 18 bp, Homo sapiens
cctcagacaatccactct

SEQ ID NO: 2108916 - DNA, 14 bp, Homo sapiens
cctcagaccaactc

SEQ ID NO: 2108917 - DNA, 18 bp, Homo sapiens
cctcagaccaactctctc

SEQ ID NO: 2108918 - DNA, 20 bp, Homo sapiens
cctcagaccaactctctcct

SEQ ID NO: 2108919 - DNA, 15 bp, Homo sapiens
cctcagactgctcaa

SEQ ID NO: 2108920 - DNA, 12 bp, Homo sapiens
cctcagagaggc

SEQ ID NO: 2108921 - DNA, 15 bp, Homo sapiens
cctcagagcaggctc

SEQ ID NO: 2108922 - DNA, 15 bp, Homo sapiens
cctcagaggcagcag

SEQ ID NO: 2108923 - DNA, 21 bp, Homo sapiens
cctcagaggcagcaggaggct

SEQ ID NO: 2108924 - DNA, 15 bp, Homo sapiens
cctcagcaggaacct

SEQ ID NO: 2108925 - DNA, 21 bp, Homo sapiens
cctcagcaggaacctgtactg

SEQ ID NO: 2108926 - DNA, 14 bp, Homo sapiens
cctcagcatcctgg

SEQ ID NO: 2108927 - DNA, 22 bp, Homo sapiens
cctcagccaaacacagagcggg

SEQ ID NO: 2108928 - DNA, 21 bp, Homo sapiens
cctcagccatgaggagttgct

SEQ ID NO: 2108929 - DNA, 11 bp, Homo sapiens
cctcagccctc

SEQ ID NO: 2108930 - DNA, 13 bp, Homo sapiens
cctcagcccttgc

SEQ ID NO: 2108931 - DNA, 17 bp, Homo sapiens
cctcagcccttgccccc

SEQ ID NO: 2108932 - DNA, 23 bp, Homo sapiens
cctcagccgactgcacagcggcc

SEQ ID NO: 2108933 - DNA, 22 bp, Homo sapiens
cctcagcctcccaaagtgctgg

SEQ ID NO: 2108934 - DNA, 23 bp, Homo sapiens
cctcagcctcccaaagtgctggg

SEQ ID NO: 2108935 - DNA, 17 bp, Homo sapiens
cctcagctcagcctccc

SEQ ID NO: 2108936 - DNA, 14 bp, Homo sapiens
cctcagctgcacat

SEQ ID NO: 2108937 - DNA, 19 bp, Homo sapiens
cctcagctgcacattcctg

SEQ ID NO: 2108938 - DNA, 16 bp, Homo sapiens
cctcaggatttcattg

SEQ ID NO: 2108939 - DNA, 21 bp, Homo sapiens
cctcaggcagaggatgttctg

SEQ ID NO: 2108940 - DNA, 22 bp, Homo sapiens
cctcaggcagaggatgttctgg

SEQ ID NO: 2108941 - DNA, 12 bp, Homo sapiens
cctcaggccagt

SEQ ID NO: 2108942 - DNA, 17 bp, Homo sapiens
cctcaggccagtgccag

SEQ ID NO: 2108943 - DNA, 20 bp, Homo sapiens
cctcaggccagtgccaggac

SEQ ID NO: 2108944 - DNA, 16 bp, Homo sapiens
cctcagggacaacatt

SEQ ID NO: 2108945 - DNA, 16 bp, Homo sapiens
cctcaggggtggagaa

SEQ ID NO: 2108946 - DNA, 17 bp, Homo sapiens
cctcaggggtggagaag

SEQ ID NO: 2108947 - DNA, 19 bp, Homo sapiens
cctcaggtgatccacccac

SEQ ID NO: 2108948 - DNA, 15 bp, Homo sapiens
cctcagtcagttccc

SEQ ID NO: 2108949 - DNA, 20 bp, Homo sapiens
cctcagtcagttcccggagc

SEQ ID NO: 2108950 - DNA, 22 bp, Homo sapiens
cctcagtcagttcccggagcac

SEQ ID NO: 2108951 - DNA, 23 bp, Homo sapiens
cctcagtcagttcccggagcaca

SEQ ID NO: 2108952 - DNA, 13 bp, Homo sapiens
cctcagtgccact

SEQ ID NO: 2108953 - DNA, 14 bp, Homo sapiens
cctcagtgccactt

SEQ ID NO: 2108954 - DNA, 22 bp, Homo sapiens
cctcagtgccacttgacattcc

SEQ ID NO: 2108955 - DNA, 23 bp, Homo sapiens
cctcagtgccacttgacattcct

SEQ ID NO: 2108956 - DNA, 15 bp, Homo sapiens
cctcagttcaacctg

SEQ ID NO: 2108957 - DNA, 11 bp, Homo sapiens
cctcagtttcc

SEQ ID NO: 2108958 - DNA, 22 bp, Homo sapiens
cctcagtttcctcatctgcaga

SEQ ID NO: 2108959 - DNA, 14 bp, Homo sapiens
cctcataccatctg

SEQ ID NO: 2108960 - DNA, 20 bp, Homo sapiens
cctcatagtatggtggctgg

SEQ ID NO: 2108961 - DNA, 22 bp, Homo sapiens
cctcatagtatggtggctgggt

SEQ ID NO: 2108962 - DNA, 17 bp, Homo sapiens
cctcatatcttcctcat

SEQ ID NO: 2108963 - DNA, 18 bp, Homo sapiens
cctcatatcttcctcatc

SEQ ID NO: 2108964 - DNA, 20 bp, Homo sapiens
cctcatatcttcctcatcag

SEQ ID NO: 2108965 - DNA, 12 bp, Homo sapiens
cctcatatttaa

SEQ ID NO: 2108966 - DNA, 13 bp, Homo sapiens
cctaccaatgcat

SEQ ID NO: 2108967 - DNA, 16 bp, Homo sapiens
cctaccacagtgtctg

SEQ ID NO: 2108968 - DNA, 17 bp, Homo sapiens
cctaccaccccttcctg

SEQ ID NO: 2108969 - DNA, 18 bp, Homo sapiens
cctaccaccccttcctgt

SEQ ID NO: 2108970 - DNA, 14 bp, Homo sapiens
cctaccatgctgct

SEQ ID NO: 2108971 - DNA, 11 bp, Homo sapiens
cctaccccacc

SEQ ID NO: 2108972 - DNA, 19 bp, Homo sapiens
cctaccccacctcatgcct

SEQ ID NO: 2108973 - DNA, 20 bp, Homo sapiens
cctaccccacctcatgcctg

SEQ ID NO: 2108974 - DNA, 17 bp, Homo sapiens
cctacccttgtacccca

SEQ ID NO: 2108975 - DNA, 22 bp, Homo sapiens
cctaccgagtctcttctccact

SEQ ID NO: 2108976 - DNA, 18 bp, Homo sapiens
cctacctcagcctagacc

SEQ ID NO: 2108977 - DNA, 21 bp, Homo sapiens
cctacctcagcctagaccctc

SEQ ID NO: 2108978 - DNA, 12 bp, Homo sapiens
cctacctgctgc

SEQ ID NO: 2108979 - DNA, 17 bp, Homo sapiens
cctactactttgtgttt

SEQ ID NO: 2108980 - DNA, 21 bp, Homo sapiens
cctactagttttccttgaaaa

SEQ ID NO: 2108981 - DNA, 14 bp, Homo sapiens
cctactcacacagg

SEQ ID NO: 2108982 - DNA, 15 bp, Homo sapiens
cctactcacacaggc

SEQ ID NO: 2108983 - DNA, 14 bp, Homo sapiens
cctactcccctggg

SEQ ID NO: 2108984 - DNA, 21 bp, Homo sapiens
cctagaaccaagcttcagagc

SEQ ID NO: 2108985 - DNA, 22 bp, Homo sapiens
cctagaaccaagcttcagagcc

SEQ ID NO: 2108986 - DNA, 14 bp, Homo sapiens
cctagaacttcaaa

SEQ ID NO: 2108987 - DNA, 20 bp, Homo sapiens
cctagaagagtcaggaaggg

SEQ ID NO: 2108988 - DNA, 20 bp, Homo sapiens
cctagacctgggccaaaagg

SEQ ID NO: 2108989 - DNA, 22 bp, Homo sapiens
cctagacctgggccaaaagggc

SEQ ID NO: 2108990 - DNA, 23 bp, Homo sapiens
cctagagagcagaaataaaaagc

SEQ ID NO: 2108991 - DNA, 13 bp, Homo sapiens
cctagagctcctg

SEQ ID NO: 2108992 - DNA, 22 bp, Homo sapiens
cctagagctcctgtccctaccc

SEQ ID NO: 2108993 - DNA, 21 bp, Homo sapiens
cctagaggcaaacatttctta

SEQ ID NO: 2108994 - DNA, 16 bp, Homo sapiens
cctagaggtgggcagc

SEQ ID NO: 2108995 - DNA, 17 bp, Homo sapiens
cctagaggtgggcagct

SEQ ID NO: 2108996 - DNA, 19 bp, Homo sapiens
cctagaggtgggcagctgg

SEQ ID NO: 2108997 - DNA, 13 bp, Homo sapiens
cctagcaattcca

SEQ ID NO: 2108998 - DNA, 14 bp, Homo sapiens
cctagcaggcacag

SEQ ID NO: 2108999 - DNA, 16 bp, Homo sapiens
cctagcaggcacagga

SEQ ID NO: 2109000 - DNA, 17 bp, Homo sapiens
cctagcaggcacaggac

SEQ ID NO: 2109001 - DNA, 19 bp, Homo sapiens
cctagccacctcccacccc

SEQ ID NO: 2109002 - DNA, 21 bp, Homo sapiens
cctagccacctcccaccccac

SEQ ID NO: 2109003 - DNA, 12 bp, Homo sapiens
cctagcccagtg

SEQ ID NO: 2109004 - DNA, 17 bp, Homo sapiens
cctagcccagtgcttct

SEQ ID NO: 2109005 - DNA, 20 bp, Homo sapiens
cctagccctctcacatttat

SEQ ID NO: 2109006 - DNA, 17 bp, Homo sapiens
cctagccgacctcagcc

SEQ ID NO: 2109007 - DNA, 11 bp, Homo sapiens
cctaggacctc

SEQ ID NO: 2109008 - DNA, 20 bp, Homo sapiens
cctaggagaagcagcctcct

SEQ ID NO: 2109009 - DNA, 22 bp, Homo sapiens
cctaggccaaatgcacaagctc

SEQ ID NO: 2109010 - DNA, 15 bp, Homo sapiens
cctaggctccacccc

SEQ ID NO: 2109011 - DNA, 14 bp, Homo sapiens
cctagggaaaagtt

SEQ ID NO: 2109012 - DNA, 13 bp, Homo sapiens
cctaggtgctgga

SEQ ID NO: 2109013 - DNA, 16 bp, Homo sapiens
cctaggtgctggatgc

SEQ ID NO: 2109014 - DNA, 19 bp, Homo sapiens
cctagtactctctgctcta

SEQ ID NO: 2109015 - DNA, 20 bp, Homo sapiens
cctagtactctctgctctag

SEQ ID NO: 2109016 - DNA, 22 bp, Homo sapiens
cctagtactctctgctctagcc

SEQ ID NO: 2109017 - DNA, 23 bp, Homo sapiens
cctagtactctctgctctagcca

SEQ ID NO: 2109018 - DNA, 20 bp, Homo sapiens
cctagtgctattctgtgttg

SEQ ID NO: 2109019 - DNA, 23 bp, Homo sapiens
cctagtgctattctgtgttgaac

SEQ ID NO: 2109020 - DNA, 18 bp, Homo sapiens
cctagtggggtctccctc

SEQ ID NO: 2109021 - DNA, 24 bp, Homo sapiens
cctagtggggtctccctctcctgc

SEQ ID NO: 2109022 - DNA, 16 bp, Homo sapiens
cccagtttcccttcta

SEQ ID NO: 2109023 - DNA, 16 bp, Homo sapiens
cccagtttgcagaaaa

SEQ ID NO: 2109024 - DNA, 22 bp, Homo sapiens
cccagtttgcagaaaagcacct

SEQ ID NO: 2109025 - DNA, 22 bp, Homo sapiens
cccagtttggctggttaattcc

SEQ ID NO: 2109026 - DNA, 16 bp, Homo sapiens
cccatacccctgcctg

SEQ ID NO: 2109027 - DNA, 16 bp, Homo sapiens
cccatagcgctggctc

SEQ ID NO: 2109028 - DNA, 23 bp, Homo sapiens
cccatattggcatggatttctgt

SEQ ID NO: 2109029 - DNA, 16 bp, Homo sapiens
cccatatttcatcgtg

SEQ ID NO: 2109030 - DNA, 20 bp, Homo sapiens
cccatcacctactcacacag

SEQ ID NO: 2109031 - DNA, 20 bp, Homo sapiens
cccatcactggagcaccagg

SEQ ID NO: 2109032 - DNA, 14 bp, Homo sapiens
cccatcagaaggag

SEQ ID NO: 2109033 - DNA, 18 bp, Homo sapiens
cccatcagaggctggggg

SEQ ID NO: 2109034 - DNA, 14 bp, Homo sapiens
cccatccagttcat

SEQ ID NO: 2109035 - DNA, 17 bp, Homo sapiens
cccatccatcagctccc

SEQ ID NO: 2109036 - DNA, 14 bp, Homo sapiens
cccatccccagcga

SEQ ID NO: 2109037 - DNA, 15 bp, Homo sapiens
cccatcccccactgc

SEQ ID NO: 2109038 - DNA, 17 bp, Homo sapiens
cccatcccctttcctcc

SEQ ID NO: 2109039 - DNA, 20 bp, Homo sapiens
cccatcctaccaatgcatgc

SEQ ID NO: 2109040 - DNA, 21 bp, Homo sapiens
cccatctaagctgcagcttcc

SEQ ID NO: 2109041 - DNA, 14 bp, Homo sapiens
cccatctccccagg

SEQ ID NO: 2109042 - DNA, 13 bp, Homo sapiens
cccatctccccct

SEQ ID NO: 2109043 - DNA, 20 bp, Homo sapiens
cccatctcctcccatggcct

SEQ ID NO: 2109044 - DNA, 12 bp, Homo sapiens
cccatctcctga

SEQ ID NO: 2109045 - DNA, 14 bp, Homo sapiens
cccatctgctcctc

SEQ ID NO: 2109046 - DNA, 23 bp, Homo sapiens
cccatctgctcctcccattcccc

SEQ ID NO: 2109047 - DNA, 18 bp, Homo sapiens
cccatctgggtccttgca

SEQ ID NO: 2109048 - DNA, 17 bp, Homo sapiens
cccatcttcctgctgct

SEQ ID NO: 2109049 - DNA, 19 bp, Homo sapiens
cccatcttcctgctgctgt

SEQ ID NO: 2109050 - DNA, 15 bp, Homo sapiens
cccatgacctccagc

SEQ ID NO: 2109051 - DNA, 14 bp, Homo sapiens
cccatgagcctcag

SEQ ID NO: 2109052 - DNA, 20 bp, Homo sapiens
cccatgagcctcagcatcct

SEQ ID NO: 2109053 - DNA, 22 bp, Homo sapiens
cccatgagcctcagcatcctgg

SEQ ID NO: 2109054 - DNA, 13 bp, Homo sapiens
cccatgatccaga

SEQ ID NO: 2109055 - DNA, 19 bp, Homo sapiens
cccatgatgccgctcttct

SEQ ID NO: 2109056 - DNA, 21 bp, Homo sapiens
cccatgctcaaccactgtggc

SEQ ID NO: 2109057 - DNA, 17 bp, Homo sapiens
cccatgctctgccccaa

SEQ ID NO: 2109058 - DNA, 14 bp, Homo sapiens
cccatgctgaatta

SEQ ID NO: 2109059 - DNA, 12 bp, Homo sapiens
cccatgctttcc

SEQ ID NO: 2109060 - DNA, 20 bp, Homo sapiens
cccatggccttccctcccca

SEQ ID NO: 2109061 - DNA, 16 bp, Homo sapiens
cccatgggcttggact

SEQ ID NO: 2109062 - DNA, 23 bp, Homo sapiens
cccatgtatttatctctatttaa

SEQ ID NO: 2109063 - DNA, 13 bp, Homo sapiens
cccatgtcacctc

SEQ ID NO: 2109064 - DNA, 17 bp, Homo sapiens
cccatgtcacctcagct

SEQ ID NO: 2109065 - DNA, 22 bp, Homo sapiens
cccatgtctttctccaaagtta

SEQ ID NO: 2109066 - DNA, 23 bp, Homo sapiens
cccatgtttaaactttgtgcctt

SEQ ID NO: 2109067 - DNA, 19 bp, Homo sapiens
cccattcgtctgtcccaga

SEQ ID NO: 2109068 - DNA, 17 bp, Homo sapiens
cccattctctctcctgt

SEQ ID NO: 2109069 - DNA, 19 bp, Homo sapiens
cccattctctctcctgtcc

SEQ ID NO: 2109070 - DNA, 15 bp, Homo sapiens
cccattctgcctgcc

SEQ ID NO: 2109071 - DNA, 20 bp, Homo sapiens
cccattctgcctgcccaggc

SEQ ID NO: 2109072 - DNA, 21 bp, Homo sapiens
cccattctgcctgcccaggcc

SEQ ID NO: 2109073 - DNA, 21 bp, Homo sapiens
cccattgacttgcacatctct

SEQ ID NO: 2109074 - DNA, 21 bp, Homo sapiens
cccattgcatcacctctgtaa

SEQ ID NO: 2109075 - DNA, 19 bp, Homo sapiens
cccatttccttggaggcca

SEQ ID NO: 2109076 - DNA, 17 bp, Homo sapiens
cccatttctatttattt

SEQ ID NO: 2109077 - DNA, 22 bp, Homo sapiens
cccattttgcaaaatttccagt

SEQ ID NO: 2109078 - DNA, 14 bp, Homo sapiens
ccccaaaccagggt

SEQ ID NO: 2109079 - DNA, 20 bp, Homo sapiens
ccccaaagagcctggagaag

SEQ ID NO: 2109080 - DNA, 14 bp, Homo sapiens
ccccaaatcccaca

SEQ ID NO: 2109081 - DNA, 19 bp, Homo sapiens
ccccaacatctccctccca

SEQ ID NO: 2109082 - DNA, 22 bp, Homo sapiens
ccccaaccccgcggtgctctgg

SEQ ID NO: 2109083 - DNA, 23 bp, Homo sapiens
ccccaacccgtggaggctgctcg

SEQ ID NO: 2109084 - DNA, 15 bp, Homo sapiens
ccccaacctttccct

SEQ ID NO: 2109085 - DNA, 15 bp, Homo sapiens
ccccaactcctggaa

SEQ ID NO: 2109086 - DNA, 18 bp, Homo sapiens
ccccaagcagccagccag

SEQ ID NO: 2109087 - DNA, 22 bp, Homo sapiens
ccccaagccatggtgacacaca

SEQ ID NO: 2109088 - DNA, 15 bp, Homo sapiens
ccccaagcctctgcc

SEQ ID NO: 2109089 - DNA, 18 bp, Homo sapiens
ccccaagcctctgcccca

SEQ ID NO: 2109090 - DNA, 22 bp, Homo sapiens
ccccaagcctctgccccaaggg

SEQ ID NO: 2109091 - DNA, 16 bp, Homo sapiens
ccccaagctgttttct

SEQ ID NO: 2109092 - DNA, 17 bp, Homo sapiens
ccccaagctgttttctt

SEQ ID NO: 2109093 - DNA, 20 bp, Homo sapiens
ccccaagggacaaccccatc

SEQ ID NO: 2109094 - DNA, 20 bp, Homo sapiens
ccccaaggttttggagtcag

SEQ ID NO: 2109095 - DNA, 20 bp, Homo sapiens
ccccaattatcttatttaat

SEQ ID NO: 2109096 - DNA, 22 bp, Homo sapiens
ccccacacgtgctcgcagcctg

SEQ ID NO: 2109097 - DNA, 23 bp, Homo sapiens
ccccacacgtgctcgcagcctgg

SEQ ID NO: 2109098 - DNA, 13 bp, Homo sapiens
ccccacagaactg

SEQ ID NO: 2109099 - DNA, 13 bp, Homo sapiens
ccccacagcaccc

SEQ ID NO: 2109100 - DNA, 15 bp, Homo sapiens
ccccacagcacccag

SEQ ID NO: 2109101 - DNA, 21 bp, Homo sapiens
ccccacagcacccaggctcca

SEQ ID NO: 2109102 - DNA, 18 bp, Homo sapiens
ccccacattggacttcct

SEQ ID NO: 2109103 - DNA, 15 bp, Homo sapiens
ccccaccagccacct

SEQ ID NO: 2109104 - DNA, 19 bp, Homo sapiens
ccccaccagccacctcttg

SEQ ID NO: 2109105 - DNA, 18 bp, Homo sapiens
ccccaccccagagttggg

SEQ ID NO: 2109106 - DNA, 23 bp, Homo sapiens
ccccaccccctccccaggggaga

SEQ ID NO: 2109107 - DNA, 22 bp, Homo sapiens
ccccaccctcgtggacacctgc

SEQ ID NO: 2109108 - DNA, 16 bp, Homo sapiens
ccccaccgaagagccc

SEQ ID NO: 2109109 - DNA, 11 bp, Homo sapiens
ccccacctggg

SEQ ID NO: 2109110 - DNA, 21 bp, Homo sapiens
ccccaccttcaattcctgggc

SEQ ID NO: 2109111 - DNA, 13 bp, Homo sapiens
ccccaccttcccc

SEQ ID NO: 2109112 - DNA, 17 bp, Homo sapiens
ccccacgagggtcagga

SEQ ID NO: 2109113 - DNA, 19 bp, Homo sapiens
ccccacgagtcacctgcaa

SEQ ID NO: 2109114 - DNA, 21 bp, Homo sapiens
ccccacgagtcacctgcaagc

SEQ ID NO: 2109115 - DNA, 22 bp, Homo sapiens
ccccacgagtcacctgcaagcc

SEQ ID NO: 2109116 - DNA, 23 bp, Homo sapiens
ccccacgagtcacctgcaagccc

SEQ ID NO: 2109117 - DNA, 12 bp, Homo sapiens
ccccactccagc

SEQ ID NO: 2109118 - DNA, 13 bp, Homo sapiens
ccccactccagcc

SEQ ID NO: 2109119 - DNA, 12 bp, Homo sapiens
ccccagccctca

SEQ ID NO: 2109120 - DNA, 13 bp, Homo sapiens
ccccagccctcag

SEQ ID NO: 2109121 - DNA, 17 bp, Homo sapiens
ccccagccctcaggcca

SEQ ID NO: 2109122 - DNA, 11 bp, Homo sapiens
ccccagccctt

SEQ ID NO: 2109123 - DNA, 17 bp, Homo sapiens
ccccagcccttctgcct

SEQ ID NO: 2109124 - DNA, 13 bp, Homo sapiens
ccccagcctgcta

SEQ ID NO: 2109125 - DNA, 17 bp, Homo sapiens
ccccagctagggctgga

SEQ ID NO: 2109126 - DNA, 10 bp, Homo sapiens
ccccagctcc

SEQ ID NO: 2109127 - DNA, 14 bp, Homo sapiens
ccccagctccccag

SEQ ID NO: 2109128 - DNA, 17 bp, Homo sapiens
ccccagctccccaggac

SEQ ID NO: 2109129 - DNA, 17 bp, Homo sapiens
ccccagctctggcttcc

SEQ ID NO: 2109130 - DNA, 12 bp, Homo sapiens
ccccagctggcc

SEQ ID NO: 2109131 - DNA, 14 bp, Homo sapiens
ccccagctggcctc

SEQ ID NO: 2109132 - DNA, 23 bp, Homo sapiens
ccccagctggcctctagaacacc

SEQ ID NO: 2109133 - DNA, 15 bp, Homo sapiens
ccccaggccaggcca

SEQ ID NO: 2109134 - DNA, 17 bp, Homo sapiens
ccccaggcctccagcct

SEQ ID NO: 2109135 - DNA, 22 bp, Homo sapiens
ccccaggcttgtcactagcagc

SEQ ID NO: 2109136 - DNA, 17 bp, Homo sapiens
ccccagggcacaggagc

SEQ ID NO: 2109137 - DNA, 19 bp, Homo sapiens
ccccagggcacaggagcta

SEQ ID NO: 2109138 - DNA, 11 bp, Homo sapiens
ccccagggccc

SEQ ID NO: 2109139 - DNA, 16 bp, Homo sapiens
ccccagggcccccaca

SEQ ID NO: 2109140 - DNA, 22 bp, Homo sapiens
ccccagggcccctccctctgcc

SEQ ID NO: 2109141 - DNA, 23 bp, Homo sapiens
ccccagggcccctccctctgccc

SEQ ID NO: 2109142 - DNA, 12 bp, Homo sapiens
ccccagggccct

SEQ ID NO: 2109143 - DNA, 17 bp, Homo sapiens
ccccagggcctgggggc

SEQ ID NO: 2109144 - DNA, 17 bp, Homo sapiens
ccccaggggaaaatgaa

SEQ ID NO: 2109145 - DNA, 23 bp, Homo sapiens
ccccaggtcatgctgctgttgct

SEQ ID NO: 2109146 - DNA, 16 bp, Homo sapiens
ccccaggtctctccac

SEQ ID NO: 2109147 - DNA, 18 bp, Homo sapiens
ccccaggtctctccactg

SEQ ID NO: 2109148 - DNA, 20 bp, Homo sapiens
ccccaggtgccaccaataaa

SEQ ID NO: 2109149 - DNA, 22 bp, Homo sapiens
ccccaggtgccaccaataaaaa

SEQ ID NO: 2109150 - DNA, 14 bp, Homo sapiens
ccccaggtgccagt

SEQ ID NO: 2109151 - DNA, 22 bp, Homo sapiens
ccccaggttcagactgagctcc

SEQ ID NO: 2109152 - DNA, 17 bp, Homo sapiens
ccccagtcgagccctgc

SEQ ID NO: 2109153 - DNA, 20 bp, Homo sapiens
ccccagtgccacagagaaga

SEQ ID NO: 2109154 - DNA, 16 bp, Homo sapiens
ccccagtgcccacagg

SEQ ID NO: 2109155 - DNA, 18 bp, Homo sapiens
ccccagtgctacctctct

SEQ ID NO: 2109156 - DNA, 18 bp, Homo sapiens
ccccagttctgctcctct

SEQ ID NO: 2109157 - DNA, 20 bp, Homo sapiens
ccccagttctgctcctctcc

SEQ ID NO: 2109158 - DNA, 22 bp, Homo sapiens
ccccatcatatcctttgcccca

SEQ ID NO: 2109159 - DNA, 13 bp, Homo sapiens
ccccatcccccac

SEQ ID NO: 2109160 - DNA, 12 bp, Homo sapiens
ccccatccctcg

SEQ ID NO: 2109161 - DNA, 14 bp, Homo sapiens
ccccatcctgggcc

SEQ ID NO: 2109162 - DNA, 20 bp, Homo sapiens
ccccatctcctcccatggcc

SEQ ID NO: 2109163 - DNA, 14 bp, Homo sapiens
ccccatctctacta

SEQ ID NO: 2109164 - DNA, 14 bp, Homo sapiens
ccccatcttggtcc

SEQ ID NO: 2109165 - DNA, 13 bp, Homo sapiens
ccccatgacctcc

SEQ ID NO: 2109166 - DNA, 22 bp, Homo sapiens
ccccatgctctgccccaagccc

SEQ ID NO: 2109167 - DNA, 15 bp, Homo sapiens
ccccatgggcttgga

SEQ ID NO: 2109168 - DNA, 23 bp, Homo sapiens
ccccatggggctgcgggacagag

SEQ ID NO: 2109169 - DNA, 17 bp, Homo sapiens
ccccatgtctctcagaa

SEQ ID NO: 2109170 - DNA, 17 bp, Homo sapiens
ccccattagagtcagcc

SEQ ID NO: 2109171 - DNA, 16 bp, Homo sapiens
ccccattcacagagcc

SEQ ID NO: 2109172 - DNA, 21 bp, Homo sapiens
ccccattctgcctgcccaggc

SEQ ID NO: 2109173 - DNA, 16 bp, Homo sapiens
ccccattcttcctagt

SEQ ID NO: 2109174 - DNA, 13 bp, Homo sapiens
ccccatttctatt

SEQ ID NO: 2109175 - DNA, 17 bp, Homo sapiens
ccccatttctatttatt

SEQ ID NO: 2109176 - DNA, 21 bp, Homo sapiens
cccccaaacatctggcatggc

SEQ ID NO: 2109177 - DNA, 15 bp, Homo sapiens
cccccaacctttccc

SEQ ID NO: 2109178 - DNA, 11 bp, Homo sapiens
cccccaagcct

SEQ ID NO: 2109179 - DNA, 12 bp, Homo sapiens
cccccaagcctc

SEQ ID NO: 2109180 - DNA, 13 bp, Homo sapiens
cccccaagcctct

SEQ ID NO: 2109181 - DNA, 12 bp, Homo sapiens
cccccaagttct

SEQ ID NO: 2109182 - DNA, 12 bp, Homo sapiens
cccccacaggcc

SEQ ID NO: 2109183 - DNA, 17 bp, Homo sapiens
cccccaccacactgaat

SEQ ID NO: 2109184 - DNA, 13 bp, Homo sapiens
cccccacctgaca

SEQ ID NO: 2109185 - DNA, 20 bp, Homo sapiens
cccccagaacctcaagtcta

SEQ ID NO: 2109186 - DNA, 17 bp, Homo sapiens
cccccagcactcctctg

SEQ ID NO: 2109187 - DNA, 15 bp, Homo sapiens
cccccagccctcagg

SEQ ID NO: 2109188 - DNA, 16 bp, Homo sapiens
cccccagccctcaggc

SEQ ID NO: 2109189 - DNA, 20 bp, Homo sapiens
cccccagtcgagccctgcag

SEQ ID NO: 2109190 - DNA, 19 bp, Homo sapiens
cccccatctccccaggcct

SEQ ID NO: 2109191 - DNA, 20 bp, Homo sapiens
cccccatctccccaggcctc

SEQ ID NO: 2109192 - DNA, 13 bp, Homo sapiens
cccccatgtggct

SEQ ID NO: 2109193 - DNA, 12 bp, Homo sapiens
ccccccactgca

SEQ ID NO: 2109194 - DNA, 13 bp, Homo sapiens
ccccccagcacta

SEQ ID NO: 2109195 - DNA, 20 bp, Homo sapiens
ccccccttgaatctgcaggg

SEQ ID NO: 2109196 - DNA, 17 bp, Homo sapiens
cccccgacactgctgca

SEQ ID NO: 2109197 - DNA, 23 bp, Homo sapiens
cccccgacactgctgcaccagag

SEQ ID NO: 2109198 - DNA, 15 bp, Homo sapiens
cccccgccacggcca

SEQ ID NO: 2109199 - DNA, 19 bp, Homo sapiens
cccccgccacggccaccct

SEQ ID NO: 2109200 - DNA, 14 bp, Homo sapiens
cccccgccatcctt

SEQ ID NO: 2109201 - DNA, 13 bp, Homo sapiens
cccccgctccaga

SEQ ID NO: 2109202 - DNA, 15 bp, Homo sapiens
cccccgtggtctttg

SEQ ID NO: 2109203 - DNA, 14 bp, Homo sapiens
ccccctatgctcca

SEQ ID NO: 2109204 - DNA, 13 bp, Homo sapiens
ccccctcatctca

SEQ ID NO: 2109205 - DNA, 11 bp, Homo sapiens
ccccctcattc

SEQ ID NO: 2109206 - DNA, 12 bp, Homo sapiens
ccccctccaggc

SEQ ID NO: 2109207 - DNA, 14 bp, Homo sapiens
ccccctctaacccc

SEQ ID NO: 2109208 - DNA, 11 bp, Homo sapiens
ccccctgcagc

SEQ ID NO: 2109209 - DNA, 16 bp, Homo sapiens
ccccctgccagtgcct

SEQ ID NO: 2109210 - DNA, 18 bp, Homo sapiens
ccccctgcttctcagccc

SEQ ID NO: 2109211 - DNA, 22 bp, Homo sapiens
ccccctggatgtcccctgtccc

SEQ ID NO: 2109212 - DNA, 11 bp, Homo sapiens
ccccctgggct

SEQ ID NO: 2109213 - DNA, 21 bp, Homo sapiens
ccccctggtggacagtcctgg

SEQ ID NO: 2109214 - DNA, 10 bp, Homo sapiens
ccccctgtgc

SEQ ID NO: 2109215 - DNA, 23 bp, Homo sapiens
cccccttcagtgcccaccaacat

SEQ ID NO: 2109216 - DNA, 18 bp, Homo sapiens
cccccttgaatctgcagg

SEQ ID NO: 2109217 - DNA, 14 bp, Homo sapiens
ccccgacactgctg

SEQ ID NO: 2109218 - DNA, 23 bp, Homo sapiens
ccccgaggccttctctgaaggac

SEQ ID NO: 2109219 - DNA, 19 bp, Homo sapiens
ccccgcagtccccagccct

SEQ ID NO: 2109220 - DNA, 21 bp, Homo sapiens
ccccgccacggccaccctcct

SEQ ID NO: 2109221 - DNA, 13 bp, Homo sapiens
ccccgccatcctt

SEQ ID NO: 2109222 - DNA, 15 bp, Homo sapiens
ccccgctggcagcca

SEQ ID NO: 2109223 - DNA, 19 bp, Homo sapiens
ccccgctggctcctccagg

SEQ ID NO: 2109224 - DNA, 21 bp, Homo sapiens
ccccgcttccccacagaactg

SEQ ID NO: 2109225 - DNA, 14 bp, Homo sapiens
ccccggcctcagca

SEQ ID NO: 2109226 - DNA, 20 bp, Homo sapiens
ccccgggctctggccaccct

SEQ ID NO: 2109227 - DNA, 12 bp, Homo sapiens
ccccggggctgg

SEQ ID NO: 2109228 - DNA, 14 bp, Homo sapiens
ccccggggctggca

SEQ ID NO: 2109229 - DNA, 16 bp, Homo sapiens
ccccggggctggcaag

SEQ ID NO: 2109230 - DNA, 20 bp, Homo sapiens
ccccgggggcagacacctgt

SEQ ID NO: 2109231 - DNA, 22 bp, Homo sapiens
ccccgggtccccagctccccag

SEQ ID NO: 2109232 - DNA, 17 bp, Homo sapiens
ccccgggtgcctcagag

SEQ ID NO: 2109233 - DNA, 16 bp, Homo sapiens
ccccggtcccttgaga

SEQ ID NO: 2109234 - DNA, 16 bp, Homo sapiens
ccccggtcctggcccc

SEQ ID NO: 2109235 - DNA, 21 bp, Homo sapiens
ccccgtggtctttgaataaag

SEQ ID NO: 2109236 - DNA, 17 bp, Homo sapiens
cccctaagagagcacct

SEQ ID NO: 2109237 - DNA, 21 bp, Homo sapiens
cccagtctacgttctccagcc

SEQ ID NO: 2109238 - DNA, 22 bp, Homo sapiens
cccagtctacgttctccagccc

SEQ ID NO: 2109239 - DNA, 19 bp, Homo sapiens
cccagtctggaatgcagtg

SEQ ID NO: 2109240 - DNA, 14 bp, Homo sapiens
cccagtgacagcta

SEQ ID NO: 2109241 - DNA, 16 bp, Homo sapiens
cccagtgcacttgctg

SEQ ID NO: 2109242 - DNA, 14 bp, Homo sapiens
cccagtgccacaga

SEQ ID NO: 2109243 - DNA, 15 bp, Homo sapiens
cccagtgccacagag

SEQ ID NO: 2109244 - DNA, 20 bp, Homo sapiens
cccagtgctgccatgccact

SEQ ID NO: 2109245 - DNA, 14 bp, Homo sapiens
cccagtgcttctcc

SEQ ID NO: 2109246 - DNA, 22 bp, Homo sapiens
cccagtggaacagtcacccttc

SEQ ID NO: 2109247 - DNA, 18 bp, Homo sapiens
cccagtgggacagaggag

SEQ ID NO: 2109248 - DNA, 20 bp, Homo sapiens
cccagtgtggccccagcccg

SEQ ID NO: 2109249 - DNA, 12 bp, Homo sapiens
cccagcctgcta

SEQ ID NO: 2109250 - DNA, 13 bp, Homo sapiens
cccagcctgggcc

SEQ ID NO: 2109251 - DNA, 15 bp, Homo sapiens
cccagcctgggccta

SEQ ID NO: 2109252 - DNA, 19 bp, Homo sapiens
cccagcctgggcctatgga

SEQ ID NO: 2109253 - DNA, 21 bp, Homo sapiens
cccagcctgtcctggtacagc

SEQ ID NO: 2109254 - DNA, 14 bp, Homo sapiens
cccagcgattccct

SEQ ID NO: 2109255 - DNA, 17 bp, Homo sapiens
cccagcgcggcttggcc

SEQ ID NO: 2109256 - DNA, 24 bp, Homo sapiens
cccagcgtttagtttctagaggcc

SEQ ID NO: 2109257 - DNA, 16 bp, Homo sapiens
cccacccatcttcctg

SEQ ID NO: 2109258 - DNA, 22 bp, Homo sapiens
cccacccatcttcctgctgctg

SEQ ID NO: 2109259 - DNA, 14 bp, Homo sapiens
cccaccccactcca

SEQ ID NO: 2109260 - DNA, 15 bp, Homo sapiens
cccaccccactccag

SEQ ID NO: 2109261 - DNA, 18 bp, Homo sapiens
caggaggctgaggcagaa

SEQ ID NO: 2109262 - DNA, 20 bp, Homo sapiens
caggaggctgaggcagaaga

SEQ ID NO: 2109263 - DNA, 18 bp, Homo sapiens
caggaggctgaggcagga

SEQ ID NO: 2109264 - DNA, 19 bp, Homo sapiens
caggaggctgaggcaggag

SEQ ID NO: 2109265 - DNA, 21 bp, Homo sapiens
caggaggctgaggcaggagga

SEQ ID NO: 2109266 - DNA, 14 bp, Homo sapiens
caggaggctgcggc

SEQ ID NO: 2109267 - DNA, 17 bp, Homo sapiens
caggaggggcctctgaa

SEQ ID NO: 2109268 - DNA, 16 bp, Homo sapiens
caggagggggtcgtgg

SEQ ID NO: 2109269 - DNA, 19 bp, Homo sapiens
caggagggggtcgtggaga

SEQ ID NO: 2109270 - DNA, 20 bp, Homo sapiens
caggagggggtcgtggagag

SEQ ID NO: 2109271 - DNA, 21 bp, Homo sapiens
caggagggtccccagctggtc

SEQ ID NO: 2109272 - DNA, 15 bp, Homo sapiens
caggaggtcctcctc

SEQ ID NO: 2109273 - DNA, 15 bp, Homo sapiens
caggaggtggaggtt

SEQ ID NO: 2109274 - DNA, 20 bp, Homo sapiens
caggaggttggtgactgaaa

SEQ ID NO: 2109275 - DNA, 13 bp, Homo sapiens
caggagtagctga

SEQ ID NO: 2109276 - DNA, 17 bp, Homo sapiens
caggagtagctgagctc

SEQ ID NO: 2109277 - DNA, 15 bp, Homo sapiens
caggagtcccaagga

SEQ ID NO: 2109278 - DNA, 18 bp, Homo sapiens
caggagtcccaaggaaag

SEQ ID NO: 2109279 - DNA, 24 bp, Homo sapiens
caggagtcccaaggaaagccccag

SEQ ID NO: 2109280 - DNA, 13 bp, Homo sapiens
caggagtccctgg

SEQ ID NO: 2109281 - DNA, 14 bp, Homo sapiens
caggagtccctggt

SEQ ID NO: 2109282 - DNA, 16 bp, Homo sapiens
caggagtctgtgctct

SEQ ID NO: 2109283 - DNA, 20 bp, Homo sapiens
caggagtggccggggaagct

SEQ ID NO: 2109284 - DNA, 21 bp, Homo sapiens
caggagttcaagaccagcctg

SEQ ID NO: 2109285 - DNA, 21 bp, Homo sapiens
caggagttcaataaatgtctg

SEQ ID NO: 2109286 - DNA, 23 bp, Homo sapiens
caggagttcaataaatgtctgtt

SEQ ID NO: 2109287 - DNA, 22 bp, Homo sapiens
caggagttcgagaccagcccag

SEQ ID NO: 2109288 - DNA, 17 bp, Homo sapiens
caggagttggagaccag

SEQ ID NO: 2109289 - DNA, 21 bp, Homo sapiens
caggagttggagaccaggcct

SEQ ID NO: 2109290 - DNA, 22 bp, Homo sapiens
caggagtttgagacaagccctg

SEQ ID NO: 2109291 - DNA, 20 bp, Homo sapiens
caggatactctgtcagatgg

SEQ ID NO: 2109292 - DNA, 17 bp, Homo sapiens
caggatcagccccgctc

SEQ ID NO: 2109293 - DNA, 13 bp, Homo sapiens
caggatcagtctg

SEQ ID NO: 2109294 - DNA, 23 bp, Homo sapiens
caggatcccaagcgtcccgtccc

SEQ ID NO: 2109295 - DNA, 16 bp, Homo sapiens
caggatccctcccaga

SEQ ID NO: 2109296 - DNA, 19 bp, Homo sapiens
caggatccctcccagatcc

SEQ ID NO: 2109297 - DNA, 20 bp, Homo sapiens
caggatccctcccagatcct

SEQ ID NO: 2109298 - DNA, 22 bp, Homo sapiens
caggatcctattctcaccagga

SEQ ID NO: 2109299 - DNA, 13 bp, Homo sapiens
caggatcctgcag

SEQ ID NO: 2109300 - DNA, 14 bp, Homo sapiens
caggatcctgcagg

SEQ ID NO: 2109301 - DNA, 17 bp, Homo sapiens
caggatcctgcaggaac

SEQ ID NO: 2109302 - DNA, 23 bp, Homo sapiens
caggatgaggaacctcaaactgg

SEQ ID NO: 2109303 - DNA, 15 bp, Homo sapiens
caggatggtgcagga

SEQ ID NO: 2109304 - DNA, 16 bp, Homo sapiens
caggatgtggcactgc

SEQ ID NO: 2109305 - DNA, 15 bp, Homo sapiens
caggattccaaagtt

SEQ ID NO: 2109306 - DNA, 21 bp, Homo sapiens
caggattccaaagttttgaag

SEQ ID NO: 2109307 - DNA, 17 bp, Homo sapiens
caggcaaaacacgcaag

SEQ ID NO: 2109308 - DNA, 21 bp, Homo sapiens
caggcaaaacacgcaagggca

SEQ ID NO: 2109309 - DNA, 15 bp, Homo sapiens
caggcaactgaggca

SEQ ID NO: 2109310 - DNA, 17 bp, Homo sapiens
caggcaactgaggcaga

SEQ ID NO: 2109311 - DNA, 18 bp, Homo sapiens
caggcaactgaggcagac

SEQ ID NO: 2109312 - DNA, 20 bp, Homo sapiens
caggcaactgaggcagacag

SEQ ID NO: 2109313 - DNA, 21 bp, Homo sapiens
caggcaagcacctcctgcctc

SEQ ID NO: 2109314 - DNA, 13 bp, Homo sapiens
caggcaagcccct

SEQ ID NO: 2109315 - DNA, 16 bp, Homo sapiens
caggcaagcccctcag

SEQ ID NO: 2109316 - DNA, 19 bp, Homo sapiens
caggcaagcccctcagccc

SEQ ID NO: 2109317 - DNA, 24 bp, Homo sapiens
caggcaagcccctcagcccttgcc

SEQ ID NO: 2109318 - DNA, 18 bp, Homo sapiens
caggcaagtgaagaaaag

SEQ ID NO: 2109319 - DNA, 21 bp, Homo sapiens
caggcaatgctggctgttggc

SEQ ID NO: 2109320 - DNA, 13 bp, Homo sapiens
caggcacaggaca

SEQ ID NO: 2109321 - DNA, 14 bp, Homo sapiens
caggcacaggcagg

SEQ ID NO: 2109322 - DNA, 16 bp, Homo sapiens
caggcaccaaaagaag

SEQ ID NO: 2109323 - DNA, 19 bp, Homo sapiens
caggcaccaaaagaagtaa

SEQ ID NO: 2109324 - DNA, 15 bp, Homo sapiens
caggcaccccctgga

SEQ ID NO: 2109325 - DNA, 16 bp, Homo sapiens
caggcaccccctggag

SEQ ID NO: 2109326 - DNA, 13 bp, Homo sapiens
caggcacccttct

SEQ ID NO: 2109327 - DNA, 16 bp, Homo sapiens
caggcacccttctttc

SEQ ID NO: 2109328 - DNA, 21 bp, Homo sapiens
caggcacccttctttcctctt

SEQ ID NO: 2109329 - DNA, 14 bp, Homo sapiens
caggcacctggcct

SEQ ID NO: 2109330 - DNA, 18 bp, Homo sapiens
caggcacctggcctgctg

SEQ ID NO: 2109331 - DNA, 20 bp, Homo sapiens
caggcacctggcctgctggg

SEQ ID NO: 2109332 - DNA, 22 bp, Homo sapiens
caggcacgaacccacctgctga

SEQ ID NO: 2109333 - DNA, 21 bp, Homo sapiens
caggcagacaagagctgctgt

SEQ ID NO: 2109334 - DNA, 14 bp, Homo sapiens
caggcagagaatca

SEQ ID NO: 2109335 - DNA, 23 bp, Homo sapiens
caggcagagatcaggtgggcaga

SEQ ID NO: 2109336 - DNA, 13 bp, Homo sapiens
caggcagagcggg

SEQ ID NO: 2109337 - DNA, 12 bp, Homo sapiens
caggcagcgatg

SEQ ID NO: 2109338 - DNA, 18 bp, Homo sapiens
caggcagcgatggtctca

SEQ ID NO: 2109339 - DNA, 17 bp, Homo sapiens
caggcaggaagagagag

SEQ ID NO: 2109340 - DNA, 20 bp, Homo sapiens
caggcagggctctcctggct

SEQ ID NO: 2109341 - DNA, 14 bp, Homo sapiens
caggcaggtccagg

SEQ ID NO: 2109342 - DNA, 19 bp, Homo sapiens
caggcaggtccagggtttg

SEQ ID NO: 2109343 - DNA, 14 bp, Homo sapiens
caggcaggtgcctg

SEQ ID NO: 2109344 - DNA, 14 bp, Homo sapiens
caggcatcccatcc

SEQ ID NO: 2109345 - DNA, 16 bp, Homo sapiens
caggcatctacacagc

SEQ ID NO: 2109346 - DNA, 20 bp, Homo sapiens
caggcatctacacagcctgg

SEQ ID NO: 2109347 - DNA, 17 bp, Homo sapiens
caggcatgcaccagtgc

SEQ ID NO: 2109348 - DNA, 18 bp, Homo sapiens
caggcatgcaccagtgcc

SEQ ID NO: 2109349 - DNA, 23 bp, Homo sapiens
caggcatgcaccagtgccgcctg

SEQ ID NO: 2109350 - DNA, 15 bp, Homo sapiens
caggcatgctggcct

SEQ ID NO: 2109351 - DNA, 15 bp, Homo sapiens
caggcatgttctctg

SEQ ID NO: 2109352 - DNA, 23 bp, Homo sapiens
cagggaaaggctctgaaagccag

SEQ ID NO: 2109353 - DNA, 15 bp, Homo sapiens
cagggaaatggaggg

SEQ ID NO: 2109354 - DNA, 14 bp, Homo sapiens
cagggaagagggca

SEQ ID NO: 2109355 - DNA, 17 bp, Homo sapiens
cagggaagagggcagta

SEQ ID NO: 2109356 - DNA, 18 bp, Homo sapiens
cagggaagcaggcagagc

SEQ ID NO: 2109357 - DNA, 12 bp, Homo sapiens
cagggaaggcag

SEQ ID NO: 2109358 - DNA, 20 bp, Homo sapiens
cagggaaggcaggcagggct

SEQ ID NO: 2109359 - DNA, 22 bp, Homo sapiens
cagggaaggcaggcagggctct

SEQ ID NO: 2109360 - DNA, 23 bp, Homo sapiens
cagggaaggcaggcagggctctc

SEQ ID NO: 2109361 - DNA, 23 bp, Homo sapiens
cagggaatccgcctgcagaggac

SEQ ID NO: 2109362 - DNA, 13 bp, Homo sapiens
cagggacaaagaa

SEQ ID NO: 2109363 - DNA, 23 bp, Homo sapiens
cagggacaaagaggcctttaacc

SEQ ID NO: 2109364 - DNA, 19 bp, Homo sapiens
cagggacagagacacctgc

SEQ ID NO: 2109365 - DNA, 16 bp, Homo sapiens
cagggacggggactgg

SEQ ID NO: 2109366 - DNA, 20 bp, Homo sapiens
cagggacggggactggccct

SEQ ID NO: 2109367 - DNA, 23 bp, Homo sapiens
cagggagaggagtgactgagctt

SEQ ID NO: 2109368 - DNA, 17 bp, Homo sapiens
cagggagcaactctcca

SEQ ID NO: 2109369 - DNA, 20 bp, Homo sapiens
cagggagcaactctccactc

SEQ ID NO: 2109370 - DNA, 15 bp, Homo sapiens
cagggagcaatggga

SEQ ID NO: 2109371 - DNA, 17 bp, Homo sapiens
cagggagctgggcttcc

SEQ ID NO: 2109372 - DNA, 12 bp, Homo sapiens
cagggaggagag

SEQ ID NO: 2109373 - DNA, 15 bp, Homo sapiens
cagggaggagaggaa

SEQ ID NO: 2109374 - DNA, 21 bp, Homo sapiens
cagggaggatgccacagcccc

SEQ ID NO: 2109375 - DNA, 23 bp, Homo sapiens
cagggaggccgaagctaacaggg

SEQ ID NO: 2109376 - DNA, 12 bp, Homo sapiens
cagggaggggac

SEQ ID NO: 2109377 - DNA, 13 bp, Homo sapiens
cagggaggggact

SEQ ID NO: 2109378 - DNA, 21 bp, Homo sapiens
cagggaggggactatttatga

SEQ ID NO: 2109379 - DNA, 22 bp, Homo sapiens
cagggagtccgaaagggacttg

SEQ ID NO: 2109380 - DNA, 23 bp, Homo sapiens
cagggatgccaacaccttcttgg

SEQ ID NO: 2109381 - DNA, 14 bp, Homo sapiens
cagggatttgagga

SEQ ID NO: 2109382 - DNA, 20 bp, Homo sapiens
caggagcaggaacagagact

SEQ ID NO: 2109383 - DNA, 21 bp, Homo sapiens
caggagcaggaacagagactc

SEQ ID NO: 2109384 - DNA, 22 bp, Homo sapiens
caggagcaggaacagagactct

SEQ ID NO: 2109385 - DNA, 23 bp, Homo sapiens
caggagcaggaacagagactctg

SEQ ID NO: 2109386 - DNA, 13 bp, Homo sapiens
caggagcccagag

SEQ ID NO: 2109387 - DNA, 18 bp, Homo sapiens
caggagccccgaggcctt

SEQ ID NO: 2109388 - DNA, 19 bp, Homo sapiens
caggagcctaccccctgaa

SEQ ID NO: 2109389 - DNA, 18 bp, Homo sapiens
caggagctacctgtgtgg

SEQ ID NO: 2109390 - DNA, 12 bp, Homo sapiens
caggagctgagt

SEQ ID NO: 2109391 - DNA, 14 bp, Homo sapiens
caggagctgagtca

SEQ ID NO: 2109392 - DNA, 22 bp, Homo sapiens
caggaggattgcttgagcccag

SEQ ID NO: 2109393 - DNA, 14 bp, Homo sapiens
caggaggccctggt

SEQ ID NO: 2109394 - DNA, 13 bp, Homo sapiens
caggaggcctggc

SEQ ID NO: 2109395 - DNA, 16 bp, Homo sapiens
caggaggcctggcctt

SEQ ID NO: 2109396 - DNA, 15 bp, Homo sapiens
caggaggcgcagccc

SEQ ID NO: 2109397 - DNA, 12 bp, Homo sapiens
caggaggctgag

SEQ ID NO: 2109398 - DNA, 13 bp, Homo sapiens
caggaggctgagg

SEQ ID NO: 2109399 - DNA, 15 bp, Homo sapiens
caggaggctgaggca

SEQ ID NO: 2109400 - DNA, 17 bp, Homo sapiens
caggaggctgaggcaga

SEQ ID NO: 2109401 - DNA, 23 bp, Homo sapiens
cagcttcatttccgtgaagggca

SEQ ID NO: 2109402 - DNA, 18 bp, Homo sapiens
cagcttcatttcctgtgt

SEQ ID NO: 2109403 - DNA, 15 bp, Homo sapiens
cagcttcatttgtgt

SEQ ID NO: 2109404 - DNA, 23 bp, Homo sapiens
cagcttcccctcgctgtcctgct

SEQ ID NO: 2109405 - DNA, 22 bp, Homo sapiens
cagcttcctgtgggccaggagc

SEQ ID NO: 2109406 - DNA, 17 bp, Homo sapiens
cagcttgaccagaccta

SEQ ID NO: 2109407 - DNA, 14 bp, Homo sapiens
cagcttgagagggc

SEQ ID NO: 2109408 - DNA, 15 bp, Homo sapiens
cagcttgagcctgtc

SEQ ID NO: 2109409 - DNA, 14 bp, Homo sapiens
cagcttgagggttg

SEQ ID NO: 2109410 - DNA, 18 bp, Homo sapiens
cagcttgagggttgggct

SEQ ID NO: 2109411 - DNA, 18 bp, Homo sapiens
cagcttgtaaatagctca

SEQ ID NO: 2109412 - DNA, 21 bp, Homo sapiens
cagcttgtaaatagctcaggt

SEQ ID NO: 2109413 - DNA, 17 bp, Homo sapiens
cagcttgtagccagccg

SEQ ID NO: 2109414 - DNA, 19 bp, Homo sapiens
cagcttgtagccagccggg

SEQ ID NO: 2109415 - DNA, 13 bp, Homo sapiens
cagcttgtccaac

SEQ ID NO: 2109416 - DNA, 23 bp, Homo sapiens
cagcttgtccaacaactccagga

SEQ ID NO: 2109417 - DNA, 22 bp, Homo sapiens
cagtcctgggagaacctcaggc

SEQ ID NO: 2109418 - DNA, 16 bp, Homo sapiens
cagtcgagccctgcag

SEQ ID NO: 2109419 - DNA, 18 bp, Homo sapiens
cagtcgagccctgcagcc

SEQ ID NO: 2109420 - DNA, 20 bp, Homo sapiens
cagtctacgttctccagccc

SEQ ID NO: 2109421 - DNA, 15 bp, Homo sapiens
cagtctcagaaagcc

SEQ ID NO: 2109422 - DNA, 14 bp, Homo sapiens
cagtctcaggagca

SEQ ID NO: 2109423 - DNA, 19 bp, Homo sapiens
cagtctcaggagcatgggg

SEQ ID NO: 2109424 - DNA, 14 bp, Homo sapiens
cagtctcagtccag

SEQ ID NO: 2109425 - DNA, 23 bp, Homo sapiens
cagtctcagtccagatgccttcc

SEQ ID NO: 2109426 - DNA, 15 bp, Homo sapiens
cagtctcgggtggct

SEQ ID NO: 2109427 - DNA, 14 bp, Homo sapiens
cagtctctgggaga

SEQ ID NO: 2109428 - DNA, 23 bp, Homo sapiens
cagtctctgggagactttcccta

SEQ ID NO: 2109429 - DNA, 15 bp, Homo sapiens
cagtctctttaatct

SEQ ID NO: 2109430 - DNA, 19 bp, Homo sapiens
cagtctgaacccttgtgct

SEQ ID NO: 2109431 - DNA, 22 bp, Homo sapiens
cagtctgattcccaagctctgc

SEQ ID NO: 2109432 - DNA, 23 bp, Homo sapiens
cagtctgattcccaagctctgct

SEQ ID NO: 2109433 - DNA, 18 bp, Homo sapiens
cagtctggaatgcagtgg

SEQ ID NO: 2109434 - DNA, 19 bp, Homo sapiens
cagtctggaatgcagtggt

SEQ ID NO: 2109435 - DNA, 20 bp, Homo sapiens
cagtctgggtaacagggaga

SEQ ID NO: 2109436 - DNA, 18 bp, Homo sapiens
cagtctgggtctgggttt

SEQ ID NO: 2109437 - DNA, 14 bp, Homo sapiens
cagtctgtgtttga

SEQ ID NO: 2109438 - DNA, 20 bp, Homo sapiens
cagtctgtgtttgaccttca

SEQ ID NO: 2109439 - DNA, 18 bp, Homo sapiens
cagtcttcttcacccgct

SEQ ID NO: 2109440 - DNA, 19 bp, Homo sapiens
cagtcttcttcacccgctg

SEQ ID NO: 2109441 - DNA, 18 bp, Homo sapiens
cagtgaaagagtagtgca

SEQ ID NO: 2109442 - DNA, 17 bp, Homo sapiens
cagtgacaagtggaggg

SEQ ID NO: 2109443 - DNA, 19 bp, Homo sapiens
cagtgacaagtggaggggg

SEQ ID NO: 2109444 - DNA, 20 bp, Homo sapiens
cagtgacagagttcactata

SEQ ID NO: 2109445 - DNA, 12 bp, Homo sapiens
cagtgacagcta

SEQ ID NO: 2109446 - DNA, 15 bp, Homo sapiens
cagtgacagctagga

SEQ ID NO: 2109447 - DNA, 15 bp, Homo sapiens
cagtgacctgaccgg

SEQ ID NO: 2109448 - DNA, 21 bp, Homo sapiens
cagtgacctgaccggcacctg

SEQ ID NO: 2109449 - DNA, 13 bp, Homo sapiens
cagtgactggcag

SEQ ID NO: 2109450 - DNA, 23 bp, Homo sapiens
cagtgactgtcgtgtttacaaaa

SEQ ID NO: 2109451 - DNA, 18 bp, Homo sapiens
cagtgactttacaggagg

SEQ ID NO: 2109452 - DNA, 19 bp, Homo sapiens
cagtgactttacaggaggt

SEQ ID NO: 2109453 - DNA, 21 bp, Homo sapiens
cagtgagaaaaagctcctgtc

SEQ ID NO: 2109454 - DNA, 22 bp, Homo sapiens
cagtgagaaaaagctcctgtcc

SEQ ID NO: 2109455 - DNA, 14 bp, Homo sapiens
cagtgagacacaga

SEQ ID NO: 2109456 - DNA, 18 bp, Homo sapiens
cagtgagattacagagga

SEQ ID NO: 2109457 - DNA, 12 bp, Homo sapiens
cagtgaggaggg

SEQ ID NO: 2109458 - DNA, 13 bp, Homo sapiens
cagtgaggagggt

SEQ ID NO: 2109459 - DNA, 13 bp, Homo sapiens
cagtgagggctgg

SEQ ID NO: 2109460 - DNA, 18 bp, Homo sapiens
cagtgagggctgggccca

SEQ ID NO: 2109461 - DNA, 19 bp, Homo sapiens
cagtgagtcgaggacaggg

SEQ ID NO: 2109462 - DNA, 22 bp, Homo sapiens
cagtgagtcgaggacagggagg

SEQ ID NO: 2109463 - DNA, 23 bp, Homo sapiens
cagtgagtcgaggacagggaggt

SEQ ID NO: 2109464 - DNA, 17 bp, Homo sapiens
cagtgagtctcttcaga

SEQ ID NO: 2109465 - DNA, 22 bp, Homo sapiens
cagtgagttacagcgagaggca

SEQ ID NO: 2109466 - DNA, 13 bp, Homo sapiens
cagtgatctccat

SEQ ID NO: 2109467 - DNA, 23 bp, Homo sapiens
cagtgatggcgcgggaggcacca

SEQ ID NO: 2109468 - DNA, 16 bp, Homo sapiens
cagtgattgtcttaat

SEQ ID NO: 2109469 - DNA, 11 bp, Homo sapiens
cagtgcaagag

SEQ ID NO: 2109470 - DNA, 18 bp, Homo sapiens
cagtgcaagagactctgg

SEQ ID NO: 2109471 - DNA, 19 bp, Homo sapiens
cagtgcaagagactctggc

SEQ ID NO: 2109472 - DNA, 22 bp, Homo sapiens
cagtgcaagagactctggcctc

SEQ ID NO: 2109473 - DNA, 23 bp, Homo sapiens
cagtgcaagagactctggcctcc

SEQ ID NO: 2109474 - DNA, 18 bp, Homo sapiens
cagtgcacacggatgcac

SEQ ID NO: 2109475 - DNA, 21 bp, Homo sapiens
cagtgcacacggatgcacaga

SEQ ID NO: 2109476 - DNA, 17 bp, Homo sapiens
cagtgcagtgatacatg

SEQ ID NO: 2109477 - DNA, 12 bp, Homo sapiens
cagtgcatctca

SEQ ID NO: 2109478 - DNA, 15 bp, Homo sapiens
cagtgcatctcagcc

SEQ ID NO: 2109479 - DNA, 16 bp, Homo sapiens
cagtgccacagagaag

SEQ ID NO: 2109480 - DNA, 19 bp, Homo sapiens
cagtgccacttgacattcc

SEQ ID NO: 2109481 - DNA, 14 bp, Homo sapiens
cagtgccaggacag

SEQ ID NO: 2109482 - DNA, 18 bp, Homo sapiens
cagtgccaggacagctgg

SEQ ID NO: 2109483 - DNA, 20 bp, Homo sapiens
cagtgccaggacagctggct

SEQ ID NO: 2109484 - DNA, 22 bp, Homo sapiens
cagtgccaggacagctggctgc

SEQ ID NO: 2109485 - DNA, 12 bp, Homo sapiens
cagtgcccacag

SEQ ID NO: 2109486 - DNA, 12 bp, Homo sapiens
cagtgcctcctg

SEQ ID NO: 2109487 - DNA, 19 bp, Homo sapiens
cagtgcctcctgggaccat

SEQ ID NO: 2109488 - DNA, 17 bp, Homo sapiens
cagtgcctcgaggcacc

SEQ ID NO: 2109489 - DNA, 10 bp, Homo sapiens
cagtgcctgc

SEQ ID NO: 2109490 - DNA, 21 bp, Homo sapiens
cagtgccttacctcctgccca

SEQ ID NO: 2109491 - DNA, 23 bp, Homo sapiens
cagtgctattttgtgcccactgt

SEQ ID NO: 2109492 - DNA, 16 bp, Homo sapiens
cagtgctcggcagtca

SEQ ID NO: 2109493 - DNA, 16 bp, Homo sapiens
cagtgctgattcagcc

SEQ ID NO: 2109494 - DNA, 13 bp, Homo sapiens
cagtgctgccatg

SEQ ID NO: 2109495 - DNA, 16 bp, Homo sapiens
cagtgctgccatgcca

SEQ ID NO: 2109496 - DNA, 22 bp, Homo sapiens
cagtgctgccatgccactgcca

SEQ ID NO: 2109497 - DNA, 15 bp, Homo sapiens
cagtgctgtacttga

SEQ ID NO: 2109498 - DNA, 17 bp, Homo sapiens
cagtgctgtggcctggg

SEQ ID NO: 2109499 - DNA, 18 bp, Homo sapiens
cagtgcttaatgtgaact

SEQ ID NO: 2109500 - DNA, 14 bp, Homo sapiens
cagtgcttcagcct

SEQ ID NO: 2109501 - DNA, 20 bp, Homo sapiens
cagtgcttcagcctgaggct

SEQ ID NO: 2109502 - DNA, 13 bp, Homo sapiens
cagtggacaccag

SEQ ID NO: 2109503 - DNA, 15 bp, Homo sapiens
cagtggagaaatatt

SEQ ID NO: 2109504 - DNA, 14 bp, Homo sapiens
cagtggagaattat

SEQ ID NO: 2109505 - DNA, 18 bp, Homo sapiens
cagtggatcatgaaaagt

SEQ ID NO: 2109506 - DNA, 14 bp, Homo sapiens
cagtggcagctgct

SEQ ID NO: 2109507 - DNA, 20 bp, Homo sapiens
cagtggcgagaggagaggaa

SEQ ID NO: 2109508 - DNA, 20 bp, Homo sapiens
cagtggctcacgcctatgat

SEQ ID NO: 2109509 - DNA, 20 bp, Homo sapiens
cagtgggaacgtgactgccc

SEQ ID NO: 2109510 - DNA, 21 bp, Homo sapiens
cagtgggaacgtgactgcccc

SEQ ID NO: 2109511 - DNA, 11 bp, Homo sapiens
cagtgggacaa

SEQ ID NO: 2109512 - DNA, 22 bp, Homo sapiens
cagtgggacaaaccagagcaga

SEQ ID NO: 2109513 - DNA, 19 bp, Homo sapiens
cagtgggacagggcatggc

SEQ ID NO: 2109514 - DNA, 14 bp, Homo sapiens
cagtgggagaaaac

SEQ ID NO: 2109515 - DNA, 16 bp, Homo sapiens
cagtgggagctgcctg

SEQ ID NO: 2109516 - DNA, 17 bp, Homo sapiens
cagtgggagctgcctgt

SEQ ID NO: 2109517 - DNA, 22 bp, Homo sapiens
cagtgggagggtaccagcagaa

SEQ ID NO: 2109518 - DNA, 13 bp, Homo sapiens
cagtgggtggcac

SEQ ID NO: 2109519 - DNA, 15 bp, Homo sapiens
cagtgggtggcacct

SEQ ID NO: 2109520 - DNA, 19 bp, Homo sapiens
cagtgggtggcacctcctg

SEQ ID NO: 2109521 - DNA, 21 bp, Homo sapiens
cagtgggtggcacctcctgag

SEQ ID NO: 2109522 - DNA, 23 bp, Homo sapiens
cagtgggtggcacctcctgagaa

SEQ ID NO: 2109523 - DNA, 20 bp, Homo sapiens
cagtggtatgatcacggctc

SEQ ID NO: 2109524 - DNA, 18 bp, Homo sapiens
cagtggtcaaaccgcact

SEQ ID NO: 2109525 - DNA, 14 bp, Homo sapiens
cagtggtgaagaaa

SEQ ID NO: 2109526 - DNA, 19 bp, Homo sapiens
cagtggtgcgatctgggtt

SEQ ID NO: 2109527 - DNA, 11 bp, Homo sapiens
cagtgtaaaga

SEQ ID NO: 2109528 - DNA, 19 bp, Homo sapiens
cagtgtaaagaataaatga

SEQ ID NO: 2109529 - DNA, 16 bp, Homo sapiens
cagtgtactgctttca

SEQ ID NO: 2109530 - DNA, 22 bp, Homo sapiens
cagtgtactgctttcaacttaa

SEQ ID NO: 2109531 - DNA, 19 bp, Homo sapiens
cagtgtagccttgcccgga

SEQ ID NO: 2109532 - DNA, 15 bp, Homo sapiens
cagtgtcccctccac

SEQ ID NO: 2109533 - DNA, 22 bp, Homo sapiens
cagtgtctgtatcggagacagt

SEQ ID NO: 2109534 - DNA, 23 bp, Homo sapiens
cagtgtctgtatcggagacagtg

SEQ ID NO: 2109535 - DNA, 24 bp, Homo sapiens
cagtgtctgtatcggagacagtga

SEQ ID NO: 2109536 - DNA, 16 bp, Homo sapiens
cagtgtcttccataat

SEQ ID NO: 2109537 - DNA, 17 bp, Homo sapiens
cagtgtcttccataatg

SEQ ID NO: 2109538 - DNA, 22 bp, Homo sapiens
cagtgtcttccataatgtataa

SEQ ID NO: 2109539 - DNA, 23 bp, Homo sapiens
cagtgtcttccataatgtataaa

SEQ ID NO: 2109540 - DNA, 19 bp, Homo sapiens
cagtgtgaatatatggtct

SEQ ID NO: 2109541 - DNA, 23 bp, Homo sapiens
cagtgtgcgttggaatcacctgg

SEQ ID NO: 2109542 - DNA, 13 bp, Homo sapiens
cagtgtggagagg

SEQ ID NO: 2109543 - DNA, 13 bp, Homo sapiens
cagtgtggcccca

SEQ ID NO: 2109544 - DNA, 19 bp, Homo sapiens
cagtgtgtccttggggcac

SEQ ID NO: 2109545 - DNA, 15 bp, Homo sapiens
cagtgttaaatgaaa

SEQ ID NO: 2109546 - DNA, 16 bp, Homo sapiens
cagtgttaaatgaaat

SEQ ID NO: 2109547 - DNA, 16 bp, Homo sapiens
cagtgttacttttaat

SEQ ID NO: 2109548 - DNA, 14 bp, Homo sapiens
cagtgttattttct

SEQ ID NO: 2109549 - DNA, 19 bp, Homo sapiens
cagtgttccccatctgggt

SEQ ID NO: 2109550 - DNA, 23 bp, Homo sapiens
cagtgttcctcaccaataacttc

SEQ ID NO: 2109551 - DNA, 15 bp, Homo sapiens
cagtgttttctggga

SEQ ID NO: 2109552 - DNA, 20 bp, Homo sapiens
cagttaactttcagaagaga

SEQ ID NO: 2109553 - DNA, 22 bp, Homo sapiens
cagttaactttcagaagagatg

SEQ ID NO: 2109554 - DNA, 22 bp, Homo sapiens
cagttacaaaaatagtagaaca

SEQ ID NO: 2109555 - DNA, 13 bp, Homo sapiens
cagttactcagcc

SEQ ID NO: 2109556 - DNA, 16 bp, Homo sapiens
cagttactcagccctg

SEQ ID NO: 2109557 - DNA, 17 bp, Homo sapiens
cagttactcagccctgg

SEQ ID NO: 2109558 - DNA, 19 bp, Homo sapiens
cagttactcagccctgggc

SEQ ID NO: 2109559 - DNA, 15 bp, Homo sapiens
cagttactggtttca

SEQ ID NO: 2109560 - DNA, 19 bp, Homo sapiens
cagttagggttgagttact

SEQ ID NO: 2109561 - DNA, 18 bp, Homo sapiens
cagttatattctttaaat

SEQ ID NO: 2109562 - DNA, 20 bp, Homo sapiens
cagttatggctataggtgct

SEQ ID NO: 2109563 - DNA, 23 bp, Homo sapiens
cagttcaacctggtggcaccaga

SEQ ID NO: 2109564 - DNA, 21 bp, Homo sapiens
cagttcagagttgtacactgt

SEQ ID NO: 2109565 - DNA, 21 bp, Homo sapiens
cagttcccggagcacagccct

SEQ ID NO: 2109566 - DNA, 13 bp, Homo sapiens
cagttcgcagcca

SEQ ID NO: 2109567 - DNA, 14 bp, Homo sapiens
cagttcgcagccac

SEQ ID NO: 2109568 - DNA, 18 bp, Homo sapiens
cagttcgcagccaccctg

SEQ ID NO: 2109569 - DNA, 21 bp, Homo sapiens
cagttcgcagccaccctgagg

SEQ ID NO: 2109570 - DNA, 22 bp, Homo sapiens
cagttcgcagccaccctgagga

SEQ ID NO: 2109571 - DNA, 13 bp, Homo sapiens
cagttctgctcct

SEQ ID NO: 2109572 - DNA, 18 bp, Homo sapiens
cagttctgctcctctcca

SEQ ID NO: 2109573 - DNA, 21 bp, Homo sapiens
cagttctgctcctctccaggc

SEQ ID NO: 2109574 - DNA, 15 bp, Homo sapiens
cagttcttggacccc

SEQ ID NO: 2109575 - DNA, 19 bp, Homo sapiens
cagttcttggacccctgaa

SEQ ID NO: 2109576 - DNA, 23 bp, Homo sapiens
cagttgaaaagactccaaagaaa

SEQ ID NO: 2109577 - DNA, 14 bp, Homo sapiens
cagttgacagcagg

SEQ ID NO: 2109578 - DNA, 20 bp, Homo sapiens
cagttgacttactgtttctt

SEQ ID NO: 2109579 - DNA, 22 bp, Homo sapiens
cagttgaggaatatgactgttt

SEQ ID NO: 2109580 - DNA, 20 bp, Homo sapiens
cagttgccatgtagacccct

SEQ ID NO: 2109581 - DNA, 22 bp, Homo sapiens
cagttggcagaaaggatgtttt

SEQ ID NO: 2109582 - DNA, 15 bp, Homo sapiens
cagttggcagagaag

SEQ ID NO: 2109583 - DNA, 20 bp, Homo sapiens
cagttggcagagaaggcctc

SEQ ID NO: 2109584 - DNA, 17 bp, Homo sapiens
cagttgggagcactgga

SEQ ID NO: 2109585 - DNA, 20 bp, Homo sapiens
cagttgggagcactggagtg

SEQ ID NO: 2109586 - DNA, 19 bp, Homo sapiens
cagttgtctattctgagcc

SEQ ID NO: 2109587 - DNA, 21 bp, Homo sapiens
cagttgtctattctgagcctt

SEQ ID NO: 2109588 - DNA, 14 bp, Homo sapiens
cagttgttttcccg

SEQ ID NO: 2109589 - DNA, 16 bp, Homo sapiens
cagtttagaacagagg

SEQ ID NO: 2109590 - DNA, 19 bp, Homo sapiens
cagtttagatttcaagaaa

SEQ ID NO: 2109591 - DNA, 15 bp, Homo sapiens
cagtttagtgcttta

SEQ ID NO: 2109592 - DNA, 17 bp, Homo sapiens
cagtttatatttaactc

SEQ ID NO: 2109593 - DNA, 19 bp, Homo sapiens
cagtttatatttaactctc

SEQ ID NO: 2109594 - DNA, 18 bp, Homo sapiens
cagtttcaattcagtgct

SEQ ID NO: 2109595 - DNA, 15 bp, Homo sapiens
cagtttcaggtgttt

SEQ ID NO: 2109596 - DNA, 22 bp, Homo sapiens
cagtttcttactgttttgtatc

SEQ ID NO: 2109597 - DNA, 23 bp, Homo sapiens
cagtttgcagaaaagcacctgcc

SEQ ID NO: 2109598 - DNA, 16 bp, Homo sapiens
cagtttgctttgccct

SEQ ID NO: 2109599 - DNA, 14 bp, Homo sapiens
cagtttgctttgta

SEQ ID NO: 2109600 - DNA, 18 bp, Homo sapiens
cagttttatccacagaaa

SEQ ID NO: 2109601 - DNA, 15 bp, Homo sapiens
cagttttctgagaaa

SEQ ID NO: 2109602 - DNA, 19 bp, Homo sapiens
cagttttctgagaaagact

SEQ ID NO: 2109603 - DNA, 22 bp, Homo sapiens
cagtttttcggtgggacagccc

SEQ ID NO: 2109604 - DNA, 19 bp, Homo sapiens
cataaaataaagtatatat

SEQ ID NO: 2109605 - DNA, 14 bp, Homo sapiens
cataaacagcattt

SEQ ID NO: 2109606 - DNA, 15 bp, Homo sapiens
cataaacttcatctt

SEQ ID NO: 2109607 - DNA, 23 bp, Homo sapiens
cataaaggtatttagaatatatt

SEQ ID NO: 2109608 - DNA, 20 bp, Homo sapiens
cataaaggtggtatgtgtgt

SEQ ID NO: 2109609 - DNA, 15 bp, Homo sapiens
cataacaacttcata

SEQ ID NO: 2109610 - DNA, 14 bp, Homo sapiens
cataacatctttga

SEQ ID NO: 2109611 - DNA, 20 bp, Homo sapiens
cataacatctttgaaaagaa

SEQ ID NO: 2109612 - DNA, 22 bp, Homo sapiens
cataaccccaggcatcccatcc

SEQ ID NO: 2109613 - DNA, 18 bp, Homo sapiens
cataaccttaccagattt

SEQ ID NO: 2109614 - DNA, 21 bp, Homo sapiens
cataacttgctgaatttcagg

SEQ ID NO: 2109615 - DNA, 16 bp, Homo sapiens
cataagaccctaagcc

SEQ ID NO: 2109616 - DNA, 20 bp, Homo sapiens
cataagaccctaagcctcct

SEQ ID NO: 2109617 - DNA, 17 bp, Homo sapiens
cataagattaaaggaag

SEQ ID NO: 2109618 - DNA, 21 bp, Homo sapiens
cataagattaaaggaaggaaa

SEQ ID NO: 2109619 - DNA, 21 bp, Homo sapiens
cataagcctccatttagttct

SEQ ID NO: 2109620 - DNA, 16 bp, Homo sapiens
cataagctaagcctta

SEQ ID NO: 2109621 - DNA, 22 bp, Homo sapiens
cataaggcatatacaaataaac

SEQ ID NO: 2109622 - DNA, 17 bp, Homo sapiens
cataaggccagaaactc

SEQ ID NO: 2109623 - DNA, 21 bp, Homo sapiens
cataaggccagaaactccttt

SEQ ID NO: 2109624 - DNA, 16 bp, Homo sapiens
cataaggtgcagtagg

SEQ ID NO: 2109625 - DNA, 18 bp, Homo sapiens
cataagttggaccagagg

SEQ ID NO: 2109626 - DNA, 14 bp, Homo sapiens
cataataaactaga

SEQ ID NO: 2109627 - DNA, 17 bp, Homo sapiens
cataatgttacattatt

SEQ ID NO: 2109628 - DNA, 14 bp, Homo sapiens
cataattatgacag

SEQ ID NO: 2109629 - DNA, 15 bp, Homo sapiens
cataatttgtacata

SEQ ID NO: 2109630 - DNA, 12 bp, Homo sapiens
cataattttcaa

SEQ ID NO: 2109631 - DNA, 22 bp, Homo sapiens
cataattttcaagagaagaaaa

SEQ ID NO: 2109632 - DNA, 20 bp, Homo sapiens
cataattttcttcatgcaat

SEQ ID NO: 2109633 - DNA, 12 bp, Homo sapiens
catacaatttgc

SEQ ID NO: 2109634 - DNA, 16 bp, Homo sapiens
catacacttgtataaa

SEQ ID NO: 2109635 - DNA, 21 bp, Homo sapiens
catacacttgtataaatgtat

SEQ ID NO: 2109636 - DNA, 16 bp, Homo sapiens
catacagaggtaacta

SEQ ID NO: 2109637 - DNA, 17 bp, Homo sapiens
catacagaggtaactat

SEQ ID NO: 2109638 - DNA, 17 bp, Homo sapiens
catacatacacatacat

SEQ ID NO: 2109639 - DNA, 14 bp, Homo sapiens
catacatacataca

SEQ ID NO: 2109640 - DNA, 15 bp, Homo sapiens
catacatacatacat

SEQ ID NO: 2109641 - DNA, 18 bp, Homo sapiens
catacatacatacatata

SEQ ID NO: 2109642 - DNA, 14 bp, Homo sapiens
catacatacatata

SEQ ID NO: 2109643 - DNA, 15 bp, Homo sapiens
catacatacatatat

SEQ ID NO: 2109644 - DNA, 14 bp, Homo sapiens
catacatatatatc

SEQ ID NO: 2109645 - DNA, 21 bp, Homo sapiens
catacatttataatgtttgct

SEQ ID NO: 2109646 - DNA, 17 bp, Homo sapiens
catacccctgcctgggt

SEQ ID NO: 2109647 - DNA, 22 bp, Homo sapiens
catacccctgcctgggttttct

SEQ ID NO: 2109648 - DNA, 22 bp, Homo sapiens
cattgtttgtctgtcttcatag

SEQ ID NO: 2109649 - DNA, 12 bp, Homo sapiens
catttaaaaaaa

SEQ ID NO: 2109650 - DNA, 13 bp, Homo sapiens
catttaaaatgat

SEQ ID NO: 2109651 - DNA, 16 bp, Homo sapiens
catttaaaatgattag

SEQ ID NO: 2109652 - DNA, 22 bp, Homo sapiens
catttaaaatggaaaagagaga

SEQ ID NO: 2109653 - DNA, 18 bp, Homo sapiens
catttaagggaaaaatat

SEQ ID NO: 2109654 - DNA, 12 bp, Homo sapiens
catttaattcat

SEQ ID NO: 2109655 - DNA, 24 bp, Homo sapiens
catttaattcataattagaacaat

SEQ ID NO: 2109656 - DNA, 21 bp, Homo sapiens
catttacacattctcacaatt

SEQ ID NO: 2109657 - DNA, 13 bp, Homo sapiens
catttactgacca

SEQ ID NO: 2109658 - DNA, 20 bp, Homo sapiens
catttagttctttgttattt

SEQ ID NO: 2109659 - DNA, 14 bp, Homo sapiens
catttataatgttt

SEQ ID NO: 2109660 - DNA, 21 bp, Homo sapiens
catttatatatatatgtatat

SEQ ID NO: 2109661 - DNA, 22 bp, Homo sapiens
catttatctaaaagaatttaaa

SEQ ID NO: 2109662 - DNA, 23 bp, Homo sapiens
catttatgagctcttcatgtttc

SEQ ID NO: 2109663 - DNA, 20 bp, Homo sapiens
catttatggtcaacacttaa

SEQ ID NO: 2109664 - DNA, 14 bp, Homo sapiens
catttatgtttatt

SEQ ID NO: 2109665 - DNA, 15 bp, Homo sapiens
catttcaactccaga

SEQ ID NO: 2109666 - DNA, 14 bp, Homo sapiens
catttcacacaggt

SEQ ID NO: 2109667 - DNA, 12 bp, Homo sapiens
catttcacatta

SEQ ID NO: 2109668 - DNA, 17 bp, Homo sapiens
catttcactttaaagtc

SEQ ID NO: 2109669 - DNA, 21 bp, Homo sapiens
catttcactttaaagtctttc

SEQ ID NO: 2109670 - DNA, 20 bp, Homo sapiens
catttcagtttgtttacttt

SEQ ID NO: 2109671 - DNA, 20 bp, Homo sapiens
catttcatctactacagggt

SEQ ID NO: 2109672 - DNA, 15 bp, Homo sapiens
catttcatctatttc

SEQ ID NO: 2109673 - DNA, 18 bp, Homo sapiens
catttcatctatttctga

SEQ ID NO: 2109674 - DNA, 14 bp, Homo sapiens
catttcatctcatt

SEQ ID NO: 2109675 - DNA, 15 bp, Homo sapiens
catttcatctcattt

SEQ ID NO: 2109676 - DNA, 11 bp, Homo sapiens
catttcatctg

SEQ ID NO: 2109677 - DNA, 13 bp, Homo sapiens
catttcattgtat

SEQ ID NO: 2109678 - DNA, 17 bp, Homo sapiens
catttccaaatgaatga

SEQ ID NO: 2109679 - DNA, 21 bp, Homo sapiens
catttccacactgtcagagct

SEQ ID NO: 2109680 - DNA, 12 bp, Homo sapiens
catttccctcct

SEQ ID NO: 2109681 - DNA, 19 bp, Homo sapiens
catttccgtgaagggcacc

SEQ ID NO: 2109682 - DNA, 20 bp, Homo sapiens
catttcctgggtggctactc

SEQ ID NO: 2109683 - DNA, 21 bp, Homo sapiens
catttcctgggtggctactct

SEQ ID NO: 2109684 - DNA, 13 bp, Homo sapiens
catttcctgtgtc

SEQ ID NO: 2109685 - DNA, 14 bp, Homo sapiens
catttccttggagg

SEQ ID NO: 2109686 - DNA, 23 bp, Homo sapiens
catttccttggaggccaccggga

SEQ ID NO: 2109687 - DNA, 20 bp, Homo sapiens
catttctaacatatgtatta

SEQ ID NO: 2109688 - DNA, 23 bp, Homo sapiens
catttctatagccaaaaatagct

SEQ ID NO: 2109689 - DNA, 13 bp, Homo sapiens
catttctatttat

SEQ ID NO: 2109690 - DNA, 13 bp, Homo sapiens
catttctctgagc

SEQ ID NO: 2109691 - DNA, 13 bp, Homo sapiens
catttctctgctt

SEQ ID NO: 2109692 - DNA, 22 bp, Homo sapiens
catttctgagtttcattctcct

SEQ ID NO: 2109693 - DNA, 14 bp, Homo sapiens
catttctgtctctc

SEQ ID NO: 2109694 - DNA, 17 bp, Homo sapiens
catttcttaaaatgttt

SEQ ID NO: 2109695 - DNA, 18 bp, Homo sapiens
catttgagcagggctcag

SEQ ID NO: 2109696 - DNA, 22 bp, Homo sapiens
catttgagttattttaattatc

SEQ ID NO: 2109697 - DNA, 20 bp, Homo sapiens
catttgatgtacatgtgtag

SEQ ID NO: 2109698 - DNA, 12 bp, Homo sapiens
catttgccctgt

SEQ ID NO: 2109699 - DNA, 14 bp, Homo sapiens
catttgccttgctg

SEQ ID NO: 2109700 - DNA, 20 bp, Homo sapiens
catttgctaactagcttgga

SEQ ID NO: 2109701 - DNA, 22 bp, Homo sapiens
catttgggaaattcagcttttg

SEQ ID NO: 2109702 - DNA, 15 bp, Homo sapiens
catttgtaatgtatc

SEQ ID NO: 2109703 - DNA, 17 bp, Homo sapiens
catttgtaatgtatctt

SEQ ID NO: 2109704 - DNA, 17 bp, Homo sapiens
catttgtacattcctga

SEQ ID NO: 2109705 - DNA, 15 bp, Homo sapiens
catttgtgtcaatgg

SEQ ID NO: 2109706 - DNA, 19 bp, Homo sapiens
catttgttcatgagtggat

SEQ ID NO: 2109707 - DNA, 20 bp, Homo sapiens
cattttaaaaaccaatcatt

SEQ ID NO: 2109708 - DNA, 21 bp, Homo sapiens
cattttaaaaaccaatcattt

SEQ ID NO: 2109709 - DNA, 16 bp, Homo sapiens
cattttaaataaaaga

SEQ ID NO: 2109710 - DNA, 17 bp, Homo sapiens
cattttaaataaaagaa

SEQ ID NO: 2109711 - DNA, 14 bp, Homo sapiens
cattttaggcctcc

SEQ ID NO: 2109712 - DNA, 15 bp, Homo sapiens
cattttaggcctcct

SEQ ID NO: 2109713 - DNA, 14 bp, Homo sapiens
cattttagtgactg

SEQ ID NO: 2109714 - DNA, 15 bp, Homo sapiens
cattttatattagaa

SEQ ID NO: 2109715 - DNA, 19 bp, Homo sapiens
catggcttggggagcagag

SEQ ID NO: 2109716 - DNA, 20 bp, Homo sapiens
catgggaaatgtcaacaagt

SEQ ID NO: 2109717 - DNA, 17 bp, Homo sapiens
catgggcccaggaatgc

SEQ ID NO: 2109718 - DNA, 11 bp, Homo sapiens
catgggcctgg

SEQ ID NO: 2109719 - DNA, 12 bp, Homo sapiens
catgggcttgga

SEQ ID NO: 2109720 - DNA, 22 bp, Homo sapiens
catggggcatagaaactgagga

SEQ ID NO: 2109721 - DNA, 17 bp, Homo sapiens
catgggtgtgccaggct

SEQ ID NO: 2109722 - DNA, 19 bp, Homo sapiens
catggtattgtaatgaata

SEQ ID NO: 2109723 - DNA, 17 bp, Homo sapiens
catggtccggtgtcctt

SEQ ID NO: 2109724 - DNA, 22 bp, Homo sapiens
catggtctctcgggccccccac

SEQ ID NO: 2109725 - DNA, 11 bp, Homo sapiens
catggtgaaaa

SEQ ID NO: 2109726 - DNA, 18 bp, Homo sapiens
catggtgaaaatgtactg

SEQ ID NO: 2109727 - DNA, 15 bp, Homo sapiens
catggtgacacacag

SEQ ID NO: 2109728 - DNA, 16 bp, Homo sapiens
catggtgacacacagc

SEQ ID NO: 2109729 - DNA, 19 bp, Homo sapiens
catggtgcttgttaatgct

SEQ ID NO: 2109730 - DNA, 19 bp, Homo sapiens
catggtgctttcaggtctg

SEQ ID NO: 2109731 - DNA, 13 bp, Homo sapiens
catggtggaaggg

SEQ ID NO: 2109732 - DNA, 14 bp, Homo sapiens
catgtaaaagagtc

SEQ ID NO: 2109733 - DNA, 16 bp, Homo sapiens
catgtaaaagagtcat

SEQ ID NO: 2109734 - DNA, 21 bp, Homo sapiens
catgtaacaggtaaccacaat

SEQ ID NO: 2109735 - DNA, 20 bp, Homo sapiens
catgtaaggtcttcttgtgt

SEQ ID NO: 2109736 - DNA, 16 bp, Homo sapiens
catgtaataaatctga

SEQ ID NO: 2109737 - DNA, 20 bp, Homo sapiens
catgtacattggtctttcta

SEQ ID NO: 2109738 - DNA, 16 bp, Homo sapiens
catgtaccagtgtact

SEQ ID NO: 2109739 - DNA, 17 bp, Homo sapiens
catgtaccagtgtactg

SEQ ID NO: 2109740 - DNA, 20 bp, Homo sapiens
catgtactccagagggacag

SEQ ID NO: 2109741 - DNA, 22 bp, Homo sapiens
catgtactgagccttgtaattc

SEQ ID NO: 2109742 - DNA, 17 bp, Homo sapiens
catgtacttcctgtgta

SEQ ID NO: 2109743 - DNA, 21 bp, Homo sapiens
catgtacttcctgtgtactct

SEQ ID NO: 2109744 - DNA, 18 bp, Homo sapiens
catgtagaataaatgaag

SEQ ID NO: 2109745 - DNA, 19 bp, Homo sapiens
catgtagaataaatgaaga

SEQ ID NO: 2109746 - DNA, 14 bp, Homo sapiens
catgtagcaggact

SEQ ID NO: 2109747 - DNA, 21 bp, Homo sapiens
catgtatagtgagtgtggctt

SEQ ID NO: 2109748 - DNA, 21 bp, Homo sapiens
catgtatgtcttggacactgt

SEQ ID NO: 2109749 - DNA, 10 bp, Homo sapiens
catgtatgtg

SEQ ID NO: 2109750 - DNA, 16 bp, Homo sapiens
catgtattatcacatc

SEQ ID NO: 2109751 - DNA, 20 bp, Homo sapiens
catgtcaccgtggaccttcc

SEQ ID NO: 2109752 - DNA, 12 bp, Homo sapiens
catgtcacctca

SEQ ID NO: 2109753 - DNA, 14 bp, Homo sapiens
catgtcacctcagc

SEQ ID NO: 2109754 - DNA, 15 bp, Homo sapiens
catgtcacctcagct

SEQ ID NO: 2109755 - DNA, 17 bp, Homo sapiens
catgtcagagccaggct

SEQ ID NO: 2109756 - DNA, 21 bp, Homo sapiens
catgtcagagccaggctctgc

SEQ ID NO: 2109757 - DNA, 21 bp, Homo sapiens
catgtcaggcctgtgtgtgaa

SEQ ID NO: 2109758 - DNA, 16 bp, Homo sapiens
catgtcctatgtgtga

SEQ ID NO: 2109759 - DNA, 19 bp, Homo sapiens
catgtccttgtgtgttttg

SEQ ID NO: 2109760 - DNA, 13 bp, Homo sapiens
catgtcgcctgcc

SEQ ID NO: 2109761 - DNA, 17 bp, Homo sapiens
catgtctctcagaattc

SEQ ID NO: 2109762 - DNA, 12 bp, Homo sapiens
catgtctggcta

SEQ ID NO: 2109763 - DNA, 14 bp, Homo sapiens
catgtcttgtacat

SEQ ID NO: 2109764 - DNA, 15 bp, Homo sapiens
catgtcttgtacatg

SEQ ID NO: 2109765 - DNA, 21 bp, Homo sapiens
catgtctttctccaaagttat

SEQ ID NO: 2109766 - DNA, 23 bp, Homo sapiens
catgtgaaaataatagccatcct

SEQ ID NO: 2109767 - DNA, 12 bp, Homo sapiens
catgtgacacat

SEQ ID NO: 2109768 - DNA, 15 bp, Homo sapiens
catgtgacacatatg

SEQ ID NO: 2109769 - DNA, 21 bp, Homo sapiens
catgtgaccacatacgtgtta

SEQ ID NO: 2109770 - DNA, 19 bp, Homo sapiens
catgtgatccttttatgtt

SEQ ID NO: 2109771 - DNA, 15 bp, Homo sapiens
catgtgcacatgcac

SEQ ID NO: 2109772 - DNA, 20 bp, Homo sapiens
catgtgctattgaactgagc

SEQ ID NO: 2109773 - DNA, 17 bp, Homo sapiens
catgtggaatataaaga

SEQ ID NO: 2109774 - DNA, 13 bp, Homo sapiens
catgtggagtgga

SEQ ID NO: 2109775 - DNA, 14 bp, Homo sapiens
catgtggagtggac

SEQ ID NO: 2109776 - DNA, 17 bp, Homo sapiens
caccatgcgctgctcaa

SEQ ID NO: 2109777 - DNA, 15 bp, Homo sapiens
caccatggaggcagg

SEQ ID NO: 2109778 - DNA, 17 bp, Homo sapiens
caccatgtaacaaccag

SEQ ID NO: 2109779 - DNA, 18 bp, Homo sapiens
caccatgtaacaaccaga

SEQ ID NO: 2109780 - DNA, 19 bp, Homo sapiens
caccatgtttgagctcaga

SEQ ID NO: 2109781 - DNA, 18 bp, Homo sapiens
cacccaaagcatggacta

SEQ ID NO: 2109782 - DNA, 20 bp, Homo sapiens
cacccaacagctcagagatg

SEQ ID NO: 2109783 - DNA, 14 bp, Homo sapiens
cacccaagagggct

SEQ ID NO: 2109784 - DNA, 21 bp, Homo sapiens
cacccaagagggctgcttccc

SEQ ID NO: 2109785 - DNA, 16 bp, Homo sapiens
cacccaagcaaggcca

SEQ ID NO: 2109786 - DNA, 23 bp, Homo sapiens
cacccaataaacattaagattga

SEQ ID NO: 2109787 - DNA, 17 bp, Homo sapiens
cacccaattcaaaacat

SEQ ID NO: 2109788 - DNA, 19 bp, Homo sapiens
cacccacatgtgacacata

SEQ ID NO: 2109789 - DNA, 16 bp, Homo sapiens
cacccacgtgagagaa

SEQ ID NO: 2109790 - DNA, 13 bp, Homo sapiens
cacccactcacca

SEQ ID NO: 2109791 - DNA, 14 bp, Homo sapiens
cacccactggccag

SEQ ID NO: 2109792 - DNA, 16 bp, Homo sapiens
cacccactggccagtc

SEQ ID NO: 2109793 - DNA, 21 bp, Homo sapiens
cacccagaaattccttcccac

SEQ ID NO: 2109794 - DNA, 20 bp, Homo sapiens
cacccagagggtagggcagc

SEQ ID NO: 2109795 - DNA, 21 bp, Homo sapiens
cacccagagggtagggcagca

SEQ ID NO: 2109796 - DNA, 12 bp, Homo sapiens
cacccagcccac

SEQ ID NO: 2109797 - DNA, 16 bp, Homo sapiens
cacccagcccacttct

SEQ ID NO: 2109798 - DNA, 12 bp, Homo sapiens
cacccagcccat

SEQ ID NO: 2109799 - DNA, 15 bp, Homo sapiens
cacccagcccattct

SEQ ID NO: 2109800 - DNA, 23 bp, Homo sapiens
cacccaggagccccgaggccttc

SEQ ID NO: 2109801 - DNA, 20 bp, Homo sapiens
cacccaggcaggccctgcct

SEQ ID NO: 2109802 - DNA, 12 bp, Homo sapiens
cacccaggctcc

SEQ ID NO: 2109803 - DNA, 23 bp, Homo sapiens
cacccaggctctggagccagaga

SEQ ID NO: 2109804 - DNA, 15 bp, Homo sapiens
cacccaggctgcact

SEQ ID NO: 2109805 - DNA, 18 bp, Homo sapiens
cacccaggctgcactgca

SEQ ID NO: 2109806 - DNA, 20 bp, Homo sapiens
cacccaggctgcactgcagt

SEQ ID NO: 2109807 - DNA, 20 bp, Homo sapiens
cacccaggctggagtacagt

SEQ ID NO: 2109808 - DNA, 20 bp, Homo sapiens
cacccaggctggagtggagt

SEQ ID NO: 2109809 - DNA, 15 bp, Homo sapiens
cacccagggctccct

SEQ ID NO: 2109810 - DNA, 16 bp, Homo sapiens
cacccagtgctgccat

SEQ ID NO: 2109811 - DNA, 14 bp, Homo sapiens
cacccatcttcctg

SEQ ID NO: 2109812 - DNA, 20 bp, Homo sapiens
cacccatcttcctgctgctg

SEQ ID NO: 2109813 - DNA, 21 bp, Homo sapiens
cacccatcttcctgctgctgt

SEQ ID NO: 2109814 - DNA, 21 bp, Homo sapiens
cacccattcccccatgtggct

SEQ ID NO: 2109815 - DNA, 23 bp, Homo sapiens
caccccaagggacaaccccatca

SEQ ID NO: 2109816 - DNA, 13 bp, Homo sapiens
caccccaccaggg

SEQ ID NO: 2109817 - DNA, 12 bp, Homo sapiens
caccccactcca

SEQ ID NO: 2109818 - DNA, 16 bp, Homo sapiens
caccccactccagccc

SEQ ID NO: 2109819 - DNA, 17 bp, Homo sapiens
caccccactccagccct

SEQ ID NO: 2109820 - DNA, 14 bp, Homo sapiens
caccccactggatc

SEQ ID NO: 2109821 - DNA, 18 bp, Homo sapiens
caccccaggacgccactc

SEQ ID NO: 2109822 - DNA, 13 bp, Homo sapiens
cacccccagcccc

SEQ ID NO: 2109823 - DNA, 14 bp, Homo sapiens
caccccctcattcc

SEQ ID NO: 2109824 - DNA, 16 bp, Homo sapiens
caccccctcattcccc

SEQ ID NO: 2109825 - DNA, 16 bp, Homo sapiens
caccccctccccaggg

SEQ ID NO: 2109826 - DNA, 14 bp, Homo sapiens
caccccctgcagct

SEQ ID NO: 2109827 - DNA, 17 bp, Homo sapiens
cacccccttcagtgccc

SEQ ID NO: 2109828 - DNA, 20 bp, Homo sapiens
cacccccttcagtgcccacc

SEQ ID NO: 2109829 - DNA, 21 bp, Homo sapiens
cacccccttcagtgcccacca

SEQ ID NO: 2109830 - DNA, 12 bp, Homo sapiens
caccccggcctc

SEQ ID NO: 2109831 - DNA, 19 bp, Homo sapiens
caccccggcctccactccc

SEQ ID NO: 2109832 - DNA, 13 bp, Homo sapiens
cacccctccccat

SEQ ID NO: 2109833 - DNA, 18 bp, Homo sapiens
cacccctctcccccgccc

SEQ ID NO: 2109834 - DNA, 17 bp, Homo sapiens
caccccttatccaggac

SEQ ID NO: 2109835 - DNA, 18 bp, Homo sapiens
caccccttgaagcctttt

SEQ ID NO: 2109836 - DNA, 17 bp, Homo sapiens
cacccgcttcctgtttc

SEQ ID NO: 2109837 - DNA, 17 bp, Homo sapiens
cacccggaaagactgaa

SEQ ID NO: 2109838 - DNA, 12 bp, Homo sapiens
cacccggcccct

SEQ ID NO: 2109839 - DNA, 13 bp, Homo sapiens
cacccggcccctg

SEQ ID NO: 2109840 - DNA, 14 bp, Homo sapiens
cacccggcccctgc

SEQ ID NO: 2109841 - DNA, 16 bp, Homo sapiens
cacccggcccctgctg

SEQ ID NO: 2109842 - DNA, 16 bp, Homo sapiens
cacccgtaggcagcct

SEQ ID NO: 2109843 - DNA, 18 bp, Homo sapiens
cacccgtaggcagcctct

SEQ ID NO: 2109844 - DNA, 21 bp, Homo sapiens
cacccgtaggcagcctctctg

SEQ ID NO: 2109845 - DNA, 21 bp, Homo sapiens
cacccgtcttggggctcgccc

SEQ ID NO: 2109846 - DNA, 16 bp, Homo sapiens
caccctacctgtgcct

SEQ ID NO: 2109847 - DNA, 17 bp, Homo sapiens
caccctatccctgtaca

SEQ ID NO: 2109848 - DNA, 18 bp, Homo sapiens
caccctcaaaccctgtgg

SEQ ID NO: 2109849 - DNA, 16 bp, Homo sapiens
caccctcaaatgtcag

SEQ ID NO: 2109850 - DNA, 14 bp, Homo sapiens
caccctccacctct

SEQ ID NO: 2109851 - DNA, 14 bp, Homo sapiens
caccctcccaccat

SEQ ID NO: 2109852 - DNA, 18 bp, Homo sapiens
caccctcccaccatgcgc

SEQ ID NO: 2109853 - DNA, 14 bp, Homo sapiens
caccctccttcccg

SEQ ID NO: 2109854 - DNA, 18 bp, Homo sapiens
caccctcgtggacacctg

SEQ ID NO: 2109855 - DNA, 20 bp, Homo sapiens
caccctcgtggacacctgcc

SEQ ID NO: 2109856 - DNA, 13 bp, Homo sapiens
caccctctccatg

SEQ ID NO: 2109857 - DNA, 18 bp, Homo sapiens
caccctctccatgcccaa

SEQ ID NO: 2109858 - DNA, 17 bp, Homo sapiens
caccctctgggcagctg

SEQ ID NO: 2109859 - DNA, 23 bp, Homo sapiens
caccctgaatggttccatgcctg

SEQ ID NO: 2109860 - DNA, 18 bp, Homo sapiens
caccctgaggagtctgag

SEQ ID NO: 2109861 - DNA, 21 bp, Homo sapiens
caccctgaggagtctgaggtc

SEQ ID NO: 2109862 - DNA, 19 bp, Homo sapiens
caccctgaggcctctggaa

SEQ ID NO: 2109863 - DNA, 12 bp, Homo sapiens
caccctgcagag

SEQ ID NO: 2109864 - DNA, 15 bp, Homo sapiens
caccctgcagagcac

SEQ ID NO: 2109865 - DNA, 23 bp, Homo sapiens
caccctgcagagcacacaggtac

SEQ ID NO: 2109866 - DNA, 17 bp, Homo sapiens
caccctggaaaggggag

SEQ ID NO: 2109867 - DNA, 11 bp, Homo sapiens
caccctggaat

SEQ ID NO: 2109868 - DNA, 11 bp, Homo sapiens
caccctggccc

SEQ ID NO: 2109869 - DNA, 13 bp, Homo sapiens
caccctggcccca

SEQ ID NO: 2109870 - DNA, 17 bp, Homo sapiens
caccctggcccgcccct

SEQ ID NO: 2109871 - DNA, 16 bp, Homo sapiens
caccctggggagaaag

SEQ ID NO: 2109872 - DNA, 15 bp, Homo sapiens
caccctgttccctct

SEQ ID NO: 2109873 - DNA, 22 bp, Homo sapiens
cacccttcacataccctccccc

SEQ ID NO: 2109874 - DNA, 18 bp, Homo sapiens
cacccttctttcctcttc

SEQ ID NO: 2109875 - DNA, 20 bp, Homo sapiens
cacccttctttcctcttccc

SEQ ID NO: 2109876 - DNA, 14 bp, Homo sapiens
cacccttggacttg

SEQ ID NO: 2109877 - DNA, 16 bp, Homo sapiens
cacccttggacttgag

SEQ ID NO: 2109878 - DNA, 14 bp, Homo sapiens
caccgaagagccct

SEQ ID NO: 2109879 - DNA, 18 bp, Homo sapiens
caccgaagagccctgagc

SEQ ID NO: 2109880 - DNA, 18 bp, Homo sapiens
caccgacgcgtctcctgt

SEQ ID NO: 2109881 - DNA, 19 bp, Homo sapiens
caccgacgcgtctcctgtt

SEQ ID NO: 2109882 - DNA, 21 bp, Homo sapiens
caccgagagtagccgagagcc

SEQ ID NO: 2109883 - DNA, 15 bp, Homo sapiens
caccgcagaaggaag

SEQ ID NO: 2109884 - DNA, 14 bp, Homo sapiens
caccgcagcatgtg

SEQ ID NO: 2109885 - DNA, 15 bp, Homo sapiens
caccgccagaggaca

SEQ ID NO: 2109886 - DNA, 12 bp, Homo sapiens
caccgctgccta

SEQ ID NO: 2109887 - DNA, 15 bp, Homo sapiens
caccttccagtgagc

SEQ ID NO: 2109888 - DNA, 17 bp, Homo sapiens
caccttcccagctctcc

SEQ ID NO: 2109889 - DNA, 21 bp, Homo sapiens
caccttcccagctctccctct

SEQ ID NO: 2109890 - DNA, 13 bp, Homo sapiens
caccttcccatgc

SEQ ID NO: 2109891 - DNA, 15 bp, Homo sapiens
caccttccccagact

SEQ ID NO: 2109892 - DNA, 20 bp, Homo sapiens
caccttccccagactcagct

SEQ ID NO: 2109893 - DNA, 21 bp, Homo sapiens
caccttccccagactcagctc

SEQ ID NO: 2109894 - DNA, 16 bp, Homo sapiens
caccttgacagggcac

SEQ ID NO: 2109895 - DNA, 18 bp, Homo sapiens
caccttgccaagctttct

SEQ ID NO: 2109896 - DNA, 23 bp, Homo sapiens
caccttgctcctccttctgctgc

SEQ ID NO: 2109897 - DNA, 13 bp, Homo sapiens
caccttggagcct

SEQ ID NO: 2109898 - DNA, 15 bp, Homo sapiens
caccttggagcctga

SEQ ID NO: 2109899 - DNA, 12 bp, Homo sapiens
caccttgggacc

SEQ ID NO: 2109900 - DNA, 20 bp, Homo sapiens
caccttgtcatgtaccatca

SEQ ID NO: 2109901 - DNA, 23 bp, Homo sapiens
caccttgtgctggggacaggtcc

SEQ ID NO: 2109902 - DNA, 15 bp, Homo sapiens
caccttgtgtctgta

SEQ ID NO: 2109903 - DNA, 15 bp, Homo sapiens
cacctttgcaaagtt

SEQ ID NO: 2109904 - DNA, 17 bp, Homo sapiens
cacctttgggatcagcc

SEQ ID NO: 2109905 - DNA, 19 bp, Homo sapiens
cacctttgggatcagcctc

SEQ ID NO: 2109906 - DNA, 15 bp, Homo sapiens
caccttttataccag

SEQ ID NO: 2109907 - DNA, 16 bp, Homo sapiens
caccttttccaggagt

SEQ ID NO: 2109908 - DNA, 15 bp, Homo sapiens
cacctttttgacttt

SEQ ID NO: 2109909 - DNA, 18 bp, Homo sapiens
cacgaacccacctgctga

SEQ ID NO: 2109910 - DNA, 22 bp, Homo sapiens
cacgaatttgctggggaatctc

SEQ ID NO: 2109911 - DNA, 19 bp, Homo sapiens
cacgacctcggctcactgc

SEQ ID NO: 2109912 - DNA, 17 bp, Homo sapiens
cacgactcttcctgcaa

SEQ ID NO: 2109913 - DNA, 19 bp, Homo sapiens
cacgagcaggctactgtca

SEQ ID NO: 2109914 - DNA, 17 bp, Homo sapiens
cacgaggagcttccagt

SEQ ID NO: 2109915 - DNA, 21 bp, Homo sapiens
cacgaggagcttccagtgcat

SEQ ID NO: 2109916 - DNA, 23 bp, Homo sapiens
cacgagtcacctgcaagccccag

SEQ ID NO: 2109917 - DNA, 12 bp, Homo sapiens
cacgatgaaaaa

SEQ ID NO: 2109918 - DNA, 21 bp, Homo sapiens
cacgatgtggccctggcctgc

SEQ ID NO: 2109919 - DNA, 16 bp, Homo sapiens
cacgcaacccttgctg

SEQ ID NO: 2109920 - DNA, 17 bp, Homo sapiens
cacgcaagggcatcagg

SEQ ID NO: 2109921 - DNA, 20 bp, Homo sapiens
cacgcactgcgtagagcctg

SEQ ID NO: 2109922 - DNA, 16 bp, Homo sapiens
cacgcaggaactccca

SEQ ID NO: 2109923 - DNA, 17 bp, Homo sapiens
cacgcaggaactcccag

SEQ ID NO: 2109924 - DNA, 19 bp, Homo sapiens
cacgcaggaactcccagca

SEQ ID NO: 2109925 - DNA, 18 bp, Homo sapiens
cacgccaccgctgccttt

SEQ ID NO: 2109926 - DNA, 15 bp, Homo sapiens
cacgccactgcacta

SEQ ID NO: 2109927 - DNA, 19 bp, Homo sapiens
cacgccagtttcaccattt

SEQ ID NO: 2109928 - DNA, 13 bp, Homo sapiens
cacgcccagcctc

SEQ ID NO: 2109929 - DNA, 18 bp, Homo sapiens
cacgcctatgatcccagc

SEQ ID NO: 2109930 - DNA, 19 bp, Homo sapiens
cacgcctgtaatcccagca

SEQ ID NO: 2109931 - DNA, 21 bp, Homo sapiens
cacgcctgtaatcccagcact

SEQ ID NO: 2109932 - DNA, 22 bp, Homo sapiens
cacgcctgtaatcccagcactt

SEQ ID NO: 2109933 - DNA, 20 bp, Homo sapiens
cacgcctgtaatcccagcag

SEQ ID NO: 2109934 - DNA, 16 bp, Homo sapiens
cacgcgtgcacacacc

SEQ ID NO: 2109935 - DNA, 17 bp, Homo sapiens
cacgctggaccttgaac

SEQ ID NO: 2109936 - DNA, 21 bp, Homo sapiens
cacgctggagtgcagtgagcc

SEQ ID NO: 2109937 - DNA, 18 bp, Homo sapiens
cacgctgtcctctcgagc

SEQ ID NO: 2109938 - DNA, 19 bp, Homo sapiens
cacggaccatgtggtatgt

SEQ ID NO: 2109939 - DNA, 11 bp, Homo sapiens
cacggcagctt

SEQ ID NO: 2109940 - DNA, 15 bp, Homo sapiens
cacggcagcttgagc

SEQ ID NO: 2109941 - DNA, 12 bp, Homo sapiens
cacggccaccct

SEQ ID NO: 2109942 - DNA, 14 bp, Homo sapiens
cacggccaccctcc

SEQ ID NO: 2109943 - DNA, 13 bp, Homo sapiens
cacggccaggcca

SEQ ID NO: 2109944 - DNA, 13 bp, Homo sapiens
cacggccctgccc

SEQ ID NO: 2109945 - DNA, 14 bp, Homo sapiens
cacggccctgcccc

SEQ ID NO: 2109946 - DNA, 17 bp, Homo sapiens
cacggccctgccccatc

SEQ ID NO: 2109947 - DNA, 16 bp, Homo sapiens
cacggctcactgcagc

SEQ ID NO: 2109948 - DNA, 13 bp, Homo sapiens
cacgggcctcagt

SEQ ID NO: 2109949 - DNA, 17 bp, Homo sapiens
cacggtgcgtggctgtg

SEQ ID NO: 2109950 - DNA, 19 bp, Homo sapiens
cacggtgcgtggctgtggc

SEQ ID NO: 2109951 - DNA, 14 bp, Homo sapiens
cacgtacacacaca

SEQ ID NO: 2109952 - DNA, 12 bp, Homo sapiens
cacgtcccatgt

SEQ ID NO: 2109953 - DNA, 13 bp, Homo sapiens
cacgtccccctgg

SEQ ID NO: 2109954 - DNA, 12 bp, Homo sapiens
cacttaatgaac

SEQ ID NO: 2109955 - DNA, 18 bp, Homo sapiens
cacttaccttcaataaag

SEQ ID NO: 2109956 - DNA, 22 bp, Homo sapiens
cacttaccttcaataaagtatc

SEQ ID NO: 2109957 - DNA, 22 bp, Homo sapiens
cacttacttcgtgcgcaacaac

SEQ ID NO: 2109958 - DNA, 23 bp, Homo sapiens
cacttagcccaagaggtctgagc

SEQ ID NO: 2109959 - DNA, 15 bp, Homo sapiens
cacttagctatcaga

SEQ ID NO: 2109960 - DNA, 11 bp, Homo sapiens
cacttatacca

SEQ ID NO: 2109961 - DNA, 15 bp, Homo sapiens
cacttatctgatact

SEQ ID NO: 2109962 - DNA, 15 bp, Homo sapiens
cacttcactgtgagg

SEQ ID NO: 2109963 - DNA, 20 bp, Homo sapiens
cacttcaggctcttctcctt

SEQ ID NO: 2109964 - DNA, 18 bp, Homo sapiens
cacttcatggaccaagaa

SEQ ID NO: 2109965 - DNA, 12 bp, Homo sapiens
cacttccagtgt

SEQ ID NO: 2109966 - DNA, 11 bp, Homo sapiens
cacttccctgg

SEQ ID NO: 2109967 - DNA, 15 bp, Homo sapiens
cacttccctgggaac

SEQ ID NO: 2109968 - DNA, 22 bp, Homo sapiens
cacttccctgggaactcatcct

SEQ ID NO: 2109969 - DNA, 13 bp, Homo sapiens
cacttctatgcaa

SEQ ID NO: 2109970 - DNA, 14 bp, Homo sapiens
cacttctcaggaca

SEQ ID NO: 2109971 - DNA, 15 bp, Homo sapiens
cacttctcaggacac

SEQ ID NO: 2109972 - DNA, 23 bp, Homo sapiens
cacttctcaggacacaggcctgt

SEQ ID NO: 2109973 - DNA, 17 bp, Homo sapiens
cacttctcatcatattg

SEQ ID NO: 2109974 - DNA, 22 bp, Homo sapiens
cacttctgccatattctgttgg

SEQ ID NO: 2109975 - DNA, 17 bp, Homo sapiens
cacttcttaaaggcctg

SEQ ID NO: 2109976 - DNA, 19 bp, Homo sapiens
cacttcttaaaggcctgga

SEQ ID NO: 2109977 - DNA, 19 bp, Homo sapiens
cacttcttgaaacagcctg

SEQ ID NO: 2109978 - DNA, 20 bp, Homo sapiens
cacttcttgaaacagcctgg

SEQ ID NO: 2109979 - DNA, 13 bp, Homo sapiens
cacttgacattcc

SEQ ID NO: 2109980 - DNA, 16 bp, Homo sapiens
cacttgaggctggcac

SEQ ID NO: 2109981 - DNA, 22 bp, Homo sapiens
cacttgaggtcaggagttccta

SEQ ID NO: 2109982 - DNA, 16 bp, Homo sapiens
cacttgcgtcctgcag

SEQ ID NO: 2109983 - DNA, 17 bp, Homo sapiens
cacttgcgtcctgcaga

SEQ ID NO: 2109984 - DNA, 18 bp, Homo sapiens
cacttgcgtcctgcagag

SEQ ID NO: 2109985 - DNA, 14 bp, Homo sapiens
cacttggagcccgt

SEQ ID NO: 2109986 - DNA, 11 bp, Homo sapiens
cacttgggagc

SEQ ID NO: 2109987 - DNA, 20 bp, Homo sapiens
cacttgggcgctctgccctc

SEQ ID NO: 2109988 - DNA, 22 bp, Homo sapiens
cacttggggtcaccaccctccc

SEQ ID NO: 2109989 - DNA, 12 bp, Homo sapiens
cacttgtaaata

SEQ ID NO: 2109990 - DNA, 16 bp, Homo sapiens
cacttgtaaataaata

SEQ ID NO: 2109991 - DNA, 12 bp, Homo sapiens
cacttgtacaaa

SEQ ID NO: 2109992 - DNA, 15 bp, Homo sapiens
cactttaaagtcttt

SEQ ID NO: 2109993 - DNA, 16 bp, Homo sapiens
cactttaaagtctttc

SEQ ID NO: 2109994 - DNA, 15 bp, Homo sapiens
cactttaaccctctc

SEQ ID NO: 2109995 - DNA, 16 bp, Homo sapiens
cactttaaccctctct

SEQ ID NO: 2109996 - DNA, 12 bp, Homo sapiens
cactttcagagt

SEQ ID NO: 2109997 - DNA, 18 bp, Homo sapiens
cactttcctacaaaatgg

SEQ ID NO: 2109998 - DNA, 16 bp, Homo sapiens
cactttctatagcaga

SEQ ID NO: 2109999 - DNA, 22 bp, Homo sapiens
cactttctcatgatttacagag

SEQ ID NO: 2110000 - DNA, 22 bp, Homo sapiens
cactttgccccagttacaaaaa

SEQ ID NO: 2110001 - DNA, 20 bp, Homo sapiens
cactttggatttcatcagac

SEQ ID NO: 2110002 - DNA, 13 bp, Homo sapiens
cactttgggaggc

SEQ ID NO: 2110003 - DNA, 17 bp, Homo sapiens
cagaaaacaaatcttca

SEQ ID NO: 2110004 - DNA, 14 bp, Homo sapiens
cagaaaaccccagc

SEQ ID NO: 2110005 - DNA, 21 bp, Homo sapiens
cagaaaacttagaaataagaa

SEQ ID NO: 2110006 - DNA, 19 bp, Homo sapiens
cagaaaagaggagaccctg

SEQ ID NO: 2110007 - DNA, 20 bp, Homo sapiens
cagaaaagaggagaccctgg

SEQ ID NO: 2110008 - DNA, 15 bp, Homo sapiens
cagaaaagcacctgc

SEQ ID NO: 2110009 - DNA, 12 bp, Homo sapiens
cagaaaagtaga

SEQ ID NO: 2110010 - DNA, 15 bp, Homo sapiens
cagaaaagtagaatt

SEQ ID NO: 2110011 - DNA, 17 bp, Homo sapiens
cagaaaagtagaattat

SEQ ID NO: 2110012 - DNA, 21 bp, Homo sapiens
cagaaaagtagaattatatct

SEQ ID NO: 2110013 - DNA, 22 bp, Homo sapiens
cagaaaagtagaattatatcta

SEQ ID NO: 2110014 - DNA, 16 bp, Homo sapiens
cagaaaatataaatgc

SEQ ID NO: 2110015 - DNA, 17 bp, Homo sapiens
cagaaaatataaatgca

SEQ ID NO: 2110016 - DNA, 22 bp, Homo sapiens
cagaaaatgtgtcagcatgcat

SEQ ID NO: 2110017 - DNA, 18 bp, Homo sapiens
cagaaacaaaaacactaa

SEQ ID NO: 2110018 - DNA, 14 bp, Homo sapiens
cagaaacagggaca

SEQ ID NO: 2110019 - DNA, 21 bp, Homo sapiens
cagaaacagggacaaagaaat

SEQ ID NO: 2110020 - DNA, 14 bp, Homo sapiens
cagaaaccagttat

SEQ ID NO: 2110021 - DNA, 21 bp, Homo sapiens
cagaaactccttttgctgtct

SEQ ID NO: 2110022 - DNA, 21 bp, Homo sapiens
cagaaagatggatgtgctttg

SEQ ID NO: 2110023 - DNA, 22 bp, Homo sapiens
cagaaagattctagctattatt

SEQ ID NO: 2110024 - DNA, 12 bp, Homo sapiens
cagaaagcaaca

SEQ ID NO: 2110025 - DNA, 19 bp, Homo sapiens
cagaaagggagggctctga

SEQ ID NO: 2110026 - DNA, 21 bp, Homo sapiens
cagaaagggagggctctgagg

SEQ ID NO: 2110027 - DNA, 23 bp, Homo sapiens
cagaaagggagggctctgaggcg

SEQ ID NO: 2110028 - DNA, 23 bp, Homo sapiens
cagaaattagaaaccttaatatg

SEQ ID NO: 2110029 - DNA, 20 bp, Homo sapiens
cagaacaaacctctatatgt

SEQ ID NO: 2110030 - DNA, 21 bp, Homo sapiens
cagaacaaggttccctctgag

SEQ ID NO: 2110031 - DNA, 13 bp, Homo sapiens
cagaacagaggca

SEQ ID NO: 2110032 - DNA, 12 bp, Homo sapiens
cagaacagcaga

SEQ ID NO: 2110033 - DNA, 14 bp, Homo sapiens
cagaacagcagagg

SEQ ID NO: 2110034 - DNA, 12 bp, Homo sapiens
cagaacagctga

SEQ ID NO: 2110035 - DNA, 16 bp, Homo sapiens
cagaacatagacagaa

SEQ ID NO: 2110036 - DNA, 21 bp, Homo sapiens
cagaacatagacagaagaaac

SEQ ID NO: 2110037 - DNA, 13 bp, Homo sapiens
cagaacatgagtt

SEQ ID NO: 2110038 - DNA, 20 bp, Homo sapiens
cagaacatgtgggaggaaga

SEQ ID NO: 2110039 - DNA, 12 bp, Homo sapiens
cagaacctggag

SEQ ID NO: 2110040 - DNA, 13 bp, Homo sapiens
cagaacctggagg

SEQ ID NO: 2110041 - DNA, 19 bp, Homo sapiens
cagaactgaggtcactggg

SEQ ID NO: 2110042 - DNA, 23 bp, Homo sapiens
cagaacttcgaccctttctctga

SEQ ID NO: 2110043 - DNA, 14 bp, Homo sapiens
cagaagaaggcagc

SEQ ID NO: 2110044 - DNA, 18 bp, Homo sapiens
cagaagaatatgacagct

SEQ ID NO: 2110045 - DNA, 12 bp, Homo sapiens
cagaagaatatt

SEQ ID NO: 2110046 - DNA, 16 bp, Homo sapiens
cagaagaatattcagg

SEQ ID NO: 2110047 - DNA, 17 bp, Homo sapiens
cagaagaattgaaccca

SEQ ID NO: 2110048 - DNA, 19 bp, Homo sapiens
cagaagaattgaacccagg

SEQ ID NO: 2110049 - DNA, 21 bp, Homo sapiens
cagaagaccacaaaaattgac

SEQ ID NO: 2110050 - DNA, 21 bp, Homo sapiens
cagaagagatgggcttgtttt

SEQ ID NO: 2110051 - DNA, 15 bp, Homo sapiens
cagaagagggaggct

SEQ ID NO: 2110052 - DNA, 16 bp, Homo sapiens
cagaagcaggttcttg

SEQ ID NO: 2110053 - DNA, 18 bp, Homo sapiens
cagaagcaggttcttgat

SEQ ID NO: 2110054 - DNA, 17 bp, Homo sapiens
cagaagccaggagcaaa

SEQ ID NO: 2110055 - DNA, 19 bp, Homo sapiens
cagaagccaggagcaaatg

SEQ ID NO: 2110056 - DNA, 20 bp, Homo sapiens
cagaagccccatttgcacag

SEQ ID NO: 2110057 - DNA, 19 bp, Homo sapiens
cagaagcctgaggctggga

SEQ ID NO: 2110058 - DNA, 20 bp, Homo sapiens
cagaagcctgggggcctggc

SEQ ID NO: 2110059 - DNA, 21 bp, Homo sapiens
cagaagcctgggggcctggct

SEQ ID NO: 2110060 - DNA, 22 bp, Homo sapiens
cagaagcctgggggcctggctg

SEQ ID NO: 2110061 - DNA, 23 bp, Homo sapiens
cagaagcctgggggcctggctgg

SEQ ID NO: 2110062 - DNA, 14 bp, Homo sapiens
cagaagcttcagaa

SEQ ID NO: 2110063 - DNA, 11 bp, Homo sapiens
cagaaggaagg

SEQ ID NO: 2110064 - DNA, 18 bp, Homo sapiens
cagaaggaatctgtgcag

SEQ ID NO: 2110065 - DNA, 19 bp, Homo sapiens
cagaaggaatctgtgcaga

SEQ ID NO: 2110066 - DNA, 15 bp, Homo sapiens
cagaaggagggcaga

SEQ ID NO: 2110067 - DNA, 11 bp, Homo sapiens
cagaaggctgg

SEQ ID NO: 2110068 - DNA, 15 bp, Homo sapiens
cagaagggagaagga

SEQ ID NO: 2110069 - DNA, 17 bp, Homo sapiens
cagaagggggagaccaa

SEQ ID NO: 2110070 - DNA, 17 bp, Homo sapiens
cagaagtcatgaagccc

SEQ ID NO: 2110071 - DNA, 21 bp, Homo sapiens
cactgccaggcacctggcctg

SEQ ID NO: 2110072 - DNA, 22 bp, Homo sapiens
cactgccaggcacctggcctgc

SEQ ID NO: 2110073 - DNA, 14 bp, Homo sapiens
cactgccatgcctc

SEQ ID NO: 2110074 - DNA, 14 bp, Homo sapiens
cactgccccaccag

SEQ ID NO: 2110075 - DNA, 17 bp, Homo sapiens
cactgccctgcctgccc

SEQ ID NO: 2110076 - DNA, 20 bp, Homo sapiens
cactgccctgcctgcccact

SEQ ID NO: 2110077 - DNA, 15 bp, Homo sapiens
cactgccttccagga

SEQ ID NO: 2110078 - DNA, 20 bp, Homo sapiens
cactgcgtagagcctggaag

SEQ ID NO: 2110079 - DNA, 19 bp, Homo sapiens
cactgctcaagaagacatg

SEQ ID NO: 2110080 - DNA, 15 bp, Homo sapiens
cactgctctcagcct

SEQ ID NO: 2110081 - DNA, 13 bp, Homo sapiens
cactgctgcacca

SEQ ID NO: 2110082 - DNA, 18 bp, Homo sapiens
cactgctgcaccagagtg

SEQ ID NO: 2110083 - DNA, 12 bp, Homo sapiens
cactgctggctg

SEQ ID NO: 2110084 - DNA, 13 bp, Homo sapiens
cactgctggctgc

SEQ ID NO: 2110085 - DNA, 14 bp, Homo sapiens
cactgctggctgcc

SEQ ID NO: 2110086 - DNA, 21 bp, Homo sapiens
cactgctggctgccttagaac

SEQ ID NO: 2110087 - DNA, 18 bp, Homo sapiens
cactgctggggagtccct

SEQ ID NO: 2110088 - DNA, 20 bp, Homo sapiens
cactgcttgaggaggggcac

SEQ ID NO: 2110089 - DNA, 16 bp, Homo sapiens
cactgctttccagcct

SEQ ID NO: 2110090 - DNA, 16 bp, Homo sapiens
cactggaacagcccat

SEQ ID NO: 2110091 - DNA, 22 bp, Homo sapiens
cactggaacagcccattttatc

SEQ ID NO: 2110092 - DNA, 16 bp, Homo sapiens
cactggaccactgggc

SEQ ID NO: 2110093 - DNA, 16 bp, Homo sapiens
cactggagcaccaggc

SEQ ID NO: 2110094 - DNA, 21 bp, Homo sapiens
cactggagcaccaggcacgaa

SEQ ID NO: 2110095 - DNA, 11 bp, Homo sapiens
cactggagccc

SEQ ID NO: 2110096 - DNA, 12 bp, Homo sapiens
cactggagccca

SEQ ID NO: 2110097 - DNA, 16 bp, Homo sapiens
cactggagtgcaggga

SEQ ID NO: 2110098 - DNA, 16 bp, Homo sapiens
cactggcaatgaaaaa

SEQ ID NO: 2110099 - DNA, 13 bp, Homo sapiens
cactggccaccca

SEQ ID NO: 2110100 - DNA, 15 bp, Homo sapiens
cactggccagtccta

SEQ ID NO: 2110101 - DNA, 18 bp, Homo sapiens
cactggccagtcctagag

SEQ ID NO: 2110102 - DNA, 23 bp, Homo sapiens
cactggcgcatcatatgcagtga

SEQ ID NO: 2110103 - DNA, 14 bp, Homo sapiens
cactggctccacat

SEQ ID NO: 2110104 - DNA, 15 bp, Homo sapiens
cactggctggggcag

SEQ ID NO: 2110105 - DNA, 18 bp, Homo sapiens
cactggctggggcagagg

SEQ ID NO: 2110106 - DNA, 20 bp, Homo sapiens
cactggctggggcagagggg

SEQ ID NO: 2110107 - DNA, 22 bp, Homo sapiens
cactgggatgagccgctgtgag

SEQ ID NO: 2110108 - DNA, 21 bp, Homo sapiens
cactgggggaggggacattga

SEQ ID NO: 2110109 - DNA, 18 bp, Homo sapiens
cactggggtcctggggcc

SEQ ID NO: 2110110 - DNA, 20 bp, Homo sapiens
cactggggtcctggggcctc

SEQ ID NO: 2110111 - DNA, 21 bp, Homo sapiens
cactgggtctcactcctgagt

SEQ ID NO: 2110112 - DNA, 15 bp, Homo sapiens
cactgggtgtggccc

SEQ ID NO: 2110113 - DNA, 23 bp, Homo sapiens
cactgggtgtggccccgcagtgc

SEQ ID NO: 2110114 - DNA, 14 bp, Homo sapiens
cactggtggcatcg

SEQ ID NO: 2110115 - DNA, 23 bp, Homo sapiens
cactggtggcccgacagcctggc

SEQ ID NO: 2110116 - DNA, 14 bp, Homo sapiens
cactggtttgaaga

SEQ ID NO: 2110117 - DNA, 13 bp, Homo sapiens
cactgtaaaatga

SEQ ID NO: 2110118 - DNA, 18 bp, Homo sapiens
cactgtaaacccctgggt

SEQ ID NO: 2110119 - DNA, 18 bp, Homo sapiens
cactgtaaatatccacag

SEQ ID NO: 2110120 - DNA, 20 bp, Homo sapiens
cactgtacaaggtacccctt

SEQ ID NO: 2110121 - DNA, 18 bp, Homo sapiens
cactgtagaatgatttca

SEQ ID NO: 2110122 - DNA, 21 bp, Homo sapiens
cactgtagcattacagtgggt

SEQ ID NO: 2110123 - DNA, 14 bp, Homo sapiens
cactgtatttgtat

SEQ ID NO: 2110124 - DNA, 16 bp, Homo sapiens
cactgtcaccctccac

SEQ ID NO: 2110125 - DNA, 22 bp, Homo sapiens
cactgtcagagctgttggcctc

SEQ ID NO: 2110126 - DNA, 23 bp, Homo sapiens
cactgtcagagctgttggcctcg

SEQ ID NO: 2110127 - DNA, 16 bp, Homo sapiens
cactgtccgcctctgc

SEQ ID NO: 2110128 - DNA, 15 bp, Homo sapiens
cactgtcctggctgc

SEQ ID NO: 2110129 - DNA, 20 bp, Homo sapiens
cactgtcctggctgctctca

SEQ ID NO: 2110130 - DNA, 13 bp, Homo sapiens
cactgtctcaact

SEQ ID NO: 2110131 - DNA, 16 bp, Homo sapiens
cactgtctgcgtgact

SEQ ID NO: 2110132 - DNA, 22 bp, Homo sapiens
cactgtctgcgtgactattttt

SEQ ID NO: 2110133 - DNA, 14 bp, Homo sapiens
cactgtcttgaaga

SEQ ID NO: 2110134 - DNA, 18 bp, Homo sapiens
cactgtcttgcctgccag

SEQ ID NO: 2110135 - DNA, 20 bp, Homo sapiens
cactgtgacaccagaataat

SEQ ID NO: 2110136 - DNA, 12 bp, Homo sapiens
cactgtgcagga

SEQ ID NO: 2110137 - DNA, 18 bp, Homo sapiens
cactgtgccatgtgccag

SEQ ID NO: 2110138 - DNA, 17 bp, Homo sapiens
cactgtgcttacagtga

SEQ ID NO: 2110139 - DNA, 18 bp, Homo sapiens
cactgtgcttacagtgac

SEQ ID NO: 2110140 - DNA, 13 bp, Homo sapiens
cactgtggccaga

SEQ ID NO: 2110141 - DNA, 18 bp, Homo sapiens
cactgtggccagagctgg

SEQ ID NO: 2110142 - DNA, 22 bp, Homo sapiens
cactgtggccagagctggaagg

SEQ ID NO: 2110143 - DNA, 18 bp, Homo sapiens
cactgtgggggctggtcc

SEQ ID NO: 2110144 - DNA, 15 bp, Homo sapiens
cactgtgtatttaac

SEQ ID NO: 2110145 - DNA, 17 bp, Homo sapiens
cactgttactccacagc

SEQ ID NO: 2110146 - DNA, 15 bp, Homo sapiens
cactgttatcaaaac

SEQ ID NO: 2110147 - DNA, 14 bp, Homo sapiens
cactgttgaaaatt

SEQ ID NO: 2110148 - DNA, 17 bp, Homo sapiens
cactgttgaaaattatt

SEQ ID NO: 2110149 - DNA, 18 bp, Homo sapiens
cactgttgaaaattattt

SEQ ID NO: 2110150 - DNA, 20 bp, Homo sapiens
cactgttgagttggacacac

SEQ ID NO: 2110151 - DNA, 22 bp, Homo sapiens
cactgttgagttggacacactg

SEQ ID NO: 2110152 - DNA, 18 bp, Homo sapiens
cactgttgcccaggctgg

SEQ ID NO: 2110153 - DNA, 23 bp, Homo sapiens
cactgttgcccaggctggcgtgc

SEQ ID NO: 2110154 - DNA, 17 bp, Homo sapiens
cactcagggctgccact

SEQ ID NO: 2110155 - DNA, 22 bp, Homo sapiens
cactcagtgaggccgcccggca

SEQ ID NO: 2110156 - DNA, 22 bp, Homo sapiens
cactcatgttgttcccacacac

SEQ ID NO: 2110157 - DNA, 13 bp, Homo sapiens
cactcattcctgt

SEQ ID NO: 2110158 - DNA, 20 bp, Homo sapiens
cactcattccttcactcatc

SEQ ID NO: 2110159 - DNA, 14 bp, Homo sapiens
cactcatttcatct

SEQ ID NO: 2110160 - DNA, 19 bp, Homo sapiens
cactcatttcatctcattt

SEQ ID NO: 2110161 - DNA, 10 bp, Homo sapiens
cactccacca

SEQ ID NO: 2110162 - DNA, 11 bp, Homo sapiens
cactccaccac

SEQ ID NO: 2110163 - DNA, 19 bp, Homo sapiens
cactccaccacccaaaagt

SEQ ID NO: 2110164 - DNA, 17 bp, Homo sapiens
cactccacctccaccca

SEQ ID NO: 2110165 - DNA, 16 bp, Homo sapiens
cactccagacccctgg

SEQ ID NO: 2110166 - DNA, 13 bp, Homo sapiens
cactccagcctga

SEQ ID NO: 2110167 - DNA, 21 bp, Homo sapiens
cactccagcctgggcgacaga

SEQ ID NO: 2110168 - DNA, 12 bp, Homo sapiens
cactccattccc

SEQ ID NO: 2110169 - DNA, 15 bp, Homo sapiens
cactccccaccttca

SEQ ID NO: 2110170 - DNA, 21 bp, Homo sapiens
cactccccgcctgtcctgcct

SEQ ID NO: 2110171 - DNA, 20 bp, Homo sapiens
cactccctaaccaaatgctg

SEQ ID NO: 2110172 - DNA, 17 bp, Homo sapiens
cactccctaagaaaccc

SEQ ID NO: 2110173 - DNA, 20 bp, Homo sapiens
cactccctaagaaaccccag

SEQ ID NO: 2110174 - DNA, 21 bp, Homo sapiens
cactccctaagaaaccccagg

SEQ ID NO: 2110175 - DNA, 14 bp, Homo sapiens
cactccctcctaac

SEQ ID NO: 2110176 - DNA, 12 bp, Homo sapiens
cactccctgagc

SEQ ID NO: 2110177 - DNA, 20 bp, Homo sapiens
cactccggcctgatgacaga

SEQ ID NO: 2110178 - DNA, 13 bp, Homo sapiens
cactcctacctgg

SEQ ID NO: 2110179 - DNA, 14 bp, Homo sapiens
cactcctacctggt

SEQ ID NO: 2110180 - DNA, 14 bp, Homo sapiens
cactcctcactgcc

SEQ ID NO: 2110181 - DNA, 17 bp, Homo sapiens
cactcctcactgcccca

SEQ ID NO: 2110182 - DNA, 13 bp, Homo sapiens
cactcctgctgtg

SEQ ID NO: 2110183 - DNA, 13 bp, Homo sapiens
cactcctgtcccg

SEQ ID NO: 2110184 - DNA, 16 bp, Homo sapiens
cactcctgtcccgcct

SEQ ID NO: 2110185 - DNA, 18 bp, Homo sapiens
cactcctgtcccgccttc

SEQ ID NO: 2110186 - DNA, 18 bp, Homo sapiens
cactcctgttacttacct

SEQ ID NO: 2110187 - DNA, 22 bp, Homo sapiens
cactcgagaccatcctggcccc

SEQ ID NO: 2110188 - DNA, 20 bp, Homo sapiens
cactctagcctggcaacaga

SEQ ID NO: 2110189 - DNA, 19 bp, Homo sapiens
cactctaggggtcaggctc

SEQ ID NO: 2110190 - DNA, 22 bp, Homo sapiens
cactctaggggtcaggctccat

SEQ ID NO: 2110191 - DNA, 20 bp, Homo sapiens
cactctagtgacttcctggt

SEQ ID NO: 2110192 - DNA, 23 bp, Homo sapiens
cactctagtgacttcctggtgag

SEQ ID NO: 2110193 - DNA, 18 bp, Homo sapiens
cactctcattccccaggt

SEQ ID NO: 2110194 - DNA, 18 bp, Homo sapiens
cactctcccctccctctt

SEQ ID NO: 2110195 - DNA, 22 bp, Homo sapiens
cactctcccctccctcttcctt

SEQ ID NO: 2110196 - DNA, 15 bp, Homo sapiens
cactctcggggccct

SEQ ID NO: 2110197 - DNA, 15 bp, Homo sapiens
cactctctgtacaaa

SEQ ID NO: 2110198 - DNA, 21 bp, Homo sapiens
cactctctgtacaaaaacaaa

SEQ ID NO: 2110199 - DNA, 13 bp, Homo sapiens
cactctgctctga

SEQ ID NO: 2110200 - DNA, 15 bp, Homo sapiens
cactctgctctgatg

SEQ ID NO: 2110201 - DNA, 17 bp, Homo sapiens
cactctgctctgatgca

SEQ ID NO: 2110202 - DNA, 12 bp, Homo sapiens
cactctggcagc

SEQ ID NO: 2110203 - DNA, 14 bp, Homo sapiens
cactctggcagcca

SEQ ID NO: 2110204 - DNA, 13 bp, Homo sapiens
cactctggcctca

SEQ ID NO: 2110205 - DNA, 18 bp, Homo sapiens
cactctgtcagccagccg

SEQ ID NO: 2110206 - DNA, 21 bp, Homo sapiens
cactctgtcagccagccgccc

SEQ ID NO: 2110207 - DNA, 23 bp, Homo sapiens
cactctgtcagccagccgccctg

SEQ ID NO: 2110208 - DNA, 16 bp, Homo sapiens
cactcttatgaaatgg

SEQ ID NO: 2110209 - DNA, 18 bp, Homo sapiens
cactcttattgcccacgc

SEQ ID NO: 2110210 - DNA, 20 bp, Homo sapiens
cactcttcttgagcagaccg

SEQ ID NO: 2110211 - DNA, 19 bp, Homo sapiens
cactctttgctacaataaa

SEQ ID NO: 2110212 - DNA, 12 bp, Homo sapiens
cactctttgtaa

SEQ ID NO: 2110213 - DNA, 22 bp, Homo sapiens
cactgaaaataccatcaggcct

SEQ ID NO: 2110214 - DNA, 16 bp, Homo sapiens
cactgaacatttgctt

SEQ ID NO: 2110215 - DNA, 17 bp, Homo sapiens
cactgaagctgggattc

SEQ ID NO: 2110216 - DNA, 13 bp, Homo sapiens
cactgaagtgctt

SEQ ID NO: 2110217 - DNA, 19 bp, Homo sapiens
cactgaagttaacagagac

SEQ ID NO: 2110218 - DNA, 16 bp, Homo sapiens
cactgacccttccaga

SEQ ID NO: 2110219 - DNA, 19 bp, Homo sapiens
cactgacccttccagacat

SEQ ID NO: 2110220 - DNA, 15 bp, Homo sapiens
cactgacctcaccgg

SEQ ID NO: 2110221 - DNA, 16 bp, Homo sapiens
cactgacctcaccggc

SEQ ID NO: 2110222 - DNA, 18 bp, Homo sapiens
cactgacctcaccggcat

SEQ ID NO: 2110223 - DNA, 20 bp, Homo sapiens
cactgaccttggagagacac

SEQ ID NO: 2110224 - DNA, 21 bp, Homo sapiens
cactgacttctaagtaaaacc

SEQ ID NO: 2110225 - DNA, 18 bp, Homo sapiens
cagaagtcatgaagccca

SEQ ID NO: 2110226 - DNA, 22 bp, Homo sapiens
cagaagtggggctctgggaggg

SEQ ID NO: 2110227 - DNA, 19 bp, Homo sapiens
cagaagtttctcagctccc

SEQ ID NO: 2110228 - DNA, 16 bp, Homo sapiens
cagaagtttggcaata

SEQ ID NO: 2110229 - DNA, 19 bp, Homo sapiens
cagaagtttgtcaagtcaa

SEQ ID NO: 2110230 - DNA, 12 bp, Homo sapiens
cagaataagtgc

SEQ ID NO: 2110231 - DNA, 17 bp, Homo sapiens
cagaataagtgctgttt

SEQ ID NO: 2110232 - DNA, 21 bp, Homo sapiens
cagaataagtgctgtttgaga

SEQ ID NO: 2110233 - DNA, 24 bp, Homo sapiens
cagaataagtgctgtttgagatgt

SEQ ID NO: 2110234 - DNA, 21 bp, Homo sapiens
cagaataccttcttcgctgct

SEQ ID NO: 2110235 - DNA, 21 bp, Homo sapiens
cagaatagatctgatggtgag

SEQ ID NO: 2110236 - DNA, 14 bp, Homo sapiens
cagaatcataattt

SEQ ID NO: 2110237 - DNA, 14 bp, Homo sapiens
cagaatccaaagat

SEQ ID NO: 2110238 - DNA, 21 bp, Homo sapiens
cagaatccacaaagccgtgcc

SEQ ID NO: 2110239 - DNA, 13 bp, Homo sapiens
cagaatctgctgt

SEQ ID NO: 2110240 - DNA, 14 bp, Homo sapiens
cagaatctgctgtt

SEQ ID NO: 2110241 - DNA, 17 bp, Homo sapiens
cagaatctgctgttgcc

SEQ ID NO: 2110242 - DNA, 21 bp, Homo sapiens
cagaatctgctgttgccatag

SEQ ID NO: 2110243 - DNA, 19 bp, Homo sapiens
cagaatcttcgtcctgccc

SEQ ID NO: 2110244 - DNA, 13 bp, Homo sapiens
cagaatcttgtat

SEQ ID NO: 2110245 - DNA, 11 bp, Homo sapiens
cagaatgaatc

SEQ ID NO: 2110246 - DNA, 18 bp, Homo sapiens
cagaatggggtgcatgaa

SEQ ID NO: 2110247 - DNA, 15 bp, Homo sapiens
cagaattccttttct

SEQ ID NO: 2110248 - DNA, 16 bp, Homo sapiens
cagaattgaaggagaa

SEQ ID NO: 2110249 - DNA, 23 bp, Homo sapiens
cagaattgcattctgaatgaata

SEQ ID NO: 2110250 - DNA, 19 bp, Homo sapiens
cagaatttctttgtcattc

SEQ ID NO: 2110251 - DNA, 18 bp, Homo sapiens
cagaattttaccaaaatt

SEQ ID NO: 2110252 - DNA, 18 bp, Homo sapiens
cagaatttttaatgactt

SEQ ID NO: 2110253 - DNA, 19 bp, Homo sapiens
cagaatttttaatgacttt

SEQ ID NO: 2110254 - DNA, 18 bp, Homo sapiens
cagacaaaaacagcctca

SEQ ID NO: 2110255 - DNA, 20 bp, Homo sapiens
cagacaaaaacagcctcaca

SEQ ID NO: 2110256 - DNA, 16 bp, Homo sapiens
cagacaacagaagtca

SEQ ID NO: 2110257 - DNA, 15 bp, Homo sapiens
cagacaatccactct

SEQ ID NO: 2110258 - DNA, 20 bp, Homo sapiens
cagacaatccactctcagga

SEQ ID NO: 2110259 - DNA, 22 bp, Homo sapiens
cagacaatccactctcaggagg

SEQ ID NO: 2110260 - DNA, 13 bp, Homo sapiens
cagacacaccccc

SEQ ID NO: 2110261 - DNA, 23 bp, Homo sapiens
cagacacaggcccggctccaggc

SEQ ID NO: 2110262 - DNA, 23 bp, Homo sapiens
cagacaccgtttgtcccccgggg

SEQ ID NO: 2110263 - DNA, 20 bp, Homo sapiens
cagacaccttgacagggcac

SEQ ID NO: 2110264 - DNA, 12 bp, Homo sapiens
cagacactaagt

SEQ ID NO: 2110265 - DNA, 21 bp, Homo sapiens
cagacactaagttatagtata

SEQ ID NO: 2110266 - DNA, 22 bp, Homo sapiens
cagacactggtttgaagaatgt

SEQ ID NO: 2110267 - DNA, 20 bp, Homo sapiens
cagacagagaaatgtgaagg

SEQ ID NO: 2110268 - DNA, 22 bp, Homo sapiens
cagacagagaaatgtgaagggt

SEQ ID NO: 2110269 - DNA, 14 bp, Homo sapiens
cagacagagccctg

SEQ ID NO: 2110270 - DNA, 12 bp, Homo sapiens
cagacagataca

SEQ ID NO: 2110271 - DNA, 16 bp, Homo sapiens
cagacagcagctcagg

SEQ ID NO: 2110272 - DNA, 20 bp, Homo sapiens
cagacaggcaagcacctcct

SEQ ID NO: 2110273 - DNA, 19 bp, Homo sapiens
cagacagggcctagctttc

SEQ ID NO: 2110274 - DNA, 19 bp, Homo sapiens
cagacaggtaaatgggcag

SEQ ID NO: 2110275 - DNA, 21 bp, Homo sapiens
cagacaggtaaatgggcagtg

SEQ ID NO: 2110276 - DNA, 23 bp, Homo sapiens
cagacatccatgtttgtaaaact

SEQ ID NO: 2110277 - DNA, 15 bp, Homo sapiens
cagaccaactctctc

SEQ ID NO: 2110278 - DNA, 19 bp, Homo sapiens
cagaccacctccctgccct

SEQ ID NO: 2110279 - DNA, 16 bp, Homo sapiens
cagaccacctgccagc

SEQ ID NO: 2110280 - DNA, 19 bp, Homo sapiens
cagaccacctgccagccat

SEQ ID NO: 2110281 - DNA, 22 bp, Homo sapiens
cagaccacctgccagccatcac

SEQ ID NO: 2110282 - DNA, 18 bp, Homo sapiens
cagaccacctgcttctga

SEQ ID NO: 2110283 - DNA, 17 bp, Homo sapiens
cagaccagtactgggaa

SEQ ID NO: 2110284 - DNA, 15 bp, Homo sapiens
cagaccattgtcttc

SEQ ID NO: 2110285 - DNA, 16 bp, Homo sapiens
cagaccattgtcttcc

SEQ ID NO: 2110286 - DNA, 23 bp, Homo sapiens
cagacccactcccaaagctcaga

SEQ ID NO: 2110287 - DNA, 14 bp, Homo sapiens
cagaccccagcggc

SEQ ID NO: 2110288 - DNA, 15 bp, Homo sapiens
cagaccccagcggct

SEQ ID NO: 2110289 - DNA, 16 bp, Homo sapiens
cagacccccactctca

SEQ ID NO: 2110290 - DNA, 13 bp, Homo sapiens
cagacccctggct

SEQ ID NO: 2110291 - DNA, 15 bp, Homo sapiens
cagacccctggcttt

SEQ ID NO: 2110292 - DNA, 18 bp, Homo sapiens
cagacccctggcttttca

SEQ ID NO: 2110293 - DNA, 21 bp, Homo sapiens
cagacccctggcttttcactg

SEQ ID NO: 2110294 - DNA, 13 bp, Homo sapiens
cagacccctgtgg

SEQ ID NO: 2110295 - DNA, 15 bp, Homo sapiens
cagaccccttggctt

SEQ ID NO: 2110296 - DNA, 16 bp, Homo sapiens
cagaccctaccccacc

SEQ ID NO: 2110297 - DNA, 17 bp, Homo sapiens
cagaccctaccccacca

SEQ ID NO: 2110298 - DNA, 12 bp, Homo sapiens
cagaccctgaag

SEQ ID NO: 2110299 - DNA, 13 bp, Homo sapiens
cagaccctgccct

SEQ ID NO: 2110300 - DNA, 12 bp, Homo sapiens
cagaccctgcct

SEQ ID NO: 2110301 - DNA, 13 bp, Homo sapiens
cagaccctgcctg

SEQ ID NO: 2110302 - DNA, 17 bp, Homo sapiens
cagaccctgcctgagcc

SEQ ID NO: 2110303 - DNA, 18 bp, Homo sapiens
cagaccgggggccagaca

SEQ ID NO: 2110304 - DNA, 14 bp, Homo sapiens
cagacctagacctg

SEQ ID NO: 2110305 - DNA, 15 bp, Homo sapiens
cagacctagacctgg

SEQ ID NO: 2110306 - DNA, 23 bp, Homo sapiens
cagacctagacctgggccaaaag

SEQ ID NO: 2110307 - DNA, 19 bp, Homo sapiens
cagacctggacactagggt

SEQ ID NO: 2110308 - DNA, 14 bp, Homo sapiens
cagacgcagcagct

SEQ ID NO: 2110309 - DNA, 15 bp, Homo sapiens
cagacgcagcagctg

SEQ ID NO: 2110310 - DNA, 17 bp, Homo sapiens
cagacgctgccgctgcc

SEQ ID NO: 2110311 - DNA, 20 bp, Homo sapiens
cagacgtatgcttattttaa

SEQ ID NO: 2110312 - DNA, 13 bp, Homo sapiens
cagactacagcca

SEQ ID NO: 2110313 - DNA, 14 bp, Homo sapiens
cagactcaataaaa

SEQ ID NO: 2110314 - DNA, 17 bp, Homo sapiens
cagactcagctccagaa

SEQ ID NO: 2110315 - DNA, 16 bp, Homo sapiens
cagactcagtttgtca

SEQ ID NO: 2110316 - DNA, 17 bp, Homo sapiens
cagactctacagaggcc

SEQ ID NO: 2110317 - DNA, 21 bp, Homo sapiens
cagactctacagaggccatgg

SEQ ID NO: 2110318 - DNA, 16 bp, Homo sapiens
cagactgctgggactg

SEQ ID NO: 2110319 - DNA, 20 bp, Homo sapiens
cagactgctgggactggcca

SEQ ID NO: 2110320 - DNA, 23 bp, Homo sapiens
cagactgctgggactggccaggt

SEQ ID NO: 2110321 - DNA, 20 bp, Homo sapiens
cagactgcttccaattttct

SEQ ID NO: 2110322 - DNA, 14 bp, Homo sapiens
cagactggaagcac

SEQ ID NO: 2110323 - DNA, 17 bp, Homo sapiens
cagactggaagcacagc

SEQ ID NO: 2110324 - DNA, 22 bp, Homo sapiens
cagactggcacagttttctgag

SEQ ID NO: 2110325 - DNA, 16 bp, Homo sapiens
cagactggctggctgc

SEQ ID NO: 2110326 - DNA, 13 bp, Homo sapiens
cagacttctccag

SEQ ID NO: 2110327 - DNA, 20 bp, Homo sapiens
cagacttctggaaggctggc

SEQ ID NO: 2110328 - DNA, 20 bp, Homo sapiens
cagacttgccaggctccctt

SEQ ID NO: 2110329 - DNA, 19 bp, Homo sapiens
cagactttctacacctgtt

SEQ ID NO: 2110330 - DNA, 22 bp, Homo sapiens
cagagaaagaagagacaggagg

SEQ ID NO: 2110331 - DNA, 16 bp, Homo sapiens
cagagaaatgtgaagg

SEQ ID NO: 2110332 - DNA, 21 bp, Homo sapiens
cagagaaatgtgaagggtggg

SEQ ID NO: 2110333 - DNA, 15 bp, Homo sapiens
cagagaaattctgtg

SEQ ID NO: 2110334 - DNA, 14 bp, Homo sapiens
cagagaagaaagaa

SEQ ID NO: 2110335 - DNA, 18 bp, Homo sapiens
cagagaagaaagaacgga

SEQ ID NO: 2110336 - DNA, 16 bp, Homo sapiens
cagagaagctcattta

SEQ ID NO: 2110337 - DNA, 11 bp, Homo sapiens
cagagaaggat

SEQ ID NO: 2110338 - DNA, 22 bp, Homo sapiens
cagagaaggatgtccgttccag

SEQ ID NO: 2110339 - DNA, 17 bp, Homo sapiens
cagagaaggcaggaatg

SEQ ID NO: 2110340 - DNA, 13 bp, Homo sapiens
cagagaaggcctc

SEQ ID NO: 2110341 - DNA, 15 bp, Homo sapiens
caaaagacatgttgt

SEQ ID NO: 2110342 - DNA, 14 bp, Homo sapiens
caaaagagaaaaaa

SEQ ID NO: 2110343 - DNA, 19 bp, Homo sapiens
caaaagagaaaaaaaatta

SEQ ID NO: 2110344 - DNA, 15 bp, Homo sapiens
caaaagcaaatgaga

SEQ ID NO: 2110345 - DNA, 14 bp, Homo sapiens
caaaagcaagactg

SEQ ID NO: 2110346 - DNA, 19 bp, Homo sapiens
caaaaggcagccctttggg

SEQ ID NO: 2110347 - DNA, 22 bp, Homo sapiens
caaaaggtgcctgtgaggcagg

SEQ ID NO: 2110348 - DNA, 20 bp, Homo sapiens
caaaagtgatctgtcccctc

SEQ ID NO: 2110349 - DNA, 15 bp, Homo sapiens
caaaataaaattatg

SEQ ID NO: 2110350 - DNA, 14 bp, Homo sapiens
caaaataaattgaa

SEQ ID NO: 2110351 - DNA, 21 bp, Homo sapiens
caaaataaggggcacctggga

SEQ ID NO: 2110352 - DNA, 19 bp, Homo sapiens
caaaatattgcttatgtct

SEQ ID NO: 2110353 - DNA, 14 bp, Homo sapiens
caaaatatttaatt

SEQ ID NO: 2110354 - DNA, 16 bp, Homo sapiens
caaaatatttgtacat

SEQ ID NO: 2110355 - DNA, 18 bp, Homo sapiens
caaaatcacaagcaataa

SEQ ID NO: 2110356 - DNA, 18 bp, Homo sapiens
caaaatgttcgtattcta

SEQ ID NO: 2110357 - DNA, 20 bp, Homo sapiens
caaaattaccaaaaatcttg

SEQ ID NO: 2110358 - DNA, 14 bp, Homo sapiens
caaaattataagaa

SEQ ID NO: 2110359 - DNA, 23 bp, Homo sapiens
caaaattttataagcaaatttca

SEQ ID NO: 2110360 - DNA, 21 bp, Homo sapiens
caaaattttatagctcagttt

SEQ ID NO: 2110361 - DNA, 12 bp, Homo sapiens
caaacaataata

SEQ ID NO: 2110362 - DNA, 14 bp, Homo sapiens
caaacacactgtaa

SEQ ID NO: 2110363 - DNA, 16 bp, Homo sapiens
caaacacactgtaaat

SEQ ID NO: 2110364 - DNA, 16 bp, Homo sapiens
caaacaccaacataaa

SEQ ID NO: 2110365 - DNA, 16 bp, Homo sapiens
caaacactgaatcatg

SEQ ID NO: 2110366 - DNA, 11 bp, Homo sapiens
caaacagagcc

SEQ ID NO: 2110367 - DNA, 14 bp, Homo sapiens
caaacatgaagtgt

SEQ ID NO: 2110368 - DNA, 22 bp, Homo sapiens
caaacatgaagtgtgtttcctt

SEQ ID NO: 2110369 - DNA, 11 bp, Homo sapiens
caaacatgtgg

SEQ ID NO: 2110370 - DNA, 20 bp, Homo sapiens
caaacatttcttaaaatgtt

SEQ ID NO: 2110371 - DNA, 14 bp, Homo sapiens
caaaccacaactga

SEQ ID NO: 2110372 - DNA, 21 bp, Homo sapiens
caaaccacaactgacacagga

SEQ ID NO: 2110373 - DNA, 15 bp, Homo sapiens
caaaccataaacttc

SEQ ID NO: 2110374 - DNA, 13 bp, Homo sapiens
caaaccatttaat

SEQ ID NO: 2110375 - DNA, 14 bp, Homo sapiens
caaaccatttaatt

SEQ ID NO: 2110376 - DNA, 20 bp, Homo sapiens
caaaccatttaattcataat

SEQ ID NO: 2110377 - DNA, 19 bp, Homo sapiens
caaacccaggagtttgtgt

SEQ ID NO: 2110378 - DNA, 18 bp, Homo sapiens
caaactcactgctcaaga

SEQ ID NO: 2110379 - DNA, 16 bp, Homo sapiens
caaactcctgcctgtg

SEQ ID NO: 2110380 - DNA, 16 bp, Homo sapiens
caaactctgccagcca

SEQ ID NO: 2110381 - DNA, 14 bp, Homo sapiens
caaactgaagccag

SEQ ID NO: 2110382 - DNA, 17 bp, Homo sapiens
caaactgagtaaattgg

SEQ ID NO: 2110383 - DNA, 17 bp, Homo sapiens
caaactgtgccctgcct

SEQ ID NO: 2110384 - DNA, 16 bp, Homo sapiens
caaactgttcaagaaa

SEQ ID NO: 2110385 - DNA, 15 bp, Homo sapiens
caaacttgtgctgag

SEQ ID NO: 2110386 - DNA, 18 bp, Homo sapiens
caaacttgtgctgagaat

SEQ ID NO: 2110387 - DNA, 17 bp, Homo sapiens
caaagaaaaaaatatat

SEQ ID NO: 2110388 - DNA, 13 bp, Homo sapiens
caaagaaacccaa

SEQ ID NO: 2110389 - DNA, 17 bp, Homo sapiens
caaagaaggaattctag

SEQ ID NO: 2110390 - DNA, 21 bp, Homo sapiens
caaagaaggcacaggtgtaaa

SEQ ID NO: 2110391 - DNA, 23 bp, Homo sapiens
caaagaaggcacaggtgtaaata

SEQ ID NO: 2110392 - DNA, 21 bp, Homo sapiens
caaagaattcctgaagccaga

SEQ ID NO: 2110393 - DNA, 15 bp, Homo sapiens
caaagagaaaaagaa

SEQ ID NO: 2110394 - DNA, 16 bp, Homo sapiens
caaagagaaaaagaaa

SEQ ID NO: 2110395 - DNA, 17 bp, Homo sapiens
caaagagaaaaagaaat

SEQ ID NO: 2110396 - DNA, 20 bp, Homo sapiens
caaagagaaaaagaaatgca

SEQ ID NO: 2110397 - DNA, 21 bp, Homo sapiens
caaagagaaaaagaaatgcaa

SEQ ID NO: 2110398 - DNA, 21 bp, Homo sapiens
caaagagaaatcacaggggcg

SEQ ID NO: 2110399 - DNA, 16 bp, Homo sapiens
caaagagactggagca

SEQ ID NO: 2110400 - DNA, 13 bp, Homo sapiens
caaagagcctgga

SEQ ID NO: 2110401 - DNA, 15 bp, Homo sapiens
caaagagcctggaga

SEQ ID NO: 2110402 - DNA, 20 bp, Homo sapiens
caaagaggttttatgaaaag

SEQ ID NO: 2110403 - DNA, 17 bp, Homo sapiens
caaagagttcaagaaat

SEQ ID NO: 2110404 - DNA, 18 bp, Homo sapiens
caaagcaaaagaagtaaa

SEQ ID NO: 2110405 - DNA, 22 bp, Homo sapiens
caaagcaagcattcagaagaaa

SEQ ID NO: 2110406 - DNA, 11 bp, Homo sapiens
caaagcaaggg

SEQ ID NO: 2110407 - DNA, 15 bp, Homo sapiens
caaagcaagggctcc

SEQ ID NO: 2110408 - DNA, 18 bp, Homo sapiens
caaagcaagggctccagc

SEQ ID NO: 2110409 - DNA, 20 bp, Homo sapiens
caaagcactgacttctaagt

SEQ ID NO: 2110410 - DNA, 22 bp, Homo sapiens
caaagcactgacttctaagtaa

SEQ ID NO: 2110411 - DNA, 17 bp, Homo sapiens
caaagcatcattgtaaa

SEQ ID NO: 2110412 - DNA, 20 bp, Homo sapiens
caaagcatcattgtaaatta

SEQ ID NO: 2110413 - DNA, 14 bp, Homo sapiens
caaagcatggacta

SEQ ID NO: 2110414 - DNA, 17 bp, Homo sapiens
caaagccaaactctgcc

SEQ ID NO: 2110415 - DNA, 22 bp, Homo sapiens
caaagccaacagtcaaaacaga

SEQ ID NO: 2110416 - DNA, 23 bp, Homo sapiens
caaagcccagctctttgttcagt

SEQ ID NO: 2110417 - DNA, 19 bp, Homo sapiens
caaagcccccacttctctc

SEQ ID NO: 2110418 - DNA, 22 bp, Homo sapiens
caaagcccccacttctctccag

SEQ ID NO: 2110419 - DNA, 14 bp, Homo sapiens
caaagcccctggaa

SEQ ID NO: 2110420 - DNA, 18 bp, Homo sapiens
caaagcccttccatgtcg

SEQ ID NO: 2110421 - DNA, 17 bp, Homo sapiens
caaagccgtgcctttct

SEQ ID NO: 2110422 - DNA, 21 bp, Homo sapiens
caaagccgtgcctttctctgg

SEQ ID NO: 2110423 - DNA, 19 bp, Homo sapiens
caaagcgagatcccatctc

SEQ ID NO: 2110424 - DNA, 16 bp, Homo sapiens
caaagcggttgcttct

SEQ ID NO: 2110425 - DNA, 19 bp, Homo sapiens
caaagctaggcctggccag

SEQ ID NO: 2110426 - DNA, 23 bp, Homo sapiens
caaagctctattaagatttccaa

SEQ ID NO: 2110427 - DNA, 20 bp, Homo sapiens
caaagctgaagaaaatgaag

SEQ ID NO: 2110428 - DNA, 21 bp, Homo sapiens
caaagctgagttacttgtctg

SEQ ID NO: 2110429 - DNA, 14 bp, Homo sapiens
caaagcttaaatgc

SEQ ID NO: 2110430 - DNA, 16 bp, Homo sapiens
caaagcttaaatgcct

SEQ ID NO: 2110431 - DNA, 20 bp, Homo sapiens
caaagcttctatcccaggag

SEQ ID NO: 2110432 - DNA, 14 bp, Homo sapiens
caaagcttgaagat

SEQ ID NO: 2110433 - DNA, 16 bp, Homo sapiens
caaagctttttccaga

SEQ ID NO: 2110434 - DNA, 16 bp, Homo sapiens
caaaggaaaccaaagg

SEQ ID NO: 2110435 - DNA, 16 bp, Homo sapiens
caaaggaagtctagga

SEQ ID NO: 2110436 - DNA, 17 bp, Homo sapiens
caaaggacattatgtgt

SEQ ID NO: 2110437 - DNA, 12 bp, Homo sapiens
caaaggagcctg

SEQ ID NO: 2110438 - DNA, 15 bp, Homo sapiens
caaaggagcctgtga

SEQ ID NO: 2110439 - DNA, 23 bp, Homo sapiens
caaaggatccagagacttgggga

SEQ ID NO: 2110440 - DNA, 14 bp, Homo sapiens
caaaggccctacca

SEQ ID NO: 2110441 - DNA, 19 bp, Homo sapiens
caaaggccctaccagaggg

SEQ ID NO: 2110442 - DNA, 22 bp, Homo sapiens
caaagggctcctctccagtctg

SEQ ID NO: 2110443 - DNA, 14 bp, Homo sapiens
caaagggctgaaag

SEQ ID NO: 2110444 - DNA, 21 bp, Homo sapiens
caaagggctgaaagccatttg

SEQ ID NO: 2110445 - DNA, 19 bp, Homo sapiens
caaaggggagaagggccag

SEQ ID NO: 2110446 - DNA, 19 bp, Homo sapiens
caaaggttttcctcttcta

SEQ ID NO: 2110447 - DNA, 13 bp, Homo sapiens
caaagtagagaag

SEQ ID NO: 2110448 - DNA, 23 bp, Homo sapiens
caaagtattaatgtacagagtgg

SEQ ID NO: 2110449 - DNA, 19 bp, Homo sapiens
caaagtcgacatactcatt

SEQ ID NO: 2110450 - DNA, 20 bp, Homo sapiens
caaagtctgatttgtgatga

SEQ ID NO: 2110451 - DNA, 13 bp, Homo sapiens
caaagtctgtgtg

SEQ ID NO: 2110452 - DNA, 20 bp, Homo sapiens
caaagtcttaaaataactta

SEQ ID NO: 2110453 - DNA, 18 bp, Homo sapiens
caaagtgcagcccttcct

SEQ ID NO: 2110454 - DNA, 16 bp, Homo sapiens
caaagtgccactcatt

SEQ ID NO: 2110455 - DNA, 22 bp, Homo sapiens
caaagtgccactcattcctgta

SEQ ID NO: 2110456 - DNA, 19 bp, Homo sapiens
caaagtgctgggattacag

SEQ ID NO: 2110457 - DNA, 13 bp, Homo sapiens
atttatattagag

SEQ ID NO: 2110458 - DNA, 20 bp, Homo sapiens
atttatattagagtgccctt

SEQ ID NO: 2110459 - DNA, 19 bp, Homo sapiens
atttatattgtatattctg

SEQ ID NO: 2110460 - DNA, 23 bp, Homo sapiens
atttatcatctcgaccacttttc

SEQ ID NO: 2110461 - DNA, 19 bp, Homo sapiens
atttatcctgaaatttcag

SEQ ID NO: 2110462 - DNA, 20 bp, Homo sapiens
atttatcctgaaatttcaga

SEQ ID NO: 2110463 - DNA, 17 bp, Homo sapiens
atttatcgcagaccttt

SEQ ID NO: 2110464 - DNA, 17 bp, Homo sapiens
atttatctaaaagaatt

SEQ ID NO: 2110465 - DNA, 16 bp, Homo sapiens
atttatctctatttaa

SEQ ID NO: 2110466 - DNA, 22 bp, Homo sapiens
atttatctctatttaatattta

SEQ ID NO: 2110467 - DNA, 16 bp, Homo sapiens
atttatgaatgtgcat

SEQ ID NO: 2110468 - DNA, 18 bp, Homo sapiens
atttatgaatgtgcattt

SEQ ID NO: 2110469 - DNA, 17 bp, Homo sapiens
atttatgagctcttcat

SEQ ID NO: 2110470 - DNA, 19 bp, Homo sapiens
atttatgagtttttgatag

SEQ ID NO: 2110471 - DNA, 21 bp, Homo sapiens
atttatgcttaaaatatgtat

SEQ ID NO: 2110472 - DNA, 22 bp, Homo sapiens
atttatgcttaaaatatgtatg

SEQ ID NO: 2110473 - DNA, 18 bp, Homo sapiens
atttatggcttataaatg

SEQ ID NO: 2110474 - DNA, 16 bp, Homo sapiens
atttatggtttctgcg

SEQ ID NO: 2110475 - DNA, 21 bp, Homo sapiens
atttatgtaatgctttatgtt

SEQ ID NO: 2110476 - DNA, 19 bp, Homo sapiens
atttattaaaatgattgta

SEQ ID NO: 2110477 - DNA, 23 bp, Homo sapiens
atttattaaaatgattgtaaaat

SEQ ID NO: 2110478 - DNA, 15 bp, Homo sapiens
attttgcaaaatttc

SEQ ID NO: 2110479 - DNA, 10 bp, Homo sapiens
attttgcaca

SEQ ID NO: 2110480 - DNA, 12 bp, Homo sapiens
attttgcactgt

SEQ ID NO: 2110481 - DNA, 19 bp, Homo sapiens
attttgcagattattttag

SEQ ID NO: 2110482 - DNA, 14 bp, Homo sapiens
attttgcagcagtg

SEQ ID NO: 2110483 - DNA, 16 bp, Homo sapiens
attttgcagcagtgag

SEQ ID NO: 2110484 - DNA, 18 bp, Homo sapiens
attttgcattagacagat

SEQ ID NO: 2110485 - DNA, 23 bp, Homo sapiens
attttgcattgtgtgagcttcta

SEQ ID NO: 2110486 - DNA, 21 bp, Homo sapiens
attttgcctcttttctctgtg

SEQ ID NO: 2110487 - DNA, 21 bp, Homo sapiens
attttggggtacccactgctc

SEQ ID NO: 2110488 - DNA, 23 bp, Homo sapiens
attttggggtacccactgctctg

SEQ ID NO: 2110489 - DNA, 22 bp, Homo sapiens
attttggtaaaatacttcttga

SEQ ID NO: 2110490 - DNA, 12 bp, Homo sapiens
attttggtttct

SEQ ID NO: 2110491 - DNA, 19 bp, Homo sapiens
attttgtaaactcaaaata

SEQ ID NO: 2110492 - DNA, 19 bp, Homo sapiens
attttgtaacgaagacaca

SEQ ID NO: 2110493 - DNA, 11 bp, Homo sapiens
attttgtaata

SEQ ID NO: 2110494 - DNA, 20 bp, Homo sapiens
attttgtacaaagatatgct

SEQ ID NO: 2110495 - DNA, 21 bp, Homo sapiens
attttgtacaaagatatgcta

SEQ ID NO: 2110496 - DNA, 15 bp, Homo sapiens
attttgtacagaatt

SEQ ID NO: 2110497 - DNA, 23 bp, Homo sapiens
attttgtacagaatttttaatga

SEQ ID NO: 2110498 - DNA, 14 bp, Homo sapiens
attttgtatatatc

SEQ ID NO: 2110499 - DNA, 10 bp, Homo sapiens
attttgtatt

SEQ ID NO: 2110500 - DNA, 15 bp, Homo sapiens
attttgtattttcaa

SEQ ID NO: 2110501 - DNA, 15 bp, Homo sapiens
attttgtatttttga

SEQ ID NO: 2110502 - DNA, 20 bp, Homo sapiens
attttgtcaaatcatggcca

SEQ ID NO: 2110503 - DNA, 15 bp, Homo sapiens
attttgtccatttta

SEQ ID NO: 2110504 - DNA, 19 bp, Homo sapiens
attttgttgctgttttgat

SEQ ID NO: 2110505 - DNA, 23 bp, Homo sapiens
attttgttgctgttttgatttgt

SEQ ID NO: 2110506 - DNA, 17 bp, Homo sapiens
attttgtttgtaatcct

SEQ ID NO: 2110507 - DNA, 16 bp, Homo sapiens
atttttaaactagtaa

SEQ ID NO: 2110508 - DNA, 13 bp, Homo sapiens
atttttacaataa

SEQ ID NO: 2110509 - DNA, 14 bp, Homo sapiens
atttttacaataaa

SEQ ID NO: 2110510 - DNA, 15 bp, Homo sapiens
atttttacaataatt

SEQ ID NO: 2110511 - DNA, 14 bp, Homo sapiens
atttttactaaagc

SEQ ID NO: 2110512 - DNA, 19 bp, Homo sapiens
atttttactactattctgt

SEQ ID NO: 2110513 - DNA, 19 bp, Homo sapiens
atttttatacatatcagaa

SEQ ID NO: 2110514 - DNA, 23 bp, Homo sapiens
atttttatacatatcagaaaagt

SEQ ID NO: 2110515 - DNA, 15 bp, Homo sapiens
atttttatatttagt

SEQ ID NO: 2110516 - DNA, 14 bp, Homo sapiens
atttttatggaatt

SEQ ID NO: 2110517 - DNA, 13 bp, Homo sapiens
atttttattaaat

SEQ ID NO: 2110518 - DNA, 15 bp, Homo sapiens
atttttcaaccagca

SEQ ID NO: 2110519 - DNA, 18 bp, Homo sapiens
atttttcatattgtgcca

SEQ ID NO: 2110520 - DNA, 19 bp, Homo sapiens
atttttcatattgtgccaa

SEQ ID NO: 2110521 - DNA, 12 bp, Homo sapiens
atttttcctgca

SEQ ID NO: 2110522 - DNA, 13 bp, Homo sapiens
atttttgaggaat

SEQ ID NO: 2110523 - DNA, 19 bp, Homo sapiens
atttttgatactaagcatt

SEQ ID NO: 2110524 - DNA, 21 bp, Homo sapiens
atttttgatactaagcattga

SEQ ID NO: 2110525 - DNA, 15 bp, Homo sapiens
atttttgtaataaaa

SEQ ID NO: 2110526 - DNA, 18 bp, Homo sapiens
atttttgtaataaaaggt

SEQ ID NO: 2110527 - DNA, 22 bp, Homo sapiens
atttttgtacgttatatattgt

SEQ ID NO: 2110528 - DNA, 18 bp, Homo sapiens
atttttgtccctgctcct

SEQ ID NO: 2110529 - DNA, 22 bp, Homo sapiens
atttttgtttcttccaaagcac

SEQ ID NO: 2110530 - DNA, 20 bp, Homo sapiens
atttttgttttccactgtgc

SEQ ID NO: 2110531 - DNA, 22 bp, Homo sapiens
atttttgttttccactgtgcta

SEQ ID NO: 2110532 - DNA, 19 bp, Homo sapiens
attttttaaaaaagcttaa

SEQ ID NO: 2110533 - DNA, 13 bp, Homo sapiens
attttttaaaata

SEQ ID NO: 2110534 - DNA, 13 bp, Homo sapiens
attttttaaatga

SEQ ID NO: 2110535 - DNA, 14 bp, Homo sapiens
attttttaaatgaa

SEQ ID NO: 2110536 - DNA, 18 bp, Homo sapiens
attttttaagtatttata

SEQ ID NO: 2110537 - DNA, 13 bp, Homo sapiens
attttttaataaa

SEQ ID NO: 2110538 - DNA, 14 bp, Homo sapiens
attttttaataatt

SEQ ID NO: 2110539 - DNA, 20 bp, Homo sapiens
attttttccttcaaagttta

SEQ ID NO: 2110540 - DNA, 21 bp, Homo sapiens
attttttccttcaaagtttaa

SEQ ID NO: 2110541 - DNA, 15 bp, Homo sapiens
atttttttcaatatt

SEQ ID NO: 2110542 - DNA, 22 bp, Homo sapiens
atttttttcactggagttacat

SEQ ID NO: 2110543 - DNA, 15 bp, Homo sapiens
attttttttgtaact

SEQ ID NO: 2110544 - DNA, 14 bp, Homo sapiens
caaaaaaaaataca

SEQ ID NO: 2110545 - DNA, 15 bp, Homo sapiens
caaaaaaagccttta

SEQ ID NO: 2110546 - DNA, 14 bp, Homo sapiens
caaaaaaattaaat

SEQ ID NO: 2110547 - DNA, 12 bp, Homo sapiens
caaaaaattgtc

SEQ ID NO: 2110548 - DNA, 15 bp, Homo sapiens
caaaaacaaaacaaa

SEQ ID NO: 2110549 - DNA, 20 bp, Homo sapiens
caaaaacaaaaccagctgct

SEQ ID NO: 2110550 - DNA, 14 bp, Homo sapiens
caaaaacacagcaa

SEQ ID NO: 2110551 - DNA, 15 bp, Homo sapiens
caaaaacacagcaag

SEQ ID NO: 2110552 - DNA, 14 bp, Homo sapiens
caaaaacagcctca

SEQ ID NO: 2110553 - DNA, 22 bp, Homo sapiens
caaaaacatacttcaaaaatgt

SEQ ID NO: 2110554 - DNA, 21 bp, Homo sapiens
caaaaacccagcaacagaaaa

SEQ ID NO: 2110555 - DNA, 20 bp, Homo sapiens
caaaaagggaaactattgtc

SEQ ID NO: 2110556 - DNA, 12 bp, Homo sapiens
caaaaagtgttt

SEQ ID NO: 2110557 - DNA, 14 bp, Homo sapiens
caaaaataaactag

SEQ ID NO: 2110558 - DNA, 15 bp, Homo sapiens
caaaaataaactagt

SEQ ID NO: 2110559 - DNA, 15 bp, Homo sapiens
caaaaatataaaata

SEQ ID NO: 2110560 - DNA, 20 bp, Homo sapiens
caaaaatgagctaggcatgg

SEQ ID NO: 2110561 - DNA, 21 bp, Homo sapiens
caaaaatgttcccttgaccat

SEQ ID NO: 2110562 - DNA, 15 bp, Homo sapiens
caaaacaacaacaat

SEQ ID NO: 2110563 - DNA, 15 bp, Homo sapiens
caaaacaagaaagaa

SEQ ID NO: 2110564 - DNA, 11 bp, Homo sapiens
caaaacaatgc

SEQ ID NO: 2110565 - DNA, 18 bp, Homo sapiens
caaaacaatgtttaaacc

SEQ ID NO: 2110566 - DNA, 19 bp, Homo sapiens
caaaacagagatgtgataa

SEQ ID NO: 2110567 - DNA, 13 bp, Homo sapiens
caaaacagattgt

SEQ ID NO: 2110568 - DNA, 18 bp, Homo sapiens
caaaacagattgtttgca

SEQ ID NO: 2110569 - DNA, 16 bp, Homo sapiens
caaaacatatcaattc

SEQ ID NO: 2110570 - DNA, 12 bp, Homo sapiens
caaaaccagctg

SEQ ID NO: 2110571 - DNA, 19 bp, Homo sapiens
caaaacctcatgacagcca

SEQ ID NO: 2110572 - DNA, 20 bp, Homo sapiens
caaaacctgcagttcctgag

SEQ ID NO: 2110573 - DNA, 21 bp, Homo sapiens
caaaacctttccccagacaca

SEQ ID NO: 2110574 - DNA, 13 bp, Homo sapiens
caaaacggggcag

SEQ ID NO: 2110575 - DNA, 14 bp, Homo sapiens
caaaactgcactgt

SEQ ID NO: 2110576 - DNA, 12 bp, Homo sapiens
caaaagaagtaa

SEQ ID NO: 2110577 - DNA, 15 bp, Homo sapiens
caaaagaagtaaaag

SEQ ID NO: 2110578 - DNA, 17 bp, Homo sapiens
caaaagaagtaaaagca

SEQ ID NO: 2110579 - DNA, 19 bp, Homo sapiens
caaaagaatcagaaacagg

SEQ ID NO: 2110580 - DNA, 19 bp, Homo sapiens
caaccatcaatggaaacag

SEQ ID NO: 2110581 - DNA, 24 bp, Homo sapiens
caaccatcaatggaaacagggcag

SEQ ID NO: 2110582 - DNA, 18 bp, Homo sapiens
caaccatgagaccactgt

SEQ ID NO: 2110583 - DNA, 23 bp, Homo sapiens
caaccatgagaccactgttatca

SEQ ID NO: 2110584 - DNA, 12 bp, Homo sapiens
caaccccagctg

SEQ ID NO: 2110585 - DNA, 13 bp, Homo sapiens
caaccccagctgg

SEQ ID NO: 2110586 - DNA, 17 bp, Homo sapiens
caaccccagctggcctc

SEQ ID NO: 2110587 - DNA, 18 bp, Homo sapiens
caaccccagctggcctct

SEQ ID NO: 2110588 - DNA, 22 bp, Homo sapiens
caaccccagctggcctctagaa

SEQ ID NO: 2110589 - DNA, 20 bp, Homo sapiens
caaccccagggcccccacag

SEQ ID NO: 2110590 - DNA, 12 bp, Homo sapiens
caacccccaccg

SEQ ID NO: 2110591 - DNA, 23 bp, Homo sapiens
caacccccaccgaagagccctga

SEQ ID NO: 2110592 - DNA, 15 bp, Homo sapiens
caacccccagcctgc

SEQ ID NO: 2110593 - DNA, 16 bp, Homo sapiens
caaccccccacctgcc

SEQ ID NO: 2110594 - DNA, 19 bp, Homo sapiens
caaccccgcggtgctctgg

SEQ ID NO: 2110595 - DNA, 12 bp, Homo sapiens
caacccctgtac

SEQ ID NO: 2110596 - DNA, 13 bp, Homo sapiens
caacccctgtacc

SEQ ID NO: 2110597 - DNA, 19 bp, Homo sapiens
caaccccttcgctcctgtg

SEQ ID NO: 2110598 - DNA, 16 bp, Homo sapiens
caacccgtgccaagtc

SEQ ID NO: 2110599 - DNA, 16 bp, Homo sapiens
caacccgtggaggctg

SEQ ID NO: 2110600 - DNA, 21 bp, Homo sapiens
caacccgtggaggctgctcgg

SEQ ID NO: 2110601 - DNA, 23 bp, Homo sapiens
caaccctgcccacttcagcccag

SEQ ID NO: 2110602 - DNA, 19 bp, Homo sapiens
caaccctgttttatactgt

SEQ ID NO: 2110603 - DNA, 15 bp, Homo sapiens
caacccttgctgctg

SEQ ID NO: 2110604 - DNA, 17 bp, Homo sapiens
caacccttgctgctgcc

SEQ ID NO: 2110605 - DNA, 22 bp, Homo sapiens
caaccgtggcccttcctggaca

SEQ ID NO: 2110606 - DNA, 23 bp, Homo sapiens
caaccgtggcccttcctggacag

SEQ ID NO: 2110607 - DNA, 18 bp, Homo sapiens
caacctaccaccccttcc

SEQ ID NO: 2110608 - DNA, 16 bp, Homo sapiens
caacctcaatgccctg

SEQ ID NO: 2110609 - DNA, 17 bp, Homo sapiens
caacctcaatgccctgc

SEQ ID NO: 2110610 - DNA, 19 bp, Homo sapiens
caacctccccgcagagctc

SEQ ID NO: 2110611 - DNA, 23 bp, Homo sapiens
caacctccccgcagagctccctt

SEQ ID NO: 2110612 - DNA, 18 bp, Homo sapiens
caacctccgtgctgggct

SEQ ID NO: 2110613 - DNA, 15 bp, Homo sapiens
caacctcctgggcta

SEQ ID NO: 2110614 - DNA, 15 bp, Homo sapiens
caacctgaccaacat

SEQ ID NO: 2110615 - DNA, 20 bp, Homo sapiens
caacctgagccttttcttat

SEQ ID NO: 2110616 - DNA, 21 bp, Homo sapiens
caacctgatgccccttcccca

SEQ ID NO: 2110617 - DNA, 12 bp, Homo sapiens
caacctgcccct

SEQ ID NO: 2110618 - DNA, 17 bp, Homo sapiens
caacctgcccctcccca

SEQ ID NO: 2110619 - DNA, 14 bp, Homo sapiens
caacctgcctgtgc

SEQ ID NO: 2110620 - DNA, 17 bp, Homo sapiens
caacctgcctgtgcatg

SEQ ID NO: 2110621 - DNA, 21 bp, Homo sapiens
caacctgctctcctcttgcca

SEQ ID NO: 2110622 - DNA, 14 bp, Homo sapiens
caacctggtggcac

SEQ ID NO: 2110623 - DNA, 18 bp, Homo sapiens
caacctggtggcaccaga

SEQ ID NO: 2110624 - DNA, 18 bp, Homo sapiens
caacctgtagagtggcca

SEQ ID NO: 2110625 - DNA, 14 bp, Homo sapiens
caacctgtgtctta

SEQ ID NO: 2110626 - DNA, 18 bp, Homo sapiens
caacctttgtgtaataaa

SEQ ID NO: 2110627 - DNA, 18 bp, Homo sapiens
caacgcagccctgctttg

SEQ ID NO: 2110628 - DNA, 20 bp, Homo sapiens
caacgggaccccctggccct

SEQ ID NO: 2110629 - DNA, 16 bp, Homo sapiens
caactaagcagtccct

SEQ ID NO: 2110630 - DNA, 21 bp, Homo sapiens
caactagatcaaggagcccag

SEQ ID NO: 2110631 - DNA, 13 bp, Homo sapiens
caactagccaagg

SEQ ID NO: 2110632 - DNA, 15 bp, Homo sapiens
caactagccaaggct

SEQ ID NO: 2110633 - DNA, 14 bp, Homo sapiens
caactatttataaa

SEQ ID NO: 2110634 - DNA, 17 bp, Homo sapiens
caactcactcttatgaa

SEQ ID NO: 2110635 - DNA, 13 bp, Homo sapiens
caactccagctcc

SEQ ID NO: 2110636 - DNA, 20 bp, Homo sapiens
caactccctgaacctcagtt

SEQ ID NO: 2110637 - DNA, 21 bp, Homo sapiens
caactcctggaagctgtgtcc

SEQ ID NO: 2110638 - DNA, 16 bp, Homo sapiens
caactcggagagggct

SEQ ID NO: 2110639 - DNA, 17 bp, Homo sapiens
caactcggagagggctg

SEQ ID NO: 2110640 - DNA, 15 bp, Homo sapiens
caactctctcctgta

SEQ ID NO: 2110641 - DNA, 13 bp, Homo sapiens
caactctgcactc

SEQ ID NO: 2110642 - DNA, 19 bp, Homo sapiens
caactctgcactccatggc

SEQ ID NO: 2110643 - DNA, 22 bp, Homo sapiens
caactcttcattttgagtctca

SEQ ID NO: 2110644 - DNA, 13 bp, Homo sapiens
caactgacacagg

SEQ ID NO: 2110645 - DNA, 15 bp, Homo sapiens
caactgacacaggaa

SEQ ID NO: 2110646 - DNA, 17 bp, Homo sapiens
caactgaccagcctcca

SEQ ID NO: 2110647 - DNA, 19 bp, Homo sapiens
caactgaccagcctccatg

SEQ ID NO: 2110648 - DNA, 21 bp, Homo sapiens
caactgaggcagacagcagct

SEQ ID NO: 2110649 - DNA, 18 bp, Homo sapiens
caactggacatcacagca

SEQ ID NO: 2110650 - DNA, 20 bp, Homo sapiens
caactggacatcacagcaga

SEQ ID NO: 2110651 - DNA, 19 bp, Homo sapiens
caactggacattgtctgcg

SEQ ID NO: 2110652 - DNA, 18 bp, Homo sapiens
caactggagcaagaagga

SEQ ID NO: 2110653 - DNA, 13 bp, Homo sapiens
caactggcttctg

SEQ ID NO: 2110654 - DNA, 15 bp, Homo sapiens
caactggcttctgtg

SEQ ID NO: 2110655 - DNA, 17 bp, Homo sapiens
caactggcttctgtgca

SEQ ID NO: 2110656 - DNA, 19 bp, Homo sapiens
caactggcttctgtgcact

SEQ ID NO: 2110657 - DNA, 14 bp, Homo sapiens
caactggtcactgt

SEQ ID NO: 2110658 - DNA, 20 bp, Homo sapiens
caactggtccactcagggct

SEQ ID NO: 2110659 - DNA, 19 bp, Homo sapiens
caactgttgattgcaggaa

SEQ ID NO: 2110660 - DNA, 14 bp, Homo sapiens
caacttaaatcact

SEQ ID NO: 2110661 - DNA, 16 bp, Homo sapiens
caacttcaagtgcatg

SEQ ID NO: 2110662 - DNA, 20 bp, Homo sapiens
caacttctttttattttctt

SEQ ID NO: 2110663 - DNA, 23 bp, Homo sapiens
caacttgaaattatatctgtggt

SEQ ID NO: 2110664 - DNA, 19 bp, Homo sapiens
caacttgaagcaagctttc

SEQ ID NO: 2110665 - DNA, 14 bp, Homo sapiens
caacttgcttctaa

SEQ ID NO: 2110666 - DNA, 12 bp, Homo sapiens
caacttggaaaa

SEQ ID NO: 2110667 - DNA, 21 bp, Homo sapiens
caacttggaaaaagaaagaaa

SEQ ID NO: 2110668 - DNA, 19 bp, Homo sapiens
caactttagtatttttact

SEQ ID NO: 2110669 - DNA, 11 bp, Homo sapiens
caactttctgt

SEQ ID NO: 2110670 - DNA, 15 bp, Homo sapiens
caagaaaaaataaat

SEQ ID NO: 2110671 - DNA, 17 bp, Homo sapiens
caagaaaaaataaatgg

SEQ ID NO: 2110672 - DNA, 15 bp, Homo sapiens
caagaaaaagaaaaa

SEQ ID NO: 2110673 - DNA, 18 bp, Homo sapiens
caagaaaactggaaatct

SEQ ID NO: 2110674 - DNA, 16 bp, Homo sapiens
caagaaagctggtaaa

SEQ ID NO: 2110675 - DNA, 12 bp, Homo sapiens
caagaaagtcca

SEQ ID NO: 2110676 - DNA, 17 bp, Homo sapiens
caagaacattatcttag

SEQ ID NO: 2110677 - DNA, 14 bp, Homo sapiens
caagaactctgggc

SEQ ID NO: 2110678 - DNA, 13 bp, Homo sapiens
caagaagctgcta

SEQ ID NO: 2110679 - DNA, 20 bp, Homo sapiens
caagaaggaaatagccaccg

SEQ ID NO: 2110680 - DNA, 23 bp, Homo sapiens
caagaagggttttccaccctgga

SEQ ID NO: 2110681 - DNA, 22 bp, Homo sapiens
caagaagtacatgaagagcagc

SEQ ID NO: 2110682 - DNA, 22 bp, Homo sapiens
caagaatacagaaaatgctttt

SEQ ID NO: 2110683 - DNA, 18 bp, Homo sapiens
caagaatagatgctgact

SEQ ID NO: 2110684 - DNA, 16 bp, Homo sapiens
caagaatattcaaatg

SEQ ID NO: 2110685 - DNA, 17 bp, Homo sapiens
caagaatattcaaatgt

SEQ ID NO: 2110686 - DNA, 17 bp, Homo sapiens
caagaatattgtatgtt

SEQ ID NO: 2110687 - DNA, 15 bp, Homo sapiens
caagaatcctctggg

SEQ ID NO: 2110688 - DNA, 14 bp, Homo sapiens
caagacaaagcaaa

SEQ ID NO: 2110689 - DNA, 14 bp, Homo sapiens
caagacctgttggt

SEQ ID NO: 2110690 - DNA, 15 bp, Homo sapiens
caagacgtcctggaa

SEQ ID NO: 2110691 - DNA, 20 bp, Homo sapiens
caagacgtcctggaatgaag

SEQ ID NO: 2110692 - DNA, 22 bp, Homo sapiens
caagacgtcctggaatgaagca

SEQ ID NO: 2110693 - DNA, 14 bp, Homo sapiens
caagactgttgctc

SEQ ID NO: 2110694 - DNA, 15 bp, Homo sapiens
caagacttggcaaca

SEQ ID NO: 2110695 - DNA, 20 bp, Homo sapiens
atttaaacagcagtgttccc

SEQ ID NO: 2110696 - DNA, 15 bp, Homo sapiens
atttaaaccagcaga

SEQ ID NO: 2110697 - DNA, 20 bp, Homo sapiens
atttaaaccagcagaaaagt

SEQ ID NO: 2110698 - DNA, 23 bp, Homo sapiens
atttaaaccagcagaaaagtgct

SEQ ID NO: 2110699 - DNA, 18 bp, Homo sapiens
atttaaaccgctaaaaga

SEQ ID NO: 2110700 - DNA, 20 bp, Homo sapiens
atttaaaccgctaaaagaaa

SEQ ID NO: 2110701 - DNA, 21 bp, Homo sapiens
atttaaaccgctaaaagaaac

SEQ ID NO: 2110702 - DNA, 23 bp, Homo sapiens
atttaaaccgctaaaagaaactt

SEQ ID NO: 2110703 - DNA, 12 bp, Homo sapiens
atttaaactata

SEQ ID NO: 2110704 - DNA, 18 bp, Homo sapiens
atttaaactgttctgtgt

SEQ ID NO: 2110705 - DNA, 21 bp, Homo sapiens
atttaaagacagggaagagca

SEQ ID NO: 2110706 - DNA, 19 bp, Homo sapiens
atttaaagcttattaaaac

SEQ ID NO: 2110707 - DNA, 14 bp, Homo sapiens
atttaaagttgttt

SEQ ID NO: 2110708 - DNA, 22 bp, Homo sapiens
atttaaatgttgaaatcttaaa

SEQ ID NO: 2110709 - DNA, 16 bp, Homo sapiens
atttaacagtcattta

SEQ ID NO: 2110710 - DNA, 18 bp, Homo sapiens
atttaacagtcatttaaa

SEQ ID NO: 2110711 - DNA, 17 bp, Homo sapiens
atttaactaatttaaac

SEQ ID NO: 2110712 - DNA, 20 bp, Homo sapiens
atttaactaatttaaaccag

SEQ ID NO: 2110713 - DNA, 21 bp, Homo sapiens
atttaactaatttaaaccagc

SEQ ID NO: 2110714 - DNA, 13 bp, Homo sapiens
atttaactctctt

SEQ ID NO: 2110715 - DNA, 13 bp, Homo sapiens
atttaactgcctt

SEQ ID NO: 2110716 - DNA, 20 bp, Homo sapiens
atttaacttaacattctgta

SEQ ID NO: 2110717 - DNA, 17 bp, Homo sapiens
atttaagaataaagtct

SEQ ID NO: 2110718 - DNA, 16 bp, Homo sapiens
atttaagggaaaaata

SEQ ID NO: 2110719 - DNA, 13 bp, Homo sapiens
atttaagtaattt

SEQ ID NO: 2110720 - DNA, 23 bp, Homo sapiens
atttaagtatatagtatatttat

SEQ ID NO: 2110721 - DNA, 15 bp, Homo sapiens
atttaataaatgtat

SEQ ID NO: 2110722 - DNA, 16 bp, Homo sapiens
atttaataaatgtgcc

SEQ ID NO: 2110723 - DNA, 13 bp, Homo sapiens
atttaatacagca

SEQ ID NO: 2110724 - DNA, 15 bp, Homo sapiens
atttaatacagcagt

SEQ ID NO: 2110725 - DNA, 17 bp, Homo sapiens
atttaatagcaaagaat

SEQ ID NO: 2110726 - DNA, 14 bp, Homo sapiens
atttaatatagcta

SEQ ID NO: 2110727 - DNA, 17 bp, Homo sapiens
atttaatatagctattt

SEQ ID NO: 2110728 - DNA, 13 bp, Homo sapiens
atttaatatttat

SEQ ID NO: 2110729 - DNA, 13 bp, Homo sapiens
atttaatgtttga

SEQ ID NO: 2110730 - DNA, 15 bp, Homo sapiens
atttaatgtttgatt

SEQ ID NO: 2110731 - DNA, 16 bp, Homo sapiens
atttaatgtttgattt

SEQ ID NO: 2110732 - DNA, 13 bp, Homo sapiens
atttaatgttttc

SEQ ID NO: 2110733 - DNA, 17 bp, Homo sapiens
atttaattcataattag

SEQ ID NO: 2110734 - DNA, 20 bp, Homo sapiens
atttaattcataattagaac

SEQ ID NO: 2110735 - DNA, 17 bp, Homo sapiens
atttaattcttatttct

SEQ ID NO: 2110736 - DNA, 18 bp, Homo sapiens
atttaattcttatttctg

SEQ ID NO: 2110737 - DNA, 19 bp, Homo sapiens
atttaattcttatttctgt

SEQ ID NO: 2110738 - DNA, 11 bp, Homo sapiens
atttaattgtg

SEQ ID NO: 2110739 - DNA, 22 bp, Homo sapiens
atttaattgtgtcatattaaac

SEQ ID NO: 2110740 - DNA, 17 bp, Homo sapiens
atttaatttttgcaatt

SEQ ID NO: 2110741 - DNA, 19 bp, Homo sapiens
atttacaataaatattctg

SEQ ID NO: 2110742 - DNA, 17 bp, Homo sapiens
atttaccacagcagctg

SEQ ID NO: 2110743 - DNA, 13 bp, Homo sapiens
atttacgactgaa

SEQ ID NO: 2110744 - DNA, 15 bp, Homo sapiens
atttacgactgaaga

SEQ ID NO: 2110745 - DNA, 22 bp, Homo sapiens
atttactaagccacaagaaatt

SEQ ID NO: 2110746 - DNA, 13 bp, Homo sapiens
atttactgagctt

SEQ ID NO: 2110747 - DNA, 15 bp, Homo sapiens
atttacttgaaagat

SEQ ID NO: 2110748 - DNA, 19 bp, Homo sapiens
atttagaaaacattcatcc

SEQ ID NO: 2110749 - DNA, 13 bp, Homo sapiens
atttagaaaactt

SEQ ID NO: 2110750 - DNA, 17 bp, Homo sapiens
atttagaaaactttaaa

SEQ ID NO: 2110751 - DNA, 17 bp, Homo sapiens
atttagagatgaattaa

SEQ ID NO: 2110752 - DNA, 23 bp, Homo sapiens
atttagagatgaattaaatttaa

SEQ ID NO: 2110753 - DNA, 18 bp, Homo sapiens
atttagcgtagctaagtg

SEQ ID NO: 2110754 - DNA, 14 bp, Homo sapiens
atttagggaagcag

SEQ ID NO: 2110755 - DNA, 17 bp, Homo sapiens
atttagggaagcaggga

SEQ ID NO: 2110756 - DNA, 23 bp, Homo sapiens
atttagggaagcagggacacccc

SEQ ID NO: 2110757 - DNA, 14 bp, Homo sapiens
atttaggtttctga

SEQ ID NO: 2110758 - DNA, 20 bp, Homo sapiens
atttagtgaaagctagagat

SEQ ID NO: 2110759 - DNA, 20 bp, Homo sapiens
atttagtgatattgtgggta

SEQ ID NO: 2110760 - DNA, 13 bp, Homo sapiens
atttagttatagt

SEQ ID NO: 2110761 - DNA, 18 bp, Homo sapiens
atttagttgaaaaatcta

SEQ ID NO: 2110762 - DNA, 14 bp, Homo sapiens
atttagttttatgg

SEQ ID NO: 2110763 - DNA, 21 bp, Homo sapiens
atttagttttatggcatgatt

SEQ ID NO: 2110764 - DNA, 22 bp, Homo sapiens
atttagttttatggcatgattt

SEQ ID NO: 2110765 - DNA, 15 bp, Homo sapiens
atttataaaattaga

SEQ ID NO: 2110766 - DNA, 21 bp, Homo sapiens
atttataaaattagaaagcaa

SEQ ID NO: 2110767 - DNA, 14 bp, Homo sapiens
atttataagcagat

SEQ ID NO: 2110768 - DNA, 21 bp, Homo sapiens
atttatacaaaataatttaac

SEQ ID NO: 2110769 - DNA, 16 bp, Homo sapiens
atttatagtttgtaca

SEQ ID NO: 2110770 - DNA, 15 bp, Homo sapiens
atttatatatatatg

SEQ ID NO: 2110771 - DNA, 16 bp, Homo sapiens
atttatatatatatgt

SEQ ID NO: 2110772 - DNA, 19 bp, Homo sapiens
atttatatatatatgtata

SEQ ID NO: 2110773 - DNA, 20 bp, Homo sapiens
atttatatatatatgtatat

SEQ ID NO: 2110774 - DNA, 17 bp, Homo sapiens
atttatatatcagttat

SEQ ID NO: 2110775 - DNA, 14 bp, Homo sapiens
atttatatatggca

SEQ ID NO: 2110776 - DNA, 15 bp, Homo sapiens
atttatatatggcat

SEQ ID NO: 2110777 - DNA, 15 bp, Homo sapiens
atttatatattggta

SEQ ID NO: 2110778 - DNA, 12 bp, Homo sapiens
atttatatattt

SEQ ID NO: 2110779 - DNA, 18 bp, Homo sapiens
atttatatatttataact

SEQ ID NO: 2110780 - DNA, 12 bp, Homo sapiens
atttatatctat

SEQ ID NO: 2110781 - DNA, 13 bp, Homo sapiens
atttatatctata

SEQ ID NO: 2110782 - DNA, 17 bp, Homo sapiens
atttatatctatagtag

SEQ ID NO: 2110783 - DNA, 19 bp, Homo sapiens
attaacattgggaaatctt

SEQ ID NO: 2110784 - DNA, 14 bp, Homo sapiens
attaacgggcatgt

SEQ ID NO: 2110785 - DNA, 18 bp, Homo sapiens
attaacgggcatgtatta

SEQ ID NO: 2110786 - DNA, 15 bp, Homo sapiens
attaactatgtgatg

SEQ ID NO: 2110787 - DNA, 12 bp, Homo sapiens
attaactcatta

SEQ ID NO: 2110788 - DNA, 18 bp, Homo sapiens
attaactgggtaatgaaa

SEQ ID NO: 2110789 - DNA, 15 bp, Homo sapiens
attaacttagcatgt

SEQ ID NO: 2110790 - DNA, 19 bp, Homo sapiens
attaagactttaaaagatg

SEQ ID NO: 2110791 - DNA, 16 bp, Homo sapiens
attaagagatacattc

SEQ ID NO: 2110792 - DNA, 19 bp, Homo sapiens
attaagatacactcctgct

SEQ ID NO: 2110793 - DNA, 17 bp, Homo sapiens
attaagattgaggcctg

SEQ ID NO: 2110794 - DNA, 16 bp, Homo sapiens
attaaggtgatgtgat

SEQ ID NO: 2110795 - DNA, 15 bp, Homo sapiens
attaaggtttgccct

SEQ ID NO: 2110796 - DNA, 18 bp, Homo sapiens
attaaggtttgccctgcc

SEQ ID NO: 2110797 - DNA, 19 bp, Homo sapiens
attaataaaaaatggaaag

SEQ ID NO: 2110798 - DNA, 17 bp, Homo sapiens
attaataccaaatattt

SEQ ID NO: 2110799 - DNA, 18 bp, Homo sapiens
attaataccaaatatttt

SEQ ID NO: 2110800 - DNA, 13 bp, Homo sapiens
attaatactaaaa

SEQ ID NO: 2110801 - DNA, 16 bp, Homo sapiens
attaatactaaaatat

SEQ ID NO: 2110802 - DNA, 16 bp, Homo sapiens
attaatacttcatttg

SEQ ID NO: 2110803 - DNA, 23 bp, Homo sapiens
attaatagcttttattgtataaa

SEQ ID NO: 2110804 - DNA, 14 bp, Homo sapiens
attaatatgttcat

SEQ ID NO: 2110805 - DNA, 15 bp, Homo sapiens
attaatatgttcatt

SEQ ID NO: 2110806 - DNA, 18 bp, Homo sapiens
attaatatgttcattaaa

SEQ ID NO: 2110807 - DNA, 21 bp, Homo sapiens
attaatcgtgtcttcaattaa

SEQ ID NO: 2110808 - DNA, 14 bp, Homo sapiens
attaatgaactgtg

SEQ ID NO: 2110809 - DNA, 17 bp, Homo sapiens
attaatgaactgtgaca

SEQ ID NO: 2110810 - DNA, 18 bp, Homo sapiens
attaatgaactgtgacag

SEQ ID NO: 2110811 - DNA, 15 bp, Homo sapiens
attaatggcactgat

SEQ ID NO: 2110812 - DNA, 21 bp, Homo sapiens
attaatgtaggtttagatata

SEQ ID NO: 2110813 - DNA, 15 bp, Homo sapiens
attaatgttttgtac

SEQ ID NO: 2110814 - DNA, 14 bp, Homo sapiens
attaattaaatgca

SEQ ID NO: 2110815 - DNA, 12 bp, Homo sapiens
attaattcatta

SEQ ID NO: 2110816 - DNA, 18 bp, Homo sapiens
attaattcttaataggct

SEQ ID NO: 2110817 - DNA, 14 bp, Homo sapiens
attaatttgagaat

SEQ ID NO: 2110818 - DNA, 19 bp, Homo sapiens
attaatttgagaattattc

SEQ ID NO: 2110819 - DNA, 16 bp, Homo sapiens
attaatttgtgtagat

SEQ ID NO: 2110820 - DNA, 19 bp, Homo sapiens
attaatttgtttttcttat

SEQ ID NO: 2110821 - DNA, 15 bp, Homo sapiens
attacagctggagaa

SEQ ID NO: 2110822 - DNA, 17 bp, Homo sapiens
attacatgtttaaattg

SEQ ID NO: 2110823 - DNA, 18 bp, Homo sapiens
attacatgtttaaattgt

SEQ ID NO: 2110824 - DNA, 16 bp, Homo sapiens
attacatttatacatc

SEQ ID NO: 2110825 - DNA, 17 bp, Homo sapiens
attacatttccaaatga

SEQ ID NO: 2110826 - DNA, 17 bp, Homo sapiens
attaccaaaaaagtatt

SEQ ID NO: 2110827 - DNA, 13 bp, Homo sapiens
attcaatatctga

SEQ ID NO: 2110828 - DNA, 23 bp, Homo sapiens
attcaatgtttatgcaaggaagg

SEQ ID NO: 2110829 - DNA, 14 bp, Homo sapiens
attcaattcctctg

SEQ ID NO: 2110830 - DNA, 18 bp, Homo sapiens
attcaattcctctgggaa

SEQ ID NO: 2110831 - DNA, 23 bp, Homo sapiens
attcacactgtgcgttttagagt

SEQ ID NO: 2110832 - DNA, 23 bp, Homo sapiens
attcacatttgatgtacatgtgt

SEQ ID NO: 2110833 - DNA, 14 bp, Homo sapiens
attcaccatccttt

SEQ ID NO: 2110834 - DNA, 13 bp, Homo sapiens
attcactcccaca

SEQ ID NO: 2110835 - DNA, 16 bp, Homo sapiens
attcactgcacaagat

SEQ ID NO: 2110836 - DNA, 18 bp, Homo sapiens
attcagaaaacataatat

SEQ ID NO: 2110837 - DNA, 20 bp, Homo sapiens
attcagaaaacataatataa

SEQ ID NO: 2110838 - DNA, 18 bp, Homo sapiens
attcagaacatcctccaa

SEQ ID NO: 2110839 - DNA, 18 bp, Homo sapiens
attcagaagaaaaagaag

SEQ ID NO: 2110840 - DNA, 16 bp, Homo sapiens
attcagagaatatcaa

SEQ ID NO: 2110841 - DNA, 16 bp, Homo sapiens
attcagcaccctgggt

SEQ ID NO: 2110842 - DNA, 14 bp, Homo sapiens
attcagcactgatt

SEQ ID NO: 2110843 - DNA, 17 bp, Homo sapiens
attcagcactgatttca

SEQ ID NO: 2110844 - DNA, 19 bp, Homo sapiens
attcagcactgatttcaca

SEQ ID NO: 2110845 - DNA, 14 bp, Homo sapiens
attcaggactggct

SEQ ID NO: 2110846 - DNA, 22 bp, Homo sapiens
attcaggacttaacggctccag

SEQ ID NO: 2110847 - DNA, 17 bp, Homo sapiens
attcaggtgttctcttc

SEQ ID NO: 2110848 - DNA, 14 bp, Homo sapiens
attcagtaacattt

SEQ ID NO: 2110849 - DNA, 18 bp, Homo sapiens
attcagtgagacacagag

SEQ ID NO: 2110850 - DNA, 21 bp, Homo sapiens
attcagtgctgtggcctgggc

SEQ ID NO: 2110851 - DNA, 22 bp, Homo sapiens
attcagtgctgtggcctgggca

SEQ ID NO: 2110852 - DNA, 17 bp, Homo sapiens
attcagtgcttcttaaa

SEQ ID NO: 2110853 - DNA, 15 bp, Homo sapiens
attcataattagaac

SEQ ID NO: 2110854 - DNA, 22 bp, Homo sapiens
attcatcatatgaatgttcttg

SEQ ID NO: 2110855 - DNA, 20 bp, Homo sapiens
attcatccagttgcaataaa

SEQ ID NO: 2110856 - DNA, 17 bp, Homo sapiens
attcatctctctttaat

SEQ ID NO: 2110857 - DNA, 18 bp, Homo sapiens
attcatctgggaggcaga

SEQ ID NO: 2110858 - DNA, 19 bp, Homo sapiens
attcatctgggaggcagaa

SEQ ID NO: 2110859 - DNA, 18 bp, Homo sapiens
attcatgctttctccttt

SEQ ID NO: 2110860 - DNA, 12 bp, Homo sapiens
attcatgtaata

SEQ ID NO: 2110861 - DNA, 13 bp, Homo sapiens
attcattcagtga

SEQ ID NO: 2110862 - DNA, 16 bp, Homo sapiens
attcattgtataaaaa

SEQ ID NO: 2110863 - DNA, 13 bp, Homo sapiens
attcatttaaaat

SEQ ID NO: 2110864 - DNA, 21 bp, Homo sapiens
attcattttaacatctgagaa

SEQ ID NO: 2110865 - DNA, 21 bp, Homo sapiens
attccaaacttctaaatgttg

SEQ ID NO: 2110866 - DNA, 23 bp, Homo sapiens
attccaacaatggggtgggccca

SEQ ID NO: 2110867 - DNA, 15 bp, Homo sapiens
attccaacagtgagt

SEQ ID NO: 2110868 - DNA, 21 bp, Homo sapiens
attccaagattaaaagttcat

SEQ ID NO: 2110869 - DNA, 16 bp, Homo sapiens
attccacacaaaatgt

SEQ ID NO: 2110870 - DNA, 18 bp, Homo sapiens
attccaccattcacattt

SEQ ID NO: 2110871 - DNA, 16 bp, Homo sapiens
attccacctgcaatca

SEQ ID NO: 2110872 - DNA, 22 bp, Homo sapiens
attccagcatttgccattcctg

SEQ ID NO: 2110873 - DNA, 23 bp, Homo sapiens
attccataaccccaggcatccca

SEQ ID NO: 2110874 - DNA, 18 bp, Homo sapiens
attccatccatatacttt

SEQ ID NO: 2110875 - DNA, 13 bp, Homo sapiens
attccatgatttt

SEQ ID NO: 2110876 - DNA, 15 bp, Homo sapiens
attccatgattttac

SEQ ID NO: 2110877 - DNA, 16 bp, Homo sapiens
attccatgattttaca

SEQ ID NO: 2110878 - DNA, 21 bp, Homo sapiens
attccatgattttacagagaa

SEQ ID NO: 2110879 - DNA, 22 bp, Homo sapiens
attccatgattttacagagaat

SEQ ID NO: 2110880 - DNA, 13 bp, Homo sapiens
attccatgtccct

SEQ ID NO: 2110881 - DNA, 14 bp, Homo sapiens
attccatgtccctg

SEQ ID NO: 2110882 - DNA, 15 bp, Homo sapiens
attccatgtccctgt

SEQ ID NO: 2110883 - DNA, 18 bp, Homo sapiens
attccatttaaaaaacaa

SEQ ID NO: 2110884 - DNA, 22 bp, Homo sapiens
attccatttttactaaagcagt

SEQ ID NO: 2110885 - DNA, 23 bp, Homo sapiens
attccatttttactaaagcagtg

SEQ ID NO: 2110886 - DNA, 15 bp, Homo sapiens
attcccaactgctct

SEQ ID NO: 2110887 - DNA, 22 bp, Homo sapiens
attcccaagctctagtgggaag

SEQ ID NO: 2110888 - DNA, 17 bp, Homo sapiens
attcccaagctctgctc

SEQ ID NO: 2110889 - DNA, 20 bp, Homo sapiens
attcccactaagctttctcc

SEQ ID NO: 2110890 - DNA, 23 bp, Homo sapiens
attcccactaagctttctccttt

SEQ ID NO: 2110891 - DNA, 16 bp, Homo sapiens
attcccagagacagga

SEQ ID NO: 2110892 - DNA, 17 bp, Homo sapiens
attcccattggttctcc

SEQ ID NO: 2110893 - DNA, 20 bp, Homo sapiens
attcccattttgcaaaattt

SEQ ID NO: 2110894 - DNA, 23 bp, Homo sapiens
attcccattttgcaaaatttcca

SEQ ID NO: 2110895 - DNA, 21 bp, Homo sapiens
attccccaggtggctgaccca

SEQ ID NO: 2110896 - DNA, 15 bp, Homo sapiens
attccctatcaaaac

SEQ ID NO: 2110897 - DNA, 19 bp, Homo sapiens
attccctatcaaaacatat

SEQ ID NO: 2110898 - DNA, 16 bp, Homo sapiens
attccctctcccaggc

SEQ ID NO: 2110899 - DNA, 19 bp, Homo sapiens
attccctggcctggctctc

SEQ ID NO: 2110900 - DNA, 20 bp, Homo sapiens
attccctggcctggctctcc

SEQ ID NO: 2110901 - DNA, 22 bp, Homo sapiens
attccctggcctggctctcctg

SEQ ID NO: 2110902 - DNA, 18 bp, Homo sapiens
atgtgtggatgtgtaaat

SEQ ID NO: 2110903 - DNA, 13 bp, Homo sapiens
atgtgtgggaaag

SEQ ID NO: 2110904 - DNA, 15 bp, Homo sapiens
atgtgtggggcatgg

SEQ ID NO: 2110905 - DNA, 16 bp, Homo sapiens
atgtgtggtgctaact

SEQ ID NO: 2110906 - DNA, 10 bp, Homo sapiens
atgtgtgtat

SEQ ID NO: 2110907 - DNA, 14 bp, Homo sapiens
atgtgtgtatatgt

SEQ ID NO: 2110908 - DNA, 17 bp, Homo sapiens
atgtgtgtatatgtatg

SEQ ID NO: 2110909 - DNA, 16 bp, Homo sapiens
atgtgtgtatgtgtat

SEQ ID NO: 2110910 - DNA, 19 bp, Homo sapiens
atgtgtgtgtatgctacta

SEQ ID NO: 2110911 - DNA, 21 bp, Homo sapiens
atgtgtgtgtatgctactaca

SEQ ID NO: 2110912 - DNA, 13 bp, Homo sapiens
atgtgtgtgtgta

SEQ ID NO: 2110913 - DNA, 12 bp, Homo sapiens
atgtgtgtttaa

SEQ ID NO: 2110914 - DNA, 18 bp, Homo sapiens
atgtgtttatgtgagctg

SEQ ID NO: 2110915 - DNA, 15 bp, Homo sapiens
atgtgttttgcacgt

SEQ ID NO: 2110916 - DNA, 19 bp, Homo sapiens
atgttaaaaaaataagaag

SEQ ID NO: 2110917 - DNA, 21 bp, Homo sapiens
atgttaaaaaaataagaagaa

SEQ ID NO: 2110918 - DNA, 12 bp, Homo sapiens
atgttaaagagg

SEQ ID NO: 2110919 - DNA, 19 bp, Homo sapiens
atgttaaagcatcagagat

SEQ ID NO: 2110920 - DNA, 20 bp, Homo sapiens
atgttaaatcccattcataa

SEQ ID NO: 2110921 - DNA, 21 bp, Homo sapiens
atgttaacctcagtgtcattt

SEQ ID NO: 2110922 - DNA, 18 bp, Homo sapiens
atgttaagacttgacagt

SEQ ID NO: 2110923 - DNA, 22 bp, Homo sapiens
atgttaagcaaaggaaaccaaa

SEQ ID NO: 2110924 - DNA, 21 bp, Homo sapiens
atgttaattaaactgaagaag

SEQ ID NO: 2110925 - DNA, 18 bp, Homo sapiens
atgttatttatatattgg

SEQ ID NO: 2110926 - DNA, 20 bp, Homo sapiens
atgttatttgttattttcag

SEQ ID NO: 2110927 - DNA, 17 bp, Homo sapiens
atgttcagaagaaattc

SEQ ID NO: 2110928 - DNA, 16 bp, Homo sapiens
atgttcatcaattccc

SEQ ID NO: 2110929 - DNA, 17 bp, Homo sapiens
atgttccaataaaactt

SEQ ID NO: 2110930 - DNA, 12 bp, Homo sapiens
atgttccctgca

SEQ ID NO: 2110931 - DNA, 15 bp, Homo sapiens
atgttcccttgacca

SEQ ID NO: 2110932 - DNA, 23 bp, Homo sapiens
atgttcccttgaccattggctgc

SEQ ID NO: 2110933 - DNA, 15 bp, Homo sapiens
atgttccctttaaaa

SEQ ID NO: 2110934 - DNA, 22 bp, Homo sapiens
atgttcctttggaagaaaaaat

SEQ ID NO: 2110935 - DNA, 17 bp, Homo sapiens
atgttctatatgcattt

SEQ ID NO: 2110936 - DNA, 13 bp, Homo sapiens
atgttctctgagg

SEQ ID NO: 2110937 - DNA, 18 bp, Homo sapiens
atgttctctgaggacact

SEQ ID NO: 2110938 - DNA, 16 bp, Homo sapiens
atgttctgaataattt

SEQ ID NO: 2110939 - DNA, 18 bp, Homo sapiens
atgttctgtcacgtgaaa

SEQ ID NO: 2110940 - DNA, 20 bp, Homo sapiens
atgttctgttgtaaagagtg

SEQ ID NO: 2110941 - DNA, 19 bp, Homo sapiens
atgttcttgcagtcatcag

SEQ ID NO: 2110942 - DNA, 14 bp, Homo sapiens
atgttgagggaaca

SEQ ID NO: 2110943 - DNA, 16 bp, Homo sapiens
atgttgcatgcctatg

SEQ ID NO: 2110944 - DNA, 12 bp, Homo sapiens
atgttgcccagg

SEQ ID NO: 2110945 - DNA, 15 bp, Homo sapiens
atgttgcccaggcag

SEQ ID NO: 2110946 - DNA, 14 bp, Homo sapiens
atgttgcccaggct

SEQ ID NO: 2110947 - DNA, 20 bp, Homo sapiens
atgttgctgtgcacggtgga

SEQ ID NO: 2110948 - DNA, 13 bp, Homo sapiens
atgttggccaggc

SEQ ID NO: 2110949 - DNA, 17 bp, Homo sapiens
atgttggccaggctggt

SEQ ID NO: 2110950 - DNA, 17 bp, Homo sapiens
atgtatatgtatatata

SEQ ID NO: 2110951 - DNA, 15 bp, Homo sapiens
atgtatcctgataaa

SEQ ID NO: 2110952 - DNA, 16 bp, Homo sapiens
atgtatcttatttata

SEQ ID NO: 2110953 - DNA, 17 bp, Homo sapiens
atgtatcttatttatat

SEQ ID NO: 2110954 - DNA, 19 bp, Homo sapiens
atgtatcttatttatatat

SEQ ID NO: 2110955 - DNA, 21 bp, Homo sapiens
atgtatcttatttatatatga

SEQ ID NO: 2110956 - DNA, 14 bp, Homo sapiens
atgtatgattacat

SEQ ID NO: 2110957 - DNA, 13 bp, Homo sapiens
atgtatgtgtgtg

SEQ ID NO: 2110958 - DNA, 20 bp, Homo sapiens
atgtatgttcagaagaaatt

SEQ ID NO: 2110959 - DNA, 19 bp, Homo sapiens
atgtattaagccaaacatg

SEQ ID NO: 2110960 - DNA, 22 bp, Homo sapiens
atgtattaagccaaacatgagt

SEQ ID NO: 2110961 - DNA, 21 bp, Homo sapiens
atgtattatcacatcaagcat

SEQ ID NO: 2110962 - DNA, 16 bp, Homo sapiens
atgtattattttctat

SEQ ID NO: 2110963 - DNA, 11 bp, Homo sapiens
atgtattgtaa

SEQ ID NO: 2110964 - DNA, 14 bp, Homo sapiens
atgtattgtaaaca

SEQ ID NO: 2110965 - DNA, 19 bp, Homo sapiens
atgtcaaatatctcagagg

SEQ ID NO: 2110966 - DNA, 18 bp, Homo sapiens
atgtcaaggactcctgtc

SEQ ID NO: 2110967 - DNA, 20 bp, Homo sapiens
atgtcacaatcctgtccctc

SEQ ID NO: 2110968 - DNA, 17 bp, Homo sapiens
atgtcacacttgtttct

SEQ ID NO: 2110969 - DNA, 15 bp, Homo sapiens
atgtcaccagtcctg

SEQ ID NO: 2110970 - DNA, 22 bp, Homo sapiens
atgtcaccgtggaccttcctgc

SEQ ID NO: 2110971 - DNA, 12 bp, Homo sapiens
atgtcacctcag

SEQ ID NO: 2110972 - DNA, 18 bp, Homo sapiens
atgtcacgtcttgaaaag

SEQ ID NO: 2110973 - DNA, 13 bp, Homo sapiens
atgtcagaaactc

SEQ ID NO: 2110974 - DNA, 15 bp, Homo sapiens
atgtcagacatgaaa

SEQ ID NO: 2110975 - DNA, 21 bp, Homo sapiens
atgtcagacatgaaaactatt

SEQ ID NO: 2110976 - DNA, 16 bp, Homo sapiens
atgtcagactggctgg

SEQ ID NO: 2110977 - DNA, 21 bp, Homo sapiens
atgtcagagccaggctctgcc

SEQ ID NO: 2110978 - DNA, 12 bp, Homo sapiens
atgtcagagcta

SEQ ID NO: 2110979 - DNA, 11 bp, Homo sapiens
atgtcagcctt

SEQ ID NO: 2110980 - DNA, 13 bp, Homo sapiens
atgtcagccttgc

SEQ ID NO: 2110981 - DNA, 21 bp, Homo sapiens
atgtcatattggcagttggag

SEQ ID NO: 2110982 - DNA, 14 bp, Homo sapiens
atgtcatcatacat

SEQ ID NO: 2110983 - DNA, 15 bp, Homo sapiens
atgtcatcatacatg

SEQ ID NO: 2110984 - DNA, 22 bp, Homo sapiens
atgtcatccccttgtgtcagag

SEQ ID NO: 2110985 - DNA, 16 bp, Homo sapiens
atgtcattaatgtgtt

SEQ ID NO: 2110986 - DNA, 13 bp, Homo sapiens
atgtccaaaatgt

SEQ ID NO: 2110987 - DNA, 23 bp, Homo sapiens
atgtccagaagaatattcaggac

SEQ ID NO: 2110988 - DNA, 21 bp, Homo sapiens
atgtccctacacccctcccct

SEQ ID NO: 2110989 - DNA, 14 bp, Homo sapiens
atgtccgttccagg

SEQ ID NO: 2110990 - DNA, 15 bp, Homo sapiens
atgtccgttccagga

SEQ ID NO: 2110991 - DNA, 18 bp, Homo sapiens
atgtcctaaggacacact

SEQ ID NO: 2110992 - DNA, 21 bp, Homo sapiens
atgtcctaaggacacactaat

SEQ ID NO: 2110993 - DNA, 13 bp, Homo sapiens
atgtcctatgtgt

SEQ ID NO: 2110994 - DNA, 22 bp, Homo sapiens
atgtcctccaacaataaagagc

SEQ ID NO: 2110995 - DNA, 19 bp, Homo sapiens
atgtcggagtagaaattgt

SEQ ID NO: 2110996 - DNA, 21 bp, Homo sapiens
atgtcggcacgtcccatgtgc

SEQ ID NO: 2110997 - DNA, 12 bp, Homo sapiens
atgtctatttaa

SEQ ID NO: 2110998 - DNA, 18 bp, Homo sapiens
atgtctcagcctcctcag

SEQ ID NO: 2110999 - DNA, 16 bp, Homo sapiens
atgtctcgctagtgat

SEQ ID NO: 2111000 - DNA, 17 bp, Homo sapiens
atgtctctcagaattct

SEQ ID NO: 2111001 - DNA, 16 bp, Homo sapiens
atgtctcttcctctgt

SEQ ID NO: 2111002 - DNA, 16 bp, Homo sapiens
atgtctcttgtagaag

SEQ ID NO: 2111003 - DNA, 16 bp, Homo sapiens
atctgttactgaaatg

SEQ ID NO: 2111004 - DNA, 22 bp, Homo sapiens
atctgttatcctgctagctgta

SEQ ID NO: 2111005 - DNA, 15 bp, Homo sapiens
atctgttttgtatat

SEQ ID NO: 2111006 - DNA, 17 bp, Homo sapiens
atctgttttgtatatga

SEQ ID NO: 2111007 - DNA, 18 bp, Homo sapiens
atctgtttttaaaaatca

SEQ ID NO: 2111008 - DNA, 15 bp, Homo sapiens
atcttaaaagtgtaa

SEQ ID NO: 2111009 - DNA, 15 bp, Homo sapiens
atcttaaatgacagt

SEQ ID NO: 2111010 - DNA, 19 bp, Homo sapiens
atcttaattttttttaatg

SEQ ID NO: 2111011 - DNA, 15 bp, Homo sapiens
atcttacatctgcag

SEQ ID NO: 2111012 - DNA, 18 bp, Homo sapiens
atcttacctgtaaagtct

SEQ ID NO: 2111013 - DNA, 16 bp, Homo sapiens
atcttactatttcaca

SEQ ID NO: 2111014 - DNA, 15 bp, Homo sapiens
atcttagctttccac

SEQ ID NO: 2111015 - DNA, 18 bp, Homo sapiens
atcttagctttccacagg

SEQ ID NO: 2111016 - DNA, 12 bp, Homo sapiens
atcttatttata

SEQ ID NO: 2111017 - DNA, 23 bp, Homo sapiens
atcttattttcatgtatatgtgt

SEQ ID NO: 2111018 - DNA, 12 bp, Homo sapiens
atcttcacatag

SEQ ID NO: 2111019 - DNA, 14 bp, Homo sapiens
atcttcagctccca

SEQ ID NO: 2111020 - DNA, 19 bp, Homo sapiens
atcttcctcatcagtagat

SEQ ID NO: 2111021 - DNA, 15 bp, Homo sapiens
atcttccttgtgagg

SEQ ID NO: 2111022 - DNA, 17 bp, Homo sapiens
atcttctgcaattgctt

SEQ ID NO: 2111023 - DNA, 18 bp, Homo sapiens
atcttctggagtctccag

SEQ ID NO: 2111024 - DNA, 14 bp, Homo sapiens
atcttctggcttga

SEQ ID NO: 2111025 - DNA, 21 bp, Homo sapiens
atcctaatgacttctaaaaat

SEQ ID NO: 2111026 - DNA, 17 bp, Homo sapiens
atcctaccaatgcatgc

SEQ ID NO: 2111027 - DNA, 19 bp, Homo sapiens
atcctagaaccaagcttca

SEQ ID NO: 2111028 - DNA, 14 bp, Homo sapiens
atcctagagaggct

SEQ ID NO: 2111029 - DNA, 21 bp, Homo sapiens
atcctaggcttaaatgcaata

SEQ ID NO: 2111030 - DNA, 18 bp, Homo sapiens
atcctattctcaccagga

SEQ ID NO: 2111031 - DNA, 21 bp, Homo sapiens
atcctcacaggagcagacaga

SEQ ID NO: 2111032 - DNA, 23 bp, Homo sapiens
atcctcacaggagcagacagaga

SEQ ID NO: 2111033 - DNA, 15 bp, Homo sapiens
atcctcaggatttca

SEQ ID NO: 2111034 - DNA, 16 bp, Homo sapiens
atcctcaggatttcat

SEQ ID NO: 2111035 - DNA, 19 bp, Homo sapiens
atcctccaacgttaaaaga

SEQ ID NO: 2111036 - DNA, 23 bp, Homo sapiens
atcctccaacgttaaaagacagt

SEQ ID NO: 2111037 - DNA, 19 bp, Homo sapiens
atcctccttataagcccag

SEQ ID NO: 2111038 - DNA, 16 bp, Homo sapiens
atcctcttctaactca

SEQ ID NO: 2111039 - DNA, 13 bp, Homo sapiens
atcctgaggctga

SEQ ID NO: 2111040 - DNA, 12 bp, Homo sapiens
atcctgataaac

SEQ ID NO: 2111041 - DNA, 20 bp, Homo sapiens
atcctgataaacattaaaca

SEQ ID NO: 2111042 - DNA, 16 bp, Homo sapiens
atcctgcagcctcctc

SEQ ID NO: 2111043 - DNA, 20 bp, Homo sapiens
atcctgcagcctcctcctga

SEQ ID NO: 2111044 - DNA, 22 bp, Homo sapiens
atcctgcaggaacgagcactgg

SEQ ID NO: 2111045 - DNA, 17 bp, Homo sapiens
atcctgcagttgggcca

SEQ ID NO: 2111046 - DNA, 15 bp, Homo sapiens
atcctgcattttacg

SEQ ID NO: 2111047 - DNA, 17 bp, Homo sapiens
atcctgcccccagccat

SEQ ID NO: 2111048 - DNA, 18 bp, Homo sapiens
atcctgctagctgtagaa

SEQ ID NO: 2111049 - DNA, 19 bp, Homo sapiens
atcctgctagctgtagaaa

SEQ ID NO: 2111050 - DNA, 20 bp, Homo sapiens
atcctgctcataacatcttt

SEQ ID NO: 2111051 - DNA, 22 bp, Homo sapiens
atcctgctcataacatctttga

SEQ ID NO: 2111052 - DNA, 19 bp, Homo sapiens
atcctgctgtggcctcact

SEQ ID NO: 2111053 - DNA, 21 bp, Homo sapiens
atcctgcttcctaggccccag

SEQ ID NO: 2111054 - DNA, 22 bp, Homo sapiens
atcctgcttcctaggccccaga

SEQ ID NO: 2111055 - DNA, 22 bp, Homo sapiens
atcctggcacccggcccctgct

SEQ ID NO: 2111056 - DNA, 11 bp, Homo sapiens
atcctggcccc

SEQ ID NO: 2111057 - DNA, 15 bp, Homo sapiens
atcctggcccctcca

SEQ ID NO: 2111058 - DNA, 13 bp, Homo sapiens
atcctggcctcct

SEQ ID NO: 2111059 - DNA, 14 bp, Homo sapiens
atcctggcctcctt

SEQ ID NO: 2111060 - DNA, 18 bp, Homo sapiens
atcctggcctccttttgc

SEQ ID NO: 2111061 - DNA, 21 bp, Homo sapiens
atcctgtctttaaggaaaaaa

SEQ ID NO: 2111062 - DNA, 15 bp, Homo sapiens
atcctgtgtggggag

SEQ ID NO: 2111063 - DNA, 14 bp, Homo sapiens
atccttatttatat

SEQ ID NO: 2111064 - DNA, 16 bp, Homo sapiens
atccttcaccagagcc

SEQ ID NO: 2111065 - DNA, 20 bp, Homo sapiens
atccttcaccagagcccatg

SEQ ID NO: 2111066 - DNA, 21 bp, Homo sapiens
atccttcaccagagcccatgc

SEQ ID NO: 2111067 - DNA, 17 bp, Homo sapiens
atccttccagtggctcg

SEQ ID NO: 2111068 - DNA, 20 bp, Homo sapiens
atccttcttatgtttgcttt

SEQ ID NO: 2111069 - DNA, 17 bp, Homo sapiens
atccttggagagcagct

SEQ ID NO: 2111070 - DNA, 18 bp, Homo sapiens
atccttggagagcagctg

SEQ ID NO: 2111071 - DNA, 20 bp, Homo sapiens
atccttggagagcagctggc

SEQ ID NO: 2111072 - DNA, 15 bp, Homo sapiens
atcctttctattgaa

SEQ ID NO: 2111073 - DNA, 19 bp, Homo sapiens
atcctttgagaatgtgatt

SEQ ID NO: 2111074 - DNA, 22 bp, Homo sapiens
atcctttgagttatagtttgct

SEQ ID NO: 2111075 - DNA, 20 bp, Homo sapiens
atcctttgccccaaggctgc

SEQ ID NO: 2111076 - DNA, 13 bp, Homo sapiens
atccttttatgtt

SEQ ID NO: 2111077 - DNA, 19 bp, Homo sapiens
atccttttatgttatttat

SEQ ID NO: 2111078 - DNA, 15 bp, Homo sapiens
atcctttttctttat

SEQ ID NO: 2111079 - DNA, 13 bp, Homo sapiens
atccttttttaaa

SEQ ID NO: 2111080 - DNA, 16 bp, Homo sapiens
atcgaaaattcatttc

SEQ ID NO: 2111081 - DNA, 15 bp, Homo sapiens
atcgaaatgaattta

SEQ ID NO: 2111082 - DNA, 14 bp, Homo sapiens
atcgaatgaaatta

SEQ ID NO: 2111083 - DNA, 15 bp, Homo sapiens
atcgacctcactgtc

SEQ ID NO: 2111084 - DNA, 12 bp, Homo sapiens
atcgactttata

SEQ ID NO: 2111085 - DNA, 19 bp, Homo sapiens
atcgagtctacctcttcag

SEQ ID NO: 2111086 - DNA, 16 bp, Homo sapiens
atcgatctgtactgta

SEQ ID NO: 2111087 - DNA, 20 bp, Homo sapiens
atcgcagaccttttttagga

SEQ ID NO: 2111088 - DNA, 14 bp, Homo sapiens
atcgccccagactc

SEQ ID NO: 2111089 - DNA, 17 bp, Homo sapiens
atcgcctgagcccagga

SEQ ID NO: 2111090 - DNA, 14 bp, Homo sapiens
atcggaagcagtgc

SEQ ID NO: 2111091 - DNA, 16 bp, Homo sapiens
atcggagcgaagcaga

SEQ ID NO: 2111092 - DNA, 21 bp, Homo sapiens
atcggaggctgggcccctggg

SEQ ID NO: 2111093 - DNA, 22 bp, Homo sapiens
atcggaggctgggcccctggga

SEQ ID NO: 2111094 - DNA, 12 bp, Homo sapiens
atcggaggtggt

SEQ ID NO: 2111095 - DNA, 18 bp, Homo sapiens
atcggaggtggtggagga

SEQ ID NO: 2111096 - DNA, 19 bp, Homo sapiens
atcggcccacagctcccac

SEQ ID NO: 2111097 - DNA, 17 bp, Homo sapiens
atcgggagcagtgtctt

SEQ ID NO: 2111098 - DNA, 14 bp, Homo sapiens
atcgtattaattat

SEQ ID NO: 2111099 - DNA, 19 bp, Homo sapiens
atcgtgacccttcagggcc

SEQ ID NO: 2111100 - DNA, 21 bp, Homo sapiens
atcgtgacccttcagggccag

SEQ ID NO: 2111101 - DNA, 17 bp, Homo sapiens
atcgtgctaaattttca

SEQ ID NO: 2111102 - DNA, 14 bp, Homo sapiens
atcgttatgtgtgt

SEQ ID NO: 2111103 - DNA, 16 bp, Homo sapiens
atcgttatgtgtgtat

SEQ ID NO: 2111104 - DNA, 18 bp, Homo sapiens
atctaaagccagtggcag

SEQ ID NO: 2111105 - DNA, 18 bp, Homo sapiens
atctaagttaatttaaag

SEQ ID NO: 2111106 - DNA, 15 bp, Homo sapiens
atctaatacctctgt

SEQ ID NO: 2111107 - DNA, 23 bp, Homo sapiens
atctaatatgtaacaagccaccc

SEQ ID NO: 2111108 - DNA, 19 bp, Homo sapiens
atctaatcaggttgttaat

SEQ ID NO: 2111109 - DNA, 16 bp, Homo sapiens
atctaatgtctcttcc

SEQ ID NO: 2111110 - DNA, 14 bp, Homo sapiens
atctaatttataca

SEQ ID NO: 2111111 - DNA, 22 bp, Homo sapiens
atctacacagcctggactttgg

SEQ ID NO: 2111112 - DNA, 15 bp, Homo sapiens
atctacctgccctct

SEQ ID NO: 2111113 - DNA, 20 bp, Homo sapiens
atctacctgccctctctcag

SEQ ID NO: 2111114 - DNA, 18 bp, Homo sapiens
atctagaaagtgggttca

SEQ ID NO: 2111115 - DNA, 13 bp, Homo sapiens
atctagagatttt

SEQ ID NO: 2111116 - DNA, 18 bp, Homo sapiens
atctagctctagttcaaa

SEQ ID NO: 2111117 - DNA, 16 bp, Homo sapiens
atctagcttcatgcct

SEQ ID NO: 2111118 - DNA, 18 bp, Homo sapiens
atctagcttcatgcctca

SEQ ID NO: 2111119 - DNA, 21 bp, Homo sapiens
atctagcttcatgcctcagtt

SEQ ID NO: 2111120 - DNA, 23 bp, Homo sapiens
atctagtttacttcctaaatttc

SEQ ID NO: 2111121 - DNA, 15 bp, Homo sapiens
atctatctatttgag

SEQ ID NO: 2111122 - DNA, 16 bp, Homo sapiens
atctatctatttgagg

SEQ ID NO: 2111123 - DNA, 21 bp, Homo sapiens
atctatctgcctttacctaca

SEQ ID NO: 2111124 - DNA, 18 bp, Homo sapiens
atctatctgtattttcat

SEQ ID NO: 2111125 - DNA, 15 bp, Homo sapiens
atctatgcaattttt

SEQ ID NO: 2111126 - DNA, 19 bp, Homo sapiens
atctatgcaatttttaaac

SEQ ID NO: 2111127 - DNA, 20 bp, Homo sapiens
atctatgcaatttttaaact

SEQ ID NO: 2111128 - DNA, 21 bp, Homo sapiens
atctatgcaatttttaaacta

SEQ ID NO: 2111129 - DNA, 17 bp, Homo sapiens
atcttcttatgcaattt

SEQ ID NO: 2111130 - DNA, 12 bp, Homo sapiens
atcttgaaaaga

SEQ ID NO: 2111131 - DNA, 14 bp, Homo sapiens
atcttgaagaatat

SEQ ID NO: 2111132 - DNA, 12 bp, Homo sapiens
atcttgaaggaa

SEQ ID NO: 2111133 - DNA, 14 bp, Homo sapiens
atcttgaatatttg

SEQ ID NO: 2111134 - DNA, 16 bp, Homo sapiens
atcttgaatttcatgc

SEQ ID NO: 2111135 - DNA, 22 bp, Homo sapiens
atcttgacacggtgaaatccag

SEQ ID NO: 2111136 - DNA, 23 bp, Homo sapiens
atcttgacacggtgaaatccagg

SEQ ID NO: 2111137 - DNA, 16 bp, Homo sapiens
atcttgactcactgca

SEQ ID NO: 2111138 - DNA, 14 bp, Homo sapiens
atcttgctctgctg

SEQ ID NO: 2111139 - DNA, 17 bp, Homo sapiens
atcttgctctgctgaca

SEQ ID NO: 2111140 - DNA, 19 bp, Homo sapiens
atcttggactgacatttag

SEQ ID NO: 2111141 - DNA, 14 bp, Homo sapiens
atcttggctcactg

SEQ ID NO: 2111142 - DNA, 22 bp, Homo sapiens
atcttggtactactagatgtct

SEQ ID NO: 2111143 - DNA, 20 bp, Homo sapiens
atcttggttgatgccaaaaa

SEQ ID NO: 2111144 - DNA, 13 bp, Homo sapiens
atcttgtcaagaa

SEQ ID NO: 2111145 - DNA, 12 bp, Homo sapiens
atctttaaaata

SEQ ID NO: 2111146 - DNA, 12 bp, Homo sapiens
atctttcaggaa

SEQ ID NO: 2111147 - DNA, 11 bp, Homo sapiens
atctttcctcc

SEQ ID NO: 2111148 - DNA, 16 bp, Homo sapiens
atctttctattccaaa

SEQ ID NO: 2111149 - DNA, 17 bp, Homo sapiens
atctttctttacctgag

SEQ ID NO: 2111150 - DNA, 18 bp, Homo sapiens
atctttctttacctgaga

SEQ ID NO: 2111151 - DNA, 18 bp, Homo sapiens
atctttgcagacaggcaa

SEQ ID NO: 2111152 - DNA, 14 bp, Homo sapiens
atctttgtgacagg

SEQ ID NO: 2111153 - DNA, 22 bp, Homo sapiens
atcttttcattgaacagcaaag

SEQ ID NO: 2111154 - DNA, 13 bp, Homo sapiens
atctttttcctcc

SEQ ID NO: 2111155 - DNA, 13 bp, Homo sapiens
atctttttctaac

SEQ ID NO: 2111156 - DNA, 20 bp, Homo sapiens
atgaaaaacaaaaataacat

SEQ ID NO: 2111157 - DNA, 15 bp, Homo sapiens
atgaaaaagaagaat

SEQ ID NO: 2111158 - DNA, 17 bp, Homo sapiens
atgaaaaagaagaatct

SEQ ID NO: 2111159 - DNA, 13 bp, Homo sapiens
atgaaaaattctc

SEQ ID NO: 2111160 - DNA, 18 bp, Homo sapiens
atgaaaagaataaaaatt

SEQ ID NO: 2111161 - DNA, 12 bp, Homo sapiens
atgaaaatgtca

SEQ ID NO: 2111162 - DNA, 13 bp, Homo sapiens
atgaaaatgtcag

SEQ ID NO: 2111163 - DNA, 15 bp, Homo sapiens
atgaaaatgtcagaa

SEQ ID NO: 2111164 - DNA, 19 bp, Homo sapiens
atgaaaatgtcagaaacca

SEQ ID NO: 2111165 - DNA, 18 bp, Homo sapiens
atgaaaattatctccctt

SEQ ID NO: 2111166 - DNA, 13 bp, Homo sapiens
atgaaacagaaac

SEQ ID NO: 2111167 - DNA, 22 bp, Homo sapiens
atgaaacagaaacaaaaacact

SEQ ID NO: 2111168 - DNA, 11 bp, Homo sapiens
atgaaaccaaa

SEQ ID NO: 2111169 - DNA, 17 bp, Homo sapiens
atgaaactcctgatttt

SEQ ID NO: 2111170 - DNA, 19 bp, Homo sapiens
atgaaactcctgattttgt

SEQ ID NO: 2111171 - DNA, 20 bp, Homo sapiens
atgaaactcctgattttgta

SEQ ID NO: 2111172 - DNA, 15 bp, Homo sapiens
atgaaagggcccaga

SEQ ID NO: 2111173 - DNA, 22 bp, Homo sapiens
atgaaagtgcaaagtgccctca

SEQ ID NO: 2111174 - DNA, 20 bp, Homo sapiens
atgaaataaattggtgataa

SEQ ID NO: 2111175 - DNA, 20 bp, Homo sapiens
atgaaatacacaagtaaaca

SEQ ID NO: 2111176 - DNA, 15 bp, Homo sapiens
atgaaatatttgctt

SEQ ID NO: 2111177 - DNA, 18 bp, Homo sapiens
atgaaatgggctttaaca

SEQ ID NO: 2111178 - DNA, 11 bp, Homo sapiens
atgaaatgtct

SEQ ID NO: 2111179 - DNA, 18 bp, Homo sapiens
atgaaattcttgaagttc

SEQ ID NO: 2111180 - DNA, 16 bp, Homo sapiens
atgaaattgaacctgg

SEQ ID NO: 2111181 - DNA, 19 bp, Homo sapiens
atgaaattgagaagggaaa

SEQ ID NO: 2111182 - DNA, 22 bp, Homo sapiens
atgaaattgtctagcagagcag

SEQ ID NO: 2111183 - DNA, 23 bp, Homo sapiens
atgaaattttctagactttctgt

SEQ ID NO: 2111184 - DNA, 13 bp, Homo sapiens
atgaacaaagaaa

SEQ ID NO: 2111185 - DNA, 22 bp, Homo sapiens
atgaacaaagggattctccagg

SEQ ID NO: 2111186 - DNA, 20 bp, Homo sapiens
atgaacacagctgctgaaga

SEQ ID NO: 2111187 - DNA, 16 bp, Homo sapiens
atgaacagcagaaaga

SEQ ID NO: 2111188 - DNA, 13 bp, Homo sapiens
atgaacctggagg

SEQ ID NO: 2111189 - DNA, 15 bp, Homo sapiens
atgaactgtgacagg

SEQ ID NO: 2111190 - DNA, 13 bp, Homo sapiens
atgaacttgagga

SEQ ID NO: 2111191 - DNA, 15 bp, Homo sapiens
atgaacttgaggaca

SEQ ID NO: 2111192 - DNA, 18 bp, Homo sapiens
atgaacttgaggacacat

SEQ ID NO: 2111193 - DNA, 21 bp, Homo sapiens
atgaacttgaggacacatgtc

SEQ ID NO: 2111194 - DNA, 19 bp, Homo sapiens
atgaagaaaaaatacattt

SEQ ID NO: 2111195 - DNA, 22 bp, Homo sapiens
atgaagaaaaaatacattttat

SEQ ID NO: 2111196 - DNA, 19 bp, Homo sapiens
atgaagaaagggaggccca

SEQ ID NO: 2111197 - DNA, 20 bp, Homo sapiens
atgaagaaagggaggcccag

SEQ ID NO: 2111198 - DNA, 23 bp, Homo sapiens
atgaagaaagggaggcccagccg

SEQ ID NO: 2111199 - DNA, 16 bp, Homo sapiens
atgaagacaggacagt

SEQ ID NO: 2111200 - DNA, 20 bp, Homo sapiens
atgaagacccagtgtaaaga

SEQ ID NO: 2111201 - DNA, 20 bp, Homo sapiens
atgaagacctaaatgacctc

SEQ ID NO: 2111202 - DNA, 23 bp, Homo sapiens
atgaagacctaaatgacctcagc

SEQ ID NO: 2111203 - DNA, 16 bp, Homo sapiens
atgaagagaagctgag

SEQ ID NO: 2111204 - DNA, 17 bp, Homo sapiens
atgaagagaagctgaga

SEQ ID NO: 2111205 - DNA, 21 bp, Homo sapiens
atgaagagaagctgagaagaa

SEQ ID NO: 2111206 - DNA, 18 bp, Homo sapiens
atgaagagacttaagaaa

SEQ ID NO: 2111207 - DNA, 16 bp, Homo sapiens
atgaagcccaataaac

SEQ ID NO: 2111208 - DNA, 16 bp, Homo sapiens
atgaagcccgtgtcct

SEQ ID NO: 2111209 - DNA, 16 bp, Homo sapiens
atgaagcctgtgccac

SEQ ID NO: 2111210 - DNA, 22 bp, Homo sapiens
atgaaggactattaattccaag

SEQ ID NO: 2111211 - DNA, 17 bp, Homo sapiens
atgaaggcgtgcaaggg

SEQ ID NO: 2111212 - DNA, 14 bp, Homo sapiens
atgaagtaagttct

SEQ ID NO: 2111213 - DNA, 15 bp, Homo sapiens
atgaagtgttagata

SEQ ID NO: 2111214 - DNA, 13 bp, Homo sapiens
atgaataaaggtt

SEQ ID NO: 2111215 - DNA, 14 bp, Homo sapiens
atgaatcaaagaca

SEQ ID NO: 2111216 - DNA, 13 bp, Homo sapiens
atgaatgccttcc

SEQ ID NO: 2111217 - DNA, 14 bp, Homo sapiens
atgaatgtgcattt

SEQ ID NO: 2111218 - DNA, 17 bp, Homo sapiens
atgaatgtgcatttctt

SEQ ID NO: 2111219 - DNA, 22 bp, Homo sapiens
atgaatgtttacactctttgta

SEQ ID NO: 2111220 - DNA, 16 bp, Homo sapiens
atgaattaaataaacc

SEQ ID NO: 2111221 - DNA, 13 bp, Homo sapiens
atgaattgcattt

SEQ ID NO: 2111222 - DNA, 23 bp, Homo sapiens
atgaatttatctgaatataggaa

SEQ ID NO: 2111223 - DNA, 15 bp, Homo sapiens
atgaatttggagact

SEQ ID NO: 2111224 - DNA, 21 bp, Homo sapiens
atgacaatcctgaagaaacca

SEQ ID NO: 2111225 - DNA, 19 bp, Homo sapiens
atgacaatgcaatgaaaca

SEQ ID NO: 2111226 - DNA, 17 bp, Homo sapiens
atgacacctccatttct

SEQ ID NO: 2111227 - DNA, 22 bp, Homo sapiens
atgacactctagtgacttcctg

SEQ ID NO: 2111228 - DNA, 16 bp, Homo sapiens
atgacagatgttgaat

SEQ ID NO: 2111229 - DNA, 12 bp, Homo sapiens
atgacagccaga

SEQ ID NO: 2111230 - DNA, 18 bp, Homo sapiens
atgacagctcttctaagg

SEQ ID NO: 2111231 - DNA, 17 bp, Homo sapiens
atgacagctgtccctgt

SEQ ID NO: 2111232 - DNA, 16 bp, Homo sapiens
atgacaggtaaattaa

SEQ ID NO: 2111233 - DNA, 19 bp, Homo sapiens
atgacagtccgtcaaaaca

SEQ ID NO: 2111234 - DNA, 21 bp, Homo sapiens
atgacagtccgtcaaaacaga

SEQ ID NO: 2111235 - DNA, 24 bp, Homo sapiens
atgacatcttcaaagcttgaagat

SEQ ID NO: 2111236 - DNA, 14 bp, Homo sapiens
atgacatgcactga

SEQ ID NO: 2111237 - DNA, 18 bp, Homo sapiens
atgacatgcactgaccct

SEQ ID NO: 2111238 - DNA, 19 bp, Homo sapiens
atgacatgcactgaccctt

SEQ ID NO: 2111239 - DNA, 15 bp, Homo sapiens
atgacatgccaccct

SEQ ID NO: 2111240 - DNA, 17 bp, Homo sapiens
atgacatgccaccctct

SEQ ID NO: 2111241 - DNA, 15 bp, Homo sapiens
atgacatgttatata

SEQ ID NO: 2111242 - DNA, 19 bp, Homo sapiens
atgacattgttaaaataaa

SEQ ID NO: 2111243 - DNA, 19 bp, Homo sapiens
atgacatttttgataaatt

SEQ ID NO: 2111244 - DNA, 15 bp, Homo sapiens
atgaccaagaaaaag

SEQ ID NO: 2111245 - DNA, 17 bp, Homo sapiens
atgaccaagaaaaagaa

SEQ ID NO: 2111246 - DNA, 20 bp, Homo sapiens
atgaccaagaaaaagaaaaa

SEQ ID NO: 2111247 - DNA, 14 bp, Homo sapiens
atgaccaagaatta

SEQ ID NO: 2111248 - DNA, 15 bp, Homo sapiens
atgaccaatctctgt

SEQ ID NO: 2111249 - DNA, 18 bp, Homo sapiens
atgaccacgggcctcagt

SEQ ID NO: 2111250 - DNA, 21 bp, Homo sapiens
atgaccagaaaacaaatcttc

SEQ ID NO: 2111251 - DNA, 14 bp, Homo sapiens
atgaccagaaacag

SEQ ID NO: 2111252 - DNA, 13 bp, Homo sapiens
atgaccaggacta

SEQ ID NO: 2111253 - DNA, 13 bp, Homo sapiens
atgacccaaagac

SEQ ID NO: 2111254 - DNA, 15 bp, Homo sapiens
atgacccaaagacca

SEQ ID NO: 2111255 - DNA, 16 bp, Homo sapiens
atgacccaaagaccaa

SEQ ID NO: 2111256 - DNA, 15 bp, Homo sapiens
atgaccctcctgtcc

SEQ ID NO: 2111257 - DNA, 15 bp, Homo sapiens
atgacctcagcaaat

SEQ ID NO: 2111258 - DNA, 18 bp, Homo sapiens
atgacctcagcaaatcct

SEQ ID NO: 2111259 - DNA, 20 bp, Homo sapiens
atgacctcagcaaatcctct

SEQ ID NO: 2111260 - DNA, 17 bp, Homo sapiens
atgaccttctaggaagc

SEQ ID NO: 2111261 - DNA, 18 bp, Homo sapiens
atgaccttctaggaagct

SEQ ID NO: 2111262 - DNA, 16 bp, Homo sapiens
atgactaaaaatatta

SEQ ID NO: 2111263 - DNA, 22 bp, Homo sapiens
atgactagaggcagggagggga

SEQ ID NO: 2111264 - DNA, 16 bp, Homo sapiens
atgactataaacatta

SEQ ID NO: 2111265 - DNA, 22 bp, Homo sapiens
atgactgctccccagccctggc

SEQ ID NO: 2111266 - DNA, 22 bp, Homo sapiens
atgactggatacagaatgaatc

SEQ ID NO: 2111267 - DNA, 11 bp, Homo sapiens
atgactgtaaa

SEQ ID NO: 2111268 - DNA, 21 bp, Homo sapiens
atgactgtttttcggacagtt

SEQ ID NO: 2111269 - DNA, 17 bp, Homo sapiens
atgactgtttttgtagt

SEQ ID NO: 2111270 - DNA, 21 bp, Homo sapiens
atgacttgggcacccccagcc

SEQ ID NO: 2111271 - DNA, 17 bp, Homo sapiens
atgacttttccatgtat

SEQ ID NO: 2111272 - DNA, 17 bp, Homo sapiens
atgacttttctggaaga

SEQ ID NO: 2111273 - DNA, 15 bp, Homo sapiens
atgagacttgctctc

SEQ ID NO: 2111274 - DNA, 12 bp, Homo sapiens
atgagagaatgg

SEQ ID NO: 2111275 - DNA, 18 bp, Homo sapiens
atgagagttccagattgt

SEQ ID NO: 2111276 - DNA, 19 bp, Homo sapiens
atgagatcccgcctcttct

SEQ ID NO: 2111277 - DNA, 23 bp, Homo sapiens
atgagatctaagcctttccataa

SEQ ID NO: 2111278 - DNA, 19 bp, Homo sapiens
atgagatttgccagcacag

SEQ ID NO: 2111279 - DNA, 20 bp, Homo sapiens
atgagatttgccagcacagg

SEQ ID NO: 2111280 - DNA, 17 bp, Homo sapiens
atgagcagtcacactgt

SEQ ID NO: 2111281 - DNA, 12 bp, Homo sapiens
atgagcctcagc

SEQ ID NO: 2111282 - DNA, 16 bp, Homo sapiens
atgagcctcagcatcc

SEQ ID NO: 2111283 - DNA, 16 bp, Homo sapiens
atgagctcctgcggga

SEQ ID NO: 2111284 - DNA, 18 bp, Homo sapiens
atgagctgtatctgtaat

SEQ ID NO: 2111285 - DNA, 23 bp, Homo sapiens
atgaggaataattatttatttaa

SEQ ID NO: 2111286 - DNA, 14 bp, Homo sapiens
atgaggagttgctg

SEQ ID NO: 2111287 - DNA, 18 bp, Homo sapiens
atgaggcaatgtcaggaa

SEQ ID NO: 2111288 - DNA, 15 bp, Homo sapiens
atgaggcctcttgga

SEQ ID NO: 2111289 - DNA, 23 bp, Homo sapiens
atgaggcctcttggacctctgct

SEQ ID NO: 2111290 - DNA, 14 bp, Homo sapiens
atgaggcctttccc

SEQ ID NO: 2111291 - DNA, 17 bp, Homo sapiens
atgaggctattaaaaga

SEQ ID NO: 2111292 - DNA, 20 bp, Homo sapiens
atgagggactggaaccaggg

SEQ ID NO: 2111293 - DNA, 16 bp, Homo sapiens
atgagggatcacaggg

SEQ ID NO: 2111294 - DNA, 11 bp, Homo sapiens
atgagggtcag

SEQ ID NO: 2111295 - DNA, 14 bp, Homo sapiens
atgagggtgactgt

SEQ ID NO: 2111296 - DNA, 13 bp, Homo sapiens
atgaggtaattct

SEQ ID NO: 2111297 - DNA, 16 bp, Homo sapiens
atgaggtcagagcctg

SEQ ID NO: 2111298 - DNA, 18 bp, Homo sapiens
atgaggtcagagcctgca

SEQ ID NO: 2111299 - DNA, 19 bp, Homo sapiens
atgaggtcagagcctgcag

SEQ ID NO: 2111300 - DNA, 15 bp, Homo sapiens
atgaggtcccaggca

SEQ ID NO: 2111301 - DNA, 14 bp, Homo sapiens
atgaggtctgaaat

SEQ ID NO: 2111302 - DNA, 14 bp, Homo sapiens
atgagtatacaata

SEQ ID NO: 2111303 - DNA, 22 bp, Homo sapiens
atgagtcagtctctctctccct

SEQ ID NO: 2111304 - DNA, 22 bp, Homo sapiens
atgagtgattgacacacagcac

SEQ ID NO: 2111305 - DNA, 15 bp, Homo sapiens
atgagtggatggatg

SEQ ID NO: 2111306 - DNA, 18 bp, Homo sapiens
atgagtggatggatggac

SEQ ID NO: 2111307 - DNA, 21 bp, Homo sapiens
atgagtggatggatggacaga

SEQ ID NO: 2111308 - DNA, 20 bp, Homo sapiens
atgagttgttttcagactca

SEQ ID NO: 2111309 - DNA, 13 bp, Homo sapiens
atgagtttatggg

SEQ ID NO: 2111310 - DNA, 15 bp, Homo sapiens
atgagtttatgggaa

SEQ ID NO: 2111311 - DNA, 19 bp, Homo sapiens
atgagtttttgatagcttt

SEQ ID NO: 2111312 - DNA, 15 bp, Homo sapiens
atgataaagatgtca

SEQ ID NO: 2111313 - DNA, 20 bp, Homo sapiens
atgataaagatgtcaaatat

SEQ ID NO: 2111314 - DNA, 12 bp, Homo sapiens
atgataatgaac

SEQ ID NO: 2111315 - DNA, 13 bp, Homo sapiens
atgatactgatgc

SEQ ID NO: 2111316 - DNA, 13 bp, Homo sapiens
atgatatgtaaac

SEQ ID NO: 2111317 - DNA, 22 bp, Homo sapiens
atgatatgtaaacataattctt

SEQ ID NO: 2111318 - DNA, 13 bp, Homo sapiens
atgatattgcata

SEQ ID NO: 2111319 - DNA, 13 bp, Homo sapiens
atgatctcaggag

SEQ ID NO: 2111320 - DNA, 15 bp, Homo sapiens
atgatctcaggagct

SEQ ID NO: 2111321 - DNA, 14 bp, Homo sapiens
atgatctccctgcc

SEQ ID NO: 2111322 - DNA, 23 bp, Homo sapiens
atgatctctccacggtagcactt

SEQ ID NO: 2111323 - DNA, 15 bp, Homo sapiens
atgatcttttcaagt

SEQ ID NO: 2111324 - DNA, 23 bp, Homo sapiens
atgatgaaatgaggtcagagcct

SEQ ID NO: 2111325 - DNA, 16 bp, Homo sapiens
atgatgatgatgatga

SEQ ID NO: 2111326 - DNA, 23 bp, Homo sapiens
atgatgattaaacacctgacaca

SEQ ID NO: 2111327 - DNA, 13 bp, Homo sapiens
atgatgccaaaat

SEQ ID NO: 2111328 - DNA, 19 bp, Homo sapiens
atgatggcaattttgtaac

SEQ ID NO: 2111329 - DNA, 16 bp, Homo sapiens
atgatggtgctgacct

SEQ ID NO: 2111330 - DNA, 18 bp, Homo sapiens
atgatggttgcaaaagac

SEQ ID NO: 2111331 - DNA, 16 bp, Homo sapiens
atgatgtatttttgta

SEQ ID NO: 2111332 - DNA, 15 bp, Homo sapiens
atgatgtccagaaga

SEQ ID NO: 2111333 - DNA, 19 bp, Homo sapiens
atgatgtgggtcaaggaat

SEQ ID NO: 2111334 - DNA, 15 bp, Homo sapiens
atgatgtttcacata

SEQ ID NO: 2111335 - DNA, 20 bp, Homo sapiens
atgattaaacacctgacaca

SEQ ID NO: 2111336 - DNA, 21 bp, Homo sapiens
atgattaaacacctgacacat

SEQ ID NO: 2111337 - DNA, 22 bp, Homo sapiens
atgattaaacacctgacacatc

SEQ ID NO: 2111338 - DNA, 16 bp, Homo sapiens
atgattactttaaaat

SEQ ID NO: 2111339 - DNA, 15 bp, Homo sapiens
atgattattttcatt

SEQ ID NO: 2111340 - DNA, 22 bp, Homo sapiens
atgattcacaactaggacctca

SEQ ID NO: 2111341 - DNA, 21 bp, Homo sapiens
atgattccttgagcattttat

SEQ ID NO: 2111342 - DNA, 16 bp, Homo sapiens
atgattggattattca

SEQ ID NO: 2111343 - DNA, 15 bp, Homo sapiens
atgattgtaaaatag

SEQ ID NO: 2111344 - DNA, 21 bp, Homo sapiens
atgatttaaaaaataaatata

SEQ ID NO: 2111345 - DNA, 23 bp, Homo sapiens
atgatttaaaaaataaatataat

SEQ ID NO: 2111346 - DNA, 21 bp, Homo sapiens
atgatttaagcattttactgt

SEQ ID NO: 2111347 - DNA, 13 bp, Homo sapiens
atgatttatagtt

SEQ ID NO: 2111348 - DNA, 20 bp, Homo sapiens
atgatttatagtttgtacat

SEQ ID NO: 2111349 - DNA, 18 bp, Homo sapiens
atgatttatatatggcat

SEQ ID NO: 2111350 - DNA, 22 bp, Homo sapiens
atgatttatatatggcatattt

SEQ ID NO: 2111351 - DNA, 20 bp, Homo sapiens
atgatttcaatgattgttta

SEQ ID NO: 2111352 - DNA, 12 bp, Homo sapiens
atgattttatac

SEQ ID NO: 2111353 - DNA, 14 bp, Homo sapiens
atgattttatacat

SEQ ID NO: 2111354 - DNA, 19 bp, Homo sapiens
atgattttatacatagtca

SEQ ID NO: 2111355 - DNA, 17 bp, Homo sapiens
atgattttttaaaagaa

SEQ ID NO: 2111356 - DNA, 19 bp, Homo sapiens
atgattttttaaaagaaat

SEQ ID NO: 2111357 - DNA, 18 bp, Homo sapiens
atgcaaaataaatgtttt

SEQ ID NO: 2111358 - DNA, 21 bp, Homo sapiens
atgcaaaataatacctgtcca

SEQ ID NO: 2111359 - DNA, 20 bp, Homo sapiens
atgcaaacactgtgtattta

SEQ ID NO: 2111360 - DNA, 14 bp, Homo sapiens
atgcaaacagttct

SEQ ID NO: 2111361 - DNA, 14 bp, Homo sapiens
atgcaaagcactga

SEQ ID NO: 2111362 - DNA, 21 bp, Homo sapiens
atgcaacaacatgtataatat

SEQ ID NO: 2111363 - DNA, 14 bp, Homo sapiens
atgcaaggaaggaa

SEQ ID NO: 2111364 - DNA, 18 bp, Homo sapiens
atgcaaggaaggaaagaa

SEQ ID NO: 2111365 - DNA, 20 bp, Homo sapiens
atgcaaggaaggaaagaaag

SEQ ID NO: 2111366 - DNA, 15 bp, Homo sapiens
atgcaataatgtgca

SEQ ID NO: 2111367 - DNA, 21 bp, Homo sapiens
atgcaatgaaacagatgataa

SEQ ID NO: 2111368 - DNA, 19 bp, Homo sapiens
atgcaatgacatcttcaaa

SEQ ID NO: 2111369 - DNA, 17 bp, Homo sapiens
atgcaatttttaaacta

SEQ ID NO: 2111370 - DNA, 19 bp, Homo sapiens
atgcaatttttaaactagt

SEQ ID NO: 2111371 - DNA, 20 bp, Homo sapiens
atgcacacaaacacctccta

SEQ ID NO: 2111372 - DNA, 22 bp, Homo sapiens
atgcacactagcctctccagga

SEQ ID NO: 2111373 - DNA, 20 bp, Homo sapiens
atgcacagctgcttgtcctg

SEQ ID NO: 2111374 - DNA, 18 bp, Homo sapiens
atgcacatatggactctg

SEQ ID NO: 2111375 - DNA, 17 bp, Homo sapiens
atgcacatttatatata

SEQ ID NO: 2111376 - DNA, 21 bp, Homo sapiens
atgcacatttatatatatatg

SEQ ID NO: 2111377 - DNA, 22 bp, Homo sapiens
atgcaccagtgccgcctgtgcc

SEQ ID NO: 2111378 - DNA, 14 bp, Homo sapiens
atgcacctaaagaa

SEQ ID NO: 2111379 - DNA, 19 bp, Homo sapiens
atgcaccttgtgtctgtac

SEQ ID NO: 2111380 - DNA, 21 bp, Homo sapiens
atgcaccttgtgtctgtacac

SEQ ID NO: 2111381 - DNA, 16 bp, Homo sapiens
atgcacgaccttggga

SEQ ID NO: 2111382 - DNA, 12 bp, Homo sapiens
atgcactggcca

SEQ ID NO: 2111383 - DNA, 13 bp, Homo sapiens
atgcagaaggaag

SEQ ID NO: 2111384 - DNA, 18 bp, Homo sapiens
atgcagactcctcagatc

SEQ ID NO: 2111385 - DNA, 23 bp, Homo sapiens
atgcagaggtaaaagtgtgagca

SEQ ID NO: 2111386 - DNA, 18 bp, Homo sapiens
atgcagattcctgggcct

SEQ ID NO: 2111387 - DNA, 14 bp, Homo sapiens
atgcagcttcatca

SEQ ID NO: 2111388 - DNA, 17 bp, Homo sapiens
atgcagcttcatcaatt

SEQ ID NO: 2111389 - DNA, 23 bp, Homo sapiens
atgcagggaagagggcagtacct

SEQ ID NO: 2111390 - DNA, 14 bp, Homo sapiens
atgcagggtattgc

SEQ ID NO: 2111391 - DNA, 17 bp, Homo sapiens
atgcagtagccagcacg

SEQ ID NO: 2111392 - DNA, 20 bp, Homo sapiens
atgcagtattgccacaatgc

SEQ ID NO: 2111393 - DNA, 16 bp, Homo sapiens
atgcagtccagaataa

SEQ ID NO: 2111394 - DNA, 23 bp, Homo sapiens
atgcagtccagaataagtgctgt

SEQ ID NO: 2111395 - DNA, 22 bp, Homo sapiens
atgcatagttcccatgttaaat

SEQ ID NO: 2111396 - DNA, 14 bp, Homo sapiens
atgcatccattcct

SEQ ID NO: 2111397 - DNA, 17 bp, Homo sapiens
atgcatccattcctcag

SEQ ID NO: 2111398 - DNA, 22 bp, Homo sapiens
atgcatccattcctcagggaca

SEQ ID NO: 2111399 - DNA, 16 bp, Homo sapiens
atgcatccatttcagt

SEQ ID NO: 2111400 - DNA, 12 bp, Homo sapiens
atgcatgatttt

SEQ ID NO: 2111401 - DNA, 14 bp, Homo sapiens
atgcatgattttat

SEQ ID NO: 2111402 - DNA, 15 bp, Homo sapiens
atgcatgattttata

SEQ ID NO: 2111403 - DNA, 22 bp, Homo sapiens
atgcatgattttatacatagtc

SEQ ID NO: 2111404 - DNA, 16 bp, Homo sapiens
atgcatgcgcaggctc

SEQ ID NO: 2111405 - DNA, 20 bp, Homo sapiens
atgcatggaaacctgaaaaa

SEQ ID NO: 2111406 - DNA, 23 bp, Homo sapiens
atgcatggagggctgccctgtac

SEQ ID NO: 2111407 - DNA, 13 bp, Homo sapiens
atgcattcacaag

SEQ ID NO: 2111408 - DNA, 15 bp, Homo sapiens
atgcatttccacact

SEQ ID NO: 2111409 - DNA, 23 bp, Homo sapiens
atgcattttattttagacacaaa

SEQ ID NO: 2111410 - DNA, 12 bp, Homo sapiens
atgcattttgca

SEQ ID NO: 2111411 - DNA, 17 bp, Homo sapiens
atgccaaaaaaaaatac

SEQ ID NO: 2111412 - DNA, 20 bp, Homo sapiens
atgccaaattgtagttcttg

SEQ ID NO: 2111413 - DNA, 22 bp, Homo sapiens
atgccaattagcaattgactgt

SEQ ID NO: 2111414 - DNA, 22 bp, Homo sapiens
atgccacagccccacagcaccc

SEQ ID NO: 2111415 - DNA, 15 bp, Homo sapiens
atgccaccctctcca

SEQ ID NO: 2111416 - DNA, 19 bp, Homo sapiens
atgccaccctgttttcagc

SEQ ID NO: 2111417 - DNA, 13 bp, Homo sapiens
atgccactgccag

SEQ ID NO: 2111418 - DNA, 17 bp, Homo sapiens
atgccactgccaggcac

SEQ ID NO: 2111419 - DNA, 20 bp, Homo sapiens
atgccactgccaggcacctg

SEQ ID NO: 2111420 - DNA, 22 bp, Homo sapiens
atgccactgccaggcacctggc

SEQ ID NO: 2111421 - DNA, 23 bp, Homo sapiens
atgccactgccaggcacctggcc

SEQ ID NO: 2111422 - DNA, 15 bp, Homo sapiens
atgccagcttcctgt

SEQ ID NO: 2111423 - DNA, 21 bp, Homo sapiens
atgccaggttaggaaggcagc

SEQ ID NO: 2111424 - DNA, 17 bp, Homo sapiens
atgccatccattctgcc

SEQ ID NO: 2111425 - DNA, 17 bp, Homo sapiens
atgccatctccaccctg

SEQ ID NO: 2111426 - DNA, 18 bp, Homo sapiens
atgccatggacagaagaa

SEQ ID NO: 2111427 - DNA, 23 bp, Homo sapiens
atgccatgtttagattccaggat

SEQ ID NO: 2111428 - DNA, 17 bp, Homo sapiens
atgccatttaaagctta

SEQ ID NO: 2111429 - DNA, 21 bp, Homo sapiens
atgccatttaaagcttattaa

SEQ ID NO: 2111430 - DNA, 15 bp, Homo sapiens
atgccccaaatatag

SEQ ID NO: 2111431 - DNA, 22 bp, Homo sapiens
atgccgaacctatacccattct

SEQ ID NO: 2111432 - DNA, 22 bp, Homo sapiens
atgccgctcttctgtcatcccg

SEQ ID NO: 2111433 - DNA, 23 bp, Homo sapiens
atgccgtataggatgtcagacaa

SEQ ID NO: 2111434 - DNA, 23 bp, Homo sapiens
atgccgtgtgtctcgtctcctga

SEQ ID NO: 2111435 - DNA, 17 bp, Homo sapiens
atgcctataaaatgccc

SEQ ID NO: 2111436 - DNA, 14 bp, Homo sapiens
atgcctcagtttcc

SEQ ID NO: 2111437 - DNA, 17 bp, Homo sapiens
atgcctcagtttcccca

SEQ ID NO: 2111438 - DNA, 12 bp, Homo sapiens
atgcctccaccg

SEQ ID NO: 2111439 - DNA, 18 bp, Homo sapiens
atgcctctgaggccagcc

SEQ ID NO: 2111440 - DNA, 21 bp, Homo sapiens
atgcctctgaggccagcctgg

SEQ ID NO: 2111441 - DNA, 12 bp, Homo sapiens
atgcctgagggt

SEQ ID NO: 2111442 - DNA, 17 bp, Homo sapiens
atgcctgattttaaaag

SEQ ID NO: 2111443 - DNA, 12 bp, Homo sapiens
atgcctggtggc

SEQ ID NO: 2111444 - DNA, 13 bp, Homo sapiens
atgcctggtggca

SEQ ID NO: 2111445 - DNA, 14 bp, Homo sapiens
atgcctggtggcag

SEQ ID NO: 2111446 - DNA, 15 bp, Homo sapiens
atgcctggtggcagc

SEQ ID NO: 2111447 - DNA, 19 bp, Homo sapiens
atgcctggtggcagctgcg

SEQ ID NO: 2111448 - DNA, 21 bp, Homo sapiens
atgcctgtcagtttcatggag

SEQ ID NO: 2111449 - DNA, 22 bp, Homo sapiens
atgccttcctgtctttctggcc

SEQ ID NO: 2111450 - DNA, 14 bp, Homo sapiens
atgcctttagatgt

SEQ ID NO: 2111451 - DNA, 20 bp, Homo sapiens
atgcgaaaacttgaatctgt

SEQ ID NO: 2111452 - DNA, 13 bp, Homo sapiens
atgcgtatatgtg

SEQ ID NO: 2111453 - DNA, 13 bp, Homo sapiens
atgctaaatgcaa

SEQ ID NO: 2111454 - DNA, 19 bp, Homo sapiens
atgctaaatgcaaacactg

SEQ ID NO: 2111455 - DNA, 19 bp, Homo sapiens
atgctaagaaatgctgaaa

SEQ ID NO: 2111456 - DNA, 15 bp, Homo sapiens
atgctaagagaagta

SEQ ID NO: 2111457 - DNA, 18 bp, Homo sapiens
atgctaagagaagtagaa

SEQ ID NO: 2111458 - DNA, 21 bp, Homo sapiens
atgctactacaaaaaagttgt

SEQ ID NO: 2111459 - DNA, 15 bp, Homo sapiens
atgctattgaaatta

SEQ ID NO: 2111460 - DNA, 17 bp, Homo sapiens
atgctattgaaattact

SEQ ID NO: 2111461 - DNA, 19 bp, Homo sapiens
atgctattgttgtgggctt

SEQ ID NO: 2111462 - DNA, 17 bp, Homo sapiens
atgctatttctggcctc

SEQ ID NO: 2111463 - DNA, 19 bp, Homo sapiens
atgctatttctggcctcag

SEQ ID NO: 2111464 - DNA, 21 bp, Homo sapiens
atgctatttctggcctcagca

SEQ ID NO: 2111465 - DNA, 22 bp, Homo sapiens
atgctatttctggcctcagcag

SEQ ID NO: 2111466 - DNA, 20 bp, Homo sapiens
atgctcaagtttttcagaaa

SEQ ID NO: 2111467 - DNA, 13 bp, Homo sapiens
atgctcagccctg

SEQ ID NO: 2111468 - DNA, 18 bp, Homo sapiens
atgctcagccctgactgg

SEQ ID NO: 2111469 - DNA, 13 bp, Homo sapiens
atgctccagggca

SEQ ID NO: 2111470 - DNA, 17 bp, Homo sapiens
atgctcccatctcctga

SEQ ID NO: 2111471 - DNA, 23 bp, Homo sapiens
atgctctctgcagccagcccagc

SEQ ID NO: 2111472 - DNA, 12 bp, Homo sapiens
atgctctgcccc

SEQ ID NO: 2111473 - DNA, 12 bp, Homo sapiens
atgctctggaag

SEQ ID NO: 2111474 - DNA, 22 bp, Homo sapiens
atgctgaattattttgttgtga

SEQ ID NO: 2111475 - DNA, 21 bp, Homo sapiens
atgctgagattacaggtgtga

SEQ ID NO: 2111476 - DNA, 21 bp, Homo sapiens
atgctgccccgttccctgtca

SEQ ID NO: 2111477 - DNA, 22 bp, Homo sapiens
atgctggacggcattcctgctt

SEQ ID NO: 2111478 - DNA, 13 bp, Homo sapiens
atgctggccagca

SEQ ID NO: 2111479 - DNA, 14 bp, Homo sapiens
tgtggtgtaattta

SEQ ID NO: 2111480 - DNA, 20 bp, Homo sapiens
tgtggttaatgccatggaca

SEQ ID NO: 2111481 - DNA, 18 bp, Homo sapiens
tgtggttcctaagcctgt

SEQ ID NO: 2111482 - DNA, 14 bp, Homo sapiens
tgtggtttatgtca

SEQ ID NO: 2111483 - DNA, 12 bp, Homo sapiens
tgtgtaataaaa

SEQ ID NO: 2111484 - DNA, 22 bp, Homo sapiens
tgtgtaataaaaatttgtttaa

SEQ ID NO: 2111485 - DNA, 18 bp, Homo sapiens
tgtgtaatagaaaactga

SEQ ID NO: 2111486 - DNA, 19 bp, Homo sapiens
tgtgtacaaagtagagaag

SEQ ID NO: 2111487 - DNA, 17 bp, Homo sapiens
tgtgtactgataaaata

SEQ ID NO: 2111488 - DNA, 14 bp, Homo sapiens
tgtgtagcctgtgc

SEQ ID NO: 2111489 - DNA, 18 bp, Homo sapiens
tgtgtagctctgtccact

SEQ ID NO: 2111490 - DNA, 16 bp, Homo sapiens
tgtgtagctgtgacct

SEQ ID NO: 2111491 - DNA, 19 bp, Homo sapiens
tgtgtagctgtgacctgct

SEQ ID NO: 2111492 - DNA, 22 bp, Homo sapiens
tgtgtaggtattaaagatgtgt

SEQ ID NO: 2111493 - DNA, 13 bp, Homo sapiens
tgtgtatatatac

SEQ ID NO: 2111494 - DNA, 12 bp, Homo sapiens
tgtgtatgtata

SEQ ID NO: 2111495 - DNA, 19 bp, Homo sapiens
tgtgtatgtatacacacat

SEQ ID NO: 2111496 - DNA, 12 bp, Homo sapiens
tgtgtatgtgta

SEQ ID NO: 2111497 - DNA, 16 bp, Homo sapiens
tgtgtatgtgtattta

SEQ ID NO: 2111498 - DNA, 13 bp, Homo sapiens
tgtgtattctggc

SEQ ID NO: 2111499 - DNA, 14 bp, Homo sapiens
tgtgtattgaagaa

SEQ ID NO: 2111500 - DNA, 17 bp, Homo sapiens
tgtgtcacagttcttgg

SEQ ID NO: 2111501 - DNA, 13 bp, Homo sapiens
tgtgtcagcatgc

SEQ ID NO: 2111502 - DNA, 17 bp, Homo sapiens
tgtgtcaggtggggcag

SEQ ID NO: 2111503 - DNA, 20 bp, Homo sapiens
tgtgtcaggtggggcagctt

SEQ ID NO: 2111504 - DNA, 13 bp, Homo sapiens
tgtgtccagcagc

SEQ ID NO: 2111505 - DNA, 13 bp, Homo sapiens
tgttctctgagga

SEQ ID NO: 2111506 - DNA, 16 bp, Homo sapiens
tgttctgcactgaaaa

SEQ ID NO: 2111507 - DNA, 17 bp, Homo sapiens
tgttctgcactgaaaag

SEQ ID NO: 2111508 - DNA, 15 bp, Homo sapiens
tgttctggagctgct

SEQ ID NO: 2111509 - DNA, 18 bp, Homo sapiens
tgttctggcctcagacca

SEQ ID NO: 2111510 - DNA, 20 bp, Homo sapiens
tgttctgggtgttgaccact

SEQ ID NO: 2111511 - DNA, 17 bp, Homo sapiens
tgttctggtttagtgtt

SEQ ID NO: 2111512 - DNA, 21 bp, Homo sapiens
tgttctggtttagtgttctgt

SEQ ID NO: 2111513 - DNA, 18 bp, Homo sapiens
tgttctgtaatggaactg

SEQ ID NO: 2111514 - DNA, 22 bp, Homo sapiens
tgttctgtaatggaactgaccc

SEQ ID NO: 2111515 - DNA, 13 bp, Homo sapiens
tgttctgtatttt

SEQ ID NO: 2111516 - DNA, 15 bp, Homo sapiens
tgttctgtattttca

SEQ ID NO: 2111517 - DNA, 21 bp, Homo sapiens
tgttctgtgggcttggccttg

SEQ ID NO: 2111518 - DNA, 22 bp, Homo sapiens
tgttcttacctgtatgtctcca

SEQ ID NO: 2111519 - DNA, 22 bp, Homo sapiens
tgttcttggttcccattgtgac

SEQ ID NO: 2111520 - DNA, 21 bp, Homo sapiens
tgttgaaaattattttaaaca

SEQ ID NO: 2111521 - DNA, 20 bp, Homo sapiens
tgttgaagaagagtttgcaa

SEQ ID NO: 2111522 - DNA, 17 bp, Homo sapiens
tgttgacagttcatatg

SEQ ID NO: 2111523 - DNA, 18 bp, Homo sapiens
tgttgaccactccagaga

SEQ ID NO: 2111524 - DNA, 19 bp, Homo sapiens
tgttgaccactccagagaa

SEQ ID NO: 2111525 - DNA, 13 bp, Homo sapiens
tgttgagctgttt

SEQ ID NO: 2111526 - DNA, 13 bp, Homo sapiens
tgttgagtgttca

SEQ ID NO: 2111527 - DNA, 18 bp, Homo sapiens
tgttgagtgttcatttta

SEQ ID NO: 2111528 - DNA, 16 bp, Homo sapiens
tgttgattaatttgag

SEQ ID NO: 2111529 - DNA, 22 bp, Homo sapiens
tgttgattacataatcaaagct

SEQ ID NO: 2111530 - DNA, 23 bp, Homo sapiens
tgttgattacataatcaaagcta

SEQ ID NO: 2111531 - DNA, 21 bp, Homo sapiens
tgttgattttctagacttcag

SEQ ID NO: 2111532 - DNA, 11 bp, Homo sapiens
tgttgcagaga

SEQ ID NO: 2111533 - DNA, 21 bp, Homo sapiens
tgttgcagagacgcaagggag

SEQ ID NO: 2111534 - DNA, 17 bp, Homo sapiens
tgttgccaactaagccc

SEQ ID NO: 2111535 - DNA, 19 bp, Homo sapiens
tgttgccaactaagccctc

SEQ ID NO: 2111536 - DNA, 20 bp, Homo sapiens
tgttgccatgaggcctttcc

SEQ ID NO: 2111537 - DNA, 21 bp, Homo sapiens
tgttgccatgaggcctttccc

SEQ ID NO: 2111538 - DNA, 17 bp, Homo sapiens
tgttgccatttctctgc

SEQ ID NO: 2111539 - DNA, 13 bp, Homo sapiens
tgttgcccaggca

SEQ ID NO: 2111540 - DNA, 17 bp, Homo sapiens
tgttgcccaggcaggtc

SEQ ID NO: 2111541 - DNA, 19 bp, Homo sapiens
tgttgcccaggctgctctt

SEQ ID NO: 2111542 - DNA, 23 bp, Homo sapiens
tgttgcccaggctggcgtgcagt

SEQ ID NO: 2111543 - DNA, 23 bp, Homo sapiens
tgttgctcaaatctattcagaca

SEQ ID NO: 2111544 - DNA, 21 bp, Homo sapiens
tgttgctgagttcctgtgggt

SEQ ID NO: 2111545 - DNA, 18 bp, Homo sapiens
tgttgcttagatgagggt

SEQ ID NO: 2111546 - DNA, 13 bp, Homo sapiens
tgttggaaaagaa

SEQ ID NO: 2111547 - DNA, 15 bp, Homo sapiens
tgttggccaaagcca

SEQ ID NO: 2111548 - DNA, 14 bp, Homo sapiens
tgttggccaggctg

SEQ ID NO: 2111549 - DNA, 11 bp, Homo sapiens
tgttggcctcg

SEQ ID NO: 2111550 - DNA, 17 bp, Homo sapiens
tgttggctgggggcctc

SEQ ID NO: 2111551 - DNA, 14 bp, Homo sapiens
tgttgtaaagagtg

SEQ ID NO: 2111552 - DNA, 16 bp, Homo sapiens
tgttgtaatagtccat

SEQ ID NO: 2111553 - DNA, 15 bp, Homo sapiens
tgttgtacaagctca

SEQ ID NO: 2111554 - DNA, 17 bp, Homo sapiens
tgttgtacgtaaagctt

SEQ ID NO: 2111555 - DNA, 15 bp, Homo sapiens
tgttgtcaagtataa

SEQ ID NO: 2111556 - DNA, 14 bp, Homo sapiens
tgttgtctgtgcag

SEQ ID NO: 2111557 - DNA, 23 bp, Homo sapiens
tgttgttcaaatgcattttgggg

SEQ ID NO: 2111558 - DNA, 18 bp, Homo sapiens
tgttgttccttttgaaag

SEQ ID NO: 2111559 - DNA, 22 bp, Homo sapiens
tgttgttctcctccattgctgt

SEQ ID NO: 2111560 - DNA, 21 bp, Homo sapiens
tgttgttgcagggaagtctta

SEQ ID NO: 2111561 - DNA, 16 bp, Homo sapiens
tgttgtttcttaaata

SEQ ID NO: 2111562 - DNA, 17 bp, Homo sapiens
tgttgtttcttaaataa

SEQ ID NO: 2111563 - DNA, 11 bp, Homo sapiens
tgttgttttgt

SEQ ID NO: 2111564 - DNA, 16 bp, Homo sapiens
tgtttaaaaacaggaa

SEQ ID NO: 2111565 - DNA, 20 bp, Homo sapiens
tgtttaaaaacattccccaa

SEQ ID NO: 2111566 - DNA, 14 bp, Homo sapiens
tgtttaaacctttt

SEQ ID NO: 2111567 - DNA, 15 bp, Homo sapiens
tgtttaaataaagta

SEQ ID NO: 2111568 - DNA, 13 bp, Homo sapiens
tgtttaaatataa

SEQ ID NO: 2111569 - DNA, 14 bp, Homo sapiens
tgtttaagatgggc

SEQ ID NO: 2111570 - DNA, 15 bp, Homo sapiens
tgtttaatatttaaa

SEQ ID NO: 2111571 - DNA, 15 bp, Homo sapiens
tgtttaattgtaggt

SEQ ID NO: 2111572 - DNA, 23 bp, Homo sapiens
tgtttacaaaaggcagccctttg

SEQ ID NO: 2111573 - DNA, 19 bp, Homo sapiens
tgtttacactctttgtaag

SEQ ID NO: 2111574 - DNA, 13 bp, Homo sapiens
tgtttacagaact

SEQ ID NO: 2111575 - DNA, 16 bp, Homo sapiens
tgtttagattccagga

SEQ ID NO: 2111576 - DNA, 16 bp, Homo sapiens
tgtttagtagcagtga

SEQ ID NO: 2111577 - DNA, 18 bp, Homo sapiens
tgtttagtagcagtgatt

SEQ ID NO: 2111578 - DNA, 21 bp, Homo sapiens
tgtttatataattttgcagca

SEQ ID NO: 2111579 - DNA, 13 bp, Homo sapiens
tgtttattaacaa

SEQ ID NO: 2111580 - DNA, 19 bp, Homo sapiens
tgtttattaacaaattatg

SEQ ID NO: 2111581 - DNA, 23 bp, Homo sapiens
tgtttatttataagcagatttaa

SEQ ID NO: 2111582 - DNA, 19 bp, Homo sapiens
tgtttcatgttttgtgact

SEQ ID NO: 2111583 - DNA, 22 bp, Homo sapiens
tgtttcatgttttgtgactata

SEQ ID NO: 2111584 - DNA, 19 bp, Homo sapiens
tgtttcattttcattaaaa

SEQ ID NO: 2111585 - DNA, 16 bp, Homo sapiens
tgtttccagaaaatat

SEQ ID NO: 2111586 - DNA, 18 bp, Homo sapiens
tgtttccagaaaatataa

SEQ ID NO: 2111587 - DNA, 15 bp, Homo sapiens
tgtttccatttctca

SEQ ID NO: 2111588 - DNA, 22 bp, Homo sapiens
tgtttcccataattttcttcat

SEQ ID NO: 2111589 - DNA, 12 bp, Homo sapiens
tgtttctgcagt

SEQ ID NO: 2111590 - DNA, 21 bp, Homo sapiens
tgtttctgcagtagtctctgt

SEQ ID NO: 2111591 - DNA, 18 bp, Homo sapiens
tgtttctggaaatggctg

SEQ ID NO: 2111592 - DNA, 19 bp, Homo sapiens
tgtttcttccaaagcacat

SEQ ID NO: 2111593 - DNA, 13 bp, Homo sapiens
tgtttcttgttca

SEQ ID NO: 2111594 - DNA, 22 bp, Homo sapiens
tgtttcttgttcatccaaggaa

SEQ ID NO: 2111595 - DNA, 21 bp, Homo sapiens
tgtttgacaaagaaacccaag

SEQ ID NO: 2111596 - DNA, 15 bp, Homo sapiens
tgtttgagatgtgat

SEQ ID NO: 2111597 - DNA, 16 bp, Homo sapiens
tgtttgagatgtgatg

SEQ ID NO: 2111598 - DNA, 17 bp, Homo sapiens
tgtttgagatgtgatgc

SEQ ID NO: 2111599 - DNA, 12 bp, Homo sapiens
tgtttgagcgca

SEQ ID NO: 2111600 - DNA, 23 bp, Homo sapiens
tgtttgagctcagacccccactc

SEQ ID NO: 2111601 - DNA, 22 bp, Homo sapiens
tgtttgagggattttattaaat

SEQ ID NO: 2111602 - DNA, 16 bp, Homo sapiens
ttcctacccaaccact

SEQ ID NO: 2111603 - DNA, 20 bp, Homo sapiens
ttcctagagagcagaaataa

SEQ ID NO: 2111604 - DNA, 18 bp, Homo sapiens
ttcctagccctctcacat

SEQ ID NO: 2111605 - DNA, 15 bp, Homo sapiens
ttcctagttttctcc

SEQ ID NO: 2111606 - DNA, 19 bp, Homo sapiens
ttcctatatagtttattga

SEQ ID NO: 2111607 - DNA, 15 bp, Homo sapiens
ttcctatttcttata

SEQ ID NO: 2111608 - DNA, 12 bp, Homo sapiens
ttcctattttaa

SEQ ID NO: 2111609 - DNA, 22 bp, Homo sapiens
ttcctattttcttttccattgc

SEQ ID NO: 2111610 - DNA, 14 bp, Homo sapiens
ttcctcaccaataa

SEQ ID NO: 2111611 - DNA, 22 bp, Homo sapiens
ttcctcaccaataacttcagag

SEQ ID NO: 2111612 - DNA, 23 bp, Homo sapiens
ttcctcaccaataacttcagaga

SEQ ID NO: 2111613 - DNA, 15 bp, Homo sapiens
ttcctcatcagtaga

SEQ ID NO: 2111614 - DNA, 14 bp, Homo sapiens
ttcctcatgaatta

SEQ ID NO: 2111615 - DNA, 14 bp, Homo sapiens
ttcctccagacaga

SEQ ID NO: 2111616 - DNA, 23 bp, Homo sapiens
ttcctccccattagagtcagcct

SEQ ID NO: 2111617 - DNA, 18 bp, Homo sapiens
ttcctccctcctcccaca

SEQ ID NO: 2111618 - DNA, 18 bp, Homo sapiens
ttcctccgtccacccagg

SEQ ID NO: 2111619 - DNA, 20 bp, Homo sapiens
ttcctccgtccacccaggct

SEQ ID NO: 2111620 - DNA, 18 bp, Homo sapiens
ttcctcctgaagcctctg

SEQ ID NO: 2111621 - DNA, 13 bp, Homo sapiens
ttcctcctgtgta

SEQ ID NO: 2111622 - DNA, 14 bp, Homo sapiens
ttcctcgccctggg

SEQ ID NO: 2111623 - DNA, 17 bp, Homo sapiens
ttcctctcactaaactt

SEQ ID NO: 2111624 - DNA, 15 bp, Homo sapiens
ttcctctccaattgt

SEQ ID NO: 2111625 - DNA, 14 bp, Homo sapiens
ttcctctccactgc

SEQ ID NO: 2111626 - DNA, 15 bp, Homo sapiens
ttcctctccactgcc

SEQ ID NO: 2111627 - DNA, 18 bp, Homo sapiens
ttcctctccactgccttc

SEQ ID NO: 2111628 - DNA, 22 bp, Homo sapiens
ttcctctccagccttctctctc

SEQ ID NO: 2111629 - DNA, 18 bp, Homo sapiens
ttcctctgaggaagaagg

SEQ ID NO: 2111630 - DNA, 20 bp, Homo sapiens
ttcctcttctattttgtaaa

SEQ ID NO: 2111631 - DNA, 19 bp, Homo sapiens
ttcctcttgcctctctcag

SEQ ID NO: 2111632 - DNA, 19 bp, Homo sapiens
ttcctctttctctccttct

SEQ ID NO: 2111633 - DNA, 14 bp, Homo sapiens
ttcctgaagccaga

SEQ ID NO: 2111634 - DNA, 14 bp, Homo sapiens
ttcctgaatattaa

SEQ ID NO: 2111635 - DNA, 16 bp, Homo sapiens
ttcctgaatattaatc

SEQ ID NO: 2111636 - DNA, 18 bp, Homo sapiens
ttcctgaatattaatccc

SEQ ID NO: 2111637 - DNA, 14 bp, Homo sapiens
ttcctgaatgaaat

SEQ ID NO: 2111638 - DNA, 16 bp, Homo sapiens
ttcctgaccctcccta

SEQ ID NO: 2111639 - DNA, 20 bp, Homo sapiens
ttcctgactgacacaggcca

SEQ ID NO: 2111640 - DNA, 22 bp, Homo sapiens
ttcctgactgacacaggccagc

SEQ ID NO: 2111641 - DNA, 19 bp, Homo sapiens
ttcctgaggatctagcttc

SEQ ID NO: 2111642 - DNA, 17 bp, Homo sapiens
ttcctgatgtgccagaa

SEQ ID NO: 2111643 - DNA, 12 bp, Homo sapiens
ttcctgcacccg

SEQ ID NO: 2111644 - DNA, 16 bp, Homo sapiens
ttcctgcacccgtacc

SEQ ID NO: 2111645 - DNA, 18 bp, Homo sapiens
ttcctgcatttgtgaaat

SEQ ID NO: 2111646 - DNA, 14 bp, Homo sapiens
ttcctgccaagcca

SEQ ID NO: 2111647 - DNA, 12 bp, Homo sapiens
ttcctgctgctg

SEQ ID NO: 2111648 - DNA, 19 bp, Homo sapiens
ttcctggacagctgtgcct

SEQ ID NO: 2111649 - DNA, 12 bp, Homo sapiens
ttcctgggcctg

SEQ ID NO: 2111650 - DNA, 20 bp, Homo sapiens
ttcctgtatttgttcccaag

SEQ ID NO: 2111651 - DNA, 22 bp, Homo sapiens
ttcctgtatttgttcccaagag

SEQ ID NO: 2111652 - DNA, 23 bp, Homo sapiens
ttcctgtgggccaggagctcagc

SEQ ID NO: 2111653 - DNA, 18 bp, Homo sapiens
ttcctgtgtactctttat

SEQ ID NO: 2111654 - DNA, 14 bp, Homo sapiens
ttcctgttcacctt

SEQ ID NO: 2111655 - DNA, 15 bp, Homo sapiens
ttcctgttcacctta

SEQ ID NO: 2111656 - DNA, 14 bp, Homo sapiens
ttccttacctttac

SEQ ID NO: 2111657 - DNA, 20 bp, Homo sapiens
ttccttagcttagacctcag

SEQ ID NO: 2111658 - DNA, 23 bp, Homo sapiens
ttccttagcttagacctcagcct

SEQ ID NO: 2111659 - DNA, 15 bp, Homo sapiens
ttccttcagcttcca

SEQ ID NO: 2111660 - DNA, 19 bp, Homo sapiens
ttccttccgctcctttacc

SEQ ID NO: 2111661 - DNA, 20 bp, Homo sapiens
ttccttccgctcctttacct

SEQ ID NO: 2111662 - DNA, 14 bp, Homo sapiens
ttccttccttccct

SEQ ID NO: 2111663 - DNA, 13 bp, Homo sapiens
ttccttctggagg

SEQ ID NO: 2111664 - DNA, 20 bp, Homo sapiens
ttccttgctgtcctaggcca

SEQ ID NO: 2111665 - DNA, 20 bp, Homo sapiens
ttccttggaggccaccggga

SEQ ID NO: 2111666 - DNA, 15 bp, Homo sapiens
ttccttgtatttaaa

SEQ ID NO: 2111667 - DNA, 18 bp, Homo sapiens
ttccttgtatttaaatat

SEQ ID NO: 2111668 - DNA, 13 bp, Homo sapiens
ttccttgtcacca

SEQ ID NO: 2111669 - DNA, 11 bp, Homo sapiens
ttcctttcctc

SEQ ID NO: 2111670 - DNA, 16 bp, Homo sapiens
ttcctttctaaatctg

SEQ ID NO: 2111671 - DNA, 20 bp, Homo sapiens
ttccttttaaaacacttcca

SEQ ID NO: 2111672 - DNA, 17 bp, Homo sapiens
ttccttttcttccttct

SEQ ID NO: 2111673 - DNA, 18 bp, Homo sapiens
ttccttttgatggggaga

SEQ ID NO: 2111674 - DNA, 21 bp, Homo sapiens
ttccttttgatggggagaaag

SEQ ID NO: 2111675 - DNA, 22 bp, Homo sapiens
ttcgaaacctgtccataaagta

SEQ ID NO: 2111676 - DNA, 17 bp, Homo sapiens
ttcgaccctttctctga

SEQ ID NO: 2111677 - DNA, 19 bp, Homo sapiens
ttcgaggcggtttccagga

SEQ ID NO: 2111678 - DNA, 21 bp, Homo sapiens
ttcgaggcggtttccaggaag

SEQ ID NO: 2111679 - DNA, 19 bp, Homo sapiens
ttcgaggttgccccttccc

SEQ ID NO: 2111680 - DNA, 20 bp, Homo sapiens
ttcgaggttgccccttcccc

SEQ ID NO: 2111681 - DNA, 16 bp, Homo sapiens
ttcgcagaacatgagt

SEQ ID NO: 2111682 - DNA, 11 bp, Homo sapiens
ttcgctgccag

SEQ ID NO: 2111683 - DNA, 16 bp, Homo sapiens
ttcgctgccaggacac

SEQ ID NO: 2111684 - DNA, 22 bp, Homo sapiens
ttcgctgccaggacacctgccc

SEQ ID NO: 2111685 - DNA, 23 bp, Homo sapiens
ttcgctgccaggacacctgcccc

SEQ ID NO: 2111686 - DNA, 16 bp, Homo sapiens
ttcgcttgcttctgca

SEQ ID NO: 2111687 - DNA, 17 bp, Homo sapiens
ttcgcttgcttctgcag

SEQ ID NO: 2111688 - DNA, 18 bp, Homo sapiens
ttcgggggaataaagaca

SEQ ID NO: 2111689 - DNA, 19 bp, Homo sapiens
ttcggtgggacagccccag

SEQ ID NO: 2111690 - DNA, 22 bp, Homo sapiens
ttcggtgggacagccccagggc

SEQ ID NO: 2111691 - DNA, 14 bp, Homo sapiens
ttcggtttctgagc

SEQ ID NO: 2111692 - DNA, 16 bp, Homo sapiens
ttcggtttctgagcat

SEQ ID NO: 2111693 - DNA, 18 bp, Homo sapiens
ttcgtcatttgcaagctg

SEQ ID NO: 2111694 - DNA, 11 bp, Homo sapiens
ttcgtgcattt

SEQ ID NO: 2111695 - DNA, 17 bp, Homo sapiens
ttcgtgcatttgtgagc

SEQ ID NO: 2111696 - DNA, 13 bp, Homo sapiens
ttcgtggctgcaa

SEQ ID NO: 2111697 - DNA, 17 bp, Homo sapiens
ttcgtggtgatcaatta

SEQ ID NO: 2111698 - DNA, 23 bp, Homo sapiens
ttcgtgtagtggaagagcagcct

SEQ ID NO: 2111699 - DNA, 17 bp, Homo sapiens
ttcgtgtctctcccacc

SEQ ID NO: 2111700 - DNA, 21 bp, Homo sapiens
ttcgtgtctctcccaccccgg

SEQ ID NO: 2111701 - DNA, 13 bp, Homo sapiens
ttctaaaagaata

SEQ ID NO: 2111702 - DNA, 14 bp, Homo sapiens
ttctaaaatgcttt

SEQ ID NO: 2111703 - DNA, 18 bp, Homo sapiens
ttctaaaatgcttttaat

SEQ ID NO: 2111704 - DNA, 16 bp, Homo sapiens
ttctaaaattgaagag

SEQ ID NO: 2111705 - DNA, 14 bp, Homo sapiens
ttctaaatgaagtg

SEQ ID NO: 2111706 - DNA, 15 bp, Homo sapiens
ttctaaatgaatgtt

SEQ ID NO: 2111707 - DNA, 15 bp, Homo sapiens
ttctaaatgctggtc

SEQ ID NO: 2111708 - DNA, 22 bp, Homo sapiens
ttctaaatgttggaattttcaa

SEQ ID NO: 2111709 - DNA, 12 bp, Homo sapiens
ttctaactgtaa

SEQ ID NO: 2111710 - DNA, 13 bp, Homo sapiens
ttctaactgtaaa

SEQ ID NO: 2111711 - DNA, 14 bp, Homo sapiens
ttctaactgtaaat

SEQ ID NO: 2111712 - DNA, 22 bp, Homo sapiens
ttctaagattgtacatatggaa

SEQ ID NO: 2111713 - DNA, 24 bp, Homo sapiens
ttctaagtaaaaccacagcagttg

SEQ ID NO: 2111714 - DNA, 12 bp, Homo sapiens
ttctaatagaac

SEQ ID NO: 2111715 - DNA, 18 bp, Homo sapiens
ttctaatagaactcagtt

SEQ ID NO: 2111716 - DNA, 17 bp, Homo sapiens
ttctaatgtcttcattt

SEQ ID NO: 2111717 - DNA, 15 bp, Homo sapiens
ttctggaatgtaatc

SEQ ID NO: 2111718 - DNA, 13 bp, Homo sapiens
ttctggagccctt

SEQ ID NO: 2111719 - DNA, 12 bp, Homo sapiens
ttctggagctgc

SEQ ID NO: 2111720 - DNA, 14 bp, Homo sapiens
ttctggagctgctg

SEQ ID NO: 2111721 - DNA, 15 bp, Homo sapiens
ttctggagctgctgt

SEQ ID NO: 2111722 - DNA, 18 bp, Homo sapiens
ttctggagctgctgttcc

SEQ ID NO: 2111723 - DNA, 22 bp, Homo sapiens
ttctggagctgctgttccaaca

SEQ ID NO: 2111724 - DNA, 15 bp, Homo sapiens
ttctggagtctccag

SEQ ID NO: 2111725 - DNA, 12 bp, Homo sapiens
ttctggcctcag

SEQ ID NO: 2111726 - DNA, 13 bp, Homo sapiens
ttctggctcctcc

SEQ ID NO: 2111727 - DNA, 16 bp, Homo sapiens
ttctggctctcccatt

SEQ ID NO: 2111728 - DNA, 16 bp, Homo sapiens
tgtttgatttagtaat

SEQ ID NO: 2111729 - DNA, 18 bp, Homo sapiens
tgtttgcacctttctagt

SEQ ID NO: 2111730 - DNA, 16 bp, Homo sapiens
tgtttgcctctgcctc

SEQ ID NO: 2111731 - DNA, 20 bp, Homo sapiens
tgtttgccttctacttttaa

SEQ ID NO: 2111732 - DNA, 22 bp, Homo sapiens
tgtttgggcagaagggagaagg

SEQ ID NO: 2111733 - DNA, 16 bp, Homo sapiens
tgtttggttgtaaatg

SEQ ID NO: 2111734 - DNA, 13 bp, Homo sapiens
tgtttgtaaatta

SEQ ID NO: 2111735 - DNA, 16 bp, Homo sapiens
tgtttgtaaattaata

SEQ ID NO: 2111736 - DNA, 23 bp, Homo sapiens
tgtttgtagccaatacatggtgt

SEQ ID NO: 2111737 - DNA, 16 bp, Homo sapiens
tgtttgtcagatatga

SEQ ID NO: 2111738 - DNA, 22 bp, Homo sapiens
tgtttgtttctccccctgggct

SEQ ID NO: 2111739 - DNA, 22 bp, Homo sapiens
tgttttaaatttatttcaaaaa

SEQ ID NO: 2111740 - DNA, 21 bp, Homo sapiens
tgttttacaagaattgtccat

SEQ ID NO: 2111741 - DNA, 12 bp, Homo sapiens
tgttttccacac

SEQ ID NO: 2111742 - DNA, 19 bp, Homo sapiens
ttttaaaaagttgcacatt

SEQ ID NO: 2111743 - DNA, 15 bp, Homo sapiens
ttttaaaaccatgca

SEQ ID NO: 2111744 - DNA, 21 bp, Homo sapiens
ttttaaaagcaattatattgt

SEQ ID NO: 2111745 - DNA, 18 bp, Homo sapiens
ttttaaaagtaaatgtac

SEQ ID NO: 2111746 - DNA, 21 bp, Homo sapiens
ttttaaaagtttcaatgtgat

SEQ ID NO: 2111747 - DNA, 15 bp, Homo sapiens
ttttaaaatctgatt

SEQ ID NO: 2111748 - DNA, 20 bp, Homo sapiens
ttttaaaatctgatttaatg

SEQ ID NO: 2111749 - DNA, 17 bp, Homo sapiens
ttttaaaggtagagatg

SEQ ID NO: 2111750 - DNA, 16 bp, Homo sapiens
ttttaaagtatatatt

SEQ ID NO: 2111751 - DNA, 17 bp, Homo sapiens
ttttaaatatgaacaaa

SEQ ID NO: 2111752 - DNA, 13 bp, Homo sapiens
ttttaaatgttca

SEQ ID NO: 2111753 - DNA, 17 bp, Homo sapiens
ttttaaattataagatg

SEQ ID NO: 2111754 - DNA, 18 bp, Homo sapiens
ttttaacagaaccagagg

SEQ ID NO: 2111755 - DNA, 22 bp, Homo sapiens
ttttaacatttatctaaaagaa

SEQ ID NO: 2111756 - DNA, 23 bp, Homo sapiens
ttttaacatttatctaaaagaat

SEQ ID NO: 2111757 - DNA, 12 bp, Homo sapiens
ttttaacatttt

SEQ ID NO: 2111758 - DNA, 13 bp, Homo sapiens
ttttaactcaata

SEQ ID NO: 2111759 - DNA, 16 bp, Homo sapiens
ttttaacttaaatttt

SEQ ID NO: 2111760 - DNA, 16 bp, Homo sapiens
ttttaagaggcagggt

SEQ ID NO: 2111761 - DNA, 20 bp, Homo sapiens
ttttaagaggctttggccca

SEQ ID NO: 2111762 - DNA, 22 bp, Homo sapiens
ttttaagataaattataagtta

SEQ ID NO: 2111763 - DNA, 20 bp, Homo sapiens
ttttaagattgtaattcaga

SEQ ID NO: 2111764 - DNA, 15 bp, Homo sapiens
ttttaagtatttagg

SEQ ID NO: 2111765 - DNA, 18 bp, Homo sapiens
ttttaagtatttatatat

SEQ ID NO: 2111766 - DNA, 17 bp, Homo sapiens
ttttaagtgctttgtaa

SEQ ID NO: 2111767 - DNA, 19 bp, Homo sapiens
ttttaagtgctttgtaatg

SEQ ID NO: 2111768 - DNA, 15 bp, Homo sapiens
ttttaatattttgta

SEQ ID NO: 2111769 - DNA, 14 bp, Homo sapiens
ttttaatgccttcc

SEQ ID NO: 2111770 - DNA, 11 bp, Homo sapiens
ttttaattatt

SEQ ID NO: 2111771 - DNA, 23 bp, Homo sapiens
ttttaattattatttatatatgt

SEQ ID NO: 2111772 - DNA, 12 bp, Homo sapiens
ttttacaaaaca

SEQ ID NO: 2111773 - DNA, 19 bp, Homo sapiens
ttttacaaaacatacccag

SEQ ID NO: 2111774 - DNA, 18 bp, Homo sapiens
ttttacaataaataatct

SEQ ID NO: 2111775 - DNA, 12 bp, Homo sapiens
ttttacaataat

SEQ ID NO: 2111776 - DNA, 20 bp, Homo sapiens
ttttacagagcttgaaaact

SEQ ID NO: 2111777 - DNA, 20 bp, Homo sapiens
ttttacctgggatatgacaa

SEQ ID NO: 2111778 - DNA, 16 bp, Homo sapiens
ttttactaaagcagtg

SEQ ID NO: 2111779 - DNA, 20 bp, Homo sapiens
ttttactaaagcagtgtttt

SEQ ID NO: 2111780 - DNA, 14 bp, Homo sapiens
ttttactgacagaa

SEQ ID NO: 2111781 - DNA, 15 bp, Homo sapiens
ttttactgacagaaa

SEQ ID NO: 2111782 - DNA, 15 bp, Homo sapiens
ttttactgtctgtaa

SEQ ID NO: 2111783 - DNA, 22 bp, Homo sapiens
ttttacttttgtcttcctcact

SEQ ID NO: 2111784 - DNA, 18 bp, Homo sapiens
ttttacttttgttctgta

SEQ ID NO: 2111785 - DNA, 17 bp, Homo sapiens
ttttagagactatggag

SEQ ID NO: 2111786 - DNA, 18 bp, Homo sapiens
ttttagagattaatttgt

SEQ ID NO: 2111787 - DNA, 23 bp, Homo sapiens
ttttagagattaatttgtgtaga

SEQ ID NO: 2111788 - DNA, 23 bp, Homo sapiens
ttttagcaaagatatctcatctc

SEQ ID NO: 2111789 - DNA, 13 bp, Homo sapiens
ttttagttttagt

SEQ ID NO: 2111790 - DNA, 14 bp, Homo sapiens
ttttataagcaaat

SEQ ID NO: 2111791 - DNA, 17 bp, Homo sapiens
ttttatacatagtcaca

SEQ ID NO: 2111792 - DNA, 13 bp, Homo sapiens
ttttatacatatc

SEQ ID NO: 2111793 - DNA, 18 bp, Homo sapiens
ttttatacatatcagaaa

SEQ ID NO: 2111794 - DNA, 23 bp, Homo sapiens
ttttatacatatcagaaaagtag

SEQ ID NO: 2111795 - DNA, 22 bp, Homo sapiens
ttttataggtcacatatgtctg

SEQ ID NO: 2111796 - DNA, 22 bp, Homo sapiens
ttttatatgaaatgtttcacta

SEQ ID NO: 2111797 - DNA, 16 bp, Homo sapiens
ttttatcagccatgtt

SEQ ID NO: 2111798 - DNA, 15 bp, Homo sapiens
ttttatgatatccct

SEQ ID NO: 2111799 - DNA, 23 bp, Homo sapiens
ttttatggaggctttgcatagat

SEQ ID NO: 2111800 - DNA, 20 bp, Homo sapiens
ttttattgtataaactatca

SEQ ID NO: 2111801 - DNA, 12 bp, Homo sapiens
ttttatttccaa

SEQ ID NO: 2111802 - DNA, 17 bp, Homo sapiens
ttttatttccacataaa

SEQ ID NO: 2111803 - DNA, 22 bp, Homo sapiens
ttttatttggaataataatttt

SEQ ID NO: 2111804 - DNA, 12 bp, Homo sapiens
ttttatttttga

SEQ ID NO: 2111805 - DNA, 12 bp, Homo sapiens
ttttcaaacttt

SEQ ID NO: 2111806 - DNA, 17 bp, Homo sapiens
ttttcaaccagcatttt

SEQ ID NO: 2111807 - DNA, 15 bp, Homo sapiens
ttttcaacttggaaa

SEQ ID NO: 2111808 - DNA, 14 bp, Homo sapiens
ttttcaagaaactg

SEQ ID NO: 2111809 - DNA, 16 bp, Homo sapiens
ttttcaattatttcaa

SEQ ID NO: 2111810 - DNA, 12 bp, Homo sapiens
ttttcacctcat

SEQ ID NO: 2111811 - DNA, 15 bp, Homo sapiens
tttttactaaagcag

SEQ ID NO: 2111812 - DNA, 19 bp, Homo sapiens
tttttagagattaatttgt

SEQ ID NO: 2111813 - DNA, 12 bp, Homo sapiens
tttttatactcc

SEQ ID NO: 2111814 - DNA, 17 bp, Homo sapiens
tttttatactccataca

SEQ ID NO: 2111815 - DNA, 15 bp, Homo sapiens
tttttatatttagtt

SEQ ID NO: 2111816 - DNA, 13 bp, Homo sapiens
tttttattctgtt

SEQ ID NO: 2111817 - DNA, 13 bp, Homo sapiens
tttttatttaaaa

SEQ ID NO: 2111818 - DNA, 19 bp, Homo sapiens
tttttcaaaaattacacta

SEQ ID NO: 2111819 - DNA, 16 bp, Homo sapiens
tttttcaatatttatt

SEQ ID NO: 2111820 - DNA, 14 bp, Homo sapiens
tttttcagaaatat

SEQ ID NO: 2111821 - DNA, 14 bp, Homo sapiens
tttttccccaaagt

SEQ ID NO: 2111822 - DNA, 22 bp, Homo sapiens
tttttccttcaaagtttaataa

SEQ ID NO: 2111823 - DNA, 22 bp, Homo sapiens
tttttctacacagtaaaaactt

SEQ ID NO: 2111824 - DNA, 18 bp, Homo sapiens
tttttctacttttaaaga

SEQ ID NO: 2111825 - DNA, 17 bp, Homo sapiens
tttttgaaaaagcgaaa

SEQ ID NO: 2111826 - DNA, 15 bp, Homo sapiens
tttttgaaaagctaa

SEQ ID NO: 2111827 - DNA, 11 bp, Homo sapiens
tttttgaagaa

SEQ ID NO: 2111828 - DNA, 21 bp, Homo sapiens
tttttgaagaagggaaattca

SEQ ID NO: 2111829 - DNA, 18 bp, Homo sapiens
tttttgatggtaagactg

SEQ ID NO: 2111830 - DNA, 13 bp, Homo sapiens
tttttgatgtcag

SEQ ID NO: 2111831 - DNA, 22 bp, Homo sapiens
tttttgcctaaatccaaagaaa

SEQ ID NO: 2111832 - DNA, 17 bp, Homo sapiens
tttttggtgtatttgag

SEQ ID NO: 2111833 - DNA, 18 bp, Homo sapiens
tttttggttgtcaatatt

SEQ ID NO: 2111834 - DNA, 16 bp, Homo sapiens
tttttgtaacttcaaa

SEQ ID NO: 2111835 - DNA, 23 bp, Homo sapiens
tttttgtacgttatatattgtat

SEQ ID NO: 2111836 - DNA, 16 bp, Homo sapiens
tttttgtccctgctcc

SEQ ID NO: 2111837 - DNA, 13 bp, Homo sapiens
tttttgtgtttct

SEQ ID NO: 2111838 - DNA, 12 bp, Homo sapiens
ttttttaatgta

SEQ ID NO: 2111839 - DNA, 13 bp, Homo sapiens
ttttttattctgt

SEQ ID NO: 2111840 - DNA, 13 bp, Homo sapiens
ttttttccactta

SEQ ID NO: 2111841 - DNA, 11 bp, Homo sapiens
ttttttgtaac

SEQ ID NO: 2111842 - DNA, 10 bp, Homo sapiens
tttttttcca

SEQ ID NO: 2111843 - DNA, 17 bp, Homo sapiens
ttggtgcctgcctctgc

SEQ ID NO: 2111844 - DNA, 21 bp, Homo sapiens
ttggtggggctcgtggccttc

SEQ ID NO: 2111845 - DNA, 19 bp, Homo sapiens
ttggttctctccaggaagg

SEQ ID NO: 2111846 - DNA, 18 bp, Homo sapiens
ttggttggggtggggcag

SEQ ID NO: 2111847 - DNA, 18 bp, Homo sapiens
ttggttgtcaatattaaa

SEQ ID NO: 2111848 - DNA, 16 bp, Homo sapiens
ttggtttaatttaaag

SEQ ID NO: 2111849 - DNA, 15 bp, Homo sapiens
ttggtttttatattt

SEQ ID NO: 2111850 - DNA, 12 bp, Homo sapiens
ttgtaaaaaagg

SEQ ID NO: 2111851 - DNA, 22 bp, Homo sapiens
ttgtaaaaaaggaacacccgga

SEQ ID NO: 2111852 - DNA, 14 bp, Homo sapiens
ttgtaaaaacaaaa

SEQ ID NO: 2111853 - DNA, 21 bp, Homo sapiens
ttgtaaaacctgtcaatgata

SEQ ID NO: 2111854 - DNA, 20 bp, Homo sapiens
ttgtaaaagaacagtaaaca

SEQ ID NO: 2111855 - DNA, 21 bp, Homo sapiens
ttgtaaaatagcttgtatagt

SEQ ID NO: 2111856 - DNA, 17 bp, Homo sapiens
ttgtaaacagaaggaga

SEQ ID NO: 2111857 - DNA, 16 bp, Homo sapiens
ttgtaaactcaaaata

SEQ ID NO: 2111858 - DNA, 14 bp, Homo sapiens
ttgtaaaggtcaga

SEQ ID NO: 2111859 - DNA, 14 bp, Homo sapiens
ttgtaaatacacca

SEQ ID NO: 2111860 - DNA, 14 bp, Homo sapiens
ttgtaaatattgtg

SEQ ID NO: 2111861 - DNA, 12 bp, Homo sapiens
ttgtaaatattt

SEQ ID NO: 2111862 - DNA, 13 bp, Homo sapiens
ttgtaaatattta

SEQ ID NO: 2111863 - DNA, 20 bp, Homo sapiens
ttgtaaatttggatttacga

SEQ ID NO: 2111864 - DNA, 16 bp, Homo sapiens
ttgtaacttcaaatat

SEQ ID NO: 2111865 - DNA, 22 bp, Homo sapiens
ttgtaagacaaaggttttcctc

SEQ ID NO: 2111866 - DNA, 20 bp, Homo sapiens
ttgtaagagtggaaccaaca

SEQ ID NO: 2111867 - DNA, 12 bp, Homo sapiens
ttgtaataaact

SEQ ID NO: 2111868 - DNA, 14 bp, Homo sapiens
ttgtaataaactct

SEQ ID NO: 2111869 - DNA, 21 bp, Homo sapiens
ttgtaatagatgtttgataga

SEQ ID NO: 2111870 - DNA, 12 bp, Homo sapiens
ttgtaatagtcc

SEQ ID NO: 2111871 - DNA, 14 bp, Homo sapiens
ttgtaatagtccat

SEQ ID NO: 2111872 - DNA, 16 bp, Homo sapiens
ttgtaatcctgtatat

SEQ ID NO: 2111873 - DNA, 14 bp, Homo sapiens
ttgtaattctaaat

SEQ ID NO: 2111874 - DNA, 19 bp, Homo sapiens
ttgtacacaccttatattt

SEQ ID NO: 2111875 - DNA, 12 bp, Homo sapiens
ttgtacagaatt

SEQ ID NO: 2111876 - DNA, 13 bp, Homo sapiens
ttgtacagaattt

SEQ ID NO: 2111877 - DNA, 18 bp, Homo sapiens
ttgtacagacgtatgctt

SEQ ID NO: 2111878 - DNA, 21 bp, Homo sapiens
ttgtacagacgtatgcttatt

SEQ ID NO: 2111879 - DNA, 16 bp, Homo sapiens
ttgtacagctgtttaa

SEQ ID NO: 2111880 - DNA, 15 bp, Homo sapiens
ttgtacagttcagtt

SEQ ID NO: 2111881 - DNA, 16 bp, Homo sapiens
ttgtacatagttattt

SEQ ID NO: 2111882 - DNA, 17 bp, Homo sapiens
ttgtacatatggaaatc

SEQ ID NO: 2111883 - DNA, 16 bp, Homo sapiens
ttgtaccagtgtgaat

SEQ ID NO: 2111884 - DNA, 13 bp, Homo sapiens
ttgtaccccatcc

SEQ ID NO: 2111885 - DNA, 16 bp, Homo sapiens
ttgtacctatgtgaca

SEQ ID NO: 2111886 - DNA, 21 bp, Homo sapiens
ttgtacgtaaagcttaaattg

SEQ ID NO: 2111887 - DNA, 14 bp, Homo sapiens
ttgtacgtaatgta

SEQ ID NO: 2111888 - DNA, 11 bp, Homo sapiens
ttgtactatgt

SEQ ID NO: 2111889 - DNA, 13 bp, Homo sapiens
ttgtagaaatctg

SEQ ID NO: 2111890 - DNA, 14 bp, Homo sapiens
ttgtagaataataa

SEQ ID NO: 2111891 - DNA, 15 bp, Homo sapiens
ttgtagagccagggt

SEQ ID NO: 2111892 - DNA, 12 bp, Homo sapiens
ttgtagccagcc

SEQ ID NO: 2111893 - DNA, 16 bp, Homo sapiens
ttgtagggatgccttt

SEQ ID NO: 2111894 - DNA, 17 bp, Homo sapiens
ttgtaggggtcaaagaa

SEQ ID NO: 2111895 - DNA, 19 bp, Homo sapiens
ttgtaggggtcaaagaaat

SEQ ID NO: 2111896 - DNA, 20 bp, Homo sapiens
ttgtaggggtcaaagaaatg

SEQ ID NO: 2111897 - DNA, 12 bp, Homo sapiens
ttgtataaaaat

SEQ ID NO: 2111898 - DNA, 20 bp, Homo sapiens
ttgtataaaaatagaagaat

SEQ ID NO: 2111899 - DNA, 19 bp, Homo sapiens
ttgtataaataataaagaa

SEQ ID NO: 2111900 - DNA, 19 bp, Homo sapiens
ttgtataaatgtatataca

SEQ ID NO: 2111901 - DNA, 22 bp, Homo sapiens
ttgtataaatgtatatacacat

SEQ ID NO: 2111902 - DNA, 21 bp, Homo sapiens
ttgtataagattagaatgaaa

SEQ ID NO: 2111903 - DNA, 14 bp, Homo sapiens
ttgtatagtaaagt

SEQ ID NO: 2111904 - DNA, 16 bp, Homo sapiens
ttgtatagtgtaaaat

SEQ ID NO: 2111905 - DNA, 23 bp, Homo sapiens
ttgtatagttttataaaactcag

SEQ ID NO: 2111906 - DNA, 13 bp, Homo sapiens
ttgtatatacata

SEQ ID NO: 2111907 - DNA, 18 bp, Homo sapiens
ttgtatatacatattata

SEQ ID NO: 2111908 - DNA, 23 bp, Homo sapiens
ttgtatatacatattataaataa

SEQ ID NO: 2111909 - DNA, 11 bp, Homo sapiens
ttgtatatatc

SEQ ID NO: 2111910 - DNA, 13 bp, Homo sapiens
ttgtatatatctg

SEQ ID NO: 2111911 - DNA, 14 bp, Homo sapiens
ttgtatatatgtgt

SEQ ID NO: 2111912 - DNA, 15 bp, Homo sapiens
ttgtatatatgtgtg

SEQ ID NO: 2111913 - DNA, 16 bp, Homo sapiens
ttgtatcacaaatctt

SEQ ID NO: 2111914 - DNA, 13 bp, Homo sapiens
ttgtatctctttt

SEQ ID NO: 2111915 - DNA, 14 bp, Homo sapiens
ttgtatctcttttg

SEQ ID NO: 2111916 - DNA, 22 bp, Homo sapiens
ttgtatgaaagatggctgtgcc

SEQ ID NO: 2111917 - DNA, 16 bp, Homo sapiens
ttgtatgatgtgttgt

SEQ ID NO: 2111918 - DNA, 12 bp, Homo sapiens
ttgtatgttaaa

SEQ ID NO: 2111919 - DNA, 23 bp, Homo sapiens
ttgtattgttaatgcatcatcat

SEQ ID NO: 2111920 - DNA, 14 bp, Homo sapiens
ttgtattttaaatg

SEQ ID NO: 2111921 - DNA, 17 bp, Homo sapiens
ttgtatttttgaataaa

SEQ ID NO: 2111922 - DNA, 18 bp, Homo sapiens
ttgtatttttgaataaaa

SEQ ID NO: 2111923 - DNA, 20 bp, Homo sapiens
ttgtattttttcctgtaaga

SEQ ID NO: 2111924 - DNA, 22 bp, Homo sapiens
ttgtcaaatgtcattatgtaga

SEQ ID NO: 2111925 - DNA, 19 bp, Homo sapiens
ttgtcaatattaaatacag

SEQ ID NO: 2111926 - DNA, 16 bp, Homo sapiens
ttgtcaccagcaacat

SEQ ID NO: 2111927 - DNA, 12 bp, Homo sapiens
ttgtcactgtct

SEQ ID NO: 2111928 - DNA, 23 bp, Homo sapiens
ttgtcactgtcttcacaacctcc

SEQ ID NO: 2111929 - DNA, 21 bp, Homo sapiens
tttagagtatgcaagaagaat

SEQ ID NO: 2111930 - DNA, 21 bp, Homo sapiens
tttagatcccatgtcacctca

SEQ ID NO: 2111931 - DNA, 22 bp, Homo sapiens
tttagatcccatgtcacctcag

SEQ ID NO: 2111932 - DNA, 20 bp, Homo sapiens
tttagatttcaagaaaaaat

SEQ ID NO: 2111933 - DNA, 16 bp, Homo sapiens
tttagccttaaatttt

SEQ ID NO: 2111934 - DNA, 18 bp, Homo sapiens
tttagctctgatcagcat

SEQ ID NO: 2111935 - DNA, 16 bp, Homo sapiens
tttaggaatatgttca

SEQ ID NO: 2111936 - DNA, 13 bp, Homo sapiens
tttaggcagcctg

SEQ ID NO: 2111937 - DNA, 20 bp, Homo sapiens
tttaggcagcctgccgccgt

SEQ ID NO: 2111938 - DNA, 21 bp, Homo sapiens
tttagtaaatcctattatgtg

SEQ ID NO: 2111939 - DNA, 21 bp, Homo sapiens
tttagtagcagtgattgtctt

SEQ ID NO: 2111940 - DNA, 17 bp, Homo sapiens
tttagtgactgtaatta

SEQ ID NO: 2111941 - DNA, 19 bp, Homo sapiens
tttagttgcagaaacattt

SEQ ID NO: 2111942 - DNA, 19 bp, Homo sapiens
tttagttgcagactcagtt

SEQ ID NO: 2111943 - DNA, 14 bp, Homo sapiens
tttagtttactcaa

SEQ ID NO: 2111944 - DNA, 20 bp, Homo sapiens
tttataactcatcataaaat

SEQ ID NO: 2111945 - DNA, 22 bp, Homo sapiens
tttataactcatcataaaataa

SEQ ID NO: 2111946 - DNA, 22 bp, Homo sapiens
tttataagcccaaatggctctg

SEQ ID NO: 2111947 - DNA, 20 bp, Homo sapiens
tttataatgtggatttccta

SEQ ID NO: 2111948 - DNA, 13 bp, Homo sapiens
tttatacaaaata

SEQ ID NO: 2111949 - DNA, 11 bp, Homo sapiens
tttatacatag

SEQ ID NO: 2111950 - DNA, 13 bp, Homo sapiens
tttatacatatca

SEQ ID NO: 2111951 - DNA, 19 bp, Homo sapiens
tttatacatatcagaaaag

SEQ ID NO: 2111952 - DNA, 21 bp, Homo sapiens
tttatacatatcagaaaagta

SEQ ID NO: 2111953 - DNA, 20 bp, Homo sapiens
tttatatatatatgtatatg

SEQ ID NO: 2111954 - DNA, 15 bp, Homo sapiens
tttatatatttataa

SEQ ID NO: 2111955 - DNA, 13 bp, Homo sapiens
tttatatgttaat

SEQ ID NO: 2111956 - DNA, 16 bp, Homo sapiens
tttatattgtaaatat

SEQ ID NO: 2111957 - DNA, 14 bp, Homo sapiens
tttatatttagtga

SEQ ID NO: 2111958 - DNA, 15 bp, Homo sapiens
tttatatttctcgta

SEQ ID NO: 2111959 - DNA, 21 bp, Homo sapiens
tttatcagtgacagagttcac

SEQ ID NO: 2111960 - DNA, 24 bp, Homo sapiens
tttatcagtgcttaatgtgaacta

SEQ ID NO: 2111961 - DNA, 16 bp, Homo sapiens
tttatccaatcctcag

SEQ ID NO: 2111962 - DNA, 18 bp, Homo sapiens
tttatccaatcctcagga

SEQ ID NO: 2111963 - DNA, 18 bp, Homo sapiens
tttatcctgaaatttcag

SEQ ID NO: 2111964 - DNA, 22 bp, Homo sapiens
tttatctgtgttgtctctctaa

SEQ ID NO: 2111965 - DNA, 21 bp, Homo sapiens
tttatcttggactgacattta

SEQ ID NO: 2111966 - DNA, 14 bp, Homo sapiens
tttatcttgtctct

SEQ ID NO: 2111967 - DNA, 13 bp, Homo sapiens
tttatgaaaagag

SEQ ID NO: 2111968 - DNA, 20 bp, Homo sapiens
tttatgactgtaaacataga

SEQ ID NO: 2111969 - DNA, 17 bp, Homo sapiens
tttatgcaaggaaggaa

SEQ ID NO: 2111970 - DNA, 23 bp, Homo sapiens
tttatggaggatggagagagggg

SEQ ID NO: 2111971 - DNA, 24 bp, Homo sapiens
tttatggatcccaattcatttcat

SEQ ID NO: 2111972 - DNA, 16 bp, Homo sapiens
tttatggcatgattta

SEQ ID NO: 2111973 - DNA, 22 bp, Homo sapiens
tttatggcatgatttatatatg

SEQ ID NO: 2111974 - DNA, 20 bp, Homo sapiens
tttatggcttataaatgtgt

SEQ ID NO: 2111975 - DNA, 13 bp, Homo sapiens
tttatgggccttg

SEQ ID NO: 2111976 - DNA, 19 bp, Homo sapiens
tttatggtattttcgtgca

SEQ ID NO: 2111977 - DNA, 16 bp, Homo sapiens
tttatggtttctccag

SEQ ID NO: 2111978 - DNA, 22 bp, Homo sapiens
tttatgtaaactgcattagaaa

SEQ ID NO: 2111979 - DNA, 20 bp, Homo sapiens
tttatgttactacatgcact

SEQ ID NO: 2111980 - DNA, 12 bp, Homo sapiens
tttatgttctag

SEQ ID NO: 2111981 - DNA, 13 bp, Homo sapiens
tttattaaaaact

SEQ ID NO: 2111982 - DNA, 18 bp, Homo sapiens
tttattaaaaactgagtg

SEQ ID NO: 2111983 - DNA, 21 bp, Homo sapiens
tttattaaaatgattgtaaaa

SEQ ID NO: 2111984 - DNA, 12 bp, Homo sapiens
tttattaaataa

SEQ ID NO: 2111985 - DNA, 15 bp, Homo sapiens
tttattaatgaactg

SEQ ID NO: 2111986 - DNA, 21 bp, Homo sapiens
tttattaatgcctctcccgca

SEQ ID NO: 2111987 - DNA, 14 bp, Homo sapiens
tttattacctctga

SEQ ID NO: 2111988 - DNA, 16 bp, Homo sapiens
tttattagctgtaaat

SEQ ID NO: 2111989 - DNA, 17 bp, Homo sapiens
tttattcaattcctctg

SEQ ID NO: 2111990 - DNA, 16 bp, Homo sapiens
tttattcactgtaagt

SEQ ID NO: 2111991 - DNA, 13 bp, Homo sapiens
tttattcattcag

SEQ ID NO: 2111992 - DNA, 17 bp, Homo sapiens
tttattcattcagtgag

SEQ ID NO: 2111993 - DNA, 14 bp, Homo sapiens
tttattgagaattt

SEQ ID NO: 2111994 - DNA, 18 bp, Homo sapiens
tttattggaagtgttcaa

SEQ ID NO: 2111995 - DNA, 13 bp, Homo sapiens
tttattgtataaa

SEQ ID NO: 2111996 - DNA, 19 bp, Homo sapiens
tttattgtcattactgcct

SEQ ID NO: 2111997 - DNA, 13 bp, Homo sapiens
tttattgtgatct

SEQ ID NO: 2111998 - DNA, 14 bp, Homo sapiens
tttatttatggctt

SEQ ID NO: 2111999 - DNA, 16 bp, Homo sapiens
tttatttattcactgt

SEQ ID NO: 2112000 - DNA, 11 bp, Homo sapiens
tttatttcatg

SEQ ID NO: 2112001 - DNA, 12 bp, Homo sapiens
tttatttgttga

SEQ ID NO: 2112002 - DNA, 13 bp, Homo sapiens
tttatttgttgag

SEQ ID NO: 2112003 - DNA, 14 bp, Homo sapiens
tttatttgttgaga

SEQ ID NO: 2112004 - DNA, 18 bp, Homo sapiens
tttatttgttgagagtgt

SEQ ID NO: 2112005 - DNA, 21 bp, Homo sapiens
tttattttcttttgtaaatgt

SEQ ID NO: 2112006 - DNA, 23 bp, Homo sapiens
tttattttgtatttttgaataaa

SEQ ID NO: 2112007 - DNA, 16 bp, Homo sapiens
tttatttttcatattg

SEQ ID NO: 2112008 - DNA, 23 bp, Homo sapiens
tttatttttgaacccctgtgtcc

SEQ ID NO: 2112009 - DNA, 18 bp, Homo sapiens
tttattttttctacacag

SEQ ID NO: 2112010 - DNA, 13 bp, Homo sapiens
tttcaaaagacat

SEQ ID NO: 2112011 - DNA, 18 bp, Homo sapiens
tttcaaaagacatgttgt

SEQ ID NO: 2112012 - DNA, 23 bp, Homo sapiens
tttcaaaagtggattttcctgaa

SEQ ID NO: 2112013 - DNA, 22 bp, Homo sapiens
tttcaaactgagtaaattggaa

SEQ ID NO: 2112014 - DNA, 23 bp, Homo sapiens
tttcaacaagaatattgtatgtt

SEQ ID NO: 2112015 - DNA, 23 bp, Homo sapiens
tttcaacaagtagctaaagtctg

SEQ ID NO: 2112016 - DNA, 20 bp, Homo sapiens
tttcaaccaactatttttga

SEQ ID NO: 2112017 - DNA, 18 bp, Homo sapiens
tttcaaccagcattcatg

SEQ ID NO: 2112018 - DNA, 18 bp, Homo sapiens
tttcaaccagcattttac

SEQ ID NO: 2112019 - DNA, 20 bp, Homo sapiens
tttcaaccagcattttacta

SEQ ID NO: 2112020 - DNA, 15 bp, Homo sapiens
tttcaacgcagccct

SEQ ID NO: 2112021 - DNA, 16 bp, Homo sapiens
tttcaacgcagccctg

SEQ ID NO: 2112022 - DNA, 16 bp, Homo sapiens
tttcaagaaaactgga

SEQ ID NO: 2112023 - DNA, 18 bp, Homo sapiens
tttcaagaaaactggaaa

SEQ ID NO: 2112024 - DNA, 17 bp, Homo sapiens
tttcaagaaactgagga

SEQ ID NO: 2112025 - DNA, 16 bp, Homo sapiens
tttcaagacttgatac

SEQ ID NO: 2112026 - DNA, 22 bp, Homo sapiens
tttcaagagaagaaaaaattaa

SEQ ID NO: 2112027 - DNA, 22 bp, Homo sapiens
tttcaagcctgcctaggaattc

SEQ ID NO: 2112028 - DNA, 21 bp, Homo sapiens
tttcaagtgaatctaaaagct

SEQ ID NO: 2112029 - DNA, 21 bp, Homo sapiens
tttcaatggtttgcaaggaag

SEQ ID NO: 2112030 - DNA, 14 bp, Homo sapiens
tttcaattgtattt

SEQ ID NO: 2112031 - DNA, 13 bp, Homo sapiens
tttcacaacagat

SEQ ID NO: 2112032 - DNA, 16 bp, Homo sapiens
tttcacaacaggcatt

SEQ ID NO: 2112033 - DNA, 23 bp, Homo sapiens
tttcacaattccatttccagttc

SEQ ID NO: 2112034 - DNA, 15 bp, Homo sapiens
tttcacagtttttcc

SEQ ID NO: 2112035 - DNA, 15 bp, Homo sapiens
tttcacattaatatt

SEQ ID NO: 2112036 - DNA, 20 bp, Homo sapiens
tttcacattaatggtctaaa

SEQ ID NO: 2112037 - DNA, 23 bp, Homo sapiens
tttcaccatttccgggaaacgaa

SEQ ID NO: 2112038 - DNA, 22 bp, Homo sapiens
tttcacgggaactctccaaata

SEQ ID NO: 2112039 - DNA, 17 bp, Homo sapiens
tttcactgctggctgcc

SEQ ID NO: 2112040 - DNA, 20 bp, Homo sapiens
tttcactgctggctgcctta

SEQ ID NO: 2112041 - DNA, 22 bp, Homo sapiens
tttcactgctggctgccttaga

SEQ ID NO: 2112042 - DNA, 24 bp, Homo sapiens
tttcactgtagaatgatttcatgc

SEQ ID NO: 2112043 - DNA, 16 bp, Homo sapiens
ttgatgtacatgtgta

SEQ ID NO: 2112044 - DNA, 13 bp, Homo sapiens
ttgatgtcagcct

SEQ ID NO: 2112045 - DNA, 15 bp, Homo sapiens
ttgatgtttccagaa

SEQ ID NO: 2112046 - DNA, 17 bp, Homo sapiens
ttgattctgaatctgaa

SEQ ID NO: 2112047 - DNA, 20 bp, Homo sapiens
ttgatttatatgtgtaattt

SEQ ID NO: 2112048 - DNA, 12 bp, Homo sapiens
ttgatttatgca

SEQ ID NO: 2112049 - DNA, 19 bp, Homo sapiens
ttgatttatgcatggaaac

SEQ ID NO: 2112050 - DNA, 15 bp, Homo sapiens
ttgatttgagaaatt

SEQ ID NO: 2112051 - DNA, 20 bp, Homo sapiens
ttgattttagccttctctgt

SEQ ID NO: 2112052 - DNA, 17 bp, Homo sapiens
ttgcaaaagactaattt

SEQ ID NO: 2112053 - DNA, 23 bp, Homo sapiens
ttgcaaaatttccagtacctttg

SEQ ID NO: 2112054 - DNA, 17 bp, Homo sapiens
ttgcaaagttacagatg

SEQ ID NO: 2112055 - DNA, 22 bp, Homo sapiens
ttgcaaatgtagtatggcctgt

SEQ ID NO: 2112056 - DNA, 14 bp, Homo sapiens
ttgcaacaggctgg

SEQ ID NO: 2112057 - DNA, 23 bp, Homo sapiens
ttgcaaggccgctgttcacccac

SEQ ID NO: 2112058 - DNA, 16 bp, Homo sapiens
ttgcaataaaatagta

SEQ ID NO: 2112059 - DNA, 18 bp, Homo sapiens
ttgcaatcccttaatatc

SEQ ID NO: 2112060 - DNA, 14 bp, Homo sapiens
ttatctgatactta

SEQ ID NO: 2112061 - DNA, 23 bp, Homo sapiens
ttatctgatcgggataacaaaat

SEQ ID NO: 2112062 - DNA, 15 bp, Homo sapiens
ttatctgcctggcct

SEQ ID NO: 2112063 - DNA, 19 bp, Homo sapiens
ttcaggaggccctggtgtc

SEQ ID NO: 2112064 - DNA, 22 bp, Homo sapiens
ttgcttagtcacttatttcata

SEQ ID NO: 2112065 - DNA, 16 bp, Homo sapiens
ttgcttatttatattc

SEQ ID NO: 2112066 - DNA, 16 bp, Homo sapiens
ttgcttctaaatgccc

SEQ ID NO: 2112067 - DNA, 18 bp, Homo sapiens
ttgcttgagcccaggagt

SEQ ID NO: 2112068 - DNA, 16 bp, Homo sapiens
ttgcttggactattat

SEQ ID NO: 2112069 - DNA, 13 bp, Homo sapiens
ttgctttgctgtt

SEQ ID NO: 2112070 - DNA, 21 bp, Homo sapiens
ttggaaaaaaattacaaaatg

SEQ ID NO: 2112071 - DNA, 22 bp, Homo sapiens
ttggaaaagaatacagaaagat

SEQ ID NO: 2112072 - DNA, 18 bp, Homo sapiens
ttggaaagagaccagcac

SEQ ID NO: 2112073 - DNA, 20 bp, Homo sapiens
ttggaaagcatcacctcagg

SEQ ID NO: 2112074 - DNA, 17 bp, Homo sapiens
ttggaaagttcagccag

SEQ ID NO: 2112075 - DNA, 18 bp, Homo sapiens
ttggaaagttcagccaga

SEQ ID NO: 2112076 - DNA, 21 bp, Homo sapiens
ttggaaccgtgtccagcacag

SEQ ID NO: 2112077 - DNA, 22 bp, Homo sapiens
ttggaaccgtgtccagcacaga

SEQ ID NO: 2112078 - DNA, 17 bp, Homo sapiens
ttggaactgaagggggc

SEQ ID NO: 2112079 - DNA, 23 bp, Homo sapiens
ttggaagagaggcacctgctgga

SEQ ID NO: 2112080 - DNA, 22 bp, Homo sapiens
ttggaataataattttcctcct

SEQ ID NO: 2112081 - DNA, 23 bp, Homo sapiens
ttggaataataattttcctccta

SEQ ID NO: 2112082 - DNA, 15 bp, Homo sapiens
ttggaatataattgt

SEQ ID NO: 2112083 - DNA, 13 bp, Homo sapiens
ttggacacactgt

SEQ ID NO: 2112084 - DNA, 13 bp, Homo sapiens
ttggacctctgct

SEQ ID NO: 2112085 - DNA, 18 bp, Homo sapiens
ttggacctctgctctgag

SEQ ID NO: 2112086 - DNA, 13 bp, Homo sapiens
ttggactattata

SEQ ID NO: 2112087 - DNA, 13 bp, Homo sapiens
ttggactcctccc

SEQ ID NO: 2112088 - DNA, 14 bp, Homo sapiens
ttggactcctccca

SEQ ID NO: 2112089 - DNA, 15 bp, Homo sapiens
ttggactgacattta

SEQ ID NO: 2112090 - DNA, 13 bp, Homo sapiens
ttggacttgagga

SEQ ID NO: 2112091 - DNA, 20 bp, Homo sapiens
ttggagactctgtggggcct

SEQ ID NO: 2112092 - DNA, 15 bp, Homo sapiens
ttggagagacacagc

SEQ ID NO: 2112093 - DNA, 20 bp, Homo sapiens
ttggagagggacgaagaaag

SEQ ID NO: 2112094 - DNA, 21 bp, Homo sapiens
ttggagagggacgaagaaagg

SEQ ID NO: 2112095 - DNA, 17 bp, Homo sapiens
ttggagagtaaaaactg

SEQ ID NO: 2112096 - DNA, 20 bp, Homo sapiens
ttggagagtaaaaactgaat

SEQ ID NO: 2112097 - DNA, 11 bp, Homo sapiens
ttggagccact

SEQ ID NO: 2112098 - DNA, 22 bp, Homo sapiens
ttggagctgttccattgggtcc

SEQ ID NO: 2112099 - DNA, 13 bp, Homo sapiens
ttggaggacagtg

SEQ ID NO: 2112100 - DNA, 15 bp, Homo sapiens
ttggaggacagtggg

SEQ ID NO: 2112101 - DNA, 22 bp, Homo sapiens
ttggagggtgggagagcccagc

SEQ ID NO: 2112102 - DNA, 16 bp, Homo sapiens
ttggagggtgtcccaa

SEQ ID NO: 2112103 - DNA, 21 bp, Homo sapiens
ttggataaccttccttctaaa

SEQ ID NO: 2112104 - DNA, 22 bp, Homo sapiens
ttggatgggactagagctttct

SEQ ID NO: 2112105 - DNA, 21 bp, Homo sapiens
ttggatgggagtgagacagaa

SEQ ID NO: 2112106 - DNA, 18 bp, Homo sapiens
ttggattattcatttaaa

SEQ ID NO: 2112107 - DNA, 23 bp, Homo sapiens
ttggattattcatttaaaatgat

SEQ ID NO: 2112108 - DNA, 14 bp, Homo sapiens
ttggcaacagaagc

SEQ ID NO: 2112109 - DNA, 15 bp, Homo sapiens
ttggcacagaaacac

SEQ ID NO: 2112110 - DNA, 16 bp, Homo sapiens
ttggcacagaaacaca

SEQ ID NO: 2112111 - DNA, 13 bp, Homo sapiens
ttggcagagaagg

SEQ ID NO: 2112112 - DNA, 17 bp, Homo sapiens
ttggcagagaaggcctc

SEQ ID NO: 2112113 - DNA, 12 bp, Homo sapiens
ttggcagagagg

SEQ ID NO: 2112114 - DNA, 13 bp, Homo sapiens
ttggcagagagga

SEQ ID NO: 2112115 - DNA, 18 bp, Homo sapiens
ttggcagcccttgaactt

SEQ ID NO: 2112116 - DNA, 19 bp, Homo sapiens
ttggcagcttaacattgac

SEQ ID NO: 2112117 - DNA, 16 bp, Homo sapiens
ttggcagtgtgtcaca

SEQ ID NO: 2112118 - DNA, 21 bp, Homo sapiens
ttggcatcacagggcagagcc

SEQ ID NO: 2112119 - DNA, 19 bp, Homo sapiens
ttggcatggatttctgtct

SEQ ID NO: 2112120 - DNA, 15 bp, Homo sapiens
ttggcatttgtgtta

SEQ ID NO: 2112121 - DNA, 22 bp, Homo sapiens
ttggccaatgcacctaaagaaa

SEQ ID NO: 2112122 - DNA, 12 bp, Homo sapiens
ttggccactggg

SEQ ID NO: 2112123 - DNA, 19 bp, Homo sapiens
ttggccactgggtctcact

SEQ ID NO: 2112124 - DNA, 20 bp, Homo sapiens
ttggccactgggtctcactc

SEQ ID NO: 2112125 - DNA, 18 bp, Homo sapiens
ttggcccctgcccggctg

SEQ ID NO: 2112126 - DNA, 14 bp, Homo sapiens
ttggcccctgtgtg

SEQ ID NO: 2112127 - DNA, 22 bp, Homo sapiens
ttggccctctcccatgcacaca

SEQ ID NO: 2112128 - DNA, 22 bp, Homo sapiens
ttggccgtggccatcagggtgg

SEQ ID NO: 2112129 - DNA, 17 bp, Homo sapiens
ttggcctcgcctgggcc

SEQ ID NO: 2112130 - DNA, 18 bp, Homo sapiens
ttggcctcgcctgggccc

SEQ ID NO: 2112131 - DNA, 22 bp, Homo sapiens
ttggcgatgaggtaattctccc

SEQ ID NO: 2112132 - DNA, 23 bp, Homo sapiens
ttggctattagagatcaacccct

SEQ ID NO: 2112133 - DNA, 22 bp, Homo sapiens
ttggctcacccaagcaaggcca

SEQ ID NO: 2112134 - DNA, 12 bp, Homo sapiens
ttggctcaggca

SEQ ID NO: 2112135 - DNA, 13 bp, Homo sapiens
ttggctcaggcag

SEQ ID NO: 2112136 - DNA, 20 bp, Homo sapiens
ttggctcaggcagacaagag

SEQ ID NO: 2112137 - DNA, 11 bp, Homo sapiens
ttggctctttc

SEQ ID NO: 2112138 - DNA, 20 bp, Homo sapiens
ttggctggatgaaattttct

SEQ ID NO: 2112139 - DNA, 18 bp, Homo sapiens
ttggctgggggcctcagt

SEQ ID NO: 2112140 - DNA, 22 bp, Homo sapiens
ttggctgggggcctcagtgcca

SEQ ID NO: 2112141 - DNA, 13 bp, Homo sapiens
ttggcttattttt

SEQ ID NO: 2112142 - DNA, 18 bp, Homo sapiens
ttggcttctcctgtgacc

SEQ ID NO: 2112143 - DNA, 22 bp, Homo sapiens
ttggctttaaacacccttcaca

SEQ ID NO: 2112144 - DNA, 22 bp, Homo sapiens
ttggctttaaccgtttttcaag

SEQ ID NO: 2112145 - DNA, 20 bp, Homo sapiens
ttggcttttgcttggcagag

SEQ ID NO: 2112146 - DNA, 12 bp, Homo sapiens
ttgggagagtgc

SEQ ID NO: 2112147 - DNA, 15 bp, Homo sapiens
ttgggatatctcctg

SEQ ID NO: 2112148 - DNA, 13 bp, Homo sapiens
ttgggattaatat

SEQ ID NO: 2112149 - DNA, 19 bp, Homo sapiens
ttgggcagaagggagaagg

SEQ ID NO: 2112150 - DNA, 20 bp, Homo sapiens
ttgggcagaagggagaagga

SEQ ID NO: 2112151 - DNA, 21 bp, Homo sapiens
ttgggcatccacccagtgctg

SEQ ID NO: 2112152 - DNA, 17 bp, Homo sapiens
ttgggccactgcactct

SEQ ID NO: 2112153 - DNA, 13 bp, Homo sapiens
ttgggccctgcac

SEQ ID NO: 2112154 - DNA, 14 bp, Homo sapiens
ttgggccctgcaca

SEQ ID NO: 2112155 - DNA, 20 bp, Homo sapiens
tttgagaaagaaataattgt

SEQ ID NO: 2112156 - DNA, 23 bp, Homo sapiens
tttgagaatatgatcatgtaaat

SEQ ID NO: 2112157 - DNA, 15 bp, Homo sapiens
tttgagacaagccct

SEQ ID NO: 2112158 - DNA, 17 bp, Homo sapiens
tttgagacaagccctgg

SEQ ID NO: 2112159 - DNA, 16 bp, Homo sapiens
tttgagaccagcctgg

SEQ ID NO: 2112160 - DNA, 14 bp, Homo sapiens
tttgagcaattcat

SEQ ID NO: 2112161 - DNA, 16 bp, Homo sapiens
tttgagcaattcattt

SEQ ID NO: 2112162 - DNA, 14 bp, Homo sapiens
tttgaggattcctg

SEQ ID NO: 2112163 - DNA, 15 bp, Homo sapiens
tttgaggctgcagcg

SEQ ID NO: 2112164 - DNA, 21 bp, Homo sapiens
tttgagtggatggaggagaaa

SEQ ID NO: 2112165 - DNA, 19 bp, Homo sapiens
tttgatacatatgtgaata

SEQ ID NO: 2112166 - DNA, 13 bp, Homo sapiens
tttgatcaaatct

SEQ ID NO: 2112167 - DNA, 15 bp, Homo sapiens
tttgatccaagctgg

SEQ ID NO: 2112168 - DNA, 17 bp, Homo sapiens
tttgatggggagaaagg

SEQ ID NO: 2112169 - DNA, 21 bp, Homo sapiens
tttgatggtaagactgtaatt

SEQ ID NO: 2112170 - DNA, 12 bp, Homo sapiens
tttgatgtacat

SEQ ID NO: 2112171 - DNA, 16 bp, Homo sapiens
tttgatgtcagccttg

SEQ ID NO: 2112172 - DNA, 13 bp, Homo sapiens
tttgatttctatt

SEQ ID NO: 2112173 - DNA, 22 bp, Homo sapiens
tttgcaacaagacaaagcaaag

SEQ ID NO: 2112174 - DNA, 12 bp, Homo sapiens
tttgcaaggaag

SEQ ID NO: 2112175 - DNA, 22 bp, Homo sapiens
tttgcaatgccctaattagggc

SEQ ID NO: 2112176 - DNA, 16 bp, Homo sapiens
tttgcacagctctccg

SEQ ID NO: 2112177 - DNA, 18 bp, Homo sapiens
tttgcacccatgccatag

SEQ ID NO: 2112178 - DNA, 20 bp, Homo sapiens
tttgcacctttctagttgaa

SEQ ID NO: 2112179 - DNA, 12 bp, Homo sapiens
tttgcactgagg

SEQ ID NO: 2112180 - DNA, 14 bp, Homo sapiens
tttgcactgagggc

SEQ ID NO: 2112181 - DNA, 19 bp, Homo sapiens
tttgcagaaaagcacctgc

SEQ ID NO: 2112182 - DNA, 20 bp, Homo sapiens
tttgcagaaaagcacctgcc

SEQ ID NO: 2112183 - DNA, 22 bp, Homo sapiens
tttgcagaaaagcacctgccga

SEQ ID NO: 2112184 - DNA, 18 bp, Homo sapiens
tttgcagtatatttctga

SEQ ID NO: 2112185 - DNA, 21 bp, Homo sapiens
tttgcatggaatttgtaagtt

SEQ ID NO: 2112186 - DNA, 10 bp, Homo sapiens
tttgccagca

SEQ ID NO: 2112187 - DNA, 15 bp, Homo sapiens
tttgccattcctgga

SEQ ID NO: 2112188 - DNA, 23 bp, Homo sapiens
tttgccccaaggctgctcagagg

SEQ ID NO: 2112189 - DNA, 13 bp, Homo sapiens
tttgcctgtaaca

SEQ ID NO: 2112190 - DNA, 14 bp, Homo sapiens
tttgcctgtaacaa

SEQ ID NO: 2112191 - DNA, 21 bp, Homo sapiens
tttgcctgtaacaagccagat

SEQ ID NO: 2112192 - DNA, 21 bp, Homo sapiens
tttgcttaaaattttactttt

SEQ ID NO: 2112193 - DNA, 15 bp, Homo sapiens
tttgcttggcagaga

SEQ ID NO: 2112194 - DNA, 11 bp, Homo sapiens
tttggaaaaat

SEQ ID NO: 2112195 - DNA, 12 bp, Homo sapiens
tttggaaaaatc

SEQ ID NO: 2112196 - DNA, 21 bp, Homo sapiens
tttggagtcagtaggtccaag

SEQ ID NO: 2112197 - DNA, 15 bp, Homo sapiens
tttggatatgtaaaa

SEQ ID NO: 2112198 - DNA, 19 bp, Homo sapiens
tttggatgggagtgagaca

SEQ ID NO: 2112199 - DNA, 22 bp, Homo sapiens
tttggcaacacctccttgcttt

SEQ ID NO: 2112200 - DNA, 19 bp, Homo sapiens
tttggcaatttttttatac

SEQ ID NO: 2112201 - DNA, 14 bp, Homo sapiens
tttgggaggccaag

SEQ ID NO: 2112202 - DNA, 17 bp, Homo sapiens
tttgggaggccaaggca

SEQ ID NO: 2112203 - DNA, 18 bp, Homo sapiens
tttgggccactgcactct

SEQ ID NO: 2112204 - DNA, 14 bp, Homo sapiens
tttgggctgccctg

SEQ ID NO: 2112205 - DNA, 20 bp, Homo sapiens
tttggggagggggaagagaa

SEQ ID NO: 2112206 - DNA, 22 bp, Homo sapiens
tttggggagggggaagagaaat

SEQ ID NO: 2112207 - DNA, 14 bp, Homo sapiens
tttggggctgcgaa

SEQ ID NO: 2112208 - DNA, 17 bp, Homo sapiens
tttgggggttggatggg

SEQ ID NO: 2112209 - DNA, 21 bp, Homo sapiens
tttggggtacccactgctctg

SEQ ID NO: 2112210 - DNA, 13 bp, Homo sapiens
tttggtatattac

SEQ ID NO: 2112211 - DNA, 14 bp, Homo sapiens
tttggtgcagaggt

SEQ ID NO: 2112212 - DNA, 21 bp, Homo sapiens
tttggtgcagaggtttcttga

SEQ ID NO: 2112213 - DNA, 18 bp, Homo sapiens
tttggtgtggctgtattc

SEQ ID NO: 2112214 - DNA, 19 bp, Homo sapiens
tttggtgtgtggagatgca

SEQ ID NO: 2112215 - DNA, 17 bp, Homo sapiens
tttggttctctccagga

SEQ ID NO: 2112216 - DNA, 20 bp, Homo sapiens
tttggttgtaaatgctcgtg

SEQ ID NO: 2112217 - DNA, 21 bp, Homo sapiens
tttggtttcccaagagctacg

SEQ ID NO: 2112218 - DNA, 15 bp, Homo sapiens
tttggtttttatatt

SEQ ID NO: 2112219 - DNA, 17 bp, Homo sapiens
tttgtaaactcaaaata

SEQ ID NO: 2112220 - DNA, 14 bp, Homo sapiens
tttgtaacttcaaa

SEQ ID NO: 2112221 - DNA, 13 bp, Homo sapiens
tttgtaataaact

SEQ ID NO: 2112222 - DNA, 18 bp, Homo sapiens
tttgtaatcgttatgtgt

SEQ ID NO: 2112223 - DNA, 21 bp, Homo sapiens
tttgtacaattgaacttaaat

SEQ ID NO: 2112224 - DNA, 18 bp, Homo sapiens
tttgtacagacgtatgct

SEQ ID NO: 2112225 - DNA, 19 bp, Homo sapiens
tttgtacatatgtaaaata

SEQ ID NO: 2112226 - DNA, 23 bp, Homo sapiens
tttgtacattcctgatactgggt

SEQ ID NO: 2112227 - DNA, 15 bp, Homo sapiens
tttgtaccagtgtga

SEQ ID NO: 2112228 - DNA, 15 bp, Homo sapiens
tgtaggtcaatgaaa

SEQ ID NO: 2112229 - DNA, 20 bp, Homo sapiens
tgtaggtgtctgcacccagg

SEQ ID NO: 2112230 - DNA, 11 bp, Homo sapiens
tgtaggttgct

SEQ ID NO: 2112231 - DNA, 18 bp, Homo sapiens
tgtagtagccctttctgt

SEQ ID NO: 2112232 - DNA, 15 bp, Homo sapiens
tgtagtagttgatga

SEQ ID NO: 2112233 - DNA, 16 bp, Homo sapiens
tgtagtgagaaactga

SEQ ID NO: 2112234 - DNA, 13 bp, Homo sapiens
tgtagtggaagag

SEQ ID NO: 2112235 - DNA, 20 bp, Homo sapiens
tgtagtggaagagcagcctg

SEQ ID NO: 2112236 - DNA, 18 bp, Homo sapiens
tgtagttaaagggcagaa

SEQ ID NO: 2112237 - DNA, 13 bp, Homo sapiens
tgtagttaggaaa

SEQ ID NO: 2112238 - DNA, 13 bp, Homo sapiens
tgtataaataata

SEQ ID NO: 2112239 - DNA, 21 bp, Homo sapiens
tgtataaatctttcttttgat

SEQ ID NO: 2112240 - DNA, 11 bp, Homo sapiens
tgtataaatgt

SEQ ID NO: 2112241 - DNA, 15 bp, Homo sapiens
tgtataaatgtatat

SEQ ID NO: 2112242 - DNA, 20 bp, Homo sapiens
tgtataagtgcacacagaaa

SEQ ID NO: 2112243 - DNA, 14 bp, Homo sapiens
tgtataatctattt

SEQ ID NO: 2112244 - DNA, 17 bp, Homo sapiens
tgtataatttaacagtg

SEQ ID NO: 2112245 - DNA, 23 bp, Homo sapiens
tgtataatttaacagtgcccttt

SEQ ID NO: 2112246 - DNA, 14 bp, Homo sapiens
tgtatacacacata

SEQ ID NO: 2112247 - DNA, 19 bp, Homo sapiens
tgtatagatgcaagatatt

SEQ ID NO: 2112248 - DNA, 21 bp, Homo sapiens
tgtatagcaccaaaaaatgga

SEQ ID NO: 2112249 - DNA, 21 bp, Homo sapiens
tgtatagtactggcatggtac

SEQ ID NO: 2112250 - DNA, 19 bp, Homo sapiens
tgtatagtgagtgtggctt

SEQ ID NO: 2112251 - DNA, 20 bp, Homo sapiens
tgtatagtgagtgtggctta

SEQ ID NO: 2112252 - DNA, 18 bp, Homo sapiens
tgtatataatactaaagt

SEQ ID NO: 2112253 - DNA, 15 bp, Homo sapiens
tgtatatacaataac

SEQ ID NO: 2112254 - DNA, 16 bp, Homo sapiens
tgtatatacacatata

SEQ ID NO: 2112255 - DNA, 20 bp, Homo sapiens
tgtatatacatattataaat

SEQ ID NO: 2112256 - DNA, 21 bp, Homo sapiens
tgtatatacatattataaata

SEQ ID NO: 2112257 - DNA, 21 bp, Homo sapiens
tgtatatactatacaacaatg

SEQ ID NO: 2112258 - DNA, 15 bp, Homo sapiens
tgtatatagatgtgc

SEQ ID NO: 2112259 - DNA, 18 bp, Homo sapiens
tgtatatagatgtgcaag

SEQ ID NO: 2112260 - DNA, 13 bp, Homo sapiens
tgtatatagtttg

SEQ ID NO: 2112261 - DNA, 15 bp, Homo sapiens
tgtatatatatatgt

SEQ ID NO: 2112262 - DNA, 18 bp, Homo sapiens
tgtatatatatatgtgtg

SEQ ID NO: 2112263 - DNA, 20 bp, Homo sapiens
tgtatatatatatgtgtgtg

SEQ ID NO: 2112264 - DNA, 14 bp, Homo sapiens
tgtatatatgtgta

SEQ ID NO: 2112265 - DNA, 16 bp, Homo sapiens
tgtatatgttgtaata

SEQ ID NO: 2112266 - DNA, 19 bp, Homo sapiens
tgtatattatggtgtaatg

SEQ ID NO: 2112267 - DNA, 15 bp, Homo sapiens
tgtatattccaccat

SEQ ID NO: 2112268 - DNA, 14 bp, Homo sapiens
tgtatattctggaa

SEQ ID NO: 2112269 - DNA, 16 bp, Homo sapiens
tgtatattctggaaaa

SEQ ID NO: 2112270 - DNA, 16 bp, Homo sapiens
tgtatattgaaaagat

SEQ ID NO: 2112271 - DNA, 21 bp, Homo sapiens
tgtatcaaatctgtatatgtt

SEQ ID NO: 2112272 - DNA, 17 bp, Homo sapiens
tgtatcatttgaacaac

SEQ ID NO: 2112273 - DNA, 14 bp, Homo sapiens
tgtatccagtgatg

SEQ ID NO: 2112274 - DNA, 18 bp, Homo sapiens
tgtatccagtgatgtgct

SEQ ID NO: 2112275 - DNA, 16 bp, Homo sapiens
tgtatcccatgagcct

SEQ ID NO: 2112276 - DNA, 19 bp, Homo sapiens
tgtatcccatgagcctcag

SEQ ID NO: 2112277 - DNA, 23 bp, Homo sapiens
tgtatcccatgagcctcagcatc

SEQ ID NO: 2112278 - DNA, 20 bp, Homo sapiens
tgtatcccccccctgtatag

SEQ ID NO: 2112279 - DNA, 17 bp, Homo sapiens
tgtatcggagacagtga

SEQ ID NO: 2112280 - DNA, 18 bp, Homo sapiens
tgtatctctgaagcatgt

SEQ ID NO: 2112281 - DNA, 21 bp, Homo sapiens
tgtatctctgaagcatgtttc

SEQ ID NO: 2112282 - DNA, 23 bp, Homo sapiens
tgtatctctgaagcatgtttcat

SEQ ID NO: 2112283 - DNA, 18 bp, Homo sapiens
tgtatctgaaggagattt

SEQ ID NO: 2112284 - DNA, 13 bp, Homo sapiens
tgtatcttattta

SEQ ID NO: 2112285 - DNA, 13 bp, Homo sapiens
tgtatgatgtgtt

SEQ ID NO: 2112286 - DNA, 18 bp, Homo sapiens
tgtatggaaataaatgta

SEQ ID NO: 2112287 - DNA, 18 bp, Homo sapiens
tgtatggaatacagtgtt

SEQ ID NO: 2112288 - DNA, 23 bp, Homo sapiens
tgtatgtaagtaattgcatttct

SEQ ID NO: 2112289 - DNA, 11 bp, Homo sapiens
tgtatgtatac

SEQ ID NO: 2112290 - DNA, 14 bp, Homo sapiens
tgtatgtatgtgtg

SEQ ID NO: 2112291 - DNA, 21 bp, Homo sapiens
tgtatgtcagacatccatgtt

SEQ ID NO: 2112292 - DNA, 14 bp, Homo sapiens
tgtatgtcttggac

SEQ ID NO: 2112293 - DNA, 19 bp, Homo sapiens
tgtatgtcttggacactgt

SEQ ID NO: 2112294 - DNA, 23 bp, Homo sapiens
tgtatgtgaaagtgtaaaataga

SEQ ID NO: 2112295 - DNA, 18 bp, Homo sapiens
tgtatgtgcacatgtgtc

SEQ ID NO: 2112296 - DNA, 12 bp, Homo sapiens
tgtatgtgtatt

SEQ ID NO: 2112297 - DNA, 13 bp, Homo sapiens
tgtatgtttacat

SEQ ID NO: 2112298 - DNA, 17 bp, Homo sapiens
tgtattaagccaaacat

SEQ ID NO: 2112299 - DNA, 19 bp, Homo sapiens
tgtattcagatcgtattaa

SEQ ID NO: 2112300 - DNA, 17 bp, Homo sapiens
tgtatttatatgttaat

SEQ ID NO: 2112301 - DNA, 13 bp, Homo sapiens
tgtatttattgtc

SEQ ID NO: 2112302 - DNA, 15 bp, Homo sapiens
tgtatttgtattccc

SEQ ID NO: 2112303 - DNA, 20 bp, Homo sapiens
tgtatttgttaatggtttga

SEQ ID NO: 2112304 - DNA, 12 bp, Homo sapiens
tgtattttccat

SEQ ID NO: 2112305 - DNA, 14 bp, Homo sapiens
tgtattttccatac

SEQ ID NO: 2112306 - DNA, 14 bp, Homo sapiens
tgtatttttagaga

SEQ ID NO: 2112307 - DNA, 23 bp, Homo sapiens
tgtcaaaatcatgaatatttcaa

SEQ ID NO: 2112308 - DNA, 13 bp, Homo sapiens
tgtcaaacaaata

SEQ ID NO: 2112309 - DNA, 19 bp, Homo sapiens
tgtcaagagggtctgagga

SEQ ID NO: 2112310 - DNA, 15 bp, Homo sapiens
tgtcaagattgcaaa

SEQ ID NO: 2112311 - DNA, 23 bp, Homo sapiens
tgtcaatacccctgttaagcaat

SEQ ID NO: 2112312 - DNA, 14 bp, Homo sapiens
tgtcaatattaaat

SEQ ID NO: 2112313 - DNA, 19 bp, Homo sapiens
tgtcaatattaaatacaga

SEQ ID NO: 2112314 - DNA, 15 bp, Homo sapiens
tgtcaatttgtatat

SEQ ID NO: 2112315 - DNA, 17 bp, Homo sapiens
tgtcaatttgtatatca

SEQ ID NO: 2112316 - DNA, 22 bp, Homo sapiens
tgtcaatttgtatatcatgaaa

SEQ ID NO: 2112317 - DNA, 14 bp, Homo sapiens
tgtcacaatcctaa

SEQ ID NO: 2112318 - DNA, 21 bp, Homo sapiens
tgtcacaatcctaacacatta

SEQ ID NO: 2112319 - DNA, 16 bp, Homo sapiens
tgtcacacaaggctgg

SEQ ID NO: 2112320 - DNA, 15 bp, Homo sapiens
tgtcacacagggcag

SEQ ID NO: 2112321 - DNA, 20 bp, Homo sapiens
tgtcacactgagctgggcac

SEQ ID NO: 2112322 - DNA, 17 bp, Homo sapiens
tgtcacacttgtttctt

SEQ ID NO: 2112323 - DNA, 13 bp, Homo sapiens
tgtcacaggcagg

SEQ ID NO: 2112324 - DNA, 16 bp, Homo sapiens
tgtcacaggcaggtcc

SEQ ID NO: 2112325 - DNA, 12 bp, Homo sapiens
tgtcacagttct

SEQ ID NO: 2112326 - DNA, 16 bp, Homo sapiens
tgtcaccaccttccca

SEQ ID NO: 2112327 - DNA, 19 bp, Homo sapiens
tgtcaccaccttcccagct

SEQ ID NO: 2112328 - DNA, 14 bp, Homo sapiens
tgtcaccctggccc

SEQ ID NO: 2112329 - DNA, 15 bp, Homo sapiens
tgtcaccctggcccc

SEQ ID NO: 2112330 - DNA, 20 bp, Homo sapiens
tgtcaccgtggaccttcctg

SEQ ID NO: 2112331 - DNA, 22 bp, Homo sapiens
tgtcaccgtggaccttcctgcc

SEQ ID NO: 2112332 - DNA, 22 bp, Homo sapiens
tgtcacgtgaaatatttaagta

SEQ ID NO: 2112333 - DNA, 23 bp, Homo sapiens
tgtcacgtggtcaaggcccggcc

SEQ ID NO: 2112334 - DNA, 16 bp, Homo sapiens
tgtcactactcacagt

SEQ ID NO: 2112335 - DNA, 17 bp, Homo sapiens
tgtcactagcagctgca

SEQ ID NO: 2112336 - DNA, 23 bp, Homo sapiens
tgtcactatgctatttctggcct

SEQ ID NO: 2112337 - DNA, 21 bp, Homo sapiens
tgtcactcccagaccacctcc

SEQ ID NO: 2112338 - DNA, 20 bp, Homo sapiens
tgtcacttagggataacact

SEQ ID NO: 2112339 - DNA, 22 bp, Homo sapiens
tgtcactttttaaaccactgta

SEQ ID NO: 2112340 - DNA, 17 bp, Homo sapiens
tgtcagaatttctttgt

SEQ ID NO: 2112341 - DNA, 18 bp, Homo sapiens
tgtcagaatttctttgtc

SEQ ID NO: 2112342 - DNA, 18 bp, Homo sapiens
tgtcagacatgaaaacta

SEQ ID NO: 2112343 - DNA, 23 bp, Homo sapiens
tgtcagactttaaagaataatat

SEQ ID NO: 2112344 - DNA, 16 bp, Homo sapiens
tgtcagagccaggctc

SEQ ID NO: 2112345 - DNA, 17 bp, Homo sapiens
tggtgatcaattaaatg

SEQ ID NO: 2112346 - DNA, 17 bp, Homo sapiens
tggtgcaggatggcttt

SEQ ID NO: 2112347 - DNA, 11 bp, Homo sapiens
tggtgcctgcc

SEQ ID NO: 2112348 - DNA, 19 bp, Homo sapiens
tggtgcctggcctggcaca

SEQ ID NO: 2112349 - DNA, 13 bp, Homo sapiens
tggtgctgccaca

SEQ ID NO: 2112350 - DNA, 20 bp, Homo sapiens
tggtgctgtggccagggtga

SEQ ID NO: 2112351 - DNA, 16 bp, Homo sapiens
tggtggacagtcctgg

SEQ ID NO: 2112352 - DNA, 18 bp, Homo sapiens
tggtggacagtcctggga

SEQ ID NO: 2112353 - DNA, 12 bp, Homo sapiens
tggtggcagctg

SEQ ID NO: 2112354 - DNA, 15 bp, Homo sapiens
tggtggcagctgcgg

SEQ ID NO: 2112355 - DNA, 12 bp, Homo sapiens
tggtggcagtgg

SEQ ID NO: 2112356 - DNA, 13 bp, Homo sapiens
tggtggcagtggg

SEQ ID NO: 2112357 - DNA, 19 bp, Homo sapiens
tggtggcccgacagcctgg

SEQ ID NO: 2112358 - DNA, 14 bp, Homo sapiens
tggtggctcatggc

SEQ ID NO: 2112359 - DNA, 18 bp, Homo sapiens
tggtgggaaccctcccca

SEQ ID NO: 2112360 - DNA, 15 bp, Homo sapiens
tggtgggctggccca

SEQ ID NO: 2112361 - DNA, 19 bp, Homo sapiens
tggtgtaatgcacaattta

SEQ ID NO: 2112362 - DNA, 22 bp, Homo sapiens
tggtgtaatgcacaatttagaa

SEQ ID NO: 2112363 - DNA, 16 bp, Homo sapiens
tggtgtcacctgaaga

SEQ ID NO: 2112364 - DNA, 18 bp, Homo sapiens
tggtgtccacctggcccc

SEQ ID NO: 2112365 - DNA, 19 bp, Homo sapiens
tggtgtgaggctgggccag

SEQ ID NO: 2112366 - DNA, 13 bp, Homo sapiens
tggttagaaaagt

SEQ ID NO: 2112367 - DNA, 13 bp, Homo sapiens
tggttagaaatgc

SEQ ID NO: 2112368 - DNA, 14 bp, Homo sapiens
tggttagaaatgca

SEQ ID NO: 2112369 - DNA, 20 bp, Homo sapiens
tggttcagggttggcccctg

SEQ ID NO: 2112370 - DNA, 13 bp, Homo sapiens
tggttccatgcct

SEQ ID NO: 2112371 - DNA, 16 bp, Homo sapiens
tggttcccattgtgac

SEQ ID NO: 2112372 - DNA, 20 bp, Homo sapiens
tggttcccctgttcactcta

SEQ ID NO: 2112373 - DNA, 16 bp, Homo sapiens
tggttctcaattgtat

SEQ ID NO: 2112374 - DNA, 17 bp, Homo sapiens
tggttctgaaagtggct

SEQ ID NO: 2112375 - DNA, 20 bp, Homo sapiens
tggttgaactatgctgaaga

SEQ ID NO: 2112376 - DNA, 23 bp, Homo sapiens
tggttgacccaaaaatgttccct

SEQ ID NO: 2112377 - DNA, 14 bp, Homo sapiens
tggttgatgccaaa

SEQ ID NO: 2112378 - DNA, 18 bp, Homo sapiens
tggttgcttaactggctg

SEQ ID NO: 2112379 - DNA, 12 bp, Homo sapiens
tggttgcttcag

SEQ ID NO: 2112380 - DNA, 21 bp, Homo sapiens
tggttggccgtggtccagctc

SEQ ID NO: 2112381 - DNA, 17 bp, Homo sapiens
tggttggggtggggcag

SEQ ID NO: 2112382 - DNA, 15 bp, Homo sapiens
tggttgtcaatatta

SEQ ID NO: 2112383 - DNA, 17 bp, Homo sapiens
tggttgtcaatattaaa

SEQ ID NO: 2112384 - DNA, 12 bp, Homo sapiens
tggttgttgcca

SEQ ID NO: 2112385 - DNA, 15 bp, Homo sapiens
tggttgttgccaact

SEQ ID NO: 2112386 - DNA, 16 bp, Homo sapiens
tggtttactgctgtca

SEQ ID NO: 2112387 - DNA, 19 bp, Homo sapiens
tggtttagtgttctgtatt

SEQ ID NO: 2112388 - DNA, 21 bp, Homo sapiens
tggtttatagagggccaagac

SEQ ID NO: 2112389 - DNA, 20 bp, Homo sapiens
tggtttccacgatgaaaaac

SEQ ID NO: 2112390 - DNA, 21 bp, Homo sapiens
tggtttccacgatgaaaaact

SEQ ID NO: 2112391 - DNA, 19 bp, Homo sapiens
tggtttcctcattcctgaa

SEQ ID NO: 2112392 - DNA, 16 bp, Homo sapiens
tggtttctagacttgt

SEQ ID NO: 2112393 - DNA, 18 bp, Homo sapiens
tggtttctcagaatccaa

SEQ ID NO: 2112394 - DNA, 16 bp, Homo sapiens
tggtttggggagaaat

SEQ ID NO: 2112395 - DNA, 12 bp, Homo sapiens
tggttttaacaa

SEQ ID NO: 2112396 - DNA, 18 bp, Homo sapiens
tggttttaacaatttcct

SEQ ID NO: 2112397 - DNA, 23 bp, Homo sapiens
tggttttcagattccacacaaaa

SEQ ID NO: 2112398 - DNA, 13 bp, Homo sapiens
tgtaaaaacaaaa

SEQ ID NO: 2112399 - DNA, 22 bp, Homo sapiens
tgtaaaaagagagaaaacttat

SEQ ID NO: 2112400 - DNA, 19 bp, Homo sapiens
tgtaaaacatttattttga

SEQ ID NO: 2112401 - DNA, 22 bp, Homo sapiens
tgtaaaacgagaatccacccat

SEQ ID NO: 2112402 - DNA, 22 bp, Homo sapiens
tgtaaaagtactctgaaaagca

SEQ ID NO: 2112403 - DNA, 12 bp, Homo sapiens
tgtaaaatagct

SEQ ID NO: 2112404 - DNA, 20 bp, Homo sapiens
tgtaaaatagcttgtatagt

SEQ ID NO: 2112405 - DNA, 17 bp, Homo sapiens
tgtaaaatatctacctg

SEQ ID NO: 2112406 - DNA, 14 bp, Homo sapiens
tgtaaaatgaaatt

SEQ ID NO: 2112407 - DNA, 19 bp, Homo sapiens
tgtaaaatgcagtccagaa

SEQ ID NO: 2112408 - DNA, 21 bp, Homo sapiens
tgtaaaatgcagtccagaata

SEQ ID NO: 2112409 - DNA, 22 bp, Homo sapiens
tgtaaaatgcagtccagaataa

SEQ ID NO: 2112410 - DNA, 14 bp, Homo sapiens
tgtaaacagaagga

SEQ ID NO: 2112411 - DNA, 15 bp, Homo sapiens
tgtaaacagaaggag

SEQ ID NO: 2112412 - DNA, 16 bp, Homo sapiens
tgtaaacagaaggaga

SEQ ID NO: 2112413 - DNA, 14 bp, Homo sapiens
tgtaaacagtgcct

SEQ ID NO: 2112414 - DNA, 19 bp, Homo sapiens
tgtaaacagtgcctgctga

SEQ ID NO: 2112415 - DNA, 22 bp, Homo sapiens
tgtaaaccatcgcgtgcaatga

SEQ ID NO: 2112416 - DNA, 13 bp, Homo sapiens
tgtaaactataaa

SEQ ID NO: 2112417 - DNA, 21 bp, Homo sapiens
tgtaaactataaactactgta

SEQ ID NO: 2112418 - DNA, 21 bp, Homo sapiens
tgtaaactcaaaacttaacat

SEQ ID NO: 2112419 - DNA, 15 bp, Homo sapiens
tgtaaactcaaaata

SEQ ID NO: 2112420 - DNA, 20 bp, Homo sapiens
tgtaaagaataaatgaatct

SEQ ID NO: 2112421 - DNA, 19 bp, Homo sapiens
tgtaaagagtggagcaaat

SEQ ID NO: 2112422 - DNA, 13 bp, Homo sapiens
tgtaaaggtcaga

SEQ ID NO: 2112423 - DNA, 15 bp, Homo sapiens
tgtaaatagctcagg

SEQ ID NO: 2112424 - DNA, 19 bp, Homo sapiens
tgtaaatagttttaaatat

SEQ ID NO: 2112425 - DNA, 23 bp, Homo sapiens
tgtaaatagttttaaatatgaac

SEQ ID NO: 2112426 - DNA, 15 bp, Homo sapiens
tgtaaatattgtgtg

SEQ ID NO: 2112427 - DNA, 12 bp, Homo sapiens
tgtaaatattta

SEQ ID NO: 2112428 - DNA, 18 bp, Homo sapiens
tgtaaatattttaaagaa

SEQ ID NO: 2112429 - DNA, 11 bp, Homo sapiens
tgtaaatcact

SEQ ID NO: 2112430 - DNA, 12 bp, Homo sapiens
tgtaaatcactt

SEQ ID NO: 2112431 - DNA, 13 bp, Homo sapiens
tgtaaatcacttg

SEQ ID NO: 2112432 - DNA, 14 bp, Homo sapiens
tgtaaatcacttgt

SEQ ID NO: 2112433 - DNA, 15 bp, Homo sapiens
tgtaaatcacttgta

SEQ ID NO: 2112434 - DNA, 16 bp, Homo sapiens
tgtaaatcacttgtaa

SEQ ID NO: 2112435 - DNA, 18 bp, Homo sapiens
tgtaaatcacttgtaaat

SEQ ID NO: 2112436 - DNA, 19 bp, Homo sapiens
tgtaaattatttcatacaa

SEQ ID NO: 2112437 - DNA, 21 bp, Homo sapiens
tgtaaattttagagcatacca

SEQ ID NO: 2112438 - DNA, 18 bp, Homo sapiens
tgtaacaagccagatttt

SEQ ID NO: 2112439 - DNA, 20 bp, Homo sapiens
tgtaacactgcaagaagtct

SEQ ID NO: 2112440 - DNA, 22 bp, Homo sapiens
tgtaacaggtctcctcttaaaa

SEQ ID NO: 2112441 - DNA, 19 bp, Homo sapiens
tgtaacattaattctacta

SEQ ID NO: 2112442 - DNA, 20 bp, Homo sapiens
tgtaacattaattctactaa

SEQ ID NO: 2112443 - DNA, 14 bp, Homo sapiens
tgtaacgcctgctt

SEQ ID NO: 2112444 - DNA, 18 bp, Homo sapiens
tgtaactatatcatcctt

SEQ ID NO: 2112445 - DNA, 14 bp, Homo sapiens
tgtaactattgaat

SEQ ID NO: 2112446 - DNA, 13 bp, Homo sapiens
tgtaactcagaca

SEQ ID NO: 2112447 - DNA, 13 bp, Homo sapiens
tgtaactccacca

SEQ ID NO: 2112448 - DNA, 19 bp, Homo sapiens
tgtaactgctgagccactc

SEQ ID NO: 2112449 - DNA, 16 bp, Homo sapiens
tgtaacttttgtaaga

SEQ ID NO: 2112450 - DNA, 21 bp, Homo sapiens
tgtaagacaaaggttttcctc

SEQ ID NO: 2112451 - DNA, 19 bp, Homo sapiens
tgtaagcaacttgcttcta

SEQ ID NO: 2112452 - DNA, 20 bp, Homo sapiens
tgtaagcattctgagctggg

SEQ ID NO: 2112453 - DNA, 15 bp, Homo sapiens
tgtaaggaactggaa

SEQ ID NO: 2112454 - DNA, 16 bp, Homo sapiens
tgtaagggtctgttgt

SEQ ID NO: 2112455 - DNA, 18 bp, Homo sapiens
tgtaagggtctgttgtaa

SEQ ID NO: 2112456 - DNA, 22 bp, Homo sapiens
tgtaaggtaatttctgtgtatt

SEQ ID NO: 2112457 - DNA, 14 bp, Homo sapiens
tgtaaggtcttctt

SEQ ID NO: 2112458 - DNA, 14 bp, Homo sapiens
tgtaagtaattatc

SEQ ID NO: 2112459 - DNA, 15 bp, Homo sapiens
tgtaagttgtgtgca

SEQ ID NO: 2112460 - DNA, 19 bp, Homo sapiens
tgtaagtttatgtctaaag

SEQ ID NO: 2112461 - DNA, 21 bp, Homo sapiens
tgtaataaaaatttgtttaaa

SEQ ID NO: 2112462 - DNA, 21 bp, Homo sapiens
tgtaataaaacttatgctagt

SEQ ID NO: 2112463 - DNA, 12 bp, Homo sapiens
tgtaataaaagg

SEQ ID NO: 2112464 - DNA, 13 bp, Homo sapiens
tgtaataaactct

SEQ ID NO: 2112465 - DNA, 15 bp, Homo sapiens
tgtaataaactctct

SEQ ID NO: 2112466 - DNA, 14 bp, Homo sapiens
tgtaataagaaagt

SEQ ID NO: 2112467 - DNA, 18 bp, Homo sapiens
tgtaatagaaaactgaaa

SEQ ID NO: 2112468 - DNA, 20 bp, Homo sapiens
tgtaatagaaaactgaaaat

SEQ ID NO: 2112469 - DNA, 14 bp, Homo sapiens
tgtaatcaatgttt

SEQ ID NO: 2112470 - DNA, 14 bp, Homo sapiens
tgtaatcagtttta

SEQ ID NO: 2112471 - DNA, 15 bp, Homo sapiens
tgtaatcccagctac

SEQ ID NO: 2112472 - DNA, 20 bp, Homo sapiens
tgtaatcccagctactcagg

SEQ ID NO: 2112473 - DNA, 20 bp, Homo sapiens
tgtaatcccagctactcggg

SEQ ID NO: 2112474 - DNA, 19 bp, Homo sapiens
tgtaatcgttatgtgtgta

SEQ ID NO: 2112475 - DNA, 21 bp, Homo sapiens
tgtaatcgttatgtgtgtata

SEQ ID NO: 2112476 - DNA, 12 bp, Homo sapiens
tgtaatcttaaa

SEQ ID NO: 2112477 - DNA, 14 bp, Homo sapiens
tgtaatcttaaaag

SEQ ID NO: 2112478 - DNA, 18 bp, Homo sapiens
tgtaatcttaaaagtgta

SEQ ID NO: 2112479 - DNA, 17 bp, Homo sapiens
tgtaatgaatatctgct

SEQ ID NO: 2112480 - DNA, 17 bp, Homo sapiens
tgtaatgagaacttcaa

SEQ ID NO: 2112481 - DNA, 17 bp, Homo sapiens
tgtaatgcacaatttag

SEQ ID NO: 2112482 - DNA, 20 bp, Homo sapiens
tgtaatgcacaatttagaaa

SEQ ID NO: 2112483 - DNA, 21 bp, Homo sapiens
tgtaatgtatcttatttatat

SEQ ID NO: 2112484 - DNA, 16 bp, Homo sapiens
tgtaatgtcaccacct

SEQ ID NO: 2112485 - DNA, 19 bp, Homo sapiens
tgtaatgtcaccaccttcc

SEQ ID NO: 2112486 - DNA, 20 bp, Homo sapiens
tgtaatgtcaccaccttccc

SEQ ID NO: 2112487 - DNA, 23 bp, Homo sapiens
tgtaatgtcaccaccttcccagc

SEQ ID NO: 2112488 - DNA, 16 bp, Homo sapiens
tgtaattaagtgcaat

SEQ ID NO: 2112489 - DNA, 20 bp, Homo sapiens
tgtaattaagtgcaatttcc

SEQ ID NO: 2112490 - DNA, 16 bp, Homo sapiens
tgtaattaatatcttg

SEQ ID NO: 2112491 - DNA, 14 bp, Homo sapiens
tgtaattaatattc

SEQ ID NO: 2112492 - DNA, 16 bp, Homo sapiens
tgtaattggtgacaat

SEQ ID NO: 2112493 - DNA, 17 bp, Homo sapiens
tgtaattggtgacaatg

SEQ ID NO: 2112494 - DNA, 15 bp, Homo sapiens
tgtaattttgtagta

SEQ ID NO: 2112495 - DNA, 17 bp, Homo sapiens
tgtaattttgtagtagt

SEQ ID NO: 2112496 - DNA, 18 bp, Homo sapiens
tgtaattttgtttgtaat

SEQ ID NO: 2112497 - DNA, 19 bp, Homo sapiens
tgtaattttgtttgtaatc

SEQ ID NO: 2112498 - DNA, 18 bp, Homo sapiens
tgtacaaaaacaaaacaa

SEQ ID NO: 2112499 - DNA, 17 bp, Homo sapiens
tgtacaaaataaacaaa

SEQ ID NO: 2112500 - DNA, 20 bp, Homo sapiens
tgtacaaagtagagaagtat

SEQ ID NO: 2112501 - DNA, 21 bp, Homo sapiens
tgtacaaagtagagaagtatc

SEQ ID NO: 2112502 - DNA, 19 bp, Homo sapiens
tgtacaagttttgtataaa

SEQ ID NO: 2112503 - DNA, 17 bp, Homo sapiens
tgtacaataccagatca

SEQ ID NO: 2112504 - DNA, 22 bp, Homo sapiens
tgtacaataccagatcactcaa

SEQ ID NO: 2112505 - DNA, 22 bp, Homo sapiens
tgtacaattgaacttaaataaa

SEQ ID NO: 2112506 - DNA, 16 bp, Homo sapiens
tgtacacgtgtcctgt

SEQ ID NO: 2112507 - DNA, 22 bp, Homo sapiens
tgtacagaatttttaatgactt

SEQ ID NO: 2112508 - DNA, 20 bp, Homo sapiens
tgtacagacgtatgcttatt

SEQ ID NO: 2112509 - DNA, 22 bp, Homo sapiens
tgtacagttatctaagttaatt

SEQ ID NO: 2112510 - DNA, 22 bp, Homo sapiens
tgtacatagatgtatcattaat

SEQ ID NO: 2112511 - DNA, 22 bp, Homo sapiens
tgtacatataggagcaatacta

SEQ ID NO: 2112512 - DNA, 16 bp, Homo sapiens
tgtacatatgtaaaat

SEQ ID NO: 2112513 - DNA, 21 bp, Homo sapiens
tgtacatatgtaaaataaaat

SEQ ID NO: 2112514 - DNA, 12 bp, Homo sapiens
tgtacatgtgta

SEQ ID NO: 2112515 - DNA, 17 bp, Homo sapiens
tgtacatgtgtagcctg

SEQ ID NO: 2112516 - DNA, 21 bp, Homo sapiens
tgtacatgtgtagcctgtgca

SEQ ID NO: 2112517 - DNA, 23 bp, Homo sapiens
tgtacattccctgcatccaatct

SEQ ID NO: 2112518 - DNA, 13 bp, Homo sapiens
tgtacatttctga

SEQ ID NO: 2112519 - DNA, 16 bp, Homo sapiens
tgtacatttctgaaat

SEQ ID NO: 2112520 - DNA, 14 bp, Homo sapiens
tgtaccaagcccct

SEQ ID NO: 2112521 - DNA, 21 bp, Homo sapiens
tgtaccagtgtactgctttca

SEQ ID NO: 2112522 - DNA, 12 bp, Homo sapiens
tgtaccagtgtg

SEQ ID NO: 2112523 - DNA, 13 bp, Homo sapiens
tgtaccatgttaa

SEQ ID NO: 2112524 - DNA, 19 bp, Homo sapiens
tgtacccaatttaattcca

SEQ ID NO: 2112525 - DNA, 12 bp, Homo sapiens
tgtacccaccgg

SEQ ID NO: 2112526 - DNA, 20 bp, Homo sapiens
tgtacccaccgggccactcc

SEQ ID NO: 2112527 - DNA, 12 bp, Homo sapiens
tgtacccagctc

SEQ ID NO: 2112528 - DNA, 13 bp, Homo sapiens
tgtacccagctcc

SEQ ID NO: 2112529 - DNA, 12 bp, Homo sapiens
tgtaccccatcc

SEQ ID NO: 2112530 - DNA, 21 bp, Homo sapiens
tgtaccgcgtctaccctggga

SEQ ID NO: 2112531 - DNA, 21 bp, Homo sapiens
tgtaccttccttaagccagga

SEQ ID NO: 2112532 - DNA, 15 bp, Homo sapiens
tgtaccttgaccatc

SEQ ID NO: 2112533 - DNA, 16 bp, Homo sapiens
tgtacgaacccctccc

SEQ ID NO: 2112534 - DNA, 19 bp, Homo sapiens
tgtacgaacccctcccctc

SEQ ID NO: 2112535 - DNA, 14 bp, Homo sapiens
tgtacgtaatgtat

SEQ ID NO: 2112536 - DNA, 17 bp, Homo sapiens
tgtacgtatcatttcta

SEQ ID NO: 2112537 - DNA, 15 bp, Homo sapiens
tgtacgtctgacagg

SEQ ID NO: 2112538 - DNA, 12 bp, Homo sapiens
tgtactacaatt

SEQ ID NO: 2112539 - DNA, 15 bp, Homo sapiens
tgtactcagagcaga

SEQ ID NO: 2112540 - DNA, 19 bp, Homo sapiens
tgtactcagagcagagcaa

SEQ ID NO: 2112541 - DNA, 18 bp, Homo sapiens
tgtactcaggaggctgag

SEQ ID NO: 2112542 - DNA, 21 bp, Homo sapiens
tgtactccagagggacagggt

SEQ ID NO: 2112543 - DNA, 19 bp, Homo sapiens
tgtactctacgccaaagtg

SEQ ID NO: 2112544 - DNA, 17 bp, Homo sapiens
tgtactgagccttgtaa

SEQ ID NO: 2112545 - DNA, 19 bp, Homo sapiens
tgtactgagccttgtaatt

SEQ ID NO: 2112546 - DNA, 22 bp, Homo sapiens
tgtactgagccttgtaattcta

SEQ ID NO: 2112547 - DNA, 13 bp, Homo sapiens
tgtactgcctgct

SEQ ID NO: 2112548 - DNA, 14 bp, Homo sapiens
tgtactgcctgctt

SEQ ID NO: 2112549 - DNA, 21 bp, Homo sapiens
tgtacttaataaattcagata

SEQ ID NO: 2112550 - DNA, 16 bp, Homo sapiens
tgtacttattttccaa

SEQ ID NO: 2112551 - DNA, 12 bp, Homo sapiens
tgtacttcctgt

SEQ ID NO: 2112552 - DNA, 15 bp, Homo sapiens
tgtacttcctgtgta

SEQ ID NO: 2112553 - DNA, 21 bp, Homo sapiens
tgtagaaacacagttttgaaa

SEQ ID NO: 2112554 - DNA, 20 bp, Homo sapiens
tgtagaaatctgtaattcta

SEQ ID NO: 2112555 - DNA, 22 bp, Homo sapiens
tgtagaataataataaaaagac

SEQ ID NO: 2112556 - DNA, 21 bp, Homo sapiens
tgtagaccactgtcctggctg

SEQ ID NO: 2112557 - DNA, 20 bp, Homo sapiens
tgtagactatatacatgtgt

SEQ ID NO: 2112558 - DNA, 21 bp, Homo sapiens
tgtagactatatacatgtgtg

SEQ ID NO: 2112559 - DNA, 12 bp, Homo sapiens
tgtagagccagg

SEQ ID NO: 2112560 - DNA, 16 bp, Homo sapiens
tgtagagccagggtct

SEQ ID NO: 2112561 - DNA, 21 bp, Homo sapiens
tgtagatagttaaaagactgc

SEQ ID NO: 2112562 - DNA, 21 bp, Homo sapiens
tgtagatggaaatcagttgtg

SEQ ID NO: 2112563 - DNA, 12 bp, Homo sapiens
tgtagcagaaag

SEQ ID NO: 2112564 - DNA, 18 bp, Homo sapiens
tgtagcatttcttgatgt

SEQ ID NO: 2112565 - DNA, 14 bp, Homo sapiens
tgtagccagccggg

SEQ ID NO: 2112566 - DNA, 17 bp, Homo sapiens
tgtagccatggctcagg

SEQ ID NO: 2112567 - DNA, 22 bp, Homo sapiens
tgtagcctcgccgtctgtgaat

SEQ ID NO: 2112568 - DNA, 15 bp, Homo sapiens
tgtagcctgtgcatg

SEQ ID NO: 2112569 - DNA, 14 bp, Homo sapiens
tgtagctgatgaaa

SEQ ID NO: 2112570 - DNA, 11 bp, Homo sapiens
tgtagctgtga

SEQ ID NO: 2112571 - DNA, 14 bp, Homo sapiens
tgtagctgtgacct

SEQ ID NO: 2112572 - DNA, 15 bp, Homo sapiens
tgtagctgtgacctg

SEQ ID NO: 2112573 - DNA, 16 bp, Homo sapiens
tgtagctgtgacctgc

SEQ ID NO: 2112574 - DNA, 19 bp, Homo sapiens
tgtagctgtgacctgctga

SEQ ID NO: 2112575 - DNA, 21 bp, Homo sapiens
tgtagctgtgacctgctgagc

SEQ ID NO: 2112576 - DNA, 14 bp, Homo sapiens
tgtaggagggactg

SEQ ID NO: 2112577 - DNA, 16 bp, Homo sapiens
tgtagggctggaccta

SEQ ID NO: 2112578 - DNA, 17 bp, Homo sapiens
tgtaggtatgaataagt

SEQ ID NO: 2112579 - DNA, 21 bp, Homo sapiens
tggggcctggcttgctccagg

SEQ ID NO: 2112580 - DNA, 11 bp, Homo sapiens
tggggcctgta

SEQ ID NO: 2112581 - DNA, 15 bp, Homo sapiens
tggggctaaatgaag

SEQ ID NO: 2112582 - DNA, 16 bp, Homo sapiens
tggggctaaatgaagt

SEQ ID NO: 2112583 - DNA, 23 bp, Homo sapiens
tggggctcctttctccagccagc

SEQ ID NO: 2112584 - DNA, 15 bp, Homo sapiens
tggggctcgtggcct

SEQ ID NO: 2112585 - DNA, 21 bp, Homo sapiens
tggggctcgtggccttcccct

SEQ ID NO: 2112586 - DNA, 17 bp, Homo sapiens
tggggctctaacgcctg

SEQ ID NO: 2112587 - DNA, 20 bp, Homo sapiens
tggggctctaacgcctgagc

SEQ ID NO: 2112588 - DNA, 22 bp, Homo sapiens
tggggctctaacgcctgagccc

SEQ ID NO: 2112589 - DNA, 17 bp, Homo sapiens
tggggctctgtgcaggg

SEQ ID NO: 2112590 - DNA, 23 bp, Homo sapiens
tggggctgcgaaaacgttgaccc

SEQ ID NO: 2112591 - DNA, 21 bp, Homo sapiens
tggggctgcgggacagaggac

SEQ ID NO: 2112592 - DNA, 16 bp, Homo sapiens
tggggctgctcctcca

SEQ ID NO: 2112593 - DNA, 19 bp, Homo sapiens
tggggctgctcctccaggg

SEQ ID NO: 2112594 - DNA, 17 bp, Homo sapiens
tgggggcagagggcaga

SEQ ID NO: 2112595 - DNA, 18 bp, Homo sapiens
tgggggcagtgactggca

SEQ ID NO: 2112596 - DNA, 19 bp, Homo sapiens
tgggggccgctggcccagg

SEQ ID NO: 2112597 - DNA, 15 bp, Homo sapiens
tgggggcctggctgg

SEQ ID NO: 2112598 - DNA, 19 bp, Homo sapiens
tgggggcctggctggctga

SEQ ID NO: 2112599 - DNA, 18 bp, Homo sapiens
tgggggcgggggagccaa

SEQ ID NO: 2112600 - DNA, 18 bp, Homo sapiens
tggggggtgatgagggca

SEQ ID NO: 2112601 - DNA, 19 bp, Homo sapiens
tggggggtgatgagggcag

SEQ ID NO: 2112602 - DNA, 24 bp, Homo sapiens
tggggggtgatgagggcagcagcc

SEQ ID NO: 2112603 - DNA, 14 bp, Homo sapiens
tgggggtggccatc

SEQ ID NO: 2112604 - DNA, 19 bp, Homo sapiens
tgggggtggccatccctgg

SEQ ID NO: 2112605 - DNA, 19 bp, Homo sapiens
tgggggttggatgggaaga

SEQ ID NO: 2112606 - DNA, 15 bp, Homo sapiens
tggggtaagccagag

SEQ ID NO: 2112607 - DNA, 22 bp, Homo sapiens
tggggtaagccagagcctgggg

SEQ ID NO: 2112608 - DNA, 15 bp, Homo sapiens
tggggtacccactgc

SEQ ID NO: 2112609 - DNA, 20 bp, Homo sapiens
tggggtacccactgctctgg

SEQ ID NO: 2112610 - DNA, 19 bp, Homo sapiens
tggggtatggattctaaaa

SEQ ID NO: 2112611 - DNA, 20 bp, Homo sapiens
tggggtatggattctaaaat

SEQ ID NO: 2112612 - DNA, 20 bp, Homo sapiens
tggggtcaccaccctcccct

SEQ ID NO: 2112613 - DNA, 21 bp, Homo sapiens
tggggtcctagcccagtgctt

SEQ ID NO: 2112614 - DNA, 21 bp, Homo sapiens
tggggtctccctctcctgcct

SEQ ID NO: 2112615 - DNA, 23 bp, Homo sapiens
tggggtgacccggcaccccctgc

SEQ ID NO: 2112616 - DNA, 19 bp, Homo sapiens
tggggtgggggtggggaga

SEQ ID NO: 2112617 - DNA, 22 bp, Homo sapiens
tggggtgggggtggggagacct

SEQ ID NO: 2112618 - DNA, 17 bp, Homo sapiens
tggggttcagcccctcc

SEQ ID NO: 2112619 - DNA, 22 bp, Homo sapiens
tgccccttccccatctccattt

SEQ ID NO: 2112620 - DNA, 13 bp, Homo sapiens
tgccccttgggca

SEQ ID NO: 2112621 - DNA, 17 bp, Homo sapiens
tgccccttgggcctccc

SEQ ID NO: 2112622 - DNA, 19 bp, Homo sapiens
tgcccgcagagcccacgcc

SEQ ID NO: 2112623 - DNA, 15 bp, Homo sapiens
tgcccgccagcctca

SEQ ID NO: 2112624 - DNA, 16 bp, Homo sapiens
tgcccgccagcctcag

SEQ ID NO: 2112625 - DNA, 23 bp, Homo sapiens
tgcccgccagcctcagtgccact

SEQ ID NO: 2112626 - DNA, 13 bp, Homo sapiens
tgcccgtcttcag

SEQ ID NO: 2112627 - DNA, 18 bp, Homo sapiens
tgcccgtcttcagcctag

SEQ ID NO: 2112628 - DNA, 19 bp, Homo sapiens
tgcccgtcttcagcctagc

SEQ ID NO: 2112629 - DNA, 16 bp, Homo sapiens
tgccctcaatcccagc

SEQ ID NO: 2112630 - DNA, 21 bp, Homo sapiens
tgccctccacagccgcagcct

SEQ ID NO: 2112631 - DNA, 14 bp, Homo sapiens
tgccctccctgggg

SEQ ID NO: 2112632 - DNA, 19 bp, Homo sapiens
tgccctctggatcctgctg

SEQ ID NO: 2112633 - DNA, 22 bp, Homo sapiens
tgccctctggatcctgctgtgg

SEQ ID NO: 2112634 - DNA, 18 bp, Homo sapiens
tgccctgacccctgcacc

SEQ ID NO: 2112635 - DNA, 20 bp, Homo sapiens
tgccctgacctcccagccct

SEQ ID NO: 2112636 - DNA, 23 bp, Homo sapiens
tgccctgagtggatctccaagga

SEQ ID NO: 2112637 - DNA, 14 bp, Homo sapiens
tgccctgccacctg

SEQ ID NO: 2112638 - DNA, 19 bp, Homo sapiens
tgccctgccacctgtctgt

SEQ ID NO: 2112639 - DNA, 20 bp, Homo sapiens
tgccctgccacctgtctgtc

SEQ ID NO: 2112640 - DNA, 11 bp, Homo sapiens
tgccctgccat

SEQ ID NO: 2112641 - DNA, 12 bp, Homo sapiens
tgccctgccatt

SEQ ID NO: 2112642 - DNA, 11 bp, Homo sapiens
tgccctgctgc

SEQ ID NO: 2112643 - DNA, 18 bp, Homo sapiens
tgccctggatccatcagg

SEQ ID NO: 2112644 - DNA, 18 bp, Homo sapiens
tgccctggtgctgccaca

SEQ ID NO: 2112645 - DNA, 19 bp, Homo sapiens
tgccctgtatataatacta

SEQ ID NO: 2112646 - DNA, 15 bp, Homo sapiens
tgccctgtcctccag

SEQ ID NO: 2112647 - DNA, 17 bp, Homo sapiens
tgccctgtcctccagct

SEQ ID NO: 2112648 - DNA, 21 bp, Homo sapiens
tgccctgtcctccagcttccc

SEQ ID NO: 2112649 - DNA, 17 bp, Homo sapiens
tgcccttcacagtgttt

SEQ ID NO: 2112650 - DNA, 17 bp, Homo sapiens
tgcccttcgctgccagg

SEQ ID NO: 2112651 - DNA, 21 bp, Homo sapiens
tgcccttcgctgccaggacac

SEQ ID NO: 2112652 - DNA, 13 bp, Homo sapiens
tgcccttctttct

SEQ ID NO: 2112653 - DNA, 14 bp, Homo sapiens
tgcccttgccctga

SEQ ID NO: 2112654 - DNA, 15 bp, Homo sapiens
tgcccttgccctgac

SEQ ID NO: 2112655 - DNA, 11 bp, Homo sapiens
tgcccttgggg

SEQ ID NO: 2112656 - DNA, 22 bp, Homo sapiens
tgcccttggggtaagccagagc

SEQ ID NO: 2112657 - DNA, 20 bp, Homo sapiens
tgcccttgtttggggcagga

SEQ ID NO: 2112658 - DNA, 23 bp, Homo sapiens
tgcccttttcatctccagtgtga

SEQ ID NO: 2112659 - DNA, 22 bp, Homo sapiens
tgccgagagaggcgcgtctgcc

SEQ ID NO: 2112660 - DNA, 23 bp, Homo sapiens
tgccgagagaggcgcgtctgccc

SEQ ID NO: 2112661 - DNA, 20 bp, Homo sapiens
tgccgagcaaccgtggccct

SEQ ID NO: 2112662 - DNA, 21 bp, Homo sapiens
tgccgagcaaccgtggccctt

SEQ ID NO: 2112663 - DNA, 16 bp, Homo sapiens
tgccgagcctaatgaa

SEQ ID NO: 2112664 - DNA, 14 bp, Homo sapiens
tgccgcaaggccct

SEQ ID NO: 2112665 - DNA, 18 bp, Homo sapiens
tgccgcaaggccctgtcc

SEQ ID NO: 2112666 - DNA, 20 bp, Homo sapiens
tgccgcaagtctgcagcccg

SEQ ID NO: 2112667 - DNA, 12 bp, Homo sapiens
tgccgcacccca

SEQ ID NO: 2112668 - DNA, 18 bp, Homo sapiens
tgccgccgtctctgtccc

SEQ ID NO: 2112669 - DNA, 19 bp, Homo sapiens
tgccgccgtctctgtcccg

SEQ ID NO: 2112670 - DNA, 13 bp, Homo sapiens
tgccgcctcccag

SEQ ID NO: 2112671 - DNA, 16 bp, Homo sapiens
tgccgcctcccagcct

SEQ ID NO: 2112672 - DNA, 18 bp, Homo sapiens
tgccgctcttctgtcatc

SEQ ID NO: 2112673 - DNA, 20 bp, Homo sapiens
tgccgctcttctgtcatccc

SEQ ID NO: 2112674 - DNA, 14 bp, Homo sapiens
tgccgctgcaccac

SEQ ID NO: 2112675 - DNA, 13 bp, Homo sapiens
tgccggggacaga

SEQ ID NO: 2112676 - DNA, 18 bp, Homo sapiens
tgccgggttttatatttt

SEQ ID NO: 2112677 - DNA, 21 bp, Homo sapiens
tgccgtgtgtctcgtctcctg

SEQ ID NO: 2112678 - DNA, 16 bp, Homo sapiens
tgcctaaatccaaaga

SEQ ID NO: 2112679 - DNA, 18 bp, Homo sapiens
tgcctaaatccaaagaaa

SEQ ID NO: 2112680 - DNA, 17 bp, Homo sapiens
tgcctaagtggctgctg

SEQ ID NO: 2112681 - DNA, 15 bp, Homo sapiens
tgcctaataaagaga

SEQ ID NO: 2112682 - DNA, 15 bp, Homo sapiens
tgcctacagataatt

SEQ ID NO: 2112683 - DNA, 23 bp, Homo sapiens
tgcctaggccaaatgcacaagct

SEQ ID NO: 2112684 - DNA, 15 bp, Homo sapiens
tgcctatttattcat

SEQ ID NO: 2112685 - DNA, 18 bp, Homo sapiens
tgcctatttattcattca

SEQ ID NO: 2112686 - DNA, 22 bp, Homo sapiens
tgcctatttattcattcagtga

SEQ ID NO: 2112687 - DNA, 21 bp, Homo sapiens
tgcctcaaataaaaagtgctt

SEQ ID NO: 2112688 - DNA, 22 bp, Homo sapiens
tgcctcaagaaattgcctcctt

SEQ ID NO: 2112689 - DNA, 19 bp, Homo sapiens
tgcctcaatgtgaccaggg

SEQ ID NO: 2112690 - DNA, 13 bp, Homo sapiens
tgcctcagtttcc

SEQ ID NO: 2112691 - DNA, 16 bp, Homo sapiens
tgcctcagtttcccca

SEQ ID NO: 2112692 - DNA, 17 bp, Homo sapiens
tgcctcagtttccccat

SEQ ID NO: 2112693 - DNA, 19 bp, Homo sapiens
tgcctcatgaccctcctgt

SEQ ID NO: 2112694 - DNA, 20 bp, Homo sapiens
tgcctcatgaccctcctgtc

SEQ ID NO: 2112695 - DNA, 23 bp, Homo sapiens
tgcctcatgaccctcctgtccag

SEQ ID NO: 2112696 - DNA, 14 bp, Homo sapiens
tgcctcatgccaca

SEQ ID NO: 2112697 - DNA, 19 bp, Homo sapiens
tgcctcccagccctgccag

SEQ ID NO: 2112698 - DNA, 21 bp, Homo sapiens
tgcctcccagccctgccagga

SEQ ID NO: 2112699 - DNA, 19 bp, Homo sapiens
tgcctccctttctgggagg

SEQ ID NO: 2112700 - DNA, 19 bp, Homo sapiens
tgcctcctcacccccagct

SEQ ID NO: 2112701 - DNA, 13 bp, Homo sapiens
tgcctcctggccg

SEQ ID NO: 2112702 - DNA, 15 bp, Homo sapiens
tgcctcctgggacca

SEQ ID NO: 2112703 - DNA, 17 bp, Homo sapiens
tgcctcctgggaccatg

SEQ ID NO: 2112704 - DNA, 17 bp, Homo sapiens
tgcctcctgtcttatgg

SEQ ID NO: 2112705 - DNA, 21 bp, Homo sapiens
tgcctcgctccccactctgct

SEQ ID NO: 2112706 - DNA, 12 bp, Homo sapiens
tgcctctcacac

SEQ ID NO: 2112707 - DNA, 13 bp, Homo sapiens
tgcctctcacaca

SEQ ID NO: 2112708 - DNA, 15 bp, Homo sapiens
tgcctctcacacaca

SEQ ID NO: 2112709 - DNA, 13 bp, Homo sapiens
tgcctctcccgca

SEQ ID NO: 2112710 - DNA, 19 bp, Homo sapiens
tgcctctcccgcaccaggc

SEQ ID NO: 2112711 - DNA, 15 bp, Homo sapiens
tgcctctctgctcca

SEQ ID NO: 2112712 - DNA, 19 bp, Homo sapiens
tgcctctctgctccagaga

SEQ ID NO: 2112713 - DNA, 14 bp, Homo sapiens
tgcctctgacacac

SEQ ID NO: 2112714 - DNA, 16 bp, Homo sapiens
tgcctctgacacacag

SEQ ID NO: 2112715 - DNA, 20 bp, Homo sapiens
tgcctctgacacacagctct

SEQ ID NO: 2112716 - DNA, 13 bp, Homo sapiens
tgcctctgaggcc

SEQ ID NO: 2112717 - DNA, 16 bp, Homo sapiens
tgcctctgaggccagc

SEQ ID NO: 2112718 - DNA, 17 bp, Homo sapiens
tgcctctgaggccagcc

SEQ ID NO: 2112719 - DNA, 18 bp, Homo sapiens
tgcctctgaggccagcct

SEQ ID NO: 2112720 - DNA, 20 bp, Homo sapiens
tgggcagtgcctcctgggac

SEQ ID NO: 2112721 - DNA, 20 bp, Homo sapiens
tgggcatccacccagtgctg

SEQ ID NO: 2112722 - DNA, 21 bp, Homo sapiens
tgggcatccacccagtgctgc

SEQ ID NO: 2112723 - DNA, 16 bp, Homo sapiens
tgggcatcttctggct

SEQ ID NO: 2112724 - DNA, 18 bp, Homo sapiens
tgggcattgggctgacac

SEQ ID NO: 2112725 - DNA, 19 bp, Homo sapiens
tgggcattgggttctaaag

SEQ ID NO: 2112726 - DNA, 19 bp, Homo sapiens
tgggccaaaagggcagcca

SEQ ID NO: 2112727 - DNA, 21 bp, Homo sapiens
tgggccaaaagggcagccagg

SEQ ID NO: 2112728 - DNA, 21 bp, Homo sapiens
tgggccaattaaaatatatat

SEQ ID NO: 2112729 - DNA, 22 bp, Homo sapiens
tgggccaattaaaatatatata

SEQ ID NO: 2112730 - DNA, 22 bp, Homo sapiens
tgggccactgcactctagcctg

SEQ ID NO: 2112731 - DNA, 20 bp, Homo sapiens
tgggccactgccagcagctg

SEQ ID NO: 2112732 - DNA, 13 bp, Homo sapiens
tgggccagagaag

SEQ ID NO: 2112733 - DNA, 14 bp, Homo sapiens
tgggccagcctcag

SEQ ID NO: 2112734 - DNA, 20 bp, Homo sapiens
tgggccagcctcagctcagc

SEQ ID NO: 2112735 - DNA, 10 bp, Homo sapiens
tgggccaggg

SEQ ID NO: 2112736 - DNA, 19 bp, Homo sapiens
tgggcccacagagatgcat

SEQ ID NO: 2112737 - DNA, 15 bp, Homo sapiens
tgggcccaggctctg

SEQ ID NO: 2112738 - DNA, 16 bp, Homo sapiens
tgggcccaggctctgg

SEQ ID NO: 2112739 - DNA, 18 bp, Homo sapiens
tgggccccaccacctagg

SEQ ID NO: 2112740 - DNA, 23 bp, Homo sapiens
tgggccccaccacctaggccact

SEQ ID NO: 2112741 - DNA, 14 bp, Homo sapiens
tgggccccacctac

SEQ ID NO: 2112742 - DNA, 13 bp, Homo sapiens
tgggccccatgct

SEQ ID NO: 2112743 - DNA, 18 bp, Homo sapiens
tgggccccatgctctgcc

SEQ ID NO: 2112744 - DNA, 17 bp, Homo sapiens
tgggcccctccacgcct

SEQ ID NO: 2112745 - DNA, 18 bp, Homo sapiens
tgggcccctccacgcctc

SEQ ID NO: 2112746 - DNA, 23 bp, Homo sapiens
tgggcccctccacgcctcctggc

SEQ ID NO: 2112747 - DNA, 13 bp, Homo sapiens
tgggcccctggga

SEQ ID NO: 2112748 - DNA, 14 bp, Homo sapiens
tgggccctgcacag

SEQ ID NO: 2112749 - DNA, 15 bp, Homo sapiens
tgggccctgcacaga

SEQ ID NO: 2112750 - DNA, 16 bp, Homo sapiens
tgggccctggggcctg

SEQ ID NO: 2112751 - DNA, 15 bp, Homo sapiens
tgggcctatggagag

SEQ ID NO: 2112752 - DNA, 18 bp, Homo sapiens
tgggcctatggagagccc

SEQ ID NO: 2112753 - DNA, 20 bp, Homo sapiens
tgggcctatggagagccctg

SEQ ID NO: 2112754 - DNA, 19 bp, Homo sapiens
tgggcctccccccagcccc

SEQ ID NO: 2112755 - DNA, 20 bp, Homo sapiens
tgggcctccccccagcccct

SEQ ID NO: 2112756 - DNA, 21 bp, Homo sapiens
tggggttcagcccctcctctg

SEQ ID NO: 2112757 - DNA, 22 bp, Homo sapiens
tggggttcagcccctcctctgc

SEQ ID NO: 2112758 - DNA, 16 bp, Homo sapiens
tggggttgcaaccact

SEQ ID NO: 2112759 - DNA, 15 bp, Homo sapiens
tgggtaactgtcaag

SEQ ID NO: 2112760 - DNA, 17 bp, Homo sapiens
tgggtaacttagaagga

SEQ ID NO: 2112761 - DNA, 17 bp, Homo sapiens
tgggtacttgtggacac

SEQ ID NO: 2112762 - DNA, 23 bp, Homo sapiens
tgggtacttgtggacacagctct

SEQ ID NO: 2112763 - DNA, 20 bp, Homo sapiens
tgggtagcaattctacccag

SEQ ID NO: 2112764 - DNA, 13 bp, Homo sapiens
tgggtcaaggaat

SEQ ID NO: 2112765 - DNA, 18 bp, Homo sapiens
tgggtccaggaaggcagc

SEQ ID NO: 2112766 - DNA, 19 bp, Homo sapiens
tgggtccaggaaggcagct

SEQ ID NO: 2112767 - DNA, 20 bp, Homo sapiens
tgggtcctgcaattctacag

SEQ ID NO: 2112768 - DNA, 13 bp, Homo sapiens
tgggtctcactcc

SEQ ID NO: 2112769 - DNA, 18 bp, Homo sapiens
tgggtgagaatcctgcct

SEQ ID NO: 2112770 - DNA, 13 bp, Homo sapiens
tgggtgatcagaa

SEQ ID NO: 2112771 - DNA, 16 bp, Homo sapiens
tgggtgatcagaaggc

SEQ ID NO: 2112772 - DNA, 18 bp, Homo sapiens
tgggtgatcagaaggctg

SEQ ID NO: 2112773 - DNA, 20 bp, Homo sapiens
tgggtgatcagaaggctggg

SEQ ID NO: 2112774 - DNA, 22 bp, Homo sapiens
tgggtgccatgtggagtggaca

SEQ ID NO: 2112775 - DNA, 23 bp, Homo sapiens
tgggtgccccccttgccagacat

SEQ ID NO: 2112776 - DNA, 22 bp, Homo sapiens
tgggtggaggaagatccaaaca

SEQ ID NO: 2112777 - DNA, 14 bp, Homo sapiens
tgggtggcacctcc

SEQ ID NO: 2112778 - DNA, 20 bp, Homo sapiens
tgggtggctactctgtgcca

SEQ ID NO: 2112779 - DNA, 13 bp, Homo sapiens
tgggtggctcctg

SEQ ID NO: 2112780 - DNA, 17 bp, Homo sapiens
tgggtggctcctgccac

SEQ ID NO: 2112781 - DNA, 21 bp, Homo sapiens
tgggtggctcctgccactgac

SEQ ID NO: 2112782 - DNA, 12 bp, Homo sapiens
tgggtgggagag

SEQ ID NO: 2112783 - DNA, 13 bp, Homo sapiens
tgggtggggctgc

SEQ ID NO: 2112784 - DNA, 19 bp, Homo sapiens
tgggttatttttgtccctg

SEQ ID NO: 2112785 - DNA, 20 bp, Homo sapiens
tgggttatttttgtccctgc

SEQ ID NO: 2112786 - DNA, 23 bp, Homo sapiens
tgggttcaagcgattcttctgct

SEQ ID NO: 2112787 - DNA, 19 bp, Homo sapiens
tgggttcactagagctggg

SEQ ID NO: 2112788 - DNA, 16 bp, Homo sapiens
tgggttcactgcaacc

SEQ ID NO: 2112789 - DNA, 21 bp, Homo sapiens
tgggttcattccccggccctc

SEQ ID NO: 2112790 - DNA, 21 bp, Homo sapiens
tgggttcctcttccccactcc

SEQ ID NO: 2112791 - DNA, 23 bp, Homo sapiens
tgggttctttggaaggagtgaga

SEQ ID NO: 2112792 - DNA, 14 bp, Homo sapiens
tgggttgactttca

SEQ ID NO: 2112793 - DNA, 14 bp, Homo sapiens
tgggttgttctgga

SEQ ID NO: 2112794 - DNA, 19 bp, Homo sapiens
tgggttttattgtccttca

SEQ ID NO: 2112795 - DNA, 22 bp, Homo sapiens
tgggtttttgttacctttatgg

SEQ ID NO: 2112796 - DNA, 17 bp, Homo sapiens
tgggttttttcacataa

SEQ ID NO: 2112797 - DNA, 23 bp, Homo sapiens
tggtaaaaagattatatatcata

SEQ ID NO: 2112798 - DNA, 21 bp, Homo sapiens
tggtaaattagtatttattta

SEQ ID NO: 2112799 - DNA, 14 bp, Homo sapiens
tggtaagctctggc

SEQ ID NO: 2112800 - DNA, 13 bp, Homo sapiens
tggtaattgttgc

SEQ ID NO: 2112801 - DNA, 22 bp, Homo sapiens
tggtaatttgtatctgaaggag

SEQ ID NO: 2112802 - DNA, 15 bp, Homo sapiens
tggtaccagctcact

SEQ ID NO: 2112803 - DNA, 20 bp, Homo sapiens
tggtactactagatgtcttt

SEQ ID NO: 2112804 - DNA, 13 bp, Homo sapiens
tggtagaagccag

SEQ ID NO: 2112805 - DNA, 20 bp, Homo sapiens
tggtagaattggagagtaaa

SEQ ID NO: 2112806 - DNA, 18 bp, Homo sapiens
tggtagaattgggaagct

SEQ ID NO: 2112807 - DNA, 17 bp, Homo sapiens
tggtagcttttcccttc

SEQ ID NO: 2112808 - DNA, 20 bp, Homo sapiens
tggtagcttttcccttcttt

SEQ ID NO: 2112809 - DNA, 21 bp, Homo sapiens
tggtagcttttcccttctttt

SEQ ID NO: 2112810 - DNA, 22 bp, Homo sapiens
tggtagtactcctgcaaaattt

SEQ ID NO: 2112811 - DNA, 18 bp, Homo sapiens
tggtatatttgtgtatgt

SEQ ID NO: 2112812 - DNA, 19 bp, Homo sapiens
tggtatatttgtgtatgtg

SEQ ID NO: 2112813 - DNA, 23 bp, Homo sapiens
tggtatgaacttgaggacacatg

SEQ ID NO: 2112814 - DNA, 14 bp, Homo sapiens
tggtatgagctgag

SEQ ID NO: 2112815 - DNA, 18 bp, Homo sapiens
tggtatgctggccagcac

SEQ ID NO: 2112816 - DNA, 22 bp, Homo sapiens
tggtatgctggccagcaccctc

SEQ ID NO: 2112817 - DNA, 19 bp, Homo sapiens
tggtatggaactctctcca

SEQ ID NO: 2112818 - DNA, 18 bp, Homo sapiens
tggtattacactgtattt

SEQ ID NO: 2112819 - DNA, 17 bp, Homo sapiens
tggtattatttacaatg

SEQ ID NO: 2112820 - DNA, 14 bp, Homo sapiens
tggtcaaaccgcac

SEQ ID NO: 2112821 - DNA, 21 bp, Homo sapiens
tggtcaaggcccggccccatc

SEQ ID NO: 2112822 - DNA, 15 bp, Homo sapiens
tggtcacaagcacaa

SEQ ID NO: 2112823 - DNA, 20 bp, Homo sapiens
tggtcacagccatgaagtca

SEQ ID NO: 2112824 - DNA, 19 bp, Homo sapiens
tggtcacaggactctgcct

SEQ ID NO: 2112825 - DNA, 23 bp, Homo sapiens
tggtcacaggactctgcctcctc

SEQ ID NO: 2112826 - DNA, 21 bp, Homo sapiens
tggtcaggtatttcagttctt

SEQ ID NO: 2112827 - DNA, 21 bp, Homo sapiens
tggtcagtgtggagaggggtg

SEQ ID NO: 2112828 - DNA, 19 bp, Homo sapiens
tggtccactcagggctgcc

SEQ ID NO: 2112829 - DNA, 13 bp, Homo sapiens
tggtccagctctt

SEQ ID NO: 2112830 - DNA, 14 bp, Homo sapiens
tggtccagggttga

SEQ ID NO: 2112831 - DNA, 20 bp, Homo sapiens
tggtcccacatccctgggcc

SEQ ID NO: 2112832 - DNA, 22 bp, Homo sapiens
tggtcccacatccctgggcctg

SEQ ID NO: 2112833 - DNA, 13 bp, Homo sapiens
tggtcccactcag

SEQ ID NO: 2112834 - DNA, 13 bp, Homo sapiens
tggtccctcgtcc

SEQ ID NO: 2112835 - DNA, 23 bp, Homo sapiens
tggtccctcgtccacaggggcag

SEQ ID NO: 2112836 - DNA, 12 bp, Homo sapiens
tggtccctgggg

SEQ ID NO: 2112837 - DNA, 14 bp, Homo sapiens
tggtcctggggctc

SEQ ID NO: 2112838 - DNA, 17 bp, Homo sapiens
tggtcctgtcaccctgg

SEQ ID NO: 2112839 - DNA, 19 bp, Homo sapiens
tggtcctgtcaccctggcc

SEQ ID NO: 2112840 - DNA, 20 bp, Homo sapiens
tggtcctgtcaccctggccc

SEQ ID NO: 2112841 - DNA, 14 bp, Homo sapiens
tggtcgcccaggag

SEQ ID NO: 2112842 - DNA, 17 bp, Homo sapiens
tggtcgtgaactcctga

SEQ ID NO: 2112843 - DNA, 17 bp, Homo sapiens
tggtctattttgatttt

SEQ ID NO: 2112844 - DNA, 13 bp, Homo sapiens
tggtctcagcttc

SEQ ID NO: 2112845 - DNA, 19 bp, Homo sapiens
tggtctctcgggcccccca

SEQ ID NO: 2112846 - DNA, 16 bp, Homo sapiens
tggtctgacccactgc

SEQ ID NO: 2112847 - DNA, 18 bp, Homo sapiens
tggtctgacccactgctt

SEQ ID NO: 2112848 - DNA, 18 bp, Homo sapiens
tggtctgagcaccccctc

SEQ ID NO: 2112849 - DNA, 22 bp, Homo sapiens
tggtctgaggggcaactgagtc

SEQ ID NO: 2112850 - DNA, 19 bp, Homo sapiens
tggtctgctcaggaattga

SEQ ID NO: 2112851 - DNA, 20 bp, Homo sapiens
tggtctgtgctgccctgctc

SEQ ID NO: 2112852 - DNA, 13 bp, Homo sapiens
tggtcttcactgc

SEQ ID NO: 2112853 - DNA, 16 bp, Homo sapiens
tggtcttgtggaattg

SEQ ID NO: 2112854 - DNA, 22 bp, Homo sapiens
tggtctttcctatcatggagtg

SEQ ID NO: 2112855 - DNA, 18 bp, Homo sapiens
tggtctttgaataaagtc

SEQ ID NO: 2112856 - DNA, 19 bp, Homo sapiens
tggtctttgaataaagtct

SEQ ID NO: 2112857 - DNA, 23 bp, Homo sapiens
tggtctttgaataaagtctgagt

SEQ ID NO: 2112858 - DNA, 13 bp, Homo sapiens
tggtgacacacag

SEQ ID NO: 2112859 - DNA, 14 bp, Homo sapiens
tggtgacacacagc

SEQ ID NO: 2112860 - DNA, 22 bp, Homo sapiens
tggtgaccatctgtttgagaat

SEQ ID NO: 2112861 - DNA, 22 bp, Homo sapiens
tggtgacctctgcctgaagtca

SEQ ID NO: 2112862 - DNA, 18 bp, Homo sapiens
tggtgactgcgatcttca

SEQ ID NO: 2112863 - DNA, 19 bp, Homo sapiens
tggtgactgtcccaccggg

SEQ ID NO: 2112864 - DNA, 23 bp, Homo sapiens
tggtgagcacatctgggaggctg

SEQ ID NO: 2112865 - DNA, 15 bp, Homo sapiens
tggtgaggcccagcc

SEQ ID NO: 2112866 - DNA, 17 bp, Homo sapiens
tggtgagggaagacgcc

SEQ ID NO: 2112867 - DNA, 13 bp, Homo sapiens
tggtgataagtgg

SEQ ID NO: 2112868 - DNA, 15 bp, Homo sapiens
tggtgataagtggaa

SEQ ID NO: 2112869 - DNA, 17 bp, Homo sapiens
tggtgataagtggaaaa

SEQ ID NO: 2112870 - DNA, 18 bp, Homo sapiens
tggtgataagtggaaaaa

SEQ ID NO: 2112871 - DNA, 22 bp, Homo sapiens
tgattgaaaatagtaaatgctt

SEQ ID NO: 2112872 - DNA, 14 bp, Homo sapiens
tgattgacacacag

SEQ ID NO: 2112873 - DNA, 15 bp, Homo sapiens
tgattgacacacagc

SEQ ID NO: 2112874 - DNA, 19 bp, Homo sapiens
tgattgacacacagcactc

SEQ ID NO: 2112875 - DNA, 18 bp, Homo sapiens
tgattggattattcattt

SEQ ID NO: 2112876 - DNA, 12 bp, Homo sapiens
tgattggctcac

SEQ ID NO: 2112877 - DNA, 14 bp, Homo sapiens
tgattgggtgccat

SEQ ID NO: 2112878 - DNA, 12 bp, Homo sapiens
tgattgtaaaat

SEQ ID NO: 2112879 - DNA, 23 bp, Homo sapiens
tgattgtaaaatagcttgtatag

SEQ ID NO: 2112880 - DNA, 14 bp, Homo sapiens
tgattgtcttaata

SEQ ID NO: 2112881 - DNA, 15 bp, Homo sapiens
tgattgtttaattgt

SEQ ID NO: 2112882 - DNA, 22 bp, Homo sapiens
tgatttaatgttttctgctgtt

SEQ ID NO: 2112883 - DNA, 22 bp, Homo sapiens
tgatttagtaatagtccaatat

SEQ ID NO: 2112884 - DNA, 16 bp, Homo sapiens
tgatttatatatggca

SEQ ID NO: 2112885 - DNA, 23 bp, Homo sapiens
tgatttatatatggcatatttat

SEQ ID NO: 2112886 - DNA, 19 bp, Homo sapiens
tgatttatatgtgtaattt

SEQ ID NO: 2112887 - DNA, 15 bp, Homo sapiens
tgatttcaatgattg

SEQ ID NO: 2112888 - DNA, 19 bp, Homo sapiens
tgatttcacaacagatcaa

SEQ ID NO: 2112889 - DNA, 11 bp, Homo sapiens
tgatttcagaa

SEQ ID NO: 2112890 - DNA, 11 bp, Homo sapiens
tgatttcagga

SEQ ID NO: 2112891 - DNA, 18 bp, Homo sapiens
tgatttcagggaaatgga

SEQ ID NO: 2112892 - DNA, 23 bp, Homo sapiens
tgatttcagggaaatggagggtg

SEQ ID NO: 2112893 - DNA, 22 bp, Homo sapiens
tgatttcagtagcacaagttat

SEQ ID NO: 2112894 - DNA, 14 bp, Homo sapiens
tgatttcattacca

SEQ ID NO: 2112895 - DNA, 16 bp, Homo sapiens
tgatttccaagtaata

SEQ ID NO: 2112896 - DNA, 11 bp, Homo sapiens
tgatttctagg

SEQ ID NO: 2112897 - DNA, 11 bp, Homo sapiens
tgatttctcac

SEQ ID NO: 2112898 - DNA, 19 bp, Homo sapiens
tgatttgacccactcacac

SEQ ID NO: 2112899 - DNA, 19 bp, Homo sapiens
tgatttggaagagaggcac

SEQ ID NO: 2112900 - DNA, 22 bp, Homo sapiens
tgatttggaagagaggcacctg

SEQ ID NO: 2112901 - DNA, 15 bp, Homo sapiens
tgattttagccttct

SEQ ID NO: 2112902 - DNA, 13 bp, Homo sapiens
tgattttatacat

SEQ ID NO: 2112903 - DNA, 14 bp, Homo sapiens
tgattttatacata

SEQ ID NO: 2112904 - DNA, 13 bp, Homo sapiens
tgattttcatcaa

SEQ ID NO: 2112905 - DNA, 14 bp, Homo sapiens
tgattttcatcaat

SEQ ID NO: 2112906 - DNA, 16 bp, Homo sapiens
tgattttcatcaattt

SEQ ID NO: 2112907 - DNA, 19 bp, Homo sapiens
tgattttcatcaatttaaa

SEQ ID NO: 2112908 - DNA, 12 bp, Homo sapiens
tgattttgtaca

SEQ ID NO: 2112909 - DNA, 15 bp, Homo sapiens
tgattttgtacagaa

SEQ ID NO: 2112910 - DNA, 18 bp, Homo sapiens
tgattttgtacagaattt

SEQ ID NO: 2112911 - DNA, 14 bp, Homo sapiens
tgatttttgtaata

SEQ ID NO: 2112912 - DNA, 14 bp, Homo sapiens
tgattttttaaagc

SEQ ID NO: 2112913 - DNA, 13 bp, Homo sapiens
tgcaaaaatataa

SEQ ID NO: 2112914 - DNA, 15 bp, Homo sapiens
tgcaaaatttccagt

SEQ ID NO: 2112915 - DNA, 14 bp, Homo sapiens
tgcaaacactgtgt

SEQ ID NO: 2112916 - DNA, 19 bp, Homo sapiens
tgcaaacactgtgtattta

SEQ ID NO: 2112917 - DNA, 21 bp, Homo sapiens
tgcaaagggtatcaggtgctg

SEQ ID NO: 2112918 - DNA, 22 bp, Homo sapiens
tgcaaagtcgacatactcattt

SEQ ID NO: 2112919 - DNA, 17 bp, Homo sapiens
tgcaaagtgcaaatact

SEQ ID NO: 2112920 - DNA, 14 bp, Homo sapiens
tgcaaagtgccctc

SEQ ID NO: 2112921 - DNA, 17 bp, Homo sapiens
tgcaaatactccaagct

SEQ ID NO: 2112922 - DNA, 21 bp, Homo sapiens
tgcaaatactccaagcttcaa

SEQ ID NO: 2112923 - DNA, 19 bp, Homo sapiens
tgcaaatattagcaaagaa

SEQ ID NO: 2112924 - DNA, 21 bp, Homo sapiens
tgcaaatgctatgagatgcat

SEQ ID NO: 2112925 - DNA, 17 bp, Homo sapiens
tgcaaattttgcattta

SEQ ID NO: 2112926 - DNA, 13 bp, Homo sapiens
tgcaacaaaattc

SEQ ID NO: 2112927 - DNA, 13 bp, Homo sapiens
tgcaacaacatgt

SEQ ID NO: 2112928 - DNA, 15 bp, Homo sapiens
tgcaacaggctgggc

SEQ ID NO: 2112929 - DNA, 19 bp, Homo sapiens
tgcaacaggctgggcttca

SEQ ID NO: 2112930 - DNA, 18 bp, Homo sapiens
tgcaacctcttcctcctg

SEQ ID NO: 2112931 - DNA, 17 bp, Homo sapiens
tgcaagaagaatataaa

SEQ ID NO: 2112932 - DNA, 14 bp, Homo sapiens
tgcaagagacagag

SEQ ID NO: 2112933 - DNA, 16 bp, Homo sapiens
tgcaagagacagagcc

SEQ ID NO: 2112934 - DNA, 20 bp, Homo sapiens
tgcaagagacagagccccca

SEQ ID NO: 2112935 - DNA, 12 bp, Homo sapiens
tgcaagaggagg

SEQ ID NO: 2112936 - DNA, 13 bp, Homo sapiens
tgcaagagtggac

SEQ ID NO: 2112937 - DNA, 14 bp, Homo sapiens
tgcaagcagcctcc

SEQ ID NO: 2112938 - DNA, 16 bp, Homo sapiens
tgcaagcagggctctg

SEQ ID NO: 2112939 - DNA, 14 bp, Homo sapiens
tgcaagccccaggg

SEQ ID NO: 2112940 - DNA, 21 bp, Homo sapiens
tgcaagccccagggcctgggg

SEQ ID NO: 2112941 - DNA, 15 bp, Homo sapiens
tgcaaggaaaataat

SEQ ID NO: 2112942 - DNA, 19 bp, Homo sapiens
tgcaaggaagccacagctg

SEQ ID NO: 2112943 - DNA, 21 bp, Homo sapiens
tgcaaggccctctatttctct

SEQ ID NO: 2112944 - DNA, 15 bp, Homo sapiens
tgcaaggggctcagc

SEQ ID NO: 2112945 - DNA, 19 bp, Homo sapiens
tgcaaggggctcagcaagg

SEQ ID NO: 2112946 - DNA, 15 bp, Homo sapiens
tgcaagtactgctgt

SEQ ID NO: 2112947 - DNA, 17 bp, Homo sapiens
tgcaagtcatacttagg

SEQ ID NO: 2112948 - DNA, 19 bp, Homo sapiens
tgcaagtgcccgccctgcc

SEQ ID NO: 2112949 - DNA, 20 bp, Homo sapiens
tgcaagtgcccgccctgccc

SEQ ID NO: 2112950 - DNA, 13 bp, Homo sapiens
tgcaataaaatag

SEQ ID NO: 2112951 - DNA, 16 bp, Homo sapiens
tgcaataaaatagtat

SEQ ID NO: 2112952 - DNA, 14 bp, Homo sapiens
tgcaatctccaggg

SEQ ID NO: 2112953 - DNA, 18 bp, Homo sapiens
tgcaatggctatatggca

SEQ ID NO: 2112954 - DNA, 19 bp, Homo sapiens
tgcaatgtcccttgcacag

SEQ ID NO: 2112955 - DNA, 15 bp, Homo sapiens
tgcaatgttttcctt

SEQ ID NO: 2112956 - DNA, 15 bp, Homo sapiens
tgcaattgcttagga

SEQ ID NO: 2112957 - DNA, 18 bp, Homo sapiens
tgcaatttattaaaatga

SEQ ID NO: 2112958 - DNA, 22 bp, Homo sapiens
tgcaatttattaaaatgattgt

SEQ ID NO: 2112959 - DNA, 19 bp, Homo sapiens
tgcaatttcccctctgtgt

SEQ ID NO: 2112960 - DNA, 22 bp, Homo sapiens
tgcaatttttaaactagtaatg

SEQ ID NO: 2112961 - DNA, 15 bp, Homo sapiens
tgcacaaagcccttc

SEQ ID NO: 2112962 - DNA, 23 bp, Homo sapiens
tgcacaagcttgtatatacatat

SEQ ID NO: 2112963 - DNA, 19 bp, Homo sapiens
tgcacaatttagaaaacat

SEQ ID NO: 2112964 - DNA, 20 bp, Homo sapiens
tgcacaatttagaaaacatt

SEQ ID NO: 2112965 - DNA, 16 bp, Homo sapiens
tgcacaatttgagcaa

SEQ ID NO: 2112966 - DNA, 21 bp, Homo sapiens
tgcacaatttgagcaattcat

SEQ ID NO: 2112967 - DNA, 13 bp, Homo sapiens
tgcacacacacag

SEQ ID NO: 2112968 - DNA, 15 bp, Homo sapiens
tgcacacaccagagc

SEQ ID NO: 2112969 - DNA, 21 bp, Homo sapiens
tgcacacaccagagcccacct

SEQ ID NO: 2112970 - DNA, 16 bp, Homo sapiens
tgcacacagaaatata

SEQ ID NO: 2112971 - DNA, 17 bp, Homo sapiens
tgcacacagaaatatat

SEQ ID NO: 2112972 - DNA, 19 bp, Homo sapiens
tgcacacagaaatatatat

SEQ ID NO: 2112973 - DNA, 22 bp, Homo sapiens
tgcacacagaaatatatataca

SEQ ID NO: 2112974 - DNA, 19 bp, Homo sapiens
tgcacactagcctctccag

SEQ ID NO: 2112975 - DNA, 21 bp, Homo sapiens
tgcacactagcctctccagga

SEQ ID NO: 2112976 - DNA, 18 bp, Homo sapiens
tgcacagagatatgcaca

SEQ ID NO: 2112977 - DNA, 19 bp, Homo sapiens
tgcacagagatatgcacac

SEQ ID NO: 2112978 - DNA, 14 bp, Homo sapiens
tgcacagcccacac

SEQ ID NO: 2112979 - DNA, 18 bp, Homo sapiens
tgcacagcggcccctgca

SEQ ID NO: 2112980 - DNA, 15 bp, Homo sapiens
tgcacagctgcttgt

SEQ ID NO: 2112981 - DNA, 19 bp, Homo sapiens
tgcacagctgcttgtcctg

SEQ ID NO: 2112982 - DNA, 23 bp, Homo sapiens
tgcacagctgcttgtcctgctct

SEQ ID NO: 2112983 - DNA, 15 bp, Homo sapiens
tgcacagtgcatctc

SEQ ID NO: 2112984 - DNA, 16 bp, Homo sapiens
tgcacagtgcatctca

SEQ ID NO: 2112985 - DNA, 20 bp, Homo sapiens
tgcacagtgcatctcagccc

SEQ ID NO: 2112986 - DNA, 18 bp, Homo sapiens
tgcacatatggactctgc

SEQ ID NO: 2112987 - DNA, 13 bp, Homo sapiens
tgcacatatttga

SEQ ID NO: 2112988 - DNA, 22 bp, Homo sapiens
tgatactatctcttgtcatata

SEQ ID NO: 2112989 - DNA, 23 bp, Homo sapiens
tgatacttcaggtgcttttgatg

SEQ ID NO: 2112990 - DNA, 14 bp, Homo sapiens
tgatagattttctg

SEQ ID NO: 2112991 - DNA, 24 bp, Homo sapiens
tgatagcagaagaaaaagttgcag

SEQ ID NO: 2112992 - DNA, 16 bp, Homo sapiens
tgatagctaacatttt

SEQ ID NO: 2112993 - DNA, 23 bp, Homo sapiens
tgatagctttattttttaagtat

SEQ ID NO: 2112994 - DNA, 16 bp, Homo sapiens
tgataggaaaagaagg

SEQ ID NO: 2112995 - DNA, 21 bp, Homo sapiens
tgataggccctggatgtgccc

SEQ ID NO: 2112996 - DNA, 14 bp, Homo sapiens
tgatatcacctctc

SEQ ID NO: 2112997 - DNA, 18 bp, Homo sapiens
tgatatcacctctcttca

SEQ ID NO: 2112998 - DNA, 20 bp, Homo sapiens
tgatatcacctctcttcagc

SEQ ID NO: 2112999 - DNA, 21 bp, Homo sapiens
tgatatcatgcccctgtactc

SEQ ID NO: 2113000 - DNA, 17 bp, Homo sapiens
tgatatctgaacacata

SEQ ID NO: 2113001 - DNA, 14 bp, Homo sapiens
tgatatgggactga

SEQ ID NO: 2113002 - DNA, 19 bp, Homo sapiens
tgatattttcaacgcagcc

SEQ ID NO: 2113003 - DNA, 15 bp, Homo sapiens
tgatcaaaaataaac

SEQ ID NO: 2113004 - DNA, 15 bp, Homo sapiens
tgatcaaattcattt

SEQ ID NO: 2113005 - DNA, 14 bp, Homo sapiens
tgatcaactgttca

SEQ ID NO: 2113006 - DNA, 14 bp, Homo sapiens
tgatcaattaaatg

SEQ ID NO: 2113007 - DNA, 16 bp, Homo sapiens
tgatcaattaaatgta

SEQ ID NO: 2113008 - DNA, 14 bp, Homo sapiens
tgatcacagtgact

SEQ ID NO: 2113009 - DNA, 20 bp, Homo sapiens
tgatcacggctcactgcagc

SEQ ID NO: 2113010 - DNA, 22 bp, Homo sapiens
tgatcacggctcactgcagcct

SEQ ID NO: 2113011 - DNA, 22 bp, Homo sapiens
tgatcactttgttaaaaatatt

SEQ ID NO: 2113012 - DNA, 15 bp, Homo sapiens
tgatcagaattttac

SEQ ID NO: 2113013 - DNA, 17 bp, Homo sapiens
tgatcagctgtttgtca

SEQ ID NO: 2113014 - DNA, 21 bp, Homo sapiens
tgatcagttttttcacctgga

SEQ ID NO: 2113015 - DNA, 15 bp, Homo sapiens
tgatcataagtctaa

SEQ ID NO: 2113016 - DNA, 15 bp, Homo sapiens
tgatcatggtcagct

SEQ ID NO: 2113017 - DNA, 21 bp, Homo sapiens
tgatcattacatggctgtggt

SEQ ID NO: 2113018 - DNA, 22 bp, Homo sapiens
tgatcattacatggctgtggtt

SEQ ID NO: 2113019 - DNA, 21 bp, Homo sapiens
tgatccaagctggtcccactc

SEQ ID NO: 2113020 - DNA, 15 bp, Homo sapiens
tgatccacccacctc

SEQ ID NO: 2113021 - DNA, 13 bp, Homo sapiens
tgatcccagcact

SEQ ID NO: 2113022 - DNA, 22 bp, Homo sapiens
tgatccgttccattgcaagctt

SEQ ID NO: 2113023 - DNA, 20 bp, Homo sapiens
tgatcctaactgaagagaca

SEQ ID NO: 2113024 - DNA, 16 bp, Homo sapiens
tgatcctcccacctca

SEQ ID NO: 2113025 - DNA, 20 bp, Homo sapiens
tgatcctcccacctcagcct

SEQ ID NO: 2113026 - DNA, 13 bp, Homo sapiens
tgatccttgtttt

SEQ ID NO: 2113027 - DNA, 20 bp, Homo sapiens
tgatccttttatgttattta

SEQ ID NO: 2113028 - DNA, 16 bp, Homo sapiens
tgatcgagccactgca

SEQ ID NO: 2113029 - DNA, 18 bp, Homo sapiens
tgatcgagccactgcact

SEQ ID NO: 2113030 - DNA, 18 bp, Homo sapiens
tgatcggagcctcctctc

SEQ ID NO: 2113031 - DNA, 18 bp, Homo sapiens
tgatctaatacaaagatg

SEQ ID NO: 2113032 - DNA, 16 bp, Homo sapiens
tgatctccatatgtta

SEQ ID NO: 2113033 - DNA, 15 bp, Homo sapiens
tgatctccctgccgc

SEQ ID NO: 2113034 - DNA, 16 bp, Homo sapiens
tgatctccctgccgcc

SEQ ID NO: 2113035 - DNA, 12 bp, Homo sapiens
tgatctctccac

SEQ ID NO: 2113036 - DNA, 15 bp, Homo sapiens
tgatctgtatataca

SEQ ID NO: 2113037 - DNA, 19 bp, Homo sapiens
tgatcttgttaatgcattt

SEQ ID NO: 2113038 - DNA, 16 bp, Homo sapiens
tgatctttgcagacag

SEQ ID NO: 2113039 - DNA, 18 bp, Homo sapiens
tgatctttgcagacaggc

SEQ ID NO: 2113040 - DNA, 19 bp, Homo sapiens
tgatctttgcagacaggca

SEQ ID NO: 2113041 - DNA, 21 bp, Homo sapiens
tgatctttgcagacaggcaag

SEQ ID NO: 2113042 - DNA, 23 bp, Homo sapiens
tgatctttgcagacaggcaagca

SEQ ID NO: 2113043 - DNA, 15 bp, Homo sapiens
tgatcttttcagtgt

SEQ ID NO: 2113044 - DNA, 22 bp, Homo sapiens
tgatgaaatgaggtcagagcct

SEQ ID NO: 2113045 - DNA, 15 bp, Homo sapiens
tgatgaactttctct

SEQ ID NO: 2113046 - DNA, 11 bp, Homo sapiens
tgatgaagccc

SEQ ID NO: 2113047 - DNA, 11 bp, Homo sapiens
tgatgaagcct

SEQ ID NO: 2113048 - DNA, 13 bp, Homo sapiens
tgatgaagcctgt

SEQ ID NO: 2113049 - DNA, 20 bp, Homo sapiens
tgatgaagcctgtgccacct

SEQ ID NO: 2113050 - DNA, 15 bp, Homo sapiens
tgatgacagagcgag

SEQ ID NO: 2113051 - DNA, 19 bp, Homo sapiens
tgatgaccaatctctgtga

SEQ ID NO: 2113052 - DNA, 17 bp, Homo sapiens
tgatgaggcctcttgga

SEQ ID NO: 2113053 - DNA, 16 bp, Homo sapiens
tgatgagggcagcagc

SEQ ID NO: 2113054 - DNA, 21 bp, Homo sapiens
tgatgagtgattgacacacag

SEQ ID NO: 2113055 - DNA, 21 bp, Homo sapiens
tgatgatctttgcagacaggc

SEQ ID NO: 2113056 - DNA, 13 bp, Homo sapiens
tgatgatgaccaa

SEQ ID NO: 2113057 - DNA, 14 bp, Homo sapiens
tgatgatgtctctt

SEQ ID NO: 2113058 - DNA, 15 bp, Homo sapiens
tgatgattaaacacc

SEQ ID NO: 2113059 - DNA, 17 bp, Homo sapiens
tgatgcatttccacact

SEQ ID NO: 2113060 - DNA, 14 bp, Homo sapiens
tgatgccaaaaaaa

SEQ ID NO: 2113061 - DNA, 18 bp, Homo sapiens
tgatgccaaaaaaaaata

SEQ ID NO: 2113062 - DNA, 23 bp, Homo sapiens
tgatgccatgtttagattccagg

SEQ ID NO: 2113063 - DNA, 16 bp, Homo sapiens
tgatgcgaaaacttga

SEQ ID NO: 2113064 - DNA, 17 bp, Homo sapiens
tgatgcgaaaacttgaa

SEQ ID NO: 2113065 - DNA, 15 bp, Homo sapiens
tgatgctcaggcttg

SEQ ID NO: 2113066 - DNA, 14 bp, Homo sapiens
tgatggagaaggaa

SEQ ID NO: 2113067 - DNA, 15 bp, Homo sapiens
tgatggcaattttgt

SEQ ID NO: 2113068 - DNA, 14 bp, Homo sapiens
tgatgggaaagcat

SEQ ID NO: 2113069 - DNA, 13 bp, Homo sapiens
tgatggggagaaa

SEQ ID NO: 2113070 - DNA, 16 bp, Homo sapiens
tgatggggtgggcagg

SEQ ID NO: 2113071 - DNA, 20 bp, Homo sapiens
tgatggggtgggcagggctg

SEQ ID NO: 2113072 - DNA, 17 bp, Homo sapiens
tgatgggtcccaaaagc

SEQ ID NO: 2113073 - DNA, 15 bp, Homo sapiens
tgatggtgacttcct

SEQ ID NO: 2113074 - DNA, 16 bp, Homo sapiens
tgatggtgagctggga

SEQ ID NO: 2113075 - DNA, 14 bp, Homo sapiens
tgatggttcccctg

SEQ ID NO: 2113076 - DNA, 11 bp, Homo sapiens
tgatgtacatg

SEQ ID NO: 2113077 - DNA, 16 bp, Homo sapiens
tgatgtacatgtgtag

SEQ ID NO: 2113078 - DNA, 20 bp, Homo sapiens
tgatgtagggtaaggtgcct

SEQ ID NO: 2113079 - DNA, 17 bp, Homo sapiens
tgatgtcattaatgtgt

SEQ ID NO: 2113080 - DNA, 23 bp, Homo sapiens
tgatgtccagaagaatattcagg

SEQ ID NO: 2113081 - DNA, 19 bp, Homo sapiens
tgatgtcccaacttgtaaa

SEQ ID NO: 2113082 - DNA, 17 bp, Homo sapiens
tgatgtgagtgtgtgtg

SEQ ID NO: 2113083 - DNA, 15 bp, Homo sapiens
tgatgtgctggagct

SEQ ID NO: 2113084 - DNA, 12 bp, Homo sapiens
tgatgttaaaaa

SEQ ID NO: 2113085 - DNA, 13 bp, Homo sapiens
tgatgttaaaaaa

SEQ ID NO: 2113086 - DNA, 14 bp, Homo sapiens
tgatgttaaaaaaa

SEQ ID NO: 2113087 - DNA, 16 bp, Homo sapiens
tgatgttgagctgagt

SEQ ID NO: 2113088 - DNA, 18 bp, Homo sapiens
tgatgttgtttgggagag

SEQ ID NO: 2113089 - DNA, 19 bp, Homo sapiens
tgatgttgtttgggagagt

SEQ ID NO: 2113090 - DNA, 23 bp, Homo sapiens
tgatgtttccagaaaatataaat

SEQ ID NO: 2113091 - DNA, 15 bp, Homo sapiens
tgattaaacacctga

SEQ ID NO: 2113092 - DNA, 19 bp, Homo sapiens
tgattaaacacctgacaca

SEQ ID NO: 2113093 - DNA, 20 bp, Homo sapiens
tgattacctcctgtgtggaa

SEQ ID NO: 2113094 - DNA, 16 bp, Homo sapiens
tgattactttaaaata

SEQ ID NO: 2113095 - DNA, 22 bp, Homo sapiens
tgattcacaactaggacctcat

SEQ ID NO: 2113096 - DNA, 17 bp, Homo sapiens
tgattcactattagaga

SEQ ID NO: 2113097 - DNA, 15 bp, Homo sapiens
tgattcataacaatg

SEQ ID NO: 2113098 - DNA, 16 bp, Homo sapiens
tgattcataacaatgt

SEQ ID NO: 2113099 - DNA, 21 bp, Homo sapiens
tgattcccaagctctgctcct

SEQ ID NO: 2113100 - DNA, 14 bp, Homo sapiens
tgattcctgcattt

SEQ ID NO: 2113101 - DNA, 22 bp, Homo sapiens
tgattccttgatggagatattt

SEQ ID NO: 2113102 - DNA, 21 bp, Homo sapiens
tgattccttttgatggggaga

SEQ ID NO: 2113103 - DNA, 17 bp, Homo sapiens
tgattctaatgtcttca

SEQ ID NO: 2113104 - DNA, 19 bp, Homo sapiens
tgattctcctgcctcagcc

SEQ ID NO: 2113105 - DNA, 19 bp, Homo sapiens
tgccagccgtgatgctcag

SEQ ID NO: 2113106 - DNA, 16 bp, Homo sapiens
tgccagcctggcttct

SEQ ID NO: 2113107 - DNA, 18 bp, Homo sapiens
tgccagcctggcttctgg

SEQ ID NO: 2113108 - DNA, 20 bp, Homo sapiens
tgccagcctggcttctggag

SEQ ID NO: 2113109 - DNA, 23 bp, Homo sapiens
tgccagcctggcttctggagccc

SEQ ID NO: 2113110 - DNA, 21 bp, Homo sapiens
tgccagctcaggtgactggag

SEQ ID NO: 2113111 - DNA, 17 bp, Homo sapiens
tgccagctcagtcccat

SEQ ID NO: 2113112 - DNA, 14 bp, Homo sapiens
tgccagctgccttc

SEQ ID NO: 2113113 - DNA, 11 bp, Homo sapiens
tgccaggacac

SEQ ID NO: 2113114 - DNA, 12 bp, Homo sapiens
tgccaggacacc

SEQ ID NO: 2113115 - DNA, 17 bp, Homo sapiens
tgccaggacacctgccc

SEQ ID NO: 2113116 - DNA, 18 bp, Homo sapiens
tgccaggacacctgcccc

SEQ ID NO: 2113117 - DNA, 23 bp, Homo sapiens
tgccaggacacctgccccagcgc

SEQ ID NO: 2113118 - DNA, 23 bp, Homo sapiens
tgccaggacagctggctgctgac

SEQ ID NO: 2113119 - DNA, 24 bp, Homo sapiens
tgccaggacagctggctgctgaca

SEQ ID NO: 2113120 - DNA, 17 bp, Homo sapiens
tgccaggaggctgcggc

SEQ ID NO: 2113121 - DNA, 21 bp, Homo sapiens
tgccaggaggctgcggcctag

SEQ ID NO: 2113122 - DNA, 13 bp, Homo sapiens
tgccaggagggac

SEQ ID NO: 2113123 - DNA, 23 bp, Homo sapiens
tgccaggagggacaaaggagcct

SEQ ID NO: 2113124 - DNA, 15 bp, Homo sapiens
tgccaggcacctggc

SEQ ID NO: 2113125 - DNA, 17 bp, Homo sapiens
tgccaggcacctggcct

SEQ ID NO: 2113126 - DNA, 19 bp, Homo sapiens
tgccaggcacctggcctgc

SEQ ID NO: 2113127 - DNA, 20 bp, Homo sapiens
tgccaggcacctggcctgct

SEQ ID NO: 2113128 - DNA, 22 bp, Homo sapiens
tgccaggcacctggcctgctgg

SEQ ID NO: 2113129 - DNA, 12 bp, Homo sapiens
tgccaggcccat

SEQ ID NO: 2113130 - DNA, 21 bp, Homo sapiens
tgccaggcccatctcaggtgc

SEQ ID NO: 2113131 - DNA, 14 bp, Homo sapiens
tgccaggcccgggg

SEQ ID NO: 2113132 - DNA, 20 bp, Homo sapiens
tgccaggctagagtgcagtg

SEQ ID NO: 2113133 - DNA, 23 bp, Homo sapiens
tgccaggctccctttctcttctt

SEQ ID NO: 2113134 - DNA, 21 bp, Homo sapiens
tgccagggcaggctacccctt

SEQ ID NO: 2113135 - DNA, 22 bp, Homo sapiens
tgccagggcaggctaccccttc

SEQ ID NO: 2113136 - DNA, 20 bp, Homo sapiens
tgccagggctcgggcgctgt

SEQ ID NO: 2113137 - DNA, 18 bp, Homo sapiens
tgccaggttaggaaggca

SEQ ID NO: 2113138 - DNA, 17 bp, Homo sapiens
tgccaggtttttggtct

SEQ ID NO: 2113139 - DNA, 19 bp, Homo sapiens
tgccaggtttttggtctga

SEQ ID NO: 2113140 - DNA, 14 bp, Homo sapiens
tgccagtaaaaaaa

SEQ ID NO: 2113141 - DNA, 20 bp, Homo sapiens
tgccagtgccttacctcctg

SEQ ID NO: 2113142 - DNA, 21 bp, Homo sapiens
tgccagtgccttacctcctgc

SEQ ID NO: 2113143 - DNA, 23 bp, Homo sapiens
tgccagtgccttacctcctgccc

SEQ ID NO: 2113144 - DNA, 23 bp, Homo sapiens
tgccataccgctggggaacagag

SEQ ID NO: 2113145 - DNA, 20 bp, Homo sapiens
tgccatagagtttaacacaa

SEQ ID NO: 2113146 - DNA, 18 bp, Homo sapiens
tgccatagtcacatggcc

SEQ ID NO: 2113147 - DNA, 20 bp, Homo sapiens
tgccatattctgttggccag

SEQ ID NO: 2113148 - DNA, 12 bp, Homo sapiens
tgccatccaggt

SEQ ID NO: 2113149 - DNA, 15 bp, Homo sapiens
tgccatccaggttca

SEQ ID NO: 2113150 - DNA, 21 bp, Homo sapiens
tgccatccaggttcagcttgt

SEQ ID NO: 2113151 - DNA, 13 bp, Homo sapiens
tgccatgccactg

SEQ ID NO: 2113152 - DNA, 19 bp, Homo sapiens
tgccatgccactgccaggc

SEQ ID NO: 2113153 - DNA, 22 bp, Homo sapiens
tgccatgccactgccaggcacc

SEQ ID NO: 2113154 - DNA, 17 bp, Homo sapiens
tgccatgggcctgctgc

SEQ ID NO: 2113155 - DNA, 23 bp, Homo sapiens
tgccatgtaaaggcctttaataa

SEQ ID NO: 2113156 - DNA, 15 bp, Homo sapiens
tgccatgtgccaggt

SEQ ID NO: 2113157 - DNA, 16 bp, Homo sapiens
tgccatgtggagtgga

SEQ ID NO: 2113158 - DNA, 18 bp, Homo sapiens
tgccatgtggagtggaca

SEQ ID NO: 2113159 - DNA, 12 bp, Homo sapiens
tgccatgttggc

SEQ ID NO: 2113160 - DNA, 17 bp, Homo sapiens
tgccatgttggccaggc

SEQ ID NO: 2113161 - DNA, 18 bp, Homo sapiens
tgccatgttggccaggct

SEQ ID NO: 2113162 - DNA, 22 bp, Homo sapiens
tgccattaaatccgcaaacagc

SEQ ID NO: 2113163 - DNA, 11 bp, Homo sapiens
tgccattccca

SEQ ID NO: 2113164 - DNA, 16 bp, Homo sapiens
tgccatttctctgctt

SEQ ID NO: 2113165 - DNA, 16 bp, Homo sapiens
tgccatttgcaccctc

SEQ ID NO: 2113166 - DNA, 21 bp, Homo sapiens
tgccatttgcaccctccgcct

SEQ ID NO: 2113167 - DNA, 19 bp, Homo sapiens
tgccattttaataaaatga

SEQ ID NO: 2113168 - DNA, 16 bp, Homo sapiens
tgcccacaggatcagt

SEQ ID NO: 2113169 - DNA, 14 bp, Homo sapiens
tgcccacagggacc

SEQ ID NO: 2113170 - DNA, 16 bp, Homo sapiens
tgcccacatcccaggc

SEQ ID NO: 2113171 - DNA, 18 bp, Homo sapiens
tgcccacgctggagtgca

SEQ ID NO: 2113172 - DNA, 22 bp, Homo sapiens
tgcccacttagccgtccatggc

SEQ ID NO: 2113173 - DNA, 21 bp, Homo sapiens
tgcccagaattcccagctgtc

SEQ ID NO: 2113174 - DNA, 23 bp, Homo sapiens
tgcccagaattcccagctgtctg

SEQ ID NO: 2113175 - DNA, 23 bp, Homo sapiens
tgcccagagaatcagggcaggct

SEQ ID NO: 2113176 - DNA, 20 bp, Homo sapiens
tgcccagagggcccaggcag

SEQ ID NO: 2113177 - DNA, 21 bp, Homo sapiens
tgcccagagggcccaggcagg

SEQ ID NO: 2113178 - DNA, 16 bp, Homo sapiens
tgcccaggagagccag

SEQ ID NO: 2113179 - DNA, 12 bp, Homo sapiens
tgcccaggcagg

SEQ ID NO: 2113180 - DNA, 13 bp, Homo sapiens
tgcccaggcaggt

SEQ ID NO: 2113181 - DNA, 20 bp, Homo sapiens
tgcccaggcaggtcttgaac

SEQ ID NO: 2113182 - DNA, 11 bp, Homo sapiens
tgcccaggccc

SEQ ID NO: 2113183 - DNA, 14 bp, Homo sapiens
tgcccaggcccctg

SEQ ID NO: 2113184 - DNA, 15 bp, Homo sapiens
tgcccaggcccctgc

SEQ ID NO: 2113185 - DNA, 20 bp, Homo sapiens
tgcccaggcccctgccaccc

SEQ ID NO: 2113186 - DNA, 15 bp, Homo sapiens
tgcccaggcctgcct

SEQ ID NO: 2113187 - DNA, 11 bp, Homo sapiens
tgcccaggctg

SEQ ID NO: 2113188 - DNA, 19 bp, Homo sapiens
tgcccaggctgctcttgaa

SEQ ID NO: 2113189 - DNA, 20 bp, Homo sapiens
tgcccaggctgctcttgaat

SEQ ID NO: 2113190 - DNA, 16 bp, Homo sapiens
tgcccaggctggcctg

SEQ ID NO: 2113191 - DNA, 14 bp, Homo sapiens
tgcccagggctcag

SEQ ID NO: 2113192 - DNA, 21 bp, Homo sapiens
tgcccagggctcagcctggtg

SEQ ID NO: 2113193 - DNA, 16 bp, Homo sapiens
tgcccatgggagctgg

SEQ ID NO: 2113194 - DNA, 18 bp, Homo sapiens
tgcccatgtgtcccctca

SEQ ID NO: 2113195 - DNA, 23 bp, Homo sapiens
tgcccatttcgaagatatacaaa

SEQ ID NO: 2113196 - DNA, 18 bp, Homo sapiens
tgccccaactccttccag

SEQ ID NO: 2113197 - DNA, 19 bp, Homo sapiens
tgccccaactccttccagc

SEQ ID NO: 2113198 - DNA, 19 bp, Homo sapiens
tgccccaagcagccagcca

SEQ ID NO: 2113199 - DNA, 21 bp, Homo sapiens
tgccccaagcagccagccagt

SEQ ID NO: 2113200 - DNA, 18 bp, Homo sapiens
tgccccaccagccacctc

SEQ ID NO: 2113201 - DNA, 20 bp, Homo sapiens
tgccccagcgcggcttggcc

SEQ ID NO: 2113202 - DNA, 18 bp, Homo sapiens
tgccccatcctgggcctt

SEQ ID NO: 2113203 - DNA, 15 bp, Homo sapiens
tgcccccagcactcc

SEQ ID NO: 2113204 - DNA, 16 bp, Homo sapiens
tgcccccatctttcct

SEQ ID NO: 2113205 - DNA, 18 bp, Homo sapiens
tgccccccttgccagaca

SEQ ID NO: 2113206 - DNA, 20 bp, Homo sapiens
tgcccccgtcttctctccat

SEQ ID NO: 2113207 - DNA, 19 bp, Homo sapiens
tgccccgaatttagtcaca

SEQ ID NO: 2113208 - DNA, 13 bp, Homo sapiens
tgccccgcccagc

SEQ ID NO: 2113209 - DNA, 15 bp, Homo sapiens
tgccccgcctccccg

SEQ ID NO: 2113210 - DNA, 18 bp, Homo sapiens
tgccccgcttccccacag

SEQ ID NO: 2113211 - DNA, 19 bp, Homo sapiens
tgccccgcttccccacaga

SEQ ID NO: 2113212 - DNA, 21 bp, Homo sapiens
tgccccgcttccccacagaac

SEQ ID NO: 2113213 - DNA, 23 bp, Homo sapiens
tgccccgcttccccacagaactg

SEQ ID NO: 2113214 - DNA, 22 bp, Homo sapiens
tgccccgggtccccagctcccc

SEQ ID NO: 2113215 - DNA, 22 bp, Homo sapiens
tgcccctcacctgcctgccctc

SEQ ID NO: 2113216 - DNA, 13 bp, Homo sapiens
tgcccctgtaaat

SEQ ID NO: 2113217 - DNA, 21 bp, Homo sapiens
tgcccctgtaggttgcttaaa

SEQ ID NO: 2113218 - DNA, 19 bp, Homo sapiens
tgccccttcccatctcttc

SEQ ID NO: 2113219 - DNA, 17 bp, Homo sapiens
tgccccttccccatctc

SEQ ID NO: 2113220 - DNA, 23 bp, Homo sapiens
tgcacatgtaacatagatttatg

SEQ ID NO: 2113221 - DNA, 15 bp, Homo sapiens
tgcacatgtcttgta

SEQ ID NO: 2113222 - DNA, 19 bp, Homo sapiens
tgcacatgtcttgtacatg

SEQ ID NO: 2113223 - DNA, 12 bp, Homo sapiens
tgcacatgtgtc

SEQ ID NO: 2113224 - DNA, 15 bp, Homo sapiens
tgcacattcctggcc

SEQ ID NO: 2113225 - DNA, 16 bp, Homo sapiens
tgcacattcctggccc

SEQ ID NO: 2113226 - DNA, 19 bp, Homo sapiens
tgcacattttgtacaaaga

SEQ ID NO: 2113227 - DNA, 13 bp, Homo sapiens
tgcaccagccctt

SEQ ID NO: 2113228 - DNA, 21 bp, Homo sapiens
tgcaccagcccttccctgctt

SEQ ID NO: 2113229 - DNA, 22 bp, Homo sapiens
tgcaccagcccttccctgcttt

SEQ ID NO: 2113230 - DNA, 16 bp, Homo sapiens
tgcaccagtgccgcct

SEQ ID NO: 2113231 - DNA, 22 bp, Homo sapiens
tgcaccagtgccgcctgtgccc

SEQ ID NO: 2113232 - DNA, 17 bp, Homo sapiens
tgcaccatcacacatgc

SEQ ID NO: 2113233 - DNA, 15 bp, Homo sapiens
tgcaccatctgcttg

SEQ ID NO: 2113234 - DNA, 18 bp, Homo sapiens
tgcacccactcaccaggg

SEQ ID NO: 2113235 - DNA, 23 bp, Homo sapiens
tgcacccagaaattccttcccac

SEQ ID NO: 2113236 - DNA, 16 bp, Homo sapiens
tgcacccatgccatag

SEQ ID NO: 2113237 - DNA, 13 bp, Homo sapiens
tgcacccgtaccc

SEQ ID NO: 2113238 - DNA, 17 bp, Homo sapiens
tgcaccgggccacagag

SEQ ID NO: 2113239 - DNA, 14 bp, Homo sapiens
tgcacctaaagaaa

SEQ ID NO: 2113240 - DNA, 15 bp, Homo sapiens
tgcacctaaagaaaa

SEQ ID NO: 2113241 - DNA, 15 bp, Homo sapiens
tgcacctccccccac

SEQ ID NO: 2113242 - DNA, 17 bp, Homo sapiens
tgcacctgccagcctgg

SEQ ID NO: 2113243 - DNA, 19 bp, Homo sapiens
tgcacctgccagcctggct

SEQ ID NO: 2113244 - DNA, 17 bp, Homo sapiens
tgcacctgtactcagga

SEQ ID NO: 2113245 - DNA, 20 bp, Homo sapiens
tgcacctgtactcaggaggc

SEQ ID NO: 2113246 - DNA, 14 bp, Homo sapiens
tgcaccttgtgtct

SEQ ID NO: 2113247 - DNA, 15 bp, Homo sapiens
tgcaccttgtgtctg

SEQ ID NO: 2113248 - DNA, 14 bp, Homo sapiens
tgcacctttctagt

SEQ ID NO: 2113249 - DNA, 16 bp, Homo sapiens
tgcacgcacacatcag

SEQ ID NO: 2113250 - DNA, 14 bp, Homo sapiens
tgcacgtgtgtgca

SEQ ID NO: 2113251 - DNA, 15 bp, Homo sapiens
tgcacgtgtgtgcac

SEQ ID NO: 2113252 - DNA, 19 bp, Homo sapiens
tgcactagcattttcttga

SEQ ID NO: 2113253 - DNA, 14 bp, Homo sapiens
tgcactagcctgtg

SEQ ID NO: 2113254 - DNA, 16 bp, Homo sapiens
tgcactccagcctggg

SEQ ID NO: 2113255 - DNA, 15 bp, Homo sapiens
tgcactctagcctgg

SEQ ID NO: 2113256 - DNA, 10 bp, Homo sapiens
tgcactgaca

SEQ ID NO: 2113257 - DNA, 14 bp, Homo sapiens
tgcactgacatgtt

SEQ ID NO: 2113258 - DNA, 21 bp, Homo sapiens
tgcactgacattgttggccaa

SEQ ID NO: 2113259 - DNA, 14 bp, Homo sapiens
tgcactgagggcca

SEQ ID NO: 2113260 - DNA, 17 bp, Homo sapiens
tgcactgagggccacac

SEQ ID NO: 2113261 - DNA, 19 bp, Homo sapiens
tgcactgagggccacacta

SEQ ID NO: 2113262 - DNA, 15 bp, Homo sapiens
tgcactgggtgtggc

SEQ ID NO: 2113263 - DNA, 12 bp, Homo sapiens
tgcactgtgggg

SEQ ID NO: 2113264 - DNA, 20 bp, Homo sapiens
tgcagaaaagcacctgccga

SEQ ID NO: 2113265 - DNA, 13 bp, Homo sapiens
tgcagaaggccaa

SEQ ID NO: 2113266 - DNA, 15 bp, Homo sapiens
tgcagaaggccaaga

SEQ ID NO: 2113267 - DNA, 15 bp, Homo sapiens
tgcagaccctgccct

SEQ ID NO: 2113268 - DNA, 16 bp, Homo sapiens
tgcagactcaataaaa

SEQ ID NO: 2113269 - DNA, 19 bp, Homo sapiens
tgcagactcaataaaatca

SEQ ID NO: 2113270 - DNA, 14 bp, Homo sapiens
tgcagactcagttt

SEQ ID NO: 2113271 - DNA, 19 bp, Homo sapiens
tgcagactcagtttgtcag

SEQ ID NO: 2113272 - DNA, 20 bp, Homo sapiens
tgcagactcagtttgtcaga

SEQ ID NO: 2113273 - DNA, 14 bp, Homo sapiens
tgcagactcctcag

SEQ ID NO: 2113274 - DNA, 20 bp, Homo sapiens
tgcagactcctcagatctga

SEQ ID NO: 2113275 - DNA, 17 bp, Homo sapiens
tgcagactctacagagg

SEQ ID NO: 2113276 - DNA, 15 bp, Homo sapiens
tgcagactgtggctg

SEQ ID NO: 2113277 - DNA, 20 bp, Homo sapiens
tgcagagacaggacctgact

SEQ ID NO: 2113278 - DNA, 19 bp, Homo sapiens
tgcagagacgcaagggaga

SEQ ID NO: 2113279 - DNA, 13 bp, Homo sapiens
tgcagagagaagc

SEQ ID NO: 2113280 - DNA, 13 bp, Homo sapiens
tgcagagatttcc

SEQ ID NO: 2113281 - DNA, 18 bp, Homo sapiens
tgcagagatttcctccat

SEQ ID NO: 2113282 - DNA, 19 bp, Homo sapiens
tgcagagccttttacccct

SEQ ID NO: 2113283 - DNA, 14 bp, Homo sapiens
tgcagagctatggt

SEQ ID NO: 2113284 - DNA, 13 bp, Homo sapiens
tgcagaggggaaa

SEQ ID NO: 2113285 - DNA, 21 bp, Homo sapiens
tgcagaggggctttctggaga

SEQ ID NO: 2113286 - DNA, 20 bp, Homo sapiens
tgcagaggtgagcagaggag

SEQ ID NO: 2113287 - DNA, 14 bp, Homo sapiens
tgcagaggtttctt

SEQ ID NO: 2113288 - DNA, 20 bp, Homo sapiens
tgcagatagccagacacatg

SEQ ID NO: 2113289 - DNA, 13 bp, Homo sapiens
tgcagattcattt

SEQ ID NO: 2113290 - DNA, 15 bp, Homo sapiens
tgcagattcctgggc

SEQ ID NO: 2113291 - DNA, 16 bp, Homo sapiens
tgcagattcctgggcc

SEQ ID NO: 2113292 - DNA, 19 bp, Homo sapiens
tgcagattcctgggcctgt

SEQ ID NO: 2113293 - DNA, 20 bp, Homo sapiens
tgcagattcctgggcctgtc

SEQ ID NO: 2113294 - DNA, 14 bp, Homo sapiens
tgcagattctgatt

SEQ ID NO: 2113295 - DNA, 16 bp, Homo sapiens
tgcagattctgatttt

SEQ ID NO: 2113296 - DNA, 20 bp, Homo sapiens
tgcagcaactcccacgactg

SEQ ID NO: 2113297 - DNA, 16 bp, Homo sapiens
tgcagcagaagccaaa

SEQ ID NO: 2113298 - DNA, 11 bp, Homo sapiens
tgcagcagccc

SEQ ID NO: 2113299 - DNA, 13 bp, Homo sapiens
tgcagcagcccag

SEQ ID NO: 2113300 - DNA, 20 bp, Homo sapiens
tgcagcagcccagcttcctg

SEQ ID NO: 2113301 - DNA, 18 bp, Homo sapiens
tgcagcagtgagtctctt

SEQ ID NO: 2113302 - DNA, 13 bp, Homo sapiens
tgcagccaaacag

SEQ ID NO: 2113303 - DNA, 18 bp, Homo sapiens
tgcagccaaacagagcct

SEQ ID NO: 2113304 - DNA, 16 bp, Homo sapiens
tgcagccagcccagcc

SEQ ID NO: 2113305 - DNA, 20 bp, Homo sapiens
tgcagcccggcgccaccatc

SEQ ID NO: 2113306 - DNA, 14 bp, Homo sapiens
tgcagcccttcctc

SEQ ID NO: 2113307 - DNA, 19 bp, Homo sapiens
tgcagcgaaccaatatttg

SEQ ID NO: 2113308 - DNA, 24 bp, Homo sapiens
tgcagctgggccccatgctctgcc

SEQ ID NO: 2113309 - DNA, 17 bp, Homo sapiens
tgcagcttcatcaattt

SEQ ID NO: 2113310 - DNA, 18 bp, Homo sapiens
tgcagcttcatcaatttt

SEQ ID NO: 2113311 - DNA, 13 bp, Homo sapiens
tgcagcttcctgt

SEQ ID NO: 2113312 - DNA, 15 bp, Homo sapiens
tgcagcttcctgtca

SEQ ID NO: 2113313 - DNA, 20 bp, Homo sapiens
tgcagcttcggggcaagtga

SEQ ID NO: 2113314 - DNA, 15 bp, Homo sapiens
tgcagcttctgtcct

SEQ ID NO: 2113315 - DNA, 15 bp, Homo sapiens
tgcagctttacatgc

SEQ ID NO: 2113316 - DNA, 16 bp, Homo sapiens
tgcagctttacatgca

SEQ ID NO: 2113317 - DNA, 16 bp, Homo sapiens
tgcaggaacgagcact

SEQ ID NO: 2113318 - DNA, 17 bp, Homo sapiens
tgcaggaacgagcactg

SEQ ID NO: 2113319 - DNA, 21 bp, Homo sapiens
tgcaggaacgagcactggcca

SEQ ID NO: 2113320 - DNA, 16 bp, Homo sapiens
tgcaggaataaggcct

SEQ ID NO: 2113321 - DNA, 17 bp, Homo sapiens
tgcaggaataaggcctt

SEQ ID NO: 2113322 - DNA, 12 bp, Homo sapiens
tgcaggaatcaa

SEQ ID NO: 2113323 - DNA, 14 bp, Homo sapiens
tgcaggaatcaaaa

SEQ ID NO: 2113324 - DNA, 21 bp, Homo sapiens
tgcaggaatcaaaaattgaag

SEQ ID NO: 2113325 - DNA, 19 bp, Homo sapiens
tgcaggcaccttagtggct

SEQ ID NO: 2113326 - DNA, 16 bp, Homo sapiens
tgcaggcccagcagac

SEQ ID NO: 2113327 - DNA, 21 bp, Homo sapiens
tgcaggcctgctcagggactg

SEQ ID NO: 2113328 - DNA, 12 bp, Homo sapiens
tgcaggctctgg

SEQ ID NO: 2113329 - DNA, 22 bp, Homo sapiens
tgcaggctctgggctcagggct

SEQ ID NO: 2113330 - DNA, 13 bp, Homo sapiens
tgcagggaagagg

SEQ ID NO: 2113331 - DNA, 15 bp, Homo sapiens
tgcagggaagagggc

SEQ ID NO: 2113332 - DNA, 17 bp, Homo sapiens
tgcagggaagagggcag

SEQ ID NO: 2113333 - DNA, 20 bp, Homo sapiens
tgcagggaagagggcagtac

SEQ ID NO: 2113334 - DNA, 14 bp, Homo sapiens
tgcagggagccgag

SEQ ID NO: 2113335 - DNA, 23 bp, Homo sapiens
tgcagggagctgggcttccagaa

SEQ ID NO: 2113336 - DNA, 24 bp, Homo sapiens
tgcagggaggaggtggcagccctg

SEQ ID NO: 2113337 - DNA, 13 bp, Homo sapiens
tgcagggagtccg

SEQ ID NO: 2113338 - DNA, 15 bp, Homo sapiens
tctgataatgaaaat

SEQ ID NO: 2113339 - DNA, 15 bp, Homo sapiens
tctgataggaaaaga

SEQ ID NO: 2113340 - DNA, 13 bp, Homo sapiens
tctgatatgggac

SEQ ID NO: 2113341 - DNA, 15 bp, Homo sapiens
tctgatccctcgccc

SEQ ID NO: 2113342 - DNA, 21 bp, Homo sapiens
tctgatcgggataacaaaatc

SEQ ID NO: 2113343 - DNA, 23 bp, Homo sapiens
tctgatcgggataacaaaatcac

SEQ ID NO: 2113344 - DNA, 17 bp, Homo sapiens
tctgatggtgagctggg

SEQ ID NO: 2113345 - DNA, 18 bp, Homo sapiens
tctgatggtgagctggga

SEQ ID NO: 2113346 - DNA, 20 bp, Homo sapiens
tctgatggtgagctgggaag

SEQ ID NO: 2113347 - DNA, 18 bp, Homo sapiens
tctgatgtttgttgctag

SEQ ID NO: 2113348 - DNA, 18 bp, Homo sapiens
tctgattatcaggtactg

SEQ ID NO: 2113349 - DNA, 11 bp, Homo sapiens
tctgattccac

SEQ ID NO: 2113350 - DNA, 22 bp, Homo sapiens
tctgattcgaatgacactgttc

SEQ ID NO: 2113351 - DNA, 18 bp, Homo sapiens
tctgattggctcacccaa

SEQ ID NO: 2113352 - DNA, 16 bp, Homo sapiens
tctgatttaatgtttt

SEQ ID NO: 2113353 - DNA, 14 bp, Homo sapiens
tctgattttggcat

SEQ ID NO: 2113354 - DNA, 17 bp, Homo sapiens
tctgatttttttgttgt

SEQ ID NO: 2113355 - DNA, 15 bp, Homo sapiens
tctgcaactagccaa

SEQ ID NO: 2113356 - DNA, 18 bp, Homo sapiens
tctgcaactagccaaggc

SEQ ID NO: 2113357 - DNA, 12 bp, Homo sapiens
tctgcacatgaa

SEQ ID NO: 2113358 - DNA, 19 bp, Homo sapiens
tctgcacccagaaattcct

SEQ ID NO: 2113359 - DNA, 21 bp, Homo sapiens
tctgcacccagaaattccttc

SEQ ID NO: 2113360 - DNA, 15 bp, Homo sapiens
tctgcacccaggggt

SEQ ID NO: 2113361 - DNA, 13 bp, Homo sapiens
tctgcactccatg

SEQ ID NO: 2113362 - DNA, 15 bp, Homo sapiens
tctgcactccatggc

SEQ ID NO: 2113363 - DNA, 18 bp, Homo sapiens
tctgcactccatggccac

SEQ ID NO: 2113364 - DNA, 19 bp, Homo sapiens
tctgcactccatggccacc

SEQ ID NO: 2113365 - DNA, 12 bp, Homo sapiens
tctgcactgaaa

SEQ ID NO: 2113366 - DNA, 17 bp, Homo sapiens
tctgcagcaactcccac

SEQ ID NO: 2113367 - DNA, 21 bp, Homo sapiens
tctgcagcaactcccacgact

SEQ ID NO: 2113368 - DNA, 15 bp, Homo sapiens
tctgcagccagccca

SEQ ID NO: 2113369 - DNA, 19 bp, Homo sapiens
tctgcagccagcccagccc

SEQ ID NO: 2113370 - DNA, 14 bp, Homo sapiens
tctgcaggcacctt

SEQ ID NO: 2113371 - DNA, 16 bp, Homo sapiens
tctgcagtagtctctg

SEQ ID NO: 2113372 - DNA, 20 bp, Homo sapiens
tctgcagtagtctctgtgct

SEQ ID NO: 2113373 - DNA, 21 bp, Homo sapiens
tctgcagtagtctctgtgctt

SEQ ID NO: 2113374 - DNA, 14 bp, Homo sapiens
tctgcataaacttc

SEQ ID NO: 2113375 - DNA, 12 bp, Homo sapiens
tctgcatggaaa

SEQ ID NO: 2113376 - DNA, 21 bp, Homo sapiens
tctgcattgttattgtggaag

SEQ ID NO: 2113377 - DNA, 19 bp, Homo sapiens
tctgcatttataaatgtgt

SEQ ID NO: 2113378 - DNA, 14 bp, Homo sapiens
tctgccacagagag

SEQ ID NO: 2113379 - DNA, 16 bp, Homo sapiens
tctgccacagagagtc

SEQ ID NO: 2113380 - DNA, 23 bp, Homo sapiens
tctgccacagagagtcctttggg

SEQ ID NO: 2113381 - DNA, 20 bp, Homo sapiens
tctgccacctcccctatcca

SEQ ID NO: 2113382 - DNA, 14 bp, Homo sapiens
tctgccaggcccat

SEQ ID NO: 2113383 - DNA, 22 bp, Homo sapiens
tctgccatattctgttggccag

SEQ ID NO: 2113384 - DNA, 14 bp, Homo sapiens
tctgccccaagcag

SEQ ID NO: 2113385 - DNA, 22 bp, Homo sapiens
tgacctccctctaatttatctt

SEQ ID NO: 2113386 - DNA, 13 bp, Homo sapiens
tgacctctgcctg

SEQ ID NO: 2113387 - DNA, 21 bp, Homo sapiens
tgacctgaccggcacctgcga

SEQ ID NO: 2113388 - DNA, 18 bp, Homo sapiens
tgacctgaggctcctgtg

SEQ ID NO: 2113389 - DNA, 16 bp, Homo sapiens
tgacctgatcacctct

SEQ ID NO: 2113390 - DNA, 15 bp, Homo sapiens
tgacctgcctctcac

SEQ ID NO: 2113391 - DNA, 11 bp, Homo sapiens
tgacctgctga

SEQ ID NO: 2113392 - DNA, 14 bp, Homo sapiens
tgacctgctgagct

SEQ ID NO: 2113393 - DNA, 16 bp, Homo sapiens
tgacctgctgagctct

SEQ ID NO: 2113394 - DNA, 12 bp, Homo sapiens
tgacctgtcacc

SEQ ID NO: 2113395 - DNA, 12 bp, Homo sapiens
tgaccttcacat

SEQ ID NO: 2113396 - DNA, 17 bp, Homo sapiens
tgaccttggagagacac

SEQ ID NO: 2113397 - DNA, 22 bp, Homo sapiens
tgacgattatttatttctgtaa

SEQ ID NO: 2113398 - DNA, 12 bp, Homo sapiens
tgacgcatcctg

SEQ ID NO: 2113399 - DNA, 19 bp, Homo sapiens
tgacgggagcctcctctgc

SEQ ID NO: 2113400 - DNA, 18 bp, Homo sapiens
tgacgggaggcctcagtt

SEQ ID NO: 2113401 - DNA, 21 bp, Homo sapiens
tgacggtcccacactggtgac

SEQ ID NO: 2113402 - DNA, 16 bp, Homo sapiens
tgacgtgaccatggtg

SEQ ID NO: 2113403 - DNA, 17 bp, Homo sapiens
tgactagaccccaccct

SEQ ID NO: 2113404 - DNA, 21 bp, Homo sapiens
tgactagaggcagggagggga

SEQ ID NO: 2113405 - DNA, 16 bp, Homo sapiens
tgactagtcatagaaa

SEQ ID NO: 2113406 - DNA, 18 bp, Homo sapiens
tgactagtcatagaaata

SEQ ID NO: 2113407 - DNA, 16 bp, Homo sapiens
tgactatatagagatg

SEQ ID NO: 2113408 - DNA, 18 bp, Homo sapiens
tgactatatagagatgtt

SEQ ID NO: 2113409 - DNA, 21 bp, Homo sapiens
tgactatatagagatgttttt

SEQ ID NO: 2113410 - DNA, 22 bp, Homo sapiens
tgactatcaaactgaagccaga

SEQ ID NO: 2113411 - DNA, 17 bp, Homo sapiens
tgactatcacatacaat

SEQ ID NO: 2113412 - DNA, 19 bp, Homo sapiens
tgactatcacatacaattt

SEQ ID NO: 2113413 - DNA, 23 bp, Homo sapiens
tgactatcacatacaatttgcac

SEQ ID NO: 2113414 - DNA, 20 bp, Homo sapiens
tgactatggctctggcacca

SEQ ID NO: 2113415 - DNA, 17 bp, Homo sapiens
tgactattttttaataa

SEQ ID NO: 2113416 - DNA, 16 bp, Homo sapiens
tgactcaaatctccag

SEQ ID NO: 2113417 - DNA, 12 bp, Homo sapiens
tgactcaagttt

SEQ ID NO: 2113418 - DNA, 21 bp, Homo sapiens
tgactcaagtttttacaaaat

SEQ ID NO: 2113419 - DNA, 19 bp, Homo sapiens
tgactcacaagaagaccag

SEQ ID NO: 2113420 - DNA, 13 bp, Homo sapiens
tgactcacccaag

SEQ ID NO: 2113421 - DNA, 14 bp, Homo sapiens
tgactcacccaagc

SEQ ID NO: 2113422 - DNA, 19 bp, Homo sapiens
tgactccaagaacaattgt

SEQ ID NO: 2113423 - DNA, 13 bp, Homo sapiens
tgactccagagtc

SEQ ID NO: 2113424 - DNA, 19 bp, Homo sapiens
tgactccagagtctgagcc

SEQ ID NO: 2113425 - DNA, 23 bp, Homo sapiens
tgactccagagtctgagcccccg

SEQ ID NO: 2113426 - DNA, 19 bp, Homo sapiens
tgactccatatggaggcct

SEQ ID NO: 2113427 - DNA, 21 bp, Homo sapiens
tgactccttgtggtttatgtc

SEQ ID NO: 2113428 - DNA, 17 bp, Homo sapiens
tgactcctttctctatc

SEQ ID NO: 2113429 - DNA, 14 bp, Homo sapiens
tgactcggtgtaaa

SEQ ID NO: 2113430 - DNA, 21 bp, Homo sapiens
tgactcggtgtaaaaccatgt

SEQ ID NO: 2113431 - DNA, 13 bp, Homo sapiens
tgactcttgcctt

SEQ ID NO: 2113432 - DNA, 22 bp, Homo sapiens
tgactctttgacgggaggcctc

SEQ ID NO: 2113433 - DNA, 13 bp, Homo sapiens
tgactgaactgca

SEQ ID NO: 2113434 - DNA, 19 bp, Homo sapiens
tgactgaaggggcacacca

SEQ ID NO: 2113435 - DNA, 18 bp, Homo sapiens
tgactgacacaggccagc

SEQ ID NO: 2113436 - DNA, 15 bp, Homo sapiens
tgactgccccaactc

SEQ ID NO: 2113437 - DNA, 17 bp, Homo sapiens
tgactgccccaactcct

SEQ ID NO: 2113438 - DNA, 22 bp, Homo sapiens
tgactgctccccagccctggct

SEQ ID NO: 2113439 - DNA, 23 bp, Homo sapiens
tgactgctccccagccctggctc

SEQ ID NO: 2113440 - DNA, 11 bp, Homo sapiens
tgactggcagg

SEQ ID NO: 2113441 - DNA, 18 bp, Homo sapiens
tgactgtactcctcccag

SEQ ID NO: 2113442 - DNA, 16 bp, Homo sapiens
tgactgtcccaccggg

SEQ ID NO: 2113443 - DNA, 15 bp, Homo sapiens
tgactgtcgtgttta

SEQ ID NO: 2113444 - DNA, 17 bp, Homo sapiens
tgactgtcgtgtttaca

SEQ ID NO: 2113445 - DNA, 21 bp, Homo sapiens
tgactgtcgtgtttacaaaag

SEQ ID NO: 2113446 - DNA, 20 bp, Homo sapiens
tgactgtttttcggacagtt

SEQ ID NO: 2113447 - DNA, 19 bp, Homo sapiens
tgacttactgtttcttacc

SEQ ID NO: 2113448 - DNA, 20 bp, Homo sapiens
tgacttcttggtttggggag

SEQ ID NO: 2113449 - DNA, 21 bp, Homo sapiens
tgacttcttggtttggggaga

SEQ ID NO: 2113450 - DNA, 20 bp, Homo sapiens
tgacttgcacatctctgcag

SEQ ID NO: 2113451 - DNA, 21 bp, Homo sapiens
tgacttgcagagttcatggaa

SEQ ID NO: 2113452 - DNA, 22 bp, Homo sapiens
tgacttgggcacccccagcctg

SEQ ID NO: 2113453 - DNA, 18 bp, Homo sapiens
tgactttttagccagtga

SEQ ID NO: 2113454 - DNA, 13 bp, Homo sapiens
tgactttttataa

SEQ ID NO: 2113455 - DNA, 15 bp, Homo sapiens
tgactttttataatg

SEQ ID NO: 2113456 - DNA, 22 bp, Homo sapiens
tgactttttataatgtggattt

SEQ ID NO: 2113457 - DNA, 16 bp, Homo sapiens
tgactttttcagagtt

SEQ ID NO: 2113458 - DNA, 16 bp, Homo sapiens
tgactttttttctgat

SEQ ID NO: 2113459 - DNA, 21 bp, Homo sapiens
tgagaaaaatttacatggcaa

SEQ ID NO: 2113460 - DNA, 19 bp, Homo sapiens
tgagaaaagctttgaaccc

SEQ ID NO: 2113461 - DNA, 19 bp, Homo sapiens
tgagaaaccagccgaccgg

SEQ ID NO: 2113462 - DNA, 21 bp, Homo sapiens
tgagaaactttgatctctgct

SEQ ID NO: 2113463 - DNA, 15 bp, Homo sapiens
tgagaaagactattc

SEQ ID NO: 2113464 - DNA, 16 bp, Homo sapiens
tgagaaagactattca

SEQ ID NO: 2113465 - DNA, 18 bp, Homo sapiens
tgagaaagactattcaaa

SEQ ID NO: 2113466 - DNA, 14 bp, Homo sapiens
tgagaaatgtgaac

SEQ ID NO: 2113467 - DNA, 21 bp, Homo sapiens
tgagaacaagtcacagctgca

SEQ ID NO: 2113468 - DNA, 15 bp, Homo sapiens
tgagaacctggcctt

SEQ ID NO: 2113469 - DNA, 16 bp, Homo sapiens
tgagaagagggcctgt

SEQ ID NO: 2113470 - DNA, 23 bp, Homo sapiens
tgagaagagggcctgtgggagcc

SEQ ID NO: 2113471 - DNA, 19 bp, Homo sapiens
tgagaagctgggcatgaac

SEQ ID NO: 2113472 - DNA, 16 bp, Homo sapiens
tgagaagggaaatctt

SEQ ID NO: 2113473 - DNA, 14 bp, Homo sapiens
tgagaagtgtatat

SEQ ID NO: 2113474 - DNA, 16 bp, Homo sapiens
tgagaagttaagcagc

SEQ ID NO: 2113475 - DNA, 17 bp, Homo sapiens
tgagaagttttgtacag

SEQ ID NO: 2113476 - DNA, 15 bp, Homo sapiens
tgagaatagtgtctg

SEQ ID NO: 2113477 - DNA, 16 bp, Homo sapiens
tgagaatcctgcctct

SEQ ID NO: 2113478 - DNA, 22 bp, Homo sapiens
tgagaatgcccaactcttcatt

SEQ ID NO: 2113479 - DNA, 12 bp, Homo sapiens
tgagaattattc

SEQ ID NO: 2113480 - DNA, 15 bp, Homo sapiens
tgagaattccaagga

SEQ ID NO: 2113481 - DNA, 16 bp, Homo sapiens
tgagaattccaaggag

SEQ ID NO: 2113482 - DNA, 17 bp, Homo sapiens
tgagacaagccctggca

SEQ ID NO: 2113483 - DNA, 18 bp, Homo sapiens
tgagacaagccctggcaa

SEQ ID NO: 2113484 - DNA, 19 bp, Homo sapiens
tgagacaagccctggcaac

SEQ ID NO: 2113485 - DNA, 11 bp, Homo sapiens
tgagacagagt

SEQ ID NO: 2113486 - DNA, 21 bp, Homo sapiens
tgagacagagttttcactctt

SEQ ID NO: 2113487 - DNA, 17 bp, Homo sapiens
tgagacattacagtttg

SEQ ID NO: 2113488 - DNA, 13 bp, Homo sapiens
tgagaccacagag

SEQ ID NO: 2113489 - DNA, 15 bp, Homo sapiens
tgagaccagcctggc

SEQ ID NO: 2113490 - DNA, 19 bp, Homo sapiens
tgagaccagcctggccaac

SEQ ID NO: 2113491 - DNA, 21 bp, Homo sapiens
tgagaccagttgggagcactg

SEQ ID NO: 2113492 - DNA, 15 bp, Homo sapiens
tgagacggcagagac

SEQ ID NO: 2113493 - DNA, 21 bp, Homo sapiens
tgagacggtgctcgcttctcc

SEQ ID NO: 2113494 - DNA, 13 bp, Homo sapiens
tgagactccagaa

SEQ ID NO: 2113495 - DNA, 14 bp, Homo sapiens
tgagacttgctctc

SEQ ID NO: 2113496 - DNA, 20 bp, Homo sapiens
tgagacttgctctctggcct

SEQ ID NO: 2113497 - DNA, 16 bp, Homo sapiens
tgagagaagccacgct

SEQ ID NO: 2113498 - DNA, 18 bp, Homo sapiens
tgaggaattttctttgtg

SEQ ID NO: 2113499 - DNA, 14 bp, Homo sapiens
tgaggacacatgtc

SEQ ID NO: 2113500 - DNA, 12 bp, Homo sapiens
tgaggacatgga

SEQ ID NO: 2113501 - DNA, 21 bp, Homo sapiens
tgaggacatgtttttgttttc

SEQ ID NO: 2113502 - DNA, 17 bp, Homo sapiens
tgaggactcatatattt

SEQ ID NO: 2113503 - DNA, 16 bp, Homo sapiens
tgaggagcagcttcag

SEQ ID NO: 2113504 - DNA, 21 bp, Homo sapiens
tgaggaggactactatttgaa

SEQ ID NO: 2113505 - DNA, 13 bp, Homo sapiens
tgaggagggtgcc

SEQ ID NO: 2113506 - DNA, 18 bp, Homo sapiens
tgaggagggtggaggaag

SEQ ID NO: 2113507 - DNA, 19 bp, Homo sapiens
tgaggagtagctgagagga

SEQ ID NO: 2113508 - DNA, 13 bp, Homo sapiens
tgaggagtctgag

SEQ ID NO: 2113509 - DNA, 16 bp, Homo sapiens
tgaggagtctgaggtc

SEQ ID NO: 2113510 - DNA, 21 bp, Homo sapiens
tgaggagtctgaggtcctgag

SEQ ID NO: 2113511 - DNA, 16 bp, Homo sapiens
tgaggagtgtgagaat

SEQ ID NO: 2113512 - DNA, 17 bp, Homo sapiens
tgaggatcctcacagga

SEQ ID NO: 2113513 - DNA, 18 bp, Homo sapiens
tgaggatcctcacaggag

SEQ ID NO: 2113514 - DNA, 20 bp, Homo sapiens
tgaggatcctcacaggagca

SEQ ID NO: 2113515 - DNA, 12 bp, Homo sapiens
cagctaggactg

SEQ ID NO: 2113516 - DNA, 14 bp, Homo sapiens
cagctaggactgag

SEQ ID NO: 2113517 - DNA, 15 bp, Homo sapiens
cagctagggctggac

SEQ ID NO: 2113518 - DNA, 19 bp, Homo sapiens
cagctcaagtcttccctga

SEQ ID NO: 2113519 - DNA, 22 bp, Homo sapiens
cagctcaagtcttccctgatca

SEQ ID NO: 2113520 - DNA, 15 bp, Homo sapiens
cagctcacaagccca

SEQ ID NO: 2113521 - DNA, 16 bp, Homo sapiens
cagctcacaagcccag

SEQ ID NO: 2113522 - DNA, 13 bp, Homo sapiens
cagctcaccagcc

SEQ ID NO: 2113523 - DNA, 16 bp, Homo sapiens
cagctcaccagcccca

SEQ ID NO: 2113524 - DNA, 17 bp, Homo sapiens
cagctcaccagccccag

SEQ ID NO: 2113525 - DNA, 22 bp, Homo sapiens
cagctcaccagccccagtgccc

SEQ ID NO: 2113526 - DNA, 16 bp, Homo sapiens
cagctcacctctgaag

SEQ ID NO: 2113527 - DNA, 23 bp, Homo sapiens
tccccagacacattctcctgtgc

SEQ ID NO: 2113528 - DNA, 12 bp, Homo sapiens
tccccagactca

SEQ ID NO: 2113529 - DNA, 16 bp, Homo sapiens
tccccagactcagctc

SEQ ID NO: 2113530 - DNA, 18 bp, Homo sapiens
tccccagattgcaacagg

SEQ ID NO: 2113531 - DNA, 19 bp, Homo sapiens
tccccagattgcaacaggc

SEQ ID NO: 2113532 - DNA, 21 bp, Homo sapiens
tccccagcaagtgagagctgg

SEQ ID NO: 2113533 - DNA, 22 bp, Homo sapiens
tccccagcaagtgagagctggg

SEQ ID NO: 2113534 - DNA, 14 bp, Homo sapiens
tccccagccagaag

SEQ ID NO: 2113535 - DNA, 17 bp, Homo sapiens
tccccagccagaagtta

SEQ ID NO: 2113536 - DNA, 13 bp, Homo sapiens
tccccagccctgg

SEQ ID NO: 2113537 - DNA, 18 bp, Homo sapiens
tccccagccctggctctg

SEQ ID NO: 2113538 - DNA, 14 bp, Homo sapiens
tccccagcccttct

SEQ ID NO: 2113539 - DNA, 19 bp, Homo sapiens
tccccagcccttctgcctt

SEQ ID NO: 2113540 - DNA, 15 bp, Homo sapiens
tccccagctccccag

SEQ ID NO: 2113541 - DNA, 19 bp, Homo sapiens
tccccagctccccaggact

SEQ ID NO: 2113542 - DNA, 15 bp, Homo sapiens
tccccagctggtcca

SEQ ID NO: 2113543 - DNA, 17 bp, Homo sapiens
tccccaggactcaccct

SEQ ID NO: 2113544 - DNA, 20 bp, Homo sapiens
tccccaggcctccagcctct

SEQ ID NO: 2113545 - DNA, 21 bp, Homo sapiens
tccccaggcctccagcctctc

SEQ ID NO: 2113546 - DNA, 21 bp, Homo sapiens
tccccagggcccctccctctg

SEQ ID NO: 2113547 - DNA, 18 bp, Homo sapiens
tccccaggggaaaatgaa

SEQ ID NO: 2113548 - DNA, 14 bp, Homo sapiens
tccccaggggagag

SEQ ID NO: 2113549 - DNA, 21 bp, Homo sapiens
tccccaggtctctccactgct

SEQ ID NO: 2113550 - DNA, 18 bp, Homo sapiens
tccccaggtggctgaccc

SEQ ID NO: 2113551 - DNA, 16 bp, Homo sapiens
tccccagtcccaatgc

SEQ ID NO: 2113552 - DNA, 14 bp, Homo sapiens
tccccagtgtggcc

SEQ ID NO: 2113553 - DNA, 14 bp, Homo sapiens
tccccatctgggtc

SEQ ID NO: 2113554 - DNA, 19 bp, Homo sapiens
tccccatttaggtttctga

SEQ ID NO: 2113555 - DNA, 17 bp, Homo sapiens
tcccccaccacactgaa

SEQ ID NO: 2113556 - DNA, 17 bp, Homo sapiens
tcccccaccccagagtt

SEQ ID NO: 2113557 - DNA, 21 bp, Homo sapiens
tcccccaccccctccccaggg

SEQ ID NO: 2113558 - DNA, 22 bp, Homo sapiens
tcccccactcctcttatttgct

SEQ ID NO: 2113559 - DNA, 16 bp, Homo sapiens
tcccccagacagagcc

SEQ ID NO: 2113560 - DNA, 23 bp, Homo sapiens
tcccccagtcattctgggaacat

SEQ ID NO: 2113561 - DNA, 14 bp, Homo sapiens
tcccccatgtggct

SEQ ID NO: 2113562 - DNA, 15 bp, Homo sapiens
tcccccatgtggctg

SEQ ID NO: 2113563 - DNA, 17 bp, Homo sapiens
tcccccatgtggctgaa

SEQ ID NO: 2113564 - DNA, 14 bp, Homo sapiens
tcccccctcactcc

SEQ ID NO: 2113565 - DNA, 17 bp, Homo sapiens
tcccccgacactgctgc

SEQ ID NO: 2113566 - DNA, 18 bp, Homo sapiens
tcccccgacactgctgca

SEQ ID NO: 2113567 - DNA, 21 bp, Homo sapiens
tcccccgacactgctgcacca

SEQ ID NO: 2113568 - DNA, 20 bp, Homo sapiens
tcccccgcagtccccagccc

SEQ ID NO: 2113569 - DNA, 15 bp, Homo sapiens
tcccccgcccaaggc

SEQ ID NO: 2113570 - DNA, 17 bp, Homo sapiens
tcccccgctggcagcca

SEQ ID NO: 2113571 - DNA, 12 bp, Homo sapiens
tccccctgcctt

SEQ ID NO: 2113572 - DNA, 13 bp, Homo sapiens
tccccctgcttct

SEQ ID NO: 2113573 - DNA, 12 bp, Homo sapiens
tccccctgggct

SEQ ID NO: 2113574 - DNA, 14 bp, Homo sapiens
tccccctgggctct

SEQ ID NO: 2113575 - DNA, 14 bp, Homo sapiens
tccccgcacccccc

SEQ ID NO: 2113576 - DNA, 15 bp, Homo sapiens
tccccgcagagctcc

SEQ ID NO: 2113577 - DNA, 16 bp, Homo sapiens
tccccgctgcccaatc

SEQ ID NO: 2113578 - DNA, 13 bp, Homo sapiens
tccccggcctcag

SEQ ID NO: 2113579 - DNA, 14 bp, Homo sapiens
tccccggctgcttc

SEQ ID NO: 2113580 - DNA, 15 bp, Homo sapiens
tccccgggggaggaa

SEQ ID NO: 2113581 - DNA, 22 bp, Homo sapiens
tccccggtcccttgagacctca

SEQ ID NO: 2113582 - DNA, 15 bp, Homo sapiens
tcccctatccaccca

SEQ ID NO: 2113583 - DNA, 18 bp, Homo sapiens
tcccctcactctgtcagc

SEQ ID NO: 2113584 - DNA, 15 bp, Homo sapiens
tcccctcagagctct

SEQ ID NO: 2113585 - DNA, 22 bp, Homo sapiens
tcccctcatggagaaacatcct

SEQ ID NO: 2113586 - DNA, 15 bp, Homo sapiens
tcccctcccccctgt

SEQ ID NO: 2113587 - DNA, 14 bp, Homo sapiens
tcccctccctcttc

SEQ ID NO: 2113588 - DNA, 16 bp, Homo sapiens
tcccctcggagaagag

SEQ ID NO: 2113589 - DNA, 17 bp, Homo sapiens
tcccctctccctgggga

SEQ ID NO: 2113590 - DNA, 19 bp, Homo sapiens
tcccctctgtcatcactcc

SEQ ID NO: 2113591 - DNA, 12 bp, Homo sapiens
tcccctgaagac

SEQ ID NO: 2113592 - DNA, 11 bp, Homo sapiens
tcccctgccag

SEQ ID NO: 2113593 - DNA, 12 bp, Homo sapiens
tcccctgccagg

SEQ ID NO: 2113594 - DNA, 14 bp, Homo sapiens
tcccctgccagggc

SEQ ID NO: 2113595 - DNA, 15 bp, Homo sapiens
tcccctgccagggct

SEQ ID NO: 2113596 - DNA, 12 bp, Homo sapiens
tcccctgccctg

SEQ ID NO: 2113597 - DNA, 17 bp, Homo sapiens
tcccctggactgggagg

SEQ ID NO: 2113598 - DNA, 15 bp, Homo sapiens
tcccctgggcctgga

SEQ ID NO: 2113599 - DNA, 17 bp, Homo sapiens
tcccctgtcccaccaac

SEQ ID NO: 2113600 - DNA, 18 bp, Homo sapiens
tcccctgtcccaccaact

SEQ ID NO: 2113601 - DNA, 21 bp, Homo sapiens
tccccttcactccctccctgg

SEQ ID NO: 2113602 - DNA, 18 bp, Homo sapiens
tccccttcctgcacccgt

SEQ ID NO: 2113603 - DNA, 19 bp, Homo sapiens
tccccttcctgcacccgta

SEQ ID NO: 2113604 - DNA, 14 bp, Homo sapiens
tccccttgcccttg

SEQ ID NO: 2113605 - DNA, 18 bp, Homo sapiens
tccccttgcccttgccct

SEQ ID NO: 2113606 - DNA, 23 bp, Homo sapiens
tccccttgcccttgccctgacct

SEQ ID NO: 2113607 - DNA, 22 bp, Homo sapiens
tccccttggcttcctccgtcca

SEQ ID NO: 2113608 - DNA, 12 bp, Homo sapiens
tcccctttcctc

SEQ ID NO: 2113609 - DNA, 18 bp, Homo sapiens
tccccttttgcctggctg

SEQ ID NO: 2113610 - DNA, 20 bp, Homo sapiens
tcccgagcaaagtctaaagt

SEQ ID NO: 2113611 - DNA, 17 bp, Homo sapiens
tcccgagtagctgggac

SEQ ID NO: 2113612 - DNA, 19 bp, Homo sapiens
tcccgccaggaggtcctcc

SEQ ID NO: 2113613 - DNA, 19 bp, Homo sapiens
tcccgcctcttcttcttca

SEQ ID NO: 2113614 - DNA, 13 bp, Homo sapiens
tcccgctcagccc

SEQ ID NO: 2113615 - DNA, 16 bp, Homo sapiens
tcccgctcagccctcc

SEQ ID NO: 2113616 - DNA, 20 bp, Homo sapiens
tcccgctcagccctccctgc

SEQ ID NO: 2113617 - DNA, 15 bp, Homo sapiens
tcccgctcctgctga

SEQ ID NO: 2113618 - DNA, 17 bp, Homo sapiens
tcccggagcacagccct

SEQ ID NO: 2113619 - DNA, 18 bp, Homo sapiens
tcccggagcacagccctg

SEQ ID NO: 2113620 - DNA, 21 bp, Homo sapiens
tcccggctgggtgggcctggc

SEQ ID NO: 2113621 - DNA, 22 bp, Homo sapiens
tcccggtcatgcttttgccact

SEQ ID NO: 2113622 - DNA, 15 bp, Homo sapiens
tcccggttcaccttg

SEQ ID NO: 2113623 - DNA, 20 bp, Homo sapiens
tccctaaaataaaaaccaga

SEQ ID NO: 2113624 - DNA, 18 bp, Homo sapiens
tccctaaagaaaaaaaat

SEQ ID NO: 2113625 - DNA, 16 bp, Homo sapiens
tccctaactctcggga

SEQ ID NO: 2113626 - DNA, 15 bp, Homo sapiens
tccctaaggaatctg

SEQ ID NO: 2113627 - DNA, 14 bp, Homo sapiens
tccctacccactct

SEQ ID NO: 2113628 - DNA, 15 bp, Homo sapiens
tccctacccactctt

SEQ ID NO: 2113629 - DNA, 21 bp, Homo sapiens
tccctaccgagtctcttctcc

SEQ ID NO: 2113630 - DNA, 22 bp, Homo sapiens
tccctaccgagtctcttctcca

SEQ ID NO: 2113631 - DNA, 23 bp, Homo sapiens
tccctaccgagtctcttctccac

SEQ ID NO: 2113632 - DNA, 17 bp, Homo sapiens
tccctactagagacctc

SEQ ID NO: 2113633 - DNA, 15 bp, Homo sapiens
tccctacttttcaag

SEQ ID NO: 2113634 - DNA, 16 bp, Homo sapiens
tccctagcagtgaact

SEQ ID NO: 2113635 - DNA, 20 bp, Homo sapiens
tccctagctgaggatgacag

SEQ ID NO: 2113636 - DNA, 17 bp, Homo sapiens
tccctagtggcttcctc

SEQ ID NO: 2113637 - DNA, 17 bp, Homo sapiens
tccctatcaaaacatat

SEQ ID NO: 2113638 - DNA, 19 bp, Homo sapiens
tccctcaaatgacccaaag

SEQ ID NO: 2113639 - DNA, 20 bp, Homo sapiens
tccctcaaatgcgcgtgtgc

SEQ ID NO: 2113640 - DNA, 10 bp, Homo sapiens
tccctcaccc

SEQ ID NO: 2113641 - DNA, 12 bp, Homo sapiens
tccctcaccccc

SEQ ID NO: 2113642 - DNA, 16 bp, Homo sapiens
tccctcagtgccctca

SEQ ID NO: 2113643 - DNA, 19 bp, Homo sapiens
tccctcatcttgccccctc

SEQ ID NO: 2113644 - DNA, 11 bp, Homo sapiens
tccctccaccc

SEQ ID NO: 2113645 - DNA, 14 bp, Homo sapiens
tccctccaccccag

SEQ ID NO: 2113646 - DNA, 15 bp, Homo sapiens
tccctccatccggct

SEQ ID NO: 2113647 - DNA, 14 bp, Homo sapiens
tccctcctctggcc

SEQ ID NO: 2113648 - DNA, 18 bp, Homo sapiens
tccctcctggagcatccc

SEQ ID NO: 2113649 - DNA, 16 bp, Homo sapiens
tccctctaatttatct

SEQ ID NO: 2113650 - DNA, 15 bp, Homo sapiens
tccctctcccaggcc

SEQ ID NO: 2113651 - DNA, 21 bp, Homo sapiens
tccctctcccaggccccatga

SEQ ID NO: 2113652 - DNA, 13 bp, Homo sapiens
tccctctcctgcc

SEQ ID NO: 2113653 - DNA, 14 bp, Homo sapiens
tccctctcctgcct

SEQ ID NO: 2113654 - DNA, 23 bp, Homo sapiens
tccctctcggaaggctggctggg

SEQ ID NO: 2113655 - DNA, 13 bp, Homo sapiens
tccctctgacctg

SEQ ID NO: 2113656 - DNA, 20 bp, Homo sapiens
tccctctgccccaagcagcc

SEQ ID NO: 2113657 - DNA, 22 bp, Homo sapiens
tccctctgccccaagcagccag

SEQ ID NO: 2113658 - DNA, 17 bp, Homo sapiens
tccctctggccctgcct

SEQ ID NO: 2113659 - DNA, 15 bp, Homo sapiens
tccctcttccttccc

SEQ ID NO: 2113660 - DNA, 17 bp, Homo sapiens
tccctctttccccacct

SEQ ID NO: 2113661 - DNA, 18 bp, Homo sapiens
tccctctttccccacctc

SEQ ID NO: 2113662 - DNA, 19 bp, Homo sapiens
tccctctttccccacctct

SEQ ID NO: 2113663 - DNA, 20 bp, Homo sapiens
tccctctttctacattctca

SEQ ID NO: 2113664 - DNA, 13 bp, Homo sapiens
tccctctttgcct

SEQ ID NO: 2113665 - DNA, 15 bp, Homo sapiens
tccctgaaccatccc

SEQ ID NO: 2113666 - DNA, 20 bp, Homo sapiens
tccctgaacctcagtttcct

SEQ ID NO: 2113667 - DNA, 16 bp, Homo sapiens
tccctgacctccctct

SEQ ID NO: 2113668 - DNA, 17 bp, Homo sapiens
tccctgacctccctcta

SEQ ID NO: 2113669 - DNA, 21 bp, Homo sapiens
tccctgacctccctctaattt

SEQ ID NO: 2113670 - DNA, 18 bp, Homo sapiens
tccctgactctctgtgac

SEQ ID NO: 2113671 - DNA, 19 bp, Homo sapiens
tccctgagaaacccaccag

SEQ ID NO: 2113672 - DNA, 16 bp, Homo sapiens
tccctgaggtcacctg

SEQ ID NO: 2113673 - DNA, 17 bp, Homo sapiens
tccctgaggtcacctgg

SEQ ID NO: 2113674 - DNA, 14 bp, Homo sapiens
tccctgagtcacca

SEQ ID NO: 2113675 - DNA, 16 bp, Homo sapiens
tccctgagtcaccagg

SEQ ID NO: 2113676 - DNA, 17 bp, Homo sapiens
tccctgagtcaccagga

SEQ ID NO: 2113677 - DNA, 17 bp, Homo sapiens
tccctgcatttctgagt

SEQ ID NO: 2113678 - DNA, 18 bp, Homo sapiens
tccctgcccctcccttca

SEQ ID NO: 2113679 - DNA, 19 bp, Homo sapiens
tccctgcccctcccttcaa

SEQ ID NO: 2113680 - DNA, 15 bp, Homo sapiens
tccctgccctgtcct

SEQ ID NO: 2113681 - DNA, 18 bp, Homo sapiens
tccctgccctgtcctcca

SEQ ID NO: 2113682 - DNA, 14 bp, Homo sapiens
tccctgccgcctca

SEQ ID NO: 2113683 - DNA, 21 bp, Homo sapiens
tccctgctaccaaggcccagc

SEQ ID NO: 2113684 - DNA, 17 bp, Homo sapiens
tccctgcttacctgacg

SEQ ID NO: 2113685 - DNA, 15 bp, Homo sapiens
tccctggctctcaga

SEQ ID NO: 2113686 - DNA, 19 bp, Homo sapiens
tccctggctctcagaaggt

SEQ ID NO: 2113687 - DNA, 11 bp, Homo sapiens
tccctggctga

SEQ ID NO: 2113688 - DNA, 21 bp, Homo sapiens
tccctggcttgtaactccacc

SEQ ID NO: 2113689 - DNA, 22 bp, Homo sapiens
tccctggcttgtaactccacca

SEQ ID NO: 2113690 - DNA, 17 bp, Homo sapiens
tccctgggcccctccac

SEQ ID NO: 2113691 - DNA, 19 bp, Homo sapiens
tccctgggcccctccacgc

SEQ ID NO: 2113692 - DNA, 18 bp, Homo sapiens
tccctgggcctgctgctg

SEQ ID NO: 2113693 - DNA, 20 bp, Homo sapiens
tccctgggcctgctgctgag

SEQ ID NO: 2113694 - DNA, 17 bp, Homo sapiens
tccctggggatatgcaa

SEQ ID NO: 2113695 - DNA, 22 bp, Homo sapiens
tccctggggtcacatgctttgt

SEQ ID NO: 2113696 - DNA, 14 bp, Homo sapiens
tccctgtagctctg

SEQ ID NO: 2113697 - DNA, 15 bp, Homo sapiens
tccctgtcaccaagc

SEQ ID NO: 2113698 - DNA, 12 bp, Homo sapiens
tccctgtcctcc

SEQ ID NO: 2113699 - DNA, 11 bp, Homo sapiens
tccctgtgggg

SEQ ID NO: 2113700 - DNA, 22 bp, Homo sapiens
tccctgtgggggtggccatccc

SEQ ID NO: 2113701 - DNA, 15 bp, Homo sapiens
tccctgttctcagct

SEQ ID NO: 2113702 - DNA, 16 bp, Homo sapiens
tccctgttctcagctc

SEQ ID NO: 2113703 - DNA, 21 bp, Homo sapiens
tccctgtttaatatttaaaca

SEQ ID NO: 2113704 - DNA, 22 bp, Homo sapiens
tccctgtttaatatttaaacag

SEQ ID NO: 2113705 - DNA, 18 bp, Homo sapiens
tcccttaaaatagaaata

SEQ ID NO: 2113706 - DNA, 13 bp, Homo sapiens
tcccttaggcatt

SEQ ID NO: 2113707 - DNA, 16 bp, Homo sapiens
tcccttaggcattatt

SEQ ID NO: 2113708 - DNA, 18 bp, Homo sapiens
tcccttaggcattattta

SEQ ID NO: 2113709 - DNA, 21 bp, Homo sapiens
tcccttcaaccattccccatg

SEQ ID NO: 2113710 - DNA, 14 bp, Homo sapiens
tcccttcctcccca

SEQ ID NO: 2113711 - DNA, 16 bp, Homo sapiens
tcccttcctgaccctc

SEQ ID NO: 2113712 - DNA, 13 bp, Homo sapiens
tcccttcctggcc

SEQ ID NO: 2113713 - DNA, 14 bp, Homo sapiens
tcccttcctggcct

SEQ ID NO: 2113714 - DNA, 16 bp, Homo sapiens
tcccttcctggcctca

SEQ ID NO: 2113715 - DNA, 14 bp, Homo sapiens
tcccttctctcctt

SEQ ID NO: 2113716 - DNA, 20 bp, Homo sapiens
tcccttctctccttccctct

SEQ ID NO: 2113717 - DNA, 13 bp, Homo sapiens
tcccttgaccatt

SEQ ID NO: 2113718 - DNA, 22 bp, Homo sapiens
tcccttgaccattggctgcgct

SEQ ID NO: 2113719 - DNA, 13 bp, Homo sapiens
tcccttgagacct

SEQ ID NO: 2113720 - DNA, 17 bp, Homo sapiens
tcccttgctcagtgcct

SEQ ID NO: 2113721 - DNA, 21 bp, Homo sapiens
tcccttgctcagtgcctcctg

SEQ ID NO: 2113722 - DNA, 20 bp, Homo sapiens
tcccttggaaagttcagcca

SEQ ID NO: 2113723 - DNA, 15 bp, Homo sapiens
tcccttgtgtgtgtg

SEQ ID NO: 2113724 - DNA, 22 bp, Homo sapiens
tccgaaagggacttggaagctc

SEQ ID NO: 2113725 - DNA, 19 bp, Homo sapiens
tccgaagaccttctgaaga

SEQ ID NO: 2113726 - DNA, 14 bp, Homo sapiens
tccgagaacaacag

SEQ ID NO: 2113727 - DNA, 12 bp, Homo sapiens
tccgaggcaggg

SEQ ID NO: 2113728 - DNA, 13 bp, Homo sapiens
tccgaggcagggt

SEQ ID NO: 2113729 - DNA, 14 bp, Homo sapiens
tccgaggcagggtc

SEQ ID NO: 2113730 - DNA, 15 bp, Homo sapiens
tccgcaccagctgct

SEQ ID NO: 2113731 - DNA, 21 bp, Homo sapiens
tccgcaccagctgctctgccc

SEQ ID NO: 2113732 - DNA, 15 bp, Homo sapiens
tccgccccagacaca

SEQ ID NO: 2113733 - DNA, 22 bp, Homo sapiens
tccgcctgcagaggacagagct

SEQ ID NO: 2113734 - DNA, 12 bp, Homo sapiens
tccgctgccacc

SEQ ID NO: 2113735 - DNA, 20 bp, Homo sapiens
tccgctgtcgccccaggccc

SEQ ID NO: 2113736 - DNA, 21 bp, Homo sapiens
tccgctgtcgccccaggccct

SEQ ID NO: 2113737 - DNA, 16 bp, Homo sapiens
tccgctttctacccag

SEQ ID NO: 2113738 - DNA, 17 bp, Homo sapiens
tccggaaatgaaggaat

SEQ ID NO: 2113739 - DNA, 18 bp, Homo sapiens
tccggagaattgcctcta

SEQ ID NO: 2113740 - DNA, 23 bp, Homo sapiens
tccgggacgcttccagaccacct

SEQ ID NO: 2113741 - DNA, 15 bp, Homo sapiens
tccggggtctgtgct

SEQ ID NO: 2113742 - DNA, 18 bp, Homo sapiens
tccggggtctgtgctgtg

SEQ ID NO: 2113743 - DNA, 21 bp, Homo sapiens
tccggggtctgtgctgtgcct

SEQ ID NO: 2113744 - DNA, 22 bp, Homo sapiens
tccgggtgtggcctcagccctc

SEQ ID NO: 2113745 - DNA, 23 bp, Homo sapiens
tccggtgtctggaaaagcacttt

SEQ ID NO: 2113746 - DNA, 13 bp, Homo sapiens
tccgtcaggagag

SEQ ID NO: 2113747 - DNA, 16 bp, Homo sapiens
tccgtccacccaggct

SEQ ID NO: 2113748 - DNA, 19 bp, Homo sapiens
tccgtcccaaacagagggc

SEQ ID NO: 2113749 - DNA, 17 bp, Homo sapiens
tccgtccggaaatgaag

SEQ ID NO: 2113750 - DNA, 19 bp, Homo sapiens
tccgtctccctaaaataaa

SEQ ID NO: 2113751 - DNA, 20 bp, Homo sapiens
tccgtctgcaatgtcccttg

SEQ ID NO: 2113752 - DNA, 23 bp, Homo sapiens
tccgttccaggagcacacggccc

SEQ ID NO: 2113753 - DNA, 18 bp, Homo sapiens
tcctaaaaataagcttta

SEQ ID NO: 2113754 - DNA, 17 bp, Homo sapiens
tcctaaaagtggttttt

SEQ ID NO: 2113755 - DNA, 19 bp, Homo sapiens
tcctaaacccccgctccag

SEQ ID NO: 2113756 - DNA, 20 bp, Homo sapiens
tcctaaacccccgctccaga

SEQ ID NO: 2113757 - DNA, 21 bp, Homo sapiens
tcctaaacccccgctccagat

SEQ ID NO: 2113758 - DNA, 15 bp, Homo sapiens
tcctaaatgcagtga

SEQ ID NO: 2113759 - DNA, 19 bp, Homo sapiens
tcctaaatgcagtgaattg

SEQ ID NO: 2113760 - DNA, 18 bp, Homo sapiens
tcctaactgaagagacag

SEQ ID NO: 2113761 - DNA, 18 bp, Homo sapiens
tcctaagacttcagtcct

SEQ ID NO: 2113762 - DNA, 15 bp, Homo sapiens
tcctaagcagctggg

SEQ ID NO: 2113763 - DNA, 19 bp, Homo sapiens
tcctaagcagtgcttgtaa

SEQ ID NO: 2113764 - DNA, 17 bp, Homo sapiens
tcctaaggacacactaa

SEQ ID NO: 2113765 - DNA, 13 bp, Homo sapiens
tcctacaaaatgg

SEQ ID NO: 2113766 - DNA, 14 bp, Homo sapiens
tcctacaaaatgga

SEQ ID NO: 2113767 - DNA, 14 bp, Homo sapiens
tcctacaaagatgt

SEQ ID NO: 2113768 - DNA, 18 bp, Homo sapiens
tcctacacccttggactt

SEQ ID NO: 2113769 - DNA, 13 bp, Homo sapiens
tcctaccaatgca

SEQ ID NO: 2113770 - DNA, 15 bp, Homo sapiens
tcctaccaatgcatg

SEQ ID NO: 2113771 - DNA, 16 bp, Homo sapiens
tcctaccaatgcatgc

SEQ ID NO: 2113772 - DNA, 16 bp, Homo sapiens
tcctacccaaccactc

SEQ ID NO: 2113773 - DNA, 13 bp, Homo sapiens
tcctactctgtgt

SEQ ID NO: 2113774 - DNA, 20 bp, Homo sapiens
tcctactttagccactggtt

SEQ ID NO: 2113775 - DNA, 18 bp, Homo sapiens
tcctagaaccaagcttca

SEQ ID NO: 2113776 - DNA, 22 bp, Homo sapiens
tcctagactaattaaaatctgg

SEQ ID NO: 2113777 - DNA, 23 bp, Homo sapiens
tcctagactaattaaaatctgga

SEQ ID NO: 2113778 - DNA, 22 bp, Homo sapiens
tcctagagctcctgtccctacc

SEQ ID NO: 2113779 - DNA, 15 bp, Homo sapiens
tcctagaggacctga

SEQ ID NO: 2113780 - DNA, 21 bp, Homo sapiens
tcctagaggtgggcagctggg

SEQ ID NO: 2113781 - DNA, 22 bp, Homo sapiens
tcctagaggtgggcagctgggc

SEQ ID NO: 2113782 - DNA, 13 bp, Homo sapiens
tcctagccactca

SEQ ID NO: 2113783 - DNA, 19 bp, Homo sapiens
tcctagcccagtgcttctc

SEQ ID NO: 2113784 - DNA, 13 bp, Homo sapiens
tcctaggagaagc

SEQ ID NO: 2113785 - DNA, 13 bp, Homo sapiens
tcctaggccacac

SEQ ID NO: 2113786 - DNA, 15 bp, Homo sapiens
tcctaggtgctggat

SEQ ID NO: 2113787 - DNA, 13 bp, Homo sapiens
tcctagtatatta

SEQ ID NO: 2113788 - DNA, 23 bp, Homo sapiens
tcctagtatattagtttgattta

SEQ ID NO: 2113789 - DNA, 15 bp, Homo sapiens
tcctagtttgacctc

SEQ ID NO: 2113790 - DNA, 23 bp, Homo sapiens
tcctagtttgacctcacagtgac

SEQ ID NO: 2113791 - DNA, 20 bp, Homo sapiens
tcctataattccctatcttt

SEQ ID NO: 2113792 - DNA, 16 bp, Homo sapiens
tcctatacatttctgt

SEQ ID NO: 2113793 - DNA, 17 bp, Homo sapiens
tcctatacatttctgtt

SEQ ID NO: 2113794 - DNA, 15 bp, Homo sapiens
tcctatatagtttat

SEQ ID NO: 2113795 - DNA, 15 bp, Homo sapiens
tcctatggaaaaggg

SEQ ID NO: 2113796 - DNA, 24 bp, Homo sapiens
tcctatgtcaatttgtatatcatg

SEQ ID NO: 2113797 - DNA, 19 bp, Homo sapiens
tcctattaaaacacagctt

SEQ ID NO: 2113798 - DNA, 15 bp, Homo sapiens
tcctattatgtgttc

SEQ ID NO: 2113799 - DNA, 17 bp, Homo sapiens
tcctattctcaccagga

SEQ ID NO: 2113800 - DNA, 20 bp, Homo sapiens
tcctattctcaccaggaagg

SEQ ID NO: 2113801 - DNA, 14 bp, Homo sapiens
tcctatttgttttc

SEQ ID NO: 2113802 - DNA, 17 bp, Homo sapiens
tcctatttgttttcatg

SEQ ID NO: 2113803 - DNA, 13 bp, Homo sapiens
tcctcacaggagc

SEQ ID NO: 2113804 - DNA, 20 bp, Homo sapiens
tcctcacaggagcagacaga

SEQ ID NO: 2113805 - DNA, 21 bp, Homo sapiens
tcctcacagttgccatgtaga

SEQ ID NO: 2113806 - DNA, 16 bp, Homo sapiens
tcctcaccaataactt

SEQ ID NO: 2113807 - DNA, 20 bp, Homo sapiens
tcctcacccccagctttgct

SEQ ID NO: 2113808 - DNA, 12 bp, Homo sapiens
tcctcacctggt

SEQ ID NO: 2113809 - DNA, 13 bp, Homo sapiens
tcctcacctggtt

SEQ ID NO: 2113810 - DNA, 23 bp, Homo sapiens
tcctcactagtgtaaacaaaaat

SEQ ID NO: 2113811 - DNA, 16 bp, Homo sapiens
tcctcactgccccacc

SEQ ID NO: 2113812 - DNA, 19 bp, Homo sapiens
tcctcagatcatccagaag

SEQ ID NO: 2113813 - DNA, 14 bp, Homo sapiens
tcctcagctgccaa

SEQ ID NO: 2113814 - DNA, 16 bp, Homo sapiens
tcctcaggatttcatt

SEQ ID NO: 2113815 - DNA, 14 bp, Homo sapiens
tcctcaggggtgga

SEQ ID NO: 2113816 - DNA, 17 bp, Homo sapiens
tcctcaggggtggagaa

SEQ ID NO: 2113817 - DNA, 19 bp, Homo sapiens
tcctcaggggtggagaagt

SEQ ID NO: 2113818 - DNA, 16 bp, Homo sapiens
tcctcagtcctggaag

SEQ ID NO: 2113819 - DNA, 17 bp, Homo sapiens
tcctcagtcctggaagc

SEQ ID NO: 2113820 - DNA, 15 bp, Homo sapiens
tcctcatcccctcgt

SEQ ID NO: 2113821 - DNA, 16 bp, Homo sapiens
tcctccaaactcctgc

SEQ ID NO: 2113822 - DNA, 19 bp, Homo sapiens
tcctccaaactcctgcctg

SEQ ID NO: 2113823 - DNA, 20 bp, Homo sapiens
tcctccaaactcctgcctgt

SEQ ID NO: 2113824 - DNA, 21 bp, Homo sapiens
tcctccaacaataaagagctc

SEQ ID NO: 2113825 - DNA, 19 bp, Homo sapiens
tcctccaacgttaaaagac

SEQ ID NO: 2113826 - DNA, 17 bp, Homo sapiens
tcctccaattccacagt

SEQ ID NO: 2113827 - DNA, 18 bp, Homo sapiens
tcctccacagtgctgctt

SEQ ID NO: 2113828 - DNA, 16 bp, Homo sapiens
tcctccactcactcca

SEQ ID NO: 2113829 - DNA, 17 bp, Homo sapiens
tcctccactcactccag

SEQ ID NO: 2113830 - DNA, 14 bp, Homo sapiens
tcctccagacagat

SEQ ID NO: 2113831 - DNA, 22 bp, Homo sapiens
tcctccagacagatacagcccc

SEQ ID NO: 2113832 - DNA, 20 bp, Homo sapiens
tcctccagacccctgtggca

SEQ ID NO: 2113833 - DNA, 22 bp, Homo sapiens
tcctccagacccctgtggcaga

SEQ ID NO: 2113834 - DNA, 20 bp, Homo sapiens
tcctccagggccacgtgcca

SEQ ID NO: 2113835 - DNA, 23 bp, Homo sapiens
tcctccagggccacgtgccaggc

SEQ ID NO: 2113836 - DNA, 12 bp, Homo sapiens
tcctccatggtg

SEQ ID NO: 2113837 - DNA, 14 bp, Homo sapiens
tcctccattgctgt

SEQ ID NO: 2113838 - DNA, 20 bp, Homo sapiens
tcctccattgctgttgttgc

SEQ ID NO: 2113839 - DNA, 13 bp, Homo sapiens
tcctcccacaatc

SEQ ID NO: 2113840 - DNA, 20 bp, Homo sapiens
tcctcccaccaccctcccac

SEQ ID NO: 2113841 - DNA, 24 bp, Homo sapiens
tcctcccaccaccctcccaccatg

SEQ ID NO: 2113842 - DNA, 13 bp, Homo sapiens
tcctcccacctca

SEQ ID NO: 2113843 - DNA, 14 bp, Homo sapiens
tcctcccacctcag

SEQ ID NO: 2113844 - DNA, 15 bp, Homo sapiens
tcctcccacctcagc

SEQ ID NO: 2113845 - DNA, 14 bp, Homo sapiens
tcctcccatggcct

SEQ ID NO: 2113846 - DNA, 13 bp, Homo sapiens
tcctcccattccc

SEQ ID NO: 2113847 - DNA, 14 bp, Homo sapiens
tcctccccaccttc

SEQ ID NO: 2113848 - DNA, 24 bp, Homo sapiens
tcctcccccaccttcaagcaccct

SEQ ID NO: 2113849 - DNA, 23 bp, Homo sapiens
tcctccccctgccagtgccttac

SEQ ID NO: 2113850 - DNA, 15 bp, Homo sapiens
tcctcccctcttgag

SEQ ID NO: 2113851 - DNA, 14 bp, Homo sapiens
tcctccccttcctg

SEQ ID NO: 2113852 - DNA, 16 bp, Homo sapiens
tcctccccttcctgca

SEQ ID NO: 2113853 - DNA, 14 bp, Homo sapiens
tcctcccttcctcc

SEQ ID NO: 2113854 - DNA, 15 bp, Homo sapiens
tcctccgtccaccca

SEQ ID NO: 2113855 - DNA, 17 bp, Homo sapiens
tcctccgtccacccagg

SEQ ID NO: 2113856 - DNA, 17 bp, Homo sapiens
tcctcctaaacaaaaac

SEQ ID NO: 2113857 - DNA, 16 bp, Homo sapiens
tcctcctccacagtgc

SEQ ID NO: 2113858 - DNA, 18 bp, Homo sapiens
tcctcctccacagtgctg

SEQ ID NO: 2113859 - DNA, 22 bp, Homo sapiens
tcctcctgaagcctctgccctg

SEQ ID NO: 2113860 - DNA, 18 bp, Homo sapiens
tcctccttataagcccag

SEQ ID NO: 2113861 - DNA, 13 bp, Homo sapiens
tcctccttcttca

SEQ ID NO: 2113862 - DNA, 17 bp, Homo sapiens
tcctccttggtgcctgg

SEQ ID NO: 2113863 - DNA, 18 bp, Homo sapiens
tcctcctttgcctaggag

SEQ ID NO: 2113864 - DNA, 13 bp, Homo sapiens
tcctcgccctggg

SEQ ID NO: 2113865 - DNA, 18 bp, Homo sapiens
tcctcgcctaggcctgtg

SEQ ID NO: 2113866 - DNA, 14 bp, Homo sapiens
tcctcggccccctc

SEQ ID NO: 2113867 - DNA, 16 bp, Homo sapiens
tcctcggtactcccat

SEQ ID NO: 2113868 - DNA, 16 bp, Homo sapiens
tcctcgtcccctgcct

SEQ ID NO: 2113869 - DNA, 12 bp, Homo sapiens
tcctctactact

SEQ ID NO: 2113870 - DNA, 18 bp, Homo sapiens
tcctctcactaaacttta

SEQ ID NO: 2113871 - DNA, 12 bp, Homo sapiens
tcctctccactg

SEQ ID NO: 2113872 - DNA, 13 bp, Homo sapiens
tcctctccactgc

SEQ ID NO: 2113873 - DNA, 21 bp, Homo sapiens
tcctctccagccttctctctc

SEQ ID NO: 2113874 - DNA, 15 bp, Homo sapiens
tcctctccaggcacc

SEQ ID NO: 2113875 - DNA, 15 bp, Homo sapiens
tcctctccccagcaa

SEQ ID NO: 2113876 - DNA, 19 bp, Homo sapiens
tcctctcccctctgccctg

SEQ ID NO: 2113877 - DNA, 17 bp, Homo sapiens
tcctctcctagcccctg

SEQ ID NO: 2113878 - DNA, 14 bp, Homo sapiens
tcctctccttgggc

SEQ ID NO: 2113879 - DNA, 20 bp, Homo sapiens
tcctctccttgggctcctgg

SEQ ID NO: 2113880 - DNA, 21 bp, Homo sapiens
tcctctccttgggctcctggc

SEQ ID NO: 2113881 - DNA, 15 bp, Homo sapiens
tcctctcgagcccag

SEQ ID NO: 2113882 - DNA, 17 bp, Homo sapiens
tcctctcgagcccagat

SEQ ID NO: 2113883 - DNA, 19 bp, Homo sapiens
tcctctctcaggtcactcc

SEQ ID NO: 2113884 - DNA, 12 bp, Homo sapiens
tcctctgccacc

SEQ ID NO: 2113885 - DNA, 14 bp, Homo sapiens
tcctctgccacctc

SEQ ID NO: 2113886 - DNA, 15 bp, Homo sapiens
tcctctgccacctcc

SEQ ID NO: 2113887 - DNA, 18 bp, Homo sapiens
tcctctgccacctcccct

SEQ ID NO: 2113888 - DNA, 9 bp, Homo sapiens
tcctctggc

SEQ ID NO: 2113889 - DNA, 16 bp, Homo sapiens
tcctctggcccagcct

SEQ ID NO: 2113890 - DNA, 21 bp, Homo sapiens
tcctctggcccagcctaccct

SEQ ID NO: 2113891 - DNA, 17 bp, Homo sapiens
tcctctgtccaggcact

SEQ ID NO: 2113892 - DNA, 22 bp, Homo sapiens
tcctctgtccaggcactgctgc

SEQ ID NO: 2113893 - DNA, 16 bp, Homo sapiens
tcctctgtccagggcc

SEQ ID NO: 2113894 - DNA, 15 bp, Homo sapiens
tcctctgtctcgagc

SEQ ID NO: 2113895 - DNA, 15 bp, Homo sapiens
tcctctgtctctgct

SEQ ID NO: 2113896 - DNA, 17 bp, Homo sapiens
tcctctgtctctgctct

SEQ ID NO: 2113897 - DNA, 17 bp, Homo sapiens
tcctctgttctatccca

SEQ ID NO: 2113898 - DNA, 22 bp, Homo sapiens
tcctctgtttctccttctgaaa

SEQ ID NO: 2113899 - DNA, 19 bp, Homo sapiens
tcctcttaccgtagcctcc

SEQ ID NO: 2113900 - DNA, 20 bp, Homo sapiens
tcctcttaccgtagcctccg

SEQ ID NO: 2113901 - DNA, 15 bp, Homo sapiens
tcctcttccccttgc

SEQ ID NO: 2113902 - DNA, 18 bp, Homo sapiens
tcctcttgcctctctcag

SEQ ID NO: 2113903 - DNA, 13 bp, Homo sapiens
tcctcttgctcaa

SEQ ID NO: 2113904 - DNA, 17 bp, Homo sapiens
tcctctttgcatggaat

SEQ ID NO: 2113905 - DNA, 21 bp, Homo sapiens
tcctcttttatcttggactga

SEQ ID NO: 2113906 - DNA, 14 bp, Homo sapiens
tcctgaaagtctgt

SEQ ID NO: 2113907 - DNA, 19 bp, Homo sapiens
tcctgaagccagatccacc

SEQ ID NO: 2113908 - DNA, 13 bp, Homo sapiens
tcctgaagcctct

SEQ ID NO: 2113909 - DNA, 14 bp, Homo sapiens
tcctgaagcctctg

SEQ ID NO: 2113910 - DNA, 15 bp, Homo sapiens
tcctgaagcctctgc

SEQ ID NO: 2113911 - DNA, 22 bp, Homo sapiens
tcctgacattaagacacacctc

SEQ ID NO: 2113912 - DNA, 15 bp, Homo sapiens
tcctgacccagtccc

SEQ ID NO: 2113913 - DNA, 16 bp, Homo sapiens
tcctgacccagtcccc

SEQ ID NO: 2113914 - DNA, 12 bp, Homo sapiens
tcctgaccctcc

SEQ ID NO: 2113915 - DNA, 13 bp, Homo sapiens
tcctgaccctccc

SEQ ID NO: 2113916 - DNA, 14 bp, Homo sapiens
tcctgaccctccct

SEQ ID NO: 2113917 - DNA, 14 bp, Homo sapiens
tcctgacctgaggc

SEQ ID NO: 2113918 - DNA, 14 bp, Homo sapiens
tcctgacgccctgc

SEQ ID NO: 2113919 - DNA, 19 bp, Homo sapiens
tcctgactccagtgagctg

SEQ ID NO: 2113920 - DNA, 19 bp, Homo sapiens
tcctgactgacacaggcca

SEQ ID NO: 2113921 - DNA, 21 bp, Homo sapiens
tcctgactgacacaggccagc

SEQ ID NO: 2113922 - DNA, 20 bp, Homo sapiens
tcctgagaaggcgaggagag

SEQ ID NO: 2113923 - DNA, 16 bp, Homo sapiens
tcctgagaccacagag

SEQ ID NO: 2113924 - DNA, 13 bp, Homo sapiens
tcctgagaggtgc

SEQ ID NO: 2113925 - DNA, 12 bp, Homo sapiens
tcctgagcactg

SEQ ID NO: 2113926 - DNA, 17 bp, Homo sapiens
tcctgagcactgccagg

SEQ ID NO: 2113927 - DNA, 19 bp, Homo sapiens
tcctgagcactgccaggag

SEQ ID NO: 2113928 - DNA, 19 bp, Homo sapiens
tcctgatactgggtacaag

SEQ ID NO: 2113929 - DNA, 14 bp, Homo sapiens
tcctgatggccaag

SEQ ID NO: 2113930 - DNA, 17 bp, Homo sapiens
tcctgatggccaagagc

SEQ ID NO: 2113931 - DNA, 18 bp, Homo sapiens
tcctgatggccaagagca

SEQ ID NO: 2113932 - DNA, 13 bp, Homo sapiens
tcctgattttgta

SEQ ID NO: 2113933 - DNA, 15 bp, Homo sapiens
tcctgcaatctccag

SEQ ID NO: 2113934 - DNA, 16 bp, Homo sapiens
tcctgcaatctccagg

SEQ ID NO: 2113935 - DNA, 20 bp, Homo sapiens
tcctgcaatctccagggctg

SEQ ID NO: 2113936 - DNA, 20 bp, Homo sapiens
tcctgcacgccgtggagcat

SEQ ID NO: 2113937 - DNA, 16 bp, Homo sapiens
tcctgcagcctcctcc

SEQ ID NO: 2113938 - DNA, 19 bp, Homo sapiens
tcctgcagcctcctcctga

SEQ ID NO: 2113939 - DNA, 24 bp, Homo sapiens
tcctgcaggaacgagcactggcca

SEQ ID NO: 2113940 - DNA, 13 bp, Homo sapiens
tcctgccaagcca

SEQ ID NO: 2113941 - DNA, 17 bp, Homo sapiens
tcctgccactgacctca

SEQ ID NO: 2113942 - DNA, 18 bp, Homo sapiens
tcctgccactgacctcac

SEQ ID NO: 2113943 - DNA, 10 bp, Homo sapiens
tcctgccagc

SEQ ID NO: 2113944 - DNA, 12 bp, Homo sapiens
tcctgccagctg

SEQ ID NO: 2113945 - DNA, 16 bp, Homo sapiens
tcctgccagctgcctt

SEQ ID NO: 2113946 - DNA, 18 bp, Homo sapiens
tcctgccagctgccttcc

SEQ ID NO: 2113947 - DNA, 20 bp, Homo sapiens
tcctgccagctgccttcctc

SEQ ID NO: 2113948 - DNA, 14 bp, Homo sapiens
tcctgcccaggaga

SEQ ID NO: 2113949 - DNA, 18 bp, Homo sapiens
tcctgcccatgtgtcccc

SEQ ID NO: 2113950 - DNA, 20 bp, Homo sapiens
tcctgcccatgtgtcccctc

SEQ ID NO: 2113951 - DNA, 23 bp, Homo sapiens
tcctgcccccgacagcccagcct

SEQ ID NO: 2113952 - DNA, 22 bp, Homo sapiens
tcctgcctacattccctggcct

SEQ ID NO: 2113953 - DNA, 23 bp, Homo sapiens
tcctgcctacattccctggcctg

SEQ ID NO: 2113954 - DNA, 11 bp, Homo sapiens
tcctgcctact

SEQ ID NO: 2113955 - DNA, 16 bp, Homo sapiens
tcctgcctcagcctcc

SEQ ID NO: 2113956 - DNA, 20 bp, Homo sapiens
tcctgcctcgaactggctgc

SEQ ID NO: 2113957 - DNA, 16 bp, Homo sapiens
tcctgcctctactggg

SEQ ID NO: 2113958 - DNA, 21 bp, Homo sapiens
tcctgcctctactgggaaggc

SEQ ID NO: 2113959 - DNA, 22 bp, Homo sapiens
tcctgcctctactgggaaggct

SEQ ID NO: 2113960 - DNA, 14 bp, Homo sapiens
tcctgcctctctgc

SEQ ID NO: 2113961 - DNA, 18 bp, Homo sapiens
tcctgcctctctgctcca

SEQ ID NO: 2113962 - DNA, 22 bp, Homo sapiens
tcctgcctctctgctccagaga

SEQ ID NO: 2113963 - DNA, 23 bp, Homo sapiens
tcctgccttgatgaagcccgtgt

SEQ ID NO: 2113964 - DNA, 19 bp, Homo sapiens
tcctgcgggagtagttgga

SEQ ID NO: 2113965 - DNA, 17 bp, Homo sapiens
tcctgctacacaaaagc

SEQ ID NO: 2113966 - DNA, 16 bp, Homo sapiens
tcctgctagctgtaga

SEQ ID NO: 2113967 - DNA, 18 bp, Homo sapiens
tcctgctagctgtagaaa

SEQ ID NO: 2113968 - DNA, 22 bp, Homo sapiens
tcctgctagctgtagaaatgta

SEQ ID NO: 2113969 - DNA, 15 bp, Homo sapiens
tcctgctctcttcag

SEQ ID NO: 2113970 - DNA, 22 bp, Homo sapiens
tcctgctgaaacacctcccagg

SEQ ID NO: 2113971 - DNA, 23 bp, Homo sapiens
tcctgctgaaacacctcccaggg

SEQ ID NO: 2113972 - DNA, 15 bp, Homo sapiens
tcctgctgcctaata

SEQ ID NO: 2113973 - DNA, 16 bp, Homo sapiens
tcctgctgcctaataa

SEQ ID NO: 2113974 - DNA, 21 bp, Homo sapiens
tcctgctgcctaataaagaga

SEQ ID NO: 2113975 - DNA, 13 bp, Homo sapiens
tcctgctgctgta

SEQ ID NO: 2113976 - DNA, 22 bp, Homo sapiens
tcctgctgctgtaactgctgag

SEQ ID NO: 2113977 - DNA, 24 bp, Homo sapiens
tcctgctgctgtaactgctgagcc

SEQ ID NO: 2113978 - DNA, 15 bp, Homo sapiens
tcctgctgctgtgtt

SEQ ID NO: 2113979 - DNA, 16 bp, Homo sapiens
tcctgctggatgcgtg

SEQ ID NO: 2113980 - DNA, 16 bp, Homo sapiens
tcctgctggcacctca

SEQ ID NO: 2113981 - DNA, 16 bp, Homo sapiens
tcctgctgtggcctca

SEQ ID NO: 2113982 - DNA, 21 bp, Homo sapiens
tcctgctgtggcctcacttcc

SEQ ID NO: 2113983 - DNA, 21 bp, Homo sapiens
tcctgctgtgtgaattcccag

SEQ ID NO: 2113984 - DNA, 21 bp, Homo sapiens
tcctgcttcctaggccccaga

SEQ ID NO: 2113985 - DNA, 22 bp, Homo sapiens
tcctgcttcctaggccccagag

SEQ ID NO: 2113986 - DNA, 18 bp, Homo sapiens
tcctgctttccctcccca

SEQ ID NO: 2113987 - DNA, 23 bp, Homo sapiens
tcctggaaagactgattgtttta

SEQ ID NO: 2113988 - DNA, 19 bp, Homo sapiens
tcctggaaaggctcagtct

SEQ ID NO: 2113989 - DNA, 15 bp, Homo sapiens
tcctggaaccaatcc

SEQ ID NO: 2113990 - DNA, 14 bp, Homo sapiens
tcctggaagctgtg

SEQ ID NO: 2113991 - DNA, 20 bp, Homo sapiens
tcctggaatgaagcatgtag

SEQ ID NO: 2113992 - DNA, 11 bp, Homo sapiens
tcctggacagc

SEQ ID NO: 2113993 - DNA, 16 bp, Homo sapiens
tcctggacagctgtgc

SEQ ID NO: 2113994 - DNA, 14 bp, Homo sapiens
tcctggacctgagt

SEQ ID NO: 2113995 - DNA, 18 bp, Homo sapiens
tcctggagcatcccaggc

SEQ ID NO: 2113996 - DNA, 22 bp, Homo sapiens
tcctggaggatgaccaggacta

SEQ ID NO: 2113997 - DNA, 21 bp, Homo sapiens
tcctggcacccggcccctgct

SEQ ID NO: 2113998 - DNA, 23 bp, Homo sapiens
tcctggcaggaagtctctcccga

SEQ ID NO: 2113999 - DNA, 18 bp, Homo sapiens
tcctggccccagccccca

SEQ ID NO: 2114000 - DNA, 22 bp, Homo sapiens
tcctggccccgggctctggcca

SEQ ID NO: 2114001 - DNA, 23 bp, Homo sapiens
tcctggccccgggctctggccac

SEQ ID NO: 2114002 - DNA, 12 bp, Homo sapiens
tcctggccctct

SEQ ID NO: 2114003 - DNA, 12 bp, Homo sapiens
tcctggcctcaa

SEQ ID NO: 2114004 - DNA, 20 bp, Homo sapiens
tcctggcttcccatccccag

SEQ ID NO: 2114005 - DNA, 19 bp, Homo sapiens
tcctggcttctagatctgg

SEQ ID NO: 2114006 - DNA, 23 bp, Homo sapiens
tcctggcttctagatctggaacc

SEQ ID NO: 2114007 - DNA, 20 bp, Homo sapiens
tcctgggaccatggacacat

SEQ ID NO: 2114008 - DNA, 21 bp, Homo sapiens
tcctgggaccatggacacatt

SEQ ID NO: 2114009 - DNA, 18 bp, Homo sapiens
tcctgggagaacctcagg

SEQ ID NO: 2114010 - DNA, 20 bp, Homo sapiens
tcctgggagaacctcaggct

SEQ ID NO: 2114011 - DNA, 23 bp, Homo sapiens
tcctgggagaacctcaggcttcc

SEQ ID NO: 2114012 - DNA, 14 bp, Homo sapiens
tcctgggagtgagc

SEQ ID NO: 2114013 - DNA, 17 bp, Homo sapiens
tcctgggagtgagctgg

SEQ ID NO: 2114014 - DNA, 14 bp, Homo sapiens
tcctgggcagcttg

SEQ ID NO: 2114015 - DNA, 10 bp, Homo sapiens
tcctgggcct

SEQ ID NO: 2114016 - DNA, 16 bp, Homo sapiens
tcctgggcctgtcccc

SEQ ID NO: 2114017 - DNA, 22 bp, Homo sapiens
tcctgggccttacctcccctgc

SEQ ID NO: 2114018 - DNA, 18 bp, Homo sapiens
tcctggggccccgctggg

SEQ ID NO: 2114019 - DNA, 18 bp, Homo sapiens
tcagcaggaacctgtact

SEQ ID NO: 2114020 - DNA, 17 bp, Homo sapiens
tcagcagttaccgagga

SEQ ID NO: 2114021 - DNA, 18 bp, Homo sapiens
tcagcatcctggcacccg

SEQ ID NO: 2114022 - DNA, 20 bp, Homo sapiens
tcagcatgcatagtgctaag

SEQ ID NO: 2114023 - DNA, 21 bp, Homo sapiens
tcagcattcagtccgcctggc

SEQ ID NO: 2114024 - DNA, 20 bp, Homo sapiens
tcagcattctcactcctacc

SEQ ID NO: 2114025 - DNA, 23 bp, Homo sapiens
tcagcattctcactcctacctgg

SEQ ID NO: 2114026 - DNA, 19 bp, Homo sapiens
tcagcatttaataaatgta

SEQ ID NO: 2114027 - DNA, 20 bp, Homo sapiens
tcagcatttaataaatgtat

SEQ ID NO: 2114028 - DNA, 14 bp, Homo sapiens
tcagccaaatgtaa

SEQ ID NO: 2114029 - DNA, 22 bp, Homo sapiens
tcagccaaatgtaattgaataa

SEQ ID NO: 2114030 - DNA, 19 bp, Homo sapiens
tcagccaccctgaggcctc

SEQ ID NO: 2114031 - DNA, 23 bp, Homo sapiens
tcagccagaatcttcgtcctgcc

SEQ ID NO: 2114032 - DNA, 18 bp, Homo sapiens
tcagccagggccaggggt

SEQ ID NO: 2114033 - DNA, 18 bp, Homo sapiens
tcagccatcaacaagagt

SEQ ID NO: 2114034 - DNA, 14 bp, Homo sapiens
tcagccatgtttgg

SEQ ID NO: 2114035 - DNA, 17 bp, Homo sapiens
tcagcccacagcagcaa

SEQ ID NO: 2114036 - DNA, 16 bp, Homo sapiens
tcagcccatatttcat

SEQ ID NO: 2114037 - DNA, 12 bp, Homo sapiens
tcagcccctcct

SEQ ID NO: 2114038 - DNA, 15 bp, Homo sapiens
tcagcccctcctctg

SEQ ID NO: 2114039 - DNA, 20 bp, Homo sapiens
tcagcccctcctctgccacc

SEQ ID NO: 2114040 - DNA, 17 bp, Homo sapiens
tcagcccgaatgcctgt

SEQ ID NO: 2114041 - DNA, 16 bp, Homo sapiens
tcagccctccctgccc

SEQ ID NO: 2114042 - DNA, 13 bp, Homo sapiens
tcagcccttgccc

SEQ ID NO: 2114043 - DNA, 20 bp, Homo sapiens
tcagccgagccgggcctggg

SEQ ID NO: 2114044 - DNA, 21 bp, Homo sapiens
tcagccgagccgggcctgggg

SEQ ID NO: 2114045 - DNA, 22 bp, Homo sapiens
tcagccggcgtggcaaatataa

SEQ ID NO: 2114046 - DNA, 10 bp, Homo sapiens
tcagccgtgc

SEQ ID NO: 2114047 - DNA, 20 bp, Homo sapiens
tcagccgtgcactccctaag

SEQ ID NO: 2114048 - DNA, 12 bp, Homo sapiens
tcagcctcccaa

SEQ ID NO: 2114049 - DNA, 22 bp, Homo sapiens
tcagcctcccaaccccagggcc

SEQ ID NO: 2114050 - DNA, 20 bp, Homo sapiens
tcagcctcccaagtagctgg

SEQ ID NO: 2114051 - DNA, 13 bp, Homo sapiens
tcagcctcccaga

SEQ ID NO: 2114052 - DNA, 21 bp, Homo sapiens
tcagcctcccagagtgctagg

SEQ ID NO: 2114053 - DNA, 12 bp, Homo sapiens
tcagcctccccc

SEQ ID NO: 2114054 - DNA, 13 bp, Homo sapiens
tcagcctcccccc

SEQ ID NO: 2114055 - DNA, 20 bp, Homo sapiens
tcagcctcccgaatagctgg

SEQ ID NO: 2114056 - DNA, 21 bp, Homo sapiens
tcagcctcccgagtagctgag

SEQ ID NO: 2114057 - DNA, 20 bp, Homo sapiens
tcagcctcccgagtagctgg

SEQ ID NO: 2114058 - DNA, 23 bp, Homo sapiens
tcagcctcctaagcagctgggac

SEQ ID NO: 2114059 - DNA, 20 bp, Homo sapiens
tcagcctcctgagtagctgg

SEQ ID NO: 2114060 - DNA, 10 bp, Homo sapiens
tcagcctgag

SEQ ID NO: 2114061 - DNA, 20 bp, Homo sapiens
tcagcctgaggctgagactg

SEQ ID NO: 2114062 - DNA, 18 bp, Homo sapiens
tcagcctggccatcccca

SEQ ID NO: 2114063 - DNA, 17 bp, Homo sapiens
tcagcctggtgggcctc

SEQ ID NO: 2114064 - DNA, 18 bp, Homo sapiens
tcagcctggtgggcctcc

SEQ ID NO: 2114065 - DNA, 21 bp, Homo sapiens
tcagccttccccctcccaggg

SEQ ID NO: 2114066 - DNA, 24 bp, Homo sapiens
tcagccttccccctcccagggcca

SEQ ID NO: 2114067 - DNA, 22 bp, Homo sapiens
tcagccttccccttgcccaggg

SEQ ID NO: 2114068 - DNA, 23 bp, Homo sapiens
tcagccttccccttgcccagggc

SEQ ID NO: 2114069 - DNA, 14 bp, Homo sapiens
tcagcgagaccctt

SEQ ID NO: 2114070 - DNA, 22 bp, Homo sapiens
tcagcgccctggagtcccctgg

SEQ ID NO: 2114071 - DNA, 14 bp, Homo sapiens
tcagcgtcccctgc

SEQ ID NO: 2114072 - DNA, 14 bp, Homo sapiens
tcagcgtggccttg

SEQ ID NO: 2114073 - DNA, 14 bp, Homo sapiens
tcagctactgattt

SEQ ID NO: 2114074 - DNA, 15 bp, Homo sapiens
tcagctactgatttt

SEQ ID NO: 2114075 - DNA, 12 bp, Homo sapiens
tcagctcagcct

SEQ ID NO: 2114076 - DNA, 15 bp, Homo sapiens
tcagctcagcctccc

SEQ ID NO: 2114077 - DNA, 22 bp, Homo sapiens
tcagctccagaataccttcttc

SEQ ID NO: 2114078 - DNA, 14 bp, Homo sapiens
tcagctcccatagc

SEQ ID NO: 2114079 - DNA, 22 bp, Homo sapiens
tcagctcccatagcgctggctc

SEQ ID NO: 2114080 - DNA, 17 bp, Homo sapiens
tcagctccgtcatctgc

SEQ ID NO: 2114081 - DNA, 15 bp, Homo sapiens
tcagctctcctgctg

SEQ ID NO: 2114082 - DNA, 18 bp, Homo sapiens
tcagctctcctgctgcag

SEQ ID NO: 2114083 - DNA, 14 bp, Homo sapiens
tcagctctctgtat

SEQ ID NO: 2114084 - DNA, 16 bp, Homo sapiens
tcagctctgacattct

SEQ ID NO: 2114085 - DNA, 18 bp, Homo sapiens
tcagctgacacataattt

SEQ ID NO: 2114086 - DNA, 18 bp, Homo sapiens
tcagctgacagctgctca

SEQ ID NO: 2114087 - DNA, 15 bp, Homo sapiens
tcagctgcacattcc

SEQ ID NO: 2114088 - DNA, 17 bp, Homo sapiens
tcagctgtctgtggctt

SEQ ID NO: 2114089 - DNA, 12 bp, Homo sapiens
tcagctgtgaac

SEQ ID NO: 2114090 - DNA, 21 bp, Homo sapiens
tcagctgtgaacatggactct

SEQ ID NO: 2114091 - DNA, 22 bp, Homo sapiens
tcagcttatgggatccttgtct

SEQ ID NO: 2114092 - DNA, 21 bp, Homo sapiens
tcagcttcatttgtgtcaatg

SEQ ID NO: 2114093 - DNA, 16 bp, Homo sapiens
tcagctttcagagcca

SEQ ID NO: 2114094 - DNA, 22 bp, Homo sapiens
tcagctttcagagccagtgaag

SEQ ID NO: 2114095 - DNA, 16 bp, Homo sapiens
tcagcttttgcttcat

SEQ ID NO: 2114096 - DNA, 20 bp, Homo sapiens
tcagctttttgtcttttctg

SEQ ID NO: 2114097 - DNA, 22 bp, Homo sapiens
tcaggaaaactgacagaggagg

SEQ ID NO: 2114098 - DNA, 14 bp, Homo sapiens
tcaggaaaaggcct

SEQ ID NO: 2114099 - DNA, 15 bp, Homo sapiens
tcaggaaaaggcctg

SEQ ID NO: 2114100 - DNA, 16 bp, Homo sapiens
tcaggaaaaggcctgg

SEQ ID NO: 2114101 - DNA, 19 bp, Homo sapiens
tcaggaaaaggcctggggt

SEQ ID NO: 2114102 - DNA, 14 bp, Homo sapiens
tcaggaaagacgga

SEQ ID NO: 2114103 - DNA, 20 bp, Homo sapiens
tcaggaaatcaaatatgcaa

SEQ ID NO: 2114104 - DNA, 13 bp, Homo sapiens
tcaggaacagaag

SEQ ID NO: 2114105 - DNA, 14 bp, Homo sapiens
tcaggaacagaagg

SEQ ID NO: 2114106 - DNA, 20 bp, Homo sapiens
tcaggaagatgaaagaggag

SEQ ID NO: 2114107 - DNA, 19 bp, Homo sapiens
tcaggaatcggaatcctgt

SEQ ID NO: 2114108 - DNA, 12 bp, Homo sapiens
tcaggacactaa

SEQ ID NO: 2114109 - DNA, 18 bp, Homo sapiens
tcaggacatggggcatag

SEQ ID NO: 2114110 - DNA, 21 bp, Homo sapiens
tcaggacccaggccgcctgcc

SEQ ID NO: 2114111 - DNA, 22 bp, Homo sapiens
tcaggacctccggggagagcag

SEQ ID NO: 2114112 - DNA, 14 bp, Homo sapiens
tcaggaccttttga

SEQ ID NO: 2114113 - DNA, 18 bp, Homo sapiens
tcaggagaggggcagaac

SEQ ID NO: 2114114 - DNA, 20 bp, Homo sapiens
tcaggagaggggcagaacag

SEQ ID NO: 2114115 - DNA, 21 bp, Homo sapiens
tcaggaggccctggtgtcagg

SEQ ID NO: 2114116 - DNA, 17 bp, Homo sapiens
tcaggaggcgaataaat

SEQ ID NO: 2114117 - DNA, 23 bp, Homo sapiens
tcaggaggcgaataaatgttcaa

SEQ ID NO: 2114118 - DNA, 23 bp, Homo sapiens
tcaggaggcgcagcccgaagccc

SEQ ID NO: 2114119 - DNA, 13 bp, Homo sapiens
tcaggaggctgag

SEQ ID NO: 2114120 - DNA, 20 bp, Homo sapiens
tcaggaggctgaggcagaag

SEQ ID NO: 2114121 - DNA, 19 bp, Homo sapiens
tcaggagtcccaaggaaag

SEQ ID NO: 2114122 - DNA, 23 bp, Homo sapiens
tcaggagttagaaatctccagtg

SEQ ID NO: 2114123 - DNA, 14 bp, Homo sapiens
tcaggagttcgaga

SEQ ID NO: 2114124 - DNA, 20 bp, Homo sapiens
tcaggatactctgtcagatg

SEQ ID NO: 2114125 - DNA, 13 bp, Homo sapiens
tcaggatttcatt

SEQ ID NO: 2114126 - DNA, 16 bp, Homo sapiens
tcaggattttagtgct

SEQ ID NO: 2114127 - DNA, 21 bp, Homo sapiens
tcaggatttttacaagttggt

SEQ ID NO: 2114128 - DNA, 17 bp, Homo sapiens
tcaggcaaattggggag

SEQ ID NO: 2114129 - DNA, 24 bp, Homo sapiens
tcaggcaagcccctcagcccttgc

SEQ ID NO: 2114130 - DNA, 22 bp, Homo sapiens
tcaggcagacaagagctgctgt

SEQ ID NO: 2114131 - DNA, 14 bp, Homo sapiens
tcaggcattttgtt

SEQ ID NO: 2114132 - DNA, 16 bp, Homo sapiens
tcaggccaggtgcagt

SEQ ID NO: 2114133 - DNA, 17 bp, Homo sapiens
tcccacaccccagcgcc

SEQ ID NO: 2114134 - DNA, 15 bp, Homo sapiens
tcccacaggcccttc

SEQ ID NO: 2114135 - DNA, 21 bp, Homo sapiens
tcccacaggcccttcctctcc

SEQ ID NO: 2114136 - DNA, 22 bp, Homo sapiens
tcccacaggcccttcctctcca

SEQ ID NO: 2114137 - DNA, 21 bp, Homo sapiens
tcccacatccctgggcctgct

SEQ ID NO: 2114138 - DNA, 20 bp, Homo sapiens
tcccacattcggaccctgcc

SEQ ID NO: 2114139 - DNA, 14 bp, Homo sapiens
tcccaccaactctg

SEQ ID NO: 2114140 - DNA, 16 bp, Homo sapiens
tcccaccaactctgca

SEQ ID NO: 2114141 - DNA, 18 bp, Homo sapiens
tcccaccaactctgcact

SEQ ID NO: 2114142 - DNA, 19 bp, Homo sapiens
tcccaccaactctgcactc

SEQ ID NO: 2114143 - DNA, 15 bp, Homo sapiens
tcccaccaccctgag

SEQ ID NO: 2114144 - DNA, 19 bp, Homo sapiens
tcccaccagcatgtcactc

SEQ ID NO: 2114145 - DNA, 23 bp, Homo sapiens
tcccaccagcatgtcactcccag

SEQ ID NO: 2114146 - DNA, 20 bp, Homo sapiens
tcccaccatgcgctgctcaa

SEQ ID NO: 2114147 - DNA, 17 bp, Homo sapiens
tcccacccaacagctca

SEQ ID NO: 2114148 - DNA, 17 bp, Homo sapiens
tcccaccccactccagc

SEQ ID NO: 2114149 - DNA, 12 bp, Homo sapiens
tcccacccccag

SEQ ID NO: 2114150 - DNA, 18 bp, Homo sapiens
tcccaccccggcctccac

SEQ ID NO: 2114151 - DNA, 14 bp, Homo sapiens
tcccacctcagcct

SEQ ID NO: 2114152 - DNA, 22 bp, Homo sapiens
tcccacctcttctcttcctgta

SEQ ID NO: 2114153 - DNA, 20 bp, Homo sapiens
tctctcgtaactggtttcat

SEQ ID NO: 2114154 - DNA, 18 bp, Homo sapiens
tctctctatatatacatg

SEQ ID NO: 2114155 - DNA, 13 bp, Homo sapiens
tctctctatctgg

SEQ ID NO: 2114156 - DNA, 22 bp, Homo sapiens
tctctctcccttttaaatggtg

SEQ ID NO: 2114157 - DNA, 13 bp, Homo sapiens
tctctctctacaa

SEQ ID NO: 2114158 - DNA, 18 bp, Homo sapiens
tctctcttgctttgttct

SEQ ID NO: 2114159 - DNA, 11 bp, Homo sapiens
tctctctttcc

SEQ ID NO: 2114160 - DNA, 14 bp, Homo sapiens
tctctgaacagaaa

SEQ ID NO: 2114161 - DNA, 16 bp, Homo sapiens
tctctgaagcatgttt

SEQ ID NO: 2114162 - DNA, 22 bp, Homo sapiens
tctctgaagcatgtttcatgtt

SEQ ID NO: 2114163 - DNA, 14 bp, Homo sapiens
tctctgaatcctaa

SEQ ID NO: 2114164 - DNA, 14 bp, Homo sapiens
tctctgagactgct

SEQ ID NO: 2114165 - DNA, 19 bp, Homo sapiens
tctctgagggagaggctgt

SEQ ID NO: 2114166 - DNA, 11 bp, Homo sapiens
tctctgcagcc

SEQ ID NO: 2114167 - DNA, 21 bp, Homo sapiens
tctctgcccccagcctctgtc

SEQ ID NO: 2114168 - DNA, 18 bp, Homo sapiens
tctctgctccagagagag

SEQ ID NO: 2114169 - DNA, 15 bp, Homo sapiens
tctctgctctagcca

SEQ ID NO: 2114170 - DNA, 17 bp, Homo sapiens
tctctgctctagccagg

SEQ ID NO: 2114171 - DNA, 15 bp, Homo sapiens
tctctgctcttgcct

SEQ ID NO: 2114172 - DNA, 18 bp, Homo sapiens
tctctgctcttgcctgca

SEQ ID NO: 2114173 - DNA, 18 bp, Homo sapiens
tctctgcttacccttcac

SEQ ID NO: 2114174 - DNA, 19 bp, Homo sapiens
tctctgcttacccttcacc

SEQ ID NO: 2114175 - DNA, 15 bp, Homo sapiens
tctctggctccagaa

SEQ ID NO: 2114176 - DNA, 15 bp, Homo sapiens
tctctgggagacttt

SEQ ID NO: 2114177 - DNA, 19 bp, Homo sapiens
tctctgtaaaatttataca

SEQ ID NO: 2114178 - DNA, 12 bp, Homo sapiens
tctctgtacaaa

SEQ ID NO: 2114179 - DNA, 13 bp, Homo sapiens
tctctgtacaaaa

SEQ ID NO: 2114180 - DNA, 16 bp, Homo sapiens
tctctgtataaacatt

SEQ ID NO: 2114181 - DNA, 18 bp, Homo sapiens
tctctgtccctcactgcc

SEQ ID NO: 2114182 - DNA, 19 bp, Homo sapiens
tctctgtccctcactgcct

SEQ ID NO: 2114183 - DNA, 20 bp, Homo sapiens
tctctgtgactcgcttagct

SEQ ID NO: 2114184 - DNA, 19 bp, Homo sapiens
tctcttacgctctctgtct

SEQ ID NO: 2114185 - DNA, 16 bp, Homo sapiens
tctcttaggtctaatg

SEQ ID NO: 2114186 - DNA, 15 bp, Homo sapiens
tctcttatagaatat

SEQ ID NO: 2114187 - DNA, 13 bp, Homo sapiens
tctcttcagcccc

SEQ ID NO: 2114188 - DNA, 24 bp, Homo sapiens
tctcttcaggaggccctggtgtca

SEQ ID NO: 2114189 - DNA, 23 bp, Homo sapiens
tctcttcaggttcttagtgtcac

SEQ ID NO: 2114190 - DNA, 22 bp, Homo sapiens
tctcttccagaagatgccctcc

SEQ ID NO: 2114191 - DNA, 13 bp, Homo sapiens
tctcttcctctgt

SEQ ID NO: 2114192 - DNA, 13 bp, Homo sapiens
tctcttctccact

SEQ ID NO: 2114193 - DNA, 15 bp, Homo sapiens
tctcttctccactgg

SEQ ID NO: 2114194 - DNA, 18 bp, Homo sapiens
tctcttctctattcctga

SEQ ID NO: 2114195 - DNA, 12 bp, Homo sapiens
tctcttctttaa

SEQ ID NO: 2114196 - DNA, 18 bp, Homo sapiens
tctcttgaggccaggagt

SEQ ID NO: 2114197 - DNA, 12 bp, Homo sapiens
tctcttgccttt

SEQ ID NO: 2114198 - DNA, 16 bp, Homo sapiens
tctcttgcctttctta

SEQ ID NO: 2114199 - DNA, 13 bp, Homo sapiens
tctcttgctttgt

SEQ ID NO: 2114200 - DNA, 14 bp, Homo sapiens
tctcttgctttgtt

SEQ ID NO: 2114201 - DNA, 13 bp, Homo sapiens
tctcttgtagaag

SEQ ID NO: 2114202 - DNA, 16 bp, Homo sapiens
tctctttaatcttcag

SEQ ID NO: 2114203 - DNA, 21 bp, Homo sapiens
tctctttaatgtcacaggcag

SEQ ID NO: 2114204 - DNA, 22 bp, Homo sapiens
tctctttaatgtcacaggcagg

SEQ ID NO: 2114205 - DNA, 14 bp, Homo sapiens
tctctttggaatga

SEQ ID NO: 2114206 - DNA, 20 bp, Homo sapiens
tctcttttgaatccatgctt

SEQ ID NO: 2114207 - DNA, 17 bp, Homo sapiens
tctcttttttattctgt

SEQ ID NO: 2114208 - DNA, 22 bp, Homo sapiens
tctcttttttattctgttttct

SEQ ID NO: 2114209 - DNA, 13 bp, Homo sapiens
tctgaaaactgtt

SEQ ID NO: 2114210 - DNA, 22 bp, Homo sapiens
tctgaaaatgttgttatgctat

SEQ ID NO: 2114211 - DNA, 19 bp, Homo sapiens
tctgaaaattaacactgct

SEQ ID NO: 2114212 - DNA, 14 bp, Homo sapiens
tctgaaacttaatt

SEQ ID NO: 2114213 - DNA, 19 bp, Homo sapiens
tctgaaacttcataaatgt

SEQ ID NO: 2114214 - DNA, 20 bp, Homo sapiens
tctgaaagacagaatgtcac

SEQ ID NO: 2114215 - DNA, 12 bp, Homo sapiens
tctgaaagcaca

SEQ ID NO: 2114216 - DNA, 12 bp, Homo sapiens
tctgaaagccac

SEQ ID NO: 2114217 - DNA, 22 bp, Homo sapiens
tctgaaagtatattttcctccc

SEQ ID NO: 2114218 - DNA, 14 bp, Homo sapiens
tctgaaatgaaaca

SEQ ID NO: 2114219 - DNA, 15 bp, Homo sapiens
tctgaacaaaagctt

SEQ ID NO: 2114220 - DNA, 16 bp, Homo sapiens
tctgaacaaacactga

SEQ ID NO: 2114221 - DNA, 22 bp, Homo sapiens
tctgaacacagtttagtgcttt

SEQ ID NO: 2114222 - DNA, 20 bp, Homo sapiens
tctgaagcatgtttcatgtt

SEQ ID NO: 2114223 - DNA, 21 bp, Homo sapiens
tctgaagcatgtttcatgttt

SEQ ID NO: 2114224 - DNA, 20 bp, Homo sapiens
tctgaaggaatagccagaga

SEQ ID NO: 2114225 - DNA, 23 bp, Homo sapiens
tctgaaggaatagccagagagga

SEQ ID NO: 2114226 - DNA, 17 bp, Homo sapiens
tctgaagtcacatcaca

SEQ ID NO: 2114227 - DNA, 20 bp, Homo sapiens
tctgaagtcacatcacagga

SEQ ID NO: 2114228 - DNA, 22 bp, Homo sapiens
tctgaagtcacatcacaggaca

SEQ ID NO: 2114229 - DNA, 19 bp, Homo sapiens
tctgaatataggaagcata

SEQ ID NO: 2114230 - DNA, 14 bp, Homo sapiens
tctgaatattttgt

SEQ ID NO: 2114231 - DNA, 13 bp, Homo sapiens
tctgaatcctaag

SEQ ID NO: 2114232 - DNA, 15 bp, Homo sapiens
tctgaatttttaaac

SEQ ID NO: 2114233 - DNA, 16 bp, Homo sapiens
tctgacaagggctgac

SEQ ID NO: 2114234 - DNA, 13 bp, Homo sapiens
tctgacacacagc

SEQ ID NO: 2114235 - DNA, 15 bp, Homo sapiens
tctgacacacagctc

SEQ ID NO: 2114236 - DNA, 21 bp, Homo sapiens
tctgacagccctgcggagacc

SEQ ID NO: 2114237 - DNA, 18 bp, Homo sapiens
tctgacagttactcttca

SEQ ID NO: 2114238 - DNA, 14 bp, Homo sapiens
tctgacccactgct

SEQ ID NO: 2114239 - DNA, 15 bp, Homo sapiens
tctgacccactgctt

SEQ ID NO: 2114240 - DNA, 12 bp, Homo sapiens
tctgacctcccc

SEQ ID NO: 2114241 - DNA, 14 bp, Homo sapiens
tctgactcacaaga

SEQ ID NO: 2114242 - DNA, 12 bp, Homo sapiens
tctgactccaga

SEQ ID NO: 2114243 - DNA, 17 bp, Homo sapiens
tctgactcttgcctttc

SEQ ID NO: 2114244 - DNA, 14 bp, Homo sapiens
tctgacttctccca

SEQ ID NO: 2114245 - DNA, 22 bp, Homo sapiens
tctgagaaaagctttgaaccct

SEQ ID NO: 2114246 - DNA, 14 bp, Homo sapiens
tctgagaaagacta

SEQ ID NO: 2114247 - DNA, 22 bp, Homo sapiens
tctgagaaagactattcaaaca

SEQ ID NO: 2114248 - DNA, 17 bp, Homo sapiens
tctgagaaggtccttaa

SEQ ID NO: 2114249 - DNA, 18 bp, Homo sapiens
tctgagaggacttttctt

SEQ ID NO: 2114250 - DNA, 18 bp, Homo sapiens
tctgagagttggctcagg

SEQ ID NO: 2114251 - DNA, 13 bp, Homo sapiens
tctgagcccaggc

SEQ ID NO: 2114252 - DNA, 18 bp, Homo sapiens
tctgagcccccggctagt

SEQ ID NO: 2114253 - DNA, 15 bp, Homo sapiens
tctgagcctaaatct

SEQ ID NO: 2114254 - DNA, 18 bp, Homo sapiens
tctgagccttgagagaaa

SEQ ID NO: 2114255 - DNA, 20 bp, Homo sapiens
tctgagcttttcatggaagt

SEQ ID NO: 2114256 - DNA, 21 bp, Homo sapiens
tctgagcttttcatggaagtg

SEQ ID NO: 2114257 - DNA, 22 bp, Homo sapiens
tctgagcttttcatggaagtgg

SEQ ID NO: 2114258 - DNA, 17 bp, Homo sapiens
tctgaggccccaggccc

SEQ ID NO: 2114259 - DNA, 21 bp, Homo sapiens
tctgaggctctttctgggcca

SEQ ID NO: 2114260 - DNA, 17 bp, Homo sapiens
tctgaggtcctgagcac

SEQ ID NO: 2114261 - DNA, 18 bp, Homo sapiens
tctgaggtcctgagcact

SEQ ID NO: 2114262 - DNA, 19 bp, Homo sapiens
tctgaggtcctgagcactg

SEQ ID NO: 2114263 - DNA, 17 bp, Homo sapiens
tctgagtacttgatttc

SEQ ID NO: 2114264 - DNA, 22 bp, Homo sapiens
tctgagtcctgtctctgcctgc

SEQ ID NO: 2114265 - DNA, 22 bp, Homo sapiens
tctgagtgacatgggtgtgcca

SEQ ID NO: 2114266 - DNA, 14 bp, Homo sapiens
tctgagtgggcggc

SEQ ID NO: 2114267 - DNA, 24 bp, Homo sapiens
tctgagtgtttttactacagttgt

SEQ ID NO: 2114268 - DNA, 21 bp, Homo sapiens
tctgataaaattgtgatgttt

SEQ ID NO: 2114269 - DNA, 15 bp, Homo sapiens
tctgataaacacaga

SEQ ID NO: 2114270 - DNA, 17 bp, Homo sapiens
tctccagggctgcccct

SEQ ID NO: 2114271 - DNA, 20 bp, Homo sapiens
tctccagtggttgctgttga

SEQ ID NO: 2114272 - DNA, 15 bp, Homo sapiens
tctccatatctcctt

SEQ ID NO: 2114273 - DNA, 14 bp, Homo sapiens
tctccatatgttac

SEQ ID NO: 2114274 - DNA, 16 bp, Homo sapiens
tctccatttcacacag

SEQ ID NO: 2114275 - DNA, 17 bp, Homo sapiens
tctcccaggccccatga

SEQ ID NO: 2114276 - DNA, 20 bp, Homo sapiens
tctcccataccatcactgag

SEQ ID NO: 2114277 - DNA, 16 bp, Homo sapiens
tctccccaggcctcca

SEQ ID NO: 2114278 - DNA, 18 bp, Homo sapiens
tctccccaggcctccagc

SEQ ID NO: 2114279 - DNA, 19 bp, Homo sapiens
tctccccaggcctccagcc

SEQ ID NO: 2114280 - DNA, 14 bp, Homo sapiens
tctcccccgcccaa

SEQ ID NO: 2114281 - DNA, 14 bp, Homo sapiens
tctcccctgccctg

SEQ ID NO: 2114282 - DNA, 14 bp, Homo sapiens
tctcccgcaccagg

SEQ ID NO: 2114283 - DNA, 21 bp, Homo sapiens
tctcccgcaccaggccgggct

SEQ ID NO: 2114284 - DNA, 19 bp, Homo sapiens
tctcccgcgggcctggaca

SEQ ID NO: 2114285 - DNA, 14 bp, Homo sapiens
tctcccggctgcct

SEQ ID NO: 2114286 - DNA, 15 bp, Homo sapiens
tctcccggctgcctg

SEQ ID NO: 2114287 - DNA, 19 bp, Homo sapiens
tctccctaaaataaaaacc

SEQ ID NO: 2114288 - DNA, 19 bp, Homo sapiens
tctccctaaggaatctgaa

SEQ ID NO: 2114289 - DNA, 14 bp, Homo sapiens
tctccctccagctg

SEQ ID NO: 2114290 - DNA, 12 bp, Homo sapiens
tctccctccagg

SEQ ID NO: 2114291 - DNA, 13 bp, Homo sapiens
tctccctccaggg

SEQ ID NO: 2114292 - DNA, 21 bp, Homo sapiens
tctccctctcctgcctactca

SEQ ID NO: 2114293 - DNA, 18 bp, Homo sapiens
tctccctctggccctgcc

SEQ ID NO: 2114294 - DNA, 19 bp, Homo sapiens
tctccctctggccctgcct

SEQ ID NO: 2114295 - DNA, 14 bp, Homo sapiens
tctccctgacattt

SEQ ID NO: 2114296 - DNA, 14 bp, Homo sapiens
tctccctgccgcct

SEQ ID NO: 2114297 - DNA, 22 bp, Homo sapiens
tctccctggctgacccctggcc

SEQ ID NO: 2114298 - DNA, 13 bp, Homo sapiens
tctccggggtctg

SEQ ID NO: 2114299 - DNA, 16 bp, Homo sapiens
tctccgggtgtggcct

SEQ ID NO: 2114300 - DNA, 15 bp, Homo sapiens
tctcctaccccacct

SEQ ID NO: 2114301 - DNA, 22 bp, Homo sapiens
tctcctaccccacctcatgcct

SEQ ID NO: 2114302 - DNA, 24 bp, Homo sapiens
tctcctaccccacctcatgcctgg

SEQ ID NO: 2114303 - DNA, 20 bp, Homo sapiens
tctcctacctgctgctgcta

SEQ ID NO: 2114304 - DNA, 23 bp, Homo sapiens
tctcctaggagaagcagcctcct

SEQ ID NO: 2114305 - DNA, 18 bp, Homo sapiens
tctcctatttttcagaat

SEQ ID NO: 2114306 - DNA, 16 bp, Homo sapiens
tctcctcccatggcct

SEQ ID NO: 2114307 - DNA, 17 bp, Homo sapiens
tctcctcccccaccttc

SEQ ID NO: 2114308 - DNA, 14 bp, Homo sapiens
tctcctcggccccc

SEQ ID NO: 2114309 - DNA, 21 bp, Homo sapiens
tctcctcggccccctccatcg

SEQ ID NO: 2114310 - DNA, 14 bp, Homo sapiens
tctcctctctgaga

SEQ ID NO: 2114311 - DNA, 23 bp, Homo sapiens
tctcctcttaaaaaataaaaact

SEQ ID NO: 2114312 - DNA, 22 bp, Homo sapiens
tctcctcttgccactgcctctt

SEQ ID NO: 2114313 - DNA, 17 bp, Homo sapiens
tctcctgacccagtccc

SEQ ID NO: 2114314 - DNA, 15 bp, Homo sapiens
tctcctgactccagt

SEQ ID NO: 2114315 - DNA, 17 bp, Homo sapiens
tctcctgagaggtgctg

SEQ ID NO: 2114316 - DNA, 21 bp, Homo sapiens
tctcctgagaggtgctgcagg

SEQ ID NO: 2114317 - DNA, 18 bp, Homo sapiens
tctcctgatttctctgaa

SEQ ID NO: 2114318 - DNA, 23 bp, Homo sapiens
tctcctgcctacattccctggcc

SEQ ID NO: 2114319 - DNA, 15 bp, Homo sapiens
tctcctgcctactca

SEQ ID NO: 2114320 - DNA, 13 bp, Homo sapiens
tctcctgcctgta

SEQ ID NO: 2114321 - DNA, 12 bp, Homo sapiens
tctcctggcttc

SEQ ID NO: 2114322 - DNA, 13 bp, Homo sapiens
tctcctggcttcc

SEQ ID NO: 2114323 - DNA, 15 bp, Homo sapiens
tctcctggcttccca

SEQ ID NO: 2114324 - DNA, 23 bp, Homo sapiens
tctcctggcttcccatccccagc

SEQ ID NO: 2114325 - DNA, 22 bp, Homo sapiens
tctcctgggcccgctttgcctg

SEQ ID NO: 2114326 - DNA, 23 bp, Homo sapiens
tctcctgggcccgctttgcctgc

SEQ ID NO: 2114327 - DNA, 19 bp, Homo sapiens
tctcctgggggtggcaggc

SEQ ID NO: 2114328 - DNA, 20 bp, Homo sapiens
tctcctggtctgtgctgccc

SEQ ID NO: 2114329 - DNA, 19 bp, Homo sapiens
tctcctgtaattttgtagt

SEQ ID NO: 2114330 - DNA, 12 bp, Homo sapiens
tctcctgtgacc

SEQ ID NO: 2114331 - DNA, 18 bp, Homo sapiens
tctcctgtgcccctcaga

SEQ ID NO: 2114332 - DNA, 14 bp, Homo sapiens
tctcctgtttttct

SEQ ID NO: 2114333 - DNA, 17 bp, Homo sapiens
tctcctgtttttctggg

SEQ ID NO: 2114334 - DNA, 16 bp, Homo sapiens
tctccttactctgagc

SEQ ID NO: 2114335 - DNA, 19 bp, Homo sapiens
tctccttactctgagccca

SEQ ID NO: 2114336 - DNA, 22 bp, Homo sapiens
tctccttactctgagcccaggc

SEQ ID NO: 2114337 - DNA, 23 bp, Homo sapiens
tctccttactctgagcccaggcc

SEQ ID NO: 2114338 - DNA, 14 bp, Homo sapiens
tctccttcccctac

SEQ ID NO: 2114339 - DNA, 19 bp, Homo sapiens
tctccttcccctttcccca

SEQ ID NO: 2114340 - DNA, 18 bp, Homo sapiens
tctccttccttacccaaa

SEQ ID NO: 2114341 - DNA, 13 bp, Homo sapiens
tctccttggagga

SEQ ID NO: 2114342 - DNA, 14 bp, Homo sapiens
tctccttgggctcc

SEQ ID NO: 2114343 - DNA, 22 bp, Homo sapiens
tctccttgggctcctggctgcc

SEQ ID NO: 2114344 - DNA, 18 bp, Homo sapiens
tctccttgttctgataat

SEQ ID NO: 2114345 - DNA, 16 bp, Homo sapiens
tctcctttgcactgag

SEQ ID NO: 2114346 - DNA, 22 bp, Homo sapiens
tctcctttgcactgagggccac

SEQ ID NO: 2114347 - DNA, 15 bp, Homo sapiens
tctcgagccccctgg

SEQ ID NO: 2114348 - DNA, 23 bp, Homo sapiens
tctcgagccccctggatgtcccc

SEQ ID NO: 2114349 - DNA, 17 bp, Homo sapiens
tctcgagcgccctgcag

SEQ ID NO: 2114350 - DNA, 22 bp, Homo sapiens
tctcgagcgccctgcagaccct

SEQ ID NO: 2114351 - DNA, 13 bp, Homo sapiens
tctcgatctcctg

SEQ ID NO: 2114352 - DNA, 12 bp, Homo sapiens
tctcgcattttc

SEQ ID NO: 2114353 - DNA, 22 bp, Homo sapiens
tctcggggcgacccctcagtgc

SEQ ID NO: 2114354 - DNA, 21 bp, Homo sapiens
tctcgggtccgattaatttat

SEQ ID NO: 2114355 - DNA, 21 bp, Homo sapiens
tctcgggtgcatttgagagaa

SEQ ID NO: 2114356 - DNA, 17 bp, Homo sapiens
tctcggttccacgtccc

SEQ ID NO: 2114357 - DNA, 17 bp, Homo sapiens
tctcgtggtagaagcca

SEQ ID NO: 2114358 - DNA, 20 bp, Homo sapiens
tctcgtggtagaagccagta

SEQ ID NO: 2114359 - DNA, 12 bp, Homo sapiens
tctcgtttttct

SEQ ID NO: 2114360 - DNA, 18 bp, Homo sapiens
tctctaaaaataaaatga

SEQ ID NO: 2114361 - DNA, 13 bp, Homo sapiens
tctctaacatatg

SEQ ID NO: 2114362 - DNA, 20 bp, Homo sapiens
tctctacagacttctccaga

SEQ ID NO: 2114363 - DNA, 16 bp, Homo sapiens
tctctacccatctccc

SEQ ID NO: 2114364 - DNA, 14 bp, Homo sapiens
tctctactaaaaat

SEQ ID NO: 2114365 - DNA, 22 bp, Homo sapiens
tctctagaattttaagtgcttt

SEQ ID NO: 2114366 - DNA, 20 bp, Homo sapiens
tctctagctttaggggacca

SEQ ID NO: 2114367 - DNA, 13 bp, Homo sapiens
tctctcaggagca

SEQ ID NO: 2114368 - DNA, 15 bp, Homo sapiens
tctctcaggagcaca

SEQ ID NO: 2114369 - DNA, 16 bp, Homo sapiens
tctctcaggagtatct

SEQ ID NO: 2114370 - DNA, 17 bp, Homo sapiens
tctctcaggagtatctt

SEQ ID NO: 2114371 - DNA, 15 bp, Homo sapiens
tctctcatgaacctc

SEQ ID NO: 2114372 - DNA, 22 bp, Homo sapiens
tctctcatgaacctcaagctgc

SEQ ID NO: 2114373 - DNA, 14 bp, Homo sapiens
tctctccactgctc

SEQ ID NO: 2114374 - DNA, 21 bp, Homo sapiens
tctctccactgctctcagcct

SEQ ID NO: 2114375 - DNA, 24 bp, Homo sapiens
tctctccactgctctcagcctccc

SEQ ID NO: 2114376 - DNA, 12 bp, Homo sapiens
tctctccacttt

SEQ ID NO: 2114377 - DNA, 21 bp, Homo sapiens
tctctccaggaaggtagccca

SEQ ID NO: 2114378 - DNA, 24 bp, Homo sapiens
tctctccaggaaggtagcccagca

SEQ ID NO: 2114379 - DNA, 20 bp, Homo sapiens
tctctcccataccatcactg

SEQ ID NO: 2114380 - DNA, 14 bp, Homo sapiens
tctctcctcagact

SEQ ID NO: 2114381 - DNA, 13 bp, Homo sapiens
tctctcctgtcca

SEQ ID NO: 2114382 - DNA, 13 bp, Homo sapiens
tctctccttccct

SEQ ID NO: 2114383 - DNA, 14 bp, Homo sapiens
tctctccttctggc

SEQ ID NO: 2114384 - DNA, 19 bp, Homo sapiens
tctctccttgttctgataa

SEQ ID NO: 2114385 - DNA, 23 bp, Homo sapiens
tctctcggttccacgtccccctg

SEQ ID NO: 2114386 - DNA, 19 bp, Homo sapiens
tctataatggaaacattta

SEQ ID NO: 2114387 - DNA, 20 bp, Homo sapiens
tctatacctgtctcctttct

SEQ ID NO: 2114388 - DNA, 13 bp, Homo sapiens
tctatagactcta

SEQ ID NO: 2114389 - DNA, 16 bp, Homo sapiens
tctatagactctagga

SEQ ID NO: 2114390 - DNA, 11 bp, Homo sapiens
tctatagagaa

SEQ ID NO: 2114391 - DNA, 15 bp, Homo sapiens
tctatagtagtcaat

SEQ ID NO: 2114392 - DNA, 21 bp, Homo sapiens
tctatatatacatgtatagtg

SEQ ID NO: 2114393 - DNA, 16 bp, Homo sapiens
tctatatgcatttaat

SEQ ID NO: 2114394 - DNA, 15 bp, Homo sapiens
tctatattaaagtgt

SEQ ID NO: 2114395 - DNA, 15 bp, Homo sapiens
tctatcaatagtcaa

SEQ ID NO: 2114396 - DNA, 17 bp, Homo sapiens
tctatcactggcaatat

SEQ ID NO: 2114397 - DNA, 17 bp, Homo sapiens
tctatctatataatgta

SEQ ID NO: 2114398 - DNA, 13 bp, Homo sapiens
tctatctgtattt

SEQ ID NO: 2114399 - DNA, 18 bp, Homo sapiens
tctatctgtattttcatt

SEQ ID NO: 2114400 - DNA, 22 bp, Homo sapiens
tctatgcaatttttaaactagt

SEQ ID NO: 2114401 - DNA, 20 bp, Homo sapiens
tctatgcagtattgccacaa

SEQ ID NO: 2114402 - DNA, 15 bp, Homo sapiens
tctatgcattttctg

SEQ ID NO: 2114403 - DNA, 18 bp, Homo sapiens
tctatgccccaaatatag

SEQ ID NO: 2114404 - DNA, 15 bp, Homo sapiens
tctatggagggcaga

SEQ ID NO: 2114405 - DNA, 23 bp, Homo sapiens
tctatggcagtccagccagctcc

SEQ ID NO: 2114406 - DNA, 19 bp, Homo sapiens
tctattagttttctttgta

SEQ ID NO: 2114407 - DNA, 21 bp, Homo sapiens
tctattcaatttaattcttat

SEQ ID NO: 2114408 - DNA, 18 bp, Homo sapiens
tctattcataataaacta

SEQ ID NO: 2114409 - DNA, 17 bp, Homo sapiens
tctattcctgaccctcc

SEQ ID NO: 2114410 - DNA, 15 bp, Homo sapiens
tctattctgagcctt

SEQ ID NO: 2114411 - DNA, 17 bp, Homo sapiens
tctattctgagccttga

SEQ ID NO: 2114412 - DNA, 17 bp, Homo sapiens
tctattgtttattcttt

SEQ ID NO: 2114413 - DNA, 16 bp, Homo sapiens
tctatttaaaaaataa

SEQ ID NO: 2114414 - DNA, 22 bp, Homo sapiens
tctattttggtgaccaatacta

SEQ ID NO: 2114415 - DNA, 21 bp, Homo sapiens
tctcaaactcttgacctcagg

SEQ ID NO: 2114416 - DNA, 19 bp, Homo sapiens
tctcaagcactaaaaagtg

SEQ ID NO: 2114417 - DNA, 17 bp, Homo sapiens
tctcaagctagccagag

SEQ ID NO: 2114418 - DNA, 15 bp, Homo sapiens
tctcaatcagtgcag

SEQ ID NO: 2114419 - DNA, 16 bp, Homo sapiens
tctcaatcagtgcagt

SEQ ID NO: 2114420 - DNA, 24 bp, Homo sapiens
tctcaatcttcggggtgtgatgaa

SEQ ID NO: 2114421 - DNA, 16 bp, Homo sapiens
tctcaatgcttttcta

SEQ ID NO: 2114422 - DNA, 12 bp, Homo sapiens
tctcaatgtgaa

SEQ ID NO: 2114423 - DNA, 15 bp, Homo sapiens
tctcaccaggaaggg

SEQ ID NO: 2114424 - DNA, 15 bp, Homo sapiens
tctcactaaacttta

SEQ ID NO: 2114425 - DNA, 16 bp, Homo sapiens
tctcactatgttgccc

SEQ ID NO: 2114426 - DNA, 20 bp, Homo sapiens
tctcactatgttgcccaggc

SEQ ID NO: 2114427 - DNA, 21 bp, Homo sapiens
tctcactatgttgcccaggca

SEQ ID NO: 2114428 - DNA, 14 bp, Homo sapiens
tctcactccaccac

SEQ ID NO: 2114429 - DNA, 15 bp, Homo sapiens
tctcactccaccacc

SEQ ID NO: 2114430 - DNA, 13 bp, Homo sapiens
tctcactcctgag

SEQ ID NO: 2114431 - DNA, 22 bp, Homo sapiens
tctcactctgtcgcccagtctg

SEQ ID NO: 2114432 - DNA, 15 bp, Homo sapiens
tctcactgttgccca

SEQ ID NO: 2114433 - DNA, 17 bp, Homo sapiens
tctcactgttgcccagg

SEQ ID NO: 2114434 - DNA, 19 bp, Homo sapiens
tctcactgttgcccaggct

SEQ ID NO: 2114435 - DNA, 20 bp, Homo sapiens
tctcagagacaggtggccta

SEQ ID NO: 2114436 - DNA, 21 bp, Homo sapiens
tctcagagacaggtggcctag

SEQ ID NO: 2114437 - DNA, 20 bp, Homo sapiens
tctcagaggctatagctggg

SEQ ID NO: 2114438 - DNA, 15 bp, Homo sapiens
tctcagatcttgaca

SEQ ID NO: 2114439 - DNA, 19 bp, Homo sapiens
tctcagccccgggcctgcc

SEQ ID NO: 2114440 - DNA, 21 bp, Homo sapiens
tctcagccccgggcctgcctc

SEQ ID NO: 2114441 - DNA, 23 bp, Homo sapiens
tctcagccccgggcctgcctctg

SEQ ID NO: 2114442 - DNA, 13 bp, Homo sapiens
tctcagcttcatt

SEQ ID NO: 2114443 - DNA, 14 bp, Homo sapiens
tctcaggaaatcaa

SEQ ID NO: 2114444 - DNA, 20 bp, Homo sapiens
tctcaggacacaggcctgtg

SEQ ID NO: 2114445 - DNA, 23 bp, Homo sapiens
tctcaggagcacaggcagctgga

SEQ ID NO: 2114446 - DNA, 15 bp, Homo sapiens
tctcaggagtatctt

SEQ ID NO: 2114447 - DNA, 18 bp, Homo sapiens
tctcagggtccagaccct

SEQ ID NO: 2114448 - DNA, 13 bp, Homo sapiens
tctcaggtcactc

SEQ ID NO: 2114449 - DNA, 16 bp, Homo sapiens
tctcaggtcactccag

SEQ ID NO: 2114450 - DNA, 18 bp, Homo sapiens
tctcaggtcactccagtg

SEQ ID NO: 2114451 - DNA, 14 bp, Homo sapiens
tctcaggtgccact

SEQ ID NO: 2114452 - DNA, 16 bp, Homo sapiens
tctcaggtgccactcc

SEQ ID NO: 2114453 - DNA, 16 bp, Homo sapiens
tctcagtgaagaatac

SEQ ID NO: 2114454 - DNA, 16 bp, Homo sapiens
tctcatacctctgacc

SEQ ID NO: 2114455 - DNA, 19 bp, Homo sapiens
tctcatacctctgaccaac

SEQ ID NO: 2114456 - DNA, 22 bp, Homo sapiens
tctcataggaaaagtacattta

SEQ ID NO: 2114457 - DNA, 14 bp, Homo sapiens
tctcatcatattgt

SEQ ID NO: 2114458 - DNA, 15 bp, Homo sapiens
tctcatcatattgta

SEQ ID NO: 2114459 - DNA, 18 bp, Homo sapiens
tctcatcatattgtatgt

SEQ ID NO: 2114460 - DNA, 23 bp, Homo sapiens
tctcatccccagtcccaatgcac

SEQ ID NO: 2114461 - DNA, 18 bp, Homo sapiens
tctcatctcttcttttaa

SEQ ID NO: 2114462 - DNA, 14 bp, Homo sapiens
tctcatgaacctca

SEQ ID NO: 2114463 - DNA, 22 bp, Homo sapiens
tctcatgaacctcaagctgcat

SEQ ID NO: 2114464 - DNA, 15 bp, Homo sapiens
tctcatgatttacag

SEQ ID NO: 2114465 - DNA, 16 bp, Homo sapiens
tctcatgcctgcctga

SEQ ID NO: 2114466 - DNA, 23 bp, Homo sapiens
tctcatggaaactggccaggggt

SEQ ID NO: 2114467 - DNA, 17 bp, Homo sapiens
tctcatgtgatcctttt

SEQ ID NO: 2114468 - DNA, 23 bp, Homo sapiens
tctcatgtgatccttttatgtta

SEQ ID NO: 2114469 - DNA, 17 bp, Homo sapiens
tctcattccaacagtga

SEQ ID NO: 2114470 - DNA, 21 bp, Homo sapiens
tctcattcccagagtcagagg

SEQ ID NO: 2114471 - DNA, 14 bp, Homo sapiens
tctcattccccagg

SEQ ID NO: 2114472 - DNA, 12 bp, Homo sapiens
tctcattctctt

SEQ ID NO: 2114473 - DNA, 21 bp, Homo sapiens
tctcattctctttctttttct

SEQ ID NO: 2114474 - DNA, 18 bp, Homo sapiens
tctcattctgttgcccag

SEQ ID NO: 2114475 - DNA, 23 bp, Homo sapiens
tctcattgtagagcttggtggct

SEQ ID NO: 2114476 - DNA, 15 bp, Homo sapiens
tctcatttaagggaa

SEQ ID NO: 2114477 - DNA, 17 bp, Homo sapiens
tctcatttaagggaaaa

SEQ ID NO: 2114478 - DNA, 19 bp, Homo sapiens
tctcatttaagggaaaaat

SEQ ID NO: 2114479 - DNA, 23 bp, Homo sapiens
tctcatttaagggaaaaatatat

SEQ ID NO: 2114480 - DNA, 14 bp, Homo sapiens
tctcatttgtcaca

SEQ ID NO: 2114481 - DNA, 17 bp, Homo sapiens
tctcatttttccgtaaa

SEQ ID NO: 2114482 - DNA, 21 bp, Homo sapiens
tctccaaacaccggcagaaaa

SEQ ID NO: 2114483 - DNA, 24 bp, Homo sapiens
tctccaaatgagatctaagccttt

SEQ ID NO: 2114484 - DNA, 14 bp, Homo sapiens
tctccaaggaccag

SEQ ID NO: 2114485 - DNA, 17 bp, Homo sapiens
tctccaattgtaaaaaa

SEQ ID NO: 2114486 - DNA, 16 bp, Homo sapiens
tctccaccctgctctc

SEQ ID NO: 2114487 - DNA, 11 bp, Homo sapiens
tctccacctca

SEQ ID NO: 2114488 - DNA, 17 bp, Homo sapiens
tctccacctgaagtgat

SEQ ID NO: 2114489 - DNA, 14 bp, Homo sapiens
tctccactgccttc

SEQ ID NO: 2114490 - DNA, 12 bp, Homo sapiens
tctccagccagc

SEQ ID NO: 2114491 - DNA, 13 bp, Homo sapiens
tctccagccagca

SEQ ID NO: 2114492 - DNA, 15 bp, Homo sapiens
tctccagccagcaat

SEQ ID NO: 2114493 - DNA, 22 bp, Homo sapiens
tctccagcccacacccctccaa

SEQ ID NO: 2114494 - DNA, 14 bp, Homo sapiens
tctccagccttctc

SEQ ID NO: 2114495 - DNA, 20 bp, Homo sapiens
tctccagccttctctctctg

SEQ ID NO: 2114496 - DNA, 21 bp, Homo sapiens
tctccagccttctctctctgg

SEQ ID NO: 2114497 - DNA, 22 bp, Homo sapiens
tctccagccttctctctctggt

SEQ ID NO: 2114498 - DNA, 22 bp, Homo sapiens
tctccaggaaggtagcccagca

SEQ ID NO: 2114499 - DNA, 22 bp, Homo sapiens
tctccaggatggtgcaggatgg

SEQ ID NO: 2114500 - DNA, 17 bp, Homo sapiens
tctccaggcaccatctc

SEQ ID NO: 2114501 - DNA, 16 bp, Homo sapiens
tctccaggctgtttct

SEQ ID NO: 2114502 - DNA, 24 bp, Homo sapiens
tcgctgccaggacacctgccccag

SEQ ID NO: 2114503 - DNA, 14 bp, Homo sapiens
tcgctgctgctact

SEQ ID NO: 2114504 - DNA, 22 bp, Homo sapiens
tcgctggaatcaatttcccaga

SEQ ID NO: 2114505 - DNA, 12 bp, Homo sapiens
tcgctgtcctgc

SEQ ID NO: 2114506 - DNA, 14 bp, Homo sapiens
tcgcttctcctcca

SEQ ID NO: 2114507 - DNA, 14 bp, Homo sapiens
tcgcttgagcccag

SEQ ID NO: 2114508 - DNA, 17 bp, Homo sapiens
tcgcttgagcccaggag

SEQ ID NO: 2114509 - DNA, 18 bp, Homo sapiens
tcgcttgagcccaggagt

SEQ ID NO: 2114510 - DNA, 14 bp, Homo sapiens
tcgcttgcttctgc

SEQ ID NO: 2114511 - DNA, 16 bp, Homo sapiens
tcgcttgcttctgcag

SEQ ID NO: 2114512 - DNA, 16 bp, Homo sapiens
tcggaagcagtgcctt

SEQ ID NO: 2114513 - DNA, 23 bp, Homo sapiens
tcggaagcagtgccttccataat

SEQ ID NO: 2114514 - DNA, 12 bp, Homo sapiens
tcggagaagagc

SEQ ID NO: 2114515 - DNA, 16 bp, Homo sapiens
tcggagaagagctgtt

SEQ ID NO: 2114516 - DNA, 23 bp, Homo sapiens
tcggagacagtgatctccatatg

SEQ ID NO: 2114517 - DNA, 22 bp, Homo sapiens
tcggagcctcatccgaggcagg

SEQ ID NO: 2114518 - DNA, 19 bp, Homo sapiens
tcggaggctgggcccctgg

SEQ ID NO: 2114519 - DNA, 17 bp, Homo sapiens
tcggaggtggtggagga

SEQ ID NO: 2114520 - DNA, 22 bp, Homo sapiens
tcggagtagaaattgttcctga

SEQ ID NO: 2114521 - DNA, 18 bp, Homo sapiens
tcggcaactaagcagtcc

SEQ ID NO: 2114522 - DNA, 16 bp, Homo sapiens
tcggcccacagctccc

SEQ ID NO: 2114523 - DNA, 23 bp, Homo sapiens
tcggcccacagctcccaccccac

SEQ ID NO: 2114524 - DNA, 14 bp, Homo sapiens
tcggccccacatgg

SEQ ID NO: 2114525 - DNA, 19 bp, Homo sapiens
tcggccccacatgggaacc

SEQ ID NO: 2114526 - DNA, 19 bp, Homo sapiens
tcggcctcccaaagtgctg

SEQ ID NO: 2114527 - DNA, 21 bp, Homo sapiens
tcggctgtaaacagctctgtg

SEQ ID NO: 2114528 - DNA, 14 bp, Homo sapiens
tcgggaacagtgtt

SEQ ID NO: 2114529 - DNA, 20 bp, Homo sapiens
tcgggacacctgccctgccc

SEQ ID NO: 2114530 - DNA, 22 bp, Homo sapiens
tcgggagcagtgtcttccataa

SEQ ID NO: 2114531 - DNA, 16 bp, Homo sapiens
tcgggaggctgagaca

SEQ ID NO: 2114532 - DNA, 13 bp, Homo sapiens
tcgggagggtgga

SEQ ID NO: 2114533 - DNA, 20 bp, Homo sapiens
tcgggcgctgtggctcctgc

SEQ ID NO: 2114534 - DNA, 22 bp, Homo sapiens
tcgggcgctgtggctcctgcct

SEQ ID NO: 2114535 - DNA, 16 bp, Homo sapiens
tcggggcatgctgggg

SEQ ID NO: 2114536 - DNA, 17 bp, Homo sapiens
tcggggcatgctggggc

SEQ ID NO: 2114537 - DNA, 17 bp, Homo sapiens
tcggggtgcacaggagg

SEQ ID NO: 2114538 - DNA, 12 bp, Homo sapiens
tcggtggccatg

SEQ ID NO: 2114539 - DNA, 14 bp, Homo sapiens
tcggtggccatgct

SEQ ID NO: 2114540 - DNA, 15 bp, Homo sapiens
tcggtgggacagccc

SEQ ID NO: 2114541 - DNA, 22 bp, Homo sapiens
tcgtagctttcccaaataaact

SEQ ID NO: 2114542 - DNA, 21 bp, Homo sapiens
tcgtataacacaatatgaata

SEQ ID NO: 2114543 - DNA, 17 bp, Homo sapiens
tcgtcatttgcaagctg

SEQ ID NO: 2114544 - DNA, 19 bp, Homo sapiens
tcgtccacaggggcaggcc

SEQ ID NO: 2114545 - DNA, 21 bp, Homo sapiens
tcgtccacaggggcaggcctg

SEQ ID NO: 2114546 - DNA, 22 bp, Homo sapiens
tcgtccacaggggcaggcctgg

SEQ ID NO: 2114547 - DNA, 17 bp, Homo sapiens
tcgtcctccccctgcca

SEQ ID NO: 2114548 - DNA, 23 bp, Homo sapiens
tcgtcctccccctgccagtgcct

SEQ ID NO: 2114549 - DNA, 23 bp, Homo sapiens
tcgtcctgcccccgacagcccag

SEQ ID NO: 2114550 - DNA, 13 bp, Homo sapiens
tcgtgacaacact

SEQ ID NO: 2114551 - DNA, 20 bp, Homo sapiens
tcgtgacccttcagggccag

SEQ ID NO: 2114552 - DNA, 17 bp, Homo sapiens
tcgtgccatgatctgta

SEQ ID NO: 2114553 - DNA, 16 bp, Homo sapiens
tcgtgcctataaatag

SEQ ID NO: 2114554 - DNA, 18 bp, Homo sapiens
tcgtgcctataaatagta

SEQ ID NO: 2114555 - DNA, 13 bp, Homo sapiens
tcgtggacacctg

SEQ ID NO: 2114556 - DNA, 20 bp, Homo sapiens
tcgtggcagataatcagcct

SEQ ID NO: 2114557 - DNA, 22 bp, Homo sapiens
tcgtggcagataatcagcctct

SEQ ID NO: 2114558 - DNA, 15 bp, Homo sapiens
tcgttatgtgtgtat

SEQ ID NO: 2114559 - DNA, 14 bp, Homo sapiens
tcgttttttacaaa

SEQ ID NO: 2114560 - DNA, 21 bp, Homo sapiens
tctaaaaattggtacttgttt

SEQ ID NO: 2114561 - DNA, 19 bp, Homo sapiens
tctaaaactatggttccca

SEQ ID NO: 2114562 - DNA, 17 bp, Homo sapiens
tctaaaagaatttaaat

SEQ ID NO: 2114563 - DNA, 14 bp, Homo sapiens
tctaaacattaatc

SEQ ID NO: 2114564 - DNA, 20 bp, Homo sapiens
tctaaacccaaataaatgtg

SEQ ID NO: 2114565 - DNA, 23 bp, Homo sapiens
tctaaacccaaataaatgtgtaa

SEQ ID NO: 2114566 - DNA, 19 bp, Homo sapiens
tctaaagctggtttaatgt

SEQ ID NO: 2114567 - DNA, 21 bp, Homo sapiens
tctaaagctggtttaatgttt

SEQ ID NO: 2114568 - DNA, 19 bp, Homo sapiens
tctaaagttgttcacatat

SEQ ID NO: 2114569 - DNA, 12 bp, Homo sapiens
tctaaagtttac

SEQ ID NO: 2114570 - DNA, 13 bp, Homo sapiens
tctaaagtttaca

SEQ ID NO: 2114571 - DNA, 17 bp, Homo sapiens
tctaaatcaagtattta

SEQ ID NO: 2114572 - DNA, 17 bp, Homo sapiens
tctaaattctttatttc

SEQ ID NO: 2114573 - DNA, 18 bp, Homo sapiens
tctaacatatgatactga

SEQ ID NO: 2114574 - DNA, 16 bp, Homo sapiens
tctaacatatgtatta

SEQ ID NO: 2114575 - DNA, 22 bp, Homo sapiens
tctaacccccagtgccacagag

SEQ ID NO: 2114576 - DNA, 12 bp, Homo sapiens
tctaactgtaaa

SEQ ID NO: 2114577 - DNA, 19 bp, Homo sapiens
tctaactgtaaatcacttg

SEQ ID NO: 2114578 - DNA, 21 bp, Homo sapiens
tctaactgtaaatcacttgta

SEQ ID NO: 2114579 - DNA, 21 bp, Homo sapiens
tctaagcatcttgtcaagaaa

SEQ ID NO: 2114580 - DNA, 14 bp, Homo sapiens
tctaagctgcagct

SEQ ID NO: 2114581 - DNA, 18 bp, Homo sapiens
tctaagctgcagcttcct

SEQ ID NO: 2114582 - DNA, 13 bp, Homo sapiens
tctaagctggagc

SEQ ID NO: 2114583 - DNA, 15 bp, Homo sapiens
tctaagctggagctc

SEQ ID NO: 2114584 - DNA, 20 bp, Homo sapiens
tctaaggaaatggagaagct

SEQ ID NO: 2114585 - DNA, 18 bp, Homo sapiens
tctaaggttctcatagga

SEQ ID NO: 2114586 - DNA, 19 bp, Homo sapiens
tctaagtaaaaccacagca

SEQ ID NO: 2114587 - DNA, 20 bp, Homo sapiens
tctaagtaaaaccacagcag

SEQ ID NO: 2114588 - DNA, 21 bp, Homo sapiens
tctaagtaaaaccacagcagt

SEQ ID NO: 2114589 - DNA, 16 bp, Homo sapiens
tctaagtatttgaaac

SEQ ID NO: 2114590 - DNA, 14 bp, Homo sapiens
tctaagttaattta

SEQ ID NO: 2114591 - DNA, 18 bp, Homo sapiens
tctaagttaatttaaagt

SEQ ID NO: 2114592 - DNA, 17 bp, Homo sapiens
tctaatacctctgtgtg

SEQ ID NO: 2114593 - DNA, 19 bp, Homo sapiens
tctaatagaactcagtttt

SEQ ID NO: 2114594 - DNA, 21 bp, Homo sapiens
tctaatagcgggttactttca

SEQ ID NO: 2114595 - DNA, 18 bp, Homo sapiens
tctaatattaaaaatatg

SEQ ID NO: 2114596 - DNA, 14 bp, Homo sapiens
tctaatgtcttcat

SEQ ID NO: 2114597 - DNA, 21 bp, Homo sapiens
tctaattcccattttgcaaaa

SEQ ID NO: 2114598 - DNA, 20 bp, Homo sapiens
tctaattggaagaaattcct

SEQ ID NO: 2114599 - DNA, 22 bp, Homo sapiens
tctaattggaagaaattcctgt

SEQ ID NO: 2114600 - DNA, 14 bp, Homo sapiens
tctaatttatacaa

SEQ ID NO: 2114601 - DNA, 17 bp, Homo sapiens
tctaatttatacaaaat

SEQ ID NO: 2114602 - DNA, 21 bp, Homo sapiens
tctaatttatacaaaataatt

SEQ ID NO: 2114603 - DNA, 22 bp, Homo sapiens
tctaatttatcttgtctctggg

SEQ ID NO: 2114604 - DNA, 13 bp, Homo sapiens
tctacaaccagag

SEQ ID NO: 2114605 - DNA, 19 bp, Homo sapiens
tctacaagcatttgccctg

SEQ ID NO: 2114606 - DNA, 11 bp, Homo sapiens
tctacacagcc

SEQ ID NO: 2114607 - DNA, 13 bp, Homo sapiens
tctacacagcctg

SEQ ID NO: 2114608 - DNA, 16 bp, Homo sapiens
tctacacagcctggac

SEQ ID NO: 2114609 - DNA, 17 bp, Homo sapiens
tctacacagcctggact

SEQ ID NO: 2114610 - DNA, 18 bp, Homo sapiens
tctacacagtgggaactc

SEQ ID NO: 2114611 - DNA, 19 bp, Homo sapiens
tctacacatatatgtatat

SEQ ID NO: 2114612 - DNA, 17 bp, Homo sapiens
tctacagaacaaagaac

SEQ ID NO: 2114613 - DNA, 16 bp, Homo sapiens
tctacagacttctcca

SEQ ID NO: 2114614 - DNA, 17 bp, Homo sapiens
tctacagacttctccag

SEQ ID NO: 2114615 - DNA, 18 bp, Homo sapiens
tctacagacttctccaga

SEQ ID NO: 2114616 - DNA, 12 bp, Homo sapiens
tcacatacaatt

SEQ ID NO: 2114617 - DNA, 13 bp, Homo sapiens
tcacatacaattt

SEQ ID NO: 2114618 - DNA, 14 bp, Homo sapiens
tcacatacaatttg

SEQ ID NO: 2114619 - DNA, 17 bp, Homo sapiens
tcacatacaatttgcac

SEQ ID NO: 2114620 - DNA, 19 bp, Homo sapiens
tcacatacaatttgcactg

SEQ ID NO: 2114621 - DNA, 21 bp, Homo sapiens
tcacatagctacccaaaagag

SEQ ID NO: 2114622 - DNA, 20 bp, Homo sapiens
tcacatcagagtgacatcca

SEQ ID NO: 2114623 - DNA, 23 bp, Homo sapiens
tcacatccaatgcatagtttgtt

SEQ ID NO: 2114624 - DNA, 15 bp, Homo sapiens
tcacatgggacaaag

SEQ ID NO: 2114625 - DNA, 21 bp, Homo sapiens
tcacattacatcatcctcctt

SEQ ID NO: 2114626 - DNA, 15 bp, Homo sapiens
tcacattatttgcat

SEQ ID NO: 2114627 - DNA, 19 bp, Homo sapiens
tcacatttattctgctcac

SEQ ID NO: 2114628 - DNA, 20 bp, Homo sapiens
tcacatttttacttggtgta

SEQ ID NO: 2114629 - DNA, 13 bp, Homo sapiens
tcaccaagcccag

SEQ ID NO: 2114630 - DNA, 21 bp, Homo sapiens
tcaccaagctcacagttcctc

SEQ ID NO: 2114631 - DNA, 17 bp, Homo sapiens
tcaaaagattgttttat

SEQ ID NO: 2114632 - DNA, 12 bp, Homo sapiens
tcaaaagcctgg

SEQ ID NO: 2114633 - DNA, 15 bp, Homo sapiens
tcaaaagctgcttga

SEQ ID NO: 2114634 - DNA, 15 bp, Homo sapiens
tcaaaagctggatta

SEQ ID NO: 2114635 - DNA, 13 bp, Homo sapiens
tcaaaaggtgcct

SEQ ID NO: 2114636 - DNA, 16 bp, Homo sapiens
tcaaaataaattgaaa

SEQ ID NO: 2114637 - DNA, 17 bp, Homo sapiens
tcaaaatatttgtacat

SEQ ID NO: 2114638 - DNA, 16 bp, Homo sapiens
tcaaacagaattttaa

SEQ ID NO: 2114639 - DNA, 13 bp, Homo sapiens
tcaaacagtctca

SEQ ID NO: 2114640 - DNA, 20 bp, Homo sapiens
tcaaacagtctcaggaaatc

SEQ ID NO: 2114641 - DNA, 22 bp, Homo sapiens
tcaaacagtctcaggaaatcaa

SEQ ID NO: 2114642 - DNA, 18 bp, Homo sapiens
tcaaacatggaagatgaa

SEQ ID NO: 2114643 - DNA, 14 bp, Homo sapiens
tcaaaccaggattt

SEQ ID NO: 2114644 - DNA, 18 bp, Homo sapiens
tcaaaccataaacttcat

SEQ ID NO: 2114645 - DNA, 15 bp, Homo sapiens
tcaaaccatttaatt

SEQ ID NO: 2114646 - DNA, 18 bp, Homo sapiens
tcaaaccatttaattcat

SEQ ID NO: 2114647 - DNA, 21 bp, Homo sapiens
tcaaaccatttaattcataat

SEQ ID NO: 2114648 - DNA, 23 bp, Homo sapiens
tcaaaccatttaattcataatta

SEQ ID NO: 2114649 - DNA, 22 bp, Homo sapiens
tcaaactgagtaaattggaaac

SEQ ID NO: 2114650 - DNA, 14 bp, Homo sapiens
tcaaacttgtgctg

SEQ ID NO: 2114651 - DNA, 15 bp, Homo sapiens
tcaaacttgtgctga

SEQ ID NO: 2114652 - DNA, 13 bp, Homo sapiens
tatatttatactc

SEQ ID NO: 2114653 - DNA, 13 bp, Homo sapiens
tatatttgctgat

SEQ ID NO: 2114654 - DNA, 18 bp, Homo sapiens
tatatttggaaagagacc

SEQ ID NO: 2114655 - DNA, 10 bp, Homo sapiens
tatattttat

SEQ ID NO: 2114656 - DNA, 17 bp, Homo sapiens
tatattttccctctctt

SEQ ID NO: 2114657 - DNA, 12 bp, Homo sapiens
tatattttcctc

SEQ ID NO: 2114658 - DNA, 18 bp, Homo sapiens
tatatttttcaaccagca

SEQ ID NO: 2114659 - DNA, 15 bp, Homo sapiens
tatatttttcacagt

SEQ ID NO: 2114660 - DNA, 14 bp, Homo sapiens
tatcaaaacatatc

SEQ ID NO: 2114661 - DNA, 16 bp, Homo sapiens
tatcaaaacatatcaa

SEQ ID NO: 2114662 - DNA, 20 bp, Homo sapiens
tatcaaaacatatcaattca

SEQ ID NO: 2114663 - DNA, 19 bp, Homo sapiens
tatcaaaactttcttttct

SEQ ID NO: 2114664 - DNA, 18 bp, Homo sapiens
tatcaaaataaattgaaa

SEQ ID NO: 2114665 - DNA, 21 bp, Homo sapiens
tatcaaaatcactatctttct

SEQ ID NO: 2114666 - DNA, 23 bp, Homo sapiens
tatcaaaatcactatctttctga

SEQ ID NO: 2114667 - DNA, 20 bp, Homo sapiens
tatcaaacagaattttaaag

SEQ ID NO: 2114668 - DNA, 13 bp, Homo sapiens
tatcaaactgaag

SEQ ID NO: 2114669 - DNA, 13 bp, Homo sapiens
tatcaaatctgta

SEQ ID NO: 2114670 - DNA, 17 bp, Homo sapiens
tatcaaccccagacact

SEQ ID NO: 2114671 - DNA, 12 bp, Homo sapiens
tatcaagaaagt

SEQ ID NO: 2114672 - DNA, 15 bp, Homo sapiens
tatcaatagtcaaga

SEQ ID NO: 2114673 - DNA, 15 bp, Homo sapiens
tatcaatcctgcccc

SEQ ID NO: 2114674 - DNA, 16 bp, Homo sapiens
tatcacaaatcttaac

SEQ ID NO: 2114675 - DNA, 20 bp, Homo sapiens
tatcacatacaatttgcact

SEQ ID NO: 2114676 - DNA, 22 bp, Homo sapiens
tatcacatcaagcatgcaataa

SEQ ID NO: 2114677 - DNA, 14 bp, Homo sapiens
tatcacccaggctg

SEQ ID NO: 2114678 - DNA, 18 bp, Homo sapiens
tatcacctctcttcagcc

SEQ ID NO: 2114679 - DNA, 17 bp, Homo sapiens
tatcactggcaatattt

SEQ ID NO: 2114680 - DNA, 13 bp, Homo sapiens
tatcagaaaagta

SEQ ID NO: 2114681 - DNA, 14 bp, Homo sapiens
tatcagaaaagtag

SEQ ID NO: 2114682 - DNA, 13 bp, Homo sapiens
tagtgtaaaataa

SEQ ID NO: 2114683 - DNA, 17 bp, Homo sapiens
tagtgtcacttacctag

SEQ ID NO: 2114684 - DNA, 21 bp, Homo sapiens
tagtgtgagtggcagccatgc

SEQ ID NO: 2114685 - DNA, 22 bp, Homo sapiens
tagtgtgagtggcagccatgcc

SEQ ID NO: 2114686 - DNA, 19 bp, Homo sapiens
tagtgtgtgtgcatgtgtg

SEQ ID NO: 2114687 - DNA, 22 bp, Homo sapiens
tagttaaaagactgcagctgct

SEQ ID NO: 2114688 - DNA, 15 bp, Homo sapiens
tagttagcaggaaat

SEQ ID NO: 2114689 - DNA, 18 bp, Homo sapiens
tagttagcaggaaatagt

SEQ ID NO: 2114690 - DNA, 22 bp, Homo sapiens
tagttaggaaataaaacctttc

SEQ ID NO: 2114691 - DNA, 15 bp, Homo sapiens
tagttaggatagcat

SEQ ID NO: 2114692 - DNA, 20 bp, Homo sapiens
tagttaggatagcatttttg

SEQ ID NO: 2114693 - DNA, 17 bp, Homo sapiens
tagttaggtgtgccaaa

SEQ ID NO: 2114694 - DNA, 20 bp, Homo sapiens
tagttaggtgtgccaaacta

SEQ ID NO: 2114695 - DNA, 21 bp, Homo sapiens
tagttattgttttatgttcta

SEQ ID NO: 2114696 - DNA, 16 bp, Homo sapiens
tagttatttacttgaa

SEQ ID NO: 2114697 - DNA, 21 bp, Homo sapiens
tagttccccgtgaacttcctt

SEQ ID NO: 2114698 - DNA, 23 bp, Homo sapiens
tagttccctgaaaacccagagag

SEQ ID NO: 2114699 - DNA, 20 bp, Homo sapiens
tagttgatgaccaatctctg

SEQ ID NO: 2114700 - DNA, 17 bp, Homo sapiens
tagttgcagaaacattt

SEQ ID NO: 2114701 - DNA, 23 bp, Homo sapiens
tagttgcagactcagtttgtcag

SEQ ID NO: 2114702 - DNA, 15 bp, Homo sapiens
tagtttaattaacta

SEQ ID NO: 2114703 - DNA, 18 bp, Homo sapiens
tagtttattggaagtgtt

SEQ ID NO: 2114704 - DNA, 18 bp, Homo sapiens
tagtttcagatatatatc

SEQ ID NO: 2114705 - DNA, 14 bp, Homo sapiens
tagtttcagtaaat

SEQ ID NO: 2114706 - DNA, 13 bp, Homo sapiens
tagtttctttctg

SEQ ID NO: 2114707 - DNA, 14 bp, Homo sapiens
tagtttctttggga

SEQ ID NO: 2114708 - DNA, 14 bp, Homo sapiens
tagttttaaatatg

SEQ ID NO: 2114709 - DNA, 15 bp, Homo sapiens
tagttttaacagaac

SEQ ID NO: 2114710 - DNA, 14 bp, Homo sapiens
tagttttagttgca

SEQ ID NO: 2114711 - DNA, 16 bp, Homo sapiens
tagttttagttgcaga

SEQ ID NO: 2114712 - DNA, 18 bp, Homo sapiens
tagttttctttgtaaagg

SEQ ID NO: 2114713 - DNA, 14 bp, Homo sapiens
tagtttttcagcta

SEQ ID NO: 2114714 - DNA, 12 bp, Homo sapiens
tataaaaacaaa

SEQ ID NO: 2114715 - DNA, 13 bp, Homo sapiens
tataaaaatatat

SEQ ID NO: 2114716 - DNA, 16 bp, Homo sapiens
tataaaaatatatata

SEQ ID NO: 2114717 - DNA, 13 bp, Homo sapiens
tataaaactcagt

SEQ ID NO: 2114718 - DNA, 16 bp, Homo sapiens
tataaaactgctttgt

SEQ ID NO: 2114719 - DNA, 16 bp, Homo sapiens
tataaaagacaaaact

SEQ ID NO: 2114720 - DNA, 19 bp, Homo sapiens
tataaaatagttgtccata

SEQ ID NO: 2114721 - DNA, 17 bp, Homo sapiens
taaccccaggcatccca

SEQ ID NO: 2114722 - DNA, 20 bp, Homo sapiens
taacccccagcccacagagc

SEQ ID NO: 2114723 - DNA, 20 bp, Homo sapiens
taacccccagtgccacagag

SEQ ID NO: 2114724 - DNA, 15 bp, Homo sapiens
taaccctctcttccc

SEQ ID NO: 2114725 - DNA, 13 bp, Homo sapiens
taaccgtttttca

SEQ ID NO: 2114726 - DNA, 15 bp, Homo sapiens
taaccgtttttcaag

SEQ ID NO: 2114727 - DNA, 21 bp, Homo sapiens
taacctcagccaaacacagag

SEQ ID NO: 2114728 - DNA, 19 bp, Homo sapiens
taacctccacagtagcatt

SEQ ID NO: 2114729 - DNA, 17 bp, Homo sapiens
taacgccctatttttgc

SEQ ID NO: 2114730 - DNA, 15 bp, Homo sapiens
taacggctccaggat

SEQ ID NO: 2114731 - DNA, 17 bp, Homo sapiens
taacgtttaagccaaaa

SEQ ID NO: 2114732 - DNA, 20 bp, Homo sapiens
taacgtttaagccaaaacaa

SEQ ID NO: 2114733 - DNA, 12 bp, Homo sapiens
taactaatttaa

SEQ ID NO: 2114734 - DNA, 16 bp, Homo sapiens
taactaatttaaacca

SEQ ID NO: 2114735 - DNA, 17 bp, Homo sapiens
taactaatttaaaccag

SEQ ID NO: 2114736 - DNA, 19 bp, Homo sapiens
taactactttttatactcc

SEQ ID NO: 2114737 - DNA, 13 bp, Homo sapiens
taactagatctcc

SEQ ID NO: 2114738 - DNA, 15 bp, Homo sapiens
taactagcttggaaa

SEQ ID NO: 2114739 - DNA, 23 bp, Homo sapiens
taactaggccatttgtatttgta

SEQ ID NO: 2114740 - DNA, 17 bp, Homo sapiens
taactagtgttgcttgg

SEQ ID NO: 2114741 - DNA, 14 bp, Homo sapiens
taactattgaattg

SEQ ID NO: 2114742 - DNA, 17 bp, Homo sapiens
taactcagacattccaa

SEQ ID NO: 2114743 - DNA, 17 bp, Homo sapiens
taactcatcataaaata

SEQ ID NO: 2114744 - DNA, 15 bp, Homo sapiens
taactcatctgtcac

SEQ ID NO: 2114745 - DNA, 14 bp, Homo sapiens
taactcatctgtta

SEQ ID NO: 2114746 - DNA, 11 bp, Homo sapiens
taactccacca

SEQ ID NO: 2114747 - DNA, 20 bp, Homo sapiens
taactgcaattttaattgat

SEQ ID NO: 2114748 - DNA, 23 bp, Homo sapiens
taactgccatcaagatgagagaa

SEQ ID NO: 2114749 - DNA, 15 bp, Homo sapiens
taactgctgagccac

SEQ ID NO: 2114750 - DNA, 22 bp, Homo sapiens
taactggggtattaactttttt

SEQ ID NO: 2114751 - DNA, 23 bp, Homo sapiens
taactggggtattaactttttta

SEQ ID NO: 2114752 - DNA, 12 bp, Homo sapiens
taactgtaaatc

SEQ ID NO: 2114753 - DNA, 18 bp, Homo sapiens
taactgtaaatcacttgt

SEQ ID NO: 2114754 - DNA, 19 bp, Homo sapiens
taactgtaaatcacttgta

SEQ ID NO: 2114755 - DNA, 20 bp, Homo sapiens
taactgtaaatcacttgtaa

SEQ ID NO: 2114756 - DNA, 16 bp, Homo sapiens
taactgtcatctagcc

SEQ ID NO: 2114757 - DNA, 20 bp, Homo sapiens
taactgtgtgaagaaatgga

SEQ ID NO: 2114758 - DNA, 19 bp, Homo sapiens
gttcaacttttcctttgaa

SEQ ID NO: 2114759 - DNA, 18 bp, Homo sapiens
gttcaagaccagcctggc

SEQ ID NO: 2114760 - DNA, 20 bp, Homo sapiens
gttcaagcctgtgggagtag

SEQ ID NO: 2114761 - DNA, 17 bp, Homo sapiens
gttcaattccctgaagg

SEQ ID NO: 2114762 - DNA, 23 bp, Homo sapiens
gttcaattctcatttgtcacaca

SEQ ID NO: 2114763 - DNA, 14 bp, Homo sapiens
gttcactagagctg

SEQ ID NO: 2114764 - DNA, 21 bp, Homo sapiens
gttcacttctttgcagagcct

SEQ ID NO: 2114765 - DNA, 14 bp, Homo sapiens
gttcagaagaaatt

SEQ ID NO: 2114766 - DNA, 19 bp, Homo sapiens
gttcagccacaaagtagtt

SEQ ID NO: 2114767 - DNA, 23 bp, Homo sapiens
gttcagccaccctgaggcctctg

SEQ ID NO: 2114768 - DNA, 21 bp, Homo sapiens
gttcagccagaatcttcgtcc

SEQ ID NO: 2114769 - DNA, 14 bp, Homo sapiens
gttcagcccctcct

SEQ ID NO: 2114770 - DNA, 22 bp, Homo sapiens
gttcagcccctcctctgccacc

SEQ ID NO: 2114771 - DNA, 19 bp, Homo sapiens
gttcagctaagctaggaat

SEQ ID NO: 2114772 - DNA, 15 bp, Homo sapiens
gttcagctccagctc

SEQ ID NO: 2114773 - DNA, 16 bp, Homo sapiens
gttcagctccagctca

SEQ ID NO: 2114774 - DNA, 17 bp, Homo sapiens
gttcaggagctgaagcc

SEQ ID NO: 2114775 - DNA, 18 bp, Homo sapiens
gttcaggagtcccaagga

SEQ ID NO: 2114776 - DNA, 20 bp, Homo sapiens
gttcaggagtcccaaggaaa

SEQ ID NO: 2114777 - DNA, 15 bp, Homo sapiens
gttcagggaagcagg

SEQ ID NO: 2114778 - DNA, 20 bp, Homo sapiens
gttcagggttggcccctgcc

SEQ ID NO: 2114779 - DNA, 22 bp, Homo sapiens
gttcatatgtaccatgtacatg

SEQ ID NO: 2114780 - DNA, 20 bp, Homo sapiens
gttcatctatggcagtccag

SEQ ID NO: 2114781 - DNA, 14 bp, Homo sapiens
gttcatgagaatct

SEQ ID NO: 2114782 - DNA, 17 bp, Homo sapiens
gttcatgagtggatgga

SEQ ID NO: 2114783 - DNA, 19 bp, Homo sapiens
gttcatgagtggatggatg

SEQ ID NO: 2114784 - DNA, 16 bp, Homo sapiens
gttcattaaagcatga

SEQ ID NO: 2114785 - DNA, 19 bp, Homo sapiens
gttcattaaattttctatg

SEQ ID NO: 2114786 - DNA, 12 bp, Homo sapiens
gttcattttagt

SEQ ID NO: 2114787 - DNA, 18 bp, Homo sapiens
gttcattttagtgactgt

SEQ ID NO: 2114788 - DNA, 19 bp, Homo sapiens
gttccaaatgaatgttgtc

SEQ ID NO: 2114789 - DNA, 20 bp, Homo sapiens
gttccacgtccccctggggc

SEQ ID NO: 2114790 - DNA, 21 bp, Homo sapiens
gttccacgtccccctggggct

SEQ ID NO: 2114791 - DNA, 12 bp, Homo sapiens
gttccagctggt

SEQ ID NO: 2114792 - DNA, 23 bp, Homo sapiens
gttccatgaagaccacatccaca

SEQ ID NO: 2114793 - DNA, 23 bp, Homo sapiens
gttcccaagagcatcatgcctct

SEQ ID NO: 2114794 - DNA, 14 bp, Homo sapiens
gttcccatgttaaa

SEQ ID NO: 2114795 - DNA, 21 bp, Homo sapiens
gttcccccgctggcagccacc

SEQ ID NO: 2114796 - DNA, 18 bp, Homo sapiens
gttcccctgttcactcta

SEQ ID NO: 2114797 - DNA, 13 bp, Homo sapiens
gttccccttggct

SEQ ID NO: 2114798 - DNA, 19 bp, Homo sapiens
gttccccttggcttcctcc

SEQ ID NO: 2114799 - DNA, 17 bp, Homo sapiens
gttcccggagcacagcc

SEQ ID NO: 2114800 - DNA, 18 bp, Homo sapiens
gttcccggagcacagccc

SEQ ID NO: 2114801 - DNA, 21 bp, Homo sapiens
gttccctagctgaggatgaca

SEQ ID NO: 2114802 - DNA, 22 bp, Homo sapiens
gttccctctgagaattccaagg

SEQ ID NO: 2114803 - DNA, 18 bp, Homo sapiens
gttccctgaaaacccaga

SEQ ID NO: 2114804 - DNA, 16 bp, Homo sapiens
gttccctgcaccctgg

SEQ ID NO: 2114805 - DNA, 17 bp, Homo sapiens
gttccctgcaccctgga

SEQ ID NO: 2114806 - DNA, 13 bp, Homo sapiens
gttcctcgccctg

SEQ ID NO: 2114807 - DNA, 15 bp, Homo sapiens
gttcctcgccctggg

SEQ ID NO: 2114808 - DNA, 14 bp, Homo sapiens
gttcctgcactcca

SEQ ID NO: 2114809 - DNA, 16 bp, Homo sapiens
gttcctgcactccaga

SEQ ID NO: 2114810 - DNA, 17 bp, Homo sapiens
gttcctgcactccagaa

SEQ ID NO: 2114811 - DNA, 17 bp, Homo sapiens
gttcctgtggccaggag

SEQ ID NO: 2114812 - DNA, 15 bp, Homo sapiens
gttccttacctttac

SEQ ID NO: 2114813 - DNA, 15 bp, Homo sapiens
gttccttactgcaga

SEQ ID NO: 2114814 - DNA, 19 bp, Homo sapiens
gttccttataagaattaat

SEQ ID NO: 2114815 - DNA, 15 bp, Homo sapiens
gttccttccctggga

SEQ ID NO: 2114816 - DNA, 17 bp, Homo sapiens
gttccttccctgggaag

SEQ ID NO: 2114817 - DNA, 21 bp, Homo sapiens
gttccttccgatgacagtgct

SEQ ID NO: 2114818 - DNA, 12 bp, Homo sapiens
gttccttctgct

SEQ ID NO: 2114819 - DNA, 22 bp, Homo sapiens
gttcgacgagacggtcgagcag

SEQ ID NO: 2114820 - DNA, 19 bp, Homo sapiens
gttcgagaccaacctgacc

SEQ ID NO: 2114821 - DNA, 16 bp, Homo sapiens
gttcgagaccagcctg

SEQ ID NO: 2114822 - DNA, 18 bp, Homo sapiens
gttctaatatttttagct

SEQ ID NO: 2114823 - DNA, 14 bp, Homo sapiens
gttctacaagcata

SEQ ID NO: 2114824 - DNA, 16 bp, Homo sapiens
gttctacaagcatatt

SEQ ID NO: 2114825 - DNA, 23 bp, Homo sapiens
gttctagtccttggtctgctggt

SEQ ID NO: 2114826 - DNA, 18 bp, Homo sapiens
gttctatataaggaggaa

SEQ ID NO: 2114827 - DNA, 21 bp, Homo sapiens
gttctatataaggaggaaaac

SEQ ID NO: 2114828 - DNA, 16 bp, Homo sapiens
gttctatattgtgcca

SEQ ID NO: 2114829 - DNA, 16 bp, Homo sapiens
gttctcaatgcttttc

SEQ ID NO: 2114830 - DNA, 23 bp, Homo sapiens
gttctcaatgtgaaaaatgtgtc

SEQ ID NO: 2114831 - DNA, 12 bp, Homo sapiens
gttctcagctcc

SEQ ID NO: 2114832 - DNA, 13 bp, Homo sapiens
gttctcagctccg

SEQ ID NO: 2114833 - DNA, 20 bp, Homo sapiens
gttctccagcccacacccct

SEQ ID NO: 2114834 - DNA, 18 bp, Homo sapiens
gttctccgggtgtggcct

SEQ ID NO: 2114835 - DNA, 22 bp, Homo sapiens
gttctccgggtgtggcctcagc

SEQ ID NO: 2114836 - DNA, 21 bp, Homo sapiens
gttctctattttgcctttaaa

SEQ ID NO: 2114837 - DNA, 12 bp, Homo sapiens
gttctctgagga

SEQ ID NO: 2114838 - DNA, 16 bp, Homo sapiens
gttctgaataatttct

SEQ ID NO: 2114839 - DNA, 19 bp, Homo sapiens
gttctgagccgggcaagtc

SEQ ID NO: 2114840 - DNA, 14 bp, Homo sapiens
gttctgagtgtttt

SEQ ID NO: 2114841 - DNA, 13 bp, Homo sapiens
gttctgcactgaa

SEQ ID NO: 2114842 - DNA, 16 bp, Homo sapiens
gttctgctcctctcca

SEQ ID NO: 2114843 - DNA, 19 bp, Homo sapiens
gttctgctcctctccaggc

SEQ ID NO: 2114844 - DNA, 17 bp, Homo sapiens
gttctgctgcccctgca

SEQ ID NO: 2114845 - DNA, 16 bp, Homo sapiens
gttctggcctcagacc

SEQ ID NO: 2114846 - DNA, 17 bp, Homo sapiens
gttctggcctcagacca

SEQ ID NO: 2114847 - DNA, 12 bp, Homo sapiens
gttctgggacac

SEQ ID NO: 2114848 - DNA, 23 bp, Homo sapiens
gttctggtatgaacttgaggaca

SEQ ID NO: 2114849 - DNA, 12 bp, Homo sapiens
gttctgtcacca

SEQ ID NO: 2114850 - DNA, 20 bp, Homo sapiens
gttctgtgtgggtctgggga

SEQ ID NO: 2114851 - DNA, 23 bp, Homo sapiens
gttctgtttcccattactttaat

SEQ ID NO: 2114852 - DNA, 21 bp, Homo sapiens
gttcttgcagtcatcagaagt

SEQ ID NO: 2114853 - DNA, 15 bp, Homo sapiens
gttcttgctgagcac

SEQ ID NO: 2114854 - DNA, 12 bp, Homo sapiens
gttcttgtctga

SEQ ID NO: 2114855 - DNA, 13 bp, Homo sapiens
gttctttaatgtt

SEQ ID NO: 2114856 - DNA, 18 bp, Homo sapiens
gttctttaggtgcctcct

SEQ ID NO: 2114857 - DNA, 20 bp, Homo sapiens
gttctttaggtgcctcctgt

SEQ ID NO: 2114858 - DNA, 14 bp, Homo sapiens
gttctttcttcctc

SEQ ID NO: 2114859 - DNA, 17 bp, Homo sapiens
gttctttcttcctctgc

SEQ ID NO: 2114860 - DNA, 18 bp, Homo sapiens
gttctttcttcctctgct

SEQ ID NO: 2114861 - DNA, 18 bp, Homo sapiens
gttctttggaaggagtga

SEQ ID NO: 2114862 - DNA, 22 bp, Homo sapiens
gtttccttttattctgtacctt

SEQ ID NO: 2114863 - DNA, 23 bp, Homo sapiens
gtttctattctctcctcagactg

SEQ ID NO: 2114864 - DNA, 14 bp, Homo sapiens
gtttctcagctccc

SEQ ID NO: 2114865 - DNA, 22 bp, Homo sapiens
gtttctccccctgggctctgcc

SEQ ID NO: 2114866 - DNA, 18 bp, Homo sapiens
gtttctcctttattgctc

SEQ ID NO: 2114867 - DNA, 20 bp, Homo sapiens
gtttctgacccaagaggtgg

SEQ ID NO: 2114868 - DNA, 21 bp, Homo sapiens
gtttctgacccaagaggtggg

SEQ ID NO: 2114869 - DNA, 22 bp, Homo sapiens
gtttctgattcactattagaga

SEQ ID NO: 2114870 - DNA, 20 bp, Homo sapiens
gtttctgcagtagtctctgt

SEQ ID NO: 2114871 - DNA, 14 bp, Homo sapiens
gtttctgcgtgctt

SEQ ID NO: 2114872 - DNA, 13 bp, Homo sapiens
gtttcttgcctca

SEQ ID NO: 2114873 - DNA, 14 bp, Homo sapiens
gtttcttgcctcat

SEQ ID NO: 2114874 - DNA, 21 bp, Homo sapiens
gtttcttggggtcccagggaa

SEQ ID NO: 2114875 - DNA, 12 bp, Homo sapiens
gtttgaacttca

SEQ ID NO: 2114876 - DNA, 17 bp, Homo sapiens
gtttgaaggaggtgagg

SEQ ID NO: 2114877 - DNA, 21 bp, Homo sapiens
gtttgacctcacagtgaccct

SEQ ID NO: 2114878 - DNA, 18 bp, Homo sapiens
gtttgagacaagccctgg

SEQ ID NO: 2114879 - DNA, 22 bp, Homo sapiens
gtttgagacaagccctggcaac

SEQ ID NO: 2114880 - DNA, 15 bp, Homo sapiens
gtttgagaccagcct

SEQ ID NO: 2114881 - DNA, 16 bp, Homo sapiens
gtttgagttttcaaag

SEQ ID NO: 2114882 - DNA, 13 bp, Homo sapiens
gtttgatttagta

SEQ ID NO: 2114883 - DNA, 21 bp, Homo sapiens
gtttgattttagctgcagaac

SEQ ID NO: 2114884 - DNA, 15 bp, Homo sapiens
gtttgcaaggaagcc

SEQ ID NO: 2114885 - DNA, 17 bp, Homo sapiens
gtttgcacctttctagt

SEQ ID NO: 2114886 - DNA, 19 bp, Homo sapiens
gtttgctctagtcttgctt

SEQ ID NO: 2114887 - DNA, 21 bp, Homo sapiens
gtttggatctccaattgcctc

SEQ ID NO: 2114888 - DNA, 15 bp, Homo sapiens
gtttggcaatagttt

SEQ ID NO: 2114889 - DNA, 16 bp, Homo sapiens
gtttggcttcctcctg

SEQ ID NO: 2114890 - DNA, 22 bp, Homo sapiens
gtttggggaatgcggccgcatt

SEQ ID NO: 2114891 - DNA, 12 bp, Homo sapiens
gtttggggagaa

SEQ ID NO: 2114892 - DNA, 15 bp, Homo sapiens
gtttggggcaggagt

SEQ ID NO: 2114893 - DNA, 21 bp, Homo sapiens
gtttggggcaggagtagctga

SEQ ID NO: 2114894 - DNA, 15 bp, Homo sapiens
gtttgtaaattctgg

SEQ ID NO: 2114895 - DNA, 20 bp, Homo sapiens
gtttgtattttaaatgtttt

SEQ ID NO: 2114896 - DNA, 17 bp, Homo sapiens
gtttgtcatatattcat

SEQ ID NO: 2114897 - DNA, 14 bp, Homo sapiens
gtttgtggctgttg

SEQ ID NO: 2114898 - DNA, 16 bp, Homo sapiens
gtttgttgattttcta

SEQ ID NO: 2114899 - DNA, 19 bp, Homo sapiens
gtttgtttctccccctggg

SEQ ID NO: 2114900 - DNA, 21 bp, Homo sapiens
gtttgtttctccccctgggct

SEQ ID NO: 2114901 - DNA, 22 bp, Homo sapiens
gttttaaatacgcactacatgt

SEQ ID NO: 2114902 - DNA, 15 bp, Homo sapiens
gttttaaatatgaac

SEQ ID NO: 2114903 - DNA, 18 bp, Homo sapiens
gttttaacagaaccagag

SEQ ID NO: 2114904 - DNA, 19 bp, Homo sapiens
gttttaacagaaccagagg

SEQ ID NO: 2114905 - DNA, 15 bp, Homo sapiens
gttttaagattgtaa

SEQ ID NO: 2114906 - DNA, 23 bp, Homo sapiens
gttttaattccaatatgatgact

SEQ ID NO: 2114907 - DNA, 19 bp, Homo sapiens
gttttacaaatttttcctg

SEQ ID NO: 2114908 - DNA, 20 bp, Homo sapiens
gttttacaagaattgtccat

SEQ ID NO: 2114909 - DNA, 21 bp, Homo sapiens
gttttacttttgtcttcctca

SEQ ID NO: 2114910 - DNA, 21 bp, Homo sapiens
gttttagctccttgactcctt

SEQ ID NO: 2114911 - DNA, 14 bp, Homo sapiens
gttttagttgcaga

SEQ ID NO: 2114912 - DNA, 21 bp, Homo sapiens
gttttagttgcagaaacattt

SEQ ID NO: 2114913 - DNA, 18 bp, Homo sapiens
gttttatactgtacttaa

SEQ ID NO: 2114914 - DNA, 22 bp, Homo sapiens
gttttatcatgacatgttatat

SEQ ID NO: 2114915 - DNA, 19 bp, Homo sapiens
gttttcacatacactcaaa

SEQ ID NO: 2114916 - DNA, 11 bp, Homo sapiens
gttttcactct

SEQ ID NO: 2114917 - DNA, 14 bp, Homo sapiens
gttttcagactcag

SEQ ID NO: 2114918 - DNA, 16 bp, Homo sapiens
gttttcagcaactcag

SEQ ID NO: 2114919 - DNA, 24 bp, Homo sapiens
gttttcataacttgctgaatttca

SEQ ID NO: 2114920 - DNA, 16 bp, Homo sapiens
gttttcatcctggcct

SEQ ID NO: 2114921 - DNA, 18 bp, Homo sapiens
gttttcatcctggcctcc

SEQ ID NO: 2114922 - DNA, 16 bp, Homo sapiens
gttttcattatctcaa

SEQ ID NO: 2114923 - DNA, 14 bp, Homo sapiens
gttttccaccctgg

SEQ ID NO: 2114924 - DNA, 15 bp, Homo sapiens
gttttccactgtgct

SEQ ID NO: 2114925 - DNA, 22 bp, Homo sapiens
gttttcccgagcaaagtctaaa

SEQ ID NO: 2114926 - DNA, 23 bp, Homo sapiens
gttttcccgagcaaagtctaaag

SEQ ID NO: 2114927 - DNA, 16 bp, Homo sapiens
gttttcctaaatgcag

SEQ ID NO: 2114928 - DNA, 20 bp, Homo sapiens
gttttctaactgtaaatcac

SEQ ID NO: 2114929 - DNA, 22 bp, Homo sapiens
gttttctaactgtaaatcactt

SEQ ID NO: 2114930 - DNA, 19 bp, Homo sapiens
gttttctcagaacagctga

SEQ ID NO: 2114931 - DNA, 20 bp, Homo sapiens
gttttctcagaacagctgaa

SEQ ID NO: 2114932 - DNA, 18 bp, Homo sapiens
gttttctcctcccaggaa

SEQ ID NO: 2114933 - DNA, 16 bp, Homo sapiens
gttttctgagaaagac

SEQ ID NO: 2114934 - DNA, 23 bp, Homo sapiens
gttttctgagaaagactattcaa

SEQ ID NO: 2114935 - DNA, 22 bp, Homo sapiens
gttttcttcaagggaagaaaca

SEQ ID NO: 2114936 - DNA, 19 bp, Homo sapiens
gttttctttgtaaaggtca

SEQ ID NO: 2114937 - DNA, 18 bp, Homo sapiens
gttttgaaagaaaaatac

SEQ ID NO: 2114938 - DNA, 21 bp, Homo sapiens
gttttgaagcctgctaaatga

SEQ ID NO: 2114939 - DNA, 21 bp, Homo sapiens
gttttgccatgttggccaggc

SEQ ID NO: 2114940 - DNA, 22 bp, Homo sapiens
gttttgccatgttggccaggct

SEQ ID NO: 2114941 - DNA, 15 bp, Homo sapiens
gttttggtgcctgcc

SEQ ID NO: 2114942 - DNA, 17 bp, Homo sapiens
gttttgtaaataagtga

SEQ ID NO: 2114943 - DNA, 17 bp, Homo sapiens
gttttgtctctgcatct

SEQ ID NO: 2114944 - DNA, 13 bp, Homo sapiens
gtttttaaaagtt

SEQ ID NO: 2114945 - DNA, 19 bp, Homo sapiens
gtttttaactcaatatttt

SEQ ID NO: 2114946 - DNA, 14 bp, Homo sapiens
gtttttaagctgtt

SEQ ID NO: 2114947 - DNA, 19 bp, Homo sapiens
gtttttaagctgtttccat

SEQ ID NO: 2114948 - DNA, 13 bp, Homo sapiens
gtttttaatgtat

SEQ ID NO: 2114949 - DNA, 22 bp, Homo sapiens
gtttttacctaccacagtgtct

SEQ ID NO: 2114950 - DNA, 16 bp, Homo sapiens
gtttttactacagttg

SEQ ID NO: 2114951 - DNA, 18 bp, Homo sapiens
gtttttatggggctgaac

SEQ ID NO: 2114952 - DNA, 11 bp, Homo sapiens
gtttttcaaga

SEQ ID NO: 2114953 - DNA, 16 bp, Homo sapiens
gtttttcggacagttt

SEQ ID NO: 2114954 - DNA, 22 bp, Homo sapiens
taaaattgtaaaattgtataga

SEQ ID NO: 2114955 - DNA, 16 bp, Homo sapiens
taaaattgtatagaga

SEQ ID NO: 2114956 - DNA, 17 bp, Homo sapiens
taaaattgtgatgtttt

SEQ ID NO: 2114957 - DNA, 20 bp, Homo sapiens
taaaattttacttttgttct

SEQ ID NO: 2114958 - DNA, 13 bp, Homo sapiens
taaacaagtattt

SEQ ID NO: 2114959 - DNA, 18 bp, Homo sapiens
taaacaagtatttgttaa

SEQ ID NO: 2114960 - DNA, 23 bp, Homo sapiens
taaacacagaggttttaaacagt

SEQ ID NO: 2114961 - DNA, 14 bp, Homo sapiens
taaacacctgacac

SEQ ID NO: 2114962 - DNA, 15 bp, Homo sapiens
taaacacctgacaca

SEQ ID NO: 2114963 - DNA, 13 bp, Homo sapiens
taaacactgtaat

SEQ ID NO: 2114964 - DNA, 17 bp, Homo sapiens
taaacactgtaatctta

SEQ ID NO: 2114965 - DNA, 13 bp, Homo sapiens
taaacagaaggag

SEQ ID NO: 2114966 - DNA, 16 bp, Homo sapiens
taaacagatataaatg

SEQ ID NO: 2114967 - DNA, 21 bp, Homo sapiens
taaacagatataaatggctgg

SEQ ID NO: 2114968 - DNA, 17 bp, Homo sapiens
taaacagcagtgttccc

SEQ ID NO: 2114969 - DNA, 18 bp, Homo sapiens
taaacagctaataatgaa

SEQ ID NO: 2114970 - DNA, 17 bp, Homo sapiens
taaacatccttcaagaa

SEQ ID NO: 2114971 - DNA, 15 bp, Homo sapiens
taaacattaaatgtc

SEQ ID NO: 2114972 - DNA, 16 bp, Homo sapiens
taaacattaaatgtct

SEQ ID NO: 2114973 - DNA, 22 bp, Homo sapiens
taaacattttggggttagacct

SEQ ID NO: 2114974 - DNA, 14 bp, Homo sapiens
taaaccaaaggaca

SEQ ID NO: 2114975 - DNA, 23 bp, Homo sapiens
taaaccaaaggacattatgtgtg

SEQ ID NO: 2114976 - DNA, 11 bp, Homo sapiens
taaaccagcag

SEQ ID NO: 2114977 - DNA, 17 bp, Homo sapiens
taaaccagcagaaaagt

SEQ ID NO: 2114978 - DNA, 21 bp, Homo sapiens
taaaccagcagaaaagtgctt

SEQ ID NO: 2114979 - DNA, 14 bp, Homo sapiens
taaacccaaataaa

SEQ ID NO: 2114980 - DNA, 17 bp, Homo sapiens
taaacccaaataaatgt

SEQ ID NO: 2114981 - DNA, 18 bp, Homo sapiens
taaacccccgctccagat

SEQ ID NO: 2114982 - DNA, 20 bp, Homo sapiens
gtgccccccttgccagacat

SEQ ID NO: 2114983 - DNA, 23 bp, Homo sapiens
gtgccccttaagggttgaaggca

SEQ ID NO: 2114984 - DNA, 21 bp, Homo sapiens
gatgtaaacagtgcctgctga

SEQ ID NO: 2114985 - DNA, 18 bp, Homo sapiens
gatgtaactattgaattg

SEQ ID NO: 2114986 - DNA, 13 bp, Homo sapiens
gatgtaggaggga

SEQ ID NO: 2114987 - DNA, 14 bp, Homo sapiens
gatgtaggagggac

SEQ ID NO: 2114988 - DNA, 15 bp, Homo sapiens
gatgtagtctgaggc

SEQ ID NO: 2114989 - DNA, 20 bp, Homo sapiens
gatgtcaaatatctcagagg

SEQ ID NO: 2114990 - DNA, 14 bp, Homo sapiens
gatgtcagccttgc

SEQ ID NO: 2114991 - DNA, 23 bp, Homo sapiens
gatgtcatccccttgtgtcagag

SEQ ID NO: 2114992 - DNA, 20 bp, Homo sapiens
gatgtcatgtacttcctgtg

SEQ ID NO: 2114993 - DNA, 17 bp, Homo sapiens
gatgtcccctgtcccac

SEQ ID NO: 2114994 - DNA, 22 bp, Homo sapiens
gatgtgaattgcctgcagagag

SEQ ID NO: 2114995 - DNA, 23 bp, Homo sapiens
gatgtgaattgcctgcagagaga

SEQ ID NO: 2114996 - DNA, 20 bp, Homo sapiens
gatgtgcacggcagcttgag

SEQ ID NO: 2114997 - DNA, 16 bp, Homo sapiens
gatgtgccagaacttc

SEQ ID NO: 2114998 - DNA, 14 bp, Homo sapiens
gatgtgctggagct

SEQ ID NO: 2114999 - DNA, 17 bp, Homo sapiens
gatgtgctggagctggc

SEQ ID NO: 2115000 - DNA, 17 bp, Homo sapiens
gatgtggagctcctgct

SEQ ID NO: 2115001 - DNA, 19 bp, Homo sapiens
gatgtggcaaagtgctgta

SEQ ID NO: 2115002 - DNA, 15 bp, Homo sapiens
gatgtgtcatctaat

SEQ ID NO: 2115003 - DNA, 13 bp, Homo sapiens
gatgtgtggggca

SEQ ID NO: 2115004 - DNA, 23 bp, Homo sapiens
gatgtgttttgcacgtcttgcta

SEQ ID NO: 2115005 - DNA, 18 bp, Homo sapiens
gatgttctggacctcccc

SEQ ID NO: 2115006 - DNA, 23 bp, Homo sapiens
gatgttgaatgcccacaggcaaa

SEQ ID NO: 2115007 - DNA, 14 bp, Homo sapiens
gatgttgagctgag

SEQ ID NO: 2115008 - DNA, 19 bp, Homo sapiens
gatgttgtcattatgtaca

SEQ ID NO: 2115009 - DNA, 17 bp, Homo sapiens
gatgttgtttgggagag

SEQ ID NO: 2115010 - DNA, 23 bp, Homo sapiens
gatgtttacaggtggacacacaa

SEQ ID NO: 2115011 - DNA, 23 bp, Homo sapiens
gatgttttgtcccatttccttgg

SEQ ID NO: 2115012 - DNA, 15 bp, Homo sapiens
gattaaacacctgac

SEQ ID NO: 2115013 - DNA, 20 bp, Homo sapiens
gattaagatacactcctgct

SEQ ID NO: 2115014 - DNA, 13 bp, Homo sapiens
gattaatttatgg

SEQ ID NO: 2115015 - DNA, 19 bp, Homo sapiens
gattaatttatggtttctg

SEQ ID NO: 2115016 - DNA, 13 bp, Homo sapiens
gattacagaggaa

SEQ ID NO: 2115017 - DNA, 14 bp, Homo sapiens
gattagaaggcaag

SEQ ID NO: 2115018 - DNA, 22 bp, Homo sapiens
gattagaatgaaaattgtatgt

SEQ ID NO: 2115019 - DNA, 13 bp, Homo sapiens
gattagctctgga

SEQ ID NO: 2115020 - DNA, 23 bp, Homo sapiens
gattataaaattatttttattaa

SEQ ID NO: 2115021 - DNA, 15 bp, Homo sapiens
gattatatatcataa

SEQ ID NO: 2115022 - DNA, 22 bp, Homo sapiens
gattatatatcataaagtatgc

SEQ ID NO: 2115023 - DNA, 15 bp, Homo sapiens
gattatgggtcctgc

SEQ ID NO: 2115024 - DNA, 19 bp, Homo sapiens
gattatgggtcctgcaatt

SEQ ID NO: 2115025 - DNA, 14 bp, Homo sapiens
gattattcatttaa

SEQ ID NO: 2115026 - DNA, 15 bp, Homo sapiens
gattattcatttaaa

SEQ ID NO: 2115027 - DNA, 16 bp, Homo sapiens
gattattcatttaaaa

SEQ ID NO: 2115028 - DNA, 19 bp, Homo sapiens
gattattctgattccactt

SEQ ID NO: 2115029 - DNA, 14 bp, Homo sapiens
gattattcttccag

SEQ ID NO: 2115030 - DNA, 23 bp, Homo sapiens
gattatttgttatttgtacagtt

SEQ ID NO: 2115031 - DNA, 12 bp, Homo sapiens
gattcaaaagtg

SEQ ID NO: 2115032 - DNA, 21 bp, Homo sapiens
gattcacaactaggacctcat

SEQ ID NO: 2115033 - DNA, 17 bp, Homo sapiens
gattcaggaaaaggcct

SEQ ID NO: 2115034 - DNA, 18 bp, Homo sapiens
gattcaggaaaaggcctg

SEQ ID NO: 2115035 - DNA, 22 bp, Homo sapiens
gattcaggaaaaggcctggggt

SEQ ID NO: 2115036 - DNA, 19 bp, Homo sapiens
gattccacacaaaatgtca

SEQ ID NO: 2115037 - DNA, 20 bp, Homo sapiens
gattccagagagtggctcct

SEQ ID NO: 2115038 - DNA, 16 bp, Homo sapiens
gattcccaagctctgc

SEQ ID NO: 2115039 - DNA, 22 bp, Homo sapiens
gattcccaagctctgctcctct

SEQ ID NO: 2115040 - DNA, 16 bp, Homo sapiens
gattcccaccaaggtc

SEQ ID NO: 2115041 - DNA, 13 bp, Homo sapiens
gattcccagagac

SEQ ID NO: 2115042 - DNA, 18 bp, Homo sapiens
gattcctcccccagagcc

SEQ ID NO: 2115043 - DNA, 13 bp, Homo sapiens
gattcctgggcct

SEQ ID NO: 2115044 - DNA, 20 bp, Homo sapiens
gattccttttgatggggaga

SEQ ID NO: 2115045 - DNA, 22 bp, Homo sapiens
gattccttttgatggggagaaa

SEQ ID NO: 2115046 - DNA, 16 bp, Homo sapiens
gtggaggcctgatgct

SEQ ID NO: 2115047 - DNA, 17 bp, Homo sapiens
gtggaggcctgatgctg

SEQ ID NO: 2115048 - DNA, 18 bp, Homo sapiens
gtggaggcctgatgctgc

SEQ ID NO: 2115049 - DNA, 19 bp, Homo sapiens
gtggaggcctgatgctgcc

SEQ ID NO: 2115050 - DNA, 21 bp, Homo sapiens
gtggaggggtgacagtggagg

SEQ ID NO: 2115051 - DNA, 12 bp, Homo sapiens
gtggagggtagg

SEQ ID NO: 2115052 - DNA, 14 bp, Homo sapiens
gtggagggtagggg

SEQ ID NO: 2115053 - DNA, 16 bp, Homo sapiens
gtggagtctcattctg

SEQ ID NO: 2115054 - DNA, 15 bp, Homo sapiens
gtggataagggagag

SEQ ID NO: 2115055 - DNA, 14 bp, Homo sapiens
gtggatcacagagg

SEQ ID NO: 2115056 - DNA, 21 bp, Homo sapiens
gtggatcaccagaggtcagga

SEQ ID NO: 2115057 - DNA, 15 bp, Homo sapiens
gtggatcacctgagg

SEQ ID NO: 2115058 - DNA, 16 bp, Homo sapiens
gtggatcatgaaaagt

SEQ ID NO: 2115059 - DNA, 15 bp, Homo sapiens
gtggatccactgtgc

SEQ ID NO: 2115060 - DNA, 17 bp, Homo sapiens
gtggatctccaaggacc

SEQ ID NO: 2115061 - DNA, 20 bp, Homo sapiens
gtggatgcctggtggcagct

SEQ ID NO: 2115062 - DNA, 20 bp, Homo sapiens
gtggatgctccagggcagcc

SEQ ID NO: 2115063 - DNA, 19 bp, Homo sapiens
gtggatggaggagaaataa

SEQ ID NO: 2115064 - DNA, 17 bp, Homo sapiens
gtggatgtgtaaatgga

SEQ ID NO: 2115065 - DNA, 18 bp, Homo sapiens
gtggcaaagtgctgtacc

SEQ ID NO: 2115066 - DNA, 20 bp, Homo sapiens
gtggcaaagtgctgtaccct

SEQ ID NO: 2115067 - DNA, 15 bp, Homo sapiens
gtggcaaatataaaa

SEQ ID NO: 2115068 - DNA, 19 bp, Homo sapiens
gtggcaagtgaatttgcct

SEQ ID NO: 2115069 - DNA, 12 bp, Homo sapiens
gtggcacctcct

SEQ ID NO: 2115070 - DNA, 16 bp, Homo sapiens
gtggcacctcctgaga

SEQ ID NO: 2115071 - DNA, 18 bp, Homo sapiens
gtggcacctcctgagaag

SEQ ID NO: 2115072 - DNA, 15 bp, Homo sapiens
gtggcactgcttgag

SEQ ID NO: 2115073 - DNA, 18 bp, Homo sapiens
gtggcagaaaagaggaga

SEQ ID NO: 2115074 - DNA, 21 bp, Homo sapiens
gtggcagataatcagcctctt

SEQ ID NO: 2115075 - DNA, 22 bp, Homo sapiens
gtggcagccatgcctcatgcca

SEQ ID NO: 2115076 - DNA, 21 bp, Homo sapiens
gtggcagctgcggtccaccca

SEQ ID NO: 2115077 - DNA, 17 bp, Homo sapiens
gtggcaggaccaggact

SEQ ID NO: 2115078 - DNA, 19 bp, Homo sapiens
gtggcaggcacacagcagc

SEQ ID NO: 2115079 - DNA, 22 bp, Homo sapiens
gtggcaggcacacagcagcccc

SEQ ID NO: 2115080 - DNA, 23 bp, Homo sapiens
gtggcaggcacacagcagccccc

SEQ ID NO: 2115081 - DNA, 19 bp, Homo sapiens
gtggcaggcctaggacctc

SEQ ID NO: 2115082 - DNA, 16 bp, Homo sapiens
gtggcagtgggagctg

SEQ ID NO: 2115083 - DNA, 16 bp, Homo sapiens
gtggccacaccacagc

SEQ ID NO: 2115084 - DNA, 23 bp, Homo sapiens
gtggccagagctgggaggcatgg

SEQ ID NO: 2115085 - DNA, 13 bp, Homo sapiens
gtggccagggtga

SEQ ID NO: 2115086 - DNA, 18 bp, Homo sapiens
gtggccatcagggtgggc

SEQ ID NO: 2115087 - DNA, 17 bp, Homo sapiens
gtggccatccctgggcc

SEQ ID NO: 2115088 - DNA, 19 bp, Homo sapiens
gtggccatccctgggcccc

SEQ ID NO: 2115089 - DNA, 20 bp, Homo sapiens
gtggccatccctgggcccct

SEQ ID NO: 2115090 - DNA, 12 bp, Homo sapiens
gtggccatgctt

SEQ ID NO: 2115091 - DNA, 16 bp, Homo sapiens
gtggccatgcttcttg

SEQ ID NO: 2115092 - DNA, 17 bp, Homo sapiens
gtggccatgcttcttgc

SEQ ID NO: 2115093 - DNA, 18 bp, Homo sapiens
gtggccatgtcgcctgcc

SEQ ID NO: 2115094 - DNA, 22 bp, Homo sapiens
gtggccatgtcgcctgccccca

SEQ ID NO: 2115095 - DNA, 17 bp, Homo sapiens
gtggccccaggtgccac

SEQ ID NO: 2115096 - DNA, 17 bp, Homo sapiens
gtggcccgacagcctgg

SEQ ID NO: 2115097 - DNA, 18 bp, Homo sapiens
gtggccctggcctgctgg

SEQ ID NO: 2115098 - DNA, 19 bp, Homo sapiens
gtggccctggcctgctggg

SEQ ID NO: 2115099 - DNA, 16 bp, Homo sapiens
gtggcccttcctggac

SEQ ID NO: 2115100 - DNA, 22 bp, Homo sapiens
gtggccgacggcggcggccctc

SEQ ID NO: 2115101 - DNA, 19 bp, Homo sapiens
gtggccggggaagctggca

SEQ ID NO: 2115102 - DNA, 13 bp, Homo sapiens
gtggcctcacttc

SEQ ID NO: 2115103 - DNA, 19 bp, Homo sapiens
gtggcctcacttccctggg

SEQ ID NO: 2115104 - DNA, 13 bp, Homo sapiens
gtggcctcagccc

SEQ ID NO: 2115105 - DNA, 19 bp, Homo sapiens
gtggcctcagccctcagaa

SEQ ID NO: 2115106 - DNA, 19 bp, Homo sapiens
gtggcctgtgtccagcagc

SEQ ID NO: 2115107 - DNA, 21 bp, Homo sapiens
gtggcctgtgtccagcagctg

SEQ ID NO: 2115108 - DNA, 22 bp, Homo sapiens
gtggcctgtgtccagcagctgc

SEQ ID NO: 2115109 - DNA, 23 bp, Homo sapiens
gtggcctgtgtccagcagctgcg

SEQ ID NO: 2115110 - DNA, 23 bp, Homo sapiens
gtggccttccccttttgcctggc

SEQ ID NO: 2115111 - DNA, 24 bp, Homo sapiens
gtggccttccccttttgcctggct

SEQ ID NO: 2115112 - DNA, 17 bp, Homo sapiens
gtggcgagaggagagga

SEQ ID NO: 2115113 - DNA, 17 bp, Homo sapiens
gtggcggtgcctgggtg

SEQ ID NO: 2115114 - DNA, 21 bp, Homo sapiens
gtggcgttctgctgcccctgc

SEQ ID NO: 2115115 - DNA, 22 bp, Homo sapiens
gtggcgttctgctgcccctgca

SEQ ID NO: 2115116 - DNA, 22 bp, Homo sapiens
gtggctaaatgcctaataaaca

SEQ ID NO: 2115117 - DNA, 14 bp, Homo sapiens
gtggctaattcaat

SEQ ID NO: 2115118 - DNA, 20 bp, Homo sapiens
gtggctactctgtgccagag

SEQ ID NO: 2115119 - DNA, 22 bp, Homo sapiens
gtggctagcaaattagaaacac

SEQ ID NO: 2115120 - DNA, 23 bp, Homo sapiens
gtggctcacgcctataatcccag

SEQ ID NO: 2115121 - DNA, 22 bp, Homo sapiens
gtggctcacgcctgtaatccca

SEQ ID NO: 2115122 - DNA, 16 bp, Homo sapiens
gtggctcctgccactg

SEQ ID NO: 2115123 - DNA, 15 bp, Homo sapiens
gtggctcctgccttg

SEQ ID NO: 2115124 - DNA, 15 bp, Homo sapiens
gtggctcgctccctg

SEQ ID NO: 2115125 - DNA, 19 bp, Homo sapiens
gtggctgggttggagggtg

SEQ ID NO: 2115126 - DNA, 21 bp, Homo sapiens
gtggctgtctctgtccctcac

SEQ ID NO: 2115127 - DNA, 15 bp, Homo sapiens
gtggctgtggcacag

SEQ ID NO: 2115128 - DNA, 16 bp, Homo sapiens
gtggctgtggcacaga

SEQ ID NO: 2115129 - DNA, 20 bp, Homo sapiens
gtggcttcccgctcagccct

SEQ ID NO: 2115130 - DNA, 13 bp, Homo sapiens
gtggcttcctccg

SEQ ID NO: 2115131 - DNA, 20 bp, Homo sapiens
gtggcttttttcctcctgtg

SEQ ID NO: 2115132 - DNA, 17 bp, Homo sapiens
gtgggaacgactgggca

SEQ ID NO: 2115133 - DNA, 13 bp, Homo sapiens
gtgggacagcccc

SEQ ID NO: 2115134 - DNA, 17 bp, Homo sapiens
gtgggacagccccaggg

SEQ ID NO: 2115135 - DNA, 18 bp, Homo sapiens
gtgggacagccccagggc

SEQ ID NO: 2115136 - DNA, 21 bp, Homo sapiens
gtgggacagccccagggccct

SEQ ID NO: 2115137 - DNA, 19 bp, Homo sapiens
gtgggagagacactcccag

SEQ ID NO: 2115138 - DNA, 13 bp, Homo sapiens
gtgggagggagca

SEQ ID NO: 2115139 - DNA, 14 bp, Homo sapiens
gtgggagggagcag

SEQ ID NO: 2115140 - DNA, 16 bp, Homo sapiens
gtgggatggaggagaa

SEQ ID NO: 2115141 - DNA, 14 bp, Homo sapiens
gtgggcagcaccct

SEQ ID NO: 2115142 - DNA, 15 bp, Homo sapiens
gtgggcagcaccctc

SEQ ID NO: 2115143 - DNA, 19 bp, Homo sapiens
gtgggccaggagctcagcc

SEQ ID NO: 2115144 - DNA, 23 bp, Homo sapiens
gtgggcccggagtaatcaggcag

SEQ ID NO: 2115145 - DNA, 22 bp, Homo sapiens
gtgggcctggcctgagctgggg

SEQ ID NO: 2115146 - DNA, 16 bp, Homo sapiens
gtgggctgagccctgg

SEQ ID NO: 2115147 - DNA, 18 bp, Homo sapiens
gtgggctgagccctggca

SEQ ID NO: 2115148 - DNA, 13 bp, Homo sapiens
gtgggctgcctgg

SEQ ID NO: 2115149 - DNA, 23 bp, Homo sapiens
gtggggaagcaagacgtcctgga

SEQ ID NO: 2115150 - DNA, 16 bp, Homo sapiens
gtggggaggaaataga

SEQ ID NO: 2115151 - DNA, 12 bp, Homo sapiens
gtggggagggag

SEQ ID NO: 2115152 - DNA, 17 bp, Homo sapiens
gtggggcagctcctctg

SEQ ID NO: 2115153 - DNA, 13 bp, Homo sapiens
gtggggccttggt

SEQ ID NO: 2115154 - DNA, 18 bp, Homo sapiens
gtggggctcgtggccttc

SEQ ID NO: 2115155 - DNA, 16 bp, Homo sapiens
gtggggctgctcctcc

SEQ ID NO: 2115156 - DNA, 17 bp, Homo sapiens
gtggggctgctcctcca

SEQ ID NO: 2115157 - DNA, 14 bp, Homo sapiens
gtgggggcagaggg

SEQ ID NO: 2115158 - DNA, 17 bp, Homo sapiens
gtgggggcagagggcag

SEQ ID NO: 2115159 - DNA, 19 bp, Homo sapiens
gtgggggccgctggcccag

SEQ ID NO: 2115160 - DNA, 14 bp, Homo sapiens
gtgggggtggccat

SEQ ID NO: 2115161 - DNA, 21 bp, Homo sapiens
gtgggggtggccatccctggg

SEQ ID NO: 2115162 - DNA, 23 bp, Homo sapiens
gtggggttttatgtgtgggaaag

SEQ ID NO: 2115163 - DNA, 14 bp, Homo sapiens
gtgggtcaaggaat

SEQ ID NO: 2115164 - DNA, 19 bp, Homo sapiens
gtgggtccaggaaggcagc

SEQ ID NO: 2115165 - DNA, 20 bp, Homo sapiens
gtgggtccaggaaggcagct

SEQ ID NO: 2115166 - DNA, 21 bp, Homo sapiens
gtgggtccaggaaggcagctg

SEQ ID NO: 2115167 - DNA, 22 bp, Homo sapiens
gtgggtccaggaaggcagctgc

SEQ ID NO: 2115168 - DNA, 23 bp, Homo sapiens
gtgggtccaggaaggcagctgct

SEQ ID NO: 2115169 - DNA, 24 bp, Homo sapiens
gtgggtgatcagaaggctggggcc

SEQ ID NO: 2115170 - DNA, 20 bp, Homo sapiens
gtgggtggcacctcctgaga

SEQ ID NO: 2115171 - DNA, 16 bp, Homo sapiens
gtgggtggtggatctg

SEQ ID NO: 2115172 - DNA, 19 bp, Homo sapiens
gtgggttcactagagctgg

SEQ ID NO: 2115173 - DNA, 22 bp, Homo sapiens
gtgggttttattgtccttcaga

SEQ ID NO: 2115174 - DNA, 16 bp, Homo sapiens
gtggtaagctctggct

SEQ ID NO: 2115175 - DNA, 20 bp, Homo sapiens
gtggtatatttgtgtatgtg

SEQ ID NO: 2115176 - DNA, 12 bp, Homo sapiens
gtggtatgtgtg

SEQ ID NO: 2115177 - DNA, 15 bp, Homo sapiens
gtggtccagctcttg

SEQ ID NO: 2115178 - DNA, 23 bp, Homo sapiens
gtggtccagctcttggcccctgt

SEQ ID NO: 2115179 - DNA, 23 bp, Homo sapiens
gtggtctccttgcactttctcag

SEQ ID NO: 2115180 - DNA, 24 bp, Homo sapiens
gtggtcttggaagtgtgtggaagg

SEQ ID NO: 2115181 - DNA, 12 bp, Homo sapiens
gtggtctttgaa

SEQ ID NO: 2115182 - DNA, 13 bp, Homo sapiens
gtggtctttgaat

SEQ ID NO: 2115183 - DNA, 18 bp, Homo sapiens
gtggtctttgaataaagt

SEQ ID NO: 2115184 - DNA, 19 bp, Homo sapiens
gtggtgactgaacgaggga

SEQ ID NO: 2115185 - DNA, 19 bp, Homo sapiens
gtggtgcgatctgggttca

SEQ ID NO: 2115186 - DNA, 16 bp, Homo sapiens
gtggtggctgtctctg

SEQ ID NO: 2115187 - DNA, 23 bp, Homo sapiens
gtggttaatgccatggacagaag

SEQ ID NO: 2115188 - DNA, 22 bp, Homo sapiens
gtggttatttctcaacaaagca

SEQ ID NO: 2115189 - DNA, 23 bp, Homo sapiens
gtggttccaagaaagatccaccc

SEQ ID NO: 2115190 - DNA, 20 bp, Homo sapiens
gtggttctaatatttttagc

SEQ ID NO: 2115191 - DNA, 23 bp, Homo sapiens
gtgtaaaatatctacctgccctc

SEQ ID NO: 2115192 - DNA, 17 bp, Homo sapiens
gtgtaaatgtggacaca

SEQ ID NO: 2115193 - DNA, 23 bp, Homo sapiens
gtgtaacactgcaagaagtcttg

SEQ ID NO: 2115194 - DNA, 14 bp, Homo sapiens
gtgtaagcattgta

SEQ ID NO: 2115195 - DNA, 15 bp, Homo sapiens
gtgtaataagaaagt

SEQ ID NO: 2115196 - DNA, 17 bp, Homo sapiens
gtgtaatgcacaattta

SEQ ID NO: 2115197 - DNA, 13 bp, Homo sapiens
gtgtacaaagtag

SEQ ID NO: 2115198 - DNA, 14 bp, Homo sapiens
gtgtacccactcct

SEQ ID NO: 2115199 - DNA, 16 bp, Homo sapiens
gtgtacccactcctca

SEQ ID NO: 2115200 - DNA, 14 bp, Homo sapiens
gtgtagcctgtgca

SEQ ID NO: 2115201 - DNA, 15 bp, Homo sapiens
gtgtagctctgtcca

SEQ ID NO: 2115202 - DNA, 12 bp, Homo sapiens
gtgtagctgtga

SEQ ID NO: 2115203 - DNA, 19 bp, Homo sapiens
gtgtagctgtgacctgctg

SEQ ID NO: 2115204 - DNA, 23 bp, Homo sapiens
gtgtagctgtgacctgctgagct

SEQ ID NO: 2115205 - DNA, 19 bp, Homo sapiens
gtgtagtggaagagcagcc

SEQ ID NO: 2115206 - DNA, 15 bp, Homo sapiens
gtgtatatatacata

SEQ ID NO: 2115207 - DNA, 13 bp, Homo sapiens
gtgtatatatgtg

SEQ ID NO: 2115208 - DNA, 22 bp, Homo sapiens
gtgtatcccccccctgtatagt

SEQ ID NO: 2115209 - DNA, 19 bp, Homo sapiens
gtgtatggaaataaatgta

SEQ ID NO: 2115210 - DNA, 16 bp, Homo sapiens
gtgtatgggtgtgtgt

SEQ ID NO: 2115211 - DNA, 14 bp, Homo sapiens
gtgtattctggctg

SEQ ID NO: 2115212 - DNA, 17 bp, Homo sapiens
gtgtatttattgaagaa

SEQ ID NO: 2115213 - DNA, 22 bp, Homo sapiens
gtgtatttttcaggtaggccct

SEQ ID NO: 2115214 - DNA, 13 bp, Homo sapiens
gtgtcaggcaggt

SEQ ID NO: 2115215 - DNA, 20 bp, Homo sapiens
gtgtcaggtggggcagcttg

SEQ ID NO: 2115216 - DNA, 13 bp, Homo sapiens
gtgtcatgatttc

SEQ ID NO: 2115217 - DNA, 18 bp, Homo sapiens
gtgtcatttatgaaaaga

SEQ ID NO: 2115218 - DNA, 22 bp, Homo sapiens
gtgtccagaccattgtcttcca

SEQ ID NO: 2115219 - DNA, 14 bp, Homo sapiens
gtgtccagcagctg

SEQ ID NO: 2115220 - DNA, 20 bp, Homo sapiens
gtgtcccctcactctgtcag

SEQ ID NO: 2115221 - DNA, 20 bp, Homo sapiens
gtgtcccctccactgtcaca

SEQ ID NO: 2115222 - DNA, 15 bp, Homo sapiens
gtgtccttccctgca

SEQ ID NO: 2115223 - DNA, 17 bp, Homo sapiens
gtgtctaaaaacaccaa

SEQ ID NO: 2115224 - DNA, 21 bp, Homo sapiens
gtgtctcggagggattcccct

SEQ ID NO: 2115225 - DNA, 20 bp, Homo sapiens
gtgtctctcccaccccggcc

SEQ ID NO: 2115226 - DNA, 23 bp, Homo sapiens
gtgtctgcattgttattgtggaa

SEQ ID NO: 2115227 - DNA, 21 bp, Homo sapiens
gtgtctgtacacgtgtcctgt

SEQ ID NO: 2115228 - DNA, 13 bp, Homo sapiens
gtgtctgtctttg

SEQ ID NO: 2115229 - DNA, 18 bp, Homo sapiens
gtgtcttgcaatggcagc

SEQ ID NO: 2115230 - DNA, 21 bp, Homo sapiens
gtgtcttgcaatggcagcctt

SEQ ID NO: 2115231 - DNA, 13 bp, Homo sapiens
gtgtgaaaatggg

SEQ ID NO: 2115232 - DNA, 21 bp, Homo sapiens
gtgtgaaaggaagctccactg

SEQ ID NO: 2115233 - DNA, 23 bp, Homo sapiens
gtgtgaaccaccacacccagccc

SEQ ID NO: 2115234 - DNA, 19 bp, Homo sapiens
gtgtgagcatctctgtgta

SEQ ID NO: 2115235 - DNA, 15 bp, Homo sapiens
gtgtgaggctgggcc

SEQ ID NO: 2115236 - DNA, 14 bp, Homo sapiens
gtgtgagtggcagc

SEQ ID NO: 2115237 - DNA, 17 bp, Homo sapiens
gtgtgagtggcagccat

SEQ ID NO: 2115238 - DNA, 21 bp, Homo sapiens
gtgtgagtggcagccatgcct

SEQ ID NO: 2115239 - DNA, 14 bp, Homo sapiens
gtgtgcagactgat

SEQ ID NO: 2115240 - DNA, 18 bp, Homo sapiens
gtgtgcagactgtggctg

SEQ ID NO: 2115241 - DNA, 13 bp, Homo sapiens
gtgtgcagtgaag

SEQ ID NO: 2115242 - DNA, 16 bp, Homo sapiens
gtgtgcatgtatgtgc

SEQ ID NO: 2115243 - DNA, 12 bp, Homo sapiens
gtgtgcatgtgt

SEQ ID NO: 2115244 - DNA, 22 bp, Homo sapiens
gtgtgccaggctagactaggag

SEQ ID NO: 2115245 - DNA, 14 bp, Homo sapiens
gtgtgcccttgggg

SEQ ID NO: 2115246 - DNA, 15 bp, Homo sapiens
gtgtgcctgcagccc

SEQ ID NO: 2115247 - DNA, 13 bp, Homo sapiens
gtgtgcctgccct

SEQ ID NO: 2115248 - DNA, 17 bp, Homo sapiens
gtgtgcctgccctggag

SEQ ID NO: 2115249 - DNA, 23 bp, Homo sapiens
gtgtgcctgccctggagggaggc

SEQ ID NO: 2115250 - DNA, 15 bp, Homo sapiens
gtgtgcctgtggcag

SEQ ID NO: 2115251 - DNA, 16 bp, Homo sapiens
gtgtgcctgtggcaga

SEQ ID NO: 2115252 - DNA, 18 bp, Homo sapiens
gtgtgcgtgcgtgtgcgt

SEQ ID NO: 2115253 - DNA, 12 bp, Homo sapiens
gtgtgctctgat

SEQ ID NO: 2115254 - DNA, 12 bp, Homo sapiens
gtgtgctgtcct

SEQ ID NO: 2115255 - DNA, 13 bp, Homo sapiens
gtgtggacaggac

SEQ ID NO: 2115256 - DNA, 12 bp, Homo sapiens
gtgtggcctcag

SEQ ID NO: 2115257 - DNA, 15 bp, Homo sapiens
gtgtggctgtattca

SEQ ID NO: 2115258 - DNA, 13 bp, Homo sapiens
gtgtgggaaggga

SEQ ID NO: 2115259 - DNA, 14 bp, Homo sapiens
gtgtgggctgtgtc

SEQ ID NO: 2115260 - DNA, 14 bp, Homo sapiens
gtgtggtggctcat

SEQ ID NO: 2115261 - DNA, 16 bp, Homo sapiens
gtgtggtgtgtgtgct

SEQ ID NO: 2115262 - DNA, 20 bp, Homo sapiens
gtgtgtatgtatacacacat

SEQ ID NO: 2115263 - DNA, 14 bp, Homo sapiens
gtgtgtatgtgtat

SEQ ID NO: 2115264 - DNA, 15 bp, Homo sapiens
gtgtgtatgtgtatt

SEQ ID NO: 2115265 - DNA, 21 bp, Homo sapiens
gtgtgtcacactgagctgggc

SEQ ID NO: 2115266 - DNA, 20 bp, Homo sapiens
gtgtgtccttggggcacagt

SEQ ID NO: 2115267 - DNA, 18 bp, Homo sapiens
gtgtgtctgtctttgtgg

SEQ ID NO: 2115268 - DNA, 14 bp, Homo sapiens
gtgtgtgaaaggaa

SEQ ID NO: 2115269 - DNA, 16 bp, Homo sapiens
gtgtgtgcatgtgtgt

SEQ ID NO: 2115270 - DNA, 20 bp, Homo sapiens
gtgtgtggaaggcagggaca

SEQ ID NO: 2115271 - DNA, 24 bp, Homo sapiens
gtgtgtggaaggcagggacagaga

SEQ ID NO: 2115272 - DNA, 14 bp, Homo sapiens
gtgtgtgtctgtct

SEQ ID NO: 2115273 - DNA, 9 bp, Homo sapiens
gtgtgtgtg

SEQ ID NO: 2115274 - DNA, 13 bp, Homo sapiens
gtgtgtgtgcatg

SEQ ID NO: 2115275 - DNA, 10 bp, Homo sapiens
gtgtgtgtgt

SEQ ID NO: 2115276 - DNA, 13 bp, Homo sapiens
gtgtgtgtgtgtg

SEQ ID NO: 2115277 - DNA, 16 bp, Homo sapiens
gtgtgttgtctgtgca

SEQ ID NO: 2115278 - DNA, 21 bp, Homo sapiens
gtgtgttgtctgtgcagctgc

SEQ ID NO: 2115279 - DNA, 18 bp, Homo sapiens
gtgtgtttaaataaagta

SEQ ID NO: 2115280 - DNA, 19 bp, Homo sapiens
gtgtgtttaaataaagtat

SEQ ID NO: 2115281 - DNA, 14 bp, Homo sapiens
gtgtgtttgtgtga

SEQ ID NO: 2115282 - DNA, 21 bp, Homo sapiens
gtgtgttttgagagtatatta

SEQ ID NO: 2115283 - DNA, 15 bp, Homo sapiens
gtgttaatttttgat

SEQ ID NO: 2115284 - DNA, 21 bp, Homo sapiens
gtgttacacagcccaagagga

SEQ ID NO: 2115285 - DNA, 18 bp, Homo sapiens
gtgttagtgtgtgtgcat

SEQ ID NO: 2115286 - DNA, 19 bp, Homo sapiens
gtgttcctcaccaataact

SEQ ID NO: 2115287 - DNA, 19 bp, Homo sapiens
gtgttctcaatgcttttct

SEQ ID NO: 2115288 - DNA, 17 bp, Homo sapiens
gtgttctttttaaaaag

SEQ ID NO: 2115289 - DNA, 18 bp, Homo sapiens
gtgttgatttgagaaatt

SEQ ID NO: 2115290 - DNA, 12 bp, Homo sapiens
gtgttgcagaga

SEQ ID NO: 2115291 - DNA, 15 bp, Homo sapiens
gtgttggctgtgtga

SEQ ID NO: 2115292 - DNA, 16 bp, Homo sapiens
gtgttgggaattgcat

SEQ ID NO: 2115293 - DNA, 12 bp, Homo sapiens
gtgttgtacaat

SEQ ID NO: 2115294 - DNA, 14 bp, Homo sapiens
gtgtttaaagtcaa

SEQ ID NO: 2115295 - DNA, 11 bp, Homo sapiens
gtgtttaaata

SEQ ID NO: 2115296 - DNA, 10 bp, Homo sapiens
gtgtttattt

SEQ ID NO: 2115297 - DNA, 15 bp, Homo sapiens
gtgtttcccataatt

SEQ ID NO: 2115298 - DNA, 16 bp, Homo sapiens
gtgtttcttgcctcat

SEQ ID NO: 2115299 - DNA, 20 bp, Homo sapiens
gtgtttggcaggagaatcaa

SEQ ID NO: 2115300 - DNA, 18 bp, Homo sapiens
gtgttttctgaataacat

SEQ ID NO: 2115301 - DNA, 19 bp, Homo sapiens
gtgttttctgaataacatt

SEQ ID NO: 2115302 - DNA, 17 bp, Homo sapiens
gttaaaaatcagctggg

SEQ ID NO: 2115303 - DNA, 20 bp, Homo sapiens
gttaaaagactgcagctgct

SEQ ID NO: 2115304 - DNA, 22 bp, Homo sapiens
gttaaaagactgcagctgctga

SEQ ID NO: 2115305 - DNA, 14 bp, Homo sapiens
gttaaaagatgaaa

SEQ ID NO: 2115306 - DNA, 16 bp, Homo sapiens
gttaaaagatgaaaat

SEQ ID NO: 2115307 - DNA, 23 bp, Homo sapiens
gttaaaatataaattaagacttt

SEQ ID NO: 2115308 - DNA, 14 bp, Homo sapiens
gttaaaatgtacac

SEQ ID NO: 2115309 - DNA, 15 bp, Homo sapiens
gttaaactgattagt

SEQ ID NO: 2115310 - DNA, 21 bp, Homo sapiens
gttaaagaggcgtcttgtatt

SEQ ID NO: 2115311 - DNA, 17 bp, Homo sapiens
gttaaagcatcagagat

SEQ ID NO: 2115312 - DNA, 20 bp, Homo sapiens
gttaaaggaagtttgttcac

SEQ ID NO: 2115313 - DNA, 20 bp, Homo sapiens
gttaaagtcagtgggaacgt

SEQ ID NO: 2115314 - DNA, 12 bp, Homo sapiens
gttaaatattta

SEQ ID NO: 2115315 - DNA, 18 bp, Homo sapiens
gttaaatgaaattgtaaa

SEQ ID NO: 2115316 - DNA, 15 bp, Homo sapiens
gttaacattaacatc

SEQ ID NO: 2115317 - DNA, 14 bp, Homo sapiens
gttaacgtcatctc

SEQ ID NO: 2115318 - DNA, 11 bp, Homo sapiens
gttaactatta

SEQ ID NO: 2115319 - DNA, 17 bp, Homo sapiens
gttaactttaagactga

SEQ ID NO: 2115320 - DNA, 12 bp, Homo sapiens
gttaaggacttc

SEQ ID NO: 2115321 - DNA, 19 bp, Homo sapiens
gttaaggacttctgcagct

SEQ ID NO: 2115322 - DNA, 14 bp, Homo sapiens
gttaagggaaggaa

SEQ ID NO: 2115323 - DNA, 22 bp, Homo sapiens
gttaagggaaggaactctggct

SEQ ID NO: 2115324 - DNA, 14 bp, Homo sapiens
gttaagtcatccac

SEQ ID NO: 2115325 - DNA, 24 bp, Homo sapiens
gttaataacttgtcctatgtcaat

SEQ ID NO: 2115326 - DNA, 23 bp, Homo sapiens
gttaatacttaacattgatttat

SEQ ID NO: 2115327 - DNA, 14 bp, Homo sapiens
gttaatagacagta

SEQ ID NO: 2115328 - DNA, 17 bp, Homo sapiens
gttaatgaaaatgtcag

SEQ ID NO: 2115329 - DNA, 17 bp, Homo sapiens
gttaatgttgggattta

SEQ ID NO: 2115330 - DNA, 15 bp, Homo sapiens
gttaattaaactgaa

SEQ ID NO: 2115331 - DNA, 18 bp, Homo sapiens
gttaattcagcactgatt

SEQ ID NO: 2115332 - DNA, 19 bp, Homo sapiens
gttaatttagaaaacttta

SEQ ID NO: 2115333 - DNA, 14 bp, Homo sapiens
gttaatttttgata

SEQ ID NO: 2115334 - DNA, 13 bp, Homo sapiens
gttacaaaaatag

SEQ ID NO: 2115335 - DNA, 16 bp, Homo sapiens
gttacaacagtaacac

SEQ ID NO: 2115336 - DNA, 16 bp, Homo sapiens
gttacacagcccaaga

SEQ ID NO: 2115337 - DNA, 20 bp, Homo sapiens
gttaccaaagcaatatttcc

SEQ ID NO: 2115338 - DNA, 23 bp, Homo sapiens
gttacgcacacgtacttaaatga

SEQ ID NO: 2115339 - DNA, 22 bp, Homo sapiens
gttacggagggaggacatcata

SEQ ID NO: 2115340 - DNA, 15 bp, Homo sapiens
gttactacatgcact

SEQ ID NO: 2115341 - DNA, 14 bp, Homo sapiens
gttactcagccctg

SEQ ID NO: 2115342 - DNA, 15 bp, Homo sapiens
gttactcagccctgg

SEQ ID NO: 2115343 - DNA, 18 bp, Homo sapiens
gttactcagccctgggcc

SEQ ID NO: 2115344 - DNA, 14 bp, Homo sapiens
gttactctccaacc

SEQ ID NO: 2115345 - DNA, 15 bp, Homo sapiens
gttactgattctcct

SEQ ID NO: 2115346 - DNA, 17 bp, Homo sapiens
gttactgattctcctgt

SEQ ID NO: 2115347 - DNA, 13 bp, Homo sapiens
gttactggtttca

SEQ ID NO: 2115348 - DNA, 13 bp, Homo sapiens
gttacttcctatc

SEQ ID NO: 2115349 - DNA, 17 bp, Homo sapiens
gttacttgtctgaggcc

SEQ ID NO: 2115350 - DNA, 18 bp, Homo sapiens
gttacttgtctgaggcct

SEQ ID NO: 2115351 - DNA, 19 bp, Homo sapiens
gttacttgtctgaggcctc

SEQ ID NO: 2115352 - DNA, 23 bp, Homo sapiens
gttacttgtctgaggcctcatcc

SEQ ID NO: 2115353 - DNA, 13 bp, Homo sapiens
gttactttttagt

SEQ ID NO: 2115354 - DNA, 18 bp, Homo sapiens
gttagagaggtagcgagc

SEQ ID NO: 2115355 - DNA, 23 bp, Homo sapiens
gttagattcctcttgcctctctc

SEQ ID NO: 2115356 - DNA, 23 bp, Homo sapiens
gttagcagcagtgagcttctatt

SEQ ID NO: 2115357 - DNA, 15 bp, Homo sapiens
gttagccctcagtca

SEQ ID NO: 2115358 - DNA, 16 bp, Homo sapiens
gttaggaaataaaacc

SEQ ID NO: 2115359 - DNA, 23 bp, Homo sapiens
gttaggaaataaaacctttcaaa

SEQ ID NO: 2115360 - DNA, 15 bp, Homo sapiens
gttaggaggctgcat

SEQ ID NO: 2115361 - DNA, 18 bp, Homo sapiens
gttaggaggctgcatgct

SEQ ID NO: 2115362 - DNA, 23 bp, Homo sapiens
gttaggatttaacagtcatttaa

SEQ ID NO: 2115363 - DNA, 17 bp, Homo sapiens
gttaggggaaaatagta

SEQ ID NO: 2115364 - DNA, 12 bp, Homo sapiens
gttagtcatttg

SEQ ID NO: 2115365 - DNA, 15 bp, Homo sapiens
gttagtgtgtgtgca

SEQ ID NO: 2115366 - DNA, 23 bp, Homo sapiens
gttagttattttaggagacagtc

SEQ ID NO: 2115367 - DNA, 14 bp, Homo sapiens
gttataaaaataca

SEQ ID NO: 2115368 - DNA, 16 bp, Homo sapiens
gttataaaaatacaac

SEQ ID NO: 2115369 - DNA, 15 bp, Homo sapiens
gttatagtatatctg

SEQ ID NO: 2115370 - DNA, 16 bp, Homo sapiens
gttatagtatatctgg

SEQ ID NO: 2115371 - DNA, 17 bp, Homo sapiens
gttatatattgtattaa

SEQ ID NO: 2115372 - DNA, 17 bp, Homo sapiens
gttatattgaatatatc

SEQ ID NO: 2115373 - DNA, 21 bp, Homo sapiens
gttatcaacacgtttgtatca

SEQ ID NO: 2115374 - DNA, 16 bp, Homo sapiens
gttatcacttatatat

SEQ ID NO: 2115375 - DNA, 15 bp, Homo sapiens
gttatcagttaacat

SEQ ID NO: 2115376 - DNA, 17 bp, Homo sapiens
gttatcagttaacatta

SEQ ID NO: 2115377 - DNA, 15 bp, Homo sapiens
gttatctaagttaat

SEQ ID NO: 2115378 - DNA, 20 bp, Homo sapiens
gttatctgcctggcctggct

SEQ ID NO: 2115379 - DNA, 22 bp, Homo sapiens
gttatgtgaatgatctctctga

SEQ ID NO: 2115380 - DNA, 21 bp, Homo sapiens
gttattaacgggcatgtatta

SEQ ID NO: 2115381 - DNA, 12 bp, Homo sapiens
gttattgtggaa

SEQ ID NO: 2115382 - DNA, 15 bp, Homo sapiens
gttatttaaatgagt

SEQ ID NO: 2115383 - DNA, 14 bp, Homo sapiens
gttatttatatatt

SEQ ID NO: 2115384 - DNA, 17 bp, Homo sapiens
gttatttgtaatagatg

SEQ ID NO: 2115385 - DNA, 19 bp, Homo sapiens
gttatttgttattttcagt

SEQ ID NO: 2115386 - DNA, 12 bp, Homo sapiens
gttattttcagt

SEQ ID NO: 2115387 - DNA, 14 bp, Homo sapiens
gttattttcagtat

SEQ ID NO: 2115388 - DNA, 20 bp, Homo sapiens
gcagccagccctgcctggag

SEQ ID NO: 2115389 - DNA, 21 bp, Homo sapiens
gcagccagccctgcctggagg

SEQ ID NO: 2115390 - DNA, 13 bp, Homo sapiens
gcagccagctctc

SEQ ID NO: 2115391 - DNA, 16 bp, Homo sapiens
gcagccagctctcagc

SEQ ID NO: 2115392 - DNA, 14 bp, Homo sapiens
gcagccaggggctg

SEQ ID NO: 2115393 - DNA, 23 bp, Homo sapiens
gcagccatgaccagttctggcca

SEQ ID NO: 2115394 - DNA, 13 bp, Homo sapiens
gcagcccagcctc

SEQ ID NO: 2115395 - DNA, 17 bp, Homo sapiens
gcagcccagcttcctgg

SEQ ID NO: 2115396 - DNA, 20 bp, Homo sapiens
gcagcccagcttcctggtgt

SEQ ID NO: 2115397 - DNA, 17 bp, Homo sapiens
gcagccccattctgcct

SEQ ID NO: 2115398 - DNA, 19 bp, Homo sapiens
gcagccccattctgcctgc

SEQ ID NO: 2115399 - DNA, 24 bp, Homo sapiens
gcagccccattctgcctgcccagg

SEQ ID NO: 2115400 - DNA, 14 bp, Homo sapiens
gcagccccccagca

SEQ ID NO: 2115401 - DNA, 16 bp, Homo sapiens
gcagcccgaagcccag

SEQ ID NO: 2115402 - DNA, 24 bp, Homo sapiens
gcagccctgctttgggctgccctg

SEQ ID NO: 2115403 - DNA, 17 bp, Homo sapiens
gcagccctgggggccag

SEQ ID NO: 2115404 - DNA, 21 bp, Homo sapiens
gcagccctgggggccagctgg

SEQ ID NO: 2115405 - DNA, 17 bp, Homo sapiens
gcagcccttcctcctga

SEQ ID NO: 2115406 - DNA, 21 bp, Homo sapiens
gcagcccttcctcctgaagcc

SEQ ID NO: 2115407 - DNA, 13 bp, Homo sapiens
gcagccctttggg

SEQ ID NO: 2115408 - DNA, 14 bp, Homo sapiens
gcagccgtgccttc

SEQ ID NO: 2115409 - DNA, 21 bp, Homo sapiens
gcagcctccaccttgctcttc

SEQ ID NO: 2115410 - DNA, 14 bp, Homo sapiens
gcagcctccagagc

SEQ ID NO: 2115411 - DNA, 17 bp, Homo sapiens
gcagcctccagagccag

SEQ ID NO: 2115412 - DNA, 19 bp, Homo sapiens
gcagcctccagagccagcc

SEQ ID NO: 2115413 - DNA, 20 bp, Homo sapiens
gcagcctccagagccagcct

SEQ ID NO: 2115414 - DNA, 13 bp, Homo sapiens
gcagcctccccca

SEQ ID NO: 2115415 - DNA, 15 bp, Homo sapiens
gcagcctcctcctga

SEQ ID NO: 2115416 - DNA, 14 bp, Homo sapiens
gcagcctcctgggc

SEQ ID NO: 2115417 - DNA, 15 bp, Homo sapiens
gcagcctctctgcta

SEQ ID NO: 2115418 - DNA, 22 bp, Homo sapiens
gcagcctggcggggcaggaggc

SEQ ID NO: 2115419 - DNA, 23 bp, Homo sapiens
gcagcctttctgtggagagtgag

SEQ ID NO: 2115420 - DNA, 18 bp, Homo sapiens
gcagcgcagccgccgggc

SEQ ID NO: 2115421 - DNA, 16 bp, Homo sapiens
gcagcgcgtgcacagc

SEQ ID NO: 2115422 - DNA, 14 bp, Homo sapiens
gcagctaggactga

SEQ ID NO: 2115423 - DNA, 16 bp, Homo sapiens
gcagctaggactgagg

SEQ ID NO: 2115424 - DNA, 14 bp, Homo sapiens
gcagctccaacagc

SEQ ID NO: 2115425 - DNA, 24 bp, Homo sapiens
gcagctccaacagcttgaccagac

SEQ ID NO: 2115426 - DNA, 22 bp, Homo sapiens
gcagctcccctgggggctagca

SEQ ID NO: 2115427 - DNA, 13 bp, Homo sapiens
gcagctcctctcc

SEQ ID NO: 2115428 - DNA, 14 bp, Homo sapiens
gcagctcctctcct

SEQ ID NO: 2115429 - DNA, 15 bp, Homo sapiens
gcagctctttcttct

SEQ ID NO: 2115430 - DNA, 14 bp, Homo sapiens
gcagctgagcaggg

SEQ ID NO: 2115431 - DNA, 15 bp, Homo sapiens
gcagctgattttgtc

SEQ ID NO: 2115432 - DNA, 14 bp, Homo sapiens
gcagctgcgggtct

SEQ ID NO: 2115433 - DNA, 17 bp, Homo sapiens
gcagctgcgggtctgaa

SEQ ID NO: 2115434 - DNA, 22 bp, Homo sapiens
gcagctgcggtccacccaggag

SEQ ID NO: 2115435 - DNA, 23 bp, Homo sapiens
gcagctgcggtccacccaggagc

SEQ ID NO: 2115436 - DNA, 22 bp, Homo sapiens
gcagctgctgaagttctgagcc

SEQ ID NO: 2115437 - DNA, 17 bp, Homo sapiens
gcagctgcttgttgtca

SEQ ID NO: 2115438 - DNA, 15 bp, Homo sapiens
gcagctggctctcca

SEQ ID NO: 2115439 - DNA, 18 bp, Homo sapiens
tcctgggccttacctccc

SEQ ID NO: 2115440 - DNA, 15 bp, Homo sapiens
tcctggggccccgct

SEQ ID NO: 2115441 - DNA, 21 bp, Homo sapiens
tcctggggccccgctgggatt

SEQ ID NO: 2115442 - DNA, 15 bp, Homo sapiens
tcctggggctctgtg

SEQ ID NO: 2115443 - DNA, 16 bp, Homo sapiens
tcctggggctctgtgc

SEQ ID NO: 2115444 - DNA, 18 bp, Homo sapiens
tcctggggctctgtgcag

SEQ ID NO: 2115445 - DNA, 19 bp, Homo sapiens
tcctggggctctgtgcagg

SEQ ID NO: 2115446 - DNA, 15 bp, Homo sapiens
tcctgggggtggcag

SEQ ID NO: 2115447 - DNA, 18 bp, Homo sapiens
tcctgggggtggcaggca

SEQ ID NO: 2115448 - DNA, 19 bp, Homo sapiens
tcctgggggtggcaggcac

SEQ ID NO: 2115449 - DNA, 23 bp, Homo sapiens
tcctgggggttctttcttcctct

SEQ ID NO: 2115450 - DNA, 17 bp, Homo sapiens
tcctgggtggctactct

SEQ ID NO: 2115451 - DNA, 19 bp, Homo sapiens
tcctggtgaggcccagcct

SEQ ID NO: 2115452 - DNA, 21 bp, Homo sapiens
tcctggtgaggcccagcctgt

SEQ ID NO: 2115453 - DNA, 24 bp, Homo sapiens
tcctggtgaggcccagcctgtcct

SEQ ID NO: 2115454 - DNA, 19 bp, Homo sapiens
tcctggtggggcagctcct

SEQ ID NO: 2115455 - DNA, 16 bp, Homo sapiens
tcctgtaattttgtag

SEQ ID NO: 2115456 - DNA, 21 bp, Homo sapiens
tcctgtagaggttttgttgtt

SEQ ID NO: 2115457 - DNA, 17 bp, Homo sapiens
tcctgtagcatcttctg

SEQ ID NO: 2115458 - DNA, 21 bp, Homo sapiens
tcctgtagttgcgtggactct

SEQ ID NO: 2115459 - DNA, 23 bp, Homo sapiens
tcctgtatattatggtgtaatgc

SEQ ID NO: 2115460 - DNA, 13 bp, Homo sapiens
tcctgtcccagag

SEQ ID NO: 2115461 - DNA, 18 bp, Homo sapiens
tcctgtcccgccttcctc

SEQ ID NO: 2115462 - DNA, 18 bp, Homo sapiens
tcctgtccctacccactc

SEQ ID NO: 2115463 - DNA, 23 bp, Homo sapiens
tcctgtccctacccactctttgc

SEQ ID NO: 2115464 - DNA, 14 bp, Homo sapiens
tcctgtctctgcct

SEQ ID NO: 2115465 - DNA, 15 bp, Homo sapiens
tcctgtctctgcctg

SEQ ID NO: 2115466 - DNA, 16 bp, Homo sapiens
tcctgtctgccagcca

SEQ ID NO: 2115467 - DNA, 19 bp, Homo sapiens
tcctgtctttaaggaaaaa

SEQ ID NO: 2115468 - DNA, 23 bp, Homo sapiens
tcctgtgaccccaccttgacggt

SEQ ID NO: 2115469 - DNA, 16 bp, Homo sapiens
tcctgtgcccctcaga

SEQ ID NO: 2115470 - DNA, 20 bp, Homo sapiens
tcctgtgcccctcagagagg

SEQ ID NO: 2115471 - DNA, 18 bp, Homo sapiens
tcctgtgctactttgcct

SEQ ID NO: 2115472 - DNA, 13 bp, Homo sapiens
tcctgtgggagcc

SEQ ID NO: 2115473 - DNA, 16 bp, Homo sapiens
tcctgtgggccaggag

SEQ ID NO: 2115474 - DNA, 13 bp, Homo sapiens
tcctgtgggtgtg

SEQ ID NO: 2115475 - DNA, 13 bp, Homo sapiens
tcctgtgtacagg

SEQ ID NO: 2115476 - DNA, 18 bp, Homo sapiens
tcctgtgtgtgcgcctac

SEQ ID NO: 2115477 - DNA, 18 bp, Homo sapiens
tcctgttacttacctaaa

SEQ ID NO: 2115478 - DNA, 24 bp, Homo sapiens
tcctgttattttttatttccacat

SEQ ID NO: 2115479 - DNA, 14 bp, Homo sapiens
tcctgttgaatctt

SEQ ID NO: 2115480 - DNA, 21 bp, Homo sapiens
tcctgttgttgttaatgaaaa

SEQ ID NO: 2115481 - DNA, 13 bp, Homo sapiens
tcctgtttccatg

SEQ ID NO: 2115482 - DNA, 16 bp, Homo sapiens
tcctgtttttctgggt

SEQ ID NO: 2115483 - DNA, 20 bp, Homo sapiens
tcctgtttttctgggtggcc

SEQ ID NO: 2115484 - DNA, 22 bp, Homo sapiens
tccttaaaggcaccatctaata

SEQ ID NO: 2115485 - DNA, 18 bp, Homo sapiens
tccttaattcactcccac

SEQ ID NO: 2115486 - DNA, 22 bp, Homo sapiens
tccttactcctgtgggagcctc

SEQ ID NO: 2115487 - DNA, 23 bp, Homo sapiens
tccttactcctgtgggagcctcg

SEQ ID NO: 2115488 - DNA, 14 bp, Homo sapiens
tccttactctgagc

SEQ ID NO: 2115489 - DNA, 18 bp, Homo sapiens
tccttactctgagcccag

SEQ ID NO: 2115490 - DNA, 19 bp, Homo sapiens
tccttactctgagcccagg

SEQ ID NO: 2115491 - DNA, 20 bp, Homo sapiens
tccttagcttagacctcagc

SEQ ID NO: 2115492 - DNA, 22 bp, Homo sapiens
tccttagcttagacctcagcct

SEQ ID NO: 2115493 - DNA, 20 bp, Homo sapiens
tccttaggaaaatgcttctg

SEQ ID NO: 2115494 - DNA, 13 bp, Homo sapiens
tccttattttgta

SEQ ID NO: 2115495 - DNA, 14 bp, Homo sapiens
tccttcaccagagc

SEQ ID NO: 2115496 - DNA, 18 bp, Homo sapiens
tccttcactcatccagcc

SEQ ID NO: 2115497 - DNA, 12 bp, Homo sapiens
tccttcagagct

SEQ ID NO: 2115498 - DNA, 23 bp, Homo sapiens
tccttcagagctcttcaagctgt

SEQ ID NO: 2115499 - DNA, 12 bp, Homo sapiens
tccttcagtgca

SEQ ID NO: 2115500 - DNA, 14 bp, Homo sapiens
tccttcatttcctc

SEQ ID NO: 2115501 - DNA, 15 bp, Homo sapiens
tccttcatttcctcc

SEQ ID NO: 2115502 - DNA, 16 bp, Homo sapiens
tccttccaggccccca

SEQ ID NO: 2115503 - DNA, 13 bp, Homo sapiens
tccttccagtggc

SEQ ID NO: 2115504 - DNA, 13 bp, Homo sapiens
tccttccatgaaa

SEQ ID NO: 2115505 - DNA, 23 bp, Homo sapiens
tccttcccccatcccctttcctc

SEQ ID NO: 2115506 - DNA, 22 bp, Homo sapiens
tccttccctctttccccacctc

SEQ ID NO: 2115507 - DNA, 19 bp, Homo sapiens
tccttccgatgacagtgct

SEQ ID NO: 2115508 - DNA, 15 bp, Homo sapiens
tccttccgctccttt

SEQ ID NO: 2115509 - DNA, 21 bp, Homo sapiens
tccttcctacacccttggact

SEQ ID NO: 2115510 - DNA, 15 bp, Homo sapiens
tccttccttccctgg

SEQ ID NO: 2115511 - DNA, 16 bp, Homo sapiens
tccttcgtgtctctcc

SEQ ID NO: 2115512 - DNA, 19 bp, Homo sapiens
tccttcgtgtctctcccac

SEQ ID NO: 2115513 - DNA, 13 bp, Homo sapiens
tccttctctgccc

SEQ ID NO: 2115514 - DNA, 12 bp, Homo sapiens
tccttctgtcct

SEQ ID NO: 2115515 - DNA, 15 bp, Homo sapiens
tccttctttctcttc

SEQ ID NO: 2115516 - DNA, 15 bp, Homo sapiens
tccttctttgtctta

SEQ ID NO: 2115517 - DNA, 21 bp, Homo sapiens
tccttgaaaaaaagttgcttt

SEQ ID NO: 2115518 - DNA, 21 bp, Homo sapiens
tccttgaactgtcagcccaca

SEQ ID NO: 2115519 - DNA, 22 bp, Homo sapiens
tccttgcacccctcactctggc

SEQ ID NO: 2115520 - DNA, 15 bp, Homo sapiens
tccttgcatcaattt

SEQ ID NO: 2115521 - DNA, 17 bp, Homo sapiens
tccttgctgtcctaggc

SEQ ID NO: 2115522 - DNA, 22 bp, Homo sapiens
tccttgcttatgacatcacttg

SEQ ID NO: 2115523 - DNA, 16 bp, Homo sapiens
tccttgctttgctgtt

SEQ ID NO: 2115524 - DNA, 16 bp, Homo sapiens
tccttggaagtttcat

SEQ ID NO: 2115525 - DNA, 16 bp, Homo sapiens
tccttggactcatttt

SEQ ID NO: 2115526 - DNA, 18 bp, Homo sapiens
tccttggaggacagtggg

SEQ ID NO: 2115527 - DNA, 12 bp, Homo sapiens
tccttgggctcc

SEQ ID NO: 2115528 - DNA, 21 bp, Homo sapiens
tccttgggctcctggctgcca

SEQ ID NO: 2115529 - DNA, 12 bp, Homo sapiens
tccttggggcac

SEQ ID NO: 2115530 - DNA, 14 bp, Homo sapiens
tccttggtctgctg

SEQ ID NO: 2115531 - DNA, 18 bp, Homo sapiens
tccttggtgcctggcctg

SEQ ID NO: 2115532 - DNA, 13 bp, Homo sapiens
tccttgtcactgg

SEQ ID NO: 2115533 - DNA, 19 bp, Homo sapiens
tccttgtggtttatgtcat

SEQ ID NO: 2115534 - DNA, 13 bp, Homo sapiens
tcctttacctacc

SEQ ID NO: 2115535 - DNA, 15 bp, Homo sapiens
tcctttagcgcccag

SEQ ID NO: 2115536 - DNA, 18 bp, Homo sapiens
tctagctgttgagctgtt

SEQ ID NO: 2115537 - DNA, 22 bp, Homo sapiens
tctagcttcatgcctcagtttc

SEQ ID NO: 2115538 - DNA, 23 bp, Homo sapiens
tctagcttcatgcctcagtttcc

SEQ ID NO: 2115539 - DNA, 16 bp, Homo sapiens
tctaggagctgggagg

SEQ ID NO: 2115540 - DNA, 18 bp, Homo sapiens
tctaggagctgggaggaa

SEQ ID NO: 2115541 - DNA, 20 bp, Homo sapiens
tctaggagctgggaggaaaa

SEQ ID NO: 2115542 - DNA, 16 bp, Homo sapiens
tctagtgacttcctgg

SEQ ID NO: 2115543 - DNA, 15 bp, Homo sapiens
tctagtgatttcctg

SEQ ID NO: 2115544 - DNA, 21 bp, Homo sapiens
tctagttagcaggaaatagtg

SEQ ID NO: 2115545 - DNA, 18 bp, Homo sapiens
tctagttagctgctttaa

SEQ ID NO: 2115546 - DNA, 12 bp, Homo sapiens
tctagtttactt

SEQ ID NO: 2115547 - DNA, 15 bp, Homo sapiens
tctagtttcagtaaa

SEQ ID NO: 2115548 - DNA, 23 bp, Homo sapiens
tctagtttcagtaaataatgaaa

SEQ ID NO: 2115549 - DNA, 20 bp, Homo sapiens
tctatagccaaaaatagcta

SEQ ID NO: 2115550 - DNA, 15 bp, Homo sapiens
tctatagctcttcta

SEQ ID NO: 2115551 - DNA, 20 bp, Homo sapiens
tctatagctcttctatttaa

SEQ ID NO: 2115552 - DNA, 17 bp, Homo sapiens
tctatagtagtcaatta

SEQ ID NO: 2115553 - DNA, 18 bp, Homo sapiens
tctatatatacatgtata

SEQ ID NO: 2115554 - DNA, 15 bp, Homo sapiens
tctatattgtgccaa

SEQ ID NO: 2115555 - DNA, 20 bp, Homo sapiens
tctatcaaccccagacactg

SEQ ID NO: 2115556 - DNA, 22 bp, Homo sapiens
tctatcaaccccagacactggt

SEQ ID NO: 2115557 - DNA, 22 bp, Homo sapiens
tctatcacattacatcatcctc

SEQ ID NO: 2115558 - DNA, 23 bp, Homo sapiens
tctatcccacccaacagctcaga

SEQ ID NO: 2115559 - DNA, 14 bp, Homo sapiens
tctatctatttgag

SEQ ID NO: 2115560 - DNA, 16 bp, Homo sapiens
tctatcttatatagtt

SEQ ID NO: 2115561 - DNA, 22 bp, Homo sapiens
tctatgcaaatgcctccaagcc

SEQ ID NO: 2115562 - DNA, 13 bp, Homo sapiens
tctatgcaatttt

SEQ ID NO: 2115563 - DNA, 14 bp, Homo sapiens
tctatgccagctca

SEQ ID NO: 2115564 - DNA, 18 bp, Homo sapiens
tctatggcagtccagcca

SEQ ID NO: 2115565 - DNA, 22 bp, Homo sapiens
tctatggcagtccagccagctc

SEQ ID NO: 2115566 - DNA, 19 bp, Homo sapiens
tctatgggactcaatgcac

SEQ ID NO: 2115567 - DNA, 23 bp, Homo sapiens
tctatgggactcaatgcactgac

SEQ ID NO: 2115568 - DNA, 17 bp, Homo sapiens
tctattataaaaccatg

SEQ ID NO: 2115569 - DNA, 19 bp, Homo sapiens
tctattcctgaccctccct

SEQ ID NO: 2115570 - DNA, 14 bp, Homo sapiens
tctattctgagcct

SEQ ID NO: 2115571 - DNA, 14 bp, Homo sapiens
tctatttaaaaaat

SEQ ID NO: 2115572 - DNA, 17 bp, Homo sapiens
tctatttaaaaaataaa

SEQ ID NO: 2115573 - DNA, 12 bp, Homo sapiens
tctatttaagcc

SEQ ID NO: 2115574 - DNA, 22 bp, Homo sapiens
tctatttatttactgagcttct

SEQ ID NO: 2115575 - DNA, 20 bp, Homo sapiens
tctatttctgagaaggtcct

SEQ ID NO: 2115576 - DNA, 14 bp, Homo sapiens
tctattttgatttt

SEQ ID NO: 2115577 - DNA, 22 bp, Homo sapiens
tctcaaactcttgacctcaggt

SEQ ID NO: 2115578 - DNA, 14 bp, Homo sapiens
tctcaaactggggc

SEQ ID NO: 2115579 - DNA, 17 bp, Homo sapiens
tctcaaatgctaaatgc

SEQ ID NO: 2115580 - DNA, 22 bp, Homo sapiens
tctcaagattatattataataa

SEQ ID NO: 2115581 - DNA, 15 bp, Homo sapiens
tctcaagctcttcct

SEQ ID NO: 2115582 - DNA, 14 bp, Homo sapiens
tctcaatcagtgca

SEQ ID NO: 2115583 - DNA, 21 bp, Homo sapiens
tctcaattgtatagttatatt

SEQ ID NO: 2115584 - DNA, 12 bp, Homo sapiens
tctcacaaacat

SEQ ID NO: 2115585 - DNA, 14 bp, Homo sapiens
tctcacacacatag

SEQ ID NO: 2115586 - DNA, 15 bp, Homo sapiens
tctcacacacataga

SEQ ID NO: 2115587 - DNA, 15 bp, Homo sapiens
tctcaccagctgctg

SEQ ID NO: 2115588 - DNA, 12 bp, Homo sapiens
tctcaccaggaa

SEQ ID NO: 2115589 - DNA, 20 bp, Homo sapiens
tctcacgggcagtagctgtg

SEQ ID NO: 2115590 - DNA, 21 bp, Homo sapiens
tctcactcagccgcagacaag

SEQ ID NO: 2115591 - DNA, 12 bp, Homo sapiens
tctcactccacc

SEQ ID NO: 2115592 - DNA, 16 bp, Homo sapiens
tctcactcctacctgg

SEQ ID NO: 2115593 - DNA, 16 bp, Homo sapiens
tctcactctgtcgccc

SEQ ID NO: 2115594 - DNA, 17 bp, Homo sapiens
tctcactctgtcgccca

SEQ ID NO: 2115595 - DNA, 18 bp, Homo sapiens
tctcactctgtcgcccag

SEQ ID NO: 2115596 - DNA, 23 bp, Homo sapiens
tctcactctgtcgcccagtctgg

SEQ ID NO: 2115597 - DNA, 18 bp, Homo sapiens
tctcactgttgcccaggc

SEQ ID NO: 2115598 - DNA, 21 bp, Homo sapiens
tctcactgttgcccaggctgg

SEQ ID NO: 2115599 - DNA, 11 bp, Homo sapiens
tctcagagaca

SEQ ID NO: 2115600 - DNA, 15 bp, Homo sapiens
tctcagataaagtga

SEQ ID NO: 2115601 - DNA, 18 bp, Homo sapiens
tctcagataaagtgacca

SEQ ID NO: 2115602 - DNA, 23 bp, Homo sapiens
tctcagccataaagtgccagttt

SEQ ID NO: 2115603 - DNA, 22 bp, Homo sapiens
tctcagcgaggtgtaaagttgt

SEQ ID NO: 2115604 - DNA, 16 bp, Homo sapiens
tctcagcttcatttcc

SEQ ID NO: 2115605 - DNA, 18 bp, Homo sapiens
tctcagcttcatttccgt

SEQ ID NO: 2115606 - DNA, 20 bp, Homo sapiens
tctcagcttcatttccgtga

SEQ ID NO: 2115607 - DNA, 23 bp, Homo sapiens
tctcaggaaatcaaatatgcaaa

SEQ ID NO: 2115608 - DNA, 17 bp, Homo sapiens
tctcaggacacaggcct

SEQ ID NO: 2115609 - DNA, 18 bp, Homo sapiens
tctcaggacacaggcctg

SEQ ID NO: 2115610 - DNA, 16 bp, Homo sapiens
tctcaggagcacaggc

SEQ ID NO: 2115611 - DNA, 14 bp, Homo sapiens
tctcaggagcttgc

SEQ ID NO: 2115612 - DNA, 21 bp, Homo sapiens
tctcaggccctgaaggttcct

SEQ ID NO: 2115613 - DNA, 21 bp, Homo sapiens
tctcaggtgccactccctgag

SEQ ID NO: 2115614 - DNA, 23 bp, Homo sapiens
tctcaggtgccactccctgagct

SEQ ID NO: 2115615 - DNA, 20 bp, Homo sapiens
tctcagtccagatgccttcc

SEQ ID NO: 2115616 - DNA, 16 bp, Homo sapiens
tctcagttattcagat

SEQ ID NO: 2115617 - DNA, 23 bp, Homo sapiens
tctcataggaaaagtacatttaa

SEQ ID NO: 2115618 - DNA, 24 bp, Homo sapiens
tctcataggaaaagtacatttaat

SEQ ID NO: 2115619 - DNA, 19 bp, Homo sapiens
tctcatatgtagccctcat

SEQ ID NO: 2115620 - DNA, 15 bp, Homo sapiens
tctcatcagaaatgt

SEQ ID NO: 2115621 - DNA, 16 bp, Homo sapiens
tctcatccccagtccc

SEQ ID NO: 2115622 - DNA, 19 bp, Homo sapiens
tctcatcgccagacaactg

SEQ ID NO: 2115623 - DNA, 20 bp, Homo sapiens
tctcatctcagtgaagaata

SEQ ID NO: 2115624 - DNA, 13 bp, Homo sapiens
tctcatgaacctc

SEQ ID NO: 2115625 - DNA, 15 bp, Homo sapiens
tctcatgcctgcctg

SEQ ID NO: 2115626 - DNA, 21 bp, Homo sapiens
tctcatgcctgcctgataccc

SEQ ID NO: 2115627 - DNA, 18 bp, Homo sapiens
tctcatggaaactggcca

SEQ ID NO: 2115628 - DNA, 20 bp, Homo sapiens
tctcatgtctcagcctcctc

SEQ ID NO: 2115629 - DNA, 16 bp, Homo sapiens
tctcatgtgatccttt

SEQ ID NO: 2115630 - DNA, 10 bp, Homo sapiens
tctcattccc

SEQ ID NO: 2115631 - DNA, 13 bp, Homo sapiens
tctcattccccag

SEQ ID NO: 2115632 - DNA, 14 bp, Homo sapiens
tctcattctgttgc

SEQ ID NO: 2115633 - DNA, 23 bp, Homo sapiens
tctcattctgttgcccaggctgg

SEQ ID NO: 2115634 - DNA, 18 bp, Homo sapiens
tctcatttaagggaaaaa

SEQ ID NO: 2115635 - DNA, 18 bp, Homo sapiens
tctccaaaggggctgctg

SEQ ID NO: 2115636 - DNA, 20 bp, Homo sapiens
tctccaaaggggctgctggg

SEQ ID NO: 2115637 - DNA, 22 bp, Homo sapiens
tctccaaaggggctgctggggc

SEQ ID NO: 2115638 - DNA, 20 bp, Homo sapiens
tctccaaatattattcaagt

SEQ ID NO: 2115639 - DNA, 19 bp, Homo sapiens
tctccaaatgattttcatc

SEQ ID NO: 2115640 - DNA, 15 bp, Homo sapiens
tctccaacctggaca

SEQ ID NO: 2115641 - DNA, 14 bp, Homo sapiens
tctccaccctgagc

SEQ ID NO: 2115642 - DNA, 17 bp, Homo sapiens
tctccaccctgagcctg

SEQ ID NO: 2115643 - DNA, 19 bp, Homo sapiens
tctccaccctgagcctgac

SEQ ID NO: 2115644 - DNA, 14 bp, Homo sapiens
tctccaccctgctc

SEQ ID NO: 2115645 - DNA, 12 bp, Homo sapiens
tctccacctcag

SEQ ID NO: 2115646 - DNA, 13 bp, Homo sapiens
tctccacctcagc

SEQ ID NO: 2115647 - DNA, 14 bp, Homo sapiens
tctccacctcagcc

SEQ ID NO: 2115648 - DNA, 19 bp, Homo sapiens
tctccacctcagccttgga

SEQ ID NO: 2115649 - DNA, 16 bp, Homo sapiens
tctccacctgaagtga

SEQ ID NO: 2115650 - DNA, 20 bp, Homo sapiens
tctccactaaatgagctcct

SEQ ID NO: 2115651 - DNA, 13 bp, Homo sapiens
tctccactccaga

SEQ ID NO: 2115652 - DNA, 15 bp, Homo sapiens
tcggggccctgtgta

SEQ ID NO: 2115653 - DNA, 17 bp, Homo sapiens
tcggggcccttggggcc

SEQ ID NO: 2115654 - DNA, 22 bp, Homo sapiens
tcggggcccttggggcctggct

SEQ ID NO: 2115655 - DNA, 19 bp, Homo sapiens
tcggggcgacccctcagtg

SEQ ID NO: 2115656 - DNA, 20 bp, Homo sapiens
tcggggcgacccctcagtgc

SEQ ID NO: 2115657 - DNA, 16 bp, Homo sapiens
tcggggctgggaagtc

SEQ ID NO: 2115658 - DNA, 14 bp, Homo sapiens
tcggggtgcacagg

SEQ ID NO: 2115659 - DNA, 15 bp, Homo sapiens
tcggggtgcacagga

SEQ ID NO: 2115660 - DNA, 14 bp, Homo sapiens
tcggggtgtgatga

SEQ ID NO: 2115661 - DNA, 22 bp, Homo sapiens
tcgggttttattgtttaaaatc

SEQ ID NO: 2115662 - DNA, 13 bp, Homo sapiens
tcggtactcccat

SEQ ID NO: 2115663 - DNA, 19 bp, Homo sapiens
tcggtggccatgcttcttg

SEQ ID NO: 2115664 - DNA, 13 bp, Homo sapiens
tcggtgggacagc

SEQ ID NO: 2115665 - DNA, 14 bp, Homo sapiens
tcggtgtaaaacca

SEQ ID NO: 2115666 - DNA, 14 bp, Homo sapiens
tcggtttctgagca

SEQ ID NO: 2115667 - DNA, 14 bp, Homo sapiens
tcgtaccagccagg

SEQ ID NO: 2115668 - DNA, 15 bp, Homo sapiens
tcgtaccagccagga

SEQ ID NO: 2115669 - DNA, 23 bp, Homo sapiens
tcgtccacaggggcaggcctggg

SEQ ID NO: 2115670 - DNA, 14 bp, Homo sapiens
tcgtcctccccctg

SEQ ID NO: 2115671 - DNA, 16 bp, Homo sapiens
tcgtcctccccctgcc

SEQ ID NO: 2115672 - DNA, 15 bp, Homo sapiens
tcgtccttactcctg

SEQ ID NO: 2115673 - DNA, 19 bp, Homo sapiens
tcgtccttactcctgtggg

SEQ ID NO: 2115674 - DNA, 14 bp, Homo sapiens
tcgtccttcctctc

SEQ ID NO: 2115675 - DNA, 12 bp, Homo sapiens
tcgtctgtccca

SEQ ID NO: 2115676 - DNA, 14 bp, Homo sapiens
tcgtgcatttgtga

SEQ ID NO: 2115677 - DNA, 18 bp, Homo sapiens
tcgtgccatgatctgtat

SEQ ID NO: 2115678 - DNA, 23 bp, Homo sapiens
tcgtgccgttactctccaacctg

SEQ ID NO: 2115679 - DNA, 16 bp, Homo sapiens
tcgtggacacctgccc

SEQ ID NO: 2115680 - DNA, 17 bp, Homo sapiens
tcgtggacacctgccct

SEQ ID NO: 2115681 - DNA, 10 bp, Homo sapiens
tcgtggagag

SEQ ID NO: 2115682 - DNA, 12 bp, Homo sapiens
tcgtggagagct

SEQ ID NO: 2115683 - DNA, 24 bp, Homo sapiens
tcgtggagagctaggagcaaagcc

SEQ ID NO: 2115684 - DNA, 21 bp, Homo sapiens
tcgtggcagataatcagcctc

SEQ ID NO: 2115685 - DNA, 18 bp, Homo sapiens
tcgttagaggagcaacag

SEQ ID NO: 2115686 - DNA, 19 bp, Homo sapiens
tcgttagtatctaacatgt

SEQ ID NO: 2115687 - DNA, 20 bp, Homo sapiens
tcgttttcataacttgctga

SEQ ID NO: 2115688 - DNA, 12 bp, Homo sapiens
tctaaaaataaa

SEQ ID NO: 2115689 - DNA, 16 bp, Homo sapiens
tctaaaaataaaatga

SEQ ID NO: 2115690 - DNA, 17 bp, Homo sapiens
tctaaaaataaaatgat

SEQ ID NO: 2115691 - DNA, 21 bp, Homo sapiens
tctaaaactatggttcccaat

SEQ ID NO: 2115692 - DNA, 17 bp, Homo sapiens
tctaaacattaatcaat

SEQ ID NO: 2115693 - DNA, 16 bp, Homo sapiens
tctaaagtttacagta

SEQ ID NO: 2115694 - DNA, 22 bp, Homo sapiens
tctaaagtttacagtaaataaa

SEQ ID NO: 2115695 - DNA, 18 bp, Homo sapiens
tctaaatcttccttgtga

SEQ ID NO: 2115696 - DNA, 13 bp, Homo sapiens
tctaaatgaagtg

SEQ ID NO: 2115697 - DNA, 13 bp, Homo sapiens
tctaaatgcccag

SEQ ID NO: 2115698 - DNA, 14 bp, Homo sapiens
tctaaatgcccagt

SEQ ID NO: 2115699 - DNA, 14 bp, Homo sapiens
tctaaatgttggaa

SEQ ID NO: 2115700 - DNA, 20 bp, Homo sapiens
tctaaattctttatttctgt

SEQ ID NO: 2115701 - DNA, 24 bp, Homo sapiens
tctaacatatgatactgatgccat

SEQ ID NO: 2115702 - DNA, 12 bp, Homo sapiens
tctaacctcagc

SEQ ID NO: 2115703 - DNA, 15 bp, Homo sapiens
tctaacctgatggca

SEQ ID NO: 2115704 - DNA, 13 bp, Homo sapiens
tctaacgcctgag

SEQ ID NO: 2115705 - DNA, 15 bp, Homo sapiens
tctaacgcctgagcc

SEQ ID NO: 2115706 - DNA, 17 bp, Homo sapiens
tctaactacaaggacaa

SEQ ID NO: 2115707 - DNA, 13 bp, Homo sapiens
tctaactgtaaat

SEQ ID NO: 2115708 - DNA, 14 bp, Homo sapiens
tctaactgtaaatc

SEQ ID NO: 2115709 - DNA, 15 bp, Homo sapiens
tctaactgtaaatca

SEQ ID NO: 2115710 - DNA, 20 bp, Homo sapiens
tctaactgtaaatcacttgt

SEQ ID NO: 2115711 - DNA, 16 bp, Homo sapiens
tctaagattgtacata

SEQ ID NO: 2115712 - DNA, 12 bp, Homo sapiens
tctaagctgcag

SEQ ID NO: 2115713 - DNA, 17 bp, Homo sapiens
tctaagctgcagcttcc

SEQ ID NO: 2115714 - DNA, 22 bp, Homo sapiens
tctaagtaaaaccacagcagtt

SEQ ID NO: 2115715 - DNA, 21 bp, Homo sapiens
tctaagtgaatacttggaagt

SEQ ID NO: 2115716 - DNA, 21 bp, Homo sapiens
tctaagttaatttaaagttgt

SEQ ID NO: 2115717 - DNA, 20 bp, Homo sapiens
tctaatatggcaaaaatggc

SEQ ID NO: 2115718 - DNA, 14 bp, Homo sapiens
tctaatatgtaaca

SEQ ID NO: 2115719 - DNA, 17 bp, Homo sapiens
tctaatgtaagaaaatt

SEQ ID NO: 2115720 - DNA, 22 bp, Homo sapiens
tctaatgtaagaaaatttgaag

SEQ ID NO: 2115721 - DNA, 16 bp, Homo sapiens
tctaatgtctcttcct

SEQ ID NO: 2115722 - DNA, 20 bp, Homo sapiens
tctaatgtctcttcctctgt

SEQ ID NO: 2115723 - DNA, 21 bp, Homo sapiens
tctaatgtctcttcctctgtt

SEQ ID NO: 2115724 - DNA, 17 bp, Homo sapiens
tctaatgtcttcatttc

SEQ ID NO: 2115725 - DNA, 14 bp, Homo sapiens
tctaatgtgtgaat

SEQ ID NO: 2115726 - DNA, 13 bp, Homo sapiens
tctaatttataca

SEQ ID NO: 2115727 - DNA, 16 bp, Homo sapiens
tctacaagcatttgcc

SEQ ID NO: 2115728 - DNA, 14 bp, Homo sapiens
tctacacacccata

SEQ ID NO: 2115729 - DNA, 18 bp, Homo sapiens
tctacacagtaaaaactt

SEQ ID NO: 2115730 - DNA, 23 bp, Homo sapiens
tctacacagtgggaactctgaca

SEQ ID NO: 2115731 - DNA, 17 bp, Homo sapiens
tctacacatatatgtat

SEQ ID NO: 2115732 - DNA, 15 bp, Homo sapiens
tctacagaacaaaga

SEQ ID NO: 2115733 - DNA, 20 bp, Homo sapiens
tctacagctaatcagcattc

SEQ ID NO: 2115734 - DNA, 23 bp, Homo sapiens
tctacagctaatcagcattctca

SEQ ID NO: 2115735 - DNA, 22 bp, Homo sapiens
tctacaggcccggcccagccta

SEQ ID NO: 2115736 - DNA, 16 bp, Homo sapiens
tctacatattctttaa

SEQ ID NO: 2115737 - DNA, 15 bp, Homo sapiens
tctaccatttcagag

SEQ ID NO: 2115738 - DNA, 17 bp, Homo sapiens
tctacccggcccagaga

SEQ ID NO: 2115739 - DNA, 19 bp, Homo sapiens
tctacccggcccagagacc

SEQ ID NO: 2115740 - DNA, 13 bp, Homo sapiens
tctaccctgggat

SEQ ID NO: 2115741 - DNA, 20 bp, Homo sapiens
tctaccctggtaggaaagca

SEQ ID NO: 2115742 - DNA, 14 bp, Homo sapiens
tctacctgccctct

SEQ ID NO: 2115743 - DNA, 21 bp, Homo sapiens
tctacctggtctctccttgtt

SEQ ID NO: 2115744 - DNA, 16 bp, Homo sapiens
tctacgttatgaaaac

SEQ ID NO: 2115745 - DNA, 20 bp, Homo sapiens
tctactacttttactacagt

SEQ ID NO: 2115746 - DNA, 14 bp, Homo sapiens
tctactcagaaatt

SEQ ID NO: 2115747 - DNA, 17 bp, Homo sapiens
tctactcctacctcagc

SEQ ID NO: 2115748 - DNA, 16 bp, Homo sapiens
tctagaaagaaaagac

SEQ ID NO: 2115749 - DNA, 23 bp, Homo sapiens
tctagaaagaaaagaccctgaga

SEQ ID NO: 2115750 - DNA, 15 bp, Homo sapiens
tctagaacacaggca

SEQ ID NO: 2115751 - DNA, 17 bp, Homo sapiens
tctagaacacaggcaaa

SEQ ID NO: 2115752 - DNA, 15 bp, Homo sapiens
tctagaacacccact

SEQ ID NO: 2115753 - DNA, 17 bp, Homo sapiens
tctagaacacccactgg

SEQ ID NO: 2115754 - DNA, 18 bp, Homo sapiens
tctagaacacccactggc

SEQ ID NO: 2115755 - DNA, 14 bp, Homo sapiens
tctagactttctgt

SEQ ID NO: 2115756 - DNA, 14 bp, Homo sapiens
tctagaggcctcag

SEQ ID NO: 2115757 - DNA, 15 bp, Homo sapiens
tctagaggcctcagt

SEQ ID NO: 2115758 - DNA, 23 bp, Homo sapiens
tctagagtgagaatctggctcct

SEQ ID NO: 2115759 - DNA, 20 bp, Homo sapiens
tctagatcaattaattctta

SEQ ID NO: 2115760 - DNA, 11 bp, Homo sapiens
tctagatgctt

SEQ ID NO: 2115761 - DNA, 13 bp, Homo sapiens
tctagcaactgtt

SEQ ID NO: 2115762 - DNA, 21 bp, Homo sapiens
tctagcaactgttggataata

SEQ ID NO: 2115763 - DNA, 13 bp, Homo sapiens
tctagcagagtga

SEQ ID NO: 2115764 - DNA, 23 bp, Homo sapiens
tctagccactttggtcccgtgca

SEQ ID NO: 2115765 - DNA, 15 bp, Homo sapiens
tctagccctccctgg

SEQ ID NO: 2115766 - DNA, 17 bp, Homo sapiens
tctagcctgggccagag

SEQ ID NO: 2115767 - DNA, 20 bp, Homo sapiens
tctagcctgggccagagaag

SEQ ID NO: 2115768 - DNA, 18 bp, Homo sapiens
tctagctgatcagaattt

SEQ ID NO: 2115769 - DNA, 22 bp, Homo sapiens
aggataccatatacagctcaga

SEQ ID NO: 2115770 - DNA, 13 bp, Homo sapiens
aggatactctgtc

SEQ ID NO: 2115771 - DNA, 16 bp, Homo sapiens
aggatactctgtcaga

SEQ ID NO: 2115772 - DNA, 15 bp, Homo sapiens
aggatatcagagctg

SEQ ID NO: 2115773 - DNA, 22 bp, Homo sapiens
aggatatcatcttttctaatct

SEQ ID NO: 2115774 - DNA, 17 bp, Homo sapiens
aggatcagccccgctcc

SEQ ID NO: 2115775 - DNA, 21 bp, Homo sapiens
aggatcatttgttggaatgaa

SEQ ID NO: 2115776 - DNA, 12 bp, Homo sapiens
aggatccagaga

SEQ ID NO: 2115777 - DNA, 18 bp, Homo sapiens
aggatccctcccagatcc

SEQ ID NO: 2115778 - DNA, 20 bp, Homo sapiens
aggatcctattctcaccagg

SEQ ID NO: 2115779 - DNA, 20 bp, Homo sapiens
aggatcctcacaggagcaga

SEQ ID NO: 2115780 - DNA, 16 bp, Homo sapiens
aggatcctgcaggaac

SEQ ID NO: 2115781 - DNA, 23 bp, Homo sapiens
aggatctagcttcatgcctcagt

SEQ ID NO: 2115782 - DNA, 15 bp, Homo sapiens
aggatctatgcaatt

SEQ ID NO: 2115783 - DNA, 18 bp, Homo sapiens
aggatctatgcaattttt

SEQ ID NO: 2115784 - DNA, 20 bp, Homo sapiens
aggatctatgcaatttttaa

SEQ ID NO: 2115785 - DNA, 22 bp, Homo sapiens
aggatctatgcaatttttaaac

SEQ ID NO: 2115786 - DNA, 15 bp, Homo sapiens
aggatctctcaggag

SEQ ID NO: 2115787 - DNA, 23 bp, Homo sapiens
aggatctgtttttaaaaatcata

SEQ ID NO: 2115788 - DNA, 20 bp, Homo sapiens
aggatgaatgaggtcccagg

SEQ ID NO: 2115789 - DNA, 23 bp, Homo sapiens
aggatgaggaacctcaaactggg

SEQ ID NO: 2115790 - DNA, 15 bp, Homo sapiens
aggatgatttcagaa

SEQ ID NO: 2115791 - DNA, 22 bp, Homo sapiens
aggatgatttcagaaggagaag

SEQ ID NO: 2115792 - DNA, 14 bp, Homo sapiens
aggatgccacagcc

SEQ ID NO: 2115793 - DNA, 16 bp, Homo sapiens
aggatgccacagcccc

SEQ ID NO: 2115794 - DNA, 19 bp, Homo sapiens
aggatgccacagccccaca

SEQ ID NO: 2115795 - DNA, 21 bp, Homo sapiens
aggatgccacagccccacagc

SEQ ID NO: 2115796 - DNA, 22 bp, Homo sapiens
aggatggacgaacaggggccaa

SEQ ID NO: 2115797 - DNA, 13 bp, Homo sapiens
aggatggagagag

SEQ ID NO: 2115798 - DNA, 19 bp, Homo sapiens
aggatggattgcagtcccc

SEQ ID NO: 2115799 - DNA, 18 bp, Homo sapiens
aggatgtccgttccagga

SEQ ID NO: 2115800 - DNA, 15 bp, Homo sapiens
aggatgtgttttgca

SEQ ID NO: 2115801 - DNA, 22 bp, Homo sapiens
aggatgttctggacctccccct

SEQ ID NO: 2115802 - DNA, 15 bp, Homo sapiens
aggattccaaagttt

SEQ ID NO: 2115803 - DNA, 19 bp, Homo sapiens
aggattccaaagttttgaa

SEQ ID NO: 2115804 - DNA, 15 bp, Homo sapiens
aggattcctccccca

SEQ ID NO: 2115805 - DNA, 15 bp, Homo sapiens
aggattgctactgtc

SEQ ID NO: 2115806 - DNA, 17 bp, Homo sapiens
aggattgctactgtcct

SEQ ID NO: 2115807 - DNA, 19 bp, Homo sapiens
aggattgcttgagcccagg

SEQ ID NO: 2115808 - DNA, 22 bp, Homo sapiens
aggattgcttgagcccaggagt

SEQ ID NO: 2115809 - DNA, 16 bp, Homo sapiens
aggatttaacagtcat

SEQ ID NO: 2115810 - DNA, 20 bp, Homo sapiens
aggatttaacagtcatttaa

SEQ ID NO: 2115811 - DNA, 20 bp, Homo sapiens
aggatttcatgatttcattt

SEQ ID NO: 2115812 - DNA, 19 bp, Homo sapiens
aggattttgatccaagctg

SEQ ID NO: 2115813 - DNA, 16 bp, Homo sapiens
aggattttgtgttttt

SEQ ID NO: 2115814 - DNA, 17 bp, Homo sapiens
aggattttgtgtttttt

SEQ ID NO: 2115815 - DNA, 21 bp, Homo sapiens
aggcaaaacacgcaagggcat

SEQ ID NO: 2115816 - DNA, 19 bp, Homo sapiens
aggcaaaatccttgcttat

SEQ ID NO: 2115817 - DNA, 13 bp, Homo sapiens
aggcaagagacag

SEQ ID NO: 2115818 - DNA, 14 bp, Homo sapiens
aggcaagagacaga

SEQ ID NO: 2115819 - DNA, 17 bp, Homo sapiens
aggcaaggttatatgca

SEQ ID NO: 2115820 - DNA, 16 bp, Homo sapiens
aggcaatatctttaat

SEQ ID NO: 2115821 - DNA, 15 bp, Homo sapiens
aggcacacagcagcc

SEQ ID NO: 2115822 - DNA, 16 bp, Homo sapiens
aggcacacagcagccc

SEQ ID NO: 2115823 - DNA, 18 bp, Homo sapiens
aggcacaggcaggaagag

SEQ ID NO: 2115824 - DNA, 18 bp, Homo sapiens
aggcaccaaaagaagtaa

SEQ ID NO: 2115825 - DNA, 17 bp, Homo sapiens
aggcaccagctctgtgg

SEQ ID NO: 2115826 - DNA, 19 bp, Homo sapiens
aggcaccagctctgtggcc

SEQ ID NO: 2115827 - DNA, 21 bp, Homo sapiens
aggcaccagctctgtggcctg

SEQ ID NO: 2115828 - DNA, 20 bp, Homo sapiens
aggcacccttctttcctctt

SEQ ID NO: 2115829 - DNA, 20 bp, Homo sapiens
aggcaccggcgctgcaggta

SEQ ID NO: 2115830 - DNA, 17 bp, Homo sapiens
aggcacctagcaattcc

SEQ ID NO: 2115831 - DNA, 15 bp, Homo sapiens
aggcacctggcctgc

SEQ ID NO: 2115832 - DNA, 17 bp, Homo sapiens
aggcacctggcctgctg

SEQ ID NO: 2115833 - DNA, 18 bp, Homo sapiens
aggcacctggcctgctgg

SEQ ID NO: 2115834 - DNA, 19 bp, Homo sapiens
aggcacctggcctgctggg

SEQ ID NO: 2115835 - DNA, 21 bp, Homo sapiens
aggcacttgtcactatgctat

SEQ ID NO: 2115836 - DNA, 18 bp, Homo sapiens
aggcagacagcagctcag

SEQ ID NO: 2115837 - DNA, 19 bp, Homo sapiens
aggcagacagcagctcagg

SEQ ID NO: 2115838 - DNA, 20 bp, Homo sapiens
aggcagacagcagctcaggc

SEQ ID NO: 2115839 - DNA, 21 bp, Homo sapiens
aggcagacagcagctcaggca

SEQ ID NO: 2115840 - DNA, 21 bp, Homo sapiens
aggcagacgtggggagggtgg

SEQ ID NO: 2115841 - DNA, 15 bp, Homo sapiens
aggcagagaagaaag

SEQ ID NO: 2115842 - DNA, 18 bp, Homo sapiens
aggcagagcggggaggtg

SEQ ID NO: 2115843 - DNA, 22 bp, Homo sapiens
aggcagagcggggaggtgcctg

SEQ ID NO: 2115844 - DNA, 17 bp, Homo sapiens
aggcagcaaggcccgag

SEQ ID NO: 2115845 - DNA, 18 bp, Homo sapiens
aggcagcctccagagcca

SEQ ID NO: 2115846 - DNA, 14 bp, Homo sapiens
aggcagcctctctg

SEQ ID NO: 2115847 - DNA, 14 bp, Homo sapiens
aggcagcctgccgc

SEQ ID NO: 2115848 - DNA, 18 bp, Homo sapiens
aggcagctccaacagctt

SEQ ID NO: 2115849 - DNA, 14 bp, Homo sapiens
aggcagctgctctt

SEQ ID NO: 2115850 - DNA, 15 bp, Homo sapiens
aggcagcttgaaact

SEQ ID NO: 2115851 - DNA, 16 bp, Homo sapiens
aggcaggaagagagag

SEQ ID NO: 2115852 - DNA, 15 bp, Homo sapiens
aggcaggagaattgc

SEQ ID NO: 2115853 - DNA, 22 bp, Homo sapiens
atagcaatccatgttagttttt

SEQ ID NO: 2115854 - DNA, 16 bp, Homo sapiens
atagcattgaacattt

SEQ ID NO: 2115855 - DNA, 14 bp, Homo sapiens
atagccaaaaatag

SEQ ID NO: 2115856 - DNA, 16 bp, Homo sapiens
atagccaaaaatagct

SEQ ID NO: 2115857 - DNA, 22 bp, Homo sapiens
atagccacatccctttgaaaca

SEQ ID NO: 2115858 - DNA, 19 bp, Homo sapiens
atagccacttaccttcaat

SEQ ID NO: 2115859 - DNA, 13 bp, Homo sapiens
atagccagacaca

SEQ ID NO: 2115860 - DNA, 14 bp, Homo sapiens
atagccagacacat

SEQ ID NO: 2115861 - DNA, 15 bp, Homo sapiens
atagccagacacatg

SEQ ID NO: 2115862 - DNA, 14 bp, Homo sapiens
atagccagagagga

SEQ ID NO: 2115863 - DNA, 22 bp, Homo sapiens
atagccagagaggagcacctga

SEQ ID NO: 2115864 - DNA, 14 bp, Homo sapiens
atagccgggcatgg

SEQ ID NO: 2115865 - DNA, 18 bp, Homo sapiens
atagccgggcatggtggc

SEQ ID NO: 2115866 - DNA, 17 bp, Homo sapiens
atagcctaggtgacaga

SEQ ID NO: 2115867 - DNA, 14 bp, Homo sapiens
atagcgctggctca

SEQ ID NO: 2115868 - DNA, 19 bp, Homo sapiens
atagctacccaaaagagaa

SEQ ID NO: 2115869 - DNA, 21 bp, Homo sapiens
atagctacccaaaagagaaaa

SEQ ID NO: 2115870 - DNA, 22 bp, Homo sapiens
atagctattactgtctggtttt

SEQ ID NO: 2115871 - DNA, 22 bp, Homo sapiens
atagctattttcttacagtgga

SEQ ID NO: 2115872 - DNA, 22 bp, Homo sapiens
atagctcaggtgtccctgcact

SEQ ID NO: 2115873 - DNA, 13 bp, Homo sapiens
atagctcagttta

SEQ ID NO: 2115874 - DNA, 14 bp, Homo sapiens
atagcttgtatagt

SEQ ID NO: 2115875 - DNA, 15 bp, Homo sapiens
atagcttttattgta

SEQ ID NO: 2115876 - DNA, 18 bp, Homo sapiens
atagcttttattgtataa

SEQ ID NO: 2115877 - DNA, 12 bp, Homo sapiens
ataggaaaagaa

SEQ ID NO: 2115878 - DNA, 23 bp, Homo sapiens
ataggatcatttgttggaatgaa

SEQ ID NO: 2115879 - DNA, 19 bp, Homo sapiens
ataggccatgttaattaaa

SEQ ID NO: 2115880 - DNA, 17 bp, Homo sapiens
ataggcggtcatgtgtg

SEQ ID NO: 2115881 - DNA, 18 bp, Homo sapiens
ataggctggagaagctca

SEQ ID NO: 2115882 - DNA, 16 bp, Homo sapiens
atagggtctcttcagg

SEQ ID NO: 2115883 - DNA, 20 bp, Homo sapiens
ataggtagaatgtaaagctt

SEQ ID NO: 2115884 - DNA, 23 bp, Homo sapiens
ataggtagaatgtaaagcttgtc

SEQ ID NO: 2115885 - DNA, 22 bp, Homo sapiens
ataggtcacatatgtctgtatc

SEQ ID NO: 2115886 - DNA, 14 bp, Homo sapiens
ataggtcagagatg

SEQ ID NO: 2115887 - DNA, 20 bp, Homo sapiens
ataggtcattttctattcac

SEQ ID NO: 2115888 - DNA, 14 bp, Homo sapiens
ataggtgctacaaa

SEQ ID NO: 2115889 - DNA, 18 bp, Homo sapiens
atagtaaaagataacaag

SEQ ID NO: 2115890 - DNA, 13 bp, Homo sapiens
atagtaaatcacg

SEQ ID NO: 2115891 - DNA, 22 bp, Homo sapiens
atagtaactactttttatactc

SEQ ID NO: 2115892 - DNA, 15 bp, Homo sapiens
atagtaagcctccct

SEQ ID NO: 2115893 - DNA, 20 bp, Homo sapiens
atagtagcagagtcattgtt

SEQ ID NO: 2115894 - DNA, 15 bp, Homo sapiens
atagtagcatacatt

SEQ ID NO: 2115895 - DNA, 16 bp, Homo sapiens
atagtagcatacattt

SEQ ID NO: 2115896 - DNA, 17 bp, Homo sapiens
atagtagcatacattta

SEQ ID NO: 2115897 - DNA, 16 bp, Homo sapiens
atagtagggttggggt

SEQ ID NO: 2115898 - DNA, 20 bp, Homo sapiens
atagtagtcaattagtacag

SEQ ID NO: 2115899 - DNA, 15 bp, Homo sapiens
atagtatatttatac

SEQ ID NO: 2115900 - DNA, 17 bp, Homo sapiens
atagtatatttatactc

SEQ ID NO: 2115901 - DNA, 15 bp, Homo sapiens
atagtatggtggctg

SEQ ID NO: 2115902 - DNA, 14 bp, Homo sapiens
atagtattcatttt

SEQ ID NO: 2115903 - DNA, 20 bp, Homo sapiens
atagtcaaaccataaacttc

SEQ ID NO: 2115904 - DNA, 19 bp, Homo sapiens
atagtcaatgtttctttta

SEQ ID NO: 2115905 - DNA, 14 bp, Homo sapiens
atagtcacaaaaat

SEQ ID NO: 2115906 - DNA, 14 bp, Homo sapiens
atagtccaatattt

SEQ ID NO: 2115907 - DNA, 21 bp, Homo sapiens
atagtccatggacaatataaa

SEQ ID NO: 2115908 - DNA, 19 bp, Homo sapiens
atagtgctatatatataaa

SEQ ID NO: 2115909 - DNA, 13 bp, Homo sapiens
atagtgtaaaata

SEQ ID NO: 2115910 - DNA, 23 bp, Homo sapiens
atagttaaaagactgcagctgct

SEQ ID NO: 2115911 - DNA, 23 bp, Homo sapiens
atagttaggatagcatttttgat

SEQ ID NO: 2115912 - DNA, 17 bp, Homo sapiens
atagttcccatgttaaa

SEQ ID NO: 2115913 - DNA, 22 bp, Homo sapiens
atagttggctaggacccctcca

SEQ ID NO: 2115914 - DNA, 19 bp, Homo sapiens
atagttgtccatattttca

SEQ ID NO: 2115915 - DNA, 22 bp, Homo sapiens
atagtttactattttacttcta

SEQ ID NO: 2115916 - DNA, 14 bp, Homo sapiens
atagtttattgaca

SEQ ID NO: 2115917 - DNA, 22 bp, Homo sapiens
atagtttgctttgctttttaat

SEQ ID NO: 2115918 - DNA, 17 bp, Homo sapiens
atagttttataaaactc

SEQ ID NO: 2115919 - DNA, 17 bp, Homo sapiens
atataaaaatatatata

SEQ ID NO: 2115920 - DNA, 12 bp, Homo sapiens
atataaacttgt

SEQ ID NO: 2115921 - DNA, 24 bp, Homo sapiens
atataaagtatcatcagtgtagaa

SEQ ID NO: 2115922 - DNA, 13 bp, Homo sapiens
atataaatatttg

SEQ ID NO: 2115923 - DNA, 14 bp, Homo sapiens
atataaatgcatga

SEQ ID NO: 2115924 - DNA, 17 bp, Homo sapiens
atataaatgcatgattt

SEQ ID NO: 2115925 - DNA, 15 bp, Homo sapiens
atataaatggctggt

SEQ ID NO: 2115926 - DNA, 12 bp, Homo sapiens
atataaattaag

SEQ ID NO: 2115927 - DNA, 21 bp, Homo sapiens
atataaccattacatgtttaa

SEQ ID NO: 2115928 - DNA, 17 bp, Homo sapiens
atataagaacttgatat

SEQ ID NO: 2115929 - DNA, 15 bp, Homo sapiens
atataatactaaagt

SEQ ID NO: 2115930 - DNA, 22 bp, Homo sapiens
atataatactaaagtgtctatt

SEQ ID NO: 2115931 - DNA, 14 bp, Homo sapiens
atataatgaacacg

SEQ ID NO: 2115932 - DNA, 16 bp, Homo sapiens
atataatggtttactg

SEQ ID NO: 2115933 - DNA, 17 bp, Homo sapiens
atataatggtttactgc

SEQ ID NO: 2115934 - DNA, 21 bp, Homo sapiens
atataatgttgttatttaaag

SEQ ID NO: 2115935 - DNA, 14 bp, Homo sapiens
atataattatcgga

SEQ ID NO: 2115936 - DNA, 18 bp, Homo sapiens
atataattgggattttaa

SEQ ID NO: 2115937 - DNA, 14 bp, Homo sapiens
atatacaaacatgt

SEQ ID NO: 2115938 - DNA, 22 bp, Homo sapiens
atatacaaatatatttaattgt

SEQ ID NO: 2115939 - DNA, 19 bp, Homo sapiens
atatacacaggatcctatt

SEQ ID NO: 2115940 - DNA, 18 bp, Homo sapiens
atatacacatggatgcac

SEQ ID NO: 2115941 - DNA, 12 bp, Homo sapiens
atatacatacac

SEQ ID NO: 2115942 - DNA, 13 bp, Homo sapiens
atatacatacact

SEQ ID NO: 2115943 - DNA, 14 bp, Homo sapiens
atatacatatgtag

SEQ ID NO: 2115944 - DNA, 15 bp, Homo sapiens
atatacatattataa

SEQ ID NO: 2115945 - DNA, 19 bp, Homo sapiens
atatacatattataaataa

SEQ ID NO: 2115946 - DNA, 20 bp, Homo sapiens
atatacatattataaataaa

SEQ ID NO: 2115947 - DNA, 14 bp, Homo sapiens
atatacatgtatag

SEQ ID NO: 2115948 - DNA, 16 bp, Homo sapiens
atatacatgtgtgtat

SEQ ID NO: 2115949 - DNA, 18 bp, Homo sapiens
atatacatgtgtgtatat

SEQ ID NO: 2115950 - DNA, 20 bp, Homo sapiens
atatacctataatgtgtgta

SEQ ID NO: 2115951 - DNA, 18 bp, Homo sapiens
atatactatacaacaatg

SEQ ID NO: 2115952 - DNA, 13 bp, Homo sapiens
atatagagatgtt

SEQ ID NO: 2115953 - DNA, 18 bp, Homo sapiens
atatagcgttcccaacaa

SEQ ID NO: 2115954 - DNA, 21 bp, Homo sapiens
atatagcgttcccaacaacat

SEQ ID NO: 2115955 - DNA, 17 bp, Homo sapiens
atatagctgatcagttt

SEQ ID NO: 2115956 - DNA, 13 bp, Homo sapiens
atatagtatattt

SEQ ID NO: 2115957 - DNA, 16 bp, Homo sapiens
atatagtatatttata

SEQ ID NO: 2115958 - DNA, 19 bp, Homo sapiens
atatagtatatttatactc

SEQ ID NO: 2115959 - DNA, 21 bp, Homo sapiens
atatagtatatttatactcta

SEQ ID NO: 2115960 - DNA, 15 bp, Homo sapiens
atatagtattcattt

SEQ ID NO: 2115961 - DNA, 18 bp, Homo sapiens
atatagtgctatatatat

SEQ ID NO: 2115962 - DNA, 24 bp, Homo sapiens
atatagtttgtggtaaaaagatta

SEQ ID NO: 2115963 - DNA, 21 bp, Homo sapiens
atatataaaaagaaaagataa

SEQ ID NO: 2115964 - DNA, 15 bp, Homo sapiens
atatataaaaatata

SEQ ID NO: 2115965 - DNA, 15 bp, Homo sapiens
atatataaatatata

SEQ ID NO: 2115966 - DNA, 14 bp, Homo sapiens
atatatacacatac

SEQ ID NO: 2115967 - DNA, 16 bp, Homo sapiens
atatatacacatacat

SEQ ID NO: 2115968 - DNA, 24 bp, Homo sapiens
ctcaccagtgtcccctccactgtc

SEQ ID NO: 2115969 - DNA, 14 bp, Homo sapiens
ctcaccatgtaaaa

SEQ ID NO: 2115970 - DNA, 15 bp, Homo sapiens
ctcaccccaaggggt

SEQ ID NO: 2115971 - DNA, 14 bp, Homo sapiens
ctcaccccctccca

SEQ ID NO: 2115972 - DNA, 18 bp, Homo sapiens
ctcaccccctcccacccc

SEQ ID NO: 2115973 - DNA, 21 bp, Homo sapiens
ctcaccccctcccacccccag

SEQ ID NO: 2115974 - DNA, 16 bp, Homo sapiens
ctcaccctcataccat

SEQ ID NO: 2115975 - DNA, 15 bp, Homo sapiens
ctcaccggcatgctg

SEQ ID NO: 2115976 - DNA, 17 bp, Homo sapiens
ctcaccggcatgctggc

SEQ ID NO: 2115977 - DNA, 22 bp, Homo sapiens
ctcaccggcatgctggcctgtg

SEQ ID NO: 2115978 - DNA, 12 bp, Homo sapiens
ctcacctcctcc

SEQ ID NO: 2115979 - DNA, 15 bp, Homo sapiens
ctcacctctctctaa

SEQ ID NO: 2115980 - DNA, 19 bp, Homo sapiens
ctcacctgagtcaccctac

SEQ ID NO: 2115981 - DNA, 22 bp, Homo sapiens
ctcaccttgtgctggggacagg

SEQ ID NO: 2115982 - DNA, 16 bp, Homo sapiens
ctcacctttgcaaagt

SEQ ID NO: 2115983 - DNA, 22 bp, Homo sapiens
ctcacgcccagcctcctcccac

SEQ ID NO: 2115984 - DNA, 18 bp, Homo sapiens
ctcacgcctataatccca

SEQ ID NO: 2115985 - DNA, 21 bp, Homo sapiens
ctcacgcctataatcccagca

SEQ ID NO: 2115986 - DNA, 20 bp, Homo sapiens
ctcacgcctatgatcccagc

SEQ ID NO: 2115987 - DNA, 23 bp, Homo sapiens
ctcacgcctgtaatcccagcagt

SEQ ID NO: 2115988 - DNA, 18 bp, Homo sapiens
ctcacgctcccccgcagt

SEQ ID NO: 2115989 - DNA, 15 bp, Homo sapiens
ctcacgctctggaca

SEQ ID NO: 2115990 - DNA, 11 bp, Homo sapiens
ctcactatgac

SEQ ID NO: 2115991 - DNA, 22 bp, Homo sapiens
ctcactatggtatgctggccag

SEQ ID NO: 2115992 - DNA, 23 bp, Homo sapiens
ctcactatggtatgctggccagc

SEQ ID NO: 2115993 - DNA, 24 bp, Homo sapiens
ctcactatggtatgctggccagca

SEQ ID NO: 2115994 - DNA, 16 bp, Homo sapiens
ctcactatgttgccca

SEQ ID NO: 2115995 - DNA, 17 bp, Homo sapiens
ctcactatgttgcccag

SEQ ID NO: 2115996 - DNA, 20 bp, Homo sapiens
ctcactatgttgcccaggca

SEQ ID NO: 2115997 - DNA, 22 bp, Homo sapiens
ctcactatgttgcccaggcagg

SEQ ID NO: 2115998 - DNA, 13 bp, Homo sapiens
ctcactccagccc

SEQ ID NO: 2115999 - DNA, 12 bp, Homo sapiens
ctcactcctgag

SEQ ID NO: 2116000 - DNA, 12 bp, Homo sapiens
ctcactcctgtt

SEQ ID NO: 2116001 - DNA, 11 bp, Homo sapiens
ctcactctgtc

SEQ ID NO: 2116002 - DNA, 13 bp, Homo sapiens
ctcactctgtcag

SEQ ID NO: 2116003 - DNA, 13 bp, Homo sapiens
ctcactctgtcgc

SEQ ID NO: 2116004 - DNA, 16 bp, Homo sapiens
ctcactgaggaaggga

SEQ ID NO: 2116005 - DNA, 13 bp, Homo sapiens
ctcactgccccac

SEQ ID NO: 2116006 - DNA, 15 bp, Homo sapiens
ctcactgccccacca

SEQ ID NO: 2116007 - DNA, 14 bp, Homo sapiens
ctcactgccttcca

SEQ ID NO: 2116008 - DNA, 14 bp, Homo sapiens
ctcactgctcaaga

SEQ ID NO: 2116009 - DNA, 19 bp, Homo sapiens
ctcactgctggggagtccc

SEQ ID NO: 2116010 - DNA, 15 bp, Homo sapiens
ctcactggctggggc

SEQ ID NO: 2116011 - DNA, 17 bp, Homo sapiens
ctcactggggtcctggg

SEQ ID NO: 2116012 - DNA, 18 bp, Homo sapiens
ctcactgttgcccaggct

SEQ ID NO: 2116013 - DNA, 21 bp, Homo sapiens
ctcactgttgcccaggctggc

SEQ ID NO: 2116014 - DNA, 15 bp, Homo sapiens
ctcacttatctgata

SEQ ID NO: 2116015 - DNA, 16 bp, Homo sapiens
ctcacttatctgatac

SEQ ID NO: 2116016 - DNA, 15 bp, Homo sapiens
ctcacttccctggga

SEQ ID NO: 2116017 - DNA, 22 bp, Homo sapiens
ctcacttttaatgaacaaatgg

SEQ ID NO: 2116018 - DNA, 14 bp, Homo sapiens
ctcagaacagctga

SEQ ID NO: 2116019 - DNA, 14 bp, Homo sapiens
ctcagaagcctgag

SEQ ID NO: 2116020 - DNA, 13 bp, Homo sapiens
ctcagaagcctgg

SEQ ID NO: 2116021 - DNA, 16 bp, Homo sapiens
ctcagaagcctggggg

SEQ ID NO: 2116022 - DNA, 17 bp, Homo sapiens
ctcagaagcctgggggc

SEQ ID NO: 2116023 - DNA, 22 bp, Homo sapiens
ctcagaagcctgggggcctggc

SEQ ID NO: 2116024 - DNA, 23 bp, Homo sapiens
ctcagaagcctgggggcctggct

SEQ ID NO: 2116025 - DNA, 13 bp, Homo sapiens
ctcagaaggtatt

SEQ ID NO: 2116026 - DNA, 19 bp, Homo sapiens
ctcagaaggtattcctttt

SEQ ID NO: 2116027 - DNA, 16 bp, Homo sapiens
ctcagaagtttcttct

SEQ ID NO: 2116028 - DNA, 14 bp, Homo sapiens
ctcagaatccaaag

SEQ ID NO: 2116029 - DNA, 14 bp, Homo sapiens
ctcagaatgctcta

SEQ ID NO: 2116030 - DNA, 14 bp, Homo sapiens
ctcagacccccact

SEQ ID NO: 2116031 - DNA, 13 bp, Homo sapiens
ctcagactgctca

SEQ ID NO: 2116032 - DNA, 13 bp, Homo sapiens
ctcagagaggcat

SEQ ID NO: 2116033 - DNA, 14 bp, Homo sapiens
ctcagagaggcatg

SEQ ID NO: 2116034 - DNA, 14 bp, Homo sapiens
ctcagagcagagca

SEQ ID NO: 2116035 - DNA, 20 bp, Homo sapiens
tactggaccccgcctcccag

SEQ ID NO: 2116036 - DNA, 12 bp, Homo sapiens
tactggcagctc

SEQ ID NO: 2116037 - DNA, 14 bp, Homo sapiens
tactggcagctcct

SEQ ID NO: 2116038 - DNA, 22 bp, Homo sapiens
tactgggaatggaaggctttgc

SEQ ID NO: 2116039 - DNA, 12 bp, Homo sapiens
tactgtaaatgt

SEQ ID NO: 2116040 - DNA, 13 bp, Homo sapiens
tactgtaaatgta

SEQ ID NO: 2116041 - DNA, 17 bp, Homo sapiens
tactgtacatagatgta

SEQ ID NO: 2116042 - DNA, 23 bp, Homo sapiens
tactgtcagctcccctcggagaa

SEQ ID NO: 2116043 - DNA, 20 bp, Homo sapiens
tactgtctggttttaacaat

SEQ ID NO: 2116044 - DNA, 13 bp, Homo sapiens
tactgtgactgat

SEQ ID NO: 2116045 - DNA, 22 bp, Homo sapiens
tactgtgtacagaattctgcta

SEQ ID NO: 2116046 - DNA, 19 bp, Homo sapiens
tactgtgtagactcctgct

SEQ ID NO: 2116047 - DNA, 20 bp, Homo sapiens
tacttaaatagcatctgctc

SEQ ID NO: 2116048 - DNA, 21 bp, Homo sapiens
tacttaaatagcatctgctct

SEQ ID NO: 2116049 - DNA, 14 bp, Homo sapiens
tacttaactgtgtg

SEQ ID NO: 2116050 - DNA, 13 bp, Homo sapiens
tacttaagagaaa

SEQ ID NO: 2116051 - DNA, 15 bp, Homo sapiens
tacttaagagaaatg

SEQ ID NO: 2116052 - DNA, 13 bp, Homo sapiens
tacttaataaatt

SEQ ID NO: 2116053 - DNA, 16 bp, Homo sapiens
tacttacctaaacaga

SEQ ID NO: 2116054 - DNA, 22 bp, Homo sapiens
tacttacctaaacagatataaa

SEQ ID NO: 2116055 - DNA, 18 bp, Homo sapiens
tacttagcaaagttttac

SEQ ID NO: 2116056 - DNA, 13 bp, Homo sapiens
tacttatcctcat

SEQ ID NO: 2116057 - DNA, 17 bp, Homo sapiens
tacttatttttgacagt

SEQ ID NO: 2116058 - DNA, 18 bp, Homo sapiens
tacttcaagttaaagtga

SEQ ID NO: 2116059 - DNA, 21 bp, Homo sapiens
tacttcaagttaaagtgaata

SEQ ID NO: 2116060 - DNA, 18 bp, Homo sapiens
tacttctccaccctgctc

SEQ ID NO: 2116061 - DNA, 17 bp, Homo sapiens
tacttgaactttccaaa

SEQ ID NO: 2116062 - DNA, 14 bp, Homo sapiens
tacttgacctccta

SEQ ID NO: 2116063 - DNA, 16 bp, Homo sapiens
tacttgagctgtatat

SEQ ID NO: 2116064 - DNA, 14 bp, Homo sapiens
tacttgtaatttct

SEQ ID NO: 2116065 - DNA, 19 bp, Homo sapiens
tacttgtggacacagctct

SEQ ID NO: 2116066 - DNA, 19 bp, Homo sapiens
tacttgttacctttcccat

SEQ ID NO: 2116067 - DNA, 20 bp, Homo sapiens
tactttacactctctgtaca

SEQ ID NO: 2116068 - DNA, 15 bp, Homo sapiens
tactttattagagta

SEQ ID NO: 2116069 - DNA, 19 bp, Homo sapiens
tactttgaaaccagaaaat

SEQ ID NO: 2116070 - DNA, 17 bp, Homo sapiens
tactttgccttttgcaa

SEQ ID NO: 2116071 - DNA, 20 bp, Homo sapiens
tacttttgttctgtattttc

SEQ ID NO: 2116072 - DNA, 20 bp, Homo sapiens
tactttttatactccataca

SEQ ID NO: 2116073 - DNA, 18 bp, Homo sapiens
tagaaaaatctcattccc

SEQ ID NO: 2116074 - DNA, 20 bp, Homo sapiens
tagaaaactgaaaatctaat

SEQ ID NO: 2116075 - DNA, 21 bp, Homo sapiens
tagaaaagaaaaaaaaaatat

SEQ ID NO: 2116076 - DNA, 13 bp, Homo sapiens
tagaaacatgaca

SEQ ID NO: 2116077 - DNA, 16 bp, Homo sapiens
tagaaacatgacactg

SEQ ID NO: 2116078 - DNA, 13 bp, Homo sapiens
tagaaactgagga

SEQ ID NO: 2116079 - DNA, 20 bp, Homo sapiens
tagaaactgaggagtagctg

SEQ ID NO: 2116080 - DNA, 14 bp, Homo sapiens
tagaaagaagccca

SEQ ID NO: 2116081 - DNA, 21 bp, Homo sapiens
tagaaagaagcccaatattat

SEQ ID NO: 2116082 - DNA, 23 bp, Homo sapiens
tagaaagaagcccaatattataa

SEQ ID NO: 2116083 - DNA, 23 bp, Homo sapiens
tagaaagctgtttatttattcac

SEQ ID NO: 2116084 - DNA, 11 bp, Homo sapiens
tagaaataagt

SEQ ID NO: 2116085 - DNA, 16 bp, Homo sapiens
tagaaataagtggtta

SEQ ID NO: 2116086 - DNA, 11 bp, Homo sapiens
tagaaatcata

SEQ ID NO: 2116087 - DNA, 13 bp, Homo sapiens
tagaaatcatttt

SEQ ID NO: 2116088 - DNA, 19 bp, Homo sapiens
tagaaatgtaacttttgta

SEQ ID NO: 2116089 - DNA, 18 bp, Homo sapiens
tagaaatgtatcctgata

SEQ ID NO: 2116090 - DNA, 17 bp, Homo sapiens
tagaacaatagctattg

SEQ ID NO: 2116091 - DNA, 22 bp, Homo sapiens
tagaacaatagctattgcatgt

SEQ ID NO: 2116092 - DNA, 15 bp, Homo sapiens
tagaacacccactgg

SEQ ID NO: 2116093 - DNA, 16 bp, Homo sapiens
tagaacacccactggc

SEQ ID NO: 2116094 - DNA, 18 bp, Homo sapiens
tagaacacccactggcca

SEQ ID NO: 2116095 - DNA, 21 bp, Homo sapiens
taataaaaaatggaaagaatc

SEQ ID NO: 2116096 - DNA, 12 bp, Homo sapiens
taataaaattga

SEQ ID NO: 2116097 - DNA, 13 bp, Homo sapiens
taataaactctct

SEQ ID NO: 2116098 - DNA, 23 bp, Homo sapiens
taataaacttagaataaaattgt

SEQ ID NO: 2116099 - DNA, 21 bp, Homo sapiens
taataaattgtttggcttcct

SEQ ID NO: 2116100 - DNA, 19 bp, Homo sapiens
taataactagatctcctgt

SEQ ID NO: 2116101 - DNA, 21 bp, Homo sapiens
taataagaaagtataaagtca

SEQ ID NO: 2116102 - DNA, 13 bp, Homo sapiens
taataagataatg

SEQ ID NO: 2116103 - DNA, 21 bp, Homo sapiens
taataagtttgatcaaatcta

SEQ ID NO: 2116104 - DNA, 22 bp, Homo sapiens
taataatttagacttcaagcat

SEQ ID NO: 2116105 - DNA, 21 bp, Homo sapiens
taataatttcatccctattta

SEQ ID NO: 2116106 - DNA, 19 bp, Homo sapiens
taatacagcagtgtcatca

SEQ ID NO: 2116107 - DNA, 13 bp, Homo sapiens
taatacctctgtg

SEQ ID NO: 2116108 - DNA, 18 bp, Homo sapiens
taatacctttggaaaaat

SEQ ID NO: 2116109 - DNA, 17 bp, Homo sapiens
taatacttcatttggtg

SEQ ID NO: 2116110 - DNA, 15 bp, Homo sapiens
taatagaaaactgaa

SEQ ID NO: 2116111 - DNA, 21 bp, Homo sapiens
taatagaagaacatccaagga

SEQ ID NO: 2116112 - DNA, 17 bp, Homo sapiens
taatagactaaatgaaa

SEQ ID NO: 2116113 - DNA, 22 bp, Homo sapiens
taatagatgtttgatagatttt

SEQ ID NO: 2116114 - DNA, 21 bp, Homo sapiens
taatagcttttattgtataaa

SEQ ID NO: 2116115 - DNA, 21 bp, Homo sapiens
taatagttcaggtaacaggca

SEQ ID NO: 2116116 - DNA, 14 bp, Homo sapiens
taatataagaatca

SEQ ID NO: 2116117 - DNA, 16 bp, Homo sapiens
taatatactatattta

SEQ ID NO: 2116118 - DNA, 18 bp, Homo sapiens
taatatccactgcaatac

SEQ ID NO: 2116119 - DNA, 21 bp, Homo sapiens
taatatctgagaagtgtatat

SEQ ID NO: 2116120 - DNA, 22 bp, Homo sapiens
taatatctgagaagtgtatata

SEQ ID NO: 2116121 - DNA, 15 bp, Homo sapiens
taatatcttgaagaa

SEQ ID NO: 2116122 - DNA, 18 bp, Homo sapiens
taatatcttgaagaatat

SEQ ID NO: 2116123 - DNA, 22 bp, Homo sapiens
taatatcttgaagaatattgtt

SEQ ID NO: 2116124 - DNA, 12 bp, Homo sapiens
taatatcttgct

SEQ ID NO: 2116125 - DNA, 22 bp, Homo sapiens
taatatcttgctggattaatgt

SEQ ID NO: 2116126 - DNA, 13 bp, Homo sapiens
taatatggaacct

SEQ ID NO: 2116127 - DNA, 16 bp, Homo sapiens
taatatggcaaaaatg

SEQ ID NO: 2116128 - DNA, 14 bp, Homo sapiens
taatatgtctgcca

SEQ ID NO: 2116129 - DNA, 21 bp, Homo sapiens
taatatgttaacctcagtgtc

SEQ ID NO: 2116130 - DNA, 19 bp, Homo sapiens
taatatgttcattaaattt

SEQ ID NO: 2116131 - DNA, 17 bp, Homo sapiens
taatatgtttgaggtta

SEQ ID NO: 2116132 - DNA, 13 bp, Homo sapiens
taatattattggg

SEQ ID NO: 2116133 - DNA, 15 bp, Homo sapiens
taatattattggggt

SEQ ID NO: 2116134 - DNA, 17 bp, Homo sapiens
taatattattggggttg

SEQ ID NO: 2116135 - DNA, 17 bp, Homo sapiens
taatattcctatatgta

SEQ ID NO: 2116136 - DNA, 13 bp, Homo sapiens
taatatttaaaca

SEQ ID NO: 2116137 - DNA, 21 bp, Homo sapiens
taatatttaaacagcagtgtt

SEQ ID NO: 2116138 - DNA, 12 bp, Homo sapiens
taatattttgta

SEQ ID NO: 2116139 - DNA, 14 bp, Homo sapiens
taatatttttaatt

SEQ ID NO: 2116140 - DNA, 15 bp, Homo sapiens
taatatttttaatta

SEQ ID NO: 2116141 - DNA, 12 bp, Homo sapiens
taatcaaagcta

SEQ ID NO: 2116142 - DNA, 16 bp, Homo sapiens
taatcaagaatattca

SEQ ID NO: 2116143 - DNA, 11 bp, Homo sapiens
taatcagcctc

SEQ ID NO: 2116144 - DNA, 15 bp, Homo sapiens
taatcaggcagcctt

SEQ ID NO: 2116145 - DNA, 20 bp, Homo sapiens
taatcaggttgttaatgttg

SEQ ID NO: 2116146 - DNA, 21 bp, Homo sapiens
taatcccagcatgctgagatt

SEQ ID NO: 2116147 - DNA, 12 bp, Homo sapiens
taatcccagcta

SEQ ID NO: 2116148 - DNA, 14 bp, Homo sapiens
taatcccagctact

SEQ ID NO: 2116149 - DNA, 19 bp, Homo sapiens
taatcccagctacttggga

SEQ ID NO: 2116150 - DNA, 19 bp, Homo sapiens
taatcctattaaaacacag

SEQ ID NO: 2116151 - DNA, 21 bp, Homo sapiens
taatcctattaaaacacagct

SEQ ID NO: 2116152 - DNA, 22 bp, Homo sapiens
taatcctcaacaacaaaccaaa

SEQ ID NO: 2116153 - DNA, 16 bp, Homo sapiens
taatcggcccacagct

SEQ ID NO: 2116154 - DNA, 17 bp, Homo sapiens
taatcgttatgtgtgta

SEQ ID NO: 2116155 - DNA, 19 bp, Homo sapiens
taatcgttatgtgtgtata

SEQ ID NO: 2116156 - DNA, 14 bp, Homo sapiens
taatctagaacaca

SEQ ID NO: 2116157 - DNA, 18 bp, Homo sapiens
taatctcctcttttatct

SEQ ID NO: 2116158 - DNA, 17 bp, Homo sapiens
taatctggactcctctg

SEQ ID NO: 2116159 - DNA, 21 bp, Homo sapiens
taatctggactcctctgtcca

SEQ ID NO: 2116160 - DNA, 16 bp, Homo sapiens
taatctgtagggctgg

SEQ ID NO: 2116161 - DNA, 23 bp, Homo sapiens
taatctttctttacctgagacca

SEQ ID NO: 2116162 - DNA, 13 bp, Homo sapiens
taatgaaaatgtc

SEQ ID NO: 2116163 - DNA, 13 bp, Homo sapiens
taatgaaacaaag

SEQ ID NO: 2116164 - DNA, 17 bp, Homo sapiens
taatgaaacaaagagtt

SEQ ID NO: 2116165 - DNA, 23 bp, Homo sapiens
taatttttgatactaagcattga

SEQ ID NO: 2116166 - DNA, 18 bp, Homo sapiens
taattttttaaatgaaaa

SEQ ID NO: 2116167 - DNA, 22 bp, Homo sapiens
taatttttttcaatatttatta

SEQ ID NO: 2116168 - DNA, 15 bp, Homo sapiens
tacaaaaacaaaaca

SEQ ID NO: 2116169 - DNA, 14 bp, Homo sapiens
tacaaaaacacagc

SEQ ID NO: 2116170 - DNA, 18 bp, Homo sapiens
tacaaaaacacagcaagg

SEQ ID NO: 2116171 - DNA, 18 bp, Homo sapiens
tacaaaaacatacttcaa

SEQ ID NO: 2116172 - DNA, 20 bp, Homo sapiens
tacaaaaacatacttcaaaa

SEQ ID NO: 2116173 - DNA, 19 bp, Homo sapiens
tacaaaacctgatgttaaa

SEQ ID NO: 2116174 - DNA, 23 bp, Homo sapiens
tacaaaataaaattatggtgaaa

SEQ ID NO: 2116175 - DNA, 14 bp, Homo sapiens
tacaaaataattta

SEQ ID NO: 2116176 - DNA, 15 bp, Homo sapiens
tacaaaataatttaa

SEQ ID NO: 2116177 - DNA, 18 bp, Homo sapiens
tacaaaataatttaacta

SEQ ID NO: 2116178 - DNA, 10 bp, Homo sapiens
tacaaaatgg

SEQ ID NO: 2116179 - DNA, 19 bp, Homo sapiens
tacaaaatttgaaatttag

SEQ ID NO: 2116180 - DNA, 12 bp, Homo sapiens
tacaaacatatt

SEQ ID NO: 2116181 - DNA, 20 bp, Homo sapiens
tacaaagagaagcaaagtgg

SEQ ID NO: 2116182 - DNA, 17 bp, Homo sapiens
tacaaatactcttagga

SEQ ID NO: 2116183 - DNA, 23 bp, Homo sapiens
tacaaatactcttaggaagagaa

SEQ ID NO: 2116184 - DNA, 17 bp, Homo sapiens
tacaaatactgcctagt

SEQ ID NO: 2116185 - DNA, 13 bp, Homo sapiens
tacaaattatcat

SEQ ID NO: 2116186 - DNA, 13 bp, Homo sapiens
tacaaattgttca

SEQ ID NO: 2116187 - DNA, 16 bp, Homo sapiens
tacaaccagagccccc

SEQ ID NO: 2116188 - DNA, 14 bp, Homo sapiens
tacaagaagcattt

SEQ ID NO: 2116189 - DNA, 21 bp, Homo sapiens
tacaagaagcattttgtaagt

SEQ ID NO: 2116190 - DNA, 17 bp, Homo sapiens
tacaagaattgtccatg

SEQ ID NO: 2116191 - DNA, 22 bp, Homo sapiens
tacaagaattgtccatgtgctt

SEQ ID NO: 2116192 - DNA, 18 bp, Homo sapiens
tacaagagccatgtacca

SEQ ID NO: 2116193 - DNA, 16 bp, Homo sapiens
tacaagcatatttgag

SEQ ID NO: 2116194 - DNA, 22 bp, Homo sapiens
tacaagccactaccttctgacc

SEQ ID NO: 2116195 - DNA, 18 bp, Homo sapiens
tacaagcgtgagccactg

SEQ ID NO: 2116196 - DNA, 18 bp, Homo sapiens
tacaagggtctagggaga

SEQ ID NO: 2116197 - DNA, 19 bp, Homo sapiens
tacaaggtttggcaaaaaa

SEQ ID NO: 2116198 - DNA, 21 bp, Homo sapiens
tacaagtagaatggcagctgg

SEQ ID NO: 2116199 - DNA, 13 bp, Homo sapiens
tacaagtgtatat

SEQ ID NO: 2116200 - DNA, 14 bp, Homo sapiens
tacaagtgtatatc

SEQ ID NO: 2116201 - DNA, 15 bp, Homo sapiens
tacaagtgtatatca

SEQ ID NO: 2116202 - DNA, 13 bp, Homo sapiens
tacaataaagtct

SEQ ID NO: 2116203 - DNA, 15 bp, Homo sapiens
tacaataaataatct

SEQ ID NO: 2116204 - DNA, 14 bp, Homo sapiens
tacaataaatattc

SEQ ID NO: 2116205 - DNA, 18 bp, Homo sapiens
tacaataaatattctgca

SEQ ID NO: 2116206 - DNA, 15 bp, Homo sapiens
tacaataaatgctga

SEQ ID NO: 2116207 - DNA, 16 bp, Homo sapiens
tacaataataaatcct

SEQ ID NO: 2116208 - DNA, 13 bp, Homo sapiens
tacaataatgagt

SEQ ID NO: 2116209 - DNA, 19 bp, Homo sapiens
tacaataccagatcactca

SEQ ID NO: 2116210 - DNA, 12 bp, Homo sapiens
tacaatatttaa

SEQ ID NO: 2116211 - DNA, 14 bp, Homo sapiens
tacaatatttaaaa

SEQ ID NO: 2116212 - DNA, 20 bp, Homo sapiens
tacaatgttctgttgtaaag

SEQ ID NO: 2116213 - DNA, 19 bp, Homo sapiens
tacaattaaagctgttatt

SEQ ID NO: 2116214 - DNA, 18 bp, Homo sapiens
tacacaaaaaagtataga

SEQ ID NO: 2116215 - DNA, 20 bp, Homo sapiens
tacacaacatttatttcaaa

SEQ ID NO: 2116216 - DNA, 16 bp, Homo sapiens
tacacacacagatgtg

SEQ ID NO: 2116217 - DNA, 16 bp, Homo sapiens
tacacactcaaatcaa

SEQ ID NO: 2116218 - DNA, 17 bp, Homo sapiens
tacacactcaaatcaag

SEQ ID NO: 2116219 - DNA, 13 bp, Homo sapiens
tacacagcctgga

SEQ ID NO: 2116220 - DNA, 15 bp, Homo sapiens
tacacagcctggact

SEQ ID NO: 2116221 - DNA, 23 bp, Homo sapiens
tacacaggatcctattctcacca

SEQ ID NO: 2116222 - DNA, 22 bp, Homo sapiens
tacacagtaaaaacttgtacta

SEQ ID NO: 2116223 - DNA, 21 bp, Homo sapiens
tacacataagaccgtgtccca

SEQ ID NO: 2116224 - DNA, 22 bp, Homo sapiens
tacacataagaccgtgtcccaa

SEQ ID NO: 2116225 - DNA, 21 bp, Homo sapiens
tacacatccccagccagaagt

SEQ ID NO: 2116226 - DNA, 15 bp, Homo sapiens
tacacatggatgcac

SEQ ID NO: 2116227 - DNA, 12 bp, Homo sapiens
tacaccactctg

SEQ ID NO: 2116228 - DNA, 17 bp, Homo sapiens
tacaccactctggcagc

SEQ ID NO: 2116229 - DNA, 21 bp, Homo sapiens
tacaccactctggcagccaca

SEQ ID NO: 2116230 - DNA, 19 bp, Homo sapiens
tacaccatgtttgagctca

SEQ ID NO: 2116231 - DNA, 17 bp, Homo sapiens
tacacctatgtcatttc

SEQ ID NO: 2116232 - DNA, 18 bp, Homo sapiens
tacacctgaggctgaggc

SEQ ID NO: 2116233 - DNA, 15 bp, Homo sapiens
tacaccttagcagct

SEQ ID NO: 2116234 - DNA, 20 bp, Homo sapiens
tacactaagggtgtaagtaa

SEQ ID NO: 2116235 - DNA, 12 bp, Homo sapiens
tacactcctgct

SEQ ID NO: 2116236 - DNA, 16 bp, Homo sapiens
tacactctctgtacaa

SEQ ID NO: 2116237 - DNA, 18 bp, Homo sapiens
tacactctctgtacaaaa

SEQ ID NO: 2116238 - DNA, 22 bp, Homo sapiens
tacactctctgtacaaaaacaa

SEQ ID NO: 2116239 - DNA, 12 bp, Homo sapiens
tacactcttata

SEQ ID NO: 2116240 - DNA, 16 bp, Homo sapiens
tacactctttgtaaga

SEQ ID NO: 2116241 - DNA, 13 bp, Homo sapiens
tacacttggagcc

SEQ ID NO: 2116242 - DNA, 17 bp, Homo sapiens
tacacttgtataaatgt

SEQ ID NO: 2116243 - DNA, 18 bp, Homo sapiens
tacacttgtataaatgta

SEQ ID NO: 2116244 - DNA, 20 bp, Homo sapiens
tacacttgtataaatgtata

SEQ ID NO: 2116245 - DNA, 21 bp, Homo sapiens
tacacttgtataaatgtatat

SEQ ID NO: 2116246 - DNA, 14 bp, Homo sapiens
tacagaacaaagaa

SEQ ID NO: 2116247 - DNA, 18 bp, Homo sapiens
tacagaataatgtgttaa

SEQ ID NO: 2116248 - DNA, 21 bp, Homo sapiens
tacagaatttttaatgacttt

SEQ ID NO: 2116249 - DNA, 19 bp, Homo sapiens
tacagacactaagttatag

SEQ ID NO: 2116250 - DNA, 15 bp, Homo sapiens
tacagacgtctcaag

SEQ ID NO: 2116251 - DNA, 14 bp, Homo sapiens
tacagacttctcca

SEQ ID NO: 2116252 - DNA, 19 bp, Homo sapiens
tacagagaaattctgtggt

SEQ ID NO: 2116253 - DNA, 20 bp, Homo sapiens
tacagagaaattctgtggtg

SEQ ID NO: 2116254 - DNA, 15 bp, Homo sapiens
tacagagaagtgaat

SEQ ID NO: 2116255 - DNA, 14 bp, Homo sapiens
tacagagcaggcca

SEQ ID NO: 2116256 - DNA, 16 bp, Homo sapiens
tacagataatttattt

SEQ ID NO: 2116257 - DNA, 20 bp, Homo sapiens
tacagataatttattttgta

SEQ ID NO: 2116258 - DNA, 18 bp, Homo sapiens
tacagatgagattccctc

SEQ ID NO: 2116259 - DNA, 23 bp, Homo sapiens
tacagcaacaggaatctcagaga

SEQ ID NO: 2116260 - DNA, 22 bp, Homo sapiens
tacagcacatcttttttttgga

SEQ ID NO: 2116261 - DNA, 13 bp, Homo sapiens
tacagccagaagc

SEQ ID NO: 2116262 - DNA, 14 bp, Homo sapiens
tacagccagaagcc

SEQ ID NO: 2116263 - DNA, 19 bp, Homo sapiens
tacagcgagaggcagagaa

SEQ ID NO: 2116264 - DNA, 20 bp, Homo sapiens
tacagcgagaggcagagaaa

SEQ ID NO: 2116265 - DNA, 21 bp, Homo sapiens
tacagctcagaagtttcttct

SEQ ID NO: 2116266 - DNA, 17 bp, Homo sapiens
tacaggaaaagctgctg

SEQ ID NO: 2116267 - DNA, 18 bp, Homo sapiens
tacaggaggttgtggatg

SEQ ID NO: 2116268 - DNA, 19 bp, Homo sapiens
tacagggtagataacctgt

SEQ ID NO: 2116269 - DNA, 17 bp, Homo sapiens
tacaggtatcaggcaca

SEQ ID NO: 2116270 - DNA, 18 bp, Homo sapiens
tacaggtatcaggcacag

SEQ ID NO: 2116271 - DNA, 16 bp, Homo sapiens
tacagtaaagtttaaa

SEQ ID NO: 2116272 - DNA, 13 bp, Homo sapiens
tacagtaaataaa

SEQ ID NO: 2116273 - DNA, 15 bp, Homo sapiens
tacagtaaataaatt

SEQ ID NO: 2116274 - DNA, 18 bp, Homo sapiens
tacagtaagctgctctat

SEQ ID NO: 2116275 - DNA, 21 bp, Homo sapiens
tacagtaagctgctctattgt

SEQ ID NO: 2116276 - DNA, 17 bp, Homo sapiens
tacagtagcttaaataa

SEQ ID NO: 2116277 - DNA, 19 bp, Homo sapiens
tacagtagcttaaataaat

SEQ ID NO: 2116278 - DNA, 20 bp, Homo sapiens
tacagtagcttaaataaatt

SEQ ID NO: 2116279 - DNA, 21 bp, Homo sapiens
tacagtagcttaaataaattc

SEQ ID NO: 2116280 - DNA, 14 bp, Homo sapiens
tacccttctttaaa

SEQ ID NO: 2116281 - DNA, 18 bp, Homo sapiens
tacccttctttaaatcaa

SEQ ID NO: 2116282 - DNA, 21 bp, Homo sapiens
tacccttctttaaatcaaaag

SEQ ID NO: 2116283 - DNA, 22 bp, Homo sapiens
tacccttttctgaccaaagaga

SEQ ID NO: 2116284 - DNA, 18 bp, Homo sapiens
taccgaggagctaaacat

SEQ ID NO: 2116285 - DNA, 12 bp, Homo sapiens
taccgctgggga

SEQ ID NO: 2116286 - DNA, 18 bp, Homo sapiens
tacctaccacagtgtctg

SEQ ID NO: 2116287 - DNA, 13 bp, Homo sapiens
tacctagatttac

SEQ ID NO: 2116288 - DNA, 17 bp, Homo sapiens
tacctataatgtgtgta

SEQ ID NO: 2116289 - DNA, 18 bp, Homo sapiens
tacctataatgtgtgtat

SEQ ID NO: 2116290 - DNA, 16 bp, Homo sapiens
tacctcagcctagacc

SEQ ID NO: 2116291 - DNA, 15 bp, Homo sapiens
tacctcccctgccag

SEQ ID NO: 2116292 - DNA, 17 bp, Homo sapiens
tacctcccctgccaggg

SEQ ID NO: 2116293 - DNA, 22 bp, Homo sapiens
tacctcccctgccagggctcgg

SEQ ID NO: 2116294 - DNA, 15 bp, Homo sapiens
tacctcctgcccagg

SEQ ID NO: 2116295 - DNA, 17 bp, Homo sapiens
tacctctcttatagaat

SEQ ID NO: 2116296 - DNA, 17 bp, Homo sapiens
tacctctgaccaacagg

SEQ ID NO: 2116297 - DNA, 13 bp, Homo sapiens
tacctgagaccag

SEQ ID NO: 2116298 - DNA, 21 bp, Homo sapiens
tacctgaggcctatctgagac

SEQ ID NO: 2116299 - DNA, 21 bp, Homo sapiens
tacctgcatgtgttgtacaat

SEQ ID NO: 2116300 - DNA, 11 bp, Homo sapiens
tacctgggaaa

SEQ ID NO: 2116301 - DNA, 18 bp, Homo sapiens
tacctgggaaaggaccca

SEQ ID NO: 2116302 - DNA, 19 bp, Homo sapiens
tacctgggaaaggacccac

SEQ ID NO: 2116303 - DNA, 22 bp, Homo sapiens
tacctgtgtattttttaaagct

SEQ ID NO: 2116304 - DNA, 21 bp, Homo sapiens
tacctgtgtttcttgcctcat

SEQ ID NO: 2116305 - DNA, 22 bp, Homo sapiens
tacctgttactattatctgtgc

SEQ ID NO: 2116306 - DNA, 23 bp, Homo sapiens
tacctgttactattatctgtgct

SEQ ID NO: 2116307 - DNA, 21 bp, Homo sapiens
taccttaaatctgcctttgtt

SEQ ID NO: 2116308 - DNA, 20 bp, Homo sapiens
taccttagattagctctgga

SEQ ID NO: 2116309 - DNA, 22 bp, Homo sapiens
taccttagattagctctggacc

SEQ ID NO: 2116310 - DNA, 18 bp, Homo sapiens
taccttccttaagccagg

SEQ ID NO: 2116311 - DNA, 22 bp, Homo sapiens
taccttctcaaaagattgtttt

SEQ ID NO: 2116312 - DNA, 19 bp, Homo sapiens
taccttctctacccatctc

SEQ ID NO: 2116313 - DNA, 14 bp, Homo sapiens
taccttctggttgc

SEQ ID NO: 2116314 - DNA, 15 bp, Homo sapiens
tacctttaaaatcat

SEQ ID NO: 2116315 - DNA, 18 bp, Homo sapiens
tacctttcccatgctgaa

SEQ ID NO: 2116316 - DNA, 12 bp, Homo sapiens
tacctttggaaa

SEQ ID NO: 2116317 - DNA, 22 bp, Homo sapiens
tacctttggaaaaatcttgggc

SEQ ID NO: 2116318 - DNA, 18 bp, Homo sapiens
tacctttttttctctcct

SEQ ID NO: 2116319 - DNA, 23 bp, Homo sapiens
tacgccaaagtgcagcccttcct

SEQ ID NO: 2116320 - DNA, 19 bp, Homo sapiens
tacgctctcctttctttct

SEQ ID NO: 2116321 - DNA, 14 bp, Homo sapiens
tacgctctctgtct

SEQ ID NO: 2116322 - DNA, 17 bp, Homo sapiens
tacgcttgcttgtcttt

SEQ ID NO: 2116323 - DNA, 15 bp, Homo sapiens
tacggttgcttcacc

SEQ ID NO: 2116324 - DNA, 16 bp, Homo sapiens
tacgtacatgtgaggc

SEQ ID NO: 2116325 - DNA, 14 bp, Homo sapiens
tacgtatcatttct

SEQ ID NO: 2116326 - DNA, 13 bp, Homo sapiens
tacgtatgagacg

SEQ ID NO: 2116327 - DNA, 16 bp, Homo sapiens
tacgtctgacaggcaa

SEQ ID NO: 2116328 - DNA, 14 bp, Homo sapiens
tacgtgagccaggt

SEQ ID NO: 2116329 - DNA, 11 bp, Homo sapiens
tactaaaagaa

SEQ ID NO: 2116330 - DNA, 20 bp, Homo sapiens
tactaaaagttcttctccaa

SEQ ID NO: 2116331 - DNA, 11 bp, Homo sapiens
tactaaagcag

SEQ ID NO: 2116332 - DNA, 20 bp, Homo sapiens
tactaagcattgaatggcta

SEQ ID NO: 2116333 - DNA, 15 bp, Homo sapiens
tactaccaatgccaa

SEQ ID NO: 2116334 - DNA, 18 bp, Homo sapiens
ctttttagtcttttactc

SEQ ID NO: 2116335 - DNA, 13 bp, Homo sapiens
ctttttatactcc

SEQ ID NO: 2116336 - DNA, 16 bp, Homo sapiens
ctttttcaacttggaa

SEQ ID NO: 2116337 - DNA, 14 bp, Homo sapiens
ctttttctaccttt

SEQ ID NO: 2116338 - DNA, 19 bp, Homo sapiens
ctttttctggaaattttgt

SEQ ID NO: 2116339 - DNA, 14 bp, Homo sapiens
ctttttctgtctct

SEQ ID NO: 2116340 - DNA, 15 bp, Homo sapiens
cttttttcttgagta

SEQ ID NO: 2116341 - DNA, 19 bp, Homo sapiens
ctttttttaataatttcat

SEQ ID NO: 2116342 - DNA, 23 bp, Homo sapiens
cttttttttatacacaacattta

SEQ ID NO: 2116343 - DNA, 15 bp, Homo sapiens
gaaaaaaaagaaagc

SEQ ID NO: 2116344 - DNA, 19 bp, Homo sapiens
gaaaaaaaagtttcagaga

SEQ ID NO: 2116345 - DNA, 22 bp, Homo sapiens
gaaaaaaaagtttcagagaagt

SEQ ID NO: 2116346 - DNA, 16 bp, Homo sapiens
gaaaaaaaatatatat

SEQ ID NO: 2116347 - DNA, 18 bp, Homo sapiens
gaaaaaaagttgctttgt

SEQ ID NO: 2116348 - DNA, 16 bp, Homo sapiens
gaaaaaaatgactaaa

SEQ ID NO: 2116349 - DNA, 15 bp, Homo sapiens
gaaaaaagagaaaaa

SEQ ID NO: 2116350 - DNA, 21 bp, Homo sapiens
gaaaaaattaagagatacatt

SEQ ID NO: 2116351 - DNA, 23 bp, Homo sapiens
gaaaaacaaactcgttttttaca

SEQ ID NO: 2116352 - DNA, 17 bp, Homo sapiens
gaaaaacacggcagctg

SEQ ID NO: 2116353 - DNA, 19 bp, Homo sapiens
gaaaaactgatcaaaaata

SEQ ID NO: 2116354 - DNA, 22 bp, Homo sapiens
gaaaaactgatcaaaaataaac

SEQ ID NO: 2116355 - DNA, 12 bp, Homo sapiens
gaaaaagaaatg

SEQ ID NO: 2116356 - DNA, 13 bp, Homo sapiens
gaaaaagaaatgc

SEQ ID NO: 2116357 - DNA, 14 bp, Homo sapiens
gaaaaagaagaatc

SEQ ID NO: 2116358 - DNA, 22 bp, Homo sapiens
gaaaaataccatgtctctaagc

SEQ ID NO: 2116359 - DNA, 10 bp, Homo sapiens
gaaaaatatg

SEQ ID NO: 2116360 - DNA, 14 bp, Homo sapiens
gaaaaatatttaag

SEQ ID NO: 2116361 - DNA, 18 bp, Homo sapiens
gaaaacataatataagaa

SEQ ID NO: 2116362 - DNA, 19 bp, Homo sapiens
gaaaacatcactgaaatgc

SEQ ID NO: 2116363 - DNA, 15 bp, Homo sapiens
gaaaacattcatcca

SEQ ID NO: 2116364 - DNA, 12 bp, Homo sapiens
gaaaacccagag

SEQ ID NO: 2116365 - DNA, 22 bp, Homo sapiens
gaaaacccagagaggaatcaga

SEQ ID NO: 2116366 - DNA, 23 bp, Homo sapiens
gaaaacctcacttgaaggcccag

SEQ ID NO: 2116367 - DNA, 20 bp, Homo sapiens
gaaaacgttgacccctttcc

SEQ ID NO: 2116368 - DNA, 22 bp, Homo sapiens
gaaaacgttgacccctttcccc

SEQ ID NO: 2116369 - DNA, 14 bp, Homo sapiens
gaaaactattttaa

SEQ ID NO: 2116370 - DNA, 24 bp, Homo sapiens
gaaaactattttaaagctgacttt

SEQ ID NO: 2116371 - DNA, 20 bp, Homo sapiens
gaaaactcctttagcaggtg

SEQ ID NO: 2116372 - DNA, 16 bp, Homo sapiens
gaaaactgaaaatcta

SEQ ID NO: 2116373 - DNA, 20 bp, Homo sapiens
gaaaactgaaaatctaatat

SEQ ID NO: 2116374 - DNA, 16 bp, Homo sapiens
gaaaactgtaaataca

SEQ ID NO: 2116375 - DNA, 21 bp, Homo sapiens
gaaaactgtaaatacaaaata

SEQ ID NO: 2116376 - DNA, 23 bp, Homo sapiens
gaaaactgtttatggtattttcg

SEQ ID NO: 2116377 - DNA, 16 bp, Homo sapiens
gaaaacttgaatctgt

SEQ ID NO: 2116378 - DNA, 12 bp, Homo sapiens
gaaaactttaaa

SEQ ID NO: 2116379 - DNA, 16 bp, Homo sapiens
gaaaactttaaagcgt

SEQ ID NO: 2116380 - DNA, 14 bp, Homo sapiens
gaaaagaaggctgc

SEQ ID NO: 2116381 - DNA, 16 bp, Homo sapiens
gaaaagaatacagaaa

SEQ ID NO: 2116382 - DNA, 22 bp, Homo sapiens
gaaaagaatccctgcagcctgg

SEQ ID NO: 2116383 - DNA, 14 bp, Homo sapiens
gaaaagactccaaa

SEQ ID NO: 2116384 - DNA, 17 bp, Homo sapiens
gaaaagactccaaagaa

SEQ ID NO: 2116385 - DNA, 18 bp, Homo sapiens
gaaaagactccaaagaaa

SEQ ID NO: 2116386 - DNA, 21 bp, Homo sapiens
gaaaagactccaaagaaatgt

SEQ ID NO: 2116387 - DNA, 20 bp, Homo sapiens
gaaaagaggagtttcgaggt

SEQ ID NO: 2116388 - DNA, 21 bp, Homo sapiens
gaaaagaggagtttcgaggta

SEQ ID NO: 2116389 - DNA, 21 bp, Homo sapiens
gaaaagattaaaattagtgag

SEQ ID NO: 2116390 - DNA, 19 bp, Homo sapiens
gaaaagcagacgcagcagc

SEQ ID NO: 2116391 - DNA, 18 bp, Homo sapiens
gaaaagcatcagaaagag

SEQ ID NO: 2116392 - DNA, 12 bp, Homo sapiens
gaaaagcccagt

SEQ ID NO: 2116393 - DNA, 11 bp, Homo sapiens
gaaaaggcagg

SEQ ID NO: 2116394 - DNA, 19 bp, Homo sapiens
gaaaagggtcttcttggca

SEQ ID NO: 2116395 - DNA, 23 bp, Homo sapiens
gaaaaggtttatgaaaaagaaga

SEQ ID NO: 2116396 - DNA, 15 bp, Homo sapiens
gaaaagtagaattat

SEQ ID NO: 2116397 - DNA, 17 bp, Homo sapiens
gaaaagtagaattatat

SEQ ID NO: 2116398 - DNA, 15 bp, Homo sapiens
gaaaagtcacacaga

SEQ ID NO: 2116399 - DNA, 14 bp, Homo sapiens
gaaaagtgcaatgc

SEQ ID NO: 2116400 - DNA, 14 bp, Homo sapiens
gaaaagtgctgttt

SEQ ID NO: 2116401 - DNA, 18 bp, Homo sapiens
gaaaagtgcttagaaagt

SEQ ID NO: 2116402 - DNA, 18 bp, Homo sapiens
gaaaataaattttgaatg

SEQ ID NO: 2116403 - DNA, 17 bp, Homo sapiens
gaaaataattgttccaa

SEQ ID NO: 2116404 - DNA, 17 bp, Homo sapiens
gaaaataatttgttgta

SEQ ID NO: 2116405 - DNA, 20 bp, Homo sapiens
gaaaataatttgttgtactt

SEQ ID NO: 2116406 - DNA, 20 bp, Homo sapiens
gaaaatagtaaatgctttgt

SEQ ID NO: 2116407 - DNA, 18 bp, Homo sapiens
gaaaatatttgtatcaca

SEQ ID NO: 2116408 - DNA, 22 bp, Homo sapiens
gaaaatcagttatattctttaa

SEQ ID NO: 2116409 - DNA, 13 bp, Homo sapiens
gaaaatcctctgg

SEQ ID NO: 2116410 - DNA, 20 bp, Homo sapiens
gaaaatctaatattaaaaat

SEQ ID NO: 2116411 - DNA, 21 bp, Homo sapiens
gaaaatctaatattaaaaata

SEQ ID NO: 2116412 - DNA, 16 bp, Homo sapiens
gaaaatgcaaaatgaa

SEQ ID NO: 2116413 - DNA, 18 bp, Homo sapiens
gaaaatgcaacaacatgt

SEQ ID NO: 2116414 - DNA, 20 bp, Homo sapiens
gaaaatgcaacaacatgtat

SEQ ID NO: 2116415 - DNA, 15 bp, Homo sapiens
gaaaatgcattatgt

SEQ ID NO: 2116416 - DNA, 14 bp, Homo sapiens
gaaaatgcttctgt

SEQ ID NO: 2116417 - DNA, 14 bp, Homo sapiens
gaaaatgtaacttt

SEQ ID NO: 2116418 - DNA, 19 bp, Homo sapiens
gaaaatgtactgagatttt

SEQ ID NO: 2116419 - DNA, 23 bp, Homo sapiens
gaaaatgtctattcaaaatatca

SEQ ID NO: 2116420 - DNA, 13 bp, Homo sapiens
gaaaattaacact

SEQ ID NO: 2116421 - DNA, 15 bp, Homo sapiens
gaaaattaacactgc

SEQ ID NO: 2116422 - DNA, 18 bp, Homo sapiens
gaaaattaggatttcatg

SEQ ID NO: 2116423 - DNA, 12 bp, Homo sapiens
gaaaattagtaa

SEQ ID NO: 2116424 - DNA, 14 bp, Homo sapiens
gaaacaaaaacact

SEQ ID NO: 2116425 - DNA, 19 bp, Homo sapiens
gaaacaaaaacactaaaaa

SEQ ID NO: 2116426 - DNA, 23 bp, Homo sapiens
gaaacaaaaacactaaaaataaa

SEQ ID NO: 2116427 - DNA, 14 bp, Homo sapiens
gaaacaaataatca

SEQ ID NO: 2116428 - DNA, 19 bp, Homo sapiens
gaaacaaataatcacattg

SEQ ID NO: 2116429 - DNA, 18 bp, Homo sapiens
gaaacaacttgtgttcta

SEQ ID NO: 2116430 - DNA, 16 bp, Homo sapiens
gaaacacctcccaggg

SEQ ID NO: 2116431 - DNA, 17 bp, Homo sapiens
gaaacacctcccagggg

SEQ ID NO: 2116432 - DNA, 13 bp, Homo sapiens
gaaacactcttat

SEQ ID NO: 2116433 - DNA, 14 bp, Homo sapiens
gaaacagagacagg

SEQ ID NO: 2116434 - DNA, 19 bp, Homo sapiens
gaaacagagacaggcccaa

SEQ ID NO: 2116435 - DNA, 14 bp, Homo sapiens
gaaacagataccat

SEQ ID NO: 2116436 - DNA, 22 bp, Homo sapiens
gaaacagatgataaatatttat

SEQ ID NO: 2116437 - DNA, 12 bp, Homo sapiens
gaaacagcctgg

SEQ ID NO: 2116438 - DNA, 18 bp, Homo sapiens
gaaacagggacaaagaaa

SEQ ID NO: 2116439 - DNA, 17 bp, Homo sapiens
gaaacagggcagtgaca

SEQ ID NO: 2116440 - DNA, 17 bp, Homo sapiens
gaaacaggggatcaaag

SEQ ID NO: 2116441 - DNA, 22 bp, Homo sapiens
gaaacaggggatcaaagttcct

SEQ ID NO: 2116442 - DNA, 13 bp, Homo sapiens
gaaacatgacact

SEQ ID NO: 2116443 - DNA, 20 bp, Homo sapiens
gaaacatgactcgtatatgt

SEQ ID NO: 2116444 - DNA, 22 bp, Homo sapiens
gaaacattcacacagggctctt

SEQ ID NO: 2116445 - DNA, 19 bp, Homo sapiens
gaaacattccgaagaggga

SEQ ID NO: 2116446 - DNA, 17 bp, Homo sapiens
gaaaccacaggcccttg

SEQ ID NO: 2116447 - DNA, 19 bp, Homo sapiens
gaaaccacaggcccttggg

SEQ ID NO: 2116448 - DNA, 23 bp, Homo sapiens
gaaaccagccgaccggccctgcc

SEQ ID NO: 2116449 - DNA, 13 bp, Homo sapiens
gaagaaaagcact

SEQ ID NO: 2116450 - DNA, 20 bp, Homo sapiens
gaagaaacaggggatcaaag

SEQ ID NO: 2116451 - DNA, 23 bp, Homo sapiens
gaagaaacaggggatcaaagttc

SEQ ID NO: 2116452 - DNA, 15 bp, Homo sapiens
gaagaaaccccaagc

SEQ ID NO: 2116453 - DNA, 17 bp, Homo sapiens
gaagaaagaggtgaccc

SEQ ID NO: 2116454 - DNA, 12 bp, Homo sapiens
gaagaaatccat

SEQ ID NO: 2116455 - DNA, 14 bp, Homo sapiens
gaagaaattcctgt

SEQ ID NO: 2116456 - DNA, 20 bp, Homo sapiens
gaagaagaggcctagcctga

SEQ ID NO: 2116457 - DNA, 14 bp, Homo sapiens
gaagaatattgtta

SEQ ID NO: 2116458 - DNA, 18 bp, Homo sapiens
gaagaatcaagagggcag

SEQ ID NO: 2116459 - DNA, 22 bp, Homo sapiens
gaagaatgttaagacttgacag

SEQ ID NO: 2116460 - DNA, 23 bp, Homo sapiens
gaagaattgaacccaggaggtgg

SEQ ID NO: 2116461 - DNA, 15 bp, Homo sapiens
gaagaattttcagac

SEQ ID NO: 2116462 - DNA, 17 bp, Homo sapiens
gaagaattttcagaccc

SEQ ID NO: 2116463 - DNA, 23 bp, Homo sapiens
gaagacaaaccactgtacatata

SEQ ID NO: 2116464 - DNA, 21 bp, Homo sapiens
gaagacacagactgcgatttg

SEQ ID NO: 2116465 - DNA, 21 bp, Homo sapiens
gaagacatggagactcctgcc

SEQ ID NO: 2116466 - DNA, 14 bp, Homo sapiens
gaagaccacatcca

SEQ ID NO: 2116467 - DNA, 14 bp, Homo sapiens
gaagacccagcagg

SEQ ID NO: 2116468 - DNA, 21 bp, Homo sapiens
gaagacgtgatgccaggacca

SEQ ID NO: 2116469 - DNA, 23 bp, Homo sapiens
gaagactatcttactatttcaca

SEQ ID NO: 2116470 - DNA, 13 bp, Homo sapiens
gaagactgtggct

SEQ ID NO: 2116471 - DNA, 12 bp, Homo sapiens
gaagagaaattt

SEQ ID NO: 2116472 - DNA, 13 bp, Homo sapiens
gaagagaagctga

SEQ ID NO: 2116473 - DNA, 14 bp, Homo sapiens
gaagagaaggagca

SEQ ID NO: 2116474 - DNA, 11 bp, Homo sapiens
gaagagagaga

SEQ ID NO: 2116475 - DNA, 12 bp, Homo sapiens
gaagagaggcac

SEQ ID NO: 2116476 - DNA, 17 bp, Homo sapiens
gaagagaggcacctgct

SEQ ID NO: 2116477 - DNA, 12 bp, Homo sapiens
gaagagcagcct

SEQ ID NO: 2116478 - DNA, 15 bp, Homo sapiens
gaagagcaggcacat

SEQ ID NO: 2116479 - DNA, 13 bp, Homo sapiens
gaagagccctgag

SEQ ID NO: 2116480 - DNA, 14 bp, Homo sapiens
gaagagccctgagc

SEQ ID NO: 2116481 - DNA, 16 bp, Homo sapiens
gaagagccctgagctc

SEQ ID NO: 2116482 - DNA, 21 bp, Homo sapiens
gaagagccctgagctcaggct

SEQ ID NO: 2116483 - DNA, 15 bp, Homo sapiens
gaagagcctgactgt

SEQ ID NO: 2116484 - DNA, 12 bp, Homo sapiens
gaagagctcttc

SEQ ID NO: 2116485 - DNA, 21 bp, Homo sapiens
gaagagctcttcggtttctga

SEQ ID NO: 2116486 - DNA, 13 bp, Homo sapiens
gaagagctgttca

SEQ ID NO: 2116487 - DNA, 19 bp, Homo sapiens
gaagagggaggcttcctga

SEQ ID NO: 2116488 - DNA, 23 bp, Homo sapiens
gaagagggaggcttcctgactga

SEQ ID NO: 2116489 - DNA, 13 bp, Homo sapiens
gaagagggcctgt

SEQ ID NO: 2116490 - DNA, 16 bp, Homo sapiens
gaagagtcaggaaggg

SEQ ID NO: 2116491 - DNA, 21 bp, Homo sapiens
gaagagtttaactttgggccc

SEQ ID NO: 2116492 - DNA, 23 bp, Homo sapiens
gaagagtttaactttgggcccag

SEQ ID NO: 2116493 - DNA, 15 bp, Homo sapiens
gaagatcttttaaaa

SEQ ID NO: 2116494 - DNA, 13 bp, Homo sapiens
gaagatgaaagag

SEQ ID NO: 2116495 - DNA, 17 bp, Homo sapiens
gaagatgaaagaggagg

SEQ ID NO: 2116496 - DNA, 17 bp, Homo sapiens
gaagatgaagagaagct

SEQ ID NO: 2116497 - DNA, 24 bp, Homo sapiens
gaagatgcgagcgctatcttcaca

SEQ ID NO: 2116498 - DNA, 19 bp, Homo sapiens
gaagatggtagcagataaa

SEQ ID NO: 2116499 - DNA, 20 bp, Homo sapiens
gaagcaaaattataagaaga

SEQ ID NO: 2116500 - DNA, 14 bp, Homo sapiens
gaagcactgctgtg

SEQ ID NO: 2116501 - DNA, 13 bp, Homo sapiens
gaagcagcctcct

SEQ ID NO: 2116502 - DNA, 14 bp, Homo sapiens
gaagcagcctccta

SEQ ID NO: 2116503 - DNA, 12 bp, Homo sapiens
gaagcaggcaga

SEQ ID NO: 2116504 - DNA, 13 bp, Homo sapiens
gaagcaggcagag

SEQ ID NO: 2116505 - DNA, 14 bp, Homo sapiens
gaagcaggcagagc

SEQ ID NO: 2116506 - DNA, 17 bp, Homo sapiens
gaagcaggttcttgatg

SEQ ID NO: 2116507 - DNA, 18 bp, Homo sapiens
gaagcaggttgaggggct

SEQ ID NO: 2116508 - DNA, 22 bp, Homo sapiens
gaagcaggttgaggggctcctg

SEQ ID NO: 2116509 - DNA, 16 bp, Homo sapiens
gaagcagtgcctcgag

SEQ ID NO: 2116510 - DNA, 18 bp, Homo sapiens
gaagcagtgcctcgaggc

SEQ ID NO: 2116511 - DNA, 19 bp, Homo sapiens
gaagcagtgcctcgaggca

SEQ ID NO: 2116512 - DNA, 16 bp, Homo sapiens
gaagcatgtaggagaa

SEQ ID NO: 2116513 - DNA, 14 bp, Homo sapiens
gaagcatgtttcat

SEQ ID NO: 2116514 - DNA, 18 bp, Homo sapiens
gaagcatttactttgtgt

SEQ ID NO: 2116515 - DNA, 19 bp, Homo sapiens
gaagcatttgtttctactt

SEQ ID NO: 2116516 - DNA, 15 bp, Homo sapiens
gaagccacgctgtcc

SEQ ID NO: 2116517 - DNA, 13 bp, Homo sapiens
gaagccaggagca

SEQ ID NO: 2116518 - DNA, 14 bp, Homo sapiens
gaagccaggagcaa

SEQ ID NO: 2116519 - DNA, 15 bp, Homo sapiens
gaagccaggagcaaa

SEQ ID NO: 2116520 - DNA, 13 bp, Homo sapiens
gaagccaggctga

SEQ ID NO: 2116521 - DNA, 15 bp, Homo sapiens
gaagcccaagtgaaa

SEQ ID NO: 2116522 - DNA, 16 bp, Homo sapiens
gaagcccaagtgaaat

SEQ ID NO: 2116523 - DNA, 18 bp, Homo sapiens
gaagcccaataaacctct

SEQ ID NO: 2116524 - DNA, 13 bp, Homo sapiens
gaagcccaggctg

SEQ ID NO: 2116525 - DNA, 16 bp, Homo sapiens
gaagcccatgctttcc

SEQ ID NO: 2116526 - DNA, 16 bp, Homo sapiens
gaagccccaagccatg

SEQ ID NO: 2116527 - DNA, 18 bp, Homo sapiens
gaagcccgtgtcctgcct

SEQ ID NO: 2116528 - DNA, 11 bp, Homo sapiens
gaagccctcct

SEQ ID NO: 2116529 - DNA, 15 bp, Homo sapiens
gaagccctccttcca

SEQ ID NO: 2116530 - DNA, 14 bp, Homo sapiens
gaagcccttccagt

SEQ ID NO: 2116531 - DNA, 22 bp, Homo sapiens
gaagccgtctgactccagagtc

SEQ ID NO: 2116532 - DNA, 18 bp, Homo sapiens
gaagcctccgtcaggaga

SEQ ID NO: 2116533 - DNA, 19 bp, Homo sapiens
gaagcctccgtcaggagag

SEQ ID NO: 2116534 - DNA, 13 bp, Homo sapiens
gaagcctgaggct

SEQ ID NO: 2116535 - DNA, 19 bp, Homo sapiens
gaagcctgggggcctggct

SEQ ID NO: 2116536 - DNA, 20 bp, Homo sapiens
gaagcctgggggcctggctg

SEQ ID NO: 2116537 - DNA, 18 bp, Homo sapiens
gaagcctgtgccacctgc

SEQ ID NO: 2116538 - DNA, 19 bp, Homo sapiens
gaagcctgtgccacctgca

SEQ ID NO: 2116539 - DNA, 21 bp, Homo sapiens
gaagcctgtgccacctgcaag

SEQ ID NO: 2116540 - DNA, 20 bp, Homo sapiens
gaagcctgttttgttggaag

SEQ ID NO: 2116541 - DNA, 15 bp, Homo sapiens
gaagcgctcatctgg

SEQ ID NO: 2116542 - DNA, 19 bp, Homo sapiens
gaagcggagcttgcagtga

SEQ ID NO: 2116543 - DNA, 14 bp, Homo sapiens
gaagctaacaggga

SEQ ID NO: 2116544 - DNA, 16 bp, Homo sapiens
gaagctaacagggaag

SEQ ID NO: 2116545 - DNA, 19 bp, Homo sapiens
gaagctaacagggaaggca

SEQ ID NO: 2116546 - DNA, 17 bp, Homo sapiens
gaagctattgagaaaga

SEQ ID NO: 2116547 - DNA, 19 bp, Homo sapiens
gaagctattgatgtttcca

SEQ ID NO: 2116548 - DNA, 20 bp, Homo sapiens
gaagctattgatgtttccag

SEQ ID NO: 2116549 - DNA, 15 bp, Homo sapiens
gaagctccactgtca

SEQ ID NO: 2116550 - DNA, 16 bp, Homo sapiens
gaagctccactgtcac

SEQ ID NO: 2116551 - DNA, 23 bp, Homo sapiens
gaagctccactgtcaccctccac

SEQ ID NO: 2116552 - DNA, 17 bp, Homo sapiens
gaagctcccagatgctg

SEQ ID NO: 2116553 - DNA, 19 bp, Homo sapiens
gaagctccgctttctaccc

SEQ ID NO: 2116554 - DNA, 20 bp, Homo sapiens
gaagctctgaagtcacatca

SEQ ID NO: 2116555 - DNA, 17 bp, Homo sapiens
gaagctctggccccagg

SEQ ID NO: 2116556 - DNA, 22 bp, Homo sapiens
gaagctctgtttataaaaacaa

SEQ ID NO: 2116557 - DNA, 22 bp, Homo sapiens
gaagctgagaagaagctgagga

SEQ ID NO: 2116558 - DNA, 12 bp, Homo sapiens
gaagctgagcag

SEQ ID NO: 2116559 - DNA, 17 bp, Homo sapiens
gaagctgggggaagggt

SEQ ID NO: 2116560 - DNA, 16 bp, Homo sapiens
gaagctgtactcagag

SEQ ID NO: 2116561 - DNA, 20 bp, Homo sapiens
gaagctgtactcagagcaga

SEQ ID NO: 2116562 - DNA, 22 bp, Homo sapiens
gaagctgtactcagagcagagc

SEQ ID NO: 2116563 - DNA, 20 bp, Homo sapiens
gaagctgtgtccttgcacct

SEQ ID NO: 2116564 - DNA, 18 bp, Homo sapiens
gacaagaatggaatagaa

SEQ ID NO: 2116565 - DNA, 13 bp, Homo sapiens
gacaagagctgct

SEQ ID NO: 2116566 - DNA, 14 bp, Homo sapiens
gacaagagctgctg

SEQ ID NO: 2116567 - DNA, 19 bp, Homo sapiens
gacaagagctgctgtcctt

SEQ ID NO: 2116568 - DNA, 21 bp, Homo sapiens
gacaagcatggtcccacatcc

SEQ ID NO: 2116569 - DNA, 12 bp, Homo sapiens
gacaagccctgg

SEQ ID NO: 2116570 - DNA, 17 bp, Homo sapiens
gacaagccctggcaaca

SEQ ID NO: 2116571 - DNA, 13 bp, Homo sapiens
gacaaggaagtgg

SEQ ID NO: 2116572 - DNA, 16 bp, Homo sapiens
gacaaggaagtggggg

SEQ ID NO: 2116573 - DNA, 21 bp, Homo sapiens
gacaaggaagtgggggccgct

SEQ ID NO: 2116574 - DNA, 18 bp, Homo sapiens
gacaaggattgctactgt

SEQ ID NO: 2116575 - DNA, 19 bp, Homo sapiens
gacaagggctgacctgcct

SEQ ID NO: 2116576 - DNA, 21 bp, Homo sapiens
gacaagggctgacctgcctct

SEQ ID NO: 2116577 - DNA, 14 bp, Homo sapiens
gacaagtaatcact

SEQ ID NO: 2116578 - DNA, 17 bp, Homo sapiens
gacaagtggagggggtg

SEQ ID NO: 2116579 - DNA, 19 bp, Homo sapiens
gacaataatttcaggtttt

SEQ ID NO: 2116580 - DNA, 15 bp, Homo sapiens
gacaatactgctgcc

SEQ ID NO: 2116581 - DNA, 13 bp, Homo sapiens
gacaatggcagct

SEQ ID NO: 2116582 - DNA, 21 bp, Homo sapiens
gacaatggcagctagactgga

SEQ ID NO: 2116583 - DNA, 12 bp, Homo sapiens
gacaattcactt

SEQ ID NO: 2116584 - DNA, 13 bp, Homo sapiens
gacacacagcact

SEQ ID NO: 2116585 - DNA, 15 bp, Homo sapiens
gacacacagcactct

SEQ ID NO: 2116586 - DNA, 19 bp, Homo sapiens
gacacacagcactctctaa

SEQ ID NO: 2116587 - DNA, 13 bp, Homo sapiens
gacacacagctct

SEQ ID NO: 2116588 - DNA, 14 bp, Homo sapiens
gacacacagctctg

SEQ ID NO: 2116589 - DNA, 21 bp, Homo sapiens
gacacacagctctgtcctggg

SEQ ID NO: 2116590 - DNA, 20 bp, Homo sapiens
gacacacagtctcagtccag

SEQ ID NO: 2116591 - DNA, 15 bp, Homo sapiens
gacacaccccccagt

SEQ ID NO: 2116592 - DNA, 20 bp, Homo sapiens
gacacagacccacacatgtt

SEQ ID NO: 2116593 - DNA, 18 bp, Homo sapiens
gacacagatacatgggga

SEQ ID NO: 2116594 - DNA, 13 bp, Homo sapiens
gacacagcgtccc

SEQ ID NO: 2116595 - DNA, 13 bp, Homo sapiens
gacacagctcttc

SEQ ID NO: 2116596 - DNA, 14 bp, Homo sapiens
gacacagctcttct

SEQ ID NO: 2116597 - DNA, 16 bp, Homo sapiens
gacacagctcttctcc

SEQ ID NO: 2116598 - DNA, 19 bp, Homo sapiens
gacacagctcttctccagg

SEQ ID NO: 2116599 - DNA, 21 bp, Homo sapiens
gacacagctcttctccaggct

SEQ ID NO: 2116600 - DNA, 22 bp, Homo sapiens
gacacagctcttctccaggctg

SEQ ID NO: 2116601 - DNA, 12 bp, Homo sapiens
gacacaggccag

SEQ ID NO: 2116602 - DNA, 13 bp, Homo sapiens
gacacaggccagc

SEQ ID NO: 2116603 - DNA, 15 bp, Homo sapiens
gacacaggccagccc

SEQ ID NO: 2116604 - DNA, 18 bp, Homo sapiens
gacacaggcccggctcca

SEQ ID NO: 2116605 - DNA, 19 bp, Homo sapiens
gacacaggcccggctccag

SEQ ID NO: 2116606 - DNA, 12 bp, Homo sapiens
gacacaggcctg

SEQ ID NO: 2116607 - DNA, 14 bp, Homo sapiens
gacacaggcctgtg

SEQ ID NO: 2116608 - DNA, 11 bp, Homo sapiens
gacacagtgtt

SEQ ID NO: 2116609 - DNA, 23 bp, Homo sapiens
gacacagtgttccagctgcctgg

SEQ ID NO: 2116610 - DNA, 21 bp, Homo sapiens
gacacagtttctattgtaaat

SEQ ID NO: 2116611 - DNA, 13 bp, Homo sapiens
gacaccagaataa

SEQ ID NO: 2116612 - DNA, 15 bp, Homo sapiens
gacacccattttcac

SEQ ID NO: 2116613 - DNA, 18 bp, Homo sapiens
gacaccgtccctcagtga

SEQ ID NO: 2116614 - DNA, 15 bp, Homo sapiens
gacacctaccatgct

SEQ ID NO: 2116615 - DNA, 17 bp, Homo sapiens
gacacctactgagtggc

SEQ ID NO: 2116616 - DNA, 9 bp, Homo sapiens
gacacctgc

SEQ ID NO: 2116617 - DNA, 15 bp, Homo sapiens
gacacctgcacctcc

SEQ ID NO: 2116618 - DNA, 19 bp, Homo sapiens
gacacctgcacctcccccc

SEQ ID NO: 2116619 - DNA, 13 bp, Homo sapiens
gacacctgcccca

SEQ ID NO: 2116620 - DNA, 14 bp, Homo sapiens
gacacctgccccag

SEQ ID NO: 2116621 - DNA, 16 bp, Homo sapiens
gacacctgccccagcg

SEQ ID NO: 2116622 - DNA, 22 bp, Homo sapiens
gacacctgccccagcgcggctt

SEQ ID NO: 2116623 - DNA, 13 bp, Homo sapiens
gacacctgccctg

SEQ ID NO: 2116624 - DNA, 14 bp, Homo sapiens
gacacctgccctgc

SEQ ID NO: 2116625 - DNA, 15 bp, Homo sapiens
gacaccttgacaggg

SEQ ID NO: 2116626 - DNA, 17 bp, Homo sapiens
gacaccttgacagggca

SEQ ID NO: 2116627 - DNA, 20 bp, Homo sapiens
gacaccttgacagggcacac

SEQ ID NO: 2116628 - DNA, 18 bp, Homo sapiens
gacacggtgaaatccagg

SEQ ID NO: 2116629 - DNA, 16 bp, Homo sapiens
gacacgtggcctgcac

SEQ ID NO: 2116630 - DNA, 18 bp, Homo sapiens
gacactaagttatagtat

SEQ ID NO: 2116631 - DNA, 22 bp, Homo sapiens
gacactctagtgacttcctggt

SEQ ID NO: 2116632 - DNA, 14 bp, Homo sapiens
gacactgctgcacc

SEQ ID NO: 2116633 - DNA, 16 bp, Homo sapiens
gacactgctgcaccag

SEQ ID NO: 2116634 - DNA, 20 bp, Homo sapiens
gacactgctgcaccagagtg

SEQ ID NO: 2116635 - DNA, 21 bp, Homo sapiens
gacactgctgcaccagagtga

SEQ ID NO: 2116636 - DNA, 19 bp, Homo sapiens
gacacttatggggacagca

SEQ ID NO: 2116637 - DNA, 15 bp, Homo sapiens
gacacttgccttctt

SEQ ID NO: 2116638 - DNA, 16 bp, Homo sapiens
gacagaaacagagaga

SEQ ID NO: 2116639 - DNA, 18 bp, Homo sapiens
gacagaaacagagagaga

SEQ ID NO: 2116640 - DNA, 14 bp, Homo sapiens
gacagaacactgtc

SEQ ID NO: 2116641 - DNA, 15 bp, Homo sapiens
gacagaacactgtct

SEQ ID NO: 2116642 - DNA, 15 bp, Homo sapiens
gacagacacaggccc

SEQ ID NO: 2116643 - DNA, 16 bp, Homo sapiens
gacagacacaggcccg

SEQ ID NO: 2116644 - DNA, 17 bp, Homo sapiens
gacagacacaggcccgg

SEQ ID NO: 2116645 - DNA, 14 bp, Homo sapiens
gacagagaaatgtg

SEQ ID NO: 2116646 - DNA, 20 bp, Homo sapiens
gacagagaaatgtgaagggt

SEQ ID NO: 2116647 - DNA, 22 bp, Homo sapiens
gacagagacacctgcacctccc

SEQ ID NO: 2116648 - DNA, 17 bp, Homo sapiens
gacagagagagactgag

SEQ ID NO: 2116649 - DNA, 15 bp, Homo sapiens
gacagagcccccaag

SEQ ID NO: 2116650 - DNA, 16 bp, Homo sapiens
gacagagcccccaagc

SEQ ID NO: 2116651 - DNA, 16 bp, Homo sapiens
gacagagccctgtgag

SEQ ID NO: 2116652 - DNA, 16 bp, Homo sapiens
gacagagctggctgtc

SEQ ID NO: 2116653 - DNA, 20 bp, Homo sapiens
gacagagctggctgtcttcc

SEQ ID NO: 2116654 - DNA, 18 bp, Homo sapiens
gacagaggaccattacaa

SEQ ID NO: 2116655 - DNA, 14 bp, Homo sapiens
gacagagtctcact

SEQ ID NO: 2116656 - DNA, 21 bp, Homo sapiens
gacagagtctcactgttgccc

SEQ ID NO: 2116657 - DNA, 21 bp, Homo sapiens
gacagagttcactataaatgg

SEQ ID NO: 2116658 - DNA, 13 bp, Homo sapiens
gacagataactct

SEQ ID NO: 2116659 - DNA, 22 bp, Homo sapiens
gacagatacatagatggaccag

SEQ ID NO: 2116660 - DNA, 23 bp, Homo sapiens
gacagatagacagtgctgccctg

SEQ ID NO: 2116661 - DNA, 18 bp, Homo sapiens
gacagcagctcaggcaca

SEQ ID NO: 2116662 - DNA, 20 bp, Homo sapiens
gacagcataccttggactga

SEQ ID NO: 2116663 - DNA, 21 bp, Homo sapiens
gacagcataccttggactgac

SEQ ID NO: 2116664 - DNA, 18 bp, Homo sapiens
gacagccacggccaggcc

SEQ ID NO: 2116665 - DNA, 16 bp, Homo sapiens
gacagccagagcctgt

SEQ ID NO: 2116666 - DNA, 11 bp, Homo sapiens
gacagccaggt

SEQ ID NO: 2116667 - DNA, 14 bp, Homo sapiens
gacagccccagggc

SEQ ID NO: 2116668 - DNA, 17 bp, Homo sapiens
gacagccccagggccct

SEQ ID NO: 2116669 - DNA, 11 bp, Homo sapiens
gacagcctggc

SEQ ID NO: 2116670 - DNA, 13 bp, Homo sapiens
gacagcctggcac

SEQ ID NO: 2116671 - DNA, 21 bp, Homo sapiens
gacagcggggaaggtttttat

SEQ ID NO: 2116672 - DNA, 13 bp, Homo sapiens
gacagctccttct

SEQ ID NO: 2116673 - DNA, 16 bp, Homo sapiens
gacagctccttctgtc

SEQ ID NO: 2116674 - DNA, 17 bp, Homo sapiens
gacagctccttctgtcc

SEQ ID NO: 2116675 - DNA, 14 bp, Homo sapiens
gacagctgacagat

SEQ ID NO: 2116676 - DNA, 15 bp, Homo sapiens
gacagctgacagata

SEQ ID NO: 2116677 - DNA, 16 bp, Homo sapiens
gacagctgacagatac

SEQ ID NO: 2116678 - DNA, 12 bp, Homo sapiens
gacagctggctg

SEQ ID NO: 2116679 - DNA, 16 bp, Homo sapiens
gacagctggctgctga

SEQ ID NO: 2116680 - DNA, 14 bp, Homo sapiens
aaaatgaggaggat

SEQ ID NO: 2116681 - DNA, 19 bp, Homo sapiens
aaaatgatgtatgatttgt

SEQ ID NO: 2116682 - DNA, 16 bp, Homo sapiens
aaaatgcaaaatgaaa

SEQ ID NO: 2116683 - DNA, 17 bp, Homo sapiens
aaaatgcactgtgacac

SEQ ID NO: 2116684 - DNA, 23 bp, Homo sapiens
aaaatggccatttgctttttcac

SEQ ID NO: 2116685 - DNA, 23 bp, Homo sapiens
aaaatggcttcagaattaaaact

SEQ ID NO: 2116686 - DNA, 21 bp, Homo sapiens
aaaatgtacactggatatgtt

SEQ ID NO: 2116687 - DNA, 10 bp, Homo sapiens
aaaatgtact

SEQ ID NO: 2116688 - DNA, 22 bp, Homo sapiens
aaaatgtcaaagagaaaactta

SEQ ID NO: 2116689 - DNA, 18 bp, Homo sapiens
aaaatgtctgttaactta

SEQ ID NO: 2116690 - DNA, 19 bp, Homo sapiens
aaaatgtgacccagatcct

SEQ ID NO: 2116691 - DNA, 20 bp, Homo sapiens
aaaatgttaaacccttacca

SEQ ID NO: 2116692 - DNA, 18 bp, Homo sapiens
aaaatgttcgtattctat

SEQ ID NO: 2116693 - DNA, 23 bp, Homo sapiens
aaaatgttctatatgcatttaat

SEQ ID NO: 2116694 - DNA, 13 bp, Homo sapiens
aaaatgttgaaat

SEQ ID NO: 2116695 - DNA, 17 bp, Homo sapiens
aaaatgttgaaatatga

SEQ ID NO: 2116696 - DNA, 19 bp, Homo sapiens
aaaattaagagatacattc

SEQ ID NO: 2116697 - DNA, 16 bp, Homo sapiens
aaaattataagaagag

SEQ ID NO: 2116698 - DNA, 18 bp, Homo sapiens
aaaattatggtgaaatta

SEQ ID NO: 2116699 - DNA, 18 bp, Homo sapiens
aaaattattttaaacaaa

SEQ ID NO: 2116700 - DNA, 14 bp, Homo sapiens
aaaattcaaaaagt

SEQ ID NO: 2116701 - DNA, 13 bp, Homo sapiens
aaaattcatttca

SEQ ID NO: 2116702 - DNA, 14 bp, Homo sapiens
aaaattcatttcac

SEQ ID NO: 2116703 - DNA, 16 bp, Homo sapiens
aaaattcatttcacat

SEQ ID NO: 2116704 - DNA, 13 bp, Homo sapiens
aaaattcttggaa

SEQ ID NO: 2116705 - DNA, 14 bp, Homo sapiens
aaaattgaatgcaa

SEQ ID NO: 2116706 - DNA, 9 bp, Homo sapiens
aaaattgca

SEQ ID NO: 2116707 - DNA, 10 bp, Homo sapiens
aaaattgcac

SEQ ID NO: 2116708 - DNA, 15 bp, Homo sapiens
aaaattgcacaattt

SEQ ID NO: 2116709 - DNA, 22 bp, Homo sapiens
aaaattgcacaatttgagcaat

SEQ ID NO: 2116710 - DNA, 17 bp, Homo sapiens
aaaattggtacttgttt

SEQ ID NO: 2116711 - DNA, 15 bp, Homo sapiens
aaaattgtatagaga

SEQ ID NO: 2116712 - DNA, 15 bp, Homo sapiens
aaaattgtgatgttt

SEQ ID NO: 2116713 - DNA, 20 bp, Homo sapiens
aaaattgtgtttagatttta

SEQ ID NO: 2116714 - DNA, 17 bp, Homo sapiens
aaaatttccagtacctt

SEQ ID NO: 2116715 - DNA, 13 bp, Homo sapiens
aaaattttattcc

SEQ ID NO: 2116716 - DNA, 22 bp, Homo sapiens
aaaattttgtgagtgactcggt

SEQ ID NO: 2116717 - DNA, 13 bp, Homo sapiens
aaacaaaacaaca

SEQ ID NO: 2116718 - DNA, 14 bp, Homo sapiens
aaacaaaacaacaa

SEQ ID NO: 2116719 - DNA, 12 bp, Homo sapiens
aaacaaaaccag

SEQ ID NO: 2116720 - DNA, 17 bp, Homo sapiens
aaacaaaaccagctgct

SEQ ID NO: 2116721 - DNA, 12 bp, Homo sapiens
aaacaaaataga

SEQ ID NO: 2116722 - DNA, 15 bp, Homo sapiens
aaacaaaatatctga

SEQ ID NO: 2116723 - DNA, 17 bp, Homo sapiens
aaacaaataatcacatt

SEQ ID NO: 2116724 - DNA, 13 bp, Homo sapiens
aaacaacaacaat

SEQ ID NO: 2116725 - DNA, 14 bp, Homo sapiens
aaacaacaacaata

SEQ ID NO: 2116726 - DNA, 21 bp, Homo sapiens
aaacaacaacaatacaacaag

SEQ ID NO: 2116727 - DNA, 12 bp, Homo sapiens
aaacaacttgtg

SEQ ID NO: 2116728 - DNA, 20 bp, Homo sapiens
aaacaaggggctgttacata

SEQ ID NO: 2116729 - DNA, 13 bp, Homo sapiens
aaacaagtatttg

SEQ ID NO: 2116730 - DNA, 23 bp, Homo sapiens
aaacaagtatttgttaatttaga

SEQ ID NO: 2116731 - DNA, 14 bp, Homo sapiens
aaacaatgtttaaa

SEQ ID NO: 2116732 - DNA, 22 bp, Homo sapiens
aaacacaaaccacaactgacac

SEQ ID NO: 2116733 - DNA, 15 bp, Homo sapiens
aaacacactgtaaat

SEQ ID NO: 2116734 - DNA, 12 bp, Homo sapiens
aaacacagagcg

SEQ ID NO: 2116735 - DNA, 11 bp, Homo sapiens
aaacacagcaa

SEQ ID NO: 2116736 - DNA, 11 bp, Homo sapiens
aaacacagctt

SEQ ID NO: 2116737 - DNA, 18 bp, Homo sapiens
aaacacagggttttgtat

SEQ ID NO: 2116738 - DNA, 15 bp, Homo sapiens
aaacaccaacataaa

SEQ ID NO: 2116739 - DNA, 13 bp, Homo sapiens
aaacacctcccca

SEQ ID NO: 2116740 - DNA, 14 bp, Homo sapiens
aaacacctgacaca

SEQ ID NO: 2116741 - DNA, 17 bp, Homo sapiens
aaacacctgacacatct

SEQ ID NO: 2116742 - DNA, 22 bp, Homo sapiens
aaacactccaccccctccagct

SEQ ID NO: 2116743 - DNA, 23 bp, Homo sapiens
aaacactgtaatcttaaaagtgt

SEQ ID NO: 2116744 - DNA, 13 bp, Homo sapiens
aaacactgtgtat

SEQ ID NO: 2116745 - DNA, 21 bp, Homo sapiens
aaacagaaacaaaaacactaa

SEQ ID NO: 2116746 - DNA, 20 bp, Homo sapiens
aaacagaggccatggcagaa

SEQ ID NO: 2116747 - DNA, 15 bp, Homo sapiens
aaacagatataaatg

SEQ ID NO: 2116748 - DNA, 18 bp, Homo sapiens
aaacagatgataaatatt

SEQ ID NO: 2116749 - DNA, 14 bp, Homo sapiens
aaacagccaaataa

SEQ ID NO: 2116750 - DNA, 11 bp, Homo sapiens
aaacagcctgg

SEQ ID NO: 2116751 - DNA, 12 bp, Homo sapiens
aaacaggaaaaa

SEQ ID NO: 2116752 - DNA, 22 bp, Homo sapiens
aaacaggaaaaaaaataatgta

SEQ ID NO: 2116753 - DNA, 22 bp, Homo sapiens
aaacagggcagtgacaagtgga

SEQ ID NO: 2116754 - DNA, 17 bp, Homo sapiens
aaacaggggatcaaagt

SEQ ID NO: 2116755 - DNA, 18 bp, Homo sapiens
aaacaggggatcaaagtt

SEQ ID NO: 2116756 - DNA, 20 bp, Homo sapiens
aaacaggggatcaaagttcc

SEQ ID NO: 2116757 - DNA, 18 bp, Homo sapiens
aaacagtgcctgctgaat

SEQ ID NO: 2116758 - DNA, 18 bp, Homo sapiens
aaacagttaactttcaga

SEQ ID NO: 2116759 - DNA, 15 bp, Homo sapiens
aaacataatataaga

SEQ ID NO: 2116760 - DNA, 14 bp, Homo sapiens
aaacataatatctt

SEQ ID NO: 2116761 - DNA, 13 bp, Homo sapiens
aaacataattctt

SEQ ID NO: 2116762 - DNA, 15 bp, Homo sapiens
aaacatatcaattca

SEQ ID NO: 2116763 - DNA, 16 bp, Homo sapiens
aaacatatcaattcaa

SEQ ID NO: 2116764 - DNA, 19 bp, Homo sapiens
aaacatcattcatttttgt

SEQ ID NO: 2116765 - DNA, 18 bp, Homo sapiens
aaacatccttcaagaact

SEQ ID NO: 2116766 - DNA, 12 bp, Homo sapiens
aaacattaaaca

SEQ ID NO: 2116767 - DNA, 14 bp, Homo sapiens
aaacattaaacact

SEQ ID NO: 2116768 - DNA, 20 bp, Homo sapiens
aaacattaaatgtcttatat

SEQ ID NO: 2116769 - DNA, 15 bp, Homo sapiens
aaacattaagattga

SEQ ID NO: 2116770 - DNA, 20 bp, Homo sapiens
aaacattatagattttcatg

SEQ ID NO: 2116771 - DNA, 20 bp, Homo sapiens
aaacatttattttgacataa

SEQ ID NO: 2116772 - DNA, 21 bp, Homo sapiens
aaacatttgtacattcctgat

SEQ ID NO: 2116773 - DNA, 18 bp, Homo sapiens
aaaccaaaacagaacaat

SEQ ID NO: 2116774 - DNA, 13 bp, Homo sapiens
aaaccaaagccag

SEQ ID NO: 2116775 - DNA, 20 bp, Homo sapiens
aaaccaaataagcatctgtg

SEQ ID NO: 2116776 - DNA, 22 bp, Homo sapiens
aaaccaagtctacttcactaat

SEQ ID NO: 2116777 - DNA, 17 bp, Homo sapiens
aaaccaatgattcataa

SEQ ID NO: 2116778 - DNA, 16 bp, Homo sapiens
aaaccacacttcttga

SEQ ID NO: 2116779 - DNA, 16 bp, Homo sapiens
aaaccacagcagttga

SEQ ID NO: 2116780 - DNA, 20 bp, Homo sapiens
aaaccacaggttccatagaa

SEQ ID NO: 2116781 - DNA, 19 bp, Homo sapiens
aaaccagcagaaaagtgct

SEQ ID NO: 2116782 - DNA, 17 bp, Homo sapiens
aaaatctgatttaatgt

SEQ ID NO: 2116783 - DNA, 16 bp, Homo sapiens
aaaatctgtggtggtc

SEQ ID NO: 2116784 - DNA, 17 bp, Homo sapiens
aaaatgaaaataagtga

SEQ ID NO: 2116785 - DNA, 19 bp, Homo sapiens
aaaatgaaagcatgtctca

SEQ ID NO: 2116786 - DNA, 17 bp, Homo sapiens
aaaatgaaatgtttttg

SEQ ID NO: 2116787 - DNA, 22 bp, Homo sapiens
aaaatgaaatgtttttgctata

SEQ ID NO: 2116788 - DNA, 16 bp, Homo sapiens
aaaatgacaaggggag

SEQ ID NO: 2116789 - DNA, 17 bp, Homo sapiens
aaaatgagcctgtaatc

SEQ ID NO: 2116790 - DNA, 17 bp, Homo sapiens
aaaatgagctaggcatg

SEQ ID NO: 2116791 - DNA, 20 bp, Homo sapiens
ctgcctctgccatgcccaga

SEQ ID NO: 2116792 - DNA, 16 bp, Homo sapiens
ctgcctgaaaaccatc

SEQ ID NO: 2116793 - DNA, 16 bp, Homo sapiens
ctgcctgaagtcacac

SEQ ID NO: 2116794 - DNA, 14 bp, Homo sapiens
ctgcctgcccaggc

SEQ ID NO: 2116795 - DNA, 17 bp, Homo sapiens
ctgcctgccgcccaaag

SEQ ID NO: 2116796 - DNA, 16 bp, Homo sapiens
ctgcctgccttggcct

SEQ ID NO: 2116797 - DNA, 14 bp, Homo sapiens
ctgcctgcggccca

SEQ ID NO: 2116798 - DNA, 21 bp, Homo sapiens
ctgcctggaaattctggaact

SEQ ID NO: 2116799 - DNA, 16 bp, Homo sapiens
ctgcctggaggacctg

SEQ ID NO: 2116800 - DNA, 17 bp, Homo sapiens
ctgcctggaggacctga

SEQ ID NO: 2116801 - DNA, 16 bp, Homo sapiens
ctgcctggcctggctc

SEQ ID NO: 2116802 - DNA, 18 bp, Homo sapiens
ctgcctggcctggctccc

SEQ ID NO: 2116803 - DNA, 19 bp, Homo sapiens
ctgcctggcctggctcccc

SEQ ID NO: 2116804 - DNA, 14 bp, Homo sapiens
ctgcctgggcctgt

SEQ ID NO: 2116805 - DNA, 16 bp, Homo sapiens
ctgcctgggcctgtgc

SEQ ID NO: 2116806 - DNA, 17 bp, Homo sapiens
ctgcctgggcctgtgca

SEQ ID NO: 2116807 - DNA, 24 bp, Homo sapiens
ctgcctggggattgggagggacag

SEQ ID NO: 2116808 - DNA, 20 bp, Homo sapiens
ctgcctgtagttaggaaata

SEQ ID NO: 2116809 - DNA, 21 bp, Homo sapiens
ctgcctgtagttaggaaataa

SEQ ID NO: 2116810 - DNA, 21 bp, Homo sapiens
ctgcctgtggccttgcccgcc

SEQ ID NO: 2116811 - DNA, 23 bp, Homo sapiens
ctgcctgtggccttgcccgccag

SEQ ID NO: 2116812 - DNA, 14 bp, Homo sapiens
ctgcctgttcagct

SEQ ID NO: 2116813 - DNA, 18 bp, Homo sapiens
ctgcctgttcagctccag

SEQ ID NO: 2116814 - DNA, 15 bp, Homo sapiens
ctgcctgttcccatt

SEQ ID NO: 2116815 - DNA, 19 bp, Homo sapiens
ctgcctgttcccattcttg

SEQ ID NO: 2116816 - DNA, 12 bp, Homo sapiens
ctgccttccagg

SEQ ID NO: 2116817 - DNA, 16 bp, Homo sapiens
ctgccttcctcatccc

SEQ ID NO: 2116818 - DNA, 22 bp, Homo sapiens
tatgctggccagcaccctctcc

SEQ ID NO: 2116819 - DNA, 13 bp, Homo sapiens
tatgcttaaaata

SEQ ID NO: 2116820 - DNA, 15 bp, Homo sapiens
tatgcttaaaatatg

SEQ ID NO: 2116821 - DNA, 14 bp, Homo sapiens
tatgcttcccagag

SEQ ID NO: 2116822 - DNA, 22 bp, Homo sapiens
tatgcttcccagagaagctcat

SEQ ID NO: 2116823 - DNA, 13 bp, Homo sapiens
tatggaactctct

SEQ ID NO: 2116824 - DNA, 13 bp, Homo sapiens
tatggaacttcta

SEQ ID NO: 2116825 - DNA, 15 bp, Homo sapiens
tatggaacttctaat

SEQ ID NO: 2116826 - DNA, 20 bp, Homo sapiens
tatggaacttctaatatatt

SEQ ID NO: 2116827 - DNA, 17 bp, Homo sapiens
tatggaatacagtgtta

SEQ ID NO: 2116828 - DNA, 15 bp, Homo sapiens
tatggagagccctgg

SEQ ID NO: 2116829 - DNA, 19 bp, Homo sapiens
tatggaggctttgcataga

SEQ ID NO: 2116830 - DNA, 14 bp, Homo sapiens
tatggcaaaaatgg

SEQ ID NO: 2116831 - DNA, 21 bp, Homo sapiens
tatggcacttattatgaggct

SEQ ID NO: 2116832 - DNA, 13 bp, Homo sapiens
tatggcagtgtct

SEQ ID NO: 2116833 - DNA, 19 bp, Homo sapiens
tatggcatatttatattgt

SEQ ID NO: 2116834 - DNA, 15 bp, Homo sapiens
tatggcatgatttat

SEQ ID NO: 2116835 - DNA, 16 bp, Homo sapiens
tatggcatgatttata

SEQ ID NO: 2116836 - DNA, 12 bp, Homo sapiens
tatggcattttt

SEQ ID NO: 2116837 - DNA, 13 bp, Homo sapiens
tatggcctgtgtc

SEQ ID NO: 2116838 - DNA, 16 bp, Homo sapiens
tatggctataggtgct

SEQ ID NO: 2116839 - DNA, 17 bp, Homo sapiens
tatggctataggtgcta

SEQ ID NO: 2116840 - DNA, 13 bp, Homo sapiens
tatggctgtattt

SEQ ID NO: 2116841 - DNA, 15 bp, Homo sapiens
tatggctgtattttt

SEQ ID NO: 2116842 - DNA, 13 bp, Homo sapiens
tatgggaagccat

SEQ ID NO: 2116843 - DNA, 18 bp, Homo sapiens
tatgggactgagcctggc

SEQ ID NO: 2116844 - DNA, 12 bp, Homo sapiens
tatgggtgctgg

SEQ ID NO: 2116845 - DNA, 13 bp, Homo sapiens
tatgggtgctggc

SEQ ID NO: 2116846 - DNA, 17 bp, Homo sapiens
tatggtatgctggccag

SEQ ID NO: 2116847 - DNA, 21 bp, Homo sapiens
tatggtcaatcccaaaagtca

SEQ ID NO: 2116848 - DNA, 13 bp, Homo sapiens
tatggtgtaatgc

SEQ ID NO: 2116849 - DNA, 21 bp, Homo sapiens
tatggttcccaataaaagtga

SEQ ID NO: 2116850 - DNA, 22 bp, Homo sapiens
tatggttcccaataaaagtgac

SEQ ID NO: 2116851 - DNA, 19 bp, Homo sapiens
tatggttgattcccagcat

SEQ ID NO: 2116852 - DNA, 14 bp, Homo sapiens
tatggtttctgcgt

SEQ ID NO: 2116853 - DNA, 17 bp, Homo sapiens
tatggtttctgcgtgct

SEQ ID NO: 2116854 - DNA, 18 bp, Homo sapiens
tatgtaaacataattctt

SEQ ID NO: 2116855 - DNA, 19 bp, Homo sapiens
tatgtaaactgcattagaa

SEQ ID NO: 2116856 - DNA, 14 bp, Homo sapiens
tatgtaaagtatgt

SEQ ID NO: 2116857 - DNA, 18 bp, Homo sapiens
tatgtaaagtatgtaaac

SEQ ID NO: 2116858 - DNA, 19 bp, Homo sapiens
tatgtaaagtatgtaaaca

SEQ ID NO: 2116859 - DNA, 14 bp, Homo sapiens
tatgtacagttata

SEQ ID NO: 2116860 - DNA, 17 bp, Homo sapiens
tatgtacagttatacat

SEQ ID NO: 2116861 - DNA, 16 bp, Homo sapiens
tatgtaccatgtacat

SEQ ID NO: 2116862 - DNA, 21 bp, Homo sapiens
tatgtactgttattgaaaata

SEQ ID NO: 2116863 - DNA, 23 bp, Homo sapiens
tatgtagaaaaaagtaaatgtga

SEQ ID NO: 2116864 - DNA, 18 bp, Homo sapiens
tatgtagactatatacat

SEQ ID NO: 2116865 - DNA, 22 bp, Homo sapiens
tatgtagactatatacatgtgt

SEQ ID NO: 2116866 - DNA, 18 bp, Homo sapiens
tatgtagcccggccaggg

SEQ ID NO: 2116867 - DNA, 21 bp, Homo sapiens
tatgtagcccggccagggcct

SEQ ID NO: 2116868 - DNA, 17 bp, Homo sapiens
tatgtagctttatcctt

SEQ ID NO: 2116869 - DNA, 9 bp, Homo sapiens
tatgtatac

SEQ ID NO: 2116870 - DNA, 16 bp, Homo sapiens
tatgtatacacacata

SEQ ID NO: 2116871 - DNA, 21 bp, Homo sapiens
tatgtatacacacatatacat

SEQ ID NO: 2116872 - DNA, 16 bp, Homo sapiens
tatgtatatagatgtg

SEQ ID NO: 2116873 - DNA, 14 bp, Homo sapiens
tatgtatgtgtgta

SEQ ID NO: 2116874 - DNA, 13 bp, Homo sapiens
tatgtatgtttac

SEQ ID NO: 2116875 - DNA, 19 bp, Homo sapiens
tatgtattaagccaaacat

SEQ ID NO: 2116876 - DNA, 20 bp, Homo sapiens
tatgtattaagccaaacatg

SEQ ID NO: 2116877 - DNA, 17 bp, Homo sapiens
tatgtattattttctat

SEQ ID NO: 2116878 - DNA, 22 bp, Homo sapiens
tatgtattattttctatagctc

SEQ ID NO: 2116879 - DNA, 12 bp, Homo sapiens
tatgtatttata

SEQ ID NO: 2116880 - DNA, 18 bp, Homo sapiens
tatgtcagacatgaaaac

SEQ ID NO: 2116881 - DNA, 12 bp, Homo sapiens
tatgtctaaaga

SEQ ID NO: 2116882 - DNA, 13 bp, Homo sapiens
tatgtctatttaa

SEQ ID NO: 2116883 - DNA, 21 bp, Homo sapiens
tatgtctgcttctgtccagga

SEQ ID NO: 2116884 - DNA, 14 bp, Homo sapiens
tatgtctgtatcta

SEQ ID NO: 2116885 - DNA, 14 bp, Homo sapiens
tatgtcttggacac

SEQ ID NO: 2116886 - DNA, 22 bp, Homo sapiens
tatgtgaatatggactcagttt

SEQ ID NO: 2116887 - DNA, 22 bp, Homo sapiens
tatgtgaatgatctctctgaat

SEQ ID NO: 2116888 - DNA, 15 bp, Homo sapiens
tatgtgcacatgtgt

SEQ ID NO: 2116889 - DNA, 16 bp, Homo sapiens
tatgtgcacatgtgtc

SEQ ID NO: 2116890 - DNA, 21 bp, Homo sapiens
tatgtgcacatgtgtctgtgt

SEQ ID NO: 2116891 - DNA, 14 bp, Homo sapiens
tatgtgcagtattt

SEQ ID NO: 2116892 - DNA, 18 bp, Homo sapiens
tatgtgcgtctctctttc

SEQ ID NO: 2116893 - DNA, 23 bp, Homo sapiens
tatgtgtaattttttaaatgaaa

SEQ ID NO: 2116894 - DNA, 14 bp, Homo sapiens
tatgtgtatatata

SEQ ID NO: 2116895 - DNA, 22 bp, Homo sapiens
tatgtgtatatatacatacact

SEQ ID NO: 2116896 - DNA, 21 bp, Homo sapiens
tatgtgtgcatgtgtgtataa

SEQ ID NO: 2116897 - DNA, 12 bp, Homo sapiens
tatgtgtgtatg

SEQ ID NO: 2116898 - DNA, 19 bp, Homo sapiens
tatgtgtgtgtatgctact

SEQ ID NO: 2116899 - DNA, 14 bp, Homo sapiens
tatgtgtgtgtgtg

SEQ ID NO: 2116900 - DNA, 14 bp, Homo sapiens
tatgtgtgtttaaa

SEQ ID NO: 2116901 - DNA, 19 bp, Homo sapiens
tatgttaacctcagtgtca

SEQ ID NO: 2116902 - DNA, 14 bp, Homo sapiens
tatgttaagctctt

SEQ ID NO: 2116903 - DNA, 22 bp, Homo sapiens
tatgttcattaaattttctatg

SEQ ID NO: 2116904 - DNA, 15 bp, Homo sapiens
tatgttctcagaatc

SEQ ID NO: 2116905 - DNA, 16 bp, Homo sapiens
tatgttgcccaggcag

SEQ ID NO: 2116906 - DNA, 16 bp, Homo sapiens
tatgttgtgttctaat

SEQ ID NO: 2116907 - DNA, 14 bp, Homo sapiens
tatgtttgtgcctt

SEQ ID NO: 2116908 - DNA, 22 bp, Homo sapiens
tattaaaatatggctataaata

SEQ ID NO: 2116909 - DNA, 19 bp, Homo sapiens
tattaaaatgattgtaaaa

SEQ ID NO: 2116910 - DNA, 20 bp, Homo sapiens
tattaaaatgattgtaaaat

SEQ ID NO: 2116911 - DNA, 13 bp, Homo sapiens
tattaaagatgtg

SEQ ID NO: 2116912 - DNA, 16 bp, Homo sapiens
tattaaagatgtgttg

SEQ ID NO: 2116913 - DNA, 13 bp, Homo sapiens
tattaaagtgcca

SEQ ID NO: 2116914 - DNA, 12 bp, Homo sapiens
tattaaatacag

SEQ ID NO: 2116915 - DNA, 17 bp, Homo sapiens
tattaaatacagacact

SEQ ID NO: 2116916 - DNA, 18 bp, Homo sapiens
tattaaatacagacacta

SEQ ID NO: 2116917 - DNA, 11 bp, Homo sapiens
tattaaatatt

SEQ ID NO: 2116918 - DNA, 14 bp, Homo sapiens
tattaaatatttaa

SEQ ID NO: 2116919 - DNA, 20 bp, Homo sapiens
tattaaatatttaacatagg

SEQ ID NO: 2116920 - DNA, 13 bp, Homo sapiens
tattaaatctttt

SEQ ID NO: 2116921 - DNA, 16 bp, Homo sapiens
tattaacaaattatgt

SEQ ID NO: 2116922 - DNA, 16 bp, Homo sapiens
tattaacgggcatgta

SEQ ID NO: 2116923 - DNA, 21 bp, Homo sapiens
tattaagggaaaggaaaagaa

SEQ ID NO: 2116924 - DNA, 14 bp, Homo sapiens
tattaataccaaat

SEQ ID NO: 2116925 - DNA, 22 bp, Homo sapiens
tattaatattgtgcttaaatta

SEQ ID NO: 2116926 - DNA, 16 bp, Homo sapiens
tattaatgaactgtga

SEQ ID NO: 2116927 - DNA, 17 bp, Homo sapiens
tattaatgaactgtgac

SEQ ID NO: 2116928 - DNA, 22 bp, Homo sapiens
tattaatgaactgtgacaggaa

SEQ ID NO: 2116929 - DNA, 14 bp, Homo sapiens
tattaattatctga

SEQ ID NO: 2116930 - DNA, 13 bp, Homo sapiens
tattaattccaag

SEQ ID NO: 2116931 - DNA, 15 bp, Homo sapiens
tattacagtagtgca

SEQ ID NO: 2116932 - DNA, 15 bp, Homo sapiens
tattacatctaatgc

SEQ ID NO: 2116933 - DNA, 15 bp, Homo sapiens
tattaccatgagaag

SEQ ID NO: 2116934 - DNA, 18 bp, Homo sapiens
tcaagtgatatatgtatt

SEQ ID NO: 2116935 - DNA, 22 bp, Homo sapiens
tcaagtgattctcctgcctcag

SEQ ID NO: 2116936 - DNA, 20 bp, Homo sapiens
tcaagtgcatgctctctgca

SEQ ID NO: 2116937 - DNA, 22 bp, Homo sapiens
tcaagtgcatgctctctgcagc

SEQ ID NO: 2116938 - DNA, 17 bp, Homo sapiens
tcaagtgcctcttgttg

SEQ ID NO: 2116939 - DNA, 19 bp, Homo sapiens
tcaagtgcctcttgttgca

SEQ ID NO: 2116940 - DNA, 14 bp, Homo sapiens
tcaagttaaagtga

SEQ ID NO: 2116941 - DNA, 17 bp, Homo sapiens
tcaagttattgtacagc

SEQ ID NO: 2116942 - DNA, 13 bp, Homo sapiens
tcaagtttttaca

SEQ ID NO: 2116943 - DNA, 15 bp, Homo sapiens
tcaagtttttacaaa

SEQ ID NO: 2116944 - DNA, 16 bp, Homo sapiens
tcaagtttttcagaaa

SEQ ID NO: 2116945 - DNA, 22 bp, Homo sapiens
tcaataaaaaaaagaaatgaaa

SEQ ID NO: 2116946 - DNA, 12 bp, Homo sapiens
tcaataaaaatc

SEQ ID NO: 2116947 - DNA, 14 bp, Homo sapiens
tcaataaaatcatg

SEQ ID NO: 2116948 - DNA, 18 bp, Homo sapiens
tcaataaaatcatgtaca

SEQ ID NO: 2116949 - DNA, 12 bp, Homo sapiens
tcaataaagtat

SEQ ID NO: 2116950 - DNA, 16 bp, Homo sapiens
tcaataaatgtctgtt

SEQ ID NO: 2116951 - DNA, 21 bp, Homo sapiens
tcaataccccaagtccacctg

SEQ ID NO: 2116952 - DNA, 17 bp, Homo sapiens
tcaatactgccttaatg

SEQ ID NO: 2116953 - DNA, 15 bp, Homo sapiens
tcaatacttcatgat

SEQ ID NO: 2116954 - DNA, 17 bp, Homo sapiens
tcaatagactgtactta

SEQ ID NO: 2116955 - DNA, 22 bp, Homo sapiens
tcaatattaaatacagacacta

SEQ ID NO: 2116956 - DNA, 22 bp, Homo sapiens
tcaatattcctgaatgaaatat

SEQ ID NO: 2116957 - DNA, 19 bp, Homo sapiens
tcaatattgcctttgcctc

SEQ ID NO: 2116958 - DNA, 10 bp, Homo sapiens
tcaatattta

SEQ ID NO: 2116959 - DNA, 13 bp, Homo sapiens
tcaatatttatta

SEQ ID NO: 2116960 - DNA, 22 bp, Homo sapiens
tcaatcagtctcagaatgtcat

SEQ ID NO: 2116961 - DNA, 19 bp, Homo sapiens
tcaatcatctgtgtgaaaa

SEQ ID NO: 2116962 - DNA, 22 bp, Homo sapiens
tcaatcccctcattcaggaaaa

SEQ ID NO: 2116963 - DNA, 15 bp, Homo sapiens
tcaatccttgttcag

SEQ ID NO: 2116964 - DNA, 12 bp, Homo sapiens
tcaatgaaatat

SEQ ID NO: 2116965 - DNA, 23 bp, Homo sapiens
tcaatgaaatatttgcttattta

SEQ ID NO: 2116966 - DNA, 14 bp, Homo sapiens
tcaatgacctgtat

SEQ ID NO: 2116967 - DNA, 15 bp, Homo sapiens
tcaatgacctgtatt

SEQ ID NO: 2116968 - DNA, 16 bp, Homo sapiens
tcaatgccctgccatt

SEQ ID NO: 2116969 - DNA, 23 bp, Homo sapiens
tcaatggaaacagggcagtgaca

SEQ ID NO: 2116970 - DNA, 14 bp, Homo sapiens
tcaatgggcaatga

SEQ ID NO: 2116971 - DNA, 11 bp, Homo sapiens
tcaatgtcact

SEQ ID NO: 2116972 - DNA, 15 bp, Homo sapiens
tcaatgtgaatcaga

SEQ ID NO: 2116973 - DNA, 17 bp, Homo sapiens
tcaatgtgattctaatg

SEQ ID NO: 2116974 - DNA, 18 bp, Homo sapiens
tcaatgtgattctaatgt

SEQ ID NO: 2116975 - DNA, 22 bp, Homo sapiens
tcaatgtgattctaatgtcttc

SEQ ID NO: 2116976 - DNA, 23 bp, Homo sapiens
tcaatgtttatgcaaggaaggaa

SEQ ID NO: 2116977 - DNA, 16 bp, Homo sapiens
tcaattattacattta

SEQ ID NO: 2116978 - DNA, 15 bp, Homo sapiens
tcaattcaaaagctc

SEQ ID NO: 2116979 - DNA, 15 bp, Homo sapiens
tcaattcaaagctgt

SEQ ID NO: 2116980 - DNA, 22 bp, Homo sapiens
tcaattcaaagctgtgtgtttg

SEQ ID NO: 2116981 - DNA, 16 bp, Homo sapiens
tcaattcccattgcat

SEQ ID NO: 2116982 - DNA, 14 bp, Homo sapiens
tcaattcctctggg

SEQ ID NO: 2116983 - DNA, 13 bp, Homo sapiens
tcaattctgtata

SEQ ID NO: 2116984 - DNA, 13 bp, Homo sapiens
tcaattgtatttt

SEQ ID NO: 2116985 - DNA, 21 bp, Homo sapiens
tcaatttaattcttatttctg

SEQ ID NO: 2116986 - DNA, 13 bp, Homo sapiens
tcaatttccaaga

SEQ ID NO: 2116987 - DNA, 18 bp, Homo sapiens
tcaatttccaagagctga

SEQ ID NO: 2116988 - DNA, 16 bp, Homo sapiens
tcaatttgtatatcat

SEQ ID NO: 2116989 - DNA, 17 bp, Homo sapiens
tcaatttttatacatat

SEQ ID NO: 2116990 - DNA, 19 bp, Homo sapiens
tcaatttttatacatatca

SEQ ID NO: 2116991 - DNA, 14 bp, Homo sapiens
tcacaaaaaagaag

SEQ ID NO: 2116992 - DNA, 13 bp, Homo sapiens
tcacaaaaatggt

SEQ ID NO: 2116993 - DNA, 18 bp, Homo sapiens
tcacaaaaatggtggttt

SEQ ID NO: 2116994 - DNA, 14 bp, Homo sapiens
tcacaaaattttat

SEQ ID NO: 2116995 - DNA, 22 bp, Homo sapiens
tcacaaaattttattcctatat

SEQ ID NO: 2116996 - DNA, 12 bp, Homo sapiens
tcacaacagatc

SEQ ID NO: 2116997 - DNA, 17 bp, Homo sapiens
tcacaacaggcattcca

SEQ ID NO: 2116998 - DNA, 17 bp, Homo sapiens
tcacaaccagccacaca

SEQ ID NO: 2116999 - DNA, 23 bp, Homo sapiens
tcacaaccagccacacagagcct

SEQ ID NO: 2117000 - DNA, 12 bp, Homo sapiens
tcacaactgttt

SEQ ID NO: 2117001 - DNA, 14 bp, Homo sapiens
tcacaagcacaaag

SEQ ID NO: 2117002 - DNA, 17 bp, Homo sapiens
tcacaagcacaaagctc

SEQ ID NO: 2117003 - DNA, 12 bp, Homo sapiens
tcacaaggcagc

SEQ ID NO: 2117004 - DNA, 22 bp, Homo sapiens
tcacaaggcagcaaggcccgag

SEQ ID NO: 2117005 - DNA, 23 bp, Homo sapiens
tcacaaggcagcaaggcccgagc

SEQ ID NO: 2117006 - DNA, 16 bp, Homo sapiens
tcacaatagaaactca

SEQ ID NO: 2117007 - DNA, 15 bp, Homo sapiens
tcacaattgtaaagt

SEQ ID NO: 2117008 - DNA, 14 bp, Homo sapiens
tcacacacatagat

SEQ ID NO: 2117009 - DNA, 13 bp, Homo sapiens
tcacacacccctc

SEQ ID NO: 2117010 - DNA, 14 bp, Homo sapiens
tcacacacccctca

SEQ ID NO: 2117011 - DNA, 21 bp, Homo sapiens
tcacacacccctcaaaaaaag

SEQ ID NO: 2117012 - DNA, 15 bp, Homo sapiens
tcacacactttggct

SEQ ID NO: 2117013 - DNA, 10 bp, Homo sapiens
tcacacagac

SEQ ID NO: 2117014 - DNA, 13 bp, Homo sapiens
tcacacagacaca

SEQ ID NO: 2117015 - DNA, 14 bp, Homo sapiens
tcacacagacacac

SEQ ID NO: 2117016 - DNA, 23 bp, Homo sapiens
tcacacagtgagtcgaggacagg

SEQ ID NO: 2117017 - DNA, 22 bp, Homo sapiens
tcacacatgcatcatcagccta

SEQ ID NO: 2117018 - DNA, 19 bp, Homo sapiens
tcacaccatcttaaatgac

SEQ ID NO: 2117019 - DNA, 22 bp, Homo sapiens
tcacacccaacttggttttgct

SEQ ID NO: 2117020 - DNA, 19 bp, Homo sapiens
tcacactctaagttctatt

SEQ ID NO: 2117021 - DNA, 13 bp, Homo sapiens
tcacactgagctg

SEQ ID NO: 2117022 - DNA, 20 bp, Homo sapiens
tcacactgttactccacagc

SEQ ID NO: 2117023 - DNA, 23 bp, Homo sapiens
tcacacttggagctaattaaggt

SEQ ID NO: 2117024 - DNA, 22 bp, Homo sapiens
tcacagacgctcctgaagttag

SEQ ID NO: 2117025 - DNA, 12 bp, Homo sapiens
tcacagaggctt

SEQ ID NO: 2117026 - DNA, 20 bp, Homo sapiens
tcacagatgggtattaaact

SEQ ID NO: 2117027 - DNA, 15 bp, Homo sapiens
tcacagcctctccct

SEQ ID NO: 2117028 - DNA, 13 bp, Homo sapiens
tcacagctctgta

SEQ ID NO: 2117029 - DNA, 15 bp, Homo sapiens
tcacagctgcagctg

SEQ ID NO: 2117030 - DNA, 17 bp, Homo sapiens
tcacagctgcagctggg

SEQ ID NO: 2117031 - DNA, 20 bp, Homo sapiens
tcacagctgcagctgggccc

SEQ ID NO: 2117032 - DNA, 13 bp, Homo sapiens
tcacaggagcaga

SEQ ID NO: 2117033 - DNA, 14 bp, Homo sapiens
tcacaggagcagac

SEQ ID NO: 2117034 - DNA, 12 bp, Homo sapiens
tcacaggcaggt

SEQ ID NO: 2117035 - DNA, 19 bp, Homo sapiens
tcacagggcagagccggga

SEQ ID NO: 2117036 - DNA, 17 bp, Homo sapiens
tcacagggccccagaag

SEQ ID NO: 2117037 - DNA, 23 bp, Homo sapiens
tcacagggccccagaaggcaggg

SEQ ID NO: 2117038 - DNA, 19 bp, Homo sapiens
tcacaggtgtggtgtaatt

SEQ ID NO: 2117039 - DNA, 13 bp, Homo sapiens
tcacagtctcaca

SEQ ID NO: 2117040 - DNA, 13 bp, Homo sapiens
tcacagtgctgag

SEQ ID NO: 2117041 - DNA, 15 bp, Homo sapiens
tcacagtggcgagag

SEQ ID NO: 2117042 - DNA, 18 bp, Homo sapiens
tcacagtggcgagaggag

SEQ ID NO: 2117043 - DNA, 20 bp, Homo sapiens
tcacagtggcgagaggagag

SEQ ID NO: 2117044 - DNA, 16 bp, Homo sapiens
tcacagttcctcgccc

SEQ ID NO: 2117045 - DNA, 17 bp, Homo sapiens
tcacagttcctcgccct

SEQ ID NO: 2117046 - DNA, 20 bp, Homo sapiens
tcacagttcctcgccctggg

SEQ ID NO: 2117047 - DNA, 14 bp, Homo sapiens
tcacataatgaatg

SEQ ID NO: 2117048 - DNA, 15 bp, Homo sapiens
tcacatacaatttgc

SEQ ID NO: 2117049 - DNA, 18 bp, Homo sapiens
tcacatacaatttgcact

SEQ ID NO: 2117050 - DNA, 15 bp, Homo sapiens
tcactgagtggcttg

SEQ ID NO: 2117051 - DNA, 20 bp, Homo sapiens
tcactgcaacctccacctcc

SEQ ID NO: 2117052 - DNA, 20 bp, Homo sapiens
tcactgcacagtgcatctca

SEQ ID NO: 2117053 - DNA, 24 bp, Homo sapiens
tcactgcacagtgcatctcagccc

SEQ ID NO: 2117054 - DNA, 13 bp, Homo sapiens
tcactgcagcctc

SEQ ID NO: 2117055 - DNA, 22 bp, Homo sapiens
tcactgcagcctccttctcctg

SEQ ID NO: 2117056 - DNA, 21 bp, Homo sapiens
tcactgccccaccagccacct

SEQ ID NO: 2117057 - DNA, 15 bp, Homo sapiens
tcactgctggctgcc

SEQ ID NO: 2117058 - DNA, 16 bp, Homo sapiens
tcactgctggctgcct

SEQ ID NO: 2117059 - DNA, 15 bp, Homo sapiens
tcactggagcccagg

SEQ ID NO: 2117060 - DNA, 19 bp, Homo sapiens
tcactggagttacattaat

SEQ ID NO: 2117061 - DNA, 21 bp, Homo sapiens
tcactggagttacattaatgt

SEQ ID NO: 2117062 - DNA, 13 bp, Homo sapiens
tcactggctgggg

SEQ ID NO: 2117063 - DNA, 17 bp, Homo sapiens
tcactggggtcctgggg

SEQ ID NO: 2117064 - DNA, 19 bp, Homo sapiens
tcactggggtcctggggcc

SEQ ID NO: 2117065 - DNA, 18 bp, Homo sapiens
tcactggtagaccaaaat

SEQ ID NO: 2117066 - DNA, 20 bp, Homo sapiens
tcactggtagaccaaaataa

SEQ ID NO: 2117067 - DNA, 20 bp, Homo sapiens
tcactgtagaatgatttcat

SEQ ID NO: 2117068 - DNA, 20 bp, Homo sapiens
tcactgtgttggccaggctg

SEQ ID NO: 2117069 - DNA, 20 bp, Homo sapiens
tcactgttgaaaattatttt

SEQ ID NO: 2117070 - DNA, 14 bp, Homo sapiens
tcactgttgcccag

SEQ ID NO: 2117071 - DNA, 23 bp, Homo sapiens
tcactgttgcccaggctggcgtg

SEQ ID NO: 2117072 - DNA, 17 bp, Homo sapiens
tcacttaatgaaccacg

SEQ ID NO: 2117073 - DNA, 16 bp, Homo sapiens
tcacttccctgggaac

SEQ ID NO: 2117074 - DNA, 18 bp, Homo sapiens
tcacttctttgcagagcc

SEQ ID NO: 2117075 - DNA, 12 bp, Homo sapiens
tcacttgtaaat

SEQ ID NO: 2117076 - DNA, 14 bp, Homo sapiens
tcacttgtaaataa

SEQ ID NO: 2117077 - DNA, 15 bp, Homo sapiens
tcacttgtacaaaat

SEQ ID NO: 2117078 - DNA, 17 bp, Homo sapiens
tcacttgtgcagtgttg

SEQ ID NO: 2117079 - DNA, 19 bp, Homo sapiens
tcacttttaatgaacaaat

SEQ ID NO: 2117080 - DNA, 14 bp, Homo sapiens
tcacttttcagtga

SEQ ID NO: 2117081 - DNA, 16 bp, Homo sapiens
tcacttttcagtgatg

SEQ ID NO: 2117082 - DNA, 18 bp, Homo sapiens
tcacttttcctccctcag

SEQ ID NO: 2117083 - DNA, 20 bp, Homo sapiens
tcactttttaaaccactgta

SEQ ID NO: 2117084 - DNA, 18 bp, Homo sapiens
tcagaaaacataatataa

SEQ ID NO: 2117085 - DNA, 23 bp, Homo sapiens
tcagaaaacataatataagaatc

SEQ ID NO: 2117086 - DNA, 14 bp, Homo sapiens
tcagaaaagggaag

SEQ ID NO: 2117087 - DNA, 15 bp, Homo sapiens
tcagaaaccagactc

SEQ ID NO: 2117088 - DNA, 22 bp, Homo sapiens
tcagaaactcgatgaatgtgtt

SEQ ID NO: 2117089 - DNA, 12 bp, Homo sapiens
tcagaaactgtt

SEQ ID NO: 2117090 - DNA, 14 bp, Homo sapiens
tcagaaagagcaag

SEQ ID NO: 2117091 - DNA, 18 bp, Homo sapiens
tcagaaagggagggctct

SEQ ID NO: 2117092 - DNA, 22 bp, Homo sapiens
tcagaaagggagggctctgagg

SEQ ID NO: 2117093 - DNA, 23 bp, Homo sapiens
tcagaaagggagggctctgaggc

SEQ ID NO: 2117094 - DNA, 16 bp, Homo sapiens
tcagaacatcctccaa

SEQ ID NO: 2117095 - DNA, 15 bp, Homo sapiens
tcagaacatgctgga

SEQ ID NO: 2117096 - DNA, 13 bp, Homo sapiens
tcagaagaaaaag

SEQ ID NO: 2117097 - DNA, 16 bp, Homo sapiens
tcagaagaaaaagaag

SEQ ID NO: 2117098 - DNA, 17 bp, Homo sapiens
tcagaagaaaaagaagc

SEQ ID NO: 2117099 - DNA, 18 bp, Homo sapiens
tcagaagaaaaagaagca

SEQ ID NO: 2117100 - DNA, 12 bp, Homo sapiens
tcagaagaaaga

SEQ ID NO: 2117101 - DNA, 12 bp, Homo sapiens
tcagaagaaatt

SEQ ID NO: 2117102 - DNA, 14 bp, Homo sapiens
tcagaagacactga

SEQ ID NO: 2117103 - DNA, 12 bp, Homo sapiens
tcagaagcaggt

SEQ ID NO: 2117104 - DNA, 13 bp, Homo sapiens
tcagaagcctgag

SEQ ID NO: 2117105 - DNA, 14 bp, Homo sapiens
tcagaagcctgggg

SEQ ID NO: 2117106 - DNA, 15 bp, Homo sapiens
tcagaagcctggggg

SEQ ID NO: 2117107 - DNA, 19 bp, Homo sapiens
tcagaagcctgggggcctg

SEQ ID NO: 2117108 - DNA, 21 bp, Homo sapiens
tcagaagcctgggggcctggc

SEQ ID NO: 2117109 - DNA, 23 bp, Homo sapiens
tcagaagcctgggggcctggctg

SEQ ID NO: 2117110 - DNA, 16 bp, Homo sapiens
tcagaaggagaaggaa

SEQ ID NO: 2117111 - DNA, 18 bp, Homo sapiens
tcagaaggagaaggaagg

SEQ ID NO: 2117112 - DNA, 17 bp, Homo sapiens
tcagaaggctggggcca

SEQ ID NO: 2117113 - DNA, 20 bp, Homo sapiens
tcagaaggctggggccagtg

SEQ ID NO: 2117114 - DNA, 19 bp, Homo sapiens
tcagaagtttctcagctcc

SEQ ID NO: 2117115 - DNA, 19 bp, Homo sapiens
tcagaagtttggataacct

SEQ ID NO: 2117116 - DNA, 17 bp, Homo sapiens
tcagaagtttggcaata

SEQ ID NO: 2117117 - DNA, 17 bp, Homo sapiens
tcagaatcaggttgaca

SEQ ID NO: 2117118 - DNA, 12 bp, Homo sapiens
tcagaatccaaa

SEQ ID NO: 2117119 - DNA, 17 bp, Homo sapiens
tcagaattgaaggagaa

SEQ ID NO: 2117120 - DNA, 15 bp, Homo sapiens
tcagaattttaccaa

SEQ ID NO: 2117121 - DNA, 14 bp, Homo sapiens
tcagaattttgtat

SEQ ID NO: 2117122 - DNA, 16 bp, Homo sapiens
tcagacaatccactct

SEQ ID NO: 2117123 - DNA, 20 bp, Homo sapiens
tcagacacttcatggaccaa

SEQ ID NO: 2117124 - DNA, 22 bp, Homo sapiens
tcagacatgaaaactattttaa

SEQ ID NO: 2117125 - DNA, 14 bp, Homo sapiens
tcagacccccactc

SEQ ID NO: 2117126 - DNA, 14 bp, Homo sapiens
tcagaccctacccc

SEQ ID NO: 2117127 - DNA, 16 bp, Homo sapiens
tcagaccctaccccac

SEQ ID NO: 2117128 - DNA, 15 bp, Homo sapiens
tcagactctgggtcc

SEQ ID NO: 2117129 - DNA, 13 bp, Homo sapiens
tcagactgctggg

SEQ ID NO: 2117130 - DNA, 14 bp, Homo sapiens
tcagactgctggga

SEQ ID NO: 2117131 - DNA, 15 bp, Homo sapiens
tcagacttacttact

SEQ ID NO: 2117132 - DNA, 23 bp, Homo sapiens
tcagactttaaagaataatatgc

SEQ ID NO: 2117133 - DNA, 15 bp, Homo sapiens
tcagacttttatcaa

SEQ ID NO: 2117134 - DNA, 19 bp, Homo sapiens
tcagacttttatcaaaatc

SEQ ID NO: 2117135 - DNA, 12 bp, Homo sapiens
tcagagaatttc

SEQ ID NO: 2117136 - DNA, 20 bp, Homo sapiens
tcagagactcagggccccag

SEQ ID NO: 2117137 - DNA, 14 bp, Homo sapiens
tcagagagagtgtt

SEQ ID NO: 2117138 - DNA, 22 bp, Homo sapiens
tcagagaggccttttgtttaaa

SEQ ID NO: 2117139 - DNA, 17 bp, Homo sapiens
tcagagaggtctcaggt

SEQ ID NO: 2117140 - DNA, 15 bp, Homo sapiens
tcagagatgaaacta

SEQ ID NO: 2117141 - DNA, 22 bp, Homo sapiens
tcagagatggtaatctacagct

SEQ ID NO: 2117142 - DNA, 15 bp, Homo sapiens
tcagagcagagcaaa

SEQ ID NO: 2117143 - DNA, 17 bp, Homo sapiens
tcagagccaggctctgc

SEQ ID NO: 2117144 - DNA, 14 bp, Homo sapiens
tcagagccagtgaa

SEQ ID NO: 2117145 - DNA, 13 bp, Homo sapiens
tcagagcctagcc

SEQ ID NO: 2117146 - DNA, 20 bp, Homo sapiens
tcagagcctagccacctccc

SEQ ID NO: 2117147 - DNA, 23 bp, Homo sapiens
tcagagcctagccacctcccacc

SEQ ID NO: 2117148 - DNA, 18 bp, Homo sapiens
tcagagcctgcagttatt

SEQ ID NO: 2117149 - DNA, 9 bp, Homo sapiens
tcagagctc

SEQ ID NO: 2117150 - DNA, 13 bp, Homo sapiens
tcagagctcttaa

SEQ ID NO: 2117151 - DNA, 16 bp, Homo sapiens
tcagagctcttaatgt

SEQ ID NO: 2117152 - DNA, 19 bp, Homo sapiens
tcagagctcttcaagctgt

SEQ ID NO: 2117153 - DNA, 15 bp, Homo sapiens
tcagagctgttggcc

SEQ ID NO: 2117154 - DNA, 19 bp, Homo sapiens
tcagagctgttggcctcgc

SEQ ID NO: 2117155 - DNA, 14 bp, Homo sapiens
tcagaggcagcagg

SEQ ID NO: 2117156 - DNA, 14 bp, Homo sapiens
tcagaggccctgga

SEQ ID NO: 2117157 - DNA, 14 bp, Homo sapiens
tcagaggctgcagg

SEQ ID NO: 2117158 - DNA, 15 bp, Homo sapiens
tcagagtcttgtccc

SEQ ID NO: 2117159 - DNA, 21 bp, Homo sapiens
tcagagtgacatccaggagga

SEQ ID NO: 2117160 - DNA, 16 bp, Homo sapiens
tcagagttgcttttct

SEQ ID NO: 2117161 - DNA, 22 bp, Homo sapiens
tcagatattttttcagaaatat

SEQ ID NO: 2117162 - DNA, 19 bp, Homo sapiens
tcagatcgtattaattatc

SEQ ID NO: 2117163 - DNA, 20 bp, Homo sapiens
tcagatctgaacacagttta

SEQ ID NO: 2117164 - DNA, 17 bp, Homo sapiens
tcagatgatctctccac

SEQ ID NO: 2117165 - DNA, 21 bp, Homo sapiens
attctccaggattccaaagtt

SEQ ID NO: 2117166 - DNA, 22 bp, Homo sapiens
attctccctaaggaatctgaaa

SEQ ID NO: 2117167 - DNA, 17 bp, Homo sapiens
attctcctgcctcagcc

SEQ ID NO: 2117168 - DNA, 18 bp, Homo sapiens
attctctcctcagactgc

SEQ ID NO: 2117169 - DNA, 22 bp, Homo sapiens
attctctcctcagactgctcaa

SEQ ID NO: 2117170 - DNA, 15 bp, Homo sapiens
attctctctcctgtc

SEQ ID NO: 2117171 - DNA, 16 bp, Homo sapiens
attctctctcctgtcc

SEQ ID NO: 2117172 - DNA, 17 bp, Homo sapiens
attctctctcctgtcca

SEQ ID NO: 2117173 - DNA, 20 bp, Homo sapiens
attctctttctttttctgtc

SEQ ID NO: 2117174 - DNA, 14 bp, Homo sapiens
attctgaatgaata

SEQ ID NO: 2117175 - DNA, 17 bp, Homo sapiens
attctgacttctcccat

SEQ ID NO: 2117176 - DNA, 18 bp, Homo sapiens
attctgcctgcccaggcc

SEQ ID NO: 2117177 - DNA, 18 bp, Homo sapiens
attctgctcacatatctg

SEQ ID NO: 2117178 - DNA, 19 bp, Homo sapiens
attctgctcacatatctgt

SEQ ID NO: 2117179 - DNA, 21 bp, Homo sapiens
attctggaaaaaaaatatata

SEQ ID NO: 2117180 - DNA, 20 bp, Homo sapiens
attctggaactgtggctttg

SEQ ID NO: 2117181 - DNA, 23 bp, Homo sapiens
attctgggctcctggaaccaatc

SEQ ID NO: 2117182 - DNA, 16 bp, Homo sapiens
attctggtcttcactg

SEQ ID NO: 2117183 - DNA, 20 bp, Homo sapiens
attctgttgcccaggctggc

SEQ ID NO: 2117184 - DNA, 12 bp, Homo sapiens
attctgttttct

SEQ ID NO: 2117185 - DNA, 20 bp, Homo sapiens
attcttaaaatatatttcag

SEQ ID NO: 2117186 - DNA, 16 bp, Homo sapiens
attcttaaaggaaaag

SEQ ID NO: 2117187 - DNA, 17 bp, Homo sapiens
attcttacaaacatgtg

SEQ ID NO: 2117188 - DNA, 17 bp, Homo sapiens
attcttaccgagaaaag

SEQ ID NO: 2117189 - DNA, 19 bp, Homo sapiens
attcttaccgagaaaagga

SEQ ID NO: 2117190 - DNA, 14 bp, Homo sapiens
attcttatgcttat

SEQ ID NO: 2117191 - DNA, 19 bp, Homo sapiens
attcttccagtgcaacaaa

SEQ ID NO: 2117192 - DNA, 14 bp, Homo sapiens
attcttccatctga

SEQ ID NO: 2117193 - DNA, 12 bp, Homo sapiens
attcttctgctt

SEQ ID NO: 2117194 - DNA, 14 bp, Homo sapiens
attcttctgcttca

SEQ ID NO: 2117195 - DNA, 16 bp, Homo sapiens
attcttgaaagctgtg

SEQ ID NO: 2117196 - DNA, 21 bp, Homo sapiens
attctttatttctgtcattca

SEQ ID NO: 2117197 - DNA, 21 bp, Homo sapiens
attgaaaatagtaaatgcttt

SEQ ID NO: 2117198 - DNA, 16 bp, Homo sapiens
attgaaattactgaaa

SEQ ID NO: 2117199 - DNA, 21 bp, Homo sapiens
attgaaatttaaaaataaagc

SEQ ID NO: 2117200 - DNA, 22 bp, Homo sapiens
attgaacaagttgtttcattga

SEQ ID NO: 2117201 - DNA, 15 bp, Homo sapiens
attgaagaaacagat

SEQ ID NO: 2117202 - DNA, 14 bp, Homo sapiens
attgaatatatcag

SEQ ID NO: 2117203 - DNA, 23 bp, Homo sapiens
attgaatctgattggacattttc

SEQ ID NO: 2117204 - DNA, 16 bp, Homo sapiens
attgaatgtttccaac

SEQ ID NO: 2117205 - DNA, 13 bp, Homo sapiens
attgacaacattt

SEQ ID NO: 2117206 - DNA, 21 bp, Homo sapiens
attgacaaggtagacatggat

SEQ ID NO: 2117207 - DNA, 16 bp, Homo sapiens
attgacacacagcact

SEQ ID NO: 2117208 - DNA, 13 bp, Homo sapiens
attgacctcagct

SEQ ID NO: 2117209 - DNA, 15 bp, Homo sapiens
attgacctcagctgc

SEQ ID NO: 2117210 - DNA, 22 bp, Homo sapiens
attgacttcttggtttggggag

SEQ ID NO: 2117211 - DNA, 21 bp, Homo sapiens
attgagaattttaaattataa

SEQ ID NO: 2117212 - DNA, 12 bp, Homo sapiens
attgaggcctgc

SEQ ID NO: 2117213 - DNA, 15 bp, Homo sapiens
attgatccacttctt

SEQ ID NO: 2117214 - DNA, 23 bp, Homo sapiens
attgatcggagcctcctctctca

SEQ ID NO: 2117215 - DNA, 16 bp, Homo sapiens
attgatgtttccagaa

SEQ ID NO: 2117216 - DNA, 20 bp, Homo sapiens
attgatgtttccagaaaata

SEQ ID NO: 2117217 - DNA, 21 bp, Homo sapiens
attgatgtttccagaaaatat

SEQ ID NO: 2117218 - DNA, 23 bp, Homo sapiens
attgatgtttccagaaaatataa

SEQ ID NO: 2117219 - DNA, 22 bp, Homo sapiens
attgatttctacgttatgaaaa

SEQ ID NO: 2117220 - DNA, 23 bp, Homo sapiens
attgatttctacgttatgaaaac

SEQ ID NO: 2117221 - DNA, 16 bp, Homo sapiens
attgcaacaggctggg

SEQ ID NO: 2117222 - DNA, 10 bp, Homo sapiens
attgcacaat

SEQ ID NO: 2117223 - DNA, 12 bp, Homo sapiens
attgcacaattt

SEQ ID NO: 2117224 - DNA, 15 bp, Homo sapiens
attgcacaatttgag

SEQ ID NO: 2117225 - DNA, 18 bp, Homo sapiens
attgcacaatttgagcaa

SEQ ID NO: 2117226 - DNA, 15 bp, Homo sapiens
attgcactccagtct

SEQ ID NO: 2117227 - DNA, 18 bp, Homo sapiens
attgcatcacctctgtaa

SEQ ID NO: 2117228 - DNA, 15 bp, Homo sapiens
atttataaatgtgtg

SEQ ID NO: 2117229 - DNA, 13 bp, Homo sapiens
atttataactcat

SEQ ID NO: 2117230 - DNA, 15 bp, Homo sapiens
atttataactcatca

SEQ ID NO: 2117231 - DNA, 16 bp, Homo sapiens
atttataactcatcat

SEQ ID NO: 2117232 - DNA, 18 bp, Homo sapiens
atttataactcatcataa

SEQ ID NO: 2117233 - DNA, 19 bp, Homo sapiens
atttataactcatcataaa

SEQ ID NO: 2117234 - DNA, 21 bp, Homo sapiens
atttataactcatcataaaat

SEQ ID NO: 2117235 - DNA, 23 bp, Homo sapiens
atttataactcatcataaaataa

SEQ ID NO: 2117236 - DNA, 14 bp, Homo sapiens
atttatacaaaata

SEQ ID NO: 2117237 - DNA, 14 bp, Homo sapiens
atttatagtttgta

SEQ ID NO: 2117238 - DNA, 18 bp, Homo sapiens
atttatatatatatgtat

SEQ ID NO: 2117239 - DNA, 17 bp, Homo sapiens
atttatatatggcatat

SEQ ID NO: 2117240 - DNA, 18 bp, Homo sapiens
atttatatatggcatatt

SEQ ID NO: 2117241 - DNA, 19 bp, Homo sapiens
atttatatatggcatattt

SEQ ID NO: 2117242 - DNA, 20 bp, Homo sapiens
atttatatatggcatattta

SEQ ID NO: 2117243 - DNA, 23 bp, Homo sapiens
atttatatatggcatatttatat

SEQ ID NO: 2117244 - DNA, 14 bp, Homo sapiens
atttatatatgtat

SEQ ID NO: 2117245 - DNA, 14 bp, Homo sapiens
atttatatatttat

SEQ ID NO: 2117246 - DNA, 16 bp, Homo sapiens
atttatatatttataa

SEQ ID NO: 2117247 - DNA, 20 bp, Homo sapiens
atttatatatttataactca

SEQ ID NO: 2117248 - DNA, 16 bp, Homo sapiens
atttatatctatagta

SEQ ID NO: 2117249 - DNA, 14 bp, Homo sapiens
atttatatgtgtaa

SEQ ID NO: 2117250 - DNA, 18 bp, Homo sapiens
atttatatgttaatttgt

SEQ ID NO: 2117251 - DNA, 16 bp, Homo sapiens
atttatattagagtgc

SEQ ID NO: 2117252 - DNA, 19 bp, Homo sapiens
atttatattcagagatgta

SEQ ID NO: 2117253 - DNA, 23 bp, Homo sapiens
atttatattcagagatgtaccat

SEQ ID NO: 2117254 - DNA, 20 bp, Homo sapiens
atttatattgtaaatattgt

SEQ ID NO: 2117255 - DNA, 17 bp, Homo sapiens
atttatattgtatattc

SEQ ID NO: 2117256 - DNA, 16 bp, Homo sapiens
atttatatttgaaatt

SEQ ID NO: 2117257 - DNA, 17 bp, Homo sapiens
atttatatttgaaattt

SEQ ID NO: 2117258 - DNA, 12 bp, Homo sapiens
atttatatttgg

SEQ ID NO: 2117259 - DNA, 14 bp, Homo sapiens
atttatatttggaa

SEQ ID NO: 2117260 - DNA, 15 bp, Homo sapiens
atttatatttggaaa

SEQ ID NO: 2117261 - DNA, 16 bp, Homo sapiens
atttatatttggaaag

SEQ ID NO: 2117262 - DNA, 18 bp, Homo sapiens
atttatcaaacttgtgct

SEQ ID NO: 2117263 - DNA, 17 bp, Homo sapiens
atttatcagtgacagag

SEQ ID NO: 2117264 - DNA, 18 bp, Homo sapiens
atttatcagtgacagagt

SEQ ID NO: 2117265 - DNA, 23 bp, Homo sapiens
atttatctgaatataggaagcat

SEQ ID NO: 2117266 - DNA, 16 bp, Homo sapiens
atttatctgtgcaaat

SEQ ID NO: 2117267 - DNA, 22 bp, Homo sapiens
atttatgaatgtgcatttcttg

SEQ ID NO: 2117268 - DNA, 23 bp, Homo sapiens
atttatgaatgtgcatttcttga

SEQ ID NO: 2117269 - DNA, 15 bp, Homo sapiens
atttatgagtttttg

SEQ ID NO: 2117270 - DNA, 12 bp, Homo sapiens
atttatggctta

SEQ ID NO: 2117271 - DNA, 14 bp, Homo sapiens
atttatggtttctg

SEQ ID NO: 2117272 - DNA, 22 bp, Homo sapiens
atttatggtttctgcgtgcttt

SEQ ID NO: 2117273 - DNA, 23 bp, Homo sapiens
atttatgtaaactgcattagaaa

SEQ ID NO: 2117274 - DNA, 22 bp, Homo sapiens
atttatgtctatttaagcctca

SEQ ID NO: 2117275 - DNA, 15 bp, Homo sapiens
atttattacctctga

SEQ ID NO: 2117276 - DNA, 15 bp, Homo sapiens
atttattagctgtaa

SEQ ID NO: 2117277 - DNA, 14 bp, Homo sapiens
atttattattttca

SEQ ID NO: 2117278 - DNA, 18 bp, Homo sapiens
atttattcaattcctctg

SEQ ID NO: 2117279 - DNA, 15 bp, Homo sapiens
atttattcactgtaa

SEQ ID NO: 2117280 - DNA, 18 bp, Homo sapiens
atttattcactgtaagtt

SEQ ID NO: 2117281 - DNA, 20 bp, Homo sapiens
atttattcagcttcatttgt

SEQ ID NO: 2117282 - DNA, 13 bp, Homo sapiens
atttattctgctc

SEQ ID NO: 2117283 - DNA, 20 bp, Homo sapiens
atttattgcttgatactttt

SEQ ID NO: 2117284 - DNA, 20 bp, Homo sapiens
atttattgtttatttatcag

SEQ ID NO: 2117285 - DNA, 22 bp, Homo sapiens
atttattgtttatttatcagtg

SEQ ID NO: 2117286 - DNA, 24 bp, Homo sapiens
atttatttactgagcttctctgtg

SEQ ID NO: 2117287 - DNA, 16 bp, Homo sapiens
atttatttcatccagt

SEQ ID NO: 2117288 - DNA, 14 bp, Homo sapiens
atttatttctgtaa

SEQ ID NO: 2117289 - DNA, 22 bp, Homo sapiens
atttattttgaaatttgtttct

SEQ ID NO: 2117290 - DNA, 13 bp, Homo sapiens
atttattttgaca

SEQ ID NO: 2117291 - DNA, 22 bp, Homo sapiens
atttattttgtatttttgaata

SEQ ID NO: 2117292 - DNA, 21 bp, Homo sapiens
atttattttttaatcatttaa

SEQ ID NO: 2117293 - DNA, 21 bp, Homo sapiens
atttcaaaagacatgttgtaa

SEQ ID NO: 2117294 - DNA, 21 bp, Homo sapiens
atttcaaaatggacgtactgg

SEQ ID NO: 2117295 - DNA, 11 bp, Homo sapiens
atttcaaatga

SEQ ID NO: 2117296 - DNA, 22 bp, Homo sapiens
caagctcaggaggcgaataaat

SEQ ID NO: 2117297 - DNA, 21 bp, Homo sapiens
caagctccatctccactccag

SEQ ID NO: 2117298 - DNA, 15 bp, Homo sapiens
caagctctgctcctc

SEQ ID NO: 2117299 - DNA, 22 bp, Homo sapiens
caagctgaagtgaaggagaaag

SEQ ID NO: 2117300 - DNA, 15 bp, Homo sapiens
caagctgaggtgccc

SEQ ID NO: 2117301 - DNA, 20 bp, Homo sapiens
caagctgaggtgcccaggag

SEQ ID NO: 2117302 - DNA, 15 bp, Homo sapiens
caagctgagtgactg

SEQ ID NO: 2117303 - DNA, 14 bp, Homo sapiens
caagctgcatctag

SEQ ID NO: 2117304 - DNA, 17 bp, Homo sapiens
caagctggtcccactca

SEQ ID NO: 2117305 - DNA, 23 bp, Homo sapiens
caagctggtcccactcagtccat

SEQ ID NO: 2117306 - DNA, 12 bp, Homo sapiens
caagctgtcccc

SEQ ID NO: 2117307 - DNA, 20 bp, Homo sapiens
caagctgtcccctctgtcat

SEQ ID NO: 2117308 - DNA, 13 bp, Homo sapiens
caagctgttccac

SEQ ID NO: 2117309 - DNA, 14 bp, Homo sapiens
caagctgttttctt

SEQ ID NO: 2117310 - DNA, 20 bp, Homo sapiens
caagcttaatggctgataat

SEQ ID NO: 2117311 - DNA, 22 bp, Homo sapiens
caagcttcaaccctcagccttg

SEQ ID NO: 2117312 - DNA, 14 bp, Homo sapiens
caagcttcaagtga

SEQ ID NO: 2117313 - DNA, 21 bp, Homo sapiens
caagcttcaagtgatatatgt

SEQ ID NO: 2117314 - DNA, 13 bp, Homo sapiens
caagcttcagagc

SEQ ID NO: 2117315 - DNA, 19 bp, Homo sapiens
caagcttcagagcctagcc

SEQ ID NO: 2117316 - DNA, 21 bp, Homo sapiens
caagcttcagagcctagccac

SEQ ID NO: 2117317 - DNA, 14 bp, Homo sapiens
caagcttgtatata

SEQ ID NO: 2117318 - DNA, 21 bp, Homo sapiens
caagcttgtatatacatatta

SEQ ID NO: 2117319 - DNA, 18 bp, Homo sapiens
caagcttgtgagagctgg

SEQ ID NO: 2117320 - DNA, 22 bp, Homo sapiens
caagctttgaatacccccagag

SEQ ID NO: 2117321 - DNA, 23 bp, Homo sapiens
caagctttgaatacccccagaga

SEQ ID NO: 2117322 - DNA, 17 bp, Homo sapiens
caaggaaagtgaacctt

SEQ ID NO: 2117323 - DNA, 15 bp, Homo sapiens
caaggaacaagagaa

SEQ ID NO: 2117324 - DNA, 19 bp, Homo sapiens
caaggaacctaattgaaat

SEQ ID NO: 2117325 - DNA, 16 bp, Homo sapiens
caaggaaggaaagaaa

SEQ ID NO: 2117326 - DNA, 13 bp, Homo sapiens
caaggaagtgggg

SEQ ID NO: 2117327 - DNA, 21 bp, Homo sapiens
caaggaagtgggggccgctgg

SEQ ID NO: 2117328 - DNA, 23 bp, Homo sapiens
caaggaagtgggggccgctggcc

SEQ ID NO: 2117329 - DNA, 16 bp, Homo sapiens
caaggacaacctgccc

SEQ ID NO: 2117330 - DNA, 20 bp, Homo sapiens
caaggacaacctgcccctcc

SEQ ID NO: 2117331 - DNA, 20 bp, Homo sapiens
caaggaccctgttttccaca

SEQ ID NO: 2117332 - DNA, 12 bp, Homo sapiens
caaggactcctg

SEQ ID NO: 2117333 - DNA, 16 bp, Homo sapiens
caaggactctggcctc

SEQ ID NO: 2117334 - DNA, 17 bp, Homo sapiens
caaggactctggcctct

SEQ ID NO: 2117335 - DNA, 14 bp, Homo sapiens
caaggagaaacaga

SEQ ID NO: 2117336 - DNA, 16 bp, Homo sapiens
caaggagaaacagaga

SEQ ID NO: 2117337 - DNA, 18 bp, Homo sapiens
caaggagaaacagagaca

SEQ ID NO: 2117338 - DNA, 20 bp, Homo sapiens
caaggagaaacagagacagg

SEQ ID NO: 2117339 - DNA, 16 bp, Homo sapiens
caaggagatataaaat

SEQ ID NO: 2117340 - DNA, 21 bp, Homo sapiens
caaggagctgatttccaggcc

SEQ ID NO: 2117341 - DNA, 12 bp, Homo sapiens
caaggaggaaaa

SEQ ID NO: 2117342 - DNA, 13 bp, Homo sapiens
caaggaggaaaaa

SEQ ID NO: 2117343 - DNA, 20 bp, Homo sapiens
caaggaggaaaaacagacaa

SEQ ID NO: 2117344 - DNA, 17 bp, Homo sapiens
caaggaggtctgtgcca

SEQ ID NO: 2117345 - DNA, 18 bp, Homo sapiens
caaggagtaagtacaaat

SEQ ID NO: 2117346 - DNA, 17 bp, Homo sapiens
caaggatatcagagctg

SEQ ID NO: 2117347 - DNA, 16 bp, Homo sapiens
caaggcacttgtcact

SEQ ID NO: 2117348 - DNA, 14 bp, Homo sapiens
caaggcagcctcca

SEQ ID NO: 2117349 - DNA, 21 bp, Homo sapiens
caaggcagcctccagagccag

SEQ ID NO: 2117350 - DNA, 22 bp, Homo sapiens
caaggcagcctccagagccagc

SEQ ID NO: 2117351 - DNA, 15 bp, Homo sapiens
caaggcagcgggatc

SEQ ID NO: 2117352 - DNA, 14 bp, Homo sapiens
caaggcagtgttcc

SEQ ID NO: 2117353 - DNA, 13 bp, Homo sapiens
caaggcccgagca

SEQ ID NO: 2117354 - DNA, 21 bp, Homo sapiens
caaggcccgagcagctgagca

SEQ ID NO: 2117355 - DNA, 16 bp, Homo sapiens
caaggccctgtcccag

SEQ ID NO: 2117356 - DNA, 20 bp, Homo sapiens
caaggccctgtcccagcaga

SEQ ID NO: 2117357 - DNA, 21 bp, Homo sapiens
caaggctcttctccttggagg

SEQ ID NO: 2117358 - DNA, 19 bp, Homo sapiens
caaggctgaccaagagaga

SEQ ID NO: 2117359 - DNA, 16 bp, Homo sapiens
caaggctgctcagagg

SEQ ID NO: 2117360 - DNA, 22 bp, Homo sapiens
caaggctgggcacctctagtgc

SEQ ID NO: 2117361 - DNA, 13 bp, Homo sapiens
caagggaaggaag

SEQ ID NO: 2117362 - DNA, 22 bp, Homo sapiens
caagggcaaaccatttcaaatg

SEQ ID NO: 2117363 - DNA, 15 bp, Homo sapiens
caagggcatcaggca

SEQ ID NO: 2117364 - DNA, 18 bp, Homo sapiens
caagggcatcaggcactg

SEQ ID NO: 2117365 - DNA, 14 bp, Homo sapiens
caagggccatgctg

SEQ ID NO: 2117366 - DNA, 12 bp, Homo sapiens
caagggctccag

SEQ ID NO: 2117367 - DNA, 23 bp, Homo sapiens
caagggctccagcatccagcctg

SEQ ID NO: 2117368 - DNA, 23 bp, Homo sapiens
caaggggaatgtttgcctctgcc

SEQ ID NO: 2117369 - DNA, 18 bp, Homo sapiens
caaggggacttgtgccag

SEQ ID NO: 2117370 - DNA, 21 bp, Homo sapiens
caaggggcccacaaaggggag

SEQ ID NO: 2117371 - DNA, 20 bp, Homo sapiens
caaggggctcagcaaggtgt

SEQ ID NO: 2117372 - DNA, 23 bp, Homo sapiens
caaggggtctgtatatacatttc

SEQ ID NO: 2117373 - DNA, 19 bp, Homo sapiens
caagggttcagagactcag

SEQ ID NO: 2117374 - DNA, 13 bp, Homo sapiens
caaggtagacatg

SEQ ID NO: 2117375 - DNA, 22 bp, Homo sapiens
caaggtctccttactctgagcc

SEQ ID NO: 2117376 - DNA, 13 bp, Homo sapiens
caaggtctgcttt

SEQ ID NO: 2117377 - DNA, 20 bp, Homo sapiens
caaggtgggctgagccctgg

SEQ ID NO: 2117378 - DNA, 24 bp, Homo sapiens
caaggtgggctgagccctggcagg

SEQ ID NO: 2117379 - DNA, 12 bp, Homo sapiens
caaggtgtcttt

SEQ ID NO: 2117380 - DNA, 21 bp, Homo sapiens
caaggtgtttccatttctcaa

SEQ ID NO: 2117381 - DNA, 23 bp, Homo sapiens
caaggttactcagcagcagagag

SEQ ID NO: 2117382 - DNA, 17 bp, Homo sapiens
caaggttccctctgaga

SEQ ID NO: 2117383 - DNA, 15 bp, Homo sapiens
caaggttcttctaaa

SEQ ID NO: 2117384 - DNA, 16 bp, Homo sapiens
caagtactgctgtaaa

SEQ ID NO: 2117385 - DNA, 19 bp, Homo sapiens
caagtatgaataaagacac

SEQ ID NO: 2117386 - DNA, 23 bp, Homo sapiens
caagtattaggggtaatatattg

SEQ ID NO: 2117387 - DNA, 20 bp, Homo sapiens
caagtattgcgaatgtgcag

SEQ ID NO: 2117388 - DNA, 20 bp, Homo sapiens
caagtatttattattgaaga

SEQ ID NO: 2117389 - DNA, 20 bp, Homo sapiens
caagtatttgttaatttaga

SEQ ID NO: 2117390 - DNA, 19 bp, Homo sapiens
caagtcaaccaatgtagaa

SEQ ID NO: 2117391 - DNA, 14 bp, Homo sapiens
caagtcacagctgc

SEQ ID NO: 2117392 - DNA, 19 bp, Homo sapiens
caagtcacagctgcagctg

SEQ ID NO: 2117393 - DNA, 19 bp, Homo sapiens
caagtcaggcccttatttt

SEQ ID NO: 2117394 - DNA, 22 bp, Homo sapiens
caagtcatgatggagacttcag

SEQ ID NO: 2117395 - DNA, 17 bp, Homo sapiens
caagtcattttaacttt

SEQ ID NO: 2117396 - DNA, 13 bp, Homo sapiens
caagtccaacctg

SEQ ID NO: 2117397 - DNA, 14 bp, Homo sapiens
caagtccaacctgc

SEQ ID NO: 2117398 - DNA, 19 bp, Homo sapiens
caagtccaacctgcctgtg

SEQ ID NO: 2117399 - DNA, 20 bp, Homo sapiens
caagtccaacctgcctgtgc

SEQ ID NO: 2117400 - DNA, 14 bp, Homo sapiens
caagtccaagcata

SEQ ID NO: 2117401 - DNA, 12 bp, Homo sapiens
caagtccagagc

SEQ ID NO: 2117402 - DNA, 18 bp, Homo sapiens
caagtctggatctgggac

SEQ ID NO: 2117403 - DNA, 13 bp, Homo sapiens
caagtgaatctaa

SEQ ID NO: 2117404 - DNA, 15 bp, Homo sapiens
caagtgacatctctt

SEQ ID NO: 2117405 - DNA, 20 bp, Homo sapiens
caagtgatatatgtatttat

SEQ ID NO: 2117406 - DNA, 21 bp, Homo sapiens
caagtgattctcctgcctcag

SEQ ID NO: 2117407 - DNA, 19 bp, Homo sapiens
caagtgcatgctctctgca

SEQ ID NO: 2117408 - DNA, 18 bp, Homo sapiens
caagtgccatcccacatt

SEQ ID NO: 2117409 - DNA, 15 bp, Homo sapiens
caagtgcccgccctg

SEQ ID NO: 2117410 - DNA, 18 bp, Homo sapiens
caagtgcctcttgttgca

SEQ ID NO: 2117411 - DNA, 15 bp, Homo sapiens
caagtgctatgccaa

SEQ ID NO: 2117412 - DNA, 13 bp, Homo sapiens
caagtgggggcag

SEQ ID NO: 2117413 - DNA, 14 bp, Homo sapiens
caagtgggggcaga

SEQ ID NO: 2117414 - DNA, 14 bp, Homo sapiens
caagtgtatatcag

SEQ ID NO: 2117415 - DNA, 23 bp, Homo sapiens
caagtgtgttgggaattgcatgc

SEQ ID NO: 2117416 - DNA, 14 bp, Homo sapiens
caagttagctcagg

SEQ ID NO: 2117417 - DNA, 16 bp, Homo sapiens
caagttagctcaggag

SEQ ID NO: 2117418 - DNA, 17 bp, Homo sapiens
caagttagctcaggagg

SEQ ID NO: 2117419 - DNA, 19 bp, Homo sapiens
caagttagctcaggaggct

SEQ ID NO: 2117420 - DNA, 20 bp, Homo sapiens
caagttataaatcaatgtca

SEQ ID NO: 2117421 - DNA, 23 bp, Homo sapiens
caagttattaatcttatgtgttt

SEQ ID NO: 2117422 - DNA, 16 bp, Homo sapiens
caagttattctcttca

SEQ ID NO: 2117423 - DNA, 12 bp, Homo sapiens
caagttcaatct

SEQ ID NO: 2117424 - DNA, 21 bp, Homo sapiens
caagttcagggaagcaggcag

SEQ ID NO: 2117425 - DNA, 17 bp, Homo sapiens
caagttccagctggtct

SEQ ID NO: 2117426 - DNA, 21 bp, Homo sapiens
caagttcctctagtgccctcc

SEQ ID NO: 2117427 - DNA, 19 bp, Homo sapiens
cacccccagcctgggccta

SEQ ID NO: 2117428 - DNA, 12 bp, Homo sapiens
cacccccagctt

SEQ ID NO: 2117429 - DNA, 15 bp, Homo sapiens
caccccccaagctgt

SEQ ID NO: 2117430 - DNA, 17 bp, Homo sapiens
cacccccgccacggcca

SEQ ID NO: 2117431 - DNA, 16 bp, Homo sapiens
caccccctaccccaga

SEQ ID NO: 2117432 - DNA, 13 bp, Homo sapiens
caccccctccagc

SEQ ID NO: 2117433 - DNA, 19 bp, Homo sapiens
caccccctccagctccagt

SEQ ID NO: 2117434 - DNA, 16 bp, Homo sapiens
caccccctcccacccc

SEQ ID NO: 2117435 - DNA, 15 bp, Homo sapiens
caccccctccccagg

SEQ ID NO: 2117436 - DNA, 17 bp, Homo sapiens
caccccctgcagcttgt

SEQ ID NO: 2117437 - DNA, 16 bp, Homo sapiens
cacccccttcagtgcc

SEQ ID NO: 2117438 - DNA, 18 bp, Homo sapiens
caccccggcctccactcc

SEQ ID NO: 2117439 - DNA, 15 bp, Homo sapiens
cacccctccaaagcc

SEQ ID NO: 2117440 - DNA, 15 bp, Homo sapiens
cacccctcccctgcc

SEQ ID NO: 2117441 - DNA, 12 bp, Homo sapiens
cacccctgcact

SEQ ID NO: 2117442 - DNA, 16 bp, Homo sapiens
caccccttatccagga

SEQ ID NO: 2117443 - DNA, 12 bp, Homo sapiens
caccccttcctg

SEQ ID NO: 2117444 - DNA, 13 bp, Homo sapiens
caccccttcctgt

SEQ ID NO: 2117445 - DNA, 14 bp, Homo sapiens
caccccttcctgtc

SEQ ID NO: 2117446 - DNA, 22 bp, Homo sapiens
caccccttcctgtcccacctct

SEQ ID NO: 2117447 - DNA, 14 bp, Homo sapiens
cacccgactcctca

SEQ ID NO: 2117448 - DNA, 17 bp, Homo sapiens
cacccgaggctgcccac

SEQ ID NO: 2117449 - DNA, 12 bp, Homo sapiens
cacccggaaaga

SEQ ID NO: 2117450 - DNA, 14 bp, Homo sapiens
cacccggaaagact

SEQ ID NO: 2117451 - DNA, 17 bp, Homo sapiens
cacccggcccctgctgg

SEQ ID NO: 2117452 - DNA, 23 bp, Homo sapiens
cacccgtacccccgtggtctttg

SEQ ID NO: 2117453 - DNA, 17 bp, Homo sapiens
cacccgtaggcagcctc

SEQ ID NO: 2117454 - DNA, 18 bp, Homo sapiens
cacccgttctgctggcct

SEQ ID NO: 2117455 - DNA, 20 bp, Homo sapiens
cacccgttctgctggcctgg

SEQ ID NO: 2117456 - DNA, 21 bp, Homo sapiens
cacccgttctgctggcctgga

SEQ ID NO: 2117457 - DNA, 15 bp, Homo sapiens
caccctaaaatgaca

SEQ ID NO: 2117458 - DNA, 18 bp, Homo sapiens
caccctcaaatgtcagag

SEQ ID NO: 2117459 - DNA, 20 bp, Homo sapiens
caccctcaaatgtcagagct

SEQ ID NO: 2117460 - DNA, 21 bp, Homo sapiens
caccctcaaatgtcagagcta

SEQ ID NO: 2117461 - DNA, 15 bp, Homo sapiens
caccctcaccaggat

SEQ ID NO: 2117462 - DNA, 17 bp, Homo sapiens
caccctccccattagta

SEQ ID NO: 2117463 - DNA, 13 bp, Homo sapiens
caccctccttccc

SEQ ID NO: 2117464 - DNA, 12 bp, Homo sapiens
caccctcctttc

SEQ ID NO: 2117465 - DNA, 15 bp, Homo sapiens
caccctctccatgcc

SEQ ID NO: 2117466 - DNA, 15 bp, Homo sapiens
caccctgaggagtct

SEQ ID NO: 2117467 - DNA, 22 bp, Homo sapiens
caccctgaggagtctgaggtcc

SEQ ID NO: 2117468 - DNA, 14 bp, Homo sapiens
caccctgcagagca

SEQ ID NO: 2117469 - DNA, 12 bp, Homo sapiens
caccctgctctc

SEQ ID NO: 2117470 - DNA, 12 bp, Homo sapiens
caccctggcccc

SEQ ID NO: 2117471 - DNA, 15 bp, Homo sapiens
caccctggggagaaa

SEQ ID NO: 2117472 - DNA, 14 bp, Homo sapiens
caccctgggtgcca

SEQ ID NO: 2117473 - DNA, 16 bp, Homo sapiens
caccctgttccctctt

SEQ ID NO: 2117474 - DNA, 12 bp, Homo sapiens
cacccttctggg

SEQ ID NO: 2117475 - DNA, 19 bp, Homo sapiens
cacccttctttcctcttcc

SEQ ID NO: 2117476 - DNA, 13 bp, Homo sapiens
cacccttggactt

SEQ ID NO: 2117477 - DNA, 16 bp, Homo sapiens
caccgaagagccctga

SEQ ID NO: 2117478 - DNA, 21 bp, Homo sapiens
caccgaagagccctgagctca

SEQ ID NO: 2117479 - DNA, 13 bp, Homo sapiens
caccgcagaagga

SEQ ID NO: 2117480 - DNA, 14 bp, Homo sapiens
caccgcagaaggaa

SEQ ID NO: 2117481 - DNA, 14 bp, Homo sapiens
caccgccagaggac

SEQ ID NO: 2117482 - DNA, 13 bp, Homo sapiens
caccgctgcctaa

SEQ ID NO: 2117483 - DNA, 22 bp, Homo sapiens
caccgctgcctaagtggctgct

SEQ ID NO: 2117484 - DNA, 16 bp, Homo sapiens
caccgctgccttttgc

SEQ ID NO: 2117485 - DNA, 21 bp, Homo sapiens
caccgctgccttttgctgctg

SEQ ID NO: 2117486 - DNA, 15 bp, Homo sapiens
caccggcatgctggc

SEQ ID NO: 2117487 - DNA, 20 bp, Homo sapiens
caccggcatgctggcctgtg

SEQ ID NO: 2117488 - DNA, 22 bp, Homo sapiens
caccggcatgctggcctgtggc

SEQ ID NO: 2117489 - DNA, 18 bp, Homo sapiens
caccgggacagacctgga

SEQ ID NO: 2117490 - DNA, 17 bp, Homo sapiens
caccgggagcctccccc

SEQ ID NO: 2117491 - DNA, 15 bp, Homo sapiens
caccgggccacagag

SEQ ID NO: 2117492 - DNA, 23 bp, Homo sapiens
caccgtcatggcttaatgtttat

SEQ ID NO: 2117493 - DNA, 15 bp, Homo sapiens
caccgtccctcagtg

SEQ ID NO: 2117494 - DNA, 15 bp, Homo sapiens
caccgtggaccttcc

SEQ ID NO: 2117495 - DNA, 17 bp, Homo sapiens
caccgtggaccttcctg

SEQ ID NO: 2117496 - DNA, 18 bp, Homo sapiens
caccgtggaccttcctgc

SEQ ID NO: 2117497 - DNA, 19 bp, Homo sapiens
caccgtggaccttcctgcc

SEQ ID NO: 2117498 - DNA, 20 bp, Homo sapiens
caccgtggaccttcctgcca

SEQ ID NO: 2117499 - DNA, 21 bp, Homo sapiens
caccgtttgtcccccggggca

SEQ ID NO: 2117500 - DNA, 21 bp, Homo sapiens
cacctacatccccaggtctct

SEQ ID NO: 2117501 - DNA, 17 bp, Homo sapiens
cacctaccatgctgctt

SEQ ID NO: 2117502 - DNA, 17 bp, Homo sapiens
cacctactactcaattg

SEQ ID NO: 2117503 - DNA, 19 bp, Homo sapiens
cacctacttgtgactgaag

SEQ ID NO: 2117504 - DNA, 22 bp, Homo sapiens
cacctacttttctttcctcaga

SEQ ID NO: 2117505 - DNA, 20 bp, Homo sapiens
cacctagcaattccatcacc

SEQ ID NO: 2117506 - DNA, 16 bp, Homo sapiens
cacctaggccactcct

SEQ ID NO: 2117507 - DNA, 23 bp, Homo sapiens
  misc_feature (7)..(7): n is a, c, g or t
  misc_feature (14)..(14): n is a, c, g or t
cacctanccccccnacccccagt

SEQ ID NO: 2117508 - DNA, 21 bp, Homo sapiens
cacctcagacaatccactctc

SEQ ID NO: 2117509 - DNA, 12 bp, Homo sapiens
cacctcagcctc

SEQ ID NO: 2117510 - DNA, 13 bp, Homo sapiens
cacctcagcctcc

SEQ ID NO: 2117511 - DNA, 13 bp, Homo sapiens
cacctcagccttg

SEQ ID NO: 2117512 - DNA, 12 bp, Homo sapiens
cacctcagctga

SEQ ID NO: 2117513 - DNA, 23 bp, Homo sapiens
cacctcaggccaggtgcagtggc

SEQ ID NO: 2117514 - DNA, 12 bp, Homo sapiens
cacctcatatgc

SEQ ID NO: 2117515 - DNA, 16 bp, Homo sapiens
cacctcatgcctggcc

SEQ ID NO: 2117516 - DNA, 13 bp, Homo sapiens
cacctccaccccc

SEQ ID NO: 2117517 - DNA, 24 bp, Homo sapiens
cacctccacccccgccacggccac

SEQ ID NO: 2117518 - DNA, 21 bp, Homo sapiens
cacctcccaaggactttccag

SEQ ID NO: 2117519 - DNA, 22 bp, Homo sapiens
cacctcccaccccactccagcc

SEQ ID NO: 2117520 - DNA, 23 bp, Homo sapiens
cacctcccaccccactccagccc

SEQ ID NO: 2117521 - DNA, 10 bp, Homo sapiens
cacctcccag

SEQ ID NO: 2117522 - DNA, 11 bp, Homo sapiens
cacctcccagg

SEQ ID NO: 2117523 - DNA, 12 bp, Homo sapiens
cacctcccagga

SEQ ID NO: 2117524 - DNA, 18 bp, Homo sapiens
cacctccccccactgcag

SEQ ID NO: 2117525 - DNA, 18 bp, Homo sapiens
cacctcccctatccaccc

SEQ ID NO: 2117526 - DNA, 20 bp, Homo sapiens
cacctcccctatccacccag

SEQ ID NO: 2117527 - DNA, 21 bp, Homo sapiens
cacctccctactcccctgggc

SEQ ID NO: 2117528 - DNA, 14 bp, Homo sapiens
cacctccctcccca

SEQ ID NO: 2117529 - DNA, 16 bp, Homo sapiens
cacctccctgccctgt

SEQ ID NO: 2117530 - DNA, 14 bp, Homo sapiens
cacctccgccccag

SEQ ID NO: 2117531 - DNA, 13 bp, Homo sapiens
cacctcctccact

SEQ ID NO: 2117532 - DNA, 14 bp, Homo sapiens
cacctcctccactc

SEQ ID NO: 2117533 - DNA, 22 bp, Homo sapiens
cacctcctccactcactccagc

SEQ ID NO: 2117534 - DNA, 13 bp, Homo sapiens
cacctcctgcctc

SEQ ID NO: 2117535 - DNA, 21 bp, Homo sapiens
cacctccttcctcagtcctgg

SEQ ID NO: 2117536 - DNA, 22 bp, Homo sapiens
cacctctcaatattcaataaag

SEQ ID NO: 2117537 - DNA, 13 bp, Homo sapiens
cacctctgcctca

SEQ ID NO: 2117538 - DNA, 19 bp, Homo sapiens
cacctctggctttgtctct

SEQ ID NO: 2117539 - DNA, 14 bp, Homo sapiens
cacctctgggcttc

SEQ ID NO: 2117540 - DNA, 16 bp, Homo sapiens
cacctcttccttccgc

SEQ ID NO: 2117541 - DNA, 18 bp, Homo sapiens
cacctcttctcttcctgt

SEQ ID NO: 2117542 - DNA, 18 bp, Homo sapiens
cacctcttgggcatgctc

SEQ ID NO: 2117543 - DNA, 23 bp, Homo sapiens
cacctcttgggcatgctcagccc

SEQ ID NO: 2117544 - DNA, 18 bp, Homo sapiens
cacctgacaatggcagct

SEQ ID NO: 2117545 - DNA, 16 bp, Homo sapiens
cacaggcatttcctgg

SEQ ID NO: 2117546 - DNA, 19 bp, Homo sapiens
cacaggcatttcctgggtg

SEQ ID NO: 2117547 - DNA, 18 bp, Homo sapiens
cacaggccagccccatct

SEQ ID NO: 2117548 - DNA, 20 bp, Homo sapiens
cacaggccccccgcagcacc

SEQ ID NO: 2117549 - DNA, 23 bp, Homo sapiens
cacaggccccccgcagcaccctg

SEQ ID NO: 2117550 - DNA, 19 bp, Homo sapiens
cacaggcccggctccaggc

SEQ ID NO: 2117551 - DNA, 22 bp, Homo sapiens
cacaggcccttcctctccactg

SEQ ID NO: 2117552 - DNA, 15 bp, Homo sapiens
cacaggcccttgggg

SEQ ID NO: 2117553 - DNA, 16 bp, Homo sapiens
cacaggcccttggggt

SEQ ID NO: 2117554 - DNA, 18 bp, Homo sapiens
cacaggcctgtgtagctg

SEQ ID NO: 2117555 - DNA, 21 bp, Homo sapiens
cacaggcctgtgtagctgtga

SEQ ID NO: 2117556 - DNA, 22 bp, Homo sapiens
cacaggcctgtgtagctgtgac

SEQ ID NO: 2117557 - DNA, 24 bp, Homo sapiens
cacaggcctgtgtagctgtgacct

SEQ ID NO: 2117558 - DNA, 13 bp, Homo sapiens
cacagggcagagc

SEQ ID NO: 2117559 - DNA, 13 bp, Homo sapiens
cacagggctaaga

SEQ ID NO: 2117560 - DNA, 13 bp, Homo sapiens
cacagggctcttt

SEQ ID NO: 2117561 - DNA, 23 bp, Homo sapiens
cacagggctctttgatggaccca

SEQ ID NO: 2117562 - DNA, 16 bp, Homo sapiens
cacaggggcaggcctg

SEQ ID NO: 2117563 - DNA, 15 bp, Homo sapiens
cacaggggccccaga

SEQ ID NO: 2117564 - DNA, 14 bp, Homo sapiens
cacaggggcggggc

SEQ ID NO: 2117565 - DNA, 19 bp, Homo sapiens
cacaggggcggggcaggaa

SEQ ID NO: 2117566 - DNA, 18 bp, Homo sapiens
cacaggtacagcaacagg

SEQ ID NO: 2117567 - DNA, 20 bp, Homo sapiens
cacaggttccatagaactaa

SEQ ID NO: 2117568 - DNA, 23 bp, Homo sapiens
cacaggttctgcgttacaacagt

SEQ ID NO: 2117569 - DNA, 16 bp, Homo sapiens
cacagtattacttctg

SEQ ID NO: 2117570 - DNA, 22 bp, Homo sapiens
cacagtcaccttctcggcaact

SEQ ID NO: 2117571 - DNA, 20 bp, Homo sapiens
cacagtcattcacatcactg

SEQ ID NO: 2117572 - DNA, 13 bp, Homo sapiens
cacagtctcccat

SEQ ID NO: 2117573 - DNA, 14 bp, Homo sapiens
cacagtgagctgat

SEQ ID NO: 2117574 - DNA, 21 bp, Homo sapiens
cacagtgagtcgaggacaggg

SEQ ID NO: 2117575 - DNA, 11 bp, Homo sapiens
cacagtgctgc

SEQ ID NO: 2117576 - DNA, 23 bp, Homo sapiens
cacagtgctgcgagatcgctggc

SEQ ID NO: 2117577 - DNA, 15 bp, Homo sapiens
cacagtgctgcttct

SEQ ID NO: 2117578 - DNA, 20 bp, Homo sapiens
cacagtggcacggagagaag

SEQ ID NO: 2117579 - DNA, 20 bp, Homo sapiens
cacagtggcgagaggagagg

SEQ ID NO: 2117580 - DNA, 17 bp, Homo sapiens
cacagtgggtggcacct

SEQ ID NO: 2117581 - DNA, 23 bp, Homo sapiens
cacagtgttaaatgaaattgtaa

SEQ ID NO: 2117582 - DNA, 21 bp, Homo sapiens
cacagtgttccagctgcctgg

SEQ ID NO: 2117583 - DNA, 10 bp, Homo sapiens
cacagtgttt

SEQ ID NO: 2117584 - DNA, 19 bp, Homo sapiens
cacagttcctcgccctggg

SEQ ID NO: 2117585 - DNA, 18 bp, Homo sapiens
cacagtttagaacagagg

SEQ ID NO: 2117586 - DNA, 19 bp, Homo sapiens
cacagtttctattgtaaat

SEQ ID NO: 2117587 - DNA, 15 bp, Homo sapiens
cacagttttctgaga

SEQ ID NO: 2117588 - DNA, 21 bp, Homo sapiens
cacagttttgaaagaaaaata

SEQ ID NO: 2117589 - DNA, 22 bp, Homo sapiens
cacagttttgaaagaaaaatac

SEQ ID NO: 2117590 - DNA, 13 bp, Homo sapiens
cacatacaatttg

SEQ ID NO: 2117591 - DNA, 16 bp, Homo sapiens
cacatacatacacata

SEQ ID NO: 2117592 - DNA, 20 bp, Homo sapiens
cacatacatacacatacata

SEQ ID NO: 2117593 - DNA, 22 bp, Homo sapiens
cacatacatacacatacataca

SEQ ID NO: 2117594 - DNA, 16 bp, Homo sapiens
cacatacgtgttagga

SEQ ID NO: 2117595 - DNA, 16 bp, Homo sapiens
cacatagagatatgca

SEQ ID NO: 2117596 - DNA, 21 bp, Homo sapiens
cacatagattaatggcactga

SEQ ID NO: 2117597 - DNA, 22 bp, Homo sapiens
cacatagattaatggcactgat

SEQ ID NO: 2117598 - DNA, 22 bp, Homo sapiens
cacatagctacccaaaagagaa

SEQ ID NO: 2117599 - DNA, 21 bp, Homo sapiens
cacatagtgatggttcccctg

SEQ ID NO: 2117600 - DNA, 14 bp, Homo sapiens
cacatatctgtcat

SEQ ID NO: 2117601 - DNA, 19 bp, Homo sapiens
cacatatgcaccttgtgtc

SEQ ID NO: 2117602 - DNA, 21 bp, Homo sapiens
cacatatgcaccttgtgtctg

SEQ ID NO: 2117603 - DNA, 22 bp, Homo sapiens
cacatatgcaccttgtgtctgt

SEQ ID NO: 2117604 - DNA, 14 bp, Homo sapiens
cacatatggcacaa

SEQ ID NO: 2117605 - DNA, 15 bp, Homo sapiens
cacatatggcacaac

SEQ ID NO: 2117606 - DNA, 22 bp, Homo sapiens
cacatcaagcatgcaataatgt

SEQ ID NO: 2117607 - DNA, 15 bp, Homo sapiens
cacatccaactcctg

SEQ ID NO: 2117608 - DNA, 21 bp, Homo sapiens
cacatccacacacgcaggaac

SEQ ID NO: 2117609 - DNA, 22 bp, Homo sapiens
cacatccattcccaagaaatgc

SEQ ID NO: 2117610 - DNA, 12 bp, Homo sapiens
cacatcccaggc

SEQ ID NO: 2117611 - DNA, 14 bp, Homo sapiens
cacatcccggcctc

SEQ ID NO: 2117612 - DNA, 16 bp, Homo sapiens
cacatcccggcctctt

SEQ ID NO: 2117613 - DNA, 17 bp, Homo sapiens
cacatcccggcctcttc

SEQ ID NO: 2117614 - DNA, 12 bp, Homo sapiens
cacatccctggg

SEQ ID NO: 2117615 - DNA, 21 bp, Homo sapiens
cacatccctgggcctgctgct

SEQ ID NO: 2117616 - DNA, 16 bp, Homo sapiens
cacatctaatgtctct

SEQ ID NO: 2117617 - DNA, 13 bp, Homo sapiens
cacatctctgaaa

SEQ ID NO: 2117618 - DNA, 18 bp, Homo sapiens
cacatctgtgtctctgga

SEQ ID NO: 2117619 - DNA, 19 bp, Homo sapiens
cacatctgtgtctctggaa

SEQ ID NO: 2117620 - DNA, 13 bp, Homo sapiens
cacatcttgctct

SEQ ID NO: 2117621 - DNA, 18 bp, Homo sapiens
cacatcttgctctgctga

SEQ ID NO: 2117622 - DNA, 21 bp, Homo sapiens
cacatcttgctctgctgacag

SEQ ID NO: 2117623 - DNA, 14 bp, Homo sapiens
cacatctttcctgt

SEQ ID NO: 2117624 - DNA, 18 bp, Homo sapiens
cacatgaaccatccttcc

SEQ ID NO: 2117625 - DNA, 18 bp, Homo sapiens
cacatgcatcatcagcct

SEQ ID NO: 2117626 - DNA, 20 bp, Homo sapiens
cacatgccgcccccagcagc

SEQ ID NO: 2117627 - DNA, 16 bp, Homo sapiens
cacatgcgtatatgtg

SEQ ID NO: 2117628 - DNA, 21 bp, Homo sapiens
cacatgcgtatatgtgcgtct

SEQ ID NO: 2117629 - DNA, 22 bp, Homo sapiens
cacatggaaggcggcacagagg

SEQ ID NO: 2117630 - DNA, 15 bp, Homo sapiens
cacatggcctatgca

SEQ ID NO: 2117631 - DNA, 13 bp, Homo sapiens
cacatgtgacaca

SEQ ID NO: 2117632 - DNA, 15 bp, Homo sapiens
cacatgtgacacata

SEQ ID NO: 2117633 - DNA, 16 bp, Homo sapiens
cacatgtttacagaac

SEQ ID NO: 2117634 - DNA, 16 bp, Homo sapiens
cacatgtttattcatg

SEQ ID NO: 2117635 - DNA, 17 bp, Homo sapiens
cacattaattagatttt

SEQ ID NO: 2117636 - DNA, 17 bp, Homo sapiens
cacattacttgcacaag

SEQ ID NO: 2117637 - DNA, 22 bp, Homo sapiens
cacattacttgcacaagcttgt

SEQ ID NO: 2117638 - DNA, 17 bp, Homo sapiens
cacattagactatccat

SEQ ID NO: 2117639 - DNA, 16 bp, Homo sapiens
cacattatcgggagca

SEQ ID NO: 2117640 - DNA, 23 bp, Homo sapiens
cacattatcgggagcagtgtctt

SEQ ID NO: 2117641 - DNA, 13 bp, Homo sapiens
cacattatttgca

SEQ ID NO: 2117642 - DNA, 14 bp, Homo sapiens
cacattcaggaaga

SEQ ID NO: 2117643 - DNA, 13 bp, Homo sapiens
cacattcctggcc

SEQ ID NO: 2117644 - DNA, 21 bp, Homo sapiens
cacattcctggccccgggctc

SEQ ID NO: 2117645 - DNA, 23 bp, Homo sapiens
cacattcctggccccgggctctg

SEQ ID NO: 2117646 - DNA, 18 bp, Homo sapiens
cacattcggaccctgccc

SEQ ID NO: 2117647 - DNA, 22 bp, Homo sapiens
cacattgagtttaagtctctga

SEQ ID NO: 2117648 - DNA, 21 bp, Homo sapiens
cacatttacctcgaggctctt

SEQ ID NO: 2117649 - DNA, 14 bp, Homo sapiens
cacatttatatata

SEQ ID NO: 2117650 - DNA, 18 bp, Homo sapiens
cacatttatatatatatg

SEQ ID NO: 2117651 - DNA, 21 bp, Homo sapiens
cacatttatatatatatgtat

SEQ ID NO: 2117652 - DNA, 14 bp, Homo sapiens
cacatttgatgtac

SEQ ID NO: 2117653 - DNA, 16 bp, Homo sapiens
cacatttgatgtacat

SEQ ID NO: 2117654 - DNA, 20 bp, Homo sapiens
cacatttgttcatgagtgga

SEQ ID NO: 2117655 - DNA, 22 bp, Homo sapiens
cacatttgttcatgagtggatg

SEQ ID NO: 2117656 - DNA, 21 bp, Homo sapiens
caccaaaaaaatacttgagct

SEQ ID NO: 2117657 - DNA, 23 bp, Homo sapiens
caccaaaaaaatacttgagctgt

SEQ ID NO: 2117658 - DNA, 22 bp, Homo sapiens
caccaaattcatgtacagcatg

SEQ ID NO: 2117659 - DNA, 17 bp, Homo sapiens
caccaacatcccattgc

SEQ ID NO: 2117660 - DNA, 19 bp, Homo sapiens
caccaactctgcactccat

SEQ ID NO: 2117661 - DNA, 20 bp, Homo sapiens
caccaactctgcactccatg

SEQ ID NO: 2117662 - DNA, 14 bp, Homo sapiens
caccaaggtcttca

SEQ ID NO: 2117663 - DNA, 15 bp, Homo sapiens
caccaaggtcttcag

SEQ ID NO: 2117664 - DNA, 12 bp, Homo sapiens
caccaataaaaa

SEQ ID NO: 2117665 - DNA, 12 bp, Homo sapiens
caccaataactt

SEQ ID NO: 2117666 - DNA, 24 bp, Homo sapiens
caccaattggttaatctttcctga

SEQ ID NO: 2117667 - DNA, 15 bp, Homo sapiens
caccacacccagccc

SEQ ID NO: 2117668 - DNA, 21 bp, Homo sapiens
caccacactccccgcctgtcc

SEQ ID NO: 2117669 - DNA, 17 bp, Homo sapiens
caccacactgaatctcc

SEQ ID NO: 2117670 - DNA, 15 bp, Homo sapiens
caccacatgtgcaca

SEQ ID NO: 2117671 - DNA, 18 bp, Homo sapiens
caccacatgtgcacatgc

SEQ ID NO: 2117672 - DNA, 21 bp, Homo sapiens
caccaccagatgagaagttaa

SEQ ID NO: 2117673 - DNA, 16 bp, Homo sapiens
caccacctcactcctg

SEQ ID NO: 2117674 - DNA, 17 bp, Homo sapiens
caccacctcactcctgt

SEQ ID NO: 2117675 - DNA, 13 bp, Homo sapiens
caccaccttccca

SEQ ID NO: 2117676 - DNA, 14 bp, Homo sapiens
caccaccttcccag

SEQ ID NO: 2117677 - DNA, 15 bp, Homo sapiens
caccaccttcccagc

SEQ ID NO: 2117678 - DNA, 19 bp, Homo sapiens
caccaccttcccagctctc

SEQ ID NO: 2117679 - DNA, 21 bp, Homo sapiens
caccaccttcccagctctccc

SEQ ID NO: 2117680 - DNA, 23 bp, Homo sapiens
caccaccttggactcctcccaca

SEQ ID NO: 2117681 - DNA, 19 bp, Homo sapiens
caccacgatgtggccctgg

SEQ ID NO: 2117682 - DNA, 21 bp, Homo sapiens
caccacgatgtggccctggcc

SEQ ID NO: 2117683 - DNA, 18 bp, Homo sapiens
caccacgtctgccaggcc

SEQ ID NO: 2117684 - DNA, 20 bp, Homo sapiens
caccactaggactctgaggc

SEQ ID NO: 2117685 - DNA, 13 bp, Homo sapiens
caccactccattc

SEQ ID NO: 2117686 - DNA, 14 bp, Homo sapiens
caccactccattcc

SEQ ID NO: 2117687 - DNA, 14 bp, Homo sapiens
caccactctggcag

SEQ ID NO: 2117688 - DNA, 17 bp, Homo sapiens
caccactctggcagcca

SEQ ID NO: 2117689 - DNA, 13 bp, Homo sapiens
caccactgcactc

SEQ ID NO: 2117690 - DNA, 18 bp, Homo sapiens
caccactgccctgcctgc

SEQ ID NO: 2117691 - DNA, 20 bp, Homo sapiens
caccactgccctgcctgccc

SEQ ID NO: 2117692 - DNA, 21 bp, Homo sapiens
caccactgccctgcctgccca

SEQ ID NO: 2117693 - DNA, 15 bp, Homo sapiens
caccagagcccacct

SEQ ID NO: 2117694 - DNA, 17 bp, Homo sapiens
caccagagcccaccttg

SEQ ID NO: 2117695 - DNA, 22 bp, Homo sapiens
caccagagcccaccttggctca

SEQ ID NO: 2117696 - DNA, 16 bp, Homo sapiens
caccagagcccatgct

SEQ ID NO: 2117697 - DNA, 20 bp, Homo sapiens
caccagaggctgcagaaggc

SEQ ID NO: 2117698 - DNA, 15 bp, Homo sapiens
caccagatgagaagt

SEQ ID NO: 2117699 - DNA, 17 bp, Homo sapiens
caccagatgagaagtta

SEQ ID NO: 2117700 - DNA, 23 bp, Homo sapiens
caccagatgcaacctcactatgg

SEQ ID NO: 2117701 - DNA, 17 bp, Homo sapiens
caccagcaacatctcga

SEQ ID NO: 2117702 - DNA, 14 bp, Homo sapiens
caccagcatgtcac

SEQ ID NO: 2117703 - DNA, 20 bp, Homo sapiens
caccagcatgtcactcccag

SEQ ID NO: 2117704 - DNA, 12 bp, Homo sapiens
caccagccacct

SEQ ID NO: 2117705 - DNA, 14 bp, Homo sapiens
caccagccccagca

SEQ ID NO: 2117706 - DNA, 16 bp, Homo sapiens
caccagccccagcaag

SEQ ID NO: 2117707 - DNA, 16 bp, Homo sapiens
caccagccccagtgcc

SEQ ID NO: 2117708 - DNA, 17 bp, Homo sapiens
caccagccccagtgccc

SEQ ID NO: 2117709 - DNA, 18 bp, Homo sapiens
caccagccccagtgccca

SEQ ID NO: 2117710 - DNA, 15 bp, Homo sapiens
caccagcccttccct

SEQ ID NO: 2117711 - DNA, 14 bp, Homo sapiens
caccagctatctgt

SEQ ID NO: 2117712 - DNA, 13 bp, Homo sapiens
caccagctctgtg

SEQ ID NO: 2117713 - DNA, 18 bp, Homo sapiens
caccagctctgtggcctg

SEQ ID NO: 2117714 - DNA, 11 bp, Homo sapiens
caccagctgct

SEQ ID NO: 2117715 - DNA, 14 bp, Homo sapiens
caccagctgctctg

SEQ ID NO: 2117716 - DNA, 16 bp, Homo sapiens
caccagctgctctgcc

SEQ ID NO: 2117717 - DNA, 19 bp, Homo sapiens
caccagcttctccaggctc

SEQ ID NO: 2117718 - DNA, 11 bp, Homo sapiens
caccaggaagg

SEQ ID NO: 2117719 - DNA, 21 bp, Homo sapiens
caccaggctgaggtcctgatc

SEQ ID NO: 2117720 - DNA, 16 bp, Homo sapiens
caccagggcactgtct

SEQ ID NO: 2117721 - DNA, 18 bp, Homo sapiens
caccagggcactgtctgc

SEQ ID NO: 2117722 - DNA, 19 bp, Homo sapiens
caccagggtccgcaccagc

SEQ ID NO: 2117723 - DNA, 15 bp, Homo sapiens
caccagtcactgtcc

SEQ ID NO: 2117724 - DNA, 17 bp, Homo sapiens
caccagtcactgtccct

SEQ ID NO: 2117725 - DNA, 19 bp, Homo sapiens
caccagtgccgcctgtgcc

SEQ ID NO: 2117726 - DNA, 20 bp, Homo sapiens
caccagtgccgcctgtgccc

SEQ ID NO: 2117727 - DNA, 13 bp, Homo sapiens
caccagtgtcccc

SEQ ID NO: 2117728 - DNA, 16 bp, Homo sapiens
caccagtgtcccctcc

SEQ ID NO: 2117729 - DNA, 17 bp, Homo sapiens
caccatcaccctctggg

SEQ ID NO: 2117730 - DNA, 20 bp, Homo sapiens
caccatcctgcagcctcctc

SEQ ID NO: 2117731 - DNA, 21 bp, Homo sapiens
caccatgccaggctaattttt

SEQ ID NO: 2117732 - DNA, 22 bp, Homo sapiens
caccatggaggcaggctccccc

SEQ ID NO: 2117733 - DNA, 16 bp, Homo sapiens
caccatgtaacaacca

SEQ ID NO: 2117734 - DNA, 22 bp, Homo sapiens
caccatgtttgagctcagaccc

SEQ ID NO: 2117735 - DNA, 21 bp, Homo sapiens
caccattcacatttgatgtac

SEQ ID NO: 2117736 - DNA, 17 bp, Homo sapiens
cacccaacagctcagag

SEQ ID NO: 2117737 - DNA, 16 bp, Homo sapiens
cacccaagagggctgc

SEQ ID NO: 2117738 - DNA, 16 bp, Homo sapiens
cacccaattcaaaaca

SEQ ID NO: 2117739 - DNA, 12 bp, Homo sapiens
cacccacatgtg

SEQ ID NO: 2117740 - DNA, 20 bp, Homo sapiens
cacccaccatcatgtctggc

SEQ ID NO: 2117741 - DNA, 15 bp, Homo sapiens
cacccacctccaccc

SEQ ID NO: 2117742 - DNA, 18 bp, Homo sapiens
cacccactcaccagggtc

SEQ ID NO: 2117743 - DNA, 11 bp, Homo sapiens
cacccactggc

SEQ ID NO: 2117744 - DNA, 13 bp, Homo sapiens
cacccactggcca

SEQ ID NO: 2117745 - DNA, 15 bp, Homo sapiens
cacccactggccagt

SEQ ID NO: 2117746 - DNA, 20 bp, Homo sapiens
cacccagaaattccttccca

SEQ ID NO: 2117747 - DNA, 17 bp, Homo sapiens
cacccagcaacacagag

SEQ ID NO: 2117748 - DNA, 10 bp, Homo sapiens
cacccagccc

SEQ ID NO: 2117749 - DNA, 13 bp, Homo sapiens
cacccagcccatt

SEQ ID NO: 2117750 - DNA, 22 bp, Homo sapiens
cacccagcccattctctctcct

SEQ ID NO: 2117751 - DNA, 23 bp, Homo sapiens
cacccagcccattctctctcctg

SEQ ID NO: 2117752 - DNA, 20 bp, Homo sapiens
cacccaggagccccgaggcc

SEQ ID NO: 2117753 - DNA, 11 bp, Homo sapiens
cacccaggctc

SEQ ID NO: 2117754 - DNA, 14 bp, Homo sapiens
cacccaggctccat

SEQ ID NO: 2117755 - DNA, 13 bp, Homo sapiens
cacccaggctgca

SEQ ID NO: 2117756 - DNA, 16 bp, Homo sapiens
cacccaggctgcactg

SEQ ID NO: 2117757 - DNA, 16 bp, Homo sapiens
cacccagtcctggcca

SEQ ID NO: 2117758 - DNA, 13 bp, Homo sapiens
cacccagtgctgc

SEQ ID NO: 2117759 - DNA, 19 bp, Homo sapiens
cacccagtgctgccatgcc

SEQ ID NO: 2117760 - DNA, 21 bp, Homo sapiens
cacccagtgctgccatgccac

SEQ ID NO: 2117761 - DNA, 23 bp, Homo sapiens
cacccatcctaccaatgcatgca

SEQ ID NO: 2117762 - DNA, 18 bp, Homo sapiens
cacccatcttcctgctgc

SEQ ID NO: 2117763 - DNA, 19 bp, Homo sapiens
cacccatcttcctgctgct

SEQ ID NO: 2117764 - DNA, 15 bp, Homo sapiens
cacccatgaagacag

SEQ ID NO: 2117765 - DNA, 22 bp, Homo sapiens
cacccatgaagacaggacagtg

SEQ ID NO: 2117766 - DNA, 14 bp, Homo sapiens
cacccatgccatag

SEQ ID NO: 2117767 - DNA, 22 bp, Homo sapiens
cacccattcccccatgtggctg

SEQ ID NO: 2117768 - DNA, 13 bp, Homo sapiens
caccccaccccct

SEQ ID NO: 2117769 - DNA, 22 bp, Homo sapiens
caccccacccccttcagtgccc

SEQ ID NO: 2117770 - DNA, 15 bp, Homo sapiens
caccccactccagcc

SEQ ID NO: 2117771 - DNA, 13 bp, Homo sapiens
caccccagagttg

SEQ ID NO: 2117772 - DNA, 23 bp, Homo sapiens
caccccagagttgggatgcgggg

SEQ ID NO: 2117773 - DNA, 12 bp, Homo sapiens
caccccagcgcc

SEQ ID NO: 2117774 - DNA, 19 bp, Homo sapiens
cacccccagccccgactcc

SEQ ID NO: 2117775 - DNA, 23 bp, Homo sapiens
cacccccagccccgactccagcc

SEQ ID NO: 2117776 - DNA, 17 bp, Homo sapiens
cacccccagcctgggcc

SEQ ID NO: 2117777 - DNA, 15 bp, Homo sapiens
cagcagctcaggcac

SEQ ID NO: 2117778 - DNA, 15 bp, Homo sapiens
cagcagctgggaccc

SEQ ID NO: 2117779 - DNA, 20 bp, Homo sapiens
cagcagctgggccggccagc

SEQ ID NO: 2117780 - DNA, 22 bp, Homo sapiens
cagcaggaacctgtactgggtt

SEQ ID NO: 2117781 - DNA, 13 bp, Homo sapiens
cagcaggaagcca

SEQ ID NO: 2117782 - DNA, 20 bp, Homo sapiens
cagcaggaggctagcaaagc

SEQ ID NO: 2117783 - DNA, 15 bp, Homo sapiens
cagcagggcctcaaa

SEQ ID NO: 2117784 - DNA, 17 bp, Homo sapiens
cagcagggcctcaaagt

SEQ ID NO: 2117785 - DNA, 17 bp, Homo sapiens
cagcagggctgctgtga

SEQ ID NO: 2117786 - DNA, 22 bp, Homo sapiens
cagcaggtgcctggtgggccac

SEQ ID NO: 2117787 - DNA, 23 bp, Homo sapiens
cagcaggtgcctggtgggccacg

SEQ ID NO: 2117788 - DNA, 19 bp, Homo sapiens
cagcaggtgtggtggctca

SEQ ID NO: 2117789 - DNA, 23 bp, Homo sapiens
cagcaggtgtggtggctcatggc

SEQ ID NO: 2117790 - DNA, 17 bp, Homo sapiens
cagcagtatgaatgatg

SEQ ID NO: 2117791 - DNA, 15 bp, Homo sapiens
cagcagtgagcttct

SEQ ID NO: 2117792 - DNA, 17 bp, Homo sapiens
cagcagtgttccccatc

SEQ ID NO: 2117793 - DNA, 20 bp, Homo sapiens
cagcagttccatgaagacac

SEQ ID NO: 2117794 - DNA, 20 bp, Homo sapiens
cagcagttgaaaagactcca

SEQ ID NO: 2117795 - DNA, 22 bp, Homo sapiens
cagcagttgaaaagactccaaa

SEQ ID NO: 2117796 - DNA, 15 bp, Homo sapiens
cagcataattcggaa

SEQ ID NO: 2117797 - DNA, 18 bp, Homo sapiens
cagcatacagagcaggcc

SEQ ID NO: 2117798 - DNA, 19 bp, Homo sapiens
cagcatagcaagacacatc

SEQ ID NO: 2117799 - DNA, 14 bp, Homo sapiens
cagcatatttatag

SEQ ID NO: 2117800 - DNA, 17 bp, Homo sapiens
cagcatccagcctgtgt

SEQ ID NO: 2117801 - DNA, 21 bp, Homo sapiens
cagcatcctggcacccggccc

SEQ ID NO: 2117802 - DNA, 12 bp, Homo sapiens
cagcatgtacaa

SEQ ID NO: 2117803 - DNA, 13 bp, Homo sapiens
cagcattcctcca

SEQ ID NO: 2117804 - DNA, 14 bp, Homo sapiens
cagcattcctccat

SEQ ID NO: 2117805 - DNA, 14 bp, Homo sapiens
cagcattctcactc

SEQ ID NO: 2117806 - DNA, 23 bp, Homo sapiens
cagcattttactacttgttacct

SEQ ID NO: 2117807 - DNA, 15 bp, Homo sapiens
cagcattttcacatt

SEQ ID NO: 2117808 - DNA, 17 bp, Homo sapiens
cagccaaacacagagcg

SEQ ID NO: 2117809 - DNA, 16 bp, Homo sapiens
cagccaaacccatgag

SEQ ID NO: 2117810 - DNA, 18 bp, Homo sapiens
cagccaacaggtggcagg

SEQ ID NO: 2117811 - DNA, 21 bp, Homo sapiens
cagccaacgagtaatttattg

SEQ ID NO: 2117812 - DNA, 13 bp, Homo sapiens
cagccaactcatt

SEQ ID NO: 2117813 - DNA, 16 bp, Homo sapiens
cagccaactgccccgg

SEQ ID NO: 2117814 - DNA, 22 bp, Homo sapiens
cagccacacagagcctgcctca

SEQ ID NO: 2117815 - DNA, 13 bp, Homo sapiens
cagccacacctgt

SEQ ID NO: 2117816 - DNA, 18 bp, Homo sapiens
cagccacacttctcagga

SEQ ID NO: 2117817 - DNA, 20 bp, Homo sapiens
cagccacacttctcaggaca

SEQ ID NO: 2117818 - DNA, 21 bp, Homo sapiens
cagccacacttctcaggacac

SEQ ID NO: 2117819 - DNA, 17 bp, Homo sapiens
cagccaccccctccccc

SEQ ID NO: 2117820 - DNA, 22 bp, Homo sapiens
cagccaccctgaggagtctgag

SEQ ID NO: 2117821 - DNA, 12 bp, Homo sapiens
cagccacctccc

SEQ ID NO: 2117822 - DNA, 18 bp, Homo sapiens
cagccacctcccaaggac

SEQ ID NO: 2117823 - DNA, 16 bp, Homo sapiens
cagccacctctctttt

SEQ ID NO: 2117824 - DNA, 17 bp, Homo sapiens
cagccacggccaggcca

SEQ ID NO: 2117825 - DNA, 19 bp, Homo sapiens
cagccacggccaggccaga

SEQ ID NO: 2117826 - DNA, 12 bp, Homo sapiens
cagccagaagcc

SEQ ID NO: 2117827 - DNA, 12 bp, Homo sapiens
cagccagaagtt

SEQ ID NO: 2117828 - DNA, 20 bp, Homo sapiens
cagccagaggaggccggtga

SEQ ID NO: 2117829 - DNA, 12 bp, Homo sapiens
cagccagcagcc

SEQ ID NO: 2117830 - DNA, 15 bp, Homo sapiens
cagccagcagccagc

SEQ ID NO: 2117831 - DNA, 13 bp, Homo sapiens
cagccagccagtc

SEQ ID NO: 2117832 - DNA, 12 bp, Homo sapiens
cagccagcccag

SEQ ID NO: 2117833 - DNA, 16 bp, Homo sapiens
cagccagcccagccca

SEQ ID NO: 2117834 - DNA, 16 bp, Homo sapiens
cagccagccctgcctg

SEQ ID NO: 2117835 - DNA, 18 bp, Homo sapiens
cagccagccctgcctgga

SEQ ID NO: 2117836 - DNA, 19 bp, Homo sapiens
cagccagccctgcctggag

SEQ ID NO: 2117837 - DNA, 16 bp, Homo sapiens
cagccagccgccctgg

SEQ ID NO: 2117838 - DNA, 23 bp, Homo sapiens
cagccagccgccctgggctgtct

SEQ ID NO: 2117839 - DNA, 18 bp, Homo sapiens
cagccagccggtgcctgg

SEQ ID NO: 2117840 - DNA, 20 bp, Homo sapiens
cagccagccggtgcctggcg

SEQ ID NO: 2117841 - DNA, 19 bp, Homo sapiens
cagccagcgcctccctcca

SEQ ID NO: 2117842 - DNA, 22 bp, Homo sapiens
cagccagcgcctccctccaccc

SEQ ID NO: 2117843 - DNA, 23 bp, Homo sapiens
cagccagcgcctccctccacccc

SEQ ID NO: 2117844 - DNA, 12 bp, Homo sapiens
cagccagctcct

SEQ ID NO: 2117845 - DNA, 15 bp, Homo sapiens
cagccagctctcagc

SEQ ID NO: 2117846 - DNA, 14 bp, Homo sapiens
cagccaggaggaga

SEQ ID NO: 2117847 - DNA, 15 bp, Homo sapiens
cagccaggggctgct

SEQ ID NO: 2117848 - DNA, 17 bp, Homo sapiens
cagccaggggctgctca

SEQ ID NO: 2117849 - DNA, 21 bp, Homo sapiens
cagccagtcttgcctaggcca

SEQ ID NO: 2117850 - DNA, 23 bp, Homo sapiens
cagccagtcttgcctaggccaaa

SEQ ID NO: 2117851 - DNA, 18 bp, Homo sapiens
cagccatcaagagactga

SEQ ID NO: 2117852 - DNA, 19 bp, Homo sapiens
cagccatcacaaggggaac

SEQ ID NO: 2117853 - DNA, 22 bp, Homo sapiens
cagccatgaccagttctggcca

SEQ ID NO: 2117854 - DNA, 18 bp, Homo sapiens
cagccatgcctcatgcca

SEQ ID NO: 2117855 - DNA, 19 bp, Homo sapiens
cagccatgcctcatgccac

SEQ ID NO: 2117856 - DNA, 13 bp, Homo sapiens
cagccattataaa

SEQ ID NO: 2117857 - DNA, 15 bp, Homo sapiens
cagcccaagcagagt

SEQ ID NO: 2117858 - DNA, 17 bp, Homo sapiens
cagcccacacccctcca

SEQ ID NO: 2117859 - DNA, 20 bp, Homo sapiens
cagcccacacccctccaaag

SEQ ID NO: 2117860 - DNA, 23 bp, Homo sapiens
cagcccacacccctccaaagccc

SEQ ID NO: 2117861 - DNA, 12 bp, Homo sapiens
cagcccacagag

SEQ ID NO: 2117862 - DNA, 13 bp, Homo sapiens
cagcccacagagc

SEQ ID NO: 2117863 - DNA, 16 bp, Homo sapiens
cagcccacagagcctg

SEQ ID NO: 2117864 - DNA, 18 bp, Homo sapiens
cagcccacttctgccata

SEQ ID NO: 2117865 - DNA, 16 bp, Homo sapiens
cagcccagcctagccc

SEQ ID NO: 2117866 - DNA, 11 bp, Homo sapiens
cagcccagctt

SEQ ID NO: 2117867 - DNA, 16 bp, Homo sapiens
cagcccagggcacttc

SEQ ID NO: 2117868 - DNA, 21 bp, Homo sapiens
cagcccatggcctctggccag

SEQ ID NO: 2117869 - DNA, 20 bp, Homo sapiens
cagcccattctctctcctgt

SEQ ID NO: 2117870 - DNA, 21 bp, Homo sapiens
cagcccattctctctcctgtc

SEQ ID NO: 2117871 - DNA, 20 bp, Homo sapiens
cagcccattggctcccatct

SEQ ID NO: 2117872 - DNA, 17 bp, Homo sapiens
cagccccaaaccagggt

SEQ ID NO: 2117873 - DNA, 12 bp, Homo sapiens
cagccccagggc

SEQ ID NO: 2117874 - DNA, 12 bp, Homo sapiens
cagccccagggg

SEQ ID NO: 2117875 - DNA, 15 bp, Homo sapiens
cagccccaggggtgc

SEQ ID NO: 2117876 - DNA, 14 bp, Homo sapiens
cagccccagtgccc

SEQ ID NO: 2117877 - DNA, 15 bp, Homo sapiens
cagccccagtgccca

SEQ ID NO: 2117878 - DNA, 16 bp, Homo sapiens
cagccccagtgcccac

SEQ ID NO: 2117879 - DNA, 23 bp, Homo sapiens
cagccccattctgcctgcccagg

SEQ ID NO: 2117880 - DNA, 24 bp, Homo sapiens
cagccccattctgcctgcccaggc

SEQ ID NO: 2117881 - DNA, 18 bp, Homo sapiens
cagcccccacctccgccc

SEQ ID NO: 2117882 - DNA, 17 bp, Homo sapiens
cagccccctaagagagc

SEQ ID NO: 2117883 - DNA, 15 bp, Homo sapiens
cagccccctggatgg

SEQ ID NO: 2117884 - DNA, 17 bp, Homo sapiens
cagccccgactccagcc

SEQ ID NO: 2117885 - DNA, 15 bp, Homo sapiens
cagcccctcctcccc

SEQ ID NO: 2117886 - DNA, 18 bp, Homo sapiens
cagccccttgagaaacct

SEQ ID NO: 2117887 - DNA, 21 bp, Homo sapiens
cagcccggcctgctcccagca

SEQ ID NO: 2117888 - DNA, 23 bp, Homo sapiens
cagcccggcctgctcccagcagc

SEQ ID NO: 2117889 - DNA, 21 bp, Homo sapiens
cagcccgtgaagcagtgcctc

SEQ ID NO: 2117890 - DNA, 23 bp, Homo sapiens
cagagagtgagagacattaactc

SEQ ID NO: 2117891 - DNA, 15 bp, Homo sapiens
cagagagtggctcct

SEQ ID NO: 2117892 - DNA, 20 bp, Homo sapiens
cagagatatgcacacaccga

SEQ ID NO: 2117893 - DNA, 13 bp, Homo sapiens
cagagatgcctcc

SEQ ID NO: 2117894 - DNA, 15 bp, Homo sapiens
cagagatgcctccac

SEQ ID NO: 2117895 - DNA, 18 bp, Homo sapiens
cagagatggaggccgagc

SEQ ID NO: 2117896 - DNA, 17 bp, Homo sapiens
cagagcaagactccgtc

SEQ ID NO: 2117897 - DNA, 20 bp, Homo sapiens
cagagcaagactctgtctca

SEQ ID NO: 2117898 - DNA, 18 bp, Homo sapiens
cagagcaagatcctgtct

SEQ ID NO: 2117899 - DNA, 15 bp, Homo sapiens
cagagcacacaggta

SEQ ID NO: 2117900 - DNA, 20 bp, Homo sapiens
cagagcacacaggtacagca

SEQ ID NO: 2117901 - DNA, 18 bp, Homo sapiens
cagagcacagcagcccct

SEQ ID NO: 2117902 - DNA, 20 bp, Homo sapiens
cagagcaggccacgctcagg

SEQ ID NO: 2117903 - DNA, 21 bp, Homo sapiens
cagagcaggccacgctcaggc

SEQ ID NO: 2117904 - DNA, 14 bp, Homo sapiens
cagagcaggggcag

SEQ ID NO: 2117905 - DNA, 18 bp, Homo sapiens
cagagcattacgtgagcc

SEQ ID NO: 2117906 - DNA, 13 bp, Homo sapiens
cagagccagcctg

SEQ ID NO: 2117907 - DNA, 14 bp, Homo sapiens
cagagccagcctgg

SEQ ID NO: 2117908 - DNA, 15 bp, Homo sapiens
cagagccagcctggg

SEQ ID NO: 2117909 - DNA, 17 bp, Homo sapiens
cagagccagcctgggac

SEQ ID NO: 2117910 - DNA, 19 bp, Homo sapiens
cagagccagcctgggactc

SEQ ID NO: 2117911 - DNA, 12 bp, Homo sapiens
cagagccaggct

SEQ ID NO: 2117912 - DNA, 11 bp, Homo sapiens
cagagccagtg

SEQ ID NO: 2117913 - DNA, 13 bp, Homo sapiens
cagagccagtgaa

SEQ ID NO: 2117914 - DNA, 14 bp, Homo sapiens
cagagccatgggcc

SEQ ID NO: 2117915 - DNA, 20 bp, Homo sapiens
cagagccatgggcctgggcc

SEQ ID NO: 2117916 - DNA, 18 bp, Homo sapiens
cagagcccaagtgccatc

SEQ ID NO: 2117917 - DNA, 20 bp, Homo sapiens
cagagcccaagtgccatccc

SEQ ID NO: 2117918 - DNA, 22 bp, Homo sapiens
cagagcccatgctcaaccactg

SEQ ID NO: 2117919 - DNA, 20 bp, Homo sapiens
cagagccccacacggaggca

SEQ ID NO: 2117920 - DNA, 23 bp, Homo sapiens
cagagccccacacggaggcatct

SEQ ID NO: 2117921 - DNA, 14 bp, Homo sapiens
cagagccccactcc

SEQ ID NO: 2117922 - DNA, 15 bp, Homo sapiens
cagagccccactccc

SEQ ID NO: 2117923 - DNA, 19 bp, Homo sapiens
cagagcccccaagcctctg

SEQ ID NO: 2117924 - DNA, 17 bp, Homo sapiens
cagagccgcaaatcaac

SEQ ID NO: 2117925 - DNA, 23 bp, Homo sapiens
cagagcctagccacctcccaccc

SEQ ID NO: 2117926 - DNA, 12 bp, Homo sapiens
cagagcctgcag

SEQ ID NO: 2117927 - DNA, 14 bp, Homo sapiens
cagagcctgcctca

SEQ ID NO: 2117928 - DNA, 15 bp, Homo sapiens
cagagcctgcctcag

SEQ ID NO: 2117929 - DNA, 20 bp, Homo sapiens
cagagcctgcctcagctgct

SEQ ID NO: 2117930 - DNA, 19 bp, Homo sapiens
cagagcctggggtgttctc

SEQ ID NO: 2117931 - DNA, 22 bp, Homo sapiens
cagagcctgtctttcagcattc

SEQ ID NO: 2117932 - DNA, 13 bp, Homo sapiens
cagagccttctcc

SEQ ID NO: 2117933 - DNA, 19 bp, Homo sapiens
cagagccttctcctgccta

SEQ ID NO: 2117934 - DNA, 13 bp, Homo sapiens
cagagcgggcctc

SEQ ID NO: 2117935 - DNA, 16 bp, Homo sapiens
cagagcgggcctcttc

SEQ ID NO: 2117936 - DNA, 15 bp, Homo sapiens
cagagcggggaggtg

SEQ ID NO: 2117937 - DNA, 18 bp, Homo sapiens
cagagctcttcaagctgt

SEQ ID NO: 2117938 - DNA, 19 bp, Homo sapiens
cagagctgatggagaagga

SEQ ID NO: 2117939 - DNA, 9 bp, Homo sapiens
cagagctgg

SEQ ID NO: 2117940 - DNA, 13 bp, Homo sapiens
cagagctggaagg

SEQ ID NO: 2117941 - DNA, 16 bp, Homo sapiens
cagagctggaaggcag

SEQ ID NO: 2117942 - DNA, 19 bp, Homo sapiens
cagagctggaaggcagggc

SEQ ID NO: 2117943 - DNA, 20 bp, Homo sapiens
cagagctggaaggcagggca

SEQ ID NO: 2117944 - DNA, 14 bp, Homo sapiens
cagagctggctgtc

SEQ ID NO: 2117945 - DNA, 15 bp, Homo sapiens
cagagctggctgtct

SEQ ID NO: 2117946 - DNA, 20 bp, Homo sapiens
cagagctgggatgtttctgt

SEQ ID NO: 2117947 - DNA, 17 bp, Homo sapiens
cagagcttattggccac

SEQ ID NO: 2117948 - DNA, 15 bp, Homo sapiens
cagagcttcccagga

SEQ ID NO: 2117949 - DNA, 14 bp, Homo sapiens
cagaggaagcccct

SEQ ID NO: 2117950 - DNA, 17 bp, Homo sapiens
cagaggaatctacctgt

SEQ ID NO: 2117951 - DNA, 17 bp, Homo sapiens
cagaggagcaaggttta

SEQ ID NO: 2117952 - DNA, 22 bp, Homo sapiens
cagaggatgttctggacctccc

SEQ ID NO: 2117953 - DNA, 13 bp, Homo sapiens
cagaggcagacag

SEQ ID NO: 2117954 - DNA, 11 bp, Homo sapiens
cagaggcagcc

SEQ ID NO: 2117955 - DNA, 20 bp, Homo sapiens
cagaggcagccccattctgc

SEQ ID NO: 2117956 - DNA, 16 bp, Homo sapiens
cagaggcagctgtgtg

SEQ ID NO: 2117957 - DNA, 14 bp, Homo sapiens
cagaggccaaggag

SEQ ID NO: 2117958 - DNA, 14 bp, Homo sapiens
cagaggccatggca

SEQ ID NO: 2117959 - DNA, 20 bp, Homo sapiens
cagaggccatgggcctcctg

SEQ ID NO: 2117960 - DNA, 16 bp, Homo sapiens
cagaggcggaaacctt

SEQ ID NO: 2117961 - DNA, 21 bp, Homo sapiens
cagaggcggaaaccttgcagc

SEQ ID NO: 2117962 - DNA, 15 bp, Homo sapiens
cagaggctgcaggac

SEQ ID NO: 2117963 - DNA, 17 bp, Homo sapiens
cagaggctgcaggactt

SEQ ID NO: 2117964 - DNA, 13 bp, Homo sapiens
cagaggctggagg

SEQ ID NO: 2117965 - DNA, 21 bp, Homo sapiens
cagaggctggaggcagggcct

SEQ ID NO: 2117966 - DNA, 15 bp, Homo sapiens
cagaggcttcttcag

SEQ ID NO: 2117967 - DNA, 16 bp, Homo sapiens
cagaggcttcttcaga

SEQ ID NO: 2117968 - DNA, 20 bp, Homo sapiens
cagagggaatgttccctgca

SEQ ID NO: 2117969 - DNA, 23 bp, Homo sapiens
cagagggaatgttccctgcaccc

SEQ ID NO: 2117970 - DNA, 14 bp, Homo sapiens
cagagggacagggt

SEQ ID NO: 2117971 - DNA, 18 bp, Homo sapiens
cagagggagtgacagagg

SEQ ID NO: 2117972 - DNA, 16 bp, Homo sapiens
cagagggccaagagag

SEQ ID NO: 2117973 - DNA, 17 bp, Homo sapiens
cagagggccaagagaga

SEQ ID NO: 2117974 - DNA, 13 bp, Homo sapiens
cagagggccacac

SEQ ID NO: 2117975 - DNA, 15 bp, Homo sapiens
cagaggggcagccgc

SEQ ID NO: 2117976 - DNA, 18 bp, Homo sapiens
cagaggggcagccgctag

SEQ ID NO: 2117977 - DNA, 21 bp, Homo sapiens
cagaggggcagccgctaggag

SEQ ID NO: 2117978 - DNA, 15 bp, Homo sapiens
cagaggggtaggcag

SEQ ID NO: 2117979 - DNA, 20 bp, Homo sapiens
cagagggtagggcagcagat

SEQ ID NO: 2117980 - DNA, 21 bp, Homo sapiens
cagaggtaaaagtgtgagcag

SEQ ID NO: 2117981 - DNA, 15 bp, Homo sapiens
cagaggtgagcagag

SEQ ID NO: 2117982 - DNA, 17 bp, Homo sapiens
cagaggtgagcagagga

SEQ ID NO: 2117983 - DNA, 21 bp, Homo sapiens
cagaggttatctgcctggcct

SEQ ID NO: 2117984 - DNA, 22 bp, Homo sapiens
cagaggttttaggaaacctggc

SEQ ID NO: 2117985 - DNA, 15 bp, Homo sapiens
cagagtataggatgg

SEQ ID NO: 2117986 - DNA, 16 bp, Homo sapiens
cagagtataggatgga

SEQ ID NO: 2117987 - DNA, 23 bp, Homo sapiens
cagagtttagaggaaaaaaatga

SEQ ID NO: 2117988 - DNA, 21 bp, Homo sapiens
cagataaagacagctgacaga

SEQ ID NO: 2117989 - DNA, 22 bp, Homo sapiens
cagataactgaaaattatttaa

SEQ ID NO: 2117990 - DNA, 21 bp, Homo sapiens
cagataagaatgctggttttc

SEQ ID NO: 2117991 - DNA, 20 bp, Homo sapiens
cagatagacagtgctgccct

SEQ ID NO: 2117992 - DNA, 12 bp, Homo sapiens
cagatagccaga

SEQ ID NO: 2117993 - DNA, 15 bp, Homo sapiens
cagatatacacatgg

SEQ ID NO: 2117994 - DNA, 19 bp, Homo sapiens
cagatatacacatggatgc

SEQ ID NO: 2117995 - DNA, 14 bp, Homo sapiens
cagatatatttttc

SEQ ID NO: 2117996 - DNA, 19 bp, Homo sapiens
cagatatatttttcacagt

SEQ ID NO: 2117997 - DNA, 15 bp, Homo sapiens
cagatatgatatgta

SEQ ID NO: 2117998 - DNA, 18 bp, Homo sapiens
cagatatgcacacacatg

SEQ ID NO: 2117999 - DNA, 20 bp, Homo sapiens
cagatattttttcagaaata

SEQ ID NO: 2118000 - DNA, 20 bp, Homo sapiens
cagatcatctggggacctgg

SEQ ID NO: 2118001 - DNA, 14 bp, Homo sapiens
cagatcccatccat

SEQ ID NO: 2118002 - DNA, 16 bp, Homo sapiens
cagatcctcacaacca

SEQ ID NO: 2118003 - DNA, 15 bp, Homo sapiens
cagatcgtattaatt

SEQ ID NO: 2118004 - DNA, 13 bp, Homo sapiens
cagatctgcactg

SEQ ID NO: 2118005 - DNA, 15 bp, Homo sapiens
cagatctgcactggg

SEQ ID NO: 2118006 - DNA, 16 bp, Homo sapiens
cagatctgcactgggt

SEQ ID NO: 2118007 - DNA, 17 bp, Homo sapiens
cagatctgcactgggtg

SEQ ID NO: 2118008 - DNA, 18 bp, Homo sapiens
cagatctgcctgggcctg

SEQ ID NO: 2118009 - DNA, 14 bp, Homo sapiens
cagatcttgacagt

SEQ ID NO: 2118010 - DNA, 13 bp, Homo sapiens
cagatctttttgt

SEQ ID NO: 2118011 - DNA, 16 bp, Homo sapiens
cagatctttttgtgaa

SEQ ID NO: 2118012 - DNA, 13 bp, Homo sapiens
cagatgagaagtt

SEQ ID NO: 2118013 - DNA, 19 bp, Homo sapiens
cagatgagcagtcacactg

SEQ ID NO: 2118014 - DNA, 15 bp, Homo sapiens
cagatgcacacacag

SEQ ID NO: 2118015 - DNA, 13 bp, Homo sapiens
cagatgcaccagc

SEQ ID NO: 2118016 - DNA, 16 bp, Homo sapiens
cagatgccacacctgc

SEQ ID NO: 2118017 - DNA, 22 bp, Homo sapiens
cagatgcccagagggcccaggc

SEQ ID NO: 2118018 - DNA, 22 bp, Homo sapiens
cagatgctggggagaatgaaga

SEQ ID NO: 2118019 - DNA, 21 bp, Homo sapiens
cagatggaaagacgtttttgt

SEQ ID NO: 2118020 - DNA, 22 bp, Homo sapiens
cagatggcatgtgtttacttta

SEQ ID NO: 2118021 - DNA, 16 bp, Homo sapiens
cagatgggtattaaac

SEQ ID NO: 2118022 - DNA, 17 bp, Homo sapiens
cagatgggtattaaact

SEQ ID NO: 2118023 - DNA, 15 bp, Homo sapiens
cagatgtaggaggga

SEQ ID NO: 2118024 - DNA, 24 bp, Homo sapiens
cagatgtaggagggactgtcgctg

SEQ ID NO: 2118025 - DNA, 22 bp, Homo sapiens
cagattattttagtctgtcatc

SEQ ID NO: 2118026 - DNA, 19 bp, Homo sapiens
cagattccacacaaaatgt

SEQ ID NO: 2118027 - DNA, 14 bp, Homo sapiens
cagattcccagagc

SEQ ID NO: 2118028 - DNA, 13 bp, Homo sapiens
cagattctgattt

SEQ ID NO: 2118029 - DNA, 17 bp, Homo sapiens
cagattgcaacaggctg

SEQ ID NO: 2118030 - DNA, 22 bp, Homo sapiens
cagattttttacagctgcctgc

SEQ ID NO: 2118031 - DNA, 18 bp, Homo sapiens
cagcaaagtgtcagtgtt

SEQ ID NO: 2118032 - DNA, 19 bp, Homo sapiens
cagcaaagtgtcagtgttg

SEQ ID NO: 2118033 - DNA, 18 bp, Homo sapiens
cagcaaatcctcttctaa

SEQ ID NO: 2118034 - DNA, 16 bp, Homo sapiens
cagcaacacaagctgg

SEQ ID NO: 2118035 - DNA, 14 bp, Homo sapiens
cagcaacacagagc

SEQ ID NO: 2118036 - DNA, 21 bp, Homo sapiens
cagcaacaggaatctcagaga

SEQ ID NO: 2118037 - DNA, 12 bp, Homo sapiens
cagcaactccca

SEQ ID NO: 2118038 - DNA, 21 bp, Homo sapiens
cagcaagccggccccccctct

SEQ ID NO: 2118039 - DNA, 20 bp, Homo sapiens
cagcaaggcccgagcagctg

SEQ ID NO: 2118040 - DNA, 12 bp, Homo sapiens
cagcaagtgaga

SEQ ID NO: 2118041 - DNA, 19 bp, Homo sapiens
cagcaagtgagagctgggt

SEQ ID NO: 2118042 - DNA, 21 bp, Homo sapiens
cagcaagtgagagctgggtgt

SEQ ID NO: 2118043 - DNA, 18 bp, Homo sapiens
cagcaagtttcaccttgg

SEQ ID NO: 2118044 - DNA, 20 bp, Homo sapiens
cagcaatgatgtccagaaga

SEQ ID NO: 2118045 - DNA, 17 bp, Homo sapiens
cagcacaccccaaggga

SEQ ID NO: 2118046 - DNA, 21 bp, Homo sapiens
cagcacagaaggaatctgtgc

SEQ ID NO: 2118047 - DNA, 17 bp, Homo sapiens
cagcacaggggccccag

SEQ ID NO: 2118048 - DNA, 21 bp, Homo sapiens
cagcacaggggccccagatct

SEQ ID NO: 2118049 - DNA, 20 bp, Homo sapiens
cagcacatagcactgggaac

SEQ ID NO: 2118050 - DNA, 13 bp, Homo sapiens
cagcacccaggct

SEQ ID NO: 2118051 - DNA, 16 bp, Homo sapiens
cagcacccaggctcca

SEQ ID NO: 2118052 - DNA, 11 bp, Homo sapiens
cagcaccctcc

SEQ ID NO: 2118053 - DNA, 14 bp, Homo sapiens
cagcaccctccccc

SEQ ID NO: 2118054 - DNA, 17 bp, Homo sapiens
cagcaccctctcctggg

SEQ ID NO: 2118055 - DNA, 18 bp, Homo sapiens
cagcaccctctcctgggg

SEQ ID NO: 2118056 - DNA, 11 bp, Homo sapiens
cagcaccctgg

SEQ ID NO: 2118057 - DNA, 13 bp, Homo sapiens
cagcaccctgggt

SEQ ID NO: 2118058 - DNA, 14 bp, Homo sapiens
cagcaccctgggtg

SEQ ID NO: 2118059 - DNA, 17 bp, Homo sapiens
cagcaccctgggtgcca

SEQ ID NO: 2118060 - DNA, 19 bp, Homo sapiens
cagcactaaagcagtggac

SEQ ID NO: 2118061 - DNA, 10 bp, Homo sapiens
cagcactaac

SEQ ID NO: 2118062 - DNA, 16 bp, Homo sapiens
cagcactcctctgtct

SEQ ID NO: 2118063 - DNA, 12 bp, Homo sapiens
cagcactgaaaa

SEQ ID NO: 2118064 - DNA, 18 bp, Homo sapiens
cagcactttaaccctctc

SEQ ID NO: 2118065 - DNA, 19 bp, Homo sapiens
cagcactttaaccctctct

SEQ ID NO: 2118066 - DNA, 20 bp, Homo sapiens
cagcactttaaccctctctt

SEQ ID NO: 2118067 - DNA, 16 bp, Homo sapiens
cagcactttgggaggc

SEQ ID NO: 2118068 - DNA, 11 bp, Homo sapiens
cagcagaaaag

SEQ ID NO: 2118069 - DNA, 13 bp, Homo sapiens
cagcagaaaagtg

SEQ ID NO: 2118070 - DNA, 14 bp, Homo sapiens
cagcagaaaagtgc

SEQ ID NO: 2118071 - DNA, 12 bp, Homo sapiens
cagcagaaagac

SEQ ID NO: 2118072 - DNA, 23 bp, Homo sapiens
cagcagaagagggaggcttcctg

SEQ ID NO: 2118073 - DNA, 13 bp, Homo sapiens
cagcagaatgaag

SEQ ID NO: 2118074 - DNA, 14 bp, Homo sapiens
cagcagaatgaaga

SEQ ID NO: 2118075 - DNA, 21 bp, Homo sapiens
cagcagactcagctctgacat

SEQ ID NO: 2118076 - DNA, 23 bp, Homo sapiens
cagcagactcagctctgacattc

SEQ ID NO: 2118077 - DNA, 16 bp, Homo sapiens
cagcagagagccctgg

SEQ ID NO: 2118078 - DNA, 17 bp, Homo sapiens
cagcagagagccctggg

SEQ ID NO: 2118079 - DNA, 18 bp, Homo sapiens
cagcagatggaaagaaag

SEQ ID NO: 2118080 - DNA, 12 bp, Homo sapiens
cagcagccagcc

SEQ ID NO: 2118081 - DNA, 14 bp, Homo sapiens
cagcagccagccct

SEQ ID NO: 2118082 - DNA, 18 bp, Homo sapiens
cagcagccagccctgcct

SEQ ID NO: 2118083 - DNA, 19 bp, Homo sapiens
cagcagccagccctgcctg

SEQ ID NO: 2118084 - DNA, 22 bp, Homo sapiens
cagcagccagccctgcctggag

SEQ ID NO: 2118085 - DNA, 23 bp, Homo sapiens
cagcagccagccctgcctggagg

SEQ ID NO: 2118086 - DNA, 19 bp, Homo sapiens
cagcagccagctctcagcc

SEQ ID NO: 2118087 - DNA, 20 bp, Homo sapiens
cagcagccagctctcagcca

SEQ ID NO: 2118088 - DNA, 21 bp, Homo sapiens
cagcagccagctctcagccaa

SEQ ID NO: 2118089 - DNA, 23 bp, Homo sapiens
cagcagcccatggcctctggcca

SEQ ID NO: 2118090 - DNA, 18 bp, Homo sapiens
cagcagccccccagcact

SEQ ID NO: 2118091 - DNA, 21 bp, Homo sapiens
cacttataagtgggagctaaa

SEQ ID NO: 2118092 - DNA, 15 bp, Homo sapiens
cacttataccaaagg

SEQ ID NO: 2118093 - DNA, 20 bp, Homo sapiens
cacttattccccattcttcc

SEQ ID NO: 2118094 - DNA, 17 bp, Homo sapiens
cacttatttcataaaca

SEQ ID NO: 2118095 - DNA, 12 bp, Homo sapiens
cacttcactgtg

SEQ ID NO: 2118096 - DNA, 14 bp, Homo sapiens
cacttcagcccagc

SEQ ID NO: 2118097 - DNA, 23 bp, Homo sapiens
cacttcaggctcttctcctttca

SEQ ID NO: 2118098 - DNA, 14 bp, Homo sapiens
cacttccagtgttg

SEQ ID NO: 2118099 - DNA, 23 bp, Homo sapiens
cacttccagtgttggctgtgtga

SEQ ID NO: 2118100 - DNA, 20 bp, Homo sapiens
cacttccataatctggactc

SEQ ID NO: 2118101 - DNA, 17 bp, Homo sapiens
cacttctaaatgaagtg

SEQ ID NO: 2118102 - DNA, 19 bp, Homo sapiens
cacttctcatcatattgta

SEQ ID NO: 2118103 - DNA, 18 bp, Homo sapiens
cacttctctactctggaa

SEQ ID NO: 2118104 - DNA, 20 bp, Homo sapiens
cacttctctactctggaagt

SEQ ID NO: 2118105 - DNA, 18 bp, Homo sapiens
cacttcttaaaggcctgg

SEQ ID NO: 2118106 - DNA, 17 bp, Homo sapiens
cacttcttgaaacagcc

SEQ ID NO: 2118107 - DNA, 21 bp, Homo sapiens
cacttcttgaaacagcctggg

SEQ ID NO: 2118108 - DNA, 18 bp, Homo sapiens
cacttgaacccgggaggc

SEQ ID NO: 2118109 - DNA, 14 bp, Homo sapiens
cacttgacattcct

SEQ ID NO: 2118110 - DNA, 18 bp, Homo sapiens
cacttgagttcaggagtt

SEQ ID NO: 2118111 - DNA, 14 bp, Homo sapiens
cacttgattccttg

SEQ ID NO: 2118112 - DNA, 18 bp, Homo sapiens
cacttgcagactctacag

SEQ ID NO: 2118113 - DNA, 24 bp, Homo sapiens
cacttgcagactctacagaggcca

SEQ ID NO: 2118114 - DNA, 14 bp, Homo sapiens
cacttggaaaggtt

SEQ ID NO: 2118115 - DNA, 12 bp, Homo sapiens
cacttggagcca

SEQ ID NO: 2118116 - DNA, 15 bp, Homo sapiens
cacttggagcccgtg

SEQ ID NO: 2118117 - DNA, 23 bp, Homo sapiens
cacttggctgcataaatgtggta

SEQ ID NO: 2118118 - DNA, 14 bp, Homo sapiens
cacttggctgctca

SEQ ID NO: 2118119 - DNA, 20 bp, Homo sapiens
cacttggtttttggctcttt

SEQ ID NO: 2118120 - DNA, 13 bp, Homo sapiens
cacttgtaaataa

SEQ ID NO: 2118121 - DNA, 14 bp, Homo sapiens
cacttgtaaataaa

SEQ ID NO: 2118122 - DNA, 15 bp, Homo sapiens
cacttgtaaataaat

SEQ ID NO: 2118123 - DNA, 17 bp, Homo sapiens
cacttgtaaataaatag

SEQ ID NO: 2118124 - DNA, 20 bp, Homo sapiens
cacttgtataaatgtatata

SEQ ID NO: 2118125 - DNA, 18 bp, Homo sapiens
cactttaagagagaaatc

SEQ ID NO: 2118126 - DNA, 14 bp, Homo sapiens
caattcacttcatt

SEQ ID NO: 2118127 - DNA, 21 bp, Homo sapiens
caattcacttcattgaccaag

SEQ ID NO: 2118128 - DNA, 20 bp, Homo sapiens
caattcaggactggctcacc

SEQ ID NO: 2118129 - DNA, 16 bp, Homo sapiens
caattcatttcacttt

SEQ ID NO: 2118130 - DNA, 19 bp, Homo sapiens
caattcatttcactttaaa

SEQ ID NO: 2118131 - DNA, 22 bp, Homo sapiens
caattcatttcactttaaagtc

SEQ ID NO: 2118132 - DNA, 15 bp, Homo sapiens
caattccaaaggaat

SEQ ID NO: 2118133 - DNA, 22 bp, Homo sapiens
caattccgtcttcttaatctga

SEQ ID NO: 2118134 - DNA, 13 bp, Homo sapiens
caattcctctggg

SEQ ID NO: 2118135 - DNA, 12 bp, Homo sapiens
caattcctgggc

SEQ ID NO: 2118136 - DNA, 15 bp, Homo sapiens
caattctgacttctc

SEQ ID NO: 2118137 - DNA, 11 bp, Homo sapiens
caattctgtat

SEQ ID NO: 2118138 - DNA, 12 bp, Homo sapiens
caattctgtata

SEQ ID NO: 2118139 - DNA, 19 bp, Homo sapiens
caattcttacaaacatgtg

SEQ ID NO: 2118140 - DNA, 21 bp, Homo sapiens
caattgaacttaaataaatgt

SEQ ID NO: 2118141 - DNA, 21 bp, Homo sapiens
caattgcacgcggagtgagtt

SEQ ID NO: 2118142 - DNA, 12 bp, Homo sapiens
caattgtaaagt

SEQ ID NO: 2118143 - DNA, 15 bp, Homo sapiens
caattgtcatttata

SEQ ID NO: 2118144 - DNA, 16 bp, Homo sapiens
caattgtcatttataa

SEQ ID NO: 2118145 - DNA, 19 bp, Homo sapiens
caattgtgggatgtcctct

SEQ ID NO: 2118146 - DNA, 20 bp, Homo sapiens
caatttaaaatcattcaata

SEQ ID NO: 2118147 - DNA, 13 bp, Homo sapiens
caatttaaagcaa

SEQ ID NO: 2118148 - DNA, 14 bp, Homo sapiens
caatttaattccat

SEQ ID NO: 2118149 - DNA, 15 bp, Homo sapiens
caatttaattcttat

SEQ ID NO: 2118150 - DNA, 20 bp, Homo sapiens
caatttaattcttatttctg

SEQ ID NO: 2118151 - DNA, 23 bp, Homo sapiens
caatttaattcttatttctgtgt

SEQ ID NO: 2118152 - DNA, 14 bp, Homo sapiens
caatttagaaaaca

SEQ ID NO: 2118153 - DNA, 14 bp, Homo sapiens
caatttattaaaat

SEQ ID NO: 2118154 - DNA, 17 bp, Homo sapiens
caatttcccagaaggga

SEQ ID NO: 2118155 - DNA, 20 bp, Homo sapiens
caatttcccctctgtgtcct

SEQ ID NO: 2118156 - DNA, 21 bp, Homo sapiens
caatttcctttatatttagtg

SEQ ID NO: 2118157 - DNA, 16 bp, Homo sapiens
caatttgagcaattca

SEQ ID NO: 2118158 - DNA, 17 bp, Homo sapiens
caatttgagcaattcat

SEQ ID NO: 2118159 - DNA, 19 bp, Homo sapiens
caatttgagcaattcattt

SEQ ID NO: 2118160 - DNA, 22 bp, Homo sapiens
caatttgcactgttacttttta

SEQ ID NO: 2118161 - DNA, 23 bp, Homo sapiens
caatttgtaattgcttacatttt

SEQ ID NO: 2118162 - DNA, 17 bp, Homo sapiens
caattttaatgctattt

SEQ ID NO: 2118163 - DNA, 23 bp, Homo sapiens
caattttcaggtttcttaaaaac

SEQ ID NO: 2118164 - DNA, 18 bp, Homo sapiens
caattttgcatgctcgat

SEQ ID NO: 2118165 - DNA, 13 bp, Homo sapiens
caatttttaaact

SEQ ID NO: 2118166 - DNA, 17 bp, Homo sapiens
caatttttaaactagta

SEQ ID NO: 2118167 - DNA, 13 bp, Homo sapiens
caatttttataca

SEQ ID NO: 2118168 - DNA, 14 bp, Homo sapiens
caatttttatacat

SEQ ID NO: 2118169 - DNA, 16 bp, Homo sapiens
caatttttatacatat

SEQ ID NO: 2118170 - DNA, 20 bp, Homo sapiens
caatttttatacatatcaga

SEQ ID NO: 2118171 - DNA, 22 bp, Homo sapiens
caatttttatacatatcagaaa

SEQ ID NO: 2118172 - DNA, 13 bp, Homo sapiens
cacaaaaaagaag

SEQ ID NO: 2118173 - DNA, 21 bp, Homo sapiens
cacaaaaatggtggtttgtca

SEQ ID NO: 2118174 - DNA, 14 bp, Homo sapiens
cacaaaagccaaaa

SEQ ID NO: 2118175 - DNA, 18 bp, Homo sapiens
cacaaaagttagctgagc

SEQ ID NO: 2118176 - DNA, 18 bp, Homo sapiens
cacaaaagtttctctttt

SEQ ID NO: 2118177 - DNA, 17 bp, Homo sapiens
cacaaaatgataatcaa

SEQ ID NO: 2118178 - DNA, 12 bp, Homo sapiens
cacaaaatgcaa

SEQ ID NO: 2118179 - DNA, 13 bp, Homo sapiens
cacaaacacctcc

SEQ ID NO: 2118180 - DNA, 20 bp, Homo sapiens
cacaaaccaccctaaaatga

SEQ ID NO: 2118181 - DNA, 15 bp, Homo sapiens
cacaaaccatgcaaa

SEQ ID NO: 2118182 - DNA, 16 bp, Homo sapiens
cacaaactttaaattc

SEQ ID NO: 2118183 - DNA, 20 bp, Homo sapiens
cacaaagagaaaaagaaatg

SEQ ID NO: 2118184 - DNA, 21 bp, Homo sapiens
cacaaataatgaacagcagaa

SEQ ID NO: 2118185 - DNA, 23 bp, Homo sapiens
cacaaatctatattaaagtgtta

SEQ ID NO: 2118186 - DNA, 11 bp, Homo sapiens
cacaacagatt

SEQ ID NO: 2118187 - DNA, 23 bp, Homo sapiens
cacaacataaggagaatgtatct

SEQ ID NO: 2118188 - DNA, 16 bp, Homo sapiens
cacaaccagccacaca

SEQ ID NO: 2118189 - DNA, 18 bp, Homo sapiens
cacaaccagccacacaga

SEQ ID NO: 2118190 - DNA, 11 bp, Homo sapiens
cacaactagga

SEQ ID NO: 2118191 - DNA, 17 bp, Homo sapiens
cacaactaggacctcat

SEQ ID NO: 2118192 - DNA, 12 bp, Homo sapiens
cacaactgacac

SEQ ID NO: 2118193 - DNA, 20 bp, Homo sapiens
cacaactgtttttgaagaag

SEQ ID NO: 2118194 - DNA, 20 bp, Homo sapiens
cacaagaaatttgatttcta

SEQ ID NO: 2118195 - DNA, 15 bp, Homo sapiens
cacaagaggaagaga

SEQ ID NO: 2118196 - DNA, 19 bp, Homo sapiens
cacaagattcccagagaca

SEQ ID NO: 2118197 - DNA, 14 bp, Homo sapiens
cacaagcaataatt

SEQ ID NO: 2118198 - DNA, 14 bp, Homo sapiens
cacaagcacaaagc

SEQ ID NO: 2118199 - DNA, 17 bp, Homo sapiens
cacaagccacagaagcc

SEQ ID NO: 2118200 - DNA, 17 bp, Homo sapiens
cacaagccttactcacc

SEQ ID NO: 2118201 - DNA, 19 bp, Homo sapiens
cacaagccttactcacctc

SEQ ID NO: 2118202 - DNA, 20 bp, Homo sapiens
cacaagccttactcacctct

SEQ ID NO: 2118203 - DNA, 21 bp, Homo sapiens
cacaagccttactcacctctc

SEQ ID NO: 2118204 - DNA, 11 bp, Homo sapiens
cacaaggcagc

SEQ ID NO: 2118205 - DNA, 17 bp, Homo sapiens
cacaaggcagcaaggcc

SEQ ID NO: 2118206 - DNA, 22 bp, Homo sapiens
cacaaggcagcaaggcccgagc

SEQ ID NO: 2118207 - DNA, 16 bp, Homo sapiens
cacaagtcctgtgaat

SEQ ID NO: 2118208 - DNA, 16 bp, Homo sapiens
cacaagttccagctgg

SEQ ID NO: 2118209 - DNA, 20 bp, Homo sapiens
cacagcagccccccagcact

SEQ ID NO: 2118210 - DNA, 17 bp, Homo sapiens
cacagcagtatgaatga

SEQ ID NO: 2118211 - DNA, 19 bp, Homo sapiens
cacagcagttgaaaagact

SEQ ID NO: 2118212 - DNA, 22 bp, Homo sapiens
cacagcagttgaaaagactcca

SEQ ID NO: 2118213 - DNA, 23 bp, Homo sapiens
cacagcccaagaggactgagact

SEQ ID NO: 2118214 - DNA, 16 bp, Homo sapiens
cacagccccacagcac

SEQ ID NO: 2118215 - DNA, 13 bp, Homo sapiens
cacagcccgggtg

SEQ ID NO: 2118216 - DNA, 17 bp, Homo sapiens
cacagccctgggagggg

SEQ ID NO: 2118217 - DNA, 22 bp, Homo sapiens
cacagccgcagcctccctctga

SEQ ID NO: 2118218 - DNA, 13 bp, Homo sapiens
cacagcctggact

SEQ ID NO: 2118219 - DNA, 17 bp, Homo sapiens
cacagcggaggagacca

SEQ ID NO: 2118220 - DNA, 18 bp, Homo sapiens
cacagcggggaagctggg

SEQ ID NO: 2118221 - DNA, 15 bp, Homo sapiens
cacagctcccacccc

SEQ ID NO: 2118222 - DNA, 16 bp, Homo sapiens
cacagctcccacccca

SEQ ID NO: 2118223 - DNA, 16 bp, Homo sapiens
cacagctctgtagaaa

SEQ ID NO: 2118224 - DNA, 18 bp, Homo sapiens
cacagctctgtcctggga

SEQ ID NO: 2118225 - DNA, 17 bp, Homo sapiens
cacagctcttctccagg

SEQ ID NO: 2118226 - DNA, 18 bp, Homo sapiens
cacagctcttctccaggc

SEQ ID NO: 2118227 - DNA, 21 bp, Homo sapiens
cacagctcttctccaggctgt

SEQ ID NO: 2118228 - DNA, 19 bp, Homo sapiens
cacagctgagagactttta

SEQ ID NO: 2118229 - DNA, 12 bp, Homo sapiens
cacagctgcagc

SEQ ID NO: 2118230 - DNA, 21 bp, Homo sapiens
cacagctgcagctgggcccca

SEQ ID NO: 2118231 - DNA, 17 bp, Homo sapiens
cacagctgcttgtcctg

SEQ ID NO: 2118232 - DNA, 22 bp, Homo sapiens
cacagcttcatttcctgtgtct

SEQ ID NO: 2118233 - DNA, 23 bp, Homo sapiens
cacaggacacctggccgcctcca

SEQ ID NO: 2118234 - DNA, 16 bp, Homo sapiens
cacaggactctgcctc

SEQ ID NO: 2118235 - DNA, 16 bp, Homo sapiens
cacaggagcagacaga

SEQ ID NO: 2118236 - DNA, 14 bp, Homo sapiens
cacaggagctacct

SEQ ID NO: 2118237 - DNA, 12 bp, Homo sapiens
cacaggatcagt

SEQ ID NO: 2118238 - DNA, 15 bp, Homo sapiens
cacaggatcagtctg

SEQ ID NO: 2118239 - DNA, 20 bp, Homo sapiens
cacaggcaaaatccttgctt

SEQ ID NO: 2118240 - DNA, 11 bp, Homo sapiens
cacaggcagct

SEQ ID NO: 2118241 - DNA, 17 bp, Homo sapiens
cacaggcaggaagagag

SEQ ID NO: 2118242 - DNA, 18 bp, Homo sapiens
cacaggcaggaagagaga

SEQ ID NO: 2118243 - DNA, 19 bp, Homo sapiens
cacaggcaggaagagagag

SEQ ID NO: 2118244 - DNA, 14 bp, Homo sapiens
cacaggcaggtcca

SEQ ID NO: 2118245 - DNA, 17 bp, Homo sapiens
cacaggcatctacacag

SEQ ID NO: 2118246 - DNA, 15 bp, Homo sapiens
cactcttatgaaatg

SEQ ID NO: 2118247 - DNA, 22 bp, Homo sapiens
cactcttattgcccacgctgga

SEQ ID NO: 2118248 - DNA, 17 bp, Homo sapiens
cactcttcctgcaagga

SEQ ID NO: 2118249 - DNA, 18 bp, Homo sapiens
cactcttcttgagcagac

SEQ ID NO: 2118250 - DNA, 12 bp, Homo sapiens
cactctttgcta

SEQ ID NO: 2118251 - DNA, 17 bp, Homo sapiens
cactctttgctacaata

SEQ ID NO: 2118252 - DNA, 21 bp, Homo sapiens
cactctttgctacaataaatg

SEQ ID NO: 2118253 - DNA, 22 bp, Homo sapiens
cactgaaaacatttcaaagctg

SEQ ID NO: 2118254 - DNA, 18 bp, Homo sapiens
cactgaagtgcttgcaga

SEQ ID NO: 2118255 - DNA, 22 bp, Homo sapiens
cactgaagttaacagagacaga

SEQ ID NO: 2118256 - DNA, 23 bp, Homo sapiens
cactgaatctcccctcctcacag

SEQ ID NO: 2118257 - DNA, 21 bp, Homo sapiens
cactgaatgcctcaatgtgac

SEQ ID NO: 2118258 - DNA, 17 bp, Homo sapiens
cactgacatgtttcaca

SEQ ID NO: 2118259 - DNA, 14 bp, Homo sapiens
cactgacctcaccg

SEQ ID NO: 2118260 - DNA, 17 bp, Homo sapiens
cactgacctcaccggca

SEQ ID NO: 2118261 - DNA, 20 bp, Homo sapiens
cactgactgggaccaggcac

SEQ ID NO: 2118262 - DNA, 15 bp, Homo sapiens
cactgacttctaagt

SEQ ID NO: 2118263 - DNA, 20 bp, Homo sapiens
cactgacttctaagtaaaac

SEQ ID NO: 2118264 - DNA, 15 bp, Homo sapiens
cactgaggatgtgag

SEQ ID NO: 2118265 - DNA, 20 bp, Homo sapiens
cactgaggatgtgagcctga

SEQ ID NO: 2118266 - DNA, 13 bp, Homo sapiens
cactgagggccac

SEQ ID NO: 2118267 - DNA, 17 bp, Homo sapiens
cactgataatatgtttg

SEQ ID NO: 2118268 - DNA, 18 bp, Homo sapiens
cactgatgggcaaccccc

SEQ ID NO: 2118269 - DNA, 19 bp, Homo sapiens
cactgatttcacaacagat

SEQ ID NO: 2118270 - DNA, 12 bp, Homo sapiens
cactgcaagaag

SEQ ID NO: 2118271 - DNA, 18 bp, Homo sapiens
cactgcacagtgcatctc

SEQ ID NO: 2118272 - DNA, 21 bp, Homo sapiens
cactgcacagtgcatctcagc

SEQ ID NO: 2118273 - DNA, 22 bp, Homo sapiens
cactgcacagtgcatctcagcc

SEQ ID NO: 2118274 - DNA, 23 bp, Homo sapiens
cactgcacagtgcatctcagccc

SEQ ID NO: 2118275 - DNA, 15 bp, Homo sapiens
cactgcaccgggcca

SEQ ID NO: 2118276 - DNA, 16 bp, Homo sapiens
cactgcaccgggccac

SEQ ID NO: 2118277 - DNA, 19 bp, Homo sapiens
cactgcactatagcctagg

SEQ ID NO: 2118278 - DNA, 19 bp, Homo sapiens
cactgcactccagcctggg

SEQ ID NO: 2118279 - DNA, 15 bp, Homo sapiens
cactgcactctagcc

SEQ ID NO: 2118280 - DNA, 19 bp, Homo sapiens
cactgcactctagcctggc

SEQ ID NO: 2118281 - DNA, 20 bp, Homo sapiens
cactgcactctagcctggca

SEQ ID NO: 2118282 - DNA, 12 bp, Homo sapiens
cactgcagagat

SEQ ID NO: 2118283 - DNA, 21 bp, Homo sapiens
cactgcagatagccagacaca

SEQ ID NO: 2118284 - DNA, 12 bp, Homo sapiens
cactgcagcctc

SEQ ID NO: 2118285 - DNA, 19 bp, Homo sapiens
cactgcagcctcaacctcc

SEQ ID NO: 2118286 - DNA, 15 bp, Homo sapiens
cactgccacaccctc

SEQ ID NO: 2118287 - DNA, 22 bp, Homo sapiens
cactgccaggagggacaaagga

SEQ ID NO: 2118288 - DNA, 15 bp, Homo sapiens
cactgccaggcacct

SEQ ID NO: 2118289 - DNA, 18 bp, Homo sapiens
cactgccaggcacctggc

SEQ ID NO: 2118290 - DNA, 17 bp, Homo sapiens
cactgccccaccagcca

SEQ ID NO: 2118291 - DNA, 22 bp, Homo sapiens
catttgtaatgtatcttattta

SEQ ID NO: 2118292 - DNA, 15 bp, Homo sapiens
catttgtacattcct

SEQ ID NO: 2118293 - DNA, 15 bp, Homo sapiens
catttgtatttgtat

SEQ ID NO: 2118294 - DNA, 16 bp, Homo sapiens
catttgtgaaatgatg

SEQ ID NO: 2118295 - DNA, 14 bp, Homo sapiens
catttgtgtcaatg

SEQ ID NO: 2118296 - DNA, 16 bp, Homo sapiens
catttgttggaatgaa

SEQ ID NO: 2118297 - DNA, 22 bp, Homo sapiens
cattttaaaagcaattatattg

SEQ ID NO: 2118298 - DNA, 19 bp, Homo sapiens
cattttaaaatctgattta

SEQ ID NO: 2118299 - DNA, 13 bp, Homo sapiens
cattttaaataaa

SEQ ID NO: 2118300 - DNA, 18 bp, Homo sapiens
cattttaaataaaagaaa

SEQ ID NO: 2118301 - DNA, 16 bp, Homo sapiens
cattttaacatctgag

SEQ ID NO: 2118302 - DNA, 15 bp, Homo sapiens
cattttactacttgt

SEQ ID NO: 2118303 - DNA, 15 bp, Homo sapiens
cattttactgtctgt

SEQ ID NO: 2118304 - DNA, 11 bp, Homo sapiens
cattttattac

SEQ ID NO: 2118305 - DNA, 19 bp, Homo sapiens
cattttatttaagaataaa

SEQ ID NO: 2118306 - DNA, 15 bp, Homo sapiens
cattttatttattag

SEQ ID NO: 2118307 - DNA, 21 bp, Homo sapiens
cattttatttattagctgtaa

SEQ ID NO: 2118308 - DNA, 13 bp, Homo sapiens
cattttcaataat

SEQ ID NO: 2118309 - DNA, 14 bp, Homo sapiens
cattttcagagtga

SEQ ID NO: 2118310 - DNA, 20 bp, Homo sapiens
cattttcctcgcctaggcct

SEQ ID NO: 2118311 - DNA, 22 bp, Homo sapiens
cattttcctcgcctaggcctgt

SEQ ID NO: 2118312 - DNA, 16 bp, Homo sapiens
cattttgaggccagag

SEQ ID NO: 2118313 - DNA, 12 bp, Homo sapiens
cattttgcaaaa

SEQ ID NO: 2118314 - DNA, 15 bp, Homo sapiens
cattttgcaaaattt

SEQ ID NO: 2118315 - DNA, 20 bp, Homo sapiens
cattttgcagcagtgagtct

SEQ ID NO: 2118316 - DNA, 22 bp, Homo sapiens
cattttgcagcagtgagtctct

SEQ ID NO: 2118317 - DNA, 13 bp, Homo sapiens
cattttgcctttc

SEQ ID NO: 2118318 - DNA, 20 bp, Homo sapiens
cattttggaagttttcagga

SEQ ID NO: 2118319 - DNA, 20 bp, Homo sapiens
cattttggggtacccactgc

SEQ ID NO: 2118320 - DNA, 16 bp, Homo sapiens
cattttggtactttgg

SEQ ID NO: 2118321 - DNA, 15 bp, Homo sapiens
cattttgttatagaa

SEQ ID NO: 2118322 - DNA, 18 bp, Homo sapiens
catttttactaaagcagt

SEQ ID NO: 2118323 - DNA, 23 bp, Homo sapiens
catttttactactattctgttaa

SEQ ID NO: 2118324 - DNA, 17 bp, Homo sapiens
catttttagtagagaca

SEQ ID NO: 2118325 - DNA, 16 bp, Homo sapiens
catttttccgtaaaaa

SEQ ID NO: 2118326 - DNA, 13 bp, Homo sapiens
catttttgagcca

SEQ ID NO: 2118327 - DNA, 14 bp, Homo sapiens
catttttgagccaa

SEQ ID NO: 2118328 - DNA, 21 bp, Homo sapiens
catttttttttttgtttctga

SEQ ID NO: 2118329 - DNA, 13 bp, Homo sapiens
ccaaaaatagcta

SEQ ID NO: 2118330 - DNA, 14 bp, Homo sapiens
ccaaaacaatgttt

SEQ ID NO: 2118331 - DNA, 23 bp, Homo sapiens
ccaaaacctcatgacagccagag

SEQ ID NO: 2118332 - DNA, 23 bp, Homo sapiens
ccaaaacctttccccagacacat

SEQ ID NO: 2118333 - DNA, 16 bp, Homo sapiens
ccaaaagggcagccag

SEQ ID NO: 2118334 - DNA, 21 bp, Homo sapiens
ccaaaagggcagccaggggct

SEQ ID NO: 2118335 - DNA, 16 bp, Homo sapiens
ccaaaagtacttaccc

SEQ ID NO: 2118336 - DNA, 21 bp, Homo sapiens
ccaaaagtcaaaaggtgcctg

SEQ ID NO: 2118337 - DNA, 21 bp, Homo sapiens
ccaaacacagagcgggagtga

SEQ ID NO: 2118338 - DNA, 18 bp, Homo sapiens
ccaaacaccatgaatctt

SEQ ID NO: 2118339 - DNA, 13 bp, Homo sapiens
ccaaactctgcca

SEQ ID NO: 2118340 - DNA, 20 bp, Homo sapiens
ccaaactgcacacacagctc

SEQ ID NO: 2118341 - DNA, 23 bp, Homo sapiens
ccaaagaattcctgaagccagat

SEQ ID NO: 2118342 - DNA, 20 bp, Homo sapiens
ccaaagagactggagcatct

SEQ ID NO: 2118343 - DNA, 14 bp, Homo sapiens
ccaaagagcctgga

SEQ ID NO: 2118344 - DNA, 17 bp, Homo sapiens
ccaaagagcctggagaa

SEQ ID NO: 2118345 - DNA, 20 bp, Homo sapiens
ccaaagagcctggagaagct

SEQ ID NO: 2118346 - DNA, 22 bp, Homo sapiens
ccaaagagcctggagaagctga

SEQ ID NO: 2118347 - DNA, 19 bp, Homo sapiens
ccaaagccaaagctaggcc

SEQ ID NO: 2118348 - DNA, 16 bp, Homo sapiens
ccaaaggggctgctgg

SEQ ID NO: 2118349 - DNA, 17 bp, Homo sapiens
ccaaagtgacctaccca

SEQ ID NO: 2118350 - DNA, 19 bp, Homo sapiens
ccaaagtgcagcccttcct

SEQ ID NO: 2118351 - DNA, 20 bp, Homo sapiens
ccaaagtgcagcccttcctc

SEQ ID NO: 2118352 - DNA, 21 bp, Homo sapiens
ccaaagtgcagcccttcctcc

SEQ ID NO: 2118353 - DNA, 23 bp, Homo sapiens
ccaaagtgcagcccttcctcctg

SEQ ID NO: 2118354 - DNA, 23 bp, Homo sapiens
ccaaagtgccactcattcctgta

SEQ ID NO: 2118355 - DNA, 15 bp, Homo sapiens
ccaaataaatgtgta

SEQ ID NO: 2118356 - DNA, 22 bp, Homo sapiens
ccaaataaatgtgtaaatgtgg

SEQ ID NO: 2118357 - DNA, 14 bp, Homo sapiens
ccaaataagcatct

SEQ ID NO: 2118358 - DNA, 18 bp, Homo sapiens
ccaaatatagcgttccca

SEQ ID NO: 2118359 - DNA, 13 bp, Homo sapiens
ccaaatattttag

SEQ ID NO: 2118360 - DNA, 20 bp, Homo sapiens
ccaaatattttagccttaaa

SEQ ID NO: 2118361 - DNA, 16 bp, Homo sapiens
ccaaatccacaagcca

SEQ ID NO: 2118362 - DNA, 17 bp, Homo sapiens
ccaaatgcacaagctca

SEQ ID NO: 2118363 - DNA, 11 bp, Homo sapiens
ccaaattattt

SEQ ID NO: 2118364 - DNA, 13 bp, Homo sapiens
ccaaattgcttct

SEQ ID NO: 2118365 - DNA, 23 bp, Homo sapiens
ccaaatttcatacctatcatctt

SEQ ID NO: 2118366 - DNA, 21 bp, Homo sapiens
ccaaattttggccaaagtgtt

SEQ ID NO: 2118367 - DNA, 18 bp, Homo sapiens
ccaacaaacctgcttgtc

SEQ ID NO: 2118368 - DNA, 17 bp, Homo sapiens
ccaacaacatccatgtc

SEQ ID NO: 2118369 - DNA, 15 bp, Homo sapiens
ccaacaataaagagc

SEQ ID NO: 2118370 - DNA, 14 bp, Homo sapiens
ccaacaatggggtg

SEQ ID NO: 2118371 - DNA, 21 bp, Homo sapiens
ccaacacaatctttccttgtc

SEQ ID NO: 2118372 - DNA, 14 bp, Homo sapiens
ccaacacccctccc

SEQ ID NO: 2118373 - DNA, 19 bp, Homo sapiens
ccaacaccttcttggcttc

SEQ ID NO: 2118374 - DNA, 18 bp, Homo sapiens
ccaacagaaggaaggagg

SEQ ID NO: 2118375 - DNA, 15 bp, Homo sapiens
ccaacaggtggcagg

SEQ ID NO: 2118376 - DNA, 20 bp, Homo sapiens
ccaacatcccattgccctgg

SEQ ID NO: 2118377 - DNA, 16 bp, Homo sapiens
ccaacatctccctccc

SEQ ID NO: 2118378 - DNA, 15 bp, Homo sapiens
ccaacatggagaaac

SEQ ID NO: 2118379 - DNA, 22 bp, Homo sapiens
ccaacatggagaaaccctgtct

SEQ ID NO: 2118380 - DNA, 20 bp, Homo sapiens
ccaaccaagtggctcccaca

SEQ ID NO: 2118381 - DNA, 12 bp, Homo sapiens
ccaaccccagct

SEQ ID NO: 2118382 - DNA, 16 bp, Homo sapiens
ccaaccccagctggcc

SEQ ID NO: 2118383 - DNA, 17 bp, Homo sapiens
ccaaccccagctggcct

SEQ ID NO: 2118384 - DNA, 18 bp, Homo sapiens
ccaaccccagctggcctc

SEQ ID NO: 2118385 - DNA, 23 bp, Homo sapiens
ccaacccccaccgaagagccctg

SEQ ID NO: 2118386 - DNA, 21 bp, Homo sapiens
ccaaccccgcggtgctctggc

SEQ ID NO: 2118387 - DNA, 14 bp, Homo sapiens
ccaaccctcagagc

SEQ ID NO: 2118388 - DNA, 15 bp, Homo sapiens
ccaacctcaatgccc

SEQ ID NO: 2118389 - DNA, 20 bp, Homo sapiens
ccaacctgatgccccttccc

SEQ ID NO: 2118390 - DNA, 18 bp, Homo sapiens
ccaacctgcctgtgcatg

SEQ ID NO: 2118391 - DNA, 16 bp, Homo sapiens
ccaacctttccctcac

SEQ ID NO: 2118392 - DNA, 17 bp, Homo sapiens
ccaacctttccctcacc

SEQ ID NO: 2118393 - DNA, 18 bp, Homo sapiens
ccaacctttccctcaccc

SEQ ID NO: 2118394 - DNA, 23 bp, Homo sapiens
ccaacctttccctcaccccctcc

SEQ ID NO: 2118395 - DNA, 15 bp, Homo sapiens
ccaacgcacaggaaa

SEQ ID NO: 2118396 - DNA, 14 bp, Homo sapiens
ccaactaagccctc

SEQ ID NO: 2118397 - DNA, 15 bp, Homo sapiens
ccaactcctggaagc

SEQ ID NO: 2118398 - DNA, 19 bp, Homo sapiens
ccaactcctggaagctgtg

SEQ ID NO: 2118399 - DNA, 16 bp, Homo sapiens
ccaactccttccagct

SEQ ID NO: 2118400 - DNA, 16 bp, Homo sapiens
ccaactctctcctgta

SEQ ID NO: 2118401 - DNA, 15 bp, Homo sapiens
ccaactcttcatttt

SEQ ID NO: 2118402 - DNA, 13 bp, Homo sapiens
ccaactggcttct

SEQ ID NO: 2118403 - DNA, 17 bp, Homo sapiens
ccactgctctcagcctc

SEQ ID NO: 2118404 - DNA, 19 bp, Homo sapiens
ccactgctctcagcctccc

SEQ ID NO: 2118405 - DNA, 11 bp, Homo sapiens
ccactggccag

SEQ ID NO: 2118406 - DNA, 12 bp, Homo sapiens
ccactggccagt

SEQ ID NO: 2118407 - DNA, 22 bp, Homo sapiens
ccactggccagtcctagagctc

SEQ ID NO: 2118408 - DNA, 11 bp, Homo sapiens
ccactggctcc

SEQ ID NO: 2118409 - DNA, 18 bp, Homo sapiens
ccactgggtctcactcct

SEQ ID NO: 2118410 - DNA, 21 bp, Homo sapiens
ccactgggtctcactcctgag

SEQ ID NO: 2118411 - DNA, 14 bp, Homo sapiens
ccactgtacatata

SEQ ID NO: 2118412 - DNA, 13 bp, Homo sapiens
ccactgtgcagga

SEQ ID NO: 2118413 - DNA, 16 bp, Homo sapiens
ccactgtgccatgtgc

SEQ ID NO: 2118414 - DNA, 19 bp, Homo sapiens
ccactgtgctgaattctgc

SEQ ID NO: 2118415 - DNA, 14 bp, Homo sapiens
ccactgtggccaga

SEQ ID NO: 2118416 - DNA, 17 bp, Homo sapiens
ccactgtggccagagct

SEQ ID NO: 2118417 - DNA, 18 bp, Homo sapiens
ccactgtggccagagctg

SEQ ID NO: 2118418 - DNA, 14 bp, Homo sapiens
ccactgttatcaaa

SEQ ID NO: 2118419 - DNA, 19 bp, Homo sapiens
ccacttaccttcaataaag

SEQ ID NO: 2118420 - DNA, 22 bp, Homo sapiens
ccacttattccccattcttcct

SEQ ID NO: 2118421 - DNA, 17 bp, Homo sapiens
ccacttcaagtgaccac

SEQ ID NO: 2118422 - DNA, 13 bp, Homo sapiens
ccacttcaataga

SEQ ID NO: 2118423 - DNA, 13 bp, Homo sapiens
ccacttcactgtg

SEQ ID NO: 2118424 - DNA, 21 bp, Homo sapiens
ccacttctctactctggaagt

SEQ ID NO: 2118425 - DNA, 14 bp, Homo sapiens
ccacttgacattcc

SEQ ID NO: 2118426 - DNA, 17 bp, Homo sapiens
ccacttgaggctggcac

SEQ ID NO: 2118427 - DNA, 13 bp, Homo sapiens
ccacttgggagct

SEQ ID NO: 2118428 - DNA, 15 bp, Homo sapiens
ccacttgtcatccat

SEQ ID NO: 2118429 - DNA, 20 bp, Homo sapiens
ccactttggcttctcctgtg

SEQ ID NO: 2118430 - DNA, 21 bp, Homo sapiens
ccactttggtacatggccagt

SEQ ID NO: 2118431 - DNA, 21 bp, Homo sapiens
ccactttggtcccgtgcagct

SEQ ID NO: 2118432 - DNA, 14 bp, Homo sapiens
ccactttgttggaa

SEQ ID NO: 2118433 - DNA, 16 bp, Homo sapiens
ccacttttattcattt

SEQ ID NO: 2118434 - DNA, 16 bp, Homo sapiens
ccagaaaacctccagt

SEQ ID NO: 2118435 - DNA, 12 bp, Homo sapiens
ccagaaaatata

SEQ ID NO: 2118436 - DNA, 15 bp, Homo sapiens
ccagaaaatataaat

SEQ ID NO: 2118437 - DNA, 16 bp, Homo sapiens
ccagaaaatataaatg

SEQ ID NO: 2118438 - DNA, 18 bp, Homo sapiens
ccagaaaatataaatgca

SEQ ID NO: 2118439 - DNA, 21 bp, Homo sapiens
ccagaaataaagttggtgaca

SEQ ID NO: 2118440 - DNA, 23 bp, Homo sapiens
ccagaaataaagttggtgacaga

SEQ ID NO: 2118441 - DNA, 16 bp, Homo sapiens
ccagaagaatattcag

SEQ ID NO: 2118442 - DNA, 17 bp, Homo sapiens
ccagaagaatattcagg

SEQ ID NO: 2118443 - DNA, 20 bp, Homo sapiens
ccagaagaatattcaggact

SEQ ID NO: 2118444 - DNA, 16 bp, Homo sapiens
ccagaagatgccctcc

SEQ ID NO: 2118445 - DNA, 12 bp, Homo sapiens
ccagaagcctct

SEQ ID NO: 2118446 - DNA, 15 bp, Homo sapiens
ccagaagcctctgcc

SEQ ID NO: 2118447 - DNA, 22 bp, Homo sapiens
ccagaagtaaagtttatttcat

SEQ ID NO: 2118448 - DNA, 15 bp, Homo sapiens
ccagaagtccctccc

SEQ ID NO: 2118449 - DNA, 20 bp, Homo sapiens
ccagaagtttgtcaagtcaa

SEQ ID NO: 2118450 - DNA, 20 bp, Homo sapiens
ccagaatcataattttcaag

SEQ ID NO: 2118451 - DNA, 17 bp, Homo sapiens
ccagaatctgctgttgc

SEQ ID NO: 2118452 - DNA, 20 bp, Homo sapiens
ccagaattgtgcaaatggaa

SEQ ID NO: 2118453 - DNA, 19 bp, Homo sapiens
ccagacacaccccccagtc

SEQ ID NO: 2118454 - DNA, 22 bp, Homo sapiens
ccagacacattctcctgtgccc

SEQ ID NO: 2118455 - DNA, 13 bp, Homo sapiens
ccagacactggtt

SEQ ID NO: 2118456 - DNA, 14 bp, Homo sapiens
ccagacagatacag

SEQ ID NO: 2118457 - DNA, 18 bp, Homo sapiens
ccagacatacgaaacaca

SEQ ID NO: 2118458 - DNA, 20 bp, Homo sapiens
ccagacatacgaaacacaaa

SEQ ID NO: 2118459 - DNA, 22 bp, Homo sapiens
ccagacatacgaaacacaaacc

SEQ ID NO: 2118460 - DNA, 23 bp, Homo sapiens
ccagacatgtggtgggacaggga

SEQ ID NO: 2118461 - DNA, 14 bp, Homo sapiens
ccagaccacctgcc

SEQ ID NO: 2118462 - DNA, 18 bp, Homo sapiens
ccagaccacctgccagcc

SEQ ID NO: 2118463 - DNA, 12 bp, Homo sapiens
ccagacccctct

SEQ ID NO: 2118464 - DNA, 14 bp, Homo sapiens
ccagacccctggct

SEQ ID NO: 2118465 - DNA, 15 bp, Homo sapiens
ccagacccctggctt

SEQ ID NO: 2118466 - DNA, 17 bp, Homo sapiens
ccagacccggctgcgtg

SEQ ID NO: 2118467 - DNA, 21 bp, Homo sapiens
ccagaccctgaagatttcaga

SEQ ID NO: 2118468 - DNA, 14 bp, Homo sapiens
ccagaccctgcctg

SEQ ID NO: 2118469 - DNA, 16 bp, Homo sapiens
ccagaccctgcctgag

SEQ ID NO: 2118470 - DNA, 19 bp, Homo sapiens
ccagaccctgcctgagccc

SEQ ID NO: 2118471 - DNA, 21 bp, Homo sapiens
ccagaccctgcctgagcccag

SEQ ID NO: 2118472 - DNA, 14 bp, Homo sapiens
ccagaccttttatc

SEQ ID NO: 2118473 - DNA, 13 bp, Homo sapiens
ccagactgtggag

SEQ ID NO: 2118474 - DNA, 18 bp, Homo sapiens
ccagagaatcagggcagg

SEQ ID NO: 2118475 - DNA, 18 bp, Homo sapiens
ccagagacaggaaagaat

SEQ ID NO: 2118476 - DNA, 22 bp, Homo sapiens
ccagagaccttttctctcccat

SEQ ID NO: 2118477 - DNA, 14 bp, Homo sapiens
ccagagagacagac

SEQ ID NO: 2118478 - DNA, 20 bp, Homo sapiens
ccagagagaggatgcagagg

SEQ ID NO: 2118479 - DNA, 21 bp, Homo sapiens
ccagagagaggatgcagaggg

SEQ ID NO: 2118480 - DNA, 16 bp, Homo sapiens
ccagagaggagcacct

SEQ ID NO: 2118481 - DNA, 13 bp, Homo sapiens
ccagagagggccc

SEQ ID NO: 2118482 - DNA, 17 bp, Homo sapiens
ccagagagggcccagct

SEQ ID NO: 2118483 - DNA, 20 bp, Homo sapiens
ccagagagggcccagctgta

SEQ ID NO: 2118484 - DNA, 20 bp, Homo sapiens
ccagagaggggacatttccc

SEQ ID NO: 2118485 - DNA, 14 bp, Homo sapiens
ccagagagggtggt

SEQ ID NO: 2118486 - DNA, 17 bp, Homo sapiens
ccagagagtcctctgga

SEQ ID NO: 2118487 - DNA, 16 bp, Homo sapiens
ccagagagtggctcct

SEQ ID NO: 2118488 - DNA, 22 bp, Homo sapiens
ccagagagtggctcctcccggt

SEQ ID NO: 2118489 - DNA, 14 bp, Homo sapiens
ccagagatgcctcc

SEQ ID NO: 2118490 - DNA, 15 bp, Homo sapiens
ccagagatgcctcca

SEQ ID NO: 2118491 - DNA, 16 bp, Homo sapiens
ccagagatgcctccac

SEQ ID NO: 2118492 - DNA, 18 bp, Homo sapiens
ccagagatgcctccaccg

SEQ ID NO: 2118493 - DNA, 14 bp, Homo sapiens
ccagagcagagagc

SEQ ID NO: 2118494 - DNA, 20 bp, Homo sapiens
ccagagcattacgtgagcca

SEQ ID NO: 2118495 - DNA, 13 bp, Homo sapiens
ccagagccactac

SEQ ID NO: 2118496 - DNA, 17 bp, Homo sapiens
ccagagccactaccttt

SEQ ID NO: 2118497 - DNA, 20 bp, Homo sapiens
ccagagccactacctttgtc

SEQ ID NO: 2118498 - DNA, 12 bp, Homo sapiens
ccagagccagcc

SEQ ID NO: 2118499 - DNA, 16 bp, Homo sapiens
ccagagccagcctggg

SEQ ID NO: 2118500 - DNA, 19 bp, Homo sapiens
ccagagccagcctgggact

SEQ ID NO: 2118501 - DNA, 17 bp, Homo sapiens
ccagagcccaagtgcca

SEQ ID NO: 2118502 - DNA, 21 bp, Homo sapiens
ccagagcccaagtgccatccc

SEQ ID NO: 2118503 - DNA, 14 bp, Homo sapiens
ccagagccccacac

SEQ ID NO: 2118504 - DNA, 19 bp, Homo sapiens
ccagagccccacacggagg

SEQ ID NO: 2118505 - DNA, 14 bp, Homo sapiens
ccagagccccccac

SEQ ID NO: 2118506 - DNA, 21 bp, Homo sapiens
ccagagccccccacaatgatg

SEQ ID NO: 2118507 - DNA, 22 bp, Homo sapiens
ccagagccggggcactttcaga

SEQ ID NO: 2118508 - DNA, 15 bp, Homo sapiens
ccagagcctggggct

SEQ ID NO: 2118509 - DNA, 13 bp, Homo sapiens
ccagagctggaag

SEQ ID NO: 2118510 - DNA, 14 bp, Homo sapiens
ccagagctggaagg

SEQ ID NO: 2118511 - DNA, 15 bp, Homo sapiens
ccagagctggaaggc

SEQ ID NO: 2118512 - DNA, 20 bp, Homo sapiens
ccagagcttattggccactg

SEQ ID NO: 2118513 - DNA, 17 bp, Homo sapiens
ccagaggaacctgaggc

SEQ ID NO: 2118514 - DNA, 15 bp, Homo sapiens
ccagaggccaaggag

SEQ ID NO: 2118515 - DNA, 19 bp, Homo sapiens
ccagaggccaaggaggcct

SEQ ID NO: 2118516 - DNA, 13 bp, Homo sapiens
ccagagggacagg

SEQ ID NO: 2118517 - DNA, 19 bp, Homo sapiens
ccagagggagtgacagagg

SEQ ID NO: 2118518 - DNA, 20 bp, Homo sapiens
ccagagggagtgacagaggc

SEQ ID NO: 2118519 - DNA, 23 bp, Homo sapiens
ccagagggagtgacagaggcagc

SEQ ID NO: 2118520 - DNA, 15 bp, Homo sapiens
ccacacttctcagga

SEQ ID NO: 2118521 - DNA, 13 bp, Homo sapiens
ccacacttcttga

SEQ ID NO: 2118522 - DNA, 18 bp, Homo sapiens
ccacactttgagaacctg

SEQ ID NO: 2118523 - DNA, 21 bp, Homo sapiens
ccacactttgagaacctgtgc

SEQ ID NO: 2118524 - DNA, 18 bp, Homo sapiens
ccacagaactgcttacta

SEQ ID NO: 2118525 - DNA, 17 bp, Homo sapiens
ccacagaagccaggagc

SEQ ID NO: 2118526 - DNA, 20 bp, Homo sapiens
ccacagaagccaggagcaaa

SEQ ID NO: 2118527 - DNA, 21 bp, Homo sapiens
ccacagaatacaagccactac

SEQ ID NO: 2118528 - DNA, 17 bp, Homo sapiens
ccacagacagatcccat

SEQ ID NO: 2118529 - DNA, 15 bp, Homo sapiens
ccacagaccacctgc

SEQ ID NO: 2118530 - DNA, 16 bp, Homo sapiens
ccacagaccacctgct

SEQ ID NO: 2118531 - DNA, 20 bp, Homo sapiens
ccacagactccctcccctgc

SEQ ID NO: 2118532 - DNA, 14 bp, Homo sapiens
ccacagcacccagg

SEQ ID NO: 2118533 - DNA, 17 bp, Homo sapiens
ccacagcacccaggctc

SEQ ID NO: 2118534 - DNA, 23 bp, Homo sapiens
ccacagcacccaggctccatggg

SEQ ID NO: 2118535 - DNA, 14 bp, Homo sapiens
ccacagcagctgaa

SEQ ID NO: 2118536 - DNA, 23 bp, Homo sapiens
ccacagcagttgaaaagactcca

SEQ ID NO: 2118537 - DNA, 18 bp, Homo sapiens
ccacagccccacagcacc

SEQ ID NO: 2118538 - DNA, 15 bp, Homo sapiens
ccacagccgcagcct

SEQ ID NO: 2118539 - DNA, 18 bp, Homo sapiens
ccacagccgcagcctccc

SEQ ID NO: 2118540 - DNA, 17 bp, Homo sapiens
ccacagcctctgcctgt

SEQ ID NO: 2118541 - DNA, 15 bp, Homo sapiens
ccacagctcccaccc

SEQ ID NO: 2118542 - DNA, 16 bp, Homo sapiens
ccacagctcccacccc

SEQ ID NO: 2118543 - DNA, 16 bp, Homo sapiens
ccacaggatcagtctg

SEQ ID NO: 2118544 - DNA, 23 bp, Homo sapiens
ccacaggcatctacacagcctgg

SEQ ID NO: 2118545 - DNA, 20 bp, Homo sapiens
ccacaggccccccgcagcac

SEQ ID NO: 2118546 - DNA, 21 bp, Homo sapiens
ccacaggccccccgcagcacc

SEQ ID NO: 2118547 - DNA, 23 bp, Homo sapiens
ccacaggccccccgcagcaccct

SEQ ID NO: 2118548 - DNA, 17 bp, Homo sapiens
ccacaggcccttcctct

SEQ ID NO: 2118549 - DNA, 19 bp, Homo sapiens
ccacaggcccttcctctcc

SEQ ID NO: 2118550 - DNA, 16 bp, Homo sapiens
ccacaggcccttgggg

SEQ ID NO: 2118551 - DNA, 17 bp, Homo sapiens
ccacagggccagatgtg

SEQ ID NO: 2118552 - DNA, 20 bp, Homo sapiens
ccacagggctaagagctagc

SEQ ID NO: 2118553 - DNA, 15 bp, Homo sapiens
ccacaggggcaggcc

SEQ ID NO: 2118554 - DNA, 22 bp, Homo sapiens
ccacaggggcaggcctgggacc

SEQ ID NO: 2118555 - DNA, 14 bp, Homo sapiens
ccacagtagcattt

SEQ ID NO: 2118556 - DNA, 14 bp, Homo sapiens
ccacagtcaaagaa

SEQ ID NO: 2118557 - DNA, 19 bp, Homo sapiens
ccacagtgcccagctaatt

SEQ ID NO: 2118558 - DNA, 14 bp, Homo sapiens
ccacagtgctgctt

SEQ ID NO: 2118559 - DNA, 15 bp, Homo sapiens
ccacagtgctgcttc

SEQ ID NO: 2118560 - DNA, 14 bp, Homo sapiens
ccacagtgggtggc

SEQ ID NO: 2118561 - DNA, 12 bp, Homo sapiens
ccacagtgtctg

SEQ ID NO: 2118562 - DNA, 14 bp, Homo sapiens
ccacagttttgcct

SEQ ID NO: 2118563 - DNA, 11 bp, Homo sapiens
ccacataaagg

SEQ ID NO: 2118564 - DNA, 19 bp, Homo sapiens
ccacatagtgatggttccc

SEQ ID NO: 2118565 - DNA, 12 bp, Homo sapiens
ccacatcccagg

SEQ ID NO: 2118566 - DNA, 19 bp, Homo sapiens
ccacatccctgggcctgct

SEQ ID NO: 2118567 - DNA, 20 bp, Homo sapiens
ccacatccctgggcctgctg

SEQ ID NO: 2118568 - DNA, 22 bp, Homo sapiens
ccacatccctgggcctgctgct

SEQ ID NO: 2118569 - DNA, 14 bp, Homo sapiens
ccacatcttctcag

SEQ ID NO: 2118570 - DNA, 17 bp, Homo sapiens
ccacatcttgctctgct

SEQ ID NO: 2118571 - DNA, 22 bp, Homo sapiens
ccacatcttgctctgctgacag

SEQ ID NO: 2118572 - DNA, 23 bp, Homo sapiens
ccacatcttgctctgctgacaga

SEQ ID NO: 2118573 - DNA, 13 bp, Homo sapiens
ccaccaactctgc

SEQ ID NO: 2118574 - DNA, 15 bp, Homo sapiens
ccaccaactctgcac

SEQ ID NO: 2118575 - DNA, 16 bp, Homo sapiens
ccaccacacccagccc

SEQ ID NO: 2118576 - DNA, 17 bp, Homo sapiens
ccaccacaccgcagaag

SEQ ID NO: 2118577 - DNA, 13 bp, Homo sapiens
ccaccacactccc

SEQ ID NO: 2118578 - DNA, 13 bp, Homo sapiens
ccaccacactgaa

SEQ ID NO: 2118579 - DNA, 15 bp, Homo sapiens
ccaccaccagaaagc

SEQ ID NO: 2118580 - DNA, 11 bp, Homo sapiens
ccaccacccaa

SEQ ID NO: 2118581 - DNA, 14 bp, Homo sapiens
ccaccaccctccca

SEQ ID NO: 2118582 - DNA, 21 bp, Homo sapiens
ccaccacctaggccactcctc

SEQ ID NO: 2118583 - DNA, 12 bp, Homo sapiens
ccaccaccttgg

SEQ ID NO: 2118584 - DNA, 17 bp, Homo sapiens
ccaccacgtctgccagg

SEQ ID NO: 2118585 - DNA, 22 bp, Homo sapiens
ccaccacgtctgccaggcccat

SEQ ID NO: 2118586 - DNA, 11 bp, Homo sapiens
ccaccacgtgc

SEQ ID NO: 2118587 - DNA, 16 bp, Homo sapiens
ccaccactagagctga

SEQ ID NO: 2118588 - DNA, 20 bp, Homo sapiens
ccaccactaggactctgagg

SEQ ID NO: 2118589 - DNA, 15 bp, Homo sapiens
ccaccagatgagaag

SEQ ID NO: 2118590 - DNA, 16 bp, Homo sapiens
ccaccagatgagaagt

SEQ ID NO: 2118591 - DNA, 16 bp, Homo sapiens
ccaccagccacctctt

SEQ ID NO: 2118592 - DNA, 12 bp, Homo sapiens
ccaccagcctaa

SEQ ID NO: 2118593 - DNA, 15 bp, Homo sapiens
ccaccagcctaagaa

SEQ ID NO: 2118594 - DNA, 15 bp, Homo sapiens
ccaccatcctgcagc

SEQ ID NO: 2118595 - DNA, 16 bp, Homo sapiens
ccaccatgccaggcta

SEQ ID NO: 2118596 - DNA, 13 bp, Homo sapiens
ccaccattcacat

SEQ ID NO: 2118597 - DNA, 15 bp, Homo sapiens
ccacccaacagctca

SEQ ID NO: 2118598 - DNA, 13 bp, Homo sapiens
ccacccagcccat

SEQ ID NO: 2118599 - DNA, 21 bp, Homo sapiens
ccacccaggagccccgaggcc

SEQ ID NO: 2118600 - DNA, 18 bp, Homo sapiens
ccacccagggctccctcc

SEQ ID NO: 2118601 - DNA, 14 bp, Homo sapiens
ccacccagtgctgc

SEQ ID NO: 2118602 - DNA, 22 bp, Homo sapiens
ccacccagtgctgccatgccac

SEQ ID NO: 2118603 - DNA, 21 bp, Homo sapiens
ccacccatcttcctgctgctg

SEQ ID NO: 2118604 - DNA, 22 bp, Homo sapiens
ccacccatcttcctgctgctgt

SEQ ID NO: 2118605 - DNA, 14 bp, Homo sapiens
ccaccccaccccct

SEQ ID NO: 2118606 - DNA, 17 bp, Homo sapiens
ccaccccacccccttca

SEQ ID NO: 2118607 - DNA, 15 bp, Homo sapiens
ccaccccactccagc

SEQ ID NO: 2118608 - DNA, 16 bp, Homo sapiens
ccaccccactccagcc

SEQ ID NO: 2118609 - DNA, 17 bp, Homo sapiens
ccaccccactccagccc

SEQ ID NO: 2118610 - DNA, 18 bp, Homo sapiens
ccaccccactccagccct

SEQ ID NO: 2118611 - DNA, 12 bp, Homo sapiens
ccaccccagagt

SEQ ID NO: 2118612 - DNA, 14 bp, Homo sapiens
ccaccccagagttg

SEQ ID NO: 2118613 - DNA, 22 bp, Homo sapiens
ccaccccagagttgggatgcgg

SEQ ID NO: 2118614 - DNA, 18 bp, Homo sapiens
ccaccccatccagttcat

SEQ ID NO: 2118615 - DNA, 14 bp, Homo sapiens
ccacccccagcccc

SEQ ID NO: 2118616 - DNA, 15 bp, Homo sapiens
ccacccccagccccg

SEQ ID NO: 2118617 - DNA, 16 bp, Homo sapiens
ccacccccgccacggc

SEQ ID NO: 2118618 - DNA, 14 bp, Homo sapiens
ccaccccctccagc

SEQ ID NO: 2118619 - DNA, 16 bp, Homo sapiens
ccaccccctccccagg

SEQ ID NO: 2118620 - DNA, 13 bp, Homo sapiens
cattcaggaaaac

SEQ ID NO: 2118621 - DNA, 17 bp, Homo sapiens
cattcaggaagatgaaa

SEQ ID NO: 2118622 - DNA, 23 bp, Homo sapiens
cattcaggaccccaacccctctc

SEQ ID NO: 2118623 - DNA, 18 bp, Homo sapiens
cattcaggtgttctcttc

SEQ ID NO: 2118624 - DNA, 16 bp, Homo sapiens
cattcagtgagacaca

SEQ ID NO: 2118625 - DNA, 16 bp, Homo sapiens
cattcatccagttgca

SEQ ID NO: 2118626 - DNA, 22 bp, Homo sapiens
cattcatgccaaagcaaaagaa

SEQ ID NO: 2118627 - DNA, 16 bp, Homo sapiens
cattccaaagaacagc

SEQ ID NO: 2118628 - DNA, 14 bp, Homo sapiens
cattccaagcctga

SEQ ID NO: 2118629 - DNA, 23 bp, Homo sapiens
cattccaagggtatgggaagcca

SEQ ID NO: 2118630 - DNA, 20 bp, Homo sapiens
cattcccactaagctttctc

SEQ ID NO: 2118631 - DNA, 23 bp, Homo sapiens
cattcccactaagctttctcctt

SEQ ID NO: 2118632 - DNA, 17 bp, Homo sapiens
cattcccagagtcagag

SEQ ID NO: 2118633 - DNA, 17 bp, Homo sapiens
cattccccaggtggctg

SEQ ID NO: 2118634 - DNA, 19 bp, Homo sapiens
cattcccccatgtggctga

SEQ ID NO: 2118635 - DNA, 20 bp, Homo sapiens
cattcccctcgtgtgactct

SEQ ID NO: 2118636 - DNA, 15 bp, Homo sapiens
cattccctgcatcca

SEQ ID NO: 2118637 - DNA, 15 bp, Homo sapiens
cattccctggcctgg

SEQ ID NO: 2118638 - DNA, 13 bp, Homo sapiens
cattcctgaaaga

SEQ ID NO: 2118639 - DNA, 18 bp, Homo sapiens
cattccttgtcaccagca

SEQ ID NO: 2118640 - DNA, 16 bp, Homo sapiens
cattcggaccctgccc

SEQ ID NO: 2118641 - DNA, 15 bp, Homo sapiens
cattcgtctgtccca

SEQ ID NO: 2118642 - DNA, 12 bp, Homo sapiens
cattctcacaat

SEQ ID NO: 2118643 - DNA, 19 bp, Homo sapiens
cattctcacaattgtaaag

SEQ ID NO: 2118644 - DNA, 21 bp, Homo sapiens
cattctcatatgtagccctca

SEQ ID NO: 2118645 - DNA, 11 bp, Homo sapiens
cattctcctgc

SEQ ID NO: 2118646 - DNA, 22 bp, Homo sapiens
cattctcctgcctgtagcagtg

SEQ ID NO: 2118647 - DNA, 13 bp, Homo sapiens
cattctgcctgcc

SEQ ID NO: 2118648 - DNA, 15 bp, Homo sapiens
cattctgcctgccca

SEQ ID NO: 2118649 - DNA, 20 bp, Homo sapiens
cattctgcctgcccaggccc

SEQ ID NO: 2118650 - DNA, 21 bp, Homo sapiens
cattctgtctgtttttctttt

SEQ ID NO: 2118651 - DNA, 15 bp, Homo sapiens
cattctgttgcccag

SEQ ID NO: 2118652 - DNA, 19 bp, Homo sapiens
cattctgttgcccaggctg

SEQ ID NO: 2118653 - DNA, 14 bp, Homo sapiens
cattcttaaaggaa

SEQ ID NO: 2118654 - DNA, 21 bp, Homo sapiens
cattcttagactagttgaaca

SEQ ID NO: 2118655 - DNA, 18 bp, Homo sapiens
cattcttcctagttttct

SEQ ID NO: 2118656 - DNA, 19 bp, Homo sapiens
cattgaaagagaaccagtt

SEQ ID NO: 2118657 - DNA, 14 bp, Homo sapiens
cattgacctcagct

SEQ ID NO: 2118658 - DNA, 17 bp, Homo sapiens
cattgacctcagctgca

SEQ ID NO: 2118659 - DNA, 18 bp, Homo sapiens
cattgactatcaaactga

SEQ ID NO: 2118660 - DNA, 22 bp, Homo sapiens
cattgactatcaaactgaagcc

SEQ ID NO: 2118661 - DNA, 14 bp, Homo sapiens
cattgcggacagcc

SEQ ID NO: 2118662 - DNA, 16 bp, Homo sapiens
cattgctttgaagcag

SEQ ID NO: 2118663 - DNA, 16 bp, Homo sapiens
cattggacttccttgg

SEQ ID NO: 2118664 - DNA, 15 bp, Homo sapiens
cattgggctgacacc

SEQ ID NO: 2118665 - DNA, 19 bp, Homo sapiens
cattggggggccgggcagg

SEQ ID NO: 2118666 - DNA, 19 bp, Homo sapiens
cattgggtgggtaaattca

SEQ ID NO: 2118667 - DNA, 14 bp, Homo sapiens
cattgtagaaacac

SEQ ID NO: 2118668 - DNA, 14 bp, Homo sapiens
cattgtatatatgt

SEQ ID NO: 2118669 - DNA, 15 bp, Homo sapiens
cattgtatgatgtgt

SEQ ID NO: 2118670 - DNA, 17 bp, Homo sapiens
cattgtatgatgtgttg

SEQ ID NO: 2118671 - DNA, 19 bp, Homo sapiens
cattgtccatgcctacaga

SEQ ID NO: 2118672 - DNA, 20 bp, Homo sapiens
cattgtccatgcctacagat

SEQ ID NO: 2118673 - DNA, 16 bp, Homo sapiens
cattgtctcagtgctg

SEQ ID NO: 2118674 - DNA, 18 bp, Homo sapiens
cattgtctcagtgctggt

SEQ ID NO: 2118675 - DNA, 12 bp, Homo sapiens
cattgtcttcca

SEQ ID NO: 2118676 - DNA, 22 bp, Homo sapiens
cattgtgccatgtcaaacaaat

SEQ ID NO: 2118677 - DNA, 19 bp, Homo sapiens
cattgtgcttggcccctgg

SEQ ID NO: 2118678 - DNA, 19 bp, Homo sapiens
cattgttacaggtgtacta

SEQ ID NO: 2118679 - DNA, 17 bp, Homo sapiens
cattgtttattaacaaa

SEQ ID NO: 2118680 - DNA, 17 bp, Homo sapiens
catttaaaatgattaga

SEQ ID NO: 2118681 - DNA, 19 bp, Homo sapiens
catttaaagcttattaaaa

SEQ ID NO: 2118682 - DNA, 15 bp, Homo sapiens
catttaaatattaat

SEQ ID NO: 2118683 - DNA, 19 bp, Homo sapiens
catttaagggaaaaatata

SEQ ID NO: 2118684 - DNA, 18 bp, Homo sapiens
catttacaataaatattc

SEQ ID NO: 2118685 - DNA, 19 bp, Homo sapiens
catttacaataaatattct

SEQ ID NO: 2118686 - DNA, 14 bp, Homo sapiens
catttacacattct

SEQ ID NO: 2118687 - DNA, 17 bp, Homo sapiens
catttactttgtgttca

SEQ ID NO: 2118688 - DNA, 22 bp, Homo sapiens
catttatacatcacctttttga

SEQ ID NO: 2118689 - DNA, 17 bp, Homo sapiens
catttatgagctcttca

SEQ ID NO: 2118690 - DNA, 21 bp, Homo sapiens
catttatggtcaacacttaag

SEQ ID NO: 2118691 - DNA, 14 bp, Homo sapiens
catttattctgctc

SEQ ID NO: 2118692 - DNA, 14 bp, Homo sapiens
catttcaactccag

SEQ ID NO: 2118693 - DNA, 17 bp, Homo sapiens
catttcaactccagaag

SEQ ID NO: 2118694 - DNA, 15 bp, Homo sapiens
catttcaactgtttg

SEQ ID NO: 2118695 - DNA, 16 bp, Homo sapiens
catttcaattctcaaa

SEQ ID NO: 2118696 - DNA, 17 bp, Homo sapiens
catttcacacaggtcct

SEQ ID NO: 2118697 - DNA, 13 bp, Homo sapiens
catttcacattaa

SEQ ID NO: 2118698 - DNA, 15 bp, Homo sapiens
catttcactttaaag

SEQ ID NO: 2118699 - DNA, 19 bp, Homo sapiens
catttcataaggcctgccc

SEQ ID NO: 2118700 - DNA, 21 bp, Homo sapiens
catttcataaggcctgccctc

SEQ ID NO: 2118701 - DNA, 12 bp, Homo sapiens
catttcattgta

SEQ ID NO: 2118702 - DNA, 14 bp, Homo sapiens
catttccctcctgg

SEQ ID NO: 2118703 - DNA, 13 bp, Homo sapiens
catttcctgacag

SEQ ID NO: 2118704 - DNA, 12 bp, Homo sapiens
catttcctgtgt

SEQ ID NO: 2118705 - DNA, 11 bp, Homo sapiens
catttccttgg

SEQ ID NO: 2118706 - DNA, 16 bp, Homo sapiens
catttccttggaggcc

SEQ ID NO: 2118707 - DNA, 13 bp, Homo sapiens
catttctaacata

SEQ ID NO: 2118708 - DNA, 18 bp, Homo sapiens
catttctactgtgactga

SEQ ID NO: 2118709 - DNA, 23 bp, Homo sapiens
catttctatttatttactgagct

SEQ ID NO: 2118710 - DNA, 18 bp, Homo sapiens
catttctctccaggaagt

SEQ ID NO: 2118711 - DNA, 19 bp, Homo sapiens
catttctctttgagagagt

SEQ ID NO: 2118712 - DNA, 16 bp, Homo sapiens
catttcttatgatttt

SEQ ID NO: 2118713 - DNA, 19 bp, Homo sapiens
catttcttttccaaaatta

SEQ ID NO: 2118714 - DNA, 15 bp, Homo sapiens
catttgacagtgtgg

SEQ ID NO: 2118715 - DNA, 23 bp, Homo sapiens
catttgagagaagccacgctgtc

SEQ ID NO: 2118716 - DNA, 17 bp, Homo sapiens
catttgagcagggctca

SEQ ID NO: 2118717 - DNA, 20 bp, Homo sapiens
catttgagcagggctcagcg

SEQ ID NO: 2118718 - DNA, 15 bp, Homo sapiens
catttgataaactaa

SEQ ID NO: 2118719 - DNA, 18 bp, Homo sapiens
catttgatgtacatgtgt

SEQ ID NO: 2118720 - DNA, 15 bp, Homo sapiens
catttgcaccctccg

SEQ ID NO: 2118721 - DNA, 19 bp, Homo sapiens
catttgcctaattcctggc

SEQ ID NO: 2118722 - DNA, 13 bp, Homo sapiens
catttgctttttg

SEQ ID NO: 2118723 - DNA, 16 bp, Homo sapiens
catttggacaaaatgg

SEQ ID NO: 2118724 - DNA, 17 bp, Homo sapiens
catttggacaaaatgga

SEQ ID NO: 2118725 - DNA, 23 bp, Homo sapiens
catttggtatattacctcaaatt

SEQ ID NO: 2118726 - DNA, 12 bp, Homo sapiens
ccaagagagaaa

SEQ ID NO: 2118727 - DNA, 13 bp, Homo sapiens
ccaagagagaaag

SEQ ID NO: 2118728 - DNA, 14 bp, Homo sapiens
ccaagagagaaaga

SEQ ID NO: 2118729 - DNA, 12 bp, Homo sapiens
ccaagagatgaa

SEQ ID NO: 2118730 - DNA, 14 bp, Homo sapiens
ccaagagatgaaga

SEQ ID NO: 2118731 - DNA, 22 bp, Homo sapiens
ccaagagctgaggcaattctaa

SEQ ID NO: 2118732 - DNA, 14 bp, Homo sapiens
ccaagaggtctgag

SEQ ID NO: 2118733 - DNA, 19 bp, Homo sapiens
ccaagaggtctgagccctg

SEQ ID NO: 2118734 - DNA, 21 bp, Homo sapiens
ccaagatgggcacatgaggag

SEQ ID NO: 2118735 - DNA, 14 bp, Homo sapiens
ccaagatttcagaa

SEQ ID NO: 2118736 - DNA, 23 bp, Homo sapiens
ccaagcagcattcagcacacccc

SEQ ID NO: 2118737 - DNA, 15 bp, Homo sapiens
ccaagcagccagcca

SEQ ID NO: 2118738 - DNA, 21 bp, Homo sapiens
ccaagcagccgcagcgcagcc

SEQ ID NO: 2118739 - DNA, 14 bp, Homo sapiens
ccaagccatggtga

SEQ ID NO: 2118740 - DNA, 22 bp, Homo sapiens
ccaagccatggtgacacacagc

SEQ ID NO: 2118741 - DNA, 18 bp, Homo sapiens
ccaagccattcacttccc

SEQ ID NO: 2118742 - DNA, 22 bp, Homo sapiens
ccaagccccttggccctctccc

SEQ ID NO: 2118743 - DNA, 23 bp, Homo sapiens
ccaagccgtggcttcccgctcag

SEQ ID NO: 2118744 - DNA, 22 bp, Homo sapiens
ccaagccttggggattcttcca

SEQ ID NO: 2118745 - DNA, 13 bp, Homo sapiens
ccaagctcacagt

SEQ ID NO: 2118746 - DNA, 17 bp, Homo sapiens
ccaagctcacagttcct

SEQ ID NO: 2118747 - DNA, 19 bp, Homo sapiens
ccaagctcacagttcctcg

SEQ ID NO: 2118748 - DNA, 15 bp, Homo sapiens
ccaagctctgctcct

SEQ ID NO: 2118749 - DNA, 16 bp, Homo sapiens
ccaagctctgctcctc

SEQ ID NO: 2118750 - DNA, 17 bp, Homo sapiens
ccaagctctgctcctct

SEQ ID NO: 2118751 - DNA, 18 bp, Homo sapiens
ccaagctctgctcctctc

SEQ ID NO: 2118752 - DNA, 19 bp, Homo sapiens
ccaagctgaagtgaaggag

SEQ ID NO: 2118753 - DNA, 23 bp, Homo sapiens
ccaagctgaggtgcccaggagaa

SEQ ID NO: 2118754 - DNA, 17 bp, Homo sapiens
ccaagctgttttcttct

SEQ ID NO: 2118755 - DNA, 13 bp, Homo sapiens
ccaagcttcagag

SEQ ID NO: 2118756 - DNA, 15 bp, Homo sapiens
ccaagcttcagagcc

SEQ ID NO: 2118757 - DNA, 17 bp, Homo sapiens
ccaagcttcagagccta

SEQ ID NO: 2118758 - DNA, 19 bp, Homo sapiens
ccaagcttcagagcctagc

SEQ ID NO: 2118759 - DNA, 23 bp, Homo sapiens
ccaagcttcagagcctagccacc

SEQ ID NO: 2118760 - DNA, 17 bp, Homo sapiens
ccaagctttgaataccc

SEQ ID NO: 2118761 - DNA, 14 bp, Homo sapiens
ccaaggaacctaat

SEQ ID NO: 2118762 - DNA, 19 bp, Homo sapiens
ccaaggaacctaattgaaa

SEQ ID NO: 2118763 - DNA, 21 bp, Homo sapiens
ccaaggaacctaattgaaatt

SEQ ID NO: 2118764 - DNA, 15 bp, Homo sapiens
ccaaggactttccag

SEQ ID NO: 2118765 - DNA, 21 bp, Homo sapiens
ccaaggagctgatttccaggc

SEQ ID NO: 2118766 - DNA, 21 bp, Homo sapiens
ccaaggaggaaaaacagacaa

SEQ ID NO: 2118767 - DNA, 18 bp, Homo sapiens
ccaaggagtaagtacaaa

SEQ ID NO: 2118768 - DNA, 18 bp, Homo sapiens
ccaaggcagcctccagag

SEQ ID NO: 2118769 - DNA, 23 bp, Homo sapiens
ccaaggcagcctccagagccagc

SEQ ID NO: 2118770 - DNA, 19 bp, Homo sapiens
ccaaggcagtgttcctcac

SEQ ID NO: 2118771 - DNA, 22 bp, Homo sapiens
ccaaggctcttctccttggagg

SEQ ID NO: 2118772 - DNA, 20 bp, Homo sapiens
ccaagggacaaccccatcat

SEQ ID NO: 2118773 - DNA, 19 bp, Homo sapiens
ccaaggggctttgtcctgg

SEQ ID NO: 2118774 - DNA, 19 bp, Homo sapiens
ccaagggtatgggaagcca

SEQ ID NO: 2118775 - DNA, 20 bp, Homo sapiens
ccaagggtatgggaagccat

SEQ ID NO: 2118776 - DNA, 20 bp, Homo sapiens
ccaaggtgggctgagccctg

SEQ ID NO: 2118777 - DNA, 14 bp, Homo sapiens
ccaagtatttatta

SEQ ID NO: 2118778 - DNA, 21 bp, Homo sapiens
ccaagtattttatctgtgttg

SEQ ID NO: 2118779 - DNA, 22 bp, Homo sapiens
ccaagtccaacctgcctgtgca

SEQ ID NO: 2118780 - DNA, 15 bp, Homo sapiens
ccaagtccaggtcct

SEQ ID NO: 2118781 - DNA, 16 bp, Homo sapiens
ccaagtccaggtcctg

SEQ ID NO: 2118782 - DNA, 16 bp, Homo sapiens
ccaagtctacttcact

SEQ ID NO: 2118783 - DNA, 22 bp, Homo sapiens
ccaagtgacctatacctgtgtt

SEQ ID NO: 2118784 - DNA, 22 bp, Homo sapiens
ccaagtgccatcccacattcgg

SEQ ID NO: 2118785 - DNA, 18 bp, Homo sapiens
ccaagtgggggcagaggg

SEQ ID NO: 2118786 - DNA, 13 bp, Homo sapiens
ccaagtgtgttgg

SEQ ID NO: 2118787 - DNA, 19 bp, Homo sapiens
ccaagttcctgcactccag

SEQ ID NO: 2118788 - DNA, 21 bp, Homo sapiens
ccaagttcctgcactccagaa

SEQ ID NO: 2118789 - DNA, 23 bp, Homo sapiens
ccaataaagctggacaagaagct

SEQ ID NO: 2118790 - DNA, 18 bp, Homo sapiens
ccaataacttcagagaag

SEQ ID NO: 2118791 - DNA, 15 bp, Homo sapiens
ccaatactactgtaa

SEQ ID NO: 2118792 - DNA, 13 bp, Homo sapiens
ccaatattataat

SEQ ID NO: 2118793 - DNA, 13 bp, Homo sapiens
ccaatcagcactg

SEQ ID NO: 2118794 - DNA, 17 bp, Homo sapiens
ccaatcagcactgaaaa

SEQ ID NO: 2118795 - DNA, 17 bp, Homo sapiens
ccaatcccggtcatgct

SEQ ID NO: 2118796 - DNA, 18 bp, Homo sapiens
ccaatcccgtgaaagaat

SEQ ID NO: 2118797 - DNA, 14 bp, Homo sapiens
ccaatcctcaggat

SEQ ID NO: 2118798 - DNA, 13 bp, Homo sapiens
ccaatctctgtga

SEQ ID NO: 2118799 - DNA, 19 bp, Homo sapiens
ccaatgcacatccattccc

SEQ ID NO: 2118800 - DNA, 19 bp, Homo sapiens
ccaatgcatagtttgttca

SEQ ID NO: 2118801 - DNA, 24 bp, Homo sapiens
ccaatgctttgggaggccaaggca

SEQ ID NO: 2118802 - DNA, 18 bp, Homo sapiens
ccaatgcttttatcaaac

SEQ ID NO: 2118803 - DNA, 21 bp, Homo sapiens
ccaatggagactgtctcaaga

SEQ ID NO: 2118804 - DNA, 18 bp, Homo sapiens
ccaatggctgtaaactat

SEQ ID NO: 2118805 - DNA, 21 bp, Homo sapiens
ccaattaaaatatatataaat

SEQ ID NO: 2118806 - DNA, 22 bp, Homo sapiens
ccaattatgtgacaacctttgt

SEQ ID NO: 2118807 - DNA, 16 bp, Homo sapiens
ccacaaactgatttct

SEQ ID NO: 2118808 - DNA, 23 bp, Homo sapiens
ccacaaatctatattaaagtgtt

SEQ ID NO: 2118809 - DNA, 18 bp, Homo sapiens
ccacaaccctgttttata

SEQ ID NO: 2118810 - DNA, 15 bp, Homo sapiens
ccacaagaaatttga

SEQ ID NO: 2118811 - DNA, 15 bp, Homo sapiens
ccacaagattcccag

SEQ ID NO: 2118812 - DNA, 21 bp, Homo sapiens
ccacaagattcccagagacag

SEQ ID NO: 2118813 - DNA, 23 bp, Homo sapiens
ccacaagccattttttgaggaga

SEQ ID NO: 2118814 - DNA, 18 bp, Homo sapiens
ccacaagccttactcacc

SEQ ID NO: 2118815 - DNA, 21 bp, Homo sapiens
ccacaagccttactcacctct

SEQ ID NO: 2118816 - DNA, 22 bp, Homo sapiens
ccacaagccttactcacctctc

SEQ ID NO: 2118817 - DNA, 23 bp, Homo sapiens
ccacaatgatgattaaacacctg

SEQ ID NO: 2118818 - DNA, 16 bp, Homo sapiens
ccacaatgcctctccc

SEQ ID NO: 2118819 - DNA, 19 bp, Homo sapiens
ccacaatgcctctcccacg

SEQ ID NO: 2118820 - DNA, 15 bp, Homo sapiens
ccacacaaaatgtca

SEQ ID NO: 2118821 - DNA, 22 bp, Homo sapiens
ccacacacagaggaagagcagg

SEQ ID NO: 2118822 - DNA, 18 bp, Homo sapiens
ccacacacgcaggaactc

SEQ ID NO: 2118823 - DNA, 12 bp, Homo sapiens
ccacacccagcc

SEQ ID NO: 2118824 - DNA, 13 bp, Homo sapiens
ccacacccagccc

SEQ ID NO: 2118825 - DNA, 22 bp, Homo sapiens
ccacacccagcccacttctgcc

SEQ ID NO: 2118826 - DNA, 17 bp, Homo sapiens
ccacacccggctccccc

SEQ ID NO: 2118827 - DNA, 12 bp, Homo sapiens
ccacaccctccc

SEQ ID NO: 2118828 - DNA, 15 bp, Homo sapiens
ccacaccgcagaagc

SEQ ID NO: 2118829 - DNA, 14 bp, Homo sapiens
ccacacctccctga

SEQ ID NO: 2118830 - DNA, 16 bp, Homo sapiens
ccacacctccctgaac

SEQ ID NO: 2118831 - DNA, 17 bp, Homo sapiens
ccacacctccctgaacc

SEQ ID NO: 2118832 - DNA, 16 bp, Homo sapiens
ccacacgtgctcgcag

SEQ ID NO: 2118833 - DNA, 20 bp, Homo sapiens
ccacacgtgctcgcagcctg

SEQ ID NO: 2118834 - DNA, 21 bp, Homo sapiens
ccacacgtgctcgcagcctgg

SEQ ID NO: 2118835 - DNA, 20 bp, Homo sapiens
ccacactattaccatgagaa

SEQ ID NO: 2118836 - DNA, 16 bp, Homo sapiens
ccacactcccccagac

SEQ ID NO: 2118837 - DNA, 22 bp, Homo sapiens
ccacactggcacgtttgtgaga

SEQ ID NO: 2118838 - DNA, 14 bp, Homo sapiens
ccacactggtgact

SEQ ID NO: 2118839 - DNA, 21 bp, Homo sapiens
ccacacttcaggctcttctcc

SEQ ID NO: 2118840 - DNA, 22 bp, Homo sapiens
ccacacttcaggctcttctcct

SEQ ID NO: 2118841 - DNA, 14 bp, Homo sapiens
catgctctggaagc

SEQ ID NO: 2118842 - DNA, 16 bp, Homo sapiens
catgctctggaagcct

SEQ ID NO: 2118843 - DNA, 13 bp, Homo sapiens
catgctgaaggga

SEQ ID NO: 2118844 - DNA, 15 bp, Homo sapiens
catgctgaattattt

SEQ ID NO: 2118845 - DNA, 14 bp, Homo sapiens
catgctgcctccag

SEQ ID NO: 2118846 - DNA, 20 bp, Homo sapiens
catgctgctttttggcacag

SEQ ID NO: 2118847 - DNA, 13 bp, Homo sapiens
catgctggcctgt

SEQ ID NO: 2118848 - DNA, 17 bp, Homo sapiens
catgctggcctgtggca

SEQ ID NO: 2118849 - DNA, 19 bp, Homo sapiens
catgctggcctgtggcagg

SEQ ID NO: 2118850 - DNA, 16 bp, Homo sapiens
catgctggcggcgcag

SEQ ID NO: 2118851 - DNA, 13 bp, Homo sapiens
catgctgtgctct

SEQ ID NO: 2118852 - DNA, 12 bp, Homo sapiens
catgcttaaata

SEQ ID NO: 2118853 - DNA, 14 bp, Homo sapiens
catgcttcttcctt

SEQ ID NO: 2118854 - DNA, 21 bp, Homo sapiens
catgcttcttgccccttgggc

SEQ ID NO: 2118855 - DNA, 18 bp, Homo sapiens
catgctttaaagtgtaat

SEQ ID NO: 2118856 - DNA, 14 bp, Homo sapiens
catgctttcccacc

SEQ ID NO: 2118857 - DNA, 13 bp, Homo sapiens
catgctttctcct

SEQ ID NO: 2118858 - DNA, 17 bp, Homo sapiens
catgctttctccttttt

SEQ ID NO: 2118859 - DNA, 19 bp, Homo sapiens
catgcttttgccactttgg

SEQ ID NO: 2118860 - DNA, 14 bp, Homo sapiens
catggaaaaatact

SEQ ID NO: 2118861 - DNA, 17 bp, Homo sapiens
catggaaaagcccagtg

SEQ ID NO: 2118862 - DNA, 20 bp, Homo sapiens
catggaaaatgtcctgtggt

SEQ ID NO: 2118863 - DNA, 16 bp, Homo sapiens
catggaaactggccag

SEQ ID NO: 2118864 - DNA, 23 bp, Homo sapiens
catggaaggcggcacagaggcag

SEQ ID NO: 2118865 - DNA, 16 bp, Homo sapiens
catggacaatataaac

SEQ ID NO: 2118866 - DNA, 22 bp, Homo sapiens
catggacacattttctcctagg

SEQ ID NO: 2118867 - DNA, 21 bp, Homo sapiens
catggacaccccttatccagg

SEQ ID NO: 2118868 - DNA, 14 bp, Homo sapiens
catggaccaagaat

SEQ ID NO: 2118869 - DNA, 24 bp, Homo sapiens
catggactctgggtttcatatcca

SEQ ID NO: 2118870 - DNA, 11 bp, Homo sapiens
catggagaaac

SEQ ID NO: 2118871 - DNA, 14 bp, Homo sapiens
catggagaaaccct

SEQ ID NO: 2118872 - DNA, 20 bp, Homo sapiens
catggagaaaccctgtctct

SEQ ID NO: 2118873 - DNA, 15 bp, Homo sapiens
catggagactcctgc

SEQ ID NO: 2118874 - DNA, 16 bp, Homo sapiens
catggagactcctgcc

SEQ ID NO: 2118875 - DNA, 19 bp, Homo sapiens
catggagactcctgccctg

SEQ ID NO: 2118876 - DNA, 20 bp, Homo sapiens
catggagactcctgccctgt

SEQ ID NO: 2118877 - DNA, 16 bp, Homo sapiens
catggagagcctctta

SEQ ID NO: 2118878 - DNA, 14 bp, Homo sapiens
catggagagctaga

SEQ ID NO: 2118879 - DNA, 14 bp, Homo sapiens
catggaggagcttg

SEQ ID NO: 2118880 - DNA, 22 bp, Homo sapiens
catggaggagcttgggggatga

SEQ ID NO: 2118881 - DNA, 20 bp, Homo sapiens
catggaggcaggctccccct

SEQ ID NO: 2118882 - DNA, 21 bp, Homo sapiens
catggattatttatgagagct

SEQ ID NO: 2118883 - DNA, 14 bp, Homo sapiens
catggcaccagccc

SEQ ID NO: 2118884 - DNA, 23 bp, Homo sapiens
catggcagatgtaggagggactg

SEQ ID NO: 2118885 - DNA, 12 bp, Homo sapiens
catggccacccc

SEQ ID NO: 2118886 - DNA, 17 bp, Homo sapiens
catggcctatgcacata

SEQ ID NO: 2118887 - DNA, 19 bp, Homo sapiens
catggcctatgcacatatg

SEQ ID NO: 2118888 - DNA, 20 bp, Homo sapiens
catggcctattatattaaaa

SEQ ID NO: 2118889 - DNA, 12 bp, Homo sapiens
catggccttccc

SEQ ID NO: 2118890 - DNA, 19 bp, Homo sapiens
catggcgtaatgggcctgc

SEQ ID NO: 2118891 - DNA, 14 bp, Homo sapiens
catggcgtgtccct

SEQ ID NO: 2118892 - DNA, 12 bp, Homo sapiens
catggctatctg

SEQ ID NO: 2118893 - DNA, 12 bp, Homo sapiens
catggctcaggc

SEQ ID NO: 2118894 - DNA, 17 bp, Homo sapiens
catggctcaggcaagcc

SEQ ID NO: 2118895 - DNA, 12 bp, Homo sapiens
catggctggggt

SEQ ID NO: 2118896 - DNA, 20 bp, Homo sapiens
catggcttggggagcagagt

SEQ ID NO: 2118897 - DNA, 22 bp, Homo sapiens
catgggaaaggaggcatgcctc

SEQ ID NO: 2118898 - DNA, 14 bp, Homo sapiens
catgggaaagtgca

SEQ ID NO: 2118899 - DNA, 15 bp, Homo sapiens
catgggactgtgcct

SEQ ID NO: 2118900 - DNA, 21 bp, Homo sapiens
catgggagctggttagaaatg

SEQ ID NO: 2118901 - DNA, 15 bp, Homo sapiens
catgggcctcctgtg

SEQ ID NO: 2118902 - DNA, 10 bp, Homo sapiens
catgggcctg

SEQ ID NO: 2118903 - DNA, 12 bp, Homo sapiens
catgggcctggg

SEQ ID NO: 2118904 - DNA, 14 bp, Homo sapiens
catgggcctgggcc

SEQ ID NO: 2118905 - DNA, 19 bp, Homo sapiens
catgggcctgggcctgctt

SEQ ID NO: 2118906 - DNA, 19 bp, Homo sapiens
catgggctagtgtgagtgg

SEQ ID NO: 2118907 - DNA, 23 bp, Homo sapiens
catgggctagtgtgagtggcagc

SEQ ID NO: 2118908 - DNA, 13 bp, Homo sapiens
catggggcataga

SEQ ID NO: 2118909 - DNA, 18 bp, Homo sapiens
catggggcatagaaactg

SEQ ID NO: 2118910 - DNA, 23 bp, Homo sapiens
catggggcatagaaactgaggag

SEQ ID NO: 2118911 - DNA, 22 bp, Homo sapiens
catggtcagctcacaccctaat

SEQ ID NO: 2118912 - DNA, 15 bp, Homo sapiens
catggtcatggacag

SEQ ID NO: 2118913 - DNA, 15 bp, Homo sapiens
catggtcccacatcc

SEQ ID NO: 2118914 - DNA, 16 bp, Homo sapiens
catggtcccacatccc

SEQ ID NO: 2118915 - DNA, 18 bp, Homo sapiens
catggtcccacatccctg

SEQ ID NO: 2118916 - DNA, 21 bp, Homo sapiens
catggtcccacatccctgggc

SEQ ID NO: 2118917 - DNA, 19 bp, Homo sapiens
catggtgaaaatgtactga

SEQ ID NO: 2118918 - DNA, 19 bp, Homo sapiens
catggtgacacacagcagc

SEQ ID NO: 2118919 - DNA, 16 bp, Homo sapiens
catggtgatcagtgca

SEQ ID NO: 2118920 - DNA, 21 bp, Homo sapiens
catggtgcagttgacagcagg

SEQ ID NO: 2118921 - DNA, 22 bp, Homo sapiens
catggtgtgaaagtcagatgcc

SEQ ID NO: 2118922 - DNA, 14 bp, Homo sapiens
catggttccttccc

SEQ ID NO: 2118923 - DNA, 20 bp, Homo sapiens
catggttccttccctgggaa

SEQ ID NO: 2118924 - DNA, 14 bp, Homo sapiens
catgtaaaatgcag

SEQ ID NO: 2118925 - DNA, 16 bp, Homo sapiens
catgtaaattttgtat

SEQ ID NO: 2118926 - DNA, 15 bp, Homo sapiens
catgtaacaaccaga

SEQ ID NO: 2118927 - DNA, 16 bp, Homo sapiens
catgtaacatagattt

SEQ ID NO: 2118928 - DNA, 18 bp, Homo sapiens
catgtaaccaagagtatt

SEQ ID NO: 2118929 - DNA, 12 bp, Homo sapiens
catgtaataaat

SEQ ID NO: 2118930 - DNA, 13 bp, Homo sapiens
catgtaataaatc

SEQ ID NO: 2118931 - DNA, 18 bp, Homo sapiens
catgtaatgaatggtcag

SEQ ID NO: 2118932 - DNA, 23 bp, Homo sapiens
catgtacaaaatcgattggcttt

SEQ ID NO: 2118933 - DNA, 14 bp, Homo sapiens
catgtacagcatgc

SEQ ID NO: 2118934 - DNA, 15 bp, Homo sapiens
catgtacatgaagaa

SEQ ID NO: 2118935 - DNA, 20 bp, Homo sapiens
catgtacatgaagaagctaa

SEQ ID NO: 2118936 - DNA, 21 bp, Homo sapiens
catgtaccatcaataaagtac

SEQ ID NO: 2118937 - DNA, 20 bp, Homo sapiens
catgtatgtgcacatgtgtc

SEQ ID NO: 2118938 - DNA, 11 bp, Homo sapiens
catgtatgtgt

SEQ ID NO: 2118939 - DNA, 14 bp, Homo sapiens
catgtattcacaca

SEQ ID NO: 2118940 - DNA, 13 bp, Homo sapiens
catgtattgtaaa

SEQ ID NO: 2118941 - DNA, 17 bp, Homo sapiens
catgtattgtaaacaga

SEQ ID NO: 2118942 - DNA, 21 bp, Homo sapiens
catgtattgtaaacagaagga

SEQ ID NO: 2118943 - DNA, 13 bp, Homo sapiens
catgtcacctcag

SEQ ID NO: 2118944 - DNA, 16 bp, Homo sapiens
catgtcacctcagctg

SEQ ID NO: 2118945 - DNA, 22 bp, Homo sapiens
catgtccaagtccaacctgcct

SEQ ID NO: 2118946 - DNA, 17 bp, Homo sapiens
catgtccctacacccct

SEQ ID NO: 2118947 - DNA, 16 bp, Homo sapiens
catgtccctaccgagt

SEQ ID NO: 2118948 - DNA, 15 bp, Homo sapiens
catgtcctatccaaa

SEQ ID NO: 2118949 - DNA, 14 bp, Homo sapiens
catgtcctatgtgt

SEQ ID NO: 2118950 - DNA, 15 bp, Homo sapiens
catgtcgcctctgca

SEQ ID NO: 2118951 - DNA, 20 bp, Homo sapiens
catgtcgcctctgcattcag

SEQ ID NO: 2118952 - DNA, 16 bp, Homo sapiens
catgtcggagtagaaa

SEQ ID NO: 2118953 - DNA, 18 bp, Homo sapiens
catgtctcagcctcctca

SEQ ID NO: 2118954 - DNA, 13 bp, Homo sapiens
catgtcttgtaca

SEQ ID NO: 2118955 - DNA, 20 bp, Homo sapiens
catgtctttctccaaagtta

SEQ ID NO: 2118956 - DNA, 22 bp, Homo sapiens
catgtgaaaaggcaaaaagcat

SEQ ID NO: 2118957 - DNA, 20 bp, Homo sapiens
catgtgaattctgtgaagaa

SEQ ID NO: 2118958 - DNA, 22 bp, Homo sapiens
catgtgaattctgtgaagaatg

SEQ ID NO: 2118959 - DNA, 18 bp, Homo sapiens
catgtgagcatggtcaca

SEQ ID NO: 2118960 - DNA, 22 bp, Homo sapiens
catgtgagcatggtcacaagca

SEQ ID NO: 2118961 - DNA, 19 bp, Homo sapiens
catgtgaggactgggggca

SEQ ID NO: 2118962 - DNA, 22 bp, Homo sapiens
catgtgaggactgggggcacct

SEQ ID NO: 2118963 - DNA, 16 bp, Homo sapiens
catgtgatccttttat

SEQ ID NO: 2118964 - DNA, 18 bp, Homo sapiens
catgtgatccttttatgt

SEQ ID NO: 2118965 - DNA, 22 bp, Homo sapiens
catgtgatccttttatgttatt

SEQ ID NO: 2118966 - DNA, 14 bp, Homo sapiens
catgtgcacatgca

SEQ ID NO: 2118967 - DNA, 12 bp, Homo sapiens
catgtgcctgta

SEQ ID NO: 2118968 - DNA, 15 bp, Homo sapiens
catgtggctgaagac

SEQ ID NO: 2118969 - DNA, 17 bp, Homo sapiens
catgtggggaagcaaga

SEQ ID NO: 2118970 - DNA, 12 bp, Homo sapiens
catgtggtggga

SEQ ID NO: 2118971 - DNA, 17 bp, Homo sapiens
catgtggttaatgccat

SEQ ID NO: 2118972 - DNA, 14 bp, Homo sapiens
catgtgtagcctgt

SEQ ID NO: 2118973 - DNA, 16 bp, Homo sapiens
catgtgtagcctgtgc

SEQ ID NO: 2118974 - DNA, 15 bp, Homo sapiens
catgtgtcccctcac

SEQ ID NO: 2118975 - DNA, 20 bp, Homo sapiens
catgtgtcccctcactctgt

SEQ ID NO: 2118976 - DNA, 18 bp, Homo sapiens
catgtgtgactccagcct

SEQ ID NO: 2118977 - DNA, 15 bp, Homo sapiens
catgtgtgcatgtga

SEQ ID NO: 2118978 - DNA, 18 bp, Homo sapiens
catgtgtgcatgtgagca

SEQ ID NO: 2118979 - DNA, 12 bp, Homo sapiens
catgtgtgcctg

SEQ ID NO: 2118980 - DNA, 18 bp, Homo sapiens
catgtgtgtgtctgtctt

SEQ ID NO: 2118981 - DNA, 19 bp, Homo sapiens
catgtgtgtgtctgtcttt

SEQ ID NO: 2118982 - DNA, 20 bp, Homo sapiens
catgtgtgtgtctgtctttg

SEQ ID NO: 2118983 - DNA, 15 bp, Homo sapiens
catgtgttgtacaat

SEQ ID NO: 2118984 - DNA, 13 bp, Homo sapiens
catgttaaagagg

SEQ ID NO: 2118985 - DNA, 22 bp, Homo sapiens
catgttaaagaggcgtcttgta

SEQ ID NO: 2118986 - DNA, 18 bp, Homo sapiens
catgttaggaaaatttca

SEQ ID NO: 2118987 - DNA, 14 bp, Homo sapiens
catgttatttgtaa

SEQ ID NO: 2118988 - DNA, 23 bp, Homo sapiens
catgttatttgtaatagatgttt

SEQ ID NO: 2118989 - DNA, 16 bp, Homo sapiens
catgttcttgcagtca

SEQ ID NO: 2118990 - DNA, 22 bp, Homo sapiens
catgttgaagccactgccttca

SEQ ID NO: 2118991 - DNA, 17 bp, Homo sapiens
catgttgcatgcctatg

SEQ ID NO: 2118992 - DNA, 13 bp, Homo sapiens
catgttggccagg

SEQ ID NO: 2118993 - DNA, 14 bp, Homo sapiens
catgttggccaggc

SEQ ID NO: 2118994 - DNA, 16 bp, Homo sapiens
catgttggccaggctg

SEQ ID NO: 2118995 - DNA, 18 bp, Homo sapiens
catgttggccaggctggt

SEQ ID NO: 2118996 - DNA, 23 bp, Homo sapiens
catgtttaaactttgtgcctttg

SEQ ID NO: 2118997 - DNA, 14 bp, Homo sapiens
catgtttaaattgt

SEQ ID NO: 2118998 - DNA, 19 bp, Homo sapiens
catgtttacttttcagggc

SEQ ID NO: 2118999 - DNA, 21 bp, Homo sapiens
catgtttacttttcagggcat

SEQ ID NO: 2119000 - DNA, 18 bp, Homo sapiens
catgtttagattccagga

SEQ ID NO: 2119001 - DNA, 19 bp, Homo sapiens
catgtttcacaacaggcat

SEQ ID NO: 2119002 - DNA, 13 bp, Homo sapiens
catgtttcatgtt

SEQ ID NO: 2119003 - DNA, 17 bp, Homo sapiens
catgtttcatgttttgt

SEQ ID NO: 2119004 - DNA, 18 bp, Homo sapiens
catgtttctgggtgggtg

SEQ ID NO: 2119005 - DNA, 18 bp, Homo sapiens
catgtttgagctcagacc

SEQ ID NO: 2119006 - DNA, 23 bp, Homo sapiens
catgtttgagctcagacccccac

SEQ ID NO: 2119007 - DNA, 21 bp, Homo sapiens
catgtttgcacctttctagtt

SEQ ID NO: 2119008 - DNA, 22 bp, Homo sapiens
catgtttgcacctttctagttg

SEQ ID NO: 2119009 - DNA, 14 bp, Homo sapiens
catgttttgtgact

SEQ ID NO: 2119010 - DNA, 17 bp, Homo sapiens
catgttttgtgactata

SEQ ID NO: 2119011 - DNA, 17 bp, Homo sapiens
catgtttttgttttctt

SEQ ID NO: 2119012 - DNA, 20 bp, Homo sapiens
cattaaaagaagactggaag

SEQ ID NO: 2119013 - DNA, 17 bp, Homo sapiens
cattaaacactgtaatc

SEQ ID NO: 2119014 - DNA, 13 bp, Homo sapiens
cattaaatccgca

SEQ ID NO: 2119015 - DNA, 14 bp, Homo sapiens
cattaaattttcta

SEQ ID NO: 2119016 - DNA, 18 bp, Homo sapiens
cattaactcattagactg

SEQ ID NO: 2119017 - DNA, 22 bp, Homo sapiens
cattaatcaatcatctgtgtga

SEQ ID NO: 2119018 - DNA, 23 bp, Homo sapiens
cattaatcaatcatctgtgtgaa

SEQ ID NO: 2119019 - DNA, 13 bp, Homo sapiens
cattaatgttaat

SEQ ID NO: 2119020 - DNA, 12 bp, Homo sapiens
cattaattatta

SEQ ID NO: 2119021 - DNA, 13 bp, Homo sapiens
cattaattattaa

SEQ ID NO: 2119022 - DNA, 22 bp, Homo sapiens
cattaattctactaaatatttt

SEQ ID NO: 2119023 - DNA, 22 bp, Homo sapiens
cattacatgtttaaattgtaaa

SEQ ID NO: 2119024 - DNA, 13 bp, Homo sapiens
cattacgtgagcc

SEQ ID NO: 2119025 - DNA, 16 bp, Homo sapiens
cattactgcatgcact

SEQ ID NO: 2119026 - DNA, 23 bp, Homo sapiens
cattactgcatgcacttcttaca

SEQ ID NO: 2119027 - DNA, 15 bp, Homo sapiens
cattacttgcacaag

SEQ ID NO: 2119028 - DNA, 18 bp, Homo sapiens
cattacttgcacaagctt

SEQ ID NO: 2119029 - DNA, 23 bp, Homo sapiens
cattactttaatactcacctcct

SEQ ID NO: 2119030 - DNA, 23 bp, Homo sapiens
cattagaaactgaaaactgtaaa

SEQ ID NO: 2119031 - DNA, 17 bp, Homo sapiens
cattagaaatagacagt

SEQ ID NO: 2119032 - DNA, 23 bp, Homo sapiens
cattaggaacagagtatatatgt

SEQ ID NO: 2119033 - DNA, 20 bp, Homo sapiens
cattataactgaaggagaag

SEQ ID NO: 2119034 - DNA, 23 bp, Homo sapiens
cattatcgggagcagtgtcttcc

SEQ ID NO: 2119035 - DNA, 21 bp, Homo sapiens
cattatgatgtgggtcaagga

SEQ ID NO: 2119036 - DNA, 12 bp, Homo sapiens
cattatgtagaa

SEQ ID NO: 2119037 - DNA, 18 bp, Homo sapiens
cattatgtgtgcatgtgt

SEQ ID NO: 2119038 - DNA, 23 bp, Homo sapiens
cattatgtgtgcatgtgtgtata

SEQ ID NO: 2119039 - DNA, 15 bp, Homo sapiens
cagtgtactgctttc

SEQ ID NO: 2119040 - DNA, 16 bp, Homo sapiens
cagtgtcccctccact

SEQ ID NO: 2119041 - DNA, 20 bp, Homo sapiens
cagtgtcccctccactgtca

SEQ ID NO: 2119042 - DNA, 22 bp, Homo sapiens
cagtgtgatcccaagtgccagt

SEQ ID NO: 2119043 - DNA, 14 bp, Homo sapiens
cagtgtggagaggg

SEQ ID NO: 2119044 - DNA, 23 bp, Homo sapiens
cagtgtggagaggggtgcaccca

SEQ ID NO: 2119045 - DNA, 14 bp, Homo sapiens
cagtgtggccccag

SEQ ID NO: 2119046 - DNA, 21 bp, Homo sapiens
cagtgtgtccttggggcacag

SEQ ID NO: 2119047 - DNA, 21 bp, Homo sapiens
cagtgtgtcgagtcaaaatgt

SEQ ID NO: 2119048 - DNA, 20 bp, Homo sapiens
cagtgttcctcaccaataac

SEQ ID NO: 2119049 - DNA, 20 bp, Homo sapiens
cagtgttggctgtgtgacag

SEQ ID NO: 2119050 - DNA, 22 bp, Homo sapiens
cagtgttggctgtgtgacagaa

SEQ ID NO: 2119051 - DNA, 21 bp, Homo sapiens
cagtgtttcccataattttct

SEQ ID NO: 2119052 - DNA, 22 bp, Homo sapiens
cagtgttttctgggataagtaa

SEQ ID NO: 2119053 - DNA, 16 bp, Homo sapiens
cagttaactttcagaa

SEQ ID NO: 2119054 - DNA, 16 bp, Homo sapiens
cagttaatacttaaca

SEQ ID NO: 2119055 - DNA, 13 bp, Homo sapiens
cagttaccgagga

SEQ ID NO: 2119056 - DNA, 15 bp, Homo sapiens
cagttactcagccct

SEQ ID NO: 2119057 - DNA, 13 bp, Homo sapiens
cagttactggttt

SEQ ID NO: 2119058 - DNA, 19 bp, Homo sapiens
cagttactggtttcagttg

SEQ ID NO: 2119059 - DNA, 22 bp, Homo sapiens
cagttactggtttcagttgaca

SEQ ID NO: 2119060 - DNA, 21 bp, Homo sapiens
cagttataagtagcaggccaa

SEQ ID NO: 2119061 - DNA, 14 bp, Homo sapiens
cagttataattatt

SEQ ID NO: 2119062 - DNA, 14 bp, Homo sapiens
cagttatcagggat

SEQ ID NO: 2119063 - DNA, 22 bp, Homo sapiens
cagttatctaagttaatttaaa

SEQ ID NO: 2119064 - DNA, 19 bp, Homo sapiens
cagttatggctataggtgc

SEQ ID NO: 2119065 - DNA, 19 bp, Homo sapiens
cagttattcagattgacaa

SEQ ID NO: 2119066 - DNA, 15 bp, Homo sapiens
cagttcaaatcctca

SEQ ID NO: 2119067 - DNA, 18 bp, Homo sapiens
cagttcaaatcctcacca

SEQ ID NO: 2119068 - DNA, 21 bp, Homo sapiens
cagttcacttctttgcagagc

SEQ ID NO: 2119069 - DNA, 22 bp, Homo sapiens
cagttcacttctttgcagagcc

SEQ ID NO: 2119070 - DNA, 23 bp, Homo sapiens
cagttcaggagtcccaaggaaag

SEQ ID NO: 2119071 - DNA, 23 bp, Homo sapiens
cagttcatatgtaccatgtacat

SEQ ID NO: 2119072 - DNA, 22 bp, Homo sapiens
cagttcatctatggcagtccag

SEQ ID NO: 2119073 - DNA, 22 bp, Homo sapiens
cagttcatgtatgttcagaaga

SEQ ID NO: 2119074 - DNA, 20 bp, Homo sapiens
cagttcccggagcacagccc

SEQ ID NO: 2119075 - DNA, 22 bp, Homo sapiens
cagttcccggagcacagccctg

SEQ ID NO: 2119076 - DNA, 18 bp, Homo sapiens
cagttcctctttgcatgg

SEQ ID NO: 2119077 - DNA, 19 bp, Homo sapiens
cagttcgcagccaccctga

SEQ ID NO: 2119078 - DNA, 21 bp, Homo sapiens
cagttctacaagcatatttga

SEQ ID NO: 2119079 - DNA, 16 bp, Homo sapiens
cagttctgctcctctc

SEQ ID NO: 2119080 - DNA, 17 bp, Homo sapiens
cagttctgctcctctcc

SEQ ID NO: 2119081 - DNA, 12 bp, Homo sapiens
cagttcttggac

SEQ ID NO: 2119082 - DNA, 21 bp, Homo sapiens
cagttgaaaagactccaaaga

SEQ ID NO: 2119083 - DNA, 20 bp, Homo sapiens
cagttgaatgacaacagaag

SEQ ID NO: 2119084 - DNA, 17 bp, Homo sapiens
cagttgacttactgttt

SEQ ID NO: 2119085 - DNA, 17 bp, Homo sapiens
cagttgattctgaatct

SEQ ID NO: 2119086 - DNA, 13 bp, Homo sapiens
cagttgcaataaa

SEQ ID NO: 2119087 - DNA, 15 bp, Homo sapiens
cagttgcaataaaat

SEQ ID NO: 2119088 - DNA, 17 bp, Homo sapiens
cagttgcaataaaatag

SEQ ID NO: 2119089 - DNA, 22 bp, Homo sapiens
cagttgcaataaaatagtattg

SEQ ID NO: 2119090 - DNA, 18 bp, Homo sapiens
cagttgggagcactggag

SEQ ID NO: 2119091 - DNA, 21 bp, Homo sapiens
cagttgggagcactggagtgc

SEQ ID NO: 2119092 - DNA, 16 bp, Homo sapiens
cagttgggtggatgcc

SEQ ID NO: 2119093 - DNA, 13 bp, Homo sapiens
cagttgttttccc

SEQ ID NO: 2119094 - DNA, 14 bp, Homo sapiens
cagtttatatttaa

SEQ ID NO: 2119095 - DNA, 20 bp, Homo sapiens
cagtttattgtaatatatgg

SEQ ID NO: 2119096 - DNA, 14 bp, Homo sapiens
cagtttatttgttg

SEQ ID NO: 2119097 - DNA, 22 bp, Homo sapiens
cagtttcaggtgtttagttgca

SEQ ID NO: 2119098 - DNA, 11 bp, Homo sapiens
cagtttcccca

SEQ ID NO: 2119099 - DNA, 17 bp, Homo sapiens
cagtttctccatcagct

SEQ ID NO: 2119100 - DNA, 12 bp, Homo sapiens
cagtttgctttg

SEQ ID NO: 2119101 - DNA, 14 bp, Homo sapiens
cagtttgctttgcc

SEQ ID NO: 2119102 - DNA, 21 bp, Homo sapiens
cagtttgctttgtatgcactt

SEQ ID NO: 2119103 - DNA, 14 bp, Homo sapiens
cagtttggaagtgt

SEQ ID NO: 2119104 - DNA, 14 bp, Homo sapiens
cagtttgtttactt

SEQ ID NO: 2119105 - DNA, 15 bp, Homo sapiens
cagttttatcatttt

SEQ ID NO: 2119106 - DNA, 14 bp, Homo sapiens
cagttttctgagaa

SEQ ID NO: 2119107 - DNA, 20 bp, Homo sapiens
cagttttctgagaaagacta

SEQ ID NO: 2119108 - DNA, 16 bp, Homo sapiens
cagttttgaaagaaaa

SEQ ID NO: 2119109 - DNA, 14 bp, Homo sapiens
cataaactgtgtgc

SEQ ID NO: 2119110 - DNA, 12 bp, Homo sapiens
cataaacttcat

SEQ ID NO: 2119111 - DNA, 13 bp, Homo sapiens
cataaacttcatc

SEQ ID NO: 2119112 - DNA, 14 bp, Homo sapiens
cataaatgaggaaa

SEQ ID NO: 2119113 - DNA, 20 bp, Homo sapiens
cataaatgttcagcttcaga

SEQ ID NO: 2119114 - DNA, 23 bp, Homo sapiens
cataaccccaggcatcccatccc

SEQ ID NO: 2119115 - DNA, 16 bp, Homo sapiens
cataacctagccttag

SEQ ID NO: 2119116 - DNA, 15 bp, Homo sapiens
cataacttgctgaat

SEQ ID NO: 2119117 - DNA, 11 bp, Homo sapiens
cataagaccat

SEQ ID NO: 2119118 - DNA, 21 bp, Homo sapiens
cataagaccataacagccaac

SEQ ID NO: 2119119 - DNA, 23 bp, Homo sapiens
cataagaccataacagccaacag

SEQ ID NO: 2119120 - DNA, 15 bp, Homo sapiens
cataagaccgtgtcc

SEQ ID NO: 2119121 - DNA, 15 bp, Homo sapiens
cataagattaaagga

SEQ ID NO: 2119122 - DNA, 16 bp, Homo sapiens
cataagattaaaggaa

SEQ ID NO: 2119123 - DNA, 22 bp, Homo sapiens
cataagattaaaggaaggaaaa

SEQ ID NO: 2119124 - DNA, 23 bp, Homo sapiens
cataagcctccatttagttcttt

SEQ ID NO: 2119125 - DNA, 22 bp, Homo sapiens
cataaggagaatgtatctcctc

SEQ ID NO: 2119126 - DNA, 15 bp, Homo sapiens
cataaggcctgccct

SEQ ID NO: 2119127 - DNA, 19 bp, Homo sapiens
cataaggcctgccctccca

SEQ ID NO: 2119128 - DNA, 19 bp, Homo sapiens
cataagttggaccagagga

SEQ ID NO: 2119129 - DNA, 23 bp, Homo sapiens
cataagttggaccagaggaagcc

SEQ ID NO: 2119130 - DNA, 12 bp, Homo sapiens
cataataaacta

SEQ ID NO: 2119131 - DNA, 17 bp, Homo sapiens
cataatagttagccctc

SEQ ID NO: 2119132 - DNA, 18 bp, Homo sapiens
cataatagttagccctca

SEQ ID NO: 2119133 - DNA, 17 bp, Homo sapiens
cataatatcttgaagaa

SEQ ID NO: 2119134 - DNA, 14 bp, Homo sapiens
cataatcaaagcta

SEQ ID NO: 2119135 - DNA, 16 bp, Homo sapiens
cataatctcattcaaa

SEQ ID NO: 2119136 - DNA, 19 bp, Homo sapiens
cataatctggactcctctg

SEQ ID NO: 2119137 - DNA, 20 bp, Homo sapiens
cataatctggactcctctgt

SEQ ID NO: 2119138 - DNA, 22 bp, Homo sapiens
cataatctggactcctctgtcc

SEQ ID NO: 2119139 - DNA, 20 bp, Homo sapiens
cataatgaatgctattgaaa

SEQ ID NO: 2119140 - DNA, 12 bp, Homo sapiens
cataatgccact

SEQ ID NO: 2119141 - DNA, 19 bp, Homo sapiens
cataatgctcccatctcct

SEQ ID NO: 2119142 - DNA, 21 bp, Homo sapiens
cataattatccaggaagggaa

SEQ ID NO: 2119143 - DNA, 21 bp, Homo sapiens
cataatttgtacatatgtaaa

SEQ ID NO: 2119144 - DNA, 13 bp, Homo sapiens
cataattttcaag

SEQ ID NO: 2119145 - DNA, 18 bp, Homo sapiens
cataattttcaagagaag

SEQ ID NO: 2119146 - DNA, 16 bp, Homo sapiens
catacaacctgagcct

SEQ ID NO: 2119147 - DNA, 14 bp, Homo sapiens
catacaatttgcac

SEQ ID NO: 2119148 - DNA, 22 bp, Homo sapiens
catacaatttgcactgttactt

SEQ ID NO: 2119149 - DNA, 14 bp, Homo sapiens
catacacatacata

SEQ ID NO: 2119150 - DNA, 20 bp, Homo sapiens
catacacctatgtcatttca

SEQ ID NO: 2119151 - DNA, 17 bp, Homo sapiens
catacactcaaacaatc

SEQ ID NO: 2119152 - DNA, 18 bp, Homo sapiens
catacacttgtataaatg

SEQ ID NO: 2119153 - DNA, 20 bp, Homo sapiens
catacatacacatacataca

SEQ ID NO: 2119154 - DNA, 17 bp, Homo sapiens
catacatacatacatat

SEQ ID NO: 2119155 - DNA, 16 bp, Homo sapiens
catacatacatatata

SEQ ID NO: 2119156 - DNA, 13 bp, Homo sapiens
catacatatatat

SEQ ID NO: 2119157 - DNA, 22 bp, Homo sapiens
catacatcctgctttccctccc

SEQ ID NO: 2119158 - DNA, 22 bp, Homo sapiens
catacatttataatgtttgcta

SEQ ID NO: 2119159 - DNA, 16 bp, Homo sapiens
cataccatctgctgcc

SEQ ID NO: 2119160 - DNA, 14 bp, Homo sapiens
catacccctgcctg

SEQ ID NO: 2119161 - DNA, 15 bp, Homo sapiens
catacccctgcctgg

SEQ ID NO: 2119162 - DNA, 16 bp, Homo sapiens
catacccctgcctggg

SEQ ID NO: 2119163 - DNA, 18 bp, Homo sapiens
catacccctgcctgggtt

SEQ ID NO: 2119164 - DNA, 17 bp, Homo sapiens
catacctctgaccaaca

SEQ ID NO: 2119165 - DNA, 19 bp, Homo sapiens
catacctttattgtgatct

SEQ ID NO: 2119166 - DNA, 17 bp, Homo sapiens
catactgatccctttcc

SEQ ID NO: 2119167 - DNA, 14 bp, Homo sapiens
catagaaacatgac

SEQ ID NO: 2119168 - DNA, 16 bp, Homo sapiens
catagaaacatgacac

SEQ ID NO: 2119169 - DNA, 17 bp, Homo sapiens
catagaaacatgacact

SEQ ID NO: 2119170 - DNA, 21 bp, Homo sapiens
catagaaacgacaaatcacca

SEQ ID NO: 2119171 - DNA, 16 bp, Homo sapiens
catagaaactgaggag

SEQ ID NO: 2119172 - DNA, 23 bp, Homo sapiens
catagaaactgaggagtagctga

SEQ ID NO: 2119173 - DNA, 23 bp, Homo sapiens
catagaaatgtaacttttgtaag

SEQ ID NO: 2119174 - DNA, 20 bp, Homo sapiens
catagacagaagaaacaagg

SEQ ID NO: 2119175 - DNA, 16 bp, Homo sapiens
catagagatatgcaca

SEQ ID NO: 2119176 - DNA, 19 bp, Homo sapiens
catagatagtgctttattt

SEQ ID NO: 2119177 - DNA, 16 bp, Homo sapiens
catagattaatggcac

SEQ ID NO: 2119178 - DNA, 17 bp, Homo sapiens
catagattaatggcact

SEQ ID NO: 2119179 - DNA, 19 bp, Homo sapiens
catagattaatggcactga

SEQ ID NO: 2119180 - DNA, 17 bp, Homo sapiens
catagattccctgagca

SEQ ID NO: 2119181 - DNA, 14 bp, Homo sapiens
catagcaagacaca

SEQ ID NO: 2119182 - DNA, 15 bp, Homo sapiens
catagcaagacacat

SEQ ID NO: 2119183 - DNA, 17 bp, Homo sapiens
catagcagattttaatt

SEQ ID NO: 2119184 - DNA, 18 bp, Homo sapiens
catagcgctggctcagga

SEQ ID NO: 2119185 - DNA, 18 bp, Homo sapiens
cataggcaatatctttaa

SEQ ID NO: 2119186 - DNA, 18 bp, Homo sapiens
cataggcggtcatgtgtg

SEQ ID NO: 2119187 - DNA, 20 bp, Homo sapiens
cataggcggtcatgtgtgca

SEQ ID NO: 2119188 - DNA, 21 bp, Homo sapiens
cataggcggtcatgtgtgcat

SEQ ID NO: 2119189 - DNA, 17 bp, Homo sapiens
cataggtagaatgtaaa

SEQ ID NO: 2119190 - DNA, 16 bp, Homo sapiens
catagtaccaatcatt

SEQ ID NO: 2119191 - DNA, 22 bp, Homo sapiens
catagtaccaatcattttaatt

SEQ ID NO: 2119192 - DNA, 15 bp, Homo sapiens
catagtgagatccca

SEQ ID NO: 2119193 - DNA, 22 bp, Homo sapiens
catagtgatggttcccctgttc

SEQ ID NO: 2119194 - DNA, 13 bp, Homo sapiens
catagtgccatag

SEQ ID NO: 2119195 - DNA, 19 bp, Homo sapiens
catagttcccatgttaaat

SEQ ID NO: 2119196 - DNA, 15 bp, Homo sapiens
catataaacctgatg

SEQ ID NO: 2119197 - DNA, 12 bp, Homo sapiens
catataaagtat

SEQ ID NO: 2119198 - DNA, 21 bp, Homo sapiens
catatacctataatgtgtgta

SEQ ID NO: 2119199 - DNA, 23 bp, Homo sapiens
catatacctataatgtgtgtatg

SEQ ID NO: 2119200 - DNA, 21 bp, Homo sapiens
catatatatatacacatacat

SEQ ID NO: 2119201 - DNA, 22 bp, Homo sapiens
catatatatatacacatacata

SEQ ID NO: 2119202 - DNA, 22 bp, Homo sapiens
catatatatgttttaagaggca

SEQ ID NO: 2119203 - DNA, 20 bp, Homo sapiens
catatatgtatatgtatatc

SEQ ID NO: 2119204 - DNA, 17 bp, Homo sapiens
catatattcatgtaata

SEQ ID NO: 2119205 - DNA, 21 bp, Homo sapiens
catatatttatgaatgtgcat

SEQ ID NO: 2119206 - DNA, 15 bp, Homo sapiens
catatcagaaaagta

SEQ ID NO: 2119207 - DNA, 16 bp, Homo sapiens
catatcagaaaagtag

SEQ ID NO: 2119208 - DNA, 17 bp, Homo sapiens
catatcagaaaagtaga

SEQ ID NO: 2119209 - DNA, 12 bp, Homo sapiens
catatcattttt

SEQ ID NO: 2119210 - DNA, 20 bp, Homo sapiens
catatcggaggtggtggagg

SEQ ID NO: 2119211 - DNA, 14 bp, Homo sapiens
catatctccttccc

SEQ ID NO: 2119212 - DNA, 15 bp, Homo sapiens
catatctccttcccc

SEQ ID NO: 2119213 - DNA, 17 bp, Homo sapiens
catatgaaatttaatat

SEQ ID NO: 2119214 - DNA, 18 bp, Homo sapiens
catatgacatgccaccct

SEQ ID NO: 2119215 - DNA, 19 bp, Homo sapiens
catatgacatgccaccctc

SEQ ID NO: 2119216 - DNA, 13 bp, Homo sapiens
catatgagtcttt

SEQ ID NO: 2119217 - DNA, 17 bp, Homo sapiens
catatgcaccttgtgtc

SEQ ID NO: 2119218 - DNA, 17 bp, Homo sapiens
catatggactctgcaca

SEQ ID NO: 2119219 - DNA, 16 bp, Homo sapiens
catatgggtgctggca

SEQ ID NO: 2119220 - DNA, 14 bp, Homo sapiens
catatgtaaaataa

SEQ ID NO: 2119221 - DNA, 21 bp, Homo sapiens
catatgtaccatgtacatgaa

SEQ ID NO: 2119222 - DNA, 17 bp, Homo sapiens
catatgtagactatata

SEQ ID NO: 2119223 - DNA, 23 bp, Homo sapiens
catatgtagactatatacatgtg

SEQ ID NO: 2119224 - DNA, 17 bp, Homo sapiens
catatgtctgcttctgt

SEQ ID NO: 2119225 - DNA, 14 bp, Homo sapiens
catattaaacttct

SEQ ID NO: 2119226 - DNA, 15 bp, Homo sapiens
catattaaacttctg

SEQ ID NO: 2119227 - DNA, 18 bp, Homo sapiens
catattaaacttctgatt

SEQ ID NO: 2119228 - DNA, 12 bp, Homo sapiens
catattataaat

SEQ ID NO: 2119229 - DNA, 14 bp, Homo sapiens
catattataaataa

SEQ ID NO: 2119230 - DNA, 17 bp, Homo sapiens
catattataaataaatg

SEQ ID NO: 2119231 - DNA, 22 bp, Homo sapiens
catattctgttggccagtgtga

SEQ ID NO: 2119232 - DNA, 20 bp, Homo sapiens
catattggaaaggtcattgt

SEQ ID NO: 2119233 - DNA, 18 bp, Homo sapiens
catattgtatgtaagtaa

SEQ ID NO: 2119234 - DNA, 12 bp, Homo sapiens
catatttcaatt

SEQ ID NO: 2119235 - DNA, 23 bp, Homo sapiens
catattttcacatgacgtaaaat

SEQ ID NO: 2119236 - DNA, 18 bp, Homo sapiens
catcaaatttgccaccac

SEQ ID NO: 2119237 - DNA, 23 bp, Homo sapiens
catcaagcatgcaataatgtgca

SEQ ID NO: 2119238 - DNA, 16 bp, Homo sapiens
catcaattaaaggcaa

SEQ ID NO: 2119239 - DNA, 11 bp, Homo sapiens
catcaattccc

SEQ ID NO: 2119240 - DNA, 14 bp, Homo sapiens
catcaattcccatt

SEQ ID NO: 2119241 - DNA, 13 bp, Homo sapiens
catcaatttttat

SEQ ID NO: 2119242 - DNA, 15 bp, Homo sapiens
catcaatttttatac

SEQ ID NO: 2119243 - DNA, 18 bp, Homo sapiens
catcaatttttatacata

SEQ ID NO: 2119244 - DNA, 13 bp, Homo sapiens
catcacagcagaa

SEQ ID NO: 2119245 - DNA, 20 bp, Homo sapiens
catcacagcagaatgaagac

SEQ ID NO: 2119246 - DNA, 22 bp, Homo sapiens
catcaccgacgcgtctcctgtt

SEQ ID NO: 2119247 - DNA, 15 bp, Homo sapiens
catcacctcaggcca

SEQ ID NO: 2119248 - DNA, 18 bp, Homo sapiens
catcacctcaggccaggt

SEQ ID NO: 2119249 - DNA, 21 bp, Homo sapiens
catcacctttttgacttttcc

SEQ ID NO: 2119250 - DNA, 22 bp, Homo sapiens
catcacctttttgacttttcca

SEQ ID NO: 2119251 - DNA, 17 bp, Homo sapiens
catcactgagtggcttg

SEQ ID NO: 2119252 - DNA, 12 bp, Homo sapiens
catcagaaaggg

SEQ ID NO: 2119253 - DNA, 16 bp, Homo sapiens
catcagaaagggaggg

SEQ ID NO: 2119254 - DNA, 20 bp, Homo sapiens
catcagaaagggagggctct

SEQ ID NO: 2119255 - DNA, 22 bp, Homo sapiens
catcagaaagggagggctctga

SEQ ID NO: 2119256 - DNA, 23 bp, Homo sapiens
catcagaaagggagggctctgag

SEQ ID NO: 2119257 - DNA, 11 bp, Homo sapiens
catcagaagga

SEQ ID NO: 2119258 - DNA, 14 bp, Homo sapiens
catcagaagtggta

SEQ ID NO: 2119259 - DNA, 20 bp, Homo sapiens
catcagcatttaataaatgt

SEQ ID NO: 2119260 - DNA, 13 bp, Homo sapiens
catcagctgctga

SEQ ID NO: 2119261 - DNA, 17 bp, Homo sapiens
catcaggcttggaatga

SEQ ID NO: 2119262 - DNA, 20 bp, Homo sapiens
catcagggtgggccactctc

SEQ ID NO: 2119263 - DNA, 21 bp, Homo sapiens
catcagtcattcccacgcttg

SEQ ID NO: 2119264 - DNA, 20 bp, Homo sapiens
catcataaaataaagtatat

SEQ ID NO: 2119265 - DNA, 17 bp, Homo sapiens
catcatatgaatgttct

SEQ ID NO: 2119266 - DNA, 16 bp, Homo sapiens
catcatatgacatgcc

SEQ ID NO: 2119267 - DNA, 22 bp, Homo sapiens
catcatcaggcttggaatgaat

SEQ ID NO: 2119268 - DNA, 23 bp, Homo sapiens
catcatcaggcttggaatgaatt

SEQ ID NO: 2119269 - DNA, 14 bp, Homo sapiens
catcatcctcctta

SEQ ID NO: 2119270 - DNA, 14 bp, Homo sapiens
catcatgcattcac

SEQ ID NO: 2119271 - DNA, 17 bp, Homo sapiens
caggtctagactttctc

SEQ ID NO: 2119272 - DNA, 20 bp, Homo sapiens
caggtctcccacgtgggaga

SEQ ID NO: 2119273 - DNA, 13 bp, Homo sapiens
caggtctcctctt

SEQ ID NO: 2119274 - DNA, 14 bp, Homo sapiens
caggtctcctctta

SEQ ID NO: 2119275 - DNA, 22 bp, Homo sapiens
caggtctcctcttaaaaaataa

SEQ ID NO: 2119276 - DNA, 14 bp, Homo sapiens
caggtctctccact

SEQ ID NO: 2119277 - DNA, 17 bp, Homo sapiens
caggtctctggcagaga

SEQ ID NO: 2119278 - DNA, 19 bp, Homo sapiens
caggtcttgaactcctggc

SEQ ID NO: 2119279 - DNA, 21 bp, Homo sapiens
caggtgatccacccacctcag

SEQ ID NO: 2119280 - DNA, 17 bp, Homo sapiens
caggtgcaagagacaga

SEQ ID NO: 2119281 - DNA, 15 bp, Homo sapiens
caggtgccaccaata

SEQ ID NO: 2119282 - DNA, 16 bp, Homo sapiens
caggtgccaccaataa

SEQ ID NO: 2119283 - DNA, 18 bp, Homo sapiens
caggtgccactccctgag

SEQ ID NO: 2119284 - DNA, 21 bp, Homo sapiens
caggtgccactccctgagctt

SEQ ID NO: 2119285 - DNA, 12 bp, Homo sapiens
caggtgcctgga

SEQ ID NO: 2119286 - DNA, 18 bp, Homo sapiens
caggtgcctggtgggcca

SEQ ID NO: 2119287 - DNA, 16 bp, Homo sapiens
caggtgcttttgatgt

SEQ ID NO: 2119288 - DNA, 14 bp, Homo sapiens
caggtggagagcac

SEQ ID NO: 2119289 - DNA, 17 bp, Homo sapiens
caggtggagagcactag

SEQ ID NO: 2119290 - DNA, 21 bp, Homo sapiens
caggtggcaggaccaggacta

SEQ ID NO: 2119291 - DNA, 19 bp, Homo sapiens
caggtggcctagcaggcac

SEQ ID NO: 2119292 - DNA, 19 bp, Homo sapiens
caggtggctgacccagtcc

SEQ ID NO: 2119293 - DNA, 22 bp, Homo sapiens
caggtggctgacccagtccctg

SEQ ID NO: 2119294 - DNA, 23 bp, Homo sapiens
caggtggctgacccagtccctgg

SEQ ID NO: 2119295 - DNA, 13 bp, Homo sapiens
caggtgggagaga

SEQ ID NO: 2119296 - DNA, 19 bp, Homo sapiens
caggtgggagagacactcc

SEQ ID NO: 2119297 - DNA, 23 bp, Homo sapiens
caggtgggagagacactcccagg

SEQ ID NO: 2119298 - DNA, 13 bp, Homo sapiens
caggtggggcagc

SEQ ID NO: 2119299 - DNA, 23 bp, Homo sapiens
caggtgtgaaccaccacacccag

SEQ ID NO: 2119300 - DNA, 20 bp, Homo sapiens
caggtgtgagtcaccaagcc

SEQ ID NO: 2119301 - DNA, 20 bp, Homo sapiens
caggtgttgccatttctctg

SEQ ID NO: 2119302 - DNA, 23 bp, Homo sapiens
caggttagaacctagaagggcta

SEQ ID NO: 2119303 - DNA, 16 bp, Homo sapiens
caggttcccagcagct

SEQ ID NO: 2119304 - DNA, 17 bp, Homo sapiens
caggttcccagcagctg

SEQ ID NO: 2119305 - DNA, 22 bp, Homo sapiens
caggttgaggggctcctggaaa

SEQ ID NO: 2119306 - DNA, 22 bp, Homo sapiens
caggttgtctgaagtcactgca

SEQ ID NO: 2119307 - DNA, 17 bp, Homo sapiens
caggtttcttaaaaaca

SEQ ID NO: 2119308 - DNA, 23 bp, Homo sapiens
caggtttggggagggggaagaga

SEQ ID NO: 2119309 - DNA, 15 bp, Homo sapiens
caggttttgtaaaga

SEQ ID NO: 2119310 - DNA, 23 bp, Homo sapiens
caggtttttggtctgacccactg

SEQ ID NO: 2119311 - DNA, 10 bp, Homo sapiens
cagtaaacat

SEQ ID NO: 2119312 - DNA, 19 bp, Homo sapiens
cagtaaactttctctgcaa

SEQ ID NO: 2119313 - DNA, 14 bp, Homo sapiens
cagtaaagtttaaa

SEQ ID NO: 2119314 - DNA, 18 bp, Homo sapiens
cagtaaagtttaaaaaat

SEQ ID NO: 2119315 - DNA, 24 bp, Homo sapiens
cagtaaataaattgtttgaccatg

SEQ ID NO: 2119316 - DNA, 13 bp, Homo sapiens
cagtaaatccaca

SEQ ID NO: 2119317 - DNA, 22 bp, Homo sapiens
cagtaaatccacagccaacaaa

SEQ ID NO: 2119318 - DNA, 14 bp, Homo sapiens
cagtaactcatctg

SEQ ID NO: 2119319 - DNA, 18 bp, Homo sapiens
cagtaagtatctggagga

SEQ ID NO: 2119320 - DNA, 21 bp, Homo sapiens
cagtacagagaaattctgtgg

SEQ ID NO: 2119321 - DNA, 22 bp, Homo sapiens
cagtacagagaaattctgtggt

SEQ ID NO: 2119322 - DNA, 14 bp, Homo sapiens
cagtacatgggaaa

SEQ ID NO: 2119323 - DNA, 15 bp, Homo sapiens
cagtacatgggaaag

SEQ ID NO: 2119324 - DNA, 12 bp, Homo sapiens
cagtactgggaa

SEQ ID NO: 2119325 - DNA, 13 bp, Homo sapiens
cagtacttctaag

SEQ ID NO: 2119326 - DNA, 23 bp, Homo sapiens
cagtagaggcatgaacacacatg

SEQ ID NO: 2119327 - DNA, 18 bp, Homo sapiens
cagtagcacaagttattt

SEQ ID NO: 2119328 - DNA, 14 bp, Homo sapiens
cagtagccagcacg

SEQ ID NO: 2119329 - DNA, 20 bp, Homo sapiens
cagtagctgtggtgaggtgg

SEQ ID NO: 2119330 - DNA, 16 bp, Homo sapiens
cagtagcttaaataaa

SEQ ID NO: 2119331 - DNA, 21 bp, Homo sapiens
cagtagcttaaataaattcaa

SEQ ID NO: 2119332 - DNA, 18 bp, Homo sapiens
cagtaggtttgtgtggat

SEQ ID NO: 2119333 - DNA, 16 bp, Homo sapiens
cagtagtttgagacca

SEQ ID NO: 2119334 - DNA, 21 bp, Homo sapiens
cagtagtttgagaccagcctg

SEQ ID NO: 2119335 - DNA, 23 bp, Homo sapiens
cagtagtttgagaccagcctggc

SEQ ID NO: 2119336 - DNA, 18 bp, Homo sapiens
cagtatagcattgaacat

SEQ ID NO: 2119337 - DNA, 11 bp, Homo sapiens
caggcatgctg

SEQ ID NO: 2119338 - DNA, 15 bp, Homo sapiens
caggcatttcctggg

SEQ ID NO: 2119339 - DNA, 19 bp, Homo sapiens
caggccaagaccccagctt

SEQ ID NO: 2119340 - DNA, 18 bp, Homo sapiens
caggccaagagcagaggc

SEQ ID NO: 2119341 - DNA, 21 bp, Homo sapiens
caggccaagagcagaggcagc

SEQ ID NO: 2119342 - DNA, 15 bp, Homo sapiens
caggccaccaggatg

SEQ ID NO: 2119343 - DNA, 14 bp, Homo sapiens
caggccactgtggc

SEQ ID NO: 2119344 - DNA, 15 bp, Homo sapiens
caggccactgtggcc

SEQ ID NO: 2119345 - DNA, 21 bp, Homo sapiens
caggccactgtggccagagct

SEQ ID NO: 2119346 - DNA, 15 bp, Homo sapiens
caggccacttgatga

SEQ ID NO: 2119347 - DNA, 12 bp, Homo sapiens
caggccagaaaa

SEQ ID NO: 2119348 - DNA, 15 bp, Homo sapiens
caggccagagggagt

SEQ ID NO: 2119349 - DNA, 19 bp, Homo sapiens
caggccagagggagtgaca

SEQ ID NO: 2119350 - DNA, 23 bp, Homo sapiens
caggccagagggagtgacagagg

SEQ ID NO: 2119351 - DNA, 16 bp, Homo sapiens
caggccagccccatct

SEQ ID NO: 2119352 - DNA, 16 bp, Homo sapiens
caggccaggccaccag

SEQ ID NO: 2119353 - DNA, 18 bp, Homo sapiens
caggccaggccaccagga

SEQ ID NO: 2119354 - DNA, 14 bp, Homo sapiens
caggccagtgccag

SEQ ID NO: 2119355 - DNA, 17 bp, Homo sapiens
caggccagtgccaggac

SEQ ID NO: 2119356 - DNA, 20 bp, Homo sapiens
caggccagtgccaggacagc

SEQ ID NO: 2119357 - DNA, 20 bp, Homo sapiens
caggcccatctcaggtgcca

SEQ ID NO: 2119358 - DNA, 12 bp, Homo sapiens
caggccccaagg

SEQ ID NO: 2119359 - DNA, 17 bp, Homo sapiens
caggccccatgacctcc

SEQ ID NO: 2119360 - DNA, 19 bp, Homo sapiens
caggccccccgcagcaccc

SEQ ID NO: 2119361 - DNA, 17 bp, Homo sapiens
caggccccgcttgtcca

SEQ ID NO: 2119362 - DNA, 18 bp, Homo sapiens
caggccccgcttgtccag

SEQ ID NO: 2119363 - DNA, 17 bp, Homo sapiens
caggcccctgaggactg

SEQ ID NO: 2119364 - DNA, 19 bp, Homo sapiens
caggcccctgccaccctgg

SEQ ID NO: 2119365 - DNA, 16 bp, Homo sapiens
caggcccggctccagg

SEQ ID NO: 2119366 - DNA, 17 bp, Homo sapiens
caggcccggctccaggc

SEQ ID NO: 2119367 - DNA, 20 bp, Homo sapiens
caggcccggctccaggctcc

SEQ ID NO: 2119368 - DNA, 19 bp, Homo sapiens
caggccctaagatgccttg

SEQ ID NO: 2119369 - DNA, 20 bp, Homo sapiens
caggccctaagatgccttga

SEQ ID NO: 2119370 - DNA, 19 bp, Homo sapiens
caggccctccatgggctag

SEQ ID NO: 2119371 - DNA, 16 bp, Homo sapiens
caggccctccctgact

SEQ ID NO: 2119372 - DNA, 20 bp, Homo sapiens
caggccctccctgactccct

SEQ ID NO: 2119373 - DNA, 22 bp, Homo sapiens
caggccctccctgactccctgt

SEQ ID NO: 2119374 - DNA, 20 bp, Homo sapiens
caggcccttcctctccactg

SEQ ID NO: 2119375 - DNA, 14 bp, Homo sapiens
caggccgcctgcca

SEQ ID NO: 2119376 - DNA, 19 bp, Homo sapiens
caggccgggcttgggccct

SEQ ID NO: 2119377 - DNA, 23 bp, Homo sapiens
caggccgggcttgggccctgcac

SEQ ID NO: 2119378 - DNA, 19 bp, Homo sapiens
caggccggtgtgggctgtg

SEQ ID NO: 2119379 - DNA, 18 bp, Homo sapiens
caggccgttccccttggc

SEQ ID NO: 2119380 - DNA, 20 bp, Homo sapiens
caggccgttccccttggctt

SEQ ID NO: 2119381 - DNA, 23 bp, Homo sapiens
caggccgttccccttggcttcct

SEQ ID NO: 2119382 - DNA, 17 bp, Homo sapiens
caggcctaggacctcag

SEQ ID NO: 2119383 - DNA, 20 bp, Homo sapiens
caggcctaggacctcaggcg

SEQ ID NO: 2119384 - DNA, 15 bp, Homo sapiens
caggcctccagcctc

SEQ ID NO: 2119385 - DNA, 19 bp, Homo sapiens
caggcctccagcctctccc

SEQ ID NO: 2119386 - DNA, 17 bp, Homo sapiens
caggcctctgtgtcctt

SEQ ID NO: 2119387 - DNA, 16 bp, Homo sapiens
caggcctgggacccag

SEQ ID NO: 2119388 - DNA, 24 bp, Homo sapiens
caggcctgggacccagctactctg

SEQ ID NO: 2119389 - DNA, 15 bp, Homo sapiens
caggcgccccttccc

SEQ ID NO: 2119390 - DNA, 16 bp, Homo sapiens
caggcgctggacagag

SEQ ID NO: 2119391 - DNA, 19 bp, Homo sapiens
caggcggggaggaggagct

SEQ ID NO: 2119392 - DNA, 15 bp, Homo sapiens
caggcggggtgctgt

SEQ ID NO: 2119393 - DNA, 18 bp, Homo sapiens
caggcgttggtgccactt

SEQ ID NO: 2119394 - DNA, 20 bp, Homo sapiens
caggcgttggtgccacttct

SEQ ID NO: 2119395 - DNA, 20 bp, Homo sapiens
caggctaccccttcatggtg

SEQ ID NO: 2119396 - DNA, 14 bp, Homo sapiens
caggctactctcct

SEQ ID NO: 2119397 - DNA, 16 bp, Homo sapiens
caggctactctcctcg

SEQ ID NO: 2119398 - DNA, 15 bp, Homo sapiens
caggctagaacctgg

SEQ ID NO: 2119399 - DNA, 15 bp, Homo sapiens
caggctatttgttca

SEQ ID NO: 2119400 - DNA, 16 bp, Homo sapiens
caggctccatggggaa

SEQ ID NO: 2119401 - DNA, 20 bp, Homo sapiens
caggctccctttctcttctt

SEQ ID NO: 2119402 - DNA, 19 bp, Homo sapiens
caggctcctttagcgccca

SEQ ID NO: 2119403 - DNA, 14 bp, Homo sapiens
caggctctgcctgg

SEQ ID NO: 2119404 - DNA, 19 bp, Homo sapiens
caggctctggagccagaga

SEQ ID NO: 2119405 - DNA, 12 bp, Homo sapiens
caggctctggga

SEQ ID NO: 2119406 - DNA, 14 bp, Homo sapiens
caggctctgggaag

SEQ ID NO: 2119407 - DNA, 15 bp, Homo sapiens
caggctctgggaagg

SEQ ID NO: 2119408 - DNA, 18 bp, Homo sapiens
caggctctgggaaggggt

SEQ ID NO: 2119409 - DNA, 15 bp, Homo sapiens
caggctctgggctca

SEQ ID NO: 2119410 - DNA, 16 bp, Homo sapiens
caggctctgggctcag

SEQ ID NO: 2119411 - DNA, 13 bp, Homo sapiens
caggctcttcctg

SEQ ID NO: 2119412 - DNA, 17 bp, Homo sapiens
caggctcttcctggacc

SEQ ID NO: 2119413 - DNA, 18 bp, Homo sapiens
caggctcttctcctttca

SEQ ID NO: 2119414 - DNA, 15 bp, Homo sapiens
ctctgccccaagcag

SEQ ID NO: 2119415 - DNA, 17 bp, Homo sapiens
ctctgccccaagcagcc

SEQ ID NO: 2119416 - DNA, 14 bp, Homo sapiens
ctctgccccaaggg

SEQ ID NO: 2119417 - DNA, 18 bp, Homo sapiens
ctctgccccaaggggccc

SEQ ID NO: 2119418 - DNA, 21 bp, Homo sapiens
ctctgccccaaggggcccaca

SEQ ID NO: 2119419 - DNA, 22 bp, Homo sapiens
ctctgccccaaggggcccacaa

SEQ ID NO: 2119420 - DNA, 23 bp, Homo sapiens
ctctgccccaaggggcccacaaa

SEQ ID NO: 2119421 - DNA, 16 bp, Homo sapiens
ctctgccccagaggcc

SEQ ID NO: 2119422 - DNA, 20 bp, Homo sapiens
ctctgccccagaggcctctc

SEQ ID NO: 2119423 - DNA, 14 bp, Homo sapiens
ctctgccccttggg

SEQ ID NO: 2119424 - DNA, 16 bp, Homo sapiens
ctctgccctccctggc

SEQ ID NO: 2119425 - DNA, 14 bp, Homo sapiens
ctctgccctgcctc

SEQ ID NO: 2119426 - DNA, 17 bp, Homo sapiens
ctctgccctgcctccct

SEQ ID NO: 2119427 - DNA, 18 bp, Homo sapiens
ctctgccctgcctccctt

SEQ ID NO: 2119428 - DNA, 15 bp, Homo sapiens
ctctgccctgtatat

SEQ ID NO: 2119429 - DNA, 14 bp, Homo sapiens
ctctgcctctgaca

SEQ ID NO: 2119430 - DNA, 19 bp, Homo sapiens
ctctgcctctgacacacag

SEQ ID NO: 2119431 - DNA, 20 bp, Homo sapiens
ctctgcctctgacacacagc

SEQ ID NO: 2119432 - DNA, 18 bp, Homo sapiens
ctctgcggtggtgccaga

SEQ ID NO: 2119433 - DNA, 19 bp, Homo sapiens
ctctgcggtggtgccagag

SEQ ID NO: 2119434 - DNA, 21 bp, Homo sapiens
ctctgcggtggtgccagaggt

SEQ ID NO: 2119435 - DNA, 16 bp, Homo sapiens
ctctgcgtcccccagc

SEQ ID NO: 2119436 - DNA, 18 bp, Homo sapiens
ctctgcgtcccccagccc

SEQ ID NO: 2119437 - DNA, 22 bp, Homo sapiens
ctctgcgtcccccagccctcag

SEQ ID NO: 2119438 - DNA, 23 bp, Homo sapiens
ctctgcgtgcagggacaaagagg

SEQ ID NO: 2119439 - DNA, 12 bp, Homo sapiens
ctctgctccaga

SEQ ID NO: 2119440 - DNA, 20 bp, Homo sapiens
ctctgctcctctccccagca

SEQ ID NO: 2119441 - DNA, 14 bp, Homo sapiens
ctctgctctagcca

SEQ ID NO: 2119442 - DNA, 18 bp, Homo sapiens
ctctgctctagccaggag

SEQ ID NO: 2119443 - DNA, 12 bp, Homo sapiens
ctctgctctgat

SEQ ID NO: 2119444 - DNA, 14 bp, Homo sapiens
ctctgctctgatgc

SEQ ID NO: 2119445 - DNA, 17 bp, Homo sapiens
ctctgctcttgcctgca

SEQ ID NO: 2119446 - DNA, 13 bp, Homo sapiens
ctctgctgacaga

SEQ ID NO: 2119447 - DNA, 18 bp, Homo sapiens
ctctgctgacagacacag

SEQ ID NO: 2119448 - DNA, 19 bp, Homo sapiens
ctctgctgacagacacagg

SEQ ID NO: 2119449 - DNA, 21 bp, Homo sapiens
ctctgctgacagacacaggcc

SEQ ID NO: 2119450 - DNA, 12 bp, Homo sapiens
ctctgctgctcc

SEQ ID NO: 2119451 - DNA, 18 bp, Homo sapiens
ctctggaaaactcaggat

SEQ ID NO: 2119452 - DNA, 21 bp, Homo sapiens
ctctggaaaactcaggattct

SEQ ID NO: 2119453 - DNA, 21 bp, Homo sapiens
ctctggaaaatgtgacccaga

SEQ ID NO: 2119454 - DNA, 16 bp, Homo sapiens
ctctggaagcctggac

SEQ ID NO: 2119455 - DNA, 15 bp, Homo sapiens
ctctggacaggcatg

SEQ ID NO: 2119456 - DNA, 16 bp, Homo sapiens
ctctggacaggcatgt

SEQ ID NO: 2119457 - DNA, 23 bp, Homo sapiens
ctctggacatgatttagggaagc

SEQ ID NO: 2119458 - DNA, 22 bp, Homo sapiens
ctctggaccaaccctgtttcct

SEQ ID NO: 2119459 - DNA, 20 bp, Homo sapiens
ctctggaccagcctgttgga

SEQ ID NO: 2119460 - DNA, 12 bp, Homo sapiens
ctctggactgtg

SEQ ID NO: 2119461 - DNA, 14 bp, Homo sapiens
ctctggagccagag

SEQ ID NO: 2119462 - DNA, 15 bp, Homo sapiens
ctctggatccctgga

SEQ ID NO: 2119463 - DNA, 22 bp, Homo sapiens
ctctggatcctgctgtggcctc

SEQ ID NO: 2119464 - DNA, 16 bp, Homo sapiens
ctctggatggcaccag

SEQ ID NO: 2119465 - DNA, 12 bp, Homo sapiens
ctctggcagaga

SEQ ID NO: 2119466 - DNA, 16 bp, Homo sapiens
ctctggcagagaagga

SEQ ID NO: 2119467 - DNA, 12 bp, Homo sapiens
ctctggccaccc

SEQ ID NO: 2119468 - DNA, 17 bp, Homo sapiens
ctctggccaccctggcc

SEQ ID NO: 2119469 - DNA, 16 bp, Homo sapiens
ctctggccccaggctt

SEQ ID NO: 2119470 - DNA, 14 bp, Homo sapiens
ctctggccctgcct

SEQ ID NO: 2119471 - DNA, 18 bp, Homo sapiens
ctctggccctgccttctt

SEQ ID NO: 2119472 - DNA, 18 bp, Homo sapiens
ctctggcctcagccgact

SEQ ID NO: 2119473 - DNA, 22 bp, Homo sapiens
ctctggcctctcgagttctcct

SEQ ID NO: 2119474 - DNA, 13 bp, Homo sapiens
ctctggcttccag

SEQ ID NO: 2119475 - DNA, 14 bp, Homo sapiens
ctctggctttgtct

SEQ ID NO: 2119476 - DNA, 12 bp, Homo sapiens
ctctgggcagct

SEQ ID NO: 2119477 - DNA, 15 bp, Homo sapiens
ctctgggctcagggc

SEQ ID NO: 2119478 - DNA, 16 bp, Homo sapiens
ctctgggctcagggct

SEQ ID NO: 2119479 - DNA, 17 bp, Homo sapiens
ctctgggctcagggctg

SEQ ID NO: 2119480 - DNA, 15 bp, Homo sapiens
ctctggggccctggg

SEQ ID NO: 2119481 - DNA, 17 bp, Homo sapiens
ctctggggccctgggcc

SEQ ID NO: 2119482 - DNA, 18 bp, Homo sapiens
ctctggggccctgggcct

SEQ ID NO: 2119483 - DNA, 20 bp, Homo sapiens
ctctgggggcctctttctgt

SEQ ID NO: 2119484 - DNA, 16 bp, Homo sapiens
ctctggggttcatcta

SEQ ID NO: 2119485 - DNA, 14 bp, Homo sapiens
ctctgtacaaaaac

SEQ ID NO: 2119486 - DNA, 13 bp, Homo sapiens
ctctgtataaaca

SEQ ID NO: 2119487 - DNA, 18 bp, Homo sapiens
ctctgtataaacattaaa

SEQ ID NO: 2119488 - DNA, 15 bp, Homo sapiens
ctctgtcagccagcc

SEQ ID NO: 2119489 - DNA, 17 bp, Homo sapiens
ctctgtcagccagccgc

SEQ ID NO: 2119490 - DNA, 23 bp, Homo sapiens
ctctgtcagccagccgccctggg

SEQ ID NO: 2119491 - DNA, 18 bp, Homo sapiens
ctctgtcatcactccctg

SEQ ID NO: 2119492 - DNA, 12 bp, Homo sapiens
ctctgtccaggc

SEQ ID NO: 2119493 - DNA, 21 bp, Homo sapiens
ctctgtccaggccactgtggc

SEQ ID NO: 2119494 - DNA, 24 bp, Homo sapiens
ctctgtccaggccactgtggccag

SEQ ID NO: 2119495 - DNA, 21 bp, Homo sapiens
ctctgtccagggccctgagct

SEQ ID NO: 2119496 - DNA, 13 bp, Homo sapiens
ctctgtcgcccag

SEQ ID NO: 2119497 - DNA, 19 bp, Homo sapiens
ctctgtcgcccagtctgga

SEQ ID NO: 2119498 - DNA, 20 bp, Homo sapiens
ctctgtctcgagcgccctgc

SEQ ID NO: 2119499 - DNA, 22 bp, Homo sapiens
ctctgtctcgagcgccctgcag

SEQ ID NO: 2119500 - DNA, 12 bp, Homo sapiens
ctctgtctctgc

SEQ ID NO: 2119501 - DNA, 16 bp, Homo sapiens
ctctgtctctgctctt

SEQ ID NO: 2119502 - DNA, 18 bp, Homo sapiens
ctctgtgaacgatttaga

SEQ ID NO: 2119503 - DNA, 23 bp, Homo sapiens
ctctgtgacctgccccgcccagc

SEQ ID NO: 2119504 - DNA, 21 bp, Homo sapiens
ctctgtgactcgcttagctga

SEQ ID NO: 2119505 - DNA, 14 bp, Homo sapiens
ctctgtgccagagc

SEQ ID NO: 2119506 - DNA, 15 bp, Homo sapiens
ctctgtgccagagcc

SEQ ID NO: 2119507 - DNA, 19 bp, Homo sapiens
ctctgtgccagagcctggg

SEQ ID NO: 2119508 - DNA, 18 bp, Homo sapiens
ctctgtgctttgactcac

SEQ ID NO: 2119509 - DNA, 23 bp, Homo sapiens
ctctgtgctttgactcacctgtt

SEQ ID NO: 2119510 - DNA, 22 bp, Homo sapiens
ctctgtgcttttaaatgcataa

SEQ ID NO: 2119511 - DNA, 18 bp, Homo sapiens
ctctgtggcctgtgtcca

SEQ ID NO: 2119512 - DNA, 19 bp, Homo sapiens
ctctgtggcctgtgtccag

SEQ ID NO: 2119513 - DNA, 23 bp, Homo sapiens
ctctgtgtacccactcctcactg

SEQ ID NO: 2119514 - DNA, 20 bp, Homo sapiens
ctctgtgtcaggtggggcag

SEQ ID NO: 2119515 - DNA, 15 bp, Homo sapiens
ctctgtgtgcacaaa

SEQ ID NO: 2119516 - DNA, 20 bp, Homo sapiens
ctctgtgttgtgaatgtcat

SEQ ID NO: 2119517 - DNA, 13 bp, Homo sapiens
ctctgttcatttc

SEQ ID NO: 2119518 - DNA, 17 bp, Homo sapiens
ctcttaaaaaataaaaa

SEQ ID NO: 2119519 - DNA, 13 bp, Homo sapiens
ctcttacccagaa

SEQ ID NO: 2119520 - DNA, 20 bp, Homo sapiens
ctcttagtgattgtgtctgc

SEQ ID NO: 2119521 - DNA, 20 bp, Homo sapiens
ctcttagtgcccgcctagga

SEQ ID NO: 2119522 - DNA, 16 bp, Homo sapiens
ctcttatagaatattt

SEQ ID NO: 2119523 - DNA, 22 bp, Homo sapiens
ctcttatagaatatttattacc

SEQ ID NO: 2119524 - DNA, 16 bp, Homo sapiens
ctcttattcagtaaaa

SEQ ID NO: 2119525 - DNA, 12 bp, Homo sapiens
ctcttatttgct

SEQ ID NO: 2119526 - DNA, 17 bp, Homo sapiens
ctcttcaactgaccagc

SEQ ID NO: 2119527 - DNA, 13 bp, Homo sapiens
ctcttcactcagc

SEQ ID NO: 2119528 - DNA, 17 bp, Homo sapiens
ctcttcactcagccaca

SEQ ID NO: 2119529 - DNA, 11 bp, Homo sapiens
ctcttcagaaa

SEQ ID NO: 2119530 - DNA, 18 bp, Homo sapiens
ctcttcagggtgagtgaa

SEQ ID NO: 2119531 - DNA, 21 bp, Homo sapiens
ctccccgcagagctcccttcc

SEQ ID NO: 2119532 - DNA, 17 bp, Homo sapiens
ctcccctatccacccag

SEQ ID NO: 2119533 - DNA, 19 bp, Homo sapiens
ctcccctatccacccagcc

SEQ ID NO: 2119534 - DNA, 14 bp, Homo sapiens
ctcccctattttaa

SEQ ID NO: 2119535 - DNA, 15 bp, Homo sapiens
ctcccctcccccctg

SEQ ID NO: 2119536 - DNA, 16 bp, Homo sapiens
ctcccctccctcttcc

SEQ ID NO: 2119537 - DNA, 19 bp, Homo sapiens
ctcccctccctcttccttc

SEQ ID NO: 2119538 - DNA, 23 bp, Homo sapiens
ctcccctgggcatcttctggctt

SEQ ID NO: 2119539 - DNA, 16 bp, Homo sapiens
ctccccttcctgcacc

SEQ ID NO: 2119540 - DNA, 17 bp, Homo sapiens
ctccccttcctgcaccc

SEQ ID NO: 2119541 - DNA, 19 bp, Homo sapiens
ctccccttcctgcacccgt

SEQ ID NO: 2119542 - DNA, 17 bp, Homo sapiens
ctcccgaatagctggga

SEQ ID NO: 2119543 - DNA, 16 bp, Homo sapiens
ctcccgagtagctggg

SEQ ID NO: 2119544 - DNA, 17 bp, Homo sapiens
ctcccgagtagctggga

SEQ ID NO: 2119545 - DNA, 18 bp, Homo sapiens
ctcccgagtagctgggac

SEQ ID NO: 2119546 - DNA, 19 bp, Homo sapiens
ctcccgagtagctgggact

SEQ ID NO: 2119547 - DNA, 20 bp, Homo sapiens
ctcccgagtagctgggacta

SEQ ID NO: 2119548 - DNA, 14 bp, Homo sapiens
ctcccgcaccaggc

SEQ ID NO: 2119549 - DNA, 21 bp, Homo sapiens
ctcccggtgcccaagaataga

SEQ ID NO: 2119550 - DNA, 14 bp, Homo sapiens
ctccctaaaataaa

SEQ ID NO: 2119551 - DNA, 16 bp, Homo sapiens
ctccctaaaataaaaa

SEQ ID NO: 2119552 - DNA, 17 bp, Homo sapiens
ctccctaaaataaaaac

SEQ ID NO: 2119553 - DNA, 15 bp, Homo sapiens
ctccctaagaaaccc

SEQ ID NO: 2119554 - DNA, 18 bp, Homo sapiens
ctccctagtggcttcctc

SEQ ID NO: 2119555 - DNA, 14 bp, Homo sapiens
ctccctcagtgccc

SEQ ID NO: 2119556 - DNA, 23 bp, Homo sapiens
ctccctcagtgccctcattttat

SEQ ID NO: 2119557 - DNA, 11 bp, Homo sapiens
ctccctcctcg

SEQ ID NO: 2119558 - DNA, 22 bp, Homo sapiens
ctccctctgccccaagcagcca

SEQ ID NO: 2119559 - DNA, 18 bp, Homo sapiens
ctccctctggccctgcct

SEQ ID NO: 2119560 - DNA, 18 bp, Homo sapiens
ctccctgaacctcagttt

SEQ ID NO: 2119561 - DNA, 17 bp, Homo sapiens
ctccctgcccctccctt

SEQ ID NO: 2119562 - DNA, 20 bp, Homo sapiens
ctccctgcccctcccttcaa

SEQ ID NO: 2119563 - DNA, 14 bp, Homo sapiens
ctccctgccctgtc

SEQ ID NO: 2119564 - DNA, 16 bp, Homo sapiens
ctccctgccgcctcaa

SEQ ID NO: 2119565 - DNA, 20 bp, Homo sapiens
ctccctggcatgtcagagcc

SEQ ID NO: 2119566 - DNA, 20 bp, Homo sapiens
ctccctggctctcagaaggt

SEQ ID NO: 2119567 - DNA, 18 bp, Homo sapiens
ctccctgtagctctgcct

SEQ ID NO: 2119568 - DNA, 11 bp, Homo sapiens
ctccctgtcct

SEQ ID NO: 2119569 - DNA, 16 bp, Homo sapiens
ctccctgtcctcctcg

SEQ ID NO: 2119570 - DNA, 18 bp, Homo sapiens
ctccctgtcctcctcgga

SEQ ID NO: 2119571 - DNA, 17 bp, Homo sapiens
ctccctgtgggggtggc

SEQ ID NO: 2119572 - DNA, 21 bp, Homo sapiens
ctccctgtgggggtggccatc

SEQ ID NO: 2119573 - DNA, 23 bp, Homo sapiens
ctccctgtgggggtggccatccc

SEQ ID NO: 2119574 - DNA, 24 bp, Homo sapiens
ctccctgtgggggtggccatccct

SEQ ID NO: 2119575 - DNA, 20 bp, Homo sapiens
ctccctgttatctgctagat

SEQ ID NO: 2119576 - DNA, 19 bp, Homo sapiens
ctcccttaggcattattta

SEQ ID NO: 2119577 - DNA, 20 bp, Homo sapiens
ctcccttcaaccattcccca

SEQ ID NO: 2119578 - DNA, 22 bp, Homo sapiens
ctcccttcaaccattccccatg

SEQ ID NO: 2119579 - DNA, 15 bp, Homo sapiens
ctcccttcctggcct

SEQ ID NO: 2119580 - DNA, 16 bp, Homo sapiens
ctcccttgctcagtgc

SEQ ID NO: 2119581 - DNA, 18 bp, Homo sapiens
ctcccttgctcagtgcct

SEQ ID NO: 2119582 - DNA, 22 bp, Homo sapiens
ctcccttgctcagtgcctcctg

SEQ ID NO: 2119583 - DNA, 15 bp, Homo sapiens
ctccctttccctgag

SEQ ID NO: 2119584 - DNA, 18 bp, Homo sapiens
ctcccttttctttttccc

SEQ ID NO: 2119585 - DNA, 15 bp, Homo sapiens
ctccgaccagacacc

SEQ ID NO: 2119586 - DNA, 15 bp, Homo sapiens
ctccgagaacaacag

SEQ ID NO: 2119587 - DNA, 16 bp, Homo sapiens
ctccgcacacctgtgg

SEQ ID NO: 2119588 - DNA, 14 bp, Homo sapiens
ctccgccattccaa

SEQ ID NO: 2119589 - DNA, 17 bp, Homo sapiens
ctccgccccagacacac

SEQ ID NO: 2119590 - DNA, 19 bp, Homo sapiens
ctccgccttcactccggtg

SEQ ID NO: 2119591 - DNA, 21 bp, Homo sapiens
ctccgccttcactccggtgtg

SEQ ID NO: 2119592 - DNA, 20 bp, Homo sapiens
ctccggcctgatgacagagc

SEQ ID NO: 2119593 - DNA, 20 bp, Homo sapiens
ctccgggaccattgacctca

SEQ ID NO: 2119594 - DNA, 13 bp, Homo sapiens
ctccggggtctgt

SEQ ID NO: 2119595 - DNA, 16 bp, Homo sapiens
ctccggggtctgtgct

SEQ ID NO: 2119596 - DNA, 22 bp, Homo sapiens
ctccggggtctgtgctgtgcct

SEQ ID NO: 2119597 - DNA, 16 bp, Homo sapiens
ctccgggtgtggcctc

SEQ ID NO: 2119598 - DNA, 18 bp, Homo sapiens
ctccgggtgtggcctcag

SEQ ID NO: 2119599 - DNA, 21 bp, Homo sapiens
ctccgggtgtggcctcagccc

SEQ ID NO: 2119600 - DNA, 22 bp, Homo sapiens
ctccgggtgtggcctcagccct

SEQ ID NO: 2119601 - DNA, 23 bp, Homo sapiens
ctccgggtgtggcctcagccctc

SEQ ID NO: 2119602 - DNA, 13 bp, Homo sapiens
ctccggtgtgcct

SEQ ID NO: 2119603 - DNA, 18 bp, Homo sapiens
ctccggtgtgcctgcagc

SEQ ID NO: 2119604 - DNA, 22 bp, Homo sapiens
ctccgtcaggagagacgcagcc

SEQ ID NO: 2119605 - DNA, 20 bp, Homo sapiens
ctccgtcatctgcggggctt

SEQ ID NO: 2119606 - DNA, 18 bp, Homo sapiens
ctccgtcatgaatgcctt

SEQ ID NO: 2119607 - DNA, 17 bp, Homo sapiens
ctccgtccacccaggct

SEQ ID NO: 2119608 - DNA, 20 bp, Homo sapiens
ctccgtccacccaggctgca

SEQ ID NO: 2119609 - DNA, 18 bp, Homo sapiens
ctccgtccaggagcctgg

SEQ ID NO: 2119610 - DNA, 14 bp, Homo sapiens
ctccgtgctgggct

SEQ ID NO: 2119611 - DNA, 17 bp, Homo sapiens
ctccgtttatgggcctt

SEQ ID NO: 2119612 - DNA, 20 bp, Homo sapiens
ctccgtttatgggccttgct

SEQ ID NO: 2119613 - DNA, 15 bp, Homo sapiens
ctcctaaacaaaaac

SEQ ID NO: 2119614 - DNA, 21 bp, Homo sapiens
ctcctaaacccccgctccaga

SEQ ID NO: 2119615 - DNA, 22 bp, Homo sapiens
ctcctaaacccccgctccagat

SEQ ID NO: 2119616 - DNA, 23 bp, Homo sapiens
ctcctaaacccccgctccagatc

SEQ ID NO: 2119617 - DNA, 16 bp, Homo sapiens
ctcctaagcagctggg

SEQ ID NO: 2119618 - DNA, 21 bp, Homo sapiens
ctcctaatttgatcacagtgg

SEQ ID NO: 2119619 - DNA, 22 bp, Homo sapiens
ctcctaatttgatcacagtggc

SEQ ID NO: 2119620 - DNA, 19 bp, Homo sapiens
ctcagagacaggtggccta

SEQ ID NO: 2119621 - DNA, 15 bp, Homo sapiens
ctcagagccacccct

SEQ ID NO: 2119622 - DNA, 16 bp, Homo sapiens
ctcagagcccctccct

SEQ ID NO: 2119623 - DNA, 18 bp, Homo sapiens
ctcagaggcagcaggagg

SEQ ID NO: 2119624 - DNA, 14 bp, Homo sapiens
ctcagaggcccagg

SEQ ID NO: 2119625 - DNA, 15 bp, Homo sapiens
ctcagaggcccagga

SEQ ID NO: 2119626 - DNA, 14 bp, Homo sapiens
ctcagatggagaca

SEQ ID NO: 2119627 - DNA, 15 bp, Homo sapiens
ctcagcaaggtgtga

SEQ ID NO: 2119628 - DNA, 20 bp, Homo sapiens
ctcagcagcagagagccctg

SEQ ID NO: 2119629 - DNA, 18 bp, Homo sapiens
ctcagcagccctcctcac

SEQ ID NO: 2119630 - DNA, 19 bp, Homo sapiens
ctcagcaggaacctgtact

SEQ ID NO: 2119631 - DNA, 12 bp, Homo sapiens
ctcagcatacct

SEQ ID NO: 2119632 - DNA, 13 bp, Homo sapiens
ctcagccaaacac

SEQ ID NO: 2119633 - DNA, 14 bp, Homo sapiens
ctcagccaaacaca

SEQ ID NO: 2119634 - DNA, 17 bp, Homo sapiens
ctcagccaaacacagag

SEQ ID NO: 2119635 - DNA, 18 bp, Homo sapiens
ctcagccaaacacagagc

SEQ ID NO: 2119636 - DNA, 15 bp, Homo sapiens
ctcagccatgaggag

SEQ ID NO: 2119637 - DNA, 14 bp, Homo sapiens
ctcagccctgggcc

SEQ ID NO: 2119638 - DNA, 19 bp, Homo sapiens
ctcagccctgggccccacc

SEQ ID NO: 2119639 - DNA, 23 bp, Homo sapiens
ctcagcccttgcccccatccctc

SEQ ID NO: 2119640 - DNA, 14 bp, Homo sapiens
ctcagcctcccccc

SEQ ID NO: 2119641 - DNA, 14 bp, Homo sapiens
ctcagcctcctcag

SEQ ID NO: 2119642 - DNA, 12 bp, Homo sapiens
ctcagcctggtg

SEQ ID NO: 2119643 - DNA, 19 bp, Homo sapiens
ctcagcctggtgggcctcc

SEQ ID NO: 2119644 - DNA, 23 bp, Homo sapiens
ctcagccttccccttgcccaggg

SEQ ID NO: 2119645 - DNA, 18 bp, Homo sapiens
ctcagccttgaaaaacaa

SEQ ID NO: 2119646 - DNA, 16 bp, Homo sapiens
ctcagcggggacagct

SEQ ID NO: 2119647 - DNA, 20 bp, Homo sapiens
ctcagcggggacagctcctt

SEQ ID NO: 2119648 - DNA, 23 bp, Homo sapiens
ctcagcggggacagctccttctg

SEQ ID NO: 2119649 - DNA, 19 bp, Homo sapiens
ctcagctcccaaggctctg

SEQ ID NO: 2119650 - DNA, 17 bp, Homo sapiens
ctcagctccgtcatctg

SEQ ID NO: 2119651 - DNA, 15 bp, Homo sapiens
ctcagctgcacattc

SEQ ID NO: 2119652 - DNA, 18 bp, Homo sapiens
ctcagctgcacattcctg

SEQ ID NO: 2119653 - DNA, 12 bp, Homo sapiens
ctcagctgccaa

SEQ ID NO: 2119654 - DNA, 16 bp, Homo sapiens
ctcagctgccaagcac

SEQ ID NO: 2119655 - DNA, 17 bp, Homo sapiens
ctcagctgctcgcacag

SEQ ID NO: 2119656 - DNA, 18 bp, Homo sapiens
ctcagctgctcgcacaga

SEQ ID NO: 2119657 - DNA, 16 bp, Homo sapiens
ctcagctgtctgtggc

SEQ ID NO: 2119658 - DNA, 18 bp, Homo sapiens
ctcagcttcatttccgtg

SEQ ID NO: 2119659 - DNA, 19 bp, Homo sapiens
ctcagcttcatttccgtga

SEQ ID NO: 2119660 - DNA, 19 bp, Homo sapiens
ctcaggaagaaaccccaag

SEQ ID NO: 2119661 - DNA, 22 bp, Homo sapiens
ctcaggaagaaaccccaagcag

SEQ ID NO: 2119662 - DNA, 24 bp, Homo sapiens
ctcaggaattgaagatgtaaggaa

SEQ ID NO: 2119663 - DNA, 14 bp, Homo sapiens
ctcaggacacaggc

SEQ ID NO: 2119664 - DNA, 16 bp, Homo sapiens
ctcaggacacaggcct

SEQ ID NO: 2119665 - DNA, 19 bp, Homo sapiens
ctcaggacacaggcctgtg

SEQ ID NO: 2119666 - DNA, 13 bp, Homo sapiens
ctcaggacccagg

SEQ ID NO: 2119667 - DNA, 20 bp, Homo sapiens
ctcaggacggaaggtcagtt

SEQ ID NO: 2119668 - DNA, 14 bp, Homo sapiens
ctcaggagcacagg

SEQ ID NO: 2119669 - DNA, 18 bp, Homo sapiens
ctcaggaggcgaataaat

SEQ ID NO: 2119670 - DNA, 23 bp, Homo sapiens
ctcaggaggcgaataaatgttca

SEQ ID NO: 2119671 - DNA, 13 bp, Homo sapiens
ctcaggaggctga

SEQ ID NO: 2119672 - DNA, 14 bp, Homo sapiens
ctcaggaggctgag

SEQ ID NO: 2119673 - DNA, 15 bp, Homo sapiens
ctcaggaggctgagg

SEQ ID NO: 2119674 - DNA, 18 bp, Homo sapiens
ctcaggaggctgaggcag

SEQ ID NO: 2119675 - DNA, 19 bp, Homo sapiens
ctcaggaggctgaggcaga

SEQ ID NO: 2119676 - DNA, 23 bp, Homo sapiens
ctcaggaggctgaggcagaagaa

SEQ ID NO: 2119677 - DNA, 20 bp, Homo sapiens
ctcaggaggctgaggcagga

SEQ ID NO: 2119678 - DNA, 14 bp, Homo sapiens
ctcaggcaagcccc

SEQ ID NO: 2119679 - DNA, 23 bp, Homo sapiens
ctcaggcagacaagagctgctgt

SEQ ID NO: 2119680 - DNA, 15 bp, Homo sapiens
ctcaggccagtgcca

SEQ ID NO: 2119681 - DNA, 21 bp, Homo sapiens
ctcaggccagtgccaggacag

SEQ ID NO: 2119682 - DNA, 22 bp, Homo sapiens
ctcaggcggggaggaggagctg

SEQ ID NO: 2119683 - DNA, 17 bp, Homo sapiens
ctcaggcttccttggca

SEQ ID NO: 2119684 - DNA, 23 bp, Homo sapiens
ctcagggacagagacacctgcac

SEQ ID NO: 2119685 - DNA, 12 bp, Homo sapiens
ctcagggcccca

SEQ ID NO: 2119686 - DNA, 16 bp, Homo sapiens
ctcagggccccagcac

SEQ ID NO: 2119687 - DNA, 16 bp, Homo sapiens
ctcagggctggagtgc

SEQ ID NO: 2119688 - DNA, 17 bp, Homo sapiens
ctcaggggtggagaagt

SEQ ID NO: 2119689 - DNA, 18 bp, Homo sapiens
ctcaggggtggagaagtg

SEQ ID NO: 2119690 - DNA, 13 bp, Homo sapiens
ctcagggtccaga

SEQ ID NO: 2119691 - DNA, 17 bp, Homo sapiens
ctcagggtccagaccct

SEQ ID NO: 2119692 - DNA, 15 bp, Homo sapiens
ctcaggtagtactgg

SEQ ID NO: 2119693 - DNA, 17 bp, Homo sapiens
ctcaggtgactggagcc

SEQ ID NO: 2119694 - DNA, 22 bp, Homo sapiens
ctcaggtgatccacccacctca

SEQ ID NO: 2119695 - DNA, 15 bp, Homo sapiens
ctcgaactggctgca

SEQ ID NO: 2119696 - DNA, 16 bp, Homo sapiens
ctcgaactggctgcaa

SEQ ID NO: 2119697 - DNA, 23 bp, Homo sapiens
ctcgaagaacaatgtcagaaact

SEQ ID NO: 2119698 - DNA, 14 bp, Homo sapiens
ctcgaagcccttcc

SEQ ID NO: 2119699 - DNA, 16 bp, Homo sapiens
ctcgaagcccttccag

SEQ ID NO: 2119700 - DNA, 15 bp, Homo sapiens
ctcgagaccatcctg

SEQ ID NO: 2119701 - DNA, 17 bp, Homo sapiens
ctcgagcccagatggaa

SEQ ID NO: 2119702 - DNA, 16 bp, Homo sapiens
ctcgagcgccctgcag

SEQ ID NO: 2119703 - DNA, 20 bp, Homo sapiens
ctcgagcgccctgcagaccc

SEQ ID NO: 2119704 - DNA, 18 bp, Homo sapiens
ctcgaggcaccggcgctg

SEQ ID NO: 2119705 - DNA, 19 bp, Homo sapiens
ctcgaggcaccggcgctgc

SEQ ID NO: 2119706 - DNA, 22 bp, Homo sapiens
ctcgaggcaccggcgctgcagg

SEQ ID NO: 2119707 - DNA, 15 bp, Homo sapiens
ctcgaggctcttcca

SEQ ID NO: 2119708 - DNA, 21 bp, Homo sapiens
ctcgcaacccgtgccaagtcc

SEQ ID NO: 2119709 - DNA, 19 bp, Homo sapiens
ctcgcagcaggtgcaagag

SEQ ID NO: 2119710 - DNA, 20 bp, Homo sapiens
ctcgcagcaggtgcaagaga

SEQ ID NO: 2119711 - DNA, 12 bp, Homo sapiens
ctcgcagcctgg

SEQ ID NO: 2119712 - DNA, 22 bp, Homo sapiens
ctcgcagcctggcggggcagga

SEQ ID NO: 2119713 - DNA, 18 bp, Homo sapiens
ctcgcattttctctagct

SEQ ID NO: 2119714 - DNA, 19 bp, Homo sapiens
ctcgccacggggaggggga

SEQ ID NO: 2119715 - DNA, 12 bp, Homo sapiens
ctcgccccaccc

SEQ ID NO: 2119716 - DNA, 14 bp, Homo sapiens
ctcgccccacccag

SEQ ID NO: 2119717 - DNA, 15 bp, Homo sapiens
ctcgccgtctgtgaa

SEQ ID NO: 2119718 - DNA, 13 bp, Homo sapiens
ctcgcctctccca

SEQ ID NO: 2119719 - DNA, 14 bp, Homo sapiens
ctcgcctctcccac

SEQ ID NO: 2119720 - DNA, 14 bp, Homo sapiens
ctcgcctgggccca

SEQ ID NO: 2119721 - DNA, 16 bp, Homo sapiens
ctcgcctgggcccagg

SEQ ID NO: 2119722 - DNA, 21 bp, Homo sapiens
ctcgctccccactctgctctg

SEQ ID NO: 2119723 - DNA, 15 bp, Homo sapiens
ctcgctgcgtctcca

SEQ ID NO: 2119724 - DNA, 14 bp, Homo sapiens
ctcgctgctgctac

SEQ ID NO: 2119725 - DNA, 16 bp, Homo sapiens
ctcgctgctgctacta

SEQ ID NO: 2119726 - DNA, 24 bp, Homo sapiens
ctcgctgctgctactacccgagcc

SEQ ID NO: 2119727 - DNA, 15 bp, Homo sapiens
ctcgctgtcctgctg

SEQ ID NO: 2119728 - DNA, 18 bp, Homo sapiens
ctcggaagccgtctgact

SEQ ID NO: 2119729 - DNA, 13 bp, Homo sapiens
ctcggacccacca

SEQ ID NO: 2119730 - DNA, 16 bp, Homo sapiens
ctcggagagggctgcg

SEQ ID NO: 2119731 - DNA, 13 bp, Homo sapiens
ctcggagcctcat

SEQ ID NO: 2119732 - DNA, 22 bp, Homo sapiens
ctcggagcctcatccgaggcag

SEQ ID NO: 2119733 - DNA, 21 bp, Homo sapiens
ctcggcacctccccggcctct

SEQ ID NO: 2119734 - DNA, 17 bp, Homo sapiens
ctcggccccctccatcg

SEQ ID NO: 2119735 - DNA, 17 bp, Homo sapiens
ctcggggtgcacaggag

SEQ ID NO: 2119736 - DNA, 18 bp, Homo sapiens
ctcggggtgcacaggagg

SEQ ID NO: 2119737 - DNA, 21 bp, Homo sapiens
ctcgggtggctagtcagagag

SEQ ID NO: 2119738 - DNA, 13 bp, Homo sapiens
ctcggtggccatg

SEQ ID NO: 2119739 - DNA, 14 bp, Homo sapiens
ctcggtggccatgc

SEQ ID NO: 2119740 - DNA, 14 bp, Homo sapiens
ctcgtaactggttt

SEQ ID NO: 2119741 - DNA, 20 bp, Homo sapiens
ctcgtatatgtctcaggtcc

SEQ ID NO: 2119742 - DNA, 15 bp, Homo sapiens
ctcgtccacaggggc

SEQ ID NO: 2119743 - DNA, 18 bp, Homo sapiens
ctcgtccacaggggcagg

SEQ ID NO: 2119744 - DNA, 20 bp, Homo sapiens
ctcgtccacaggggcaggcc

SEQ ID NO: 2119745 - DNA, 23 bp, Homo sapiens
ctcgtccacaggggcaggcctgg

SEQ ID NO: 2119746 - DNA, 24 bp, Homo sapiens
ctcgtcctccccctgccagtgcct

SEQ ID NO: 2119747 - DNA, 13 bp, Homo sapiens
ctcgtcctgtccc

SEQ ID NO: 2119748 - DNA, 23 bp, Homo sapiens
ctcgtggccttccccttttgcct

SEQ ID NO: 2119749 - DNA, 14 bp, Homo sapiens
ctcgtgtgatttcc

SEQ ID NO: 2119750 - DNA, 18 bp, Homo sapiens
ctcgtgtgatttcctaca

SEQ ID NO: 2119751 - DNA, 22 bp, Homo sapiens
ctcgtttgctctagtcttgctt

SEQ ID NO: 2119752 - DNA, 14 bp, Homo sapiens
ctcgtttgggagtg

SEQ ID NO: 2119753 - DNA, 18 bp, Homo sapiens
ctctaaaaataaaatgat

SEQ ID NO: 2119754 - DNA, 18 bp, Homo sapiens
ctctaaactgctgttaat

SEQ ID NO: 2119755 - DNA, 15 bp, Homo sapiens
ctctaaatatttcat

SEQ ID NO: 2119756 - DNA, 23 bp, Homo sapiens
ctctaacccccagtgccacagag

SEQ ID NO: 2119757 - DNA, 12 bp, Homo sapiens
ctctaacgcctg

SEQ ID NO: 2119758 - DNA, 16 bp, Homo sapiens
ctctaacgcctgagcc

SEQ ID NO: 2119759 - DNA, 17 bp, Homo sapiens
ctctaacgcctgagccc

SEQ ID NO: 2119760 - DNA, 20 bp, Homo sapiens
ctctaacgcctgagcccagg

SEQ ID NO: 2119761 - DNA, 21 bp, Homo sapiens
ctctaagccacagcttcttca

SEQ ID NO: 2119762 - DNA, 19 bp, Homo sapiens
ctctaagccactcttccaa

SEQ ID NO: 2119763 - DNA, 14 bp, Homo sapiens
ctctaagctggagc

SEQ ID NO: 2119764 - DNA, 13 bp, Homo sapiens
ctctaagtctcca

SEQ ID NO: 2119765 - DNA, 17 bp, Homo sapiens
ctctaattggaagaaat

SEQ ID NO: 2119766 - DNA, 14 bp, Homo sapiens
ctctacgccaaagt

SEQ ID NO: 2119767 - DNA, 22 bp, Homo sapiens
ctctactaaaaatacaaaaaat

SEQ ID NO: 2119768 - DNA, 19 bp, Homo sapiens
ctctactaaaaatacagaa

SEQ ID NO: 2119769 - DNA, 23 bp, Homo sapiens
ctctactacttttactacagtga

SEQ ID NO: 2119770 - DNA, 16 bp, Homo sapiens
ctctactgggaaggct

SEQ ID NO: 2119771 - DNA, 15 bp, Homo sapiens
ctctacttaatgaga

SEQ ID NO: 2119772 - DNA, 19 bp, Homo sapiens
ctctacttagcatgtccct

SEQ ID NO: 2119773 - DNA, 15 bp, Homo sapiens
ctctagaacacccac

SEQ ID NO: 2119774 - DNA, 16 bp, Homo sapiens
ctctagaacacccact

SEQ ID NO: 2119775 - DNA, 17 bp, Homo sapiens
ctctagaacacccactg

SEQ ID NO: 2119776 - DNA, 11 bp, Homo sapiens
ctctagaacat

SEQ ID NO: 2119777 - DNA, 18 bp, Homo sapiens
ctctagaacatgcacatt

SEQ ID NO: 2119778 - DNA, 21 bp, Homo sapiens
ctctagccaggagtctgtgct

SEQ ID NO: 2119779 - DNA, 18 bp, Homo sapiens
ctctagcctggcaacaga

SEQ ID NO: 2119780 - DNA, 20 bp, Homo sapiens
ctctagcctggcaacagagc

SEQ ID NO: 2119781 - DNA, 13 bp, Homo sapiens
ctctagcctgggc

SEQ ID NO: 2119782 - DNA, 14 bp, Homo sapiens
ctctagcctgggca

SEQ ID NO: 2119783 - DNA, 15 bp, Homo sapiens
ctctagcctgggcca

SEQ ID NO: 2119784 - DNA, 14 bp, Homo sapiens
ctctagctggcagg

SEQ ID NO: 2119785 - DNA, 18 bp, Homo sapiens
ctctagctggcaggacac

SEQ ID NO: 2119786 - DNA, 19 bp, Homo sapiens
ctctagctggcaggacaca

SEQ ID NO: 2119787 - DNA, 20 bp, Homo sapiens
ctctaggggtcaggctccat

SEQ ID NO: 2119788 - DNA, 15 bp, Homo sapiens
ctctagtgacttcct

SEQ ID NO: 2119789 - DNA, 13 bp, Homo sapiens
ctctagtgccctc

SEQ ID NO: 2119790 - DNA, 18 bp, Homo sapiens
ctctagtgccctccacag

SEQ ID NO: 2119791 - DNA, 20 bp, Homo sapiens
ctctagtttctttctgttat

SEQ ID NO: 2119792 - DNA, 20 bp, Homo sapiens
ctctagttttcagccttggg

SEQ ID NO: 2119793 - DNA, 13 bp, Homo sapiens
ctctatatataca

SEQ ID NO: 2119794 - DNA, 15 bp, Homo sapiens
ctctatatatacatg

SEQ ID NO: 2119795 - DNA, 14 bp, Homo sapiens
ctcctcccaccacc

SEQ ID NO: 2119796 - DNA, 23 bp, Homo sapiens
ctcctcccaccaccctcccacca

SEQ ID NO: 2119797 - DNA, 12 bp, Homo sapiens
ctcctcccagga

SEQ ID NO: 2119798 - DNA, 15 bp, Homo sapiens
ctcctcccattcccc

SEQ ID NO: 2119799 - DNA, 16 bp, Homo sapiens
ctcctccccttcctgc

SEQ ID NO: 2119800 - DNA, 18 bp, Homo sapiens
ctcctccccttcctgcac

SEQ ID NO: 2119801 - DNA, 15 bp, Homo sapiens
ctcctcccggtgccc

SEQ ID NO: 2119802 - DNA, 17 bp, Homo sapiens
ctcctcccggtgcccaa

SEQ ID NO: 2119803 - DNA, 15 bp, Homo sapiens
ctcctcctcccccag

SEQ ID NO: 2119804 - DNA, 19 bp, Homo sapiens
ctcctccttggtgcctggc

SEQ ID NO: 2119805 - DNA, 14 bp, Homo sapiens
ctcctcctttgcct

SEQ ID NO: 2119806 - DNA, 20 bp, Homo sapiens
ctcctcctttgcctaggagg

SEQ ID NO: 2119807 - DNA, 15 bp, Homo sapiens
ctcctctccctgcac

SEQ ID NO: 2119808 - DNA, 11 bp, Homo sapiens
ctcctctgcca

SEQ ID NO: 2119809 - DNA, 16 bp, Homo sapiens
ctcctctggcccagcc

SEQ ID NO: 2119810 - DNA, 14 bp, Homo sapiens
ctcctctgtccagg

SEQ ID NO: 2119811 - DNA, 17 bp, Homo sapiens
ctcctctgtccagggcc

SEQ ID NO: 2119812 - DNA, 14 bp, Homo sapiens
ctcctctgtctctg

SEQ ID NO: 2119813 - DNA, 17 bp, Homo sapiens
ctcctctgtctctgctc

SEQ ID NO: 2119814 - DNA, 23 bp, Homo sapiens
ctcctctgtctctgctcttgcct

SEQ ID NO: 2119815 - DNA, 20 bp, Homo sapiens
ctcctcttaaaaaataaaaa

SEQ ID NO: 2119816 - DNA, 21 bp, Homo sapiens
ctcctcttaccgtagcctccg

SEQ ID NO: 2119817 - DNA, 23 bp, Homo sapiens
ctcctcttcaactgaccagcctc

SEQ ID NO: 2119818 - DNA, 12 bp, Homo sapiens
ctcctcttgcca

SEQ ID NO: 2119819 - DNA, 16 bp, Homo sapiens
ctcctcttgccactgc

SEQ ID NO: 2119820 - DNA, 16 bp, Homo sapiens
ctcctgacccagtccc

SEQ ID NO: 2119821 - DNA, 14 bp, Homo sapiens
ctcctgacctgagg

SEQ ID NO: 2119822 - DNA, 15 bp, Homo sapiens
ctcctgacctgaggc

SEQ ID NO: 2119823 - DNA, 16 bp, Homo sapiens
ctcctgacctgtcacc

SEQ ID NO: 2119824 - DNA, 20 bp, Homo sapiens
ctcctgagaaggcgaggaga

SEQ ID NO: 2119825 - DNA, 22 bp, Homo sapiens
ctcctgagaaggcgaggagagt

SEQ ID NO: 2119826 - DNA, 19 bp, Homo sapiens
ctcctgagaggtgctgcag

SEQ ID NO: 2119827 - DNA, 19 bp, Homo sapiens
ctcctgagttcaagcgatt

SEQ ID NO: 2119828 - DNA, 13 bp, Homo sapiens
ctcctgatggcca

SEQ ID NO: 2119829 - DNA, 20 bp, Homo sapiens
ctcctgatggccaagagcat

SEQ ID NO: 2119830 - DNA, 17 bp, Homo sapiens
ctcctgatttctctgaa

SEQ ID NO: 2119831 - DNA, 14 bp, Homo sapiens
ctcctgattttgta

SEQ ID NO: 2119832 - DNA, 15 bp, Homo sapiens
ctcctgcccaggaga

SEQ ID NO: 2119833 - DNA, 16 bp, Homo sapiens
ctcctgcccaggagag

SEQ ID NO: 2119834 - DNA, 13 bp, Homo sapiens
ctcctgccctgtt

SEQ ID NO: 2119835 - DNA, 13 bp, Homo sapiens
ctcctgcctactc

SEQ ID NO: 2119836 - DNA, 13 bp, Homo sapiens
ctcctgcctcagc

SEQ ID NO: 2119837 - DNA, 17 bp, Homo sapiens
ctcctgcctcagcctcc

SEQ ID NO: 2119838 - DNA, 17 bp, Homo sapiens
ctcctgccttgatgaag

SEQ ID NO: 2119839 - DNA, 22 bp, Homo sapiens
ctcctgctgaaacacctcccag

SEQ ID NO: 2119840 - DNA, 17 bp, Homo sapiens
ctcctgctgcctaataa

SEQ ID NO: 2119841 - DNA, 17 bp, Homo sapiens
ctcctggaaaggctcag

SEQ ID NO: 2119842 - DNA, 24 bp, Homo sapiens
ctcctggaaaggctcagtctcagg

SEQ ID NO: 2119843 - DNA, 15 bp, Homo sapiens
ctcctggaagctgtg

SEQ ID NO: 2119844 - DNA, 16 bp, Homo sapiens
ctcctggagcatccca

SEQ ID NO: 2119845 - DNA, 15 bp, Homo sapiens
ctcctggccagacgc

SEQ ID NO: 2119846 - DNA, 20 bp, Homo sapiens
ctcctggccggggcccctca

SEQ ID NO: 2119847 - DNA, 19 bp, Homo sapiens
ctcctggcctcaagtgatt

SEQ ID NO: 2119848 - DNA, 23 bp, Homo sapiens
ctcctggctgaggggcttcaacc

SEQ ID NO: 2119849 - DNA, 12 bp, Homo sapiens
ctcctggctgcc

SEQ ID NO: 2119850 - DNA, 11 bp, Homo sapiens
ctcctgggaga

SEQ ID NO: 2119851 - DNA, 13 bp, Homo sapiens
ctcctgggagaga

SEQ ID NO: 2119852 - DNA, 16 bp, Homo sapiens
ctcctgggggtggcag

SEQ ID NO: 2119853 - DNA, 17 bp, Homo sapiens
ctcctgggggtggcagg

SEQ ID NO: 2119854 - DNA, 18 bp, Homo sapiens
ctcctgggggttctttct

SEQ ID NO: 2119855 - DNA, 22 bp, Homo sapiens
ctcctgggggttctttcttcct

SEQ ID NO: 2119856 - DNA, 15 bp, Homo sapiens
ctcctggtcttgaga

SEQ ID NO: 2119857 - DNA, 20 bp, Homo sapiens
ctcctgtataaccccacctt

SEQ ID NO: 2119858 - DNA, 17 bp, Homo sapiens
ctcctgtccctacccac

SEQ ID NO: 2119859 - DNA, 20 bp, Homo sapiens
ctcctgtccctacccactct

SEQ ID NO: 2119860 - DNA, 24 bp, Homo sapiens
ctcctgtccctacccactctttgc

SEQ ID NO: 2119861 - DNA, 18 bp, Homo sapiens
ctcctgtcccttcttggg

SEQ ID NO: 2119862 - DNA, 13 bp, Homo sapiens
ctcctgtcctccc

SEQ ID NO: 2119863 - DNA, 14 bp, Homo sapiens
ctcctgtctgccag

SEQ ID NO: 2119864 - DNA, 16 bp, Homo sapiens
ctcctgtctgccagcc

SEQ ID NO: 2119865 - DNA, 19 bp, Homo sapiens
ctcctgtctgccagccagc

SEQ ID NO: 2119866 - DNA, 23 bp, Homo sapiens
ctcctgtctgccagccagcagcc

SEQ ID NO: 2119867 - DNA, 21 bp, Homo sapiens
ctcctgtctgtcctggaggtg

SEQ ID NO: 2119868 - DNA, 14 bp, Homo sapiens
ctcctgtgcccaca

SEQ ID NO: 2119869 - DNA, 21 bp, Homo sapiens
ctcctgtgcccacatcccagg

SEQ ID NO: 2119870 - DNA, 22 bp, Homo sapiens
ctcctgtgcccacatcccaggc

SEQ ID NO: 2119871 - DNA, 19 bp, Homo sapiens
ctcctgtgcccctcagaga

SEQ ID NO: 2119872 - DNA, 21 bp, Homo sapiens
ctcctgtgcccctcagagagg

SEQ ID NO: 2119873 - DNA, 20 bp, Homo sapiens
ctcctgtgctactttgcctt

SEQ ID NO: 2119874 - DNA, 21 bp, Homo sapiens
ctcctgtgctctggaggctgc

SEQ ID NO: 2119875 - DNA, 17 bp, Homo sapiens
ctcctgtgggagcctcg

SEQ ID NO: 2119876 - DNA, 18 bp, Homo sapiens
ctcctgtgggagcctcgc

SEQ ID NO: 2119877 - DNA, 14 bp, Homo sapiens
ctcctgtgtacagg

SEQ ID NO: 2119878 - DNA, 15 bp, Homo sapiens
ctcctgtgtcttgca

SEQ ID NO: 2119879 - DNA, 21 bp, Homo sapiens
ctcctgtgtgtgcgcctacag

SEQ ID NO: 2119880 - DNA, 20 bp, Homo sapiens
ctccttagagacatcaaaat

SEQ ID NO: 2119881 - DNA, 21 bp, Homo sapiens
ctccttatttatcaacatctt

SEQ ID NO: 2119882 - DNA, 22 bp, Homo sapiens
ctccttcccgccgcccgacccc

SEQ ID NO: 2119883 - DNA, 16 bp, Homo sapiens
ctccttcccttctctc

SEQ ID NO: 2119884 - DNA, 20 bp, Homo sapiens
ctccttcctcagtcctggaa

SEQ ID NO: 2119885 - DNA, 23 bp, Homo sapiens
ctccttccttacccaaactgttc

SEQ ID NO: 2119886 - DNA, 21 bp, Homo sapiens
ctccttcgtgtctctcccacc

SEQ ID NO: 2119887 - DNA, 17 bp, Homo sapiens
ctccttctctgccccca

SEQ ID NO: 2119888 - DNA, 19 bp, Homo sapiens
ctccttgactccttgtggt

SEQ ID NO: 2119889 - DNA, 13 bp, Homo sapiens
ctccttgctctgc

SEQ ID NO: 2119890 - DNA, 14 bp, Homo sapiens
ctccttgctctgca

SEQ ID NO: 2119891 - DNA, 17 bp, Homo sapiens
ctctatatatacatgta

SEQ ID NO: 2119892 - DNA, 22 bp, Homo sapiens
ctctatatttagattgttaaaa

SEQ ID NO: 2119893 - DNA, 21 bp, Homo sapiens
ctctatgccagctcagtccca

SEQ ID NO: 2119894 - DNA, 18 bp, Homo sapiens
ctctattcctgaccctcc

SEQ ID NO: 2119895 - DNA, 20 bp, Homo sapiens
ctctcaagctagccagaggg

SEQ ID NO: 2119896 - DNA, 15 bp, Homo sapiens
ctctcaatatgctta

SEQ ID NO: 2119897 - DNA, 19 bp, Homo sapiens
ctctcaatattcaataaag

SEQ ID NO: 2119898 - DNA, 21 bp, Homo sapiens
ctctcaatattcaataaagct

SEQ ID NO: 2119899 - DNA, 15 bp, Homo sapiens
ctctcactaaacttt

SEQ ID NO: 2119900 - DNA, 16 bp, Homo sapiens
ctctcagaaggtattc

SEQ ID NO: 2119901 - DNA, 23 bp, Homo sapiens
ctctcagccaacgagtaatttat

SEQ ID NO: 2119902 - DNA, 23 bp, Homo sapiens
ctattccctaactctcgggacct

SEQ ID NO: 2119903 - DNA, 16 bp, Homo sapiens
ctattcctgaccctcc

SEQ ID NO: 2119904 - DNA, 18 bp, Homo sapiens
ctattctctcctcagact

SEQ ID NO: 2119905 - DNA, 19 bp, Homo sapiens
ctattgaacctaggacttg

SEQ ID NO: 2119906 - DNA, 14 bp, Homo sapiens
ctattgagaaagac

SEQ ID NO: 2119907 - DNA, 19 bp, Homo sapiens
ctattgatgtttccagaaa

SEQ ID NO: 2119908 - DNA, 17 bp, Homo sapiens
ctattgcactccagtct

SEQ ID NO: 2119909 - DNA, 18 bp, Homo sapiens
ctattgcagttatagaaa

SEQ ID NO: 2119910 - DNA, 14 bp, Homo sapiens
ctattgcatgtaaa

SEQ ID NO: 2119911 - DNA, 15 bp, Homo sapiens
ctattgcatgtaaaa

SEQ ID NO: 2119912 - DNA, 17 bp, Homo sapiens
ctattgggagggatgag

SEQ ID NO: 2119913 - DNA, 15 bp, Homo sapiens
ctattgtaaatttgg

SEQ ID NO: 2119914 - DNA, 22 bp, Homo sapiens
ctattgtgcaatgtaaatattt

SEQ ID NO: 2119915 - DNA, 16 bp, Homo sapiens
ctattgttgtgggctt

SEQ ID NO: 2119916 - DNA, 15 bp, Homo sapiens
ctatttaaaaaagag

SEQ ID NO: 2119917 - DNA, 13 bp, Homo sapiens
ctatttaaaaaat

SEQ ID NO: 2119918 - DNA, 11 bp, Homo sapiens
ctatttatgaa

SEQ ID NO: 2119919 - DNA, 21 bp, Homo sapiens
ctatttattcattcagtgaga

SEQ ID NO: 2119920 - DNA, 19 bp, Homo sapiens
ctatttattccctgttaaa

SEQ ID NO: 2119921 - DNA, 13 bp, Homo sapiens
ctatttattgggg

SEQ ID NO: 2119922 - DNA, 16 bp, Homo sapiens
ctatttattggggtgc

SEQ ID NO: 2119923 - DNA, 22 bp, Homo sapiens
ctatttctacacagtgggaact

SEQ ID NO: 2119924 - DNA, 12 bp, Homo sapiens
ctatttctctct

SEQ ID NO: 2119925 - DNA, 15 bp, Homo sapiens
ctatttctctctttc

SEQ ID NO: 2119926 - DNA, 17 bp, Homo sapiens
ctatttgtctttcagga

SEQ ID NO: 2119927 - DNA, 23 bp, Homo sapiens
ctatttgttttcttctgtatgtt

SEQ ID NO: 2119928 - DNA, 14 bp, Homo sapiens
ctattttaaaacca

SEQ ID NO: 2119929 - DNA, 14 bp, Homo sapiens
ctattttaaagctg

SEQ ID NO: 2119930 - DNA, 19 bp, Homo sapiens
ctattttaagacgtgaatg

SEQ ID NO: 2119931 - DNA, 16 bp, Homo sapiens
ctattttatttgtatt

SEQ ID NO: 2119932 - DNA, 14 bp, Homo sapiens
ctatttttcaaatt

SEQ ID NO: 2119933 - DNA, 13 bp, Homo sapiens
ctatttttgagga

SEQ ID NO: 2119934 - DNA, 15 bp, Homo sapiens
ctattttttaataaa

SEQ ID NO: 2119935 - DNA, 13 bp, Homo sapiens
ctcaaaactgcac

SEQ ID NO: 2119936 - DNA, 17 bp, Homo sapiens
ctcaaaactgcactgtc

SEQ ID NO: 2119937 - DNA, 16 bp, Homo sapiens
ctcaaaacttaacata

SEQ ID NO: 2119938 - DNA, 22 bp, Homo sapiens
ctcaaaagcacttgttccttct

SEQ ID NO: 2119939 - DNA, 18 bp, Homo sapiens
ctcaaaatatttgtacat

SEQ ID NO: 2119940 - DNA, 14 bp, Homo sapiens
ctcaaaccctgtgg

SEQ ID NO: 2119941 - DNA, 13 bp, Homo sapiens
ctcaaactgggta

SEQ ID NO: 2119942 - DNA, 22 bp, Homo sapiens
ctcaaagagactccaagattca

SEQ ID NO: 2119943 - DNA, 19 bp, Homo sapiens
ctcaaataaaaagtgcttt

SEQ ID NO: 2119944 - DNA, 22 bp, Homo sapiens
ctcaaatacatacctactgact

SEQ ID NO: 2119945 - DNA, 22 bp, Homo sapiens
ctcaaatctattcagacaagca

SEQ ID NO: 2119946 - DNA, 16 bp, Homo sapiens
ctcaaatgctaaatgc

SEQ ID NO: 2119947 - DNA, 24 bp, Homo sapiens
ctcaaatgctaaatgcaaacactg

SEQ ID NO: 2119948 - DNA, 23 bp, Homo sapiens
ctcaaattaatctttctttacct

SEQ ID NO: 2119949 - DNA, 19 bp, Homo sapiens
ctcaacaaagcacagtgtt

SEQ ID NO: 2119950 - DNA, 18 bp, Homo sapiens
ctcaacaataaagactga

SEQ ID NO: 2119951 - DNA, 13 bp, Homo sapiens
ctatacctgtgtt

SEQ ID NO: 2119952 - DNA, 12 bp, Homo sapiens
ctatagagaaaa

SEQ ID NO: 2119953 - DNA, 22 bp, Homo sapiens
ctatagagaaaaactttcattt

SEQ ID NO: 2119954 - DNA, 19 bp, Homo sapiens
ctatagagagggggctctc

SEQ ID NO: 2119955 - DNA, 18 bp, Homo sapiens
ctatagcctaggtgacag

SEQ ID NO: 2119956 - DNA, 20 bp, Homo sapiens
ctatagctcttctatttaaa

SEQ ID NO: 2119957 - DNA, 21 bp, Homo sapiens
ctatagctcttctatttaaaa

SEQ ID NO: 2119958 - DNA, 15 bp, Homo sapiens
ctataggctggagaa

SEQ ID NO: 2119959 - DNA, 18 bp, Homo sapiens
ctataggctggagaagct

SEQ ID NO: 2119960 - DNA, 22 bp, Homo sapiens
ctataggctggagaagctcacc

SEQ ID NO: 2119961 - DNA, 15 bp, Homo sapiens
ctataggtgctacaa

SEQ ID NO: 2119962 - DNA, 20 bp, Homo sapiens
ctataggtgctacaaaaaca

SEQ ID NO: 2119963 - DNA, 21 bp, Homo sapiens
ctataggtgctacaaaaacac

SEQ ID NO: 2119964 - DNA, 17 bp, Homo sapiens
ctatagttattgtttta

SEQ ID NO: 2119965 - DNA, 16 bp, Homo sapiens
ctatatacatgtgtgt

SEQ ID NO: 2119966 - DNA, 17 bp, Homo sapiens
ctatatacatgtgtgta

SEQ ID NO: 2119967 - DNA, 15 bp, Homo sapiens
ctatatagagatgtt

SEQ ID NO: 2119968 - DNA, 19 bp, Homo sapiens
ctatatagctgatcagttt

SEQ ID NO: 2119969 - DNA, 22 bp, Homo sapiens
ctatatagtttattgacaataa

SEQ ID NO: 2119970 - DNA, 17 bp, Homo sapiens
ctatatatacatgtata

SEQ ID NO: 2119971 - DNA, 18 bp, Homo sapiens
ctatatatacatgtatag

SEQ ID NO: 2119972 - DNA, 19 bp, Homo sapiens
ctatatatacatgtatagt

SEQ ID NO: 2119973 - DNA, 22 bp, Homo sapiens
ctatatcatcctttatccctga

SEQ ID NO: 2119974 - DNA, 20 bp, Homo sapiens
ctatatcatgctttaaagtg

SEQ ID NO: 2119975 - DNA, 17 bp, Homo sapiens
ctatatgatttatagtt

SEQ ID NO: 2119976 - DNA, 18 bp, Homo sapiens
ctatatgatttatagttt

SEQ ID NO: 2119977 - DNA, 21 bp, Homo sapiens
ctatatgtagtataaagaaaa

SEQ ID NO: 2119978 - DNA, 13 bp, Homo sapiens
ctatattaaagtg

SEQ ID NO: 2119979 - DNA, 15 bp, Homo sapiens
ctatattaaagtgtt

SEQ ID NO: 2119980 - DNA, 16 bp, Homo sapiens
ctatatttaacaagat

SEQ ID NO: 2119981 - DNA, 14 bp, Homo sapiens
ctatcaaaacatat

SEQ ID NO: 2119982 - DNA, 15 bp, Homo sapiens
ctatcaaaacatatc

SEQ ID NO: 2119983 - DNA, 19 bp, Homo sapiens
ctatcaaaacatatcaatt

SEQ ID NO: 2119984 - DNA, 19 bp, Homo sapiens
ctatcaacctaagcaacag

SEQ ID NO: 2119985 - DNA, 21 bp, Homo sapiens
ctatcaatagtcaagaaaaat

SEQ ID NO: 2119986 - DNA, 14 bp, Homo sapiens
ctatcaatatttaa

SEQ ID NO: 2119987 - DNA, 17 bp, Homo sapiens
ctatcacatacaatttg

SEQ ID NO: 2119988 - DNA, 14 bp, Homo sapiens
ctatcatggagtga

SEQ ID NO: 2119989 - DNA, 15 bp, Homo sapiens
ctatccacccagccc

SEQ ID NO: 2119990 - DNA, 19 bp, Homo sapiens
ctatccacccagcccattc

SEQ ID NO: 2119991 - DNA, 14 bp, Homo sapiens
ctatccacctgggg

SEQ ID NO: 2119992 - DNA, 22 bp, Homo sapiens
ctatccatcatgaccagcaaat

SEQ ID NO: 2119993 - DNA, 21 bp, Homo sapiens
ctatccttggagagcagctgg

SEQ ID NO: 2119994 - DNA, 14 bp, Homo sapiens
ctatcgactttata

SEQ ID NO: 2119995 - DNA, 17 bp, Homo sapiens
ctatctgcatttataaa

SEQ ID NO: 2119996 - DNA, 18 bp, Homo sapiens
ctatctgcatttataaat

SEQ ID NO: 2119997 - DNA, 21 bp, Homo sapiens
ctatcttatatagtttactat

SEQ ID NO: 2119998 - DNA, 13 bp, Homo sapiens
ctatgaaatgaaa

SEQ ID NO: 2119999 - DNA, 16 bp, Homo sapiens
ctatgactgctcccca

SEQ ID NO: 2120000 - DNA, 20 bp, Homo sapiens
ctatgacttgggcaccccca

SEQ ID NO: 2120001 - DNA, 23 bp, Homo sapiens
ctatgacttgggcacccccagcc

SEQ ID NO: 2120002 - DNA, 21 bp, Homo sapiens
ctatgagaacaagtcacagct

SEQ ID NO: 2120003 - DNA, 21 bp, Homo sapiens
ctatgagaattgggattacat

SEQ ID NO: 2120004 - DNA, 14 bp, Homo sapiens
ctatgatcacagtg

SEQ ID NO: 2120005 - DNA, 17 bp, Homo sapiens
ctatgatcacagtgact

SEQ ID NO: 2120006 - DNA, 15 bp, Homo sapiens
ctatgatctcaggag

SEQ ID NO: 2120007 - DNA, 18 bp, Homo sapiens
ctatgattatgccactgc

SEQ ID NO: 2120008 - DNA, 14 bp, Homo sapiens
ctaggattcctccc

SEQ ID NO: 2120009 - DNA, 15 bp, Homo sapiens
ctaggattcctcccc

SEQ ID NO: 2120010 - DNA, 23 bp, Homo sapiens
ctaggattcctcccccagagcca

SEQ ID NO: 2120011 - DNA, 22 bp, Homo sapiens
ctaggccaaatgcacaagctca

SEQ ID NO: 2120012 - DNA, 17 bp, Homo sapiens
ctaggccatttgtattt

SEQ ID NO: 2120013 - DNA, 13 bp, Homo sapiens
ctaggcctggcca

SEQ ID NO: 2120014 - DNA, 14 bp, Homo sapiens
ctaggcctggccag

SEQ ID NO: 2120015 - DNA, 19 bp, Homo sapiens
ctaggcctggccagatgca

SEQ ID NO: 2120016 - DNA, 20 bp, Homo sapiens
ctaggcgagtgccaggactc

SEQ ID NO: 2120017 - DNA, 13 bp, Homo sapiens
ctaggctccaccc

SEQ ID NO: 2120018 - DNA, 17 bp, Homo sapiens
ctaggctgagctggcat

SEQ ID NO: 2120019 - DNA, 13 bp, Homo sapiens
ctaggctgccccg

SEQ ID NO: 2120020 - DNA, 10 bp, Homo sapiens
ctagggagcc

SEQ ID NO: 2120021 - DNA, 14 bp, Homo sapiens
ctaggggatgaggg

SEQ ID NO: 2120022 - DNA, 17 bp, Homo sapiens
ctaggtaggaaatgtgg

SEQ ID NO: 2120023 - DNA, 14 bp, Homo sapiens
ctaggtgacagagt

SEQ ID NO: 2120024 - DNA, 12 bp, Homo sapiens
ctaggtgctgga

SEQ ID NO: 2120025 - DNA, 13 bp, Homo sapiens
ctaggttctaaaa

SEQ ID NO: 2120026 - DNA, 14 bp, Homo sapiens
ctagtatatgtcag

SEQ ID NO: 2120027 - DNA, 21 bp, Homo sapiens
ctagtatatgtcagacatgaa

SEQ ID NO: 2120028 - DNA, 11 bp, Homo sapiens
ctagtatatta

SEQ ID NO: 2120029 - DNA, 23 bp, Homo sapiens
ctagtattccagacctgaagaat

SEQ ID NO: 2120030 - DNA, 13 bp, Homo sapiens
ctagtcagagaga

SEQ ID NO: 2120031 - DNA, 16 bp, Homo sapiens
ctagtcagagagagtg

SEQ ID NO: 2120032 - DNA, 19 bp, Homo sapiens
ctagtccttggtctgctgg

SEQ ID NO: 2120033 - DNA, 16 bp, Homo sapiens
ctagtgacccacatgc

SEQ ID NO: 2120034 - DNA, 19 bp, Homo sapiens
ctagtgatgtttttatgat

SEQ ID NO: 2120035 - DNA, 17 bp, Homo sapiens
ctagtgctattctgtgt

SEQ ID NO: 2120036 - DNA, 16 bp, Homo sapiens
ctagtggaaatgagcg

SEQ ID NO: 2120037 - DNA, 22 bp, Homo sapiens
ctagtggcaataagttccatgt

SEQ ID NO: 2120038 - DNA, 21 bp, Homo sapiens
ctagtggggtctccctctcct

SEQ ID NO: 2120039 - DNA, 19 bp, Homo sapiens
ctagtgtaacactgcaaga

SEQ ID NO: 2120040 - DNA, 18 bp, Homo sapiens
ctagtgtgagtggcagcc

SEQ ID NO: 2120041 - DNA, 20 bp, Homo sapiens
ctagtgtgagtggcagccat

SEQ ID NO: 2120042 - DNA, 21 bp, Homo sapiens
ctagtgtgagtggcagccatg

SEQ ID NO: 2120043 - DNA, 23 bp, Homo sapiens
ctagtgtgagtggcagccatgcc

SEQ ID NO: 2120044 - DNA, 16 bp, Homo sapiens
ctagttagcaggaaat

SEQ ID NO: 2120045 - DNA, 20 bp, Homo sapiens
ctagttagcaggaaatagtg

SEQ ID NO: 2120046 - DNA, 23 bp, Homo sapiens
ctagttccccgtgaacttccttt

SEQ ID NO: 2120047 - DNA, 15 bp, Homo sapiens
ctagttgttatcaat

SEQ ID NO: 2120048 - DNA, 14 bp, Homo sapiens
ctagtttattttgt

SEQ ID NO: 2120049 - DNA, 14 bp, Homo sapiens
ctagtttccagtgg

SEQ ID NO: 2120050 - DNA, 15 bp, Homo sapiens
ctagtttctttctgt

SEQ ID NO: 2120051 - DNA, 16 bp, Homo sapiens
ctataaaatgcccatt

SEQ ID NO: 2120052 - DNA, 18 bp, Homo sapiens
ctataaacattaaaagaa

SEQ ID NO: 2120053 - DNA, 16 bp, Homo sapiens
ctataaactactgtaa

SEQ ID NO: 2120054 - DNA, 22 bp, Homo sapiens
ctataaactactgtaattaagt

SEQ ID NO: 2120055 - DNA, 21 bp, Homo sapiens
ctataaggagagttcaagcct

SEQ ID NO: 2120056 - DNA, 16 bp, Homo sapiens
ctataatgtgtgtatg

SEQ ID NO: 2120057 - DNA, 12 bp, Homo sapiens
ctatacaacaat

SEQ ID NO: 2120058 - DNA, 13 bp, Homo sapiens
ctatacaacaatg

SEQ ID NO: 2120059 - DNA, 16 bp, Homo sapiens
ctacagacttctccag

SEQ ID NO: 2120060 - DNA, 21 bp, Homo sapiens
ctacagacttctccagaccca

SEQ ID NO: 2120061 - DNA, 18 bp, Homo sapiens
ctacagaggccatgggcc

SEQ ID NO: 2120062 - DNA, 20 bp, Homo sapiens
ctacagaggccatgggcctc

SEQ ID NO: 2120063 - DNA, 22 bp, Homo sapiens
ctacagaggccatgggcctcct

SEQ ID NO: 2120064 - DNA, 14 bp, Homo sapiens
ctacagataattta

SEQ ID NO: 2120065 - DNA, 20 bp, Homo sapiens
ctacagccagaagcccatgg

SEQ ID NO: 2120066 - DNA, 14 bp, Homo sapiens
ctacagcctcagaa

SEQ ID NO: 2120067 - DNA, 17 bp, Homo sapiens
ctacaggcacccaccat

SEQ ID NO: 2120068 - DNA, 23 bp, Homo sapiens
ctacagttagggttgagttactt

SEQ ID NO: 2120069 - DNA, 22 bp, Homo sapiens
ctacagttgttttttgaaaaca

SEQ ID NO: 2120070 - DNA, 16 bp, Homo sapiens
ctacatagttattcta

SEQ ID NO: 2120071 - DNA, 22 bp, Homo sapiens
ctacattataaatgtctcttta

SEQ ID NO: 2120072 - DNA, 15 bp, Homo sapiens
ctacattccctggcc

SEQ ID NO: 2120073 - DNA, 16 bp, Homo sapiens
ctacattccctggcct

SEQ ID NO: 2120074 - DNA, 11 bp, Homo sapiens
ctacattcctc

SEQ ID NO: 2120075 - DNA, 14 bp, Homo sapiens
ctacattcctcagc

SEQ ID NO: 2120076 - DNA, 17 bp, Homo sapiens
ctacattcctcagctgc

SEQ ID NO: 2120077 - DNA, 18 bp, Homo sapiens
ctacattcctcagctgcc

SEQ ID NO: 2120078 - DNA, 22 bp, Homo sapiens
ctacattcctcagctgccaagc

SEQ ID NO: 2120079 - DNA, 13 bp, Homo sapiens
ctaccaaatataa

SEQ ID NO: 2120080 - DNA, 16 bp, Homo sapiens
ctaccaaatataaact

SEQ ID NO: 2120081 - DNA, 18 bp, Homo sapiens
ctaccaaatataaacttg

SEQ ID NO: 2120082 - DNA, 17 bp, Homo sapiens
ctaccagctaactccag

SEQ ID NO: 2120083 - DNA, 12 bp, Homo sapiens
ctaccatttcag

SEQ ID NO: 2120084 - DNA, 13 bp, Homo sapiens
ctacccaaccact

SEQ ID NO: 2120085 - DNA, 14 bp, Homo sapiens
ctacccaaccactc

SEQ ID NO: 2120086 - DNA, 14 bp, Homo sapiens
ctacccactctttg

SEQ ID NO: 2120087 - DNA, 22 bp, Homo sapiens
ctacccagagccttctcctgcc

SEQ ID NO: 2120088 - DNA, 15 bp, Homo sapiens
ctacccagcgagccc

SEQ ID NO: 2120089 - DNA, 17 bp, Homo sapiens
ctacccagcgagccctg

SEQ ID NO: 2120090 - DNA, 13 bp, Homo sapiens
ctaccccaccacg

SEQ ID NO: 2120091 - DNA, 13 bp, Homo sapiens
ctacccgagccca

SEQ ID NO: 2120092 - DNA, 15 bp, Homo sapiens
ctacccgagcccagc

SEQ ID NO: 2120093 - DNA, 16 bp, Homo sapiens
ctacccgagcccagct

SEQ ID NO: 2120094 - DNA, 14 bp, Homo sapiens
ctaccctcccccag

SEQ ID NO: 2120095 - DNA, 19 bp, Homo sapiens
ctaccctggtaggaaagca

SEQ ID NO: 2120096 - DNA, 14 bp, Homo sapiens
ctacccttgtaccc

SEQ ID NO: 2120097 - DNA, 21 bp, Homo sapiens
ctaccgacctgtctccctggg

SEQ ID NO: 2120098 - DNA, 19 bp, Homo sapiens
ctaccgagtctcttctcca

SEQ ID NO: 2120099 - DNA, 21 bp, Homo sapiens
ctaccgagtctcttctccact

SEQ ID NO: 2120100 - DNA, 22 bp, Homo sapiens
ctaccgagtctcttctccactg

SEQ ID NO: 2120101 - DNA, 18 bp, Homo sapiens
ctaccgttcccaaattgg

SEQ ID NO: 2120102 - DNA, 13 bp, Homo sapiens
ctacctcacagaa

SEQ ID NO: 2120103 - DNA, 17 bp, Homo sapiens
ctacctcactggggtcc

SEQ ID NO: 2120104 - DNA, 12 bp, Homo sapiens
ctacctcagcct

SEQ ID NO: 2120105 - DNA, 14 bp, Homo sapiens
ctacctgaggccta

SEQ ID NO: 2120106 - DNA, 22 bp, Homo sapiens
ctacctgaggcctatctgagac

SEQ ID NO: 2120107 - DNA, 13 bp, Homo sapiens
ctacctgccctct

SEQ ID NO: 2120108 - DNA, 16 bp, Homo sapiens
ctacctgccctctctc

SEQ ID NO: 2120109 - DNA, 19 bp, Homo sapiens
ctaccttaaaatgtaaaac

SEQ ID NO: 2120110 - DNA, 14 bp, Homo sapiens
ctaccttatcaggc

SEQ ID NO: 2120111 - DNA, 15 bp, Homo sapiens
ctaccttatcaggca

SEQ ID NO: 2120112 - DNA, 22 bp, Homo sapiens
ctaccttctctacccatctccc

SEQ ID NO: 2120113 - DNA, 14 bp, Homo sapiens
ctaccttctgacct

SEQ ID NO: 2120114 - DNA, 17 bp, Homo sapiens
ctacgtacatgtgaggc

SEQ ID NO: 2120115 - DNA, 16 bp, Homo sapiens
ctactaaaaatacaaa

SEQ ID NO: 2120116 - DNA, 12 bp, Homo sapiens
ctactaaagtgc

SEQ ID NO: 2120117 - DNA, 15 bp, Homo sapiens
ctactacccgagccc

SEQ ID NO: 2120118 - DNA, 17 bp, Homo sapiens
ctactacccgagcccag

SEQ ID NO: 2120119 - DNA, 15 bp, Homo sapiens
ctactagatgtcttt

SEQ ID NO: 2120120 - DNA, 14 bp, Homo sapiens
ctactcacacaggc

SEQ ID NO: 2120121 - DNA, 15 bp, Homo sapiens
ctactcacacaggca

SEQ ID NO: 2120122 - DNA, 17 bp, Homo sapiens
ctactcagcagccctcc

SEQ ID NO: 2120123 - DNA, 19 bp, Homo sapiens
ctactcagcagccctcctc

SEQ ID NO: 2120124 - DNA, 17 bp, Homo sapiens
ctactcagctctcctgc

SEQ ID NO: 2120125 - DNA, 13 bp, Homo sapiens
ctactcaggaggc

SEQ ID NO: 2120126 - DNA, 23 bp, Homo sapiens
ctactcaggaggctgaggcagaa

SEQ ID NO: 2120127 - DNA, 19 bp, Homo sapiens
ctactcataagttggacca

SEQ ID NO: 2120128 - DNA, 21 bp, Homo sapiens
ctactcataagttggaccaga

SEQ ID NO: 2120129 - DNA, 14 bp, Homo sapiens
ctactcccctgggc

SEQ ID NO: 2120130 - DNA, 16 bp, Homo sapiens
ctactcctacctcagc

SEQ ID NO: 2120131 - DNA, 16 bp, Homo sapiens
cggtaggccaagctga

SEQ ID NO: 2120132 - DNA, 20 bp, Homo sapiens
cggtcagatttgctgttcac

SEQ ID NO: 2120133 - DNA, 15 bp, Homo sapiens
cggtcatgtgtgcat

SEQ ID NO: 2120134 - DNA, 14 bp, Homo sapiens
cggtcccacactgg

SEQ ID NO: 2120135 - DNA, 21 bp, Homo sapiens
cggtcctggccccagccccca

SEQ ID NO: 2120136 - DNA, 17 bp, Homo sapiens
cggtcctttaggcagcc

SEQ ID NO: 2120137 - DNA, 16 bp, Homo sapiens
cggtgaaatccaggtc

SEQ ID NO: 2120138 - DNA, 20 bp, Homo sapiens
cggtgcctgggtggggctgc

SEQ ID NO: 2120139 - DNA, 15 bp, Homo sapiens
cggtgctctggcggc

SEQ ID NO: 2120140 - DNA, 20 bp, Homo sapiens
cggtggctcacgcctgtaat

SEQ ID NO: 2120141 - DNA, 14 bp, Homo sapiens
cggtgggacagccc

SEQ ID NO: 2120142 - DNA, 19 bp, Homo sapiens
cggtgggacagccccaggg

SEQ ID NO: 2120143 - DNA, 18 bp, Homo sapiens
cggtgtctggaaaagcac

SEQ ID NO: 2120144 - DNA, 20 bp, Homo sapiens
cggtgtctggaaaagcactt

SEQ ID NO: 2120145 - DNA, 15 bp, Homo sapiens
cggtgtgcctgcagc

SEQ ID NO: 2120146 - DNA, 20 bp, Homo sapiens
cggtgtgcctgcagccccgc

SEQ ID NO: 2120147 - DNA, 13 bp, Homo sapiens
cggtgttgcagag

SEQ ID NO: 2120148 - DNA, 20 bp, Homo sapiens
cggttcaggaaaattgaatg

SEQ ID NO: 2120149 - DNA, 19 bp, Homo sapiens
cggttcatcaattttcact

SEQ ID NO: 2120150 - DNA, 12 bp, Homo sapiens
cggtttctgagc

SEQ ID NO: 2120151 - DNA, 16 bp, Homo sapiens
cgtaaaaatgatttca

SEQ ID NO: 2120152 - DNA, 13 bp, Homo sapiens
cgtaatgggcctg

SEQ ID NO: 2120153 - DNA, 14 bp, Homo sapiens
cgtaatgggcctgc

SEQ ID NO: 2120154 - DNA, 12 bp, Homo sapiens
cgtaattttatt

SEQ ID NO: 2120155 - DNA, 18 bp, Homo sapiens
cgtaattttattattaga

SEQ ID NO: 2120156 - DNA, 14 bp, Homo sapiens
cgtacatgtgaggc

SEQ ID NO: 2120157 - DNA, 18 bp, Homo sapiens
cgtacccccgtggtcttt

SEQ ID NO: 2120158 - DNA, 21 bp, Homo sapiens
cgtacccccgtggtctttgaa

SEQ ID NO: 2120159 - DNA, 21 bp, Homo sapiens
cgtagtcagcgcagtttagca

SEQ ID NO: 2120160 - DNA, 13 bp, Homo sapiens
cgtagttccctga

SEQ ID NO: 2120161 - DNA, 14 bp, Homo sapiens
cgtagttccctgaa

SEQ ID NO: 2120162 - DNA, 22 bp, Homo sapiens
cgtagttccctgaaaacccaga

SEQ ID NO: 2120163 - DNA, 22 bp, Homo sapiens
cgtatcatttctaattttaagt

SEQ ID NO: 2120164 - DNA, 21 bp, Homo sapiens
cgtatttatatttggaaagag

SEQ ID NO: 2120165 - DNA, 22 bp, Homo sapiens
cgtattttaaaagccacataga

SEQ ID NO: 2120166 - DNA, 22 bp, Homo sapiens
cgtcaaaacagattgtttgcaa

SEQ ID NO: 2120167 - DNA, 23 bp, Homo sapiens
cgtcaggagagacgcagccctgg

SEQ ID NO: 2120168 - DNA, 23 bp, Homo sapiens
cgtcagtagtttgagaccagcct

SEQ ID NO: 2120169 - DNA, 24 bp, Homo sapiens
cgtcagtagtttgagaccagcctg

SEQ ID NO: 2120170 - DNA, 19 bp, Homo sapiens
cgtcatcacttttcagtga

SEQ ID NO: 2120171 - DNA, 18 bp, Homo sapiens
cgtcatcggaggctgggc

SEQ ID NO: 2120172 - DNA, 19 bp, Homo sapiens
cgtcatggcttaatgttta

SEQ ID NO: 2120173 - DNA, 20 bp, Homo sapiens
cgtcatggcttaatgtttat

SEQ ID NO: 2120174 - DNA, 14 bp, Homo sapiens
cgtccacaggggca

SEQ ID NO: 2120175 - DNA, 15 bp, Homo sapiens
cgtccatggcaccag

SEQ ID NO: 2120176 - DNA, 17 bp, Homo sapiens
cgtccatggcaccagcc

SEQ ID NO: 2120177 - DNA, 22 bp, Homo sapiens
cgtcccaaacagagggccacac

SEQ ID NO: 2120178 - DNA, 21 bp, Homo sapiens
cgtcccttggaaagttcagcc

SEQ ID NO: 2120179 - DNA, 22 bp, Homo sapiens
cgtcccttggaaagttcagcca

SEQ ID NO: 2120180 - DNA, 13 bp, Homo sapiens
cgtcctccccctg

SEQ ID NO: 2120181 - DNA, 11 bp, Homo sapiens
cgtcctggaat

SEQ ID NO: 2120182 - DNA, 13 bp, Homo sapiens
cgtcctgtcccag

SEQ ID NO: 2120183 - DNA, 16 bp, Homo sapiens
cgtccttactcctgtg

SEQ ID NO: 2120184 - DNA, 17 bp, Homo sapiens
cgtccttactcctgtgg

SEQ ID NO: 2120185 - DNA, 20 bp, Homo sapiens
cgtctcacatttttacttgg

SEQ ID NO: 2120186 - DNA, 15 bp, Homo sapiens
cgtctccctaaaata

SEQ ID NO: 2120187 - DNA, 17 bp, Homo sapiens
cgtctccctaaaataaa

SEQ ID NO: 2120188 - DNA, 19 bp, Homo sapiens
cgtctctctttctccctca

SEQ ID NO: 2120189 - DNA, 14 bp, Homo sapiens
cgtctgactccaga

SEQ ID NO: 2120190 - DNA, 16 bp, Homo sapiens
cgtctgactccagagt

SEQ ID NO: 2120191 - DNA, 17 bp, Homo sapiens
cgtctgactccagagtc

SEQ ID NO: 2120192 - DNA, 18 bp, Homo sapiens
cgtctgactccagagtct

SEQ ID NO: 2120193 - DNA, 19 bp, Homo sapiens
cgtctgactccagagtctg

SEQ ID NO: 2120194 - DNA, 23 bp, Homo sapiens
cgtctgactccagagtctgagcc

SEQ ID NO: 2120195 - DNA, 13 bp, Homo sapiens
cgtctgccaggcc

SEQ ID NO: 2120196 - DNA, 15 bp, Homo sapiens
cgtctgccccaccct

SEQ ID NO: 2120197 - DNA, 14 bp, Homo sapiens
cgtctggtgttctc

SEQ ID NO: 2120198 - DNA, 11 bp, Homo sapiens
cgtctgtccca

SEQ ID NO: 2120199 - DNA, 13 bp, Homo sapiens
cgtcttcagccta

SEQ ID NO: 2120200 - DNA, 14 bp, Homo sapiens
cgtcttcagcctag

SEQ ID NO: 2120201 - DNA, 15 bp, Homo sapiens
cgtcttcagcctagc

SEQ ID NO: 2120202 - DNA, 15 bp, Homo sapiens
cgtcttgtattttct

SEQ ID NO: 2120203 - DNA, 18 bp, Homo sapiens
cgtctttggaggaacagc

SEQ ID NO: 2120204 - DNA, 18 bp, Homo sapiens
cgtgaaagaattattttt

SEQ ID NO: 2120205 - DNA, 16 bp, Homo sapiens
cgtgaaagcagatgag

SEQ ID NO: 2120206 - DNA, 21 bp, Homo sapiens
cgtgaagcagtgcctcgaggc

SEQ ID NO: 2120207 - DNA, 15 bp, Homo sapiens
cgtgaagggcaccga

SEQ ID NO: 2120208 - DNA, 18 bp, Homo sapiens
cgtgaagggcaccgagaa

SEQ ID NO: 2120209 - DNA, 15 bp, Homo sapiens
cgtgaatgtctcagc

SEQ ID NO: 2120210 - DNA, 12 bp, Homo sapiens
cgtgacaacact

SEQ ID NO: 2120211 - DNA, 15 bp, Homo sapiens
cgtgacaacacttgt

SEQ ID NO: 2120212 - DNA, 18 bp, Homo sapiens
cgtgacccttcagggcca

SEQ ID NO: 2120213 - DNA, 21 bp, Homo sapiens
cgtgactattttttaataaaa

SEQ ID NO: 2120214 - DNA, 17 bp, Homo sapiens
cgtgactcacccaagca

SEQ ID NO: 2120215 - DNA, 16 bp, Homo sapiens
cgtgactgccccaact

SEQ ID NO: 2120216 - DNA, 21 bp, Homo sapiens
cgtgactgccccaactcctgg

SEQ ID NO: 2120217 - DNA, 22 bp, Homo sapiens
cgtgactgccccaactcctgga

SEQ ID NO: 2120218 - DNA, 14 bp, Homo sapiens
ctaaatccaaagaa

SEQ ID NO: 2120219 - DNA, 16 bp, Homo sapiens
ctaaatccaaatgagg

SEQ ID NO: 2120220 - DNA, 21 bp, Homo sapiens
ctaaatcctttactgttagtc

SEQ ID NO: 2120221 - DNA, 20 bp, Homo sapiens
ctaaatcttttataggattt

SEQ ID NO: 2120222 - DNA, 12 bp, Homo sapiens
ctaaatgaagag

SEQ ID NO: 2120223 - DNA, 12 bp, Homo sapiens
ctaaatgaatgt

SEQ ID NO: 2120224 - DNA, 16 bp, Homo sapiens
ctaaatgaatgtttac

SEQ ID NO: 2120225 - DNA, 13 bp, Homo sapiens
ctaaatgacctca

SEQ ID NO: 2120226 - DNA, 19 bp, Homo sapiens
ctaaatgacctcagcaaat

SEQ ID NO: 2120227 - DNA, 16 bp, Homo sapiens
ctaaatgagctcctgc

SEQ ID NO: 2120228 - DNA, 17 bp, Homo sapiens
ctaaatgcaaacactgt

SEQ ID NO: 2120229 - DNA, 12 bp, Homo sapiens
ctaaatgcccag

SEQ ID NO: 2120230 - DNA, 17 bp, Homo sapiens
ctaaatgcccagttcac

SEQ ID NO: 2120231 - DNA, 18 bp, Homo sapiens
ctaaatgcctaataaaca

SEQ ID NO: 2120232 - DNA, 19 bp, Homo sapiens
ctaaatgcctaataaacaa

SEQ ID NO: 2120233 - DNA, 19 bp, Homo sapiens
ctaaatggtcgcccaggag

SEQ ID NO: 2120234 - DNA, 22 bp, Homo sapiens
ctaaatgtggacatcatgaagc

SEQ ID NO: 2120235 - DNA, 18 bp, Homo sapiens
ctaaatgttggaattttc

SEQ ID NO: 2120236 - DNA, 21 bp, Homo sapiens
ctaaatgttggaattttcaaa

SEQ ID NO: 2120237 - DNA, 17 bp, Homo sapiens
ctaaattctttatttct

SEQ ID NO: 2120238 - DNA, 17 bp, Homo sapiens
ctaaattgtatacattt

SEQ ID NO: 2120239 - DNA, 17 bp, Homo sapiens
ctaacactcagaagcct

SEQ ID NO: 2120240 - DNA, 16 bp, Homo sapiens
ctaacagggaaggcag

SEQ ID NO: 2120241 - DNA, 16 bp, Homo sapiens
ctaacataaaatctgt

SEQ ID NO: 2120242 - DNA, 17 bp, Homo sapiens
ctaacataaaatctgtg

SEQ ID NO: 2120243 - DNA, 18 bp, Homo sapiens
ctaacataaaatctgtga

SEQ ID NO: 2120244 - DNA, 23 bp, Homo sapiens
ctaacataaaatctgtgaattaa

SEQ ID NO: 2120245 - DNA, 12 bp, Homo sapiens
ctaacatataat

SEQ ID NO: 2120246 - DNA, 23 bp, Homo sapiens
ctaacatataatgttgttattta

SEQ ID NO: 2120247 - DNA, 18 bp, Homo sapiens
ctaacatatgatactgat

SEQ ID NO: 2120248 - DNA, 16 bp, Homo sapiens
ctaacatatgtattaa

SEQ ID NO: 2120249 - DNA, 21 bp, Homo sapiens
ctaacatcatgcattcacaag

SEQ ID NO: 2120250 - DNA, 19 bp, Homo sapiens
ctaatttaaaccagcagaa

SEQ ID NO: 2120251 - DNA, 20 bp, Homo sapiens
ctaatttaaaccagcagaaa

SEQ ID NO: 2120252 - DNA, 22 bp, Homo sapiens
ctaatttaaaccagcagaaaag

SEQ ID NO: 2120253 - DNA, 23 bp, Homo sapiens
ctaatttaaaccagcagaaaagt

SEQ ID NO: 2120254 - DNA, 14 bp, Homo sapiens
ctaatttatacaaa

SEQ ID NO: 2120255 - DNA, 20 bp, Homo sapiens
ctaatttatacaaaataatt

SEQ ID NO: 2120256 - DNA, 21 bp, Homo sapiens
ctaatttatacaaaataattt

SEQ ID NO: 2120257 - DNA, 15 bp, Homo sapiens
ctaatttgatgttta

SEQ ID NO: 2120258 - DNA, 16 bp, Homo sapiens
ctaatttgatgtttac

SEQ ID NO: 2120259 - DNA, 15 bp, Homo sapiens
ctacaaaaacacagc

SEQ ID NO: 2120260 - DNA, 20 bp, Homo sapiens
ctacaaaaacacagcaaggg

SEQ ID NO: 2120261 - DNA, 13 bp, Homo sapiens
ctacaaaatggag

SEQ ID NO: 2120262 - DNA, 18 bp, Homo sapiens
ctacaaaatttgaaattt

SEQ ID NO: 2120263 - DNA, 16 bp, Homo sapiens
ctacaacaagagttta

SEQ ID NO: 2120264 - DNA, 16 bp, Homo sapiens
ctacaaccagagcccc

SEQ ID NO: 2120265 - DNA, 13 bp, Homo sapiens
ctacaagcatttg

SEQ ID NO: 2120266 - DNA, 12 bp, Homo sapiens
ctacaataaatg

SEQ ID NO: 2120267 - DNA, 15 bp, Homo sapiens
ctacaataaatgctg

SEQ ID NO: 2120268 - DNA, 18 bp, Homo sapiens
ctacaataaatgctgaat

SEQ ID NO: 2120269 - DNA, 19 bp, Homo sapiens
ctacaataaatgctgaatg

SEQ ID NO: 2120270 - DNA, 16 bp, Homo sapiens
ctacaatttaaagcaa

SEQ ID NO: 2120271 - DNA, 14 bp, Homo sapiens
ctacacagcctgga

SEQ ID NO: 2120272 - DNA, 19 bp, Homo sapiens
ctacacagtgggaactctg

SEQ ID NO: 2120273 - DNA, 20 bp, Homo sapiens
ctacacagtgggaactctga

SEQ ID NO: 2120274 - DNA, 21 bp, Homo sapiens
ctacacagtgggaactctgac

SEQ ID NO: 2120275 - DNA, 12 bp, Homo sapiens
ctacacatatat

SEQ ID NO: 2120276 - DNA, 15 bp, Homo sapiens
ctacacatcagggct

SEQ ID NO: 2120277 - DNA, 15 bp, Homo sapiens
ctacaccactctggc

SEQ ID NO: 2120278 - DNA, 18 bp, Homo sapiens
ctacaccactctggcagc

SEQ ID NO: 2120279 - DNA, 21 bp, Homo sapiens
ctacaccactctggcagccac

SEQ ID NO: 2120280 - DNA, 22 bp, Homo sapiens
ctacacccctcccctgccctag

SEQ ID NO: 2120281 - DNA, 20 bp, Homo sapiens
ctacacccttggacttgagg

SEQ ID NO: 2120282 - DNA, 19 bp, Homo sapiens
ctacacctgttgcacctca

SEQ ID NO: 2120283 - DNA, 20 bp, Homo sapiens
ctacaccttagcagctcttc

SEQ ID NO: 2120284 - DNA, 14 bp, Homo sapiens
ctacactaataaat

SEQ ID NO: 2120285 - DNA, 16 bp, Homo sapiens
ctacactccagcctga

SEQ ID NO: 2120286 - DNA, 22 bp, Homo sapiens
ctacagaaatactgctctgaat

SEQ ID NO: 2120287 - DNA, 14 bp, Homo sapiens
ctacagaataatgt

SEQ ID NO: 2120288 - DNA, 17 bp, Homo sapiens
ctacagaataatgtgtt

SEQ ID NO: 2120289 - DNA, 22 bp, Homo sapiens
ctacagacgattaacacaccac

SEQ ID NO: 2120290 - DNA, 23 bp, Homo sapiens
ccttgatgaagcctgtgccacct

SEQ ID NO: 2120291 - DNA, 20 bp, Homo sapiens
ccttgattttagccttctct

SEQ ID NO: 2120292 - DNA, 23 bp, Homo sapiens
ccttgcaaagaccataaagtcca

SEQ ID NO: 2120293 - DNA, 21 bp, Homo sapiens
ccttgcacagcccacacatga

SEQ ID NO: 2120294 - DNA, 14 bp, Homo sapiens
ccttgcacccctca

SEQ ID NO: 2120295 - DNA, 17 bp, Homo sapiens
ccttgcacccctcactc

SEQ ID NO: 2120296 - DNA, 18 bp, Homo sapiens
ccttgcacccctcactct

SEQ ID NO: 2120297 - DNA, 16 bp, Homo sapiens
cctgtgaacccaggac

SEQ ID NO: 2120298 - DNA, 18 bp, Homo sapiens
cctgtgactatggctctg

SEQ ID NO: 2120299 - DNA, 18 bp, Homo sapiens
cctgtgacttcagctctg

SEQ ID NO: 2120300 - DNA, 19 bp, Homo sapiens
cctgtgaggtaactgggat

SEQ ID NO: 2120301 - DNA, 18 bp, Homo sapiens
cctgtgcagcagcccagc

SEQ ID NO: 2120302 - DNA, 23 bp, Homo sapiens
cctgtgcagcagcccagcttcct

SEQ ID NO: 2120303 - DNA, 14 bp, Homo sapiens
cctgtgcatgtatg

SEQ ID NO: 2120304 - DNA, 15 bp, Homo sapiens
cctgtgccacctgca

SEQ ID NO: 2120305 - DNA, 17 bp, Homo sapiens
cctgtgcccacgtgtgc

SEQ ID NO: 2120306 - DNA, 24 bp, Homo sapiens
cctgtgcccacgtgtgcagactgt

SEQ ID NO: 2120307 - DNA, 15 bp, Homo sapiens
cctgtgcctgaccct

SEQ ID NO: 2120308 - DNA, 14 bp, Homo sapiens
cctgtgctgaggac

SEQ ID NO: 2120309 - DNA, 17 bp, Homo sapiens
cctgtgctgaggactcc

SEQ ID NO: 2120310 - DNA, 21 bp, Homo sapiens
cctgtgctgaggactccctcc

SEQ ID NO: 2120311 - DNA, 18 bp, Homo sapiens
cctgtggattccagcatt

SEQ ID NO: 2120312 - DNA, 20 bp, Homo sapiens
cctgtggcagaaaagaggag

SEQ ID NO: 2120313 - DNA, 21 bp, Homo sapiens
cctgtggcagaaaagaggaga

SEQ ID NO: 2120314 - DNA, 16 bp, Homo sapiens
cctgtggcagaccggg

SEQ ID NO: 2120315 - DNA, 21 bp, Homo sapiens
cctgtggcagaccgggggcca

SEQ ID NO: 2120316 - DNA, 22 bp, Homo sapiens
cctgtggcagaccgggggccag

SEQ ID NO: 2120317 - DNA, 14 bp, Homo sapiens
cctgtggcaggcct

SEQ ID NO: 2120318 - DNA, 16 bp, Homo sapiens
cctgtggcaggcctag

SEQ ID NO: 2120319 - DNA, 20 bp, Homo sapiens
cctgtggcaggcctaggacc

SEQ ID NO: 2120320 - DNA, 22 bp, Homo sapiens
cctgtggcaggcctaggacctc

SEQ ID NO: 2120321 - DNA, 14 bp, Homo sapiens
cctgtggccaggag

SEQ ID NO: 2120322 - DNA, 14 bp, Homo sapiens
cctgtggccttgcc

SEQ ID NO: 2120323 - DNA, 22 bp, Homo sapiens
cctgtggccttgcccgccagcc

SEQ ID NO: 2120324 - DNA, 16 bp, Homo sapiens
cctgtggcggtgcctg

SEQ ID NO: 2120325 - DNA, 15 bp, Homo sapiens
cctgtgggagcctcg

SEQ ID NO: 2120326 - DNA, 14 bp, Homo sapiens
cctgtgggccagga

SEQ ID NO: 2120327 - DNA, 20 bp, Homo sapiens
cctgtgggccaggagctcag

SEQ ID NO: 2120328 - DNA, 14 bp, Homo sapiens
cctgtggggcctga

SEQ ID NO: 2120329 - DNA, 21 bp, Homo sapiens
cctgtggggcctgatggtgct

SEQ ID NO: 2120330 - DNA, 16 bp, Homo sapiens
cctgtgggggcggctg

SEQ ID NO: 2120331 - DNA, 15 bp, Homo sapiens
cctgtgggggtggcc

SEQ ID NO: 2120332 - DNA, 12 bp, Homo sapiens
cctgtgggtgtg

SEQ ID NO: 2120333 - DNA, 19 bp, Homo sapiens
cctgtggtgacaggcccag

SEQ ID NO: 2120334 - DNA, 12 bp, Homo sapiens
cctgtgtacagg

SEQ ID NO: 2120335 - DNA, 20 bp, Homo sapiens
cctgtgtagctgtgacctgc

SEQ ID NO: 2120336 - DNA, 17 bp, Homo sapiens
cctgtgtcttgcaatgg

SEQ ID NO: 2120337 - DNA, 21 bp, Homo sapiens
cctgtgtgagcatctctgtgt

SEQ ID NO: 2120338 - DNA, 15 bp, Homo sapiens
cctgtgtggacagga

SEQ ID NO: 2120339 - DNA, 13 bp, Homo sapiens
cctgtgtggggag

SEQ ID NO: 2120340 - DNA, 20 bp, Homo sapiens
cctgtgtggggaggcagctc

SEQ ID NO: 2120341 - DNA, 20 bp, Homo sapiens
cctgtgtgtgcgcctacagg

SEQ ID NO: 2120342 - DNA, 20 bp, Homo sapiens
cctgttaacgtcatctcagg

SEQ ID NO: 2120343 - DNA, 21 bp, Homo sapiens
cctgttaacgtcatctcaggg

SEQ ID NO: 2120344 - DNA, 15 bp, Homo sapiens
cctgttacccagaga

SEQ ID NO: 2120345 - DNA, 20 bp, Homo sapiens
cctgttactattatctgtgc

SEQ ID NO: 2120346 - DNA, 17 bp, Homo sapiens
cctgttacttaaatagc

SEQ ID NO: 2120347 - DNA, 14 bp, Homo sapiens
cctgttacttacct

SEQ ID NO: 2120348 - DNA, 22 bp, Homo sapiens
cctgttacttgaaataccagtg

SEQ ID NO: 2120349 - DNA, 18 bp, Homo sapiens
cctgttaggggaaaatag

SEQ ID NO: 2120350 - DNA, 15 bp, Homo sapiens
cctgttcagctccag

SEQ ID NO: 2120351 - DNA, 19 bp, Homo sapiens
cctgttcagctccagctca

SEQ ID NO: 2120352 - DNA, 20 bp, Homo sapiens
cctgttcagctccagctcac

SEQ ID NO: 2120353 - DNA, 23 bp, Homo sapiens
cctgttcagctccagctcaccag

SEQ ID NO: 2120354 - DNA, 13 bp, Homo sapiens
cctgttccctacc

SEQ ID NO: 2120355 - DNA, 14 bp, Homo sapiens
cctgttccctaccc

SEQ ID NO: 2120356 - DNA, 16 bp, Homo sapiens
cctgttctcagctccg

SEQ ID NO: 2120357 - DNA, 19 bp, Homo sapiens
cctgttggacccgctctgg

SEQ ID NO: 2120358 - DNA, 14 bp, Homo sapiens
cctgtttaatattt

SEQ ID NO: 2120359 - DNA, 15 bp, Homo sapiens
cctgtttaatattta

SEQ ID NO: 2120360 - DNA, 19 bp, Homo sapiens
cctgttttatactgtactt

SEQ ID NO: 2120361 - DNA, 13 bp, Homo sapiens
cctgttttccaca

SEQ ID NO: 2120362 - DNA, 18 bp, Homo sapiens
cctgttttgttggaaggt

SEQ ID NO: 2120363 - DNA, 17 bp, Homo sapiens
cctgtttttctgggtgg

SEQ ID NO: 2120364 - DNA, 12 bp, Homo sapiens
ccttaaaaatgc

SEQ ID NO: 2120365 - DNA, 22 bp, Homo sapiens
ccttaagggttgaaggcagtct

SEQ ID NO: 2120366 - DNA, 15 bp, Homo sapiens
ccttaccaactttct

SEQ ID NO: 2120367 - DNA, 19 bp, Homo sapiens
ccttaccaactttctgtaa

SEQ ID NO: 2120368 - DNA, 17 bp, Homo sapiens
ccttacctcccctgcca

SEQ ID NO: 2120369 - DNA, 18 bp, Homo sapiens
ccttacctcccctgccag

SEQ ID NO: 2120370 - DNA, 19 bp, Homo sapiens
ccttacctcccctgccagg

SEQ ID NO: 2120371 - DNA, 21 bp, Homo sapiens
ccttacctcccctgccagggc

SEQ ID NO: 2120372 - DNA, 16 bp, Homo sapiens
ccttacctcctgccca

SEQ ID NO: 2120373 - DNA, 20 bp, Homo sapiens
ccttacctcctgcccaggag

SEQ ID NO: 2120374 - DNA, 14 bp, Homo sapiens
ccttacctttacat

SEQ ID NO: 2120375 - DNA, 20 bp, Homo sapiens
ccttactacttcttggaaaa

SEQ ID NO: 2120376 - DNA, 19 bp, Homo sapiens
ccttactatgatctcagga

SEQ ID NO: 2120377 - DNA, 14 bp, Homo sapiens
ccttactcacctct

SEQ ID NO: 2120378 - DNA, 14 bp, Homo sapiens
ccttactcctgtgg

SEQ ID NO: 2120379 - DNA, 20 bp, Homo sapiens
ccttactcctgtgggagcct

SEQ ID NO: 2120380 - DNA, 14 bp, Homo sapiens
ccttactctgagcc

SEQ ID NO: 2120381 - DNA, 17 bp, Homo sapiens
ccttactctgagcccag

SEQ ID NO: 2120382 - DNA, 14 bp, Homo sapiens
ccttagaacctttc

SEQ ID NO: 2120383 - DNA, 17 bp, Homo sapiens
ccttagaagtcacacag

SEQ ID NO: 2120384 - DNA, 18 bp, Homo sapiens
ccttagaagtcacacagt

SEQ ID NO: 2120385 - DNA, 17 bp, Homo sapiens
ccttagagattgcccca

SEQ ID NO: 2120386 - DNA, 16 bp, Homo sapiens
ccttagcacttctttc

SEQ ID NO: 2120387 - DNA, 22 bp, Homo sapiens
ccttagctggcattacagctgg

SEQ ID NO: 2120388 - DNA, 17 bp, Homo sapiens
ccttagcttagacctca

SEQ ID NO: 2120389 - DNA, 23 bp, Homo sapiens
ccttagcttagacctcagcctgt

SEQ ID NO: 2120390 - DNA, 19 bp, Homo sapiens
ccttaggaaaatgcttctg

SEQ ID NO: 2120391 - DNA, 18 bp, Homo sapiens
ccttaggcattatttaat

SEQ ID NO: 2120392 - DNA, 16 bp, Homo sapiens
ccttataagaattaat

SEQ ID NO: 2120393 - DNA, 14 bp, Homo sapiens
ccttataagcccag

SEQ ID NO: 2120394 - DNA, 14 bp, Homo sapiens
ccttatcaggcaaa

SEQ ID NO: 2120395 - DNA, 14 bp, Homo sapiens
ccttatccaggact

SEQ ID NO: 2120396 - DNA, 15 bp, Homo sapiens
cctctcgagcccaga

SEQ ID NO: 2120397 - DNA, 17 bp, Homo sapiens
cctctcggaaggctggc

SEQ ID NO: 2120398 - DNA, 16 bp, Homo sapiens
cctctctcagttattc

SEQ ID NO: 2120399 - DNA, 19 bp, Homo sapiens
cctctctctaagtttagaa

SEQ ID NO: 2120400 - DNA, 12 bp, Homo sapiens
cctctctctccg

SEQ ID NO: 2120401 - DNA, 13 bp, Homo sapiens
cctctctgaatgt

SEQ ID NO: 2120402 - DNA, 16 bp, Homo sapiens
cctctctgctccagag

SEQ ID NO: 2120403 - DNA, 19 bp, Homo sapiens
cctctgacacacagctctg

SEQ ID NO: 2120404 - DNA, 20 bp, Homo sapiens
cctctgacacacagctctgt

SEQ ID NO: 2120405 - DNA, 17 bp, Homo sapiens
cctctgaccaacaggct

SEQ ID NO: 2120406 - DNA, 17 bp, Homo sapiens
cctctgaggccagcctg

SEQ ID NO: 2120407 - DNA, 15 bp, Homo sapiens
cctctgatacctcaa

SEQ ID NO: 2120408 - DNA, 14 bp, Homo sapiens
cctctgcagcactt

SEQ ID NO: 2120409 - DNA, 12 bp, Homo sapiens
cctctgccacct

SEQ ID NO: 2120410 - DNA, 20 bp, Homo sapiens
cctctgccacctcccctatc

SEQ ID NO: 2120411 - DNA, 16 bp, Homo sapiens
cctctgccatgcccag

SEQ ID NO: 2120412 - DNA, 19 bp, Homo sapiens
cctctgccatgcccagaga

SEQ ID NO: 2120413 - DNA, 11 bp, Homo sapiens
cctctgcccca

SEQ ID NO: 2120414 - DNA, 16 bp, Homo sapiens
cctctgccccaagcag

SEQ ID NO: 2120415 - DNA, 20 bp, Homo sapiens
cctctgccccaaggggccca

SEQ ID NO: 2120416 - DNA, 16 bp, Homo sapiens
cctctgccctgcctcc

SEQ ID NO: 2120417 - DNA, 11 bp, Homo sapiens
cctctgcctca

SEQ ID NO: 2120418 - DNA, 22 bp, Homo sapiens
cctctgcctgaagtcacacagt

SEQ ID NO: 2120419 - DNA, 12 bp, Homo sapiens
cctctgcctgtc

SEQ ID NO: 2120420 - DNA, 19 bp, Homo sapiens
cctctgcctgtctccccca

SEQ ID NO: 2120421 - DNA, 18 bp, Homo sapiens
cctctgcgtcccccagcc

SEQ ID NO: 2120422 - DNA, 20 bp, Homo sapiens
cctctgcgtcccccagccct

SEQ ID NO: 2120423 - DNA, 20 bp, Homo sapiens
cctctgctctgaggcttcca

SEQ ID NO: 2120424 - DNA, 22 bp, Homo sapiens
cctctgctctgaggcttccaga

SEQ ID NO: 2120425 - DNA, 15 bp, Homo sapiens
cctctgctgccatgg

SEQ ID NO: 2120426 - DNA, 22 bp, Homo sapiens
cctctgctgctcccatctgcac

SEQ ID NO: 2120427 - DNA, 16 bp, Homo sapiens
cctctggatccctgga

SEQ ID NO: 2120428 - DNA, 21 bp, Homo sapiens
cctctggatccctggaggggc

SEQ ID NO: 2120429 - DNA, 21 bp, Homo sapiens
cctctggattctctgggtcta

SEQ ID NO: 2120430 - DNA, 12 bp, Homo sapiens
cctctggccctg

SEQ ID NO: 2120431 - DNA, 13 bp, Homo sapiens
cctctggccctgc

SEQ ID NO: 2120432 - DNA, 15 bp, Homo sapiens
cctctggccctgcct

SEQ ID NO: 2120433 - DNA, 22 bp, Homo sapiens
cctctggctggctaactggaag

SEQ ID NO: 2120434 - DNA, 23 bp, Homo sapiens
cctctggctggctaactggaagc

SEQ ID NO: 2120435 - DNA, 14 bp, Homo sapiens
cctctgggcagctg

SEQ ID NO: 2120436 - DNA, 15 bp, Homo sapiens
cctctgtcatcactc

SEQ ID NO: 2120437 - DNA, 23 bp, Homo sapiens
cctctgtccagggccctgagctc

SEQ ID NO: 2120438 - DNA, 19 bp, Homo sapiens
cctctgtctcgagcgccct

SEQ ID NO: 2120439 - DNA, 21 bp, Homo sapiens
cctctgtctcgagcgccctgc

SEQ ID NO: 2120440 - DNA, 13 bp, Homo sapiens
cctctgtctctgc

SEQ ID NO: 2120441 - DNA, 15 bp, Homo sapiens
cctctgtctctgctc

SEQ ID NO: 2120442 - DNA, 23 bp, Homo sapiens
cctctgtctctgctcttgcctgc

SEQ ID NO: 2120443 - DNA, 19 bp, Homo sapiens
cctctgtgtccttccctgc

SEQ ID NO: 2120444 - DNA, 17 bp, Homo sapiens
cctcttaaaaaataaaa

SEQ ID NO: 2120445 - DNA, 20 bp, Homo sapiens
cctcttaaagctgcctgtag

SEQ ID NO: 2120446 - DNA, 22 bp, Homo sapiens
cctcttaaagctgcctgtagtt

SEQ ID NO: 2120447 - DNA, 13 bp, Homo sapiens
cctcttattccta

SEQ ID NO: 2120448 - DNA, 17 bp, Homo sapiens
cctcttcaccccccact

SEQ ID NO: 2120449 - DNA, 15 bp, Homo sapiens
cctcttccacccatt

SEQ ID NO: 2120450 - DNA, 21 bp, Homo sapiens
cctcttccccttgcccttgcc

SEQ ID NO: 2120451 - DNA, 19 bp, Homo sapiens
cctcttcctccctcattcc

SEQ ID NO: 2120452 - DNA, 13 bp, Homo sapiens
cctcttcctcctg

SEQ ID NO: 2120453 - DNA, 14 bp, Homo sapiens
cctcttccttcccc

SEQ ID NO: 2120454 - DNA, 17 bp, Homo sapiens
cctcttctattttgtaa

SEQ ID NO: 2120455 - DNA, 14 bp, Homo sapiens
cctcttctcttcct

SEQ ID NO: 2120456 - DNA, 15 bp, Homo sapiens
cctcttcttcttcag

SEQ ID NO: 2120457 - DNA, 12 bp, Homo sapiens
cctcttgctcaa

SEQ ID NO: 2120458 - DNA, 21 bp, Homo sapiens
cctcttggacctctgctctga

SEQ ID NO: 2120459 - DNA, 19 bp, Homo sapiens
cctgcaagtgcccgccctg

SEQ ID NO: 2120460 - DNA, 20 bp, Homo sapiens
cctgcaagtgcccgccctgc

SEQ ID NO: 2120461 - DNA, 21 bp, Homo sapiens
cctgcaagtgcccgccctgcc

SEQ ID NO: 2120462 - DNA, 22 bp, Homo sapiens
cctgcaagtgcccgccctgccc

SEQ ID NO: 2120463 - DNA, 22 bp, Homo sapiens
cctgcacaaagcccttccatgt

SEQ ID NO: 2120464 - DNA, 20 bp, Homo sapiens
cctgcaccctggaaagggga

SEQ ID NO: 2120465 - DNA, 17 bp, Homo sapiens
cctgcaccgccccttct

SEQ ID NO: 2120466 - DNA, 20 bp, Homo sapiens
cctgcacctccccccactgc

SEQ ID NO: 2120467 - DNA, 15 bp, Homo sapiens
cctgcacctgtgcag

SEQ ID NO: 2120468 - DNA, 16 bp, Homo sapiens
cctgcacttgcagact

SEQ ID NO: 2120469 - DNA, 17 bp, Homo sapiens
cctgcacttgcagactc

SEQ ID NO: 2120470 - DNA, 22 bp, Homo sapiens
cctgcacttgcagactctacag

SEQ ID NO: 2120471 - DNA, 15 bp, Homo sapiens
cctgcagagctatgg

SEQ ID NO: 2120472 - DNA, 12 bp, Homo sapiens
cctgcagcctcc

SEQ ID NO: 2120473 - DNA, 17 bp, Homo sapiens
cctgcagcctcccccac

SEQ ID NO: 2120474 - DNA, 18 bp, Homo sapiens
cctgcagcctcctcctga

SEQ ID NO: 2120475 - DNA, 16 bp, Homo sapiens
cctgcaggaacgagca

SEQ ID NO: 2120476 - DNA, 17 bp, Homo sapiens
cctgcaggaacgagcac

SEQ ID NO: 2120477 - DNA, 15 bp, Homo sapiens
cctgcagggccaagc

SEQ ID NO: 2120478 - DNA, 22 bp, Homo sapiens
cctgcaggtgtctatccacctg

SEQ ID NO: 2120479 - DNA, 16 bp, Homo sapiens
cctgcatccggagaat

SEQ ID NO: 2120480 - DNA, 18 bp, Homo sapiens
cctgcatgtgttgtacaa

SEQ ID NO: 2120481 - DNA, 20 bp, Homo sapiens
cctgccacactcagtccccc

SEQ ID NO: 2120482 - DNA, 14 bp, Homo sapiens
cctgccaccctggg

SEQ ID NO: 2120483 - DNA, 16 bp, Homo sapiens
cctgccaccctgggga

SEQ ID NO: 2120484 - DNA, 19 bp, Homo sapiens
cctgccaccgccagaggac

SEQ ID NO: 2120485 - DNA, 22 bp, Homo sapiens
cctgccaccgccagaggacaag

SEQ ID NO: 2120486 - DNA, 17 bp, Homo sapiens
cctgccacctgtctgtc

SEQ ID NO: 2120487 - DNA, 23 bp, Homo sapiens
cctgccactttggtacatggcca

SEQ ID NO: 2120488 - DNA, 13 bp, Homo sapiens
cctgccagcctgg

SEQ ID NO: 2120489 - DNA, 16 bp, Homo sapiens
cctgccagcctggctt

SEQ ID NO: 2120490 - DNA, 23 bp, Homo sapiens
cctgccagcgtcagaggccctgg

SEQ ID NO: 2120491 - DNA, 13 bp, Homo sapiens
cctgccagctgcc

SEQ ID NO: 2120492 - DNA, 14 bp, Homo sapiens
cctgccagctgcct

SEQ ID NO: 2120493 - DNA, 12 bp, Homo sapiens
cctgccaggagg

SEQ ID NO: 2120494 - DNA, 17 bp, Homo sapiens
cctgccagggcccctgt

SEQ ID NO: 2120495 - DNA, 22 bp, Homo sapiens
cctgccagtgccttacctcctg

SEQ ID NO: 2120496 - DNA, 23 bp, Homo sapiens
cctgccagtgccttacctcctgc

SEQ ID NO: 2120497 - DNA, 19 bp, Homo sapiens
cctgccagttgaaaatgga

SEQ ID NO: 2120498 - DNA, 18 bp, Homo sapiens
cctgccataccgctgggg

SEQ ID NO: 2120499 - DNA, 13 bp, Homo sapiens
cctgcccaatgct

SEQ ID NO: 2120500 - DNA, 17 bp, Homo sapiens
cctgcccaatgctttgg

SEQ ID NO: 2120501 - DNA, 21 bp, Homo sapiens
cctgcccaatgctttgggagg

SEQ ID NO: 2120502 - DNA, 19 bp, Homo sapiens
cctgcccacttagccgtcc

SEQ ID NO: 2120503 - DNA, 15 bp, Homo sapiens
cctgcccaggcccct

SEQ ID NO: 2120504 - DNA, 16 bp, Homo sapiens
cctgcccaggcccctg

SEQ ID NO: 2120505 - DNA, 19 bp, Homo sapiens
cctgcccaggcccctgcca

SEQ ID NO: 2120506 - DNA, 21 bp, Homo sapiens
cctgcccaggcccctgccacc

SEQ ID NO: 2120507 - DNA, 22 bp, Homo sapiens
cctgcccaggcccctgccaccc

SEQ ID NO: 2120508 - DNA, 22 bp, Homo sapiens
cctgcccagtgcacttgctgga

SEQ ID NO: 2120509 - DNA, 20 bp, Homo sapiens
cctgcccatacccctgcctg

SEQ ID NO: 2120510 - DNA, 21 bp, Homo sapiens
cctgcccatacccctgcctgg

SEQ ID NO: 2120511 - DNA, 22 bp, Homo sapiens
cctgcccatacccctgcctggg

SEQ ID NO: 2120512 - DNA, 23 bp, Homo sapiens
cctgcccatacccctgcctgggt

SEQ ID NO: 2120513 - DNA, 12 bp, Homo sapiens
cctgccccaacc

SEQ ID NO: 2120514 - DNA, 21 bp, Homo sapiens
cctgccccaacccccaccgaa

SEQ ID NO: 2120515 - DNA, 22 bp, Homo sapiens
cctgccccaactccttccagct

SEQ ID NO: 2120516 - DNA, 17 bp, Homo sapiens
cctgccccagcgcggct

SEQ ID NO: 2120517 - DNA, 20 bp, Homo sapiens
cctgccccatcctgggcctt

SEQ ID NO: 2120518 - DNA, 19 bp, Homo sapiens
cctgcccccatctccccag

SEQ ID NO: 2120519 - DNA, 20 bp, Homo sapiens
cctgcccccgacagcccagc

SEQ ID NO: 2120520 - DNA, 16 bp, Homo sapiens
cctgccccctggtgga

SEQ ID NO: 2120521 - DNA, 17 bp, Homo sapiens
cctgcccctccccagcc

SEQ ID NO: 2120522 - DNA, 18 bp, Homo sapiens
cctgcccctcttcccggg

SEQ ID NO: 2120523 - DNA, 16 bp, Homo sapiens
cctcaccccctcccac

SEQ ID NO: 2120524 - DNA, 19 bp, Homo sapiens
cctcacccgaggctgccca

SEQ ID NO: 2120525 - DNA, 21 bp, Homo sapiens
cctcacccgaggctgcccact

SEQ ID NO: 2120526 - DNA, 21 bp, Homo sapiens
cctcaccggcatgctggcctg

SEQ ID NO: 2120527 - DNA, 22 bp, Homo sapiens
cctcaccggcatgctggcctgt

SEQ ID NO: 2120528 - DNA, 23 bp, Homo sapiens
cctcacctgggcctttcctgtgc

SEQ ID NO: 2120529 - DNA, 15 bp, Homo sapiens
cctcacgcccagcct

SEQ ID NO: 2120530 - DNA, 16 bp, Homo sapiens
cctcacgctctggaca

SEQ ID NO: 2120531 - DNA, 23 bp, Homo sapiens
cctcactatgacactgagcaaga

SEQ ID NO: 2120532 - DNA, 13 bp, Homo sapiens
cctcactcctgtt

SEQ ID NO: 2120533 - DNA, 18 bp, Homo sapiens
cctcactctgtcagccag

SEQ ID NO: 2120534 - DNA, 20 bp, Homo sapiens
cctcactctgtcagccagcc

SEQ ID NO: 2120535 - DNA, 13 bp, Homo sapiens
cctcactgcccca

SEQ ID NO: 2120536 - DNA, 14 bp, Homo sapiens
cctcactgccccac

SEQ ID NO: 2120537 - DNA, 17 bp, Homo sapiens
cctcactgccccaccag

SEQ ID NO: 2120538 - DNA, 13 bp, Homo sapiens
cctcactggctgg

SEQ ID NO: 2120539 - DNA, 17 bp, Homo sapiens
cctcactggctggggca

SEQ ID NO: 2120540 - DNA, 23 bp, Homo sapiens
cctcactggctggggcagagggg

SEQ ID NO: 2120541 - DNA, 17 bp, Homo sapiens
cctcacttccctgggaa

SEQ ID NO: 2120542 - DNA, 14 bp, Homo sapiens
cctcacttgaatgt

SEQ ID NO: 2120543 - DNA, 22 bp, Homo sapiens
cctcacttttaatgaacaaatg

SEQ ID NO: 2120544 - DNA, 23 bp, Homo sapiens
cctcagacaatccactctcagga

SEQ ID NO: 2120545 - DNA, 22 bp, Homo sapiens
cctcagaccaactctctcctgt

SEQ ID NO: 2120546 - DNA, 16 bp, Homo sapiens
cctcagagccacccct

SEQ ID NO: 2120547 - DNA, 11 bp, Homo sapiens
cctcagagctc

SEQ ID NO: 2120548 - DNA, 17 bp, Homo sapiens
cctcagatctgaacaca

SEQ ID NO: 2120549 - DNA, 17 bp, Homo sapiens
cctcagcatcctggcac

SEQ ID NO: 2120550 - DNA, 18 bp, Homo sapiens
cctcagccaaacacagag

SEQ ID NO: 2120551 - DNA, 19 bp, Homo sapiens
cctcagccaaacacagagc

SEQ ID NO: 2120552 - DNA, 17 bp, Homo sapiens
cctcccgggagcacaga

SEQ ID NO: 2120553 - DNA, 13 bp, Homo sapiens
cctcccggtgccc

SEQ ID NO: 2120554 - DNA, 18 bp, Homo sapiens
cctccctactcccctggg

SEQ ID NO: 2120555 - DNA, 13 bp, Homo sapiens
cctccctccaccc

SEQ ID NO: 2120556 - DNA, 15 bp, Homo sapiens
cctccctccacccca

SEQ ID NO: 2120557 - DNA, 20 bp, Homo sapiens
cctccctccaccccaggacg

SEQ ID NO: 2120558 - DNA, 13 bp, Homo sapiens
cctccctcctcgt

SEQ ID NO: 2120559 - DNA, 18 bp, Homo sapiens
cctccctcctctggccca

SEQ ID NO: 2120560 - DNA, 14 bp, Homo sapiens
cctccctctgacct

SEQ ID NO: 2120561 - DNA, 18 bp, Homo sapiens
cctccctctgacctgcag

SEQ ID NO: 2120562 - DNA, 17 bp, Homo sapiens
cctccctctgccccaag

SEQ ID NO: 2120563 - DNA, 22 bp, Homo sapiens
cctccctctgccccaagcagcc

SEQ ID NO: 2120564 - DNA, 21 bp, Homo sapiens
cctccctgcccctcccttcaa

SEQ ID NO: 2120565 - DNA, 12 bp, Homo sapiens
cctccctgccct

SEQ ID NO: 2120566 - DNA, 14 bp, Homo sapiens
cctccctgctacca

SEQ ID NO: 2120567 - DNA, 21 bp, Homo sapiens
cctccctgctaccaaggccca

SEQ ID NO: 2120568 - DNA, 22 bp, Homo sapiens
cctccctgctaccaaggcccag

SEQ ID NO: 2120569 - DNA, 19 bp, Homo sapiens
cctccctggcatgtcagag

SEQ ID NO: 2120570 - DNA, 14 bp, Homo sapiens
cctccctggcctca

SEQ ID NO: 2120571 - DNA, 11 bp, Homo sapiens
cctccctgtcc

SEQ ID NO: 2120572 - DNA, 14 bp, Homo sapiens
cctccctttctggg

SEQ ID NO: 2120573 - DNA, 16 bp, Homo sapiens
cctccggggagagcag

SEQ ID NO: 2120574 - DNA, 19 bp, Homo sapiens
cctccggggagagcagagg

SEQ ID NO: 2120575 - DNA, 20 bp, Homo sapiens
cctccgtccacccaggctgc

SEQ ID NO: 2120576 - DNA, 18 bp, Homo sapiens
cctccgtttatgggcctt

SEQ ID NO: 2120577 - DNA, 20 bp, Homo sapiens
cctccgtttatgggccttgc

SEQ ID NO: 2120578 - DNA, 21 bp, Homo sapiens
cctccgtttatgggccttgct

SEQ ID NO: 2120579 - DNA, 19 bp, Homo sapiens
cctcctagaggtgggcagc

SEQ ID NO: 2120580 - DNA, 20 bp, Homo sapiens
cctcctagaggtgggcagct

SEQ ID NO: 2120581 - DNA, 17 bp, Homo sapiens
cctcctagcaagacctg

SEQ ID NO: 2120582 - DNA, 14 bp, Homo sapiens
cctcctcaccccca

SEQ ID NO: 2120583 - DNA, 16 bp, Homo sapiens
cctcctcacccccagc

SEQ ID NO: 2120584 - DNA, 13 bp, Homo sapiens
cctcctcaccccg

SEQ ID NO: 2120585 - DNA, 14 bp, Homo sapiens
cctcctccacagtg

SEQ ID NO: 2120586 - DNA, 20 bp, Homo sapiens
cctcctccacagtgctgctt

SEQ ID NO: 2120587 - DNA, 15 bp, Homo sapiens
cctcctccactccac

SEQ ID NO: 2120588 - DNA, 16 bp, Homo sapiens
cctcctccccttcctg

SEQ ID NO: 2120589 - DNA, 19 bp, Homo sapiens
cctcctccccttcctgcac

SEQ ID NO: 2120590 - DNA, 15 bp, Homo sapiens
cctcctcctgccctc

SEQ ID NO: 2120591 - DNA, 14 bp, Homo sapiens
cctcctctgccacc

SEQ ID NO: 2120592 - DNA, 21 bp, Homo sapiens
cctcctctgccacctccccta

SEQ ID NO: 2120593 - DNA, 12 bp, Homo sapiens
cctcctctgtcc

SEQ ID NO: 2120594 - DNA, 17 bp, Homo sapiens
cctcctgaagcctctgc

SEQ ID NO: 2120595 - DNA, 19 bp, Homo sapiens
cctcctgaagcctctgccc

SEQ ID NO: 2120596 - DNA, 22 bp, Homo sapiens
cctcctgaagcctctgccctgc

SEQ ID NO: 2120597 - DNA, 16 bp, Homo sapiens
cctcctgacctgaggc

SEQ ID NO: 2120598 - DNA, 18 bp, Homo sapiens
cctcctgacctgaggctc

SEQ ID NO: 2120599 - DNA, 20 bp, Homo sapiens
cctcctgatggccaagagca

SEQ ID NO: 2120600 - DNA, 15 bp, Homo sapiens
cctcctgcccaggag

SEQ ID NO: 2120601 - DNA, 16 bp, Homo sapiens
cctcctgcccaggaga

SEQ ID NO: 2120602 - DNA, 23 bp, Homo sapiens
cctcctgcctcgaactggctgca

SEQ ID NO: 2120603 - DNA, 18 bp, Homo sapiens
cctcctgcctctactggg

SEQ ID NO: 2120604 - DNA, 17 bp, Homo sapiens
cctcctgctgcctaata

SEQ ID NO: 2120605 - DNA, 11 bp, Homo sapiens
cctcctggcca

SEQ ID NO: 2120606 - DNA, 12 bp, Homo sapiens
cctcctggccag

SEQ ID NO: 2120607 - DNA, 13 bp, Homo sapiens
cctcctggccaga

SEQ ID NO: 2120608 - DNA, 16 bp, Homo sapiens
cctcctggccagacgc

SEQ ID NO: 2120609 - DNA, 23 bp, Homo sapiens
cctcctggccggggcccctcacc

SEQ ID NO: 2120610 - DNA, 12 bp, Homo sapiens
cctcctgggacc

SEQ ID NO: 2120611 - DNA, 13 bp, Homo sapiens
cctcctgggctaa

SEQ ID NO: 2120612 - DNA, 20 bp, Homo sapiens
cctcctgtgtggaagaagga

SEQ ID NO: 2120613 - DNA, 13 bp, Homo sapiens
cctcctgtgtgtg

SEQ ID NO: 2120614 - DNA, 22 bp, Homo sapiens
cctcctgtgtgtgcgcctacag

SEQ ID NO: 2120615 - DNA, 23 bp, Homo sapiens
cctcctgtgtgtgcgcctacagg

SEQ ID NO: 2120616 - DNA, 12 bp, Homo sapiens
cctccttcccgc

SEQ ID NO: 2120617 - DNA, 21 bp, Homo sapiens
cctccttcctcagtcctggaa

SEQ ID NO: 2120618 - DNA, 20 bp, Homo sapiens
cctccttccttgctgtccta

SEQ ID NO: 2120619 - DNA, 18 bp, Homo sapiens
cctccttgctctgcaggc

SEQ ID NO: 2120620 - DNA, 16 bp, Homo sapiens
cctcgaaccaaggcag

SEQ ID NO: 2120621 - DNA, 13 bp, Homo sapiens
cctcgaggcaccg

SEQ ID NO: 2120622 - DNA, 19 bp, Homo sapiens
ccgccaggaggtcctcctc

SEQ ID NO: 2120623 - DNA, 19 bp, Homo sapiens
ccgccatccgggacgcttc

SEQ ID NO: 2120624 - DNA, 22 bp, Homo sapiens
ccgcccagctgcacctgccagc

SEQ ID NO: 2120625 - DNA, 14 bp, Homo sapiens
ccgccccagacaca

SEQ ID NO: 2120626 - DNA, 18 bp, Homo sapiens
ccgcccctcgctgctgct

SEQ ID NO: 2120627 - DNA, 13 bp, Homo sapiens
ccgccctggcagt

SEQ ID NO: 2120628 - DNA, 24 bp, Homo sapiens
ccgccctgggctgtctgtcaccag

SEQ ID NO: 2120629 - DNA, 21 bp, Homo sapiens
ccgccggaccgcgtagagagc

SEQ ID NO: 2120630 - DNA, 12 bp, Homo sapiens
ccgcctccagga

SEQ ID NO: 2120631 - DNA, 14 bp, Homo sapiens
ccgcctcccagcct

SEQ ID NO: 2120632 - DNA, 15 bp, Homo sapiens
ccgcctcccagcctg

SEQ ID NO: 2120633 - DNA, 17 bp, Homo sapiens
ccgcctctgcccgcaga

SEQ ID NO: 2120634 - DNA, 20 bp, Homo sapiens
ccgcctgccataccgctggg

SEQ ID NO: 2120635 - DNA, 16 bp, Homo sapiens
ccgcggtgctctggcg

SEQ ID NO: 2120636 - DNA, 21 bp, Homo sapiens
ccgcgtagagagccgggcccc

SEQ ID NO: 2120637 - DNA, 15 bp, Homo sapiens
ccgcgtctaccctgg

SEQ ID NO: 2120638 - DNA, 19 bp, Homo sapiens
ccgctacaccactctggca

SEQ ID NO: 2120639 - DNA, 15 bp, Homo sapiens
ccgctcagccctccc

SEQ ID NO: 2120640 - DNA, 18 bp, Homo sapiens
ccgctccagatctgcact

SEQ ID NO: 2120641 - DNA, 13 bp, Homo sapiens
ccgctcctgctga

SEQ ID NO: 2120642 - DNA, 21 bp, Homo sapiens
ccgctgccaccacgtctgcca

SEQ ID NO: 2120643 - DNA, 22 bp, Homo sapiens
ccgctgccaccacgtctgccag

SEQ ID NO: 2120644 - DNA, 15 bp, Homo sapiens
ccgctgccgctgcac

SEQ ID NO: 2120645 - DNA, 16 bp, Homo sapiens
ccgctgccgctgcacc

SEQ ID NO: 2120646 - DNA, 15 bp, Homo sapiens
ccgctggcagccacc

SEQ ID NO: 2120647 - DNA, 10 bp, Homo sapiens
ccgctggccc

SEQ ID NO: 2120648 - DNA, 17 bp, Homo sapiens
ccgctggctcctccagg

SEQ ID NO: 2120649 - DNA, 18 bp, Homo sapiens
ccgctggggaacagagcg

SEQ ID NO: 2120650 - DNA, 18 bp, Homo sapiens
ccgctgtcgccccaggcc

SEQ ID NO: 2120651 - DNA, 14 bp, Homo sapiens
ccgctgttcaccca

SEQ ID NO: 2120652 - DNA, 14 bp, Homo sapiens
ccgcttcacccctg

SEQ ID NO: 2120653 - DNA, 13 bp, Homo sapiens
ccgcttcccagag

SEQ ID NO: 2120654 - DNA, 15 bp, Homo sapiens
ccgcttcccagaggc

SEQ ID NO: 2120655 - DNA, 12 bp, Homo sapiens
ccgctttctacc

SEQ ID NO: 2120656 - DNA, 23 bp, Homo sapiens
ccgctttctacccagcgagccct

SEQ ID NO: 2120657 - DNA, 14 bp, Homo sapiens
ccgctttgcctgct

SEQ ID NO: 2120658 - DNA, 16 bp, Homo sapiens
ccggaatgaccagcat

SEQ ID NO: 2120659 - DNA, 23 bp, Homo sapiens
ccggacggacgttggttctgcac

SEQ ID NO: 2120660 - DNA, 16 bp, Homo sapiens
ccggagaattgcctct

SEQ ID NO: 2120661 - DNA, 13 bp, Homo sapiens
ccggagcacagcc

SEQ ID NO: 2120662 - DNA, 21 bp, Homo sapiens
ccggagctttcaaagaaggaa

SEQ ID NO: 2120663 - DNA, 17 bp, Homo sapiens
ccggaggggcctggcag

SEQ ID NO: 2120664 - DNA, 21 bp, Homo sapiens
ccggaggggttgcgggggagc

SEQ ID NO: 2120665 - DNA, 21 bp, Homo sapiens
ccggagtaatcaggcagcctt

SEQ ID NO: 2120666 - DNA, 17 bp, Homo sapiens
ccggcaaccccagttct

SEQ ID NO: 2120667 - DNA, 22 bp, Homo sapiens
ccggcaaccccagttctgctcc

SEQ ID NO: 2120668 - DNA, 19 bp, Homo sapiens
ccggcatgctggcctgtgg

SEQ ID NO: 2120669 - DNA, 23 bp, Homo sapiens
ccggcatgctggcctgtggcagg

SEQ ID NO: 2120670 - DNA, 14 bp, Homo sapiens
ccggccagggcctg

SEQ ID NO: 2120671 - DNA, 16 bp, Homo sapiens
ccggccagggcctggt

SEQ ID NO: 2120672 - DNA, 20 bp, Homo sapiens
ccggcccagagaccccttcc

SEQ ID NO: 2120673 - DNA, 17 bp, Homo sapiens
ccggcccaggcctccac

SEQ ID NO: 2120674 - DNA, 23 bp, Homo sapiens
ccggccccccctcttttggcctt

SEQ ID NO: 2120675 - DNA, 21 bp, Homo sapiens
ccggccggagccgcccaccgt

SEQ ID NO: 2120676 - DNA, 16 bp, Homo sapiens
ccggcctgctcccagc

SEQ ID NO: 2120677 - DNA, 14 bp, Homo sapiens
ccggcgctgcaggt

SEQ ID NO: 2120678 - DNA, 15 bp, Homo sapiens
ccggcgctgcaggta

SEQ ID NO: 2120679 - DNA, 17 bp, Homo sapiens
ccggctatgggggcact

SEQ ID NO: 2120680 - DNA, 23 bp, Homo sapiens
ccggctatgggggcactgaggac

SEQ ID NO: 2120681 - DNA, 14 bp, Homo sapiens
ccggctccaggctc

SEQ ID NO: 2120682 - DNA, 15 bp, Homo sapiens
ccggctccccctgct

SEQ ID NO: 2120683 - DNA, 23 bp, Homo sapiens
ccggctgcttccttctgcaccca

SEQ ID NO: 2120684 - DNA, 21 bp, Homo sapiens
ccgggaccattgacctcagct

SEQ ID NO: 2120685 - DNA, 16 bp, Homo sapiens
ccgggacttcaaagcc

SEQ ID NO: 2120686 - DNA, 17 bp, Homo sapiens
ccgggagaggactctgc

SEQ ID NO: 2120687 - DNA, 20 bp, Homo sapiens
ccgggagaggactctgcctt

SEQ ID NO: 2120688 - DNA, 15 bp, Homo sapiens
ccgggagcctccccc

SEQ ID NO: 2120689 - DNA, 15 bp, Homo sapiens
ccgggcactcagaag

SEQ ID NO: 2120690 - DNA, 20 bp, Homo sapiens
ccgggcactcagaagacact

SEQ ID NO: 2120691 - DNA, 15 bp, Homo sapiens
ccgggcaggtcctgc

SEQ ID NO: 2120692 - DNA, 18 bp, Homo sapiens
ccgggccactccttcctg

SEQ ID NO: 2120693 - DNA, 21 bp, Homo sapiens
ccgggccactccttcctgccc

SEQ ID NO: 2120694 - DNA, 17 bp, Homo sapiens
ccgggccatgctttcct

SEQ ID NO: 2120695 - DNA, 18 bp, Homo sapiens
ccgggcctgcctctgact

SEQ ID NO: 2120696 - DNA, 20 bp, Homo sapiens
ccgggcggaaggggacgcgg

SEQ ID NO: 2120697 - DNA, 12 bp, Homo sapiens
ccgggctctgac

SEQ ID NO: 2120698 - DNA, 20 bp, Homo sapiens
ccgggctgcccttcgctgcc

SEQ ID NO: 2120699 - DNA, 24 bp, Homo sapiens
ccgggctgcccttcgctgccagga

SEQ ID NO: 2120700 - DNA, 12 bp, Homo sapiens
ccgggcttgggc

SEQ ID NO: 2120701 - DNA, 21 bp, Homo sapiens
ccgggcttgggccctgcacag

SEQ ID NO: 2120702 - DNA, 20 bp, Homo sapiens
ccggggaacccagccctggg

SEQ ID NO: 2120703 - DNA, 18 bp, Homo sapiens
ccggggaactggccaagc

SEQ ID NO: 2120704 - DNA, 19 bp, Homo sapiens
ccggggctggcggctactc

SEQ ID NO: 2120705 - DNA, 18 bp, Homo sapiens
ccgggggccagacacaga

SEQ ID NO: 2120706 - DNA, 18 bp, Homo sapiens
ccggggtctgtgctgtgc

SEQ ID NO: 2120707 - DNA, 18 bp, Homo sapiens
ccggggttcaagccatgg

SEQ ID NO: 2120708 - DNA, 16 bp, Homo sapiens
ccgggtccccagctcc

SEQ ID NO: 2120709 - DNA, 22 bp, Homo sapiens
ccgggtgcctcagagcaggctc

SEQ ID NO: 2120710 - DNA, 20 bp, Homo sapiens
ccgggtggaaaagaatccct

SEQ ID NO: 2120711 - DNA, 15 bp, Homo sapiens
ccgggtgggcctggc

SEQ ID NO: 2120712 - DNA, 16 bp, Homo sapiens
ccgggtgggcctggcc

SEQ ID NO: 2120713 - DNA, 17 bp, Homo sapiens
ccgggtgggcctggcct

SEQ ID NO: 2120714 - DNA, 19 bp, Homo sapiens
ccgggtgggcctggcctga

SEQ ID NO: 2120715 - DNA, 21 bp, Homo sapiens
ccgggtgggcctggcctgagc

SEQ ID NO: 2120716 - DNA, 17 bp, Homo sapiens
ccgggtgtggcctcagc

SEQ ID NO: 2120717 - DNA, 21 bp, Homo sapiens
ccgggtgtggcctcagccctc

SEQ ID NO: 2120718 - DNA, 14 bp, Homo sapiens
ccggtcacccaggc

SEQ ID NO: 2120719 - DNA, 20 bp, Homo sapiens
ccggtcccttgagacctcag

SEQ ID NO: 2120720 - DNA, 22 bp, Homo sapiens
ccggtcctggccccagccccca

SEQ ID NO: 2120721 - DNA, 15 bp, Homo sapiens
ccggtgtgcctgcag

SEQ ID NO: 2120722 - DNA, 18 bp, Homo sapiens
ccgtacattcaatgttta

SEQ ID NO: 2120723 - DNA, 22 bp, Homo sapiens
ccgtacccccgtggtctttgaa

SEQ ID NO: 2120724 - DNA, 21 bp, Homo sapiens
cctagaagagtgtgaaaagga

SEQ ID NO: 2120725 - DNA, 13 bp, Homo sapiens
cctagaagggcta

SEQ ID NO: 2120726 - DNA, 22 bp, Homo sapiens
cctagaagggctagaacctgga

SEQ ID NO: 2120727 - DNA, 14 bp, Homo sapiens
cctagacctgggcc

SEQ ID NO: 2120728 - DNA, 21 bp, Homo sapiens
cctagactaattaaaatctgg

SEQ ID NO: 2120729 - DNA, 23 bp, Homo sapiens
cctagagaagctaaaacctgagc

SEQ ID NO: 2120730 - DNA, 14 bp, Homo sapiens
cctagagaggctgg

SEQ ID NO: 2120731 - DNA, 17 bp, Homo sapiens
cctagagaggctggcaa

SEQ ID NO: 2120732 - DNA, 15 bp, Homo sapiens
cctagagcacactgt

SEQ ID NO: 2120733 - DNA, 15 bp, Homo sapiens
cctagagctcctgtc

SEQ ID NO: 2120734 - DNA, 18 bp, Homo sapiens
cctagagctcctgtccct

SEQ ID NO: 2120735 - DNA, 19 bp, Homo sapiens
cctagagctcctgtcccta

SEQ ID NO: 2120736 - DNA, 21 bp, Homo sapiens
cctagagctcctgtccctacc

SEQ ID NO: 2120737 - DNA, 18 bp, Homo sapiens
cctagaggtgggcagctg

SEQ ID NO: 2120738 - DNA, 23 bp, Homo sapiens
cctagaggtgggcagctgggccc

SEQ ID NO: 2120739 - DNA, 13 bp, Homo sapiens
cctagcaggcaca

SEQ ID NO: 2120740 - DNA, 13 bp, Homo sapiens
cctagcagtgaac

SEQ ID NO: 2120741 - DNA, 16 bp, Homo sapiens
cctagcagtgaactat

SEQ ID NO: 2120742 - DNA, 12 bp, Homo sapiens
cctagccacctc

SEQ ID NO: 2120743 - DNA, 13 bp, Homo sapiens
cctagccacctcc

SEQ ID NO: 2120744 - DNA, 20 bp, Homo sapiens
ccctgccacactcagtcccc

SEQ ID NO: 2120745 - DNA, 12 bp, Homo sapiens
ccctgccaccct

SEQ ID NO: 2120746 - DNA, 17 bp, Homo sapiens
ccctgccacctgtctgt

SEQ ID NO: 2120747 - DNA, 13 bp, Homo sapiens
ccctgccaggagg

SEQ ID NO: 2120748 - DNA, 14 bp, Homo sapiens
ccctgccaggaggc

SEQ ID NO: 2120749 - DNA, 23 bp, Homo sapiens
ccctgccaggcccccgctggctc

SEQ ID NO: 2120750 - DNA, 14 bp, Homo sapiens
ccctgccagtgcct

SEQ ID NO: 2120751 - DNA, 23 bp, Homo sapiens
ccctgcccatacccctgcctggg

SEQ ID NO: 2120752 - DNA, 12 bp, Homo sapiens
ccctgccccaac

SEQ ID NO: 2120753 - DNA, 16 bp, Homo sapiens
ccctgccccagcaaga

SEQ ID NO: 2120754 - DNA, 19 bp, Homo sapiens
ccctgccccatcctgggcc

SEQ ID NO: 2120755 - DNA, 18 bp, Homo sapiens
ccctgcccctcccttcaa

SEQ ID NO: 2120756 - DNA, 17 bp, Homo sapiens
ccctgcccggctgcgga

SEQ ID NO: 2120757 - DNA, 17 bp, Homo sapiens
ccctgccctctccttcc

SEQ ID NO: 2120758 - DNA, 17 bp, Homo sapiens
ccctgccctgccacctg

SEQ ID NO: 2120759 - DNA, 17 bp, Homo sapiens
ccctgccctgtcctcca

SEQ ID NO: 2120760 - DNA, 23 bp, Homo sapiens
ccctgcccttgtttggggcagga

SEQ ID NO: 2120761 - DNA, 15 bp, Homo sapiens
ccctgcctgagccca

SEQ ID NO: 2120762 - DNA, 16 bp, Homo sapiens
ccctgcctgagcccag

SEQ ID NO: 2120763 - DNA, 13 bp, Homo sapiens
ccctgcctgccca

SEQ ID NO: 2120764 - DNA, 14 bp, Homo sapiens
ccctgcctgcccac

SEQ ID NO: 2120765 - DNA, 15 bp, Homo sapiens
ccctgcctgcccact

SEQ ID NO: 2120766 - DNA, 11 bp, Homo sapiens
ccctgcctgga

SEQ ID NO: 2120767 - DNA, 17 bp, Homo sapiens
ccctgcctggaggacct

SEQ ID NO: 2120768 - DNA, 18 bp, Homo sapiens
ccctgcctggaggacctg

SEQ ID NO: 2120769 - DNA, 19 bp, Homo sapiens
ccctgcctggaggacctga

SEQ ID NO: 2120770 - DNA, 14 bp, Homo sapiens
ccctgccttcagct

SEQ ID NO: 2120771 - DNA, 13 bp, Homo sapiens
ccctgcggagacc

SEQ ID NO: 2120772 - DNA, 18 bp, Homo sapiens
ccctgctaccaaggccca

SEQ ID NO: 2120773 - DNA, 17 bp, Homo sapiens
ccctgctactcctgtgc

SEQ ID NO: 2120774 - DNA, 13 bp, Homo sapiens
ccctgctcctccc

SEQ ID NO: 2120775 - DNA, 21 bp, Homo sapiens
ccctgctctccgaccagacac

SEQ ID NO: 2120776 - DNA, 19 bp, Homo sapiens
ccctgctggttcagggttg

SEQ ID NO: 2120777 - DNA, 14 bp, Homo sapiens
ccctgctgtgggag

SEQ ID NO: 2120778 - DNA, 13 bp, Homo sapiens
ccctgcttacctg

SEQ ID NO: 2120779 - DNA, 17 bp, Homo sapiens
ccctgcttacctgacgg

SEQ ID NO: 2120780 - DNA, 17 bp, Homo sapiens
ccctgctttgggctgcc

SEQ ID NO: 2120781 - DNA, 22 bp, Homo sapiens
ccctgctttgggctgccctggt

SEQ ID NO: 2120782 - DNA, 21 bp, Homo sapiens
ccctggaattcagcaccctgg

SEQ ID NO: 2120783 - DNA, 22 bp, Homo sapiens
ccctggaccaccagccccagca

SEQ ID NO: 2120784 - DNA, 13 bp, Homo sapiens
ccctggactggga

SEQ ID NO: 2120785 - DNA, 19 bp, Homo sapiens
ccctggagcggctctcctg

SEQ ID NO: 2120786 - DNA, 12 bp, Homo sapiens
ccctggaggggc

SEQ ID NO: 2120787 - DNA, 20 bp, Homo sapiens
ccctggagtcccctgggcct

SEQ ID NO: 2120788 - DNA, 17 bp, Homo sapiens
ccctggatcagaacagg

SEQ ID NO: 2120789 - DNA, 19 bp, Homo sapiens
ccctggatcagcgtggcct

SEQ ID NO: 2120790 - DNA, 19 bp, Homo sapiens
ccctggatccatcaggcca

SEQ ID NO: 2120791 - DNA, 22 bp, Homo sapiens
ccctggatgggcattgggctga

SEQ ID NO: 2120792 - DNA, 23 bp, Homo sapiens
ccctggatgggcattgggctgac

SEQ ID NO: 2120793 - DNA, 17 bp, Homo sapiens
ccctggatgtgcccaca

SEQ ID NO: 2120794 - DNA, 22 bp, Homo sapiens
ccctggatgtgcccacagggac

SEQ ID NO: 2120795 - DNA, 19 bp, Homo sapiens
ccctggatgtgtggggcat

SEQ ID NO: 2120796 - DNA, 21 bp, Homo sapiens
ccctggcatgaccatcctgtc

SEQ ID NO: 2120797 - DNA, 16 bp, Homo sapiens
ccctggcatgtcagag

SEQ ID NO: 2120798 - DNA, 22 bp, Homo sapiens
ccctggccggcccaggcctcca

SEQ ID NO: 2120799 - DNA, 10 bp, Homo sapiens
ccctggcctc

SEQ ID NO: 2120800 - DNA, 21 bp, Homo sapiens
ccctggcctgctgggctctcc

SEQ ID NO: 2120801 - DNA, 15 bp, Homo sapiens
ccctggcctggctct

SEQ ID NO: 2120802 - DNA, 19 bp, Homo sapiens
ccctggcctggctctcctg

SEQ ID NO: 2120803 - DNA, 13 bp, Homo sapiens
ccctggctctgca

SEQ ID NO: 2120804 - DNA, 16 bp, Homo sapiens
ccctggcttgcttgcc

SEQ ID NO: 2120805 - DNA, 23 bp, Homo sapiens
ccctggcttgtaactccaccaac

SEQ ID NO: 2120806 - DNA, 18 bp, Homo sapiens
ccctgggaactcatcctg

SEQ ID NO: 2120807 - DNA, 20 bp, Homo sapiens
ccctgggatgggaccaggga

SEQ ID NO: 2120808 - DNA, 19 bp, Homo sapiens
ccctgggcacccacctcca

SEQ ID NO: 2120809 - DNA, 22 bp, Homo sapiens
ccctgggccccaccacctaggc

SEQ ID NO: 2120810 - DNA, 17 bp, Homo sapiens
ccctgggcccctccacg

SEQ ID NO: 2120811 - DNA, 22 bp, Homo sapiens
ccctgggcccctccacgcctcc

SEQ ID NO: 2120812 - DNA, 11 bp, Homo sapiens
ccctgggcctg

SEQ ID NO: 2120813 - DNA, 13 bp, Homo sapiens
ccctgggcctgct

SEQ ID NO: 2120814 - DNA, 15 bp, Homo sapiens
ccctgggctctgccc

SEQ ID NO: 2120815 - DNA, 19 bp, Homo sapiens
ccctgggctgtctgtcacc

SEQ ID NO: 2120816 - DNA, 20 bp, Homo sapiens
ccctgggtgccattcccagc

SEQ ID NO: 2120817 - DNA, 18 bp, Homo sapiens
ccctggtaagcagaggct

SEQ ID NO: 2120818 - DNA, 23 bp, Homo sapiens
ccctggtaataagtactgtgtac

SEQ ID NO: 2120819 - DNA, 15 bp, Homo sapiens
ccctggtcctgaggg

SEQ ID NO: 2120820 - DNA, 17 bp, Homo sapiens
ccctggtccttccaggc

SEQ ID NO: 2120821 - DNA, 15 bp, Homo sapiens
ccctggtctgccctg

SEQ ID NO: 2120822 - DNA, 14 bp, Homo sapiens
ccctggtgctgcca

SEQ ID NO: 2120823 - DNA, 15 bp, Homo sapiens
ccctggtgctgccac

SEQ ID NO: 2120824 - DNA, 23 bp, Homo sapiens
ccctggtggacagtcctgggaga

SEQ ID NO: 2120825 - DNA, 15 bp, Homo sapiens
ccctggtggcagtgg

SEQ ID NO: 2120826 - DNA, 16 bp, Homo sapiens
ccctggtggcagtggg

SEQ ID NO: 2120827 - DNA, 21 bp, Homo sapiens
ccctggtggcagtgggagctg

SEQ ID NO: 2120828 - DNA, 22 bp, Homo sapiens
ccctggtggcagtgggagctgc

SEQ ID NO: 2120829 - DNA, 17 bp, Homo sapiens
ccctgtacaatatttaa

SEQ ID NO: 2120830 - DNA, 13 bp, Homo sapiens
ccctgtacccagc

SEQ ID NO: 2120831 - DNA, 16 bp, Homo sapiens
ccctgtacccagctcc

SEQ ID NO: 2120832 - DNA, 13 bp, Homo sapiens
ccctgtagctctg

SEQ ID NO: 2120833 - DNA, 18 bp, Homo sapiens
ccctgtagctctgcctcc

SEQ ID NO: 2120834 - DNA, 21 bp, Homo sapiens
ccctgtagctctgcctccctc

SEQ ID NO: 2120835 - DNA, 22 bp, Homo sapiens
ccctgtatataatactaaagtg

SEQ ID NO: 2120836 - DNA, 19 bp, Homo sapiens
ccctgtcaccaagctcaca

SEQ ID NO: 2120837 - DNA, 15 bp, Homo sapiens
ccctgtcccaccaac

SEQ ID NO: 2120838 - DNA, 16 bp, Homo sapiens
ccctgtcccaccaact

SEQ ID NO: 2120839 - DNA, 20 bp, Homo sapiens
ccctgtcccaccaactctgc

SEQ ID NO: 2120840 - DNA, 13 bp, Homo sapiens
ccctgtcccagca

SEQ ID NO: 2120841 - DNA, 16 bp, Homo sapiens
ccctgtcctcctcgga

SEQ ID NO: 2120842 - DNA, 15 bp, Homo sapiens
ccctgtcgagacact

SEQ ID NO: 2120843 - DNA, 13 bp, Homo sapiens
ccctgtcttgtcc

SEQ ID NO: 2120844 - DNA, 13 bp, Homo sapiens
ccctgtgccagct

SEQ ID NO: 2120845 - DNA, 21 bp, Homo sapiens
ccctgtgccagctcaggtgac

SEQ ID NO: 2120846 - DNA, 21 bp, Homo sapiens
ccctgtggattccagcatttg

SEQ ID NO: 2120847 - DNA, 13 bp, Homo sapiens
ccctgtggcagac

SEQ ID NO: 2120848 - DNA, 20 bp, Homo sapiens
ccctgtgggggcggctgtgg

SEQ ID NO: 2120849 - DNA, 22 bp, Homo sapiens
ccctgtgggggtggccatccct

SEQ ID NO: 2120850 - DNA, 23 bp, Homo sapiens
ccctgtgtgagttgagtctcctc

SEQ ID NO: 2120851 - DNA, 17 bp, Homo sapiens
ccctgttatctgctaga

SEQ ID NO: 2120852 - DNA, 14 bp, Homo sapiens
ccctgttctcagct

SEQ ID NO: 2120853 - DNA, 15 bp, Homo sapiens
ccctgttctcagctc

SEQ ID NO: 2120854 - DNA, 11 bp, Homo sapiens
ccctgtttaat

SEQ ID NO: 2120855 - DNA, 14 bp, Homo sapiens
ccctgtttaatatt

SEQ ID NO: 2120856 - DNA, 16 bp, Homo sapiens
ccctgtttaatattta

SEQ ID NO: 2120857 - DNA, 17 bp, Homo sapiens
ccctgtttaatatttaa

SEQ ID NO: 2120858 - DNA, 19 bp, Homo sapiens
ccctgtttcctttcaggag

SEQ ID NO: 2120859 - DNA, 15 bp, Homo sapiens
cccttacacgtacct

SEQ ID NO: 2120860 - DNA, 18 bp, Homo sapiens
cccttagagattgcccca

SEQ ID NO: 2120861 - DNA, 20 bp, Homo sapiens
cccttagagattgccccaga

SEQ ID NO: 2120862 - DNA, 12 bp, Homo sapiens
cccttatccagg

SEQ ID NO: 2120863 - DNA, 15 bp, Homo sapiens
cccttatccaggact

SEQ ID NO: 2120864 - DNA, 18 bp, Homo sapiens
cccttcaaccattcccca

SEQ ID NO: 2120865 - DNA, 16 bp, Homo sapiens
cccttcacagtgtttc

SEQ ID NO: 2120866 - DNA, 12 bp, Homo sapiens
cccttcagggcc

SEQ ID NO: 2120867 - DNA, 11 bp, Homo sapiens
cccttcatttg

SEQ ID NO: 2120868 - DNA, 20 bp, Homo sapiens
cccttccagtggtaccagct

SEQ ID NO: 2120869 - DNA, 20 bp, Homo sapiens
cccttccatgtcgcctctgc

SEQ ID NO: 2120870 - DNA, 18 bp, Homo sapiens
cccttcccaatcagcact

SEQ ID NO: 2120871 - DNA, 19 bp, Homo sapiens
cccttcccaatcagcactg

SEQ ID NO: 2120872 - DNA, 15 bp, Homo sapiens
cccttccctgctttg

SEQ ID NO: 2120873 - DNA, 20 bp, Homo sapiens
cccttcctacagatagtcaa

SEQ ID NO: 2120874 - DNA, 13 bp, Homo sapiens
cccttcctcctga

SEQ ID NO: 2120875 - DNA, 21 bp, Homo sapiens
cccttcctctccactgccttc

SEQ ID NO: 2120876 - DNA, 18 bp, Homo sapiens
cccttcctggacagctgt

SEQ ID NO: 2120877 - DNA, 20 bp, Homo sapiens
cccttcctggacagctgtgc

SEQ ID NO: 2120878 - DNA, 23 bp, Homo sapiens
cccttcctggcctcactggctgg

SEQ ID NO: 2120879 - DNA, 20 bp, Homo sapiens
cccttcctttcctctgcagc

SEQ ID NO: 2120880 - DNA, 16 bp, Homo sapiens
cccttcgctcctgtgt

SEQ ID NO: 2120881 - DNA, 16 bp, Homo sapiens
cccttcgctgccagga

SEQ ID NO: 2120882 - DNA, 17 bp, Homo sapiens
cccttcgctgccaggac

SEQ ID NO: 2120883 - DNA, 18 bp, Homo sapiens
cccttctctccttccctc

SEQ ID NO: 2120884 - DNA, 12 bp, Homo sapiens
cccttctgcctt

SEQ ID NO: 2120885 - DNA, 12 bp, Homo sapiens
cccttctgggca

SEQ ID NO: 2120886 - DNA, 12 bp, Homo sapiens
cccttctgtgtc

SEQ ID NO: 2120887 - DNA, 19 bp, Homo sapiens
cccttctttaaatcaaaag

SEQ ID NO: 2120888 - DNA, 20 bp, Homo sapiens
cccttgaagaggggaggggc

SEQ ID NO: 2120889 - DNA, 19 bp, Homo sapiens
cccttgaatctgcagggag

SEQ ID NO: 2120890 - DNA, 23 bp, Homo sapiens
cccttgacgtcaagtctccttcc

SEQ ID NO: 2120891 - DNA, 14 bp, Homo sapiens
cccttgagaaacct

SEQ ID NO: 2120892 - DNA, 16 bp, Homo sapiens
cccttgagacctcagc

SEQ ID NO: 2120893 - DNA, 15 bp, Homo sapiens
cccttgcccccatcc

SEQ ID NO: 2120894 - DNA, 15 bp, Homo sapiens
cccttgccctgacct

SEQ ID NO: 2120895 - DNA, 21 bp, Homo sapiens
cccttgccctgacctcccagc

SEQ ID NO: 2120896 - DNA, 20 bp, Homo sapiens
cccttggaaagttcagccag

SEQ ID NO: 2120897 - DNA, 21 bp, Homo sapiens
cccttggaaagttcagccaga

SEQ ID NO: 2120898 - DNA, 18 bp, Homo sapiens
cccttggcgggcagccca

SEQ ID NO: 2120899 - DNA, 14 bp, Homo sapiens
cccttggcttcctc

SEQ ID NO: 2120900 - DNA, 23 bp, Homo sapiens
cccttgggcatccacccagtgct

SEQ ID NO: 2120901 - DNA, 20 bp, Homo sapiens
cccttgtacctatggctgcc

SEQ ID NO: 2120902 - DNA, 14 bp, Homo sapiens
cccttgtcctgcca

SEQ ID NO: 2120903 - DNA, 14 bp, Homo sapiens
cccttgtgtcagag

SEQ ID NO: 2120904 - DNA, 12 bp, Homo sapiens
cccttgtgtgtg

SEQ ID NO: 2120905 - DNA, 21 bp, Homo sapiens
ccctttcccatgatccagaac

SEQ ID NO: 2120906 - DNA, 12 bp, Homo sapiens
ccctttccccca

SEQ ID NO: 2120907 - DNA, 20 bp, Homo sapiens
ccctttcccccaccccagag

SEQ ID NO: 2120908 - DNA, 22 bp, Homo sapiens
ccctttcccccaccccagagtt

SEQ ID NO: 2120909 - DNA, 21 bp, Homo sapiens
ccctttccttccttccctggc

SEQ ID NO: 2120910 - DNA, 14 bp, Homo sapiens
ccctttctcttctt

SEQ ID NO: 2120911 - DNA, 12 bp, Homo sapiens
ccctttctgtgt

SEQ ID NO: 2120912 - DNA, 20 bp, Homo sapiens
ccctttgcaggcccagcaga

SEQ ID NO: 2120913 - DNA, 23 bp, Homo sapiens
ccctttgggtactactgctgcaa

SEQ ID NO: 2120914 - DNA, 16 bp, Homo sapiens
cccttttacagctctt

SEQ ID NO: 2120915 - DNA, 16 bp, Homo sapiens
cccttttctacagtta

SEQ ID NO: 2120916 - DNA, 17 bp, Homo sapiens
cccttttgcctggctgt

SEQ ID NO: 2120917 - DNA, 19 bp, Homo sapiens
cccttttgcctggctgtgg

SEQ ID NO: 2120918 - DNA, 24 bp, Homo sapiens
ccgaaacaggctactctcctcggc

SEQ ID NO: 2120919 - DNA, 14 bp, Homo sapiens
ccgaagagccctga

SEQ ID NO: 2120920 - DNA, 18 bp, Homo sapiens
ccgaagagccctgagctc

SEQ ID NO: 2120921 - DNA, 22 bp, Homo sapiens
ccgaagaggaagcaagaaagcc

SEQ ID NO: 2120922 - DNA, 11 bp, Homo sapiens
ccgaagcccag

SEQ ID NO: 2120923 - DNA, 12 bp, Homo sapiens
ccgaagcccagt

SEQ ID NO: 2120924 - DNA, 23 bp, Homo sapiens
ccgaagctaacagggaaggcagg

SEQ ID NO: 2120925 - DNA, 20 bp, Homo sapiens
ccgaatagctgggactacag

SEQ ID NO: 2120926 - DNA, 13 bp, Homo sapiens
ccgaatgcctgtc

SEQ ID NO: 2120927 - DNA, 23 bp, Homo sapiens
ccgaattttattttacagagctt

SEQ ID NO: 2120928 - DNA, 19 bp, Homo sapiens
ccgacagcccagcctagcc

SEQ ID NO: 2120929 - DNA, 20 bp, Homo sapiens
ccgacaggcatgcaccagtg

SEQ ID NO: 2120930 - DNA, 15 bp, Homo sapiens
ccgaccacctgccca

SEQ ID NO: 2120931 - DNA, 14 bp, Homo sapiens
ccgaccccatctca

SEQ ID NO: 2120932 - DNA, 23 bp, Homo sapiens
ccgacctcgtcctccccctgcca

SEQ ID NO: 2120933 - DNA, 15 bp, Homo sapiens
ccgactagcaggcat

SEQ ID NO: 2120934 - DNA, 10 bp, Homo sapiens
ccgactcagg

SEQ ID NO: 2120935 - DNA, 14 bp, Homo sapiens
ccgactcagggacc

SEQ ID NO: 2120936 - DNA, 15 bp, Homo sapiens
ccgactcagggacct

SEQ ID NO: 2120937 - DNA, 11 bp, Homo sapiens
ccgactccagc

SEQ ID NO: 2120938 - DNA, 14 bp, Homo sapiens
ccgactccagccag

SEQ ID NO: 2120939 - DNA, 16 bp, Homo sapiens
ccgactccagccagcg

SEQ ID NO: 2120940 - DNA, 12 bp, Homo sapiens
ccgagaaaagga

SEQ ID NO: 2120941 - DNA, 22 bp, Homo sapiens
ccgagagaggcgcgtctgcccc

SEQ ID NO: 2120942 - DNA, 13 bp, Homo sapiens
ccgagagcctgct

SEQ ID NO: 2120943 - DNA, 14 bp, Homo sapiens
ccgagagcctgctc

SEQ ID NO: 2120944 - DNA, 15 bp, Homo sapiens
ccgagagcctgctcc

SEQ ID NO: 2120945 - DNA, 22 bp, Homo sapiens
ccgagagtagccgagagcctgc

SEQ ID NO: 2120946 - DNA, 18 bp, Homo sapiens
ccgagatcacgccactgc

SEQ ID NO: 2120947 - DNA, 17 bp, Homo sapiens
ccgagattgcgccactg

SEQ ID NO: 2120948 - DNA, 14 bp, Homo sapiens
ccgagcaaccgtgg

SEQ ID NO: 2120949 - DNA, 18 bp, Homo sapiens
ccgagcaaccgtggccct

SEQ ID NO: 2120950 - DNA, 14 bp, Homo sapiens
ccgagcagctgagc

SEQ ID NO: 2120951 - DNA, 15 bp, Homo sapiens
ccgagcagctgagca

SEQ ID NO: 2120952 - DNA, 16 bp, Homo sapiens
ccgagcccagctacat

SEQ ID NO: 2120953 - DNA, 18 bp, Homo sapiens
ccgagcccagctacattc

SEQ ID NO: 2120954 - DNA, 21 bp, Homo sapiens
ccgagcccagctacattcctc

SEQ ID NO: 2120955 - DNA, 18 bp, Homo sapiens
ccgagcggtgtggggacc

SEQ ID NO: 2120956 - DNA, 20 bp, Homo sapiens
ccgaggcagggtcaggagag

SEQ ID NO: 2120957 - DNA, 12 bp, Homo sapiens
ccgagggcctga

SEQ ID NO: 2120958 - DNA, 17 bp, Homo sapiens
ccgagtagctgggacta

SEQ ID NO: 2120959 - DNA, 14 bp, Homo sapiens
ccgagtctcttctc

SEQ ID NO: 2120960 - DNA, 12 bp, Homo sapiens
ccgatgccagcc

SEQ ID NO: 2120961 - DNA, 15 bp, Homo sapiens
ccgcaagcgcaggga

SEQ ID NO: 2120962 - DNA, 18 bp, Homo sapiens
ccgcaagcgcagggagga

SEQ ID NO: 2120963 - DNA, 20 bp, Homo sapiens
ccgcaagcgcagggaggatg

SEQ ID NO: 2120964 - DNA, 17 bp, Homo sapiens
ccgcaagttcagggaag

SEQ ID NO: 2120965 - DNA, 13 bp, Homo sapiens
ccgcaccagctgc

SEQ ID NO: 2120966 - DNA, 16 bp, Homo sapiens
ccgcaccagctgctct

SEQ ID NO: 2120967 - DNA, 17 bp, Homo sapiens
ccgcaccagctgctctg

SEQ ID NO: 2120968 - DNA, 22 bp, Homo sapiens
ccgcaccagctgctctgcccct

SEQ ID NO: 2120969 - DNA, 17 bp, Homo sapiens
ccgcaccccagagtgtg

SEQ ID NO: 2120970 - DNA, 19 bp, Homo sapiens
ccgcaccgggccctccttg

SEQ ID NO: 2120971 - DNA, 13 bp, Homo sapiens
ccgcagaaggaag

SEQ ID NO: 2120972 - DNA, 18 bp, Homo sapiens
ccgcagaaggaaggcagg

SEQ ID NO: 2120973 - DNA, 21 bp, Homo sapiens
ccgcagcccgtgaagcagtgc

SEQ ID NO: 2120974 - DNA, 15 bp, Homo sapiens
ccgcagggacgggga

SEQ ID NO: 2120975 - DNA, 14 bp, Homo sapiens
ccgcattccctgag

SEQ ID NO: 2120976 - DNA, 15 bp, Homo sapiens
ccgcattccctgagt

SEQ ID NO: 2120977 - DNA, 15 bp, Homo sapiens
ccgccacggccaccc

SEQ ID NO: 2120978 - DNA, 15 bp, Homo sapiens
tggcttcccatgtct

SEQ ID NO: 2120979 - DNA, 15 bp, Homo sapiens
tggcttcccgctcag

SEQ ID NO: 2120980 - DNA, 22 bp, Homo sapiens
tggcttcctaaaattcagtgga

SEQ ID NO: 2120981 - DNA, 22 bp, Homo sapiens
tggcttcctccgtccacccagg

SEQ ID NO: 2120982 - DNA, 13 bp, Homo sapiens
tggcttcctcctg

SEQ ID NO: 2120983 - DNA, 22 bp, Homo sapiens
tggcttcgtcatttgcaagctg

SEQ ID NO: 2120984 - DNA, 13 bp, Homo sapiens
tggcttctcctgt

SEQ ID NO: 2120985 - DNA, 15 bp, Homo sapiens
tggcttctcctgtga

SEQ ID NO: 2120986 - DNA, 19 bp, Homo sapiens
tggcttctgggacctgtgt

SEQ ID NO: 2120987 - DNA, 14 bp, Homo sapiens
tggcttctgggaga

SEQ ID NO: 2120988 - DNA, 14 bp, Homo sapiens
tggcttctgtgcac

SEQ ID NO: 2120989 - DNA, 22 bp, Homo sapiens
tggcttctgtgcactagcctgt

SEQ ID NO: 2120990 - DNA, 12 bp, Homo sapiens
tggcttgctcca

SEQ ID NO: 2120991 - DNA, 13 bp, Homo sapiens
tggcttgctccag

SEQ ID NO: 2120992 - DNA, 15 bp, Homo sapiens
tggcttgctccaggg

SEQ ID NO: 2120993 - DNA, 19 bp, Homo sapiens
tggcttgctccagggtctt

SEQ ID NO: 2120994 - DNA, 22 bp, Homo sapiens
tggcttgtgattctgggatgga

SEQ ID NO: 2120995 - DNA, 18 bp, Homo sapiens
tggctttgacatgaaaag

SEQ ID NO: 2120996 - DNA, 16 bp, Homo sapiens
tggcttttcactgctg

SEQ ID NO: 2120997 - DNA, 22 bp, Homo sapiens
tggcttttcgcttgcttctgca

SEQ ID NO: 2120998 - DNA, 19 bp, Homo sapiens
tggcttttttcctcctgtg

SEQ ID NO: 2120999 - DNA, 22 bp, Homo sapiens
tgggaaaaaagttttgatgaaa

SEQ ID NO: 2121000 - DNA, 17 bp, Homo sapiens
tgggaaaagtgttatta

SEQ ID NO: 2121001 - DNA, 13 bp, Homo sapiens
tgggaaaggaaaa

SEQ ID NO: 2121002 - DNA, 23 bp, Homo sapiens
tgggaaagggacccgaagcccag

SEQ ID NO: 2121003 - DNA, 17 bp, Homo sapiens
tgggaaataagagagaa

SEQ ID NO: 2121004 - DNA, 23 bp, Homo sapiens
tgggaaatggtatgagctgaggg

SEQ ID NO: 2121005 - DNA, 17 bp, Homo sapiens
tgggaaccatgaagctg

SEQ ID NO: 2121006 - DNA, 20 bp, Homo sapiens
tgggaaccccttcatcctct

SEQ ID NO: 2121007 - DNA, 19 bp, Homo sapiens
tgggaacccgactgtgaaa

SEQ ID NO: 2121008 - DNA, 23 bp, Homo sapiens
tgggaacctagtactctctgctc

SEQ ID NO: 2121009 - DNA, 18 bp, Homo sapiens
tgggaacgtgactgcccc

SEQ ID NO: 2121010 - DNA, 24 bp, Homo sapiens
tgggaagctgtactcagagcagag

SEQ ID NO: 2121011 - DNA, 13 bp, Homo sapiens
tgggaagcttgct

SEQ ID NO: 2121012 - DNA, 17 bp, Homo sapiens
tgggaagcttgctggct

SEQ ID NO: 2121013 - DNA, 23 bp, Homo sapiens
tgggaaggctacttcggggctgg

SEQ ID NO: 2121014 - DNA, 21 bp, Homo sapiens
tgggaagggagagcggggcag

SEQ ID NO: 2121015 - DNA, 22 bp, Homo sapiens
tgggaattctttacaataaaca

SEQ ID NO: 2121016 - DNA, 13 bp, Homo sapiens
tgggaattgcatg

SEQ ID NO: 2121017 - DNA, 23 bp, Homo sapiens
tgggacaaaccagagcagagagc

SEQ ID NO: 2121018 - DNA, 16 bp, Homo sapiens
tgggacagcaacctgt

SEQ ID NO: 2121019 - DNA, 16 bp, Homo sapiens
tgggacagccccaggg

SEQ ID NO: 2121020 - DNA, 18 bp, Homo sapiens
tgggacagccccagggcc

SEQ ID NO: 2121021 - DNA, 19 bp, Homo sapiens
tgggacagccccagggccc

SEQ ID NO: 2121022 - DNA, 14 bp, Homo sapiens
tgggaccaggcacc

SEQ ID NO: 2121023 - DNA, 14 bp, Homo sapiens
tgggaccagggcat

SEQ ID NO: 2121024 - DNA, 18 bp, Homo sapiens
tgggacccagctactctg

SEQ ID NO: 2121025 - DNA, 22 bp, Homo sapiens
tgggacccctcccaacctcaat

SEQ ID NO: 2121026 - DNA, 14 bp, Homo sapiens
tgggactacaggca

SEQ ID NO: 2121027 - DNA, 18 bp, Homo sapiens
tgggactacaggcaccca

SEQ ID NO: 2121028 - DNA, 22 bp, Homo sapiens
tgggagaacctcaggcttcctt

SEQ ID NO: 2121029 - DNA, 22 bp, Homo sapiens
tgggagacaagaaatccctgtt

SEQ ID NO: 2121030 - DNA, 19 bp, Homo sapiens
tgggagagaatatttcaaa

SEQ ID NO: 2121031 - DNA, 14 bp, Homo sapiens
tgggagagcccagc

SEQ ID NO: 2121032 - DNA, 12 bp, Homo sapiens
tgggagcactgg

SEQ ID NO: 2121033 - DNA, 23 bp, Homo sapiens
tgggagcactggagtgcagggag

SEQ ID NO: 2121034 - DNA, 19 bp, Homo sapiens
tgggagcctgaggcatgag

SEQ ID NO: 2121035 - DNA, 22 bp, Homo sapiens
tgggagcctgcaaactcactgc

SEQ ID NO: 2121036 - DNA, 21 bp, Homo sapiens
tgggagctgcctgttcagctc

SEQ ID NO: 2121037 - DNA, 12 bp, Homo sapiens
tgggaggaaaag

SEQ ID NO: 2121038 - DNA, 20 bp, Homo sapiens
tgggaggaaaagaaaagagg

SEQ ID NO: 2121039 - DNA, 11 bp, Homo sapiens
tgggaggaagc

SEQ ID NO: 2121040 - DNA, 22 bp, Homo sapiens
tgggaggcctcgtaccagccag

SEQ ID NO: 2121041 - DNA, 17 bp, Homo sapiens
tgggaggctggtctccc

SEQ ID NO: 2121042 - DNA, 19 bp, Homo sapiens
tgggagggagcagacagga

SEQ ID NO: 2121043 - DNA, 18 bp, Homo sapiens
tgggagggagggagaggt

SEQ ID NO: 2121044 - DNA, 23 bp, Homo sapiens
tgggagggggctatttctctccc

SEQ ID NO: 2121045 - DNA, 18 bp, Homo sapiens
tgggagggggctccatgg

SEQ ID NO: 2121046 - DNA, 22 bp, Homo sapiens
tgggagtagcatggactctggg

SEQ ID NO: 2121047 - DNA, 15 bp, Homo sapiens
tgggagtgagctggt

SEQ ID NO: 2121048 - DNA, 20 bp, Homo sapiens
tgggatataagaggcagcgt

SEQ ID NO: 2121049 - DNA, 15 bp, Homo sapiens
tgggatatgacaagc

SEQ ID NO: 2121050 - DNA, 21 bp, Homo sapiens
tgggatgcggggcagagccac

SEQ ID NO: 2121051 - DNA, 14 bp, Homo sapiens
tgggatggaggaga

SEQ ID NO: 2121052 - DNA, 16 bp, Homo sapiens
tgggatggaggagaag

SEQ ID NO: 2121053 - DNA, 18 bp, Homo sapiens
tgggatggaggtatacaa

SEQ ID NO: 2121054 - DNA, 15 bp, Homo sapiens
tgggatgggaccagg

SEQ ID NO: 2121055 - DNA, 13 bp, Homo sapiens
tgggatgtcctct

SEQ ID NO: 2121056 - DNA, 20 bp, Homo sapiens
tgggatgttaagcaaaggaa

SEQ ID NO: 2121057 - DNA, 16 bp, Homo sapiens
tgggattacaggtgtg

SEQ ID NO: 2121058 - DNA, 23 bp, Homo sapiens
tgggattcaggaaaaggcctggg

SEQ ID NO: 2121059 - DNA, 16 bp, Homo sapiens
tgggattttaaaaaca

SEQ ID NO: 2121060 - DNA, 16 bp, Homo sapiens
tgggcaacagagcaag

SEQ ID NO: 2121061 - DNA, 17 bp, Homo sapiens
tgggcacatgaggaggg

SEQ ID NO: 2121062 - DNA, 20 bp, Homo sapiens
tgggcacatgaggagggtgc

SEQ ID NO: 2121063 - DNA, 19 bp, Homo sapiens
tggtgactgaacgagggat

SEQ ID NO: 2121064 - DNA, 14 bp, Homo sapiens
tggtgactgtccca

SEQ ID NO: 2121065 - DNA, 15 bp, Homo sapiens
tggtgactgtcccac

SEQ ID NO: 2121066 - DNA, 18 bp, Homo sapiens
tggtgagctgggaagctg

SEQ ID NO: 2121067 - DNA, 17 bp, Homo sapiens
tggtgaggcccagcctg

SEQ ID NO: 2121068 - DNA, 19 bp, Homo sapiens
tggtgaggcccagcctgtc

SEQ ID NO: 2121069 - DNA, 21 bp, Homo sapiens
tggtgaggcccagcctgtcct

SEQ ID NO: 2121070 - DNA, 14 bp, Homo sapiens
tggtgaggtgtgga

SEQ ID NO: 2121071 - DNA, 18 bp, Homo sapiens
tggtgatcaattaaatgt

SEQ ID NO: 2121072 - DNA, 19 bp, Homo sapiens
tggtgcagaggtgagcaga

SEQ ID NO: 2121073 - DNA, 23 bp, Homo sapiens
tggtgcagaggtgagcagaggag

SEQ ID NO: 2121074 - DNA, 19 bp, Homo sapiens
tggtgcagaggtttcttga

SEQ ID NO: 2121075 - DNA, 14 bp, Homo sapiens
tggtgccagaggtt

SEQ ID NO: 2121076 - DNA, 22 bp, Homo sapiens
tggtgcctatttattcattcag

SEQ ID NO: 2121077 - DNA, 18 bp, Homo sapiens
tggtgcctgcctctgcca

SEQ ID NO: 2121078 - DNA, 18 bp, Homo sapiens
tggtgcctggcctggcac

SEQ ID NO: 2121079 - DNA, 22 bp, Homo sapiens
tggtgcctggcctggcacacat

SEQ ID NO: 2121080 - DNA, 14 bp, Homo sapiens
tggtgccttcattt

SEQ ID NO: 2121081 - DNA, 12 bp, Homo sapiens
tggtgctaactg

SEQ ID NO: 2121082 - DNA, 18 bp, Homo sapiens
tggtgctataggctggag

SEQ ID NO: 2121083 - DNA, 15 bp, Homo sapiens
tggtgctgacctctg

SEQ ID NO: 2121084 - DNA, 15 bp, Homo sapiens
tggtgctgcaaggaa

SEQ ID NO: 2121085 - DNA, 12 bp, Homo sapiens
tggtgctgtggc

SEQ ID NO: 2121086 - DNA, 17 bp, Homo sapiens
tggtggacagtcctggg

SEQ ID NO: 2121087 - DNA, 19 bp, Homo sapiens
tggtggaccacaggcatct

SEQ ID NO: 2121088 - DNA, 16 bp, Homo sapiens
tggtggcaccagatgc

SEQ ID NO: 2121089 - DNA, 18 bp, Homo sapiens
tggtggcagtgggagctg

SEQ ID NO: 2121090 - DNA, 20 bp, Homo sapiens
tggtggcagtgggagctgcc

SEQ ID NO: 2121091 - DNA, 21 bp, Homo sapiens
tggtggcccgacagcctggca

SEQ ID NO: 2121092 - DNA, 13 bp, Homo sapiens
tggtggctgggtt

SEQ ID NO: 2121093 - DNA, 14 bp, Homo sapiens
tggtggctgtctct

SEQ ID NO: 2121094 - DNA, 15 bp, Homo sapiens
tggtggctgtctctg

SEQ ID NO: 2121095 - DNA, 14 bp, Homo sapiens
tggtggggcagctc

SEQ ID NO: 2121096 - DNA, 18 bp, Homo sapiens
tggtgtaatgcacaattt

SEQ ID NO: 2121097 - DNA, 23 bp, Homo sapiens
tggtgtaatgcacaatttagaaa

SEQ ID NO: 2121098 - DNA, 15 bp, Homo sapiens
tggtgtccacctggc

SEQ ID NO: 2121099 - DNA, 21 bp, Homo sapiens
tggtgtccagacagagccctg

SEQ ID NO: 2121100 - DNA, 23 bp, Homo sapiens
tggtgtggctgtattcagatcgt

SEQ ID NO: 2121101 - DNA, 21 bp, Homo sapiens
tggtgttacacagcccaagag

SEQ ID NO: 2121102 - DNA, 23 bp, Homo sapiens
tggtgttacacagcccaagagga

SEQ ID NO: 2121103 - DNA, 21 bp, Homo sapiens
tggtgttctcaatgcttttct

SEQ ID NO: 2121104 - DNA, 17 bp, Homo sapiens
tggtgttttataggtca

SEQ ID NO: 2121105 - DNA, 17 bp, Homo sapiens
tggttaaaataaagcct

SEQ ID NO: 2121106 - DNA, 20 bp, Homo sapiens
tggttaaaataaagcctatt

SEQ ID NO: 2121107 - DNA, 17 bp, Homo sapiens
tggttaatctttcctga

SEQ ID NO: 2121108 - DNA, 13 bp, Homo sapiens
tggttaatgccat

SEQ ID NO: 2121109 - DNA, 22 bp, Homo sapiens
tggttagtggggtaattctgct

SEQ ID NO: 2121110 - DNA, 23 bp, Homo sapiens
tggttcagggttggcccctgccc

SEQ ID NO: 2121111 - DNA, 17 bp, Homo sapiens
tggttccatgcctgagg

SEQ ID NO: 2121112 - DNA, 19 bp, Homo sapiens
tggttcccaataaaagtga

SEQ ID NO: 2121113 - DNA, 21 bp, Homo sapiens
tggttcccaataaaagtgact

SEQ ID NO: 2121114 - DNA, 19 bp, Homo sapiens
tggttcccctgttcactct

SEQ ID NO: 2121115 - DNA, 17 bp, Homo sapiens
tggttcctaagcctgtt

SEQ ID NO: 2121116 - DNA, 14 bp, Homo sapiens
tggttccttccctg

SEQ ID NO: 2121117 - DNA, 15 bp, Homo sapiens
tggttctaatagaac

SEQ ID NO: 2121118 - DNA, 15 bp, Homo sapiens
tggttctctccagga

SEQ ID NO: 2121119 - DNA, 15 bp, Homo sapiens
tggttgactgggttt

SEQ ID NO: 2121120 - DNA, 15 bp, Homo sapiens
tggttgaggtggaag

SEQ ID NO: 2121121 - DNA, 18 bp, Homo sapiens
tggttgatgatctttgca

SEQ ID NO: 2121122 - DNA, 23 bp, Homo sapiens
tggttggccgtggtccagctctt

SEQ ID NO: 2121123 - DNA, 17 bp, Homo sapiens
tggttgtaaatgctcgt

SEQ ID NO: 2121124 - DNA, 18 bp, Homo sapiens
tggttgtaaatgctcgtg

SEQ ID NO: 2121125 - DNA, 11 bp, Homo sapiens
tggtttactgc

SEQ ID NO: 2121126 - DNA, 17 bp, Homo sapiens
tggtttagtgttctgta

SEQ ID NO: 2121127 - DNA, 11 bp, Homo sapiens
tggtttataga

SEQ ID NO: 2121128 - DNA, 12 bp, Homo sapiens
tggtttatgtca

SEQ ID NO: 2121129 - DNA, 21 bp, Homo sapiens
tggtttctcagaatccaaaga

SEQ ID NO: 2121130 - DNA, 20 bp, Homo sapiens
tggtttgatggtgacttcct

SEQ ID NO: 2121131 - DNA, 23 bp, Homo sapiens
tggtttggcaacacctccttgct

SEQ ID NO: 2121132 - DNA, 15 bp, Homo sapiens
tggtttggggagaaa

SEQ ID NO: 2121133 - DNA, 20 bp, Homo sapiens
tggtttgtcatatattcatg

SEQ ID NO: 2121134 - DNA, 19 bp, Homo sapiens
tggttttctccaagagcta

SEQ ID NO: 2121135 - DNA, 24 bp, Homo sapiens
tggtttttgcaagatttaacacta

SEQ ID NO: 2121136 - DNA, 20 bp, Homo sapiens
tgtaaaaacaaaaagacagt

SEQ ID NO: 2121137 - DNA, 23 bp, Homo sapiens
tgtaaaacaaaaatgtaatgatc

SEQ ID NO: 2121138 - DNA, 19 bp, Homo sapiens
tgtaaaaccatgtagtttt

SEQ ID NO: 2121139 - DNA, 16 bp, Homo sapiens
tgtaaaacctgtcaat

SEQ ID NO: 2121140 - DNA, 19 bp, Homo sapiens
tgtaaaagaacagtaaaca

SEQ ID NO: 2121141 - DNA, 18 bp, Homo sapiens
tgtaaaataagaatgatt

SEQ ID NO: 2121142 - DNA, 14 bp, Homo sapiens
tgtaaaatagcttg

SEQ ID NO: 2121143 - DNA, 13 bp, Homo sapiens
tgtaaaatgcagt

SEQ ID NO: 2121144 - DNA, 15 bp, Homo sapiens
tgtaaaatgcagtcc

SEQ ID NO: 2121145 - DNA, 12 bp, Homo sapiens
tgtaaacagtgc

SEQ ID NO: 2121146 - DNA, 16 bp, Homo sapiens
tgtaaacagtgcctgc

SEQ ID NO: 2121147 - DNA, 14 bp, Homo sapiens
tgtaaacatgtgtt

SEQ ID NO: 2121148 - DNA, 12 bp, Homo sapiens
tgtaaactataa

SEQ ID NO: 2121149 - DNA, 22 bp, Homo sapiens
tgtaaactataaactactgtaa

SEQ ID NO: 2121150 - DNA, 16 bp, Homo sapiens
tgtaaactcaaaactt

SEQ ID NO: 2121151 - DNA, 22 bp, Homo sapiens
tgtaaactcaaaacttaacata

SEQ ID NO: 2121152 - DNA, 20 bp, Homo sapiens
tgtaaactgtatcaaatctg

SEQ ID NO: 2121153 - DNA, 15 bp, Homo sapiens
tgtaaagaataaatg

SEQ ID NO: 2121154 - DNA, 19 bp, Homo sapiens
tgtaaaggtcagagtcaaa

SEQ ID NO: 2121155 - DNA, 14 bp, Homo sapiens
tgtaaataaataga

SEQ ID NO: 2121156 - DNA, 23 bp, Homo sapiens
tgtaaatacaaaataaaattatg

SEQ ID NO: 2121157 - DNA, 18 bp, Homo sapiens
tgcctttcttatttgcaa

SEQ ID NO: 2121158 - DNA, 23 bp, Homo sapiens
tgcctttcttatttgcaataaaa

SEQ ID NO: 2121159 - DNA, 19 bp, Homo sapiens
tgcctttgaaattccccca

SEQ ID NO: 2121160 - DNA, 20 bp, Homo sapiens
tgcctttgaaattcccccac

SEQ ID NO: 2121161 - DNA, 16 bp, Homo sapiens
tgccttttaaaagaaa

SEQ ID NO: 2121162 - DNA, 22 bp, Homo sapiens
tgccttttatagctattactgt

SEQ ID NO: 2121163 - DNA, 15 bp, Homo sapiens
tgccttttccctctg

SEQ ID NO: 2121164 - DNA, 18 bp, Homo sapiens
tgcctttttgtttttgta

SEQ ID NO: 2121165 - DNA, 23 bp, Homo sapiens
tgccttttttcacagcccgggtg

SEQ ID NO: 2121166 - DNA, 14 bp, Homo sapiens
tgcgaaaacttgaa

SEQ ID NO: 2121167 - DNA, 19 bp, Homo sapiens
tgcgagagaggtgggcagc

SEQ ID NO: 2121168 - DNA, 22 bp, Homo sapiens
tgcgagagaggtgggcagcagc

SEQ ID NO: 2121169 - DNA, 18 bp, Homo sapiens
tgcgagcatttccctccc

SEQ ID NO: 2121170 - DNA, 21 bp, Homo sapiens
tgcgagcgctatcttcacata

SEQ ID NO: 2121171 - DNA, 22 bp, Homo sapiens
tgcgcacacacagatatgcaca

SEQ ID NO: 2121172 - DNA, 20 bp, Homo sapiens
tgcgccactgagacggcaga

SEQ ID NO: 2121173 - DNA, 13 bp, Homo sapiens
tgcgcctacagga

SEQ ID NO: 2121174 - DNA, 20 bp, Homo sapiens
tgcggacagccacggccagg

SEQ ID NO: 2121175 - DNA, 23 bp, Homo sapiens
tgcggacagccacggccaggcca

SEQ ID NO: 2121176 - DNA, 13 bp, Homo sapiens
tgcggcaggagca

SEQ ID NO: 2121177 - DNA, 17 bp, Homo sapiens
tgcggcaggagcaggaa

SEQ ID NO: 2121178 - DNA, 20 bp, Homo sapiens
tgcggcaggagcaggaacag

SEQ ID NO: 2121179 - DNA, 19 bp, Homo sapiens
tgcggccgcattccctgag

SEQ ID NO: 2121180 - DNA, 21 bp, Homo sapiens
tgcgggaccggtacagaaagg

SEQ ID NO: 2121181 - DNA, 17 bp, Homo sapiens
tgcggtccacccaggag

SEQ ID NO: 2121182 - DNA, 21 bp, Homo sapiens
tgcggtggctcacgcctgtaa

SEQ ID NO: 2121183 - DNA, 20 bp, Homo sapiens
tgcgtacgtttcctgagaag

SEQ ID NO: 2121184 - DNA, 17 bp, Homo sapiens
tgcgtatatgtgcgtct

SEQ ID NO: 2121185 - DNA, 22 bp, Homo sapiens
tgcgtatatgtgcgtctctctt

SEQ ID NO: 2121186 - DNA, 15 bp, Homo sapiens
tgcgtcccccagccc

SEQ ID NO: 2121187 - DNA, 23 bp, Homo sapiens
tgcgtccccccccaacctttccc

SEQ ID NO: 2121188 - DNA, 19 bp, Homo sapiens
tgcgtcctgcagaggacca

SEQ ID NO: 2121189 - DNA, 21 bp, Homo sapiens
tgcgtctctctttctccctca

SEQ ID NO: 2121190 - DNA, 19 bp, Homo sapiens
tgcgtgactattttttaat

SEQ ID NO: 2121191 - DNA, 21 bp, Homo sapiens
tgcgtgactattttttaataa

SEQ ID NO: 2121192 - DNA, 23 bp, Homo sapiens
tgcgtgactattttttaataaaa

SEQ ID NO: 2121193 - DNA, 21 bp, Homo sapiens
tgcgtgctttatttatggctt

SEQ ID NO: 2121194 - DNA, 17 bp, Homo sapiens
tgcgtggactctgcaca

SEQ ID NO: 2121195 - DNA, 21 bp, Homo sapiens
tgcgtggctgtggcacagact

SEQ ID NO: 2121196 - DNA, 23 bp, Homo sapiens
tgcgtgttagtgtgtgtgcatgt

SEQ ID NO: 2121197 - DNA, 13 bp, Homo sapiens
tgcgttactaatt

SEQ ID NO: 2121198 - DNA, 23 bp, Homo sapiens
tgcgttggaatcacctggagggc

SEQ ID NO: 2121199 - DNA, 22 bp, Homo sapiens
tgctaaacgactccgagaacaa

SEQ ID NO: 2121200 - DNA, 13 bp, Homo sapiens
tgctaaatgaaga

SEQ ID NO: 2121201 - DNA, 20 bp, Homo sapiens
tgctaaatggtcgcccagga

SEQ ID NO: 2121202 - DNA, 11 bp, Homo sapiens
tgctaagaaat

SEQ ID NO: 2121203 - DNA, 16 bp, Homo sapiens
tgctaagagaagtaga

SEQ ID NO: 2121204 - DNA, 22 bp, Homo sapiens
tgctaatcagggaggtcatttt

SEQ ID NO: 2121205 - DNA, 13 bp, Homo sapiens
tgctaatcttctt

SEQ ID NO: 2121206 - DNA, 17 bp, Homo sapiens
tgctaattaaaaagtta

SEQ ID NO: 2121207 - DNA, 17 bp, Homo sapiens
tgctacaaaaacacagc

SEQ ID NO: 2121208 - DNA, 20 bp, Homo sapiens
tgctacaaaaacacagcaag

SEQ ID NO: 2121209 - DNA, 18 bp, Homo sapiens
tgctacaataaatgctga

SEQ ID NO: 2121210 - DNA, 21 bp, Homo sapiens
tgctacagtactatgtaaatt

SEQ ID NO: 2121211 - DNA, 14 bp, Homo sapiens
tgctacctcactgg

SEQ ID NO: 2121212 - DNA, 15 bp, Homo sapiens
tgctacctcactggg

SEQ ID NO: 2121213 - DNA, 22 bp, Homo sapiens
tgctagagcaacccctgtaccc

SEQ ID NO: 2121214 - DNA, 17 bp, Homo sapiens
tgctaggcgagtgccag

SEQ ID NO: 2121215 - DNA, 19 bp, Homo sapiens
tgctaggcgagtgccagga

SEQ ID NO: 2121216 - DNA, 15 bp, Homo sapiens
tgctaggggatgagg

SEQ ID NO: 2121217 - DNA, 23 bp, Homo sapiens
tgctatagatttgtattttaaaa

SEQ ID NO: 2121218 - DNA, 19 bp, Homo sapiens
tgctataggctggagaagc

SEQ ID NO: 2121219 - DNA, 18 bp, Homo sapiens
tgctgccccgcttcccca

SEQ ID NO: 2121220 - DNA, 21 bp, Homo sapiens
tgctgcccctgcagttggcag

SEQ ID NO: 2121221 - DNA, 21 bp, Homo sapiens
tgctgcccgtcttcagcctag

SEQ ID NO: 2121222 - DNA, 22 bp, Homo sapiens
tgctgcccgtcttcagcctagc

SEQ ID NO: 2121223 - DNA, 20 bp, Homo sapiens
tgctgccgcctcccagcctg

SEQ ID NO: 2121224 - DNA, 14 bp, Homo sapiens
tgctgcctaataaa

SEQ ID NO: 2121225 - DNA, 17 bp, Homo sapiens
tgctgcctaataaagag

SEQ ID NO: 2121226 - DNA, 14 bp, Homo sapiens
tgctgcctccagaa

SEQ ID NO: 2121227 - DNA, 14 bp, Homo sapiens
tgctgcctgagtca

SEQ ID NO: 2121228 - DNA, 15 bp, Homo sapiens
tgctgctcatccagg

SEQ ID NO: 2121229 - DNA, 11 bp, Homo sapiens
tgctgctccta

SEQ ID NO: 2121230 - DNA, 13 bp, Homo sapiens
tgctgctgagaac

SEQ ID NO: 2121231 - DNA, 22 bp, Homo sapiens
tgctgctgagaacctggccttc

SEQ ID NO: 2121232 - DNA, 22 bp, Homo sapiens
tgctgctgtaactgctgagcca

SEQ ID NO: 2121233 - DNA, 17 bp, Homo sapiens
tgctggaaaccacactt

SEQ ID NO: 2121234 - DNA, 22 bp, Homo sapiens
tgctggaagacgcaagggcctg

SEQ ID NO: 2121235 - DNA, 19 bp, Homo sapiens
tgctggactgaggaccaca

SEQ ID NO: 2121236 - DNA, 14 bp, Homo sapiens
tgctggagctggct

SEQ ID NO: 2121237 - DNA, 15 bp, Homo sapiens
tgctggataaaatga

SEQ ID NO: 2121238 - DNA, 13 bp, Homo sapiens
tgctggcacctca

SEQ ID NO: 2121239 - DNA, 16 bp, Homo sapiens
tgctggccagcaccct

SEQ ID NO: 2121240 - DNA, 17 bp, Homo sapiens
tgctggccagcaccctc

SEQ ID NO: 2121241 - DNA, 19 bp, Homo sapiens
tgctggccagcaccctctc

SEQ ID NO: 2121242 - DNA, 12 bp, Homo sapiens
tgctggcctgga

SEQ ID NO: 2121243 - DNA, 18 bp, Homo sapiens
tgctggcctggatctccc

SEQ ID NO: 2121244 - DNA, 18 bp, Homo sapiens
tgctggcctgtggcaggc

SEQ ID NO: 2121245 - DNA, 21 bp, Homo sapiens
tgctggcctgtggcaggccta

SEQ ID NO: 2121246 - DNA, 21 bp, Homo sapiens
tgctggctgttggctgggggc

SEQ ID NO: 2121247 - DNA, 20 bp, Homo sapiens
tgctgggaaccccgcagccc

SEQ ID NO: 2121248 - DNA, 22 bp, Homo sapiens
tgctgggaccccagctagggct

SEQ ID NO: 2121249 - DNA, 21 bp, Homo sapiens
tgctgggattacaagcgtgag

SEQ ID NO: 2121250 - DNA, 18 bp, Homo sapiens
tgctggggcaagtccctg

SEQ ID NO: 2121251 - DNA, 23 bp, Homo sapiens
tgctggggcaagtccctgactct

SEQ ID NO: 2121252 - DNA, 12 bp, Homo sapiens
tgctggggcatg

SEQ ID NO: 2121253 - DNA, 20 bp, Homo sapiens
tgctggggcatgtgtgcctg

SEQ ID NO: 2121254 - DNA, 22 bp, Homo sapiens
tgctggtaatttgtatctgaag

SEQ ID NO: 2121255 - DNA, 17 bp, Homo sapiens
tgctggtgtcattgctg

SEQ ID NO: 2121256 - DNA, 15 bp, Homo sapiens
tgctggttttaacaa

SEQ ID NO: 2121257 - DNA, 16 bp, Homo sapiens
tgctgtcctaggccac

SEQ ID NO: 2121258 - DNA, 15 bp, Homo sapiens
tgctgtccttttagg

SEQ ID NO: 2121259 - DNA, 22 bp, Homo sapiens
tgctgtctccataatgccactg

SEQ ID NO: 2121260 - DNA, 23 bp, Homo sapiens
tgctgtctccataatgccactgg

SEQ ID NO: 2121261 - DNA, 22 bp, Homo sapiens
tgctgtgaatagtctgtgtgca

SEQ ID NO: 2121262 - DNA, 21 bp, Homo sapiens
tgctgtgaatttgtgtaagga

SEQ ID NO: 2121263 - DNA, 12 bp, Homo sapiens
tgctgtggcctg

SEQ ID NO: 2121264 - DNA, 15 bp, Homo sapiens
tgctgtggcctgggc

SEQ ID NO: 2121265 - DNA, 14 bp, Homo sapiens
tgctgtgggagagc

SEQ ID NO: 2121266 - DNA, 17 bp, Homo sapiens
tgctgtgggcagcaccc

SEQ ID NO: 2121267 - DNA, 21 bp, Homo sapiens
tgctgtgggtgatatggacag

SEQ ID NO: 2121268 - DNA, 20 bp, Homo sapiens
tgctgtggtggggagaggca

SEQ ID NO: 2121269 - DNA, 13 bp, Homo sapiens
tgctgtgtgcctt

SEQ ID NO: 2121270 - DNA, 21 bp, Homo sapiens
tgctgttccaacagacagggc

SEQ ID NO: 2121271 - DNA, 15 bp, Homo sapiens
tgctgttgctggact

SEQ ID NO: 2121272 - DNA, 15 bp, Homo sapiens
tgctgttgttgcagg

SEQ ID NO: 2121273 - DNA, 21 bp, Homo sapiens
tgctgtttgagatgtgatgct

SEQ ID NO: 2121274 - DNA, 17 bp, Homo sapiens
tgcctcttgttgcagag

SEQ ID NO: 2121275 - DNA, 18 bp, Homo sapiens
tgcctcttgttgcagaga

SEQ ID NO: 2121276 - DNA, 14 bp, Homo sapiens
tgcctctttcctgt

SEQ ID NO: 2121277 - DNA, 18 bp, Homo sapiens
tgcctgagcccaggagct

SEQ ID NO: 2121278 - DNA, 13 bp, Homo sapiens
tgcctgagctggg

SEQ ID NO: 2121279 - DNA, 20 bp, Homo sapiens
tgcctgaggctcaagaggcc

SEQ ID NO: 2121280 - DNA, 21 bp, Homo sapiens
tgcctgaggctcaagaggccc

SEQ ID NO: 2121281 - DNA, 22 bp, Homo sapiens
tgcctgaggctcaagaggccca

SEQ ID NO: 2121282 - DNA, 16 bp, Homo sapiens
tgcctgcagagagaag

SEQ ID NO: 2121283 - DNA, 15 bp, Homo sapiens
tgcctgccagggccc

SEQ ID NO: 2121284 - DNA, 16 bp, Homo sapiens
tgcctgcccaggcccc

SEQ ID NO: 2121285 - DNA, 18 bp, Homo sapiens
tgcctgcccaggcccctg

SEQ ID NO: 2121286 - DNA, 19 bp, Homo sapiens
tgcctgcccaggcccctgc

SEQ ID NO: 2121287 - DNA, 11 bp, Homo sapiens
tgcctgccctc

SEQ ID NO: 2121288 - DNA, 17 bp, Homo sapiens
tgcctgccctggaggga

SEQ ID NO: 2121289 - DNA, 23 bp, Homo sapiens
tgcctgctgaatgatttccaaag

SEQ ID NO: 2121290 - DNA, 11 bp, Homo sapiens
tgcctggagga

SEQ ID NO: 2121291 - DNA, 18 bp, Homo sapiens
tgcctggcccccctccag

SEQ ID NO: 2121292 - DNA, 16 bp, Homo sapiens
tgcctggcctggcaca

SEQ ID NO: 2121293 - DNA, 20 bp, Homo sapiens
tgcctggcctggcacacatc

SEQ ID NO: 2121294 - DNA, 15 bp, Homo sapiens
tgcctggctgtggag

SEQ ID NO: 2121295 - DNA, 18 bp, Homo sapiens
tgcctggctgtggaggcc

SEQ ID NO: 2121296 - DNA, 20 bp, Homo sapiens
tgcctggctgtggaggcctg

SEQ ID NO: 2121297 - DNA, 23 bp, Homo sapiens
tgcctgggtggggctgctcctcc

SEQ ID NO: 2121298 - DNA, 19 bp, Homo sapiens
tgcctgggttttctaactg

SEQ ID NO: 2121299 - DNA, 15 bp, Homo sapiens
tgcctggtggcagct

SEQ ID NO: 2121300 - DNA, 17 bp, Homo sapiens
tgcctggtggcagctgc

SEQ ID NO: 2121301 - DNA, 20 bp, Homo sapiens
tgcctgtagccccagtgaca

SEQ ID NO: 2121302 - DNA, 19 bp, Homo sapiens
tgcctgtagttaggaaata

SEQ ID NO: 2121303 - DNA, 21 bp, Homo sapiens
tgcctgtagttaggaaataaa

SEQ ID NO: 2121304 - DNA, 20 bp, Homo sapiens
tgcctgtcagtttcatggag

SEQ ID NO: 2121305 - DNA, 17 bp, Homo sapiens
tgcctgtgaggcagggg

SEQ ID NO: 2121306 - DNA, 17 bp, Homo sapiens
tgcctgttcagctccag

SEQ ID NO: 2121307 - DNA, 23 bp, Homo sapiens
tgccttaataagaatggttgcct

SEQ ID NO: 2121308 - DNA, 23 bp, Homo sapiens
tgccttacctcctgcccaggaga

SEQ ID NO: 2121309 - DNA, 17 bp, Homo sapiens
tgccttatgtaattatt

SEQ ID NO: 2121310 - DNA, 24 bp, Homo sapiens
tgccttcatggaactcagctgtct

SEQ ID NO: 2121311 - DNA, 12 bp, Homo sapiens
tgccttcatttg

SEQ ID NO: 2121312 - DNA, 17 bp, Homo sapiens
tgccttccaggagcaat

SEQ ID NO: 2121313 - DNA, 14 bp, Homo sapiens
tgccttccataatt

SEQ ID NO: 2121314 - DNA, 13 bp, Homo sapiens
tgccttcctcatc

SEQ ID NO: 2121315 - DNA, 16 bp, Homo sapiens
tgccttcctgtttaaa

SEQ ID NO: 2121316 - DNA, 20 bp, Homo sapiens
tgccttcgcggtggaaggcc

SEQ ID NO: 2121317 - DNA, 16 bp, Homo sapiens
tgccttcttcacccag

SEQ ID NO: 2121318 - DNA, 21 bp, Homo sapiens
tgccttcttcggggaactcct

SEQ ID NO: 2121319 - DNA, 17 bp, Homo sapiens
tgccttgatgaagcccg

SEQ ID NO: 2121320 - DNA, 19 bp, Homo sapiens
tgccttgatgaagcctgtg

SEQ ID NO: 2121321 - DNA, 19 bp, Homo sapiens
tgccttgtgtacagttatt

SEQ ID NO: 2121322 - DNA, 15 bp, Homo sapiens
tgcctttccacctgc

SEQ ID NO: 2121323 - DNA, 19 bp, Homo sapiens
tgcctttctctggctccag

SEQ ID NO: 2121324 - DNA, 20 bp, Homo sapiens
tcccttgctcagtgcctcct

SEQ ID NO: 2121325 - DNA, 22 bp, Homo sapiens
tcccttggatgtagtctgaggc

SEQ ID NO: 2121326 - DNA, 23 bp, Homo sapiens
tcccttgtacctatggctgcctg

SEQ ID NO: 2121327 - DNA, 21 bp, Homo sapiens
tccctttcacaaaattttatt

SEQ ID NO: 2121328 - DNA, 20 bp, Homo sapiens
tccctttcccatgatccaga

SEQ ID NO: 2121329 - DNA, 17 bp, Homo sapiens
tccctttctcttcttcc

SEQ ID NO: 2121330 - DNA, 15 bp, Homo sapiens
tccctttctgggagg

SEQ ID NO: 2121331 - DNA, 21 bp, Homo sapiens
tccgaagtatgagggaaaatg

SEQ ID NO: 2121332 - DNA, 17 bp, Homo sapiens
tccgaccagacaccttg

SEQ ID NO: 2121333 - DNA, 17 bp, Homo sapiens
tccgactcttctgagca

SEQ ID NO: 2121334 - DNA, 12 bp, Homo sapiens
tccgagaacaac

SEQ ID NO: 2121335 - DNA, 18 bp, Homo sapiens
tccgatgacagtgctcta

SEQ ID NO: 2121336 - DNA, 19 bp, Homo sapiens
tccgattaatttatggttt

SEQ ID NO: 2121337 - DNA, 14 bp, Homo sapiens
tccgcaccagctgc

SEQ ID NO: 2121338 - DNA, 16 bp, Homo sapiens
tccgcaccagctgctc

SEQ ID NO: 2121339 - DNA, 18 bp, Homo sapiens
tccgcaccagctgctctg

SEQ ID NO: 2121340 - DNA, 14 bp, Homo sapiens
tccgcacttggaaa

SEQ ID NO: 2121341 - DNA, 17 bp, Homo sapiens
tccgccaaacactccac

SEQ ID NO: 2121342 - DNA, 19 bp, Homo sapiens
tccgccacgaggagcttcc

SEQ ID NO: 2121343 - DNA, 15 bp, Homo sapiens
tccgccattccaagt

SEQ ID NO: 2121344 - DNA, 17 bp, Homo sapiens
tccgccccagacacacc

SEQ ID NO: 2121345 - DNA, 13 bp, Homo sapiens
tccgcctctgtcc

SEQ ID NO: 2121346 - DNA, 15 bp, Homo sapiens
tccgcctgcagagga

SEQ ID NO: 2121347 - DNA, 13 bp, Homo sapiens
tccgctgccacca

SEQ ID NO: 2121348 - DNA, 14 bp, Homo sapiens
tccgctgccaccac

SEQ ID NO: 2121349 - DNA, 22 bp, Homo sapiens
tctggagagctagaacctggag

SEQ ID NO: 2121350 - DNA, 16 bp, Homo sapiens
tctggagcccttgggt

SEQ ID NO: 2121351 - DNA, 19 bp, Homo sapiens
tctggagctgctgttccaa

SEQ ID NO: 2121352 - DNA, 19 bp, Homo sapiens
tctggatcctgctgtggcc

SEQ ID NO: 2121353 - DNA, 23 bp, Homo sapiens
tctggatcctgctgtggcctcac

SEQ ID NO: 2121354 - DNA, 22 bp, Homo sapiens
tctggatctatctgtattttca

SEQ ID NO: 2121355 - DNA, 18 bp, Homo sapiens
tctggatggcaccagagg

SEQ ID NO: 2121356 - DNA, 16 bp, Homo sapiens
tctggatttttacaaa

SEQ ID NO: 2121357 - DNA, 18 bp, Homo sapiens
tctggcaaagttatattt

SEQ ID NO: 2121358 - DNA, 19 bp, Homo sapiens
tctggcagggtgggatgga

SEQ ID NO: 2121359 - DNA, 16 bp, Homo sapiens
tctggcatggctccct

SEQ ID NO: 2121360 - DNA, 14 bp, Homo sapiens
tctggccaggcatg

SEQ ID NO: 2121361 - DNA, 14 bp, Homo sapiens
tctggccctgcctt

SEQ ID NO: 2121362 - DNA, 15 bp, Homo sapiens
tctggccctgccttc

SEQ ID NO: 2121363 - DNA, 15 bp, Homo sapiens
tctggcctcagacca

SEQ ID NO: 2121364 - DNA, 12 bp, Homo sapiens
tctggcctcagc

SEQ ID NO: 2121365 - DNA, 18 bp, Homo sapiens
tctggcctcagcaggaac

SEQ ID NO: 2121366 - DNA, 15 bp, Homo sapiens
tctggcggcttcctg

SEQ ID NO: 2121367 - DNA, 12 bp, Homo sapiens
tctggctcctgt

SEQ ID NO: 2121368 - DNA, 21 bp, Homo sapiens
tctggctggctaactggaagc

SEQ ID NO: 2121369 - DNA, 13 bp, Homo sapiens
tctggcttccagg

SEQ ID NO: 2121370 - DNA, 22 bp, Homo sapiens
tctggcttccaggtatctccag

SEQ ID NO: 2121371 - DNA, 14 bp, Homo sapiens
tctggcttgactgg

SEQ ID NO: 2121372 - DNA, 23 bp, Homo sapiens
tctggctttctccgactgctagg

SEQ ID NO: 2121373 - DNA, 15 bp, Homo sapiens
tctggctttgtctct

SEQ ID NO: 2121374 - DNA, 23 bp, Homo sapiens
tctggcttttcgcttgcttctgc

SEQ ID NO: 2121375 - DNA, 14 bp, Homo sapiens
tctgggaagggaag

SEQ ID NO: 2121376 - DNA, 13 bp, Homo sapiens
tctgggaaggggt

SEQ ID NO: 2121377 - DNA, 14 bp, Homo sapiens
tctgggacacagtt

SEQ ID NO: 2121378 - DNA, 15 bp, Homo sapiens
tctgggaccctttcc

SEQ ID NO: 2121379 - DNA, 20 bp, Homo sapiens
tctgggaggcagaacaggct

SEQ ID NO: 2121380 - DNA, 23 bp, Homo sapiens
tctgggaggctggtctccctcca

SEQ ID NO: 2121381 - DNA, 19 bp, Homo sapiens
tctgggaggtctccactga

SEQ ID NO: 2121382 - DNA, 17 bp, Homo sapiens
tctgggagtgttctgtt

SEQ ID NO: 2121383 - DNA, 19 bp, Homo sapiens
tctgggagtgttctgtttc

SEQ ID NO: 2121384 - DNA, 21 bp, Homo sapiens
tctgggagtgttctgtttccc

SEQ ID NO: 2121385 - DNA, 18 bp, Homo sapiens
tctgggataagtaagttt

SEQ ID NO: 2121386 - DNA, 15 bp, Homo sapiens
tctgggatgtagaac

SEQ ID NO: 2121387 - DNA, 16 bp, Homo sapiens
tctgggccaagttcct

SEQ ID NO: 2121388 - DNA, 23 bp, Homo sapiens
tctgggccaagttcctctagtgc

SEQ ID NO: 2121389 - DNA, 15 bp, Homo sapiens
tctgggctcagggct

SEQ ID NO: 2121390 - DNA, 17 bp, Homo sapiens
tctgggctcagggctgg

SEQ ID NO: 2121391 - DNA, 20 bp, Homo sapiens
tctggggccctgggcctcag

SEQ ID NO: 2121392 - DNA, 22 bp, Homo sapiens
tctggggttcagcccctcctct

SEQ ID NO: 2121393 - DNA, 15 bp, Homo sapiens
tctgggtcaatactg

SEQ ID NO: 2121394 - DNA, 17 bp, Homo sapiens
tctgggtggctcctgcc

SEQ ID NO: 2121395 - DNA, 20 bp, Homo sapiens
tctgggtgttgaccactcca

SEQ ID NO: 2121396 - DNA, 20 bp, Homo sapiens
tctggtagatttttaacgaa

SEQ ID NO: 2121397 - DNA, 23 bp, Homo sapiens
tctggtatgaacttgaggacaca

SEQ ID NO: 2121398 - DNA, 21 bp, Homo sapiens
tctggtgttctcaatgctttt

SEQ ID NO: 2121399 - DNA, 17 bp, Homo sapiens
tctgtaaggaactggaa

SEQ ID NO: 2121400 - DNA, 14 bp, Homo sapiens
tctgtaatttatta

SEQ ID NO: 2121401 - DNA, 14 bp, Homo sapiens
tctgtaatttttca

SEQ ID NO: 2121402 - DNA, 15 bp, Homo sapiens
tctgtacaaaaacaa

SEQ ID NO: 2121403 - DNA, 14 bp, Homo sapiens
tctgtagggctgga

SEQ ID NO: 2121404 - DNA, 14 bp, Homo sapiens
tctgtataatctat

SEQ ID NO: 2121405 - DNA, 17 bp, Homo sapiens
tctgtataatctattta

SEQ ID NO: 2121406 - DNA, 19 bp, Homo sapiens
tctgtatagattataaaat

SEQ ID NO: 2121407 - DNA, 20 bp, Homo sapiens
tctgtatttaatggttttta

SEQ ID NO: 2121408 - DNA, 15 bp, Homo sapiens
tctgtattttcatgt

SEQ ID NO: 2121409 - DNA, 18 bp, Homo sapiens
tctgtcacgtgaaatatt

SEQ ID NO: 2121410 - DNA, 19 bp, Homo sapiens
tctgtcagatgggaagaca

SEQ ID NO: 2121411 - DNA, 12 bp, Homo sapiens
tctgtcatcccg

SEQ ID NO: 2121412 - DNA, 19 bp, Homo sapiens
tctgtcatcccgctcctgc

SEQ ID NO: 2121413 - DNA, 20 bp, Homo sapiens
tctgtcatcccgctcctgct

SEQ ID NO: 2121414 - DNA, 17 bp, Homo sapiens
tctgtcatctctctggg

SEQ ID NO: 2121415 - DNA, 18 bp, Homo sapiens
tctgtcatctctctgggg

SEQ ID NO: 2121416 - DNA, 21 bp, Homo sapiens
tctgtcatctctctggggccc

SEQ ID NO: 2121417 - DNA, 15 bp, Homo sapiens
tctgtcatttgagca

SEQ ID NO: 2121418 - DNA, 12 bp, Homo sapiens
tctgtccaagga

SEQ ID NO: 2121419 - DNA, 13 bp, Homo sapiens
tctgtccactctg

SEQ ID NO: 2121420 - DNA, 24 bp, Homo sapiens
tctgtccaggcactgctgcccagc

SEQ ID NO: 2121421 - DNA, 14 bp, Homo sapiens
tctgtccaggccac

SEQ ID NO: 2121422 - DNA, 16 bp, Homo sapiens
tctgtccaggccactg

SEQ ID NO: 2121423 - DNA, 18 bp, Homo sapiens
tctgtccaggccactgtg

SEQ ID NO: 2121424 - DNA, 23 bp, Homo sapiens
tctgtccaggccactgtggccag

SEQ ID NO: 2121425 - DNA, 17 bp, Homo sapiens
tctgtccagggccctga

SEQ ID NO: 2121426 - DNA, 15 bp, Homo sapiens
tctgtccagtttcca

SEQ ID NO: 2121427 - DNA, 15 bp, Homo sapiens
tctgtcctactctgt

SEQ ID NO: 2121428 - DNA, 19 bp, Homo sapiens
tctgtcctactctgtgtca

SEQ ID NO: 2121429 - DNA, 21 bp, Homo sapiens
tctgtcctgggagtgagctgg

SEQ ID NO: 2121430 - DNA, 19 bp, Homo sapiens
tctgtccttttggcactga

SEQ ID NO: 2121431 - DNA, 16 bp, Homo sapiens
tctgtcgctgggctgt

SEQ ID NO: 2121432 - DNA, 21 bp, Homo sapiens
tctgtctcaaaaaataaaaat

SEQ ID NO: 2121433 - DNA, 21 bp, Homo sapiens
tctgtctcgagcgccctgcag

SEQ ID NO: 2121434 - DNA, 22 bp, Homo sapiens
tctgtctctagtttctttctgt

SEQ ID NO: 2121435 - DNA, 14 bp, Homo sapiens
tctgtctgtcccaa

SEQ ID NO: 2121436 - DNA, 12 bp, Homo sapiens
tctgtcttgaag

SEQ ID NO: 2121437 - DNA, 16 bp, Homo sapiens
tctgtcttgccagcca

SEQ ID NO: 2121438 - DNA, 14 bp, Homo sapiens
tctgtgaaatcaga

SEQ ID NO: 2121439 - DNA, 17 bp, Homo sapiens
tctgtgaacgatttaga

SEQ ID NO: 2121440 - DNA, 20 bp, Homo sapiens
tctgtgcactagcctgtgat

SEQ ID NO: 2121441 - DNA, 23 bp, Homo sapiens
tctgtgccagagcctggggctct

SEQ ID NO: 2121442 - DNA, 20 bp, Homo sapiens
tctgtgctttgactcacctg

SEQ ID NO: 2121443 - DNA, 21 bp, Homo sapiens
tctgtggcttcccatgtcttt

SEQ ID NO: 2121444 - DNA, 17 bp, Homo sapiens
tctgtgtcaggtggggc

SEQ ID NO: 2121445 - DNA, 17 bp, Homo sapiens
tctgtgtccttccctgc

SEQ ID NO: 2121446 - DNA, 13 bp, Homo sapiens
tctgtgtgaaaat

SEQ ID NO: 2121447 - DNA, 18 bp, Homo sapiens
tctgtgtgatgaactttc

SEQ ID NO: 2121448 - DNA, 19 bp, Homo sapiens
tctgtgtgcaccttaccaa

SEQ ID NO: 2121449 - DNA, 12 bp, Homo sapiens
tctgtgttactc

SEQ ID NO: 2121450 - DNA, 12 bp, Homo sapiens
tctgttactgaa

SEQ ID NO: 2121451 - DNA, 13 bp, Homo sapiens
tctgttactgaaa

SEQ ID NO: 2121452 - DNA, 14 bp, Homo sapiens
tctgttatcctgct

SEQ ID NO: 2121453 - DNA, 20 bp, Homo sapiens
tctgttccccatggccactt

SEQ ID NO: 2121454 - DNA, 23 bp, Homo sapiens
tctgttctgttgatcccacttca

SEQ ID NO: 2121455 - DNA, 18 bp, Homo sapiens
tctgttgatcccacttca

SEQ ID NO: 2121456 - DNA, 20 bp, Homo sapiens
tctgttgatcccacttcact

SEQ ID NO: 2121457 - DNA, 12 bp, Homo sapiens
tctgttggccag

SEQ ID NO: 2121458 - DNA, 17 bp, Homo sapiens
tctgttggccagtgtga

SEQ ID NO: 2121459 - DNA, 19 bp, Homo sapiens
tctgttggccagtgtgaca

SEQ ID NO: 2121460 - DNA, 20 bp, Homo sapiens
tctgttggccagtgtgacaa

SEQ ID NO: 2121461 - DNA, 12 bp, Homo sapiens
tctgttgtaata

SEQ ID NO: 2121462 - DNA, 23 bp, Homo sapiens
tcttaaaagttgtgattccagat

SEQ ID NO: 2121463 - DNA, 20 bp, Homo sapiens
tcttaaaatatatttcagat

SEQ ID NO: 2121464 - DNA, 21 bp, Homo sapiens
tcttaaagctgcctgtagtta

SEQ ID NO: 2121465 - DNA, 18 bp, Homo sapiens
tcttaaaggaaaagtcaa

SEQ ID NO: 2121466 - DNA, 14 bp, Homo sapiens
tcttaaaggcctgg

SEQ ID NO: 2121467 - DNA, 15 bp, Homo sapiens
tcttaaataagaaac

SEQ ID NO: 2121468 - DNA, 12 bp, Homo sapiens
tcttaaatgaca

SEQ ID NO: 2121469 - DNA, 23 bp, Homo sapiens
tcttaagatttctcctgactcca

SEQ ID NO: 2121470 - DNA, 21 bp, Homo sapiens
tcttaagccttttgctcacaa

SEQ ID NO: 2121471 - DNA, 21 bp, Homo sapiens
tcttaattaaaagaatatttt

SEQ ID NO: 2121472 - DNA, 19 bp, Homo sapiens
tcttacaaaaacaagacac

SEQ ID NO: 2121473 - DNA, 19 bp, Homo sapiens
tcttacaataattctatga

SEQ ID NO: 2121474 - DNA, 14 bp, Homo sapiens
tcttaccgagaaaa

SEQ ID NO: 2121475 - DNA, 16 bp, Homo sapiens
tcttaccgagaaaagg

SEQ ID NO: 2121476 - DNA, 20 bp, Homo sapiens
tcttaccgagaaaaggagaa

SEQ ID NO: 2121477 - DNA, 23 bp, Homo sapiens
tcttaccgagaaaaggagaaagg

SEQ ID NO: 2121478 - DNA, 17 bp, Homo sapiens
tcttaccgtagcctccg

SEQ ID NO: 2121479 - DNA, 21 bp, Homo sapiens
tcttacctgtatgtctccagt

SEQ ID NO: 2121480 - DNA, 19 bp, Homo sapiens
tcttaccttaaaaagtaat

SEQ ID NO: 2121481 - DNA, 16 bp, Homo sapiens
tcttactaaacatttt

SEQ ID NO: 2121482 - DNA, 19 bp, Homo sapiens
tcttagaagtggaccagga

SEQ ID NO: 2121483 - DNA, 15 bp, Homo sapiens
tcttagctgtctgct

SEQ ID NO: 2121484 - DNA, 23 bp, Homo sapiens
tcttagctgtctgctcagacaga

SEQ ID NO: 2121485 - DNA, 15 bp, Homo sapiens
tcttagctttccaca

SEQ ID NO: 2121486 - DNA, 14 bp, Homo sapiens
tcttaggagcagag

SEQ ID NO: 2121487 - DNA, 19 bp, Homo sapiens
tcttaggagcagagctctg

SEQ ID NO: 2121488 - DNA, 19 bp, Homo sapiens
tcttaggggagagctttct

SEQ ID NO: 2121489 - DNA, 13 bp, Homo sapiens
tcttatagaaagt

SEQ ID NO: 2121490 - DNA, 19 bp, Homo sapiens
tcttatagaatatttatta

SEQ ID NO: 2121491 - DNA, 13 bp, Homo sapiens
tcttatataagac

SEQ ID NO: 2121492 - DNA, 13 bp, Homo sapiens
tcttatgaaatgg

SEQ ID NO: 2121493 - DNA, 20 bp, Homo sapiens
tcttatgatttttaaaagtt

SEQ ID NO: 2121494 - DNA, 14 bp, Homo sapiens
tcttatgcaatttc

SEQ ID NO: 2121495 - DNA, 16 bp, Homo sapiens
tcttatggagacctag

SEQ ID NO: 2121496 - DNA, 22 bp, Homo sapiens
tcttattcatgctttctccttt

SEQ ID NO: 2121497 - DNA, 23 bp, Homo sapiens
tcttattcatgctttctcctttt

SEQ ID NO: 2121498 - DNA, 16 bp, Homo sapiens
tcttattcccaaacta

SEQ ID NO: 2121499 - DNA, 14 bp, Homo sapiens
tcttattgcccacg

SEQ ID NO: 2121500 - DNA, 18 bp, Homo sapiens
tcttattgcccacgctgg

SEQ ID NO: 2121501 - DNA, 22 bp, Homo sapiens
tcttattgcccacgctggagtg

SEQ ID NO: 2121502 - DNA, 21 bp, Homo sapiens
tcttatttacttgtagaaatc

SEQ ID NO: 2121503 - DNA, 19 bp, Homo sapiens
tcttatttatatatgaagt

SEQ ID NO: 2121504 - DNA, 13 bp, Homo sapiens
tcttatttattat

SEQ ID NO: 2121505 - DNA, 14 bp, Homo sapiens
tcttattttgtaat

SEQ ID NO: 2121506 - DNA, 16 bp, Homo sapiens
tcttattttgtaataa

SEQ ID NO: 2121507 - DNA, 17 bp, Homo sapiens
tcttattttgtaataaa

SEQ ID NO: 2121508 - DNA, 19 bp, Homo sapiens
tcttattttgtaataaact

SEQ ID NO: 2121509 - DNA, 20 bp, Homo sapiens
tcttcaagcacctgcagatt

SEQ ID NO: 2121510 - DNA, 22 bp, Homo sapiens
tcttcaagcacctgcagattct

SEQ ID NO: 2121511 - DNA, 19 bp, Homo sapiens
tcttcaagggaagaaacac

SEQ ID NO: 2121512 - DNA, 17 bp, Homo sapiens
tcttcaaggtgtaaaat

SEQ ID NO: 2121513 - DNA, 15 bp, Homo sapiens
tcttcacaacagatt

SEQ ID NO: 2121514 - DNA, 16 bp, Homo sapiens
tcttcaccaaatcttg

SEQ ID NO: 2121515 - DNA, 19 bp, Homo sapiens
tcttcacccagctaatctg

SEQ ID NO: 2121516 - DNA, 23 bp, Homo sapiens
tcttcacctgggcgccaactgct

SEQ ID NO: 2121517 - DNA, 12 bp, Homo sapiens
tcttcactcagc

SEQ ID NO: 2121518 - DNA, 14 bp, Homo sapiens
tcttcactcagcca

SEQ ID NO: 2121519 - DNA, 13 bp, Homo sapiens
tcttcagaagaca

SEQ ID NO: 2121520 - DNA, 21 bp, Homo sapiens
tcttcagcctagccgacctca

SEQ ID NO: 2121521 - DNA, 23 bp, Homo sapiens
tcttcagcctagccgacctcagc

SEQ ID NO: 2121522 - DNA, 17 bp, Homo sapiens
tcttcagggtgagtgaa

SEQ ID NO: 2121523 - DNA, 16 bp, Homo sapiens
tcttcaggtggaaaaa

SEQ ID NO: 2121524 - DNA, 14 bp, Homo sapiens
tcttcaggttctta

SEQ ID NO: 2121525 - DNA, 20 bp, Homo sapiens
tcttcatcagcatttaataa

SEQ ID NO: 2121526 - DNA, 13 bp, Homo sapiens
tcttcatcttgac

SEQ ID NO: 2121527 - DNA, 14 bp, Homo sapiens
tcttcatgcaatga

SEQ ID NO: 2121528 - DNA, 15 bp, Homo sapiens
tcttcatttcattgt

SEQ ID NO: 2121529 - DNA, 24 bp, Homo sapiens
tcttcatttcattgtatgatgtgt

SEQ ID NO: 2121530 - DNA, 11 bp, Homo sapiens
tcttcattttg

SEQ ID NO: 2121531 - DNA, 12 bp, Homo sapiens
tcttccaacccc

SEQ ID NO: 2121532 - DNA, 19 bp, Homo sapiens
tcttccaaccccagctggc

SEQ ID NO: 2121533 - DNA, 22 bp, Homo sapiens
tcttccaaccccagctggcctc

SEQ ID NO: 2121534 - DNA, 16 bp, Homo sapiens
tcttcccatcactgga

SEQ ID NO: 2121535 - DNA, 18 bp, Homo sapiens
tcttcccatttgtaatgt

SEQ ID NO: 2121536 - DNA, 24 bp, Homo sapiens
tcttcccatttgtaatgtatctta

SEQ ID NO: 2121537 - DNA, 23 bp, Homo sapiens
tcttcccccacccctaacctggc

SEQ ID NO: 2121538 - DNA, 18 bp, Homo sapiens
tcttcccccactcctctt

SEQ ID NO: 2121539 - DNA, 22 bp, Homo sapiens
tcttccccttgcccttgccctg

SEQ ID NO: 2121540 - DNA, 23 bp, Homo sapiens
tcttccccttgcccttgccctga

SEQ ID NO: 2121541 - DNA, 15 bp, Homo sapiens
tcttcctcatcagta

SEQ ID NO: 2121542 - DNA, 13 bp, Homo sapiens
tcttcctgctgct

SEQ ID NO: 2121543 - DNA, 14 bp, Homo sapiens
tcttcctgctgctg

SEQ ID NO: 2121544 - DNA, 18 bp, Homo sapiens
tcttcctggacctgagtc

SEQ ID NO: 2121545 - DNA, 11 bp, Homo sapiens
tcttccttccg

SEQ ID NO: 2121546 - DNA, 14 bp, Homo sapiens
tcttccttctttct

SEQ ID NO: 2121547 - DNA, 18 bp, Homo sapiens
tcttccttctttctcttc

SEQ ID NO: 2121548 - DNA, 20 bp, Homo sapiens
tcttcgctgctagagaaggg

SEQ ID NO: 2121549 - DNA, 13 bp, Homo sapiens
tcttcgctgctct

SEQ ID NO: 2121550 - DNA, 14 bp, Homo sapiens
tcttctaactcatg

SEQ ID NO: 2121551 - DNA, 17 bp, Homo sapiens
tcttctacaaccagagc

SEQ ID NO: 2121552 - DNA, 18 bp, Homo sapiens
tcttctacaaccagagcc

SEQ ID NO: 2121553 - DNA, 19 bp, Homo sapiens
tcttctacgtataaatatg

SEQ ID NO: 2121554 - DNA, 17 bp, Homo sapiens
tcttctaggttctaaaa

SEQ ID NO: 2121555 - DNA, 12 bp, Homo sapiens
tcttctccaggc

SEQ ID NO: 2121556 - DNA, 17 bp, Homo sapiens
tcttctgccagcctccc

SEQ ID NO: 2121557 - DNA, 19 bp, Homo sapiens
tcttctgcttcagcctccc

SEQ ID NO: 2121558 - DNA, 19 bp, Homo sapiens
tcttctggagtctccagtg

SEQ ID NO: 2121559 - DNA, 22 bp, Homo sapiens
tcttctgtcatcccgctcctgc

SEQ ID NO: 2121560 - DNA, 21 bp, Homo sapiens
tcttcttattcatgctttctc

SEQ ID NO: 2121561 - DNA, 15 bp, Homo sapiens
tcttcttcttcagaa

SEQ ID NO: 2121562 - DNA, 17 bp, Homo sapiens
tcttctttttttgtgat

SEQ ID NO: 2121563 - DNA, 20 bp, Homo sapiens
tcttgaaaagaatctagata

SEQ ID NO: 2121564 - DNA, 15 bp, Homo sapiens
tcttgaaacagcctg

SEQ ID NO: 2121565 - DNA, 12 bp, Homo sapiens
tcttgaactcct

SEQ ID NO: 2121566 - DNA, 17 bp, Homo sapiens
tcttgaactcctggcct

SEQ ID NO: 2121567 - DNA, 14 bp, Homo sapiens
tcttgaagaatatt

SEQ ID NO: 2121568 - DNA, 13 bp, Homo sapiens
tcttgaatatttg

SEQ ID NO: 2121569 - DNA, 13 bp, Homo sapiens
tcttgaatcccat

SEQ ID NO: 2121570 - DNA, 15 bp, Homo sapiens
tcttgacttcacagc

SEQ ID NO: 2121571 - DNA, 20 bp, Homo sapiens
tcttgagaatttggatacac

SEQ ID NO: 2121572 - DNA, 12 bp, Homo sapiens
tcttgagcagac

SEQ ID NO: 2121573 - DNA, 15 bp, Homo sapiens
tcttgaggccaggag

SEQ ID NO: 2121574 - DNA, 15 bp, Homo sapiens
tcttgagtagatctg

SEQ ID NO: 2121575 - DNA, 18 bp, Homo sapiens
tcttgagtagatctgctt

SEQ ID NO: 2121576 - DNA, 18 bp, Homo sapiens
tcttgcaatggcagcctt

SEQ ID NO: 2121577 - DNA, 22 bp, Homo sapiens
tcttgcaatggcagccttggca

SEQ ID NO: 2121578 - DNA, 18 bp, Homo sapiens
tgaaaactgtaaatacaa

SEQ ID NO: 2121579 - DNA, 17 bp, Homo sapiens
tgaaaactgtttatggt

SEQ ID NO: 2121580 - DNA, 17 bp, Homo sapiens
tgaaaagactccaaaga

SEQ ID NO: 2121581 - DNA, 19 bp, Homo sapiens
tgaaaagactccaaagaaa

SEQ ID NO: 2121582 - DNA, 14 bp, Homo sapiens
tgaaaagaggaaca

SEQ ID NO: 2121583 - DNA, 23 bp, Homo sapiens
tgaaaagaggggaccagaagcca

SEQ ID NO: 2121584 - DNA, 19 bp, Homo sapiens
tgaaaaggtttatgaaaaa

SEQ ID NO: 2121585 - DNA, 21 bp, Homo sapiens
tgaaaaggtttatgaaaaaga

SEQ ID NO: 2121586 - DNA, 22 bp, Homo sapiens
tgaaaaggtttatgaaaaagaa

SEQ ID NO: 2121587 - DNA, 20 bp, Homo sapiens
tgaaaatatgatgtttcaca

SEQ ID NO: 2121588 - DNA, 17 bp, Homo sapiens
tgaaaatatttgtatca

SEQ ID NO: 2121589 - DNA, 14 bp, Homo sapiens
tgaaaatcactata

SEQ ID NO: 2121590 - DNA, 14 bp, Homo sapiens
tgaaaatctaatat

SEQ ID NO: 2121591 - DNA, 12 bp, Homo sapiens
tgaaaatgtaac

SEQ ID NO: 2121592 - DNA, 22 bp, Homo sapiens
tgaaaatgtaacttttcttaca

SEQ ID NO: 2121593 - DNA, 16 bp, Homo sapiens
tgaaaatgtactgaga

SEQ ID NO: 2121594 - DNA, 16 bp, Homo sapiens
tgaaaatgttgttatg

SEQ ID NO: 2121595 - DNA, 16 bp, Homo sapiens
tgaaaattaacactgc

SEQ ID NO: 2121596 - DNA, 18 bp, Homo sapiens
tgaaaattaacactgctt

SEQ ID NO: 2121597 - DNA, 20 bp, Homo sapiens
tgaaaattaggatttcatga

SEQ ID NO: 2121598 - DNA, 19 bp, Homo sapiens
tgaaaattcaaaaagtgtt

SEQ ID NO: 2121599 - DNA, 17 bp, Homo sapiens
tgaaaattgtatgttaa

SEQ ID NO: 2121600 - DNA, 14 bp, Homo sapiens
tgaaacaaagagtt

SEQ ID NO: 2121601 - DNA, 18 bp, Homo sapiens
tgaaacaaataatcacat

SEQ ID NO: 2121602 - DNA, 22 bp, Homo sapiens
tgaaacaacaaataggaattgt

SEQ ID NO: 2121603 - DNA, 17 bp, Homo sapiens
tgaaacaagaagccaca

SEQ ID NO: 2121604 - DNA, 15 bp, Homo sapiens
tgaaacacctcccag

SEQ ID NO: 2121605 - DNA, 13 bp, Homo sapiens
tgaaacagaaaca

SEQ ID NO: 2121606 - DNA, 16 bp, Homo sapiens
tgaaacagatgataaa

SEQ ID NO: 2121607 - DNA, 18 bp, Homo sapiens
tgaaacagatgataaata

SEQ ID NO: 2121608 - DNA, 20 bp, Homo sapiens
tgaaacagatgataaatatt

SEQ ID NO: 2121609 - DNA, 21 bp, Homo sapiens
tgaaactatggctttaaacta

SEQ ID NO: 2121610 - DNA, 22 bp, Homo sapiens
tgaaactcctgattttgtagtt

SEQ ID NO: 2121611 - DNA, 22 bp, Homo sapiens
tgaaactgtgtacgacaaagca

SEQ ID NO: 2121612 - DNA, 15 bp, Homo sapiens
tgaaacttcataaat

SEQ ID NO: 2121613 - DNA, 20 bp, Homo sapiens
tgaaagaaacagttaacttt

SEQ ID NO: 2121614 - DNA, 13 bp, Homo sapiens
tgaaagagaacca

SEQ ID NO: 2121615 - DNA, 16 bp, Homo sapiens
tgaaagagaaccagtt

SEQ ID NO: 2121616 - DNA, 21 bp, Homo sapiens
tgaaagagagtaccatgctgg

SEQ ID NO: 2121617 - DNA, 20 bp, Homo sapiens
tgaaagagtagtgcatttaa

SEQ ID NO: 2121618 - DNA, 18 bp, Homo sapiens
tgaaagatggctgtgcct

SEQ ID NO: 2121619 - DNA, 19 bp, Homo sapiens
tgaaagatggctgtgcctc

SEQ ID NO: 2121620 - DNA, 21 bp, Homo sapiens
tgaaagatggctgtgcctctg

SEQ ID NO: 2121621 - DNA, 23 bp, Homo sapiens
tgaaagatggctgtgcctctgcc

SEQ ID NO: 2121622 - DNA, 16 bp, Homo sapiens
tgaaagcagcagctag

SEQ ID NO: 2121623 - DNA, 17 bp, Homo sapiens
tgaaagcagcagctagg

SEQ ID NO: 2121624 - DNA, 22 bp, Homo sapiens
tgaaagcagcagctaggactga

SEQ ID NO: 2121625 - DNA, 23 bp, Homo sapiens
tgaaagccagctgccgaccagag

SEQ ID NO: 2121626 - DNA, 16 bp, Homo sapiens
tgaaagggcccagaga

SEQ ID NO: 2121627 - DNA, 15 bp, Homo sapiens
tgaaagggctatggc

SEQ ID NO: 2121628 - DNA, 19 bp, Homo sapiens
tgaaagggctatggcaagg

SEQ ID NO: 2121629 - DNA, 16 bp, Homo sapiens
tgaaagtgacagagac

SEQ ID NO: 2121630 - DNA, 17 bp, Homo sapiens
tgaaagtgacagagacc

SEQ ID NO: 2121631 - DNA, 11 bp, Homo sapiens
tgaaagtgact

SEQ ID NO: 2121632 - DNA, 17 bp, Homo sapiens
tgaaagtgtaaaataga

SEQ ID NO: 2121633 - DNA, 20 bp, Homo sapiens
tgaaataaattggtgataag

SEQ ID NO: 2121634 - DNA, 19 bp, Homo sapiens
tgaaatacacaagtaaaca

SEQ ID NO: 2121635 - DNA, 22 bp, Homo sapiens
tgaaataccagtgaaccaaaga

SEQ ID NO: 2121636 - DNA, 14 bp, Homo sapiens
tgaaataccagtgt

SEQ ID NO: 2121637 - DNA, 19 bp, Homo sapiens
tgaaatcttaaaaacctgc

SEQ ID NO: 2121638 - DNA, 13 bp, Homo sapiens
tgaaatgaaagaa

SEQ ID NO: 2121639 - DNA, 16 bp, Homo sapiens
tgaaatgactgtctaa

SEQ ID NO: 2121640 - DNA, 21 bp, Homo sapiens
tgaaatgaggtcagagcctgc

SEQ ID NO: 2121641 - DNA, 22 bp, Homo sapiens
tgaaatgaggtcagagcctgca

SEQ ID NO: 2121642 - DNA, 23 bp, Homo sapiens
tgaaatgaggtcagagcctgcag

SEQ ID NO: 2121643 - DNA, 16 bp, Homo sapiens
tgaaatgctctccttt

SEQ ID NO: 2121644 - DNA, 15 bp, Homo sapiens
tgaaatgggctttaa

SEQ ID NO: 2121645 - DNA, 16 bp, Homo sapiens
tgaaatgggctttaac

SEQ ID NO: 2121646 - DNA, 10 bp, Homo sapiens
tgaaatgtct

SEQ ID NO: 2121647 - DNA, 16 bp, Homo sapiens
tgaaatgtttcactat

SEQ ID NO: 2121648 - DNA, 21 bp, Homo sapiens
tgaaattcaacctgtgtctta

SEQ ID NO: 2121649 - DNA, 16 bp, Homo sapiens
tgaaattcttgaagtt

SEQ ID NO: 2121650 - DNA, 22 bp, Homo sapiens
tgaaatttaaaaataaagctac

SEQ ID NO: 2121651 - DNA, 21 bp, Homo sapiens
tgaaatttattagttaatata

SEQ ID NO: 2121652 - DNA, 12 bp, Homo sapiens
tgaaatttcaga

SEQ ID NO: 2121653 - DNA, 18 bp, Homo sapiens
tgaaattttctagacttt

SEQ ID NO: 2121654 - DNA, 22 bp, Homo sapiens
tgaacaaacactgaatcatgtt

SEQ ID NO: 2121655 - DNA, 22 bp, Homo sapiens
tgaacaaagaaaaaaatatatt

SEQ ID NO: 2121656 - DNA, 21 bp, Homo sapiens
tgaacaaagggattctccagg

SEQ ID NO: 2121657 - DNA, 22 bp, Homo sapiens
tgaacaatacgtgaaagatgca

SEQ ID NO: 2121658 - DNA, 18 bp, Homo sapiens
tgaacacaattgatactt

SEQ ID NO: 2121659 - DNA, 23 bp, Homo sapiens
tgaacacaattgatacttcaggt

SEQ ID NO: 2121660 - DNA, 15 bp, Homo sapiens
tgaacacagcctggg

SEQ ID NO: 2121661 - DNA, 15 bp, Homo sapiens
tgaacacagtttagt

SEQ ID NO: 2121662 - DNA, 17 bp, Homo sapiens
tgaacaccaacttttat

SEQ ID NO: 2121663 - DNA, 16 bp, Homo sapiens
tgaacaccactttgtc

SEQ ID NO: 2121664 - DNA, 13 bp, Homo sapiens
tgaacagaacata

SEQ ID NO: 2121665 - DNA, 17 bp, Homo sapiens
tgaacagcagaaagact

SEQ ID NO: 2121666 - DNA, 16 bp, Homo sapiens
tgaacagtgttaataa

SEQ ID NO: 2121667 - DNA, 14 bp, Homo sapiens
tgaacatggactct

SEQ ID NO: 2121668 - DNA, 17 bp, Homo sapiens
tgaacatttcttatgat

SEQ ID NO: 2121669 - DNA, 21 bp, Homo sapiens
tgaaccacatcttgctctgct

SEQ ID NO: 2121670 - DNA, 22 bp, Homo sapiens
tgaaccacatcttgctctgctg

SEQ ID NO: 2121671 - DNA, 21 bp, Homo sapiens
tgaaccaccacacccagccca

SEQ ID NO: 2121672 - DNA, 15 bp, Homo sapiens
tgaaccatccttccc

SEQ ID NO: 2121673 - DNA, 19 bp, Homo sapiens
tgaaccatccttcccatga

SEQ ID NO: 2121674 - DNA, 13 bp, Homo sapiens
tgaacccaggaca

SEQ ID NO: 2121675 - DNA, 19 bp, Homo sapiens
tgaacccattttgagtgac

SEQ ID NO: 2121676 - DNA, 15 bp, Homo sapiens
tgaaccccatgggct

SEQ ID NO: 2121677 - DNA, 16 bp, Homo sapiens
tgaaccccatgggctt

SEQ ID NO: 2121678 - DNA, 20 bp, Homo sapiens
tgaacccccgccatccttca

SEQ ID NO: 2121679 - DNA, 21 bp, Homo sapiens
tgaacccccgccatccttcac

SEQ ID NO: 2121680 - DNA, 22 bp, Homo sapiens
tgaacccccgccatccttcacc

SEQ ID NO: 2121681 - DNA, 14 bp, Homo sapiens
tgaacccctgtgtc

SEQ ID NO: 2121682 - DNA, 14 bp, Homo sapiens
tgaaccgacttttc

SEQ ID NO: 2121683 - DNA, 22 bp, Homo sapiens
tgaaccgacttttctaaagctc

SEQ ID NO: 2121684 - DNA, 18 bp, Homo sapiens
tgaacctcagtttcctca

SEQ ID NO: 2121685 - DNA, 13 bp, Homo sapiens
tgaacggggagaa

SEQ ID NO: 2121686 - DNA, 21 bp, Homo sapiens
tgaactacgcttgctcatttt

SEQ ID NO: 2121687 - DNA, 14 bp, Homo sapiens
tgaactcaatgtgc

SEQ ID NO: 2121688 - DNA, 22 bp, Homo sapiens
tgaactcagagcccctccctgc

SEQ ID NO: 2121689 - DNA, 14 bp, Homo sapiens
tgaactcctggcct

SEQ ID NO: 2121690 - DNA, 14 bp, Homo sapiens
tgaactcttaatca

SEQ ID NO: 2121691 - DNA, 15 bp, Homo sapiens
tgaactcttaatcaa

SEQ ID NO: 2121692 - DNA, 22 bp, Homo sapiens
tgaactgagccaaacacactgt

SEQ ID NO: 2121693 - DNA, 17 bp, Homo sapiens
tgaactgattcacatct

SEQ ID NO: 2121694 - DNA, 13 bp, Homo sapiens
tgaactgccaaga

SEQ ID NO: 2121695 - DNA, 13 bp, Homo sapiens
tgaactggttcat

SEQ ID NO: 2121696 - DNA, 17 bp, Homo sapiens
tgaactgtgacaggaag

SEQ ID NO: 2121697 - DNA, 22 bp, Homo sapiens
tgaacttaaataaatgtcatta

SEQ ID NO: 2121698 - DNA, 16 bp, Homo sapiens
tgaacttacacttgga

SEQ ID NO: 2121699 - DNA, 19 bp, Homo sapiens
tgacccacagcctctgcct

SEQ ID NO: 2121700 - DNA, 19 bp, Homo sapiens
tgacccagccccttgagaa

SEQ ID NO: 2121701 - DNA, 21 bp, Homo sapiens
tgacccagtccccgtgccccg

SEQ ID NO: 2121702 - DNA, 12 bp, Homo sapiens
tgaccccagggc

SEQ ID NO: 2121703 - DNA, 17 bp, Homo sapiens
tgaccccagggcacagg

SEQ ID NO: 2121704 - DNA, 18 bp, Homo sapiens
tgaccccagggcacagga

SEQ ID NO: 2121705 - DNA, 22 bp, Homo sapiens
tgacccctggccggcccaggcc

SEQ ID NO: 2121706 - DNA, 16 bp, Homo sapiens
tgacccctttccccca

SEQ ID NO: 2121707 - DNA, 20 bp, Homo sapiens
tgacccggcaccccctgcag

SEQ ID NO: 2121708 - DNA, 22 bp, Homo sapiens
tgaccctctgaatggtccaggg

SEQ ID NO: 2121709 - DNA, 20 bp, Homo sapiens
tgaccctgcgaaggggccct

SEQ ID NO: 2121710 - DNA, 19 bp, Homo sapiens
tgagaattattcctttcct

SEQ ID NO: 2121711 - DNA, 23 bp, Homo sapiens
tgagaattttaaattataactta

SEQ ID NO: 2121712 - DNA, 12 bp, Homo sapiens
tgagacaagccc

SEQ ID NO: 2121713 - DNA, 15 bp, Homo sapiens
tgagacaggagaatc

SEQ ID NO: 2121714 - DNA, 15 bp, Homo sapiens
tgagaccacctctca

SEQ ID NO: 2121715 - DNA, 12 bp, Homo sapiens
tgagaccagttg

SEQ ID NO: 2121716 - DNA, 23 bp, Homo sapiens
tgagaccagttgggagcactgga

SEQ ID NO: 2121717 - DNA, 23 bp, Homo sapiens
tgagaccctcgccacggggaggg

SEQ ID NO: 2121718 - DNA, 13 bp, Homo sapiens
tgagacctcagcc

SEQ ID NO: 2121719 - DNA, 14 bp, Homo sapiens
tgagacctcagcca

SEQ ID NO: 2121720 - DNA, 16 bp, Homo sapiens
tgagacctcagccatg

SEQ ID NO: 2121721 - DNA, 20 bp, Homo sapiens
tgagacctcgccggccttgt

SEQ ID NO: 2121722 - DNA, 23 bp, Homo sapiens
tgagacggcagagaccccaggat

SEQ ID NO: 2121723 - DNA, 22 bp, Homo sapiens
tgagactataaagcagtagaca

SEQ ID NO: 2121724 - DNA, 18 bp, Homo sapiens
tgagcttctattaaatgt

SEQ ID NO: 2121725 - DNA, 16 bp, Homo sapiens
tgaggaacctcaaact

SEQ ID NO: 2121726 - DNA, 18 bp, Homo sapiens
tgaggaagcctaaataaa

SEQ ID NO: 2121727 - DNA, 21 bp, Homo sapiens
tgaggaatatgactgttttta

SEQ ID NO: 2121728 - DNA, 19 bp, Homo sapiens
tgaggacaaccattccaga

SEQ ID NO: 2121729 - DNA, 21 bp, Homo sapiens
tgaggacacgtggcctgcacc

SEQ ID NO: 2121730 - DNA, 21 bp, Homo sapiens
tgaggacactaaccacgctgg

SEQ ID NO: 2121731 - DNA, 17 bp, Homo sapiens
tgaggacatggagagag

SEQ ID NO: 2121732 - DNA, 18 bp, Homo sapiens
tgaggacatggagagaga

SEQ ID NO: 2121733 - DNA, 19 bp, Homo sapiens
tgaggacatggagagagac

SEQ ID NO: 2121734 - DNA, 21 bp, Homo sapiens
tgaggacatggagagagactc

SEQ ID NO: 2121735 - DNA, 19 bp, Homo sapiens
tgaggaggggcacctgcca

SEQ ID NO: 2121736 - DNA, 20 bp, Homo sapiens
tgaggaggggcacctgccac

SEQ ID NO: 2121737 - DNA, 22 bp, Homo sapiens
tgaggaggggcacctgccaccg

SEQ ID NO: 2121738 - DNA, 14 bp, Homo sapiens
tgaggagggtgccc

SEQ ID NO: 2121739 - DNA, 17 bp, Homo sapiens
tgaggagggtggaggaa

SEQ ID NO: 2121740 - DNA, 15 bp, Homo sapiens
tgcactatgaggaat

SEQ ID NO: 2121741 - DNA, 14 bp, Homo sapiens
tgcactccagcctg

SEQ ID NO: 2121742 - DNA, 17 bp, Homo sapiens
tgcactccagcctgggc

SEQ ID NO: 2121743 - DNA, 18 bp, Homo sapiens
tgcactccagcctgggca

SEQ ID NO: 2121744 - DNA, 14 bp, Homo sapiens
tgcactccatggcc

SEQ ID NO: 2121745 - DNA, 16 bp, Homo sapiens
tgcactccatggccac

SEQ ID NO: 2121746 - DNA, 17 bp, Homo sapiens
tgcactccatggccacc

SEQ ID NO: 2121747 - DNA, 14 bp, Homo sapiens
tgcactccctaaga

SEQ ID NO: 2121748 - DNA, 18 bp, Homo sapiens
tgcactgacattgttggc

SEQ ID NO: 2121749 - DNA, 18 bp, Homo sapiens
tgcactgacccacagcct

SEQ ID NO: 2121750 - DNA, 23 bp, Homo sapiens
tgcactgacccttccagacatac

SEQ ID NO: 2121751 - DNA, 15 bp, Homo sapiens
tgcactgagggccac

SEQ ID NO: 2121752 - DNA, 16 bp, Homo sapiens
tgcactgagggccaca

SEQ ID NO: 2121753 - DNA, 16 bp, Homo sapiens
tgcactgggtgtggcc

SEQ ID NO: 2121754 - DNA, 21 bp, Homo sapiens
tgcactgtgacaccagaataa

SEQ ID NO: 2121755 - DNA, 16 bp, Homo sapiens
tgcacttgcagactct

SEQ ID NO: 2121756 - DNA, 22 bp, Homo sapiens
tgcactttctcatgatttacag

SEQ ID NO: 2121757 - DNA, 15 bp, Homo sapiens
tgcacttttctgtgt

SEQ ID NO: 2121758 - DNA, 19 bp, Homo sapiens
tgcagaaaaaaaaaaagaa

SEQ ID NO: 2121759 - DNA, 21 bp, Homo sapiens
tgcagaaaaaaaaaaagaaac

SEQ ID NO: 2121760 - DNA, 18 bp, Homo sapiens
tgcagaaaagcacctgcc

SEQ ID NO: 2121761 - DNA, 21 bp, Homo sapiens
tgcagaaaagcacctgccgac

SEQ ID NO: 2121762 - DNA, 13 bp, Homo sapiens
tgcagacactgtg

SEQ ID NO: 2121763 - DNA, 12 bp, Homo sapiens
tgcagacaggca

SEQ ID NO: 2121764 - DNA, 18 bp, Homo sapiens
tgcagactctacagaggc

SEQ ID NO: 2121765 - DNA, 19 bp, Homo sapiens
tgcagactctacagaggcc

SEQ ID NO: 2121766 - DNA, 20 bp, Homo sapiens
tgcagactctacagaggcca

SEQ ID NO: 2121767 - DNA, 18 bp, Homo sapiens
tgcagactgtggctgcag

SEQ ID NO: 2121768 - DNA, 23 bp, Homo sapiens
tgcagactgtggctgcagagacc

SEQ ID NO: 2121769 - DNA, 15 bp, Homo sapiens
tgcagagaaagaaag

SEQ ID NO: 2121770 - DNA, 20 bp, Homo sapiens
tgcagagaaagaaagggaaa

SEQ ID NO: 2121771 - DNA, 13 bp, Homo sapiens
tgcagagaccttg

SEQ ID NO: 2121772 - DNA, 22 bp, Homo sapiens
tgcagagacgcaagggagaaga

SEQ ID NO: 2121773 - DNA, 14 bp, Homo sapiens
tgcagagagaagcc

SEQ ID NO: 2121774 - DNA, 10 bp, Homo sapiens
tgcagagcct

SEQ ID NO: 2121775 - DNA, 15 bp, Homo sapiens
tgcagagctgaagat

SEQ ID NO: 2121776 - DNA, 19 bp, Homo sapiens
tgcagaggattgaggctta

SEQ ID NO: 2121777 - DNA, 16 bp, Homo sapiens
tgcagaggtgagcaga

SEQ ID NO: 2121778 - DNA, 16 bp, Homo sapiens
tgcagagttcatggaa

SEQ ID NO: 2121779 - DNA, 18 bp, Homo sapiens
tgcagatagccagacaca

SEQ ID NO: 2121780 - DNA, 14 bp, Homo sapiens
tgcagatgggctgt

SEQ ID NO: 2121781 - DNA, 18 bp, Homo sapiens
tgcagatggtgagagata

SEQ ID NO: 2121782 - DNA, 23 bp, Homo sapiens
tgcagattattttagtctgtcat

SEQ ID NO: 2121783 - DNA, 22 bp, Homo sapiens
tgcagattcctgggcctgtccc

SEQ ID NO: 2121784 - DNA, 15 bp, Homo sapiens
tgcagattctgattt

SEQ ID NO: 2121785 - DNA, 12 bp, Homo sapiens
tgcagcaactcc

SEQ ID NO: 2121786 - DNA, 17 bp, Homo sapiens
tgcagcaactcccacga

SEQ ID NO: 2121787 - DNA, 19 bp, Homo sapiens
tgcagcaactcccacgact

SEQ ID NO: 2121788 - DNA, 22 bp, Homo sapiens
tgcagcactttaaccctctctt

SEQ ID NO: 2121789 - DNA, 23 bp, Homo sapiens
tgcagcactttaaccctctcttc

SEQ ID NO: 2121790 - DNA, 15 bp, Homo sapiens
tgcagcagaagccaa

SEQ ID NO: 2121791 - DNA, 15 bp, Homo sapiens
tgcagcagcccagct

SEQ ID NO: 2121792 - DNA, 16 bp, Homo sapiens
tgcagcagcccagctt

SEQ ID NO: 2121793 - DNA, 16 bp, Homo sapiens
tgcagccaaacagagc

SEQ ID NO: 2121794 - DNA, 21 bp, Homo sapiens
tgcagccaaacagagccttca

SEQ ID NO: 2121795 - DNA, 19 bp, Homo sapiens
tgcagccagcccagcccag

SEQ ID NO: 2121796 - DNA, 22 bp, Homo sapiens
tgcagccagcccagcccagctg

SEQ ID NO: 2121797 - DNA, 12 bp, Homo sapiens
tgcagcccttcc

SEQ ID NO: 2121798 - DNA, 22 bp, Homo sapiens
tgcagcccttcctcctgaagcc

SEQ ID NO: 2121799 - DNA, 20 bp, Homo sapiens
tgcagcctcaacctcctggg

SEQ ID NO: 2121800 - DNA, 13 bp, Homo sapiens
tgcagcctccccc

SEQ ID NO: 2121801 - DNA, 22 bp, Homo sapiens
tgcagcctcccccacaaataat

SEQ ID NO: 2121802 - DNA, 14 bp, Homo sapiens
tgcagcctcctcct

SEQ ID NO: 2121803 - DNA, 15 bp, Homo sapiens
tgcagcctcctcctg

SEQ ID NO: 2121804 - DNA, 19 bp, Homo sapiens
tgcagcctcctcctgacca

SEQ ID NO: 2121805 - DNA, 12 bp, Homo sapiens
tgcagctgggcc

SEQ ID NO: 2121806 - DNA, 18 bp, Homo sapiens
tgcagctgggccccatgc

SEQ ID NO: 2121807 - DNA, 15 bp, Homo sapiens
tgcagcttcatcaat

SEQ ID NO: 2121808 - DNA, 20 bp, Homo sapiens
tgcagcttcatcaattttta

SEQ ID NO: 2121809 - DNA, 16 bp, Homo sapiens
tgcagcttgtagccag

SEQ ID NO: 2121810 - DNA, 19 bp, Homo sapiens
tgcagcttgtagccagccg

SEQ ID NO: 2121811 - DNA, 20 bp, Homo sapiens
tgcaggaacgagcactggcc

SEQ ID NO: 2121812 - DNA, 20 bp, Homo sapiens
tgcaggaatcaaaaattgaa

SEQ ID NO: 2121813 - DNA, 16 bp, Homo sapiens
tgcaggcaccttagtg

SEQ ID NO: 2121814 - DNA, 21 bp, Homo sapiens
tgcaggcaccttagtggcttt

SEQ ID NO: 2121815 - DNA, 21 bp, Homo sapiens
tgcaggccaagagcagaggca

SEQ ID NO: 2121816 - DNA, 23 bp, Homo sapiens
tgcaggccaggttatgcctcatg

SEQ ID NO: 2121817 - DNA, 14 bp, Homo sapiens
tgcaggcccagcag

SEQ ID NO: 2121818 - DNA, 17 bp, Homo sapiens
tgcaggcccagcagact

SEQ ID NO: 2121819 - DNA, 10 bp, Homo sapiens
tgcaggcccc

SEQ ID NO: 2121820 - DNA, 19 bp, Homo sapiens
tgcaggccccgcttgtcca

SEQ ID NO: 2121821 - DNA, 11 bp, Homo sapiens
tgcaggctctg

SEQ ID NO: 2121822 - DNA, 14 bp, Homo sapiens
tgcaggctctgggc

SEQ ID NO: 2121823 - DNA, 17 bp, Homo sapiens
tgcaggctctgggctca

SEQ ID NO: 2121824 - DNA, 18 bp, Homo sapiens
tgcaggctctgggctcag

SEQ ID NO: 2121825 - DNA, 19 bp, Homo sapiens
tgcaggctctgggctcagg

SEQ ID NO: 2121826 - DNA, 20 bp, Homo sapiens
tgcaggctctgggctcaggg

SEQ ID NO: 2121827 - DNA, 21 bp, Homo sapiens
tgcaggctctgggctcagggc

SEQ ID NO: 2121828 - DNA, 16 bp, Homo sapiens
tgcagggacaaagagg

SEQ ID NO: 2121829 - DNA, 24 bp, Homo sapiens
tgcaggtacttcctcctgatggcc

SEQ ID NO: 2121830 - DNA, 20 bp, Homo sapiens
tgcaggtattttaactgtgt

SEQ ID NO: 2121831 - DNA, 17 bp, Homo sapiens
tgcagtagccagcacgt

SEQ ID NO: 2121832 - DNA, 21 bp, Homo sapiens
tgcagtagtctctgtgctttg

SEQ ID NO: 2121833 - DNA, 17 bp, Homo sapiens
tgcagtatggccatggg

SEQ ID NO: 2121834 - DNA, 14 bp, Homo sapiens
tgcagtattgccac

SEQ ID NO: 2121835 - DNA, 22 bp, Homo sapiens
tgcagtattgccacaatgcctc

SEQ ID NO: 2121836 - DNA, 17 bp, Homo sapiens
tgcagtcaacagttcaa

SEQ ID NO: 2121837 - DNA, 21 bp, Homo sapiens
tgcagtcagtcatgatggcac

SEQ ID NO: 2121838 - DNA, 21 bp, Homo sapiens
tgcagtccagaataagtgctg

SEQ ID NO: 2121839 - DNA, 12 bp, Homo sapiens
tgcagtccccag

SEQ ID NO: 2121840 - DNA, 20 bp, Homo sapiens
tgcagtccgcagtctggcct

SEQ ID NO: 2121841 - DNA, 19 bp, Homo sapiens
tgcagtgacgtgcacctgt

SEQ ID NO: 2121842 - DNA, 14 bp, Homo sapiens
tgcagtgagccatg

SEQ ID NO: 2121843 - DNA, 22 bp, Homo sapiens
tgcagtggtatgatcacggctc

SEQ ID NO: 2121844 - DNA, 20 bp, Homo sapiens
tgcagtggtgcgatctgggt

SEQ ID NO: 2121845 - DNA, 12 bp, Homo sapiens
tgcagtttccaa

SEQ ID NO: 2121846 - DNA, 13 bp, Homo sapiens
tgcataaaccaat

SEQ ID NO: 2121847 - DNA, 15 bp, Homo sapiens
tgcataaacttcatc

SEQ ID NO: 2121848 - DNA, 16 bp, Homo sapiens
tgcataaacttcatct

SEQ ID NO: 2121849 - DNA, 22 bp, Homo sapiens
tgcataagattaaaggaaggaa

SEQ ID NO: 2121850 - DNA, 22 bp, Homo sapiens
tgcatagtaccaatcattttaa

SEQ ID NO: 2121851 - DNA, 22 bp, Homo sapiens
tgcatcaatttttcttatttca

SEQ ID NO: 2121852 - DNA, 22 bp, Homo sapiens
tgcatcacttggggtcaccacc

SEQ ID NO: 2121853 - DNA, 20 bp, Homo sapiens
tgcatcagaaagggagggct

SEQ ID NO: 2121854 - DNA, 20 bp, Homo sapiens
tgcatcagtattaatactaa

SEQ ID NO: 2121855 - DNA, 17 bp, Homo sapiens
tgcatccaatctgctca

SEQ ID NO: 2121856 - DNA, 18 bp, Homo sapiens
tgcatccattcctcaggg

SEQ ID NO: 2121857 - DNA, 19 bp, Homo sapiens
tgcatccattcctcaggga

SEQ ID NO: 2121858 - DNA, 21 bp, Homo sapiens
tgcatccattcctcagggaca

SEQ ID NO: 2121859 - DNA, 18 bp, Homo sapiens
tgcatcccccagcactga

SEQ ID NO: 2121860 - DNA, 20 bp, Homo sapiens
tgcatccgtagttccctgaa

SEQ ID NO: 2121861 - DNA, 15 bp, Homo sapiens
tgcatctcagcccac

SEQ ID NO: 2121862 - DNA, 13 bp, Homo sapiens
tgcatgaaggttt

SEQ ID NO: 2121863 - DNA, 18 bp, Homo sapiens
tgcatgaaggtttctgaa

SEQ ID NO: 2121864 - DNA, 17 bp, Homo sapiens
tgcatgattttatacat

SEQ ID NO: 2121865 - DNA, 20 bp, Homo sapiens
tgcatgattttatacatagt

SEQ ID NO: 2121866 - DNA, 21 bp, Homo sapiens
tgcatgattttatacatagtc

SEQ ID NO: 2121867 - DNA, 14 bp, Homo sapiens
tgcatgcctggtct

SEQ ID NO: 2121868 - DNA, 15 bp, Homo sapiens
tgcatgcgcaggctc

SEQ ID NO: 2121869 - DNA, 16 bp, Homo sapiens
tgcatgcgcaggctca

SEQ ID NO: 2121870 - DNA, 17 bp, Homo sapiens
tgcatgctctctgcagc

SEQ ID NO: 2121871 - DNA, 18 bp, Homo sapiens
tgcatgctctctgcagcc

SEQ ID NO: 2121872 - DNA, 15 bp, Homo sapiens
tgcatgctctggaag

SEQ ID NO: 2121873 - DNA, 16 bp, Homo sapiens
tgcatgctctggaagc

SEQ ID NO: 2121874 - DNA, 13 bp, Homo sapiens
tgcatggactgtg

SEQ ID NO: 2121875 - DNA, 20 bp, Homo sapiens
tgcatggcttggggagcaga

SEQ ID NO: 2121876 - DNA, 17 bp, Homo sapiens
tgcatggggaaagagat

SEQ ID NO: 2121877 - DNA, 12 bp, Homo sapiens
tgcatgtatgtg

SEQ ID NO: 2121878 - DNA, 20 bp, Homo sapiens
tgcatgtatgtgcacatgtg

SEQ ID NO: 2121879 - DNA, 15 bp, Homo sapiens
tgcatgtatgtgtgt

SEQ ID NO: 2121880 - DNA, 15 bp, Homo sapiens
tgcatgtattgtaaa

SEQ ID NO: 2121881 - DNA, 19 bp, Homo sapiens
tgcatgtgagcacatgcgt

SEQ ID NO: 2121882 - DNA, 16 bp, Homo sapiens
tgcatgtgtgtgtctg

SEQ ID NO: 2121883 - DNA, 20 bp, Homo sapiens
tgcatgtgtgtgtctgtctt

SEQ ID NO: 2121884 - DNA, 20 bp, Homo sapiens
tgcatgttgccatgaggcct

SEQ ID NO: 2121885 - DNA, 20 bp, Homo sapiens
tgcatgtttactttattaga

SEQ ID NO: 2121886 - DNA, 14 bp, Homo sapiens
tgcattaacttaaa

SEQ ID NO: 2121887 - DNA, 22 bp, Homo sapiens
tgcattagaaatagacagtata

SEQ ID NO: 2121888 - DNA, 15 bp, Homo sapiens
tgccagcctggcttc

SEQ ID NO: 2121889 - DNA, 22 bp, Homo sapiens
tgccagcctggcttctggagcc

SEQ ID NO: 2121890 - DNA, 24 bp, Homo sapiens
tgccagctcaggtgactggagccc

SEQ ID NO: 2121891 - DNA, 15 bp, Homo sapiens
tgccagctgccttcc

SEQ ID NO: 2121892 - DNA, 21 bp, Homo sapiens
tgccagctgccttcctcatcc

SEQ ID NO: 2121893 - DNA, 14 bp, Homo sapiens
tgccaggacacctg

SEQ ID NO: 2121894 - DNA, 15 bp, Homo sapiens
tgccaggacacctgc

SEQ ID NO: 2121895 - DNA, 16 bp, Homo sapiens
tgccaggacagctggc

SEQ ID NO: 2121896 - DNA, 20 bp, Homo sapiens
tgccaggacagctggctgct

SEQ ID NO: 2121897 - DNA, 22 bp, Homo sapiens
tgccaggactccccaggccagg

SEQ ID NO: 2121898 - DNA, 14 bp, Homo sapiens
tgccaggcacctgg

SEQ ID NO: 2121899 - DNA, 21 bp, Homo sapiens
tgccaggcacctggcctgctg

SEQ ID NO: 2121900 - DNA, 22 bp, Homo sapiens
tgccaggcccatctcaggtgcc

SEQ ID NO: 2121901 - DNA, 11 bp, Homo sapiens
tgccaggcccg

SEQ ID NO: 2121902 - DNA, 20 bp, Homo sapiens
tgccaggcgttggtgccact

SEQ ID NO: 2121903 - DNA, 16 bp, Homo sapiens
tgccaggctaattttt

SEQ ID NO: 2121904 - DNA, 17 bp, Homo sapiens
tgccaggctaatttttt

SEQ ID NO: 2121905 - DNA, 18 bp, Homo sapiens
tgccaggctagactagga

SEQ ID NO: 2121906 - DNA, 16 bp, Homo sapiens
tgccaggctgtaagca

SEQ ID NO: 2121907 - DNA, 22 bp, Homo sapiens
tgccagggctcgggcgctgtgg

SEQ ID NO: 2121908 - DNA, 22 bp, Homo sapiens
tgccagtaaaaaaaaaaaatgg

SEQ ID NO: 2121909 - DNA, 17 bp, Homo sapiens
tgccagtccccctgccc

SEQ ID NO: 2121910 - DNA, 19 bp, Homo sapiens
tgccagtccccctgcccca

SEQ ID NO: 2121911 - DNA, 20 bp, Homo sapiens
tgccagtccccctgccccag

SEQ ID NO: 2121912 - DNA, 15 bp, Homo sapiens
tgccagtgaagactt

SEQ ID NO: 2121913 - DNA, 22 bp, Homo sapiens
tgccagtgaagacttcttgggt

SEQ ID NO: 2121914 - DNA, 14 bp, Homo sapiens
tgccagtggaatac

SEQ ID NO: 2121915 - DNA, 18 bp, Homo sapiens
tgccataccgctggggaa

SEQ ID NO: 2121916 - DNA, 13 bp, Homo sapiens
tgccatagagttt

SEQ ID NO: 2121917 - DNA, 16 bp, Homo sapiens
tgccatagtcacatgg

SEQ ID NO: 2121918 - DNA, 16 bp, Homo sapiens
tgccatattctgttgg

SEQ ID NO: 2121919 - DNA, 21 bp, Homo sapiens
tgccatattctgttggccagt

SEQ ID NO: 2121920 - DNA, 20 bp, Homo sapiens
tgccatccaggttcagcttg

SEQ ID NO: 2121921 - DNA, 16 bp, Homo sapiens
tgccatccattctgcc

SEQ ID NO: 2121922 - DNA, 17 bp, Homo sapiens
tgccatccattctgccg

SEQ ID NO: 2121923 - DNA, 14 bp, Homo sapiens
tgccatctccaccc

SEQ ID NO: 2121924 - DNA, 19 bp, Homo sapiens
tcagaatatggacaaagaa

SEQ ID NO: 2121925 - DNA, 14 bp, Homo sapiens
tcagaatccaaaga

SEQ ID NO: 2121926 - DNA, 15 bp, Homo sapiens
tcagaatccaaagat

SEQ ID NO: 2121927 - DNA, 14 bp, Homo sapiens
tcagaatgctctac

SEQ ID NO: 2121928 - DNA, 14 bp, Homo sapiens
tcagaatgtcattt

SEQ ID NO: 2121929 - DNA, 11 bp, Homo sapiens
tcagacaagca

SEQ ID NO: 2121930 - DNA, 18 bp, Homo sapiens
tcagacagaacccctaca

SEQ ID NO: 2121931 - DNA, 23 bp, Homo sapiens
tcagacaggtaaatgggcagtgc

SEQ ID NO: 2121932 - DNA, 12 bp, Homo sapiens
tcagacccccac

SEQ ID NO: 2121933 - DNA, 18 bp, Homo sapiens
tcagaccctaccccacca

SEQ ID NO: 2121934 - DNA, 13 bp, Homo sapiens
tcagacctctgat

SEQ ID NO: 2121935 - DNA, 17 bp, Homo sapiens
tcagactgctgggactg

SEQ ID NO: 2121936 - DNA, 21 bp, Homo sapiens
tcagactgctgggactggcca

SEQ ID NO: 2121937 - DNA, 14 bp, Homo sapiens
tcagactgtttagt

SEQ ID NO: 2121938 - DNA, 11 bp, Homo sapiens
tcagagaagtc

SEQ ID NO: 2121939 - DNA, 21 bp, Homo sapiens
tcagagacagaccccttggct

SEQ ID NO: 2121940 - DNA, 19 bp, Homo sapiens
tcagagactcagggcccca

SEQ ID NO: 2121941 - DNA, 23 bp, Homo sapiens
tcagagatggtaatctacagctc

SEQ ID NO: 2121942 - DNA, 14 bp, Homo sapiens
tcagagcaggctca

SEQ ID NO: 2121943 - DNA, 14 bp, Homo sapiens
tcagagcaggggtc

SEQ ID NO: 2121944 - DNA, 18 bp, Homo sapiens
tcagagccaggctctgcc

SEQ ID NO: 2121945 - DNA, 18 bp, Homo sapiens
tcagagcccctccctgct

SEQ ID NO: 2121946 - DNA, 16 bp, Homo sapiens
tcagagcctagccacc

SEQ ID NO: 2121947 - DNA, 17 bp, Homo sapiens
tcagagcctagccacct

SEQ ID NO: 2121948 - DNA, 19 bp, Homo sapiens
tcagagcctagccacctcc

SEQ ID NO: 2121949 - DNA, 21 bp, Homo sapiens
tcagagcctagccacctccca

SEQ ID NO: 2121950 - DNA, 23 bp, Homo sapiens
tcagagctcttcaagctgtcccc

SEQ ID NO: 2121951 - DNA, 14 bp, Homo sapiens
tcagagctgggagt

SEQ ID NO: 2121952 - DNA, 21 bp, Homo sapiens
tcagagctgttggcctcgcct

SEQ ID NO: 2121953 - DNA, 14 bp, Homo sapiens
tcagaggagaagag

SEQ ID NO: 2121954 - DNA, 16 bp, Homo sapiens
tcagaggctgggggag

SEQ ID NO: 2121955 - DNA, 21 bp, Homo sapiens
tcagagggaaagtaaatattt

SEQ ID NO: 2121956 - DNA, 21 bp, Homo sapiens
tcagagtagagggcttgggaa

SEQ ID NO: 2121957 - DNA, 23 bp, Homo sapiens
tcagagtgacacccaagagggct

SEQ ID NO: 2121958 - DNA, 19 bp, Homo sapiens
tcagagtgacatccaggag

SEQ ID NO: 2121959 - DNA, 17 bp, Homo sapiens
tcagataaagtgaccag

SEQ ID NO: 2121960 - DNA, 17 bp, Homo sapiens
tcagatagaatgacagt

SEQ ID NO: 2121961 - DNA, 23 bp, Homo sapiens
tcagatatatttttcacagtttt

SEQ ID NO: 2121962 - DNA, 21 bp, Homo sapiens
tcagatattttttcagaaata

SEQ ID NO: 2121963 - DNA, 23 bp, Homo sapiens
tcagatattttttcagaaatatg

SEQ ID NO: 2121964 - DNA, 15 bp, Homo sapiens
tcagatcttgacagt

SEQ ID NO: 2121965 - DNA, 21 bp, Homo sapiens
tcagatgcccagagggcccag

SEQ ID NO: 2121966 - DNA, 15 bp, Homo sapiens
tcagatgggaagaca

SEQ ID NO: 2121967 - DNA, 18 bp, Homo sapiens
tcagatgggaagacatga

SEQ ID NO: 2121968 - DNA, 21 bp, Homo sapiens
tcagattccacacaaaatgtc

SEQ ID NO: 2121969 - DNA, 22 bp, Homo sapiens
tcagattccacacaaaatgtca

SEQ ID NO: 2121970 - DNA, 19 bp, Homo sapiens
tcagattcccagagcaaaa

SEQ ID NO: 2121971 - DNA, 22 bp, Homo sapiens
tcagattcccagagcaaaataa

SEQ ID NO: 2121972 - DNA, 16 bp, Homo sapiens
tcagatttgctgttca

SEQ ID NO: 2121973 - DNA, 12 bp, Homo sapiens
tcagcaaatcct

SEQ ID NO: 2121974 - DNA, 19 bp, Homo sapiens
tcatgatctccctgccgcc

SEQ ID NO: 2121975 - DNA, 22 bp, Homo sapiens
tcatgatctccctgccgcctca

SEQ ID NO: 2121976 - DNA, 14 bp, Homo sapiens
tcatgattcacaac

SEQ ID NO: 2121977 - DNA, 15 bp, Homo sapiens
tcatgcaatgacatc

SEQ ID NO: 2121978 - DNA, 16 bp, Homo sapiens
tcatgcaatgacatct

SEQ ID NO: 2121979 - DNA, 11 bp, Homo sapiens
tcatgccatct

SEQ ID NO: 2121980 - DNA, 12 bp, Homo sapiens
tcatgcctcagt

SEQ ID NO: 2121981 - DNA, 13 bp, Homo sapiens
tcatgcctcagtt

SEQ ID NO: 2121982 - DNA, 14 bp, Homo sapiens
tcatgcctctgagg

SEQ ID NO: 2121983 - DNA, 15 bp, Homo sapiens
tcatgcctctgaggc

SEQ ID NO: 2121984 - DNA, 21 bp, Homo sapiens
tcatgcctctgaggccagcct

SEQ ID NO: 2121985 - DNA, 22 bp, Homo sapiens
tcatgcctctgaggccagcctg

SEQ ID NO: 2121986 - DNA, 14 bp, Homo sapiens
tcatgcctgcctga

SEQ ID NO: 2121987 - DNA, 14 bp, Homo sapiens
tcatgcctggcccc

SEQ ID NO: 2121988 - DNA, 13 bp, Homo sapiens
tcatgcttcagtt

SEQ ID NO: 2121989 - DNA, 22 bp, Homo sapiens
tcatgctttaaagtgtaataat

SEQ ID NO: 2121990 - DNA, 17 bp, Homo sapiens
tcatggaaactggccag

SEQ ID NO: 2121991 - DNA, 20 bp, Homo sapiens
tcatggaagtggcagtgaaa

SEQ ID NO: 2121992 - DNA, 11 bp, Homo sapiens
tcatggagaaa

SEQ ID NO: 2121993 - DNA, 21 bp, Homo sapiens
tcatggcagatgtaggaggga

SEQ ID NO: 2121994 - DNA, 18 bp, Homo sapiens
tcatggcccaaatccagt

SEQ ID NO: 2121995 - DNA, 18 bp, Homo sapiens
tcatggcgtaatgggcct

SEQ ID NO: 2121996 - DNA, 14 bp, Homo sapiens
tcatggcttaatgt

SEQ ID NO: 2121997 - DNA, 15 bp, Homo sapiens
tcatggcttaatgtt

SEQ ID NO: 2121998 - DNA, 15 bp, Homo sapiens
tcatggcttagaaat

SEQ ID NO: 2121999 - DNA, 15 bp, Homo sapiens
tcatggtcagctcac

SEQ ID NO: 2122000 - DNA, 16 bp, Homo sapiens
tcatgtaaattttgta

SEQ ID NO: 2122001 - DNA, 17 bp, Homo sapiens
tcatgtaaattttgtat

SEQ ID NO: 2122002 - DNA, 16 bp, Homo sapiens
tcatgtacagcatgca

SEQ ID NO: 2122003 - DNA, 21 bp, Homo sapiens
tcatgtacattggtctttcta

SEQ ID NO: 2122004 - DNA, 12 bp, Homo sapiens
tcatgtacattt

SEQ ID NO: 2122005 - DNA, 15 bp, Homo sapiens
tcatgtaccatcaat

SEQ ID NO: 2122006 - DNA, 15 bp, Homo sapiens
tcatgtacttcctgt

SEQ ID NO: 2122007 - DNA, 16 bp, Homo sapiens
tcatgtacttcctgtg

SEQ ID NO: 2122008 - DNA, 23 bp, Homo sapiens
tcatgtacttcctgtgtactctt

SEQ ID NO: 2122009 - DNA, 20 bp, Homo sapiens
tcatgtagattttagttcac

SEQ ID NO: 2122010 - DNA, 19 bp, Homo sapiens
tcatgtatgttcagaagaa

SEQ ID NO: 2122011 - DNA, 19 bp, Homo sapiens
tcatgtctcagcctcctca

SEQ ID NO: 2122012 - DNA, 20 bp, Homo sapiens
tcatgtgatccttttatgtt

SEQ ID NO: 2122013 - DNA, 14 bp, Homo sapiens
tcatgtgtgcatgt

SEQ ID NO: 2122014 - DNA, 15 bp, Homo sapiens
tcatgttttgtgact

SEQ ID NO: 2122015 - DNA, 22 bp, Homo sapiens
tccacaaatctatattaaagtg

SEQ ID NO: 2122016 - DNA, 19 bp, Homo sapiens
tccacacacagaggaagag

SEQ ID NO: 2122017 - DNA, 23 bp, Homo sapiens
tccacaccatcaccctctgggca

SEQ ID NO: 2122018 - DNA, 14 bp, Homo sapiens
tccacagccgcagc

SEQ ID NO: 2122019 - DNA, 18 bp, Homo sapiens
tccacagccgcagcctcc

SEQ ID NO: 2122020 - DNA, 13 bp, Homo sapiens
tccacaggggcag

SEQ ID NO: 2122021 - DNA, 16 bp, Homo sapiens
tccacaggggcaggcc

SEQ ID NO: 2122022 - DNA, 21 bp, Homo sapiens
tccacagtagcatttcttatt

SEQ ID NO: 2122023 - DNA, 17 bp, Homo sapiens
tccacagtctcccattc

SEQ ID NO: 2122024 - DNA, 14 bp, Homo sapiens
tccacagtctctgg

SEQ ID NO: 2122025 - DNA, 22 bp, Homo sapiens
tccacagttcgacctgcggctg

SEQ ID NO: 2122026 - DNA, 12 bp, Homo sapiens
tccacataaagg

SEQ ID NO: 2122027 - DNA, 17 bp, Homo sapiens
tccaccattcacatttg

SEQ ID NO: 2122028 - DNA, 13 bp, Homo sapiens
tccacccacctca

SEQ ID NO: 2122029 - DNA, 15 bp, Homo sapiens
tccacccacctcagc

SEQ ID NO: 2122030 - DNA, 18 bp, Homo sapiens
tccacccacctcagcctc

SEQ ID NO: 2122031 - DNA, 12 bp, Homo sapiens
tccacccactgt

SEQ ID NO: 2122032 - DNA, 13 bp, Homo sapiens
tccacccagccca

SEQ ID NO: 2122033 - DNA, 14 bp, Homo sapiens
tccacccagcccat

SEQ ID NO: 2122034 - DNA, 16 bp, Homo sapiens
tccacccaggctgcac

SEQ ID NO: 2122035 - DNA, 12 bp, Homo sapiens
tccacccagtgc

SEQ ID NO: 2122036 - DNA, 16 bp, Homo sapiens
tccacccagtgctgcc

SEQ ID NO: 2122037 - DNA, 20 bp, Homo sapiens
tccacccagtgctgccatgc

SEQ ID NO: 2122038 - DNA, 13 bp, Homo sapiens
tccacccattccc

SEQ ID NO: 2122039 - DNA, 13 bp, Homo sapiens
tccaccccaggac

SEQ ID NO: 2122040 - DNA, 19 bp, Homo sapiens
tccaccccaggacgccact

SEQ ID NO: 2122041 - DNA, 23 bp, Homo sapiens
tccacccccgccacggccaccct

SEQ ID NO: 2122042 - DNA, 16 bp, Homo sapiens
tccaccccctccagct

SEQ ID NO: 2122043 - DNA, 16 bp, Homo sapiens
tccaccctgagcctga

SEQ ID NO: 2122044 - DNA, 19 bp, Homo sapiens
tccaccctgagcctgacct

SEQ ID NO: 2122045 - DNA, 21 bp, Homo sapiens
tccaccctgctctccgaccag

SEQ ID NO: 2122046 - DNA, 16 bp, Homo sapiens
tccaccgcagaaggaa

SEQ ID NO: 2122047 - DNA, 13 bp, Homo sapiens
tccaccgctgcct

SEQ ID NO: 2122048 - DNA, 19 bp, Homo sapiens
tccaccgctgcctaagtgg

SEQ ID NO: 2122049 - DNA, 23 bp, Homo sapiens
tccaccgggcctgaaccacagcg

SEQ ID NO: 2122050 - DNA, 17 bp, Homo sapiens
tccacctcagccttgga

SEQ ID NO: 2122051 - DNA, 16 bp, Homo sapiens
tccacctctccttgga

SEQ ID NO: 2122052 - DNA, 13 bp, Homo sapiens
tccacctggcccc

SEQ ID NO: 2122053 - DNA, 12 bp, Homo sapiens
tccacctggggt

SEQ ID NO: 2122054 - DNA, 18 bp, Homo sapiens
tccacctgttcaggagct

SEQ ID NO: 2122055 - DNA, 15 bp, Homo sapiens
tccaccttcccatgc

SEQ ID NO: 2122056 - DNA, 18 bp, Homo sapiens
tccaccttcccatgccct

SEQ ID NO: 2122057 - DNA, 19 bp, Homo sapiens
tccacgcctcctggccaga

SEQ ID NO: 2122058 - DNA, 14 bp, Homo sapiens
tccacgggaagcct

SEQ ID NO: 2122059 - DNA, 19 bp, Homo sapiens
tccacggtcagatttgctg

SEQ ID NO: 2122060 - DNA, 15 bp, Homo sapiens
tccacggtgcgtggc

SEQ ID NO: 2122061 - DNA, 20 bp, Homo sapiens
tccacggtgcgtggctgtgg

SEQ ID NO: 2122062 - DNA, 17 bp, Homo sapiens
tccacgtccccctgggg

SEQ ID NO: 2122063 - DNA, 19 bp, Homo sapiens
tccactaaatgagctcctg

SEQ ID NO: 2122064 - DNA, 15 bp, Homo sapiens
tccactcactccagc

SEQ ID NO: 2122065 - DNA, 19 bp, Homo sapiens
tccactcccccacctgaca

SEQ ID NO: 2122066 - DNA, 23 bp, Homo sapiens
tccactctccttcgtgtctctcc

SEQ ID NO: 2122067 - DNA, 18 bp, Homo sapiens
tccactgctctcagcctc

SEQ ID NO: 2122068 - DNA, 10 bp, Homo sapiens
tccactggac

SEQ ID NO: 2122069 - DNA, 19 bp, Homo sapiens
tccactgtcaccctccacc

SEQ ID NO: 2122070 - DNA, 19 bp, Homo sapiens
tccactgtcttgcctgcca

SEQ ID NO: 2122071 - DNA, 23 bp, Homo sapiens
tccacttagaaattgcatttcct

SEQ ID NO: 2122072 - DNA, 14 bp, Homo sapiens
tccacttcaatctg

SEQ ID NO: 2122073 - DNA, 17 bp, Homo sapiens
tccacttctctagagaa

SEQ ID NO: 2122074 - DNA, 18 bp, Homo sapiens
tccacttcttaatgcttt

SEQ ID NO: 2122075 - DNA, 21 bp, Homo sapiens
tccacttcttaatgctttcct

SEQ ID NO: 2122076 - DNA, 14 bp, Homo sapiens
tccagaaaatataa

SEQ ID NO: 2122077 - DNA, 19 bp, Homo sapiens
tccagaaaatataaatgca

SEQ ID NO: 2122078 - DNA, 11 bp, Homo sapiens
tccagaaagaa

SEQ ID NO: 2122079 - DNA, 19 bp, Homo sapiens
tccagaagaatattcagga

SEQ ID NO: 2122080 - DNA, 15 bp, Homo sapiens
tccagaagtccctcc

SEQ ID NO: 2122081 - DNA, 18 bp, Homo sapiens
tccagaagtggggctctg

SEQ ID NO: 2122082 - DNA, 19 bp, Homo sapiens
tccagaagtggggctctgg

SEQ ID NO: 2122083 - DNA, 17 bp, Homo sapiens
tccagaataagtgctgt

SEQ ID NO: 2122084 - DNA, 15 bp, Homo sapiens
tccagaatctgctgt

SEQ ID NO: 2122085 - DNA, 16 bp, Homo sapiens
tccagaatctgctgtt

SEQ ID NO: 2122086 - DNA, 19 bp, Homo sapiens
tccagaatctgctgttgcc

SEQ ID NO: 2122087 - DNA, 16 bp, Homo sapiens
tccagaattgaccttt

SEQ ID NO: 2122088 - DNA, 16 bp, Homo sapiens
tccagaccattgtctt

SEQ ID NO: 2122089 - DNA, 20 bp, Homo sapiens
tccagacccctgtggcagac

SEQ ID NO: 2122090 - DNA, 15 bp, Homo sapiens
tccagacccggctgc

SEQ ID NO: 2122091 - DNA, 19 bp, Homo sapiens
tccagacccggctgcgtgg

SEQ ID NO: 2122092 - DNA, 22 bp, Homo sapiens
tccagaccctgcctgagcccag

SEQ ID NO: 2122093 - DNA, 13 bp, Homo sapiens
tccagagacagga

SEQ ID NO: 2122094 - DNA, 16 bp, Homo sapiens
tccagagagaggatgc

SEQ ID NO: 2122095 - DNA, 12 bp, Homo sapiens
tccccagccctt

SEQ ID NO: 2122096 - DNA, 13 bp, Homo sapiens
tccccagcccttc

SEQ ID NO: 2122097 - DNA, 16 bp, Homo sapiens
tccccagcccttctgc

SEQ ID NO: 2122098 - DNA, 17 bp, Homo sapiens
tccccagcccttctgcc

SEQ ID NO: 2122099 - DNA, 15 bp, Homo sapiens
tccccagccctttgc

SEQ ID NO: 2122100 - DNA, 23 bp, Homo sapiens
tccccagcgattccctctcccag

SEQ ID NO: 2122101 - DNA, 16 bp, Homo sapiens
tccccagctccccagg

SEQ ID NO: 2122102 - DNA, 17 bp, Homo sapiens
tccccagctccccagga

SEQ ID NO: 2122103 - DNA, 21 bp, Homo sapiens
tccccagctccccaggactca

SEQ ID NO: 2122104 - DNA, 12 bp, Homo sapiens
tccccagctggt

SEQ ID NO: 2122105 - DNA, 22 bp, Homo sapiens
tccccaggccaggccaccagga

SEQ ID NO: 2122106 - DNA, 23 bp, Homo sapiens
tccccaggccaggccaccaggat

SEQ ID NO: 2122107 - DNA, 12 bp, Homo sapiens
tccccaggcctc

SEQ ID NO: 2122108 - DNA, 18 bp, Homo sapiens
tccccaggcctccagcct

SEQ ID NO: 2122109 - DNA, 22 bp, Homo sapiens
tccccaggcctccagcctctcc

SEQ ID NO: 2122110 - DNA, 15 bp, Homo sapiens
tccccagggcccctc

SEQ ID NO: 2122111 - DNA, 19 bp, Homo sapiens
tccccaggggaaaatgaag

SEQ ID NO: 2122112 - DNA, 23 bp, Homo sapiens
tccccaggggagagggtctggag

SEQ ID NO: 2122113 - DNA, 16 bp, Homo sapiens
tccccaggtctctcca

SEQ ID NO: 2122114 - DNA, 20 bp, Homo sapiens
tccccaggtctctccactgc

SEQ ID NO: 2122115 - DNA, 19 bp, Homo sapiens
tccccaggtggctgaccca

SEQ ID NO: 2122116 - DNA, 20 bp, Homo sapiens
tccccaggtggctgacccag

SEQ ID NO: 2122117 - DNA, 12 bp, Homo sapiens
tccccagtgtgg

SEQ ID NO: 2122118 - DNA, 23 bp, Homo sapiens
tccccagtgtggccccagcccga

SEQ ID NO: 2122119 - DNA, 16 bp, Homo sapiens
tccccatcatcccagc

SEQ ID NO: 2122120 - DNA, 17 bp, Homo sapiens
tccccatcatcccagct

SEQ ID NO: 2122121 - DNA, 19 bp, Homo sapiens
tccccatcatcccagctgc

SEQ ID NO: 2122122 - DNA, 19 bp, Homo sapiens
tccccatctccatttcaca

SEQ ID NO: 2122123 - DNA, 17 bp, Homo sapiens
tccccattcacagagcc

SEQ ID NO: 2122124 - DNA, 18 bp, Homo sapiens
tccccattcacagagcct

SEQ ID NO: 2122125 - DNA, 22 bp, Homo sapiens
tccccattcttcctagttttct

SEQ ID NO: 2122126 - DNA, 19 bp, Homo sapiens
tcccccacagtttgatgtc

SEQ ID NO: 2122127 - DNA, 19 bp, Homo sapiens
tcccccaccccctccccag

SEQ ID NO: 2122128 - DNA, 20 bp, Homo sapiens
tcccccaccccctccccagg

SEQ ID NO: 2122129 - DNA, 15 bp, Homo sapiens
tcccccacctgacaa

SEQ ID NO: 2122130 - DNA, 23 bp, Homo sapiens
tcccccacctgacaatggcagct

SEQ ID NO: 2122131 - DNA, 15 bp, Homo sapiens
tcccccagagccact

SEQ ID NO: 2122132 - DNA, 12 bp, Homo sapiens
tcccccagccct

SEQ ID NO: 2122133 - DNA, 14 bp, Homo sapiens
tcccccagccctca

SEQ ID NO: 2122134 - DNA, 19 bp, Homo sapiens
tcccccagccctcaggcca

SEQ ID NO: 2122135 - DNA, 21 bp, Homo sapiens
tcccccatcatatcctttgcc

SEQ ID NO: 2122136 - DNA, 18 bp, Homo sapiens
tcccccatcccctttcct

SEQ ID NO: 2122137 - DNA, 20 bp, Homo sapiens
tcccccatcccctttcctcc

SEQ ID NO: 2122138 - DNA, 13 bp, Homo sapiens
tccccccactgca

SEQ ID NO: 2122139 - DNA, 23 bp, Homo sapiens
tccccccactgcaggccccgctt

SEQ ID NO: 2122140 - DNA, 18 bp, Homo sapiens
tccccccagcccctcctc

SEQ ID NO: 2122141 - DNA, 19 bp, Homo sapiens
tcccccgacactgctgcac

SEQ ID NO: 2122142 - DNA, 22 bp, Homo sapiens
tcccccgacactgctgcaccag

SEQ ID NO: 2122143 - DNA, 17 bp, Homo sapiens
tcccccgcagtccccag

SEQ ID NO: 2122144 - DNA, 21 bp, Homo sapiens
tcccccgcagtccccagccct

SEQ ID NO: 2122145 - DNA, 22 bp, Homo sapiens
tcccccgcagtccccagccctt

SEQ ID NO: 2122146 - DNA, 16 bp, Homo sapiens
tcccccgctggcagcc

SEQ ID NO: 2122147 - DNA, 21 bp, Homo sapiens
tccccctatgctccagtatgg

SEQ ID NO: 2122148 - DNA, 22 bp, Homo sapiens
tccccctcagatgatctctcca

SEQ ID NO: 2122149 - DNA, 18 bp, Homo sapiens
tccccctcccagggccag

SEQ ID NO: 2122150 - DNA, 16 bp, Homo sapiens
tccccctgccagtgcc

SEQ ID NO: 2122151 - DNA, 18 bp, Homo sapiens
tccccctgccagtgcctt

SEQ ID NO: 2122152 - DNA, 15 bp, Homo sapiens
tccccctgctgctca

SEQ ID NO: 2122153 - DNA, 10 bp, Homo sapiens
tccccctggg

SEQ ID NO: 2122154 - DNA, 20 bp, Homo sapiens
tccccctgggctctgcccca

SEQ ID NO: 2122155 - DNA, 23 bp, Homo sapiens
tccccctgggctctgccccagct

SEQ ID NO: 2122156 - DNA, 14 bp, Homo sapiens
tccccgcagagctc

SEQ ID NO: 2122157 - DNA, 18 bp, Homo sapiens
tccccgcagagctccctt

SEQ ID NO: 2122158 - DNA, 23 bp, Homo sapiens
tccccgcagagctcccttcctga

SEQ ID NO: 2122159 - DNA, 16 bp, Homo sapiens
tccccgcctgtcctgc

SEQ ID NO: 2122160 - DNA, 19 bp, Homo sapiens
tccccgcctgtcctgcctc

SEQ ID NO: 2122161 - DNA, 14 bp, Homo sapiens
tccccgctgcccaa

SEQ ID NO: 2122162 - DNA, 21 bp, Homo sapiens
tcccctacactttggccaagc

SEQ ID NO: 2122163 - DNA, 21 bp, Homo sapiens
tcccctatccacccagcccat

SEQ ID NO: 2122164 - DNA, 17 bp, Homo sapiens
tcccctcactctgtcag

SEQ ID NO: 2122165 - DNA, 19 bp, Homo sapiens
tcccctcactgatggacaa

SEQ ID NO: 2122166 - DNA, 20 bp, Homo sapiens
tcccctcagagctcttatgt

SEQ ID NO: 2122167 - DNA, 16 bp, Homo sapiens
tcccctcccccctgta

SEQ ID NO: 2122168 - DNA, 15 bp, Homo sapiens
tcccctccctcttcc

SEQ ID NO: 2122169 - DNA, 16 bp, Homo sapiens
tcccctcgctgtcctg

SEQ ID NO: 2122170 - DNA, 23 bp, Homo sapiens
tcccctcgtcctgtcccagaggt

SEQ ID NO: 2122171 - DNA, 13 bp, Homo sapiens
tcccctctcccct

SEQ ID NO: 2122172 - DNA, 20 bp, Homo sapiens
tcccctgacctcacctttgc

SEQ ID NO: 2122173 - DNA, 18 bp, Homo sapiens
tcccctgcccccatccca

SEQ ID NO: 2122174 - DNA, 15 bp, Homo sapiens
tcccctgccctgctg

SEQ ID NO: 2122175 - DNA, 18 bp, Homo sapiens
tcccctggaactgtctct

SEQ ID NO: 2122176 - DNA, 16 bp, Homo sapiens
tcccctggactgggag

SEQ ID NO: 2122177 - DNA, 15 bp, Homo sapiens
tcccctgtcccacca

SEQ ID NO: 2122178 - DNA, 16 bp, Homo sapiens
tcccctgtcccaccaa

SEQ ID NO: 2122179 - DNA, 15 bp, Homo sapiens
tcccctgtcttctct

SEQ ID NO: 2122180 - DNA, 18 bp, Homo sapiens
tcccctgtcttctctcaa

SEQ ID NO: 2122181 - DNA, 20 bp, Homo sapiens
tccagctcttggcccctgtg

SEQ ID NO: 2122182 - DNA, 21 bp, Homo sapiens
tccagctggaattgctgctct

SEQ ID NO: 2122183 - DNA, 22 bp, Homo sapiens
tccagctggaattgctgctctc

SEQ ID NO: 2122184 - DNA, 20 bp, Homo sapiens
tccagcttcccctcgctgtc

SEQ ID NO: 2122185 - DNA, 22 bp, Homo sapiens
tccagcttcccctcgctgtcct

SEQ ID NO: 2122186 - DNA, 15 bp, Homo sapiens
tccagcttgctcttc

SEQ ID NO: 2122187 - DNA, 16 bp, Homo sapiens
tccagcttgctcttca

SEQ ID NO: 2122188 - DNA, 19 bp, Homo sapiens
tccagcttgctcttcagtg

SEQ ID NO: 2122189 - DNA, 15 bp, Homo sapiens
tccaggaaggcagct

SEQ ID NO: 2122190 - DNA, 18 bp, Homo sapiens
tccaggaaggcagctgct

SEQ ID NO: 2122191 - DNA, 20 bp, Homo sapiens
tccaggaaggcagctgctct

SEQ ID NO: 2122192 - DNA, 22 bp, Homo sapiens
tccaggaaggtagcccagcact

SEQ ID NO: 2122193 - DNA, 23 bp, Homo sapiens
tccaggaaggtagcccagcactg

SEQ ID NO: 2122194 - DNA, 18 bp, Homo sapiens
tccaggacatgatactga

SEQ ID NO: 2122195 - DNA, 12 bp, Homo sapiens
tccaggagcaca

SEQ ID NO: 2122196 - DNA, 22 bp, Homo sapiens
tccaggagcacacggccctgcc

SEQ ID NO: 2122197 - DNA, 16 bp, Homo sapiens
tccaggagcccagagg

SEQ ID NO: 2122198 - DNA, 13 bp, Homo sapiens
tccaggagcctgg

SEQ ID NO: 2122199 - DNA, 23 bp, Homo sapiens
tccaggagcctggctccgtccag

SEQ ID NO: 2122200 - DNA, 17 bp, Homo sapiens
tccaggattccaaagtt

SEQ ID NO: 2122201 - DNA, 15 bp, Homo sapiens
tccaggcaccatctc

SEQ ID NO: 2122202 - DNA, 15 bp, Homo sapiens
tccaggcacccttct

SEQ ID NO: 2122203 - DNA, 16 bp, Homo sapiens
tccaggcacccttctt

SEQ ID NO: 2122204 - DNA, 19 bp, Homo sapiens
tccaggcacccttctttcc

SEQ ID NO: 2122205 - DNA, 20 bp, Homo sapiens
tccaggcacccttctttcct

SEQ ID NO: 2122206 - DNA, 21 bp, Homo sapiens
tccaggcacccttctttcctc

SEQ ID NO: 2122207 - DNA, 14 bp, Homo sapiens
tccaggcatgctgg

SEQ ID NO: 2122208 - DNA, 19 bp, Homo sapiens
tccaggccaccgctctcct

SEQ ID NO: 2122209 - DNA, 18 bp, Homo sapiens
tccaggccactgtggcca

SEQ ID NO: 2122210 - DNA, 19 bp, Homo sapiens
tccaggccactgtggccag

SEQ ID NO: 2122211 - DNA, 14 bp, Homo sapiens
tccaggctcttcct

SEQ ID NO: 2122212 - DNA, 22 bp, Homo sapiens
tccaggctctttggggtcagcc

SEQ ID NO: 2122213 - DNA, 14 bp, Homo sapiens
tccaggctgtatcc

SEQ ID NO: 2122214 - DNA, 16 bp, Homo sapiens
tccagggtcttgggct

SEQ ID NO: 2122215 - DNA, 17 bp, Homo sapiens
tccagggtcttgggcta

SEQ ID NO: 2122216 - DNA, 21 bp, Homo sapiens
tccagggtcttgggctactgg

SEQ ID NO: 2122217 - DNA, 15 bp, Homo sapiens
tccaggtatctccag

SEQ ID NO: 2122218 - DNA, 15 bp, Homo sapiens
tccaggtctcgggtc

SEQ ID NO: 2122219 - DNA, 17 bp, Homo sapiens
tccaggtgggagagaca

SEQ ID NO: 2122220 - DNA, 16 bp, Homo sapiens
tccaggttcagcttgt

SEQ ID NO: 2122221 - DNA, 14 bp, Homo sapiens
tccagtaagcacat

SEQ ID NO: 2122222 - DNA, 17 bp, Homo sapiens
tccagtacctttgtcac

SEQ ID NO: 2122223 - DNA, 13 bp, Homo sapiens
tccagtattcttg

SEQ ID NO: 2122224 - DNA, 22 bp, Homo sapiens
tccagtgagccgagatggcgct

SEQ ID NO: 2122225 - DNA, 13 bp, Homo sapiens
tccagtgagctgg

SEQ ID NO: 2122226 - DNA, 17 bp, Homo sapiens
tccagtgcaaccacaca

SEQ ID NO: 2122227 - DNA, 23 bp, Homo sapiens
tccagtggtaccagctcactccc

SEQ ID NO: 2122228 - DNA, 22 bp, Homo sapiens
tccagtgtgcacccctccccat

SEQ ID NO: 2122229 - DNA, 16 bp, Homo sapiens
tccagtgttggctgtg

SEQ ID NO: 2122230 - DNA, 22 bp, Homo sapiens
tccagttaaggaccgtggccct

SEQ ID NO: 2122231 - DNA, 14 bp, Homo sapiens
tccagttagttctc

SEQ ID NO: 2122232 - DNA, 23 bp, Homo sapiens
tccagttcacaggccagaaaaca

SEQ ID NO: 2122233 - DNA, 16 bp, Homo sapiens
tccagttcatgagaat

SEQ ID NO: 2122234 - DNA, 16 bp, Homo sapiens
tccagttgcaataaaa

SEQ ID NO: 2122235 - DNA, 18 bp, Homo sapiens
tccagttgcaataaaata

SEQ ID NO: 2122236 - DNA, 19 bp, Homo sapiens
tccagttgcaataaaatag

SEQ ID NO: 2122237 - DNA, 21 bp, Homo sapiens
tccagttgcaataaaatagta

SEQ ID NO: 2122238 - DNA, 13 bp, Homo sapiens
tccagtttcccac

SEQ ID NO: 2122239 - DNA, 14 bp, Homo sapiens
tccagtttcccacc

SEQ ID NO: 2122240 - DNA, 22 bp, Homo sapiens
tccagtttccccatggggctgc

SEQ ID NO: 2122241 - DNA, 18 bp, Homo sapiens
tccagtttgttctccggg

SEQ ID NO: 2122242 - DNA, 12 bp, Homo sapiens
tccataaagtaa

SEQ ID NO: 2122243 - DNA, 21 bp, Homo sapiens
tccataaccccaggcatccca

SEQ ID NO: 2122244 - DNA, 17 bp, Homo sapiens
tccataattatgacagt

SEQ ID NO: 2122245 - DNA, 19 bp, Homo sapiens
tccataattatgacagtta

SEQ ID NO: 2122246 - DNA, 24 bp, Homo sapiens
tccatatctccttcccctacacct

SEQ ID NO: 2122247 - DNA, 13 bp, Homo sapiens
tccatattttcac

SEQ ID NO: 2122248 - DNA, 17 bp, Homo sapiens
tccatcaggacttggga

SEQ ID NO: 2122249 - DNA, 18 bp, Homo sapiens
tccatcaggttccatccc

SEQ ID NO: 2122250 - DNA, 19 bp, Homo sapiens
tccatcaggttccatcccg

SEQ ID NO: 2122251 - DNA, 14 bp, Homo sapiens
tccatcccatcatc

SEQ ID NO: 2122252 - DNA, 22 bp, Homo sapiens
tccatccccaaactgtgccctg

SEQ ID NO: 2122253 - DNA, 23 bp, Homo sapiens
tccatccccaaactgtgccctgc

SEQ ID NO: 2122254 - DNA, 20 bp, Homo sapiens
tccatcccgaaaatctctcg

SEQ ID NO: 2122255 - DNA, 23 bp, Homo sapiens
tccatctagagattttcttggca

SEQ ID NO: 2122256 - DNA, 15 bp, Homo sapiens
tccatgaaaatgcaa

SEQ ID NO: 2122257 - DNA, 16 bp, Homo sapiens
tccatgaaaatgcaac

SEQ ID NO: 2122258 - DNA, 16 bp, Homo sapiens
tccatgaccagaaaca

SEQ ID NO: 2122259 - DNA, 16 bp, Homo sapiens
tccatgattttacaga

SEQ ID NO: 2122260 - DNA, 20 bp, Homo sapiens
tccatgattttacagagaat

SEQ ID NO: 2122261 - DNA, 13 bp, Homo sapiens
tccatgcccaacc

SEQ ID NO: 2122262 - DNA, 16 bp, Homo sapiens
tccatgcctgagggtg

SEQ ID NO: 2122263 - DNA, 17 bp, Homo sapiens
tcccctgtggtcttgga

SEQ ID NO: 2122264 - DNA, 15 bp, Homo sapiens
tccccttcctgcacc

SEQ ID NO: 2122265 - DNA, 15 bp, Homo sapiens
tccccttgcccaggg

SEQ ID NO: 2122266 - DNA, 20 bp, Homo sapiens
tccccttgcccagggctcag

SEQ ID NO: 2122267 - DNA, 22 bp, Homo sapiens
tccccttgcccagggctcagcc

SEQ ID NO: 2122268 - DNA, 19 bp, Homo sapiens
tccccttgcccttgccctg

SEQ ID NO: 2122269 - DNA, 20 bp, Homo sapiens
tccccttgcccttgccctga

SEQ ID NO: 2122270 - DNA, 16 bp, Homo sapiens
tccccttggcttcctc

SEQ ID NO: 2122271 - DNA, 19 bp, Homo sapiens
tccccttgtgtcagagaca

SEQ ID NO: 2122272 - DNA, 14 bp, Homo sapiens
tcccctttattaat

SEQ ID NO: 2122273 - DNA, 16 bp, Homo sapiens
tccccttttgcctggc

SEQ ID NO: 2122274 - DNA, 17 bp, Homo sapiens
tccccttttgcctggct

SEQ ID NO: 2122275 - DNA, 20 bp, Homo sapiens
tccccttttgcctggctgtg

SEQ ID NO: 2122276 - DNA, 21 bp, Homo sapiens
tccccttttgcctggctgtgg

SEQ ID NO: 2122277 - DNA, 18 bp, Homo sapiens
tcccgaatagctgggact

SEQ ID NO: 2122278 - DNA, 20 bp, Homo sapiens
tcccgaatagctgggactac

SEQ ID NO: 2122279 - DNA, 19 bp, Homo sapiens
tcccgagcaaagtctaaag

SEQ ID NO: 2122280 - DNA, 15 bp, Homo sapiens
tcccgagtagctggg

SEQ ID NO: 2122281 - DNA, 20 bp, Homo sapiens
tcccgagtagctgggactac

SEQ ID NO: 2122282 - DNA, 18 bp, Homo sapiens
tcccgccttcctcctcca

SEQ ID NO: 2122283 - DNA, 18 bp, Homo sapiens
tcccgcgggcctggacac

SEQ ID NO: 2122284 - DNA, 21 bp, Homo sapiens
tcccgcgggcctggacactta

SEQ ID NO: 2122285 - DNA, 14 bp, Homo sapiens
tcccgctcagccct

SEQ ID NO: 2122286 - DNA, 18 bp, Homo sapiens
tcccggccaggcgggaga

SEQ ID NO: 2122287 - DNA, 20 bp, Homo sapiens
tcccggcctcttccacccat

SEQ ID NO: 2122288 - DNA, 13 bp, Homo sapiens
tcccgtgcagctt

SEQ ID NO: 2122289 - DNA, 15 bp, Homo sapiens
tccctaaaataaaaa

SEQ ID NO: 2122290 - DNA, 14 bp, Homo sapiens
gacccctttccccc

SEQ ID NO: 2122291 - DNA, 22 bp, Homo sapiens
gacccgaagcccaggctgaaga

SEQ ID NO: 2122292 - DNA, 18 bp, Homo sapiens
gacccggaggggcctggc

SEQ ID NO: 2122293 - DNA, 20 bp, Homo sapiens
gacccggcaccccctgcagc

SEQ ID NO: 2122294 - DNA, 21 bp, Homo sapiens
gacccggcaccccctgcagct

SEQ ID NO: 2122295 - DNA, 15 bp, Homo sapiens
gaccctacaggagag

SEQ ID NO: 2122296 - DNA, 17 bp, Homo sapiens
gaccctccccgcacccc

SEQ ID NO: 2122297 - DNA, 11 bp, Homo sapiens
gaccctgagac

SEQ ID NO: 2122298 - DNA, 17 bp, Homo sapiens
gaccctgagactccaga

SEQ ID NO: 2122299 - DNA, 13 bp, Homo sapiens
gaccctgcccttg

SEQ ID NO: 2122300 - DNA, 15 bp, Homo sapiens
gaccctgcccttgtt

SEQ ID NO: 2122301 - DNA, 17 bp, Homo sapiens
gaccctgcctgagccca

SEQ ID NO: 2122302 - DNA, 21 bp, Homo sapiens
gaccctgcctgagcccaggag

SEQ ID NO: 2122303 - DNA, 11 bp, Homo sapiens
gaccctggaat

SEQ ID NO: 2122304 - DNA, 19 bp, Homo sapiens
gaccctggagcggctctcc

SEQ ID NO: 2122305 - DNA, 15 bp, Homo sapiens
gaccctggctcttct

SEQ ID NO: 2122306 - DNA, 23 bp, Homo sapiens
gaccctggctcttctctcggggc

SEQ ID NO: 2122307 - DNA, 22 bp, Homo sapiens
gaccctgtaaagggtcagggtg

SEQ ID NO: 2122308 - DNA, 22 bp, Homo sapiens
gaccctgtagagtcactgaccc

SEQ ID NO: 2122309 - DNA, 14 bp, Homo sapiens
gacccttcagggcc

SEQ ID NO: 2122310 - DNA, 16 bp, Homo sapiens
gacccttcagggccag

SEQ ID NO: 2122311 - DNA, 15 bp, Homo sapiens
gacccttccagacat

SEQ ID NO: 2122312 - DNA, 20 bp, Homo sapiens
gaccctttccttccttccct

SEQ ID NO: 2122313 - DNA, 16 bp, Homo sapiens
gaccgcttcacccctg

SEQ ID NO: 2122314 - DNA, 17 bp, Homo sapiens
gaccgcttcacccctgc

SEQ ID NO: 2122315 - DNA, 22 bp, Homo sapiens
gcctccactcccccacctgaca

SEQ ID NO: 2122316 - DNA, 19 bp, Homo sapiens
gcctccagagccagcctgg

SEQ ID NO: 2122317 - DNA, 16 bp, Homo sapiens
gcctccagcctctccc

SEQ ID NO: 2122318 - DNA, 18 bp, Homo sapiens
gcctccagcctctcccgg

SEQ ID NO: 2122319 - DNA, 20 bp, Homo sapiens
gcctccagcctctcccggct

SEQ ID NO: 2122320 - DNA, 22 bp, Homo sapiens
gcctccagcctctcccggctgc

SEQ ID NO: 2122321 - DNA, 17 bp, Homo sapiens
gcctccattctgaccat

SEQ ID NO: 2122322 - DNA, 18 bp, Homo sapiens
gcctcccaaagtgctggg

SEQ ID NO: 2122323 - DNA, 19 bp, Homo sapiens
gcctcccaaagtgctggga

SEQ ID NO: 2122324 - DNA, 17 bp, Homo sapiens
gcctcccaaccccaggg

SEQ ID NO: 2122325 - DNA, 20 bp, Homo sapiens
gcctcccaataaagctggac

SEQ ID NO: 2122326 - DNA, 10 bp, Homo sapiens
gcctcccagc

SEQ ID NO: 2122327 - DNA, 21 bp, Homo sapiens
gcctcccagccccaggggtgc

SEQ ID NO: 2122328 - DNA, 20 bp, Homo sapiens
gcctcccagccctgccagga

SEQ ID NO: 2122329 - DNA, 21 bp, Homo sapiens
gcctcccagccctgccaggag

SEQ ID NO: 2122330 - DNA, 16 bp, Homo sapiens
gcctccccacatatgg

SEQ ID NO: 2122331 - DNA, 22 bp, Homo sapiens
tcaattattacatttatacatc

SEQ ID NO: 2122332 - DNA, 18 bp, Homo sapiens
tcaattcaacacattact

SEQ ID NO: 2122333 - DNA, 24 bp, Homo sapiens
tcaattcaacacattacttgcaca

SEQ ID NO: 2122334 - DNA, 13 bp, Homo sapiens
tcaatttcccaga

SEQ ID NO: 2122335 - DNA, 13 bp, Homo sapiens
tcaatttttatac

SEQ ID NO: 2122336 - DNA, 14 bp, Homo sapiens
tcaatttttataca

SEQ ID NO: 2122337 - DNA, 23 bp, Homo sapiens
tcaatttttcttatttcatttct

SEQ ID NO: 2122338 - DNA, 17 bp, Homo sapiens
tcacaaaacctggcaca

SEQ ID NO: 2122339 - DNA, 12 bp, Homo sapiens
tcacaaaatgca

SEQ ID NO: 2122340 - DNA, 15 bp, Homo sapiens
tcacaacaggcattc

SEQ ID NO: 2122341 - DNA, 15 bp, Homo sapiens
tcacaaccagccaca

SEQ ID NO: 2122342 - DNA, 18 bp, Homo sapiens
tcacaaccagccacacag

SEQ ID NO: 2122343 - DNA, 14 bp, Homo sapiens
tcacaaccttctgt

SEQ ID NO: 2122344 - DNA, 16 bp, Homo sapiens
tcacaactaggacctc

SEQ ID NO: 2122345 - DNA, 18 bp, Homo sapiens
tcacaactaggacctcat

SEQ ID NO: 2122346 - DNA, 15 bp, Homo sapiens
tcacaagaagaccag

SEQ ID NO: 2122347 - DNA, 14 bp, Homo sapiens
tcacaagcaataat

SEQ ID NO: 2122348 - DNA, 12 bp, Homo sapiens
tcacaagcccag

SEQ ID NO: 2122349 - DNA, 16 bp, Homo sapiens
tcacaagcccaggctg

SEQ ID NO: 2122350 - DNA, 16 bp, Homo sapiens
tcacaaggcagcaagg

SEQ ID NO: 2122351 - DNA, 18 bp, Homo sapiens
tcacaaggcagcaaggcc

SEQ ID NO: 2122352 - DNA, 16 bp, Homo sapiens
tcacaataattttcta

SEQ ID NO: 2122353 - DNA, 16 bp, Homo sapiens
tcacaatcctgtccct

SEQ ID NO: 2122354 - DNA, 23 bp, Homo sapiens
tcacaatgaaatgctctcctttc

SEQ ID NO: 2122355 - DNA, 20 bp, Homo sapiens
tcacacacaggcaactgagg

SEQ ID NO: 2122356 - DNA, 11 bp, Homo sapiens
tcacacagaca

SEQ ID NO: 2122357 - DNA, 17 bp, Homo sapiens
tcacacagggctctttg

SEQ ID NO: 2122358 - DNA, 23 bp, Homo sapiens
tcacacagggctctttgatggac

SEQ ID NO: 2122359 - DNA, 21 bp, Homo sapiens
tcacacagtattacttctgct

SEQ ID NO: 2122360 - DNA, 13 bp, Homo sapiens
tcacacagtgagt

SEQ ID NO: 2122361 - DNA, 23 bp, Homo sapiens
tcacacagtgggtggtggatctg

SEQ ID NO: 2122362 - DNA, 15 bp, Homo sapiens
tcacacatgcatcat

SEQ ID NO: 2122363 - DNA, 20 bp, Homo sapiens
tcacaccatcttaaatgaca

SEQ ID NO: 2122364 - DNA, 12 bp, Homo sapiens
tcacacctctgg

SEQ ID NO: 2122365 - DNA, 17 bp, Homo sapiens
tcacacctctgggcttc

SEQ ID NO: 2122366 - DNA, 22 bp, Homo sapiens
tcacacctgtaatcccagcact

SEQ ID NO: 2122367 - DNA, 15 bp, Homo sapiens
tcacactgagctggg

SEQ ID NO: 2122368 - DNA, 18 bp, Homo sapiens
tcacactgcaagagcctt

SEQ ID NO: 2122369 - DNA, 20 bp, Homo sapiens
tcacactgcaagagccttgg

SEQ ID NO: 2122370 - DNA, 18 bp, Homo sapiens
tcacactgttactccaca

SEQ ID NO: 2122371 - DNA, 13 bp, Homo sapiens
tcacacttggagc

SEQ ID NO: 2122372 - DNA, 20 bp, Homo sapiens
tcacagacgctcctgaagtt

SEQ ID NO: 2122373 - DNA, 17 bp, Homo sapiens
tcacagaggcttcttca

SEQ ID NO: 2122374 - DNA, 23 bp, Homo sapiens
tcacagccagactggcacagttt

SEQ ID NO: 2122375 - DNA, 22 bp, Homo sapiens
tcacagcccgggtgtgcctgcc

SEQ ID NO: 2122376 - DNA, 11 bp, Homo sapiens
tcacagctgca

SEQ ID NO: 2122377 - DNA, 13 bp, Homo sapiens
tcacagctgcagc

SEQ ID NO: 2122378 - DNA, 19 bp, Homo sapiens
tcacagctgcagctgggcc

SEQ ID NO: 2122379 - DNA, 22 bp, Homo sapiens
tcacagctgcagctgggcccca

SEQ ID NO: 2122380 - DNA, 16 bp, Homo sapiens
tcacaggactctgcct

SEQ ID NO: 2122381 - DNA, 17 bp, Homo sapiens
tcacaggactctgcctc

SEQ ID NO: 2122382 - DNA, 23 bp, Homo sapiens
tcacaggactctgcctcctcttc

SEQ ID NO: 2122383 - DNA, 19 bp, Homo sapiens
tcacaggagcagacagaga

SEQ ID NO: 2122384 - DNA, 18 bp, Homo sapiens
tcacaggcaggtccaggg

SEQ ID NO: 2122385 - DNA, 18 bp, Homo sapiens
tcacagtctctttaatct

SEQ ID NO: 2122386 - DNA, 17 bp, Homo sapiens
tcacagtggcgagagga

SEQ ID NO: 2122387 - DNA, 11 bp, Homo sapiens
tcacagtgttt

SEQ ID NO: 2122388 - DNA, 22 bp, Homo sapiens
tcacagtgtttgcaatggtgtt

SEQ ID NO: 2122389 - DNA, 18 bp, Homo sapiens
tcacagttcctcgccctg

SEQ ID NO: 2122390 - DNA, 21 bp, Homo sapiens
tcacagttcctcgccctgggt

SEQ ID NO: 2122391 - DNA, 13 bp, Homo sapiens
tcacagttgacaa

SEQ ID NO: 2122392 - DNA, 17 bp, Homo sapiens
tcacataaaacctcatt

SEQ ID NO: 2122393 - DNA, 16 bp, Homo sapiens
tcacatacaatttgca

SEQ ID NO: 2122394 - DNA, 15 bp, Homo sapiens
tatggattctaaaat

SEQ ID NO: 2122395 - DNA, 11 bp, Homo sapiens
tatggcaaggg

SEQ ID NO: 2122396 - DNA, 14 bp, Homo sapiens
tatggcagcgaaag

SEQ ID NO: 2122397 - DNA, 20 bp, Homo sapiens
tatggcagtccagccagctc

SEQ ID NO: 2122398 - DNA, 22 bp, Homo sapiens
tatggcagtccagccagctcct

SEQ ID NO: 2122399 - DNA, 20 bp, Homo sapiens
tatggcatatttatattgta

SEQ ID NO: 2122400 - DNA, 11 bp, Homo sapiens
tatggccaggg

SEQ ID NO: 2122401 - DNA, 20 bp, Homo sapiens
tatggctgtatttttagaga

SEQ ID NO: 2122402 - DNA, 16 bp, Homo sapiens
tatggcttataaatgt

SEQ ID NO: 2122403 - DNA, 16 bp, Homo sapiens
tatgggactcaatgca

SEQ ID NO: 2122404 - DNA, 20 bp, Homo sapiens
tatggggctgaacggggaga

SEQ ID NO: 2122405 - DNA, 20 bp, Homo sapiens
tatggtataatggttgactg

SEQ ID NO: 2122406 - DNA, 16 bp, Homo sapiens
tatggtatgctggcca

SEQ ID NO: 2122407 - DNA, 22 bp, Homo sapiens
tatggtattttcgtgcatttgt

SEQ ID NO: 2122408 - DNA, 20 bp, Homo sapiens
tatggtcatctttttctcta

SEQ ID NO: 2122409 - DNA, 13 bp, Homo sapiens
tatggtgaaatta

SEQ ID NO: 2122410 - DNA, 16 bp, Homo sapiens
tatggttcccaataaa

SEQ ID NO: 2122411 - DNA, 19 bp, Homo sapiens
tatggttcccaataaaagt

SEQ ID NO: 2122412 - DNA, 20 bp, Homo sapiens
tatggttcccaataaaagtg

SEQ ID NO: 2122413 - DNA, 13 bp, Homo sapiens
tatgtaaaacatt

SEQ ID NO: 2122414 - DNA, 19 bp, Homo sapiens
tatgtaaaataaaattatg

SEQ ID NO: 2122415 - DNA, 17 bp, Homo sapiens
tatgtaaagtatgtaaa

SEQ ID NO: 2122416 - DNA, 20 bp, Homo sapiens
tatgtaaagtatgtaaacag

SEQ ID NO: 2122417 - DNA, 21 bp, Homo sapiens
tatgtactctacgccaaagtg

SEQ ID NO: 2122418 - DNA, 13 bp, Homo sapiens
tatgtagaaatat

SEQ ID NO: 2122419 - DNA, 17 bp, Homo sapiens
tatgtagactatataca

SEQ ID NO: 2122420 - DNA, 13 bp, Homo sapiens
tatgtatacacac

SEQ ID NO: 2122421 - DNA, 14 bp, Homo sapiens
tatgtatacacaca

SEQ ID NO: 2122422 - DNA, 15 bp, Homo sapiens
tatgtatacacacat

SEQ ID NO: 2122423 - DNA, 17 bp, Homo sapiens
tatgtatacacacatat

SEQ ID NO: 2122424 - DNA, 14 bp, Homo sapiens
tatgtatatgtata

SEQ ID NO: 2122425 - DNA, 16 bp, Homo sapiens
tatgtatatgtatata

SEQ ID NO: 2122426 - DNA, 16 bp, Homo sapiens
tatgtatatgtatatc

SEQ ID NO: 2122427 - DNA, 17 bp, Homo sapiens
tatgtatatgtatatct

SEQ ID NO: 2122428 - DNA, 17 bp, Homo sapiens
tatgtatggtatccaag

SEQ ID NO: 2122429 - DNA, 21 bp, Homo sapiens
tatgtattaagccaaacatga

SEQ ID NO: 2122430 - DNA, 18 bp, Homo sapiens
tatgtattgtaaacatgt

SEQ ID NO: 2122431 - DNA, 20 bp, Homo sapiens
tatgtattgtaaacatgtgt

SEQ ID NO: 2122432 - DNA, 21 bp, Homo sapiens
tatgtatttattgtcattact

SEQ ID NO: 2122433 - DNA, 17 bp, Homo sapiens
tatgtcaatttgtatat

SEQ ID NO: 2122434 - DNA, 20 bp, Homo sapiens
tatgtcaatttgtatatcat

SEQ ID NO: 2122435 - DNA, 19 bp, Homo sapiens
tatgtccagctagccaact

SEQ ID NO: 2122436 - DNA, 15 bp, Homo sapiens
tatgtcccttgctgt

SEQ ID NO: 2122437 - DNA, 13 bp, Homo sapiens
tatgtcctaagga

SEQ ID NO: 2122438 - DNA, 16 bp, Homo sapiens
tatgtctaaagagctt

SEQ ID NO: 2122439 - DNA, 19 bp, Homo sapiens
tatgtctcgctagtgatgt

SEQ ID NO: 2122440 - DNA, 14 bp, Homo sapiens
tatgtctgcttctg

SEQ ID NO: 2122441 - DNA, 12 bp, Homo sapiens
tatgtctgtgtg

SEQ ID NO: 2122442 - DNA, 15 bp, Homo sapiens
tatgtctgtgtgtgt

SEQ ID NO: 2122443 - DNA, 17 bp, Homo sapiens
tatgtcttggacactgt

SEQ ID NO: 2122444 - DNA, 21 bp, Homo sapiens
tatgtcttggacactgtacaa

SEQ ID NO: 2122445 - DNA, 17 bp, Homo sapiens
tatgtgaaagtgtaaaa

SEQ ID NO: 2122446 - DNA, 21 bp, Homo sapiens
tatgtgaaagtgtaaaataga

SEQ ID NO: 2122447 - DNA, 22 bp, Homo sapiens
tatgtgaaagtgtaaaatagaa

SEQ ID NO: 2122448 - DNA, 17 bp, Homo sapiens
tatgtgacaacctttgt

SEQ ID NO: 2122449 - DNA, 16 bp, Homo sapiens
tatgtgacagacattt

SEQ ID NO: 2122450 - DNA, 19 bp, Homo sapiens
tatgtggtttccacgatga

SEQ ID NO: 2122451 - DNA, 12 bp, Homo sapiens
tatgtgtaattt

SEQ ID NO: 2122452 - DNA, 22 bp, Homo sapiens
tatgtgtatttgtatgtactgt

SEQ ID NO: 2122453 - DNA, 17 bp, Homo sapiens
tatgtgtcacagctctg

SEQ ID NO: 2122454 - DNA, 13 bp, Homo sapiens
tatgtgtgcatgt

SEQ ID NO: 2122455 - DNA, 14 bp, Homo sapiens
tatgtgtgggtaca

SEQ ID NO: 2122456 - DNA, 13 bp, Homo sapiens
tatgtgtgtttaa

SEQ ID NO: 2122457 - DNA, 22 bp, Homo sapiens
tatgttaacctcagtgtcattt

SEQ ID NO: 2122458 - DNA, 20 bp, Homo sapiens
tatgttaatttgttatgtat

SEQ ID NO: 2122459 - DNA, 13 bp, Homo sapiens
tatgttagagagg

SEQ ID NO: 2122460 - DNA, 15 bp, Homo sapiens
tatgttcattaaatt

SEQ ID NO: 2122461 - DNA, 13 bp, Homo sapiens
tatgttgcccagg

SEQ ID NO: 2122462 - DNA, 20 bp, Homo sapiens
tatgttgcccaggcaggtct

SEQ ID NO: 2122463 - DNA, 13 bp, Homo sapiens
tatgttgctgaaa

SEQ ID NO: 2122464 - DNA, 15 bp, Homo sapiens
tatgttgctgaaaca

SEQ ID NO: 2122465 - DNA, 16 bp, Homo sapiens
tatgttgctgaaacac

SEQ ID NO: 2122466 - DNA, 14 bp, Homo sapiens
tatgttgtaataaa

SEQ ID NO: 2122467 - DNA, 14 bp, Homo sapiens
tatgtttacatatc

SEQ ID NO: 2122468 - DNA, 17 bp, Homo sapiens
tatgtttgatcacacag

SEQ ID NO: 2122469 - DNA, 19 bp, Homo sapiens
tatgttttaagaggcaggg

SEQ ID NO: 2122470 - DNA, 22 bp, Homo sapiens
tattaaaaatatggaacttcta

SEQ ID NO: 2122471 - DNA, 16 bp, Homo sapiens
tattaaaactcatttt

SEQ ID NO: 2122472 - DNA, 16 bp, Homo sapiens
tattattcaagtgcct

SEQ ID NO: 2122473 - DNA, 14 bp, Homo sapiens
tattattgaagatt

SEQ ID NO: 2122474 - DNA, 16 bp, Homo sapiens
tattatttacaatgca

SEQ ID NO: 2122475 - DNA, 19 bp, Homo sapiens
tattcaaatgaaggtggtt

SEQ ID NO: 2122476 - DNA, 23 bp, Homo sapiens
tattcaataaaaaaaagaaatga

SEQ ID NO: 2122477 - DNA, 16 bp, Homo sapiens
tattcaattcctctgg

SEQ ID NO: 2122478 - DNA, 16 bp, Homo sapiens
tattcaggcactgaga

SEQ ID NO: 2122479 - DNA, 14 bp, Homo sapiens
tattcataataaac

SEQ ID NO: 2122480 - DNA, 18 bp, Homo sapiens
tattcatgctttctcctt

SEQ ID NO: 2122481 - DNA, 20 bp, Homo sapiens
tattcatgctttctcctttt

SEQ ID NO: 2122482 - DNA, 20 bp, Homo sapiens
tattcatgggtgtcagcttt

SEQ ID NO: 2122483 - DNA, 13 bp, Homo sapiens
tattcatgtaata

SEQ ID NO: 2122484 - DNA, 17 bp, Homo sapiens
tattcatgtaataaatc

SEQ ID NO: 2122485 - DNA, 23 bp, Homo sapiens
tattcccaagctctagtgggaag

SEQ ID NO: 2122486 - DNA, 14 bp, Homo sapiens
tattcctattgtgc

SEQ ID NO: 2122487 - DNA, 16 bp, Homo sapiens
tattcctgaccctccc

SEQ ID NO: 2122488 - DNA, 20 bp, Homo sapiens
tattctacacatatatgtat

SEQ ID NO: 2122489 - DNA, 12 bp, Homo sapiens
tattctattgca

SEQ ID NO: 2122490 - DNA, 14 bp, Homo sapiens
tattctcactccac

SEQ ID NO: 2122491 - DNA, 15 bp, Homo sapiens
tattctcactccacc

SEQ ID NO: 2122492 - DNA, 15 bp, Homo sapiens
tattctcctccctgt

SEQ ID NO: 2122493 - DNA, 16 bp, Homo sapiens
tattctcctccctgtt

SEQ ID NO: 2122494 - DNA, 16 bp, Homo sapiens
tattctctcctcagac

SEQ ID NO: 2122495 - DNA, 15 bp, Homo sapiens
tattctgagccttga

SEQ ID NO: 2122496 - DNA, 19 bp, Homo sapiens
tattctggaaaaaaaatat

SEQ ID NO: 2122497 - DNA, 15 bp, Homo sapiens
tattctgttaaaatc

SEQ ID NO: 2122498 - DNA, 13 bp, Homo sapiens
tattctgttttct

SEQ ID NO: 2122499 - DNA, 14 bp, Homo sapiens
tattcttggagaac

SEQ ID NO: 2122500 - DNA, 21 bp, Homo sapiens
tattcttggagaactttccat

SEQ ID NO: 2122501 - DNA, 22 bp, Homo sapiens
tattgaaaaggttaacagatac

SEQ ID NO: 2122502 - DNA, 20 bp, Homo sapiens
tattgaagaaaagcactttt

SEQ ID NO: 2122503 - DNA, 17 bp, Homo sapiens
tattgaataagtattct

SEQ ID NO: 2122504 - DNA, 13 bp, Homo sapiens
tattgacaataat

SEQ ID NO: 2122505 - DNA, 14 bp, Homo sapiens
tattgatgtttcca

SEQ ID NO: 2122506 - DNA, 20 bp, Homo sapiens
tattgatgtttccagaaaat

SEQ ID NO: 2122507 - DNA, 21 bp, Homo sapiens
tattgatgtttccagaaaata

SEQ ID NO: 2122508 - DNA, 18 bp, Homo sapiens
tattgcactcagcttttt

SEQ ID NO: 2122509 - DNA, 19 bp, Homo sapiens
tattgcatgtaaaatgcag

SEQ ID NO: 2122510 - DNA, 22 bp, Homo sapiens
tattgctgctggtaatttgtat

SEQ ID NO: 2122511 - DNA, 18 bp, Homo sapiens
tattggaagtgttcaaga

SEQ ID NO: 2122512 - DNA, 16 bp, Homo sapiens
tattggaatataattg

SEQ ID NO: 2122513 - DNA, 11 bp, Homo sapiens
tattggccact

SEQ ID NO: 2122514 - DNA, 14 bp, Homo sapiens
tattggccactggg

SEQ ID NO: 2122515 - DNA, 21 bp, Homo sapiens
tattggggttggttggggtgg

SEQ ID NO: 2122516 - DNA, 15 bp, Homo sapiens
tattggtaacatcct

SEQ ID NO: 2122517 - DNA, 18 bp, Homo sapiens
tattggtaacatcctttc

SEQ ID NO: 2122518 - DNA, 22 bp, Homo sapiens
tattggtccagcttgctcttca

SEQ ID NO: 2122519 - DNA, 20 bp, Homo sapiens
tattgtacactaacatattt

SEQ ID NO: 2122520 - DNA, 14 bp, Homo sapiens
tattgtatattctg

SEQ ID NO: 2122521 - DNA, 17 bp, Homo sapiens
tattgtatattctggaa

SEQ ID NO: 2122522 - DNA, 13 bp, Homo sapiens
tattgtatgtaag

SEQ ID NO: 2122523 - DNA, 14 bp, Homo sapiens
tattgtatgtaagt

SEQ ID NO: 2122524 - DNA, 20 bp, Homo sapiens
tattgtcattactgcctttg

SEQ ID NO: 2122525 - DNA, 17 bp, Homo sapiens
tattgtccttcagagct

SEQ ID NO: 2122526 - DNA, 19 bp, Homo sapiens
tattgtgcaatgtaaatat

SEQ ID NO: 2122527 - DNA, 22 bp, Homo sapiens
tattgtgcctatgataaattca

SEQ ID NO: 2122528 - DNA, 19 bp, Homo sapiens
tattgtgtgttatttaaat

SEQ ID NO: 2122529 - DNA, 17 bp, Homo sapiens
tattgtttaaaatcatt

SEQ ID NO: 2122530 - DNA, 22 bp, Homo sapiens
tattgtttattctttttaaagt

SEQ ID NO: 2122531 - DNA, 22 bp, Homo sapiens
tattgtttttccttgtatttaa

SEQ ID NO: 2122532 - DNA, 21 bp, Homo sapiens
tatttaaaatagcaaaagaag

SEQ ID NO: 2122533 - DNA, 19 bp, Homo sapiens
tatttaaaatttattgctt

SEQ ID NO: 2122534 - DNA, 14 bp, Homo sapiens
tatttaaagacagg

SEQ ID NO: 2122535 - DNA, 16 bp, Homo sapiens
tatttaaatgttgaaa

SEQ ID NO: 2122536 - DNA, 20 bp, Homo sapiens
tatttaagataattataata

SEQ ID NO: 2122537 - DNA, 17 bp, Homo sapiens
tatttaataacaattgt

SEQ ID NO: 2122538 - DNA, 19 bp, Homo sapiens
tatttaatagcaaagaatt

SEQ ID NO: 2122539 - DNA, 20 bp, Homo sapiens
tatttaatttttacatgacc

SEQ ID NO: 2122540 - DNA, 21 bp, Homo sapiens
tatttaatttttacatgacca

SEQ ID NO: 2122541 - DNA, 21 bp, Homo sapiens
tatttacatgaattgcatttt

SEQ ID NO: 2122542 - DNA, 16 bp, Homo sapiens
tatttactaaaagaat

SEQ ID NO: 2122543 - DNA, 21 bp, Homo sapiens
tatttactgagcttctctgtg

SEQ ID NO: 2122544 - DNA, 17 bp, Homo sapiens
tatttacttgaaagatg

SEQ ID NO: 2122545 - DNA, 19 bp, Homo sapiens
tagccttgtgccctgcccc

SEQ ID NO: 2122546 - DNA, 15 bp, Homo sapiens
tagcctttgccctgt

SEQ ID NO: 2122547 - DNA, 17 bp, Homo sapiens
tagcgagctgctctgct

SEQ ID NO: 2122548 - DNA, 17 bp, Homo sapiens
tagcgtgctcactgacc

SEQ ID NO: 2122549 - DNA, 18 bp, Homo sapiens
tagcgttcccaacaacat

SEQ ID NO: 2122550 - DNA, 20 bp, Homo sapiens
tagctaacattttaaataaa

SEQ ID NO: 2122551 - DNA, 19 bp, Homo sapiens
tagctacccaaaagagaaa

SEQ ID NO: 2122552 - DNA, 19 bp, Homo sapiens
tagctagaaatatgatttt

SEQ ID NO: 2122553 - DNA, 21 bp, Homo sapiens
tagctatcagaagaccacaaa

SEQ ID NO: 2122554 - DNA, 14 bp, Homo sapiens
tagctattactgtc

SEQ ID NO: 2122555 - DNA, 16 bp, Homo sapiens
tagctattgcatgtaa

SEQ ID NO: 2122556 - DNA, 17 bp, Homo sapiens
tagctattgcatgtaaa

SEQ ID NO: 2122557 - DNA, 16 bp, Homo sapiens
tagctatttttatgga

SEQ ID NO: 2122558 - DNA, 21 bp, Homo sapiens
tagctcaggtgtccctgcact

SEQ ID NO: 2122559 - DNA, 12 bp, Homo sapiens
tagctcagttta

SEQ ID NO: 2122560 - DNA, 13 bp, Homo sapiens
tagctctgtccac

SEQ ID NO: 2122561 - DNA, 19 bp, Homo sapiens
tagctgaaacctaaggcaa

SEQ ID NO: 2122562 - DNA, 17 bp, Homo sapiens
tagctgagcgtggtggc

SEQ ID NO: 2122563 - DNA, 12 bp, Homo sapiens
tagctgagctca

SEQ ID NO: 2122564 - DNA, 13 bp, Homo sapiens
tagctggcaggac

SEQ ID NO: 2122565 - DNA, 15 bp, Homo sapiens
tagctggcaggacac

SEQ ID NO: 2122566 - DNA, 20 bp, Homo sapiens
tagctggttggagagctaga

SEQ ID NO: 2122567 - DNA, 22 bp, Homo sapiens
tagctggtttcctcattcctga

SEQ ID NO: 2122568 - DNA, 16 bp, Homo sapiens
tagctgtgacctctcc

SEQ ID NO: 2122569 - DNA, 15 bp, Homo sapiens
tagctgtgacctgct

SEQ ID NO: 2122570 - DNA, 17 bp, Homo sapiens
tagctgtgacctgctga

SEQ ID NO: 2122571 - DNA, 22 bp, Homo sapiens
tagctgtgacctgctgagctct

SEQ ID NO: 2122572 - DNA, 14 bp, Homo sapiens
tagctgtgtgaaat

SEQ ID NO: 2122573 - DNA, 20 bp, Homo sapiens
tagctgttatttctattttt

SEQ ID NO: 2122574 - DNA, 19 bp, Homo sapiens
tagcttacctgacacaaga

SEQ ID NO: 2122575 - DNA, 18 bp, Homo sapiens
tagcttagacctcagcct

SEQ ID NO: 2122576 - DNA, 19 bp, Homo sapiens
tagcttagacctcagcctg

SEQ ID NO: 2122577 - DNA, 16 bp, Homo sapiens
tagcttcatgcctcag

SEQ ID NO: 2122578 - DNA, 13 bp, Homo sapiens
tagcttgtatagt

SEQ ID NO: 2122579 - DNA, 19 bp, Homo sapiens
tagcttgtatagtgtaaaa

SEQ ID NO: 2122580 - DNA, 22 bp, Homo sapiens
tagctttaacttaaatagtatt

SEQ ID NO: 2122581 - DNA, 13 bp, Homo sapiens
tagctttctcagg

SEQ ID NO: 2122582 - DNA, 18 bp, Homo sapiens
tagcttttattgtataaa

SEQ ID NO: 2122583 - DNA, 17 bp, Homo sapiens
taggaaaagtacattta

SEQ ID NO: 2122584 - DNA, 19 bp, Homo sapiens
taggaaaagtacatttaat

SEQ ID NO: 2122585 - DNA, 16 bp, Homo sapiens
taggaaataaaacctt

SEQ ID NO: 2122586 - DNA, 19 bp, Homo sapiens
taggaacagagtatatatg

SEQ ID NO: 2122587 - DNA, 22 bp, Homo sapiens
taggaacagagtatatatgtac

SEQ ID NO: 2122588 - DNA, 20 bp, Homo sapiens
taggaaggctactggcatta

SEQ ID NO: 2122589 - DNA, 20 bp, Homo sapiens
taggacataaattagaggtc

SEQ ID NO: 2122590 - DNA, 15 bp, Homo sapiens
taggactctgaggct

SEQ ID NO: 2122591 - DNA, 16 bp, Homo sapiens
taggactctgaggctc

SEQ ID NO: 2122592 - DNA, 13 bp, Homo sapiens
taggactgaggag

SEQ ID NO: 2122593 - DNA, 14 bp, Homo sapiens
taggagctgggagg

SEQ ID NO: 2122594 - DNA, 18 bp, Homo sapiens
taggagctgggaggaaaa

SEQ ID NO: 2122595 - DNA, 14 bp, Homo sapiens
taggaggctgcatg

SEQ ID NO: 2122596 - DNA, 20 bp, Homo sapiens
taggaggctgcatgctctgg

SEQ ID NO: 2122597 - DNA, 21 bp, Homo sapiens
taggaggctgcatgctctgga

SEQ ID NO: 2122598 - DNA, 12 bp, Homo sapiens
taggagggactg

SEQ ID NO: 2122599 - DNA, 23 bp, Homo sapiens
taggagggactgtcgctgcttcg

SEQ ID NO: 2122600 - DNA, 23 bp, Homo sapiens
taggagttcgagaccagcctggc

SEQ ID NO: 2122601 - DNA, 16 bp, Homo sapiens
taggatagatgtgatt

SEQ ID NO: 2122602 - DNA, 13 bp, Homo sapiens
taggatagcattt

SEQ ID NO: 2122603 - DNA, 22 bp, Homo sapiens
taggatttatttaaaatagcaa

SEQ ID NO: 2122604 - DNA, 15 bp, Homo sapiens
taggcaatatcttta

SEQ ID NO: 2122605 - DNA, 13 bp, Homo sapiens
taggcagacgtgg

SEQ ID NO: 2122606 - DNA, 17 bp, Homo sapiens
taggcagacgtggggag

SEQ ID NO: 2122607 - DNA, 16 bp, Homo sapiens
taggcagcctctctgc

SEQ ID NO: 2122608 - DNA, 14 bp, Homo sapiens
taggcagcctgccg

SEQ ID NO: 2122609 - DNA, 19 bp, Homo sapiens
taggcagggatttgaggag

SEQ ID NO: 2122610 - DNA, 14 bp, Homo sapiens
taggcatcccaggg

SEQ ID NO: 2122611 - DNA, 16 bp, Homo sapiens
taggcattatttaatg

SEQ ID NO: 2122612 - DNA, 14 bp, Homo sapiens
taggccaagctgaa

SEQ ID NO: 2122613 - DNA, 20 bp, Homo sapiens
taggcccctggtctgccctg

SEQ ID NO: 2122614 - DNA, 23 bp, Homo sapiens
taggccctggatgtgcccacagg

SEQ ID NO: 2122615 - DNA, 14 bp, Homo sapiens
taggcctggccaga

SEQ ID NO: 2122616 - DNA, 16 bp, Homo sapiens
taggcgggaaggaggg

SEQ ID NO: 2122617 - DNA, 18 bp, Homo sapiens
taggcggtcatgtgtgca

SEQ ID NO: 2122618 - DNA, 12 bp, Homo sapiens
taggctggagaa

SEQ ID NO: 2122619 - DNA, 21 bp, Homo sapiens
taggctggagaagctcaccca

SEQ ID NO: 2122620 - DNA, 18 bp, Homo sapiens
taggctttatgctgtgtt

SEQ ID NO: 2122621 - DNA, 18 bp, Homo sapiens
taggcttttaagaaacac

SEQ ID NO: 2122622 - DNA, 16 bp, Homo sapiens
tagggaaaagttcata

SEQ ID NO: 2122623 - DNA, 15 bp, Homo sapiens
tagggaagcagggac

SEQ ID NO: 2122624 - DNA, 21 bp, Homo sapiens
tagggaatatgtaagtcagga

SEQ ID NO: 2122625 - DNA, 15 bp, Homo sapiens
tagggagagaagata

SEQ ID NO: 2122626 - DNA, 22 bp, Homo sapiens
tagggccagctcacaagcccag

SEQ ID NO: 2122627 - DNA, 21 bp, Homo sapiens
tagggccaggcaggtgcctgg

SEQ ID NO: 2122628 - DNA, 23 bp, Homo sapiens
tagggctacaaaacctgatgtta

SEQ ID NO: 2122629 - DNA, 14 bp, Homo sapiens
taggggagtgtggg

SEQ ID NO: 2122630 - DNA, 17 bp, Homo sapiens
taggggagtgtgggtga

SEQ ID NO: 2122631 - DNA, 21 bp, Homo sapiens
taggggtccacgggaagcctc

SEQ ID NO: 2122632 - DNA, 13 bp, Homo sapiens
taggggttgctaa

SEQ ID NO: 2122633 - DNA, 13 bp, Homo sapiens
tagggtcaggcgg

SEQ ID NO: 2122634 - DNA, 22 bp, Homo sapiens
taggtaaaaatataagaacttg

SEQ ID NO: 2122635 - DNA, 11 bp, Homo sapiens
taggtaaatct

SEQ ID NO: 2122636 - DNA, 17 bp, Homo sapiens
taggtattaaagatgtg

SEQ ID NO: 2122637 - DNA, 16 bp, Homo sapiens
taggtgacagagtgag

SEQ ID NO: 2122638 - DNA, 16 bp, Homo sapiens
taggtgcctcctgtct

SEQ ID NO: 2122639 - DNA, 14 bp, Homo sapiens
taggtgtgccaaac

SEQ ID NO: 2122640 - DNA, 12 bp, Homo sapiens
taggttctaaaa

SEQ ID NO: 2122641 - DNA, 19 bp, Homo sapiens
tagtaagcctccctcctcg

SEQ ID NO: 2122642 - DNA, 20 bp, Homo sapiens
tagtaatagtccaatatttg

SEQ ID NO: 2122643 - DNA, 17 bp, Homo sapiens
tagtaatctgcattatt

SEQ ID NO: 2122644 - DNA, 16 bp, Homo sapiens
tagtaatgggccaatt

SEQ ID NO: 2122645 - DNA, 17 bp, Homo sapiens
tagtaattgatttgacc

SEQ ID NO: 2122646 - DNA, 16 bp, Homo sapiens
tagtaccaatcatttt

SEQ ID NO: 2122647 - DNA, 19 bp, Homo sapiens
tagtactcctgcaaaattt

SEQ ID NO: 2122648 - DNA, 20 bp, Homo sapiens
tagtactcctgcaaaatttt

SEQ ID NO: 2122649 - DNA, 18 bp, Homo sapiens
tacaaaaacaaaacaaaa

SEQ ID NO: 2122650 - DNA, 16 bp, Homo sapiens
tacaaaaacacagcaa

SEQ ID NO: 2122651 - DNA, 17 bp, Homo sapiens
tacaaaaacacagcaag

SEQ ID NO: 2122652 - DNA, 22 bp, Homo sapiens
tacaaaaatagtagaacaagca

SEQ ID NO: 2122653 - DNA, 22 bp, Homo sapiens
tacaaaaatgagctaggcatgg

SEQ ID NO: 2122654 - DNA, 18 bp, Homo sapiens
tacaaaaattagccggac

SEQ ID NO: 2122655 - DNA, 18 bp, Homo sapiens
tacaaaataaaattatgg

SEQ ID NO: 2122656 - DNA, 19 bp, Homo sapiens
tacaaaataaacaaataac

SEQ ID NO: 2122657 - DNA, 13 bp, Homo sapiens
tacaaaataattt

SEQ ID NO: 2122658 - DNA, 15 bp, Homo sapiens
tacaaacatatttgt

SEQ ID NO: 2122659 - DNA, 17 bp, Homo sapiens
tacaaagctgaagaaaa

SEQ ID NO: 2122660 - DNA, 14 bp, Homo sapiens
tacaaagtagagaa

SEQ ID NO: 2122661 - DNA, 16 bp, Homo sapiens
tacaaagtagagaagt

SEQ ID NO: 2122662 - DNA, 14 bp, Homo sapiens
tacaaataaagatg

SEQ ID NO: 2122663 - DNA, 15 bp, Homo sapiens
tacaaatatatttaa

SEQ ID NO: 2122664 - DNA, 21 bp, Homo sapiens
tacaaatttaattttgcagat

SEQ ID NO: 2122665 - DNA, 13 bp, Homo sapiens
tacaacaagaaca

SEQ ID NO: 2122666 - DNA, 15 bp, Homo sapiens
tacaacaagaacaac

SEQ ID NO: 2122667 - DNA, 17 bp, Homo sapiens
tacaacattcaacttta

SEQ ID NO: 2122668 - DNA, 15 bp, Homo sapiens
tacaaccagagcccc

SEQ ID NO: 2122669 - DNA, 21 bp, Homo sapiens
tacaaccagagccccccacaa

SEQ ID NO: 2122670 - DNA, 22 bp, Homo sapiens
tacaaccagagccccccacaat

SEQ ID NO: 2122671 - DNA, 23 bp, Homo sapiens
tacaacctgagccttttcttata

SEQ ID NO: 2122672 - DNA, 17 bp, Homo sapiens
tacaactagatcaagga

SEQ ID NO: 2122673 - DNA, 14 bp, Homo sapiens
tacaacttcaagtg

SEQ ID NO: 2122674 - DNA, 19 bp, Homo sapiens
tacaagaagcattttgtaa

SEQ ID NO: 2122675 - DNA, 22 bp, Homo sapiens
tacaagagccatgtaccagtgt

SEQ ID NO: 2122676 - DNA, 21 bp, Homo sapiens
tacaagcattctgtcttgaag

SEQ ID NO: 2122677 - DNA, 21 bp, Homo sapiens
tacaagcatttgccctgtgga

SEQ ID NO: 2122678 - DNA, 19 bp, Homo sapiens
tacaagcgtgagccactgc

SEQ ID NO: 2122679 - DNA, 20 bp, Homo sapiens
tacaagcgtgagccactgca

SEQ ID NO: 2122680 - DNA, 21 bp, Homo sapiens
tacaagcgtgagccactgcac

SEQ ID NO: 2122681 - DNA, 20 bp, Homo sapiens
tacaataaaatcttgaaaat

SEQ ID NO: 2122682 - DNA, 10 bp, Homo sapiens
tacaataaat

SEQ ID NO: 2122683 - DNA, 13 bp, Homo sapiens
tacaataaataat

SEQ ID NO: 2122684 - DNA, 16 bp, Homo sapiens
tacaataaataatctg

SEQ ID NO: 2122685 - DNA, 12 bp, Homo sapiens
tacaataaatgc

SEQ ID NO: 2122686 - DNA, 20 bp, Homo sapiens
tacaataataaatcctcagg

SEQ ID NO: 2122687 - DNA, 18 bp, Homo sapiens
tacaatatataaaaatat

SEQ ID NO: 2122688 - DNA, 20 bp, Homo sapiens
tacaatatataaaaatatat

SEQ ID NO: 2122689 - DNA, 16 bp, Homo sapiens
tacaatatttaaaatt

SEQ ID NO: 2122690 - DNA, 14 bp, Homo sapiens
tacaatggaaacaa

SEQ ID NO: 2122691 - DNA, 13 bp, Homo sapiens
tacaatttgcact

SEQ ID NO: 2122692 - DNA, 19 bp, Homo sapiens
tacaatttgcactgttact

SEQ ID NO: 2122693 - DNA, 15 bp, Homo sapiens
tacacaaaaaagtat

SEQ ID NO: 2122694 - DNA, 21 bp, Homo sapiens
tacacacacacgcgtgcacac

SEQ ID NO: 2122695 - DNA, 14 bp, Homo sapiens
tacacacacagatg

SEQ ID NO: 2122696 - DNA, 12 bp, Homo sapiens
tacacacatata

SEQ ID NO: 2122697 - DNA, 15 bp, Homo sapiens
tacacacatatacat

SEQ ID NO: 2122698 - DNA, 18 bp, Homo sapiens
tacacacatatacatata

SEQ ID NO: 2122699 - DNA, 17 bp, Homo sapiens
tacacagcaccagaatg

SEQ ID NO: 2122700 - DNA, 18 bp, Homo sapiens
tacacagcagtatgaatg

SEQ ID NO: 2122701 - DNA, 14 bp, Homo sapiens
tacacagcctggac

SEQ ID NO: 2122702 - DNA, 15 bp, Homo sapiens
tacacagctctagac

SEQ ID NO: 2122703 - DNA, 23 bp, Homo sapiens
tacacagtaaaaacttgtactat

SEQ ID NO: 2122704 - DNA, 23 bp, Homo sapiens
tacacagtgggaactctgacaag

SEQ ID NO: 2122705 - DNA, 11 bp, Homo sapiens
tacacatacat

SEQ ID NO: 2122706 - DNA, 16 bp, Homo sapiens
tacacatacatacaca

SEQ ID NO: 2122707 - DNA, 17 bp, Homo sapiens
tacacatacatacacat

SEQ ID NO: 2122708 - DNA, 18 bp, Homo sapiens
tacacatatacctataat

SEQ ID NO: 2122709 - DNA, 18 bp, Homo sapiens
tacacatccccagccaga

SEQ ID NO: 2122710 - DNA, 19 bp, Homo sapiens
tacacatccccagccagaa

SEQ ID NO: 2122711 - DNA, 14 bp, Homo sapiens
tacacattctcaca

SEQ ID NO: 2122712 - DNA, 14 bp, Homo sapiens
tacacccaaagagg

SEQ ID NO: 2122713 - DNA, 13 bp, Homo sapiens
tacacgtgtcctg

SEQ ID NO: 2122714 - DNA, 17 bp, Homo sapiens
tacacgtgtcctgtagt

SEQ ID NO: 2122715 - DNA, 17 bp, Homo sapiens
tacactattgcattgtt

SEQ ID NO: 2122716 - DNA, 15 bp, Homo sapiens
tacactccagcctga

SEQ ID NO: 2122717 - DNA, 18 bp, Homo sapiens
tacactccagcctgagca

SEQ ID NO: 2122718 - DNA, 11 bp, Homo sapiens
tacactcctgc

SEQ ID NO: 2122719 - DNA, 16 bp, Homo sapiens
tacacttcctgcttaa

SEQ ID NO: 2122720 - DNA, 19 bp, Homo sapiens
tacacttgtataaatgtat

SEQ ID NO: 2122721 - DNA, 22 bp, Homo sapiens
tacacttgtataaatgtatata

SEQ ID NO: 2122722 - DNA, 21 bp, Homo sapiens
tacagaaagatggatgtgctt

SEQ ID NO: 2122723 - DNA, 19 bp, Homo sapiens
tacagaaatactgctctga

SEQ ID NO: 2122724 - DNA, 20 bp, Homo sapiens
tacagaaatactgctctgaa

SEQ ID NO: 2122725 - DNA, 17 bp, Homo sapiens
tacagaaattagccggg

SEQ ID NO: 2122726 - DNA, 19 bp, Homo sapiens
tacagaacacgctttcaca

SEQ ID NO: 2122727 - DNA, 18 bp, Homo sapiens
tacagaattctgctacct

SEQ ID NO: 2122728 - DNA, 12 bp, Homo sapiens
tacagaattttt

SEQ ID NO: 2122729 - DNA, 13 bp, Homo sapiens
tacagaattttta

SEQ ID NO: 2122730 - DNA, 13 bp, Homo sapiens
tacagacactaag

SEQ ID NO: 2122731 - DNA, 18 bp, Homo sapiens
tacagacactaagttata

SEQ ID NO: 2122732 - DNA, 16 bp, Homo sapiens
tacagacgtatgctta

SEQ ID NO: 2122733 - DNA, 22 bp, Homo sapiens
tacagacgtctcaagactgaaa

SEQ ID NO: 2122734 - DNA, 15 bp, Homo sapiens
tacagacttctccag

SEQ ID NO: 2122735 - DNA, 17 bp, Homo sapiens
tacagagcttgaaaact

SEQ ID NO: 2122736 - DNA, 20 bp, Homo sapiens
tacagagtggcccctcacct

SEQ ID NO: 2122737 - DNA, 18 bp, Homo sapiens
tacagcagggtcttgctg

SEQ ID NO: 2122738 - DNA, 22 bp, Homo sapiens
tacagccccaaaccagggtgca

SEQ ID NO: 2122739 - DNA, 16 bp, Homo sapiens
tacagctgtttaagat

SEQ ID NO: 2122740 - DNA, 19 bp, Homo sapiens
tacaggaaaagctgctgac

SEQ ID NO: 2122741 - DNA, 22 bp, Homo sapiens
tacaggcaaaacacgcaagggc

SEQ ID NO: 2122742 - DNA, 14 bp, Homo sapiens
tacaggcaattccg

SEQ ID NO: 2122743 - DNA, 19 bp, Homo sapiens
tacaggccttttgactctt

SEQ ID NO: 2122744 - DNA, 19 bp, Homo sapiens
tacaggtatcaggcacagg

SEQ ID NO: 2122745 - DNA, 16 bp, Homo sapiens
tacaggtgtgagtcac

SEQ ID NO: 2122746 - DNA, 19 bp, Homo sapiens
tacagtaaagtttaaaaaa

SEQ ID NO: 2122747 - DNA, 16 bp, Homo sapiens
tacagtactatgtaaa

SEQ ID NO: 2122748 - DNA, 18 bp, Homo sapiens
tacagtagcttaaataaa

SEQ ID NO: 2122749 - DNA, 23 bp, Homo sapiens
tacagtagcttaaataaattcaa

SEQ ID NO: 2122750 - DNA, 15 bp, Homo sapiens
tacagtctaaagctg

SEQ ID NO: 2122751 - DNA, 19 bp, Homo sapiens
tacagtcttcttacttgga

SEQ ID NO: 2122752 - DNA, 20 bp, Homo sapiens
tacagtctttctttctgaat

SEQ ID NO: 2122753 - DNA, 14 bp, Homo sapiens
tacagtgagccaag

SEQ ID NO: 2122754 - DNA, 17 bp, Homo sapiens
tacagtgaggagggtgg

SEQ ID NO: 2122755 - DNA, 13 bp, Homo sapiens
tacagtggagaaa

SEQ ID NO: 2122756 - DNA, 15 bp, Homo sapiens
tacagtggagaaata

SEQ ID NO: 2122757 - DNA, 15 bp, Homo sapiens
tacagtggagtgaga

SEQ ID NO: 2122758 - DNA, 16 bp, Homo sapiens
tacagtgttattttct

SEQ ID NO: 2122759 - DNA, 17 bp, Homo sapiens
tacagttatacatacct

SEQ ID NO: 2122760 - DNA, 12 bp, Homo sapiens
tacagttcagtt

SEQ ID NO: 2122761 - DNA, 22 bp, Homo sapiens
tacagttcagttcctctttgca

SEQ ID NO: 2122762 - DNA, 19 bp, Homo sapiens
tacataacaagaaaatcaa

SEQ ID NO: 2122763 - DNA, 22 bp, Homo sapiens
tatatatgtacagttatacata

SEQ ID NO: 2122764 - DNA, 15 bp, Homo sapiens
tatatatgtatatgt

SEQ ID NO: 2122765 - DNA, 20 bp, Homo sapiens
tatatatgtatatgtatata

SEQ ID NO: 2122766 - DNA, 17 bp, Homo sapiens
tatatatgtgtgtttaa

SEQ ID NO: 2122767 - DNA, 22 bp, Homo sapiens
tatatatgtgtgtttaaataaa

SEQ ID NO: 2122768 - DNA, 22 bp, Homo sapiens
tatatattctacacatatatgt

SEQ ID NO: 2122769 - DNA, 16 bp, Homo sapiens
tatatattgtattaag

SEQ ID NO: 2122770 - DNA, 14 bp, Homo sapiens
tatatatttataac

SEQ ID NO: 2122771 - DNA, 11 bp, Homo sapiens
tatatcagcct

SEQ ID NO: 2122772 - DNA, 15 bp, Homo sapiens
tatatcagcctgagt

SEQ ID NO: 2122773 - DNA, 14 bp, Homo sapiens
tatatcataaagta

SEQ ID NO: 2122774 - DNA, 20 bp, Homo sapiens
tatatctaatttatacaaaa

SEQ ID NO: 2122775 - DNA, 17 bp, Homo sapiens
tatatctatctatttga

SEQ ID NO: 2122776 - DNA, 17 bp, Homo sapiens
tatatctgaaaactgga

SEQ ID NO: 2122777 - DNA, 18 bp, Homo sapiens
tatatctgaaaactggaa

SEQ ID NO: 2122778 - DNA, 20 bp, Homo sapiens
tatatctgataaaattgtga

SEQ ID NO: 2122779 - DNA, 17 bp, Homo sapiens
tatatctgcttcagtgg

SEQ ID NO: 2122780 - DNA, 14 bp, Homo sapiens
tatatctttttcca

SEQ ID NO: 2122781 - DNA, 19 bp, Homo sapiens
tatatgaaatgtttcacta

SEQ ID NO: 2122782 - DNA, 13 bp, Homo sapiens
tatatgatctaat

SEQ ID NO: 2122783 - DNA, 23 bp, Homo sapiens
tatatgatctaatacaaagatga

SEQ ID NO: 2122784 - DNA, 21 bp, Homo sapiens
tatatgcacatgtaacccaaa

SEQ ID NO: 2122785 - DNA, 17 bp, Homo sapiens
tatatggaaattctgct

SEQ ID NO: 2122786 - DNA, 20 bp, Homo sapiens
tatatggcatatttatattg

SEQ ID NO: 2122787 - DNA, 16 bp, Homo sapiens
tatatggtctgtgtgt

SEQ ID NO: 2122788 - DNA, 20 bp, Homo sapiens
tatatgtacagttatacata

SEQ ID NO: 2122789 - DNA, 14 bp, Homo sapiens
tatatgtatatcta

SEQ ID NO: 2122790 - DNA, 12 bp, Homo sapiens
tatatgtatatg

SEQ ID NO: 2122791 - DNA, 15 bp, Homo sapiens
tatatgtatatgtat

SEQ ID NO: 2122792 - DNA, 12 bp, Homo sapiens
tatatgtatgtg

SEQ ID NO: 2122793 - DNA, 18 bp, Homo sapiens
tatatgtcagacatgaaa

SEQ ID NO: 2122794 - DNA, 20 bp, Homo sapiens
tatatgtcagacatgaaaac

SEQ ID NO: 2122795 - DNA, 17 bp, Homo sapiens
tatatgtgtaatttttt

SEQ ID NO: 2122796 - DNA, 20 bp, Homo sapiens
tatatgtgtatatatacata

SEQ ID NO: 2122797 - DNA, 23 bp, Homo sapiens
tatatgtgtgtttaaataaagta

SEQ ID NO: 2122798 - DNA, 19 bp, Homo sapiens
tatatgttttaagaggcag

SEQ ID NO: 2122799 - DNA, 14 bp, Homo sapiens
tatattaatttgtt

SEQ ID NO: 2122800 - DNA, 22 bp, Homo sapiens
tatattcatgtaataaatctga

SEQ ID NO: 2122801 - DNA, 21 bp, Homo sapiens
tatattccatatattagcatt

SEQ ID NO: 2122802 - DNA, 15 bp, Homo sapiens
tatattgaatatatc

SEQ ID NO: 2122803 - DNA, 15 bp, Homo sapiens
tatatttaacaagat

SEQ ID NO: 2122804 - DNA, 19 bp, Homo sapiens
tatatttaactctctttat

SEQ ID NO: 2122805 - DNA, 17 bp, Homo sapiens
tatatttactaaaagaa

SEQ ID NO: 2122806 - DNA, 16 bp, Homo sapiens
tatatttataactcat

SEQ ID NO: 2122807 - DNA, 22 bp, Homo sapiens
tatatttatcaaacttgtgctg

SEQ ID NO: 2122808 - DNA, 14 bp, Homo sapiens
tatatttgaaattt

SEQ ID NO: 2122809 - DNA, 17 bp, Homo sapiens
tatatttggaaagagac

SEQ ID NO: 2122810 - DNA, 11 bp, Homo sapiens
tatattttatg

SEQ ID NO: 2122811 - DNA, 12 bp, Homo sapiens
tatattttatga

SEQ ID NO: 2122812 - DNA, 13 bp, Homo sapiens
tatatttttcaac

SEQ ID NO: 2122813 - DNA, 21 bp, Homo sapiens
tatatttttcaaccagcattt

SEQ ID NO: 2122814 - DNA, 22 bp, Homo sapiens
tatatttttcaaccagcatttt

SEQ ID NO: 2122815 - DNA, 19 bp, Homo sapiens
tatatttttggttgtcaat

SEQ ID NO: 2122816 - DNA, 15 bp, Homo sapiens
tatcaaaacatatca

SEQ ID NO: 2122817 - DNA, 22 bp, Homo sapiens
tatcaaaacatatcaattcaac

SEQ ID NO: 2122818 - DNA, 15 bp, Homo sapiens
tatcaaaagacagca

SEQ ID NO: 2122819 - DNA, 21 bp, Homo sapiens
tatcaaaataaattgaaatat

SEQ ID NO: 2122820 - DNA, 14 bp, Homo sapiens
tatcaaaatcacta

SEQ ID NO: 2122821 - DNA, 19 bp, Homo sapiens
tatcaaacaccaacataaa

SEQ ID NO: 2122822 - DNA, 16 bp, Homo sapiens
tatcaaatctgtatat

SEQ ID NO: 2122823 - DNA, 22 bp, Homo sapiens
tatcaaatctgtatatgttgta

SEQ ID NO: 2122824 - DNA, 22 bp, Homo sapiens
tatcaacatctttttcctccct

SEQ ID NO: 2122825 - DNA, 19 bp, Homo sapiens
tatcaaggatgttctggct

SEQ ID NO: 2122826 - DNA, 17 bp, Homo sapiens
tatcaatccttgttcag

SEQ ID NO: 2122827 - DNA, 16 bp, Homo sapiens
tatcaattcaacacat

SEQ ID NO: 2122828 - DNA, 20 bp, Homo sapiens
tatcaattcaacacattact

SEQ ID NO: 2122829 - DNA, 14 bp, Homo sapiens
tatcacaaatctta

SEQ ID NO: 2122830 - DNA, 20 bp, Homo sapiens
tatcacaaatcttaacttga

SEQ ID NO: 2122831 - DNA, 18 bp, Homo sapiens
tatcacatcaagcatgca

SEQ ID NO: 2122832 - DNA, 23 bp, Homo sapiens
tatcacattacatcatcctcctt

SEQ ID NO: 2122833 - DNA, 13 bp, Homo sapiens
tatcacattattt

SEQ ID NO: 2122834 - DNA, 13 bp, Homo sapiens
tatcacccaggct

SEQ ID NO: 2122835 - DNA, 16 bp, Homo sapiens
tatcacctctcttcag

SEQ ID NO: 2122836 - DNA, 17 bp, Homo sapiens
tatcacctctcttcagc

SEQ ID NO: 2122837 - DNA, 20 bp, Homo sapiens
tatcactggcaatatttgtt

SEQ ID NO: 2122838 - DNA, 21 bp, Homo sapiens
tatcactggcaatatttgttc

SEQ ID NO: 2122839 - DNA, 12 bp, Homo sapiens
tatcagaaaagt

SEQ ID NO: 2122840 - DNA, 16 bp, Homo sapiens
tatcagaaaagtagaa

SEQ ID NO: 2122841 - DNA, 23 bp, Homo sapiens
tatcagaagaccacaaaaattga

SEQ ID NO: 2122842 - DNA, 14 bp, Homo sapiens
tatcagacctctga

SEQ ID NO: 2122843 - DNA, 13 bp, Homo sapiens
tatcagcctgagt

SEQ ID NO: 2122844 - DNA, 19 bp, Homo sapiens
tatcagcctgagtctcctg

SEQ ID NO: 2122845 - DNA, 20 bp, Homo sapiens
taagcctccatttagttctt

SEQ ID NO: 2122846 - DNA, 16 bp, Homo sapiens
taagcctgttgagact

SEQ ID NO: 2122847 - DNA, 14 bp, Homo sapiens
taagctgcagcttc

SEQ ID NO: 2122848 - DNA, 12 bp, Homo sapiens
taagctggagct

SEQ ID NO: 2122849 - DNA, 19 bp, Homo sapiens
taagctggagctcttggaa

SEQ ID NO: 2122850 - DNA, 21 bp, Homo sapiens
taagctgggaaaaaagttttg

SEQ ID NO: 2122851 - DNA, 15 bp, Homo sapiens
taagctgtaaaaaga

SEQ ID NO: 2122852 - DNA, 16 bp, Homo sapiens
taagcttatgtcagac

SEQ ID NO: 2122853 - DNA, 18 bp, Homo sapiens
taagcttatttaattaaa

SEQ ID NO: 2122854 - DNA, 18 bp, Homo sapiens
taatgcacaatttagaaa

SEQ ID NO: 2122855 - DNA, 19 bp, Homo sapiens
taatgcacaatttagaaaa

SEQ ID NO: 2122856 - DNA, 20 bp, Homo sapiens
taatgcacaatttagaaaac

SEQ ID NO: 2122857 - DNA, 22 bp, Homo sapiens
taatgcatcatcatagaaaaac

SEQ ID NO: 2122858 - DNA, 19 bp, Homo sapiens
taatgcatgtggtatgagt

SEQ ID NO: 2122859 - DNA, 16 bp, Homo sapiens
taatgcatgttaggaa

SEQ ID NO: 2122860 - DNA, 20 bp, Homo sapiens
taatgccacacattgtgctt

SEQ ID NO: 2122861 - DNA, 17 bp, Homo sapiens
taatgcctctcccgcac

SEQ ID NO: 2122862 - DNA, 14 bp, Homo sapiens
taatgctaagaaat

SEQ ID NO: 2122863 - DNA, 16 bp, Homo sapiens
taatgctgttgcctca

SEQ ID NO: 2122864 - DNA, 19 bp, Homo sapiens
taatgcttagagaatgttc

SEQ ID NO: 2122865 - DNA, 13 bp, Homo sapiens
taatggaagagaa

SEQ ID NO: 2122866 - DNA, 14 bp, Homo sapiens
taatggaagagaaa

SEQ ID NO: 2122867 - DNA, 17 bp, Homo sapiens
taatggaagagaaatct

SEQ ID NO: 2122868 - DNA, 17 bp, Homo sapiens
taatgggccaattaaaa

SEQ ID NO: 2122869 - DNA, 13 bp, Homo sapiens
taatggtctaaaa

SEQ ID NO: 2122870 - DNA, 17 bp, Homo sapiens
taatggtctaaaaataa

SEQ ID NO: 2122871 - DNA, 13 bp, Homo sapiens
taatggtttactg

SEQ ID NO: 2122872 - DNA, 14 bp, Homo sapiens
taatggtttttatt

SEQ ID NO: 2122873 - DNA, 19 bp, Homo sapiens
taatggtttttatttctcg

SEQ ID NO: 2122874 - DNA, 22 bp, Homo sapiens
taatgtaagaaaatttgaagta

SEQ ID NO: 2122875 - DNA, 20 bp, Homo sapiens
taatgtaagggtctgttgta

SEQ ID NO: 2122876 - DNA, 15 bp, Homo sapiens
taatgtcaaaatcat

SEQ ID NO: 2122877 - DNA, 18 bp, Homo sapiens
taatgtcaaaatcatgaa

SEQ ID NO: 2122878 - DNA, 13 bp, Homo sapiens
taatgtcttcatt

SEQ ID NO: 2122879 - DNA, 19 bp, Homo sapiens
taatgtgccccatgtccaa

SEQ ID NO: 2122880 - DNA, 17 bp, Homo sapiens
taatgtggatttcctat

SEQ ID NO: 2122881 - DNA, 13 bp, Homo sapiens
taatgtgtgtatg

SEQ ID NO: 2122882 - DNA, 19 bp, Homo sapiens
taatgtgtgtatgtgtatt

SEQ ID NO: 2122883 - DNA, 22 bp, Homo sapiens
taatgttctgaataatttctta

SEQ ID NO: 2122884 - DNA, 21 bp, Homo sapiens
taatgttgggatttatatcta

SEQ ID NO: 2122885 - DNA, 14 bp, Homo sapiens
taatgttgttattt

SEQ ID NO: 2122886 - DNA, 13 bp, Homo sapiens
taatgtttgctat

SEQ ID NO: 2122887 - DNA, 14 bp, Homo sapiens
taatgttttgtaca

SEQ ID NO: 2122888 - DNA, 16 bp, Homo sapiens
taatgttttgtacaat

SEQ ID NO: 2122889 - DNA, 14 bp, Homo sapiens
taattaaaaaattt

SEQ ID NO: 2122890 - DNA, 13 bp, Homo sapiens
taattaaaatctg

SEQ ID NO: 2122891 - DNA, 14 bp, Homo sapiens
taattaaaatctgg

SEQ ID NO: 2122892 - DNA, 20 bp, Homo sapiens
taattaataaacgaagataa

SEQ ID NO: 2122893 - DNA, 22 bp, Homo sapiens
taattaatcgaaatgaatttat

SEQ ID NO: 2122894 - DNA, 14 bp, Homo sapiens
taattagaacaata

SEQ ID NO: 2122895 - DNA, 22 bp, Homo sapiens
taattagaacaatagctattgc

SEQ ID NO: 2122896 - DNA, 19 bp, Homo sapiens
taattagattttcttgcag

SEQ ID NO: 2122897 - DNA, 16 bp, Homo sapiens
taattaggttaacatt

SEQ ID NO: 2122898 - DNA, 13 bp, Homo sapiens
taattagtaataa

SEQ ID NO: 2122899 - DNA, 18 bp, Homo sapiens
taattatcggaagcagtg

SEQ ID NO: 2122900 - DNA, 21 bp, Homo sapiens
taattatcgggaacagtgttt

SEQ ID NO: 2122901 - DNA, 18 bp, Homo sapiens
taattattaataccaaat

SEQ ID NO: 2122902 - DNA, 12 bp, Homo sapiens
taattattattc

SEQ ID NO: 2122903 - DNA, 14 bp, Homo sapiens
taattattattctt

SEQ ID NO: 2122904 - DNA, 12 bp, Homo sapiens
taattcagaaaa

SEQ ID NO: 2122905 - DNA, 16 bp, Homo sapiens
taattcagaaaacata

SEQ ID NO: 2122906 - DNA, 17 bp, Homo sapiens
taattcagaaaacataa

SEQ ID NO: 2122907 - DNA, 21 bp, Homo sapiens
taattcagcactgatttcaca

SEQ ID NO: 2122908 - DNA, 15 bp, Homo sapiens
taattcataattaga

SEQ ID NO: 2122909 - DNA, 16 bp, Homo sapiens
taattcataattagaa

SEQ ID NO: 2122910 - DNA, 17 bp, Homo sapiens
taattccaagattaaaa

SEQ ID NO: 2122911 - DNA, 16 bp, Homo sapiens
taattccaatatgatg

SEQ ID NO: 2122912 - DNA, 14 bp, Homo sapiens
taattccataaccc

SEQ ID NO: 2122913 - DNA, 16 bp, Homo sapiens
taattcccattttgca

SEQ ID NO: 2122914 - DNA, 19 bp, Homo sapiens
taattcccattttgcaaaa

SEQ ID NO: 2122915 - DNA, 20 bp, Homo sapiens
taattcccattttgcaaaat

SEQ ID NO: 2122916 - DNA, 23 bp, Homo sapiens
taattcccattttgcaaaatttc

SEQ ID NO: 2122917 - DNA, 20 bp, Homo sapiens
taattccctatcttttagtt

SEQ ID NO: 2122918 - DNA, 11 bp, Homo sapiens
taattctaaat

SEQ ID NO: 2122919 - DNA, 22 bp, Homo sapiens
taattctccctaaggaatctga

SEQ ID NO: 2122920 - DNA, 12 bp, Homo sapiens
taattcttaata

SEQ ID NO: 2122921 - DNA, 18 bp, Homo sapiens
taattcttaataggcttt

SEQ ID NO: 2122922 - DNA, 15 bp, Homo sapiens
taattcttatttctg

SEQ ID NO: 2122923 - DNA, 21 bp, Homo sapiens
taattgaaatttaaaaataaa

SEQ ID NO: 2122924 - DNA, 23 bp, Homo sapiens
taattgatttgacccactcacac

SEQ ID NO: 2122925 - DNA, 14 bp, Homo sapiens
taattgcatttaaa

SEQ ID NO: 2122926 - DNA, 18 bp, Homo sapiens
taattgcatttctgctct

SEQ ID NO: 2122927 - DNA, 21 bp, Homo sapiens
taattgcttacatttttacaa

SEQ ID NO: 2122928 - DNA, 23 bp, Homo sapiens
taattgcttacatttttacaata

SEQ ID NO: 2122929 - DNA, 21 bp, Homo sapiens
taattggaagaaattcctgta

SEQ ID NO: 2122930 - DNA, 15 bp, Homo sapiens
taattggaattctgg

SEQ ID NO: 2122931 - DNA, 17 bp, Homo sapiens
taattgtagatggaaat

SEQ ID NO: 2122932 - DNA, 11 bp, Homo sapiens
taattgtgtac

SEQ ID NO: 2122933 - DNA, 12 bp, Homo sapiens
taattgtgtaca

SEQ ID NO: 2122934 - DNA, 14 bp, Homo sapiens
taattgtgtacaaa

SEQ ID NO: 2122935 - DNA, 13 bp, Homo sapiens
taatttaaaccag

SEQ ID NO: 2122936 - DNA, 17 bp, Homo sapiens
taatttaaaccagcaga

SEQ ID NO: 2122937 - DNA, 19 bp, Homo sapiens
taatttaaagccacaacca

SEQ ID NO: 2122938 - DNA, 17 bp, Homo sapiens
taatttaactaatttaa

SEQ ID NO: 2122939 - DNA, 21 bp, Homo sapiens
taatttaactaatttaaacca

SEQ ID NO: 2122940 - DNA, 14 bp, Homo sapiens
taatttaatgcatg

SEQ ID NO: 2122941 - DNA, 16 bp, Homo sapiens
taatttagaaaacttt

SEQ ID NO: 2122942 - DNA, 15 bp, Homo sapiens
taatttagaaatcat

SEQ ID NO: 2122943 - DNA, 16 bp, Homo sapiens
taatttatacaaaata

SEQ ID NO: 2122944 - DNA, 14 bp, Homo sapiens
taatttatatttga

SEQ ID NO: 2122945 - DNA, 20 bp, Homo sapiens
taatttattgtttttccttg

SEQ ID NO: 2122946 - DNA, 13 bp, Homo sapiens
taatttattttgt

SEQ ID NO: 2122947 - DNA, 14 bp, Homo sapiens
taatttattttgta

SEQ ID NO: 2122948 - DNA, 15 bp, Homo sapiens
taatttattttgtat

SEQ ID NO: 2122949 - DNA, 21 bp, Homo sapiens
taatttctaactccttatgtt

SEQ ID NO: 2122950 - DNA, 22 bp, Homo sapiens
taatttgaaaacataatctgca

SEQ ID NO: 2122951 - DNA, 13 bp, Homo sapiens
taatttgagaatt

SEQ ID NO: 2122952 - DNA, 18 bp, Homo sapiens
taatttgaggacaaccat

SEQ ID NO: 2122953 - DNA, 22 bp, Homo sapiens
taatttgatagtattgtgcata

SEQ ID NO: 2122954 - DNA, 15 bp, Homo sapiens
taatttgttatgtat

SEQ ID NO: 2122955 - DNA, 19 bp, Homo sapiens
taatttgttgtacttttta

SEQ ID NO: 2122956 - DNA, 21 bp, Homo sapiens
taatttgtttttcttatccaa

SEQ ID NO: 2122957 - DNA, 14 bp, Homo sapiens
taattttaaacaaa

SEQ ID NO: 2122958 - DNA, 13 bp, Homo sapiens
taattttaaattc

SEQ ID NO: 2122959 - DNA, 18 bp, Homo sapiens
taattttatgaatgtctt

SEQ ID NO: 2122960 - DNA, 16 bp, Homo sapiens
taattttattattaga

SEQ ID NO: 2122961 - DNA, 22 bp, Homo sapiens
taattttcaagagaagaaaaaa

SEQ ID NO: 2122962 - DNA, 14 bp, Homo sapiens
taattttcttcatg

SEQ ID NO: 2122963 - DNA, 15 bp, Homo sapiens
taattttgaataaat

SEQ ID NO: 2122964 - DNA, 20 bp, Homo sapiens
taattttgtttgtaatcctg

SEQ ID NO: 2122965 - DNA, 13 bp, Homo sapiens
taatttttaaagt

SEQ ID NO: 2122966 - DNA, 18 bp, Homo sapiens
taccgagtctcttctcca

SEQ ID NO: 2122967 - DNA, 15 bp, Homo sapiens
taccgctggggaaca

SEQ ID NO: 2122968 - DNA, 17 bp, Homo sapiens
taccgctggggaacaga

SEQ ID NO: 2122969 - DNA, 22 bp, Homo sapiens
tacctaaacagatataaatggc

SEQ ID NO: 2122970 - DNA, 17 bp, Homo sapiens
tacctaccaccttccct

SEQ ID NO: 2122971 - DNA, 20 bp, Homo sapiens
tacctagcacacaataagca

SEQ ID NO: 2122972 - DNA, 16 bp, Homo sapiens
tacctataatgtgtgt

SEQ ID NO: 2122973 - DNA, 14 bp, Homo sapiens
tacctatgtgacag

SEQ ID NO: 2122974 - DNA, 16 bp, Homo sapiens
tacctatgtgacagac

SEQ ID NO: 2122975 - DNA, 14 bp, Homo sapiens
tacctcagcctaga

SEQ ID NO: 2122976 - DNA, 14 bp, Homo sapiens
tacctcagtttctc

SEQ ID NO: 2122977 - DNA, 15 bp, Homo sapiens
tacctcatgggacag

SEQ ID NO: 2122978 - DNA, 14 bp, Homo sapiens
tacctcccctgcca

SEQ ID NO: 2122979 - DNA, 13 bp, Homo sapiens
tacctcctgccca

SEQ ID NO: 2122980 - DNA, 16 bp, Homo sapiens
tacctcctgcccagga

SEQ ID NO: 2122981 - DNA, 15 bp, Homo sapiens
tacctcgaggctctt

SEQ ID NO: 2122982 - DNA, 20 bp, Homo sapiens
tacctctctctatatataca

SEQ ID NO: 2122983 - DNA, 15 bp, Homo sapiens
tacctctgatacctc

SEQ ID NO: 2122984 - DNA, 21 bp, Homo sapiens
tacctctttgtcagtctgggt

SEQ ID NO: 2122985 - DNA, 13 bp, Homo sapiens
tacctgacacaag

SEQ ID NO: 2122986 - DNA, 17 bp, Homo sapiens
tacctgatcatggtcag

SEQ ID NO: 2122987 - DNA, 20 bp, Homo sapiens
tacctgcatgtgttgtacaa

SEQ ID NO: 2122988 - DNA, 14 bp, Homo sapiens
tacctgggaagggg

SEQ ID NO: 2122989 - DNA, 16 bp, Homo sapiens
tacctgtagtgagaaa

SEQ ID NO: 2122990 - DNA, 20 bp, Homo sapiens
tacctgtgcgttactaattg

SEQ ID NO: 2122991 - DNA, 20 bp, Homo sapiens
tacctgtgtttcttgcctca

SEQ ID NO: 2122992 - DNA, 13 bp, Homo sapiens
taccttcaataaa

SEQ ID NO: 2122993 - DNA, 17 bp, Homo sapiens
taccttctggttgcttc

SEQ ID NO: 2122994 - DNA, 15 bp, Homo sapiens
taccttcttcgctgc

SEQ ID NO: 2122995 - DNA, 20 bp, Homo sapiens
taccttgaccatcgtccttc

SEQ ID NO: 2122996 - DNA, 22 bp, Homo sapiens
tacctttattaatgaactgtga

SEQ ID NO: 2122997 - DNA, 14 bp, Homo sapiens
tacctttggaaaaa

SEQ ID NO: 2122998 - DNA, 15 bp, Homo sapiens
tacctttggaaaaat

SEQ ID NO: 2122999 - DNA, 12 bp, Homo sapiens
tacctttgtcac

SEQ ID NO: 2123000 - DNA, 16 bp, Homo sapiens
taccttttctgttgta

SEQ ID NO: 2123001 - DNA, 17 bp, Homo sapiens
taccttttctgttgtac

SEQ ID NO: 2123002 - DNA, 23 bp, Homo sapiens
tacgaaactgtatgattaagcaa

SEQ ID NO: 2123003 - DNA, 13 bp, Homo sapiens
tacgactgaagaa

SEQ ID NO: 2123004 - DNA, 23 bp, Homo sapiens
tacgcactacatgtggtttatag

SEQ ID NO: 2123005 - DNA, 13 bp, Homo sapiens
tacgctctccttt

SEQ ID NO: 2123006 - DNA, 13 bp, Homo sapiens
tacgctctctgtc

SEQ ID NO: 2123007 - DNA, 20 bp, Homo sapiens
tacgtataaatatgaaatga

SEQ ID NO: 2123008 - DNA, 16 bp, Homo sapiens
tacgtatttaatagca

SEQ ID NO: 2123009 - DNA, 18 bp, Homo sapiens
tacgtcaaacatgaagtg

SEQ ID NO: 2123010 - DNA, 14 bp, Homo sapiens
tacgtctggtgttc

SEQ ID NO: 2123011 - DNA, 21 bp, Homo sapiens
tacgttctccagcccacaccc

SEQ ID NO: 2123012 - DNA, 12 bp, Homo sapiens
tactaaaagaat

SEQ ID NO: 2123013 - DNA, 12 bp, Homo sapiens
tactaaagcagt

SEQ ID NO: 2123014 - DNA, 14 bp, Homo sapiens
tactaaagtgtcta

SEQ ID NO: 2123015 - DNA, 15 bp, Homo sapiens
tactaaagtgtctat

SEQ ID NO: 2123016 - DNA, 15 bp, Homo sapiens
tactaagaggctatt

SEQ ID NO: 2123017 - DNA, 23 bp, Homo sapiens
tactacagttgttttttgaaaac

SEQ ID NO: 2123018 - DNA, 13 bp, Homo sapiens
tactacatgcact

SEQ ID NO: 2123019 - DNA, 16 bp, Homo sapiens
tactactattctgtta

SEQ ID NO: 2123020 - DNA, 22 bp, Homo sapiens
tactactgctgcaaagtgcaaa

SEQ ID NO: 2123021 - DNA, 20 bp, Homo sapiens
tactactgtggaaaaatatt

SEQ ID NO: 2123022 - DNA, 20 bp, Homo sapiens
tactacttcttggaaaaaaa

SEQ ID NO: 2123023 - DNA, 13 bp, Homo sapiens
tactactttgtgt

SEQ ID NO: 2123024 - DNA, 17 bp, Homo sapiens
tactagaatttgtattt

SEQ ID NO: 2123025 - DNA, 18 bp, Homo sapiens
tactagaatttgtatttt

SEQ ID NO: 2123026 - DNA, 14 bp, Homo sapiens
tactagatgtcttt

SEQ ID NO: 2123027 - DNA, 20 bp, Homo sapiens
tactagcttttcaaacaaga

SEQ ID NO: 2123028 - DNA, 14 bp, Homo sapiens
tactatacaacaat

SEQ ID NO: 2123029 - DNA, 15 bp, Homo sapiens
tactatacaacaatg

SEQ ID NO: 2123030 - DNA, 19 bp, Homo sapiens
tactatctcttgtcatata

SEQ ID NO: 2123031 - DNA, 14 bp, Homo sapiens
tactatctgtgaag

SEQ ID NO: 2123032 - DNA, 16 bp, Homo sapiens
tactatggctgtattt

SEQ ID NO: 2123033 - DNA, 23 bp, Homo sapiens
tactatggctgtatttttagaga

SEQ ID NO: 2123034 - DNA, 13 bp, Homo sapiens
tactatgtaaatt

SEQ ID NO: 2123035 - DNA, 18 bp, Homo sapiens
tactatgttaataacttg

SEQ ID NO: 2123036 - DNA, 14 bp, Homo sapiens
tactattggtaata

SEQ ID NO: 2123037 - DNA, 21 bp, Homo sapiens
tactattgtttaaaaacagga

SEQ ID NO: 2123038 - DNA, 12 bp, Homo sapiens
tactcacctcct

SEQ ID NO: 2123039 - DNA, 13 bp, Homo sapiens
tactcacctcctc

SEQ ID NO: 2123040 - DNA, 15 bp, Homo sapiens
tactcacctcctccc

SEQ ID NO: 2123041 - DNA, 13 bp, Homo sapiens
tactcacctctct

SEQ ID NO: 2123042 - DNA, 20 bp, Homo sapiens
tactcagcagcagagagccc

SEQ ID NO: 2123043 - DNA, 17 bp, Homo sapiens
tactcagcagccctcct

SEQ ID NO: 2123044 - DNA, 20 bp, Homo sapiens
tactcagcagccctcctcac

SEQ ID NO: 2123045 - DNA, 15 bp, Homo sapiens
tactcagtatagcat

SEQ ID NO: 2123046 - DNA, 22 bp, Homo sapiens
tactcagttagaattttcctaa

SEQ ID NO: 2123047 - DNA, 20 bp, Homo sapiens
tactcataaggcatatacaa

SEQ ID NO: 2123048 - DNA, 22 bp, Homo sapiens
tactcataaggcatatacaaat

SEQ ID NO: 2123049 - DNA, 15 bp, Homo sapiens
tactcatttctaaaa

SEQ ID NO: 2123050 - DNA, 18 bp, Homo sapiens
tactcatttctaaaagaa

SEQ ID NO: 2123051 - DNA, 16 bp, Homo sapiens
tactcatttttcatga

SEQ ID NO: 2123052 - DNA, 15 bp, Homo sapiens
tactccaagcttcaa

SEQ ID NO: 2123053 - DNA, 18 bp, Homo sapiens
tactccaagcttcaagtg

SEQ ID NO: 2123054 - DNA, 22 bp, Homo sapiens
tactccacagcggaggagacca

SEQ ID NO: 2123055 - DNA, 14 bp, Homo sapiens
tactccagtggtga

SEQ ID NO: 2123056 - DNA, 13 bp, Homo sapiens
tactcccttcctg

SEQ ID NO: 2123057 - DNA, 13 bp, Homo sapiens
tactccgaaacaa

SEQ ID NO: 2123058 - DNA, 15 bp, Homo sapiens
tactcctacctcagc

SEQ ID NO: 2123059 - DNA, 16 bp, Homo sapiens
tactcctgcaaaattt

SEQ ID NO: 2123060 - DNA, 17 bp, Homo sapiens
tactcctgtgggagcct

SEQ ID NO: 2123061 - DNA, 20 bp, Homo sapiens
tactcctgtgggagcctcgc

SEQ ID NO: 2123062 - DNA, 16 bp, Homo sapiens
tactctacgccaaagt

SEQ ID NO: 2123063 - DNA, 20 bp, Homo sapiens
tactctagaacatgcacatt

SEQ ID NO: 2123064 - DNA, 22 bp, Homo sapiens
tactctagaacatgcacattta

SEQ ID NO: 2123065 - DNA, 18 bp, Homo sapiens
tactctagcctgggccag

SEQ ID NO: 2123066 - DNA, 14 bp, Homo sapiens
tactctccaacctg

SEQ ID NO: 2123067 - DNA, 14 bp, Homo sapiens
tactctctgctcta

SEQ ID NO: 2123068 - DNA, 11 bp, Homo sapiens
tactctgagcc

SEQ ID NO: 2123069 - DNA, 13 bp, Homo sapiens
tactctgagccca

SEQ ID NO: 2123070 - DNA, 16 bp, Homo sapiens
tactctgagcccaggc

SEQ ID NO: 2123071 - DNA, 11 bp, Homo sapiens
tactctgtcca

SEQ ID NO: 2123072 - DNA, 13 bp, Homo sapiens
tactctgtccagg

SEQ ID NO: 2123073 - DNA, 17 bp, Homo sapiens
tactctgtccaggccac

SEQ ID NO: 2123074 - DNA, 16 bp, Homo sapiens
tactctgtgccagagc

SEQ ID NO: 2123075 - DNA, 22 bp, Homo sapiens
tactctgtgccagagcctgggg

SEQ ID NO: 2123076 - DNA, 12 bp, Homo sapiens
tactctgtgtca

SEQ ID NO: 2123077 - DNA, 19 bp, Homo sapiens
tactctttatttctagcag

SEQ ID NO: 2123078 - DNA, 14 bp, Homo sapiens
tactgacagaaatg

SEQ ID NO: 2123079 - DNA, 19 bp, Homo sapiens
tactgagccttgtaattct

SEQ ID NO: 2123080 - DNA, 23 bp, Homo sapiens
tagaattagtggagcttttgtat

SEQ ID NO: 2123081 - DNA, 17 bp, Homo sapiens
tagaattatatctaatt

SEQ ID NO: 2123082 - DNA, 24 bp, Homo sapiens
tagaattatatctaatttatacaa

SEQ ID NO: 2123083 - DNA, 22 bp, Homo sapiens
tagaattgggaagctgggggaa

SEQ ID NO: 2123084 - DNA, 15 bp, Homo sapiens
tagaatttattcaat

SEQ ID NO: 2123085 - DNA, 14 bp, Homo sapiens
taaataaatgccaa

SEQ ID NO: 2123086 - DNA, 16 bp, Homo sapiens
taaataaatgtcatta

SEQ ID NO: 2123087 - DNA, 12 bp, Homo sapiens
taaataaattca

SEQ ID NO: 2123088 - DNA, 12 bp, Homo sapiens
taaataaattgt

SEQ ID NO: 2123089 - DNA, 11 bp, Homo sapiens
taaataagaaa

SEQ ID NO: 2123090 - DNA, 15 bp, Homo sapiens
taaataagaaacttt

SEQ ID NO: 2123091 - DNA, 21 bp, Homo sapiens
taaatacacttcctgcttaaa

SEQ ID NO: 2123092 - DNA, 17 bp, Homo sapiens
taaatacagacactaag

SEQ ID NO: 2123093 - DNA, 19 bp, Homo sapiens
taaatacagacactaagtt

SEQ ID NO: 2123094 - DNA, 15 bp, Homo sapiens
taaatacatgtgtgg

SEQ ID NO: 2123095 - DNA, 22 bp, Homo sapiens
taaatacctcaacctatggtat

SEQ ID NO: 2123096 - DNA, 15 bp, Homo sapiens
taaatactgtacata

SEQ ID NO: 2123097 - DNA, 18 bp, Homo sapiens
taaatactgtacatagat

SEQ ID NO: 2123098 - DNA, 13 bp, Homo sapiens
taaatagcatctg

SEQ ID NO: 2123099 - DNA, 17 bp, Homo sapiens
taaatagcatctgctct

SEQ ID NO: 2123100 - DNA, 15 bp, Homo sapiens
taaatagcattctct

SEQ ID NO: 2123101 - DNA, 24 bp, Homo sapiens
taaatagttttaaatatgaacaaa

SEQ ID NO: 2123102 - DNA, 11 bp, Homo sapiens
taaatatatat

SEQ ID NO: 2123103 - DNA, 19 bp, Homo sapiens
taaatatatatttttcaac

SEQ ID NO: 2123104 - DNA, 17 bp, Homo sapiens
taaatatatttaagata

SEQ ID NO: 2123105 - DNA, 13 bp, Homo sapiens
taaatatccacag

SEQ ID NO: 2123106 - DNA, 13 bp, Homo sapiens
taaatatgaacaa

SEQ ID NO: 2123107 - DNA, 21 bp, Homo sapiens
taaatatgttagcaaagagtt

SEQ ID NO: 2123108 - DNA, 14 bp, Homo sapiens
taaatattctgcat

SEQ ID NO: 2123109 - DNA, 10 bp, Homo sapiens
taaatattta

SEQ ID NO: 2123110 - DNA, 11 bp, Homo sapiens
taaatatttac

SEQ ID NO: 2123111 - DNA, 19 bp, Homo sapiens
taaatatttacatatgaaa

SEQ ID NO: 2123112 - DNA, 20 bp, Homo sapiens
taaatatttcatgattcaca

SEQ ID NO: 2123113 - DNA, 19 bp, Homo sapiens
taaatatttggtctctatt

SEQ ID NO: 2123114 - DNA, 13 bp, Homo sapiens
taaatattttaca

SEQ ID NO: 2123115 - DNA, 15 bp, Homo sapiens
taaatcaactccagc

SEQ ID NO: 2123116 - DNA, 23 bp, Homo sapiens
taaatcaatgtcacttaaaggct

SEQ ID NO: 2123117 - DNA, 16 bp, Homo sapiens
taaatcacgctttttg

SEQ ID NO: 2123118 - DNA, 19 bp, Homo sapiens
taaatcacgctttttgaaa

SEQ ID NO: 2123119 - DNA, 22 bp, Homo sapiens
taaatcacgctttttgaaaaag

SEQ ID NO: 2123120 - DNA, 11 bp, Homo sapiens
taaatcactga

SEQ ID NO: 2123121 - DNA, 19 bp, Homo sapiens
taaatcacttgtaaataaa

SEQ ID NO: 2123122 - DNA, 14 bp, Homo sapiens
taaatcattaatac

SEQ ID NO: 2123123 - DNA, 12 bp, Homo sapiens
taaatccaaaga

SEQ ID NO: 2123124 - DNA, 17 bp, Homo sapiens
taaatcctttactgtta

SEQ ID NO: 2123125 - DNA, 17 bp, Homo sapiens
taaatcctttttcttta

SEQ ID NO: 2123126 - DNA, 15 bp, Homo sapiens
taaatctagtttact

SEQ ID NO: 2123127 - DNA, 19 bp, Homo sapiens
taaatctgagcctaaatct

SEQ ID NO: 2123128 - DNA, 20 bp, Homo sapiens
taaatctgagcctaaatcta

SEQ ID NO: 2123129 - DNA, 17 bp, Homo sapiens
taaatgaaaatgtaact

SEQ ID NO: 2123130 - DNA, 18 bp, Homo sapiens
taaatgaaaatgtaactt

SEQ ID NO: 2123131 - DNA, 15 bp, Homo sapiens
taaatgaaattgtaa

SEQ ID NO: 2123132 - DNA, 17 bp, Homo sapiens
taaatgaatcttactcc

SEQ ID NO: 2123133 - DNA, 12 bp, Homo sapiens
taaatgaatgtt

SEQ ID NO: 2123134 - DNA, 13 bp, Homo sapiens
taaatgaatgttt

SEQ ID NO: 2123135 - DNA, 13 bp, Homo sapiens
taaatgacctcag

SEQ ID NO: 2123136 - DNA, 14 bp, Homo sapiens
taaatgacctcagc

SEQ ID NO: 2123137 - DNA, 17 bp, Homo sapiens
taaatgacctcagcaaa

SEQ ID NO: 2123138 - DNA, 15 bp, Homo sapiens
taaatgagctcctgc

SEQ ID NO: 2123139 - DNA, 16 bp, Homo sapiens
taaatgagctcctgcg

SEQ ID NO: 2123140 - DNA, 18 bp, Homo sapiens
taaatgcaaacactgtgt

SEQ ID NO: 2123141 - DNA, 20 bp, Homo sapiens
taaatgcaaacactgtgtat

SEQ ID NO: 2123142 - DNA, 21 bp, Homo sapiens
taaatgcatgattttatacat

SEQ ID NO: 2123143 - DNA, 22 bp, Homo sapiens
taaatgcatgattttatacata

SEQ ID NO: 2123144 - DNA, 14 bp, Homo sapiens
taaatgcattatag

SEQ ID NO: 2123145 - DNA, 17 bp, Homo sapiens
taaatggtcgcccagga

SEQ ID NO: 2123146 - DNA, 20 bp, Homo sapiens
taaatggtgggaaccctccc

SEQ ID NO: 2123147 - DNA, 23 bp, Homo sapiens
taaatggtgggaaccctccccaa

SEQ ID NO: 2123148 - DNA, 21 bp, Homo sapiens
taaatgtaccttcagaataag

SEQ ID NO: 2123149 - DNA, 13 bp, Homo sapiens
taaatgtatatac

SEQ ID NO: 2123150 - DNA, 14 bp, Homo sapiens
taaatgtatataca

SEQ ID NO: 2123151 - DNA, 15 bp, Homo sapiens
taaatgtatatacac

SEQ ID NO: 2123152 - DNA, 18 bp, Homo sapiens
taaatgtatatacacata

SEQ ID NO: 2123153 - DNA, 13 bp, Homo sapiens
taaatgtcttata

SEQ ID NO: 2123154 - DNA, 11 bp, Homo sapiens
taaatgttcaa

SEQ ID NO: 2123155 - DNA, 12 bp, Homo sapiens
taaatgttcaaa

SEQ ID NO: 2123156 - DNA, 18 bp, Homo sapiens
taaatgtttaaatataaa

SEQ ID NO: 2123157 - DNA, 12 bp, Homo sapiens
taaattaagaca

SEQ ID NO: 2123158 - DNA, 14 bp, Homo sapiens
taaattaagacttt

SEQ ID NO: 2123159 - DNA, 19 bp, Homo sapiens
taaattacaattgtcattt

SEQ ID NO: 2123160 - DNA, 23 bp, Homo sapiens
taaattaggaggctcaacaataa

SEQ ID NO: 2123161 - DNA, 17 bp, Homo sapiens
taaattataacttaaaa

SEQ ID NO: 2123162 - DNA, 16 bp, Homo sapiens
taaattatatctgagg

SEQ ID NO: 2123163 - DNA, 14 bp, Homo sapiens
taaattatttttat

SEQ ID NO: 2123164 - DNA, 21 bp, Homo sapiens
taaattcaaaccatttaattc

SEQ ID NO: 2123165 - DNA, 14 bp, Homo sapiens
taaattccactgga

SEQ ID NO: 2123166 - DNA, 18 bp, Homo sapiens
taaattctggaaatgtct

SEQ ID NO: 2123167 - DNA, 16 bp, Homo sapiens
taaattctttttcaaa

SEQ ID NO: 2123168 - DNA, 18 bp, Homo sapiens
taaattctttttcaaaaa

SEQ ID NO: 2123169 - DNA, 20 bp, Homo sapiens
taaattggaaacattttctt

SEQ ID NO: 2123170 - DNA, 17 bp, Homo sapiens
taaattggtgataagtg

SEQ ID NO: 2123171 - DNA, 23 bp, Homo sapiens
taaatttaataaaaacttcagaa

SEQ ID NO: 2123172 - DNA, 13 bp, Homo sapiens
taaatttggattt

SEQ ID NO: 2123173 - DNA, 23 bp, Homo sapiens
taaatttgtccaatggctgtaaa

SEQ ID NO: 2123174 - DNA, 15 bp, Homo sapiens
taaatttttgtcatt

SEQ ID NO: 2123175 - DNA, 14 bp, Homo sapiens
taacaaaatcacaa

SEQ ID NO: 2123176 - DNA, 12 bp, Homo sapiens
taacaaatgaac

SEQ ID NO: 2123177 - DNA, 12 bp, Homo sapiens
taacaaattatg

SEQ ID NO: 2123178 - DNA, 11 bp, Homo sapiens
taacaacaatg

SEQ ID NO: 2123179 - DNA, 23 bp, Homo sapiens
taacaacaatggtttacatgaac

SEQ ID NO: 2123180 - DNA, 16 bp, Homo sapiens
taacaagatctttcag

SEQ ID NO: 2123181 - DNA, 18 bp, Homo sapiens
taacaagatctttcagga

SEQ ID NO: 2123182 - DNA, 14 bp, Homo sapiens
taacaaggttcttc

SEQ ID NO: 2123183 - DNA, 22 bp, Homo sapiens
taacaatgtatgtgaaagtgta

SEQ ID NO: 2123184 - DNA, 13 bp, Homo sapiens
taacaatttcctt

SEQ ID NO: 2123185 - DNA, 15 bp, Homo sapiens
taacaatttccttta

SEQ ID NO: 2123186 - DNA, 18 bp, Homo sapiens
taacacataactagaaac

SEQ ID NO: 2123187 - DNA, 14 bp, Homo sapiens
taacacatgtcctt

SEQ ID NO: 2123188 - DNA, 16 bp, Homo sapiens
taacactataaaggtt

SEQ ID NO: 2123189 - DNA, 19 bp, Homo sapiens
taacaggcagatacaggaa

SEQ ID NO: 2123190 - DNA, 16 bp, Homo sapiens
taacaggtctcctctt

SEQ ID NO: 2123191 - DNA, 23 bp, Homo sapiens
taacagtatttgtacaaatactg

SEQ ID NO: 2123192 - DNA, 15 bp, Homo sapiens
taacataaaatctgt

SEQ ID NO: 2123193 - DNA, 23 bp, Homo sapiens
taacatatttactaagccacaag

SEQ ID NO: 2123194 - DNA, 23 bp, Homo sapiens
taacatcatcaggcttggaatga

SEQ ID NO: 2123195 - DNA, 13 bp, Homo sapiens
taacatctgagaa

SEQ ID NO: 2123196 - DNA, 22 bp, Homo sapiens
taacatgaaaaacacggcagct

SEQ ID NO: 2123197 - DNA, 14 bp, Homo sapiens
taacattgacttct

SEQ ID NO: 2123198 - DNA, 14 bp, Homo sapiens
taacattgatttat

SEQ ID NO: 2123199 - DNA, 20 bp, Homo sapiens
taacatttatctaaaagaat

SEQ ID NO: 2123200 - DNA, 13 bp, Homo sapiens
taacattttaaat

SEQ ID NO: 2123201 - DNA, 17 bp, Homo sapiens
taaccagtacttctaag

SEQ ID NO: 2123202 - DNA, 18 bp, Homo sapiens
taaccagtacttctaaga

SEQ ID NO: 2123203 - DNA, 18 bp, Homo sapiens
gtttttttacaacattca

SEQ ID NO: 2123204 - DNA, 20 bp, Homo sapiens
gttttttttaaataaaagca

SEQ ID NO: 2123205 - DNA, 12 bp, Homo sapiens
taaaaaaaagaa

SEQ ID NO: 2123206 - DNA, 21 bp, Homo sapiens
taaaaaaacaatcatttgctt

SEQ ID NO: 2123207 - DNA, 14 bp, Homo sapiens
taaaaaaagtatat

SEQ ID NO: 2123208 - DNA, 22 bp, Homo sapiens
taaaaaaataagaagaatgctt

SEQ ID NO: 2123209 - DNA, 13 bp, Homo sapiens
taaaaaaatgaca

SEQ ID NO: 2123210 - DNA, 17 bp, Homo sapiens
taaaaaactaaaaacta

SEQ ID NO: 2123211 - DNA, 18 bp, Homo sapiens
taaaaaagcttaaaactt

SEQ ID NO: 2123212 - DNA, 13 bp, Homo sapiens
taaaaaataaaaa

SEQ ID NO: 2123213 - DNA, 15 bp, Homo sapiens
taaaaaatggaaaga

SEQ ID NO: 2123214 - DNA, 21 bp, Homo sapiens
taaaaaatgtctatagagaaa

SEQ ID NO: 2123215 - DNA, 16 bp, Homo sapiens
taaaaaattaaagccc

SEQ ID NO: 2123216 - DNA, 18 bp, Homo sapiens
taaaaaattaaagcccat

SEQ ID NO: 2123217 - DNA, 15 bp, Homo sapiens
taaaaacatgagaaa

SEQ ID NO: 2123218 - DNA, 19 bp, Homo sapiens
taaaaacatgagaaatgtg

SEQ ID NO: 2123219 - DNA, 20 bp, Homo sapiens
taaaaacatgagaaatgtga

SEQ ID NO: 2123220 - DNA, 16 bp, Homo sapiens
taaaaactgactcctt

SEQ ID NO: 2123221 - DNA, 21 bp, Homo sapiens
taaaaactgagtgactctata

SEQ ID NO: 2123222 - DNA, 23 bp, Homo sapiens
taaaaagactattaagagcaata

SEQ ID NO: 2123223 - DNA, 19 bp, Homo sapiens
taaaaagagagaaaactta

SEQ ID NO: 2123224 - DNA, 22 bp, Homo sapiens
taaaaagaggatgatttcagaa

SEQ ID NO: 2123225 - DNA, 12 bp, Homo sapiens
taaaaagattat

SEQ ID NO: 2123226 - DNA, 14 bp, Homo sapiens
taaaaagattatat

SEQ ID NO: 2123227 - DNA, 19 bp, Homo sapiens
taaaaagattatatatcat

SEQ ID NO: 2123228 - DNA, 13 bp, Homo sapiens
taaaaagatttgt

SEQ ID NO: 2123229 - DNA, 22 bp, Homo sapiens
taaaaagtaattgtagatggaa

SEQ ID NO: 2123230 - DNA, 17 bp, Homo sapiens
taaaaataaaatgatgt

SEQ ID NO: 2123231 - DNA, 20 bp, Homo sapiens
taaaaataaagctactgaat

SEQ ID NO: 2123232 - DNA, 15 bp, Homo sapiens
taaaaataagcttta

SEQ ID NO: 2123233 - DNA, 21 bp, Homo sapiens
taaaaatactatgaaatgaaa

SEQ ID NO: 2123234 - DNA, 13 bp, Homo sapiens
taaaaatataaga

SEQ ID NO: 2123235 - DNA, 13 bp, Homo sapiens
taaaaatatatat

SEQ ID NO: 2123236 - DNA, 22 bp, Homo sapiens
taaaaatatatatagtgctata

SEQ ID NO: 2123237 - DNA, 10 bp, Homo sapiens
taaaaatatt

SEQ ID NO: 2123238 - DNA, 17 bp, Homo sapiens
taaaaatctttgattca

SEQ ID NO: 2123239 - DNA, 15 bp, Homo sapiens
taaaaatgatctaaa

SEQ ID NO: 2123240 - DNA, 11 bp, Homo sapiens
taaaaatgcaa

SEQ ID NO: 2123241 - DNA, 16 bp, Homo sapiens
taaaaatttgtttaaa

SEQ ID NO: 2123242 - DNA, 12 bp, Homo sapiens
gtttatttcatg

SEQ ID NO: 2123243 - DNA, 21 bp, Homo sapiens
gtttatttccaaataaaatga

SEQ ID NO: 2123244 - DNA, 15 bp, Homo sapiens
gtttcaattcagtgc

SEQ ID NO: 2123245 - DNA, 23 bp, Homo sapiens
gtttcacagcctataaccagaca

SEQ ID NO: 2123246 - DNA, 12 bp, Homo sapiens
gtttcaccattt

SEQ ID NO: 2123247 - DNA, 21 bp, Homo sapiens
gtttcactatgattttctatt

SEQ ID NO: 2123248 - DNA, 17 bp, Homo sapiens
gtttcagatatatatca

SEQ ID NO: 2123249 - DNA, 21 bp, Homo sapiens
gtttcagctgacagctgctca

SEQ ID NO: 2123250 - DNA, 22 bp, Homo sapiens
gtttcaggagagagttgaacct

SEQ ID NO: 2123251 - DNA, 23 bp, Homo sapiens
gtttcaggagagagttgaaccta

SEQ ID NO: 2123252 - DNA, 18 bp, Homo sapiens
gtttcatgttttgtgact

SEQ ID NO: 2123253 - DNA, 19 bp, Homo sapiens
gtttcatttctactgtgac

SEQ ID NO: 2123254 - DNA, 22 bp, Homo sapiens
gtttccaaaaaggaacactgga

SEQ ID NO: 2123255 - DNA, 23 bp, Homo sapiens
gtttccactgtcttgcctgccag

SEQ ID NO: 2123256 - DNA, 13 bp, Homo sapiens
gtttccagaaaat

SEQ ID NO: 2123257 - DNA, 19 bp, Homo sapiens
gtttccagaaaatataaat

SEQ ID NO: 2123258 - DNA, 22 bp, Homo sapiens
gtttccagaaaatataaatgca

SEQ ID NO: 2123259 - DNA, 12 bp, Homo sapiens
gtttccaggaag

SEQ ID NO: 2123260 - DNA, 16 bp, Homo sapiens
gtttcccaaattccct

SEQ ID NO: 2123261 - DNA, 20 bp, Homo sapiens
gtttcccaaattccctggac

SEQ ID NO: 2123262 - DNA, 20 bp, Homo sapiens
gtttcccataattttcttca

SEQ ID NO: 2123263 - DNA, 17 bp, Homo sapiens
gtttctaaaactatggt

SEQ ID NO: 2123264 - DNA, 16 bp, Homo sapiens
gtttctagaggcctca

SEQ ID NO: 2123265 - DNA, 17 bp, Homo sapiens
gtttctagaggcctcag

SEQ ID NO: 2123266 - DNA, 18 bp, Homo sapiens
gtttctagaggcctcagt

SEQ ID NO: 2123267 - DNA, 17 bp, Homo sapiens
gtttctccccctgggct

SEQ ID NO: 2123268 - DNA, 20 bp, Homo sapiens
gtttctgaaaattaacactg

SEQ ID NO: 2123269 - DNA, 21 bp, Homo sapiens
gtttctgaaaattaacactgc

SEQ ID NO: 2123270 - DNA, 18 bp, Homo sapiens
gtttctgaatgacatcaa

SEQ ID NO: 2123271 - DNA, 17 bp, Homo sapiens
gtttctgagaaaagaac

SEQ ID NO: 2123272 - DNA, 21 bp, Homo sapiens
gtttctgcccacattggaccc

SEQ ID NO: 2123273 - DNA, 23 bp, Homo sapiens
gtttcttgcctcatttttttcct

SEQ ID NO: 2123274 - DNA, 18 bp, Homo sapiens
gtttcttggtctcagctt

SEQ ID NO: 2123275 - DNA, 15 bp, Homo sapiens
gtttctttctgttat

SEQ ID NO: 2123276 - DNA, 19 bp, Homo sapiens
gtttctttttttatgactg

SEQ ID NO: 2123277 - DNA, 19 bp, Homo sapiens
gtttgaaagtgaataaact

SEQ ID NO: 2123278 - DNA, 13 bp, Homo sapiens
gtttgaatataaa

SEQ ID NO: 2123279 - DNA, 13 bp, Homo sapiens
gtttgacctcaca

SEQ ID NO: 2123280 - DNA, 20 bp, Homo sapiens
gtttgagacaagccctggca

SEQ ID NO: 2123281 - DNA, 21 bp, Homo sapiens
gtttgagacaagccctggcaa

SEQ ID NO: 2123282 - DNA, 22 bp, Homo sapiens
gtttgagcgcagagtaaaataa

SEQ ID NO: 2123283 - DNA, 16 bp, Homo sapiens
gtttgaggttaaaata

SEQ ID NO: 2123284 - DNA, 19 bp, Homo sapiens
gtttgaggttaaaatataa

SEQ ID NO: 2123285 - DNA, 20 bp, Homo sapiens
gtttgatcacacagccactt

SEQ ID NO: 2123286 - DNA, 20 bp, Homo sapiens
gtttgatgtcattaatgtgt

SEQ ID NO: 2123287 - DNA, 15 bp, Homo sapiens
ggctgttggctgggg

SEQ ID NO: 2123288 - DNA, 18 bp, Homo sapiens
ggctgtttcgtgtagtgg

SEQ ID NO: 2123289 - DNA, 18 bp, Homo sapiens
ggctgtttgatagcagaa

SEQ ID NO: 2123290 - DNA, 14 bp, Homo sapiens
ggcttaaaagagta

SEQ ID NO: 2123291 - DNA, 14 bp, Homo sapiens
ggcttaaatgcaat

SEQ ID NO: 2123292 - DNA, 16 bp, Homo sapiens
ggcttaggtgccaggc

SEQ ID NO: 2123293 - DNA, 13 bp, Homo sapiens
ggcttataaatgt

SEQ ID NO: 2123294 - DNA, 23 bp, Homo sapiens
ggcttattcccaactgctctgcc

SEQ ID NO: 2123295 - DNA, 18 bp, Homo sapiens
ggcttattttttaaaata

SEQ ID NO: 2123296 - DNA, 18 bp, Homo sapiens
ggcttcagtggcagctgc

SEQ ID NO: 2123297 - DNA, 19 bp, Homo sapiens
ggcttcagtggcagctgct

SEQ ID NO: 2123298 - DNA, 20 bp, Homo sapiens
ggcttcagtggcagctgctt

SEQ ID NO: 2123299 - DNA, 13 bp, Homo sapiens
ggcttccaggctc

SEQ ID NO: 2123300 - DNA, 14 bp, Homo sapiens
ggcttccaggctct

SEQ ID NO: 2123301 - DNA, 18 bp, Homo sapiens
ggcttccaggctcttcct

SEQ ID NO: 2123302 - DNA, 12 bp, Homo sapiens
ggcttccaggta

SEQ ID NO: 2123303 - DNA, 17 bp, Homo sapiens
ggcttcccatccccagc

SEQ ID NO: 2123304 - DNA, 18 bp, Homo sapiens
ggcttcccgctcagccct

SEQ ID NO: 2123305 - DNA, 22 bp, Homo sapiens
ggcttcccgctcagccctccct

SEQ ID NO: 2123306 - DNA, 21 bp, Homo sapiens
ggcttcctcagttcctgccct

SEQ ID NO: 2123307 - DNA, 23 bp, Homo sapiens
ggcttcctccagcggctgggtgg

SEQ ID NO: 2123308 - DNA, 23 bp, Homo sapiens
ggcttcctccgtccacccaggct

SEQ ID NO: 2123309 - DNA, 19 bp, Homo sapiens
gggctgctcctccagggcc

SEQ ID NO: 2123310 - DNA, 11 bp, Homo sapiens
gggctgctggg

SEQ ID NO: 2123311 - DNA, 18 bp, Homo sapiens
gggctggaatctggagag

SEQ ID NO: 2123312 - DNA, 21 bp, Homo sapiens
gggctggaatctggagagcta

SEQ ID NO: 2123313 - DNA, 13 bp, Homo sapiens
gggctggcaagca

SEQ ID NO: 2123314 - DNA, 11 bp, Homo sapiens
gggctggccca

SEQ ID NO: 2123315 - DNA, 18 bp, Homo sapiens
gggctgggagctctgcag

SEQ ID NO: 2123316 - DNA, 13 bp, Homo sapiens
gggctgggcccac

SEQ ID NO: 2123317 - DNA, 21 bp, Homo sapiens
ggtagcagataaagacagctg

SEQ ID NO: 2123318 - DNA, 15 bp, Homo sapiens
ggtagcccagcactg

SEQ ID NO: 2123319 - DNA, 19 bp, Homo sapiens
ggttactcagcagcagaga

SEQ ID NO: 2123320 - DNA, 13 bp, Homo sapiens
ggttagggagggg

SEQ ID NO: 2123321 - DNA, 22 bp, Homo sapiens
gtaaatttgtccaatggctgta

SEQ ID NO: 2123322 - DNA, 15 bp, Homo sapiens
gtaacaaccagagat

SEQ ID NO: 2123323 - DNA, 15 bp, Homo sapiens
gtaacaagccagatt

SEQ ID NO: 2123324 - DNA, 19 bp, Homo sapiens
gtaacacaagccacagaag

SEQ ID NO: 2123325 - DNA, 18 bp, Homo sapiens
gtaccttgaacactgggg

SEQ ID NO: 2123326 - DNA, 14 bp, Homo sapiens
gtacgaacccctcc

SEQ ID NO: 2123327 - DNA, 16 bp, Homo sapiens
gtacgttatatattgt

SEQ ID NO: 2123328 - DNA, 18 bp, Homo sapiens
gtacgtttttgcattatt

SEQ ID NO: 2123329 - DNA, 16 bp, Homo sapiens
gtactaaggagcatga

SEQ ID NO: 2123330 - DNA, 15 bp, Homo sapiens
gtactacaatttaaa

SEQ ID NO: 2123331 - DNA, 13 bp, Homo sapiens
gtactactgctgc

SEQ ID NO: 2123332 - DNA, 19 bp, Homo sapiens
gtactagaatttgtatttt

SEQ ID NO: 2123333 - DNA, 14 bp, Homo sapiens
gtactatctgtgaa

SEQ ID NO: 2123334 - DNA, 16 bp, Homo sapiens
gtactatgttaataac

SEQ ID NO: 2123335 - DNA, 14 bp, Homo sapiens
gtactcagagcaga

SEQ ID NO: 2123336 - DNA, 15 bp, Homo sapiens
gtactcagagcagag

SEQ ID NO: 2123337 - DNA, 15 bp, Homo sapiens
gtactcctgcaaaat

SEQ ID NO: 2123338 - DNA, 16 bp, Homo sapiens
gtactcctgcaaaatt

SEQ ID NO: 2123339 - DNA, 19 bp, Homo sapiens
gtactctctgctctagcca

SEQ ID NO: 2123340 - DNA, 13 bp, Homo sapiens
gtactgcctgctt

SEQ ID NO: 2123341 - DNA, 14 bp, Homo sapiens
gtactggcatggta

SEQ ID NO: 2123342 - DNA, 20 bp, Homo sapiens
gtacttcctcctgatggcca

SEQ ID NO: 2123343 - DNA, 13 bp, Homo sapiens
gtacttcctgtgt

SEQ ID NO: 2123344 - DNA, 14 bp, Homo sapiens
gtacttctccaccc

SEQ ID NO: 2123345 - DNA, 15 bp, Homo sapiens
gtacttctccaccct

SEQ ID NO: 2123346 - DNA, 18 bp, Homo sapiens
gtacttctccaccctgct

SEQ ID NO: 2123347 - DNA, 21 bp, Homo sapiens
gtacttctccaccctgctctc

SEQ ID NO: 2123348 - DNA, 23 bp, Homo sapiens
gtactttttattcaattctgtat

SEQ ID NO: 2123349 - DNA, 13 bp, Homo sapiens
gtagaaaagctat

SEQ ID NO: 2123350 - DNA, 12 bp, Homo sapiens
gtagaaatatta

SEQ ID NO: 2123351 - DNA, 18 bp, Homo sapiens
gtagaaattgttcctgat

SEQ ID NO: 2123352 - DNA, 16 bp, Homo sapiens
gtagaagatggactct

SEQ ID NO: 2123353 - DNA, 17 bp, Homo sapiens
gtagaagggttatattt

SEQ ID NO: 2123354 - DNA, 14 bp, Homo sapiens
gtagaataataata

SEQ ID NO: 2123355 - DNA, 16 bp, Homo sapiens
gtagaatgtaaagctt

SEQ ID NO: 2123356 - DNA, 15 bp, Homo sapiens
gtagacaactggtcc

SEQ ID NO: 2123357 - DNA, 19 bp, Homo sapiens
gtagacacgctcttctatt

SEQ ID NO: 2123358 - DNA, 14 bp, Homo sapiens
gtagaccaaaataa

SEQ ID NO: 2123359 - DNA, 15 bp, Homo sapiens
gtagaccactgtcct

SEQ ID NO: 2123360 - DNA, 13 bp, Homo sapiens
gtagagatgtgtg

SEQ ID NO: 2123361 - DNA, 11 bp, Homo sapiens
gtagagccagg

SEQ ID NO: 2123362 - DNA, 15 bp, Homo sapiens
gtagagccagggtct

SEQ ID NO: 2123363 - DNA, 21 bp, Homo sapiens
gtagagctagaacatggagag

SEQ ID NO: 2123364 - DNA, 14 bp, Homo sapiens
gtagaggttttgtt

SEQ ID NO: 2123365 - DNA, 14 bp, Homo sapiens
gtagagtcactgac

SEQ ID NO: 2123366 - DNA, 22 bp, Homo sapiens
gtagatcatcttgaatatttgc

SEQ ID NO: 2123367 - DNA, 21 bp, Homo sapiens
gtagcaaccttcattttacat

SEQ ID NO: 2123368 - DNA, 22 bp, Homo sapiens
gtagcaaccttcattttacatt

SEQ ID NO: 2123369 - DNA, 13 bp, Homo sapiens
gtagcagaaacca

SEQ ID NO: 2123370 - DNA, 18 bp, Homo sapiens
gtagcagagtcattgtta

SEQ ID NO: 2123371 - DNA, 20 bp, Homo sapiens
gtagcagataaagacagctg

SEQ ID NO: 2123372 - DNA, 24 bp, Homo sapiens
gtagcagataaagacagctgacag

SEQ ID NO: 2123373 - DNA, 17 bp, Homo sapiens
gtagcaggtaccactga

SEQ ID NO: 2123374 - DNA, 12 bp, Homo sapiens
gtagcatgagag

SEQ ID NO: 2123375 - DNA, 16 bp, Homo sapiens
gtagcatggactctgg

SEQ ID NO: 2123376 - DNA, 18 bp, Homo sapiens
gtagccaaggtgggctga

SEQ ID NO: 2123377 - DNA, 11 bp, Homo sapiens
gtagccagccg

SEQ ID NO: 2123378 - DNA, 20 bp, Homo sapiens
gtagccatggctcaggcaag

SEQ ID NO: 2123379 - DNA, 16 bp, Homo sapiens
gtagccccagtgacag

SEQ ID NO: 2123380 - DNA, 20 bp, Homo sapiens
gtagcccggccagggcctgg

SEQ ID NO: 2123381 - DNA, 21 bp, Homo sapiens
gtagcctccgtttatgggcct

SEQ ID NO: 2123382 - DNA, 22 bp, Homo sapiens
gtagcctccgtttatgggcctt

SEQ ID NO: 2123383 - DNA, 21 bp, Homo sapiens
gtagcctcgccgtctgtgaat

SEQ ID NO: 2123384 - DNA, 12 bp, Homo sapiens
gtagcctgtgca

SEQ ID NO: 2123385 - DNA, 15 bp, Homo sapiens
gtagccttgcccgga

SEQ ID NO: 2123386 - DNA, 15 bp, Homo sapiens
gtagcgagctgctct

SEQ ID NO: 2123387 - DNA, 18 bp, Homo sapiens
gtagctcctctgctgctc

SEQ ID NO: 2123388 - DNA, 13 bp, Homo sapiens
gtagctctgcctc

SEQ ID NO: 2123389 - DNA, 18 bp, Homo sapiens
gtagctctgtccactctg

SEQ ID NO: 2123390 - DNA, 22 bp, Homo sapiens
gtagctgagctcacaaggcagc

SEQ ID NO: 2123391 - DNA, 13 bp, Homo sapiens
gtagctgtgacct

SEQ ID NO: 2123392 - DNA, 14 bp, Homo sapiens
gtagctgtgacctg

SEQ ID NO: 2123393 - DNA, 15 bp, Homo sapiens
gtagctgtgacctgc

SEQ ID NO: 2123394 - DNA, 17 bp, Homo sapiens
gtagctgtgacctgctg

SEQ ID NO: 2123395 - DNA, 18 bp, Homo sapiens
gtagctgtgacctgctga

SEQ ID NO: 2123396 - DNA, 21 bp, Homo sapiens
gtagctgtgacctgctgagct

SEQ ID NO: 2123397 - DNA, 16 bp, Homo sapiens
gtagcttaaataaatt

SEQ ID NO: 2123398 - DNA, 18 bp, Homo sapiens
gtagcttacctgacacaa

SEQ ID NO: 2123399 - DNA, 13 bp, Homo sapiens
gtaggaaatgtgg

SEQ ID NO: 2123400 - DNA, 17 bp, Homo sapiens
gtaggaatcctttgaga

SEQ ID NO: 2123401 - DNA, 21 bp, Homo sapiens
gtaggaatcctttgagaatgt

SEQ ID NO: 2123402 - DNA, 23 bp, Homo sapiens
gtaggaatgaccacgggcctcag

SEQ ID NO: 2123403 - DNA, 21 bp, Homo sapiens
gtaggagggactgtcgctgct

SEQ ID NO: 2123404 - DNA, 13 bp, Homo sapiens
gtaggcagagcct

SEQ ID NO: 2123405 - DNA, 17 bp, Homo sapiens
gtaggcatgagggatca

SEQ ID NO: 2123406 - DNA, 23 bp, Homo sapiens
gtaggcatgagggatcacagggc

SEQ ID NO: 2123407 - DNA, 13 bp, Homo sapiens
gtaggccaagctg

SEQ ID NO: 2123408 - DNA, 18 bp, Homo sapiens
gtaggcccttgtcctgcc

SEQ ID NO: 2123409 - DNA, 21 bp, Homo sapiens
gtaggcccttgtcctgccagc

SEQ ID NO: 2123410 - DNA, 23 bp, Homo sapiens
gtaggcccttgtcctgccagctg

SEQ ID NO: 2123411 - DNA, 23 bp, Homo sapiens
gtagggcgggaggatgttctggg

SEQ ID NO: 2123412 - DNA, 15 bp, Homo sapiens
gtaggggagggtggg

SEQ ID NO: 2123413 - DNA, 19 bp, Homo sapiens
gtaggtattaaagatgtgt

SEQ ID NO: 2123414 - DNA, 16 bp, Homo sapiens
gtagtataaagaaaag

SEQ ID NO: 2123415 - DNA, 13 bp, Homo sapiens
gtagtggaagagc

SEQ ID NO: 2123416 - DNA, 17 bp, Homo sapiens
gtagtggaagagcagcc

SEQ ID NO: 2123417 - DNA, 18 bp, Homo sapiens
gtagtggaagagcagcct

SEQ ID NO: 2123418 - DNA, 20 bp, Homo sapiens
gtagttccctgaaaacccag

SEQ ID NO: 2123419 - DNA, 22 bp, Homo sapiens
gtagttgatgaccaatctctgt

SEQ ID NO: 2123420 - DNA, 21 bp, Homo sapiens
gtagttttaacagaaccagag

SEQ ID NO: 2123421 - DNA, 18 bp, Homo sapiens
gtataaaatgcaaaataa

SEQ ID NO: 2123422 - DNA, 13 bp, Homo sapiens
gtataaacattaa

SEQ ID NO: 2123423 - DNA, 17 bp, Homo sapiens
gtataaactatcagttt

SEQ ID NO: 2123424 - DNA, 12 bp, Homo sapiens
gtataaagaaca

SEQ ID NO: 2123425 - DNA, 12 bp, Homo sapiens
gtataaatggtt

SEQ ID NO: 2123426 - DNA, 12 bp, Homo sapiens
gtataaatgtat

SEQ ID NO: 2123427 - DNA, 20 bp, Homo sapiens
gtataaccccaccttgccaa

SEQ ID NO: 2123428 - DNA, 14 bp, Homo sapiens
gtataatctattta

SEQ ID NO: 2123429 - DNA, 23 bp, Homo sapiens
gtataatggttgactgggtttct

SEQ ID NO: 2123430 - DNA, 22 bp, Homo sapiens
gtatacaatatataaaaatata

SEQ ID NO: 2123431 - DNA, 13 bp, Homo sapiens
gtatacacacata

SEQ ID NO: 2123432 - DNA, 21 bp, Homo sapiens
gtcacaccctccccattagta

SEQ ID NO: 2123433 - DNA, 16 bp, Homo sapiens
gtcacactgagctggg

SEQ ID NO: 2123434 - DNA, 12 bp, Homo sapiens
gtcacagctgca

SEQ ID NO: 2123435 - DNA, 20 bp, Homo sapiens
gtcacagctgcagctgggcc

SEQ ID NO: 2123436 - DNA, 19 bp, Homo sapiens
gtcacaggactctgcctcc

SEQ ID NO: 2123437 - DNA, 12 bp, Homo sapiens
gtcacaggcagg

SEQ ID NO: 2123438 - DNA, 22 bp, Homo sapiens
gtcaccaatgtacccaccgggc

SEQ ID NO: 2123439 - DNA, 14 bp, Homo sapiens
gtcaccaccctccc

SEQ ID NO: 2123440 - DNA, 13 bp, Homo sapiens
gtcaccacctctc

SEQ ID NO: 2123441 - DNA, 15 bp, Homo sapiens
gtcaccaccttccca

SEQ ID NO: 2123442 - DNA, 18 bp, Homo sapiens
gtcaccactccattccca

SEQ ID NO: 2123443 - DNA, 18 bp, Homo sapiens
gtcaccaggaatgttaaa

SEQ ID NO: 2123444 - DNA, 20 bp, Homo sapiens
gtcacccaggctggagtaca

SEQ ID NO: 2123445 - DNA, 16 bp, Homo sapiens
gtcaccctccacctct

SEQ ID NO: 2123446 - DNA, 16 bp, Homo sapiens
gtcaccctgcagagct

SEQ ID NO: 2123447 - DNA, 13 bp, Homo sapiens
gtcaccctggccc

SEQ ID NO: 2123448 - DNA, 16 bp, Homo sapiens
gtcaccctggccccaa

SEQ ID NO: 2123449 - DNA, 15 bp, Homo sapiens
gtcacccttctgggc

SEQ ID NO: 2123450 - DNA, 17 bp, Homo sapiens
gtcacccttctgggcaa

SEQ ID NO: 2123451 - DNA, 21 bp, Homo sapiens
gtcacctcagagacatacacc

SEQ ID NO: 2123452 - DNA, 14 bp, Homo sapiens
gtcacctcctccac

SEQ ID NO: 2123453 - DNA, 16 bp, Homo sapiens
gtcacctcctccactc

SEQ ID NO: 2123454 - DNA, 18 bp, Homo sapiens
gtcacctgcaagccccag

SEQ ID NO: 2123455 - DNA, 24 bp, Homo sapiens
gtcacctgcaagccccagggcctg

SEQ ID NO: 2123456 - DNA, 16 bp, Homo sapiens
gtcacgtgaaatattt

SEQ ID NO: 2123457 - DNA, 14 bp, Homo sapiens
gtcactactcacag

SEQ ID NO: 2123458 - DNA, 17 bp, Homo sapiens
gtcactactcacagtct

SEQ ID NO: 2123459 - DNA, 22 bp, Homo sapiens
gtcactactcacagtctcttta

SEQ ID NO: 2123460 - DNA, 16 bp, Homo sapiens
gtcactagcagctgca

SEQ ID NO: 2123461 - DNA, 11 bp, Homo sapiens
gtcactcccag

SEQ ID NO: 2123462 - DNA, 19 bp, Homo sapiens
gtcactgaccctggagcgg

SEQ ID NO: 2123463 - DNA, 15 bp, Homo sapiens
gtcactgctctggac

SEQ ID NO: 2123464 - DNA, 17 bp, Homo sapiens
gtcactgtccctcaaat

SEQ ID NO: 2123465 - DNA, 17 bp, Homo sapiens
gtcagaagcaggttctt

SEQ ID NO: 2123466 - DNA, 18 bp, Homo sapiens
gtcagacatccatgtttg

SEQ ID NO: 2123467 - DNA, 15 bp, Homo sapiens
gtcagactttaaaga

SEQ ID NO: 2123468 - DNA, 16 bp, Homo sapiens
gtcagactttaaagaa

SEQ ID NO: 2123469 - DNA, 19 bp, Homo sapiens
gtcagagctatgttccctc

SEQ ID NO: 2123470 - DNA, 17 bp, Homo sapiens
gtcagagctgttggcct

SEQ ID NO: 2123471 - DNA, 23 bp, Homo sapiens
gtcagagtaacatgccagcttcc

SEQ ID NO: 2123472 - DNA, 18 bp, Homo sapiens
gtcagccacacctgtcag

SEQ ID NO: 2123473 - DNA, 11 bp, Homo sapiens
gtcagccaggg

SEQ ID NO: 2123474 - DNA, 12 bp, Homo sapiens
gtcagccagggc

SEQ ID NO: 2123475 - DNA, 16 bp, Homo sapiens
gtcagcccacagcagc

SEQ ID NO: 2123476 - DNA, 22 bp, Homo sapiens
gtcagccttgcatcaagggctt

SEQ ID NO: 2123477 - DNA, 22 bp, Homo sapiens
gtcagctcccctcggagaagag

SEQ ID NO: 2123478 - DNA, 16 bp, Homo sapiens
gtcaggaacagaagga

SEQ ID NO: 2123479 - DNA, 18 bp, Homo sapiens
gtcaggacaccagcctgg

SEQ ID NO: 2123480 - DNA, 14 bp, Homo sapiens
gtcaggacccaggc

SEQ ID NO: 2123481 - DNA, 15 bp, Homo sapiens
gtcaggacccaggcc

SEQ ID NO: 2123482 - DNA, 19 bp, Homo sapiens
gtcaggacccaggccgcct

SEQ ID NO: 2123483 - DNA, 15 bp, Homo sapiens
gtcaggacctccggg

SEQ ID NO: 2123484 - DNA, 15 bp, Homo sapiens
gtcaggacctggctt

SEQ ID NO: 2123485 - DNA, 21 bp, Homo sapiens
gtcaggcccttattttcaaga

SEQ ID NO: 2123486 - DNA, 19 bp, Homo sapiens
gtcaggcggggtgctgtgg

SEQ ID NO: 2123487 - DNA, 17 bp, Homo sapiens
gtcaggctccattagga

SEQ ID NO: 2123488 - DNA, 12 bp, Homo sapiens
gtcagggcagta

SEQ ID NO: 2123489 - DNA, 16 bp, Homo sapiens
gtcaggtggggcagct

SEQ ID NO: 2123490 - DNA, 19 bp, Homo sapiens
gtcagtaggtccaagggcc

SEQ ID NO: 2123491 - DNA, 21 bp, Homo sapiens
gtcagtaggtccaagggccat

SEQ ID NO: 2123492 - DNA, 22 bp, Homo sapiens
gtcagtcatgatggcaccactg

SEQ ID NO: 2123493 - DNA, 22 bp, Homo sapiens
gtcagtgggaacgtgactgccc

SEQ ID NO: 2123494 - DNA, 15 bp, Homo sapiens
gtcagtgtggagagg

SEQ ID NO: 2123495 - DNA, 22 bp, Homo sapiens
gtcagttcccggagcacagccc

SEQ ID NO: 2123496 - DNA, 17 bp, Homo sapiens
gtcagttggagaaaatg

SEQ ID NO: 2123497 - DNA, 13 bp, Homo sapiens
gtcatagaaatta

SEQ ID NO: 2123498 - DNA, 19 bp, Homo sapiens
gtcatataaacctgatgtt

SEQ ID NO: 2123499 - DNA, 21 bp, Homo sapiens
gtcatatattcatgtaataaa

SEQ ID NO: 2123500 - DNA, 18 bp, Homo sapiens
gtcatatgtaggtgtctg

SEQ ID NO: 2123501 - DNA, 17 bp, Homo sapiens
gtcatattaaacttctg

SEQ ID NO: 2123502 - DNA, 23 bp, Homo sapiens
gtcatcaattaaaggcaaaggca

SEQ ID NO: 2123503 - DNA, 16 bp, Homo sapiens
gtcatcacttttcagt

SEQ ID NO: 2123504 - DNA, 12 bp, Homo sapiens
gtcatccacagc

SEQ ID NO: 2123505 - DNA, 19 bp, Homo sapiens
gtcatcggaggctgggccc

SEQ ID NO: 2123506 - DNA, 15 bp, Homo sapiens
gtcatctagcccctt

SEQ ID NO: 2123507 - DNA, 15 bp, Homo sapiens
gtcatctctctgggg

SEQ ID NO: 2123508 - DNA, 19 bp, Homo sapiens
gtcatctgcggggcttctg

SEQ ID NO: 2123509 - DNA, 20 bp, Homo sapiens
gtcatctgcggggcttctgg

SEQ ID NO: 2123510 - DNA, 14 bp, Homo sapiens
gtcatgaagcccaa

SEQ ID NO: 2123511 - DNA, 23 bp, Homo sapiens
gtcatgagagaatgggtttactc

SEQ ID NO: 2123512 - DNA, 19 bp, Homo sapiens
gtcatgatctccctgccgc

SEQ ID NO: 2123513 - DNA, 20 bp, Homo sapiens
gtcatgctgctgttgctgga

SEQ ID NO: 2123514 - DNA, 14 bp, Homo sapiens
gtcatgtaccatca

SEQ ID NO: 2123515 - DNA, 17 bp, Homo sapiens
gtcatgtgtgcatgtga

SEQ ID NO: 2123516 - DNA, 19 bp, Homo sapiens
gtcatgtgtgcatgtgagc

SEQ ID NO: 2123517 - DNA, 20 bp, Homo sapiens
gtcatgtgtgcatgtgagca

SEQ ID NO: 2123518 - DNA, 15 bp, Homo sapiens
gtcattactaaccat

SEQ ID NO: 2123519 - DNA, 23 bp, Homo sapiens
gtcattcttaagatttctcctga

SEQ ID NO: 2123520 - DNA, 16 bp, Homo sapiens
gtcatttattttaaaa

SEQ ID NO: 2123521 - DNA, 15 bp, Homo sapiens
gtcatttcatttcct

SEQ ID NO: 2123522 - DNA, 16 bp, Homo sapiens
gtcattttaaaatctg

SEQ ID NO: 2123523 - DNA, 17 bp, Homo sapiens
gtcattttaaaatctga

SEQ ID NO: 2123524 - DNA, 21 bp, Homo sapiens
gtcattttaaaatctgattta

SEQ ID NO: 2123525 - DNA, 21 bp, Homo sapiens
gtcattttaactttatcacat

SEQ ID NO: 2123526 - DNA, 20 bp, Homo sapiens
gtcattttggtactttggtg

SEQ ID NO: 2123527 - DNA, 14 bp, Homo sapiens
gtccaacctaaccc

SEQ ID NO: 2123528 - DNA, 15 bp, Homo sapiens
gtccaacctgcctgt

SEQ ID NO: 2123529 - DNA, 16 bp, Homo sapiens
gtccaacctgcctgtg

SEQ ID NO: 2123530 - DNA, 17 bp, Homo sapiens
gtccaatggctgtaaac

SEQ ID NO: 2123531 - DNA, 20 bp, Homo sapiens
gtccaatggctgtaaactat

SEQ ID NO: 2123532 - DNA, 13 bp, Homo sapiens
gtccacaggggca

SEQ ID NO: 2123533 - DNA, 22 bp, Homo sapiens
gtccacaggggcaggcctggga

SEQ ID NO: 2123534 - DNA, 21 bp, Homo sapiens
gtcctgcaatctccagggctg

SEQ ID NO: 2123535 - DNA, 20 bp, Homo sapiens
gtcctgcagaggaccacagt

SEQ ID NO: 2123536 - DNA, 12 bp, Homo sapiens
gtcctgccagct

SEQ ID NO: 2123537 - DNA, 15 bp, Homo sapiens
gtcctgccagctgcc

SEQ ID NO: 2123538 - DNA, 16 bp, Homo sapiens
gtcctgccagctgcct

SEQ ID NO: 2123539 - DNA, 21 bp, Homo sapiens
gtcctgcccatgtgtcccctc

SEQ ID NO: 2123540 - DNA, 21 bp, Homo sapiens
gtcctgcccccgacagcccag

SEQ ID NO: 2123541 - DNA, 22 bp, Homo sapiens
gtcctgccttgatgaagcctgt

SEQ ID NO: 2123542 - DNA, 19 bp, Homo sapiens
gtcctgcgtcgaagctttg

SEQ ID NO: 2123543 - DNA, 17 bp, Homo sapiens
gtcctgctctcttcagg

SEQ ID NO: 2123544 - DNA, 21 bp, Homo sapiens
gtcctgctctcttcaggaggc

SEQ ID NO: 2123545 - DNA, 16 bp, Homo sapiens
gtcctgctggcacctc

SEQ ID NO: 2123546 - DNA, 12 bp, Homo sapiens
gtcctggcccca

SEQ ID NO: 2123547 - DNA, 13 bp, Homo sapiens
gtcctggctgctc

SEQ ID NO: 2123548 - DNA, 23 bp, Homo sapiens
gtcctggcttctagatctggaac

SEQ ID NO: 2123549 - DNA, 21 bp, Homo sapiens
gtcctgggagaacctcaggct

SEQ ID NO: 2123550 - DNA, 19 bp, Homo sapiens
gtcctgggagtgagctggt

SEQ ID NO: 2123551 - DNA, 14 bp, Homo sapiens
gtcctggggcctcg

SEQ ID NO: 2123552 - DNA, 16 bp, Homo sapiens
gtcctggtacagcagg

SEQ ID NO: 2123553 - DNA, 19 bp, Homo sapiens
gtcctggtctgctcaggaa

SEQ ID NO: 2123554 - DNA, 17 bp, Homo sapiens
ggaccagcctgttggac

SEQ ID NO: 2123555 - DNA, 21 bp, Homo sapiens
ggaccaggactatagcccagg

SEQ ID NO: 2123556 - DNA, 16 bp, Homo sapiens
ggaccagtcccagagc

SEQ ID NO: 2123557 - DNA, 14 bp, Homo sapiens
ggaccatcctattt

SEQ ID NO: 2123558 - DNA, 20 bp, Homo sapiens
ggaccattgacctcagctgc

SEQ ID NO: 2123559 - DNA, 12 bp, Homo sapiens
ggacccaccaaa

SEQ ID NO: 2123560 - DNA, 18 bp, Homo sapiens
ggacccaccaaactgcac

SEQ ID NO: 2123561 - DNA, 23 bp, Homo sapiens
ggacccagccgccatcagcccaa

SEQ ID NO: 2123562 - DNA, 13 bp, Homo sapiens
ggacccagctact

SEQ ID NO: 2123563 - DNA, 14 bp, Homo sapiens
ggacccagctactc

SEQ ID NO: 2123564 - DNA, 20 bp, Homo sapiens
ggacccagctactctgtcca

SEQ ID NO: 2123565 - DNA, 21 bp, Homo sapiens
ggacccagctactctgtccag

SEQ ID NO: 2123566 - DNA, 22 bp, Homo sapiens
ggacccagctactctgtccagg

SEQ ID NO: 2123567 - DNA, 11 bp, Homo sapiens
ggacccaggcc

SEQ ID NO: 2123568 - DNA, 20 bp, Homo sapiens
ggaccccagctagggctgga

SEQ ID NO: 2123569 - DNA, 18 bp, Homo sapiens
ggaccccgcctcccagcc

SEQ ID NO: 2123570 - DNA, 14 bp, Homo sapiens
ggacccctcccttg

SEQ ID NO: 2123571 - DNA, 21 bp, Homo sapiens
ggacccctcccttgctcagtg

SEQ ID NO: 2123572 - DNA, 23 bp, Homo sapiens
ggacccctcccttgctcagtgcc

SEQ ID NO: 2123573 - DNA, 20 bp, Homo sapiens
ggacccgaagcccaggctga

SEQ ID NO: 2123574 - DNA, 20 bp, Homo sapiens
ggaccctcgcagcaggtgca

SEQ ID NO: 2123575 - DNA, 17 bp, Homo sapiens
ggaccctgttttccaca

SEQ ID NO: 2123576 - DNA, 18 bp, Homo sapiens
ggaccctgttttccacac

SEQ ID NO: 2123577 - DNA, 17 bp, Homo sapiens
ggaccctttccttcctt

SEQ ID NO: 2123578 - DNA, 23 bp, Homo sapiens
ggaccctttccttccttccctgg

SEQ ID NO: 2123579 - DNA, 16 bp, Homo sapiens
ggaccgcgtagagagc

SEQ ID NO: 2123580 - DNA, 21 bp, Homo sapiens
ggaccgctacaccactctggc

SEQ ID NO: 2123581 - DNA, 15 bp, Homo sapiens
ggaccgggtgggcct

SEQ ID NO: 2123582 - DNA, 20 bp, Homo sapiens
ggaccgggtgggcctggcct

SEQ ID NO: 2123583 - DNA, 21 bp, Homo sapiens
ggaccgggtgggcctggcctg

SEQ ID NO: 2123584 - DNA, 16 bp, Homo sapiens
ggacctcaggcgggga

SEQ ID NO: 2123585 - DNA, 17 bp, Homo sapiens
ggacctcaggcggggag

SEQ ID NO: 2123586 - DNA, 21 bp, Homo sapiens
ggacctcatatcttcctcatc

SEQ ID NO: 2123587 - DNA, 12 bp, Homo sapiens
ggacctctgctc

SEQ ID NO: 2123588 - DNA, 20 bp, Homo sapiens
ggacctgagcctgccgagca

SEQ ID NO: 2123589 - DNA, 12 bp, Homo sapiens
ggaccttcctgc

SEQ ID NO: 2123590 - DNA, 18 bp, Homo sapiens
ggaccttgaactgggtac

SEQ ID NO: 2123591 - DNA, 16 bp, Homo sapiens
ggacctttggggaagg

SEQ ID NO: 2123592 - DNA, 22 bp, Homo sapiens
ggacgagggatgggatttcatg

SEQ ID NO: 2123593 - DNA, 23 bp, Homo sapiens
ggacgatagcttggagggatgga

SEQ ID NO: 2123594 - DNA, 16 bp, Homo sapiens
ggacgcgcacacacac

SEQ ID NO: 2123595 - DNA, 19 bp, Homo sapiens
ggacgcgggctgtgcctta

SEQ ID NO: 2123596 - DNA, 12 bp, Homo sapiens
ggacgcttccag

SEQ ID NO: 2123597 - DNA, 15 bp, Homo sapiens
ggacgcttccagacc

SEQ ID NO: 2123598 - DNA, 18 bp, Homo sapiens
ggacgcttccagaccacc

SEQ ID NO: 2123599 - DNA, 21 bp, Homo sapiens
ggacgtcatcggaggctgggc

SEQ ID NO: 2123600 - DNA, 20 bp, Homo sapiens
ggacgtcctgctggcacctc

SEQ ID NO: 2123601 - DNA, 22 bp, Homo sapiens
ggactaacactcagaagcctgg

SEQ ID NO: 2123602 - DNA, 21 bp, Homo sapiens
ggactaacataaaatctgtga

SEQ ID NO: 2123603 - DNA, 14 bp, Homo sapiens
ggactagaacctgg

SEQ ID NO: 2123604 - DNA, 16 bp, Homo sapiens
ggactagagctttctt

SEQ ID NO: 2123605 - DNA, 18 bp, Homo sapiens
ggactcaagggtccagaa

SEQ ID NO: 2123606 - DNA, 23 bp, Homo sapiens
ggactcaccctcataccatctgc

SEQ ID NO: 2123607 - DNA, 13 bp, Homo sapiens
ggactccagttca

SEQ ID NO: 2123608 - DNA, 13 bp, Homo sapiens
ggactcccagtga

SEQ ID NO: 2123609 - DNA, 13 bp, Homo sapiens
ggactcctcccac

SEQ ID NO: 2123610 - DNA, 12 bp, Homo sapiens
ggactcctctgt

SEQ ID NO: 2123611 - DNA, 15 bp, Homo sapiens
ggactcctctgtcca

SEQ ID NO: 2123612 - DNA, 21 bp, Homo sapiens
ggactctgccccttctgtttc

SEQ ID NO: 2123613 - DNA, 14 bp, Homo sapiens
ggactctggcctct

SEQ ID NO: 2123614 - DNA, 22 bp, Homo sapiens
ggcccgagcagctgagcagggc

SEQ ID NO: 2123615 - DNA, 12 bp, Homo sapiens
ggcccgcccctc

SEQ ID NO: 2123616 - DNA, 21 bp, Homo sapiens
ggcccgcccctcgctgctgct

SEQ ID NO: 2123617 - DNA, 22 bp, Homo sapiens
ggcccggggctggcggctactc

SEQ ID NO: 2123618 - DNA, 22 bp, Homo sapiens
ggccctaggattcctcccccag

SEQ ID NO: 2123619 - DNA, 14 bp, Homo sapiens
ggccctccatgggc

SEQ ID NO: 2123620 - DNA, 17 bp, Homo sapiens
ggccctccatgggctag

SEQ ID NO: 2123621 - DNA, 19 bp, Homo sapiens
ggccctccctgactccctg

SEQ ID NO: 2123622 - DNA, 21 bp, Homo sapiens
ggccctccctgactccctgtg

SEQ ID NO: 2123623 - DNA, 22 bp, Homo sapiens
ggccctccctgactccctgtgg

SEQ ID NO: 2123624 - DNA, 19 bp, Homo sapiens
ggccctcttcttattcatg

SEQ ID NO: 2123625 - DNA, 18 bp, Homo sapiens
ggccctgaaggttcctga

SEQ ID NO: 2123626 - DNA, 19 bp, Homo sapiens
ggccctgagctcggtggac

SEQ ID NO: 2123627 - DNA, 12 bp, Homo sapiens
ggccctgcccca

SEQ ID NO: 2123628 - DNA, 13 bp, Homo sapiens
ggccctgccccat

SEQ ID NO: 2123629 - DNA, 20 bp, Homo sapiens
ggccctgccccatcctgggc

SEQ ID NO: 2123630 - DNA, 21 bp, Homo sapiens
ggccctgccccatcctgggcc

SEQ ID NO: 2123631 - DNA, 22 bp, Homo sapiens
ggccctgccccatcctgggcct

SEQ ID NO: 2123632 - DNA, 15 bp, Homo sapiens
ggccctgccctctcc

SEQ ID NO: 2123633 - DNA, 21 bp, Homo sapiens
ggccctgccctctccttcctt

SEQ ID NO: 2123634 - DNA, 14 bp, Homo sapiens
ggccctgccttctt

SEQ ID NO: 2123635 - DNA, 20 bp, Homo sapiens
ggccctggatgtgcccacag

SEQ ID NO: 2123636 - DNA, 22 bp, Homo sapiens
ggccctggatgtgcccacaggg

SEQ ID NO: 2123637 - DNA, 12 bp, Homo sapiens
ggccctggcctg

SEQ ID NO: 2123638 - DNA, 13 bp, Homo sapiens
ggccctggctccc

SEQ ID NO: 2123639 - DNA, 13 bp, Homo sapiens
ggccctggggcct

SEQ ID NO: 2123640 - DNA, 14 bp, Homo sapiens
ggccctggggcctg

SEQ ID NO: 2123641 - DNA, 18 bp, Homo sapiens
ggccctggggcctgtact

SEQ ID NO: 2123642 - DNA, 18 bp, Homo sapiens
ggccctggtgtcaggcag

SEQ ID NO: 2123643 - DNA, 12 bp, Homo sapiens
ggccctgtccca

SEQ ID NO: 2123644 - DNA, 16 bp, Homo sapiens
ggccctgtcccagcag

SEQ ID NO: 2123645 - DNA, 17 bp, Homo sapiens
ggcccttagctctcccg

SEQ ID NO: 2123646 - DNA, 13 bp, Homo sapiens
ggcccttcctctc

SEQ ID NO: 2123647 - DNA, 23 bp, Homo sapiens
ggcccttcctctccactgccttc

SEQ ID NO: 2123648 - DNA, 12 bp, Homo sapiens
ggcccttcctgg

SEQ ID NO: 2123649 - DNA, 20 bp, Homo sapiens
ggcccttcctggacagctgt

SEQ ID NO: 2123650 - DNA, 15 bp, Homo sapiens
ggcccttggggcctg

SEQ ID NO: 2123651 - DNA, 18 bp, Homo sapiens
ggcccttggggcctggct

SEQ ID NO: 2123652 - DNA, 16 bp, Homo sapiens
ggcccttgtcctgcca

SEQ ID NO: 2123653 - DNA, 19 bp, Homo sapiens
ggcccttgtcctgccagct

SEQ ID NO: 2123654 - DNA, 15 bp, Homo sapiens
ggctcaggcaagccc

SEQ ID NO: 2123655 - DNA, 19 bp, Homo sapiens
ggctcaggcaagcccctca

SEQ ID NO: 2123656 - DNA, 12 bp, Homo sapiens
ggctcagggctg

SEQ ID NO: 2123657 - DNA, 16 bp, Homo sapiens
ggctcagggctggagt

SEQ ID NO: 2123658 - DNA, 17 bp, Homo sapiens
ggctcagggctggagtg

SEQ ID NO: 2123659 - DNA, 23 bp, Homo sapiens
ggctcatggcgtaatgggcctgc

SEQ ID NO: 2123660 - DNA, 15 bp, Homo sapiens
ggctccagcatccag

SEQ ID NO: 2123661 - DNA, 12 bp, Homo sapiens
ggctccaggctc

SEQ ID NO: 2123662 - DNA, 13 bp, Homo sapiens
ggctccaggtccg

SEQ ID NO: 2123663 - DNA, 22 bp, Homo sapiens
ggctccagtttccccatggggc

SEQ ID NO: 2123664 - DNA, 12 bp, Homo sapiens
ggctccatggag

SEQ ID NO: 2123665 - DNA, 16 bp, Homo sapiens
ggctccatggaggagg

SEQ ID NO: 2123666 - DNA, 18 bp, Homo sapiens
ggctccatggaggaggtg

SEQ ID NO: 2123667 - DNA, 21 bp, Homo sapiens
ggctcccacaggcccttcctc

SEQ ID NO: 2123668 - DNA, 15 bp, Homo sapiens
ggctccctcctggag

SEQ ID NO: 2123669 - DNA, 15 bp, Homo sapiens
ggctcctgccactga

SEQ ID NO: 2123670 - DNA, 22 bp, Homo sapiens
ggctcctgccttgatgaagccc

SEQ ID NO: 2123671 - DNA, 13 bp, Homo sapiens
ggctcctggaaag

SEQ ID NO: 2123672 - DNA, 17 bp, Homo sapiens
ggctcctggaaccaatc

SEQ ID NO: 2123673 - DNA, 13 bp, Homo sapiens
ggctcctggctgc

SEQ ID NO: 2123674 - DNA, 17 bp, Homo sapiens
ggctcctttctccagcc

SEQ ID NO: 2123675 - DNA, 22 bp, Homo sapiens
ggctcgctccctgtagctctgc

SEQ ID NO: 2123676 - DNA, 20 bp, Homo sapiens
ggctcgggcgctgtggctcc

SEQ ID NO: 2123677 - DNA, 13 bp, Homo sapiens
ggctcgtggcctt

SEQ ID NO: 2123678 - DNA, 16 bp, Homo sapiens
ggctctaacgcctgag

SEQ ID NO: 2123679 - DNA, 19 bp, Homo sapiens
ggctctaacgcctgagccc

SEQ ID NO: 2123680 - DNA, 23 bp, Homo sapiens
ggctctaacgcctgagcccaggg

SEQ ID NO: 2123681 - DNA, 19 bp, Homo sapiens
ggctctccaaaggggctgc

SEQ ID NO: 2123682 - DNA, 21 bp, Homo sapiens
ggctctccaaaggggctgctg

SEQ ID NO: 2123683 - DNA, 16 bp, Homo sapiens
ggctctccacctcagc

SEQ ID NO: 2123684 - DNA, 15 bp, Homo sapiens
ggagggctctgaggc

SEQ ID NO: 2123685 - DNA, 14 bp, Homo sapiens
ggagggctggaatc

SEQ ID NO: 2123686 - DNA, 16 bp, Homo sapiens
ggagggctggaatctg

SEQ ID NO: 2123687 - DNA, 20 bp, Homo sapiens
ggagggctggaatctggaga

SEQ ID NO: 2123688 - DNA, 15 bp, Homo sapiens
ggaggggcctaggga

SEQ ID NO: 2123689 - DNA, 15 bp, Homo sapiens
ggaggggcctctgaa

SEQ ID NO: 2123690 - DNA, 13 bp, Homo sapiens
ggaggggcctggc

SEQ ID NO: 2123691 - DNA, 18 bp, Homo sapiens
ggaggggcctggcagccg

SEQ ID NO: 2123692 - DNA, 21 bp, Homo sapiens
ggaggggcctggcagccgtgc

SEQ ID NO: 2123693 - DNA, 18 bp, Homo sapiens
ggagggggctccatggag

SEQ ID NO: 2123694 - DNA, 21 bp, Homo sapiens
ggagggggtgtctggaagctg

SEQ ID NO: 2123695 - DNA, 13 bp, Homo sapiens
ggagggtagggga

SEQ ID NO: 2123696 - DNA, 20 bp, Homo sapiens
ggagggtgccctcctagctc

SEQ ID NO: 2123697 - DNA, 20 bp, Homo sapiens
ggaggtagaggttgtggtga

SEQ ID NO: 2123698 - DNA, 16 bp, Homo sapiens
ggaggtagctcccagc

SEQ ID NO: 2123699 - DNA, 19 bp, Homo sapiens
ggaggtcacattcaggaag

SEQ ID NO: 2123700 - DNA, 18 bp, Homo sapiens
ggaggtctccactgagga

SEQ ID NO: 2123701 - DNA, 18 bp, Homo sapiens
ggaggtgcctgagctggg

SEQ ID NO: 2123702 - DNA, 18 bp, Homo sapiens
ggaggtggctatggccac

SEQ ID NO: 2123703 - DNA, 16 bp, Homo sapiens
ggaggtggtggaggag

SEQ ID NO: 2123704 - DNA, 20 bp, Homo sapiens
ggaggtggtggaggaggagg

SEQ ID NO: 2123705 - DNA, 18 bp, Homo sapiens
ggaggttccagtgagccg

SEQ ID NO: 2123706 - DNA, 14 bp, Homo sapiens
ggaggttggtgact

SEQ ID NO: 2123707 - DNA, 15 bp, Homo sapiens
ggagtagctgagagg

SEQ ID NO: 2123708 - DNA, 19 bp, Homo sapiens
ggagtagctgagaggaaga

SEQ ID NO: 2123709 - DNA, 21 bp, Homo sapiens
ggagtagctgagaggaagatg

SEQ ID NO: 2123710 - DNA, 16 bp, Homo sapiens
ggagtagctgagctca

SEQ ID NO: 2123711 - DNA, 12 bp, Homo sapiens
ggagtagttgga

SEQ ID NO: 2123712 - DNA, 14 bp, Homo sapiens
ggagtcaactggct

SEQ ID NO: 2123713 - DNA, 23 bp, Homo sapiens
ggagtcagtaggtccaagggcca

SEQ ID NO: 2123714 - DNA, 20 bp, Homo sapiens
ggagtctgaggtcctgagca

SEQ ID NO: 2123715 - DNA, 16 bp, Homo sapiens
ggagtctgtgctcttt

SEQ ID NO: 2123716 - DNA, 23 bp, Homo sapiens
ggagtcttcggtgtttaaagtca

SEQ ID NO: 2123717 - DNA, 16 bp, Homo sapiens
ggagtgcagagaaaga

SEQ ID NO: 2123718 - DNA, 18 bp, Homo sapiens
ggagtgcagggaggagag

SEQ ID NO: 2123719 - DNA, 14 bp, Homo sapiens
ggagtgcagtgagc

SEQ ID NO: 2123720 - DNA, 13 bp, Homo sapiens
ggagtgttctgtg

SEQ ID NO: 2123721 - DNA, 19 bp, Homo sapiens
ggagtgttctgtttcccat

SEQ ID NO: 2123722 - DNA, 22 bp, Homo sapiens
ggagttagaaatctccagtgtg

SEQ ID NO: 2123723 - DNA, 14 bp, Homo sapiens
ggagttataaaaat

SEQ ID NO: 2123724 - DNA, 20 bp, Homo sapiens
ggagttcagtggtgtgatct

SEQ ID NO: 2123725 - DNA, 15 bp, Homo sapiens
ggagttccatgaaga

SEQ ID NO: 2123726 - DNA, 19 bp, Homo sapiens
ggagttccatgaagaccac

SEQ ID NO: 2123727 - DNA, 19 bp, Homo sapiens
ggagttgacgcatcctgca

SEQ ID NO: 2123728 - DNA, 20 bp, Homo sapiens
ggagttgctcactcaggact

SEQ ID NO: 2123729 - DNA, 18 bp, Homo sapiens
ggagtttgagacaagccc

SEQ ID NO: 2123730 - DNA, 19 bp, Homo sapiens
ggagtttgaggctgcagcg

SEQ ID NO: 2123731 - DNA, 11 bp, Homo sapiens
ggagtttgtgt

SEQ ID NO: 2123732 - DNA, 21 bp, Homo sapiens
ggataacaaaatcacaagcaa

SEQ ID NO: 2123733 - DNA, 19 bp, Homo sapiens
ggataatagacacatcaaa

SEQ ID NO: 2123734 - DNA, 20 bp, Homo sapiens
ggataatgctgttgcctcat

SEQ ID NO: 2123735 - DNA, 21 bp, Homo sapiens
ggatagatgaatactaaatgg

SEQ ID NO: 2123736 - DNA, 24 bp, Homo sapiens
ggatagatgtgattcctgcatttt

SEQ ID NO: 2123737 - DNA, 15 bp, Homo sapiens
ggatataaaacacat

SEQ ID NO: 2123738 - DNA, 22 bp, Homo sapiens
ggatcaaaccccgaccacctgc

SEQ ID NO: 2123739 - DNA, 14 bp, Homo sapiens
ggatcacagggccc

SEQ ID NO: 2123740 - DNA, 17 bp, Homo sapiens
ggatcactggagcccag

SEQ ID NO: 2123741 - DNA, 24 bp, Homo sapiens
ggcaggtgccctctgctccccagt

SEQ ID NO: 2123742 - DNA, 20 bp, Homo sapiens
ggcaggttagaacctagaag

SEQ ID NO: 2123743 - DNA, 16 bp, Homo sapiens
ggcaggtttgccagtg

SEQ ID NO: 2123744 - DNA, 23 bp, Homo sapiens
ggcagtcattcagcaccagagca

SEQ ID NO: 2123745 - DNA, 22 bp, Homo sapiens
ggcagtgacaagtggagggggt

SEQ ID NO: 2123746 - DNA, 13 bp, Homo sapiens
ggcagtgactggc

SEQ ID NO: 2123747 - DNA, 15 bp, Homo sapiens
ggcagtgactggcag

SEQ ID NO: 2123748 - DNA, 18 bp, Homo sapiens
ggcagtgactggcaggtg

SEQ ID NO: 2123749 - DNA, 20 bp, Homo sapiens
ggcagtgactggcaggtgca

SEQ ID NO: 2123750 - DNA, 14 bp, Homo sapiens
ggcagtgccagggc

SEQ ID NO: 2123751 - DNA, 16 bp, Homo sapiens
ggcagtgcctcctggg

SEQ ID NO: 2123752 - DNA, 21 bp, Homo sapiens
ggcagtgggacagggcatggc

SEQ ID NO: 2123753 - DNA, 13 bp, Homo sapiens
ggcagtgggagct

SEQ ID NO: 2123754 - DNA, 14 bp, Homo sapiens
ggcagtgggagctg

SEQ ID NO: 2123755 - DNA, 22 bp, Homo sapiens
ggcagtgtgtcacactgagctg

SEQ ID NO: 2123756 - DNA, 16 bp, Homo sapiens
ggcagttcgcagccac

SEQ ID NO: 2123757 - DNA, 17 bp, Homo sapiens
ggcagttcgcagccacc

SEQ ID NO: 2123758 - DNA, 18 bp, Homo sapiens
ggcagttcgcagccaccc

SEQ ID NO: 2123759 - DNA, 19 bp, Homo sapiens
ggcagttcgcagccaccct

SEQ ID NO: 2123760 - DNA, 20 bp, Homo sapiens
ggcagttcgcagccaccctg

SEQ ID NO: 2123761 - DNA, 18 bp, Homo sapiens
ggcagtttaaagcacaat

SEQ ID NO: 2123762 - DNA, 23 bp, Homo sapiens
ggcatcacagggcagagccggga

SEQ ID NO: 2123763 - DNA, 20 bp, Homo sapiens
ggcatcaggcactggtggca

SEQ ID NO: 2123764 - DNA, 20 bp, Homo sapiens
ggcatcagtgtccttggcag

SEQ ID NO: 2123765 - DNA, 18 bp, Homo sapiens
ggcatccacccagtgctg

SEQ ID NO: 2123766 - DNA, 22 bp, Homo sapiens
ggcatccacccagtgctgccat

SEQ ID NO: 2123767 - DNA, 23 bp, Homo sapiens
ggcatccacccagtgctgccatg

SEQ ID NO: 2123768 - DNA, 17 bp, Homo sapiens
ggcatccgcagcccagg

SEQ ID NO: 2123769 - DNA, 16 bp, Homo sapiens
ggcatccttctgcctt

SEQ ID NO: 2123770 - DNA, 16 bp, Homo sapiens
ggcatcgtagaagaga

SEQ ID NO: 2123771 - DNA, 22 bp, Homo sapiens
ggcatcgtagaagagatgtggc

SEQ ID NO: 2123772 - DNA, 20 bp, Homo sapiens
ggcatctacacagcctggac

SEQ ID NO: 2123773 - DNA, 21 bp, Homo sapiens
ggcatctacacagcctggact

SEQ ID NO: 2123774 - DNA, 16 bp, Homo sapiens
ggcatctccatgtaga

SEQ ID NO: 2123775 - DNA, 21 bp, Homo sapiens
ggcatctcgtgccagggcagg

SEQ ID NO: 2123776 - DNA, 22 bp, Homo sapiens
ggcatctcgtgccagggcaggc

SEQ ID NO: 2123777 - DNA, 15 bp, Homo sapiens
ggcatgaacgcactt

SEQ ID NO: 2123778 - DNA, 14 bp, Homo sapiens
ggcatgacactcta

SEQ ID NO: 2123779 - DNA, 15 bp, Homo sapiens
ggcatgacactctag

SEQ ID NO: 2123780 - DNA, 21 bp, Homo sapiens
ggcatgacactctagtgactt

SEQ ID NO: 2123781 - DNA, 18 bp, Homo sapiens
ggcatgaccatcctgtcc

SEQ ID NO: 2123782 - DNA, 22 bp, Homo sapiens
ggcatgcaccagtgccgcctgt

SEQ ID NO: 2123783 - DNA, 12 bp, Homo sapiens
ggcatgctggcc

SEQ ID NO: 2123784 - DNA, 13 bp, Homo sapiens
ggcatgctggcct

SEQ ID NO: 2123785 - DNA, 14 bp, Homo sapiens
ggcatgctggcctg

SEQ ID NO: 2123786 - DNA, 16 bp, Homo sapiens
ggcatgctggcctgtg

SEQ ID NO: 2123787 - DNA, 13 bp, Homo sapiens
ggcatgctggggc

SEQ ID NO: 2123788 - DNA, 18 bp, Homo sapiens
ggcatggccaggtggcca

SEQ ID NO: 2123789 - DNA, 21 bp, Homo sapiens
ggcatggtggcgcaagcctgt

SEQ ID NO: 2123790 - DNA, 20 bp, Homo sapiens
ggcatggttccttccctggg

SEQ ID NO: 2123791 - DNA, 23 bp, Homo sapiens
ggcatggttccttccctgggaag

SEQ ID NO: 2123792 - DNA, 14 bp, Homo sapiens
ggcatgtcagagcc

SEQ ID NO: 2123793 - DNA, 14 bp, Homo sapiens
ggcatgtgtgcctg

SEQ ID NO: 2123794 - DNA, 17 bp, Homo sapiens
ggcatgtgtgcctgtgg

SEQ ID NO: 2123795 - DNA, 20 bp, Homo sapiens
ggcatgttctctgaggacac

SEQ ID NO: 2123796 - DNA, 13 bp, Homo sapiens
ggcattcctgctt

SEQ ID NO: 2123797 - DNA, 15 bp, Homo sapiens
ggcattgggctgaca

SEQ ID NO: 2123798 - DNA, 13 bp, Homo sapiens
ggcattgggttct

SEQ ID NO: 2123799 - DNA, 12 bp, Homo sapiens
ggcatttcctgg

SEQ ID NO: 2123800 - DNA, 15 bp, Homo sapiens
ggcatttcctgggtg

SEQ ID NO: 2123801 - DNA, 21 bp, Homo sapiens
ggcattttcctcgcctaggcc

SEQ ID NO: 2123802 - DNA, 14 bp, Homo sapiens
ggcatttttttaaa

SEQ ID NO: 2123803 - DNA, 14 bp, Homo sapiens
ggccaaaagggcag

SEQ ID NO: 2123804 - DNA, 20 bp, Homo sapiens
ggccaaaagggcagccaggg

SEQ ID NO: 2123805 - DNA, 23 bp, Homo sapiens
ggccaagacttggcaacagaagc

SEQ ID NO: 2123806 - DNA, 23 bp, Homo sapiens
ggccaagagagacattgcctcca

SEQ ID NO: 2123807 - DNA, 14 bp, Homo sapiens
ggccaggccagagg

SEQ ID NO: 2123808 - DNA, 16 bp, Homo sapiens
ggccaggccagaggga

SEQ ID NO: 2123809 - DNA, 12 bp, Homo sapiens
ggccaggctggt

SEQ ID NO: 2123810 - DNA, 18 bp, Homo sapiens
ggccagggccctgcagag

SEQ ID NO: 2123811 - DNA, 17 bp, Homo sapiens
ggccaggttatgcctca

SEQ ID NO: 2123812 - DNA, 17 bp, Homo sapiens
ggccaggtttctgccca

SEQ ID NO: 2123813 - DNA, 17 bp, Homo sapiens
ggccagtcctagagctc

SEQ ID NO: 2123814 - DNA, 21 bp, Homo sapiens
ggccagtcctagagctcctgt

SEQ ID NO: 2123815 - DNA, 22 bp, Homo sapiens
ggccagtgagggctgggcccac

SEQ ID NO: 2123816 - DNA, 16 bp, Homo sapiens
ggccagtgccaggaca

SEQ ID NO: 2123817 - DNA, 18 bp, Homo sapiens
ggccagtgccaggacagc

SEQ ID NO: 2123818 - DNA, 21 bp, Homo sapiens
ggccagtgccaggacagctgg

SEQ ID NO: 2123819 - DNA, 20 bp, Homo sapiens
ggccagtgtgacaaggattg

SEQ ID NO: 2123820 - DNA, 17 bp, Homo sapiens
ggccatccctgggcccc

SEQ ID NO: 2123821 - DNA, 20 bp, Homo sapiens
ggccatgcttcttgcccctt

SEQ ID NO: 2123822 - DNA, 13 bp, Homo sapiens
ggccatgggcctc

SEQ ID NO: 2123823 - DNA, 16 bp, Homo sapiens
ggccatgggcctcctg

SEQ ID NO: 2123824 - DNA, 16 bp, Homo sapiens
ggcccaatgcctataa

SEQ ID NO: 2123825 - DNA, 15 bp, Homo sapiens
ggcccacaaagggga

SEQ ID NO: 2123826 - DNA, 19 bp, Homo sapiens
ggcccacaaaggggagaag

SEQ ID NO: 2123827 - DNA, 20 bp, Homo sapiens
ggcccacaaaggggagaagg

SEQ ID NO: 2123828 - DNA, 14 bp, Homo sapiens
ggcccacagctccc

SEQ ID NO: 2123829 - DNA, 17 bp, Homo sapiens
ggcccacagctcccacc

SEQ ID NO: 2123830 - DNA, 16 bp, Homo sapiens
ggcccagagacccctt

SEQ ID NO: 2123831 - DNA, 11 bp, Homo sapiens
ggcccagagag

SEQ ID NO: 2123832 - DNA, 17 bp, Homo sapiens
ggcccagcctgtcctgg

SEQ ID NO: 2123833 - DNA, 18 bp, Homo sapiens
ggcccagctgtagccatg

SEQ ID NO: 2123834 - DNA, 20 bp, Homo sapiens
ggcccagctgtagccatggc

SEQ ID NO: 2123835 - DNA, 22 bp, Homo sapiens
ggcccagctgtagccatggctc

SEQ ID NO: 2123836 - DNA, 15 bp, Homo sapiens
ggcccaggcaggcca

SEQ ID NO: 2123837 - DNA, 22 bp, Homo sapiens
ggcccagggagcaatgggaggg

SEQ ID NO: 2123838 - DNA, 21 bp, Homo sapiens
ggcccataatagttagccctc

SEQ ID NO: 2123839 - DNA, 22 bp, Homo sapiens
ggccccaactattaaagtgcca

SEQ ID NO: 2123840 - DNA, 13 bp, Homo sapiens
ggccccacatggg

SEQ ID NO: 2123841 - DNA, 14 bp, Homo sapiens
ggccccaccaccta

SEQ ID NO: 2123842 - DNA, 23 bp, Homo sapiens
ggccccaccctcgtggacacctg

SEQ ID NO: 2123843 - DNA, 21 bp, Homo sapiens
ggccccacctacttgtgactg

SEQ ID NO: 2123844 - DNA, 15 bp, Homo sapiens
ggccccagatctgcc

SEQ ID NO: 2123845 - DNA, 17 bp, Homo sapiens
ggccccagatctgcctg

SEQ ID NO: 2123846 - DNA, 19 bp, Homo sapiens
ggccccagatctgcctggg

SEQ ID NO: 2123847 - DNA, 20 bp, Homo sapiens
ggccccagatctgcctgggc

SEQ ID NO: 2123848 - DNA, 23 bp, Homo sapiens
ggccccagatctgcctgggcctg

SEQ ID NO: 2123849 - DNA, 14 bp, Homo sapiens
ggccccaggtgcca

SEQ ID NO: 2123850 - DNA, 16 bp, Homo sapiens
ggccccatcagaggct

SEQ ID NO: 2123851 - DNA, 23 bp, Homo sapiens
ggccccatcagaggctgggggag

SEQ ID NO: 2123852 - DNA, 16 bp, Homo sapiens
ggccccatgacctcca

SEQ ID NO: 2123853 - DNA, 14 bp, Homo sapiens
ggccccatgctctg

SEQ ID NO: 2123854 - DNA, 12 bp, Homo sapiens
ggcccccacagg

SEQ ID NO: 2123855 - DNA, 21 bp, Homo sapiens
ggcccccacaggccccccgca

SEQ ID NO: 2123856 - DNA, 16 bp, Homo sapiens
ggcccccacctggctc

SEQ ID NO: 2123857 - DNA, 16 bp, Homo sapiens
ggcccccctccaggca

SEQ ID NO: 2123858 - DNA, 18 bp, Homo sapiens
ggcccccctccaggcatg

SEQ ID NO: 2123859 - DNA, 19 bp, Homo sapiens
ggcccccctccaggcatgc

SEQ ID NO: 2123860 - DNA, 23 bp, Homo sapiens
ggcccccctccaggcatgctggc

SEQ ID NO: 2123861 - DNA, 21 bp, Homo sapiens
ggcccccgctggctcctccag

SEQ ID NO: 2123862 - DNA, 15 bp, Homo sapiens
ggccccctccatcgg

SEQ ID NO: 2123863 - DNA, 14 bp, Homo sapiens
ggccccctgtgcca

SEQ ID NO: 2123864 - DNA, 18 bp, Homo sapiens
ggccccctgtgccagctc

SEQ ID NO: 2123865 - DNA, 18 bp, Homo sapiens
ggccccgggctctggcca

SEQ ID NO: 2123866 - DNA, 21 bp, Homo sapiens
ggccccgggctctggccaccc

SEQ ID NO: 2123867 - DNA, 22 bp, Homo sapiens
ggccccgggctctggccaccct

SEQ ID NO: 2123868 - DNA, 15 bp, Homo sapiens
ggccccggggctggc

SEQ ID NO: 2123869 - DNA, 23 bp, Homo sapiens
ggccccggtcctggccccagccc

SEQ ID NO: 2123870 - DNA, 17 bp, Homo sapiens
ggcccctccctctgccc

SEQ ID NO: 2123871 - DNA, 21 bp, Homo sapiens
ggcccctgttcccccgctggc

SEQ ID NO: 2123872 - DNA, 13 bp, Homo sapiens
ggcccgacagaga

SEQ ID NO: 2123873 - DNA, 16 bp, Homo sapiens
ggcccgacagcctggc

SEQ ID NO: 2123874 - DNA, 17 bp, Homo sapiens
ggcccgacagcctggca

SEQ ID NO: 2123875 - DNA, 18 bp, Homo sapiens
ggcccgagcagctgagca

SEQ ID NO: 2123876 - DNA, 18 bp, Homo sapiens
gcttggacttcctggggc

SEQ ID NO: 2123877 - DNA, 13 bp, Homo sapiens
gcttggcagagag

SEQ ID NO: 2123878 - DNA, 15 bp, Homo sapiens
gcttggcagagagga

SEQ ID NO: 2123879 - DNA, 12 bp, Homo sapiens
gcttggccttgt

SEQ ID NO: 2123880 - DNA, 20 bp, Homo sapiens
gcttgggccctgcacagata

SEQ ID NO: 2123881 - DNA, 16 bp, Homo sapiens
gcttggggagcagagt

SEQ ID NO: 2123882 - DNA, 15 bp, Homo sapiens
gcttggggagcaggt

SEQ ID NO: 2123883 - DNA, 17 bp, Homo sapiens
gcttggggagcaggtct

SEQ ID NO: 2123884 - DNA, 23 bp, Homo sapiens
gcttggggagcaggtctctggca

SEQ ID NO: 2123885 - DNA, 16 bp, Homo sapiens
gcttggggcttcctaa

SEQ ID NO: 2123886 - DNA, 24 bp, Homo sapiens
gcttgggggatgactagaggcagg

SEQ ID NO: 2123887 - DNA, 20 bp, Homo sapiens
gcttgtaaatagctcaggtg

SEQ ID NO: 2123888 - DNA, 15 bp, Homo sapiens
gcttgtaactccacc

SEQ ID NO: 2123889 - DNA, 16 bp, Homo sapiens
gcttgtaactccacca

SEQ ID NO: 2123890 - DNA, 22 bp, Homo sapiens
gcttgtaactccaccaacccat

SEQ ID NO: 2123891 - DNA, 18 bp, Homo sapiens
gcttgtacatattggaaa

SEQ ID NO: 2123892 - DNA, 15 bp, Homo sapiens
gcttgtatatacata

SEQ ID NO: 2123893 - DNA, 17 bp, Homo sapiens
gcttgtatatacatatt

SEQ ID NO: 2123894 - DNA, 22 bp, Homo sapiens
gcttgtatatacatattataaa

SEQ ID NO: 2123895 - DNA, 18 bp, Homo sapiens
gcttgtcactagcagctg

SEQ ID NO: 2123896 - DNA, 15 bp, Homo sapiens
gcttgtccctgccca

SEQ ID NO: 2123897 - DNA, 15 bp, Homo sapiens
gcttgtcctgctctc

SEQ ID NO: 2123898 - DNA, 14 bp, Homo sapiens
gcttgtgagagctg

SEQ ID NO: 2123899 - DNA, 18 bp, Homo sapiens
gcttgtgattctgggatg

SEQ ID NO: 2123900 - DNA, 18 bp, Homo sapiens
gcttgtggcaagtgaatt

SEQ ID NO: 2123901 - DNA, 17 bp, Homo sapiens
gctttaaactaccctcc

SEQ ID NO: 2123902 - DNA, 18 bp, Homo sapiens
gctttaaactaccctcca

SEQ ID NO: 2123903 - DNA, 16 bp, Homo sapiens
gctttaaagtgtaata

SEQ ID NO: 2123904 - DNA, 22 bp, Homo sapiens
gctttaacaaaacaagaaagaa

SEQ ID NO: 2123905 - DNA, 15 bp, Homo sapiens
gctttacattttatt

SEQ ID NO: 2123906 - DNA, 14 bp, Homo sapiens
gctttacctttatt

SEQ ID NO: 2123907 - DNA, 19 bp, Homo sapiens
gctttacctttattaatga

SEQ ID NO: 2123908 - DNA, 17 bp, Homo sapiens
gctttatctgtcacaca

SEQ ID NO: 2123909 - DNA, 23 bp, Homo sapiens
gctttattttttaagtatttata

SEQ ID NO: 2123910 - DNA, 20 bp, Homo sapiens
gctttcaacttaaatcactg

SEQ ID NO: 2123911 - DNA, 17 bp, Homo sapiens
gctttcagagccagtga

SEQ ID NO: 2123912 - DNA, 21 bp, Homo sapiens
gctttcagggcgataaaacta

SEQ ID NO: 2123913 - DNA, 17 bp, Homo sapiens
gctttcccttccagttc

SEQ ID NO: 2123914 - DNA, 19 bp, Homo sapiens
gctttcctaaagtctctgc

SEQ ID NO: 2123915 - DNA, 23 bp, Homo sapiens
gctttcctaaagtctctgctgct

SEQ ID NO: 2123916 - DNA, 20 bp, Homo sapiens
gctttcctccctggcatgac

SEQ ID NO: 2123917 - DNA, 22 bp, Homo sapiens
gctttctacccagcgagccctg

SEQ ID NO: 2123918 - DNA, 12 bp, Homo sapiens
gctttctccttt

SEQ ID NO: 2123919 - DNA, 21 bp, Homo sapiens
gctttcttctacaaccagagc

SEQ ID NO: 2123920 - DNA, 15 bp, Homo sapiens
gctgggggcctcagt

SEQ ID NO: 2123921 - DNA, 20 bp, Homo sapiens
gctgggggcgggggagccaa

SEQ ID NO: 2123922 - DNA, 23 bp, Homo sapiens
gctggtaatttgtatctgaagga

SEQ ID NO: 2123923 - DNA, 20 bp, Homo sapiens
gctggtccagggcctgggaa

SEQ ID NO: 2123924 - DNA, 15 bp, Homo sapiens
gctggtcccactcag

SEQ ID NO: 2123925 - DNA, 20 bp, Homo sapiens
gctggtgcagagctgaagat

SEQ ID NO: 2123926 - DNA, 17 bp, Homo sapiens
gctggtgctgtggccag

SEQ ID NO: 2123927 - DNA, 14 bp, Homo sapiens
gctggtgtcacctg

SEQ ID NO: 2123928 - DNA, 15 bp, Homo sapiens
gctggtgtcacctga

SEQ ID NO: 2123929 - DNA, 15 bp, Homo sapiens
gctggtttcctcatt

SEQ ID NO: 2123930 - DNA, 12 bp, Homo sapiens
gctggttttcct

SEQ ID NO: 2123931 - DNA, 23 bp, Homo sapiens
gctggttttcctaaatgcagtga

SEQ ID NO: 2123932 - DNA, 16 bp, Homo sapiens
gctgtaaacagctctg

SEQ ID NO: 2123933 - DNA, 21 bp, Homo sapiens
gctgtaaactataaactactg

SEQ ID NO: 2123934 - DNA, 20 bp, Homo sapiens
gctgtaaatacatgtgtgga

SEQ ID NO: 2123935 - DNA, 23 bp, Homo sapiens
gctgtaactcagacattccaagg

SEQ ID NO: 2123936 - DNA, 14 bp, Homo sapiens
gctgtaactgctga

SEQ ID NO: 2123937 - DNA, 18 bp, Homo sapiens
gctgtaactgctgagcca

SEQ ID NO: 2123938 - DNA, 19 bp, Homo sapiens
gctgtaactgctgagccac

SEQ ID NO: 2123939 - DNA, 22 bp, Homo sapiens
gctgtaactgctgagccactcg

SEQ ID NO: 2123940 - DNA, 13 bp, Homo sapiens
gctgtaagcattc

SEQ ID NO: 2123941 - DNA, 22 bp, Homo sapiens
gctgtaagcattctgagctggg

SEQ ID NO: 2123942 - DNA, 12 bp, Homo sapiens
gctgtacactgc

SEQ ID NO: 2123943 - DNA, 18 bp, Homo sapiens
gctgtacccttccacctc

SEQ ID NO: 2123944 - DNA, 20 bp, Homo sapiens
gctgtacccttccacctcct

SEQ ID NO: 2123945 - DNA, 16 bp, Homo sapiens
gctgtacgtctggtgt

SEQ ID NO: 2123946 - DNA, 14 bp, Homo sapiens
gctgtagccatggc

SEQ ID NO: 2123947 - DNA, 21 bp, Homo sapiens
gctgtagccatggctcaggca

SEQ ID NO: 2123948 - DNA, 22 bp, Homo sapiens
gctgtagccatggctcaggcaa

SEQ ID NO: 2123949 - DNA, 15 bp, Homo sapiens
gctgtagctcccgag

SEQ ID NO: 2123950 - DNA, 17 bp, Homo sapiens
gctgtatatatatatgt

SEQ ID NO: 2123951 - DNA, 20 bp, Homo sapiens
gctgtatatatatatgtgtg

SEQ ID NO: 2123952 - DNA, 17 bp, Homo sapiens
gctgtatcccatgagcc

SEQ ID NO: 2123953 - DNA, 19 bp, Homo sapiens
gctgtatcccatgagcctc

SEQ ID NO: 2123954 - DNA, 19 bp, Homo sapiens
gctgtatttttagagatta

SEQ ID NO: 2123955 - DNA, 18 bp, Homo sapiens
gctgtcatcaattaaagg

SEQ ID NO: 2123956 - DNA, 17 bp, Homo sapiens
gctgtcatggaaaagcc

SEQ ID NO: 2123957 - DNA, 13 bp, Homo sapiens
gctgtcctgctgt

SEQ ID NO: 2123958 - DNA, 16 bp, Homo sapiens
gctgtcgccccaggcc

SEQ ID NO: 2123959 - DNA, 20 bp, Homo sapiens
gctgtcgccccaggccctcc

SEQ ID NO: 2123960 - DNA, 21 bp, Homo sapiens
gctgtctccataatgccactg

SEQ ID NO: 2123961 - DNA, 16 bp, Homo sapiens
gctgtctctgtccctc

SEQ ID NO: 2123962 - DNA, 17 bp, Homo sapiens
gctgtctctgtccctca

SEQ ID NO: 2123963 - DNA, 12 bp, Homo sapiens
gctgtctgtcac

SEQ ID NO: 2123964 - DNA, 14 bp, Homo sapiens
gctgtctgtggctt

SEQ ID NO: 2123965 - DNA, 14 bp, Homo sapiens
gctgtctttctcta

SEQ ID NO: 2123966 - DNA, 18 bp, Homo sapiens
gctgtgaacattgtctgg

SEQ ID NO: 2123967 - DNA, 12 bp, Homo sapiens
gctgtgacctgc

SEQ ID NO: 2123968 - DNA, 13 bp, Homo sapiens
gctgtgacctgct

SEQ ID NO: 2123969 - DNA, 14 bp, Homo sapiens
gctgtgacctgctg

SEQ ID NO: 2123970 - DNA, 15 bp, Homo sapiens
gctgtgacctgctga

SEQ ID NO: 2123971 - DNA, 19 bp, Homo sapiens
gctgtgacctgctgagctc

SEQ ID NO: 2123972 - DNA, 22 bp, Homo sapiens
gctgtgacctgctgagctctga

SEQ ID NO: 2123973 - DNA, 15 bp, Homo sapiens
gctgtgagcccctgg

SEQ ID NO: 2123974 - DNA, 16 bp, Homo sapiens
gctgtgaggcccctgg

SEQ ID NO: 2123975 - DNA, 13 bp, Homo sapiens
gctgtgcctgcta

SEQ ID NO: 2123976 - DNA, 16 bp, Homo sapiens
gctgtgcctgctagag

SEQ ID NO: 2123977 - DNA, 20 bp, Homo sapiens
gctgtgcctgctagagcaac

SEQ ID NO: 2123978 - DNA, 13 bp, Homo sapiens
gctgtgctctgga

SEQ ID NO: 2123979 - DNA, 15 bp, Homo sapiens
gctgtgctctggaca

SEQ ID NO: 2123980 - DNA, 16 bp, Homo sapiens
gctgtgctctggacag

SEQ ID NO: 2123981 - DNA, 18 bp, Homo sapiens
gctgtgctctggacaggc

SEQ ID NO: 2123982 - DNA, 12 bp, Homo sapiens
gctgtggcacag

SEQ ID NO: 2123983 - DNA, 17 bp, Homo sapiens
gctgtggccagggtgag

SEQ ID NO: 2123984 - DNA, 21 bp, Homo sapiens
gctgtggccagggtgagagct

SEQ ID NO: 2123985 - DNA, 22 bp, Homo sapiens
gctgtggccagggtgagagctg

SEQ ID NO: 2123986 - DNA, 22 bp, Homo sapiens
gctgtggcctcacttccctggg

SEQ ID NO: 2123987 - DNA, 23 bp, Homo sapiens
gctgtggcctcacttccctggga

SEQ ID NO: 2123988 - DNA, 17 bp, Homo sapiens
gctgtggctcctgcctt

SEQ ID NO: 2123989 - DNA, 20 bp, Homo sapiens
gctgtgggcagcaccctccc

SEQ ID NO: 2123990 - DNA, 18 bp, Homo sapiens
gctgtgggggaggtccct

SEQ ID NO: 2123991 - DNA, 20 bp, Homo sapiens
gctgtggttcctaagcctgt

SEQ ID NO: 2123992 - DNA, 21 bp, Homo sapiens
gctgtgtccgctttcatgaac

SEQ ID NO: 2123993 - DNA, 21 bp, Homo sapiens
gctgtgtccttgcacctgcat

SEQ ID NO: 2123994 - DNA, 23 bp, Homo sapiens
gctgtgtccttgcacctgcatcc

SEQ ID NO: 2123995 - DNA, 19 bp, Homo sapiens
gctgtgtgaattcccaggt

SEQ ID NO: 2123996 - DNA, 16 bp, Homo sapiens
gctgttcacagccaga

SEQ ID NO: 2123997 - DNA, 15 bp, Homo sapiens
gctgttctgcactga

SEQ ID NO: 2123998 - DNA, 17 bp, Homo sapiens
gctgttctgcactgaaa

SEQ ID NO: 2123999 - DNA, 16 bp, Homo sapiens
gctgttgagctgtttt

SEQ ID NO: 2124000 - DNA, 21 bp, Homo sapiens
gctgttgatgaggcctcttgg

SEQ ID NO: 2124001 - DNA, 14 bp, Homo sapiens
gctgttgccatagc

SEQ ID NO: 2124002 - DNA, 17 bp, Homo sapiens
gctgttggacagctgct

SEQ ID NO: 2124003 - DNA, 18 bp, Homo sapiens
gctgttggacagctgctt

SEQ ID NO: 2124004 - DNA, 18 bp, Homo sapiens
gctgttggcctcgcctgg

SEQ ID NO: 2124005 - DNA, 19 bp, Homo sapiens
gctgttggcctcgcctggg

SEQ ID NO: 2124006 - DNA, 15 bp, Homo sapiens
gctgttggctggggg

SEQ ID NO: 2124007 - DNA, 22 bp, Homo sapiens
gctgttggctgggggcctcagt

SEQ ID NO: 2124008 - DNA, 13 bp, Homo sapiens
gctgtttccatag

SEQ ID NO: 2124009 - DNA, 11 bp, Homo sapiens
gctgtttcctt

SEQ ID NO: 2124010 - DNA, 13 bp, Homo sapiens
gctgtttctggaa

SEQ ID NO: 2124011 - DNA, 13 bp, Homo sapiens
gctgtttgagatg

SEQ ID NO: 2124012 - DNA, 12 bp, Homo sapiens
gcttaaaacttt

SEQ ID NO: 2124013 - DNA, 18 bp, Homo sapiens
gcttaaaactttgaagtt

SEQ ID NO: 2124014 - DNA, 13 bp, Homo sapiens
gcttaaaagacat

SEQ ID NO: 2124015 - DNA, 17 bp, Homo sapiens
gcttaaaagagtagaat

SEQ ID NO: 2124016 - DNA, 14 bp, Homo sapiens
gcttaaatgcaata

SEQ ID NO: 2124017 - DNA, 20 bp, Homo sapiens
gcttaacattgacttcttgg

SEQ ID NO: 2124018 - DNA, 23 bp, Homo sapiens
gcttaaggagaggagaaactgag

SEQ ID NO: 2124019 - DNA, 14 bp, Homo sapiens
gcttaatgtttatt

SEQ ID NO: 2124020 - DNA, 19 bp, Homo sapiens
gcttacatttttacaataa

SEQ ID NO: 2124021 - DNA, 23 bp, Homo sapiens
gcttacccttcacctttggtgca

SEQ ID NO: 2124022 - DNA, 16 bp, Homo sapiens
gcttagacctcagcct

SEQ ID NO: 2124023 - DNA, 19 bp, Homo sapiens
gcttagacctcagcctgtg

SEQ ID NO: 2124024 - DNA, 23 bp, Homo sapiens
gcttagacttcgactcaggatcc

SEQ ID NO: 2124025 - DNA, 20 bp, Homo sapiens
gcttagatgagggtgactgt

SEQ ID NO: 2124026 - DNA, 17 bp, Homo sapiens
gcttagccttgtgccct

SEQ ID NO: 2124027 - DNA, 18 bp, Homo sapiens
gcttagccttgtgccctg

SEQ ID NO: 2124028 - DNA, 19 bp, Homo sapiens
gcttagccttgtgccctgc

SEQ ID NO: 2124029 - DNA, 17 bp, Homo sapiens
gcttagctgaaacctaa

SEQ ID NO: 2124030 - DNA, 16 bp, Homo sapiens
gcttaggtgccaggct

SEQ ID NO: 2124031 - DNA, 17 bp, Homo sapiens
gcttaggtgccaggctg

SEQ ID NO: 2124032 - DNA, 18 bp, Homo sapiens
gcttaggtgccaggctgt

SEQ ID NO: 2124033 - DNA, 23 bp, Homo sapiens
gcttagtatctcatcaacaaaga

SEQ ID NO: 2124034 - DNA, 16 bp, Homo sapiens
gcttagttctcactgt

SEQ ID NO: 2124035 - DNA, 13 bp, Homo sapiens
gcttataaatgtg

SEQ ID NO: 2124036 - DNA, 20 bp, Homo sapiens
gctgggaaccccgcagcccg

SEQ ID NO: 2124037 - DNA, 22 bp, Homo sapiens
gctgggaaccccgcagcccgtg

SEQ ID NO: 2124038 - DNA, 18 bp, Homo sapiens
gctgggactacaggcacc

SEQ ID NO: 2124039 - DNA, 20 bp, Homo sapiens
gctgggactacaggcaccca

SEQ ID NO: 2124040 - DNA, 14 bp, Homo sapiens
gctgggactggcca

SEQ ID NO: 2124041 - DNA, 16 bp, Homo sapiens
gctgggactggccagg

SEQ ID NO: 2124042 - DNA, 16 bp, Homo sapiens
gctgggagctctgcag

SEQ ID NO: 2124043 - DNA, 20 bp, Homo sapiens
gctgggaggcatggccctgg

SEQ ID NO: 2124044 - DNA, 17 bp, Homo sapiens
gctgggcacctctagtg

SEQ ID NO: 2124045 - DNA, 16 bp, Homo sapiens
gctgggccccatgctc

SEQ ID NO: 2124046 - DNA, 14 bp, Homo sapiens
gctgggcccctggg

SEQ ID NO: 2124047 - DNA, 17 bp, Homo sapiens
gctgggcccctgggatg

SEQ ID NO: 2124048 - DNA, 18 bp, Homo sapiens
gctgggcccctgggatgg

SEQ ID NO: 2124049 - DNA, 15 bp, Homo sapiens
gctgggccggccagc

SEQ ID NO: 2124050 - DNA, 22 bp, Homo sapiens
gctgggctaccccccctcctgc

SEQ ID NO: 2124051 - DNA, 17 bp, Homo sapiens
gctgggcttcagtggca

SEQ ID NO: 2124052 - DNA, 19 bp, Homo sapiens
gctgggcttcagtggcagc

SEQ ID NO: 2124053 - DNA, 22 bp, Homo sapiens
gctgggcttcagtggcagctgc

SEQ ID NO: 2124054 - DNA, 18 bp, Homo sapiens
gctggggaacagagcggg

SEQ ID NO: 2124055 - DNA, 13 bp, Homo sapiens
gctggggagcgaa

SEQ ID NO: 2124056 - DNA, 21 bp, Homo sapiens
gctggggagcgaaagtttctt

SEQ ID NO: 2124057 - DNA, 14 bp, Homo sapiens
gctggggagtccct

SEQ ID NO: 2124058 - DNA, 17 bp, Homo sapiens
gctggggcaagtccctg

SEQ ID NO: 2124059 - DNA, 13 bp, Homo sapiens
gctggggcagagg

SEQ ID NO: 2124060 - DNA, 18 bp, Homo sapiens
gctggggcagaggggcag

SEQ ID NO: 2124061 - DNA, 20 bp, Homo sapiens
gctggggcagaggggcagcc

SEQ ID NO: 2124062 - DNA, 22 bp, Homo sapiens
gctggggccagtgtaaggcata

SEQ ID NO: 2124063 - DNA, 13 bp, Homo sapiens
gctggggcctgga

SEQ ID NO: 2124064 - DNA, 13 bp, Homo sapiens
gctgggggcctca

SEQ ID NO: 2124065 - DNA, 16 bp, Homo sapiens
gcctgatgctgccccg

SEQ ID NO: 2124066 - DNA, 15 bp, Homo sapiens
gcctgatggccaagg

SEQ ID NO: 2124067 - DNA, 13 bp, Homo sapiens
gcctgattttaaa

SEQ ID NO: 2124068 - DNA, 21 bp, Homo sapiens
gcctgcaaactcactgctcaa

SEQ ID NO: 2124069 - DNA, 19 bp, Homo sapiens
gcctgcacccttcctcctc

SEQ ID NO: 2124070 - DNA, 11 bp, Homo sapiens
gcctgcagaga

SEQ ID NO: 2124071 - DNA, 16 bp, Homo sapiens
gcctgcagagagaagc

SEQ ID NO: 2124072 - DNA, 17 bp, Homo sapiens
gcctgcagagagaagcc

SEQ ID NO: 2124073 - DNA, 19 bp, Homo sapiens
gcctgcagaggacagagct

SEQ ID NO: 2124074 - DNA, 11 bp, Homo sapiens
gcctgcagccc

SEQ ID NO: 2124075 - DNA, 14 bp, Homo sapiens
gcctgcagcctccc

SEQ ID NO: 2124076 - DNA, 18 bp, Homo sapiens
gcctgcagcctcccccac

SEQ ID NO: 2124077 - DNA, 22 bp, Homo sapiens
gcgttattggtcggcagccttc

SEQ ID NO: 2124078 - DNA, 17 bp, Homo sapiens
gcgttctgctgcccctg

SEQ ID NO: 2124079 - DNA, 21 bp, Homo sapiens
gcgttctgctgcccctgcagt

SEQ ID NO: 2124080 - DNA, 20 bp, Homo sapiens
gcgttggaatcacctggagg

SEQ ID NO: 2124081 - DNA, 14 bp, Homo sapiens
gcgttggtgccact

SEQ ID NO: 2124082 - DNA, 22 bp, Homo sapiens
gcgtttattaatgcctctcccg

SEQ ID NO: 2124083 - DNA, 14 bp, Homo sapiens
gcgtttttttacaa

SEQ ID NO: 2124084 - DNA, 14 bp, Homo sapiens
gctaaaacctgagc

SEQ ID NO: 2124085 - DNA, 15 bp, Homo sapiens
gctaaatactgtaca

SEQ ID NO: 2124086 - DNA, 23 bp, Homo sapiens
gctaaatgaagagacttaagaaa

SEQ ID NO: 2124087 - DNA, 19 bp, Homo sapiens
gctaaatgcctaataaaca

SEQ ID NO: 2124088 - DNA, 18 bp, Homo sapiens
gctaaattacaattgtca

SEQ ID NO: 2124089 - DNA, 19 bp, Homo sapiens
gctaacacgtgaaaccccg

SEQ ID NO: 2124090 - DNA, 15 bp, Homo sapiens
gctaacagggaaggc

SEQ ID NO: 2124091 - DNA, 16 bp, Homo sapiens
gctaacagggaaggca

SEQ ID NO: 2124092 - DNA, 22 bp, Homo sapiens
gctaacagggaaggcaggcagg

SEQ ID NO: 2124093 - DNA, 23 bp, Homo sapiens
gctaactccagtctcctgacatt

SEQ ID NO: 2124094 - DNA, 12 bp, Homo sapiens
gctaactggaag

SEQ ID NO: 2124095 - DNA, 14 bp, Homo sapiens
gctaagagaagtag

SEQ ID NO: 2124096 - DNA, 18 bp, Homo sapiens
gctaagagctagcgctgc

SEQ ID NO: 2124097 - DNA, 21 bp, Homo sapiens
gctaagccccctactgagaaa

SEQ ID NO: 2124098 - DNA, 15 bp, Homo sapiens
gctaagctaggaatg

SEQ ID NO: 2124099 - DNA, 19 bp, Homo sapiens
gctaagctaggaatgaaat

SEQ ID NO: 2124100 - DNA, 22 bp, Homo sapiens
gctaagggtaagggagagggag

SEQ ID NO: 2124101 - DNA, 13 bp, Homo sapiens
gctaagtgaaaag

SEQ ID NO: 2124102 - DNA, 14 bp, Homo sapiens
gctaatcagcattc

SEQ ID NO: 2124103 - DNA, 22 bp, Homo sapiens
gctaatcagcattctcactcct

SEQ ID NO: 2124104 - DNA, 23 bp, Homo sapiens
gctaatgaagctattgagaaaga

SEQ ID NO: 2124105 - DNA, 20 bp, Homo sapiens
gctaatttatcctgaaattt

SEQ ID NO: 2124106 - DNA, 16 bp, Homo sapiens
gctaatttttcatttt

SEQ ID NO: 2124107 - DNA, 19 bp, Homo sapiens
gctaatttttttgtatttt

SEQ ID NO: 2124108 - DNA, 12 bp, Homo sapiens
gctacaataaat

SEQ ID NO: 2124109 - DNA, 18 bp, Homo sapiens
gctacaataaatgctgaa

SEQ ID NO: 2124110 - DNA, 19 bp, Homo sapiens
gctacaccactctggcagc

SEQ ID NO: 2124111 - DNA, 13 bp, Homo sapiens
gctacataattta

SEQ ID NO: 2124112 - DNA, 12 bp, Homo sapiens
gctacattcctc

SEQ ID NO: 2124113 - DNA, 20 bp, Homo sapiens
gctacattcctcagctgcca

SEQ ID NO: 2124114 - DNA, 20 bp, Homo sapiens
gctaccaaagcaccttagct

SEQ ID NO: 2124115 - DNA, 15 bp, Homo sapiens
gctaccaaggcccag

SEQ ID NO: 2124116 - DNA, 15 bp, Homo sapiens
gctacccaaaagaga

SEQ ID NO: 2124117 - DNA, 19 bp, Homo sapiens
gctacccaaaagagaaaaa

SEQ ID NO: 2124118 - DNA, 17 bp, Homo sapiens
gctacctgtgtggacag

SEQ ID NO: 2124119 - DNA, 23 bp, Homo sapiens
gctaccttctctacccatctccc

SEQ ID NO: 2124120 - DNA, 19 bp, Homo sapiens
gctactacccgagcccagc

SEQ ID NO: 2124121 - DNA, 20 bp, Homo sapiens
gctactacccgagcccagct

SEQ ID NO: 2124122 - DNA, 21 bp, Homo sapiens
gctactacccgagcccagcta

SEQ ID NO: 2124123 - DNA, 20 bp, Homo sapiens
gctactcaagaggctgaggc

SEQ ID NO: 2124124 - DNA, 21 bp, Homo sapiens
gctactcaagaggctgaggca

SEQ ID NO: 2124125 - DNA, 14 bp, Homo sapiens
gctactcagaagcc

SEQ ID NO: 2124126 - DNA, 11 bp, Homo sapiens
gctactcagca

SEQ ID NO: 2124127 - DNA, 18 bp, Homo sapiens
gctactcagcagccctcc

SEQ ID NO: 2124128 - DNA, 16 bp, Homo sapiens
gctactcaggaggctg

SEQ ID NO: 2124129 - DNA, 20 bp, Homo sapiens
gctactcataagttggacca

SEQ ID NO: 2124130 - DNA, 14 bp, Homo sapiens
gctactcctgtgct

SEQ ID NO: 2124131 - DNA, 22 bp, Homo sapiens
gctactcgggaggctgaggcag

SEQ ID NO: 2124132 - DNA, 14 bp, Homo sapiens
gctactctcttgcc

SEQ ID NO: 2124133 - DNA, 13 bp, Homo sapiens
gctactctgtcca

SEQ ID NO: 2124134 - DNA, 17 bp, Homo sapiens
gctactctgtccaggcc

SEQ ID NO: 2124135 - DNA, 18 bp, Homo sapiens
gctactctgtccaggcca

SEQ ID NO: 2124136 - DNA, 15 bp, Homo sapiens
gctactctgtgccag

SEQ ID NO: 2124137 - DNA, 16 bp, Homo sapiens
gctactctgtgccaga

SEQ ID NO: 2124138 - DNA, 18 bp, Homo sapiens
gctactctgtgccagagc

SEQ ID NO: 2124139 - DNA, 14 bp, Homo sapiens
gctactcttcagaa

SEQ ID NO: 2124140 - DNA, 20 bp, Homo sapiens
gctactggcagctcctctcc

SEQ ID NO: 2124141 - DNA, 16 bp, Homo sapiens
gctacttaagagaaat

SEQ ID NO: 2124142 - DNA, 22 bp, Homo sapiens
gctacttgggaggctgaggcag

SEQ ID NO: 2124143 - DNA, 18 bp, Homo sapiens
gctagaacctggaagggc

SEQ ID NO: 2124144 - DNA, 19 bp, Homo sapiens
gctagaacctggaagggct

SEQ ID NO: 2124145 - DNA, 20 bp, Homo sapiens
gctagaacctggaagggcta

SEQ ID NO: 2124146 - DNA, 15 bp, Homo sapiens
gctagaacctggagg

SEQ ID NO: 2124147 - DNA, 20 bp, Homo sapiens
gctagaacctgtagagctag

SEQ ID NO: 2124148 - DNA, 17 bp, Homo sapiens
gctagaaggccacatgt

SEQ ID NO: 2124149 - DNA, 20 bp, Homo sapiens
gctagaagtgggccaggaca

SEQ ID NO: 2124150 - DNA, 21 bp, Homo sapiens
gctagaattgagtgtttaaag

SEQ ID NO: 2124151 - DNA, 21 bp, Homo sapiens
gctagagatatggcagcgaaa

SEQ ID NO: 2124152 - DNA, 23 bp, Homo sapiens
gctagagcagcccaaatttttct

SEQ ID NO: 2124153 - DNA, 19 bp, Homo sapiens
gctagcaaagcttaaatgc

SEQ ID NO: 2124154 - DNA, 17 bp, Homo sapiens
gctagcacttggagcca

SEQ ID NO: 2124155 - DNA, 12 bp, Homo sapiens
gctagcagaagt

SEQ ID NO: 2124156 - DNA, 13 bp, Homo sapiens
gctagcagaagta

SEQ ID NO: 2124157 - DNA, 12 bp, Homo sapiens
gctagccagagg

SEQ ID NO: 2124158 - DNA, 14 bp, Homo sapiens
gctagcgctgccgc

SEQ ID NO: 2124159 - DNA, 23 bp, Homo sapiens
gctagcgctgccgcaccccagag

SEQ ID NO: 2124160 - DNA, 17 bp, Homo sapiens
gctagctgtagaaatgt

SEQ ID NO: 2124161 - DNA, 18 bp, Homo sapiens
gctagctgtagaaatgta

SEQ ID NO: 2124162 - DNA, 22 bp, Homo sapiens
gctaggacccctccatgtgggc

SEQ ID NO: 2124163 - DNA, 19 bp, Homo sapiens
gctaggactgaggagtggg

SEQ ID NO: 2124164 - DNA, 15 bp, Homo sapiens
gctaggagcaaagcc

SEQ ID NO: 2124165 - DNA, 17 bp, Homo sapiens
gctaggagcaaagcctg

SEQ ID NO: 2124166 - DNA, 19 bp, Homo sapiens
gctaggagcaaagcctgtt

SEQ ID NO: 2124167 - DNA, 18 bp, Homo sapiens
gctaggcgagtgccagga

SEQ ID NO: 2124168 - DNA, 20 bp, Homo sapiens
gctaggcgagtgccaggact

SEQ ID NO: 2124169 - DNA, 19 bp, Homo sapiens
gctagggagaatgcagaga

SEQ ID NO: 2124170 - DNA, 18 bp, Homo sapiens
gctagtcagagagagtgt

SEQ ID NO: 2124171 - DNA, 15 bp, Homo sapiens
gctagtctatggtca

SEQ ID NO: 2124172 - DNA, 17 bp, Homo sapiens
gctagtgtgagtggcag

SEQ ID NO: 2124173 - DNA, 18 bp, Homo sapiens
gctagtgtgagtggcagc

SEQ ID NO: 2124174 - DNA, 14 bp, Homo sapiens
gctagttgggcttc

SEQ ID NO: 2124175 - DNA, 15 bp, Homo sapiens
gctataaatatataa

SEQ ID NO: 2124176 - DNA, 19 bp, Homo sapiens
gctataggctggagaagct

SEQ ID NO: 2124177 - DNA, 17 bp, Homo sapiens
gctataggtcagagatg

SEQ ID NO: 2124178 - DNA, 13 bp, Homo sapiens
gctataggtgcta

SEQ ID NO: 2124179 - DNA, 14 bp, Homo sapiens
gctatatatataaa

SEQ ID NO: 2124180 - DNA, 15 bp, Homo sapiens
gctatatatataaat

SEQ ID NO: 2124181 - DNA, 19 bp, Homo sapiens
gctatatatataaatattt

SEQ ID NO: 2124182 - DNA, 20 bp, Homo sapiens
gctatctactgagacatgac

SEQ ID NO: 2124183 - DNA, 16 bp, Homo sapiens
gctatctctgtgtgca

SEQ ID NO: 2124184 - DNA, 19 bp, Homo sapiens
gctatggccccagggttga

SEQ ID NO: 2124185 - DNA, 22 bp, Homo sapiens
gctatgtatggaatacagtgtt

SEQ ID NO: 2124186 - DNA, 16 bp, Homo sapiens
gctatgtttttaatgt

SEQ ID NO: 2124187 - DNA, 19 bp, Homo sapiens
gctcccgagctactctctt

SEQ ID NO: 2124188 - DNA, 19 bp, Homo sapiens
gctccctagtggcttcctc

SEQ ID NO: 2124189 - DNA, 13 bp, Homo sapiens
gctccctcctgga

SEQ ID NO: 2124190 - DNA, 15 bp, Homo sapiens
gctccctcctggagc

SEQ ID NO: 2124191 - DNA, 19 bp, Homo sapiens
gctccctcctggagcatcc

SEQ ID NO: 2124192 - DNA, 16 bp, Homo sapiens
gctccctgtagctctg

SEQ ID NO: 2124193 - DNA, 16 bp, Homo sapiens
gctcccttttgtcctt

SEQ ID NO: 2124194 - DNA, 22 bp, Homo sapiens
gctccgctttctacccagcgag

SEQ ID NO: 2124195 - DNA, 23 bp, Homo sapiens
gctccgctttctacccagcgagc

SEQ ID NO: 2124196 - DNA, 14 bp, Homo sapiens
gccacggccaggcc

SEQ ID NO: 2124197 - DNA, 16 bp, Homo sapiens
gccacggccaggccag

SEQ ID NO: 2124198 - DNA, 17 bp, Homo sapiens
gccacggggagggggac

SEQ ID NO: 2124199 - DNA, 21 bp, Homo sapiens
gccacgttccttactgcagaa

SEQ ID NO: 2124200 - DNA, 21 bp, Homo sapiens
gccactacactccagcctgag

SEQ ID NO: 2124201 - DNA, 20 bp, Homo sapiens
gccactcaggaggctgaggc

SEQ ID NO: 2124202 - DNA, 13 bp, Homo sapiens
gccactcatttca

SEQ ID NO: 2124203 - DNA, 20 bp, Homo sapiens
gccactccagacccctggct

SEQ ID NO: 2124204 - DNA, 21 bp, Homo sapiens
gccactccagacccctggctt

SEQ ID NO: 2124205 - DNA, 14 bp, Homo sapiens
gccactcctgtccc

SEQ ID NO: 2124206 - DNA, 15 bp, Homo sapiens
gccactccttcctgc

SEQ ID NO: 2124207 - DNA, 17 bp, Homo sapiens
gccactccttcctgccc

SEQ ID NO: 2124208 - DNA, 18 bp, Homo sapiens
gccactcgcagtcgcagg

SEQ ID NO: 2124209 - DNA, 14 bp, Homo sapiens
gccactgaagctgg

SEQ ID NO: 2124210 - DNA, 17 bp, Homo sapiens
gccactgaagctgggat

SEQ ID NO: 2124211 - DNA, 19 bp, Homo sapiens
gccactgaagctgggattc

SEQ ID NO: 2124212 - DNA, 12 bp, Homo sapiens
gccactgacctc

SEQ ID NO: 2124213 - DNA, 17 bp, Homo sapiens
gccactgcaccgggcca

SEQ ID NO: 2124214 - DNA, 21 bp, Homo sapiens
gccactgcaccgggccacaga

SEQ ID NO: 2124215 - DNA, 21 bp, Homo sapiens
gccactgcactatagcctagg

SEQ ID NO: 2124216 - DNA, 21 bp, Homo sapiens
gccactgcactccagcctggg

SEQ ID NO: 2124217 - DNA, 19 bp, Homo sapiens
gccactgcactctagcctg

SEQ ID NO: 2124218 - DNA, 16 bp, Homo sapiens
gccactgccaggcacc

SEQ ID NO: 2124219 - DNA, 18 bp, Homo sapiens
gccactgccaggcacctg

SEQ ID NO: 2124220 - DNA, 20 bp, Homo sapiens
gccactgccaggcacctggc

SEQ ID NO: 2124221 - DNA, 22 bp, Homo sapiens
gccactgccaggcacctggcct

SEQ ID NO: 2124222 - DNA, 18 bp, Homo sapiens
gccactgctttccagcct

SEQ ID NO: 2124223 - DNA, 20 bp, Homo sapiens
gccactgggtctcactcctg

SEQ ID NO: 2124224 - DNA, 17 bp, Homo sapiens
gccactggtttctcaga

SEQ ID NO: 2124225 - DNA, 19 bp, Homo sapiens
gccactggtttctcagaat

SEQ ID NO: 2124226 - DNA, 17 bp, Homo sapiens
gccactgtggccagagc

SEQ ID NO: 2124227 - DNA, 18 bp, Homo sapiens
gccactgtggccagagct

SEQ ID NO: 2124228 - DNA, 21 bp, Homo sapiens
gccactgtggccagagctgga

SEQ ID NO: 2124229 - DNA, 19 bp, Homo sapiens
gccacttcttaaaggcctg

SEQ ID NO: 2124230 - DNA, 15 bp, Homo sapiens
gccacttgacattcc

SEQ ID NO: 2124231 - DNA, 17 bp, Homo sapiens
gccacttgacattcctt

SEQ ID NO: 2124232 - DNA, 23 bp, Homo sapiens
gccacttgacattccttgtcacc

SEQ ID NO: 2124233 - DNA, 15 bp, Homo sapiens
gccactttaagagag

SEQ ID NO: 2124234 - DNA, 20 bp, Homo sapiens
gccactttaagagagaaatc

SEQ ID NO: 2124235 - DNA, 22 bp, Homo sapiens
gccactttggcttctcctgtga

SEQ ID NO: 2124236 - DNA, 23 bp, Homo sapiens
gccagaagcctctgcctccctag

SEQ ID NO: 2124237 - DNA, 17 bp, Homo sapiens
gccagaaggagggcaga

SEQ ID NO: 2124238 - DNA, 20 bp, Homo sapiens
gccagaaggagggcagagcc

SEQ ID NO: 2124239 - DNA, 21 bp, Homo sapiens
gccagaagtttgtcaagtcaa

SEQ ID NO: 2124240 - DNA, 22 bp, Homo sapiens
gccagaatcttcgtcctgcccc

SEQ ID NO: 2124241 - DNA, 19 bp, Homo sapiens
gccagacgctgccgctgcc

SEQ ID NO: 2124242 - DNA, 14 bp, Homo sapiens
cagtctagctttta

SEQ ID NO: 2124243 - DNA, 19 bp, Homo sapiens
cagtctagtgaagatgttg

SEQ ID NO: 2124244 - DNA, 18 bp, Homo sapiens
cagtctcaagcactaaaa

SEQ ID NO: 2124245 - DNA, 19 bp, Homo sapiens
cagtctcagaatgtcattt

SEQ ID NO: 2124246 - DNA, 13 bp, Homo sapiens
cagtctcaggagc

SEQ ID NO: 2124247 - DNA, 15 bp, Homo sapiens
cagtctcagtccaga

SEQ ID NO: 2124248 - DNA, 19 bp, Homo sapiens
cagtctcagtccagatgcc

SEQ ID NO: 2124249 - DNA, 22 bp, Homo sapiens
cagtctcgggtggctagtcaga

SEQ ID NO: 2124250 - DNA, 16 bp, Homo sapiens
cagtctctgggagact

SEQ ID NO: 2124251 - DNA, 19 bp, Homo sapiens
cagtctctgggagactttc

SEQ ID NO: 2124252 - DNA, 20 bp, Homo sapiens
cagtctctttaatcttcagt

SEQ ID NO: 2124253 - DNA, 22 bp, Homo sapiens
cagtctctttaatcttcagttt

SEQ ID NO: 2124254 - DNA, 19 bp, Homo sapiens
cagtctgattcccaagctc

SEQ ID NO: 2124255 - DNA, 20 bp, Homo sapiens
cagtctgattcccaagctct

SEQ ID NO: 2124256 - DNA, 17 bp, Homo sapiens
cagtctggaatgcagtg

SEQ ID NO: 2124257 - DNA, 17 bp, Homo sapiens
cagtctggtttatataa

SEQ ID NO: 2124258 - DNA, 23 bp, Homo sapiens
cagtcttatagcaagactgttag

SEQ ID NO: 2124259 - DNA, 17 bp, Homo sapiens
cagtcttcttcacccgc

SEQ ID NO: 2124260 - DNA, 22 bp, Homo sapiens
cagtcttgaatttctaaaaaac

SEQ ID NO: 2124261 - DNA, 15 bp, Homo sapiens
cagtcttgcctaggc

SEQ ID NO: 2124262 - DNA, 17 bp, Homo sapiens
cagtcttgcctaggcca

SEQ ID NO: 2124263 - DNA, 18 bp, Homo sapiens
cagtcttgcctaggccaa

SEQ ID NO: 2124264 - DNA, 14 bp, Homo sapiens
cagtgaaaaactat

SEQ ID NO: 2124265 - DNA, 13 bp, Homo sapiens
cagtgaaagcatc

SEQ ID NO: 2124266 - DNA, 19 bp, Homo sapiens
cagtgaacacactcagcag

SEQ ID NO: 2124267 - DNA, 23 bp, Homo sapiens
cagtgaaccaaagagactggagc

SEQ ID NO: 2124268 - DNA, 20 bp, Homo sapiens
cagtgaacttacacttggag

SEQ ID NO: 2124269 - DNA, 22 bp, Homo sapiens
cagtgaaggagccacgtgaatg

SEQ ID NO: 2124270 - DNA, 22 bp, Homo sapiens
cagtgaatagtaacaataaata

SEQ ID NO: 2124271 - DNA, 18 bp, Homo sapiens
cagtgacaagtggagggg

SEQ ID NO: 2124272 - DNA, 24 bp, Homo sapiens
cagtgacccttcccaatcagcact

SEQ ID NO: 2124273 - DNA, 14 bp, Homo sapiens
cagtgacctgaccg

SEQ ID NO: 2124274 - DNA, 20 bp, Homo sapiens
cagtgacctgaccggcacct

SEQ ID NO: 2124275 - DNA, 17 bp, Homo sapiens
cagtgacgtgcacctgt

SEQ ID NO: 2124276 - DNA, 18 bp, Homo sapiens
cagtgactggcaggtgca

SEQ ID NO: 2124277 - DNA, 20 bp, Homo sapiens
cagtgactgtcgtgtttaca

SEQ ID NO: 2124278 - DNA, 22 bp, Homo sapiens
cagtgactgtcgtgtttacaaa

SEQ ID NO: 2124279 - DNA, 19 bp, Homo sapiens
cagtgactttttctgagct

SEQ ID NO: 2124280 - DNA, 14 bp, Homo sapiens
cagtgagaaaaagc

SEQ ID NO: 2124281 - DNA, 16 bp, Homo sapiens
cagtgagacacagagt

SEQ ID NO: 2124282 - DNA, 19 bp, Homo sapiens
cagtgagacacagagtgga

SEQ ID NO: 2124283 - DNA, 19 bp, Homo sapiens
cagtgagattacagaggaa

SEQ ID NO: 2124284 - DNA, 20 bp, Homo sapiens
cagtgagattacagaggaag

SEQ ID NO: 2124285 - DNA, 23 bp, Homo sapiens
cagtgagccaagatcgcgccact

SEQ ID NO: 2124286 - DNA, 18 bp, Homo sapiens
cagtgagctgatgtgccc

SEQ ID NO: 2124287 - DNA, 21 bp, Homo sapiens
cagtgaggagggtggaggaag

SEQ ID NO: 2124288 - DNA, 14 bp, Homo sapiens
cagtgagggctggg

SEQ ID NO: 2124289 - DNA, 19 bp, Homo sapiens
cagtgagggctgggcccac

SEQ ID NO: 2124290 - DNA, 15 bp, Homo sapiens
cagtgagtcctcctc

SEQ ID NO: 2124291 - DNA, 16 bp, Homo sapiens
cagtgatctccatatg

SEQ ID NO: 2124292 - DNA, 21 bp, Homo sapiens
cagtgatctccatatgttaca

SEQ ID NO: 2124293 - DNA, 14 bp, Homo sapiens
cagtgatgtgctgg

SEQ ID NO: 2124294 - DNA, 18 bp, Homo sapiens
cagtgatgtgctggagct

SEQ ID NO: 2124295 - DNA, 20 bp, Homo sapiens
cagtgatgtgctggagctgg

SEQ ID NO: 2124296 - DNA, 21 bp, Homo sapiens
cagtgatgtgctggagctggc

SEQ ID NO: 2124297 - DNA, 14 bp, Homo sapiens
cagtgcaacaaaat

SEQ ID NO: 2124298 - DNA, 21 bp, Homo sapiens
cagtgcaagagactctggcct

SEQ ID NO: 2124299 - DNA, 18 bp, Homo sapiens
cagtgcatctcagcccac

SEQ ID NO: 2124300 - DNA, 21 bp, Homo sapiens
cagtgccacttgacattcctt

SEQ ID NO: 2124301 - DNA, 14 bp, Homo sapiens
gcatgtaggagaat

SEQ ID NO: 2124302 - DNA, 15 bp, Homo sapiens
gcatgtaggagaatc

SEQ ID NO: 2124303 - DNA, 20 bp, Homo sapiens
gcatgtatgtgcacatgtgt

SEQ ID NO: 2124304 - DNA, 16 bp, Homo sapiens
gcatgtcactcccaga

SEQ ID NO: 2124305 - DNA, 13 bp, Homo sapiens
gcatgtgaattct

SEQ ID NO: 2124306 - DNA, 22 bp, Homo sapiens
gcatgtgaattctgtgaagaat

SEQ ID NO: 2124307 - DNA, 15 bp, Homo sapiens
gcatgtgtgcctgtg

SEQ ID NO: 2124308 - DNA, 12 bp, Homo sapiens
gcatgtgtgtat

SEQ ID NO: 2124309 - DNA, 21 bp, Homo sapiens
gcatgttctctgaggacacta

SEQ ID NO: 2124310 - DNA, 23 bp, Homo sapiens
gcatgttgccatgaggcctttcc

SEQ ID NO: 2124311 - DNA, 15 bp, Homo sapiens
gcatgtttcatgttt

SEQ ID NO: 2124312 - DNA, 23 bp, Homo sapiens
gcatgtttcccgctccaagagaa

SEQ ID NO: 2124313 - DNA, 17 bp, Homo sapiens
gcattacgtgagccagg

SEQ ID NO: 2124314 - DNA, 16 bp, Homo sapiens
gcattatttaatgttt

SEQ ID NO: 2124315 - DNA, 18 bp, Homo sapiens
gcattcagaagaaaaaga

SEQ ID NO: 2124316 - DNA, 15 bp, Homo sapiens
gcattcagcacaccc

SEQ ID NO: 2124317 - DNA, 15 bp, Homo sapiens
gcattccatgaccag

SEQ ID NO: 2124318 - DNA, 17 bp, Homo sapiens
gcattccatgattttac

SEQ ID NO: 2124319 - DNA, 22 bp, Homo sapiens
gcattccatgattttacagaga

SEQ ID NO: 2124320 - DNA, 13 bp, Homo sapiens
gcattcccagtgg

SEQ ID NO: 2124321 - DNA, 22 bp, Homo sapiens
gcattcggtacttacccggaga

SEQ ID NO: 2124322 - DNA, 13 bp, Homo sapiens
gcattctcactcc

SEQ ID NO: 2124323 - DNA, 19 bp, Homo sapiens
gcattctgaatgaataaag

SEQ ID NO: 2124324 - DNA, 16 bp, Homo sapiens
gcattcttttaaagtt

SEQ ID NO: 2124325 - DNA, 13 bp, Homo sapiens
gcattgcatggac

SEQ ID NO: 2124326 - DNA, 15 bp, Homo sapiens
gcattgggctgacac

SEQ ID NO: 2124327 - DNA, 16 bp, Homo sapiens
gcattgggctgacacc

SEQ ID NO: 2124328 - DNA, 17 bp, Homo sapiens
gcattggtctgctgacc

SEQ ID NO: 2124329 - DNA, 19 bp, Homo sapiens
gcattgttattgtggaaga

SEQ ID NO: 2124330 - DNA, 18 bp, Homo sapiens
gcatttactttgtgttca

SEQ ID NO: 2124331 - DNA, 22 bp, Homo sapiens
gcatttagttttatggcatgat

SEQ ID NO: 2124332 - DNA, 23 bp, Homo sapiens
gcatttagttttatggcatgatt

SEQ ID NO: 2124333 - DNA, 16 bp, Homo sapiens
gcatttataaatgtgt

SEQ ID NO: 2124334 - DNA, 15 bp, Homo sapiens
gcatttccacactgt

SEQ ID NO: 2124335 - DNA, 12 bp, Homo sapiens
gcatttcctggg

SEQ ID NO: 2124336 - DNA, 13 bp, Homo sapiens
gcatttcctgggt

SEQ ID NO: 2124337 - DNA, 14 bp, Homo sapiens
gcatttcctgggtg

SEQ ID NO: 2124338 - DNA, 15 bp, Homo sapiens
gcatttgccattcct

SEQ ID NO: 2124339 - DNA, 19 bp, Homo sapiens
gcatttgccctgtggattc

SEQ ID NO: 2124340 - DNA, 19 bp, Homo sapiens
gcatttgtgagccaaagag

SEQ ID NO: 2124341 - DNA, 22 bp, Homo sapiens
gcattttcacattttgcctttc

SEQ ID NO: 2124342 - DNA, 17 bp, Homo sapiens
gcattttctctagctga

SEQ ID NO: 2124343 - DNA, 20 bp, Homo sapiens
gcatttttgatttatgcatg

SEQ ID NO: 2124344 - DNA, 21 bp, Homo sapiens
gcatttttgatttatgcatgg

SEQ ID NO: 2124345 - DNA, 20 bp, Homo sapiens
gccaaaaaggaccaactggc

SEQ ID NO: 2124346 - DNA, 21 bp, Homo sapiens
gccaaaacaatgcccgtaaga

SEQ ID NO: 2124347 - DNA, 17 bp, Homo sapiens
gccaaacacactgtaaa

SEQ ID NO: 2124348 - DNA, 17 bp, Homo sapiens
gccaaactctgccagcc

SEQ ID NO: 2124349 - DNA, 21 bp, Homo sapiens
gccaaagcaaaagaagtaaaa

SEQ ID NO: 2124350 - DNA, 20 bp, Homo sapiens
gccaaagccaaagctaggcc

SEQ ID NO: 2124351 - DNA, 13 bp, Homo sapiens
gccaggaggctgc

SEQ ID NO: 2124352 - DNA, 16 bp, Homo sapiens
gccaggaggctgcggc

SEQ ID NO: 2124353 - DNA, 19 bp, Homo sapiens
gccaggaggtcctcctctc

SEQ ID NO: 2124354 - DNA, 20 bp, Homo sapiens
gccaggaggttggtgactga

SEQ ID NO: 2124355 - DNA, 23 bp, Homo sapiens
gccaggagttgacgcatcctgca

SEQ ID NO: 2124356 - DNA, 14 bp, Homo sapiens
gccaggcacctggc

SEQ ID NO: 2124357 - DNA, 20 bp, Homo sapiens
gccaggcacctggcctgctg

SEQ ID NO: 2124358 - DNA, 22 bp, Homo sapiens
gccaggcacctggcctgctggg

SEQ ID NO: 2124359 - DNA, 15 bp, Homo sapiens
gccaggccaccagga

SEQ ID NO: 2124360 - DNA, 15 bp, Homo sapiens
gccaggccagaggga

SEQ ID NO: 2124361 - DNA, 17 bp, Homo sapiens
gccaggcccatctcagg

SEQ ID NO: 2124362 - DNA, 18 bp, Homo sapiens
gccaggcccatctcaggt

SEQ ID NO: 2124363 - DNA, 17 bp, Homo sapiens
gccaggcccggggctgg

SEQ ID NO: 2124364 - DNA, 18 bp, Homo sapiens
gccaggcgttggtgccac

SEQ ID NO: 2124365 - DNA, 14 bp, Homo sapiens
gccaggctctgcct

SEQ ID NO: 2124366 - DNA, 18 bp, Homo sapiens
gccaggctgagtgagcca

SEQ ID NO: 2124367 - DNA, 21 bp, Homo sapiens
gccaggctgagtgagccacag

SEQ ID NO: 2124368 - DNA, 13 bp, Homo sapiens
gccaggctggtct

SEQ ID NO: 2124369 - DNA, 18 bp, Homo sapiens
gccagggattgaggagga

SEQ ID NO: 2124370 - DNA, 16 bp, Homo sapiens
gccagggcaggctacc

SEQ ID NO: 2124371 - DNA, 21 bp, Homo sapiens
gccagggcaggctaccccttc

SEQ ID NO: 2124372 - DNA, 13 bp, Homo sapiens
gccagggcccctg

SEQ ID NO: 2124373 - DNA, 15 bp, Homo sapiens
gccagggccctgcag

SEQ ID NO: 2124374 - DNA, 17 bp, Homo sapiens
gccagggccctgcagag

SEQ ID NO: 2124375 - DNA, 16 bp, Homo sapiens
gccagggcctggtgtg

SEQ ID NO: 2124376 - DNA, 11 bp, Homo sapiens
gccagggctcg

SEQ ID NO: 2124377 - DNA, 14 bp, Homo sapiens
gccagggctcgggc

SEQ ID NO: 2124378 - DNA, 20 bp, Homo sapiens
gccaggggctgctcatcacc

SEQ ID NO: 2124379 - DNA, 17 bp, Homo sapiens
gccagggtgagagctgc

SEQ ID NO: 2124380 - DNA, 23 bp, Homo sapiens
gccagggtgagagctgctctgga

SEQ ID NO: 2124381 - DNA, 16 bp, Homo sapiens
gccaggtaatgaggga

SEQ ID NO: 2124382 - DNA, 23 bp, Homo sapiens
gccaggttagcctttgccctgtc

SEQ ID NO: 2124383 - DNA, 22 bp, Homo sapiens
gccaggtttctgcccacattgg

SEQ ID NO: 2124384 - DNA, 21 bp, Homo sapiens
gccagtaaaaaaaaaaaatgg

SEQ ID NO: 2124385 - DNA, 14 bp, Homo sapiens
gccagtatttttta

SEQ ID NO: 2124386 - DNA, 18 bp, Homo sapiens
gccagtcctagagctcct

SEQ ID NO: 2124387 - DNA, 22 bp, Homo sapiens
gccagtcctagagctcctgtcc

SEQ ID NO: 2124388 - DNA, 14 bp, Homo sapiens
gccagtctgggctg

SEQ ID NO: 2124389 - DNA, 15 bp, Homo sapiens
gccagtctgggctgc

SEQ ID NO: 2124390 - DNA, 23 bp, Homo sapiens
gccagtctgggtctgggtttgga

SEQ ID NO: 2124391 - DNA, 17 bp, Homo sapiens
gccagtcttgcctaggc

SEQ ID NO: 2124392 - DNA, 15 bp, Homo sapiens
gccagtgccttacct

SEQ ID NO: 2124393 - DNA, 18 bp, Homo sapiens
gccagtggaaattcaggt

SEQ ID NO: 2124394 - DNA, 17 bp, Homo sapiens
gccagtttcaccatttc

SEQ ID NO: 2124395 - DNA, 17 bp, Homo sapiens
gccataccgctggggaa

SEQ ID NO: 2124396 - DNA, 21 bp, Homo sapiens
gcagtgaattgtgaccaagtt

SEQ ID NO: 2124397 - DNA, 19 bp, Homo sapiens
gcagtgacaagtggagggg

SEQ ID NO: 2124398 - DNA, 18 bp, Homo sapiens
gcagtgactggcaggtgc

SEQ ID NO: 2124399 - DNA, 17 bp, Homo sapiens
gcagtgagcttctatta

SEQ ID NO: 2124400 - DNA, 15 bp, Homo sapiens
gcagtgatacatgta

SEQ ID NO: 2124401 - DNA, 20 bp, Homo sapiens
gcagtgcaagagactctggc

SEQ ID NO: 2124402 - DNA, 23 bp, Homo sapiens
gcagtgcaagagactctggcctc

SEQ ID NO: 2124403 - DNA, 19 bp, Homo sapiens
gcagtgcctcgaggcaccg

SEQ ID NO: 2124404 - DNA, 21 bp, Homo sapiens
gcagtggagagtgttcctgtt

SEQ ID NO: 2124405 - DNA, 23 bp, Homo sapiens
gcagtggccgcaagcgcagggag

SEQ ID NO: 2124406 - DNA, 18 bp, Homo sapiens
gcagtgggagggtaccag

SEQ ID NO: 2124407 - DNA, 18 bp, Homo sapiens
gcagtggtaagctctggc

SEQ ID NO: 2124408 - DNA, 18 bp, Homo sapiens
gcagtggtgcgatctggg

SEQ ID NO: 2124409 - DNA, 21 bp, Homo sapiens
gcagtggtgcgatctgggttc

SEQ ID NO: 2124410 - DNA, 22 bp, Homo sapiens
gcagtggtgcgatctgggttca

SEQ ID NO: 2124411 - DNA, 13 bp, Homo sapiens
gcagtgtgtcctt

SEQ ID NO: 2124412 - DNA, 20 bp, Homo sapiens
gcagtgttttcacctcatat

SEQ ID NO: 2124413 - DNA, 21 bp, Homo sapiens
gcagttaatggggtagaggag

SEQ ID NO: 2124414 - DNA, 14 bp, Homo sapiens
gcagttatagaaaa

SEQ ID NO: 2124415 - DNA, 20 bp, Homo sapiens
gcagttcgcagccaccctga

SEQ ID NO: 2124416 - DNA, 22 bp, Homo sapiens
gcagttgaatgacaacagaagc

SEQ ID NO: 2124417 - DNA, 22 bp, Homo sapiens
gcagtttattgtaatatatggg

SEQ ID NO: 2124418 - DNA, 22 bp, Homo sapiens
gcagttttgtaaataagtgaaa

SEQ ID NO: 2124419 - DNA, 11 bp, Homo sapiens
gcagttttttt

SEQ ID NO: 2124420 - DNA, 22 bp, Homo sapiens
gcagtttttttatggcattttt

SEQ ID NO: 2124421 - DNA, 15 bp, Homo sapiens
gcataaacttcatct

SEQ ID NO: 2124422 - DNA, 19 bp, Homo sapiens
gcataagattaaaggaagg

SEQ ID NO: 2124423 - DNA, 22 bp, Homo sapiens
gcataatgctcccatctcctga

SEQ ID NO: 2124424 - DNA, 16 bp, Homo sapiens
gcatacctttattgtg

SEQ ID NO: 2124425 - DNA, 16 bp, Homo sapiens
gcatagaaactgagga

SEQ ID NO: 2124426 - DNA, 18 bp, Homo sapiens
gcatagaaactgaggagt

SEQ ID NO: 2124427 - DNA, 21 bp, Homo sapiens
gcatagaaactgaggagtagc

SEQ ID NO: 2124428 - DNA, 18 bp, Homo sapiens
gcatagattccctgagca

SEQ ID NO: 2124429 - DNA, 12 bp, Homo sapiens
gcatattaaagg

SEQ ID NO: 2124430 - DNA, 13 bp, Homo sapiens
gcatattaaaggc

SEQ ID NO: 2124431 - DNA, 15 bp, Homo sapiens
gcatattaaaggctt

SEQ ID NO: 2124432 - DNA, 16 bp, Homo sapiens
gcatcacagggcagag

SEQ ID NO: 2124433 - DNA, 22 bp, Homo sapiens
gcatcacagggcagagccggga

SEQ ID NO: 2124434 - DNA, 13 bp, Homo sapiens
gcatcacctcagg

SEQ ID NO: 2124435 - DNA, 17 bp, Homo sapiens
gcatcacctcaggccag

SEQ ID NO: 2124436 - DNA, 14 bp, Homo sapiens
gcatcacttggggt

SEQ ID NO: 2124437 - DNA, 17 bp, Homo sapiens
gcatcagaaagaggcag

SEQ ID NO: 2124438 - DNA, 23 bp, Homo sapiens
gcatcagaaagggagggctctga

SEQ ID NO: 2124439 - DNA, 12 bp, Homo sapiens
gcatcatgcctc

SEQ ID NO: 2124440 - DNA, 20 bp, Homo sapiens
gcatcatgcctctgaggcca

SEQ ID NO: 2124441 - DNA, 21 bp, Homo sapiens
gcatcatgcctctgaggccag

SEQ ID NO: 2124442 - DNA, 19 bp, Homo sapiens
gcatcattgtaaattattt

SEQ ID NO: 2124443 - DNA, 23 bp, Homo sapiens
gcatcattgtaaattatttcata

SEQ ID NO: 2124444 - DNA, 15 bp, Homo sapiens
gcatccacccagtgc

SEQ ID NO: 2124445 - DNA, 22 bp, Homo sapiens
gcatccacccagtgctgccatg

SEQ ID NO: 2124446 - DNA, 14 bp, Homo sapiens
gcatccattcctca

SEQ ID NO: 2124447 - DNA, 13 bp, Homo sapiens
gcatcccagggga

SEQ ID NO: 2124448 - DNA, 21 bp, Homo sapiens
gagggctagaacctggagagc

SEQ ID NO: 2124449 - DNA, 18 bp, Homo sapiens
gagggctagaactggaga

SEQ ID NO: 2124450 - DNA, 19 bp, Homo sapiens
gagggctagaatctggaga

SEQ ID NO: 2124451 - DNA, 15 bp, Homo sapiens
gagggctctgaggcg

SEQ ID NO: 2124452 - DNA, 13 bp, Homo sapiens
gagggctgcctga

SEQ ID NO: 2124453 - DNA, 15 bp, Homo sapiens
gagggctggaatctg

SEQ ID NO: 2124454 - DNA, 18 bp, Homo sapiens
gagggctggaatctggag

SEQ ID NO: 2124455 - DNA, 19 bp, Homo sapiens
gagggctggaatctggaga

SEQ ID NO: 2124456 - DNA, 20 bp, Homo sapiens
gagggctggaatctggagag

SEQ ID NO: 2124457 - DNA, 14 bp, Homo sapiens
gagggctgggccca

SEQ ID NO: 2124458 - DNA, 21 bp, Homo sapiens
gagggctgttggacagctgct

SEQ ID NO: 2124459 - DNA, 15 bp, Homo sapiens
gaggggaagggccag

SEQ ID NO: 2124460 - DNA, 20 bp, Homo sapiens
gaggggacatttccctcctg

SEQ ID NO: 2124461 - DNA, 12 bp, Homo sapiens
gaggggagaagc

SEQ ID NO: 2124462 - DNA, 21 bp, Homo sapiens
gaggggaggatcactggagcc

SEQ ID NO: 2124463 - DNA, 14 bp, Homo sapiens
gaggggcctctgaa

SEQ ID NO: 2124464 - DNA, 17 bp, Homo sapiens
gaggggcctgggaaagg

SEQ ID NO: 2124465 - DNA, 13 bp, Homo sapiens
gaggggctcctgg

SEQ ID NO: 2124466 - DNA, 13 bp, Homo sapiens
gaggggctgaatg

SEQ ID NO: 2124467 - DNA, 20 bp, Homo sapiens
gagggggctccatggaggag

SEQ ID NO: 2124468 - DNA, 17 bp, Homo sapiens
gagggggtcgtggagag

SEQ ID NO: 2124469 - DNA, 18 bp, Homo sapiens
gagggggtcgtggagagc

SEQ ID NO: 2124470 - DNA, 15 bp, Homo sapiens
gaggggtgacagtgg

SEQ ID NO: 2124471 - DNA, 17 bp, Homo sapiens
gaggggttgcgggggag

SEQ ID NO: 2124472 - DNA, 21 bp, Homo sapiens
gagggtccccgggagcacacg

SEQ ID NO: 2124473 - DNA, 19 bp, Homo sapiens
gagggtcgccacacccggc

SEQ ID NO: 2124474 - DNA, 20 bp, Homo sapiens
gagggtggagactaagccct

SEQ ID NO: 2124475 - DNA, 18 bp, Homo sapiens
gagggtgggagagcccag

SEQ ID NO: 2124476 - DNA, 21 bp, Homo sapiens
gagggtggggcaatggggaga

SEQ ID NO: 2124477 - DNA, 18 bp, Homo sapiens
gagggtggggccgggtga

SEQ ID NO: 2124478 - DNA, 14 bp, Homo sapiens
gagggtggtgacct

SEQ ID NO: 2124479 - DNA, 22 bp, Homo sapiens
gaggtaaaagtgtgagcagtga

SEQ ID NO: 2124480 - DNA, 18 bp, Homo sapiens
gaggtaactatcaatatt

SEQ ID NO: 2124481 - DNA, 23 bp, Homo sapiens
gaggtagagtttgaaggaggtga

SEQ ID NO: 2124482 - DNA, 17 bp, Homo sapiens
gaggtatacaatgttct

SEQ ID NO: 2124483 - DNA, 19 bp, Homo sapiens
gaggtatttatctttactt

SEQ ID NO: 2124484 - DNA, 15 bp, Homo sapiens
gaggtcaacagagaa

SEQ ID NO: 2124485 - DNA, 21 bp, Homo sapiens
gaggtcacattcaggaagatg

SEQ ID NO: 2124486 - DNA, 13 bp, Homo sapiens
gaggtcagagcct

SEQ ID NO: 2124487 - DNA, 20 bp, Homo sapiens
gaggtcagagcctgcagtta

SEQ ID NO: 2124488 - DNA, 12 bp, Homo sapiens
gaggtcccaggc

SEQ ID NO: 2124489 - DNA, 14 bp, Homo sapiens
gaggtccctgccag

SEQ ID NO: 2124490 - DNA, 20 bp, Homo sapiens
gaggtccctgcttacctgac

SEQ ID NO: 2124491 - DNA, 12 bp, Homo sapiens
gaggtcctcctc

SEQ ID NO: 2124492 - DNA, 14 bp, Homo sapiens
gaggtcctgagcac

SEQ ID NO: 2124493 - DNA, 20 bp, Homo sapiens
gaggtcctgagcactgccag

SEQ ID NO: 2124494 - DNA, 21 bp, Homo sapiens
gaggtcctgagcactgccagg

SEQ ID NO: 2124495 - DNA, 19 bp, Homo sapiens
gaggtgaccccagggcaca

SEQ ID NO: 2124496 - DNA, 22 bp, Homo sapiens
gaggtgaccccagggcacagga

SEQ ID NO: 2124497 - DNA, 16 bp, Homo sapiens
gaggtgagaccacctc

SEQ ID NO: 2124498 - DNA, 14 bp, Homo sapiens
gaggtgcccaggag

SEQ ID NO: 2124499 - DNA, 16 bp, Homo sapiens
gaggtgcccaggagaa

SEQ ID NO: 2124500 - DNA, 22 bp, Homo sapiens
gaggtgcctgagctggggcctg

SEQ ID NO: 2124501 - DNA, 20 bp, Homo sapiens
gaggtgcggccaccacccta

SEQ ID NO: 2124502 - DNA, 20 bp, Homo sapiens
gaggtggaagccctccttcc

SEQ ID NO: 2124503 - DNA, 19 bp, Homo sapiens
gaggtggaggttgcagtga

SEQ ID NO: 2124504 - DNA, 17 bp, Homo sapiens
gaggtggccagagctgg

SEQ ID NO: 2124505 - DNA, 15 bp, Homo sapiens
gaggtgggagacaag

SEQ ID NO: 2124506 - DNA, 21 bp, Homo sapiens
gaggtgggagacaaggaacca

SEQ ID NO: 2124507 - DNA, 15 bp, Homo sapiens
gaggtgggcagctgg

SEQ ID NO: 2124508 - DNA, 22 bp, Homo sapiens
gaggtggtagaaccacttggct

SEQ ID NO: 2124509 - DNA, 17 bp, Homo sapiens
gaggtggtgccttctca

SEQ ID NO: 2124510 - DNA, 14 bp, Homo sapiens
gaggtggtggagga

SEQ ID NO: 2124511 - DNA, 15 bp, Homo sapiens
gaggtgtcaccctgc

SEQ ID NO: 2124512 - DNA, 13 bp, Homo sapiens
gaggttaaaatat

SEQ ID NO: 2124513 - DNA, 15 bp, Homo sapiens
gaggttaaaatataa

SEQ ID NO: 2124514 - DNA, 14 bp, Homo sapiens
gaggttatctgcct

SEQ ID NO: 2124515 - DNA, 18 bp, Homo sapiens
gaggttatctgcctggcc

SEQ ID NO: 2124516 - DNA, 19 bp, Homo sapiens
gaggttatctgcctggcct

SEQ ID NO: 2124517 - DNA, 22 bp, Homo sapiens
gaggttatctgcctggcctggc

SEQ ID NO: 2124518 - DNA, 19 bp, Homo sapiens
gaggttgcagtgagccgag

SEQ ID NO: 2124519 - DNA, 14 bp, Homo sapiens
gaggttggtgactg

SEQ ID NO: 2124520 - DNA, 23 bp, Homo sapiens
gaggttttattctgacttcctct

SEQ ID NO: 2124521 - DNA, 20 bp, Homo sapiens
gagtactagaatttgtattt

SEQ ID NO: 2124522 - DNA, 19 bp, Homo sapiens
gagtagaaattgttcctga

SEQ ID NO: 2124523 - DNA, 17 bp, Homo sapiens
gagtagccgagagcctg

SEQ ID NO: 2124524 - DNA, 19 bp, Homo sapiens
gagtagccgagagcctgct

SEQ ID NO: 2124525 - DNA, 16 bp, Homo sapiens
gagtagctgagaggaa

SEQ ID NO: 2124526 - DNA, 18 bp, Homo sapiens
gagtagctgagaggaaga

SEQ ID NO: 2124527 - DNA, 19 bp, Homo sapiens
gagtagctgggactacagg

SEQ ID NO: 2124528 - DNA, 14 bp, Homo sapiens
gagtagtcagaagt

SEQ ID NO: 2124529 - DNA, 19 bp, Homo sapiens
gagtatacaatatataaaa

SEQ ID NO: 2124530 - DNA, 11 bp, Homo sapiens
gagtatatatg

SEQ ID NO: 2124531 - DNA, 19 bp, Homo sapiens
gagtatgcaagaagaatat

SEQ ID NO: 2124532 - DNA, 19 bp, Homo sapiens
gagtattaaatatttaaca

SEQ ID NO: 2124533 - DNA, 16 bp, Homo sapiens
gagtcaaaagcctggg

SEQ ID NO: 2124534 - DNA, 14 bp, Homo sapiens
gagtcaactggagc

SEQ ID NO: 2124535 - DNA, 15 bp, Homo sapiens
gagtcaactggagca

SEQ ID NO: 2124536 - DNA, 15 bp, Homo sapiens
gagtcaactggctgg

SEQ ID NO: 2124537 - DNA, 20 bp, Homo sapiens
gagtcaatcccctcattcag

SEQ ID NO: 2124538 - DNA, 13 bp, Homo sapiens
gagtcaccaagcc

SEQ ID NO: 2124539 - DNA, 14 bp, Homo sapiens
gagtcaccaagccc

SEQ ID NO: 2124540 - DNA, 17 bp, Homo sapiens
gagtcaccaagcccagt

SEQ ID NO: 2124541 - DNA, 14 bp, Homo sapiens
gagtcacctcctcc

SEQ ID NO: 2124542 - DNA, 14 bp, Homo sapiens
gagtcagaggagaa

SEQ ID NO: 2124543 - DNA, 18 bp, Homo sapiens
gagtcccaaggaaagccc

SEQ ID NO: 2124544 - DNA, 13 bp, Homo sapiens
gagtcccaccttg

SEQ ID NO: 2124545 - DNA, 21 bp, Homo sapiens
gagtcccaccttggctgcagg

SEQ ID NO: 2124546 - DNA, 22 bp, Homo sapiens
gatatatatttactaaaagaat

SEQ ID NO: 2124547 - DNA, 22 bp, Homo sapiens
gatatatgtatttattgtcatt

SEQ ID NO: 2124548 - DNA, 15 bp, Homo sapiens
gatatatttttcaca

SEQ ID NO: 2124549 - DNA, 13 bp, Homo sapiens
gatatctcatctc

SEQ ID NO: 2124550 - DNA, 14 bp, Homo sapiens
gatatctcatctct

SEQ ID NO: 2124551 - DNA, 15 bp, Homo sapiens
gatatctgaacacat

SEQ ID NO: 2124552 - DNA, 14 bp, Homo sapiens
gatatgaaaaatat

SEQ ID NO: 2124553 - DNA, 15 bp, Homo sapiens
gatatgaaaaatatg

SEQ ID NO: 2124554 - DNA, 15 bp, Homo sapiens
gatatgcaaaagctg

SEQ ID NO: 2124555 - DNA, 19 bp, Homo sapiens
gatatgtaaaacatttatt

SEQ ID NO: 2124556 - DNA, 16 bp, Homo sapiens
gatattatggcaagtg

SEQ ID NO: 2124557 - DNA, 19 bp, Homo sapiens
gatatttccatttcttcct

SEQ ID NO: 2124558 - DNA, 22 bp, Homo sapiens
gatatttccatttcttcctcac

SEQ ID NO: 2124559 - DNA, 23 bp, Homo sapiens
gatattttcaacgcagccctgct

SEQ ID NO: 2124560 - DNA, 20 bp, Homo sapiens
gatattttcttccaagcaaa

SEQ ID NO: 2124561 - DNA, 12 bp, Homo sapiens
gatatttttgta

SEQ ID NO: 2124562 - DNA, 14 bp, Homo sapiens
gatcaaaaataaac

SEQ ID NO: 2124563 - DNA, 15 bp, Homo sapiens
gatcaaaaataaact

SEQ ID NO: 2124564 - DNA, 16 bp, Homo sapiens
gatcaaaaataaacta

SEQ ID NO: 2124565 - DNA, 23 bp, Homo sapiens
gatcaaccccttcgctcctgtgt

SEQ ID NO: 2124566 - DNA, 13 bp, Homo sapiens
gatcaagtccaga

SEQ ID NO: 2124567 - DNA, 15 bp, Homo sapiens
gatcaattaaatgta

SEQ ID NO: 2124568 - DNA, 16 bp, Homo sapiens
gatcaattaaatgtag

SEQ ID NO: 2124569 - DNA, 20 bp, Homo sapiens
gatcacacagccacttagca

SEQ ID NO: 2124570 - DNA, 20 bp, Homo sapiens
gatcacagggccccagaagg

SEQ ID NO: 2124571 - DNA, 22 bp, Homo sapiens
gatcacagtgactttacaggag

SEQ ID NO: 2124572 - DNA, 14 bp, Homo sapiens
gatcaccagcccgg

SEQ ID NO: 2124573 - DNA, 15 bp, Homo sapiens
gatcaccagcccggc

SEQ ID NO: 2124574 - DNA, 18 bp, Homo sapiens
gatcaccagcccggcctg

SEQ ID NO: 2124575 - DNA, 20 bp, Homo sapiens
gatcaccagcccggcctgct

SEQ ID NO: 2124576 - DNA, 16 bp, Homo sapiens
gatcacgccactgcac

SEQ ID NO: 2124577 - DNA, 18 bp, Homo sapiens
gatcacgccactgcacta

SEQ ID NO: 2124578 - DNA, 12 bp, Homo sapiens
gatcacggctca

SEQ ID NO: 2124579 - DNA, 18 bp, Homo sapiens
gatcacggctcactgcag

SEQ ID NO: 2124580 - DNA, 13 bp, Homo sapiens
gatcactggagcc

SEQ ID NO: 2124581 - DNA, 14 bp, Homo sapiens
gatcactggagccc

SEQ ID NO: 2124582 - DNA, 18 bp, Homo sapiens
gatcactggagcccagga

SEQ ID NO: 2124583 - DNA, 15 bp, Homo sapiens
gatcagaacagcaga

SEQ ID NO: 2124584 - DNA, 13 bp, Homo sapiens
gatcagaaggctg

SEQ ID NO: 2124585 - DNA, 14 bp, Homo sapiens
gatcagaaggctgg

SEQ ID NO: 2124586 - DNA, 11 bp, Homo sapiens
gatcagcctcc

SEQ ID NO: 2124587 - DNA, 17 bp, Homo sapiens
gatcagcgtggccttgt

SEQ ID NO: 2124588 - DNA, 16 bp, Homo sapiens
gatcagctgtttgtca

SEQ ID NO: 2124589 - DNA, 18 bp, Homo sapiens
gatcaggaagagaaggag

SEQ ID NO: 2124590 - DNA, 18 bp, Homo sapiens
gatcagttataagtagca

SEQ ID NO: 2124591 - DNA, 17 bp, Homo sapiens
gatcataggtatttcaa

SEQ ID NO: 2124592 - DNA, 13 bp, Homo sapiens
gatcatccactgt

SEQ ID NO: 2124593 - DNA, 19 bp, Homo sapiens
gatcatccactgtgccatg

SEQ ID NO: 2124594 - DNA, 12 bp, Homo sapiens
gatcatcttgaa

SEQ ID NO: 2124595 - DNA, 18 bp, Homo sapiens
gatcatcttgaatatttg

SEQ ID NO: 2124596 - DNA, 14 bp, Homo sapiens
gatcatgaaaagtg

SEQ ID NO: 2124597 - DNA, 16 bp, Homo sapiens
gatcatgtaaatgatt

SEQ ID NO: 2124598 - DNA, 14 bp, Homo sapiens
gatccacacacaga

SEQ ID NO: 2124599 - DNA, 15 bp, Homo sapiens
gatccacacacagag

SEQ ID NO: 2124600 - DNA, 17 bp, Homo sapiens
gatccacacacagagga

SEQ ID NO: 2124601 - DNA, 18 bp, Homo sapiens
gatccacccacctcagcc

SEQ ID NO: 2124602 - DNA, 19 bp, Homo sapiens
gatccacccacctcagcct

SEQ ID NO: 2124603 - DNA, 16 bp, Homo sapiens
gatccaccctatccct

SEQ ID NO: 2124604 - DNA, 21 bp, Homo sapiens
gatccaccctcaaatgtcaga

SEQ ID NO: 2124605 - DNA, 22 bp, Homo sapiens
gatccacttcttaatgctttcc

SEQ ID NO: 2124606 - DNA, 23 bp, Homo sapiens
gatccagagacttggggaccaga

SEQ ID NO: 2124607 - DNA, 19 bp, Homo sapiens
gatccaggaagcatgagtg

SEQ ID NO: 2124608 - DNA, 19 bp, Homo sapiens
gatccatttggacaaaatg

SEQ ID NO: 2124609 - DNA, 18 bp, Homo sapiens
gatcccacttcactgtga

SEQ ID NO: 2124610 - DNA, 17 bp, Homo sapiens
gatcccatgtcacctca

SEQ ID NO: 2124611 - DNA, 19 bp, Homo sapiens
gatccctagctgtgacctc

SEQ ID NO: 2124612 - DNA, 20 bp, Homo sapiens
gatccctccatccggctcct

SEQ ID NO: 2124613 - DNA, 18 bp, Homo sapiens
gatccctgttacccagag

SEQ ID NO: 2124614 - DNA, 22 bp, Homo sapiens
gatccctttcccatgatccaga

SEQ ID NO: 2124615 - DNA, 13 bp, Homo sapiens
gatccgctgccac

SEQ ID NO: 2124616 - DNA, 14 bp, Homo sapiens
gatccgctgccacc

SEQ ID NO: 2124617 - DNA, 15 bp, Homo sapiens
gatccgctgccacca

SEQ ID NO: 2124618 - DNA, 19 bp, Homo sapiens
gatcctactcttcctttct

SEQ ID NO: 2124619 - DNA, 15 bp, Homo sapiens
gatcctcacaggagc

SEQ ID NO: 2124620 - DNA, 18 bp, Homo sapiens
gatcctcacaggagcaga

SEQ ID NO: 2124621 - DNA, 18 bp, Homo sapiens
gatcctcccacctcagcc

SEQ ID NO: 2124622 - DNA, 19 bp, Homo sapiens
gatcctcccacctcagcct

SEQ ID NO: 2124623 - DNA, 11 bp, Homo sapiens
gatcctgcagg

SEQ ID NO: 2124624 - DNA, 21 bp, Homo sapiens
gatcctgctgtggcctcactt

SEQ ID NO: 2124625 - DNA, 17 bp, Homo sapiens
gatcctggattcactca

SEQ ID NO: 2124626 - DNA, 18 bp, Homo sapiens
gatcctggattcactcac

SEQ ID NO: 2124627 - DNA, 19 bp, Homo sapiens
gatcctgtctttaaggaaa

SEQ ID NO: 2124628 - DNA, 23 bp, Homo sapiens
gatccttcatcgaacaaactgat

SEQ ID NO: 2124629 - DNA, 22 bp, Homo sapiens
gatccttgtctttactgacaag

SEQ ID NO: 2124630 - DNA, 14 bp, Homo sapiens
gatcgctggcagag

SEQ ID NO: 2124631 - DNA, 20 bp, Homo sapiens
gatcgcttgagcccaggagt

SEQ ID NO: 2124632 - DNA, 16 bp, Homo sapiens
gatcgttcaaagcatg

SEQ ID NO: 2124633 - DNA, 19 bp, Homo sapiens
gatctaaatagcccttgga

SEQ ID NO: 2124634 - DNA, 21 bp, Homo sapiens
gatctagttctcaatcactgc

SEQ ID NO: 2124635 - DNA, 16 bp, Homo sapiens
gatctatcaatagtca

SEQ ID NO: 2124636 - DNA, 16 bp, Homo sapiens
gatctatgcaattttt

SEQ ID NO: 2124637 - DNA, 20 bp, Homo sapiens
gatctcagataaagtgacca

SEQ ID NO: 2124638 - DNA, 21 bp, Homo sapiens
gatctcagataaagtgaccag

SEQ ID NO: 2124639 - DNA, 13 bp, Homo sapiens
gatctcaggagct

SEQ ID NO: 2124640 - DNA, 20 bp, Homo sapiens
gatctccaaggaccaggtta

SEQ ID NO: 2124641 - DNA, 18 bp, Homo sapiens
gatctccctgccgcctca

SEQ ID NO: 2124642 - DNA, 20 bp, Homo sapiens
gatctccctgccgcctcaat

SEQ ID NO: 2124643 - DNA, 14 bp, Homo sapiens
gatctctcaggagc

SEQ ID NO: 2124644 - DNA, 16 bp, Homo sapiens
gatctctcaggagcac

SEQ ID NO: 2124645 - DNA, 18 bp, Homo sapiens
gatctgatggtgagctgg

SEQ ID NO: 2124646 - DNA, 19 bp, Homo sapiens
gatctgatggtgagctggg

SEQ ID NO: 2124647 - DNA, 20 bp, Homo sapiens
gatctgatggtgagctggga

SEQ ID NO: 2124648 - DNA, 22 bp, Homo sapiens
gatctgatggtgagctgggaag

SEQ ID NO: 2124649 - DNA, 17 bp, Homo sapiens
gatctgcattccccgct

SEQ ID NO: 2124650 - DNA, 14 bp, Homo sapiens
gatctgcctgggcc

SEQ ID NO: 2124651 - DNA, 18 bp, Homo sapiens
gatctgcctgggcctgtg

SEQ ID NO: 2124652 - DNA, 21 bp, Homo sapiens
gatctgcctgggcctgtgcag

SEQ ID NO: 2124653 - DNA, 22 bp, Homo sapiens
gatctgcctgggcctgtgcagc

SEQ ID NO: 2124654 - DNA, 13 bp, Homo sapiens
gatctgcttcttc

SEQ ID NO: 2124655 - DNA, 11 bp, Homo sapiens
gatctgggagg

SEQ ID NO: 2124656 - DNA, 23 bp, Homo sapiens
gatctgggaggtctccactgagg

SEQ ID NO: 2124657 - DNA, 20 bp, Homo sapiens
gatctgggttcactgcaacc

SEQ ID NO: 2124658 - DNA, 18 bp, Homo sapiens
gatctgtcccctctcccc

SEQ ID NO: 2124659 - DNA, 21 bp, Homo sapiens
gagcaatgggagggggctcca

SEQ ID NO: 2124660 - DNA, 19 bp, Homo sapiens
gagcaattcatttcacttt

SEQ ID NO: 2124661 - DNA, 18 bp, Homo sapiens
gagcacaagttccagctg

SEQ ID NO: 2124662 - DNA, 15 bp, Homo sapiens
gagcacacggccctg

SEQ ID NO: 2124663 - DNA, 20 bp, Homo sapiens
gacatgaaaactattttaaa

SEQ ID NO: 2124664 - DNA, 12 bp, Homo sapiens
gacatgcactga

SEQ ID NO: 2124665 - DNA, 13 bp, Homo sapiens
gacatgcactgac

SEQ ID NO: 2124666 - DNA, 14 bp, Homo sapiens
gacatgcactgacc

SEQ ID NO: 2124667 - DNA, 14 bp, Homo sapiens
gacatgccaccctc

SEQ ID NO: 2124668 - DNA, 19 bp, Homo sapiens
gacatgccaccctctccat

SEQ ID NO: 2124669 - DNA, 15 bp, Homo sapiens
gacatgccatccatt

SEQ ID NO: 2124670 - DNA, 19 bp, Homo sapiens
gacatggagactcctgccc

SEQ ID NO: 2124671 - DNA, 12 bp, Homo sapiens
gacatggctttg

SEQ ID NO: 2124672 - DNA, 12 bp, Homo sapiens
gacatggggcat

SEQ ID NO: 2124673 - DNA, 15 bp, Homo sapiens
gacatggggcataga

SEQ ID NO: 2124674 - DNA, 14 bp, Homo sapiens
gacatgtttttgtt

SEQ ID NO: 2124675 - DNA, 22 bp, Homo sapiens
gacattatgtgtgcatgtgtgt

SEQ ID NO: 2124676 - DNA, 23 bp, Homo sapiens
gacattatgtgtgcatgtgtgta

SEQ ID NO: 2124677 - DNA, 23 bp, Homo sapiens
gacattcagtatataaaatatgt

SEQ ID NO: 2124678 - DNA, 14 bp, Homo sapiens
gacattccaacaat

SEQ ID NO: 2124679 - DNA, 17 bp, Homo sapiens
gacattgcggacagcca

SEQ ID NO: 2124680 - DNA, 18 bp, Homo sapiens
gacattgttaaaataaag

SEQ ID NO: 2124681 - DNA, 14 bp, Homo sapiens
gacatttccctcct

SEQ ID NO: 2124682 - DNA, 16 bp, Homo sapiens
gacatttccctcctgg

SEQ ID NO: 2124683 - DNA, 21 bp, Homo sapiens
gacatttctaacatatgtatt

SEQ ID NO: 2124684 - DNA, 22 bp, Homo sapiens
gacatttctaacatatgtatta

SEQ ID NO: 2124685 - DNA, 15 bp, Homo sapiens
gacatttgccttgct

SEQ ID NO: 2124686 - DNA, 18 bp, Homo sapiens
gacattttctctttaaaa

SEQ ID NO: 2124687 - DNA, 17 bp, Homo sapiens
gaccaaattgcttctag

SEQ ID NO: 2124688 - DNA, 17 bp, Homo sapiens
gaccaacatggagaaac

SEQ ID NO: 2124689 - DNA, 17 bp, Homo sapiens
gaccaaccctgtttcct

SEQ ID NO: 2124690 - DNA, 14 bp, Homo sapiens
gaccaacctgacca

SEQ ID NO: 2124691 - DNA, 13 bp, Homo sapiens
gaccaactggctt

SEQ ID NO: 2124692 - DNA, 16 bp, Homo sapiens
gaccaactggcttctg

SEQ ID NO: 2124693 - DNA, 13 bp, Homo sapiens
gagaaatttttat

SEQ ID NO: 2124694 - DNA, 16 bp, Homo sapiens
gagaacaagtcacagc

SEQ ID NO: 2124695 - DNA, 22 bp, Homo sapiens
gagaacaagtcacagctgcagc

SEQ ID NO: 2124696 - DNA, 13 bp, Homo sapiens
gagaacctggcct

SEQ ID NO: 2124697 - DNA, 14 bp, Homo sapiens
gagaacctggcctt

SEQ ID NO: 2124698 - DNA, 17 bp, Homo sapiens
gagaactcgaagccctt

SEQ ID NO: 2124699 - DNA, 20 bp, Homo sapiens
gagaactcgaagcccttcca

SEQ ID NO: 2124700 - DNA, 22 bp, Homo sapiens
gagaagaaagaggtgaccccag

SEQ ID NO: 2124701 - DNA, 13 bp, Homo sapiens
gagaagagctgtt

SEQ ID NO: 2124702 - DNA, 17 bp, Homo sapiens
gagaagatgtgatttat

SEQ ID NO: 2124703 - DNA, 14 bp, Homo sapiens
gagaagccacgctg

SEQ ID NO: 2124704 - DNA, 20 bp, Homo sapiens
gagaagccacgctgtcctct

SEQ ID NO: 2124705 - DNA, 19 bp, Homo sapiens
gagaagctaaaacctgagc

SEQ ID NO: 2124706 - DNA, 18 bp, Homo sapiens
gagaaggaaaattttagc

SEQ ID NO: 2124707 - DNA, 21 bp, Homo sapiens
gagaaggaaggagactcacct

SEQ ID NO: 2124708 - DNA, 20 bp, Homo sapiens
gagaaggacccggaggggcc

SEQ ID NO: 2124709 - DNA, 11 bp, Homo sapiens
gagaaggagcc

SEQ ID NO: 2124710 - DNA, 22 bp, Homo sapiens
gagaaggatgtccgttccagga

SEQ ID NO: 2124711 - DNA, 12 bp, Homo sapiens
gagaaggcagga

SEQ ID NO: 2124712 - DNA, 14 bp, Homo sapiens
gagaagggaagcct

SEQ ID NO: 2124713 - DNA, 15 bp, Homo sapiens
gagaagggatggagg

SEQ ID NO: 2124714 - DNA, 16 bp, Homo sapiens
gagaagggccagccct

SEQ ID NO: 2124715 - DNA, 21 bp, Homo sapiens
gagaagtatccaattatgtga

SEQ ID NO: 2124716 - DNA, 21 bp, Homo sapiens
gagaagtgagggctgggcagc

SEQ ID NO: 2124717 - DNA, 15 bp, Homo sapiens
gagaagttaagcagc

SEQ ID NO: 2124718 - DNA, 21 bp, Homo sapiens
gagaagtttctggccctggct

SEQ ID NO: 2124719 - DNA, 18 bp, Homo sapiens
gagaagttttgtacagag

SEQ ID NO: 2124720 - DNA, 19 bp, Homo sapiens
gagaagttttgtacagaga

SEQ ID NO: 2124721 - DNA, 16 bp, Homo sapiens
gagaataaagacttca

SEQ ID NO: 2124722 - DNA, 18 bp, Homo sapiens
gagaataagagaaagaaa

SEQ ID NO: 2124723 - DNA, 16 bp, Homo sapiens
gagaataattgtgtac

SEQ ID NO: 2124724 - DNA, 17 bp, Homo sapiens
gagaataattgtgtaca

SEQ ID NO: 2124725 - DNA, 16 bp, Homo sapiens
gagaatatttcaaatg

SEQ ID NO: 2124726 - DNA, 21 bp, Homo sapiens
gagaatcacacaagtttgtgc

SEQ ID NO: 2124727 - DNA, 19 bp, Homo sapiens
gagaatcagggcaggcttg

SEQ ID NO: 2124728 - DNA, 23 bp, Homo sapiens
gagaatctggctcctgtttccat

SEQ ID NO: 2124729 - DNA, 17 bp, Homo sapiens
gagaatgagggccaaga

SEQ ID NO: 2124730 - DNA, 17 bp, Homo sapiens
gagaatgcccaactctt

SEQ ID NO: 2124731 - DNA, 20 bp, Homo sapiens
gagaatggtgtgaacccggg

SEQ ID NO: 2124732 - DNA, 13 bp, Homo sapiens
gagaattgcctct

SEQ ID NO: 2124733 - DNA, 22 bp, Homo sapiens
gagaattgtgcgacttcacaaa

SEQ ID NO: 2124734 - DNA, 21 bp, Homo sapiens
gagaatttctaccatttcaga

SEQ ID NO: 2124735 - DNA, 17 bp, Homo sapiens
gagacaagaaatccctg

SEQ ID NO: 2124736 - DNA, 16 bp, Homo sapiens
gagacaagccctggca

SEQ ID NO: 2124737 - DNA, 19 bp, Homo sapiens
gagacaagccctggcaaca

SEQ ID NO: 2124738 - DNA, 16 bp, Homo sapiens
gagacaataaaacatt

SEQ ID NO: 2124739 - DNA, 19 bp, Homo sapiens
gagacaatcacagctcctc

SEQ ID NO: 2124740 - DNA, 14 bp, Homo sapiens
gagacacagagatg

SEQ ID NO: 2124741 - DNA, 16 bp, Homo sapiens
gagacacagcgtccct

SEQ ID NO: 2124742 - DNA, 20 bp, Homo sapiens
gagacacattaaagggtagc

SEQ ID NO: 2124743 - DNA, 20 bp, Homo sapiens
gagacacctgcacctccccc

SEQ ID NO: 2124744 - DNA, 19 bp, Homo sapiens
gagacacgtgtggcgggca

SEQ ID NO: 2124745 - DNA, 20 bp, Homo sapiens
gagacactgtgctataaatc

SEQ ID NO: 2124746 - DNA, 21 bp, Homo sapiens
gagacagaaacagagagagac

SEQ ID NO: 2124747 - DNA, 22 bp, Homo sapiens
gagacagaccggggttcaagcc

SEQ ID NO: 2124748 - DNA, 14 bp, Homo sapiens
gagacagagagaga

SEQ ID NO: 2124749 - DNA, 18 bp, Homo sapiens
gagacagagagagactga

SEQ ID NO: 2124750 - DNA, 17 bp, Homo sapiens
gagacagagcccccaag

SEQ ID NO: 2124751 - DNA, 19 bp, Homo sapiens
gagacagagcccccaagcc

SEQ ID NO: 2124752 - DNA, 21 bp, Homo sapiens
gagacagagcccccaagcctc

SEQ ID NO: 2124753 - DNA, 20 bp, Homo sapiens
gagacagcgaactagaagaa

SEQ ID NO: 2124754 - DNA, 20 bp, Homo sapiens
gagacaggaaaatcctctgg

SEQ ID NO: 2124755 - DNA, 18 bp, Homo sapiens
gagacagttatttatagt

SEQ ID NO: 2124756 - DNA, 16 bp, Homo sapiens
gagacagttcaagaaa

SEQ ID NO: 2124757 - DNA, 14 bp, Homo sapiens
gagaccaacctgac

SEQ ID NO: 2124758 - DNA, 15 bp, Homo sapiens
gagaccaacctgacc

SEQ ID NO: 2124759 - DNA, 18 bp, Homo sapiens
gagaccaaggcgggagca

SEQ ID NO: 2124760 - DNA, 15 bp, Homo sapiens
gagaccagctcagag

SEQ ID NO: 2124761 - DNA, 21 bp, Homo sapiens
gagaccagttgggagcactgg

SEQ ID NO: 2124762 - DNA, 22 bp, Homo sapiens
gagaccagttgggagcactgga

SEQ ID NO: 2124763 - DNA, 18 bp, Homo sapiens
gagaccatcctggcccct

SEQ ID NO: 2124764 - DNA, 13 bp, Homo sapiens
gagacccagatct

SEQ ID NO: 2124765 - DNA, 22 bp, Homo sapiens
gagacccagatctcatggaaac

SEQ ID NO: 2124766 - DNA, 14 bp, Homo sapiens
gagaccccaggatc

SEQ ID NO: 2124767 - DNA, 20 bp, Homo sapiens
gagaccccttcctttcctct

SEQ ID NO: 2124768 - DNA, 17 bp, Homo sapiens
gagaccctacaggagag

SEQ ID NO: 2124769 - DNA, 12 bp, Homo sapiens
gagaccctcact

SEQ ID NO: 2124770 - DNA, 22 bp, Homo sapiens
gagaccctggaattcagcaccc

SEQ ID NO: 2124771 - DNA, 17 bp, Homo sapiens
gagacccttgcattaga

SEQ ID NO: 2124772 - DNA, 19 bp, Homo sapiens
gagacccttgcattagaaa

SEQ ID NO: 2124773 - DNA, 13 bp, Homo sapiens
gagacctcagcca

SEQ ID NO: 2124774 - DNA, 14 bp, Homo sapiens
gagacctcagccat

SEQ ID NO: 2124775 - DNA, 16 bp, Homo sapiens
gagacctgaggcagat

SEQ ID NO: 2124776 - DNA, 19 bp, Homo sapiens
gagacgcagccctgggggc

SEQ ID NO: 2124777 - DNA, 23 bp, Homo sapiens
gagacgcagccctgggggccagc

SEQ ID NO: 2124778 - DNA, 21 bp, Homo sapiens
gagacggaggttgcagtgagc

SEQ ID NO: 2124779 - DNA, 14 bp, Homo sapiens
gagacggagtccca

SEQ ID NO: 2124780 - DNA, 22 bp, Homo sapiens
gagacggcagagaccccaggat

SEQ ID NO: 2124781 - DNA, 14 bp, Homo sapiens
gagacggctggacc

SEQ ID NO: 2124782 - DNA, 15 bp, Homo sapiens
gagacggctggacct

SEQ ID NO: 2124783 - DNA, 21 bp, Homo sapiens
gagacggtgctcgcttctcct

SEQ ID NO: 2124784 - DNA, 15 bp, Homo sapiens
gagacgtgtacatag

SEQ ID NO: 2124785 - DNA, 16 bp, Homo sapiens
gagacgtgtacatagt

SEQ ID NO: 2124786 - DNA, 14 bp, Homo sapiens
gagactaagccctg

SEQ ID NO: 2124787 - DNA, 15 bp, Homo sapiens
gagactatgtgtcat

SEQ ID NO: 2124788 - DNA, 23 bp, Homo sapiens
gagactccagaatctgctgttgc

SEQ ID NO: 2124789 - DNA, 19 bp, Homo sapiens
gagactctcttaggagcag

SEQ ID NO: 2124790 - DNA, 16 bp, Homo sapiens
gagactctggaagccc

SEQ ID NO: 2124791 - DNA, 13 bp, Homo sapiens
gagactctgtctc

SEQ ID NO: 2124792 - DNA, 19 bp, Homo sapiens
gagactgaaagcagcagct

SEQ ID NO: 2124793 - DNA, 15 bp, Homo sapiens
gagactgagggagag

SEQ ID NO: 2124794 - DNA, 16 bp, Homo sapiens
gagactgagggagaga

SEQ ID NO: 2124795 - DNA, 20 bp, Homo sapiens
gagactgggtgaaagtgact

SEQ ID NO: 2124796 - DNA, 15 bp, Homo sapiens
gacacaggcctgtgt

SEQ ID NO: 2124797 - DNA, 16 bp, Homo sapiens
gacacaggcctgtgta

SEQ ID NO: 2124798 - DNA, 21 bp, Homo sapiens
gacacaggcctgtgtagctgt

SEQ ID NO: 2124799 - DNA, 18 bp, Homo sapiens
gacacagtttctattgta

SEQ ID NO: 2124800 - DNA, 15 bp, Homo sapiens
gacacataatttgaa

SEQ ID NO: 2124801 - DNA, 17 bp, Homo sapiens
gacacatcccggcctct

SEQ ID NO: 2124802 - DNA, 21 bp, Homo sapiens
gacacatcccggcctcttcca

SEQ ID NO: 2124803 - DNA, 20 bp, Homo sapiens
gacaccaaattccaaacttc

SEQ ID NO: 2124804 - DNA, 16 bp, Homo sapiens
gacaccagaataatga

SEQ ID NO: 2124805 - DNA, 22 bp, Homo sapiens
gacaccatcttttgtgagatgt

SEQ ID NO: 2124806 - DNA, 17 bp, Homo sapiens
gacaccccttatccagg

SEQ ID NO: 2124807 - DNA, 19 bp, Homo sapiens
gacaccccttatccaggac

SEQ ID NO: 2124808 - DNA, 20 bp, Homo sapiens
gacaccccttatccaggact

SEQ ID NO: 2124809 - DNA, 15 bp, Homo sapiens
gacaccgtccctcag

SEQ ID NO: 2124810 - DNA, 17 bp, Homo sapiens
gacaccgtccctcagtg

SEQ ID NO: 2124811 - DNA, 16 bp, Homo sapiens
gacacctaccatgctg

SEQ ID NO: 2124812 - DNA, 18 bp, Homo sapiens
gacacctaccatgctgct

SEQ ID NO: 2124813 - DNA, 16 bp, Homo sapiens
gacacctgcacctccc

SEQ ID NO: 2124814 - DNA, 15 bp, Homo sapiens
gacacctgccccagc

SEQ ID NO: 2124815 - DNA, 18 bp, Homo sapiens
gacacctgccccagcgcg

SEQ ID NO: 2124816 - DNA, 12 bp, Homo sapiens
gacacctgccct

SEQ ID NO: 2124817 - DNA, 23 bp, Homo sapiens
gacacctgccctgccctgccacc

SEQ ID NO: 2124818 - DNA, 19 bp, Homo sapiens
gacacctggccgcctccag

SEQ ID NO: 2124819 - DNA, 20 bp, Homo sapiens
gacacctggccgcctccagg

SEQ ID NO: 2124820 - DNA, 18 bp, Homo sapiens
gacaccttgacagggcac

SEQ ID NO: 2124821 - DNA, 23 bp, Homo sapiens
gacacgctcttctattttattcc

SEQ ID NO: 2124822 - DNA, 22 bp, Homo sapiens
gacacggtgaaatccaggtctc

SEQ ID NO: 2124823 - DNA, 21 bp, Homo sapiens
gacacgtgtggcgggcagtgg

SEQ ID NO: 2124824 - DNA, 19 bp, Homo sapiens
gacactcctataaggagag

SEQ ID NO: 2124825 - DNA, 15 bp, Homo sapiens
gacactgatgggcaa

SEQ ID NO: 2124826 - DNA, 16 bp, Homo sapiens
gacactgccacacagg

SEQ ID NO: 2124827 - DNA, 12 bp, Homo sapiens
gacactgctgca

SEQ ID NO: 2124828 - DNA, 16 bp, Homo sapiens
gacactggtttgaaga

SEQ ID NO: 2124829 - DNA, 21 bp, Homo sapiens
gacacttcatggaccaagaat

SEQ ID NO: 2124830 - DNA, 14 bp, Homo sapiens
gacagaaaaaaata

SEQ ID NO: 2124831 - DNA, 13 bp, Homo sapiens
gacagaagaaggc

SEQ ID NO: 2124832 - DNA, 20 bp, Homo sapiens
gacagacacaggcccggctc

SEQ ID NO: 2124833 - DNA, 23 bp, Homo sapiens
gacagacacttctaaatgaagtg

SEQ ID NO: 2124834 - DNA, 16 bp, Homo sapiens
gacagaccccttggct

SEQ ID NO: 2124835 - DNA, 19 bp, Homo sapiens
gacagaccccttggctttt

SEQ ID NO: 2124836 - DNA, 20 bp, Homo sapiens
gacagaccggggttcaagcc

SEQ ID NO: 2124837 - DNA, 15 bp, Homo sapiens
gacagacctggacac

SEQ ID NO: 2124838 - DNA, 16 bp, Homo sapiens
gacagagacacctgca

SEQ ID NO: 2124839 - DNA, 21 bp, Homo sapiens
gacagagacacctgcacctcc

SEQ ID NO: 2124840 - DNA, 16 bp, Homo sapiens
gacagagacagagaga

SEQ ID NO: 2124841 - DNA, 15 bp, Homo sapiens
gacagagacccagat

SEQ ID NO: 2124842 - DNA, 12 bp, Homo sapiens
gacagagagaga

SEQ ID NO: 2124843 - DNA, 13 bp, Homo sapiens
gacagagagagac

SEQ ID NO: 2124844 - DNA, 15 bp, Homo sapiens
gacagagagagactg

SEQ ID NO: 2124845 - DNA, 17 bp, Homo sapiens
gacagagcccccaagcc

SEQ ID NO: 2124846 - DNA, 21 bp, Homo sapiens
gacagagcccccaagcctctg

SEQ ID NO: 2124847 - DNA, 17 bp, Homo sapiens
gacagagccctgtgagg

SEQ ID NO: 2124848 - DNA, 12 bp, Homo sapiens
gacagaggcagc

SEQ ID NO: 2124849 - DNA, 19 bp, Homo sapiens
gacagagtgagactctgtc

SEQ ID NO: 2124850 - DNA, 18 bp, Homo sapiens
gacagatacatagatgga

SEQ ID NO: 2124851 - DNA, 15 bp, Homo sapiens
gacagcagctcaggc

SEQ ID NO: 2124852 - DNA, 16 bp, Homo sapiens
gacagcagctcaggca

SEQ ID NO: 2124853 - DNA, 22 bp, Homo sapiens
gacagcataccttggactgact

SEQ ID NO: 2124854 - DNA, 13 bp, Homo sapiens
gacagccacggcc

SEQ ID NO: 2124855 - DNA, 17 bp, Homo sapiens
gacagccacggccaggc

SEQ ID NO: 2124856 - DNA, 20 bp, Homo sapiens
gacagccacggccaggccag

SEQ ID NO: 2124857 - DNA, 17 bp, Homo sapiens
gacagccagagcctgtc

SEQ ID NO: 2124858 - DNA, 11 bp, Homo sapiens
gacagcccagc

SEQ ID NO: 2124859 - DNA, 13 bp, Homo sapiens
gacagcccagcct

SEQ ID NO: 2124860 - DNA, 10 bp, Homo sapiens
gacagcccca

SEQ ID NO: 2124861 - DNA, 11 bp, Homo sapiens
gacagccccag

SEQ ID NO: 2124862 - DNA, 12 bp, Homo sapiens
gacagccccagg

SEQ ID NO: 2124863 - DNA, 13 bp, Homo sapiens
gacagccccaggg

SEQ ID NO: 2124864 - DNA, 15 bp, Homo sapiens
gacagccgcctggag

SEQ ID NO: 2124865 - DNA, 12 bp, Homo sapiens
gacagcctggca

SEQ ID NO: 2124866 - DNA, 20 bp, Homo sapiens
gacagcctgtggcggtgcct

SEQ ID NO: 2124867 - DNA, 15 bp, Homo sapiens
gacagctccttctgt

SEQ ID NO: 2124868 - DNA, 18 bp, Homo sapiens
gacagctccttctgtcct

SEQ ID NO: 2124869 - DNA, 13 bp, Homo sapiens
gacagctgacaga

SEQ ID NO: 2124870 - DNA, 15 bp, Homo sapiens
gacagctgcttgtgg

SEQ ID NO: 2124871 - DNA, 14 bp, Homo sapiens
gacagctggctgct

SEQ ID NO: 2124872 - DNA, 15 bp, Homo sapiens
gacagctggctgctg

SEQ ID NO: 2124873 - DNA, 17 bp, Homo sapiens
gacagctggctgctgac

SEQ ID NO: 2124874 - DNA, 15 bp, Homo sapiens
gacagctgtccctgt

SEQ ID NO: 2124875 - DNA, 17 bp, Homo sapiens
gacagctgtccctgtca

SEQ ID NO: 2124876 - DNA, 18 bp, Homo sapiens
gacagctgtccctgtcac

SEQ ID NO: 2124877 - DNA, 21 bp, Homo sapiens
gacagcttgtggcaagtgaat

SEQ ID NO: 2124878 - DNA, 18 bp, Homo sapiens
gacaggaaaatcctctgg

SEQ ID NO: 2124879 - DNA, 13 bp, Homo sapiens
gacaggaaagaat

SEQ ID NO: 2124880 - DNA, 16 bp, Homo sapiens
gacaggaaagccctcc

SEQ ID NO: 2124881 - DNA, 24 bp, Homo sapiens
gacaggactaacactcagaagcct

SEQ ID NO: 2124882 - DNA, 17 bp, Homo sapiens
gacaggagggcaagggc

SEQ ID NO: 2124883 - DNA, 21 bp, Homo sapiens
gacaggaggggcccacaatgg

SEQ ID NO: 2124884 - DNA, 20 bp, Homo sapiens
gacaggcaagcacctcctgc

SEQ ID NO: 2124885 - DNA, 14 bp, Homo sapiens
gacaggcaatgctg

SEQ ID NO: 2124886 - DNA, 17 bp, Homo sapiens
gacaggcaatgctggct

SEQ ID NO: 2124887 - DNA, 19 bp, Homo sapiens
gacaggcaatgctggctgt

SEQ ID NO: 2124888 - DNA, 18 bp, Homo sapiens
gacaggcatgttctctga

SEQ ID NO: 2124889 - DNA, 20 bp, Homo sapiens
gacaggcatgttctctgagg

SEQ ID NO: 2124890 - DNA, 15 bp, Homo sapiens
gacaggcccaagaga

SEQ ID NO: 2124891 - DNA, 18 bp, Homo sapiens
gacaggcccaagagatga

SEQ ID NO: 2124892 - DNA, 22 bp, Homo sapiens
gacaggcccaagagatgaagag

SEQ ID NO: 2124893 - DNA, 19 bp, Homo sapiens
gacaggcgctggacagagg

SEQ ID NO: 2124894 - DNA, 19 bp, Homo sapiens
gacagggcaatcttgtcca

SEQ ID NO: 2124895 - DNA, 20 bp, Homo sapiens
gacagggcatggccaggtgg

SEQ ID NO: 2124896 - DNA, 17 bp, Homo sapiens
gacagggtctcactatg

SEQ ID NO: 2124897 - DNA, 21 bp, Homo sapiens
gacaggttcccagcagctggg

SEQ ID NO: 2124898 - DNA, 21 bp, Homo sapiens
gacagtccgtcaaaacagatt

SEQ ID NO: 2124899 - DNA, 15 bp, Homo sapiens
gacagtcctgggaga

SEQ ID NO: 2124900 - DNA, 22 bp, Homo sapiens
gacagtgaattgacccatgttc

SEQ ID NO: 2124901 - DNA, 16 bp, Homo sapiens
gacagtgatctccata

SEQ ID NO: 2124902 - DNA, 17 bp, Homo sapiens
gacagtgcttcagcctg

SEQ ID NO: 2124903 - DNA, 20 bp, Homo sapiens
gacagtgcttcagcctgagg

SEQ ID NO: 2124904 - DNA, 21 bp, Homo sapiens
gacagttatactgtcggtttt

SEQ ID NO: 2124905 - DNA, 13 bp, Homo sapiens
gacagttggcaga

SEQ ID NO: 2124906 - DNA, 18 bp, Homo sapiens
gacagttggcagagaagg

SEQ ID NO: 2124907 - DNA, 24 bp, Homo sapiens
gacagttggcagagaaggcctctt

SEQ ID NO: 2124908 - DNA, 16 bp, Homo sapiens
gacatatatattaaaa

SEQ ID NO: 2124909 - DNA, 15 bp, Homo sapiens
gacatattcttggag

SEQ ID NO: 2124910 - DNA, 21 bp, Homo sapiens
gacatattcttggagaacttt

SEQ ID NO: 2124911 - DNA, 16 bp, Homo sapiens
gacatcacttgtacaa

SEQ ID NO: 2124912 - DNA, 16 bp, Homo sapiens
gacatccgttgtgctt

SEQ ID NO: 2124913 - DNA, 21 bp, Homo sapiens
tgtaaatacagtggatctcaa

SEQ ID NO: 2124914 - DNA, 19 bp, Homo sapiens
tgtaaatacatgtgtggat

SEQ ID NO: 2124915 - DNA, 20 bp, Homo sapiens
tgtaaatacatgtgtggatg

SEQ ID NO: 2124916 - DNA, 16 bp, Homo sapiens
tgtaaatagctcaggt

SEQ ID NO: 2124917 - DNA, 22 bp, Homo sapiens
tgtaaatagttttaaatatgaa

SEQ ID NO: 2124918 - DNA, 15 bp, Homo sapiens
tgtaaatatccacag

SEQ ID NO: 2124919 - DNA, 13 bp, Homo sapiens
tgtaaatatgttt

SEQ ID NO: 2124920 - DNA, 17 bp, Homo sapiens
tgtaaatatgtttgtgc

SEQ ID NO: 2124921 - DNA, 13 bp, Homo sapiens
tgtaaatatttat

SEQ ID NO: 2124922 - DNA, 14 bp, Homo sapiens
tgtaaatattttaa

SEQ ID NO: 2124923 - DNA, 22 bp, Homo sapiens
tgtaaatcacttgtaaataaat

SEQ ID NO: 2124924 - DNA, 19 bp, Homo sapiens
tgtaaatcctttttcttta

SEQ ID NO: 2124925 - DNA, 17 bp, Homo sapiens
tgtaaatggagcttgta

SEQ ID NO: 2124926 - DNA, 18 bp, Homo sapiens
tgtaaattatttcataca

SEQ ID NO: 2124927 - DNA, 16 bp, Homo sapiens
tgtaaatttggattta

SEQ ID NO: 2124928 - DNA, 20 bp, Homo sapiens
tgtaaattttgtatgaaaaa

SEQ ID NO: 2124929 - DNA, 15 bp, Homo sapiens
tgtaacacaagccac

SEQ ID NO: 2124930 - DNA, 16 bp, Homo sapiens
tgtaacacaagccaca

SEQ ID NO: 2124931 - DNA, 21 bp, Homo sapiens
tgtaacacaagccacagaagc

SEQ ID NO: 2124932 - DNA, 24 bp, Homo sapiens
tgtaacacaagccacagaagccag

SEQ ID NO: 2124933 - DNA, 22 bp, Homo sapiens
tgtccctaccgagtctcttctc

SEQ ID NO: 2124934 - DNA, 19 bp, Homo sapiens
tgtccctcaaatgacccaa

SEQ ID NO: 2124935 - DNA, 20 bp, Homo sapiens
tgtccctcactgccttccag

SEQ ID NO: 2124936 - DNA, 16 bp, Homo sapiens
tgtccctgctcctccc

SEQ ID NO: 2124937 - DNA, 21 bp, Homo sapiens
tgtcccttttgcataagatta

SEQ ID NO: 2124938 - DNA, 15 bp, Homo sapiens
tgtccgactcttctg

SEQ ID NO: 2124939 - DNA, 12 bp, Homo sapiens
tgtcctactctg

SEQ ID NO: 2124940 - DNA, 17 bp, Homo sapiens
tgtcctactctgtgtca

SEQ ID NO: 2124941 - DNA, 23 bp, Homo sapiens
tgtcctaggggccgagggaaatg

SEQ ID NO: 2124942 - DNA, 22 bp, Homo sapiens
tgtcctatgtgtgactctaaat

SEQ ID NO: 2124943 - DNA, 13 bp, Homo sapiens
tgtcctcccatcc

SEQ ID NO: 2124944 - DNA, 23 bp, Homo sapiens
tgtcctcccatcccctggactgg

SEQ ID NO: 2124945 - DNA, 11 bp, Homo sapiens
tgtcctcctcg

SEQ ID NO: 2124946 - DNA, 22 bp, Homo sapiens
tgtcctctcccctctgccctgt

SEQ ID NO: 2124947 - DNA, 19 bp, Homo sapiens
tgctttgggctgccctggt

SEQ ID NO: 2124948 - DNA, 21 bp, Homo sapiens
tgctttgggctgccctggtgc

SEQ ID NO: 2124949 - DNA, 12 bp, Homo sapiens
tgctttgggctt

SEQ ID NO: 2124950 - DNA, 21 bp, Homo sapiens
tgctttgggctttgcaggctc

SEQ ID NO: 2124951 - DNA, 22 bp, Homo sapiens
tgctttgggctttgcaggctct

SEQ ID NO: 2124952 - DNA, 19 bp, Homo sapiens
tgctttgtcatccatgcgt

SEQ ID NO: 2124953 - DNA, 19 bp, Homo sapiens
tgctttgttctttatttgt

SEQ ID NO: 2124954 - DNA, 14 bp, Homo sapiens
tgcttttcatcctt

SEQ ID NO: 2124955 - DNA, 21 bp, Homo sapiens
tgcttttgccactttggcttc

SEQ ID NO: 2124956 - DNA, 14 bp, Homo sapiens
tgcttttgctgggg

SEQ ID NO: 2124957 - DNA, 14 bp, Homo sapiens
tgcttttggtctgt

SEQ ID NO: 2124958 - DNA, 20 bp, Homo sapiens
tgcttttgtctatgggactc

SEQ ID NO: 2124959 - DNA, 15 bp, Homo sapiens
tgctttttcaccaga

SEQ ID NO: 2124960 - DNA, 19 bp, Homo sapiens
tggaaaaaaaatatatata

SEQ ID NO: 2124961 - DNA, 12 bp, Homo sapiens
tggaaaaatatt

SEQ ID NO: 2124962 - DNA, 13 bp, Homo sapiens
tggaaaaatccag

SEQ ID NO: 2124963 - DNA, 14 bp, Homo sapiens
tggaaaagaataca

SEQ ID NO: 2124964 - DNA, 18 bp, Homo sapiens
tggaaaagaatccctgca

SEQ ID NO: 2124965 - DNA, 16 bp, Homo sapiens
tggaaaagaggagttt

SEQ ID NO: 2124966 - DNA, 13 bp, Homo sapiens
tggaaaagcccag

SEQ ID NO: 2124967 - DNA, 14 bp, Homo sapiens
tggaaaagcccagt

SEQ ID NO: 2124968 - DNA, 21 bp, Homo sapiens
tggaaaagcccagtgacctga

SEQ ID NO: 2124969 - DNA, 21 bp, Homo sapiens
tggaaaagtcacacagacaca

SEQ ID NO: 2124970 - DNA, 14 bp, Homo sapiens
tggaaacagggcag

SEQ ID NO: 2124971 - DNA, 17 bp, Homo sapiens
tggaaacagggcagtga

SEQ ID NO: 2124972 - DNA, 15 bp, Homo sapiens
tggaaaccacacttc

SEQ ID NO: 2124973 - DNA, 20 bp, Homo sapiens
tggaaaccacacttcttgaa

SEQ ID NO: 2124974 - DNA, 21 bp, Homo sapiens
tggaaaccacacttcttgaaa

SEQ ID NO: 2124975 - DNA, 17 bp, Homo sapiens
tggaaacctgaaaaaaa

SEQ ID NO: 2124976 - DNA, 21 bp, Homo sapiens
tggaaactggatgaggtcata

SEQ ID NO: 2124977 - DNA, 22 bp, Homo sapiens
tggaaagacgtttttgtgctgt

SEQ ID NO: 2124978 - DNA, 13 bp, Homo sapiens
tggaaagagacca

SEQ ID NO: 2124979 - DNA, 15 bp, Homo sapiens
tggaaagcaaagggc

SEQ ID NO: 2124980 - DNA, 20 bp, Homo sapiens
tggaaagcatcacctcaggc

SEQ ID NO: 2124981 - DNA, 12 bp, Homo sapiens
tggaaagcctct

SEQ ID NO: 2124982 - DNA, 14 bp, Homo sapiens
tggaaagcctctgc

SEQ ID NO: 2124983 - DNA, 20 bp, Homo sapiens
tggaaaggtcattgtggcta

SEQ ID NO: 2124984 - DNA, 21 bp, Homo sapiens
tggaaataaacctggagatga

SEQ ID NO: 2124985 - DNA, 15 bp, Homo sapiens
tggaaataaatgtat

SEQ ID NO: 2124986 - DNA, 23 bp, Homo sapiens
tggaaataaatgtatcatagaaa

SEQ ID NO: 2124987 - DNA, 22 bp, Homo sapiens
tggaaatatcagttactcagcc

SEQ ID NO: 2124988 - DNA, 14 bp, Homo sapiens
tggaaatatgttct

SEQ ID NO: 2124989 - DNA, 15 bp, Homo sapiens
tggaaatatgttcta

SEQ ID NO: 2124990 - DNA, 16 bp, Homo sapiens
tggaaatatgttctaa

SEQ ID NO: 2124991 - DNA, 22 bp, Homo sapiens
tggaaatcctgttacttaaata

SEQ ID NO: 2124992 - DNA, 15 bp, Homo sapiens
tggaaatctggattt

SEQ ID NO: 2124993 - DNA, 16 bp, Homo sapiens
tggaaattttgtccat

SEQ ID NO: 2124994 - DNA, 18 bp, Homo sapiens
tggaacagtcacccttct

SEQ ID NO: 2124995 - DNA, 18 bp, Homo sapiens
tggaaccagggaggagag

SEQ ID NO: 2124996 - DNA, 23 bp, Homo sapiens
tggaactacattagtacacagca

SEQ ID NO: 2124997 - DNA, 13 bp, Homo sapiens
tggaactgaaggg

SEQ ID NO: 2124998 - DNA, 15 bp, Homo sapiens
tggaactgaaggggg

SEQ ID NO: 2124999 - DNA, 21 bp, Homo sapiens
tggaactgaagggggcggcct

SEQ ID NO: 2125000 - DNA, 23 bp, Homo sapiens
tggaactgtctctcatgaacctc

SEQ ID NO: 2125001 - DNA, 14 bp, Homo sapiens
tggaacttctaata

SEQ ID NO: 2125002 - DNA, 15 bp, Homo sapiens
tggaacttgaactga

SEQ ID NO: 2125003 - DNA, 16 bp, Homo sapiens
tggaagagaaatctca

SEQ ID NO: 2125004 - DNA, 12 bp, Homo sapiens
tggaagagcagc

SEQ ID NO: 2125005 - DNA, 16 bp, Homo sapiens
tggaagcactgctgtg

SEQ ID NO: 2125006 - DNA, 11 bp, Homo sapiens
gtctcttcaga

SEQ ID NO: 2125007 - DNA, 14 bp, Homo sapiens
gtctcttctccact

SEQ ID NO: 2125008 - DNA, 16 bp, Homo sapiens
gtctcttctccactgg

SEQ ID NO: 2125009 - DNA, 18 bp, Homo sapiens
gtctcttctccactggat

SEQ ID NO: 2125010 - DNA, 17 bp, Homo sapiens
gtctctttaatcttcag

SEQ ID NO: 2125011 - DNA, 18 bp, Homo sapiens
gtctctttaatcttcagt

SEQ ID NO: 2125012 - DNA, 19 bp, Homo sapiens
gtctctttaatgtcacagg

SEQ ID NO: 2125013 - DNA, 22 bp, Homo sapiens
gtctctttaatgtcacaggcag

SEQ ID NO: 2125014 - DNA, 19 bp, Homo sapiens
gtctgaaaatgttgttatg

SEQ ID NO: 2125015 - DNA, 23 bp, Homo sapiens
gtctgaaagacagaatgtcacca

SEQ ID NO: 2125016 - DNA, 11 bp, Homo sapiens
gtctgaaatgg

SEQ ID NO: 2125017 - DNA, 13 bp, Homo sapiens
gtctgacccactg

SEQ ID NO: 2125018 - DNA, 13 bp, Homo sapiens
gtctgactccaga

SEQ ID NO: 2125019 - DNA, 14 bp, Homo sapiens
gtctgactccagag

SEQ ID NO: 2125020 - DNA, 15 bp, Homo sapiens
gtctgactccagagt

SEQ ID NO: 2125021 - DNA, 23 bp, Homo sapiens
gtctgagactctcttaggagcag

SEQ ID NO: 2125022 - DNA, 15 bp, Homo sapiens
gtctgagcaccccct

SEQ ID NO: 2125023 - DNA, 13 bp, Homo sapiens
gtctgagccctgg

SEQ ID NO: 2125024 - DNA, 15 bp, Homo sapiens
gtctgagccctggtg

SEQ ID NO: 2125025 - DNA, 19 bp, Homo sapiens
gtctgaggaatccagaccc

SEQ ID NO: 2125026 - DNA, 19 bp, Homo sapiens
gtctgaggccccaggccct

SEQ ID NO: 2125027 - DNA, 22 bp, Homo sapiens
gtctgaggggcaactgagtctg

SEQ ID NO: 2125028 - DNA, 14 bp, Homo sapiens
gtctgaggtcctga

SEQ ID NO: 2125029 - DNA, 17 bp, Homo sapiens
gtctgaggtcctgagca

SEQ ID NO: 2125030 - DNA, 17 bp, Homo sapiens
gtctgagtcctgtctct

SEQ ID NO: 2125031 - DNA, 23 bp, Homo sapiens
gtctgagtcctgtctctgcctgc

SEQ ID NO: 2125032 - DNA, 20 bp, Homo sapiens
aagctctctttggaatgaac

SEQ ID NO: 2125033 - DNA, 22 bp, Homo sapiens
aagctctgaagtcacatcacag

SEQ ID NO: 2125034 - DNA, 17 bp, Homo sapiens
aagctctgcatgtgtgt

SEQ ID NO: 2125035 - DNA, 18 bp, Homo sapiens
aagctctggccccaggct

SEQ ID NO: 2125036 - DNA, 14 bp, Homo sapiens
aagctgaagtgaag

SEQ ID NO: 2125037 - DNA, 15 bp, Homo sapiens
aagctgaagtgaagg

SEQ ID NO: 2125038 - DNA, 19 bp, Homo sapiens
aagctgacagcactacaaa

SEQ ID NO: 2125039 - DNA, 21 bp, Homo sapiens
aagctgagaagaagctgagga

SEQ ID NO: 2125040 - DNA, 23 bp, Homo sapiens
aagctgagtgactgtaggcaggg

SEQ ID NO: 2125041 - DNA, 21 bp, Homo sapiens
aagctgatgatgtctcttgta

SEQ ID NO: 2125042 - DNA, 11 bp, Homo sapiens
aagctgcagct

SEQ ID NO: 2125043 - DNA, 14 bp, Homo sapiens
aagctgcagcttcc

SEQ ID NO: 2125044 - DNA, 18 bp, Homo sapiens
aagctgcatctagaggct

SEQ ID NO: 2125045 - DNA, 15 bp, Homo sapiens
aagctgcctgtagtt

SEQ ID NO: 2125046 - DNA, 14 bp, Homo sapiens
aagctgctgacagt

SEQ ID NO: 2125047 - DNA, 23 bp, Homo sapiens
aagctgcttgactatcacataca

SEQ ID NO: 2125048 - DNA, 17 bp, Homo sapiens
aagctggacaagaagct

SEQ ID NO: 2125049 - DNA, 16 bp, Homo sapiens
aagctggagctcttgg

SEQ ID NO: 2125050 - DNA, 19 bp, Homo sapiens
aagctggaggactagaacc

SEQ ID NO: 2125051 - DNA, 17 bp, Homo sapiens
aaatttaaaaataaagc

SEQ ID NO: 2125052 - DNA, 21 bp, Homo sapiens
aaatttaaaaataaagctact

SEQ ID NO: 2125053 - DNA, 19 bp, Homo sapiens
aaatttaaactataagcaa

SEQ ID NO: 2125054 - DNA, 17 bp, Homo sapiens
aaatttactgtgagact

SEQ ID NO: 2125055 - DNA, 23 bp, Homo sapiens
aaatttccagtacctttgtcaca

SEQ ID NO: 2125056 - DNA, 14 bp, Homo sapiens
aaatttgatttcta

SEQ ID NO: 2125057 - DNA, 20 bp, Homo sapiens
aaatttggatttacgactga

SEQ ID NO: 2125058 - DNA, 15 bp, Homo sapiens
aaatttggttctaat

SEQ ID NO: 2125059 - DNA, 22 bp, Homo sapiens
aaatttgtccaatggctgtaaa

SEQ ID NO: 2125060 - DNA, 15 bp, Homo sapiens
aaatttgtttaaagt

SEQ ID NO: 2125061 - DNA, 18 bp, Homo sapiens
aaattttactgacagaaa

SEQ ID NO: 2125062 - DNA, 12 bp, Homo sapiens
aaattttagagc

SEQ ID NO: 2125063 - DNA, 11 bp, Homo sapiens
aaattttcaaa

SEQ ID NO: 2125064 - DNA, 12 bp, Homo sapiens
aaattttggcca

SEQ ID NO: 2125065 - DNA, 22 bp, Homo sapiens
aaattttgtttcagaattttgt

SEQ ID NO: 2125066 - DNA, 16 bp, Homo sapiens
aaatttttatttttga

SEQ ID NO: 2125067 - DNA, 12 bp, Homo sapiens
aaatttttgtca

SEQ ID NO: 2125068 - DNA, 17 bp, Homo sapiens
aaatttttgtcatttta

SEQ ID NO: 2125069 - DNA, 23 bp, Homo sapiens
aaatttttgtcattttaaaatct

SEQ ID NO: 2125070 - DNA, 20 bp, Homo sapiens
aaattttttgatgtcagcct

SEQ ID NO: 2125071 - DNA, 16 bp, Homo sapiens
aacaaaaaccagcagg

SEQ ID NO: 2125072 - DNA, 11 bp, Homo sapiens
aacaaaaataa

SEQ ID NO: 2125073 - DNA, 13 bp, Homo sapiens
aacaaaacaacaa

SEQ ID NO: 2125074 - DNA, 14 bp, Homo sapiens
aacaaaacaacaac

SEQ ID NO: 2125075 - DNA, 14 bp, Homo sapiens
aacaaaaccagctg

SEQ ID NO: 2125076 - DNA, 12 bp, Homo sapiens
aacaaaatatct

SEQ ID NO: 2125077 - DNA, 13 bp, Homo sapiens
aacaaaatcacaa

SEQ ID NO: 2125078 - DNA, 21 bp, Homo sapiens
aacaaacctctatatgttgct

SEQ ID NO: 2125079 - DNA, 21 bp, Homo sapiens
aacaaactatgatcacagtga

SEQ ID NO: 2125080 - DNA, 12 bp, Homo sapiens
aacaaagaaata

SEQ ID NO: 2125081 - DNA, 14 bp, Homo sapiens
aacaaagaaatatt

SEQ ID NO: 2125082 - DNA, 15 bp, Homo sapiens
aacaaagcacagtgt

SEQ ID NO: 2125083 - DNA, 16 bp, Homo sapiens
aacaaagcacagtgtt

SEQ ID NO: 2125084 - DNA, 16 bp, Homo sapiens
aacaaaggttgagatg

SEQ ID NO: 2125085 - DNA, 16 bp, Homo sapiens
aacaaataatcacatt

SEQ ID NO: 2125086 - DNA, 13 bp, Homo sapiens
aacaaatcttcaa

SEQ ID NO: 2125087 - DNA, 19 bp, Homo sapiens
aacaaatgaacgatatgta

SEQ ID NO: 2125088 - DNA, 14 bp, Homo sapiens
aacaacaacaacaa

SEQ ID NO: 2125089 - DNA, 15 bp, Homo sapiens
aacaacaacaacaat

SEQ ID NO: 2125090 - DNA, 12 bp, Homo sapiens
aacaacaacaat

SEQ ID NO: 2125091 - DNA, 16 bp, Homo sapiens
aacaacaacaatacaa

SEQ ID NO: 2125092 - DNA, 10 bp, Homo sapiens
aacaacaata

SEQ ID NO: 2125093 - DNA, 12 bp, Homo sapiens
aacaacaataac

SEQ ID NO: 2125094 - DNA, 15 bp, Homo sapiens
aacaacaataacaac

SEQ ID NO: 2125095 - DNA, 20 bp, Homo sapiens
aacaacaatggtttacatga

SEQ ID NO: 2125096 - DNA, 24 bp, Homo sapiens
aacaacatgtgagcatggtcacaa

SEQ ID NO: 2125097 - DNA, 14 bp, Homo sapiens
aacaaccatcctgc

SEQ ID NO: 2125098 - DNA, 17 bp, Homo sapiens
aagggagagcggggcag

SEQ ID NO: 2125099 - DNA, 24 bp, Homo sapiens
aagggagcactgggttgactttca

SEQ ID NO: 2125100 - DNA, 14 bp, Homo sapiens
aagggagggctctg

SEQ ID NO: 2125101 - DNA, 18 bp, Homo sapiens
aagggagttgctcactca

SEQ ID NO: 2125102 - DNA, 22 bp, Homo sapiens
aagggagttgctcactcaggac

SEQ ID NO: 2125103 - DNA, 23 bp, Homo sapiens
aagggagttgctcactcaggact

SEQ ID NO: 2125104 - DNA, 18 bp, Homo sapiens
aagggcagaaggggaaga

SEQ ID NO: 2125105 - DNA, 12 bp, Homo sapiens
aagggcagccag

SEQ ID NO: 2125106 - DNA, 13 bp, Homo sapiens
aagggcagccagg

SEQ ID NO: 2125107 - DNA, 19 bp, Homo sapiens
aagggcagccaggggctgc

SEQ ID NO: 2125108 - DNA, 17 bp, Homo sapiens
aagggcatcaggcactg

SEQ ID NO: 2125109 - DNA, 17 bp, Homo sapiens
aagggcatccttctgcc

SEQ ID NO: 2125110 - DNA, 13 bp, Homo sapiens
aagggccaggaga

SEQ ID NO: 2125111 - DNA, 15 bp, Homo sapiens
aagggccaggagaga

SEQ ID NO: 2125112 - DNA, 20 bp, Homo sapiens
aagtgaatttgcctgtaaca

SEQ ID NO: 2125113 - DNA, 15 bp, Homo sapiens
aagtgactctcagcg

SEQ ID NO: 2125114 - DNA, 14 bp, Homo sapiens
aagtgagagctggg

SEQ ID NO: 2125115 - DNA, 15 bp, Homo sapiens
aagtgagagctgggt

SEQ ID NO: 2125116 - DNA, 15 bp, Homo sapiens
aagtgataatttctg

SEQ ID NO: 2125117 - DNA, 16 bp, Homo sapiens
aagtgatatcacctct

SEQ ID NO: 2125118 - DNA, 19 bp, Homo sapiens
aagtgatcctcccacctca

SEQ ID NO: 2125119 - DNA, 13 bp, Homo sapiens
aataaacgaagat

SEQ ID NO: 2125120 - DNA, 19 bp, Homo sapiens
aataaactagtttccagtg

SEQ ID NO: 2125121 - DNA, 12 bp, Homo sapiens
aataaactctct

SEQ ID NO: 2125122 - DNA, 15 bp, Homo sapiens
aataaactctctagg

SEQ ID NO: 2125123 - DNA, 22 bp, Homo sapiens
aataaagaactccttattttgt

SEQ ID NO: 2125124 - DNA, 16 bp, Homo sapiens
aataaagctactgaat

SEQ ID NO: 2125125 - DNA, 17 bp, Homo sapiens
aataaagctactgaatt

SEQ ID NO: 2125126 - DNA, 21 bp, Homo sapiens
aataaagctactgaatttatt

SEQ ID NO: 2125127 - DNA, 22 bp, Homo sapiens
aataaagctggacaagaagctg

SEQ ID NO: 2125128 - DNA, 15 bp, Homo sapiens
aataaaggttaaaaa

SEQ ID NO: 2125129 - DNA, 15 bp, Homo sapiens
aataaagtatatata

SEQ ID NO: 2125130 - DNA, 16 bp, Homo sapiens
aataaagtatcatgca

SEQ ID NO: 2125131 - DNA, 18 bp, Homo sapiens
aataaagtatcatgcatt

SEQ ID NO: 2125132 - DNA, 12 bp, Homo sapiens
aataaataaatg

SEQ ID NO: 2125133 - DNA, 21 bp, Homo sapiens
aataaatagatttgattattt

SEQ ID NO: 2125134 - DNA, 23 bp, Homo sapiens
aataaatagatttgattatttcc

SEQ ID NO: 2125135 - DNA, 14 bp, Homo sapiens
aataaatattctgc

SEQ ID NO: 2125136 - DNA, 14 bp, Homo sapiens
aataaatattttac

SEQ ID NO: 2125137 - DNA, 21 bp, Homo sapiens
aataaatcattaatactcttc

SEQ ID NO: 2125138 - DNA, 18 bp, Homo sapiens
aataaatctgagcctaaa

SEQ ID NO: 2125139 - DNA, 21 bp, Homo sapiens
aataaatctgagcctaaatct

SEQ ID NO: 2125140 - DNA, 14 bp, Homo sapiens
aataaatgaagaaa

SEQ ID NO: 2125141 - DNA, 13 bp, Homo sapiens
aataaatgttcaa

SEQ ID NO: 2125142 - DNA, 15 bp, Homo sapiens
aataaattatattaa

SEQ ID NO: 2125143 - DNA, 22 bp, Homo sapiens
aataaattggtgataagtggaa

SEQ ID NO: 2125144 - DNA, 21 bp, Homo sapiens
aataaatttggttctaataga

SEQ ID NO: 2125145 - DNA, 13 bp, Homo sapiens
aataaattttgtt

SEQ ID NO: 2125146 - DNA, 14 bp, Homo sapiens
aataaattttgttt

SEQ ID NO: 2125147 - DNA, 14 bp, Homo sapiens
aataaccacttaaa

SEQ ID NO: 2125148 - DNA, 21 bp, Homo sapiens
aataactaatgctaagaaatg

SEQ ID NO: 2125149 - DNA, 22 bp, Homo sapiens
aataactaatgctaagaaatgc

SEQ ID NO: 2125150 - DNA, 22 bp, Homo sapiens
aataactagatctcctgtaatt

SEQ ID NO: 2125151 - DNA, 17 bp, Homo sapiens
aataacttcagagaagt

SEQ ID NO: 2125152 - DNA, 19 bp, Homo sapiens
aataacttgtcctatgtca

SEQ ID NO: 2125153 - DNA, 15 bp, Homo sapiens
aataagaaagtttca

SEQ ID NO: 2125154 - DNA, 17 bp, Homo sapiens
aataaggatttgttcac

SEQ ID NO: 2125155 - DNA, 17 bp, Homo sapiens
aataaggggcacctggg

SEQ ID NO: 2125156 - DNA, 18 bp, Homo sapiens
aataaggggcacctggga

SEQ ID NO: 2125157 - DNA, 15 bp, Homo sapiens
aataagtcattgaaa

SEQ ID NO: 2125158 - DNA, 14 bp, Homo sapiens
aataagtgctgttt

SEQ ID NO: 2125159 - DNA, 22 bp, Homo sapiens
aataagtgctgtttgagatgtg

SEQ ID NO: 2125160 - DNA, 21 bp, Homo sapiens
aataataattaggttaacatt

SEQ ID NO: 2125161 - DNA, 18 bp, Homo sapiens
aataatacctaagccttc

SEQ ID NO: 2125162 - DNA, 20 bp, Homo sapiens
aataatcattctttcccctc

SEQ ID NO: 2125163 - DNA, 22 bp, Homo sapiens
aataatgagtctgcataaactt

SEQ ID NO: 2125164 - DNA, 23 bp, Homo sapiens
aataatgagtctgcataaacttc

SEQ ID NO: 2125165 - DNA, 14 bp, Homo sapiens
aataatgatttaag

SEQ ID NO: 2125166 - DNA, 18 bp, Homo sapiens
aataatgtgttaaacatg

SEQ ID NO: 2125167 - DNA, 15 bp, Homo sapiens
aataatgttctgtca

SEQ ID NO: 2125168 - DNA, 20 bp, Homo sapiens
aataattaggttaacattgt

SEQ ID NO: 2125169 - DNA, 23 bp, Homo sapiens
aataattcttccagtgcaacaaa

SEQ ID NO: 2125170 - DNA, 12 bp, Homo sapiens
aataattgtgta

SEQ ID NO: 2125171 - DNA, 10 bp, Homo sapiens
aataatttaa

SEQ ID NO: 2125172 - DNA, 21 bp, Homo sapiens
aataatttaactaatttaaac

SEQ ID NO: 2125173 - DNA, 12 bp, Homo sapiens
aataattttaaa

SEQ ID NO: 2125174 - DNA, 17 bp, Homo sapiens
aatacaaaataaaatta

SEQ ID NO: 2125175 - DNA, 16 bp, Homo sapiens
aatacaacaagaacaa

SEQ ID NO: 2125176 - DNA, 21 bp, Homo sapiens
aatacaccacctcactcctgt

SEQ ID NO: 2125177 - DNA, 13 bp, Homo sapiens
aatacagacacta

SEQ ID NO: 2125178 - DNA, 21 bp, Homo sapiens
aatacagacactaagttatag

SEQ ID NO: 2125179 - DNA, 16 bp, Homo sapiens
aatacagggcattttg

SEQ ID NO: 2125180 - DNA, 19 bp, Homo sapiens
aatacagtaagctgctcta

SEQ ID NO: 2125181 - DNA, 12 bp, Homo sapiens
aatacagtgtta

SEQ ID NO: 2125182 - DNA, 14 bp, Homo sapiens
aatacatgctgcta

SEQ ID NO: 2125183 - DNA, 13 bp, Homo sapiens
aataccaaatatt

SEQ ID NO: 2125184 - DNA, 17 bp, Homo sapiens
aataccagatcactcaa

SEQ ID NO: 2125185 - DNA, 18 bp, Homo sapiens
aataccatgccatttaaa

SEQ ID NO: 2125186 - DNA, 14 bp, Homo sapiens
aatacccccagaga

SEQ ID NO: 2125187 - DNA, 15 bp, Homo sapiens
aatacccccagagac

SEQ ID NO: 2125188 - DNA, 16 bp, Homo sapiens
aatacctttggaaaaa

SEQ ID NO: 2125189 - DNA, 18 bp, Homo sapiens
aatacgcactacatgtgg

SEQ ID NO: 2125190 - DNA, 15 bp, Homo sapiens
aatactaaaatatgt

SEQ ID NO: 2125191 - DNA, 13 bp, Homo sapiens
aatactactgtaa

SEQ ID NO: 2125192 - DNA, 22 bp, Homo sapiens
aatactatgaaatgaaagaact

SEQ ID NO: 2125193 - DNA, 13 bp, Homo sapiens
aatactgctctga

SEQ ID NO: 2125194 - DNA, 16 bp, Homo sapiens
aatactgtacatagat

SEQ ID NO: 2125195 - DNA, 14 bp, Homo sapiens
aatacttctcattt

SEQ ID NO: 2125196 - DNA, 16 bp, Homo sapiens
aatacttctcattttt

SEQ ID NO: 2125197 - DNA, 16 bp, Homo sapiens
aatagaaataagtggt

SEQ ID NO: 2125198 - DNA, 16 bp, Homo sapiens
aatagactaaatgaaa

SEQ ID NO: 2125199 - DNA, 19 bp, Homo sapiens
aatagagattaattttaac

SEQ ID NO: 2125200 - DNA, 16 bp, Homo sapiens
aatagatgtgatcact

SEQ ID NO: 2125201 - DNA, 20 bp, Homo sapiens
aatagatttgattatttcct

SEQ ID NO: 2125202 - DNA, 20 bp, Homo sapiens
aatagcaaaagaagaagttt

SEQ ID NO: 2125203 - DNA, 18 bp, Homo sapiens
aatagcaaagaattgact

SEQ ID NO: 2125204 - DNA, 12 bp, Homo sapiens
aatagccagaga

SEQ ID NO: 2125205 - DNA, 22 bp, Homo sapiens
aatagccagagaggagcacctg

SEQ ID NO: 2125206 - DNA, 22 bp, Homo sapiens
aatagctattgcatgtaaaatg

SEQ ID NO: 2125207 - DNA, 19 bp, Homo sapiens
aatagcttgtatagtgtaa

SEQ ID NO: 2125208 - DNA, 17 bp, Homo sapiens
aatagcttttattgtat

SEQ ID NO: 2125209 - DNA, 19 bp, Homo sapiens
aataggatataaaacacat

SEQ ID NO: 2125210 - DNA, 16 bp, Homo sapiens
aataggttaatatcaa

SEQ ID NO: 2125211 - DNA, 20 bp, Homo sapiens
aatagtaagcctccctcctc

SEQ ID NO: 2125212 - DNA, 21 bp, Homo sapiens
aatagtaagcctccctcctcg

SEQ ID NO: 2125213 - DNA, 21 bp, Homo sapiens
aatagtttctgattcactatt

SEQ ID NO: 2125214 - DNA, 17 bp, Homo sapiens
aatagttttaaatatga

SEQ ID NO: 2125215 - DNA, 19 bp, Homo sapiens
aatagttttaaatatgaac

SEQ ID NO: 2125216 - DNA, 21 bp, Homo sapiens
aatataaactgaaaaatgtca

SEQ ID NO: 2125217 - DNA, 19 bp, Homo sapiens
aatataaataaataaaaat

SEQ ID NO: 2125218 - DNA, 23 bp, Homo sapiens
aatataaataaataaaaatattc

SEQ ID NO: 2125219 - DNA, 15 bp, Homo sapiens
aatataaatgcatga

SEQ ID NO: 2125220 - DNA, 17 bp, Homo sapiens
aatataaatgcatgatt

SEQ ID NO: 2125221 - DNA, 18 bp, Homo sapiens
aatataaatgcatgattt

SEQ ID NO: 2125222 - DNA, 19 bp, Homo sapiens
aatataatggaagagaaat

SEQ ID NO: 2125223 - DNA, 14 bp, Homo sapiens
aatataattatcgg

SEQ ID NO: 2125224 - DNA, 14 bp, Homo sapiens
aatatacaaacatg

SEQ ID NO: 2125225 - DNA, 15 bp, Homo sapiens
aatatacaaacatgt

SEQ ID NO: 2125226 - DNA, 11 bp, Homo sapiens
aatatagagat

SEQ ID NO: 2125227 - DNA, 16 bp, Homo sapiens
aatatagagatatttt

SEQ ID NO: 2125228 - DNA, 21 bp, Homo sapiens
aatatagatcagttataagta

SEQ ID NO: 2125229 - DNA, 16 bp, Homo sapiens
aatatagctatcattt

SEQ ID NO: 2125230 - DNA, 14 bp, Homo sapiens
aatataggaagcat

SEQ ID NO: 2125231 - DNA, 16 bp, Homo sapiens
aatatataaaaatata

SEQ ID NO: 2125232 - DNA, 17 bp, Homo sapiens
aatatataaaaatatat

SEQ ID NO: 2125233 - DNA, 19 bp, Homo sapiens
aatatataaaaatatatat

SEQ ID NO: 2125234 - DNA, 19 bp, Homo sapiens
aatcattgctttgaagcag

SEQ ID NO: 2125235 - DNA, 16 bp, Homo sapiens
aatcattttaattatt

SEQ ID NO: 2125236 - DNA, 17 bp, Homo sapiens
aatcattttaattatta

SEQ ID NO: 2125237 - DNA, 11 bp, Homo sapiens
aatccaaagaa

SEQ ID NO: 2125238 - DNA, 12 bp, Homo sapiens
aatgcacaattt

SEQ ID NO: 2125239 - DNA, 15 bp, Homo sapiens
aatgcacaatttaga

SEQ ID NO: 2125240 - DNA, 18 bp, Homo sapiens
aatgcacaatttagaaaa

SEQ ID NO: 2125241 - DNA, 13 bp, Homo sapiens
aatgcacactagc

SEQ ID NO: 2125242 - DNA, 11 bp, Homo sapiens
aatgcactgtg

SEQ ID NO: 2125243 - DNA, 21 bp, Homo sapiens
aatgcactgtgacaccagaat

SEQ ID NO: 2125244 - DNA, 22 bp, Homo sapiens
aatgcagaattttttgagtaat

SEQ ID NO: 2125245 - DNA, 22 bp, Homo sapiens
aatgcagcgaaccaatatttgt

SEQ ID NO: 2125246 - DNA, 15 bp, Homo sapiens
aatgcagtccagaat

SEQ ID NO: 2125247 - DNA, 17 bp, Homo sapiens
aatgcagtccagaataa

SEQ ID NO: 2125248 - DNA, 18 bp, Homo sapiens
aatgcagtccagaataag

SEQ ID NO: 2125249 - DNA, 19 bp, Homo sapiens
aatgcagtccagaataagt

SEQ ID NO: 2125250 - DNA, 23 bp, Homo sapiens
aatgcagtccagaataagtgctg

SEQ ID NO: 2125251 - DNA, 18 bp, Homo sapiens
aatgcatcatcatagaaa

SEQ ID NO: 2125252 - DNA, 19 bp, Homo sapiens
aatgcatccattcctcagg

SEQ ID NO: 2125253 - DNA, 15 bp, Homo sapiens
aatgcatgattttat

SEQ ID NO: 2125254 - DNA, 17 bp, Homo sapiens
aatgcatgattttatac

SEQ ID NO: 2125255 - DNA, 16 bp, Homo sapiens
aatgcattttcaagat

SEQ ID NO: 2125256 - DNA, 23 bp, Homo sapiens
aatgccaacttgtccttttgtac

SEQ ID NO: 2125257 - DNA, 13 bp, Homo sapiens
aatgccaagataa

SEQ ID NO: 2125258 - DNA, 22 bp, Homo sapiens
aatgccagagacggaagccttt

SEQ ID NO: 2125259 - DNA, 21 bp, Homo sapiens
aatgcccaactcttcattttg

SEQ ID NO: 2125260 - DNA, 14 bp, Homo sapiens
aatgccctgccatt

SEQ ID NO: 2125261 - DNA, 18 bp, Homo sapiens
aatgcctataaaatgccc

SEQ ID NO: 2125262 - DNA, 15 bp, Homo sapiens
aatgcctcctccctg

SEQ ID NO: 2125263 - DNA, 13 bp, Homo sapiens
aatgcctctccca

SEQ ID NO: 2125264 - DNA, 15 bp, Homo sapiens
aatgccttttcccaa

SEQ ID NO: 2125265 - DNA, 14 bp, Homo sapiens
aatgctaaatgcaa

SEQ ID NO: 2125266 - DNA, 13 bp, Homo sapiens
aatgctaagaaat

SEQ ID NO: 2125267 - DNA, 19 bp, Homo sapiens
aatgctattgttgtgggct

SEQ ID NO: 2125268 - DNA, 18 bp, Homo sapiens
aatgctcgtgtgatttcc

SEQ ID NO: 2125269 - DNA, 19 bp, Homo sapiens
aatgctggttttcctaaat

SEQ ID NO: 2125270 - DNA, 22 bp, Homo sapiens
aatgctggttttcctaaatgca

SEQ ID NO: 2125271 - DNA, 15 bp, Homo sapiens
aatgcttaaaacaag

SEQ ID NO: 2125272 - DNA, 14 bp, Homo sapiens
aatgcttaatcaga

SEQ ID NO: 2125273 - DNA, 22 bp, Homo sapiens
aatgcttaatcagatagatatt

SEQ ID NO: 2125274 - DNA, 20 bp, Homo sapiens
aatgcttcaagtgttgctct

SEQ ID NO: 2125275 - DNA, 20 bp, Homo sapiens
aatgcttgtggattgagggt

SEQ ID NO: 2125276 - DNA, 14 bp, Homo sapiens
aatgctttcctccc

SEQ ID NO: 2125277 - DNA, 17 bp, Homo sapiens
aatgctttctgaagctt

SEQ ID NO: 2125278 - DNA, 21 bp, Homo sapiens
aatgctttgggaggccaaggc

SEQ ID NO: 2125279 - DNA, 19 bp, Homo sapiens
aatgctttgtgtgattgaa

SEQ ID NO: 2125280 - DNA, 11 bp, Homo sapiens
aatgctttttg

SEQ ID NO: 2125281 - DNA, 17 bp, Homo sapiens
aatgctttttgaatgtt

SEQ ID NO: 2125282 - DNA, 18 bp, Homo sapiens
aatggaaggtttgtatat

SEQ ID NO: 2125283 - DNA, 20 bp, Homo sapiens
aatggaaggtttgtatattg

SEQ ID NO: 2125284 - DNA, 12 bp, Homo sapiens
aatggaatgtgg

SEQ ID NO: 2125285 - DNA, 13 bp, Homo sapiens
aatggagggtggg

SEQ ID NO: 2125286 - DNA, 21 bp, Homo sapiens
aatggagtgggagatcagcca

SEQ ID NO: 2125287 - DNA, 22 bp, Homo sapiens
aatggcaaagcggttgcttctg

SEQ ID NO: 2125288 - DNA, 20 bp, Homo sapiens
aatggcacagcccaaagaag

SEQ ID NO: 2125289 - DNA, 22 bp, Homo sapiens
aatggcagcagttccatgaaga

SEQ ID NO: 2125290 - DNA, 12 bp, Homo sapiens
aatggcagcctt

SEQ ID NO: 2125291 - DNA, 10 bp, Homo sapiens
aatggccatg

SEQ ID NO: 2125292 - DNA, 16 bp, Homo sapiens
aatggctaattcccag

SEQ ID NO: 2125293 - DNA, 16 bp, Homo sapiens
aatggctatgttttta

SEQ ID NO: 2125294 - DNA, 20 bp, Homo sapiens
aatggctatgtttttaatgt

SEQ ID NO: 2125295 - DNA, 14 bp, Homo sapiens
aatggctctgtgaa

SEQ ID NO: 2125296 - DNA, 16 bp, Homo sapiens
aatggctctgtgaaat

SEQ ID NO: 2125297 - DNA, 19 bp, Homo sapiens
aatggctgataattttaaa

SEQ ID NO: 2125298 - DNA, 13 bp, Homo sapiens
aatgggacactaa

SEQ ID NO: 2125299 - DNA, 19 bp, Homo sapiens
aatgggagggggctccatg

SEQ ID NO: 2125300 - DNA, 23 bp, Homo sapiens
aatgggcactgggatgagccgct

SEQ ID NO: 2125301 - DNA, 13 bp, Homo sapiens
aatgggcctgccc

SEQ ID NO: 2125302 - DNA, 15 bp, Homo sapiens
aatgggcctgcccaa

SEQ ID NO: 2125303 - DNA, 15 bp, Homo sapiens
aatggggagaggcaa

SEQ ID NO: 2125304 - DNA, 21 bp, Homo sapiens
aatggggtagaggagggcatg

SEQ ID NO: 2125305 - DNA, 15 bp, Homo sapiens
aatggggtgggccca

SEQ ID NO: 2125306 - DNA, 12 bp, Homo sapiens
aatgggtaatat

SEQ ID NO: 2125307 - DNA, 22 bp, Homo sapiens
aatgggtttactctcaatgcat

SEQ ID NO: 2125308 - DNA, 15 bp, Homo sapiens
aatggtatgagctga

SEQ ID NO: 2125309 - DNA, 16 bp, Homo sapiens
aatggtatggaactct

SEQ ID NO: 2125310 - DNA, 13 bp, Homo sapiens
aatggtccagggt

SEQ ID NO: 2125311 - DNA, 18 bp, Homo sapiens
aatggtctaaaaataaac

SEQ ID NO: 2125312 - DNA, 16 bp, Homo sapiens
aatggtgccttcattt

SEQ ID NO: 2125313 - DNA, 15 bp, Homo sapiens
aatggtggtttgtca

SEQ ID NO: 2125314 - DNA, 23 bp, Homo sapiens
aatggtggtttgtcatatattca

SEQ ID NO: 2125315 - DNA, 17 bp, Homo sapiens
aatggtgttactaaagt

SEQ ID NO: 2125316 - DNA, 18 bp, Homo sapiens
aatggtgttactaaagtc

SEQ ID NO: 2125317 - DNA, 17 bp, Homo sapiens
aatggtgtttttttaat

SEQ ID NO: 2125318 - DNA, 14 bp, Homo sapiens
aatggtttgaatat

SEQ ID NO: 2125319 - DNA, 17 bp, Homo sapiens
aatggtttgaatataaa

SEQ ID NO: 2125320 - DNA, 19 bp, Homo sapiens
aatggtttgcaaggaagcc

SEQ ID NO: 2125321 - DNA, 17 bp, Homo sapiens
aatgtaaatattttaaa

SEQ ID NO: 2125322 - DNA, 20 bp, Homo sapiens
aatgtaaatattttaaagaa

SEQ ID NO: 2125323 - DNA, 16 bp, Homo sapiens
aatgtaacttttgtaa

SEQ ID NO: 2125324 - DNA, 15 bp, Homo sapiens
aatgtaagaaaattt

SEQ ID NO: 2125325 - DNA, 23 bp, Homo sapiens
aatgtaagggtctgttgtaaatg

SEQ ID NO: 2125326 - DNA, 21 bp, Homo sapiens
aatgtaatgatcataagtcta

SEQ ID NO: 2125327 - DNA, 16 bp, Homo sapiens
aatgtacaagttttgt

SEQ ID NO: 2125328 - DNA, 17 bp, Homo sapiens
aatgtacaagttttgta

SEQ ID NO: 2125329 - DNA, 19 bp, Homo sapiens
aatgtacaagttttgtata

SEQ ID NO: 2125330 - DNA, 22 bp, Homo sapiens
aatgtacccaccgggccactcc

SEQ ID NO: 2125331 - DNA, 15 bp, Homo sapiens
aatgtactgagattt

SEQ ID NO: 2125332 - DNA, 14 bp, Homo sapiens
aatgtagctggttt

SEQ ID NO: 2125333 - DNA, 17 bp, Homo sapiens
aatgtagctggtttcct

SEQ ID NO: 2125334 - DNA, 16 bp, Homo sapiens
aatgtaggtttagata

SEQ ID NO: 2125335 - DNA, 13 bp, Homo sapiens
aatgtatagtaaa

SEQ ID NO: 2125336 - DNA, 15 bp, Homo sapiens
aatgtatatacacat

SEQ ID NO: 2125337 - DNA, 16 bp, Homo sapiens
aatgtatatacacata

SEQ ID NO: 2125338 - DNA, 17 bp, Homo sapiens
aatgtatatacacatat

SEQ ID NO: 2125339 - DNA, 17 bp, Homo sapiens
aatgtatatgtcattta

SEQ ID NO: 2125340 - DNA, 16 bp, Homo sapiens
aatgtatcttattcac

SEQ ID NO: 2125341 - DNA, 17 bp, Homo sapiens
aatgtatcttattcaca

SEQ ID NO: 2125342 - DNA, 15 bp, Homo sapiens
aatgtatcttattta

SEQ ID NO: 2125343 - DNA, 20 bp, Homo sapiens
aattttcagtataatttaac

SEQ ID NO: 2125344 - DNA, 12 bp, Homo sapiens
aattttctagac

SEQ ID NO: 2125345 - DNA, 13 bp, Homo sapiens
aattttcttcatg

SEQ ID NO: 2125346 - DNA, 22 bp, Homo sapiens
aattttcttcatgcaatgacat

SEQ ID NO: 2125347 - DNA, 18 bp, Homo sapiens
aattttgaatgtttatgt

SEQ ID NO: 2125348 - DNA, 12 bp, Homo sapiens
aattttgtttca

SEQ ID NO: 2125349 - DNA, 15 bp, Homo sapiens
aattttgtttcagaa

SEQ ID NO: 2125350 - DNA, 13 bp, Homo sapiens
aattttgtttgta

SEQ ID NO: 2125351 - DNA, 13 bp, Homo sapiens
aatttttaaacaa

SEQ ID NO: 2125352 - DNA, 19 bp, Homo sapiens
aatttttaaacaagtattt

SEQ ID NO: 2125353 - DNA, 17 bp, Homo sapiens
aatttttaaactagtaa

SEQ ID NO: 2125354 - DNA, 19 bp, Homo sapiens
aatttttaaagtatatatt

SEQ ID NO: 2125355 - DNA, 20 bp, Homo sapiens
aatttttaaagtatatattt

SEQ ID NO: 2125356 - DNA, 22 bp, Homo sapiens
aatttttaaagtatatatttat

SEQ ID NO: 2125357 - DNA, 21 bp, Homo sapiens
aatttttaatgactttttata

SEQ ID NO: 2125358 - DNA, 12 bp, Homo sapiens
aatttttataca

SEQ ID NO: 2125359 - DNA, 23 bp, Homo sapiens
aatttttcagctctctgtataaa

SEQ ID NO: 2125360 - DNA, 21 bp, Homo sapiens
aatttttcttatttcatttct

SEQ ID NO: 2125361 - DNA, 23 bp, Homo sapiens
aatttttgtcattttaaaatctg

SEQ ID NO: 2125362 - DNA, 19 bp, Homo sapiens
aattttttgatgtcagcct

SEQ ID NO: 2125363 - DNA, 17 bp, Homo sapiens
aatttttttattactga

SEQ ID NO: 2125364 - DNA, 17 bp, Homo sapiens
aattttttttaatgtac

SEQ ID NO: 2125365 - DNA, 12 bp, Homo sapiens
acaaaaaagaag

SEQ ID NO: 2125366 - DNA, 16 bp, Homo sapiens
acaaaaacaaaacaaa

SEQ ID NO: 2125367 - DNA, 15 bp, Homo sapiens
acaaaaacacagcaa

SEQ ID NO: 2125368 - DNA, 16 bp, Homo sapiens
acaaaaacacagcaag

SEQ ID NO: 2125369 - DNA, 15 bp, Homo sapiens
acaaaaattgactca

SEQ ID NO: 2125370 - DNA, 13 bp, Homo sapiens
acaaaacaacaac

SEQ ID NO: 2125371 - DNA, 16 bp, Homo sapiens
acaaaacaacaacaat

SEQ ID NO: 2125372 - DNA, 16 bp, Homo sapiens
acaaaacaagaaagaa

SEQ ID NO: 2125373 - DNA, 13 bp, Homo sapiens
acaaaacttcctg

SEQ ID NO: 2125374 - DNA, 14 bp, Homo sapiens
acaaaagagagaat

SEQ ID NO: 2125375 - DNA, 23 bp, Homo sapiens
acaaaagcaagactgttgctcaa

SEQ ID NO: 2125376 - DNA, 16 bp, Homo sapiens
acaaaataaaattatg

SEQ ID NO: 2125377 - DNA, 15 bp, Homo sapiens
acaaaataacatttg

SEQ ID NO: 2125378 - DNA, 10 bp, Homo sapiens
acaaaataat

SEQ ID NO: 2125379 - DNA, 12 bp, Homo sapiens
acaaaataattt

SEQ ID NO: 2125380 - DNA, 18 bp, Homo sapiens
acaaaatatataatggtt

SEQ ID NO: 2125381 - DNA, 23 bp, Homo sapiens
acaaaatgtcacacttgtttctt

SEQ ID NO: 2125382 - DNA, 15 bp, Homo sapiens
acaaacaaataaata

SEQ ID NO: 2125383 - DNA, 15 bp, Homo sapiens
acaaacacctcccag

SEQ ID NO: 2125384 - DNA, 15 bp, Homo sapiens
acaaaccacaactga

SEQ ID NO: 2125385 - DNA, 21 bp, Homo sapiens
acaaaccacaactgacacagg

SEQ ID NO: 2125386 - DNA, 23 bp, Homo sapiens
acaaaccacaactgacacaggaa

SEQ ID NO: 2125387 - DNA, 14 bp, Homo sapiens
acaaaccactgtac

SEQ ID NO: 2125388 - DNA, 17 bp, Homo sapiens
acaaaccactgtacata

SEQ ID NO: 2125389 - DNA, 23 bp, Homo sapiens
acaaacccaggagtttgtgtgtc

SEQ ID NO: 2125390 - DNA, 18 bp, Homo sapiens
acaaacctctatatgttg

SEQ ID NO: 2125391 - DNA, 20 bp, Homo sapiens
acaaactatgatcacagtga

SEQ ID NO: 2125392 - DNA, 21 bp, Homo sapiens
acaaactcgttttttacaaag

SEQ ID NO: 2125393 - DNA, 17 bp, Homo sapiens
acaaagaaaaaaatata

SEQ ID NO: 2125394 - DNA, 18 bp, Homo sapiens
acaaagaaaaaaatatat

SEQ ID NO: 2125395 - DNA, 16 bp, Homo sapiens
acaaagaaggcacagg

SEQ ID NO: 2125396 - DNA, 18 bp, Homo sapiens
acaaagagaataaagact

SEQ ID NO: 2125397 - DNA, 20 bp, Homo sapiens
acaaagatgagctctgaaca

SEQ ID NO: 2125398 - DNA, 24 bp, Homo sapiens
acaaagatgtttgtcagatatgat

SEQ ID NO: 2125399 - DNA, 20 bp, Homo sapiens
acaaagcatcattgtaaatt

SEQ ID NO: 2125400 - DNA, 16 bp, Homo sapiens
acaaagcccttttata

SEQ ID NO: 2125401 - DNA, 23 bp, Homo sapiens
acaaaggagcctgtgaacccagg

SEQ ID NO: 2125402 - DNA, 18 bp, Homo sapiens
acaaagggattctccagg

SEQ ID NO: 2125403 - DNA, 14 bp, Homo sapiens
acaaaggggagaag

SEQ ID NO: 2125404 - DNA, 19 bp, Homo sapiens
acaaaggtataattttatg

SEQ ID NO: 2125405 - DNA, 18 bp, Homo sapiens
acaaagttacaaattcaa

SEQ ID NO: 2125406 - DNA, 19 bp, Homo sapiens
acaaagttccaaaatgcca

SEQ ID NO: 2125407 - DNA, 20 bp, Homo sapiens
acaaataatgaacagcagaa

SEQ ID NO: 2125408 - DNA, 23 bp, Homo sapiens
acaaatactcttaggaagagaaa

SEQ ID NO: 2125409 - DNA, 16 bp, Homo sapiens
acaaatactgcctagt

SEQ ID NO: 2125410 - DNA, 23 bp, Homo sapiens
acaaatatttattttctttctgt

SEQ ID NO: 2125411 - DNA, 22 bp, Homo sapiens
acaaatcaccatgtaacaacca

SEQ ID NO: 2125412 - DNA, 23 bp, Homo sapiens
acaaatcaccatgtaacaaccag

SEQ ID NO: 2125413 - DNA, 19 bp, Homo sapiens
acaaatctatattaaagtg

SEQ ID NO: 2125414 - DNA, 21 bp, Homo sapiens
acaaatctgggcattgagcaa

SEQ ID NO: 2125415 - DNA, 14 bp, Homo sapiens
acaaatggccttta

SEQ ID NO: 2125416 - DNA, 15 bp, Homo sapiens
acaaattctacagca

SEQ ID NO: 2125417 - DNA, 19 bp, Homo sapiens
acaaatttaattttgcaga

SEQ ID NO: 2125418 - DNA, 13 bp, Homo sapiens
acaacaaaccaaa

SEQ ID NO: 2125419 - DNA, 13 bp, Homo sapiens
acaacaacaacaa

SEQ ID NO: 2125420 - DNA, 15 bp, Homo sapiens
acaacaacaataaca

SEQ ID NO: 2125421 - DNA, 17 bp, Homo sapiens
acaacaacaataacaac

SEQ ID NO: 2125422 - DNA, 16 bp, Homo sapiens
acaacaacaatacaac

SEQ ID NO: 2125423 - DNA, 14 bp, Homo sapiens
acagactggaagca

SEQ ID NO: 2125424 - DNA, 19 bp, Homo sapiens
acagacttctggaaggctg

SEQ ID NO: 2125425 - DNA, 20 bp, Homo sapiens
acagacttctggaaggctgg

SEQ ID NO: 2125426 - DNA, 21 bp, Homo sapiens
acagacttctggaaggctggc

SEQ ID NO: 2125427 - DNA, 18 bp, Homo sapiens
acagagaaattctgtggt

SEQ ID NO: 2125428 - DNA, 21 bp, Homo sapiens
acagagaaattctgtggtggg

SEQ ID NO: 2125429 - DNA, 15 bp, Homo sapiens
acagagaaggcagga

SEQ ID NO: 2125430 - DNA, 16 bp, Homo sapiens
acagagaaggcaggaa

SEQ ID NO: 2125431 - DNA, 19 bp, Homo sapiens
acagagaatctgaagctat

SEQ ID NO: 2125432 - DNA, 21 bp, Homo sapiens
acagagacacctgcacctccc

SEQ ID NO: 2125433 - DNA, 21 bp, Homo sapiens
acagagacaggcccaagagat

SEQ ID NO: 2125434 - DNA, 22 bp, Homo sapiens
acagagacccagatctcatgga

SEQ ID NO: 2125435 - DNA, 13 bp, Homo sapiens
acagagactctgg

SEQ ID NO: 2125436 - DNA, 21 bp, Homo sapiens
acagagagagactgagggaga

SEQ ID NO: 2125437 - DNA, 17 bp, Homo sapiens
acagagagtcctttggg

SEQ ID NO: 2125438 - DNA, 19 bp, Homo sapiens
acagagatgcatgcgcagg

SEQ ID NO: 2125439 - DNA, 21 bp, Homo sapiens
acagagatgcatgcgcaggct

SEQ ID NO: 2125440 - DNA, 22 bp, Homo sapiens
acagagatgcatgcgcaggctc

SEQ ID NO: 2125441 - DNA, 22 bp, Homo sapiens
acagagcccccaagcctctgcc

SEQ ID NO: 2125442 - DNA, 15 bp, Homo sapiens
acagagcctgcctca

SEQ ID NO: 2125443 - DNA, 14 bp, Homo sapiens
acagagccttcaca

SEQ ID NO: 2125444 - DNA, 17 bp, Homo sapiens
acagagccttcacaacc

SEQ ID NO: 2125445 - DNA, 21 bp, Homo sapiens
acagagcgagagtctgtctca

SEQ ID NO: 2125446 - DNA, 19 bp, Homo sapiens
acagagcgggcctcttccc

SEQ ID NO: 2125447 - DNA, 15 bp, Homo sapiens
acagagctggctgtc

SEQ ID NO: 2125448 - DNA, 13 bp, Homo sapiens
acagaggcagccc

SEQ ID NO: 2125449 - DNA, 23 bp, Homo sapiens
acagaggcagccccattctgcct

SEQ ID NO: 2125450 - DNA, 17 bp, Homo sapiens
acagaggccatgggcct

SEQ ID NO: 2125451 - DNA, 20 bp, Homo sapiens
acagagggctagggaggtgg

SEQ ID NO: 2125452 - DNA, 17 bp, Homo sapiens
acagagtatatatgtac

SEQ ID NO: 2125453 - DNA, 22 bp, Homo sapiens
acagagtatatatgtacagtta

SEQ ID NO: 2125454 - DNA, 12 bp, Homo sapiens
acagagtctcac

SEQ ID NO: 2125455 - DNA, 18 bp, Homo sapiens
acagagtggagccctcag

SEQ ID NO: 2125456 - DNA, 19 bp, Homo sapiens
acagagtggcccctcacct

SEQ ID NO: 2125457 - DNA, 14 bp, Homo sapiens
acagataactgaaa

SEQ ID NO: 2125458 - DNA, 18 bp, Homo sapiens
acagataactgaaaatta

SEQ ID NO: 2125459 - DNA, 18 bp, Homo sapiens
acagatacatagatggac

SEQ ID NO: 2125460 - DNA, 12 bp, Homo sapiens
acagataccata

SEQ ID NO: 2125461 - DNA, 23 bp, Homo sapiens
acagataccccacgttctatata

SEQ ID NO: 2125462 - DNA, 17 bp, Homo sapiens
acagatagacagtgctg

SEQ ID NO: 2125463 - DNA, 15 bp, Homo sapiens
acagatatacacatg

SEQ ID NO: 2125464 - DNA, 23 bp, Homo sapiens
acagatatttccatttcttcctc

SEQ ID NO: 2125465 - DNA, 22 bp, Homo sapiens
acagatcccatccatcagctcc

SEQ ID NO: 2125466 - DNA, 19 bp, Homo sapiens
acagatgataaatatttat

SEQ ID NO: 2125467 - DNA, 22 bp, Homo sapiens
acagatgataaatatttatgct

SEQ ID NO: 2125468 - DNA, 20 bp, Homo sapiens
acagatgtcagccgagccgg

SEQ ID NO: 2125469 - DNA, 12 bp, Homo sapiens
acagatgttgaa

SEQ ID NO: 2125470 - DNA, 21 bp, Homo sapiens
acagattctagccaaactatt

SEQ ID NO: 2125471 - DNA, 15 bp, Homo sapiens
acagattgtttgcaa

SEQ ID NO: 2125472 - DNA, 19 bp, Homo sapiens
acagcaacaggaatctcag

SEQ ID NO: 2125473 - DNA, 17 bp, Homo sapiens
acagcaagccggccccc

SEQ ID NO: 2125474 - DNA, 12 bp, Homo sapiens
acagcacccagg

SEQ ID NO: 2125475 - DNA, 14 bp, Homo sapiens
acagcacccaggct

SEQ ID NO: 2125476 - DNA, 20 bp, Homo sapiens
acagcacccaggctccatgg

SEQ ID NO: 2125477 - DNA, 23 bp, Homo sapiens
acagcactctctaaatcttcctt

SEQ ID NO: 2125478 - DNA, 23 bp, Homo sapiens
acagcagactcagctctgacatt

SEQ ID NO: 2125479 - DNA, 16 bp, Homo sapiens
acagcagcactgcaga

SEQ ID NO: 2125480 - DNA, 17 bp, Homo sapiens
acagcagcccctgcaca

SEQ ID NO: 2125481 - DNA, 18 bp, Homo sapiens
acagcagcccctgcacaa

SEQ ID NO: 2125482 - DNA, 14 bp, Homo sapiens
acagcagctcaggc

SEQ ID NO: 2125483 - DNA, 15 bp, Homo sapiens
acagcagctcaggca

SEQ ID NO: 2125484 - DNA, 18 bp, Homo sapiens
acagcagggtcttgctgt

SEQ ID NO: 2125485 - DNA, 22 bp, Homo sapiens
acagcagtcttcttcacccgct

SEQ ID NO: 2125486 - DNA, 19 bp, Homo sapiens
acagcagtgttccccatct

SEQ ID NO: 2125487 - DNA, 15 bp, Homo sapiens
acagcagttgaaaag

SEQ ID NO: 2125488 - DNA, 18 bp, Homo sapiens
acagcagttgaaaagact

SEQ ID NO: 2125489 - DNA, 21 bp, Homo sapiens
acagcagttgaaaagactcca

SEQ ID NO: 2125490 - DNA, 22 bp, Homo sapiens
acagcatctgcctctattcaat

SEQ ID NO: 2125491 - DNA, 23 bp, Homo sapiens
acagccaaatgcatggtgcagtt

SEQ ID NO: 2125492 - DNA, 15 bp, Homo sapiens
acagccaacaaacat

SEQ ID NO: 2125493 - DNA, 15 bp, Homo sapiens
acagccacggccagg

SEQ ID NO: 2125494 - DNA, 19 bp, Homo sapiens
acagccacggccaggccag

SEQ ID NO: 2125495 - DNA, 13 bp, Homo sapiens
acagccagactgg

SEQ ID NO: 2125496 - DNA, 15 bp, Homo sapiens
acagccagactggca

SEQ ID NO: 2125497 - DNA, 16 bp, Homo sapiens
acagccagactggcac

SEQ ID NO: 2125498 - DNA, 17 bp, Homo sapiens
acagccagagcctgtct

SEQ ID NO: 2125499 - DNA, 13 bp, Homo sapiens
acagcccaagagg

SEQ ID NO: 2125500 - DNA, 14 bp, Homo sapiens
acagcccaggtcct

SEQ ID NO: 2125501 - DNA, 17 bp, Homo sapiens
acagcccaggtcctccc

SEQ ID NO: 2125502 - DNA, 12 bp, Homo sapiens
acagccccacag

SEQ ID NO: 2125503 - DNA, 14 bp, Homo sapiens
acagccccagggcc

SEQ ID NO: 2125504 - DNA, 20 bp, Homo sapiens
acagccgcagcctccctctg

SEQ ID NO: 2125505 - DNA, 14 bp, Homo sapiens
acagccgctcctgt

SEQ ID NO: 2125506 - DNA, 23 bp, Homo sapiens
acagccgctcctgtctgccagcc

SEQ ID NO: 2125507 - DNA, 17 bp, Homo sapiens
acagccgtcagccaaat

SEQ ID NO: 2125508 - DNA, 20 bp, Homo sapiens
acagccgtcagccaaatgta

SEQ ID NO: 2125509 - DNA, 13 bp, Homo sapiens
acagcctctccct

SEQ ID NO: 2125510 - DNA, 17 bp, Homo sapiens
acagcctgacaacattt

SEQ ID NO: 2125511 - DNA, 20 bp, Homo sapiens
acagcctgggtgacggtcct

SEQ ID NO: 2125512 - DNA, 18 bp, Homo sapiens
acagcgaactagaagaaa

SEQ ID NO: 2125513 - DNA, 22 bp, Homo sapiens
acagcgagaggcagagaaagaa

SEQ ID NO: 2125514 - DNA, 21 bp, Homo sapiens
acagcgcgggcggaggcggct

SEQ ID NO: 2125515 - DNA, 14 bp, Homo sapiens
acagcggggaaggt

SEQ ID NO: 2125516 - DNA, 23 bp, Homo sapiens
acagcgtccctagcagtgaacta

SEQ ID NO: 2125517 - DNA, 16 bp, Homo sapiens
acagctaatgggacac

SEQ ID NO: 2125518 - DNA, 15 bp, Homo sapiens
acagctcacctctga

SEQ ID NO: 2125519 - DNA, 14 bp, Homo sapiens
acagctcagagatg

SEQ ID NO: 2125520 - DNA, 13 bp, Homo sapiens
acagctcccaccc

SEQ ID NO: 2125521 - DNA, 14 bp, Homo sapiens
acagctcccacccc

SEQ ID NO: 2125522 - DNA, 12 bp, Homo sapiens
acagctccctag

SEQ ID NO: 2125523 - DNA, 16 bp, Homo sapiens
acagctccttctgtcc

SEQ ID NO: 2125524 - DNA, 17 bp, Homo sapiens
acagctctgtcctggga

SEQ ID NO: 2125525 - DNA, 17 bp, Homo sapiens
acagctcttcactcagc

SEQ ID NO: 2125526 - DNA, 21 bp, Homo sapiens
acagctcttcactcagccaca

SEQ ID NO: 2125527 - DNA, 14 bp, Homo sapiens
acagctgacagata

SEQ ID NO: 2125528 - DNA, 16 bp, Homo sapiens
acagctgcagctgggc

SEQ ID NO: 2125529 - DNA, 11 bp, Homo sapiens
acagctgcttg

SEQ ID NO: 2125530 - DNA, 13 bp, Homo sapiens
acagctgcttgtg

SEQ ID NO: 2125531 - DNA, 14 bp, Homo sapiens
acagctggctgctg

SEQ ID NO: 2125532 - DNA, 15 bp, Homo sapiens
acagctggctgctga

SEQ ID NO: 2125533 - DNA, 18 bp, Homo sapiens
acagctggctgctgacag

SEQ ID NO: 2125534 - DNA, 19 bp, Homo sapiens
acagctggctgctgacagg

SEQ ID NO: 2125535 - DNA, 15 bp, Homo sapiens
acagctgtccctgtc

SEQ ID NO: 2125536 - DNA, 12 bp, Homo sapiens
acagctgtgcct

SEQ ID NO: 2125537 - DNA, 21 bp, Homo sapiens
acagcttcatttcctgtgtct

SEQ ID NO: 2125538 - DNA, 15 bp, Homo sapiens
acagcttgaccagac

SEQ ID NO: 2125539 - DNA, 20 bp, Homo sapiens
acagcttgaccagacctaga

SEQ ID NO: 2125540 - DNA, 16 bp, Homo sapiens
acagctttacacacac

SEQ ID NO: 2125541 - DNA, 20 bp, Homo sapiens
acagcttttcccaggagacc

SEQ ID NO: 2125542 - DNA, 21 bp, Homo sapiens
acaggaaaagctgctgacagt

SEQ ID NO: 2125543 - DNA, 15 bp, Homo sapiens
acaggaaagccctcc

SEQ ID NO: 2125544 - DNA, 17 bp, Homo sapiens
acaggaaagccctcccc

SEQ ID NO: 2125545 - DNA, 19 bp, Homo sapiens
acaggaaagccctccccct

SEQ ID NO: 2125546 - DNA, 21 bp, Homo sapiens
acaggaagcccaaggcagtgt

SEQ ID NO: 2125547 - DNA, 16 bp, Homo sapiens
acaggacacctggccg

SEQ ID NO: 2125548 - DNA, 22 bp, Homo sapiens
acaggacagtgcttcagcctga

SEQ ID NO: 2125549 - DNA, 16 bp, Homo sapiens
acaggactctgcctcc

SEQ ID NO: 2125550 - DNA, 18 bp, Homo sapiens
acaggacttaaaatgaca

SEQ ID NO: 2125551 - DNA, 11 bp, Homo sapiens
acaggagaaat

SEQ ID NO: 2125552 - DNA, 14 bp, Homo sapiens
acaggagacactgt

SEQ ID NO: 2125553 - DNA, 20 bp, Homo sapiens
acaggagccccacccccatg

SEQ ID NO: 2125554 - DNA, 13 bp, Homo sapiens
acaggagctacct

SEQ ID NO: 2125555 - DNA, 14 bp, Homo sapiens
acaggagctacctg

SEQ ID NO: 2125556 - DNA, 12 bp, Homo sapiens
acaggagggaga

SEQ ID NO: 2125557 - DNA, 14 bp, Homo sapiens
acaggagggagaga

SEQ ID NO: 2125558 - DNA, 18 bp, Homo sapiens
acaggagggcaagggcca

SEQ ID NO: 2125559 - DNA, 15 bp, Homo sapiens
acaggatcagtctga

SEQ ID NO: 2125560 - DNA, 22 bp, Homo sapiens
acaggatcctattctcaccagg

SEQ ID NO: 2125561 - DNA, 17 bp, Homo sapiens
acaggatgtggcactgc

SEQ ID NO: 2125562 - DNA, 19 bp, Homo sapiens
acaggcaactgaggcagac

SEQ ID NO: 2125563 - DNA, 22 bp, Homo sapiens
acaggcaactgaggcagacagc

SEQ ID NO: 2125564 - DNA, 16 bp, Homo sapiens
acaggcaagcacctcc

SEQ ID NO: 2125565 - DNA, 18 bp, Homo sapiens
acaggcaagcacctcctg

SEQ ID NO: 2125566 - DNA, 18 bp, Homo sapiens
acaggcaatgctggctgt

SEQ ID NO: 2125567 - DNA, 23 bp, Homo sapiens
acaggcacccaccatcatgtctg

SEQ ID NO: 2125568 - DNA, 15 bp, Homo sapiens
acaggcagatacagg

SEQ ID NO: 2125569 - DNA, 13 bp, Homo sapiens
acaggcaggaaga

SEQ ID NO: 2125570 - DNA, 16 bp, Homo sapiens
acaggcaggaagagag

SEQ ID NO: 2125571 - DNA, 18 bp, Homo sapiens
acaggcatctacacagcc

SEQ ID NO: 2125572 - DNA, 15 bp, Homo sapiens
acaggcatgttctct

SEQ ID NO: 2125573 - DNA, 19 bp, Homo sapiens
acaggcatgttctctgagg

SEQ ID NO: 2125574 - DNA, 20 bp, Homo sapiens
acaggcatgttctctgagga

SEQ ID NO: 2125575 - DNA, 22 bp, Homo sapiens
acaggcatgttctctgaggaca

SEQ ID NO: 2125576 - DNA, 18 bp, Homo sapiens
acaggcatttcctgggtg

SEQ ID NO: 2125577 - DNA, 20 bp, Homo sapiens
acaggccccccgcagcaccc

SEQ ID NO: 2125578 - DNA, 23 bp, Homo sapiens
acaggcccggcccagcctaggcc

SEQ ID NO: 2125579 - DNA, 23 bp, Homo sapiens
acaggcccttggggttcccccag

SEQ ID NO: 2125580 - DNA, 20 bp, Homo sapiens
acaggcctgtgtagctgtga

SEQ ID NO: 2125581 - DNA, 12 bp, Homo sapiens
acaggctgggct

SEQ ID NO: 2125582 - DNA, 21 bp, Homo sapiens
acaggctgggcttcagtggca

SEQ ID NO: 2125583 - DNA, 14 bp, Homo sapiens
acagggaaggcagg

SEQ ID NO: 2125584 - DNA, 15 bp, Homo sapiens
acagggaaggcaggc

SEQ ID NO: 2125585 - DNA, 20 bp, Homo sapiens
acagggaaggcaggcagggc

SEQ ID NO: 2125586 - DNA, 21 bp, Homo sapiens
acagggaaggcaggcagggct

SEQ ID NO: 2125587 - DNA, 12 bp, Homo sapiens
acagggacccac

SEQ ID NO: 2125588 - DNA, 21 bp, Homo sapiens
acagggagcccctaggaaagc

SEQ ID NO: 2125589 - DNA, 23 bp, Homo sapiens
acagggagcccctaggaaagcag

SEQ ID NO: 2125590 - DNA, 14 bp, Homo sapiens
acagggcaatcttg

SEQ ID NO: 2125591 - DNA, 19 bp, Homo sapiens
acagggcaatcttgtccac

SEQ ID NO: 2125592 - DNA, 20 bp, Homo sapiens
acagggcacaccgggcactc

SEQ ID NO: 2125593 - DNA, 22 bp, Homo sapiens
acagggcacaccgggcactcag

SEQ ID NO: 2125594 - DNA, 22 bp, Homo sapiens
acagggctctttgatggaccca

SEQ ID NO: 2125595 - DNA, 15 bp, Homo sapiens
acagggcttggggag

SEQ ID NO: 2125596 - DNA, 16 bp, Homo sapiens
acaggggatcaaagtt

SEQ ID NO: 2125597 - DNA, 16 bp, Homo sapiens
acaggggcaggcctgg

SEQ ID NO: 2125598 - DNA, 17 bp, Homo sapiens
acaggggcaggcctggg

SEQ ID NO: 2125599 - DNA, 20 bp, Homo sapiens
acaggggcaggcctgggacc

SEQ ID NO: 2125600 - DNA, 14 bp, Homo sapiens
acaggtatcaggca

SEQ ID NO: 2125601 - DNA, 18 bp, Homo sapiens
acaggtatcaggcacagg

SEQ ID NO: 2125602 - DNA, 22 bp, Homo sapiens
acaggtatcaggcacaggcagg

SEQ ID NO: 2125603 - DNA, 23 bp, Homo sapiens
acaggtcctgaaagtctgtgtcc

SEQ ID NO: 2125604 - DNA, 14 bp, Homo sapiens
acagtgagcctgaa

SEQ ID NO: 2125605 - DNA, 14 bp, Homo sapiens
acagtgatctccat

SEQ ID NO: 2125606 - DNA, 22 bp, Homo sapiens
acagtgcatccttgaactgtca

SEQ ID NO: 2125607 - DNA, 11 bp, Homo sapiens
acagtgcctgc

SEQ ID NO: 2125608 - DNA, 15 bp, Homo sapiens
acagtgctctaggct

SEQ ID NO: 2125609 - DNA, 15 bp, Homo sapiens
acagtgctgccctgc

SEQ ID NO: 2125610 - DNA, 15 bp, Homo sapiens
acagtgctgcttctc

SEQ ID NO: 2125611 - DNA, 16 bp, Homo sapiens
acagtgctgttctgga

SEQ ID NO: 2125612 - DNA, 21 bp, Homo sapiens
acagtgctgttctggagctgc

SEQ ID NO: 2125613 - DNA, 15 bp, Homo sapiens
acagtgcttcagcct

SEQ ID NO: 2125614 - DNA, 17 bp, Homo sapiens
acagtgcttcagcctga

SEQ ID NO: 2125615 - DNA, 18 bp, Homo sapiens
acagtgcttcagcctgag

SEQ ID NO: 2125616 - DNA, 13 bp, Homo sapiens
acagtggagaaat

SEQ ID NO: 2125617 - DNA, 22 bp, Homo sapiens
acagtggaggaaaatccatgga

SEQ ID NO: 2125618 - DNA, 19 bp, Homo sapiens
acagtggcacggagagaag

SEQ ID NO: 2125619 - DNA, 16 bp, Homo sapiens
acagtgggtggcacct

SEQ ID NO: 2125620 - DNA, 15 bp, Homo sapiens
acagtgggtggtgga

SEQ ID NO: 2125621 - DNA, 16 bp, Homo sapiens
acagtgttattttctt

SEQ ID NO: 2125622 - DNA, 22 bp, Homo sapiens
acagtgtttcccataattttct

SEQ ID NO: 2125623 - DNA, 13 bp, Homo sapiens
acagttaactttc

SEQ ID NO: 2125624 - DNA, 16 bp, Homo sapiens
acagttaactttcaga

SEQ ID NO: 2125625 - DNA, 16 bp, Homo sapiens
acagttacatgaaagt

SEQ ID NO: 2125626 - DNA, 16 bp, Homo sapiens
acagttactcttcagt

SEQ ID NO: 2125627 - DNA, 22 bp, Homo sapiens
acagttagggttgagttacttc

SEQ ID NO: 2125628 - DNA, 13 bp, Homo sapiens
acagttatacata

SEQ ID NO: 2125629 - DNA, 23 bp, Homo sapiens
acagttatttatagtcatttatt

SEQ ID NO: 2125630 - DNA, 13 bp, Homo sapiens
acagttcaaagaa

SEQ ID NO: 2125631 - DNA, 16 bp, Homo sapiens
acagttcaagaaagct

SEQ ID NO: 2125632 - DNA, 12 bp, Homo sapiens
acagttcagttc

SEQ ID NO: 2125633 - DNA, 12 bp, Homo sapiens
acagttcctcgc

SEQ ID NO: 2125634 - DNA, 14 bp, Homo sapiens
acagttcctcgccc

SEQ ID NO: 2125635 - DNA, 15 bp, Homo sapiens
acagttcctcgccct

SEQ ID NO: 2125636 - DNA, 18 bp, Homo sapiens
acagttcctcgccctggg

SEQ ID NO: 2125637 - DNA, 17 bp, Homo sapiens
acagttcttggtgactg

SEQ ID NO: 2125638 - DNA, 15 bp, Homo sapiens
acagttgctgtcata

SEQ ID NO: 2125639 - DNA, 21 bp, Homo sapiens
acagttggcagagaaggcctc

SEQ ID NO: 2125640 - DNA, 22 bp, Homo sapiens
acagttggcagagaaggcctct

SEQ ID NO: 2125641 - DNA, 23 bp, Homo sapiens
acagttgtctattctgagccttg

SEQ ID NO: 2125642 - DNA, 14 bp, Homo sapiens
acagtttgctctag

SEQ ID NO: 2125643 - DNA, 15 bp, Homo sapiens
acagttttctgagaa

SEQ ID NO: 2125644 - DNA, 20 bp, Homo sapiens
acagttttctgagaaagact

SEQ ID NO: 2125645 - DNA, 13 bp, Homo sapiens
acagttttgtgaa

SEQ ID NO: 2125646 - DNA, 19 bp, Homo sapiens
acataaaaatgatctaaac

SEQ ID NO: 2125647 - DNA, 19 bp, Homo sapiens
acataaaatatacaaacat

SEQ ID NO: 2125648 - DNA, 20 bp, Homo sapiens
acataaaatatacaaacatg

SEQ ID NO: 2125649 - DNA, 17 bp, Homo sapiens
acataaaatctgtgaat

SEQ ID NO: 2125650 - DNA, 12 bp, Homo sapiens
acataaaggtat

SEQ ID NO: 2125651 - DNA, 14 bp, Homo sapiens
acataagaccataa

SEQ ID NO: 2125652 - DNA, 15 bp, Homo sapiens
acataaggagaatgt

SEQ ID NO: 2125653 - DNA, 15 bp, Homo sapiens
acataatatcttgaa

SEQ ID NO: 2125654 - DNA, 16 bp, Homo sapiens
acataatcaaagctac

SEQ ID NO: 2125655 - DNA, 15 bp, Homo sapiens
acataatgaatgcta

SEQ ID NO: 2125656 - DNA, 12 bp, Homo sapiens
acataatttttt

SEQ ID NO: 2125657 - DNA, 17 bp, Homo sapiens
acatacaatttgcactg

SEQ ID NO: 2125658 - DNA, 21 bp, Homo sapiens
acatacacctatgtcatttca

SEQ ID NO: 2125659 - DNA, 16 bp, Homo sapiens
acatacacttgtataa

SEQ ID NO: 2125660 - DNA, 14 bp, Homo sapiens
acatacatacacat

SEQ ID NO: 2125661 - DNA, 13 bp, Homo sapiens
acatacatacata

SEQ ID NO: 2125662 - DNA, 14 bp, Homo sapiens
acatacatacatac

SEQ ID NO: 2125663 - DNA, 16 bp, Homo sapiens
acatacatacatacat

SEQ ID NO: 2125664 - DNA, 15 bp, Homo sapiens
acatacatacatata

SEQ ID NO: 2125665 - DNA, 16 bp, Homo sapiens
acatacatacatatat

SEQ ID NO: 2125666 - DNA, 15 bp, Homo sapiens
acatacatatatatc

SEQ ID NO: 2125667 - DNA, 18 bp, Homo sapiens
acatacatatatatctga

SEQ ID NO: 2125668 - DNA, 13 bp, Homo sapiens
acataccatctgt

SEQ ID NO: 2125669 - DNA, 17 bp, Homo sapiens
acatacccttctttaaa

SEQ ID NO: 2125670 - DNA, 20 bp, Homo sapiens
acatacctctctctatatat

SEQ ID NO: 2125671 - DNA, 16 bp, Homo sapiens
acatacgtgtctgtgt

SEQ ID NO: 2125672 - DNA, 12 bp, Homo sapiens
acatacgtgtta

SEQ ID NO: 2125673 - DNA, 16 bp, Homo sapiens
acatactcatttttca

SEQ ID NO: 2125674 - DNA, 18 bp, Homo sapiens
acatagacagaagaaaca

SEQ ID NO: 2125675 - DNA, 21 bp, Homo sapiens
acatagatgtatcattaatgt

SEQ ID NO: 2125676 - DNA, 20 bp, Homo sapiens
acataggttttgatttatat

SEQ ID NO: 2125677 - DNA, 23 bp, Homo sapiens
acataggttttgatttatatgtg

SEQ ID NO: 2125678 - DNA, 13 bp, Homo sapiens
acatagtcacaaa

SEQ ID NO: 2125679 - DNA, 16 bp, Homo sapiens
acatagtgatggttcc

SEQ ID NO: 2125680 - DNA, 15 bp, Homo sapiens
acatatacatatata

SEQ ID NO: 2125681 - DNA, 19 bp, Homo sapiens
acatatacctataatgtgt

SEQ ID NO: 2125682 - DNA, 22 bp, Homo sapiens
acatatacctataatgtgtgta

SEQ ID NO: 2125683 - DNA, 16 bp, Homo sapiens
acatatatatctgata

SEQ ID NO: 2125684 - DNA, 14 bp, Homo sapiens
acatatatgtatat

SEQ ID NO: 2125685 - DNA, 12 bp, Homo sapiens
acatatcaattc

SEQ ID NO: 2125686 - DNA, 17 bp, Homo sapiens
acaccttcttggcttct

SEQ ID NO: 2125687 - DNA, 20 bp, Homo sapiens
acaccttcttggcttctggg

SEQ ID NO: 2125688 - DNA, 17 bp, Homo sapiens
acacctttgttttgcac

SEQ ID NO: 2125689 - DNA, 22 bp, Homo sapiens
acaccttttccaggagttctga

SEQ ID NO: 2125690 - DNA, 19 bp, Homo sapiens
acacgagcaggctactgtc

SEQ ID NO: 2125691 - DNA, 21 bp, Homo sapiens
acacgagcaggctactgtcag

SEQ ID NO: 2125692 - DNA, 24 bp, Homo sapiens
acacgcaagggcatcaggcactgg

SEQ ID NO: 2125693 - DNA, 19 bp, Homo sapiens
acacgcaggaactcccagc

SEQ ID NO: 2125694 - DNA, 15 bp, Homo sapiens
acacggaccatgtgg

SEQ ID NO: 2125695 - DNA, 12 bp, Homo sapiens
acacggccctgc

SEQ ID NO: 2125696 - DNA, 22 bp, Homo sapiens
acacggccctgccccatcctgg

SEQ ID NO: 2125697 - DNA, 22 bp, Homo sapiens
acacggtgaaatccaggtctcg

SEQ ID NO: 2125698 - DNA, 19 bp, Homo sapiens
acacgtacctctcatcagt

SEQ ID NO: 2125699 - DNA, 16 bp, Homo sapiens
acacgtacttaaatga

SEQ ID NO: 2125700 - DNA, 14 bp, Homo sapiens
acacgtgctcgcag

SEQ ID NO: 2125701 - DNA, 16 bp, Homo sapiens
acacgtgctcgcagcc

SEQ ID NO: 2125702 - DNA, 15 bp, Homo sapiens
acactaaacagacta

SEQ ID NO: 2125703 - DNA, 21 bp, Homo sapiens
acactaaacagactatttaac

SEQ ID NO: 2125704 - DNA, 20 bp, Homo sapiens
acactaaccacgctggacct

SEQ ID NO: 2125705 - DNA, 23 bp, Homo sapiens
acactaattcctttctatcctac

SEQ ID NO: 2125706 - DNA, 18 bp, Homo sapiens
acactacaagtttataag

SEQ ID NO: 2125707 - DNA, 19 bp, Homo sapiens
acactacaagtttataagc

SEQ ID NO: 2125708 - DNA, 17 bp, Homo sapiens
acactacacactgtgta

SEQ ID NO: 2125709 - DNA, 16 bp, Homo sapiens
acactaccttatcagg

SEQ ID NO: 2125710 - DNA, 13 bp, Homo sapiens
acactacttaaaa

SEQ ID NO: 2125711 - DNA, 15 bp, Homo sapiens
acactagcctctcca

SEQ ID NO: 2125712 - DNA, 19 bp, Homo sapiens
acactagttttgtgccagc

SEQ ID NO: 2125713 - DNA, 18 bp, Homo sapiens
acactattaccatgagaa

SEQ ID NO: 2125714 - DNA, 17 bp, Homo sapiens
acactattgcattgttc

SEQ ID NO: 2125715 - DNA, 17 bp, Homo sapiens
acactcaaatcaagaaa

SEQ ID NO: 2125716 - DNA, 18 bp, Homo sapiens
acactcaaatcaagaaac

SEQ ID NO: 2125717 - DNA, 20 bp, Homo sapiens
acactcacatttattctgct

SEQ ID NO: 2125718 - DNA, 16 bp, Homo sapiens
acactcagaagcctgg

SEQ ID NO: 2125719 - DNA, 17 bp, Homo sapiens
acactcagaagcctggg

SEQ ID NO: 2125720 - DNA, 18 bp, Homo sapiens
acactcagtcccccacca

SEQ ID NO: 2125721 - DNA, 23 bp, Homo sapiens
acactccaccccctccagctcca

SEQ ID NO: 2125722 - DNA, 16 bp, Homo sapiens
acactccagcctgagc

SEQ ID NO: 2125723 - DNA, 13 bp, Homo sapiens
acactcccaggga

SEQ ID NO: 2125724 - DNA, 17 bp, Homo sapiens
acactcccccagactgc

SEQ ID NO: 2125725 - DNA, 17 bp, Homo sapiens
acactctaagttctatt

SEQ ID NO: 2125726 - DNA, 20 bp, Homo sapiens
acactctagtgacttcctgg

SEQ ID NO: 2125727 - DNA, 15 bp, Homo sapiens
acactctctgtacaa

SEQ ID NO: 2125728 - DNA, 22 bp, Homo sapiens
acactctctgtacaaaaacaaa

SEQ ID NO: 2125729 - DNA, 12 bp, Homo sapiens
acactctttgta

SEQ ID NO: 2125730 - DNA, 19 bp, Homo sapiens
acactgaagttaacagaga

SEQ ID NO: 2125731 - DNA, 19 bp, Homo sapiens
acactgagcaagatcttgt

SEQ ID NO: 2125732 - DNA, 15 bp, Homo sapiens
acactgctgcaccag

SEQ ID NO: 2125733 - DNA, 19 bp, Homo sapiens
acactgctgcaccagagtg

SEQ ID NO: 2125734 - DNA, 19 bp, Homo sapiens
acactgcttgtgtttttaa

SEQ ID NO: 2125735 - DNA, 20 bp, Homo sapiens
acactggaaaataaattttg

SEQ ID NO: 2125736 - DNA, 21 bp, Homo sapiens
acactggcgaaccatctcaat

SEQ ID NO: 2125737 - DNA, 15 bp, Homo sapiens
acactgggggagggg

SEQ ID NO: 2125738 - DNA, 16 bp, Homo sapiens
acactgggggagggga

SEQ ID NO: 2125739 - DNA, 18 bp, Homo sapiens
acactgggtagtagctaa

SEQ ID NO: 2125740 - DNA, 15 bp, Homo sapiens
acattcctctgcagc

SEQ ID NO: 2125741 - DNA, 16 bp, Homo sapiens
acattcctgatactgg

SEQ ID NO: 2125742 - DNA, 19 bp, Homo sapiens
acattcctggccccgggct

SEQ ID NO: 2125743 - DNA, 18 bp, Homo sapiens
acattccttgtcaccagc

SEQ ID NO: 2125744 - DNA, 19 bp, Homo sapiens
acattccttgtcaccagca

SEQ ID NO: 2125745 - DNA, 21 bp, Homo sapiens
acattgcggacagccacggcc

SEQ ID NO: 2125746 - DNA, 13 bp, Homo sapiens
acattggacttcc

SEQ ID NO: 2125747 - DNA, 16 bp, Homo sapiens
acattggtaagaatga

SEQ ID NO: 2125748 - DNA, 16 bp, Homo sapiens
acatttacacattctc

SEQ ID NO: 2125749 - DNA, 15 bp, Homo sapiens
acatttataatgttt

SEQ ID NO: 2125750 - DNA, 14 bp, Homo sapiens
acatttatacatca

SEQ ID NO: 2125751 - DNA, 16 bp, Homo sapiens
acatttatatatatat

SEQ ID NO: 2125752 - DNA, 19 bp, Homo sapiens
acatttatatatatatgta

SEQ ID NO: 2125753 - DNA, 16 bp, Homo sapiens
acatttatctaaaaga

SEQ ID NO: 2125754 - DNA, 20 bp, Homo sapiens
acatttcataaggcctgccc

SEQ ID NO: 2125755 - DNA, 21 bp, Homo sapiens
acatttcataaggcctgccct

SEQ ID NO: 2125756 - DNA, 12 bp, Homo sapiens
acatttcatctg

SEQ ID NO: 2125757 - DNA, 18 bp, Homo sapiens
acatttctaacatatgta

SEQ ID NO: 2125758 - DNA, 14 bp, Homo sapiens
acatttctctgagc

SEQ ID NO: 2125759 - DNA, 14 bp, Homo sapiens
acatttcttatgat

SEQ ID NO: 2125760 - DNA, 18 bp, Homo sapiens
acatttgagtatccgatt

SEQ ID NO: 2125761 - DNA, 12 bp, Homo sapiens
acatttgatgta

SEQ ID NO: 2125762 - DNA, 13 bp, Homo sapiens
acatttgttcatg

SEQ ID NO: 2125763 - DNA, 19 bp, Homo sapiens
acatttgttcatgagtgga

SEQ ID NO: 2125764 - DNA, 15 bp, Homo sapiens
acattttaaataaaa

SEQ ID NO: 2125765 - DNA, 14 bp, Homo sapiens
accactctggcagc

SEQ ID NO: 2125766 - DNA, 18 bp, Homo sapiens
accactctggcagccaca

SEQ ID NO: 2125767 - DNA, 20 bp, Homo sapiens
accactgtaaaatgaaatta

SEQ ID NO: 2125768 - DNA, 20 bp, Homo sapiens
accactgtggcgttctgctg

SEQ ID NO: 2125769 - DNA, 15 bp, Homo sapiens
accacttcttttata

SEQ ID NO: 2125770 - DNA, 13 bp, Homo sapiens
accacttggctgc

SEQ ID NO: 2125771 - DNA, 14 bp, Homo sapiens
accagaagccaaag

SEQ ID NO: 2125772 - DNA, 19 bp, Homo sapiens
accagaatcataattttca

SEQ ID NO: 2125773 - DNA, 18 bp, Homo sapiens
accagacctagacctggg

SEQ ID NO: 2125774 - DNA, 21 bp, Homo sapiens
accagacctagacctgggcca

SEQ ID NO: 2125775 - DNA, 13 bp, Homo sapiens
accagactgtgga

SEQ ID NO: 2125776 - DNA, 14 bp, Homo sapiens
accagagcccacct

SEQ ID NO: 2125777 - DNA, 17 bp, Homo sapiens
accagagcccaccttgg

SEQ ID NO: 2125778 - DNA, 19 bp, Homo sapiens
accagagcccaccttggct

SEQ ID NO: 2125779 - DNA, 22 bp, Homo sapiens
accagagcccaccttggctcaa

SEQ ID NO: 2125780 - DNA, 11 bp, Homo sapiens
accagagcccc

SEQ ID NO: 2125781 - DNA, 14 bp, Homo sapiens
accagagccccaca

SEQ ID NO: 2125782 - DNA, 17 bp, Homo sapiens
accagagccccacacgg

SEQ ID NO: 2125783 - DNA, 20 bp, Homo sapiens
accagagccccacacggagg

SEQ ID NO: 2125784 - DNA, 19 bp, Homo sapiens
accattacaactagatcaa

SEQ ID NO: 2125785 - DNA, 13 bp, Homo sapiens
accattacatgtt

SEQ ID NO: 2125786 - DNA, 14 bp, Homo sapiens
accattacatgttt

SEQ ID NO: 2125787 - DNA, 13 bp, Homo sapiens
accattcacattt

SEQ ID NO: 2125788 - DNA, 17 bp, Homo sapiens
accattcatctctaaca

SEQ ID NO: 2125789 - DNA, 15 bp, Homo sapiens
accattgacctcagc

SEQ ID NO: 2125790 - DNA, 16 bp, Homo sapiens
accattgacctcagct

SEQ ID NO: 2125791 - DNA, 12 bp, Homo sapiens
accattggctgc

SEQ ID NO: 2125792 - DNA, 15 bp, Homo sapiens
accattgtcttccaa

SEQ ID NO: 2125793 - DNA, 23 bp, Homo sapiens
accattgtcttccaaccccagct

SEQ ID NO: 2125794 - DNA, 14 bp, Homo sapiens
accatttaacatgc

SEQ ID NO: 2125795 - DNA, 11 bp, Homo sapiens
accatttcaga

SEQ ID NO: 2125796 - DNA, 14 bp, Homo sapiens
accatttcagagag

SEQ ID NO: 2125797 - DNA, 20 bp, Homo sapiens
accatttcagagaggccttt

SEQ ID NO: 2125798 - DNA, 22 bp, Homo sapiens
accattttggggtacccactgc

SEQ ID NO: 2125799 - DNA, 23 bp, Homo sapiens
accattttggggtacccactgct

SEQ ID NO: 2125800 - DNA, 13 bp, Homo sapiens
acccaaataaatg

SEQ ID NO: 2125801 - DNA, 15 bp, Homo sapiens
acccaatgctcctgg

SEQ ID NO: 2125802 - DNA, 14 bp, Homo sapiens
acccaatttaattc

SEQ ID NO: 2125803 - DNA, 13 bp, Homo sapiens
acccacagcctct

SEQ ID NO: 2125804 - DNA, 19 bp, Homo sapiens
acccacagcctctgcctgt

SEQ ID NO: 2125805 - DNA, 23 bp, Homo sapiens
acccacatgccatttgtactgac

SEQ ID NO: 2125806 - DNA, 17 bp, Homo sapiens
acccacccatcttcctg

SEQ ID NO: 2125807 - DNA, 17 bp, Homo sapiens
acccaccccctctttgt

SEQ ID NO: 2125808 - DNA, 15 bp, Homo sapiens
acccaccctcctttc

SEQ ID NO: 2125809 - DNA, 22 bp, Homo sapiens
acccaccgggccactccttcct

SEQ ID NO: 2125810 - DNA, 12 bp, Homo sapiens
acccacctccac

SEQ ID NO: 2125811 - DNA, 16 bp, Homo sapiens
acccacctccaccccc

SEQ ID NO: 2125812 - DNA, 13 bp, Homo sapiens
acccacctgctga

SEQ ID NO: 2125813 - DNA, 17 bp, Homo sapiens
acccacctgctgagaga

SEQ ID NO: 2125814 - DNA, 17 bp, Homo sapiens
acccactcaccagggtc

SEQ ID NO: 2125815 - DNA, 13 bp, Homo sapiens
acccactctttgc

SEQ ID NO: 2125816 - DNA, 10 bp, Homo sapiens
acccactgct

SEQ ID NO: 2125817 - DNA, 14 bp, Homo sapiens
acccactgctctgg

SEQ ID NO: 2125818 - DNA, 16 bp, Homo sapiens
acccactgtccgcctc

SEQ ID NO: 2125819 - DNA, 18 bp, Homo sapiens
acccagaaattccttccc

SEQ ID NO: 2125820 - DNA, 19 bp, Homo sapiens
acccagaactggacgccca

SEQ ID NO: 2125821 - DNA, 14 bp, Homo sapiens
acccagagaatata

SEQ ID NO: 2125822 - DNA, 18 bp, Homo sapiens
acccagagaatatataca

SEQ ID NO: 2125823 - DNA, 21 bp, Homo sapiens
acccagagggtagggcagcag

SEQ ID NO: 2125824 - DNA, 14 bp, Homo sapiens
acccagatcctcac

SEQ ID NO: 2125825 - DNA, 15 bp, Homo sapiens
acccagatctcatgg

SEQ ID NO: 2125826 - DNA, 15 bp, Homo sapiens
acccagcatgtacaa

SEQ ID NO: 2125827 - DNA, 16 bp, Homo sapiens
acccagcatgtacaaa

SEQ ID NO: 2125828 - DNA, 15 bp, Homo sapiens
acccagcccacttct

SEQ ID NO: 2125829 - DNA, 18 bp, Homo sapiens
acccagcccacttctgcc

SEQ ID NO: 2125830 - DNA, 20 bp, Homo sapiens
acccagctactctgtccagg

SEQ ID NO: 2125831 - DNA, 22 bp, Homo sapiens
acccagctactctgtccaggcc

SEQ ID NO: 2125832 - DNA, 11 bp, Homo sapiens
acccagctcct

SEQ ID NO: 2125833 - DNA, 21 bp, Homo sapiens
acccagctccttttgtcccca

SEQ ID NO: 2125834 - DNA, 23 bp, Homo sapiens
acccaggagatggaagttgcagt

SEQ ID NO: 2125835 - DNA, 15 bp, Homo sapiens
acccaggagccccga

SEQ ID NO: 2125836 - DNA, 11 bp, Homo sapiens
acccaggaggt

SEQ ID NO: 2125837 - DNA, 23 bp, Homo sapiens
acccaggaggtggaggttgcagt

SEQ ID NO: 2125838 - DNA, 12 bp, Homo sapiens
acccaggccctc

SEQ ID NO: 2125839 - DNA, 17 bp, Homo sapiens
acccaggccctccatgg

SEQ ID NO: 2125840 - DNA, 19 bp, Homo sapiens
acccaggccctccatgggc

SEQ ID NO: 2125841 - DNA, 18 bp, Homo sapiens
acccaggctccatgggga

SEQ ID NO: 2125842 - DNA, 19 bp, Homo sapiens
acccaggctctggagccag

SEQ ID NO: 2125843 - DNA, 20 bp, Homo sapiens
acccaggctctggagccaga

SEQ ID NO: 2125844 - DNA, 21 bp, Homo sapiens
acccaggctctggagccagag

SEQ ID NO: 2125845 - DNA, 19 bp, Homo sapiens
acccaggctgcactgcagt

SEQ ID NO: 2125846 - DNA, 20 bp, Homo sapiens
acccaggctggagtacagtg

SEQ ID NO: 2125847 - DNA, 20 bp, Homo sapiens
acccagggctccctcctgga

SEQ ID NO: 2125848 - DNA, 13 bp, Homo sapiens
acccaggggtggg

SEQ ID NO: 2125849 - DNA, 14 bp, Homo sapiens
acccaggtctccct

SEQ ID NO: 2125850 - DNA, 18 bp, Homo sapiens
acccagtaactcatctgt

SEQ ID NO: 2125851 - DNA, 21 bp, Homo sapiens
acccagtccccgtgccccgcc

SEQ ID NO: 2125852 - DNA, 13 bp, Homo sapiens
acccagtccctgg

SEQ ID NO: 2125853 - DNA, 15 bp, Homo sapiens
acccagtccctgggg

SEQ ID NO: 2125854 - DNA, 22 bp, Homo sapiens
acccagtccgccaaacactcca

SEQ ID NO: 2125855 - DNA, 22 bp, Homo sapiens
acccagtcctggccattttctt

SEQ ID NO: 2125856 - DNA, 16 bp, Homo sapiens
acccagtctgttcccc

SEQ ID NO: 2125857 - DNA, 15 bp, Homo sapiens
acccagtgctgccat

SEQ ID NO: 2125858 - DNA, 17 bp, Homo sapiens
acccagtgctgccatgc

SEQ ID NO: 2125859 - DNA, 18 bp, Homo sapiens
acccagtgctgccatgcc

SEQ ID NO: 2125860 - DNA, 22 bp, Homo sapiens
acccagtgctgccatgccactg

SEQ ID NO: 2125861 - DNA, 21 bp, Homo sapiens
acccatagatcttctgaaatg

SEQ ID NO: 2125862 - DNA, 15 bp, Homo sapiens
acccatagcttccat

SEQ ID NO: 2125863 - DNA, 19 bp, Homo sapiens
acccatcagaaggagaagg

SEQ ID NO: 2125864 - DNA, 17 bp, Homo sapiens
acccatcagacaggtaa

SEQ ID NO: 2125865 - DNA, 21 bp, Homo sapiens
acccatcctaccaatgcatgc

SEQ ID NO: 2125866 - DNA, 18 bp, Homo sapiens
acccatcttcctgctgct

SEQ ID NO: 2125867 - DNA, 19 bp, Homo sapiens
acccatgaagacaggacag

SEQ ID NO: 2125868 - DNA, 14 bp, Homo sapiens
acccatgtgccaag

SEQ ID NO: 2125869 - DNA, 22 bp, Homo sapiens
acccatgtttctgggtgggtga

SEQ ID NO: 2125870 - DNA, 22 bp, Homo sapiens
acccattcccccatgtggctga

SEQ ID NO: 2125871 - DNA, 20 bp, Homo sapiens
acccattcttcagtgcctag

SEQ ID NO: 2125872 - DNA, 18 bp, Homo sapiens
acccatttttgagccaag

SEQ ID NO: 2125873 - DNA, 15 bp, Homo sapiens
accccaaagagcctg

SEQ ID NO: 2125874 - DNA, 22 bp, Homo sapiens
accccaaagagcctggagaagc

SEQ ID NO: 2125875 - DNA, 16 bp, Homo sapiens
accccaaagccccttg

SEQ ID NO: 2125876 - DNA, 13 bp, Homo sapiens
accccaagcagca

SEQ ID NO: 2125877 - DNA, 14 bp, Homo sapiens
accccaagcagcat

SEQ ID NO: 2125878 - DNA, 22 bp, Homo sapiens
accccaagtccacctgcctatc

SEQ ID NO: 2125879 - DNA, 12 bp, Homo sapiens
accccactccag

SEQ ID NO: 2125880 - DNA, 14 bp, Homo sapiens
accccactccagcc

SEQ ID NO: 2125881 - DNA, 15 bp, Homo sapiens
accccactccagccc

SEQ ID NO: 2125882 - DNA, 19 bp, Homo sapiens
accccactccagccctgtc

SEQ ID NO: 2125883 - DNA, 21 bp, Homo sapiens
accccagactcaaactcaagg

SEQ ID NO: 2125884 - DNA, 13 bp, Homo sapiens
accccagagtgtg

SEQ ID NO: 2125885 - DNA, 13 bp, Homo sapiens
accccagcggctg

SEQ ID NO: 2125886 - DNA, 15 bp, Homo sapiens
actccttattttgta

SEQ ID NO: 2125887 - DNA, 20 bp, Homo sapiens
actccttcaacaattctaaa

SEQ ID NO: 2125888 - DNA, 12 bp, Homo sapiens
actccttccagc

SEQ ID NO: 2125889 - DNA, 13 bp, Homo sapiens
actccttccagct

SEQ ID NO: 2125890 - DNA, 18 bp, Homo sapiens
actccttgtggtttatgt

SEQ ID NO: 2125891 - DNA, 20 bp, Homo sapiens
actccttgtggtttatgtca

SEQ ID NO: 2125892 - DNA, 20 bp, Homo sapiens
actcgagaccatcctggccc

SEQ ID NO: 2125893 - DNA, 21 bp, Homo sapiens
actcgagaccatcctggcccc

SEQ ID NO: 2125894 - DNA, 22 bp, Homo sapiens
actcgagaccatcctggcccct

SEQ ID NO: 2125895 - DNA, 19 bp, Homo sapiens
actcgcttagctgaaacct

SEQ ID NO: 2125896 - DNA, 18 bp, Homo sapiens
actcggtgtaaaaccatg

SEQ ID NO: 2125897 - DNA, 14 bp, Homo sapiens
actcgtatatgtct

SEQ ID NO: 2125898 - DNA, 14 bp, Homo sapiens
actcgttttttaca

SEQ ID NO: 2125899 - DNA, 22 bp, Homo sapiens
actctaaattctttatttctgt

SEQ ID NO: 2125900 - DNA, 16 bp, Homo sapiens
actctaagctggagct

SEQ ID NO: 2125901 - DNA, 19 bp, Homo sapiens
actctaagctggagctctt

SEQ ID NO: 2125902 - DNA, 16 bp, Homo sapiens
actctagcctggcaac

SEQ ID NO: 2125903 - DNA, 20 bp, Homo sapiens
actctagcctgggccagaga

SEQ ID NO: 2125904 - DNA, 22 bp, Homo sapiens
actctatatagctgatcagttt

SEQ ID NO: 2125905 - DNA, 16 bp, Homo sapiens
actctatgccccaaat

SEQ ID NO: 2125906 - DNA, 20 bp, Homo sapiens
actctatgccccaaatatag

SEQ ID NO: 2125907 - DNA, 18 bp, Homo sapiens
actctcaggatcaagaaa

SEQ ID NO: 2125908 - DNA, 22 bp, Homo sapiens
actctcaggatcaagaaagtgt

SEQ ID NO: 2125909 - DNA, 21 bp, Homo sapiens
actctcattccccaggtggct

SEQ ID NO: 2125910 - DNA, 14 bp, Homo sapiens
actctccaacctgg

SEQ ID NO: 2125911 - DNA, 19 bp, Homo sapiens
actctccccctttcaagga

SEQ ID NO: 2125912 - DNA, 12 bp, Homo sapiens
actctcccctcc

SEQ ID NO: 2125913 - DNA, 19 bp, Homo sapiens
actctcctcggccccctcc

SEQ ID NO: 2125914 - DNA, 20 bp, Homo sapiens
actctcctcggccccctcca

SEQ ID NO: 2125915 - DNA, 14 bp, Homo sapiens
actctcctctgcct

SEQ ID NO: 2125916 - DNA, 19 bp, Homo sapiens
actctcggggcccttgggg

SEQ ID NO: 2125917 - DNA, 23 bp, Homo sapiens
actctctaaatcttccttgtgag

SEQ ID NO: 2125918 - DNA, 20 bp, Homo sapiens
actctctccaccctatatgt

SEQ ID NO: 2125919 - DNA, 17 bp, Homo sapiens
actctctgctctagcca

SEQ ID NO: 2125920 - DNA, 16 bp, Homo sapiens
actctctgtacaaaaa

SEQ ID NO: 2125921 - DNA, 18 bp, Homo sapiens
actctgacaagggctgac

SEQ ID NO: 2125922 - DNA, 19 bp, Homo sapiens
actctgacaagggctgacc

SEQ ID NO: 2125923 - DNA, 21 bp, Homo sapiens
actctgacaagggctgacctg

SEQ ID NO: 2125924 - DNA, 12 bp, Homo sapiens
actctgagccca

SEQ ID NO: 2125925 - DNA, 13 bp, Homo sapiens
actctgagcccag

SEQ ID NO: 2125926 - DNA, 22 bp, Homo sapiens
actctgaggacatggagagaga

SEQ ID NO: 2125927 - DNA, 21 bp, Homo sapiens
actctgaggctctttctgggc

SEQ ID NO: 2125928 - DNA, 16 bp, Homo sapiens
actctgcacagcaact

SEQ ID NO: 2125929 - DNA, 11 bp, Homo sapiens
actctgcacat

SEQ ID NO: 2125930 - DNA, 13 bp, Homo sapiens
actctgcacatgt

SEQ ID NO: 2125931 - DNA, 17 bp, Homo sapiens
actctgcacatgtcttg

SEQ ID NO: 2125932 - DNA, 18 bp, Homo sapiens
actctgcacatgtcttgt

SEQ ID NO: 2125933 - DNA, 17 bp, Homo sapiens
actctgcactccatggc

SEQ ID NO: 2125934 - DNA, 20 bp, Homo sapiens
actctgcactccatggccac

SEQ ID NO: 2125935 - DNA, 13 bp, Homo sapiens
actctgccagcca

SEQ ID NO: 2125936 - DNA, 16 bp, Homo sapiens
actctgccagccacat

SEQ ID NO: 2125937 - DNA, 21 bp, Homo sapiens
actctgccccttctgtttcca

SEQ ID NO: 2125938 - DNA, 12 bp, Homo sapiens
actctgcctcct

SEQ ID NO: 2125939 - DNA, 16 bp, Homo sapiens
actctgcctcctcttc

SEQ ID NO: 2125940 - DNA, 14 bp, Homo sapiens
actctgctctgatg

SEQ ID NO: 2125941 - DNA, 17 bp, Homo sapiens
actctggaagcccccca

SEQ ID NO: 2125942 - DNA, 23 bp, Homo sapiens
actctggcaccccggatcgagga

SEQ ID NO: 2125943 - DNA, 14 bp, Homo sapiens
actctggcagccac

SEQ ID NO: 2125944 - DNA, 17 bp, Homo sapiens
actctggcagccacact

SEQ ID NO: 2125945 - DNA, 13 bp, Homo sapiens
actctggcctctc

SEQ ID NO: 2125946 - DNA, 20 bp, Homo sapiens
actctggcctctcgagttct

SEQ ID NO: 2125947 - DNA, 14 bp, Homo sapiens
actctggcttccag

SEQ ID NO: 2125948 - DNA, 19 bp, Homo sapiens
actctgggaaataagagag

SEQ ID NO: 2125949 - DNA, 17 bp, Homo sapiens
actctggtggtgctttt

SEQ ID NO: 2125950 - DNA, 20 bp, Homo sapiens
actctggtggtgcttttgta

SEQ ID NO: 2125951 - DNA, 21 bp, Homo sapiens
actctggtggtgcttttgtat

SEQ ID NO: 2125952 - DNA, 16 bp, Homo sapiens
actctgtccaggccac

SEQ ID NO: 2125953 - DNA, 23 bp, Homo sapiens
actctgtgccagagcctggggct

SEQ ID NO: 2125954 - DNA, 17 bp, Homo sapiens
actctgtggggccttgg

SEQ ID NO: 2125955 - DNA, 15 bp, Homo sapiens
actcttaagcaatgg

SEQ ID NO: 2125956 - DNA, 20 bp, Homo sapiens
actcttaggaagagaaacca

SEQ ID NO: 2125957 - DNA, 16 bp, Homo sapiens
actcttattgcccacg

SEQ ID NO: 2125958 - DNA, 21 bp, Homo sapiens
actcttattgcccacgctgga

SEQ ID NO: 2125959 - DNA, 20 bp, Homo sapiens
actcttcccccactcctctt

SEQ ID NO: 2125960 - DNA, 11 bp, Homo sapiens
actcttcctgc

SEQ ID NO: 2125961 - DNA, 16 bp, Homo sapiens
actcttctactttcat

SEQ ID NO: 2125962 - DNA, 14 bp, Homo sapiens
actcttgacctcag

SEQ ID NO: 2125963 - DNA, 16 bp, Homo sapiens
actcttgacctcaggt

SEQ ID NO: 2125964 - DNA, 19 bp, Homo sapiens
actcttgcctttccacctg

SEQ ID NO: 2125965 - DNA, 16 bp, Homo sapiens
actctttgctacaata

SEQ ID NO: 2125966 - DNA, 24 bp, Homo sapiens
actctttgctacaataaatgctga

SEQ ID NO: 2125967 - DNA, 18 bp, Homo sapiens
actgaaaaatgtcagtct

SEQ ID NO: 2125968 - DNA, 20 bp, Homo sapiens
actgaaaaggttcttcatcc

SEQ ID NO: 2125969 - DNA, 19 bp, Homo sapiens
actgaaaataccatcaggc

SEQ ID NO: 2125970 - DNA, 15 bp, Homo sapiens
actgaaaatctaata

SEQ ID NO: 2125971 - DNA, 16 bp, Homo sapiens
actgaaaatctaatat

SEQ ID NO: 2125972 - DNA, 10 bp, Homo sapiens
actgaaagaa

SEQ ID NO: 2125973 - DNA, 16 bp, Homo sapiens
actgaaagcagcagct

SEQ ID NO: 2125974 - DNA, 13 bp, Homo sapiens
actgaaagtggtt

SEQ ID NO: 2125975 - DNA, 18 bp, Homo sapiens
actgaagacctccacatt

SEQ ID NO: 2125976 - DNA, 18 bp, Homo sapiens
actgaagccagaaataaa

SEQ ID NO: 2125977 - DNA, 11 bp, Homo sapiens
actgaaggaga

SEQ ID NO: 2125978 - DNA, 13 bp, Homo sapiens
actgaaggagaag

SEQ ID NO: 2125979 - DNA, 13 bp, Homo sapiens
actgaaggggcac

SEQ ID NO: 2125980 - DNA, 16 bp, Homo sapiens
actgaaggggcacacc

SEQ ID NO: 2125981 - DNA, 19 bp, Homo sapiens
actgaatctcccctcctca

SEQ ID NO: 2125982 - DNA, 16 bp, Homo sapiens
actgaatgctctgtgc

SEQ ID NO: 2125983 - DNA, 17 bp, Homo sapiens
actgaatttattgccgc

SEQ ID NO: 2125984 - DNA, 19 bp, Homo sapiens
actgaattttaaatgttca

SEQ ID NO: 2125985 - DNA, 16 bp, Homo sapiens
actgacaagatggaaa

SEQ ID NO: 2125986 - DNA, 22 bp, Homo sapiens
actgacaagatggaaaataaat

SEQ ID NO: 2125987 - DNA, 13 bp, Homo sapiens
actgacacaggaa

SEQ ID NO: 2125988 - DNA, 21 bp, Homo sapiens
actgacacaggaaaccaacac

SEQ ID NO: 2125989 - DNA, 14 bp, Homo sapiens
actgacacaggcca

SEQ ID NO: 2125990 - DNA, 21 bp, Homo sapiens
actgacacaggccagccccat

SEQ ID NO: 2125991 - DNA, 19 bp, Homo sapiens
actgacacctcactgagga

SEQ ID NO: 2125992 - DNA, 20 bp, Homo sapiens
actgaccagcctccatgctg

SEQ ID NO: 2125993 - DNA, 20 bp, Homo sapiens
actgaccctggagcggctct

SEQ ID NO: 2125994 - DNA, 15 bp, Homo sapiens
actgacccttccaga

SEQ ID NO: 2125995 - DNA, 14 bp, Homo sapiens
actgacctcaccgg

SEQ ID NO: 2125996 - DNA, 22 bp, Homo sapiens
actgagacagccacttggtttt

SEQ ID NO: 2125997 - DNA, 16 bp, Homo sapiens
actgagagcagatggt

SEQ ID NO: 2125998 - DNA, 17 bp, Homo sapiens
actgagatgtgaacaca

SEQ ID NO: 2125999 - DNA, 21 bp, Homo sapiens
actgagccaaacacactgtaa

SEQ ID NO: 2126000 - DNA, 22 bp, Homo sapiens
actgagccaaacacactgtaaa

SEQ ID NO: 2126001 - DNA, 24 bp, Homo sapiens
actgagccaaacacactgtaaata

SEQ ID NO: 2126002 - DNA, 22 bp, Homo sapiens
accctgcccatacccctgcctg

SEQ ID NO: 2126003 - DNA, 23 bp, Homo sapiens
accctgcccatacccctgcctgg

SEQ ID NO: 2126004 - DNA, 15 bp, Homo sapiens
accctgcctgagccc

SEQ ID NO: 2126005 - DNA, 16 bp, Homo sapiens
accctgcctgagccca

SEQ ID NO: 2126006 - DNA, 19 bp, Homo sapiens
accctgcctgagcccagga

SEQ ID NO: 2126007 - DNA, 19 bp, Homo sapiens
accctgcgaaggggccctg

SEQ ID NO: 2126008 - DNA, 22 bp, Homo sapiens
accctgcgaaggggccctggtc

SEQ ID NO: 2126009 - DNA, 23 bp, Homo sapiens
accctgctgggaccccagctagg

SEQ ID NO: 2126010 - DNA, 18 bp, Homo sapiens
accctggaattcagcacc

SEQ ID NO: 2126011 - DNA, 19 bp, Homo sapiens
accctggagcggctctcct

SEQ ID NO: 2126012 - DNA, 21 bp, Homo sapiens
accctggagcggctctcctga

SEQ ID NO: 2126013 - DNA, 22 bp, Homo sapiens
accctggcccgcccctcgctgc

SEQ ID NO: 2126014 - DNA, 16 bp, Homo sapiens
accctggcctgagaag

SEQ ID NO: 2126015 - DNA, 11 bp, Homo sapiens
accctggctct

SEQ ID NO: 2126016 - DNA, 21 bp, Homo sapiens
accctggcttgcttgccgagc

SEQ ID NO: 2126017 - DNA, 20 bp, Homo sapiens
accctgggtgccattcccag

SEQ ID NO: 2126018 - DNA, 17 bp, Homo sapiens
accctggttactctggt

SEQ ID NO: 2126019 - DNA, 18 bp, Homo sapiens
accctgtgggggcggctg

SEQ ID NO: 2126020 - DNA, 19 bp, Homo sapiens
accctgtttcctttcagga

SEQ ID NO: 2126021 - DNA, 19 bp, Homo sapiens
accctgttttccacaccat

SEQ ID NO: 2126022 - DNA, 14 bp, Homo sapiens
acccttcagggcca

SEQ ID NO: 2126023 - DNA, 15 bp, Homo sapiens
acccttcagggccag

SEQ ID NO: 2126024 - DNA, 22 bp, Homo sapiens
acccttcccaatcagcactgaa

SEQ ID NO: 2126025 - DNA, 13 bp, Homo sapiens
acccttcctcctc

SEQ ID NO: 2126026 - DNA, 22 bp, Homo sapiens
acccttcctcctcctttgccta

SEQ ID NO: 2126027 - DNA, 18 bp, Homo sapiens
acccttcgggagggcact

SEQ ID NO: 2126028 - DNA, 15 bp, Homo sapiens
acccttctcttctcc

SEQ ID NO: 2126029 - DNA, 15 bp, Homo sapiens
acccttctttcctct

SEQ ID NO: 2126030 - DNA, 16 bp, Homo sapiens
acccttctttcctctt

SEQ ID NO: 2126031 - DNA, 16 bp, Homo sapiens
acccttgcattagaaa

SEQ ID NO: 2126032 - DNA, 15 bp, Homo sapiens
acccttggacttgag

SEQ ID NO: 2126033 - DNA, 20 bp, Homo sapiens
acccttgtaccccatccctt

SEQ ID NO: 2126034 - DNA, 16 bp, Homo sapiens
accctttatctctgta

SEQ ID NO: 2126035 - DNA, 17 bp, Homo sapiens
accctttccttccttcc

SEQ ID NO: 2126036 - DNA, 23 bp, Homo sapiens
accctttccttccttccctggct

SEQ ID NO: 2126037 - DNA, 19 bp, Homo sapiens
acccttttcctccagacag

SEQ ID NO: 2126038 - DNA, 18 bp, Homo sapiens
accgaagagccctgagct

SEQ ID NO: 2126039 - DNA, 15 bp, Homo sapiens
accgaaggggaaaac

SEQ ID NO: 2126040 - DNA, 12 bp, Homo sapiens
accgaattttat

SEQ ID NO: 2126041 - DNA, 14 bp, Homo sapiens
accgagaaaaggag

SEQ ID NO: 2126042 - DNA, 23 bp, Homo sapiens
accgagagtagccgagagcctgc

SEQ ID NO: 2126043 - DNA, 16 bp, Homo sapiens
accgagtctcttctcc

SEQ ID NO: 2126044 - DNA, 17 bp, Homo sapiens
accgagtctcttctcca

SEQ ID NO: 2126045 - DNA, 18 bp, Homo sapiens
accgatgtacacacacag

SEQ ID NO: 2126046 - DNA, 13 bp, Homo sapiens
accgcagaaggaa

SEQ ID NO: 2126047 - DNA, 14 bp, Homo sapiens
accgcagaaggaag

SEQ ID NO: 2126048 - DNA, 13 bp, Homo sapiens
accgcagcatgtg

SEQ ID NO: 2126049 - DNA, 18 bp, Homo sapiens
accgccagaggacaagga

SEQ ID NO: 2126050 - DNA, 17 bp, Homo sapiens
accgctacaccactctg

SEQ ID NO: 2126051 - DNA, 19 bp, Homo sapiens
accgctacaccactctggc

SEQ ID NO: 2126052 - DNA, 19 bp, Homo sapiens
accgctgcctaagtggctg

SEQ ID NO: 2126053 - DNA, 11 bp, Homo sapiens
accggcacctg

SEQ ID NO: 2126054 - DNA, 16 bp, Homo sapiens
accggcatgctggcct

SEQ ID NO: 2126055 - DNA, 20 bp, Homo sapiens
accggcatgctggcctgtgg

SEQ ID NO: 2126056 - DNA, 14 bp, Homo sapiens
accggcgctgcagg

SEQ ID NO: 2126057 - DNA, 14 bp, Homo sapiens
accgggacagacct

SEQ ID NO: 2126058 - DNA, 16 bp, Homo sapiens
accgggcactcagaag

SEQ ID NO: 2126059 - DNA, 11 bp, Homo sapiens
accgggcctga

SEQ ID NO: 2126060 - DNA, 21 bp, Homo sapiens
accgggctgggagctctgcag

SEQ ID NO: 2126061 - DNA, 13 bp, Homo sapiens
accgggggccaga

SEQ ID NO: 2126062 - DNA, 19 bp, Homo sapiens
accgggggccagacacaga

SEQ ID NO: 2126063 - DNA, 19 bp, Homo sapiens
accgggtgggcctggcctg

SEQ ID NO: 2126064 - DNA, 20 bp, Homo sapiens
accgggtgggcctggcctga

SEQ ID NO: 2126065 - DNA, 21 bp, Homo sapiens
accgggtgggcctggcctgag

SEQ ID NO: 2126066 - DNA, 22 bp, Homo sapiens
accgggtgggcctggcctgagc

SEQ ID NO: 2126067 - DNA, 23 bp, Homo sapiens
accgggtgggcctggcctgagct

SEQ ID NO: 2126068 - DNA, 13 bp, Homo sapiens
accgtaattttat

SEQ ID NO: 2126069 - DNA, 16 bp, Homo sapiens
accgtaattttattat

SEQ ID NO: 2126070 - DNA, 23 bp, Homo sapiens
accgtcatggcttaatgtttatt

SEQ ID NO: 2126071 - DNA, 13 bp, Homo sapiens
accgtcctgccca

SEQ ID NO: 2126072 - DNA, 17 bp, Homo sapiens
accgtggaccttcctgc

SEQ ID NO: 2126073 - DNA, 18 bp, Homo sapiens
accgtggaccttcctgcc

SEQ ID NO: 2126074 - DNA, 15 bp, Homo sapiens
accgtggccctgccc

SEQ ID NO: 2126075 - DNA, 21 bp, Homo sapiens
accgtggccctgccctctcct

SEQ ID NO: 2126076 - DNA, 17 bp, Homo sapiens
accgtggcccttcctgg

SEQ ID NO: 2126077 - DNA, 19 bp, Homo sapiens
accgtggcccttcctggac

SEQ ID NO: 2126078 - DNA, 20 bp, Homo sapiens
accgtggcccttcctggaca

SEQ ID NO: 2126079 - DNA, 22 bp, Homo sapiens
accgtggcccttcctggacagc

SEQ ID NO: 2126080 - DNA, 16 bp, Homo sapiens
accgtgtccagcacag

SEQ ID NO: 2126081 - DNA, 21 bp, Homo sapiens
accgtgtcccaaggagctgat

SEQ ID NO: 2126082 - DNA, 18 bp, Homo sapiens
accgttggggattgggga

SEQ ID NO: 2126083 - DNA, 21 bp, Homo sapiens
accgttttcatcctggcctcc

SEQ ID NO: 2126084 - DNA, 23 bp, Homo sapiens
acctaaacatagaaattgcctga

SEQ ID NO: 2126085 - DNA, 13 bp, Homo sapiens
acctaaagaaaaa

SEQ ID NO: 2126086 - DNA, 15 bp, Homo sapiens
acctaaatgacctca

SEQ ID NO: 2126087 - DNA, 17 bp, Homo sapiens
acctaaatgacctcagc

SEQ ID NO: 2126088 - DNA, 20 bp, Homo sapiens
acctaaatgacctcagcaaa

SEQ ID NO: 2126089 - DNA, 18 bp, Homo sapiens
acctaacattatttattc

SEQ ID NO: 2126090 - DNA, 16 bp, Homo sapiens
acctaacccctttcct

SEQ ID NO: 2126091 - DNA, 18 bp, Homo sapiens
acctaacccctttcctgc

SEQ ID NO: 2126092 - DNA, 15 bp, Homo sapiens
acctaattgaaattt

SEQ ID NO: 2126093 - DNA, 21 bp, Homo sapiens
acctacataggcaaattggaa

SEQ ID NO: 2126094 - DNA, 14 bp, Homo sapiens
acctaccatgctgc

SEQ ID NO: 2126095 - DNA, 17 bp, Homo sapiens
acctactactcaattgt

SEQ ID NO: 2126096 - DNA, 14 bp, Homo sapiens
acctactcacacag

SEQ ID NO: 2126097 - DNA, 16 bp, Homo sapiens
acctactcacacaggc

SEQ ID NO: 2126098 - DNA, 16 bp, Homo sapiens
acctactgactgatga

SEQ ID NO: 2126099 - DNA, 14 bp, Homo sapiens
acctagacctgggc

SEQ ID NO: 2126100 - DNA, 15 bp, Homo sapiens
acctagacctgggcc

SEQ ID NO: 2126101 - DNA, 18 bp, Homo sapiens
acctagcaattccatcac

SEQ ID NO: 2126102 - DNA, 13 bp, Homo sapiens
acctagccttaga

SEQ ID NO: 2126103 - DNA, 18 bp, Homo sapiens
acctaggccactcctcca

SEQ ID NO: 2126104 - DNA, 16 bp, Homo sapiens
acctatagtcccagct

SEQ ID NO: 2126105 - DNA, 22 bp, Homo sapiens
acctatggtataatggttgact

SEQ ID NO: 2126106 - DNA, 14 bp, Homo sapiens
acctatttgacata

SEQ ID NO: 2126107 - DNA, 19 bp, Homo sapiens
acctcaacccccatttcta

SEQ ID NO: 2126108 - DNA, 14 bp, Homo sapiens
acctcaagctgcat

SEQ ID NO: 2126109 - DNA, 16 bp, Homo sapiens
acctcaagctgcatct

SEQ ID NO: 2126110 - DNA, 16 bp, Homo sapiens
acctcaatgccctgcc

SEQ ID NO: 2126111 - DNA, 18 bp, Homo sapiens
acctcaatgccctgccat

SEQ ID NO: 2126112 - DNA, 14 bp, Homo sapiens
acctcacagtgacc

SEQ ID NO: 2126113 - DNA, 20 bp, Homo sapiens
acctcaccggcatgctggcc

SEQ ID NO: 2126114 - DNA, 13 bp, Homo sapiens
acctcactcctgt

SEQ ID NO: 2126115 - DNA, 14 bp, Homo sapiens
acctcactcctgtt

SEQ ID NO: 2126116 - DNA, 22 bp, Homo sapiens
actgtcagctcccctcggagaa

SEQ ID NO: 2126117 - DNA, 13 bp, Homo sapiens
actgtccctcaaa

SEQ ID NO: 2126118 - DNA, 23 bp, Homo sapiens
actgtccctcaaatgacccaaag

SEQ ID NO: 2126119 - DNA, 15 bp, Homo sapiens
actgtccgcctctgc

SEQ ID NO: 2126120 - DNA, 20 bp, Homo sapiens
actgtccgcctctgcccgca

SEQ ID NO: 2126121 - DNA, 17 bp, Homo sapiens
actgtcctacccaccct

SEQ ID NO: 2126122 - DNA, 13 bp, Homo sapiens
actgtcgctgctt

SEQ ID NO: 2126123 - DNA, 14 bp, Homo sapiens
actgtcgctgcttc

SEQ ID NO: 2126124 - DNA, 16 bp, Homo sapiens
actgtcgtgtttacaa

SEQ ID NO: 2126125 - DNA, 19 bp, Homo sapiens
actgtctcaagagggcact

SEQ ID NO: 2126126 - DNA, 20 bp, Homo sapiens
actgtctcaagagggcactg

SEQ ID NO: 2126127 - DNA, 21 bp, Homo sapiens
actgtctcaagagggcactgg

SEQ ID NO: 2126128 - DNA, 18 bp, Homo sapiens
actgtctctcatgaacct

SEQ ID NO: 2126129 - DNA, 15 bp, Homo sapiens
actgtctctcctgat

SEQ ID NO: 2126130 - DNA, 23 bp, Homo sapiens
actgtcttgcctgccagggcccc

SEQ ID NO: 2126131 - DNA, 20 bp, Homo sapiens
actgtgaagacccagcagga

SEQ ID NO: 2126132 - DNA, 22 bp, Homo sapiens
actgtgaagacccagcaggaag

SEQ ID NO: 2126133 - DNA, 17 bp, Homo sapiens
actgtgcgttttagagt

SEQ ID NO: 2126134 - DNA, 18 bp, Homo sapiens
actgtgcttacagtgact

SEQ ID NO: 2126135 - DNA, 19 bp, Homo sapiens
actgtggaaaaatatttaa

SEQ ID NO: 2126136 - DNA, 14 bp, Homo sapiens
actgtggccagagc

SEQ ID NO: 2126137 - DNA, 22 bp, Homo sapiens
actgtggccagagctggaaggc

SEQ ID NO: 2126138 - DNA, 16 bp, Homo sapiens
actgtggcgttctgct

SEQ ID NO: 2126139 - DNA, 12 bp, Homo sapiens
actgtggctgct

SEQ ID NO: 2126140 - DNA, 22 bp, Homo sapiens
actgtggggaaccaattgcttt

SEQ ID NO: 2126141 - DNA, 19 bp, Homo sapiens
actgtgtgcagactcaata

SEQ ID NO: 2126142 - DNA, 14 bp, Homo sapiens
actgtgttcagtgc

SEQ ID NO: 2126143 - DNA, 15 bp, Homo sapiens
actgtgttcagtgcc

SEQ ID NO: 2126144 - DNA, 14 bp, Homo sapiens
actgtgttcattag

SEQ ID NO: 2126145 - DNA, 21 bp, Homo sapiens
actgttaatagttcaggtaac

SEQ ID NO: 2126146 - DNA, 17 bp, Homo sapiens
actgttactccacagcg

SEQ ID NO: 2126147 - DNA, 17 bp, Homo sapiens
actgttactttttagtc

SEQ ID NO: 2126148 - DNA, 16 bp, Homo sapiens
actgttattgaaaata

SEQ ID NO: 2126149 - DNA, 22 bp, Homo sapiens
actgttcacgttgggtggagag

SEQ ID NO: 2126150 - DNA, 20 bp, Homo sapiens
actgttctggcctcagacca

SEQ ID NO: 2126151 - DNA, 23 bp, Homo sapiens
actgttgaaaattattttaaaca

SEQ ID NO: 2126152 - DNA, 22 bp, Homo sapiens
actgttgagttggacacactgt

SEQ ID NO: 2126153 - DNA, 13 bp, Homo sapiens
actgttgcccagg

SEQ ID NO: 2126154 - DNA, 12 bp, Homo sapiens
actgttgctcaa

SEQ ID NO: 2126155 - DNA, 19 bp, Homo sapiens
actgtttatggtattttcg

SEQ ID NO: 2126156 - DNA, 19 bp, Homo sapiens
actgtttttcggacagttt

SEQ ID NO: 2126157 - DNA, 13 bp, Homo sapiens
acttaaaaaaatg

SEQ ID NO: 2126158 - DNA, 13 bp, Homo sapiens
acttaaaaaactt

SEQ ID NO: 2126159 - DNA, 20 bp, Homo sapiens
acttaaaatattcctgcatt

SEQ ID NO: 2126160 - DNA, 22 bp, Homo sapiens
acttaaaatattcctgcatttg

SEQ ID NO: 2126161 - DNA, 19 bp, Homo sapiens
acttaaataaatgtcatta

SEQ ID NO: 2126162 - DNA, 12 bp, Homo sapiens
acttaaatcact

SEQ ID NO: 2126163 - DNA, 14 bp, Homo sapiens
acttaacatattta

SEQ ID NO: 2126164 - DNA, 19 bp, Homo sapiens
acttaactgtgtgaagaaa

SEQ ID NO: 2126165 - DNA, 13 bp, Homo sapiens
acttaagattaaa

SEQ ID NO: 2126166 - DNA, 15 bp, Homo sapiens
acttacacttggagc

SEQ ID NO: 2126167 - DNA, 19 bp, Homo sapiens
acttacatgattcatttta

SEQ ID NO: 2126168 - DNA, 22 bp, Homo sapiens
acttaccaggcaccaaaagaag

SEQ ID NO: 2126169 - DNA, 16 bp, Homo sapiens
acttaccttcaataaa

SEQ ID NO: 2126170 - DNA, 20 bp, Homo sapiens
acttaccttcaataaagtat

SEQ ID NO: 2126171 - DNA, 18 bp, Homo sapiens
acttagaataaaattgta

SEQ ID NO: 2126172 - DNA, 22 bp, Homo sapiens
acttagcccaagaggtctgagc

SEQ ID NO: 2126173 - DNA, 15 bp, Homo sapiens
acttataccaaaggg

SEQ ID NO: 2126174 - DNA, 22 bp, Homo sapiens
acttatatcatcagcatacctt

SEQ ID NO: 2126175 - DNA, 20 bp, Homo sapiens
acttatcaaaagacagcact

SEQ ID NO: 2126176 - DNA, 22 bp, Homo sapiens
acttattaatctgtatgaagat

SEQ ID NO: 2126177 - DNA, 12 bp, Homo sapiens
acttattttcca

SEQ ID NO: 2126178 - DNA, 17 bp, Homo sapiens
acttattttccaataaa

SEQ ID NO: 2126179 - DNA, 18 bp, Homo sapiens
acttattttccaataaaa

SEQ ID NO: 2126180 - DNA, 17 bp, Homo sapiens
acttcaaatatagagat

SEQ ID NO: 2126181 - DNA, 22 bp, Homo sapiens
acttcaagtgcatgctctctgc

SEQ ID NO: 2126182 - DNA, 19 bp, Homo sapiens
acttcacacacaggcaact

SEQ ID NO: 2126183 - DNA, 12 bp, Homo sapiens
acttcactgtga

SEQ ID NO: 2126184 - DNA, 13 bp, Homo sapiens
acttcactgtgag

SEQ ID NO: 2126185 - DNA, 14 bp, Homo sapiens
acttcactgtgagg

SEQ ID NO: 2126186 - DNA, 17 bp, Homo sapiens
acttcactgtgagggga

SEQ ID NO: 2126187 - DNA, 13 bp, Homo sapiens
acttcagagaagt

SEQ ID NO: 2126188 - DNA, 14 bp, Homo sapiens
acttcagagaagtc

SEQ ID NO: 2126189 - DNA, 10 bp, Homo sapiens
acttcagcac

SEQ ID NO: 2126190 - DNA, 11 bp, Homo sapiens
acttcagcacc

SEQ ID NO: 2126191 - DNA, 12 bp, Homo sapiens
acttcagcccag

SEQ ID NO: 2126192 - DNA, 14 bp, Homo sapiens
acttcagctctgtt

SEQ ID NO: 2126193 - DNA, 14 bp, Homo sapiens
acttcaggctcttc

SEQ ID NO: 2126194 - DNA, 18 bp, Homo sapiens
acttcaggctcttctcct

SEQ ID NO: 2126195 - DNA, 18 bp, Homo sapiens
acttcatggaccaagaat

SEQ ID NO: 2126196 - DNA, 16 bp, Homo sapiens
acttcattagcaagtg

SEQ ID NO: 2126197 - DNA, 15 bp, Homo sapiens
acttcattttcagag

SEQ ID NO: 2126198 - DNA, 20 bp, Homo sapiens
acttccaaacctgacagatg

SEQ ID NO: 2126199 - DNA, 16 bp, Homo sapiens
acttccaggagcccag

SEQ ID NO: 2126200 - DNA, 19 bp, Homo sapiens
acttccaggagcccagagg

SEQ ID NO: 2126201 - DNA, 21 bp, Homo sapiens
acttccagtgttggctgtgtg

SEQ ID NO: 2126202 - DNA, 17 bp, Homo sapiens
acttccatgaggccaaa

SEQ ID NO: 2126203 - DNA, 13 bp, Homo sapiens
acttccctgggaa

SEQ ID NO: 2126204 - DNA, 14 bp, Homo sapiens
acttccctgggaac

SEQ ID NO: 2126205 - DNA, 11 bp, Homo sapiens
acttcctgtgt

SEQ ID NO: 2126206 - DNA, 13 bp, Homo sapiens
acttccttggttt

SEQ ID NO: 2126207 - DNA, 20 bp, Homo sapiens
acttcgaccctttctctgag

SEQ ID NO: 2126208 - DNA, 19 bp, Homo sapiens
acttcgactcaggatccag

SEQ ID NO: 2126209 - DNA, 17 bp, Homo sapiens
acttcggggctgggaag

SEQ ID NO: 2126210 - DNA, 15 bp, Homo sapiens
acttctaaatgaagt

SEQ ID NO: 2126211 - DNA, 16 bp, Homo sapiens
acttctaaatgaagtg

SEQ ID NO: 2126212 - DNA, 18 bp, Homo sapiens
acttctaagtaaaaccac

SEQ ID NO: 2126213 - DNA, 21 bp, Homo sapiens
acttctaagtaaaaccacagc

SEQ ID NO: 2126214 - DNA, 15 bp, Homo sapiens
acttctaatatattt

SEQ ID NO: 2126215 - DNA, 22 bp, Homo sapiens
acttctaatatatttttatatt

SEQ ID NO: 2126216 - DNA, 16 bp, Homo sapiens
acttctccaccctgct

SEQ ID NO: 2126217 - DNA, 22 bp, Homo sapiens
acttctccagacccaccacacc

SEQ ID NO: 2126218 - DNA, 17 bp, Homo sapiens
acttctctactctggaa

SEQ ID NO: 2126219 - DNA, 11 bp, Homo sapiens
acttctctaga

SEQ ID NO: 2126220 - DNA, 15 bp, Homo sapiens
acttctctttgcctc

SEQ ID NO: 2126221 - DNA, 20 bp, Homo sapiens
acttctgccatattctgttg

SEQ ID NO: 2126222 - DNA, 20 bp, Homo sapiens
acttctgccccagctttatc

SEQ ID NO: 2126223 - DNA, 12 bp, Homo sapiens
acttctgcctga

SEQ ID NO: 2126224 - DNA, 13 bp, Homo sapiens
acttctggaaggc

SEQ ID NO: 2126225 - DNA, 22 bp, Homo sapiens
acttctggaaggctggctgagt

SEQ ID NO: 2126226 - DNA, 21 bp, Homo sapiens
acttctgtcttcacaacagat

SEQ ID NO: 2126227 - DNA, 16 bp, Homo sapiens
acttcttaaaggcctg

SEQ ID NO: 2126228 - DNA, 17 bp, Homo sapiens
acttcttaaaggcctgg

SEQ ID NO: 2126229 - DNA, 18 bp, Homo sapiens
acttcttaaaggcctgga

SEQ ID NO: 2126230 - DNA, 20 bp, Homo sapiens
acttcttaaaggcctggaac

SEQ ID NO: 2126231 - DNA, 18 bp, Homo sapiens
acttcttgaaacagcctg

SEQ ID NO: 2126232 - DNA, 12 bp, Homo sapiens
acttcttggaaa

SEQ ID NO: 2126233 - DNA, 14 bp, Homo sapiens
acttcttggaaaaa

SEQ ID NO: 2126234 - DNA, 23 bp, Homo sapiens
acttcttggaaaaaaattacaaa

SEQ ID NO: 2126235 - DNA, 21 bp, Homo sapiens
acttcttggtttggggagaaa

SEQ ID NO: 2126236 - DNA, 23 bp, Homo sapiens
acttcttggtttggggagaaata

SEQ ID NO: 2126237 - DNA, 22 bp, Homo sapiens
acttcttttataactagtcctt

SEQ ID NO: 2126238 - DNA, 20 bp, Homo sapiens
acttcttttgctcttagctg

SEQ ID NO: 2126239 - DNA, 15 bp, Homo sapiens
acttgaactttccaa

SEQ ID NO: 2126240 - DNA, 15 bp, Homo sapiens
acttgaagcaagctt

SEQ ID NO: 2126241 - DNA, 23 bp, Homo sapiens
acttgaaggcccaggtcaacatc

SEQ ID NO: 2126242 - DNA, 13 bp, Homo sapiens
acttgaatctgtt

SEQ ID NO: 2126243 - DNA, 16 bp, Homo sapiens
acttgaatctgttact

SEQ ID NO: 2126244 - DNA, 20 bp, Homo sapiens
acttgaatctgttactgaaa

SEQ ID NO: 2126245 - DNA, 23 bp, Homo sapiens
acttgaatctgttactgaaatga

SEQ ID NO: 2126246 - DNA, 16 bp, Homo sapiens
acttgaatgtgtcact

SEQ ID NO: 2126247 - DNA, 17 bp, Homo sapiens
acttgacagaacactgt

SEQ ID NO: 2126248 - DNA, 17 bp, Homo sapiens
acttgactaataccttg

SEQ ID NO: 2126249 - DNA, 19 bp, Homo sapiens
acttgagctgtatatatat

SEQ ID NO: 2126250 - DNA, 11 bp, Homo sapiens
acttgaggaca

SEQ ID NO: 2126251 - DNA, 16 bp, Homo sapiens
acttgaggacacatgt

SEQ ID NO: 2126252 - DNA, 17 bp, Homo sapiens
acttgaggacacatgtc

SEQ ID NO: 2126253 - DNA, 21 bp, Homo sapiens
acttgagttacaccagacctg

SEQ ID NO: 2126254 - DNA, 15 bp, Homo sapiens
acttgcgtcctgcag

SEQ ID NO: 2126255 - DNA, 18 bp, Homo sapiens
acttgcgtcctgcagagg

SEQ ID NO: 2126256 - DNA, 22 bp, Homo sapiens
acttggaaaaatccagaaagaa

SEQ ID NO: 2126257 - DNA, 23 bp, Homo sapiens
acttggaactgaagggggcggcc

SEQ ID NO: 2126258 - DNA, 14 bp, Homo sapiens
acttggagccaagg

SEQ ID NO: 2126259 - DNA, 16 bp, Homo sapiens
acttggagcccgtgca

SEQ ID NO: 2126260 - DNA, 17 bp, Homo sapiens
acttggagtggagagga

SEQ ID NO: 2126261 - DNA, 15 bp, Homo sapiens
acttggcaacagaag

SEQ ID NO: 2126262 - DNA, 11 bp, Homo sapiens
acttggctttc

SEQ ID NO: 2126263 - DNA, 13 bp, Homo sapiens
acttgggcacccc

SEQ ID NO: 2126264 - DNA, 20 bp, Homo sapiens
acttgggcacccccagcctg

SEQ ID NO: 2126265 - DNA, 19 bp, Homo sapiens
acttgggcgctctgccctc

SEQ ID NO: 2126266 - DNA, 16 bp, Homo sapiens
acttggtgtaattaat

SEQ ID NO: 2126267 - DNA, 18 bp, Homo sapiens
acttggtgtaattaataa

SEQ ID NO: 2126268 - DNA, 13 bp, Homo sapiens
acttgtaaataaa

SEQ ID NO: 2126269 - DNA, 15 bp, Homo sapiens
acttgtaaataaata

SEQ ID NO: 2126270 - DNA, 14 bp, Homo sapiens
acttgtaaatacac

SEQ ID NO: 2126271 - DNA, 16 bp, Homo sapiens
acttgtaaatacacca

SEQ ID NO: 2126272 - DNA, 14 bp, Homo sapiens
acttgtagaaatct

SEQ ID NO: 2126273 - DNA, 17 bp, Homo sapiens
acttgtagggatgcctt

SEQ ID NO: 2126274 - DNA, 21 bp, Homo sapiens
acttgtataaatgtatataca

SEQ ID NO: 2126275 - DNA, 14 bp, Homo sapiens
acttgtatattcca

SEQ ID NO: 2126276 - DNA, 20 bp, Homo sapiens
acttgtatattccaccattc

SEQ ID NO: 2126277 - DNA, 14 bp, Homo sapiens
acttgtatgaaaga

SEQ ID NO: 2126278 - DNA, 13 bp, Homo sapiens
acttgtcatgtga

SEQ ID NO: 2126279 - DNA, 16 bp, Homo sapiens
acttgtctgaggcctc

SEQ ID NO: 2126280 - DNA, 16 bp, Homo sapiens
acttgtgactgaaggg

SEQ ID NO: 2126281 - DNA, 11 bp, Homo sapiens
acttgtgccag

SEQ ID NO: 2126282 - DNA, 14 bp, Homo sapiens
acttgtggacacag

SEQ ID NO: 2126283 - DNA, 16 bp, Homo sapiens
acttgtggacacagct

SEQ ID NO: 2126284 - DNA, 17 bp, Homo sapiens
acttgtggacacagctc

SEQ ID NO: 2126285 - DNA, 22 bp, Homo sapiens
acttgtggacacagctcttctc

SEQ ID NO: 2126286 - DNA, 17 bp, Homo sapiens
acttgtgtatgatccaa

SEQ ID NO: 2126287 - DNA, 14 bp, Homo sapiens
acttgtgtctctgt

SEQ ID NO: 2126288 - DNA, 16 bp, Homo sapiens
actttaaaaggagcca

SEQ ID NO: 2126289 - DNA, 15 bp, Homo sapiens
actttaaagtctttc

SEQ ID NO: 2126290 - DNA, 15 bp, Homo sapiens
actttaaccctctct

SEQ ID NO: 2126291 - DNA, 12 bp, Homo sapiens
actttaagagag

SEQ ID NO: 2126292 - DNA, 20 bp, Homo sapiens
actttaatactcacctcctc

SEQ ID NO: 2126293 - DNA, 21 bp, Homo sapiens
actttaatactcacctcctcc

SEQ ID NO: 2126294 - DNA, 19 bp, Homo sapiens
actttaattctcatgtgat

SEQ ID NO: 2126295 - DNA, 20 bp, Homo sapiens
actttaattgcttaaaagac

SEQ ID NO: 2126296 - DNA, 22 bp, Homo sapiens
actttacactctctgtacaaaa

SEQ ID NO: 2126297 - DNA, 14 bp, Homo sapiens
agaaaaaatacatt

SEQ ID NO: 2126298 - DNA, 18 bp, Homo sapiens
agaaaaaatacattttat

SEQ ID NO: 2126299 - DNA, 14 bp, Homo sapiens
agaaaaaccaatga

SEQ ID NO: 2126300 - DNA, 18 bp, Homo sapiens
agaaaaaccaatgattca

SEQ ID NO: 2126301 - DNA, 20 bp, Homo sapiens
agaaaaagctcctgtcctcc

SEQ ID NO: 2126302 - DNA, 15 bp, Homo sapiens
agaaaaagggctgcc

SEQ ID NO: 2126303 - DNA, 16 bp, Homo sapiens
agaaaaagggctgccg

SEQ ID NO: 2126304 - DNA, 15 bp, Homo sapiens
agaaaaattattgta

SEQ ID NO: 2126305 - DNA, 19 bp, Homo sapiens
agaaaaatttacatggcaa

SEQ ID NO: 2126306 - DNA, 22 bp, Homo sapiens
agaaaacattcatccagttgca

SEQ ID NO: 2126307 - DNA, 16 bp, Homo sapiens
agaaaaccattttagt

SEQ ID NO: 2126308 - DNA, 14 bp, Homo sapiens
agaaaacctccagt

SEQ ID NO: 2126309 - DNA, 13 bp, Homo sapiens
agaaaactaacaa

SEQ ID NO: 2126310 - DNA, 21 bp, Homo sapiens
agaaaactcctttagcaggtg

SEQ ID NO: 2126311 - DNA, 13 bp, Homo sapiens
agaaaactggaaa

SEQ ID NO: 2126312 - DNA, 13 bp, Homo sapiens
agaaaagaccctg

SEQ ID NO: 2126313 - DNA, 14 bp, Homo sapiens
agaaaagaccctga

SEQ ID NO: 2126314 - DNA, 18 bp, Homo sapiens
agaaaagaccctgagact

SEQ ID NO: 2126315 - DNA, 16 bp, Homo sapiens
agaaaagataaagatg

SEQ ID NO: 2126316 - DNA, 14 bp, Homo sapiens
agaaaagtagaatt

SEQ ID NO: 2126317 - DNA, 17 bp, Homo sapiens
agaaaagtgcaaagtta

SEQ ID NO: 2126318 - DNA, 17 bp, Homo sapiens
agaaaagtgcttagaaa

SEQ ID NO: 2126319 - DNA, 21 bp, Homo sapiens
agaaaagtgcttagaaagtta

SEQ ID NO: 2126320 - DNA, 12 bp, Homo sapiens
agaaaatataaa

SEQ ID NO: 2126321 - DNA, 16 bp, Homo sapiens
agaaaatataaatgca

SEQ ID NO: 2126322 - DNA, 17 bp, Homo sapiens
agaaaatataaatgcat

SEQ ID NO: 2126323 - DNA, 19 bp, Homo sapiens
agaaacacagggttttgta

SEQ ID NO: 2126324 - DNA, 15 bp, Homo sapiens
agaaacacagttttg

SEQ ID NO: 2126325 - DNA, 14 bp, Homo sapiens
agaaacactcaaca

SEQ ID NO: 2126326 - DNA, 21 bp, Homo sapiens
agaaacagataccatactcat

SEQ ID NO: 2126327 - DNA, 20 bp, Homo sapiens
agaaacaggggatcaaagtt

SEQ ID NO: 2126328 - DNA, 20 bp, Homo sapiens
agaaacagttaactttcaga

SEQ ID NO: 2126329 - DNA, 13 bp, Homo sapiens
agaaacatgacac

SEQ ID NO: 2126330 - DNA, 14 bp, Homo sapiens
agaaacatgacact

SEQ ID NO: 2126331 - DNA, 17 bp, Homo sapiens
agaaaccagtatggaag

SEQ ID NO: 2126332 - DNA, 19 bp, Homo sapiens
agaaaccagtatggaaggg

SEQ ID NO: 2126333 - DNA, 17 bp, Homo sapiens
agaaaccccaagcagca

SEQ ID NO: 2126334 - DNA, 14 bp, Homo sapiens
agaaaccctgtctc

SEQ ID NO: 2126335 - DNA, 17 bp, Homo sapiens
agaaaccgtaattttat

SEQ ID NO: 2126336 - DNA, 23 bp, Homo sapiens
agaaacctgaggatgcaacaaat

SEQ ID NO: 2126337 - DNA, 16 bp, Homo sapiens
agaaaccttattgtac

SEQ ID NO: 2126338 - DNA, 21 bp, Homo sapiens
agaaactcaaccatcaatgga

SEQ ID NO: 2126339 - DNA, 18 bp, Homo sapiens
agaaactgaggagtagct

SEQ ID NO: 2126340 - DNA, 22 bp, Homo sapiens
agaaacttcctttgagaattgt

SEQ ID NO: 2126341 - DNA, 19 bp, Homo sapiens
agaaagaaaagaccctgag

SEQ ID NO: 2126342 - DNA, 15 bp, Homo sapiens
agaaagaaagggaaa

SEQ ID NO: 2126343 - DNA, 13 bp, Homo sapiens
agaaagaaggaag

SEQ ID NO: 2126344 - DNA, 14 bp, Homo sapiens
agaaagaaggaagt

SEQ ID NO: 2126345 - DNA, 18 bp, Homo sapiens
agaaagacagagctggga

SEQ ID NO: 2126346 - DNA, 16 bp, Homo sapiens
agaaagactattcaaa

SEQ ID NO: 2126347 - DNA, 22 bp, Homo sapiens
agaaagaggtgaccccagggca

SEQ ID NO: 2126348 - DNA, 14 bp, Homo sapiens
agaaagatccaccc

SEQ ID NO: 2126349 - DNA, 14 bp, Homo sapiens
agaaagcaacttat

SEQ ID NO: 2126350 - DNA, 14 bp, Homo sapiens
agaaagcataaaat

SEQ ID NO: 2126351 - DNA, 16 bp, Homo sapiens
agaaagcattacattt

SEQ ID NO: 2126352 - DNA, 19 bp, Homo sapiens
agaaagctggtaaactatt

SEQ ID NO: 2126353 - DNA, 20 bp, Homo sapiens
agaaaggaggggatagagag

SEQ ID NO: 2126354 - DNA, 23 bp, Homo sapiens
agaaaggaggggatagagagaga

SEQ ID NO: 2126355 - DNA, 16 bp, Homo sapiens
agaaagggaaactggc

SEQ ID NO: 2126356 - DNA, 13 bp, Homo sapiens
agaaagggagggc

SEQ ID NO: 2126357 - DNA, 15 bp, Homo sapiens
agaaagggagggctc

SEQ ID NO: 2126358 - DNA, 18 bp, Homo sapiens
agaaagggagggctctga

SEQ ID NO: 2126359 - DNA, 14 bp, Homo sapiens
agaaagggcaaatt

SEQ ID NO: 2126360 - DNA, 14 bp, Homo sapiens
agaaagtgggttca

SEQ ID NO: 2126361 - DNA, 12 bp, Homo sapiens
agaaataaaaat

SEQ ID NO: 2126362 - DNA, 14 bp, Homo sapiens
agaaataaattttg

SEQ ID NO: 2126363 - DNA, 15 bp, Homo sapiens
agaaataaattttgt

SEQ ID NO: 2126364 - DNA, 23 bp, Homo sapiens
agaaatactgctctgaatatttt

SEQ ID NO: 2126365 - DNA, 18 bp, Homo sapiens
agaaatagacagtatatt

SEQ ID NO: 2126366 - DNA, 20 bp, Homo sapiens
agaaatagcctgcgctgttt

SEQ ID NO: 2126367 - DNA, 19 bp, Homo sapiens
agaaatcacaggggcgggg

SEQ ID NO: 2126368 - DNA, 14 bp, Homo sapiens
agaaatgcaaaaat

SEQ ID NO: 2126369 - DNA, 22 bp, Homo sapiens
agaaatgcatccattcctcagg

SEQ ID NO: 2126370 - DNA, 17 bp, Homo sapiens
agaaatgtgaagggtgg

SEQ ID NO: 2126371 - DNA, 14 bp, Homo sapiens
agaaattagccggg

SEQ ID NO: 2126372 - DNA, 16 bp, Homo sapiens
agaaattatttaataa

SEQ ID NO: 2126373 - DNA, 15 bp, Homo sapiens
agaagttaagcagcc

SEQ ID NO: 2126374 - DNA, 19 bp, Homo sapiens
agaagttaagcagcctttc

SEQ ID NO: 2126375 - DNA, 15 bp, Homo sapiens
agaagttgccaagag

SEQ ID NO: 2126376 - DNA, 16 bp, Homo sapiens
agaagttgccaagagt

SEQ ID NO: 2126377 - DNA, 23 bp, Homo sapiens
agaagtttctggccctggctgac

SEQ ID NO: 2126378 - DNA, 14 bp, Homo sapiens
agaataaaattgta

SEQ ID NO: 2126379 - DNA, 21 bp, Homo sapiens
agaataaagttctgagtgttt

SEQ ID NO: 2126380 - DNA, 16 bp, Homo sapiens
agaataagagaaagaa

SEQ ID NO: 2126381 - DNA, 23 bp, Homo sapiens
agaataatatgctgccaaatttt

SEQ ID NO: 2126382 - DNA, 16 bp, Homo sapiens
agaataatctttgggt

SEQ ID NO: 2126383 - DNA, 21 bp, Homo sapiens
agaatacagaaagatggatgt

SEQ ID NO: 2126384 - DNA, 21 bp, Homo sapiens
agaatacattttatatctgga

SEQ ID NO: 2126385 - DNA, 19 bp, Homo sapiens
agaatacttttttctagtt

SEQ ID NO: 2126386 - DNA, 23 bp, Homo sapiens
agaatagatctgatggtgagctg

SEQ ID NO: 2126387 - DNA, 19 bp, Homo sapiens
agaatatgatcatgtaaat

SEQ ID NO: 2126388 - DNA, 12 bp, Homo sapiens
agaatatgttca

SEQ ID NO: 2126389 - DNA, 18 bp, Homo sapiens
agaatattcagagaatat

SEQ ID NO: 2126390 - DNA, 13 bp, Homo sapiens
agaatattcagga

SEQ ID NO: 2126391 - DNA, 15 bp, Homo sapiens
agaatattcaggact

SEQ ID NO: 2126392 - DNA, 11 bp, Homo sapiens
agaatatttat

SEQ ID NO: 2126393 - DNA, 22 bp, Homo sapiens
agaatatttattacctctgata

SEQ ID NO: 2126394 - DNA, 15 bp, Homo sapiens
agaatatttcaaatg

SEQ ID NO: 2126395 - DNA, 21 bp, Homo sapiens
agaatatttcaaatgaacacg

SEQ ID NO: 2126396 - DNA, 19 bp, Homo sapiens
agaatcagggcaggcttgc

SEQ ID NO: 2126397 - DNA, 19 bp, Homo sapiens
agacaggaaaatcctctgg

SEQ ID NO: 2126398 - DNA, 23 bp, Homo sapiens
agacaggcccaagagatgaagag

SEQ ID NO: 2126399 - DNA, 21 bp, Homo sapiens
agacaggcgctggacagaggg

SEQ ID NO: 2126400 - DNA, 11 bp, Homo sapiens
agacagggcaa

SEQ ID NO: 2126401 - DNA, 22 bp, Homo sapiens
agacagggcaatcttgtccaca

SEQ ID NO: 2126402 - DNA, 15 bp, Homo sapiens
agacaggtctagact

SEQ ID NO: 2126403 - DNA, 15 bp, Homo sapiens
agacagtgatctcca

SEQ ID NO: 2126404 - DNA, 17 bp, Homo sapiens
agacagtgatctccata

SEQ ID NO: 2126405 - DNA, 18 bp, Homo sapiens
agacagtggatcatgaaa

SEQ ID NO: 2126406 - DNA, 22 bp, Homo sapiens
agacagtggatcatgaaaagtg

SEQ ID NO: 2126407 - DNA, 14 bp, Homo sapiens
agacagttcaagaa

SEQ ID NO: 2126408 - DNA, 21 bp, Homo sapiens
agacatattcttggagaactt

SEQ ID NO: 2126409 - DNA, 21 bp, Homo sapiens
agacatccatgtttgtaaaac

SEQ ID NO: 2126410 - DNA, 22 bp, Homo sapiens
agacatccatgtttgtaaaact

SEQ ID NO: 2126411 - DNA, 18 bp, Homo sapiens
agacatgaaaactatttt

SEQ ID NO: 2126412 - DNA, 17 bp, Homo sapiens
agacatgtggtgggaca

SEQ ID NO: 2126413 - DNA, 22 bp, Homo sapiens
agacatttgtaaatgtaaaact

SEQ ID NO: 2126414 - DNA, 13 bp, Homo sapiens
agactgaagagac

SEQ ID NO: 2126415 - DNA, 16 bp, Homo sapiens
agactgagcacctgct

SEQ ID NO: 2126416 - DNA, 13 bp, Homo sapiens
agactgagggaga

SEQ ID NO: 2126417 - DNA, 17 bp, Homo sapiens
agactgagggagagact

SEQ ID NO: 2126418 - DNA, 12 bp, Homo sapiens
agactgattacc

SEQ ID NO: 2126419 - DNA, 15 bp, Homo sapiens
agactgcagctgctg

SEQ ID NO: 2126420 - DNA, 17 bp, Homo sapiens
agactgcatctcaaaaa

SEQ ID NO: 2126421 - DNA, 23 bp, Homo sapiens
agactgcgatttgtcccaggtcc

SEQ ID NO: 2126422 - DNA, 22 bp, Homo sapiens
agactgcgggatggtcctgggg

SEQ ID NO: 2126423 - DNA, 15 bp, Homo sapiens
agactgctgggactg

SEQ ID NO: 2126424 - DNA, 19 bp, Homo sapiens
agactgctgggactggcca

SEQ ID NO: 2126425 - DNA, 22 bp, Homo sapiens
agactgctgggactggccaggt

SEQ ID NO: 2126426 - DNA, 14 bp, Homo sapiens
agagagggcccagc

SEQ ID NO: 2126427 - DNA, 18 bp, Homo sapiens
agagaggggacatttccc

SEQ ID NO: 2126428 - DNA, 15 bp, Homo sapiens
agagagggggctctc

SEQ ID NO: 2126429 - DNA, 20 bp, Homo sapiens
agagagggtggtgacctctg

SEQ ID NO: 2126430 - DNA, 17 bp, Homo sapiens
agagaggtggagaactg

SEQ ID NO: 2126431 - DNA, 21 bp, Homo sapiens
agagaggtgggcagcagctca

SEQ ID NO: 2126432 - DNA, 13 bp, Homo sapiens
agagaggttctgg

SEQ ID NO: 2126433 - DNA, 16 bp, Homo sapiens
agagaggttctgggga

SEQ ID NO: 2126434 - DNA, 21 bp, Homo sapiens
agagagtattaaatatttaac

SEQ ID NO: 2126435 - DNA, 23 bp, Homo sapiens
agagagtgctgagaaggacacct

SEQ ID NO: 2126436 - DNA, 17 bp, Homo sapiens
agagagtttatcattgg

SEQ ID NO: 2126437 - DNA, 16 bp, Homo sapiens
agagataccttgaaaa

SEQ ID NO: 2126438 - DNA, 14 bp, Homo sapiens
agagatatgcacac

SEQ ID NO: 2126439 - DNA, 17 bp, Homo sapiens
agagatatggcagcgaa

SEQ ID NO: 2126440 - DNA, 22 bp, Homo sapiens
agagatcaaccccttcgctcct

SEQ ID NO: 2126441 - DNA, 14 bp, Homo sapiens
agagatcaggaaga

SEQ ID NO: 2126442 - DNA, 19 bp, Homo sapiens
agagatcaggaagagaagg

SEQ ID NO: 2126443 - DNA, 13 bp, Homo sapiens
agagatctagaaa

SEQ ID NO: 2126444 - DNA, 16 bp, Homo sapiens
agagatctagaaagtg

SEQ ID NO: 2126445 - DNA, 19 bp, Homo sapiens
agagatctagaaagtgggt

SEQ ID NO: 2126446 - DNA, 17 bp, Homo sapiens
agagatgactgagtcct

SEQ ID NO: 2126447 - DNA, 18 bp, Homo sapiens
agagatgactgagtcctc

SEQ ID NO: 2126448 - DNA, 23 bp, Homo sapiens
agagatgatcgtgcctataaata

SEQ ID NO: 2126449 - DNA, 14 bp, Homo sapiens
agagatgcctccac

SEQ ID NO: 2126450 - DNA, 17 bp, Homo sapiens
agagatgcctccaccgc

SEQ ID NO: 2126451 - DNA, 17 bp, Homo sapiens
agagatgggatttcatc

SEQ ID NO: 2126452 - DNA, 19 bp, Homo sapiens
agagatgtggcaaagtgct

SEQ ID NO: 2126453 - DNA, 18 bp, Homo sapiens
agagatttcaacaagaat

SEQ ID NO: 2126454 - DNA, 16 bp, Homo sapiens
agagatttcaacatat

SEQ ID NO: 2126455 - DNA, 21 bp, Homo sapiens
agagatttcctccatggtgga

SEQ ID NO: 2126456 - DNA, 15 bp, Homo sapiens
agagcaacccctgta

SEQ ID NO: 2126457 - DNA, 17 bp, Homo sapiens
agagcaagactccgtct

SEQ ID NO: 2126458 - DNA, 18 bp, Homo sapiens
agagcaagactccgtctc

SEQ ID NO: 2126459 - DNA, 21 bp, Homo sapiens
agagcaatgcccgtaatgctt

SEQ ID NO: 2126460 - DNA, 14 bp, Homo sapiens
agagcagaggcagc

SEQ ID NO: 2126461 - DNA, 11 bp, Homo sapiens
agagcagcctg

SEQ ID NO: 2126462 - DNA, 13 bp, Homo sapiens
agagcagcctgat

SEQ ID NO: 2126463 - DNA, 12 bp, Homo sapiens
agagcagctggc

SEQ ID NO: 2126464 - DNA, 16 bp, Homo sapiens
agagcagctggctctc

SEQ ID NO: 2126465 - DNA, 12 bp, Homo sapiens
agagcagctggt

SEQ ID NO: 2126466 - DNA, 14 bp, Homo sapiens
agagcaggaatggg

SEQ ID NO: 2126467 - DNA, 13 bp, Homo sapiens
agagcaggcacat

SEQ ID NO: 2126468 - DNA, 20 bp, Homo sapiens
agagcaggcacatggaggag

SEQ ID NO: 2126469 - DNA, 13 bp, Homo sapiens
agagcatagggtc

SEQ ID NO: 2126470 - DNA, 16 bp, Homo sapiens
agagcatcatgcctct

SEQ ID NO: 2126471 - DNA, 17 bp, Homo sapiens
agagcatcatgcctctg

SEQ ID NO: 2126472 - DNA, 16 bp, Homo sapiens
agagcatcgtgaccct

SEQ ID NO: 2126473 - DNA, 20 bp, Homo sapiens
agagcatcgtgacccttcag

SEQ ID NO: 2126474 - DNA, 22 bp, Homo sapiens
agagcatcgtgacccttcaggg

SEQ ID NO: 2126475 - DNA, 17 bp, Homo sapiens
agagcattacgtgagcc

SEQ ID NO: 2126476 - DNA, 19 bp, Homo sapiens
agagcattacgtgagccag

SEQ ID NO: 2126477 - DNA, 20 bp, Homo sapiens
agagcattacgtgagccagg

SEQ ID NO: 2126478 - DNA, 17 bp, Homo sapiens
agagcattgcatggaca

SEQ ID NO: 2126479 - DNA, 23 bp, Homo sapiens
agagccaccagggcactgtctgc

SEQ ID NO: 2126480 - DNA, 13 bp, Homo sapiens
agagccagccctc

SEQ ID NO: 2126481 - DNA, 13 bp, Homo sapiens
agagccagcctgg

SEQ ID NO: 2126482 - DNA, 14 bp, Homo sapiens
agagccagcctggg

SEQ ID NO: 2126483 - DNA, 16 bp, Homo sapiens
agagccagcctgggac

SEQ ID NO: 2126484 - DNA, 14 bp, Homo sapiens
agagccaggctctg

SEQ ID NO: 2126485 - DNA, 17 bp, Homo sapiens
agagccaggctctgcct

SEQ ID NO: 2126486 - DNA, 18 bp, Homo sapiens
agagccaggctctgcctg

SEQ ID NO: 2126487 - DNA, 20 bp, Homo sapiens
agagccaggctctgcctgga

SEQ ID NO: 2126488 - DNA, 18 bp, Homo sapiens
agagccatgggcctgggc

SEQ ID NO: 2126489 - DNA, 21 bp, Homo sapiens
agagcccatgctcaaccactg

SEQ ID NO: 2126490 - DNA, 13 bp, Homo sapiens
agagccccactcc

SEQ ID NO: 2126491 - DNA, 22 bp, Homo sapiens
agagccccactcccggccaggc

SEQ ID NO: 2126492 - DNA, 21 bp, Homo sapiens
agagcccccaagcctctgccc

SEQ ID NO: 2126493 - DNA, 16 bp, Homo sapiens
agagccccccacaatg

SEQ ID NO: 2126494 - DNA, 21 bp, Homo sapiens
agagccccccgtgtggcttac

SEQ ID NO: 2126495 - DNA, 12 bp, Homo sapiens
agagccctgagc

SEQ ID NO: 2126496 - DNA, 14 bp, Homo sapiens
agagccctgagctc

SEQ ID NO: 2126497 - DNA, 19 bp, Homo sapiens
agagccctgagctcaggct

SEQ ID NO: 2126498 - DNA, 13 bp, Homo sapiens
agagccctgctgt

SEQ ID NO: 2126499 - DNA, 20 bp, Homo sapiens
agagccctgctgtgggagag

SEQ ID NO: 2126500 - DNA, 16 bp, Homo sapiens
agagccgcaaatcaac

SEQ ID NO: 2126501 - DNA, 13 bp, Homo sapiens
agagccgggaagc

SEQ ID NO: 2126502 - DNA, 15 bp, Homo sapiens
agagccgggccccgg

SEQ ID NO: 2126503 - DNA, 15 bp, Homo sapiens
agagcctagccacct

SEQ ID NO: 2126504 - DNA, 15 bp, Homo sapiens
agagcctgaatttgt

SEQ ID NO: 2126505 - DNA, 18 bp, Homo sapiens
agagcctgcctcagctgc

SEQ ID NO: 2126506 - DNA, 15 bp, Homo sapiens
agagcctgctccccc

SEQ ID NO: 2126507 - DNA, 16 bp, Homo sapiens
agagcctgctccccca

SEQ ID NO: 2126508 - DNA, 12 bp, Homo sapiens
agagcctggggc

SEQ ID NO: 2126509 - DNA, 18 bp, Homo sapiens
agagcctggggtgttctc

SEQ ID NO: 2126510 - DNA, 20 bp, Homo sapiens
agagcctgtctttcagcatt

SEQ ID NO: 2126511 - DNA, 21 bp, Homo sapiens
agagcctgtctttcagcattc

SEQ ID NO: 2126512 - DNA, 19 bp, Homo sapiens
agagccttggtgtccacct

SEQ ID NO: 2126513 - DNA, 23 bp, Homo sapiens
agagccttggtgtccacctggcc

SEQ ID NO: 2126514 - DNA, 21 bp, Homo sapiens
agagcctttggatgaccagaa

SEQ ID NO: 2126515 - DNA, 19 bp, Homo sapiens
agagcggggaggtgcctga

SEQ ID NO: 2126516 - DNA, 20 bp, Homo sapiens
agagcgtggctgtgctctca

SEQ ID NO: 2126517 - DNA, 18 bp, Homo sapiens
agagctacataatttagt

SEQ ID NO: 2126518 - DNA, 14 bp, Homo sapiens
agagctacgtattt

SEQ ID NO: 2126519 - DNA, 17 bp, Homo sapiens
agagctacgtatttaat

SEQ ID NO: 2126520 - DNA, 16 bp, Homo sapiens
agagctagaacctgga

SEQ ID NO: 2126521 - DNA, 22 bp, Homo sapiens
agagctagaacctggagaacta

SEQ ID NO: 2126522 - DNA, 13 bp, Homo sapiens
agagctagcgctg

SEQ ID NO: 2126523 - DNA, 20 bp, Homo sapiens
agagctaggagcaaagcctg

SEQ ID NO: 2126524 - DNA, 21 bp, Homo sapiens
agagctaggagcaaagcctgt

SEQ ID NO: 2126525 - DNA, 15 bp, Homo sapiens
agagctatggtgagg

SEQ ID NO: 2126526 - DNA, 15 bp, Homo sapiens
agagctcctgtccct

SEQ ID NO: 2126527 - DNA, 21 bp, Homo sapiens
agagctcctgtccctacccac

SEQ ID NO: 2126528 - DNA, 17 bp, Homo sapiens
agagctcttcaagctgt

SEQ ID NO: 2126529 - DNA, 19 bp, Homo sapiens
agagctcttcaagctgtcc

SEQ ID NO: 2126530 - DNA, 23 bp, Homo sapiens
agagctgacccagagtggagtct

SEQ ID NO: 2126531 - DNA, 16 bp, Homo sapiens
agagctgatggagaag

SEQ ID NO: 2126532 - DNA, 17 bp, Homo sapiens
agagctgatggagaagg

SEQ ID NO: 2126533 - DNA, 21 bp, Homo sapiens
agagctgatggagaaggaagg

SEQ ID NO: 2126534 - DNA, 22 bp, Homo sapiens
agagctgatgtgagtgtgtgtg

SEQ ID NO: 2126535 - DNA, 23 bp, Homo sapiens
agagctgatgtgagtgtgtgtga

SEQ ID NO: 2126536 - DNA, 14 bp, Homo sapiens
agagctgctctgga

SEQ ID NO: 2126537 - DNA, 22 bp, Homo sapiens
agagctgctctggaaaatgtga

SEQ ID NO: 2126538 - DNA, 22 bp, Homo sapiens
agagctgctgtccttttaggaa

SEQ ID NO: 2126539 - DNA, 14 bp, Homo sapiens
agagctggaaggca

SEQ ID NO: 2126540 - DNA, 16 bp, Homo sapiens
agagctggaaggcagg

SEQ ID NO: 2126541 - DNA, 17 bp, Homo sapiens
agagctggaaggcaggg

SEQ ID NO: 2126542 - DNA, 19 bp, Homo sapiens
agagctggaaggcagggca

SEQ ID NO: 2126543 - DNA, 21 bp, Homo sapiens
agagctggaaggcagggcaga

SEQ ID NO: 2126544 - DNA, 18 bp, Homo sapiens
agagctggcaaaggtggc

SEQ ID NO: 2126545 - DNA, 17 bp, Homo sapiens
agagctggctgtcttcc

SEQ ID NO: 2126546 - DNA, 19 bp, Homo sapiens
agagctgggaaacagggag

SEQ ID NO: 2126547 - DNA, 18 bp, Homo sapiens
agagctgggaaattcatg

SEQ ID NO: 2126548 - DNA, 20 bp, Homo sapiens
agagctgggaaattcatgtg

SEQ ID NO: 2126549 - DNA, 22 bp, Homo sapiens
agagctgggaggcatggccctg

SEQ ID NO: 2126550 - DNA, 19 bp, Homo sapiens
agagctgggtgtcaagagg

SEQ ID NO: 2126551 - DNA, 18 bp, Homo sapiens
agagctgttggcctcgcc

SEQ ID NO: 2126552 - DNA, 20 bp, Homo sapiens
agagctgttggcctcgcctg

SEQ ID NO: 2126553 - DNA, 22 bp, Homo sapiens
agagctgttggcctcgcctggg

SEQ ID NO: 2126554 - DNA, 19 bp, Homo sapiens
agagcttattggccactgg

SEQ ID NO: 2126555 - DNA, 13 bp, Homo sapiens
agagcttcccagg

SEQ ID NO: 2126556 - DNA, 15 bp, Homo sapiens
agagcttctggcact

SEQ ID NO: 2126557 - DNA, 16 bp, Homo sapiens
agagcttggtggctga

SEQ ID NO: 2126558 - DNA, 19 bp, Homo sapiens
agagcttggtggctgagct

SEQ ID NO: 2126559 - DNA, 15 bp, Homo sapiens
agaggaacaggtgga

SEQ ID NO: 2126560 - DNA, 17 bp, Homo sapiens
agaggaagatgaagaga

SEQ ID NO: 2126561 - DNA, 18 bp, Homo sapiens
agaggaagatgaagagaa

SEQ ID NO: 2126562 - DNA, 22 bp, Homo sapiens
agaggaatctacctgtggtgac

SEQ ID NO: 2126563 - DNA, 15 bp, Homo sapiens
agaggacaaggaagt

SEQ ID NO: 2126564 - DNA, 21 bp, Homo sapiens
agaggacaaggaagtgggggc

SEQ ID NO: 2126565 - DNA, 19 bp, Homo sapiens
agaggaccacagtgggtgg

SEQ ID NO: 2126566 - DNA, 20 bp, Homo sapiens
agaggactgagactggcact

SEQ ID NO: 2126567 - DNA, 14 bp, Homo sapiens
agaggacttttctt

SEQ ID NO: 2126568 - DNA, 14 bp, Homo sapiens
agaggagaccctgg

SEQ ID NO: 2126569 - DNA, 15 bp, Homo sapiens
agaggagaccctgga

SEQ ID NO: 2126570 - DNA, 14 bp, Homo sapiens
agaggagaggaaaa

SEQ ID NO: 2126571 - DNA, 12 bp, Homo sapiens
agaggagatcag

SEQ ID NO: 2126572 - DNA, 14 bp, Homo sapiens
agaggagatcaggg

SEQ ID NO: 2126573 - DNA, 14 bp, Homo sapiens
agaggagggcatgg

SEQ ID NO: 2126574 - DNA, 19 bp, Homo sapiens
agaggagggcgtgactcac

SEQ ID NO: 2126575 - DNA, 13 bp, Homo sapiens
agaggcacctgct

SEQ ID NO: 2126576 - DNA, 18 bp, Homo sapiens
agaggcacctgtcccaga

SEQ ID NO: 2126577 - DNA, 13 bp, Homo sapiens
agaggcagaagaa

SEQ ID NO: 2126578 - DNA, 17 bp, Homo sapiens
agaggcagaagaaccct

SEQ ID NO: 2126579 - DNA, 18 bp, Homo sapiens
agaggcagagaaagaaga

SEQ ID NO: 2126580 - DNA, 24 bp, Homo sapiens
agaggcagccccattctgcctgcc

SEQ ID NO: 2126581 - DNA, 17 bp, Homo sapiens
agaggcagggaggggac

SEQ ID NO: 2126582 - DNA, 24 bp, Homo sapiens
agaggcatgaacacacatggatgc

SEQ ID NO: 2126583 - DNA, 13 bp, Homo sapiens
agaggcatggctg

SEQ ID NO: 2126584 - DNA, 17 bp, Homo sapiens
agaggcatttaaaatgg

SEQ ID NO: 2126585 - DNA, 19 bp, Homo sapiens
agaggccaggaatctgcca

SEQ ID NO: 2126586 - DNA, 14 bp, Homo sapiens
agaggccatggcag

SEQ ID NO: 2126587 - DNA, 15 bp, Homo sapiens
agaggccatggcaga

SEQ ID NO: 2126588 - DNA, 20 bp, Homo sapiens
agaggccatggcagaataat

SEQ ID NO: 2126589 - DNA, 19 bp, Homo sapiens
agaggccatgggcctcctg

SEQ ID NO: 2126590 - DNA, 16 bp, Homo sapiens
agaggcccagggagca

SEQ ID NO: 2126591 - DNA, 17 bp, Homo sapiens
agaggccctggatcagc

SEQ ID NO: 2126592 - DNA, 23 bp, Homo sapiens
agaggccctggatcagcgtggcc

SEQ ID NO: 2126593 - DNA, 21 bp, Homo sapiens
agaggcctttaaccatggtgc

SEQ ID NO: 2126594 - DNA, 19 bp, Homo sapiens
agaggccttttggaatgtg

SEQ ID NO: 2126595 - DNA, 14 bp, Homo sapiens
agaggcgacttcct

SEQ ID NO: 2126596 - DNA, 16 bp, Homo sapiens
agaggcgcgtctgccc

SEQ ID NO: 2126597 - DNA, 17 bp, Homo sapiens
agaggcgcgtctgcccc

SEQ ID NO: 2126598 - DNA, 18 bp, Homo sapiens
agaggcgcgtctgcccca

SEQ ID NO: 2126599 - DNA, 23 bp, Homo sapiens
agaggcggaaaccttgcagcatt

SEQ ID NO: 2126600 - DNA, 12 bp, Homo sapiens
agaggcggcctc

SEQ ID NO: 2126601 - DNA, 22 bp, Homo sapiens
agaggctggaggcagggccttg

SEQ ID NO: 2126602 - DNA, 14 bp, Homo sapiens
agaggctggtgctg

SEQ ID NO: 2126603 - DNA, 20 bp, Homo sapiens
agaggcttccttcatttcct

SEQ ID NO: 2126604 - DNA, 14 bp, Homo sapiens
agaggcttcttcag

SEQ ID NO: 2126605 - DNA, 21 bp, Homo sapiens
agagggaaggggcctacaccc

SEQ ID NO: 2126606 - DNA, 19 bp, Homo sapiens
agagggagaagggatggag

SEQ ID NO: 2126607 - DNA, 20 bp, Homo sapiens
agagggaggcttcctgactg

SEQ ID NO: 2126608 - DNA, 20 bp, Homo sapiens
agagggagtgacagaggcag

SEQ ID NO: 2126609 - DNA, 18 bp, Homo sapiens
agagggcaaacccaaaac

SEQ ID NO: 2126610 - DNA, 21 bp, Homo sapiens
agagggcaaacccaaaacctc

SEQ ID NO: 2126611 - DNA, 14 bp, Homo sapiens
agagggcagaggct

SEQ ID NO: 2126612 - DNA, 14 bp, Homo sapiens
agagggccaagaga

SEQ ID NO: 2126613 - DNA, 19 bp, Homo sapiens
agagggccaagagagacat

SEQ ID NO: 2126614 - DNA, 12 bp, Homo sapiens
agagggccacac

SEQ ID NO: 2126615 - DNA, 23 bp, Homo sapiens
agagggcccagctgtagccatgg

SEQ ID NO: 2126616 - DNA, 14 bp, Homo sapiens
agagggcccaggca

SEQ ID NO: 2126617 - DNA, 17 bp, Homo sapiens
agagggcccaggcaggc

SEQ ID NO: 2126618 - DNA, 15 bp, Homo sapiens
agagggcctgtggga

SEQ ID NO: 2126619 - DNA, 16 bp, Homo sapiens
agagggcctgtgggag

SEQ ID NO: 2126620 - DNA, 14 bp, Homo sapiens
agagggctagggag

SEQ ID NO: 2126621 - DNA, 21 bp, Homo sapiens
agagggctgttggacagctgc

SEQ ID NO: 2126622 - DNA, 23 bp, Homo sapiens
agagggctgttggacagctgctt

SEQ ID NO: 2126623 - DNA, 19 bp, Homo sapiens
agaggggaataatagaaga

SEQ ID NO: 2126624 - DNA, 20 bp, Homo sapiens
agaggggaggggcctaggga

SEQ ID NO: 2126625 - DNA, 20 bp, Homo sapiens
agaggggcagccgctaggag

SEQ ID NO: 2126626 - DNA, 15 bp, Homo sapiens
agaggggcctgggaa

SEQ ID NO: 2126627 - DNA, 22 bp, Homo sapiens
agaggggcctgggaaaggaaaa

SEQ ID NO: 2126628 - DNA, 13 bp, Homo sapiens
agagggggctctc

SEQ ID NO: 2126629 - DNA, 16 bp, Homo sapiens
agaggggtgcacccac

SEQ ID NO: 2126630 - DNA, 23 bp, Homo sapiens
agaggggtgcacccactcaccag

SEQ ID NO: 2126631 - DNA, 18 bp, Homo sapiens
agagggtctggagaagca

SEQ ID NO: 2126632 - DNA, 19 bp, Homo sapiens
agagggtggtgacctctgc

SEQ ID NO: 2126633 - DNA, 18 bp, Homo sapiens
agaggtaaaagtgtgagc

SEQ ID NO: 2126634 - DNA, 19 bp, Homo sapiens
agaggtaaaagtgtgagca

SEQ ID NO: 2126635 - DNA, 17 bp, Homo sapiens
agaggtagcgagctgct

SEQ ID NO: 2126636 - DNA, 23 bp, Homo sapiens
agaggtagcgagctgctctgcta

SEQ ID NO: 2126637 - DNA, 16 bp, Homo sapiens
agaggtccctgcttac

SEQ ID NO: 2126638 - DNA, 22 bp, Homo sapiens
agaggtccctgcttacctgacg

SEQ ID NO: 2126639 - DNA, 14 bp, Homo sapiens
agaggtctgagccc

SEQ ID NO: 2126640 - DNA, 21 bp, Homo sapiens
agaggtctgagccctggtgtg

SEQ ID NO: 2126641 - DNA, 16 bp, Homo sapiens
agaggtgaccccaggg

SEQ ID NO: 2126642 - DNA, 23 bp, Homo sapiens
agaggtgaccccagggcacagga

SEQ ID NO: 2126643 - DNA, 24 bp, Homo sapiens
agaggtgaccccagggcacaggag

SEQ ID NO: 2126644 - DNA, 13 bp, Homo sapiens
agaggtgagcaga

SEQ ID NO: 2126645 - DNA, 16 bp, Homo sapiens
agaggtgctgcaggca

SEQ ID NO: 2126646 - DNA, 20 bp, Homo sapiens
agaggtggagaactgggatt

SEQ ID NO: 2126647 - DNA, 16 bp, Homo sapiens
agaggtgggcagcagc

SEQ ID NO: 2126648 - DNA, 18 bp, Homo sapiens
agaggtgggcagcagctc

SEQ ID NO: 2126649 - DNA, 20 bp, Homo sapiens
agaggtgggcagcagctcag

SEQ ID NO: 2126650 - DNA, 17 bp, Homo sapiens
agaggtgggcagctggg

SEQ ID NO: 2126651 - DNA, 20 bp, Homo sapiens
agaggtgggcagctgggccc

SEQ ID NO: 2126652 - DNA, 17 bp, Homo sapiens
agaggtggtgggggcag

SEQ ID NO: 2126653 - DNA, 16 bp, Homo sapiens
agaggttctggggagg

SEQ ID NO: 2126654 - DNA, 17 bp, Homo sapiens
agaggttctggggagga

SEQ ID NO: 2126655 - DNA, 14 bp, Homo sapiens
agaggtttcttgaa

SEQ ID NO: 2126656 - DNA, 15 bp, Homo sapiens
agaggtttcttgaat

SEQ ID NO: 2126657 - DNA, 19 bp, Homo sapiens
agaggttttgttgttttat

SEQ ID NO: 2126658 - DNA, 15 bp, Homo sapiens
agagtaaaaactgaa

SEQ ID NO: 2126659 - DNA, 12 bp, Homo sapiens
aaacccagagag

SEQ ID NO: 2126660 - DNA, 18 bp, Homo sapiens
aaacccagcatgtacaaa

SEQ ID NO: 2126661 - DNA, 19 bp, Homo sapiens
aaacccattaggcatgcct

SEQ ID NO: 2126662 - DNA, 17 bp, Homo sapiens
aaaccctatctgtgatt

SEQ ID NO: 2126663 - DNA, 17 bp, Homo sapiens
aaaccctggcttgcttg

SEQ ID NO: 2126664 - DNA, 12 bp, Homo sapiens
aaaccctgtctc

SEQ ID NO: 2126665 - DNA, 16 bp, Homo sapiens
aaaccgctaaaagaaa

SEQ ID NO: 2126666 - DNA, 23 bp, Homo sapiens
aaacctaaagaggaaaagtgcaa

SEQ ID NO: 2126667 - DNA, 22 bp, Homo sapiens
aaacctatcaatcctgccccca

SEQ ID NO: 2126668 - DNA, 19 bp, Homo sapiens
aaacctcagggacaacatt

SEQ ID NO: 2126669 - DNA, 21 bp, Homo sapiens
aaacctcagtcatattcttat

SEQ ID NO: 2126670 - DNA, 16 bp, Homo sapiens
aaacctgaaaaaaagt

SEQ ID NO: 2126671 - DNA, 19 bp, Homo sapiens
aaacctgatgttgagctga

SEQ ID NO: 2126672 - DNA, 17 bp, Homo sapiens
aaacctgtccataaagt

SEQ ID NO: 2126673 - DNA, 17 bp, Homo sapiens
aaaccttattgtacctc

SEQ ID NO: 2126674 - DNA, 11 bp, Homo sapiens
aaaccttgcag

SEQ ID NO: 2126675 - DNA, 16 bp, Homo sapiens
aaaccttgcagcattt

SEQ ID NO: 2126676 - DNA, 21 bp, Homo sapiens
aaaccttgcagcatttttatt

SEQ ID NO: 2126677 - DNA, 19 bp, Homo sapiens
aaacctttcaaatttcaca

SEQ ID NO: 2126678 - DNA, 20 bp, Homo sapiens
aaacctttccccagacacat

SEQ ID NO: 2126679 - DNA, 18 bp, Homo sapiens
aaacgaagccatctttct

SEQ ID NO: 2126680 - DNA, 19 bp, Homo sapiens
aaacgcaaagggctgaaag

SEQ ID NO: 2126681 - DNA, 13 bp, Homo sapiens
aaacgcagacact

SEQ ID NO: 2126682 - DNA, 21 bp, Homo sapiens
aaacgtgggtatttcctgcta

SEQ ID NO: 2126683 - DNA, 18 bp, Homo sapiens
aaacgttgacccctttcc

SEQ ID NO: 2126684 - DNA, 21 bp, Homo sapiens
aaacgttgacccctttccccc

SEQ ID NO: 2126685 - DNA, 14 bp, Homo sapiens
aaactaaaaactag

SEQ ID NO: 2126686 - DNA, 14 bp, Homo sapiens
aaactaacaaccaa

SEQ ID NO: 2126687 - DNA, 17 bp, Homo sapiens
aaactacaaagctgaag

SEQ ID NO: 2126688 - DNA, 22 bp, Homo sapiens
aaactacacatccctaatgtgt

SEQ ID NO: 2126689 - DNA, 20 bp, Homo sapiens
aaactacctaacattattta

SEQ ID NO: 2126690 - DNA, 19 bp, Homo sapiens
aaactactgtaattaagtg

SEQ ID NO: 2126691 - DNA, 16 bp, Homo sapiens
aaactagaagtcaaaa

SEQ ID NO: 2126692 - DNA, 18 bp, Homo sapiens
aaactataaactactgta

SEQ ID NO: 2126693 - DNA, 19 bp, Homo sapiens
aaactatccaattaaaatt

SEQ ID NO: 2126694 - DNA, 23 bp, Homo sapiens
aaactatccaattaaaattaagg

SEQ ID NO: 2126695 - DNA, 16 bp, Homo sapiens
aaactatcttggtgaa

SEQ ID NO: 2126696 - DNA, 21 bp, Homo sapiens
aaactatggttcccaataaaa

SEQ ID NO: 2126697 - DNA, 20 bp, Homo sapiens
aaactatttgtctttcagga

SEQ ID NO: 2126698 - DNA, 18 bp, Homo sapiens
aaactcaccatgtaaaag

SEQ ID NO: 2126699 - DNA, 16 bp, Homo sapiens
aaactcactgctcaag

SEQ ID NO: 2126700 - DNA, 21 bp, Homo sapiens
aaactcacttcaatgaacaaa

SEQ ID NO: 2126701 - DNA, 16 bp, Homo sapiens
aaactcagttaaaatg

SEQ ID NO: 2126702 - DNA, 23 bp, Homo sapiens
aaactcccacttgtcatgtgaca

SEQ ID NO: 2126703 - DNA, 14 bp, Homo sapiens
aaactcctgcctgt

SEQ ID NO: 2126704 - DNA, 19 bp, Homo sapiens
aaactccttttgctgtctt

SEQ ID NO: 2126705 - DNA, 20 bp, Homo sapiens
aaactctaaacattaatcaa

SEQ ID NO: 2126706 - DNA, 12 bp, Homo sapiens
aaactgaaaatc

SEQ ID NO: 2126707 - DNA, 14 bp, Homo sapiens
aaactgaaaatcta

SEQ ID NO: 2126708 - DNA, 19 bp, Homo sapiens
aaactgaaaatctaatatt

SEQ ID NO: 2126709 - DNA, 14 bp, Homo sapiens
aaactgaatggaag

SEQ ID NO: 2126710 - DNA, 21 bp, Homo sapiens
aaactgagatgtgaacacatc

SEQ ID NO: 2126711 - DNA, 16 bp, Homo sapiens
aaactgatcaaaaata

SEQ ID NO: 2126712 - DNA, 21 bp, Homo sapiens
aaactgatggaccgggtgggc

SEQ ID NO: 2126713 - DNA, 17 bp, Homo sapiens
aaactgcattagaaatt

SEQ ID NO: 2126714 - DNA, 15 bp, Homo sapiens
aaactgccagcaacg

SEQ ID NO: 2126715 - DNA, 19 bp, Homo sapiens
aaactgccagcaacgcagg

SEQ ID NO: 2126716 - DNA, 11 bp, Homo sapiens
aaactggaaat

SEQ ID NO: 2126717 - DNA, 19 bp, Homo sapiens
aaactggaaatctggattt

SEQ ID NO: 2126718 - DNA, 15 bp, Homo sapiens
aaactggaataagaa

SEQ ID NO: 2126719 - DNA, 22 bp, Homo sapiens
aaactggggagttataaaaata

SEQ ID NO: 2126720 - DNA, 14 bp, Homo sapiens
aaactggggcttgc

SEQ ID NO: 2126721 - DNA, 22 bp, Homo sapiens
aaactggtttgttgcagccaaa

SEQ ID NO: 2126722 - DNA, 21 bp, Homo sapiens
aaactgtatcaaatctgtata

SEQ ID NO: 2126723 - DNA, 19 bp, Homo sapiens
aaactgtgccctgccttca

SEQ ID NO: 2126724 - DNA, 19 bp, Homo sapiens
aaactgttaatagttcagg

SEQ ID NO: 2126725 - DNA, 22 bp, Homo sapiens
aaactgttcaagaaataataaa

SEQ ID NO: 2126726 - DNA, 16 bp, Homo sapiens
aaactgtttatggtat

SEQ ID NO: 2126727 - DNA, 20 bp, Homo sapiens
aaactgtttatggtattttc

SEQ ID NO: 2126728 - DNA, 18 bp, Homo sapiens
aaacttagaataaaattg

SEQ ID NO: 2126729 - DNA, 12 bp, Homo sapiens
aaacttatttga

SEQ ID NO: 2126730 - DNA, 14 bp, Homo sapiens
aaacttatttgagt

SEQ ID NO: 2126731 - DNA, 12 bp, Homo sapiens
aaacttcagaaa

SEQ ID NO: 2126732 - DNA, 13 bp, Homo sapiens
aaacttcagcacc

SEQ ID NO: 2126733 - DNA, 13 bp, Homo sapiens
aaacttgaatctg

SEQ ID NO: 2126734 - DNA, 22 bp, Homo sapiens
aaacttgaatctgttactgaaa

SEQ ID NO: 2126735 - DNA, 13 bp, Homo sapiens
aaacttgacccag

SEQ ID NO: 2126736 - DNA, 11 bp, Homo sapiens
aaacttgtaaa

SEQ ID NO: 2126737 - DNA, 18 bp, Homo sapiens
aaactttcatttttggta

SEQ ID NO: 2126738 - DNA, 19 bp, Homo sapiens
aaactttgatctctgctta

SEQ ID NO: 2126739 - DNA, 15 bp, Homo sapiens
aaactttgtgccttt

SEQ ID NO: 2126740 - DNA, 19 bp, Homo sapiens
aaacttttaatgccttcca

SEQ ID NO: 2126741 - DNA, 14 bp, Homo sapiens
aaagaaaaaaatat

SEQ ID NO: 2126742 - DNA, 22 bp, Homo sapiens
aaagaaaaaaatatattttatg

SEQ ID NO: 2126743 - DNA, 13 bp, Homo sapiens
aaagaaaaacaaa

SEQ ID NO: 2126744 - DNA, 23 bp, Homo sapiens
aaagaaaagataaagatgatcta

SEQ ID NO: 2126745 - DNA, 20 bp, Homo sapiens
aaagaaaccgtaattttatt

SEQ ID NO: 2126746 - DNA, 13 bp, Homo sapiens
aaagaaagggaaa

SEQ ID NO: 2126747 - DNA, 14 bp, Homo sapiens
aaagaacaagaaat

SEQ ID NO: 2126748 - DNA, 22 bp, Homo sapiens
aaagaaccaaaagttttcctga

SEQ ID NO: 2126749 - DNA, 15 bp, Homo sapiens
aaagaacggaagaag

SEQ ID NO: 2126750 - DNA, 23 bp, Homo sapiens
aaagaacggcatgtgaattctgt

SEQ ID NO: 2126751 - DNA, 20 bp, Homo sapiens
aaagaactccttattttgta

SEQ ID NO: 2126752 - DNA, 21 bp, Homo sapiens
aaagaactccttattttgtat

SEQ ID NO: 2126753 - DNA, 19 bp, Homo sapiens
aaaggggcgagcacccacg

SEQ ID NO: 2126754 - DNA, 17 bp, Homo sapiens
aaaggtagagatgtgtg

SEQ ID NO: 2126755 - DNA, 16 bp, Homo sapiens
aaaggtagatcatctt

SEQ ID NO: 2126756 - DNA, 13 bp, Homo sapiens
aaaggtatttaga

SEQ ID NO: 2126757 - DNA, 19 bp, Homo sapiens
aaaggtcattgtggctatc

SEQ ID NO: 2126758 - DNA, 18 bp, Homo sapiens
aaaggtctttttaaacca

SEQ ID NO: 2126759 - DNA, 21 bp, Homo sapiens
aaaggtggtatgtgtgtgtat

SEQ ID NO: 2126760 - DNA, 22 bp, Homo sapiens
aaaggttcttcatccctttcca

SEQ ID NO: 2126761 - DNA, 18 bp, Homo sapiens
aaaggtttatgaaaaaga

SEQ ID NO: 2126762 - DNA, 18 bp, Homo sapiens
aaagtaaaagaaccacga

SEQ ID NO: 2126763 - DNA, 16 bp, Homo sapiens
aaagtaattttgtgaa

SEQ ID NO: 2126764 - DNA, 12 bp, Homo sapiens
aaagtacattta

SEQ ID NO: 2126765 - DNA, 19 bp, Homo sapiens
aaagtacttctccaccctg

SEQ ID NO: 2126766 - DNA, 20 bp, Homo sapiens
aaagtacttctccaccctgc

SEQ ID NO: 2126767 - DNA, 14 bp, Homo sapiens
aaagtagaattata

SEQ ID NO: 2126768 - DNA, 17 bp, Homo sapiens
aaagtagaattatatct

SEQ ID NO: 2126769 - DNA, 21 bp, Homo sapiens
aaagtagaattatatctaatt

SEQ ID NO: 2126770 - DNA, 16 bp, Homo sapiens
aaagtatacttttgtt

SEQ ID NO: 2126771 - DNA, 13 bp, Homo sapiens
aaagtatatatag

SEQ ID NO: 2126772 - DNA, 15 bp, Homo sapiens
aaagtatatattcta

SEQ ID NO: 2126773 - DNA, 23 bp, Homo sapiens
aaagtatatatttatttaagctt

SEQ ID NO: 2126774 - DNA, 15 bp, Homo sapiens
aaagtatcatgcatt

SEQ ID NO: 2126775 - DNA, 16 bp, Homo sapiens
aaagtatcatgcattc

SEQ ID NO: 2126776 - DNA, 18 bp, Homo sapiens
aaagtcaaaaggtgcctg

SEQ ID NO: 2126777 - DNA, 13 bp, Homo sapiens
aaagtcacacaga

SEQ ID NO: 2126778 - DNA, 22 bp, Homo sapiens
aaagtctaaagtttacagtaaa

SEQ ID NO: 2126779 - DNA, 13 bp, Homo sapiens
aaagtctgagtgg

SEQ ID NO: 2126780 - DNA, 18 bp, Homo sapiens
aaagtctgagtgggcggc

SEQ ID NO: 2126781 - DNA, 15 bp, Homo sapiens
aaagtgaataaactt

SEQ ID NO: 2126782 - DNA, 23 bp, Homo sapiens
aaagtgagactgacacctcactg

SEQ ID NO: 2126783 - DNA, 22 bp, Homo sapiens
aaagtgatcagtatgctgtttt

SEQ ID NO: 2126784 - DNA, 15 bp, Homo sapiens
aaagtgcagcccttc

SEQ ID NO: 2126785 - DNA, 15 bp, Homo sapiens
aaagtgccactcatt

SEQ ID NO: 2126786 - DNA, 21 bp, Homo sapiens
aaagtgccccttaagggttga

SEQ ID NO: 2126787 - DNA, 14 bp, Homo sapiens
aaagtgctgggatt

SEQ ID NO: 2126788 - DNA, 12 bp, Homo sapiens
aaagtgctgttt

SEQ ID NO: 2126789 - DNA, 15 bp, Homo sapiens
aaagtggattttcct

SEQ ID NO: 2126790 - DNA, 17 bp, Homo sapiens
aaagtgtaaaatagaat

SEQ ID NO: 2126791 - DNA, 16 bp, Homo sapiens
aaagtgtagcaccctg

SEQ ID NO: 2126792 - DNA, 13 bp, Homo sapiens
aaagttaaaaaaa

SEQ ID NO: 2126793 - DNA, 23 bp, Homo sapiens
aaagttccctacttcctgtgact

SEQ ID NO: 2126794 - DNA, 19 bp, Homo sapiens
aaagttcctgttcacctta

SEQ ID NO: 2126795 - DNA, 23 bp, Homo sapiens
aaagttgtagttcttgtgcatgt

SEQ ID NO: 2126796 - DNA, 12 bp, Homo sapiens
aaagtttaataa

SEQ ID NO: 2126797 - DNA, 19 bp, Homo sapiens
aaagtttacaagtgtatat

SEQ ID NO: 2126798 - DNA, 15 bp, Homo sapiens
aaagtttacagtaaa

SEQ ID NO: 2126799 - DNA, 18 bp, Homo sapiens
aaagtttacagtaaataa

SEQ ID NO: 2126800 - DNA, 12 bp, Homo sapiens
aaagtttcaatg

SEQ ID NO: 2126801 - DNA, 21 bp, Homo sapiens
aaagtttctcttttcaaaaca

SEQ ID NO: 2126802 - DNA, 13 bp, Homo sapiens
aaagtttgccaga

SEQ ID NO: 2126803 - DNA, 15 bp, Homo sapiens
aaagtttgccagaag

SEQ ID NO: 2126804 - DNA, 15 bp, Homo sapiens
aaagttttcctgaga

SEQ ID NO: 2126805 - DNA, 18 bp, Homo sapiens
aaataaaaaaatacagta

SEQ ID NO: 2126806 - DNA, 16 bp, Homo sapiens
aaataaaaagtgcttt

SEQ ID NO: 2126807 - DNA, 13 bp, Homo sapiens
aaataaaaatatt

SEQ ID NO: 2126808 - DNA, 14 bp, Homo sapiens
aaataaaaatattc

SEQ ID NO: 2126809 - DNA, 18 bp, Homo sapiens
aaataaaaatattctcca

SEQ ID NO: 2126810 - DNA, 20 bp, Homo sapiens
aaataaaaatattctccatg

SEQ ID NO: 2126811 - DNA, 12 bp, Homo sapiens
aaataaaacctt

SEQ ID NO: 2126812 - DNA, 14 bp, Homo sapiens
aaataaaacctttc

SEQ ID NO: 2126813 - DNA, 11 bp, Homo sapiens
aaataaaagca

SEQ ID NO: 2126814 - DNA, 13 bp, Homo sapiens
aaataaaagcagc

SEQ ID NO: 2126815 - DNA, 13 bp, Homo sapiens
aaataaaattatg

SEQ ID NO: 2126816 - DNA, 22 bp, Homo sapiens
aaataaaccaaaggacattatg

SEQ ID NO: 2126817 - DNA, 21 bp, Homo sapiens
aaataaacctggagatgatga

SEQ ID NO: 2126818 - DNA, 13 bp, Homo sapiens
aaataaacttatt

SEQ ID NO: 2126819 - DNA, 17 bp, Homo sapiens
aaataaagctactgaat

SEQ ID NO: 2126820 - DNA, 18 bp, Homo sapiens
aaataaagtatcatgcat

SEQ ID NO: 2126821 - DNA, 16 bp, Homo sapiens
aaataaatagcctctt

SEQ ID NO: 2126822 - DNA, 12 bp, Homo sapiens
aaataaatataa

SEQ ID NO: 2126823 - DNA, 13 bp, Homo sapiens
aaataaatataat

SEQ ID NO: 2126824 - DNA, 13 bp, Homo sapiens
aaataaatgcaat

SEQ ID NO: 2126825 - DNA, 14 bp, Homo sapiens
aaataaatggaaat

SEQ ID NO: 2126826 - DNA, 16 bp, Homo sapiens
aaataaatgtatcata

SEQ ID NO: 2126827 - DNA, 11 bp, Homo sapiens
aaataaatgtg

SEQ ID NO: 2126828 - DNA, 17 bp, Homo sapiens
aaataaattatattaat

SEQ ID NO: 2126829 - DNA, 15 bp, Homo sapiens
aaataaattcaaacc

SEQ ID NO: 2126830 - DNA, 22 bp, Homo sapiens
aaataaattggtgataagtgga

SEQ ID NO: 2126831 - DNA, 19 bp, Homo sapiens
aaataaatttggttctaat

SEQ ID NO: 2126832 - DNA, 23 bp, Homo sapiens
aaataaattttgaatgtttatgt

SEQ ID NO: 2126833 - DNA, 19 bp, Homo sapiens
aaataaattttgtttcaga

SEQ ID NO: 2126834 - DNA, 17 bp, Homo sapiens
aaataactagtgttgct

SEQ ID NO: 2126835 - DNA, 12 bp, Homo sapiens
aaataagaaact

SEQ ID NO: 2126836 - DNA, 16 bp, Homo sapiens
aaataagtttttgttt

SEQ ID NO: 2126837 - DNA, 17 bp, Homo sapiens
aaataatgtaagggtct

SEQ ID NO: 2126838 - DNA, 23 bp, Homo sapiens
aaataatgtaagggtctgttgta

SEQ ID NO: 2126839 - DNA, 17 bp, Homo sapiens
aaataattgatttcaag

SEQ ID NO: 2126840 - DNA, 16 bp, Homo sapiens
aaataatttaactaat

SEQ ID NO: 2126841 - DNA, 12 bp, Homo sapiens
aaataattttaa

SEQ ID NO: 2126842 - DNA, 13 bp, Homo sapiens
aaatacaaaataa

SEQ ID NO: 2126843 - DNA, 19 bp, Homo sapiens
aaatacaaacaagcacaga

SEQ ID NO: 2126844 - DNA, 23 bp, Homo sapiens
aaatacacagatgattaaacaga

SEQ ID NO: 2126845 - DNA, 23 bp, Homo sapiens
aaatacaccacctcactcctgtt

SEQ ID NO: 2126846 - DNA, 17 bp, Homo sapiens
aaatacaccacgaattt

SEQ ID NO: 2126847 - DNA, 14 bp, Homo sapiens
aaatacagacacta

SEQ ID NO: 2126848 - DNA, 16 bp, Homo sapiens
aaatacagacactaag

SEQ ID NO: 2126849 - DNA, 22 bp, Homo sapiens
aaatacagacactaagttatag

SEQ ID NO: 2126850 - DNA, 14 bp, Homo sapiens
aaatacagtaaagt

SEQ ID NO: 2126851 - DNA, 16 bp, Homo sapiens
aaatacagtggatctc

SEQ ID NO: 2126852 - DNA, 13 bp, Homo sapiens
aaatactacacat

SEQ ID NO: 2126853 - DNA, 15 bp, Homo sapiens
aaatactccaagctt

SEQ ID NO: 2126854 - DNA, 21 bp, Homo sapiens
aaatactgtacatagatgtat

SEQ ID NO: 2126855 - DNA, 23 bp, Homo sapiens
aaatactgtacatagatgtatca

SEQ ID NO: 2126856 - DNA, 22 bp, Homo sapiens
aaatagaagaatacaaacatat

SEQ ID NO: 2126857 - DNA, 16 bp, Homo sapiens
aaatagacagtatatt

SEQ ID NO: 2126858 - DNA, 19 bp, Homo sapiens
aaatagacagtatatttat

SEQ ID NO: 2126859 - DNA, 17 bp, Homo sapiens
aaatagatttgattatt

SEQ ID NO: 2126860 - DNA, 17 bp, Homo sapiens
aaatagcaaaagaagaa

SEQ ID NO: 2126861 - DNA, 19 bp, Homo sapiens
aaatagcctcttaggtaaa

SEQ ID NO: 2126862 - DNA, 13 bp, Homo sapiens
aaatagctctttc

SEQ ID NO: 2126863 - DNA, 20 bp, Homo sapiens
aaatatgattttatttgaca

SEQ ID NO: 2126864 - DNA, 13 bp, Homo sapiens
aaatatgcaaagc

SEQ ID NO: 2126865 - DNA, 15 bp, Homo sapiens
aaatatgcaaagcac

SEQ ID NO: 2126866 - DNA, 17 bp, Homo sapiens
aaatatgcaaagcactg

SEQ ID NO: 2126867 - DNA, 16 bp, Homo sapiens
aaatatggaacttcta

SEQ ID NO: 2126868 - DNA, 19 bp, Homo sapiens
aaatatggctataaatata

SEQ ID NO: 2126869 - DNA, 12 bp, Homo sapiens
aaatatgttcta

SEQ ID NO: 2126870 - DNA, 14 bp, Homo sapiens
aaatatgtttgtgc

SEQ ID NO: 2126871 - DNA, 15 bp, Homo sapiens
aaatatgtttgtgcc

SEQ ID NO: 2126872 - DNA, 20 bp, Homo sapiens
aaatattataacttaaaaaa

SEQ ID NO: 2126873 - DNA, 23 bp, Homo sapiens
aaatattattgtggaaatgaata

SEQ ID NO: 2126874 - DNA, 16 bp, Homo sapiens
aaatattctgtaagaa

SEQ ID NO: 2126875 - DNA, 15 bp, Homo sapiens
aaatatttaacatag

SEQ ID NO: 2126876 - DNA, 12 bp, Homo sapiens
aaatatttaagt

SEQ ID NO: 2126877 - DNA, 17 bp, Homo sapiens
aaatatttaagtatata

SEQ ID NO: 2126878 - DNA, 21 bp, Homo sapiens
aaatatttacatatgaaattt

SEQ ID NO: 2126879 - DNA, 15 bp, Homo sapiens
aaatatttatatatt

SEQ ID NO: 2126880 - DNA, 15 bp, Homo sapiens
aaatatttatgtaaa

SEQ ID NO: 2126881 - DNA, 19 bp, Homo sapiens
aaatatttcatgattcaca

SEQ ID NO: 2126882 - DNA, 15 bp, Homo sapiens
aaatattttaaagaa

SEQ ID NO: 2126883 - DNA, 18 bp, Homo sapiens
aaatattttaaagaattg

SEQ ID NO: 2126884 - DNA, 18 bp, Homo sapiens
aaatcaaaagctgcttga

SEQ ID NO: 2126885 - DNA, 14 bp, Homo sapiens
aaatcaaccccaga

SEQ ID NO: 2126886 - DNA, 16 bp, Homo sapiens
aaatcacaagcaataa

SEQ ID NO: 2126887 - DNA, 17 bp, Homo sapiens
aaatcacaagcaataat

SEQ ID NO: 2126888 - DNA, 18 bp, Homo sapiens
aaatcacaagcaataatt

SEQ ID NO: 2126889 - DNA, 19 bp, Homo sapiens
aaatcacaagcaataatta

SEQ ID NO: 2126890 - DNA, 20 bp, Homo sapiens
aaatcacgctttttgaaaaa

SEQ ID NO: 2126891 - DNA, 21 bp, Homo sapiens
aaatcactgaggcatttttac

SEQ ID NO: 2126892 - DNA, 13 bp, Homo sapiens
aaatcacttgtaa

SEQ ID NO: 2126893 - DNA, 16 bp, Homo sapiens
aaatcacttgtaaata

SEQ ID NO: 2126894 - DNA, 23 bp, Homo sapiens
aaatcacttgtaaataaatagat

SEQ ID NO: 2126895 - DNA, 14 bp, Homo sapiens
aaatcagtcttgga

SEQ ID NO: 2126896 - DNA, 16 bp, Homo sapiens
aaatcagttatgtcaa

SEQ ID NO: 2126897 - DNA, 11 bp, Homo sapiens
aaatcagttgt

SEQ ID NO: 2126898 - DNA, 14 bp, Homo sapiens
aaatcataaactgt

SEQ ID NO: 2126899 - DNA, 17 bp, Homo sapiens
aaatcatcgaaaattca

SEQ ID NO: 2126900 - DNA, 21 bp, Homo sapiens
aaatcattgctttgaagcagt

SEQ ID NO: 2126901 - DNA, 14 bp, Homo sapiens
aaatcattgtagaa

SEQ ID NO: 2126902 - DNA, 20 bp, Homo sapiens
aaatcattgtagaaacacag

SEQ ID NO: 2126903 - DNA, 11 bp, Homo sapiens
aaatcatttct

SEQ ID NO: 2126904 - DNA, 23 bp, Homo sapiens
aaatcatttctgcatcagctgct

SEQ ID NO: 2126905 - DNA, 11 bp, Homo sapiens
aaatccaaaga

SEQ ID NO: 2126906 - DNA, 14 bp, Homo sapiens
aaatccagaaagaa

SEQ ID NO: 2126907 - DNA, 19 bp, Homo sapiens
aaatccagtgtgcacccct

SEQ ID NO: 2126908 - DNA, 20 bp, Homo sapiens
aaatccagttacgggtggag

SEQ ID NO: 2126909 - DNA, 16 bp, Homo sapiens
aaatccagtttcccac

SEQ ID NO: 2126910 - DNA, 21 bp, Homo sapiens
aaatcccattcataactttca

SEQ ID NO: 2126911 - DNA, 17 bp, Homo sapiens
aaatccccccttcagaa

SEQ ID NO: 2126912 - DNA, 18 bp, Homo sapiens
aaatccccccttcagaac

SEQ ID NO: 2126913 - DNA, 22 bp, Homo sapiens
aaatccccggctgcttccttct

SEQ ID NO: 2126914 - DNA, 17 bp, Homo sapiens
aaatccctgtttaatat

SEQ ID NO: 2126915 - DNA, 12 bp, Homo sapiens
aaatcctcacca

SEQ ID NO: 2126916 - DNA, 11 bp, Homo sapiens
aaatcctctgg

SEQ ID NO: 2126917 - DNA, 18 bp, Homo sapiens
aaatcctcttctaactca

SEQ ID NO: 2126918 - DNA, 20 bp, Homo sapiens
aaatcgaatgaaattaactg

SEQ ID NO: 2126919 - DNA, 18 bp, Homo sapiens
aaatctaatattaaaaat

SEQ ID NO: 2126920 - DNA, 19 bp, Homo sapiens
aaatctagttttttttgta

SEQ ID NO: 2126921 - DNA, 21 bp, Homo sapiens
aaatctagttttttttgtaaa

SEQ ID NO: 2126922 - DNA, 22 bp, Homo sapiens
aaatctatattaaagtgttata

SEQ ID NO: 2126923 - DNA, 12 bp, Homo sapiens
aaatctcattcc

SEQ ID NO: 2126924 - DNA, 16 bp, Homo sapiens
aaatctgatttaatgt

SEQ ID NO: 2126925 - DNA, 18 bp, Homo sapiens
aaatctgatttaatgttt

SEQ ID NO: 2126926 - DNA, 19 bp, Homo sapiens
aaatctgatttaatgtttt

SEQ ID NO: 2126927 - DNA, 17 bp, Homo sapiens
aaatctggcaaagttat

SEQ ID NO: 2126928 - DNA, 22 bp, Homo sapiens
aaatctgtatatgttgtaataa

SEQ ID NO: 2126929 - DNA, 19 bp, Homo sapiens
aaatctgtttgatccctgt

SEQ ID NO: 2126930 - DNA, 13 bp, Homo sapiens
aaatctgttttgt

SEQ ID NO: 2126931 - DNA, 19 bp, Homo sapiens
aaatctgttttgtatatga

SEQ ID NO: 2126932 - DNA, 19 bp, Homo sapiens
aaatcttatattccatata

SEQ ID NO: 2126933 - DNA, 21 bp, Homo sapiens
aaatcttatattccatatatt

SEQ ID NO: 2126934 - DNA, 22 bp, Homo sapiens
aaatcttcaaggtgtaaaatat

SEQ ID NO: 2126935 - DNA, 22 bp, Homo sapiens
aaatcttggttgatgccaaaaa

SEQ ID NO: 2126936 - DNA, 17 bp, Homo sapiens
aaatgaaaatcgtgaca

SEQ ID NO: 2126937 - DNA, 17 bp, Homo sapiens
aaatgaaaatgtaactt

SEQ ID NO: 2126938 - DNA, 11 bp, Homo sapiens
aaatgaaaatt

SEQ ID NO: 2126939 - DNA, 21 bp, Homo sapiens
aaatgaaacaaataatcacat

SEQ ID NO: 2126940 - DNA, 13 bp, Homo sapiens
aaatgaaatgtct

SEQ ID NO: 2126941 - DNA, 14 bp, Homo sapiens
aaatgaaatgtctt

SEQ ID NO: 2126942 - DNA, 15 bp, Homo sapiens
aaatgaaattgtaaa

SEQ ID NO: 2126943 - DNA, 23 bp, Homo sapiens
aaatgaacgatatgtagcagaaa

SEQ ID NO: 2126944 - DNA, 23 bp, Homo sapiens
aaatgaagagacttaagaaagct

SEQ ID NO: 2126945 - DNA, 11 bp, Homo sapiens
aaatgaagtgc

SEQ ID NO: 2126946 - DNA, 14 bp, Homo sapiens
aaatgacatgcact

SEQ ID NO: 2126947 - DNA, 17 bp, Homo sapiens
aaatgacatgcactgac

SEQ ID NO: 2126948 - DNA, 15 bp, Homo sapiens
aaatgaccaagaaaa

SEQ ID NO: 2126949 - DNA, 17 bp, Homo sapiens
aaatgaccaagaaaaag

SEQ ID NO: 2126950 - DNA, 18 bp, Homo sapiens
aaatgaccaagaaaaaga

SEQ ID NO: 2126951 - DNA, 17 bp, Homo sapiens
aaatgacctcagcaaat

SEQ ID NO: 2126952 - DNA, 14 bp, Homo sapiens
aaatgagctcctgc

SEQ ID NO: 2126953 - DNA, 13 bp, Homo sapiens
aaatgaggaaact

SEQ ID NO: 2126954 - DNA, 12 bp, Homo sapiens
aaatgagtgtgt

SEQ ID NO: 2126955 - DNA, 18 bp, Homo sapiens
aaatgagtgtgtttgtca

SEQ ID NO: 2126956 - DNA, 15 bp, Homo sapiens
aaatgataaagatgt

SEQ ID NO: 2126957 - DNA, 13 bp, Homo sapiens
aaatgattttcat

SEQ ID NO: 2126958 - DNA, 17 bp, Homo sapiens
aaatgcaaacactgtgt

SEQ ID NO: 2126959 - DNA, 20 bp, Homo sapiens
aaatgcaaacactgtgtatt

SEQ ID NO: 2126960 - DNA, 13 bp, Homo sapiens
aaatgcaatatgt

SEQ ID NO: 2126961 - DNA, 21 bp, Homo sapiens
aaatgcagcgaaccaatattt

SEQ ID NO: 2126962 - DNA, 20 bp, Homo sapiens
aaatgcatccattcctcagg

SEQ ID NO: 2126963 - DNA, 12 bp, Homo sapiens
aaatgcatgatt

SEQ ID NO: 2126964 - DNA, 13 bp, Homo sapiens
aaatgcatgattt

SEQ ID NO: 2126965 - DNA, 15 bp, Homo sapiens
aaatgcatgatttta

SEQ ID NO: 2126966 - DNA, 16 bp, Homo sapiens
aaatgcatgattttat

SEQ ID NO: 2126967 - DNA, 21 bp, Homo sapiens
aaatgcatgattttatacata

SEQ ID NO: 2126968 - DNA, 11 bp, Homo sapiens
aaatgcccagt

SEQ ID NO: 2126969 - DNA, 12 bp, Homo sapiens
aaatgcccagtt

SEQ ID NO: 2126970 - DNA, 15 bp, Homo sapiens
aaatgcctaataaac

SEQ ID NO: 2126971 - DNA, 18 bp, Homo sapiens
aaatgcttctgttgtaat

SEQ ID NO: 2126972 - DNA, 19 bp, Homo sapiens
aaatgctttgtgtgattga

SEQ ID NO: 2126973 - DNA, 16 bp, Homo sapiens
aaatggaaaagagaga

SEQ ID NO: 2126974 - DNA, 19 bp, Homo sapiens
aaatggccatttgcttttt

SEQ ID NO: 2126975 - DNA, 17 bp, Homo sapiens
aaatggctctgtgaaat

SEQ ID NO: 2126976 - DNA, 18 bp, Homo sapiens
aaatggtcgcccaggaga

SEQ ID NO: 2126977 - DNA, 14 bp, Homo sapiens
aaatggtgtttttt

SEQ ID NO: 2126978 - DNA, 17 bp, Homo sapiens
aaatgtaaaagtactct

SEQ ID NO: 2126979 - DNA, 23 bp, Homo sapiens
aaatgtaacttttcttacagcac

SEQ ID NO: 2126980 - DNA, 16 bp, Homo sapiens
aaatgtaagggaaact

SEQ ID NO: 2126981 - DNA, 13 bp, Homo sapiens
aaaccagcaggtg

SEQ ID NO: 2126982 - DNA, 11 bp, Homo sapiens
aaaccagctgc

SEQ ID NO: 2126983 - DNA, 12 bp, Homo sapiens
aaaccagggagc

SEQ ID NO: 2126984 - DNA, 16 bp, Homo sapiens
aaaccagggtgcatgg

SEQ ID NO: 2126985 - DNA, 20 bp, Homo sapiens
aaaccagtatggaagggagg

SEQ ID NO: 2126986 - DNA, 18 bp, Homo sapiens
aaaccagttaagaatgga

SEQ ID NO: 2126987 - DNA, 23 bp, Homo sapiens
aaaccagtttagatttcaagaaa

SEQ ID NO: 2126988 - DNA, 15 bp, Homo sapiens
aaaccataaacttca

SEQ ID NO: 2126989 - DNA, 23 bp, Homo sapiens
aaaccatccatctgtggaaatga

SEQ ID NO: 2126990 - DNA, 15 bp, Homo sapiens
aaaccatgcaaatgc

SEQ ID NO: 2126991 - DNA, 14 bp, Homo sapiens
aaaccatgcagctt

SEQ ID NO: 2126992 - DNA, 18 bp, Homo sapiens
aaaccatttaattcataa

SEQ ID NO: 2126993 - DNA, 13 bp, Homo sapiens
aaaccatttcaaa

SEQ ID NO: 2126994 - DNA, 14 bp, Homo sapiens
aaaccatttcaaat

SEQ ID NO: 2126995 - DNA, 17 bp, Homo sapiens
aaacccaaataaatgtg

SEQ ID NO: 2126996 - DNA, 23 bp, Homo sapiens
aaacccaaataaatgtgtaaatg

SEQ ID NO: 2126997 - DNA, 19 bp, Homo sapiens
agtttatttgttgagagtg

SEQ ID NO: 2126998 - DNA, 14 bp, Homo sapiens
agtttattttgtta

SEQ ID NO: 2126999 - DNA, 18 bp, Homo sapiens
agtttattttttctacac

SEQ ID NO: 2127000 - DNA, 23 bp, Homo sapiens
agtttattttttctacacagtaa

SEQ ID NO: 2127001 - DNA, 22 bp, Homo sapiens
agtttcaatgtgattctaatgt

SEQ ID NO: 2127002 - DNA, 14 bp, Homo sapiens
agtttcagatatat

SEQ ID NO: 2127003 - DNA, 19 bp, Homo sapiens
agtttcagtaaataatgaa

SEQ ID NO: 2127004 - DNA, 21 bp, Homo sapiens
agtttcagtaaataatgaaaa

SEQ ID NO: 2127005 - DNA, 16 bp, Homo sapiens
agtttcatataaagta

SEQ ID NO: 2127006 - DNA, 10 bp, Homo sapiens
agtttcccca

SEQ ID NO: 2127007 - DNA, 18 bp, Homo sapiens
agtttcctcatctgcaga

SEQ ID NO: 2127008 - DNA, 20 bp, Homo sapiens
agtttcgaggggtcctcacc

SEQ ID NO: 2127009 - DNA, 16 bp, Homo sapiens
agtttctagaggcctc

SEQ ID NO: 2127010 - DNA, 15 bp, Homo sapiens
agtttctattgtaaa

SEQ ID NO: 2127011 - DNA, 20 bp, Homo sapiens
agtttctcctttattgctcc

SEQ ID NO: 2127012 - DNA, 18 bp, Homo sapiens
ataaagattttttaataa

SEQ ID NO: 2127013 - DNA, 12 bp, Homo sapiens
ataaagcaaata

SEQ ID NO: 2127014 - DNA, 16 bp, Homo sapiens
ataaagcaagctcaac

SEQ ID NO: 2127015 - DNA, 15 bp, Homo sapiens
ataaagcagtagaca

SEQ ID NO: 2127016 - DNA, 12 bp, Homo sapiens
ataaagctactg

SEQ ID NO: 2127017 - DNA, 18 bp, Homo sapiens
ataaaggaagtcaccaaa

SEQ ID NO: 2127018 - DNA, 15 bp, Homo sapiens
ataaaggtctttgca

SEQ ID NO: 2127019 - DNA, 23 bp, Homo sapiens
ataaagtactttagcctggtacc

SEQ ID NO: 2127020 - DNA, 14 bp, Homo sapiens
ataaagtatctaca

SEQ ID NO: 2127021 - DNA, 21 bp, Homo sapiens
ataaagtcacttccagtgttg

SEQ ID NO: 2127022 - DNA, 17 bp, Homo sapiens
ataaagtctgagtgggc

SEQ ID NO: 2127023 - DNA, 17 bp, Homo sapiens
ataaagttgataaagat

SEQ ID NO: 2127024 - DNA, 20 bp, Homo sapiens
ataaagttgataaagatttt

SEQ ID NO: 2127025 - DNA, 17 bp, Homo sapiens
ataaagttggtgacaga

SEQ ID NO: 2127026 - DNA, 13 bp, Homo sapiens
ataaataaatgcc

SEQ ID NO: 2127027 - DNA, 21 bp, Homo sapiens
ataaataatcggcccacagct

SEQ ID NO: 2127028 - DNA, 15 bp, Homo sapiens
ataaataatctgtac

SEQ ID NO: 2127029 - DNA, 14 bp, Homo sapiens
ataaatataattgg

SEQ ID NO: 2127030 - DNA, 15 bp, Homo sapiens
ataaatataattggg

SEQ ID NO: 2127031 - DNA, 21 bp, Homo sapiens
ataaatatatatttttcaacc

SEQ ID NO: 2127032 - DNA, 22 bp, Homo sapiens
ataaatctgagcctaaatctaa

SEQ ID NO: 2127033 - DNA, 15 bp, Homo sapiens
ataaatgaatcttac

SEQ ID NO: 2127034 - DNA, 18 bp, Homo sapiens
ataaatgcaatatgtatt

SEQ ID NO: 2127035 - DNA, 13 bp, Homo sapiens
ataaatgcatgat

SEQ ID NO: 2127036 - DNA, 16 bp, Homo sapiens
ataaatgcatgatttt

SEQ ID NO: 2127037 - DNA, 21 bp, Homo sapiens
ataaatgcatgattttataca

SEQ ID NO: 2127038 - DNA, 14 bp, Homo sapiens
ataaatggaaatca

SEQ ID NO: 2127039 - DNA, 13 bp, Homo sapiens
ataaatggctggt

SEQ ID NO: 2127040 - DNA, 15 bp, Homo sapiens
ataaatgtacattaa

SEQ ID NO: 2127041 - DNA, 17 bp, Homo sapiens
ataaatgtatatacaca

SEQ ID NO: 2127042 - DNA, 18 bp, Homo sapiens
ataaatgtatatacacat

SEQ ID NO: 2127043 - DNA, 20 bp, Homo sapiens
ataaatgtatatacacatat

SEQ ID NO: 2127044 - DNA, 21 bp, Homo sapiens
ataaatgtatcatagaaatgt

SEQ ID NO: 2127045 - DNA, 15 bp, Homo sapiens
ataaatgtatcttat

SEQ ID NO: 2127046 - DNA, 12 bp, Homo sapiens
ataaatgtctgt

SEQ ID NO: 2127047 - DNA, 13 bp, Homo sapiens
ataaatgtgtaaa

SEQ ID NO: 2127048 - DNA, 21 bp, Homo sapiens
ataaatgtgtaaatgtggaca

SEQ ID NO: 2127049 - DNA, 12 bp, Homo sapiens
ataaatgtttaa

SEQ ID NO: 2127050 - DNA, 14 bp, Homo sapiens
ataaatgtttgtct

SEQ ID NO: 2127051 - DNA, 15 bp, Homo sapiens
ataaattaagacttt

SEQ ID NO: 2127052 - DNA, 23 bp, Homo sapiens
ataaattatattaatttttgaaa

SEQ ID NO: 2127053 - DNA, 13 bp, Homo sapiens
ataaattcaaacc

SEQ ID NO: 2127054 - DNA, 15 bp, Homo sapiens
ataaattcaaaccat

SEQ ID NO: 2127055 - DNA, 18 bp, Homo sapiens
ataaattgctccttgaca

SEQ ID NO: 2127056 - DNA, 18 bp, Homo sapiens
ataaattggtgataagtg

SEQ ID NO: 2127057 - DNA, 20 bp, Homo sapiens
ataaattggtgataagtgga

SEQ ID NO: 2127058 - DNA, 21 bp, Homo sapiens
ataaattggtgataagtggaa

SEQ ID NO: 2127059 - DNA, 20 bp, Homo sapiens
ataaatttggttctaataga

SEQ ID NO: 2127060 - DNA, 14 bp, Homo sapiens
ataaattttgtttc

SEQ ID NO: 2127061 - DNA, 13 bp, Homo sapiens
ataacaaaatcac

SEQ ID NO: 2127062 - DNA, 15 bp, Homo sapiens
ataacaaaatcacaa

SEQ ID NO: 2127063 - DNA, 21 bp, Homo sapiens
ataacaaaatcacaagcaata

SEQ ID NO: 2127064 - DNA, 13 bp, Homo sapiens
ataacaagaaaat

SEQ ID NO: 2127065 - DNA, 19 bp, Homo sapiens
ataacaagatctttcagga

SEQ ID NO: 2127066 - DNA, 14 bp, Homo sapiens
ataacaatgtatgt

SEQ ID NO: 2127067 - DNA, 16 bp, Homo sapiens
ataacaatgtgctctc

SEQ ID NO: 2127068 - DNA, 14 bp, Homo sapiens
ataacacaatatga

SEQ ID NO: 2127069 - DNA, 23 bp, Homo sapiens
ataacactataaaggttgacaat

SEQ ID NO: 2127070 - DNA, 12 bp, Homo sapiens
ataacactgtct

SEQ ID NO: 2127071 - DNA, 11 bp, Homo sapiens
ataacatcttt

SEQ ID NO: 2127072 - DNA, 19 bp, Homo sapiens
ataacatctttgaaaagaa

SEQ ID NO: 2127073 - DNA, 21 bp, Homo sapiens
ataacatctttgaaaagaaaa

SEQ ID NO: 2127074 - DNA, 20 bp, Homo sapiens
ataacatttgagtatccgat

SEQ ID NO: 2127075 - DNA, 19 bp, Homo sapiens
ataaccatcagttactggt

SEQ ID NO: 2127076 - DNA, 23 bp, Homo sapiens
ataaccatcagttactggtttca

SEQ ID NO: 2127077 - DNA, 13 bp, Homo sapiens
ataaccccacctt

SEQ ID NO: 2127078 - DNA, 20 bp, Homo sapiens
ataaccccagctccctagga

SEQ ID NO: 2127079 - DNA, 17 bp, Homo sapiens
ataacgtttaagccaaa

SEQ ID NO: 2127080 - DNA, 19 bp, Homo sapiens
ataactaatgctaagaaat

SEQ ID NO: 2127081 - DNA, 15 bp, Homo sapiens
ataactagaaacctg

SEQ ID NO: 2127082 - DNA, 17 bp, Homo sapiens
ataactagatctcctgt

SEQ ID NO: 2127083 - DNA, 13 bp, Homo sapiens
ataactagtttaa

SEQ ID NO: 2127084 - DNA, 15 bp, Homo sapiens
ataactcatcataaa

SEQ ID NO: 2127085 - DNA, 14 bp, Homo sapiens
ataactgaaggaga

SEQ ID NO: 2127086 - DNA, 16 bp, Homo sapiens
ataactgaaggagaag

SEQ ID NO: 2127087 - DNA, 12 bp, Homo sapiens
ataactgagaat

SEQ ID NO: 2127088 - DNA, 20 bp, Homo sapiens
ataactgcaaagtgaagttg

SEQ ID NO: 2127089 - DNA, 15 bp, Homo sapiens
ataactgcatagtaa

SEQ ID NO: 2127090 - DNA, 22 bp, Homo sapiens
ataactgtcatctagccccttc

SEQ ID NO: 2127091 - DNA, 17 bp, Homo sapiens
ataacttcagagaagtc

SEQ ID NO: 2127092 - DNA, 18 bp, Homo sapiens
ataacttcagagaagtca

SEQ ID NO: 2127093 - DNA, 15 bp, Homo sapiens
ataacttgatataga

SEQ ID NO: 2127094 - DNA, 16 bp, Homo sapiens
ataacttgctgaattt

SEQ ID NO: 2127095 - DNA, 16 bp, Homo sapiens
ataactttagaaataa

SEQ ID NO: 2127096 - DNA, 22 bp, Homo sapiens
ataactttagaaataagaagca

SEQ ID NO: 2127097 - DNA, 18 bp, Homo sapiens
ataagaatggagcagtac

SEQ ID NO: 2127098 - DNA, 15 bp, Homo sapiens
ataagaattaatctt

SEQ ID NO: 2127099 - DNA, 20 bp, Homo sapiens
ataagaccgtgtcccaagga

SEQ ID NO: 2127100 - DNA, 18 bp, Homo sapiens
ataagagaaagaaaatga

SEQ ID NO: 2127101 - DNA, 14 bp, Homo sapiens
ataagattaaagga

SEQ ID NO: 2127102 - DNA, 20 bp, Homo sapiens
ataagcaaattagtaattgt

SEQ ID NO: 2127103 - DNA, 23 bp, Homo sapiens
ataagcatgatcttgttaatgca

SEQ ID NO: 2127104 - DNA, 13 bp, Homo sapiens
ataaggaagttat

SEQ ID NO: 2127105 - DNA, 14 bp, Homo sapiens
ataaggaagttatt

SEQ ID NO: 2127106 - DNA, 14 bp, Homo sapiens
ataaggaggaaaac

SEQ ID NO: 2127107 - DNA, 22 bp, Homo sapiens
ataaggatcagaacagcagagg

SEQ ID NO: 2127108 - DNA, 16 bp, Homo sapiens
ataaggccagaaactc

SEQ ID NO: 2127109 - DNA, 16 bp, Homo sapiens
ataaggcctgccctcc

SEQ ID NO: 2127110 - DNA, 18 bp, Homo sapiens
ataaggggcacctgggaa

SEQ ID NO: 2127111 - DNA, 16 bp, Homo sapiens
ataagtgctgtttgag

SEQ ID NO: 2127112 - DNA, 17 bp, Homo sapiens
ataagtgctgtttgaga

SEQ ID NO: 2127113 - DNA, 22 bp, Homo sapiens
ataagtgctgtttgagatgtga

SEQ ID NO: 2127114 - DNA, 17 bp, Homo sapiens
ataagtgggagctaaat

SEQ ID NO: 2127115 - DNA, 13 bp, Homo sapiens
ataataaaaagac

SEQ ID NO: 2127116 - DNA, 15 bp, Homo sapiens
ataataaatgtacat

SEQ ID NO: 2127117 - DNA, 20 bp, Homo sapiens
ataataggatataaaacaca

SEQ ID NO: 2127118 - DNA, 18 bp, Homo sapiens
ataatataccaatgcttt

SEQ ID NO: 2127119 - DNA, 17 bp, Homo sapiens
ataatatcttgaagaat

SEQ ID NO: 2127120 - DNA, 19 bp, Homo sapiens
ataatatcttgaagaatat

SEQ ID NO: 2127121 - DNA, 22 bp, Homo sapiens
ataatatcttgaagaatattgt

SEQ ID NO: 2127122 - DNA, 14 bp, Homo sapiens
ataatatgtttgag

SEQ ID NO: 2127123 - DNA, 20 bp, Homo sapiens
ataatatttttaattaaata

SEQ ID NO: 2127124 - DNA, 18 bp, Homo sapiens
ataatcaaagctacctgt

SEQ ID NO: 2127125 - DNA, 16 bp, Homo sapiens
ataatcagcctcttaa

SEQ ID NO: 2127126 - DNA, 22 bp, Homo sapiens
ataatcggcccacagctcccac

SEQ ID NO: 2127127 - DNA, 22 bp, Homo sapiens
ataatctggactcctctgtcca

SEQ ID NO: 2127128 - DNA, 13 bp, Homo sapiens
ataatctttgggt

SEQ ID NO: 2127129 - DNA, 22 bp, Homo sapiens
agagtagatggtgaaatttatt

SEQ ID NO: 2127130 - DNA, 18 bp, Homo sapiens
agagtagccgagagcctg

SEQ ID NO: 2127131 - DNA, 22 bp, Homo sapiens
agagtagccgagagcctgctcc

SEQ ID NO: 2127132 - DNA, 14 bp, Homo sapiens
agagtagtttttca

SEQ ID NO: 2127133 - DNA, 23 bp, Homo sapiens
agagtataggatggattgcagtc

SEQ ID NO: 2127134 - DNA, 13 bp, Homo sapiens
agagtatatatgt

SEQ ID NO: 2127135 - DNA, 20 bp, Homo sapiens
agagtatgcaagaagaatat

SEQ ID NO: 2127136 - DNA, 21 bp, Homo sapiens
agagtcactgaccctggagcg

SEQ ID NO: 2127137 - DNA, 16 bp, Homo sapiens
agagtcagaggagaag

SEQ ID NO: 2127138 - DNA, 18 bp, Homo sapiens
agagtcagccttccccct

SEQ ID NO: 2127139 - DNA, 15 bp, Homo sapiens
agagtcattgttaca

SEQ ID NO: 2127140 - DNA, 12 bp, Homo sapiens
agagtcctattt

SEQ ID NO: 2127141 - DNA, 12 bp, Homo sapiens
agagtcctttgg

SEQ ID NO: 2127142 - DNA, 17 bp, Homo sapiens
agagtctgaaagacaga

SEQ ID NO: 2127143 - DNA, 13 bp, Homo sapiens
agagtctgagccc

SEQ ID NO: 2127144 - DNA, 12 bp, Homo sapiens
agagtctgtctc

SEQ ID NO: 2127145 - DNA, 22 bp, Homo sapiens
agagtgacacccaagagggctg

SEQ ID NO: 2127146 - DNA, 21 bp, Homo sapiens
agagtgagaataattgtgtac

SEQ ID NO: 2127147 - DNA, 22 bp, Homo sapiens
agagtgagaataattgtgtaca

SEQ ID NO: 2127148 - DNA, 15 bp, Homo sapiens
agagtgagaatctgg

SEQ ID NO: 2127149 - DNA, 22 bp, Homo sapiens
agagtgagaatctggctcctgt

SEQ ID NO: 2127150 - DNA, 21 bp, Homo sapiens
agagtgattcaggggctcccc

SEQ ID NO: 2127151 - DNA, 12 bp, Homo sapiens
agagtgctgaga

SEQ ID NO: 2127152 - DNA, 20 bp, Homo sapiens
agagtggagcaaatgcttaa

SEQ ID NO: 2127153 - DNA, 18 bp, Homo sapiens
agagtggagtctgagtct

SEQ ID NO: 2127154 - DNA, 23 bp, Homo sapiens
agagtggctcctcccggtgccca

SEQ ID NO: 2127155 - DNA, 16 bp, Homo sapiens
agagtgggctgcctgg

SEQ ID NO: 2127156 - DNA, 14 bp, Homo sapiens
agagtgtgaccaaa

SEQ ID NO: 2127157 - DNA, 20 bp, Homo sapiens
agagttaatatatagaaggg

SEQ ID NO: 2127158 - DNA, 15 bp, Homo sapiens
agagttattcaaatg

SEQ ID NO: 2127159 - DNA, 18 bp, Homo sapiens
agagttattcaaatgaag

SEQ ID NO: 2127160 - DNA, 19 bp, Homo sapiens
agagttattgaatcttaat

SEQ ID NO: 2127161 - DNA, 18 bp, Homo sapiens
agagttcaagaaataagt

SEQ ID NO: 2127162 - DNA, 16 bp, Homo sapiens
agagttcaagcctgtg

SEQ ID NO: 2127163 - DNA, 17 bp, Homo sapiens
agagttccacaaatcta

SEQ ID NO: 2127164 - DNA, 22 bp, Homo sapiens
agagttccacaaatctatatta

SEQ ID NO: 2127165 - DNA, 21 bp, Homo sapiens
agagttctttaggtgcctcct

SEQ ID NO: 2127166 - DNA, 23 bp, Homo sapiens
agagttctttaggtgcctcctgt

SEQ ID NO: 2127167 - DNA, 15 bp, Homo sapiens
agagtttaacacaag

SEQ ID NO: 2127168 - DNA, 13 bp, Homo sapiens
agagtttgaagga

SEQ ID NO: 2127169 - DNA, 15 bp, Homo sapiens
agataaagatgatct

SEQ ID NO: 2127170 - DNA, 21 bp, Homo sapiens
agataacaagatctttcagga

SEQ ID NO: 2127171 - DNA, 21 bp, Homo sapiens
agataaccagctgtaacacag

SEQ ID NO: 2127172 - DNA, 16 bp, Homo sapiens
agataatatctgtgag

SEQ ID NO: 2127173 - DNA, 16 bp, Homo sapiens
agataatttattttgt

SEQ ID NO: 2127174 - DNA, 17 bp, Homo sapiens
agataatttattttgta

SEQ ID NO: 2127175 - DNA, 19 bp, Homo sapiens
agataatttattttgtatt

SEQ ID NO: 2127176 - DNA, 13 bp, Homo sapiens
agatacactcctg

SEQ ID NO: 2127177 - DNA, 14 bp, Homo sapiens
agatacactcctgc

SEQ ID NO: 2127178 - DNA, 23 bp, Homo sapiens
agatacagccccaaaccagggtg

SEQ ID NO: 2127179 - DNA, 22 bp, Homo sapiens
agatacattccctatcaaaaca

SEQ ID NO: 2127180 - DNA, 17 bp, Homo sapiens
agatactgttgatcttt

SEQ ID NO: 2127181 - DNA, 13 bp, Homo sapiens
agatagaatttcc

SEQ ID NO: 2127182 - DNA, 16 bp, Homo sapiens
agataggtgcttttaa

SEQ ID NO: 2127183 - DNA, 19 bp, Homo sapiens
agatagtgctttattttgt

SEQ ID NO: 2127184 - DNA, 23 bp, Homo sapiens
agatagttaaaagactgcagctg

SEQ ID NO: 2127185 - DNA, 23 bp, Homo sapiens
agatagttttgccagaacagttt

SEQ ID NO: 2127186 - DNA, 12 bp, Homo sapiens
agatataaaatc

SEQ ID NO: 2127187 - DNA, 15 bp, Homo sapiens
agatataaatggctg

SEQ ID NO: 2127188 - DNA, 14 bp, Homo sapiens
agatatacaaatat

SEQ ID NO: 2127189 - DNA, 23 bp, Homo sapiens
agatatacaaatatatttaattg

SEQ ID NO: 2127190 - DNA, 15 bp, Homo sapiens
agatatattttgagt

SEQ ID NO: 2127191 - DNA, 16 bp, Homo sapiens
agatatatttttcaca

SEQ ID NO: 2127192 - DNA, 15 bp, Homo sapiens
agatatcagagctct

SEQ ID NO: 2127193 - DNA, 18 bp, Homo sapiens
agatatcagagctcttaa

SEQ ID NO: 2127194 - DNA, 15 bp, Homo sapiens
agatatgagttgttt

SEQ ID NO: 2127195 - DNA, 13 bp, Homo sapiens
agatatgcaaaag

SEQ ID NO: 2127196 - DNA, 11 bp, Homo sapiens
agatatgcaca

SEQ ID NO: 2127197 - DNA, 19 bp, Homo sapiens
agatatgctaagcagtagt

SEQ ID NO: 2127198 - DNA, 14 bp, Homo sapiens
agatattgcactag

SEQ ID NO: 2127199 - DNA, 13 bp, Homo sapiens
agatatttatata

SEQ ID NO: 2127200 - DNA, 17 bp, Homo sapiens
agatatttatatatatt

SEQ ID NO: 2127201 - DNA, 23 bp, Homo sapiens
agatatttattgtttatttatca

SEQ ID NO: 2127202 - DNA, 20 bp, Homo sapiens
agatatttccatttcttcct

SEQ ID NO: 2127203 - DNA, 23 bp, Homo sapiens
agatatttttgtacgttatatat

SEQ ID NO: 2127204 - DNA, 19 bp, Homo sapiens
agatcaaccccttcgctcc

SEQ ID NO: 2127205 - DNA, 18 bp, Homo sapiens
agatcaaggagcccagaa

SEQ ID NO: 2127206 - DNA, 14 bp, Homo sapiens
agatcacgccactg

SEQ ID NO: 2127207 - DNA, 15 bp, Homo sapiens
agatcacgccactgc

SEQ ID NO: 2127208 - DNA, 16 bp, Homo sapiens
agatcacgccactgca

SEQ ID NO: 2127209 - DNA, 17 bp, Homo sapiens
agatcaggaagagaagg

SEQ ID NO: 2127210 - DNA, 18 bp, Homo sapiens
agatcaggaagagaagga

SEQ ID NO: 2127211 - DNA, 21 bp, Homo sapiens
agatcatccagaagttcctca

SEQ ID NO: 2127212 - DNA, 15 bp, Homo sapiens
agatccacacacaga

SEQ ID NO: 2127213 - DNA, 13 bp, Homo sapiens
agatccaccctca

SEQ ID NO: 2127214 - DNA, 21 bp, Homo sapiens
agatccaccctcaaatgtcag

SEQ ID NO: 2127215 - DNA, 21 bp, Homo sapiens
agatccatttggacaaaatgg

SEQ ID NO: 2127216 - DNA, 22 bp, Homo sapiens
agatcccatccatcagctccct

SEQ ID NO: 2127217 - DNA, 18 bp, Homo sapiens
agatcccatgtcacctca

SEQ ID NO: 2127218 - DNA, 17 bp, Homo sapiens
agatcctaactgagaat

SEQ ID NO: 2127219 - DNA, 15 bp, Homo sapiens
agatcgcgccactgc

SEQ ID NO: 2127220 - DNA, 16 bp, Homo sapiens
agatcgcttgagccca

SEQ ID NO: 2127221 - DNA, 17 bp, Homo sapiens
agatcgtattaattatc

SEQ ID NO: 2127222 - DNA, 20 bp, Homo sapiens
agatcgtattaattatctga

SEQ ID NO: 2127223 - DNA, 22 bp, Homo sapiens
agatcgtgccgttactctccaa

SEQ ID NO: 2127224 - DNA, 16 bp, Homo sapiens
agatcgttagtatcta

SEQ ID NO: 2127225 - DNA, 14 bp, Homo sapiens
agatctagaaagtg

SEQ ID NO: 2127226 - DNA, 22 bp, Homo sapiens
agatctcagataaagtgaccag

SEQ ID NO: 2127227 - DNA, 20 bp, Homo sapiens
agatctcctgtaattttgta

SEQ ID NO: 2127228 - DNA, 18 bp, Homo sapiens
agatctgatggtgagctg

SEQ ID NO: 2127229 - DNA, 23 bp, Homo sapiens
agatctgatggtgagctgggaag

SEQ ID NO: 2127230 - DNA, 12 bp, Homo sapiens
agatctgcctgg

SEQ ID NO: 2127231 - DNA, 17 bp, Homo sapiens
agatctgcctgggcctg

SEQ ID NO: 2127232 - DNA, 19 bp, Homo sapiens
agatctgcctgggcctgtg

SEQ ID NO: 2127233 - DNA, 20 bp, Homo sapiens
agatctgcctgggcctgtgc

SEQ ID NO: 2127234 - DNA, 23 bp, Homo sapiens
agatctgcttcttcatcttgaca

SEQ ID NO: 2127235 - DNA, 12 bp, Homo sapiens
agatctgtcttg

SEQ ID NO: 2127236 - DNA, 16 bp, Homo sapiens
agatcttacatctgca

SEQ ID NO: 2127237 - DNA, 19 bp, Homo sapiens
agatcttcaaacagaataa

SEQ ID NO: 2127238 - DNA, 13 bp, Homo sapiens
agatcttgtctcc

SEQ ID NO: 2127239 - DNA, 16 bp, Homo sapiens
agatcttgtctccact

SEQ ID NO: 2127240 - DNA, 23 bp, Homo sapiens
agatgaaagaggaggtttggggt

SEQ ID NO: 2127241 - DNA, 20 bp, Homo sapiens
ataatgaacagcagaaagac

SEQ ID NO: 2127242 - DNA, 12 bp, Homo sapiens
ataatgccactg

SEQ ID NO: 2127243 - DNA, 16 bp, Homo sapiens
ataatggaagagaaat

SEQ ID NO: 2127244 - DNA, 16 bp, Homo sapiens
atataaacttgtgtat

SEQ ID NO: 2127245 - DNA, 23 bp, Homo sapiens
atataaacttgtgtatgatccaa

SEQ ID NO: 2127246 - DNA, 17 bp, Homo sapiens
atataaattaagacttt

SEQ ID NO: 2127247 - DNA, 15 bp, Homo sapiens
atataaccattacat

SEQ ID NO: 2127248 - DNA, 14 bp, Homo sapiens
atataagacaagaa

SEQ ID NO: 2127249 - DNA, 16 bp, Homo sapiens
atataaggaggaaaac

SEQ ID NO: 2127250 - DNA, 14 bp, Homo sapiens
atataatactaaag

SEQ ID NO: 2127251 - DNA, 16 bp, Homo sapiens
atataatactaaagtg

SEQ ID NO: 2127252 - DNA, 16 bp, Homo sapiens
atataatggaagagaa

SEQ ID NO: 2127253 - DNA, 22 bp, Homo sapiens
atataatggaagagaaatctca

SEQ ID NO: 2127254 - DNA, 19 bp, Homo sapiens
atataatggtttactgctg

SEQ ID NO: 2127255 - DNA, 20 bp, Homo sapiens
atataatggtttactgctgt

SEQ ID NO: 2127256 - DNA, 22 bp, Homo sapiens
atataatgttgttatttaaaga

SEQ ID NO: 2127257 - DNA, 18 bp, Homo sapiens
atataattgttttatctg

SEQ ID NO: 2127258 - DNA, 15 bp, Homo sapiens
atatacaaacatgtg

SEQ ID NO: 2127259 - DNA, 14 bp, Homo sapiens
atatacaaataaac

SEQ ID NO: 2127260 - DNA, 14 bp, Homo sapiens
atatacaaatatat

SEQ ID NO: 2127261 - DNA, 18 bp, Homo sapiens
atatacaataacataatt

SEQ ID NO: 2127262 - DNA, 22 bp, Homo sapiens
atatacacatacatacacatac

SEQ ID NO: 2127263 - DNA, 13 bp, Homo sapiens
atatacatatata

SEQ ID NO: 2127264 - DNA, 14 bp, Homo sapiens
atatacatatatat

SEQ ID NO: 2127265 - DNA, 15 bp, Homo sapiens
atatacatatatata

SEQ ID NO: 2127266 - DNA, 23 bp, Homo sapiens
atatacatatatatatacacata

SEQ ID NO: 2127267 - DNA, 15 bp, Homo sapiens
atatacatgtgtgta

SEQ ID NO: 2127268 - DNA, 17 bp, Homo sapiens
atatacatgtgtgtata

SEQ ID NO: 2127269 - DNA, 21 bp, Homo sapiens
atatacatgtgtgtatatatg

SEQ ID NO: 2127270 - DNA, 11 bp, Homo sapiens
atatacatttc

SEQ ID NO: 2127271 - DNA, 12 bp, Homo sapiens
atatacatttca

SEQ ID NO: 2127272 - DNA, 14 bp, Homo sapiens
atatacctataatg

SEQ ID NO: 2127273 - DNA, 16 bp, Homo sapiens
atatactatacaacaa

SEQ ID NO: 2127274 - DNA, 15 bp, Homo sapiens
atatagagatgtttt

SEQ ID NO: 2127275 - DNA, 18 bp, Homo sapiens
atatagctatcatttctt

SEQ ID NO: 2127276 - DNA, 13 bp, Homo sapiens
atataggaagcat

SEQ ID NO: 2127277 - DNA, 19 bp, Homo sapiens
atatataaaaagaaaagat

SEQ ID NO: 2127278 - DNA, 12 bp, Homo sapiens
atatataaatat

SEQ ID NO: 2127279 - DNA, 15 bp, Homo sapiens
atatatacacataca

SEQ ID NO: 2127280 - DNA, 17 bp, Homo sapiens
atatatacacatacata

SEQ ID NO: 2127281 - DNA, 23 bp, Homo sapiens
atatatacacatacatacacata

SEQ ID NO: 2127282 - DNA, 16 bp, Homo sapiens
atatatacatacactt

SEQ ID NO: 2127283 - DNA, 18 bp, Homo sapiens
atatatacatacacttgt

SEQ ID NO: 2127284 - DNA, 13 bp, Homo sapiens
atatatacatatg

SEQ ID NO: 2127285 - DNA, 17 bp, Homo sapiens
atatatacatgtatagt

SEQ ID NO: 2127286 - DNA, 19 bp, Homo sapiens
atatatacatgtatagtga

SEQ ID NO: 2127287 - DNA, 15 bp, Homo sapiens
atatatagtgctata

SEQ ID NO: 2127288 - DNA, 16 bp, Homo sapiens
atatatagtgctatat

SEQ ID NO: 2127289 - DNA, 16 bp, Homo sapiens
atatatatacatatgt

SEQ ID NO: 2127290 - DNA, 13 bp, Homo sapiens
atatatatatagt

SEQ ID NO: 2127291 - DNA, 14 bp, Homo sapiens
atatatatatattt

SEQ ID NO: 2127292 - DNA, 12 bp, Homo sapiens
atatatatatgt

SEQ ID NO: 2127293 - DNA, 21 bp, Homo sapiens
atatatatctatctatttgag

SEQ ID NO: 2127294 - DNA, 22 bp, Homo sapiens
atatatatctgataaaattgtg

SEQ ID NO: 2127295 - DNA, 22 bp, Homo sapiens
atatatatgtatatgtatatat

SEQ ID NO: 2127296 - DNA, 14 bp, Homo sapiens
atatatatgtgtgt

SEQ ID NO: 2127297 - DNA, 14 bp, Homo sapiens
atatatattaaaat

SEQ ID NO: 2127298 - DNA, 13 bp, Homo sapiens
atatatattttaa

SEQ ID NO: 2127299 - DNA, 16 bp, Homo sapiens
atatatcagaatctgt

SEQ ID NO: 2127300 - DNA, 15 bp, Homo sapiens
atatatcagttataa

SEQ ID NO: 2127301 - DNA, 14 bp, Homo sapiens
atatatcataaagt

SEQ ID NO: 2127302 - DNA, 16 bp, Homo sapiens
atatatcataaagtat

SEQ ID NO: 2127303 - DNA, 13 bp, Homo sapiens
atatatcatattg

SEQ ID NO: 2127304 - DNA, 16 bp, Homo sapiens
atatatctatctattt

SEQ ID NO: 2127305 - DNA, 14 bp, Homo sapiens
atatatctatctta

SEQ ID NO: 2127306 - DNA, 13 bp, Homo sapiens
atatatgaggact

SEQ ID NO: 2127307 - DNA, 18 bp, Homo sapiens
atatatgctcaaccagaa

SEQ ID NO: 2127308 - DNA, 23 bp, Homo sapiens
atatatggcatatttatattgta

SEQ ID NO: 2127309 - DNA, 23 bp, Homo sapiens
atatatgtatatgtatatctata

SEQ ID NO: 2127310 - DNA, 19 bp, Homo sapiens
atatatgtgcagtatttta

SEQ ID NO: 2127311 - DNA, 21 bp, Homo sapiens
atatatgtgcagtattttatt

SEQ ID NO: 2127312 - DNA, 18 bp, Homo sapiens
atatatgtgtatatatac

SEQ ID NO: 2127313 - DNA, 21 bp, Homo sapiens
atatatgtgtatatatacata

SEQ ID NO: 2127314 - DNA, 14 bp, Homo sapiens
atatatgtgtgtgt

SEQ ID NO: 2127315 - DNA, 22 bp, Homo sapiens
atatatgttttaagaggcaggg

SEQ ID NO: 2127316 - DNA, 19 bp, Homo sapiens
atatattggtaacatcctt

SEQ ID NO: 2127317 - DNA, 12 bp, Homo sapiens
atatatttaaag

SEQ ID NO: 2127318 - DNA, 21 bp, Homo sapiens
atatatttataactcatcata

SEQ ID NO: 2127319 - DNA, 23 bp, Homo sapiens
atatatttataactcatcataaa

SEQ ID NO: 2127320 - DNA, 21 bp, Homo sapiens
atatatttgaatatcattaaa

SEQ ID NO: 2127321 - DNA, 13 bp, Homo sapiens
atatattttaatt

SEQ ID NO: 2127322 - DNA, 12 bp, Homo sapiens
atatcaattcaa

SEQ ID NO: 2127323 - DNA, 14 bp, Homo sapiens
atatcagaaaaggg

SEQ ID NO: 2127324 - DNA, 17 bp, Homo sapiens
atatcagaaaagggaag

SEQ ID NO: 2127325 - DNA, 13 bp, Homo sapiens
atatcagaaaagt

SEQ ID NO: 2127326 - DNA, 22 bp, Homo sapiens
atatcagaaaagtagaattata

SEQ ID NO: 2127327 - DNA, 18 bp, Homo sapiens
atatcagacctctgatcc

SEQ ID NO: 2127328 - DNA, 18 bp, Homo sapiens
atatcagagctcttaatg

SEQ ID NO: 2127329 - DNA, 12 bp, Homo sapiens
atatcagcctga

SEQ ID NO: 2127330 - DNA, 14 bp, Homo sapiens
atatcagcctgagt

SEQ ID NO: 2127331 - DNA, 22 bp, Homo sapiens
atatcagcctgagtctcctgtg

SEQ ID NO: 2127332 - DNA, 18 bp, Homo sapiens
atatcagttactcagccc

SEQ ID NO: 2127333 - DNA, 19 bp, Homo sapiens
atatcagttactcagccct

SEQ ID NO: 2127334 - DNA, 22 bp, Homo sapiens
atatcagttactcagccctggg

SEQ ID NO: 2127335 - DNA, 13 bp, Homo sapiens
atatcataaagta

SEQ ID NO: 2127336 - DNA, 18 bp, Homo sapiens
atatcatcagcatacctt

SEQ ID NO: 2127337 - DNA, 20 bp, Homo sapiens
atatcatcagcataccttta

SEQ ID NO: 2127338 - DNA, 14 bp, Homo sapiens
atatcatgaaacac

SEQ ID NO: 2127339 - DNA, 15 bp, Homo sapiens
atatcatgaaacact

SEQ ID NO: 2127340 - DNA, 18 bp, Homo sapiens
atatcatgaaacacttct

SEQ ID NO: 2127341 - DNA, 17 bp, Homo sapiens
atatcattaaattggaa

SEQ ID NO: 2127342 - DNA, 22 bp, Homo sapiens
atatccacagactccctcccct

SEQ ID NO: 2127343 - DNA, 16 bp, Homo sapiens
atatccacatctttaa

SEQ ID NO: 2127344 - DNA, 20 bp, Homo sapiens
atatccacatctttaagtat

SEQ ID NO: 2127345 - DNA, 13 bp, Homo sapiens
atatcctaaacat

SEQ ID NO: 2127346 - DNA, 16 bp, Homo sapiens
atatcctttgccccaa

SEQ ID NO: 2127347 - DNA, 16 bp, Homo sapiens
atatcggaggtggtgg

SEQ ID NO: 2127348 - DNA, 15 bp, Homo sapiens
atatctaatttatac

SEQ ID NO: 2127349 - DNA, 18 bp, Homo sapiens
atatctaatttatacaaa

SEQ ID NO: 2127350 - DNA, 21 bp, Homo sapiens
atatctatcttatatagttta

SEQ ID NO: 2127351 - DNA, 13 bp, Homo sapiens
atatctcctgaaa

SEQ ID NO: 2127352 - DNA, 15 bp, Homo sapiens
atatctcctgaaaag

SEQ ID NO: 2127353 - DNA, 22 bp, Homo sapiens
atatctcctgaaaaggtttatg

SEQ ID NO: 2127354 - DNA, 16 bp, Homo sapiens
atatctgaaaactgga

SEQ ID NO: 2127355 - DNA, 23 bp, Homo sapiens
atatctgaaaactggaataagaa

SEQ ID NO: 2127356 - DNA, 22 bp, Homo sapiens
atatctgaacacatactagaaa

SEQ ID NO: 2127357 - DNA, 20 bp, Homo sapiens
atatctgataaaattgtgat

SEQ ID NO: 2127358 - DNA, 13 bp, Homo sapiens
atatgaaaaatat

SEQ ID NO: 2127359 - DNA, 21 bp, Homo sapiens
atattttgtatatatctgctt

SEQ ID NO: 2127360 - DNA, 13 bp, Homo sapiens
atattttgtattt

SEQ ID NO: 2127361 - DNA, 15 bp, Homo sapiens
atatttttagctctg

SEQ ID NO: 2127362 - DNA, 16 bp, Homo sapiens
atatttttatatttag

SEQ ID NO: 2127363 - DNA, 13 bp, Homo sapiens
atatttttcaacc

SEQ ID NO: 2127364 - DNA, 20 bp, Homo sapiens
atatttttcaaccagcattt

SEQ ID NO: 2127365 - DNA, 21 bp, Homo sapiens
atatttttcaaccagcatttt

SEQ ID NO: 2127366 - DNA, 18 bp, Homo sapiens
atatttttggttgtcaat

SEQ ID NO: 2127367 - DNA, 15 bp, Homo sapiens
atattttttaaagtc

SEQ ID NO: 2127368 - DNA, 11 bp, Homo sapiens
atcaaaaataa

SEQ ID NO: 2127369 - DNA, 15 bp, Homo sapiens
atcaaaaataaacta

SEQ ID NO: 2127370 - DNA, 16 bp, Homo sapiens
atcaaaaataaactag

SEQ ID NO: 2127371 - DNA, 19 bp, Homo sapiens
atcaaaaataaactagttt

SEQ ID NO: 2127372 - DNA, 22 bp, Homo sapiens
atcaaaaataaactagtttcca

SEQ ID NO: 2127373 - DNA, 17 bp, Homo sapiens
atcaaaacatatcaatt

SEQ ID NO: 2127374 - DNA, 16 bp, Homo sapiens
atcaaaagctgcttga

SEQ ID NO: 2127375 - DNA, 19 bp, Homo sapiens
atcaaaataaattgaaata

SEQ ID NO: 2127376 - DNA, 20 bp, Homo sapiens
atcaaagcaagggctccagc

SEQ ID NO: 2127377 - DNA, 15 bp, Homo sapiens
atcaaagcagcacat

SEQ ID NO: 2127378 - DNA, 22 bp, Homo sapiens
atcaaagttcctgttcacctta

SEQ ID NO: 2127379 - DNA, 18 bp, Homo sapiens
atcaaatatgcaaagcac

SEQ ID NO: 2127380 - DNA, 20 bp, Homo sapiens
atcaaatatgcaaagcactg

SEQ ID NO: 2127381 - DNA, 19 bp, Homo sapiens
atcaaccccagacactggt

SEQ ID NO: 2127382 - DNA, 16 bp, Homo sapiens
atcaaccccagactca

SEQ ID NO: 2127383 - DNA, 15 bp, Homo sapiens
atcaagaaagtgttg

SEQ ID NO: 2127384 - DNA, 22 bp, Homo sapiens
atcaagagtgagtgaacaacta

SEQ ID NO: 2127385 - DNA, 22 bp, Homo sapiens
atcaagatgagagaactggagg

SEQ ID NO: 2127386 - DNA, 18 bp, Homo sapiens
atcaagatgtcagactgg

SEQ ID NO: 2127387 - DNA, 20 bp, Homo sapiens
atcaagcatgcaataatgtg

SEQ ID NO: 2127388 - DNA, 17 bp, Homo sapiens
atcaagctagaaggcca

SEQ ID NO: 2127389 - DNA, 12 bp, Homo sapiens
atcaagtcaccg

SEQ ID NO: 2127390 - DNA, 15 bp, Homo sapiens
atcaagtccagagcc

SEQ ID NO: 2127391 - DNA, 22 bp, Homo sapiens
atcaatcatctgtgtgaaaatg

SEQ ID NO: 2127392 - DNA, 14 bp, Homo sapiens
atcaatcctgcccc

SEQ ID NO: 2127393 - DNA, 20 bp, Homo sapiens
atcaatcctgcccccagcca

SEQ ID NO: 2127394 - DNA, 14 bp, Homo sapiens
atcaatggaaacag

SEQ ID NO: 2127395 - DNA, 21 bp, Homo sapiens
atcaatgttcacgcaacttga

SEQ ID NO: 2127396 - DNA, 22 bp, Homo sapiens
atcaatgttcacgcaacttgaa

SEQ ID NO: 2127397 - DNA, 13 bp, Homo sapiens
atcaattaaatgt

SEQ ID NO: 2127398 - DNA, 14 bp, Homo sapiens
atcaattaattctt

SEQ ID NO: 2127399 - DNA, 15 bp, Homo sapiens
atcaattcaacacat

SEQ ID NO: 2127400 - DNA, 23 bp, Homo sapiens
atcaattcaacacattacttgca

SEQ ID NO: 2127401 - DNA, 21 bp, Homo sapiens
atcaatttaaaatcattcaat

SEQ ID NO: 2127402 - DNA, 23 bp, Homo sapiens
atcaatttaaaatcattcaatat

SEQ ID NO: 2127403 - DNA, 14 bp, Homo sapiens
atcaatttcccaga

SEQ ID NO: 2127404 - DNA, 15 bp, Homo sapiens
atcaattttcacttg

SEQ ID NO: 2127405 - DNA, 20 bp, Homo sapiens
atcaattttcacttgcttaa

SEQ ID NO: 2127406 - DNA, 13 bp, Homo sapiens
atcaatttttata

SEQ ID NO: 2127407 - DNA, 15 bp, Homo sapiens
atcaatttttataca

SEQ ID NO: 2127408 - DNA, 17 bp, Homo sapiens
atcaatttttatacata

SEQ ID NO: 2127409 - DNA, 19 bp, Homo sapiens
atcaatttttatacatatc

SEQ ID NO: 2127410 - DNA, 16 bp, Homo sapiens
atcacaagcaataatt

SEQ ID NO: 2127411 - DNA, 18 bp, Homo sapiens
atcacaagcaataattag

SEQ ID NO: 2127412 - DNA, 15 bp, Homo sapiens
atcacacagccactt

SEQ ID NO: 2127413 - DNA, 18 bp, Homo sapiens
atcacacctctgggcttc

SEQ ID NO: 2127414 - DNA, 21 bp, Homo sapiens
atcacactctaagttctattg

SEQ ID NO: 2127415 - DNA, 21 bp, Homo sapiens
atcacagatgggtattaaact

SEQ ID NO: 2127416 - DNA, 20 bp, Homo sapiens
atcacaggggcggggcagga

SEQ ID NO: 2127417 - DNA, 23 bp, Homo sapiens
atcacagtgactttacaggaggt

SEQ ID NO: 2127418 - DNA, 15 bp, Homo sapiens
atcacatacaatttg

SEQ ID NO: 2127419 - DNA, 17 bp, Homo sapiens
atcacatacaatttgca

SEQ ID NO: 2127420 - DNA, 19 bp, Homo sapiens
atcacatacaatttgcact

SEQ ID NO: 2127421 - DNA, 20 bp, Homo sapiens
atcacatacaatttgcactg

SEQ ID NO: 2127422 - DNA, 16 bp, Homo sapiens
atcacattatttgcat

SEQ ID NO: 2127423 - DNA, 14 bp, Homo sapiens
atcaccatgtaaca

SEQ ID NO: 2127424 - DNA, 12 bp, Homo sapiens
atcacccaggct

SEQ ID NO: 2127425 - DNA, 15 bp, Homo sapiens
atcacccaggctgga

SEQ ID NO: 2127426 - DNA, 10 bp, Homo sapiens
atcacccagt

SEQ ID NO: 2127427 - DNA, 17 bp, Homo sapiens
atcacccagtcctggcc

SEQ ID NO: 2127428 - DNA, 21 bp, Homo sapiens
atcaccccttgaagccttttt

SEQ ID NO: 2127429 - DNA, 19 bp, Homo sapiens
atcacctactcacacaggc

SEQ ID NO: 2127430 - DNA, 14 bp, Homo sapiens
atcacctctcttca

SEQ ID NO: 2127431 - DNA, 14 bp, Homo sapiens
atcacctggagggc

SEQ ID NO: 2127432 - DNA, 21 bp, Homo sapiens
atcacctttttgacttttcca

SEQ ID NO: 2127433 - DNA, 23 bp, Homo sapiens
atcacgccactgcactccagcct

SEQ ID NO: 2127434 - DNA, 16 bp, Homo sapiens
atcactatctttctga

SEQ ID NO: 2127435 - DNA, 12 bp, Homo sapiens
atcactccctgg

SEQ ID NO: 2127436 - DNA, 10 bp, Homo sapiens
atcactggag

SEQ ID NO: 2127437 - DNA, 17 bp, Homo sapiens
atcactggagcaccagg

SEQ ID NO: 2127438 - DNA, 23 bp, Homo sapiens
atcactggagcaccaggcacgaa

SEQ ID NO: 2127439 - DNA, 13 bp, Homo sapiens
atcactggagccc

SEQ ID NO: 2127440 - DNA, 14 bp, Homo sapiens
atcactggagccca

SEQ ID NO: 2127441 - DNA, 15 bp, Homo sapiens
atcactggagcccag

SEQ ID NO: 2127442 - DNA, 17 bp, Homo sapiens
atcactggcaatatttg

SEQ ID NO: 2127443 - DNA, 16 bp, Homo sapiens
atcactggcaatgaaa

SEQ ID NO: 2127444 - DNA, 11 bp, Homo sapiens
atcacttgtaa

SEQ ID NO: 2127445 - DNA, 14 bp, Homo sapiens
atcacttgtaaata

SEQ ID NO: 2127446 - DNA, 16 bp, Homo sapiens
atcacttgtaaataaa

SEQ ID NO: 2127447 - DNA, 18 bp, Homo sapiens
atcacttgtacaaaataa

SEQ ID NO: 2127448 - DNA, 14 bp, Homo sapiens
atcactttgttaaa

SEQ ID NO: 2127449 - DNA, 19 bp, Homo sapiens
atcactttgttaaaaatat

SEQ ID NO: 2127450 - DNA, 14 bp, Homo sapiens
atcacttttcagtg

SEQ ID NO: 2127451 - DNA, 13 bp, Homo sapiens
atcagaaaaggga

SEQ ID NO: 2127452 - DNA, 15 bp, Homo sapiens
atcagaaaagggaag

SEQ ID NO: 2127453 - DNA, 23 bp, Homo sapiens
atcagaaaagtagaattatatct

SEQ ID NO: 2127454 - DNA, 14 bp, Homo sapiens
atcagaaagaggca

SEQ ID NO: 2127455 - DNA, 16 bp, Homo sapiens
atcagaaagggagggc

SEQ ID NO: 2127456 - DNA, 19 bp, Homo sapiens
atcagaaagggagggctct

SEQ ID NO: 2127457 - DNA, 21 bp, Homo sapiens
atcagaaagggagggctctga

SEQ ID NO: 2127458 - DNA, 13 bp, Homo sapiens
atcagaacagcag

SEQ ID NO: 2127459 - DNA, 14 bp, Homo sapiens
atcagaacagcaga

SEQ ID NO: 2127460 - DNA, 23 bp, Homo sapiens
atcagaagaccacaaaaattgac

SEQ ID NO: 2127461 - DNA, 13 bp, Homo sapiens
atcagaagataac

SEQ ID NO: 2127462 - DNA, 12 bp, Homo sapiens
atcagaaggaga

SEQ ID NO: 2127463 - DNA, 14 bp, Homo sapiens
atcagaattttacc

SEQ ID NO: 2127464 - DNA, 16 bp, Homo sapiens
atcagaccataatgtt

SEQ ID NO: 2127465 - DNA, 19 bp, Homo sapiens
atcagaccctaccccacca

SEQ ID NO: 2127466 - DNA, 21 bp, Homo sapiens
atcagagctcttaatgttgct

SEQ ID NO: 2127467 - DNA, 17 bp, Homo sapiens
atcagaggctgggggag

SEQ ID NO: 2127468 - DNA, 16 bp, Homo sapiens
atcagagtgacatcca

SEQ ID NO: 2127469 - DNA, 12 bp, Homo sapiens
atcagcactgaa

SEQ ID NO: 2127470 - DNA, 13 bp, Homo sapiens
atcagcactgaaa

SEQ ID NO: 2127471 - DNA, 17 bp, Homo sapiens
atcagccccgctcctcc

SEQ ID NO: 2127472 - DNA, 17 bp, Homo sapiens
atcagcctgagtctcct

SEQ ID NO: 2127473 - DNA, 19 bp, Homo sapiens
atcagcctgagtctcctgt

SEQ ID NO: 2127474 - DNA, 15 bp, Homo sapiens
atcagcgtggccttg

SEQ ID NO: 2127475 - DNA, 21 bp, Homo sapiens
atcagcgtggccttgttctgt

SEQ ID NO: 2127476 - DNA, 18 bp, Homo sapiens
atcagctacttaagagaa

SEQ ID NO: 2127477 - DNA, 19 bp, Homo sapiens
atcagctcccttcccctgc

SEQ ID NO: 2127478 - DNA, 22 bp, Homo sapiens
atcagctcccttcccctgcctg

SEQ ID NO: 2127479 - DNA, 21 bp, Homo sapiens
atcagctgctgaaacaacaaa

SEQ ID NO: 2127480 - DNA, 19 bp, Homo sapiens
atcagcttttaataaaatt

SEQ ID NO: 2127481 - DNA, 15 bp, Homo sapiens
atcaggacttgggaa

SEQ ID NO: 2127482 - DNA, 18 bp, Homo sapiens
atcaggcctaatctcata

SEQ ID NO: 2127483 - DNA, 15 bp, Homo sapiens
atcaggctatgtatg

SEQ ID NO: 2127484 - DNA, 23 bp, Homo sapiens
atcaggcttggaatgaattctct

SEQ ID NO: 2127485 - DNA, 16 bp, Homo sapiens
atcaggtcctcagaga

SEQ ID NO: 2127486 - DNA, 17 bp, Homo sapiens
atcaggtgctgccatcc

SEQ ID NO: 2127487 - DNA, 15 bp, Homo sapiens
atcaggttccatccc

SEQ ID NO: 2127488 - DNA, 17 bp, Homo sapiens
atcaggttgttaatgtt

SEQ ID NO: 2127489 - DNA, 22 bp, Homo sapiens
atcagtatgctgttttaataat

SEQ ID NO: 2127490 - DNA, 20 bp, Homo sapiens
atcagtatgggaaccccaaa

SEQ ID NO: 2127491 - DNA, 19 bp, Homo sapiens
atcagtctgattcccaagc

SEQ ID NO: 2127492 - DNA, 16 bp, Homo sapiens
atcagtgcttaatgtg

SEQ ID NO: 2127493 - DNA, 17 bp, Homo sapiens
atcagttactcagccct

SEQ ID NO: 2127494 - DNA, 21 bp, Homo sapiens
atcagttactcagccctgggc

SEQ ID NO: 2127495 - DNA, 17 bp, Homo sapiens
atcagttatattcttta

SEQ ID NO: 2127496 - DNA, 17 bp, Homo sapiens
atcataaggaagttatt

SEQ ID NO: 2127497 - DNA, 20 bp, Homo sapiens
atcatataataaatgtacat

SEQ ID NO: 2127498 - DNA, 21 bp, Homo sapiens
atcatattggtattcactaat

SEQ ID NO: 2127499 - DNA, 22 bp, Homo sapiens
atcatcagcatacctttattgt

SEQ ID NO: 2127500 - DNA, 15 bp, Homo sapiens
atcatcagtgtagaa

SEQ ID NO: 2127501 - DNA, 14 bp, Homo sapiens
atcatccagaagtt

SEQ ID NO: 2127502 - DNA, 14 bp, Homo sapiens
atcatcccagctgc

SEQ ID NO: 2127503 - DNA, 12 bp, Homo sapiens
atcatcctcctt

SEQ ID NO: 2127504 - DNA, 20 bp, Homo sapiens
atcatcgaaaattcatttca

SEQ ID NO: 2127505 - DNA, 19 bp, Homo sapiens
atcatctgtgtgaaaatgg

SEQ ID NO: 2127506 - DNA, 11 bp, Homo sapiens
atcatcttgaa

SEQ ID NO: 2127507 - DNA, 16 bp, Homo sapiens
atcatcttgaatattt

SEQ ID NO: 2127508 - DNA, 15 bp, Homo sapiens
atcatgaaaagtgct

SEQ ID NO: 2127509 - DNA, 18 bp, Homo sapiens
atcatgaatatttcaaaa

SEQ ID NO: 2127510 - DNA, 16 bp, Homo sapiens
atcatgcattcacaag

SEQ ID NO: 2127511 - DNA, 15 bp, Homo sapiens
atcatgcctctgagg

SEQ ID NO: 2127512 - DNA, 22 bp, Homo sapiens
atcatgcctctgaggccagcct

SEQ ID NO: 2127513 - DNA, 20 bp, Homo sapiens
atcatgctttaaagtgtaat

SEQ ID NO: 2127514 - DNA, 19 bp, Homo sapiens
atcatgggaaaagaccagg

SEQ ID NO: 2127515 - DNA, 16 bp, Homo sapiens
atcatgtgcctggaaa

SEQ ID NO: 2127516 - DNA, 17 bp, Homo sapiens
atcatgtgcctggaaat

SEQ ID NO: 2127517 - DNA, 18 bp, Homo sapiens
atcatgttggccaggctg

SEQ ID NO: 2127518 - DNA, 23 bp, Homo sapiens
atcattataaacgtgatgatcag

SEQ ID NO: 2127519 - DNA, 14 bp, Homo sapiens
atcattcaaaacaa

SEQ ID NO: 2127520 - DNA, 16 bp, Homo sapiens
atcattctttcccctc

SEQ ID NO: 2127521 - DNA, 23 bp, Homo sapiens
atcattgctttgaagcagttgtg

SEQ ID NO: 2127522 - DNA, 13 bp, Homo sapiens
atcattgtagaaa

SEQ ID NO: 2127523 - DNA, 20 bp, Homo sapiens
atcatttctgcatcagctgc

SEQ ID NO: 2127524 - DNA, 14 bp, Homo sapiens
atcattttttactt

SEQ ID NO: 2127525 - DNA, 21 bp, Homo sapiens
atccaaagaaaaagggctgcc

SEQ ID NO: 2127526 - DNA, 15 bp, Homo sapiens
atccaaaggaatcag

SEQ ID NO: 2127527 - DNA, 11 bp, Homo sapiens
atccaaagtaa

SEQ ID NO: 2127528 - DNA, 23 bp, Homo sapiens
atccaaggaacctaattgaaatt

SEQ ID NO: 2127529 - DNA, 13 bp, Homo sapiens
atccaaggagaaa

SEQ ID NO: 2127530 - DNA, 14 bp, Homo sapiens
atccaaggagaaac

SEQ ID NO: 2127531 - DNA, 22 bp, Homo sapiens
atccaaggagaaacagagacag

SEQ ID NO: 2127532 - DNA, 19 bp, Homo sapiens
atccaagttgaaatcagaa

SEQ ID NO: 2127533 - DNA, 21 bp, Homo sapiens
atccaagttgaaatcagaagc

SEQ ID NO: 2127534 - DNA, 22 bp, Homo sapiens
atccaatcctcaggatttcatt

SEQ ID NO: 2127535 - DNA, 17 bp, Homo sapiens
atccaattatgtgacaa

SEQ ID NO: 2127536 - DNA, 20 bp, Homo sapiens
atccacacacagaggaagag

SEQ ID NO: 2127537 - DNA, 16 bp, Homo sapiens
atccacagccaacaaa

SEQ ID NO: 2127538 - DNA, 21 bp, Homo sapiens
atccacagccaacaaacatag

SEQ ID NO: 2127539 - DNA, 16 bp, Homo sapiens
atccacccacctcagc

SEQ ID NO: 2127540 - DNA, 18 bp, Homo sapiens
atccacccacctcagcct

SEQ ID NO: 2127541 - DNA, 13 bp, Homo sapiens
atccacccagtgc

SEQ ID NO: 2127542 - DNA, 14 bp, Homo sapiens
atccacccagtgct

SEQ ID NO: 2127543 - DNA, 18 bp, Homo sapiens
atccacccagtgctgcca

SEQ ID NO: 2127544 - DNA, 20 bp, Homo sapiens
atccacccagtgctgccatg

SEQ ID NO: 2127545 - DNA, 22 bp, Homo sapiens
atccacccagtgctgccatgcc

SEQ ID NO: 2127546 - DNA, 23 bp, Homo sapiens
atccacccagtgctgccatgcca

SEQ ID NO: 2127547 - DNA, 18 bp, Homo sapiens
atccaccctcaaatgtca

SEQ ID NO: 2127548 - DNA, 15 bp, Homo sapiens
atccacgcacacatg

SEQ ID NO: 2127549 - DNA, 21 bp, Homo sapiens
atccacttcttaatgctttcc

SEQ ID NO: 2127550 - DNA, 22 bp, Homo sapiens
atccagaaaatgtgtcagcatg

SEQ ID NO: 2127551 - DNA, 13 bp, Homo sapiens
atccagcctgtgt

SEQ ID NO: 2127552 - DNA, 20 bp, Homo sapiens
atccagcctgtgtgttctgt

SEQ ID NO: 2127553 - DNA, 16 bp, Homo sapiens
atccaggttcagcttg

SEQ ID NO: 2127554 - DNA, 17 bp, Homo sapiens
atccaggttcagcttgt

SEQ ID NO: 2127555 - DNA, 15 bp, Homo sapiens
atccagtaagcacat

SEQ ID NO: 2127556 - DNA, 17 bp, Homo sapiens
atccagttgcaataaaa

SEQ ID NO: 2127557 - DNA, 21 bp, Homo sapiens
atccagttgcaataaaatagt

SEQ ID NO: 2127558 - DNA, 15 bp, Homo sapiens
atccagtttcccacc

SEQ ID NO: 2127559 - DNA, 15 bp, Homo sapiens
atccagtttgttctc

SEQ ID NO: 2127560 - DNA, 21 bp, Homo sapiens
atccatcagctcccttttctt

SEQ ID NO: 2127561 - DNA, 14 bp, Homo sapiens
atccatcaggactt

SEQ ID NO: 2127562 - DNA, 14 bp, Homo sapiens
atccattcctcagg

SEQ ID NO: 2127563 - DNA, 13 bp, Homo sapiens
atccatttcagtt

SEQ ID NO: 2127564 - DNA, 22 bp, Homo sapiens
atccatttcatctatttctgag

SEQ ID NO: 2127565 - DNA, 23 bp, Homo sapiens
atccatttcatctatttctgaga

SEQ ID NO: 2127566 - DNA, 16 bp, Homo sapiens
atcccaaacttcggaa

SEQ ID NO: 2127567 - DNA, 16 bp, Homo sapiens
atcccaaaggacagcc

SEQ ID NO: 2127568 - DNA, 20 bp, Homo sapiens
atcccaaaggacagccgcct

SEQ ID NO: 2127569 - DNA, 23 bp, Homo sapiens
atcccacagtggcacggagagaa

SEQ ID NO: 2127570 - DNA, 20 bp, Homo sapiens
atcccacattcggaccctgc

SEQ ID NO: 2127571 - DNA, 23 bp, Homo sapiens
atcccacattcggaccctgccca

SEQ ID NO: 2127572 - DNA, 15 bp, Homo sapiens
atcccacccacatgt

SEQ ID NO: 2127573 - DNA, 23 bp, Homo sapiens
atcccacccacatgtgacacata

SEQ ID NO: 2127574 - DNA, 17 bp, Homo sapiens
atcccagaaattagaaa

SEQ ID NO: 2127575 - DNA, 23 bp, Homo sapiens
atctaatttatacaaaataattt

SEQ ID NO: 2127576 - DNA, 14 bp, Homo sapiens
atctacacagcctg

SEQ ID NO: 2127577 - DNA, 15 bp, Homo sapiens
atctacacagcctgg

SEQ ID NO: 2127578 - DNA, 19 bp, Homo sapiens
atctacacagcctggactt

SEQ ID NO: 2127579 - DNA, 16 bp, Homo sapiens
atctacagaacaaaga

SEQ ID NO: 2127580 - DNA, 19 bp, Homo sapiens
atctacctgccctctctca

SEQ ID NO: 2127581 - DNA, 21 bp, Homo sapiens
atctacctgccctctctcagt

SEQ ID NO: 2127582 - DNA, 22 bp, Homo sapiens
atctactaaaaatacaaaaatt

SEQ ID NO: 2127583 - DNA, 19 bp, Homo sapiens
atctagaggcttccttcat

SEQ ID NO: 2127584 - DNA, 23 bp, Homo sapiens
atctagaggcttccttcatttcc

SEQ ID NO: 2127585 - DNA, 20 bp, Homo sapiens
atctagcttcatgcctcagt

SEQ ID NO: 2127586 - DNA, 14 bp, Homo sapiens
atctatataatgta

SEQ ID NO: 2127587 - DNA, 21 bp, Homo sapiens
atctatatctctaaactgctg

SEQ ID NO: 2127588 - DNA, 16 bp, Homo sapiens
atctatattaaagtgt

SEQ ID NO: 2127589 - DNA, 20 bp, Homo sapiens
atctatcaatagtcaagaaa

SEQ ID NO: 2127590 - DNA, 14 bp, Homo sapiens
atctatctatttga

SEQ ID NO: 2127591 - DNA, 17 bp, Homo sapiens
atctatctgtattttca

SEQ ID NO: 2127592 - DNA, 18 bp, Homo sapiens
atctatcttatatagttt

SEQ ID NO: 2127593 - DNA, 24 bp, Homo sapiens
atctatgcaatttttaaactagta

SEQ ID NO: 2127594 - DNA, 16 bp, Homo sapiens
atctatgcattttctg

SEQ ID NO: 2127595 - DNA, 16 bp, Homo sapiens
atctatggagggcaga

SEQ ID NO: 2127596 - DNA, 15 bp, Homo sapiens
atatgacagctgtcc

SEQ ID NO: 2127597 - DNA, 15 bp, Homo sapiens
atatgactgttttta

SEQ ID NO: 2127598 - DNA, 13 bp, Homo sapiens
atatgagtataca

SEQ ID NO: 2127599 - DNA, 15 bp, Homo sapiens
atatgatactgatgc

SEQ ID NO: 2127600 - DNA, 15 bp, Homo sapiens
atatgatattgcata

SEQ ID NO: 2127601 - DNA, 14 bp, Homo sapiens
atatgatttatagt

SEQ ID NO: 2127602 - DNA, 19 bp, Homo sapiens
atatgattttatttgacaa

SEQ ID NO: 2127603 - DNA, 16 bp, Homo sapiens
atatgattttttaaaa

SEQ ID NO: 2127604 - DNA, 19 bp, Homo sapiens
atatgcacacacagatgca

SEQ ID NO: 2127605 - DNA, 20 bp, Homo sapiens
atatgcaccttgtgtctgta

SEQ ID NO: 2127606 - DNA, 21 bp, Homo sapiens
atatgcaccttgtgtctgtac

SEQ ID NO: 2127607 - DNA, 16 bp, Homo sapiens
atatgccttatgtaat

SEQ ID NO: 2127608 - DNA, 23 bp, Homo sapiens
atatgctacagtactatgtaaat

SEQ ID NO: 2127609 - DNA, 13 bp, Homo sapiens
atatggaaccttc

SEQ ID NO: 2127610 - DNA, 16 bp, Homo sapiens
atatggactctgcaca

SEQ ID NO: 2127611 - DNA, 16 bp, Homo sapiens
atatggcaaaaatggc

SEQ ID NO: 2127612 - DNA, 19 bp, Homo sapiens
atatggcaagaaagctggt

SEQ ID NO: 2127613 - DNA, 14 bp, Homo sapiens
atatgggactgagc

SEQ ID NO: 2127614 - DNA, 12 bp, Homo sapiens
atatgtaaaaca

SEQ ID NO: 2127615 - DNA, 13 bp, Homo sapiens
atatgtaaaacat

SEQ ID NO: 2127616 - DNA, 14 bp, Homo sapiens
atatgtaaaacatt

SEQ ID NO: 2127617 - DNA, 15 bp, Homo sapiens
atatgtaaaacattt

SEQ ID NO: 2127618 - DNA, 24 bp, Homo sapiens
atatgtaaaacatttattttgaca

SEQ ID NO: 2127619 - DNA, 16 bp, Homo sapiens
atatgtaaaataaaat

SEQ ID NO: 2127620 - DNA, 19 bp, Homo sapiens
atatgtacagttatacata

SEQ ID NO: 2127621 - DNA, 14 bp, Homo sapiens
atatgtaccatgta

SEQ ID NO: 2127622 - DNA, 16 bp, Homo sapiens
atatgtagactatata

SEQ ID NO: 2127623 - DNA, 17 bp, Homo sapiens
atatgtagactatatac

SEQ ID NO: 2127624 - DNA, 19 bp, Homo sapiens
atatgtagactatatacat

SEQ ID NO: 2127625 - DNA, 21 bp, Homo sapiens
atatgtagactatatacatgt

SEQ ID NO: 2127626 - DNA, 23 bp, Homo sapiens
atatgtagactatatacatgtgt

SEQ ID NO: 2127627 - DNA, 22 bp, Homo sapiens
atatgtagccttgccttttaaa

SEQ ID NO: 2127628 - DNA, 22 bp, Homo sapiens
atatgtatatctatatctctaa

SEQ ID NO: 2127629 - DNA, 12 bp, Homo sapiens
atatgtatatgt

SEQ ID NO: 2127630 - DNA, 19 bp, Homo sapiens
atatgtatgtctaattgag

SEQ ID NO: 2127631 - DNA, 21 bp, Homo sapiens
atatgtattaagccaaacatg

SEQ ID NO: 2127632 - DNA, 14 bp, Homo sapiens
atatgtattgtaaa

SEQ ID NO: 2127633 - DNA, 20 bp, Homo sapiens
atatgtatttattgtcatta

SEQ ID NO: 2127634 - DNA, 19 bp, Homo sapiens
atatgtcagacatgaaaac

SEQ ID NO: 2127635 - DNA, 20 bp, Homo sapiens
atatgtctcgctagtgatgt

SEQ ID NO: 2127636 - DNA, 15 bp, Homo sapiens
atatgtctgcttctg

SEQ ID NO: 2127637 - DNA, 16 bp, Homo sapiens
atatgtctgcttctgt

SEQ ID NO: 2127638 - DNA, 22 bp, Homo sapiens
atatgtgtaattttttaaatga

SEQ ID NO: 2127639 - DNA, 13 bp, Homo sapiens
atatgtgtgtgtg

SEQ ID NO: 2127640 - DNA, 17 bp, Homo sapiens
atatgttaatttgttat

SEQ ID NO: 2127641 - DNA, 14 bp, Homo sapiens
atatgttcattaaa

SEQ ID NO: 2127642 - DNA, 13 bp, Homo sapiens
atatgttgctgaa

SEQ ID NO: 2127643 - DNA, 14 bp, Homo sapiens
atatgttgtaataa

SEQ ID NO: 2127644 - DNA, 16 bp, Homo sapiens
atatgttgttaaacac

SEQ ID NO: 2127645 - DNA, 18 bp, Homo sapiens
atatgttttaagaggcag

SEQ ID NO: 2127646 - DNA, 14 bp, Homo sapiens
atattaaaggagtt

SEQ ID NO: 2127647 - DNA, 14 bp, Homo sapiens
atattaaaggcttt

SEQ ID NO: 2127648 - DNA, 12 bp, Homo sapiens
atattaaagtgt

SEQ ID NO: 2127649 - DNA, 14 bp, Homo sapiens
atattaatcccagc

SEQ ID NO: 2127650 - DNA, 18 bp, Homo sapiens
atattaccaaaaaagtat

SEQ ID NO: 2127651 - DNA, 18 bp, Homo sapiens
atattagaagtgttaact

SEQ ID NO: 2127652 - DNA, 23 bp, Homo sapiens
atattagagtgcccttaaaataa

SEQ ID NO: 2127653 - DNA, 22 bp, Homo sapiens
atattagtttgatttaatatct

SEQ ID NO: 2127654 - DNA, 13 bp, Homo sapiens
atattataaataa

SEQ ID NO: 2127655 - DNA, 15 bp, Homo sapiens
atattataaataaat

SEQ ID NO: 2127656 - DNA, 14 bp, Homo sapiens
atattataataatg

SEQ ID NO: 2127657 - DNA, 17 bp, Homo sapiens
atattatggtgtaatgc

SEQ ID NO: 2127658 - DNA, 21 bp, Homo sapiens
atattatggtgtaatgcacaa

SEQ ID NO: 2127659 - DNA, 19 bp, Homo sapiens
atattattcaagtgcctct

SEQ ID NO: 2127660 - DNA, 17 bp, Homo sapiens
atattattcattcattt

SEQ ID NO: 2127661 - DNA, 23 bp, Homo sapiens
atattcagagatgtaccatgtta

SEQ ID NO: 2127662 - DNA, 22 bp, Homo sapiens
atattcagtgctgtggcctggg

SEQ ID NO: 2127663 - DNA, 14 bp, Homo sapiens
atattcattgtata

SEQ ID NO: 2127664 - DNA, 16 bp, Homo sapiens
atattcattgtataaa

SEQ ID NO: 2127665 - DNA, 18 bp, Homo sapiens
atattccaccattcacat

SEQ ID NO: 2127666 - DNA, 18 bp, Homo sapiens
atattcctgaatgaaata

SEQ ID NO: 2127667 - DNA, 21 bp, Homo sapiens
atattctggaaaaaaaatata

SEQ ID NO: 2127668 - DNA, 23 bp, Homo sapiens
atattctggaaaaaaaatatata

SEQ ID NO: 2127669 - DNA, 14 bp, Homo sapiens
atattgaaaagata

SEQ ID NO: 2127670 - DNA, 15 bp, Homo sapiens
atattgaatatatca

SEQ ID NO: 2127671 - DNA, 16 bp, Homo sapiens
atattgcactaggtca

SEQ ID NO: 2127672 - DNA, 16 bp, Homo sapiens
atattgcatatgcata

SEQ ID NO: 2127673 - DNA, 14 bp, Homo sapiens
atattgcttatgtc

SEQ ID NO: 2127674 - DNA, 15 bp, Homo sapiens
atattgtatattctg

SEQ ID NO: 2127675 - DNA, 18 bp, Homo sapiens
atattgtatattctggaa

SEQ ID NO: 2127676 - DNA, 17 bp, Homo sapiens
atattgtcagatatttt

SEQ ID NO: 2127677 - DNA, 12 bp, Homo sapiens
atattgtgccaa

SEQ ID NO: 2127678 - DNA, 19 bp, Homo sapiens
atattgtgccaatatgtat

SEQ ID NO: 2127679 - DNA, 21 bp, Homo sapiens
atattgtgccaatatgtattg

SEQ ID NO: 2127680 - DNA, 21 bp, Homo sapiens
atattgtgggtgttaattttt

SEQ ID NO: 2127681 - DNA, 12 bp, Homo sapiens
atatttaaacag

SEQ ID NO: 2127682 - DNA, 14 bp, Homo sapiens
atatttaaacagca

SEQ ID NO: 2127683 - DNA, 19 bp, Homo sapiens
atatttaagccttttgtgt

SEQ ID NO: 2127684 - DNA, 15 bp, Homo sapiens
atatttaagtatata

SEQ ID NO: 2127685 - DNA, 12 bp, Homo sapiens
atatttaattgt

SEQ ID NO: 2127686 - DNA, 20 bp, Homo sapiens
atatttacatatgaaattta

SEQ ID NO: 2127687 - DNA, 23 bp, Homo sapiens
atatttactaagccacaagaaat

SEQ ID NO: 2127688 - DNA, 14 bp, Homo sapiens
atatttaggcaaga

SEQ ID NO: 2127689 - DNA, 22 bp, Homo sapiens
atatttagttatagtttcagat

SEQ ID NO: 2127690 - DNA, 13 bp, Homo sapiens
atatttataactc

SEQ ID NO: 2127691 - DNA, 14 bp, Homo sapiens
atatttatactcta

SEQ ID NO: 2127692 - DNA, 15 bp, Homo sapiens
atatttatagtcaca

SEQ ID NO: 2127693 - DNA, 17 bp, Homo sapiens
atatttatattgtatat

SEQ ID NO: 2127694 - DNA, 22 bp, Homo sapiens
atatttatcaaacttgtgctga

SEQ ID NO: 2127695 - DNA, 18 bp, Homo sapiens
atatttatgaatgtgcat

SEQ ID NO: 2127696 - DNA, 18 bp, Homo sapiens
atatttatgtctatttaa

SEQ ID NO: 2127697 - DNA, 16 bp, Homo sapiens
atatttattacctctg

SEQ ID NO: 2127698 - DNA, 21 bp, Homo sapiens
atatttattttctttctgtaa

SEQ ID NO: 2127699 - DNA, 15 bp, Homo sapiens
atatttccatttctt

SEQ ID NO: 2127700 - DNA, 15 bp, Homo sapiens
atatttctgatataa

SEQ ID NO: 2127701 - DNA, 17 bp, Homo sapiens
atatttgcttatttata

SEQ ID NO: 2127702 - DNA, 23 bp, Homo sapiens
atatttggcgatgaggtaattct

SEQ ID NO: 2127703 - DNA, 15 bp, Homo sapiens
atatttgtgtatgtg

SEQ ID NO: 2127704 - DNA, 15 bp, Homo sapiens
atctatggcagtcca

SEQ ID NO: 2127705 - DNA, 22 bp, Homo sapiens
atctatggcagtccagccagct

SEQ ID NO: 2127706 - DNA, 16 bp, Homo sapiens
atctatttattaagtt

SEQ ID NO: 2127707 - DNA, 12 bp, Homo sapiens
atctatttgagg

SEQ ID NO: 2127708 - DNA, 15 bp, Homo sapiens
atctcaaaactgcac

SEQ ID NO: 2127709 - DNA, 14 bp, Homo sapiens
atctcactgcccag

SEQ ID NO: 2127710 - DNA, 14 bp, Homo sapiens
atctcactttgccc

SEQ ID NO: 2127711 - DNA, 12 bp, Homo sapiens
atctcagagaca

SEQ ID NO: 2127712 - DNA, 14 bp, Homo sapiens
atctcagagacagg

SEQ ID NO: 2127713 - DNA, 19 bp, Homo sapiens
atctcagaggctatagctg

SEQ ID NO: 2127714 - DNA, 16 bp, Homo sapiens
atctcaggagcttgca

SEQ ID NO: 2127715 - DNA, 17 bp, Homo sapiens
atctcagggtccagacc

SEQ ID NO: 2127716 - DNA, 15 bp, Homo sapiens
atctcatacctctga

SEQ ID NO: 2127717 - DNA, 18 bp, Homo sapiens
atctcatacctctgacca

SEQ ID NO: 2127718 - DNA, 17 bp, Homo sapiens
atctcatggaaactggc

SEQ ID NO: 2127719 - DNA, 13 bp, Homo sapiens
atctcatttaagg

SEQ ID NO: 2127720 - DNA, 23 bp, Homo sapiens
atctcatttttccgtaaaaatga

SEQ ID NO: 2127721 - DNA, 16 bp, Homo sapiens
atctccaaggaccagg

SEQ ID NO: 2127722 - DNA, 15 bp, Homo sapiens
atctccagcatcctg

SEQ ID NO: 2127723 - DNA, 15 bp, Homo sapiens
atctccagtattctt

SEQ ID NO: 2127724 - DNA, 18 bp, Homo sapiens
atctccagtattcttgtc

SEQ ID NO: 2127725 - DNA, 12 bp, Homo sapiens
atctccatttca

SEQ ID NO: 2127726 - DNA, 14 bp, Homo sapiens
atctccatttcaca

SEQ ID NO: 2127727 - DNA, 12 bp, Homo sapiens
atctccccaggc

SEQ ID NO: 2127728 - DNA, 16 bp, Homo sapiens
atctccccaggcctcc

SEQ ID NO: 2127729 - DNA, 18 bp, Homo sapiens
atctccccaggcctccag

SEQ ID NO: 2127730 - DNA, 22 bp, Homo sapiens
atctcccccatcccccactgcc

SEQ ID NO: 2127731 - DNA, 23 bp, Homo sapiens
atctcccctcctcacagttgcca

SEQ ID NO: 2127732 - DNA, 15 bp, Homo sapiens
atctccctgccgcct

SEQ ID NO: 2127733 - DNA, 12 bp, Homo sapiens
atctcctgaaaa

SEQ ID NO: 2127734 - DNA, 22 bp, Homo sapiens
atctcgtttttcttcttaagac

SEQ ID NO: 2127735 - DNA, 13 bp, Homo sapiens
atctctaatatgg

SEQ ID NO: 2127736 - DNA, 15 bp, Homo sapiens
atctctaattggaag

SEQ ID NO: 2127737 - DNA, 16 bp, Homo sapiens
atctctagaattttaa

SEQ ID NO: 2127738 - DNA, 18 bp, Homo sapiens
atctctagaattttaagt

SEQ ID NO: 2127739 - DNA, 13 bp, Homo sapiens
atctctatttaat

SEQ ID NO: 2127740 - DNA, 19 bp, Homo sapiens
atctctatttaatatttat

SEQ ID NO: 2127741 - DNA, 14 bp, Homo sapiens
atctctcaggagca

SEQ ID NO: 2127742 - DNA, 18 bp, Homo sapiens
atctctcaggagcacagg

SEQ ID NO: 2127743 - DNA, 22 bp, Homo sapiens
atctctcaggagcacaggcagc

SEQ ID NO: 2127744 - DNA, 20 bp, Homo sapiens
atctctccacggtagcactt

SEQ ID NO: 2127745 - DNA, 22 bp, Homo sapiens
atctctctgcctatttattggg

SEQ ID NO: 2127746 - DNA, 23 bp, Homo sapiens
atctctctgcctatttattgggg

SEQ ID NO: 2127747 - DNA, 16 bp, Homo sapiens
atctctgaagcatgtt

SEQ ID NO: 2127748 - DNA, 13 bp, Homo sapiens
atctctgtaaaat

SEQ ID NO: 2127749 - DNA, 22 bp, Homo sapiens
atctctgtgactcgcttagctg

SEQ ID NO: 2127750 - DNA, 15 bp, Homo sapiens
atctcttgaggccag

SEQ ID NO: 2127751 - DNA, 16 bp, Homo sapiens
atctcttgtcatataa

SEQ ID NO: 2127752 - DNA, 17 bp, Homo sapiens
atctcttgtcatataaa

SEQ ID NO: 2127753 - DNA, 21 bp, Homo sapiens
atctcttgtcatataaacctg

SEQ ID NO: 2127754 - DNA, 22 bp, Homo sapiens
atctcttttgaatccatgcttg

SEQ ID NO: 2127755 - DNA, 15 bp, Homo sapiens
atctgaaaactggaa

SEQ ID NO: 2127756 - DNA, 13 bp, Homo sapiens
atctgaaaggcac

SEQ ID NO: 2127757 - DNA, 18 bp, Homo sapiens
atctgaaccactttgcct

SEQ ID NO: 2127758 - DNA, 15 bp, Homo sapiens
atctgaaggagattt

SEQ ID NO: 2127759 - DNA, 18 bp, Homo sapiens
atctgaatttttaaacaa

SEQ ID NO: 2127760 - DNA, 22 bp, Homo sapiens
atctgacagttactcttcagtt

SEQ ID NO: 2127761 - DNA, 17 bp, Homo sapiens
atctgactttaattgtg

SEQ ID NO: 2127762 - DNA, 18 bp, Homo sapiens
atctgactttaattgtgt

SEQ ID NO: 2127763 - DNA, 18 bp, Homo sapiens
atctgagaaaagctttga

SEQ ID NO: 2127764 - DNA, 19 bp, Homo sapiens
atctgagaagtgtatatag

SEQ ID NO: 2127765 - DNA, 18 bp, Homo sapiens
atctgagatctccctcca

SEQ ID NO: 2127766 - DNA, 20 bp, Homo sapiens
atctgagatctccctccagg

SEQ ID NO: 2127767 - DNA, 15 bp, Homo sapiens
atctgataaaattgt

SEQ ID NO: 2127768 - DNA, 22 bp, Homo sapiens
atctgataaaattgtgatgttt

SEQ ID NO: 2127769 - DNA, 17 bp, Homo sapiens
atctgatctgagtgaga

SEQ ID NO: 2127770 - DNA, 19 bp, Homo sapiens
atctgattggacattttct

SEQ ID NO: 2127771 - DNA, 15 bp, Homo sapiens
atctgatttaatgtt

SEQ ID NO: 2127772 - DNA, 14 bp, Homo sapiens
atctgcactgggtg

SEQ ID NO: 2127773 - DNA, 19 bp, Homo sapiens
atctgcagctctttcttct

SEQ ID NO: 2127774 - DNA, 20 bp, Homo sapiens
atctgcagctctttcttctt

SEQ ID NO: 2127775 - DNA, 17 bp, Homo sapiens
atctgccattactctgc

SEQ ID NO: 2127776 - DNA, 16 bp, Homo sapiens
atctgcctctattcaa

SEQ ID NO: 2127777 - DNA, 13 bp, Homo sapiens
atctgcctggcct

SEQ ID NO: 2127778 - DNA, 16 bp, Homo sapiens
atctgcctggcctggc

SEQ ID NO: 2127779 - DNA, 23 bp, Homo sapiens
atctgcctggcctggctccccac

SEQ ID NO: 2127780 - DNA, 12 bp, Homo sapiens
atctgcctgggc

SEQ ID NO: 2127781 - DNA, 15 bp, Homo sapiens
atctgcctgggcctg

SEQ ID NO: 2127782 - DNA, 19 bp, Homo sapiens
atctgcctgggcctgtgca

SEQ ID NO: 2127783 - DNA, 20 bp, Homo sapiens
atctgcctgggcctgtgcag

SEQ ID NO: 2127784 - DNA, 21 bp, Homo sapiens
atctgcctgggcctgtgcagc

SEQ ID NO: 2127785 - DNA, 20 bp, Homo sapiens
atctgcctgtggccttgccc

SEQ ID NO: 2127786 - DNA, 14 bp, Homo sapiens
atctgcctttgttt

SEQ ID NO: 2127787 - DNA, 15 bp, Homo sapiens
atctgcggggcttct

SEQ ID NO: 2127788 - DNA, 20 bp, Homo sapiens
atctgcggggcttctgggtg

SEQ ID NO: 2127789 - DNA, 13 bp, Homo sapiens
atctgctgccccg

SEQ ID NO: 2127790 - DNA, 18 bp, Homo sapiens
atctgctgctgaaactgt

SEQ ID NO: 2127791 - DNA, 20 bp, Homo sapiens
atctgctgctgaaactgtgt

SEQ ID NO: 2127792 - DNA, 15 bp, Homo sapiens
atctgctgttgccat

SEQ ID NO: 2127793 - DNA, 17 bp, Homo sapiens
atctgctgttgccatag

SEQ ID NO: 2127794 - DNA, 20 bp, Homo sapiens
atctgtttttaaaaatcata

SEQ ID NO: 2127795 - DNA, 22 bp, Homo sapiens
atcttacaggtatcaggcacag

SEQ ID NO: 2127796 - DNA, 20 bp, Homo sapiens
atcttaggggagagctttct

SEQ ID NO: 2127797 - DNA, 13 bp, Homo sapiens
atcttatttatat

SEQ ID NO: 2127798 - DNA, 17 bp, Homo sapiens
atcttatttatatatga

SEQ ID NO: 2127799 - DNA, 19 bp, Homo sapiens
atcttcaaagcttgaagat

SEQ ID NO: 2127800 - DNA, 15 bp, Homo sapiens
atcttcaaggtgtaa

SEQ ID NO: 2127801 - DNA, 19 bp, Homo sapiens
atcttcacatagttctcca

SEQ ID NO: 2127802 - DNA, 18 bp, Homo sapiens
atcttcagctcccatagc

SEQ ID NO: 2127803 - DNA, 24 bp, Homo sapiens
atcttcagctcccatagcgctggc

SEQ ID NO: 2127804 - DNA, 14 bp, Homo sapiens
atcttcagttttat

SEQ ID NO: 2127805 - DNA, 15 bp, Homo sapiens
atcttcctgctgctg

SEQ ID NO: 2127806 - DNA, 16 bp, Homo sapiens
atcttcctgctgctgt

SEQ ID NO: 2127807 - DNA, 15 bp, Homo sapiens
atcttcggggtgtga

SEQ ID NO: 2127808 - DNA, 19 bp, Homo sapiens
atcttcggggtgtgatgaa

SEQ ID NO: 2127809 - DNA, 15 bp, Homo sapiens
atcttcgtcctgccc

SEQ ID NO: 2127810 - DNA, 22 bp, Homo sapiens
atcttctccatctggcagggtg

SEQ ID NO: 2127811 - DNA, 13 bp, Homo sapiens
atcttctgcagac

SEQ ID NO: 2127812 - DNA, 14 bp, Homo sapiens
atcttctttataac

SEQ ID NO: 2127813 - DNA, 17 bp, Homo sapiens
atcttgaaaagaatcta

SEQ ID NO: 2127814 - DNA, 16 bp, Homo sapiens
atcttgaatatttgct

SEQ ID NO: 2127815 - DNA, 21 bp, Homo sapiens
atcttgacacggtgaaatcca

SEQ ID NO: 2127816 - DNA, 17 bp, Homo sapiens
atcttgacattcaaggc

SEQ ID NO: 2127817 - DNA, 17 bp, Homo sapiens
atcttgccccctcatct

SEQ ID NO: 2127818 - DNA, 21 bp, Homo sapiens
atcttgcccctccagagacag

SEQ ID NO: 2127819 - DNA, 13 bp, Homo sapiens
atcttgctctgct

SEQ ID NO: 2127820 - DNA, 15 bp, Homo sapiens
atcttgctctgctga

SEQ ID NO: 2127821 - DNA, 16 bp, Homo sapiens
atcttgctctgctgac

SEQ ID NO: 2127822 - DNA, 19 bp, Homo sapiens
atcttgctctgctgacaga

SEQ ID NO: 2127823 - DNA, 20 bp, Homo sapiens
atcttggtcctgtcaccctg

SEQ ID NO: 2127824 - DNA, 20 bp, Homo sapiens
atcttgtccacagtctccca

SEQ ID NO: 2127825 - DNA, 21 bp, Homo sapiens
atcttgtccacagtctcccat

SEQ ID NO: 2127826 - DNA, 14 bp, Homo sapiens
atcttgtctctggg

SEQ ID NO: 2127827 - DNA, 15 bp, Homo sapiens
atcttgtctctgggc

SEQ ID NO: 2127828 - DNA, 16 bp, Homo sapiens
atcttgttaatgcatt

SEQ ID NO: 2127829 - DNA, 17 bp, Homo sapiens
atcttgttaatgcattt

SEQ ID NO: 2127830 - DNA, 19 bp, Homo sapiens
atctttcctccaaactcct

SEQ ID NO: 2127831 - DNA, 21 bp, Homo sapiens
atctttcctccaaactcctgc

SEQ ID NO: 2127832 - DNA, 19 bp, Homo sapiens
atctttccttgtctctcat

SEQ ID NO: 2127833 - DNA, 11 bp, Homo sapiens
atctttcttct

SEQ ID NO: 2127834 - DNA, 14 bp, Homo sapiens
atctttgaaaagaa

SEQ ID NO: 2127835 - DNA, 15 bp, Homo sapiens
atctttgaaaagaaa

SEQ ID NO: 2127836 - DNA, 16 bp, Homo sapiens
atctttgttttaacca

SEQ ID NO: 2127837 - DNA, 23 bp, Homo sapiens
atcttttgtgagatgtaattgtt

SEQ ID NO: 2127838 - DNA, 20 bp, Homo sapiens
atgaaaaacacggcagctgt

SEQ ID NO: 2127839 - DNA, 14 bp, Homo sapiens
atgaaaaagaagaa

SEQ ID NO: 2127840 - DNA, 16 bp, Homo sapiens
atgaaaaagaagaatc

SEQ ID NO: 2127841 - DNA, 13 bp, Homo sapiens
atgaaaaatatga

SEQ ID NO: 2127842 - DNA, 20 bp, Homo sapiens
atgaaaatgtaacttttctt

SEQ ID NO: 2127843 - DNA, 16 bp, Homo sapiens
atgaaacacttctcat

SEQ ID NO: 2127844 - DNA, 18 bp, Homo sapiens
atgaaacagaaacaaaaa

SEQ ID NO: 2127845 - DNA, 22 bp, Homo sapiens
atgaaacagatgataaatattt

SEQ ID NO: 2127846 - DNA, 23 bp, Homo sapiens
atgaaacagatgataaatattta

SEQ ID NO: 2127847 - DNA, 13 bp, Homo sapiens
atgaaaccaaagc

SEQ ID NO: 2127848 - DNA, 13 bp, Homo sapiens
atgaaagaggagg

SEQ ID NO: 2127849 - DNA, 19 bp, Homo sapiens
atgaaagatggctgtgcct

SEQ ID NO: 2127850 - DNA, 23 bp, Homo sapiens
atgaaagatggctgtgcctctgc

SEQ ID NO: 2127851 - DNA, 21 bp, Homo sapiens
atgaaagggaaagtcagcttt

SEQ ID NO: 2127852 - DNA, 13 bp, Homo sapiens
atgaaatatcaga

SEQ ID NO: 2127853 - DNA, 19 bp, Homo sapiens
atgaaatatcagactagtg

SEQ ID NO: 2127854 - DNA, 22 bp, Homo sapiens
atgaaatatttgcttatttata

SEQ ID NO: 2127855 - DNA, 14 bp, Homo sapiens
atgaaatgactgtc

SEQ ID NO: 2127856 - DNA, 18 bp, Homo sapiens
atgaaatgataaagatgt

SEQ ID NO: 2127857 - DNA, 16 bp, Homo sapiens
atgaaatggttaagaa

SEQ ID NO: 2127858 - DNA, 23 bp, Homo sapiens
atgaaattgtctagcagagcagg

SEQ ID NO: 2127859 - DNA, 21 bp, Homo sapiens
atgaaattttctagactttct

SEQ ID NO: 2127860 - DNA, 13 bp, Homo sapiens
atgaacaaactat

SEQ ID NO: 2127861 - DNA, 10 bp, Homo sapiens
atgaacaaag

SEQ ID NO: 2127862 - DNA, 21 bp, Homo sapiens
atgaacaaagaaaaaaatata

SEQ ID NO: 2127863 - DNA, 20 bp, Homo sapiens
atgaaccacatcttgctctg

SEQ ID NO: 2127864 - DNA, 17 bp, Homo sapiens
atgaacctggagggcta

SEQ ID NO: 2127865 - DNA, 16 bp, Homo sapiens
atgaacttgaggacac

SEQ ID NO: 2127866 - DNA, 19 bp, Homo sapiens
atgaacttgaggacacatg

SEQ ID NO: 2127867 - DNA, 20 bp, Homo sapiens
atgaacttgaggacacatgt

SEQ ID NO: 2127868 - DNA, 20 bp, Homo sapiens
atgaagaaaaaggctggctg

SEQ ID NO: 2127869 - DNA, 22 bp, Homo sapiens
atgaagaaagggaggcccagcc

SEQ ID NO: 2127870 - DNA, 12 bp, Homo sapiens
atgaagacccag

SEQ ID NO: 2127871 - DNA, 17 bp, Homo sapiens
atgaagacccagtgtaa

SEQ ID NO: 2127872 - DNA, 22 bp, Homo sapiens
atgaagactgttaaatgaaacc

SEQ ID NO: 2127873 - DNA, 15 bp, Homo sapiens
atgaagagaagctga

SEQ ID NO: 2127874 - DNA, 20 bp, Homo sapiens
atgaagagaagctgagaaga

SEQ ID NO: 2127875 - DNA, 14 bp, Homo sapiens
atgaagagactctc

SEQ ID NO: 2127876 - DNA, 18 bp, Homo sapiens
atgaagagactctcttag

SEQ ID NO: 2127877 - DNA, 18 bp, Homo sapiens
atgaagagtgagagggca

SEQ ID NO: 2127878 - DNA, 19 bp, Homo sapiens
atgaagagtgagagggcat

SEQ ID NO: 2127879 - DNA, 19 bp, Homo sapiens
atgaagattctcctgtgct

SEQ ID NO: 2127880 - DNA, 18 bp, Homo sapiens
atgatctactcagaaatt

SEQ ID NO: 2127881 - DNA, 12 bp, Homo sapiens
atgatctccctg

SEQ ID NO: 2127882 - DNA, 15 bp, Homo sapiens
atgatctccctgccg

SEQ ID NO: 2127883 - DNA, 14 bp, Homo sapiens
atgatctctgatga

SEQ ID NO: 2127884 - DNA, 17 bp, Homo sapiens
atgatctttgcagacag

SEQ ID NO: 2127885 - DNA, 18 bp, Homo sapiens
atgatctttgcagacagg

SEQ ID NO: 2127886 - DNA, 18 bp, Homo sapiens
atgatgaaatgaggtcag

SEQ ID NO: 2127887 - DNA, 15 bp, Homo sapiens
atgatgaccaagaat

SEQ ID NO: 2127888 - DNA, 16 bp, Homo sapiens
atgatgaccaagaatt

SEQ ID NO: 2127889 - DNA, 21 bp, Homo sapiens
atgatgatctttaaaatacac

SEQ ID NO: 2127890 - DNA, 16 bp, Homo sapiens
atgatgattaaacacc

SEQ ID NO: 2127891 - DNA, 17 bp, Homo sapiens
atgatgattaaacacct

SEQ ID NO: 2127892 - DNA, 23 bp, Homo sapiens
atgatgattccttgagcatttta

SEQ ID NO: 2127893 - DNA, 17 bp, Homo sapiens
atgatggagcgcacctg

SEQ ID NO: 2127894 - DNA, 16 bp, Homo sapiens
atgatgggtgttttta

SEQ ID NO: 2127895 - DNA, 14 bp, Homo sapiens
atgatgttaaaaaa

SEQ ID NO: 2127896 - DNA, 19 bp, Homo sapiens
atgattaaacacctgacac

SEQ ID NO: 2127897 - DNA, 18 bp, Homo sapiens
atgattccttgagcattt

SEQ ID NO: 2127898 - DNA, 22 bp, Homo sapiens
atgattccttgatggagatatt

SEQ ID NO: 2127899 - DNA, 19 bp, Homo sapiens
atgattcggatttgacaaa

SEQ ID NO: 2127900 - DNA, 13 bp, Homo sapiens
atgattggattat

SEQ ID NO: 2127901 - DNA, 21 bp, Homo sapiens
atgattggattattcatttaa

SEQ ID NO: 2127902 - DNA, 14 bp, Homo sapiens
atgattgtaaaata

SEQ ID NO: 2127903 - DNA, 18 bp, Homo sapiens
atgattgtaaaatagctt

SEQ ID NO: 2127904 - DNA, 20 bp, Homo sapiens
atgattgtttaattgtaggt

SEQ ID NO: 2127905 - DNA, 17 bp, Homo sapiens
atgatttaaaaaataaa

SEQ ID NO: 2127906 - DNA, 14 bp, Homo sapiens
atgatttatatatg

SEQ ID NO: 2127907 - DNA, 14 bp, Homo sapiens
atgatttcagtagc

SEQ ID NO: 2127908 - DNA, 20 bp, Homo sapiens
atgatttcatgctatctctg

SEQ ID NO: 2127909 - DNA, 11 bp, Homo sapiens
atgattttaca

SEQ ID NO: 2127910 - DNA, 13 bp, Homo sapiens
atgattttacaga

SEQ ID NO: 2127911 - DNA, 20 bp, Homo sapiens
atgattttacagagaatctg

SEQ ID NO: 2127912 - DNA, 15 bp, Homo sapiens
atgattttatacata

SEQ ID NO: 2127913 - DNA, 17 bp, Homo sapiens
atgattttatacatagt

SEQ ID NO: 2127914 - DNA, 18 bp, Homo sapiens
atgattttatacatagtc

SEQ ID NO: 2127915 - DNA, 18 bp, Homo sapiens
atgattttatttgacaaa

SEQ ID NO: 2127916 - DNA, 23 bp, Homo sapiens
atgattttctatttttcttctaa

SEQ ID NO: 2127917 - DNA, 22 bp, Homo sapiens
atgatttttagatgagattgtt

SEQ ID NO: 2127918 - DNA, 12 bp, Homo sapiens
atgcaaaaagaa

SEQ ID NO: 2127919 - DNA, 14 bp, Homo sapiens
atgcaaaagtgggg

SEQ ID NO: 2127920 - DNA, 13 bp, Homo sapiens
atgcaaacactgt

SEQ ID NO: 2127921 - DNA, 14 bp, Homo sapiens
atgcaaaccatagc

SEQ ID NO: 2127922 - DNA, 15 bp, Homo sapiens
atgcaagaagaatat

SEQ ID NO: 2127923 - DNA, 13 bp, Homo sapiens
atgcaatatgtat

SEQ ID NO: 2127924 - DNA, 18 bp, Homo sapiens
atgcaatgaaacagatga

SEQ ID NO: 2127925 - DNA, 16 bp, Homo sapiens
atgcaattcatcccag

SEQ ID NO: 2127926 - DNA, 17 bp, Homo sapiens
atgcaatttcctttttt

SEQ ID NO: 2127927 - DNA, 20 bp, Homo sapiens
atgcaattttgcatttgaat

SEQ ID NO: 2127928 - DNA, 15 bp, Homo sapiens
atgcaatttttaaac

SEQ ID NO: 2127929 - DNA, 20 bp, Homo sapiens
atgcaatttttaaactagta

SEQ ID NO: 2127930 - DNA, 22 bp, Homo sapiens
atgcacacaaacacctcctagc

SEQ ID NO: 2127931 - DNA, 14 bp, Homo sapiens
atgcacacacacag

SEQ ID NO: 2127932 - DNA, 17 bp, Homo sapiens
atgcacacacacagaga

SEQ ID NO: 2127933 - DNA, 19 bp, Homo sapiens
atgcacacacacagagata

SEQ ID NO: 2127934 - DNA, 23 bp, Homo sapiens
atgcacaccaaaaaaatacttga

SEQ ID NO: 2127935 - DNA, 21 bp, Homo sapiens
atgcacacgcacatagagata

SEQ ID NO: 2127936 - DNA, 13 bp, Homo sapiens
atgcacagctgct

SEQ ID NO: 2127937 - DNA, 15 bp, Homo sapiens
atgcacagctgcttg

SEQ ID NO: 2127938 - DNA, 19 bp, Homo sapiens
atgcacatatggactctgc

SEQ ID NO: 2127939 - DNA, 21 bp, Homo sapiens
atgcacatatggactctgcac

SEQ ID NO: 2127940 - DNA, 17 bp, Homo sapiens
atgcacatccattccca

SEQ ID NO: 2127941 - DNA, 14 bp, Homo sapiens
atgcacatttatat

SEQ ID NO: 2127942 - DNA, 13 bp, Homo sapiens
atgcaccagccct

SEQ ID NO: 2127943 - DNA, 14 bp, Homo sapiens
atgcaccagccctt

SEQ ID NO: 2127944 - DNA, 18 bp, Homo sapiens
atgcaccagtgccgcctg

SEQ ID NO: 2127945 - DNA, 15 bp, Homo sapiens
atgcacctaaagaaa

SEQ ID NO: 2127946 - DNA, 23 bp, Homo sapiens
atgcacctaaagaaaaacaaact

SEQ ID NO: 2127947 - DNA, 18 bp, Homo sapiens
atgcaccttgtgtctgta

SEQ ID NO: 2127948 - DNA, 14 bp, Homo sapiens
atgcacgaccttgg

SEQ ID NO: 2127949 - DNA, 18 bp, Homo sapiens
atgcacggcggcagggtg

SEQ ID NO: 2127950 - DNA, 13 bp, Homo sapiens
atgcactatgagg

SEQ ID NO: 2127951 - DNA, 16 bp, Homo sapiens
atgcactatgaggaat

SEQ ID NO: 2127952 - DNA, 21 bp, Homo sapiens
atgcagaggggtgctgctcct

SEQ ID NO: 2127953 - DNA, 19 bp, Homo sapiens
atgcagattcctgggcctg

SEQ ID NO: 2127954 - DNA, 21 bp, Homo sapiens
atgcagattcctgggcctgtc

SEQ ID NO: 2127955 - DNA, 22 bp, Homo sapiens
atgcagattcctgggcctgtcc

SEQ ID NO: 2127956 - DNA, 19 bp, Homo sapiens
atgcagcctcttccccacc

SEQ ID NO: 2127957 - DNA, 18 bp, Homo sapiens
atgcagggaagagggcag

SEQ ID NO: 2127958 - DNA, 17 bp, Homo sapiens
atgcagtattgccacaa

SEQ ID NO: 2127959 - DNA, 17 bp, Homo sapiens
atgcagtccagaataag

SEQ ID NO: 2127960 - DNA, 16 bp, Homo sapiens
atgcagtgaattgtga

SEQ ID NO: 2127961 - DNA, 14 bp, Homo sapiens
atgcataaatgcat

SEQ ID NO: 2127962 - DNA, 14 bp, Homo sapiens
atgcatcagaaagg

SEQ ID NO: 2127963 - DNA, 18 bp, Homo sapiens
atgcatcagaaagggagg

SEQ ID NO: 2127964 - DNA, 23 bp, Homo sapiens
atgcatccattcctcagggacag

SEQ ID NO: 2127965 - DNA, 23 bp, Homo sapiens
atgcatccatttcagtttgttta

SEQ ID NO: 2127966 - DNA, 19 bp, Homo sapiens
atgcatgattttatacata

SEQ ID NO: 2127967 - DNA, 23 bp, Homo sapiens
atgcatggtgcagttgacagcag

SEQ ID NO: 2127968 - DNA, 21 bp, Homo sapiens
atgcatgtaaggtcttcttgt

SEQ ID NO: 2127969 - DNA, 21 bp, Homo sapiens
atgcattataggatcatttgt

SEQ ID NO: 2127970 - DNA, 22 bp, Homo sapiens
atgcattataggatcatttgtt

SEQ ID NO: 2127971 - DNA, 21 bp, Homo sapiens
atgcatttccacactgtcaga

SEQ ID NO: 2127972 - DNA, 13 bp, Homo sapiens
atgcattttgcag

SEQ ID NO: 2127973 - DNA, 13 bp, Homo sapiens
atgccaacatacc

SEQ ID NO: 2127974 - DNA, 22 bp, Homo sapiens
atgccaacatacccttctttaa

SEQ ID NO: 2127975 - DNA, 14 bp, Homo sapiens
atgccaacttgtcc

SEQ ID NO: 2127976 - DNA, 20 bp, Homo sapiens
atgccacccagcaacacaga

SEQ ID NO: 2127977 - DNA, 17 bp, Homo sapiens
atgccaccctctccatg

SEQ ID NO: 2127978 - DNA, 16 bp, Homo sapiens
atgccactgccaggca

SEQ ID NO: 2127979 - DNA, 13 bp, Homo sapiens
atgccagagcctg

SEQ ID NO: 2127980 - DNA, 22 bp, Homo sapiens
atgccagccgggtacctcagtt

SEQ ID NO: 2127981 - DNA, 22 bp, Homo sapiens
atgccagcttcctgtgggccag

SEQ ID NO: 2127982 - DNA, 16 bp, Homo sapiens
atgccaggaccagtcc

SEQ ID NO: 2127983 - DNA, 22 bp, Homo sapiens
atgccaggttaggaaggcagca

SEQ ID NO: 2127984 - DNA, 23 bp, Homo sapiens
atgccatctccaccctgagcctg

SEQ ID NO: 2127985 - DNA, 23 bp, Homo sapiens
atgcccagagggcccaggcaggc

SEQ ID NO: 2127986 - DNA, 19 bp, Homo sapiens
atgccctccaatcctttcc

SEQ ID NO: 2127987 - DNA, 13 bp, Homo sapiens
atgccctgccatt

SEQ ID NO: 2127988 - DNA, 18 bp, Homo sapiens
atgccgcggtaggtaagg

SEQ ID NO: 2127989 - DNA, 14 bp, Homo sapiens
atgccgctcttctg

SEQ ID NO: 2127990 - DNA, 22 bp, Homo sapiens
atgccgtataggatgtcagaca

SEQ ID NO: 2127991 - DNA, 13 bp, Homo sapiens
atgcctaataaac

SEQ ID NO: 2127992 - DNA, 18 bp, Homo sapiens
atgcctcaagaacacctt

SEQ ID NO: 2127993 - DNA, 19 bp, Homo sapiens
atgcctcaagaacaccttt

SEQ ID NO: 2127994 - DNA, 15 bp, Homo sapiens
atgcctcaatgtgac

SEQ ID NO: 2127995 - DNA, 12 bp, Homo sapiens
atgcctcagttt

SEQ ID NO: 2127996 - DNA, 18 bp, Homo sapiens
atgcctcatgccacacct

SEQ ID NO: 2127997 - DNA, 13 bp, Homo sapiens
atgcctccaccgc

SEQ ID NO: 2127998 - DNA, 21 bp, Homo sapiens
atgcctccaccgctgcctaag

SEQ ID NO: 2127999 - DNA, 11 bp, Homo sapiens
atgcctctccc

SEQ ID NO: 2128000 - DNA, 15 bp, Homo sapiens
atgcctctcccgcac

SEQ ID NO: 2128001 - DNA, 12 bp, Homo sapiens
atgcctctgagg

SEQ ID NO: 2128002 - DNA, 14 bp, Homo sapiens
atgcctctgaggcc

SEQ ID NO: 2128003 - DNA, 19 bp, Homo sapiens
atgcctctgaggccagcct

SEQ ID NO: 2128004 - DNA, 20 bp, Homo sapiens
atgcctctgaggccagcctg

SEQ ID NO: 2128005 - DNA, 14 bp, Homo sapiens
atgcctgagggtgg

SEQ ID NO: 2128006 - DNA, 16 bp, Homo sapiens
atgcctgattttaaaa

SEQ ID NO: 2128007 - DNA, 22 bp, Homo sapiens
atgcctggcccccctccaggca

SEQ ID NO: 2128008 - DNA, 16 bp, Homo sapiens
atgcctggtctttcct

SEQ ID NO: 2128009 - DNA, 11 bp, Homo sapiens
atgcctggtgg

SEQ ID NO: 2128010 - DNA, 16 bp, Homo sapiens
atgcctggtggcagct

SEQ ID NO: 2128011 - DNA, 21 bp, Homo sapiens
atgcctggtggcagctgcggt

SEQ ID NO: 2128012 - DNA, 12 bp, Homo sapiens
atgccttatgta

SEQ ID NO: 2128013 - DNA, 21 bp, Homo sapiens
atgccttccgggccgggcgga

SEQ ID NO: 2128014 - DNA, 16 bp, Homo sapiens
atgccttgtctgggga

SEQ ID NO: 2128015 - DNA, 13 bp, Homo sapiens
atgcctttctagt

SEQ ID NO: 2128016 - DNA, 14 bp, Homo sapiens
atgcgaaaacttga

SEQ ID NO: 2128017 - DNA, 15 bp, Homo sapiens
atgcgcaatgtggca

SEQ ID NO: 2128018 - DNA, 12 bp, Homo sapiens
atgcgcaggctc

SEQ ID NO: 2128019 - DNA, 19 bp, Homo sapiens
atgcggccgcattccctga

SEQ ID NO: 2128020 - DNA, 14 bp, Homo sapiens
atgcgtatatgtgc

SEQ ID NO: 2128021 - DNA, 20 bp, Homo sapiens
atgctaaatgcaaacactgt

SEQ ID NO: 2128022 - DNA, 17 bp, Homo sapiens
atgctaagagaagtaga

SEQ ID NO: 2128023 - DNA, 22 bp, Homo sapiens
atgctaagagaagtagaaatca

SEQ ID NO: 2128024 - DNA, 12 bp, Homo sapiens
atgctagtttat

SEQ ID NO: 2128025 - DNA, 13 bp, Homo sapiens
atgctatctctgt

SEQ ID NO: 2128026 - DNA, 18 bp, Homo sapiens
atgctccagggcagcctc

SEQ ID NO: 2128027 - DNA, 21 bp, Homo sapiens
atgctcccatctcctgatttc

SEQ ID NO: 2128028 - DNA, 15 bp, Homo sapiens
atgctcgtgtgattt

SEQ ID NO: 2128029 - DNA, 13 bp, Homo sapiens
atgctctctgcag

SEQ ID NO: 2128030 - DNA, 13 bp, Homo sapiens
atgctctgcccca

SEQ ID NO: 2128031 - DNA, 11 bp, Homo sapiens
atgctgaatta

SEQ ID NO: 2128032 - DNA, 15 bp, Homo sapiens
atgctgaattatttt

SEQ ID NO: 2128033 - DNA, 12 bp, Homo sapiens
atgctgcctcca

SEQ ID NO: 2128034 - DNA, 15 bp, Homo sapiens
atgctgcctccagaa

SEQ ID NO: 2128035 - DNA, 12 bp, Homo sapiens
atgctgcctgag

SEQ ID NO: 2128036 - DNA, 13 bp, Homo sapiens
atgctgcctgagt

SEQ ID NO: 2128037 - DNA, 19 bp, Homo sapiens
atgctgctaattcaaagct

SEQ ID NO: 2128038 - DNA, 22 bp, Homo sapiens
atgctgctttttggcacagttg

SEQ ID NO: 2128039 - DNA, 17 bp, Homo sapiens
atgctggccagcaccct

SEQ ID NO: 2128040 - DNA, 20 bp, Homo sapiens
atgctggccagcaccctctc

SEQ ID NO: 2128041 - DNA, 21 bp, Homo sapiens
atgctggccagcaccctctcc

SEQ ID NO: 2128042 - DNA, 16 bp, Homo sapiens
atgctggcctgtggca

SEQ ID NO: 2128043 - DNA, 21 bp, Homo sapiens
atgctggcctgtggcaggcct

SEQ ID NO: 2128044 - DNA, 22 bp, Homo sapiens
atgctggcctgtggcaggccta

SEQ ID NO: 2128045 - DNA, 21 bp, Homo sapiens
atgctggttttcctaaatgca

SEQ ID NO: 2128046 - DNA, 22 bp, Homo sapiens
atgctgtcaactatgatatggt

SEQ ID NO: 2128047 - DNA, 14 bp, Homo sapiens
atgctgtgctcttt

SEQ ID NO: 2128048 - DNA, 16 bp, Homo sapiens
atgctgtgctctttga

SEQ ID NO: 2128049 - DNA, 18 bp, Homo sapiens
atgctgttgcctcatcta

SEQ ID NO: 2128050 - DNA, 13 bp, Homo sapiens
atgcttaaaatat

SEQ ID NO: 2128051 - DNA, 16 bp, Homo sapiens
atgcttaaaatatgta

SEQ ID NO: 2128052 - DNA, 22 bp, Homo sapiens
atgcttaaaatatgtatgtcta

SEQ ID NO: 2128053 - DNA, 14 bp, Homo sapiens
atgcttattttaaa

SEQ ID NO: 2128054 - DNA, 16 bp, Homo sapiens
atgcttattttaaaat

SEQ ID NO: 2128055 - DNA, 16 bp, Homo sapiens
atgcttcaagtgttgc

SEQ ID NO: 2128056 - DNA, 17 bp, Homo sapiens
atgcttcagttgtactt

SEQ ID NO: 2128057 - DNA, 18 bp, Homo sapiens
atgcttcccagagaagct

SEQ ID NO: 2128058 - DNA, 15 bp, Homo sapiens
atgctttccttttct

SEQ ID NO: 2128059 - DNA, 22 bp, Homo sapiens
atgctttccttttcttccttct

SEQ ID NO: 2128060 - DNA, 16 bp, Homo sapiens
atgctttctccttttt

SEQ ID NO: 2128061 - DNA, 16 bp, Homo sapiens
atgctttgggaggcca

SEQ ID NO: 2128062 - DNA, 18 bp, Homo sapiens
atgctttgggaggccaag

SEQ ID NO: 2128063 - DNA, 21 bp, Homo sapiens
atgctttgggaggccaaggca

SEQ ID NO: 2128064 - DNA, 15 bp, Homo sapiens
atgcttttattcaag

SEQ ID NO: 2128065 - DNA, 14 bp, Homo sapiens
atggaaaagcccag

SEQ ID NO: 2128066 - DNA, 16 bp, Homo sapiens
atggaaaagggtcttc

SEQ ID NO: 2128067 - DNA, 17 bp, Homo sapiens
atggaaaataaattata

SEQ ID NO: 2128068 - DNA, 19 bp, Homo sapiens
atggaaaatgtcctgtggt

SEQ ID NO: 2128069 - DNA, 11 bp, Homo sapiens
atggaaagaat

SEQ ID NO: 2128070 - DNA, 17 bp, Homo sapiens
atggaaagaatctaata

SEQ ID NO: 2128071 - DNA, 18 bp, Homo sapiens
atggaaattctgctcaga

SEQ ID NO: 2128072 - DNA, 16 bp, Homo sapiens
atggaacataaaatac

SEQ ID NO: 2128073 - DNA, 18 bp, Homo sapiens
atggaaccttccctccaa

SEQ ID NO: 2128074 - DNA, 14 bp, Homo sapiens
atggaagagaaatc

SEQ ID NO: 2128075 - DNA, 13 bp, Homo sapiens
atggaagggaggg

SEQ ID NO: 2128076 - DNA, 16 bp, Homo sapiens
atggaatacagtgtta

SEQ ID NO: 2128077 - DNA, 17 bp, Homo sapiens
atggaatacagtgttat

SEQ ID NO: 2128078 - DNA, 22 bp, Homo sapiens
atggacaatataaactgaaaaa

SEQ ID NO: 2128079 - DNA, 17 bp, Homo sapiens
atggacacattttctcc

SEQ ID NO: 2128080 - DNA, 23 bp, Homo sapiens
atggacaccccttatccaggact

SEQ ID NO: 2128081 - DNA, 20 bp, Homo sapiens
atggacagaagaaggcagca

SEQ ID NO: 2128082 - DNA, 13 bp, Homo sapiens
atggaccagtaga

SEQ ID NO: 2128083 - DNA, 13 bp, Homo sapiens
atggacccctccc

SEQ ID NO: 2128084 - DNA, 15 bp, Homo sapiens
atggaccctcgcagc

SEQ ID NO: 2128085 - DNA, 19 bp, Homo sapiens
atggaccgggtgggcctgg

SEQ ID NO: 2128086 - DNA, 20 bp, Homo sapiens
atggaccgggtgggcctggc

SEQ ID NO: 2128087 - DNA, 22 bp, Homo sapiens
atggacggccccgtcagccaca

SEQ ID NO: 2128088 - DNA, 23 bp, Homo sapiens
atggactcatggcttagaaatct

SEQ ID NO: 2128089 - DNA, 14 bp, Homo sapiens
atggagaaaccctg

SEQ ID NO: 2128090 - DNA, 18 bp, Homo sapiens
atggagactgtctcaaga

SEQ ID NO: 2128091 - DNA, 13 bp, Homo sapiens
atggagagagggg

SEQ ID NO: 2128092 - DNA, 16 bp, Homo sapiens
atggagagccctggga

SEQ ID NO: 2128093 - DNA, 16 bp, Homo sapiens
atggagaggcggcctc

SEQ ID NO: 2128094 - DNA, 20 bp, Homo sapiens
atggagaggcggcctcgtgc

SEQ ID NO: 2128095 - DNA, 21 bp, Homo sapiens
atggagccagctctgcattat

SEQ ID NO: 2128096 - DNA, 17 bp, Homo sapiens
atggagcgcacctgccc

SEQ ID NO: 2128097 - DNA, 15 bp, Homo sapiens
atggagcttgtacat

SEQ ID NO: 2128098 - DNA, 16 bp, Homo sapiens
atggagcttgtacata

SEQ ID NO: 2128099 - DNA, 16 bp, Homo sapiens
atggaggaaaaccaag

SEQ ID NO: 2128100 - DNA, 15 bp, Homo sapiens
atggaggagaaataa

SEQ ID NO: 2128101 - DNA, 15 bp, Homo sapiens
atggaggagaagaat

SEQ ID NO: 2128102 - DNA, 17 bp, Homo sapiens
atggaggagaagaattt

SEQ ID NO: 2128103 - DNA, 22 bp, Homo sapiens
atggaggcaggctccccctgcc

SEQ ID NO: 2128104 - DNA, 11 bp, Homo sapiens
atggagtgacg

SEQ ID NO: 2128105 - DNA, 19 bp, Homo sapiens
atggagtgggagatcagcc

SEQ ID NO: 2128106 - DNA, 20 bp, Homo sapiens
atggagtgggagatcagcca

SEQ ID NO: 2128107 - DNA, 19 bp, Homo sapiens
atggataacctatatgatt

SEQ ID NO: 2128108 - DNA, 20 bp, Homo sapiens
atgtctttttaagcttattt

SEQ ID NO: 2128109 - DNA, 18 bp, Homo sapiens
atgtgaaaaggcaaaaag

SEQ ID NO: 2128110 - DNA, 14 bp, Homo sapiens
atgtgaaagtgtaa

SEQ ID NO: 2128111 - DNA, 15 bp, Homo sapiens
atgtgaaagtgtaaa

SEQ ID NO: 2128112 - DNA, 16 bp, Homo sapiens
atgtgaagggtggggt

SEQ ID NO: 2128113 - DNA, 12 bp, Homo sapiens
atgtgaatcaga

SEQ ID NO: 2128114 - DNA, 15 bp, Homo sapiens
atgtgaatcagaccc

SEQ ID NO: 2128115 - DNA, 20 bp, Homo sapiens
atgtgaattctgtgaagaat

SEQ ID NO: 2128116 - DNA, 18 bp, Homo sapiens
atgtgaattgcctgcaga

SEQ ID NO: 2128117 - DNA, 14 bp, Homo sapiens
atgtgacaaccttt

SEQ ID NO: 2128118 - DNA, 18 bp, Homo sapiens
atgtgacaacctttgtgt

SEQ ID NO: 2128119 - DNA, 11 bp, Homo sapiens
atgtgacacat

SEQ ID NO: 2128120 - DNA, 20 bp, Homo sapiens
atgtgacccagatcctcaca

SEQ ID NO: 2128121 - DNA, 16 bp, Homo sapiens
atgtgagcacatgcgt

SEQ ID NO: 2128122 - DNA, 18 bp, Homo sapiens
atgtgagcacatgcgtat

SEQ ID NO: 2128123 - DNA, 23 bp, Homo sapiens
atgtgagtacccaggatgatttc

SEQ ID NO: 2128124 - DNA, 16 bp, Homo sapiens
atgtgatccttttatg

SEQ ID NO: 2128125 - DNA, 18 bp, Homo sapiens
atgtgatgttaactatta

SEQ ID NO: 2128126 - DNA, 15 bp, Homo sapiens
atgtgattctaatgt

SEQ ID NO: 2128127 - DNA, 14 bp, Homo sapiens
atgtgcaaattttg

SEQ ID NO: 2128128 - DNA, 23 bp, Homo sapiens
atgtgcaagttgtactgtatgca

SEQ ID NO: 2128129 - DNA, 20 bp, Homo sapiens
atgtgcacatgtgtctgtgt

SEQ ID NO: 2128130 - DNA, 16 bp, Homo sapiens
atgtgcacggcagctt

SEQ ID NO: 2128131 - DNA, 13 bp, Homo sapiens
atgtgcatttctt

SEQ ID NO: 2128132 - DNA, 13 bp, Homo sapiens
atgtgccaaggtg

SEQ ID NO: 2128133 - DNA, 14 bp, Homo sapiens
atgtgcccacaggg

SEQ ID NO: 2128134 - DNA, 18 bp, Homo sapiens
atgtgccccatgtccaag

SEQ ID NO: 2128135 - DNA, 22 bp, Homo sapiens
atgtgcctttttgtttttgtaa

SEQ ID NO: 2128136 - DNA, 18 bp, Homo sapiens
atgtggaatggattatag

SEQ ID NO: 2128137 - DNA, 19 bp, Homo sapiens
atgtggagtggacattcaa

SEQ ID NO: 2128138 - DNA, 16 bp, Homo sapiens
atgtggccccaggtgc

SEQ ID NO: 2128139 - DNA, 18 bp, Homo sapiens
atgtggccccaggtgcca

SEQ ID NO: 2128140 - DNA, 22 bp, Homo sapiens
atgtggcccctgaacaagaatt

SEQ ID NO: 2128141 - DNA, 13 bp, Homo sapiens
atgtggccctggc

SEQ ID NO: 2128142 - DNA, 16 bp, Homo sapiens
atgtggccctggcctg

SEQ ID NO: 2128143 - DNA, 19 bp, Homo sapiens
atgtggccctggcctgctg

SEQ ID NO: 2128144 - DNA, 14 bp, Homo sapiens
atgtggctgaagac

SEQ ID NO: 2128145 - DNA, 17 bp, Homo sapiens
atgtgggcgtttgtaaa

SEQ ID NO: 2128146 - DNA, 16 bp, Homo sapiens
atgtgggtcaaggaat

SEQ ID NO: 2128147 - DNA, 19 bp, Homo sapiens
atgtgtaaatggagcttgt

SEQ ID NO: 2128148 - DNA, 19 bp, Homo sapiens
atgtgtaaatgtggacaca

SEQ ID NO: 2128149 - DNA, 16 bp, Homo sapiens
atgtgtagcctgtgca

SEQ ID NO: 2128150 - DNA, 23 bp, Homo sapiens
atgtgtagcctgtgcatgtatgt

SEQ ID NO: 2128151 - DNA, 16 bp, Homo sapiens
atgtgtagggaaagtt

SEQ ID NO: 2128152 - DNA, 15 bp, Homo sapiens
atgtgtatatataca

SEQ ID NO: 2128153 - DNA, 16 bp, Homo sapiens
atgtgtatttgtatgt

SEQ ID NO: 2128154 - DNA, 18 bp, Homo sapiens
atgtgtcatgatttcaat

SEQ ID NO: 2128155 - DNA, 14 bp, Homo sapiens
atgtgtcccctcac

SEQ ID NO: 2128156 - DNA, 17 bp, Homo sapiens
atgtgtgcatgtgagca

SEQ ID NO: 2128157 - DNA, 16 bp, Homo sapiens
atgtgtgcatgtgtgt

SEQ ID NO: 2128158 - DNA, 14 bp, Homo sapiens
atgttgttatttaa

SEQ ID NO: 2128159 - DNA, 15 bp, Homo sapiens
atgttgttcaaatgc

SEQ ID NO: 2128160 - DNA, 22 bp, Homo sapiens
atgtttaaactttgtgcctttg

SEQ ID NO: 2128161 - DNA, 13 bp, Homo sapiens
atgtttaaattgt

SEQ ID NO: 2128162 - DNA, 21 bp, Homo sapiens
atgtttacactctttgtaaga

SEQ ID NO: 2128163 - DNA, 22 bp, Homo sapiens
atgtttacaggtggacacacaa

SEQ ID NO: 2128164 - DNA, 17 bp, Homo sapiens
atgtttagattccagga

SEQ ID NO: 2128165 - DNA, 22 bp, Homo sapiens
atgtttatgcaaggaaggaaag

SEQ ID NO: 2128166 - DNA, 14 bp, Homo sapiens
atgtttattcctga

SEQ ID NO: 2128167 - DNA, 19 bp, Homo sapiens
atgtttcacgaagtttgtt

SEQ ID NO: 2128168 - DNA, 13 bp, Homo sapiens
atgtttccagaaa

SEQ ID NO: 2128169 - DNA, 22 bp, Homo sapiens
atgtttcccgctccaagagaat

SEQ ID NO: 2128170 - DNA, 15 bp, Homo sapiens
atgtttcttctaggt

SEQ ID NO: 2128171 - DNA, 15 bp, Homo sapiens
atgtttgaggttaaa

SEQ ID NO: 2128172 - DNA, 12 bp, Homo sapiens
atgtttgattta

SEQ ID NO: 2128173 - DNA, 13 bp, Homo sapiens
atgtttgatttag

SEQ ID NO: 2128174 - DNA, 17 bp, Homo sapiens
atgtttgcctctgcctc

SEQ ID NO: 2128175 - DNA, 20 bp, Homo sapiens
atgtttggttgtaaatgctc

SEQ ID NO: 2128176 - DNA, 13 bp, Homo sapiens
atgtttgtgcctt

SEQ ID NO: 2128177 - DNA, 14 bp, Homo sapiens
atgttttgtacaat

SEQ ID NO: 2128178 - DNA, 14 bp, Homo sapiens
atgttttgtgacta

SEQ ID NO: 2128179 - DNA, 17 bp, Homo sapiens
atgttttgtgactatat

SEQ ID NO: 2128180 - DNA, 21 bp, Homo sapiens
atgttttgtgactatatagag

SEQ ID NO: 2128181 - DNA, 20 bp, Homo sapiens
atgtttttaaaagtttcaat

SEQ ID NO: 2128182 - DNA, 16 bp, Homo sapiens
atgtttttaatgtata

SEQ ID NO: 2128183 - DNA, 20 bp, Homo sapiens
atgtttttatgatatccctg

SEQ ID NO: 2128184 - DNA, 12 bp, Homo sapiens
attaaaaaccac

SEQ ID NO: 2128185 - DNA, 13 bp, Homo sapiens
attaaaaactgag

SEQ ID NO: 2128186 - DNA, 14 bp, Homo sapiens
attaaaaactgagt

SEQ ID NO: 2128187 - DNA, 14 bp, Homo sapiens
attaaaaatatgga

SEQ ID NO: 2128188 - DNA, 21 bp, Homo sapiens
attaaaaatatggaacttcta

SEQ ID NO: 2128189 - DNA, 15 bp, Homo sapiens
attaaaacacagctt

SEQ ID NO: 2128190 - DNA, 18 bp, Homo sapiens
attaaaagaagactggaa

SEQ ID NO: 2128191 - DNA, 14 bp, Homo sapiens
attaaaatatatat

SEQ ID NO: 2128192 - DNA, 15 bp, Homo sapiens
attaaaatatatata

SEQ ID NO: 2128193 - DNA, 16 bp, Homo sapiens
attaaaatatatataa

SEQ ID NO: 2128194 - DNA, 18 bp, Homo sapiens
attaaaatatatataaat

SEQ ID NO: 2128195 - DNA, 15 bp, Homo sapiens
attaaaatctggaaa

SEQ ID NO: 2128196 - DNA, 17 bp, Homo sapiens
attaaaatctggaaatc

SEQ ID NO: 2128197 - DNA, 18 bp, Homo sapiens
attaaaatgtaggaagaa

SEQ ID NO: 2128198 - DNA, 22 bp, Homo sapiens
attaaaatgtaggaagaaaaat

SEQ ID NO: 2128199 - DNA, 12 bp, Homo sapiens
attaaaattaag

SEQ ID NO: 2128200 - DNA, 14 bp, Homo sapiens
attaaacactgtaa

SEQ ID NO: 2128201 - DNA, 15 bp, Homo sapiens
attaaacactgtaat

SEQ ID NO: 2128202 - DNA, 12 bp, Homo sapiens
attaaacctgga

SEQ ID NO: 2128203 - DNA, 17 bp, Homo sapiens
attaaacgagataatgt

SEQ ID NO: 2128204 - DNA, 14 bp, Homo sapiens
attaaactgaagaa

SEQ ID NO: 2128205 - DNA, 14 bp, Homo sapiens
attaaagatgtgtt

SEQ ID NO: 2128206 - DNA, 19 bp, Homo sapiens
attaaagcaacattttatt

SEQ ID NO: 2128207 - DNA, 12 bp, Homo sapiens
attaaagcccat

SEQ ID NO: 2128208 - DNA, 15 bp, Homo sapiens
attaaagtcttccat

SEQ ID NO: 2128209 - DNA, 12 bp, Homo sapiens
attaaatattta

SEQ ID NO: 2128210 - DNA, 14 bp, Homo sapiens
attaaatatttaac

SEQ ID NO: 2128211 - DNA, 17 bp, Homo sapiens
attaaatatttaacata

SEQ ID NO: 2128212 - DNA, 13 bp, Homo sapiens
atttgttgtactt

SEQ ID NO: 2128213 - DNA, 21 bp, Homo sapiens
atttgttgtgactggcaccca

SEQ ID NO: 2128214 - DNA, 14 bp, Homo sapiens
atttgttttcatgg

SEQ ID NO: 2128215 - DNA, 21 bp, Homo sapiens
atttgttttgacggatgattg

SEQ ID NO: 2128216 - DNA, 20 bp, Homo sapiens
attttaaaaaaattcatcat

SEQ ID NO: 2128217 - DNA, 14 bp, Homo sapiens
attttaaaaaatga

SEQ ID NO: 2128218 - DNA, 16 bp, Homo sapiens
attttaaaaaatgaaa

SEQ ID NO: 2128219 - DNA, 23 bp, Homo sapiens
attttaaaaaatgaaaataagtg

SEQ ID NO: 2128220 - DNA, 15 bp, Homo sapiens
attttaaaaacatga

SEQ ID NO: 2128221 - DNA, 17 bp, Homo sapiens
attttaaaaacatgaga

SEQ ID NO: 2128222 - DNA, 23 bp, Homo sapiens
attttaaaaacatgagaaatgtg

SEQ ID NO: 2128223 - DNA, 17 bp, Homo sapiens
attttaaaaccatgcag

SEQ ID NO: 2128224 - DNA, 19 bp, Homo sapiens
attttaaaaccatgcagct

SEQ ID NO: 2128225 - DNA, 21 bp, Homo sapiens
attttaaaagcaattatattg

SEQ ID NO: 2128226 - DNA, 14 bp, Homo sapiens
attttaaaatctga

SEQ ID NO: 2128227 - DNA, 16 bp, Homo sapiens
attttaaaatctgatt

SEQ ID NO: 2128228 - DNA, 17 bp, Homo sapiens
attttaaacaaaataga

SEQ ID NO: 2128229 - DNA, 13 bp, Homo sapiens
attttaaagaatt

SEQ ID NO: 2128230 - DNA, 17 bp, Homo sapiens
attttaaagaattgtgt

SEQ ID NO: 2128231 - DNA, 14 bp, Homo sapiens
attttaaataaaag

SEQ ID NO: 2128232 - DNA, 15 bp, Homo sapiens
attttaaataaaaga

SEQ ID NO: 2128233 - DNA, 16 bp, Homo sapiens
attttaaataaaagaa

SEQ ID NO: 2128234 - DNA, 22 bp, Homo sapiens
attttaaattataacttaaaat

SEQ ID NO: 2128235 - DNA, 13 bp, Homo sapiens
attttaacatttt

SEQ ID NO: 2128236 - DNA, 16 bp, Homo sapiens
attttaacttaaattt

SEQ ID NO: 2128237 - DNA, 17 bp, Homo sapiens
attttaacttaaatttt

SEQ ID NO: 2128238 - DNA, 17 bp, Homo sapiens
attttaagaagacatga

SEQ ID NO: 2128239 - DNA, 16 bp, Homo sapiens
attttaagaggctttg

SEQ ID NO: 2128240 - DNA, 15 bp, Homo sapiens
attttaagcattctt

SEQ ID NO: 2128241 - DNA, 18 bp, Homo sapiens
attttaagcattcttaga

SEQ ID NO: 2128242 - DNA, 14 bp, Homo sapiens
attttaagcttgaa

SEQ ID NO: 2128243 - DNA, 18 bp, Homo sapiens
attttaagtgctttgtaa

SEQ ID NO: 2128244 - DNA, 16 bp, Homo sapiens
attttaatattttgta

SEQ ID NO: 2128245 - DNA, 18 bp, Homo sapiens
attttaattatcttttct

SEQ ID NO: 2128246 - DNA, 13 bp, Homo sapiens
attttaattatta

SEQ ID NO: 2128247 - DNA, 13 bp, Homo sapiens
attttacagagct

SEQ ID NO: 2128248 - DNA, 18 bp, Homo sapiens
attttactactgtggaaa

SEQ ID NO: 2128249 - DNA, 22 bp, Homo sapiens
attttactacttgttacctttc

SEQ ID NO: 2128250 - DNA, 15 bp, Homo sapiens
attttactgacagaa

SEQ ID NO: 2128251 - DNA, 21 bp, Homo sapiens
attttactgacagaaatgcaa

SEQ ID NO: 2128252 - DNA, 13 bp, Homo sapiens
attttagcagaga

SEQ ID NO: 2128253 - DNA, 18 bp, Homo sapiens
attttagccttctctgtt

SEQ ID NO: 2128254 - DNA, 19 bp, Homo sapiens
attttaggagacagtctca

SEQ ID NO: 2128255 - DNA, 17 bp, Homo sapiens
attttaggcagggattt

SEQ ID NO: 2128256 - DNA, 16 bp, Homo sapiens
attttagggctgtaga

SEQ ID NO: 2128257 - DNA, 18 bp, Homo sapiens
attttagggctgtagact

SEQ ID NO: 2128258 - DNA, 17 bp, Homo sapiens
attttagtctgtcatcc

SEQ ID NO: 2128259 - DNA, 12 bp, Homo sapiens
attttatacata

SEQ ID NO: 2128260 - DNA, 14 bp, Homo sapiens
attttatacatagt

SEQ ID NO: 2128261 - DNA, 20 bp, Homo sapiens
attttatacatagtcacaaa

SEQ ID NO: 2128262 - DNA, 21 bp, Homo sapiens
attttatacatagtcacaaaa

SEQ ID NO: 2128263 - DNA, 19 bp, Homo sapiens
attttatagctcagtttat

SEQ ID NO: 2128264 - DNA, 22 bp, Homo sapiens
attttatatgaaatgtttcact

SEQ ID NO: 2128265 - DNA, 19 bp, Homo sapiens
attttatatgagagaatca

SEQ ID NO: 2128266 - DNA, 20 bp, Homo sapiens
attttatattagaagtgtta

SEQ ID NO: 2128267 - DNA, 15 bp, Homo sapiens
attttatctcttatt

SEQ ID NO: 2128268 - DNA, 16 bp, Homo sapiens
attttatgatttaaaa

SEQ ID NO: 2128269 - DNA, 17 bp, Homo sapiens
attttattaaagcaaca

SEQ ID NO: 2128270 - DNA, 18 bp, Homo sapiens
attttattaaagcaacat

SEQ ID NO: 2128271 - DNA, 12 bp, Homo sapiens
attttattaaat

SEQ ID NO: 2128272 - DNA, 16 bp, Homo sapiens
attttatttagttctt

SEQ ID NO: 2128273 - DNA, 18 bp, Homo sapiens
attttcaaactttgtact

SEQ ID NO: 2128274 - DNA, 22 bp, Homo sapiens
attttcaaagctttttccagag

SEQ ID NO: 2128275 - DNA, 14 bp, Homo sapiens
attttcaagaaact

SEQ ID NO: 2128276 - DNA, 22 bp, Homo sapiens
attttcaagaaactgaggaatt

SEQ ID NO: 2128277 - DNA, 20 bp, Homo sapiens
attttcaagagaagaaaaaa

SEQ ID NO: 2128278 - DNA, 22 bp, Homo sapiens
attttcacattcccatctgtca

SEQ ID NO: 2128279 - DNA, 15 bp, Homo sapiens
attttcagagtgaca

SEQ ID NO: 2128280 - DNA, 19 bp, Homo sapiens
attttcagcgaacatgcct

SEQ ID NO: 2128281 - DNA, 21 bp, Homo sapiens
attttcagtagggctacaaaa

SEQ ID NO: 2128282 - DNA, 14 bp, Homo sapiens
attttcagtatttt

SEQ ID NO: 2128283 - DNA, 19 bp, Homo sapiens
attttcatgacttttccat

SEQ ID NO: 2128284 - DNA, 17 bp, Homo sapiens
attttcatgtatatgtg

SEQ ID NO: 2128285 - DNA, 15 bp, Homo sapiens
attttcattaaaagc

SEQ ID NO: 2128286 - DNA, 15 bp, Homo sapiens
attttcattacaatg

SEQ ID NO: 2128287 - DNA, 14 bp, Homo sapiens
attttcatttaact

SEQ ID NO: 2128288 - DNA, 16 bp, Homo sapiens
attttcattttaattt

SEQ ID NO: 2128289 - DNA, 22 bp, Homo sapiens
attttccaataaaattttcaaa

SEQ ID NO: 2128290 - DNA, 20 bp, Homo sapiens
attttccacaagattcccag

SEQ ID NO: 2128291 - DNA, 21 bp, Homo sapiens
attttccacaagattcccaga

SEQ ID NO: 2128292 - DNA, 22 bp, Homo sapiens
attttccagggcaatcaatgtt

SEQ ID NO: 2128293 - DNA, 14 bp, Homo sapiens
attttccctctctt

SEQ ID NO: 2128294 - DNA, 17 bp, Homo sapiens
attttcgtgcatttgtg

SEQ ID NO: 2128295 - DNA, 18 bp, Homo sapiens
attttctagactttctgt

SEQ ID NO: 2128296 - DNA, 19 bp, Homo sapiens
attttctcctaggagaagc

SEQ ID NO: 2128297 - DNA, 19 bp, Homo sapiens
attttctggaatacatgaa

SEQ ID NO: 2128298 - DNA, 22 bp, Homo sapiens
attttctggggctcctcacata

SEQ ID NO: 2128299 - DNA, 23 bp, Homo sapiens
attttctggggctcctcacatag

SEQ ID NO: 2128300 - DNA, 21 bp, Homo sapiens
attttcttccaagcaaaggtg

SEQ ID NO: 2128301 - DNA, 16 bp, Homo sapiens
attttcttcccatttg

SEQ ID NO: 2128302 - DNA, 17 bp, Homo sapiens
attttcttcccatttgt

SEQ ID NO: 2128303 - DNA, 15 bp, Homo sapiens
attttcttgcagttt

SEQ ID NO: 2128304 - DNA, 16 bp, Homo sapiens
attttcttgcctgagg

SEQ ID NO: 2128305 - DNA, 21 bp, Homo sapiens
attttctttctttttctggaa

SEQ ID NO: 2128306 - DNA, 16 bp, Homo sapiens
attttcttttgtaaat

SEQ ID NO: 2128307 - DNA, 20 bp, Homo sapiens
attttgaataaataaatgta

SEQ ID NO: 2128308 - DNA, 20 bp, Homo sapiens
attttgaatgtttatgttct

SEQ ID NO: 2128309 - DNA, 17 bp, Homo sapiens
attttgacataaagttg

SEQ ID NO: 2128310 - DNA, 14 bp, Homo sapiens
attttgagtgactc

SEQ ID NO: 2128311 - DNA, 18 bp, Homo sapiens
attttgatccaagctggt

SEQ ID NO: 2128312 - DNA, 18 bp, Homo sapiens
attttgcaaaatttccag

SEQ ID NO: 2128313 - DNA, 19 bp, Homo sapiens
attttgcaaaatttccagt

SEQ ID NO: 2128314 - DNA, 12 bp, Homo sapiens
attttgcacaaa

SEQ ID NO: 2128315 - DNA, 15 bp, Homo sapiens
attttgcagcagtga

SEQ ID NO: 2128316 - DNA, 18 bp, Homo sapiens
attttgcctcttttctct

SEQ ID NO: 2128317 - DNA, 22 bp, Homo sapiens
attttggggtacccactgctct

SEQ ID NO: 2128318 - DNA, 21 bp, Homo sapiens
attttggtattacactgtatt

SEQ ID NO: 2128319 - DNA, 10 bp, Homo sapiens
attttgtaaa

SEQ ID NO: 2128320 - DNA, 17 bp, Homo sapiens
attttgtaaactcaaaa

SEQ ID NO: 2128321 - DNA, 18 bp, Homo sapiens
attttgtaacgaagacac

SEQ ID NO: 2128322 - DNA, 12 bp, Homo sapiens
attttgtaagtt

SEQ ID NO: 2128323 - DNA, 14 bp, Homo sapiens
attttgtaataaac

SEQ ID NO: 2128324 - DNA, 16 bp, Homo sapiens
attttgtaataaactc

SEQ ID NO: 2128325 - DNA, 18 bp, Homo sapiens
attttgtaataaactctc

SEQ ID NO: 2128326 - DNA, 20 bp, Homo sapiens
attttgtaataaactctcta

SEQ ID NO: 2128327 - DNA, 10 bp, Homo sapiens
attttgtaca

SEQ ID NO: 2128328 - DNA, 23 bp, Homo sapiens
attttgtagtagttgatgaccaa

SEQ ID NO: 2128329 - DNA, 23 bp, Homo sapiens
atttcccttgaaattttaaacta

SEQ ID NO: 2128330 - DNA, 21 bp, Homo sapiens
atttccgaagaccttctgaag

SEQ ID NO: 2128331 - DNA, 13 bp, Homo sapiens
atttcctatttta

SEQ ID NO: 2128332 - DNA, 24 bp, Homo sapiens
atttcctcaacgttgctccccatc

SEQ ID NO: 2128333 - DNA, 17 bp, Homo sapiens
atttcctcccccagtta

SEQ ID NO: 2128334 - DNA, 20 bp, Homo sapiens
atttcctccgtcacctcaga

SEQ ID NO: 2128335 - DNA, 14 bp, Homo sapiens
atttcgaagatata

SEQ ID NO: 2128336 - DNA, 20 bp, Homo sapiens
atttctaaaaaacagaggcc

SEQ ID NO: 2128337 - DNA, 12 bp, Homo sapiens
atttctaacata

SEQ ID NO: 2128338 - DNA, 19 bp, Homo sapiens
atttctaacatatgtatta

SEQ ID NO: 2128339 - DNA, 19 bp, Homo sapiens
atttctacacagtgggaac

SEQ ID NO: 2128340 - DNA, 19 bp, Homo sapiens
atttctacatagtaactct

SEQ ID NO: 2128341 - DNA, 19 bp, Homo sapiens
atttctaggtaggaaatgt

SEQ ID NO: 2128342 - DNA, 17 bp, Homo sapiens
atttctatagccaaaaa

SEQ ID NO: 2128343 - DNA, 14 bp, Homo sapiens
atttctctccccac

SEQ ID NO: 2128344 - DNA, 13 bp, Homo sapiens
atttctctgagca

SEQ ID NO: 2128345 - DNA, 16 bp, Homo sapiens
atttctggcctcagca

SEQ ID NO: 2128346 - DNA, 21 bp, Homo sapiens
atttctgtcattcaaatgggt

SEQ ID NO: 2128347 - DNA, 13 bp, Homo sapiens
atttcttaaacaa

SEQ ID NO: 2128348 - DNA, 13 bp, Homo sapiens
atttcttatactt

SEQ ID NO: 2128349 - DNA, 22 bp, Homo sapiens
atttcttcgctgctctagctgg

SEQ ID NO: 2128350 - DNA, 19 bp, Homo sapiens
atttcttggtaagaagccg

SEQ ID NO: 2128351 - DNA, 21 bp, Homo sapiens
atttctttgtgataacaaaga

SEQ ID NO: 2128352 - DNA, 17 bp, Homo sapiens
atttcttttaaagaagt

SEQ ID NO: 2128353 - DNA, 18 bp, Homo sapiens
atttcttttaaagaagta

SEQ ID NO: 2128354 - DNA, 21 bp, Homo sapiens
atttcttttaaagaagtaaat

SEQ ID NO: 2128355 - DNA, 22 bp, Homo sapiens
atttcttttaaagaagtaaatt

SEQ ID NO: 2128356 - DNA, 17 bp, Homo sapiens
atttgaaaataattgtt

SEQ ID NO: 2128357 - DNA, 18 bp, Homo sapiens
atttgaaaataattgttc

SEQ ID NO: 2128358 - DNA, 15 bp, Homo sapiens
atttgaaatttagct

SEQ ID NO: 2128359 - DNA, 18 bp, Homo sapiens
atttgaaattttatttag

SEQ ID NO: 2128360 - DNA, 16 bp, Homo sapiens
atttgaagctgtaccc

SEQ ID NO: 2128361 - DNA, 13 bp, Homo sapiens
atttgaagtgtaa

SEQ ID NO: 2128362 - DNA, 21 bp, Homo sapiens
atttgagcaattcatttcact

SEQ ID NO: 2128363 - DNA, 22 bp, Homo sapiens
atttgagcatgcacagctgctt

SEQ ID NO: 2128364 - DNA, 22 bp, Homo sapiens
atttgaggagcagcttcagttg

SEQ ID NO: 2128365 - DNA, 15 bp, Homo sapiens
atttgataaactaaa

SEQ ID NO: 2128366 - DNA, 12 bp, Homo sapiens
atttgatcacag

SEQ ID NO: 2128367 - DNA, 13 bp, Homo sapiens
atttgatgtacat

SEQ ID NO: 2128368 - DNA, 15 bp, Homo sapiens
atttgatgtacatgt

SEQ ID NO: 2128369 - DNA, 16 bp, Homo sapiens
atttgatgtacatgtg

SEQ ID NO: 2128370 - DNA, 13 bp, Homo sapiens
atttgcaataaaa

SEQ ID NO: 2128371 - DNA, 16 bp, Homo sapiens
atttgccattcctgga

SEQ ID NO: 2128372 - DNA, 18 bp, Homo sapiens
atttgcctaattcctggc

SEQ ID NO: 2128373 - DNA, 20 bp, Homo sapiens
atttgcctaattcctggcat

SEQ ID NO: 2128374 - DNA, 11 bp, Homo sapiens
atttgcctgta

SEQ ID NO: 2128375 - DNA, 17 bp, Homo sapiens
atttgccttctccctgg

SEQ ID NO: 2128376 - DNA, 15 bp, Homo sapiens
atttgccttgctgga

SEQ ID NO: 2128377 - DNA, 14 bp, Homo sapiens
atttgcttatttat

SEQ ID NO: 2128378 - DNA, 20 bp, Homo sapiens
atttgctttcttttctccca

SEQ ID NO: 2128379 - DNA, 13 bp, Homo sapiens
atttggaaagaga

SEQ ID NO: 2128380 - DNA, 16 bp, Homo sapiens
atttggacaaaatgga

SEQ ID NO: 2128381 - DNA, 16 bp, Homo sapiens
atttggcctgcactaa

SEQ ID NO: 2128382 - DNA, 15 bp, Homo sapiens
atttggctgggtgtt

SEQ ID NO: 2128383 - DNA, 14 bp, Homo sapiens
atttggtctctatt

SEQ ID NO: 2128384 - DNA, 14 bp, Homo sapiens
atttggtgaccatc

SEQ ID NO: 2128385 - DNA, 18 bp, Homo sapiens
atttgtaagttgtgtgca

SEQ ID NO: 2128386 - DNA, 14 bp, Homo sapiens
atttgtaagtttat

SEQ ID NO: 2128387 - DNA, 22 bp, Homo sapiens
atttgtaagtttatgtctaaag

SEQ ID NO: 2128388 - DNA, 15 bp, Homo sapiens
atttgtaattgctta

SEQ ID NO: 2128389 - DNA, 16 bp, Homo sapiens
atttgtacatatgtaa

SEQ ID NO: 2128390 - DNA, 15 bp, Homo sapiens
atttgtatcacaaat

SEQ ID NO: 2128391 - DNA, 16 bp, Homo sapiens
atttgtatttatatta

SEQ ID NO: 2128392 - DNA, 14 bp, Homo sapiens
atttgtattttaaa

SEQ ID NO: 2128393 - DNA, 21 bp, Homo sapiens
atttgtgagccaaagagaaaa

SEQ ID NO: 2128394 - DNA, 23 bp, Homo sapiens
atttgtgagccaaagagaaaaga

SEQ ID NO: 2128395 - DNA, 19 bp, Homo sapiens
atttgtgtatgtgtatttg

SEQ ID NO: 2128396 - DNA, 19 bp, Homo sapiens
atttgttatttgtacagtt

SEQ ID NO: 2128397 - DNA, 16 bp, Homo sapiens
atttgttgaaattatg

SEQ ID NO: 2128398 - DNA, 13 bp, Homo sapiens
atttgttgagagt

SEQ ID NO: 2128399 - DNA, 14 bp, Homo sapiens
atttgttggaatga

SEQ ID NO: 2128400 - DNA, 19 bp, Homo sapiens
attttgtattacatctaat

SEQ ID NO: 2128401 - DNA, 19 bp, Homo sapiens
attttgttaataataagat

SEQ ID NO: 2128402 - DNA, 15 bp, Homo sapiens
attttgttgtgattt

SEQ ID NO: 2128403 - DNA, 23 bp, Homo sapiens
attttgttgtgattttgtacaga

SEQ ID NO: 2128404 - DNA, 24 bp, Homo sapiens
attttgttgtgattttgtacagaa

SEQ ID NO: 2128405 - DNA, 21 bp, Homo sapiens
attttgtttcagaattttgta

SEQ ID NO: 2128406 - DNA, 20 bp, Homo sapiens
attttgtttgtaatcctgta

SEQ ID NO: 2128407 - DNA, 14 bp, Homo sapiens
atttttaaacaagt

SEQ ID NO: 2128408 - DNA, 14 bp, Homo sapiens
atttttaaactagt

SEQ ID NO: 2128409 - DNA, 15 bp, Homo sapiens
atttttaaactagta

SEQ ID NO: 2128410 - DNA, 17 bp, Homo sapiens
atttttaaagtatatat

SEQ ID NO: 2128411 - DNA, 15 bp, Homo sapiens
atttttaatgacttt

SEQ ID NO: 2128412 - DNA, 18 bp, Homo sapiens
atttttaatgacttttta

SEQ ID NO: 2128413 - DNA, 17 bp, Homo sapiens
atttttactaaagcagt

SEQ ID NO: 2128414 - DNA, 21 bp, Homo sapiens
atttttactaaagcagtgttt

SEQ ID NO: 2128415 - DNA, 22 bp, Homo sapiens
atttttagaattttagaagaga

SEQ ID NO: 2128416 - DNA, 13 bp, Homo sapiens
atttttagagatt

SEQ ID NO: 2128417 - DNA, 16 bp, Homo sapiens
atttttatacatatca

SEQ ID NO: 2128418 - DNA, 17 bp, Homo sapiens
atttttatacatatcag

SEQ ID NO: 2128419 - DNA, 12 bp, Homo sapiens
atttttatccat

SEQ ID NO: 2128420 - DNA, 12 bp, Homo sapiens
atttttatggaa

SEQ ID NO: 2128421 - DNA, 14 bp, Homo sapiens
atttttatttttga

SEQ ID NO: 2128422 - DNA, 19 bp, Homo sapiens
atttttcattgatatgaaa

SEQ ID NO: 2128423 - DNA, 20 bp, Homo sapiens
atttttcttatttcatttct

SEQ ID NO: 2128424 - DNA, 15 bp, Homo sapiens
atttttcttctaaaa

SEQ ID NO: 2128425 - DNA, 14 bp, Homo sapiens
atttttgaataaaa

SEQ ID NO: 2128426 - DNA, 23 bp, Homo sapiens
atttttgagccaagcttcaaccc

SEQ ID NO: 2128427 - DNA, 11 bp, Homo sapiens
atttttgcaat

SEQ ID NO: 2128428 - DNA, 23 bp, Homo sapiens
atttttgtcattttaaaatctga

SEQ ID NO: 2128429 - DNA, 14 bp, Homo sapiens
atttttgtccctgc

SEQ ID NO: 2128430 - DNA, 15 bp, Homo sapiens
atttttgtccctgct

SEQ ID NO: 2128431 - DNA, 23 bp, Homo sapiens
atttttgtccctgctcctcccaa

SEQ ID NO: 2128432 - DNA, 17 bp, Homo sapiens
atttttgtgtttctaaa

SEQ ID NO: 2128433 - DNA, 21 bp, Homo sapiens
atttttgttttcattatctca

SEQ ID NO: 2128434 - DNA, 20 bp, Homo sapiens
attttttaaaaaagcttaaa

SEQ ID NO: 2128435 - DNA, 17 bp, Homo sapiens
attttttaaaagaaatt

SEQ ID NO: 2128436 - DNA, 23 bp, Homo sapiens
attttttaaatgaaaatgtaact

SEQ ID NO: 2128437 - DNA, 17 bp, Homo sapiens
attttttaagtatttat

SEQ ID NO: 2128438 - DNA, 20 bp, Homo sapiens
attttttaagtatttatata

SEQ ID NO: 2128439 - DNA, 12 bp, Homo sapiens
attttttaataa

SEQ ID NO: 2128440 - DNA, 19 bp, Homo sapiens
attttttacagctgcctgc

SEQ ID NO: 2128441 - DNA, 15 bp, Homo sapiens
attttttctacacag

SEQ ID NO: 2128442 - DNA, 19 bp, Homo sapiens
attttttgatgtcagcctt

SEQ ID NO: 2128443 - DNA, 18 bp, Homo sapiens
atttttttaaagatgccc

SEQ ID NO: 2128444 - DNA, 13 bp, Homo sapiens
atttttttaagct

SEQ ID NO: 2128445 - DNA, 22 bp, Homo sapiens
atttttttaagttagagaatat

SEQ ID NO: 2128446 - DNA, 16 bp, Homo sapiens
atttttttattactga

SEQ ID NO: 2128447 - DNA, 17 bp, Homo sapiens
attttttttttaaaact

SEQ ID NO: 2128448 - DNA, 16 bp, Homo sapiens
caaaaaaacactagtt

SEQ ID NO: 2128449 - DNA, 12 bp, Homo sapiens
caaaaaagaaaa

SEQ ID NO: 2128450 - DNA, 14 bp, Homo sapiens
caaaaaagaaaacc

SEQ ID NO: 2128451 - DNA, 18 bp, Homo sapiens
caaaaaagtatagaaaag

SEQ ID NO: 2128452 - DNA, 17 bp, Homo sapiens
caaaaacaaaaccagct

SEQ ID NO: 2128453 - DNA, 18 bp, Homo sapiens
caaaaacaaaaccagctg

SEQ ID NO: 2128454 - DNA, 19 bp, Homo sapiens
caaaaacaaaaccagctgc

SEQ ID NO: 2128455 - DNA, 16 bp, Homo sapiens
caaaaacagcctcaca

SEQ ID NO: 2128456 - DNA, 15 bp, Homo sapiens
caaaaaccagcaggt

SEQ ID NO: 2128457 - DNA, 22 bp, Homo sapiens
caaaaaggaccaactggcttct

SEQ ID NO: 2128458 - DNA, 11 bp, Homo sapiens
caaaaagtgtt

SEQ ID NO: 2128459 - DNA, 16 bp, Homo sapiens
caaaaagtttcctttt

SEQ ID NO: 2128460 - DNA, 16 bp, Homo sapiens
caaaaataaactagtt

SEQ ID NO: 2128461 - DNA, 23 bp, Homo sapiens
caaaaataaactagtttccagtg

SEQ ID NO: 2128462 - DNA, 14 bp, Homo sapiens
caaaaatagctaaa

SEQ ID NO: 2128463 - DNA, 14 bp, Homo sapiens
caaaaatgttccct

SEQ ID NO: 2128464 - DNA, 21 bp, Homo sapiens
caaaaattacactacaagttt

SEQ ID NO: 2128465 - DNA, 15 bp, Homo sapiens
caaaaattagccggg

SEQ ID NO: 2128466 - DNA, 21 bp, Homo sapiens
caaaaattgtgtttagatttt

SEQ ID NO: 2128467 - DNA, 16 bp, Homo sapiens
caaaacaaaacaacaa

SEQ ID NO: 2128468 - DNA, 11 bp, Homo sapiens
caaaacaacaa

SEQ ID NO: 2128469 - DNA, 12 bp, Homo sapiens
caaaacaacaac

SEQ ID NO: 2128470 - DNA, 16 bp, Homo sapiens
caaaacaacaacaata

SEQ ID NO: 2128471 - DNA, 19 bp, Homo sapiens
caaaacaaccatcctgctc

SEQ ID NO: 2128472 - DNA, 16 bp, Homo sapiens
caaaacaatgtttaaa

SEQ ID NO: 2128473 - DNA, 17 bp, Homo sapiens
caaaacatatcaattca

SEQ ID NO: 2128474 - DNA, 22 bp, Homo sapiens
caaaaccatgcattcctaagaa

SEQ ID NO: 2128475 - DNA, 16 bp, Homo sapiens
caaaaccccatctcta

SEQ ID NO: 2128476 - DNA, 21 bp, Homo sapiens
caaaacctcatgacagccaga

SEQ ID NO: 2128477 - DNA, 21 bp, Homo sapiens
caaaacctgatgttaaaattc

SEQ ID NO: 2128478 - DNA, 18 bp, Homo sapiens
caaaacctttccccagac

SEQ ID NO: 2128479 - DNA, 18 bp, Homo sapiens
caaaactgcactgtcaag

SEQ ID NO: 2128480 - DNA, 13 bp, Homo sapiens
caaaacttaacat

SEQ ID NO: 2128481 - DNA, 19 bp, Homo sapiens
caaaagaacaagaatttct

SEQ ID NO: 2128482 - DNA, 15 bp, Homo sapiens
caaaagaagaagttt

SEQ ID NO: 2128483 - DNA, 11 bp, Homo sapiens
caaaagacagc

SEQ ID NO: 2128484 - DNA, 13 bp, Homo sapiens
caaaagagagaat

SEQ ID NO: 2128485 - DNA, 23 bp, Homo sapiens
caaaagcaagactgttgctcaaa

SEQ ID NO: 2128486 - DNA, 21 bp, Homo sapiens
caaaagcacttgttccttctg

SEQ ID NO: 2128487 - DNA, 20 bp, Homo sapiens
caaaagctctctttggaatg

SEQ ID NO: 2128488 - DNA, 16 bp, Homo sapiens
caaaagggcagccagg

SEQ ID NO: 2128489 - DNA, 17 bp, Homo sapiens
caaaagggcagccaggg

SEQ ID NO: 2128490 - DNA, 20 bp, Homo sapiens
caaaagggcagccaggggct

SEQ ID NO: 2128491 - DNA, 21 bp, Homo sapiens
caaaagggcagccaggggctg

SEQ ID NO: 2128492 - DNA, 14 bp, Homo sapiens
caaaagtgaacttg

SEQ ID NO: 2128493 - DNA, 14 bp, Homo sapiens
caaaagtgatctgt

SEQ ID NO: 2128494 - DNA, 21 bp, Homo sapiens
caaaagtgatctgtcccctct

SEQ ID NO: 2128495 - DNA, 22 bp, Homo sapiens
caaaagtgatctgtcccctctc

SEQ ID NO: 2128496 - DNA, 22 bp, Homo sapiens
caaaagtggggctaaatgaagt

SEQ ID NO: 2128497 - DNA, 16 bp, Homo sapiens
caaaagttacatgttt

SEQ ID NO: 2128498 - DNA, 17 bp, Homo sapiens
caaaagttagctgagcg

SEQ ID NO: 2128499 - DNA, 11 bp, Homo sapiens
caaaataaatt

SEQ ID NO: 2128500 - DNA, 13 bp, Homo sapiens
caaaataatttaa

SEQ ID NO: 2128501 - DNA, 17 bp, Homo sapiens
caaaataatttaactaa

SEQ ID NO: 2128502 - DNA, 20 bp, Homo sapiens
caaaataatttaactaattt

SEQ ID NO: 2128503 - DNA, 13 bp, Homo sapiens
caaaatagaagct

SEQ ID NO: 2128504 - DNA, 16 bp, Homo sapiens
caaaatagtgccacta

SEQ ID NO: 2128505 - DNA, 13 bp, Homo sapiens
caaaatatataat

SEQ ID NO: 2128506 - DNA, 15 bp, Homo sapiens
caaaatatttaatta

SEQ ID NO: 2128507 - DNA, 12 bp, Homo sapiens
caaaatattttc

SEQ ID NO: 2128508 - DNA, 16 bp, Homo sapiens
caaaatcacaagcaat

SEQ ID NO: 2128509 - DNA, 23 bp, Homo sapiens
caaaatcatgaatatttcaaaat

SEQ ID NO: 2128510 - DNA, 21 bp, Homo sapiens
caaaatgaagttttatagaaa

SEQ ID NO: 2128511 - DNA, 22 bp, Homo sapiens
caaaatgtcacaatcctgtccc

SEQ ID NO: 2128512 - DNA, 22 bp, Homo sapiens
caaaatgttgaaatatgatgtt

SEQ ID NO: 2128513 - DNA, 13 bp, Homo sapiens
caaaatgttgcaa

SEQ ID NO: 2128514 - DNA, 13 bp, Homo sapiens
caaaattacttct

SEQ ID NO: 2128515 - DNA, 16 bp, Homo sapiens
caaaattataagaaga

SEQ ID NO: 2128516 - DNA, 18 bp, Homo sapiens
caaaattataagaagagg

SEQ ID NO: 2128517 - DNA, 14 bp, Homo sapiens
caaccctcagcctt

SEQ ID NO: 2128518 - DNA, 13 bp, Homo sapiens
caaccctgtttcc

SEQ ID NO: 2128519 - DNA, 22 bp, Homo sapiens
caaccgccacacacacaggagc

SEQ ID NO: 2128520 - DNA, 16 bp, Homo sapiens
caaccgcttgccatat

SEQ ID NO: 2128521 - DNA, 15 bp, Homo sapiens
caaccgtggcccttc

SEQ ID NO: 2128522 - DNA, 20 bp, Homo sapiens
caaccgtggcccttcctgga

SEQ ID NO: 2128523 - DNA, 14 bp, Homo sapiens
caacctaagcaaca

SEQ ID NO: 2128524 - DNA, 21 bp, Homo sapiens
caacctaccaccccttcctgt

SEQ ID NO: 2128525 - DNA, 18 bp, Homo sapiens
caacctcaatgccctgcc

SEQ ID NO: 2128526 - DNA, 20 bp, Homo sapiens
caacctcaatgccctgccat

SEQ ID NO: 2128527 - DNA, 15 bp, Homo sapiens
caacctcagtaattt

SEQ ID NO: 2128528 - DNA, 16 bp, Homo sapiens
caacctcccaacccag

SEQ ID NO: 2128529 - DNA, 20 bp, Homo sapiens
caacctccccgcagagctcc

SEQ ID NO: 2128530 - DNA, 21 bp, Homo sapiens
caacctccccgcagagctccc

SEQ ID NO: 2128531 - DNA, 16 bp, Homo sapiens
caacctcttcctcctg

SEQ ID NO: 2128532 - DNA, 17 bp, Homo sapiens
caacctcttcctcctgg

SEQ ID NO: 2128533 - DNA, 24 bp, Homo sapiens
caacctgaatacccttttctgacc

SEQ ID NO: 2128534 - DNA, 23 bp, Homo sapiens
caacctgaccaacatggagaaac

SEQ ID NO: 2128535 - DNA, 21 bp, Homo sapiens
caacctgagccttttcttata

SEQ ID NO: 2128536 - DNA, 12 bp, Homo sapiens
caacctgcctgt

SEQ ID NO: 2128537 - DNA, 16 bp, Homo sapiens
caacctgcctgtgcat

SEQ ID NO: 2128538 - DNA, 18 bp, Homo sapiens
caacctgctctcctcttg

SEQ ID NO: 2128539 - DNA, 17 bp, Homo sapiens
caacctggtggcaccag

SEQ ID NO: 2128540 - DNA, 22 bp, Homo sapiens
caacctggtggcaccagatgca

SEQ ID NO: 2128541 - DNA, 15 bp, Homo sapiens
caaccttcattttac

SEQ ID NO: 2128542 - DNA, 20 bp, Homo sapiens
caaccttctgtggctcacag

SEQ ID NO: 2128543 - DNA, 14 bp, Homo sapiens
caaccttgcatcca

SEQ ID NO: 2128544 - DNA, 16 bp, Homo sapiens
caacctttaaaaaagc

SEQ ID NO: 2128545 - DNA, 19 bp, Homo sapiens
caacctttccctcaccccc

SEQ ID NO: 2128546 - DNA, 14 bp, Homo sapiens
caacctttgtgtaa

SEQ ID NO: 2128547 - DNA, 12 bp, Homo sapiens
caacgcagccct

SEQ ID NO: 2128548 - DNA, 13 bp, Homo sapiens
caactaagccctc

SEQ ID NO: 2128549 - DNA, 16 bp, Homo sapiens
caactaatcaagagtg

SEQ ID NO: 2128550 - DNA, 20 bp, Homo sapiens
caactactcagctctcctgc

SEQ ID NO: 2128551 - DNA, 15 bp, Homo sapiens
caactagacattacc

SEQ ID NO: 2128552 - DNA, 16 bp, Homo sapiens
caactaggacctcata

SEQ ID NO: 2128553 - DNA, 13 bp, Homo sapiens
caactatttataa

SEQ ID NO: 2128554 - DNA, 20 bp, Homo sapiens
caactcactcttatgaaatg

SEQ ID NO: 2128555 - DNA, 22 bp, Homo sapiens
caactccagaagtggggctctg

SEQ ID NO: 2128556 - DNA, 19 bp, Homo sapiens
caactccaggaaaactgtt

SEQ ID NO: 2128557 - DNA, 14 bp, Homo sapiens
caactcctggaagc

SEQ ID NO: 2128558 - DNA, 17 bp, Homo sapiens
caactcctggaagctgt

SEQ ID NO: 2128559 - DNA, 17 bp, Homo sapiens
caactccttccagctag

SEQ ID NO: 2128560 - DNA, 13 bp, Homo sapiens
caactctccactc

SEQ ID NO: 2128561 - DNA, 16 bp, Homo sapiens
caactctccactccat

SEQ ID NO: 2128562 - DNA, 12 bp, Homo sapiens
caactctctcct

SEQ ID NO: 2128563 - DNA, 14 bp, Homo sapiens
caactgaaaagact

SEQ ID NO: 2128564 - DNA, 11 bp, Homo sapiens
caactgacaca

SEQ ID NO: 2128565 - DNA, 20 bp, Homo sapiens
caactgaggcagacagcagc

SEQ ID NO: 2128566 - DNA, 15 bp, Homo sapiens
caactgccccgggtg

SEQ ID NO: 2128567 - DNA, 17 bp, Homo sapiens
caactgcctggatgtgt

SEQ ID NO: 2128568 - DNA, 15 bp, Homo sapiens
caactgctctgccca

SEQ ID NO: 2128569 - DNA, 15 bp, Homo sapiens
caactggctggccag

SEQ ID NO: 2128570 - DNA, 16 bp, Homo sapiens
caactggctggccagt

SEQ ID NO: 2128571 - DNA, 22 bp, Homo sapiens
caactgtttttgaagaagggaa

SEQ ID NO: 2128572 - DNA, 20 bp, Homo sapiens
caacttaaatcactgaggca

SEQ ID NO: 2128573 - DNA, 21 bp, Homo sapiens
caacttaatgttctgaataat

SEQ ID NO: 2128574 - DNA, 18 bp, Homo sapiens
caacttagatctccagga

SEQ ID NO: 2128575 - DNA, 17 bp, Homo sapiens
caacttcaagtgcatgc

SEQ ID NO: 2128576 - DNA, 13 bp, Homo sapiens
caacttgcttcta

SEQ ID NO: 2128577 - DNA, 20 bp, Homo sapiens
caacttggaaaaagaaagaa

SEQ ID NO: 2128578 - DNA, 12 bp, Homo sapiens
caacttggcttt

SEQ ID NO: 2128579 - DNA, 17 bp, Homo sapiens
caacttggctttcccgg

SEQ ID NO: 2128580 - DNA, 22 bp, Homo sapiens
caacttgtaaatacaccacctc

SEQ ID NO: 2128581 - DNA, 12 bp, Homo sapiens
caacttgtgtac

SEQ ID NO: 2128582 - DNA, 12 bp, Homo sapiens
caactttctgta

SEQ ID NO: 2128583 - DNA, 23 bp, Homo sapiens
caactttctgtaaactcaaaact

SEQ ID NO: 2128584 - DNA, 21 bp, Homo sapiens
caagaaaagaggaaaaaaagc

SEQ ID NO: 2128585 - DNA, 15 bp, Homo sapiens
caagaaaaggcatgg

SEQ ID NO: 2128586 - DNA, 14 bp, Homo sapiens
caagaaacagaagt

SEQ ID NO: 2128587 - DNA, 17 bp, Homo sapiens
caagaaacagaagtaga

SEQ ID NO: 2128588 - DNA, 17 bp, Homo sapiens
caagaaagatccaccct

SEQ ID NO: 2128589 - DNA, 22 bp, Homo sapiens
caagaaatccagtttcccacca

SEQ ID NO: 2128590 - DNA, 14 bp, Homo sapiens
caagaaatccctgt

SEQ ID NO: 2128591 - DNA, 23 bp, Homo sapiens
caagaacaacaacaacaataaca

SEQ ID NO: 2128592 - DNA, 19 bp, Homo sapiens
caagaactctgcacagcaa

SEQ ID NO: 2128593 - DNA, 13 bp, Homo sapiens
caagaagaatata

SEQ ID NO: 2128594 - DNA, 21 bp, Homo sapiens
caagaagaccagactgtggag

SEQ ID NO: 2128595 - DNA, 16 bp, Homo sapiens
caagaagctcccagat

SEQ ID NO: 2128596 - DNA, 19 bp, Homo sapiens
caagaaggaaggaggcaga

SEQ ID NO: 2128597 - DNA, 20 bp, Homo sapiens
caagaaggaaggaggcagac

SEQ ID NO: 2128598 - DNA, 20 bp, Homo sapiens
caagaaggggacagcgccac

SEQ ID NO: 2128599 - DNA, 14 bp, Homo sapiens
caagaatcctctgg

SEQ ID NO: 2128600 - DNA, 17 bp, Homo sapiens
caagaattctagaaaat

SEQ ID NO: 2128601 - DNA, 13 bp, Homo sapiens
caagacacctttt

SEQ ID NO: 2128602 - DNA, 16 bp, Homo sapiens
caagactgttagccct

SEQ ID NO: 2128603 - DNA, 16 bp, Homo sapiens
caagactgttgctcaa

SEQ ID NO: 2128604 - DNA, 17 bp, Homo sapiens
caagactgttgctcaaa

SEQ ID NO: 2128605 - DNA, 21 bp, Homo sapiens
caagacttctctttgcctcaa

SEQ ID NO: 2128606 - DNA, 13 bp, Homo sapiens
caagagaaaataa

SEQ ID NO: 2128607 - DNA, 12 bp, Homo sapiens
caagagaacatt

SEQ ID NO: 2128608 - DNA, 19 bp, Homo sapiens
caaggagaaacagagacag

SEQ ID NO: 2128609 - DNA, 14 bp, Homo sapiens
caaggagcccagaa

SEQ ID NO: 2128610 - DNA, 19 bp, Homo sapiens
caaggagctgatttccagg

SEQ ID NO: 2128611 - DNA, 20 bp, Homo sapiens
caaggagctgatttccaggc

SEQ ID NO: 2128612 - DNA, 23 bp, Homo sapiens
caaggagctgatttccaggcccc

SEQ ID NO: 2128613 - DNA, 18 bp, Homo sapiens
caaggagtatgcagggag

SEQ ID NO: 2128614 - DNA, 21 bp, Homo sapiens
caaggagttccatgaagacca

SEQ ID NO: 2128615 - DNA, 20 bp, Homo sapiens
caaggattgctactgtccta

SEQ ID NO: 2128616 - DNA, 14 bp, Homo sapiens
caaggcacttgtca

SEQ ID NO: 2128617 - DNA, 14 bp, Homo sapiens
caaggcagcaaggc

SEQ ID NO: 2128618 - DNA, 17 bp, Homo sapiens
caaggcagcaaggcccg

SEQ ID NO: 2128619 - DNA, 15 bp, Homo sapiens
caaggcagcctccag

SEQ ID NO: 2128620 - DNA, 17 bp, Homo sapiens
caaggcagcctccagag

SEQ ID NO: 2128621 - DNA, 24 bp, Homo sapiens
caaggcagcctccagagccagcct

SEQ ID NO: 2128622 - DNA, 13 bp, Homo sapiens
caaggcagtgttc

SEQ ID NO: 2128623 - DNA, 12 bp, Homo sapiens
caaggcccagct

SEQ ID NO: 2128624 - DNA, 14 bp, Homo sapiens
caaggcccgagcag

SEQ ID NO: 2128625 - DNA, 17 bp, Homo sapiens
caaggcccgagcagctg

SEQ ID NO: 2128626 - DNA, 14 bp, Homo sapiens
caatatttattatt

SEQ ID NO: 2128627 - DNA, 13 bp, Homo sapiens
caatatttgtaga

SEQ ID NO: 2128628 - DNA, 15 bp, Homo sapiens
caatattttccatga

SEQ ID NO: 2128629 - DNA, 16 bp, Homo sapiens
caatattttccatgaa

SEQ ID NO: 2128630 - DNA, 19 bp, Homo sapiens
caatattttccatgaaaat

SEQ ID NO: 2128631 - DNA, 14 bp, Homo sapiens
caatcagcactgaa

SEQ ID NO: 2128632 - DNA, 15 bp, Homo sapiens
caatcagcactgaaa

SEQ ID NO: 2128633 - DNA, 17 bp, Homo sapiens
caatcagcactgaaaat

SEQ ID NO: 2128634 - DNA, 14 bp, Homo sapiens
caatcattttaaga

SEQ ID NO: 2128635 - DNA, 14 bp, Homo sapiens
caatccactctcag

SEQ ID NO: 2128636 - DNA, 15 bp, Homo sapiens
caatccactctcagg

SEQ ID NO: 2128637 - DNA, 16 bp, Homo sapiens
caatccactctcagga

SEQ ID NO: 2128638 - DNA, 21 bp, Homo sapiens
caatccatgttagtttttact

SEQ ID NO: 2128639 - DNA, 21 bp, Homo sapiens
caatcccctcattcaggaaaa

SEQ ID NO: 2128640 - DNA, 22 bp, Homo sapiens
caatcccttaatatcctaaaca

SEQ ID NO: 2128641 - DNA, 17 bp, Homo sapiens
caatcctaacacattat

SEQ ID NO: 2128642 - DNA, 20 bp, Homo sapiens
caatcctagaaccaagcttc

SEQ ID NO: 2128643 - DNA, 14 bp, Homo sapiens
caatccttgttcag

SEQ ID NO: 2128644 - DNA, 21 bp, Homo sapiens
caatctcaaattctcaaccta

SEQ ID NO: 2128645 - DNA, 18 bp, Homo sapiens
caatctccagggctgccc

SEQ ID NO: 2128646 - DNA, 20 bp, Homo sapiens
caatctccagggctgcccct

SEQ ID NO: 2128647 - DNA, 15 bp, Homo sapiens
caatctctgtgactc

SEQ ID NO: 2128648 - DNA, 18 bp, Homo sapiens
caatctgggactttcact

SEQ ID NO: 2128649 - DNA, 21 bp, Homo sapiens
caatcttcggggtgtgatgaa

SEQ ID NO: 2128650 - DNA, 15 bp, Homo sapiens
caatgaaacagatga

SEQ ID NO: 2128651 - DNA, 12 bp, Homo sapiens
caatgaaaccaa

SEQ ID NO: 2128652 - DNA, 13 bp, Homo sapiens
caatgaaaccaaa

SEQ ID NO: 2128653 - DNA, 15 bp, Homo sapiens
caatgaaaccaaagc

SEQ ID NO: 2128654 - DNA, 17 bp, Homo sapiens
caatgaaagtttgcact

SEQ ID NO: 2128655 - DNA, 22 bp, Homo sapiens
caatgaaatacacaagtaaaca

SEQ ID NO: 2128656 - DNA, 20 bp, Homo sapiens
caatgaaatatttgcttatt

SEQ ID NO: 2128657 - DNA, 15 bp, Homo sapiens
caatgaacaaaggga

SEQ ID NO: 2128658 - DNA, 12 bp, Homo sapiens
caatgagctgta

SEQ ID NO: 2128659 - DNA, 13 bp, Homo sapiens
caatgagctgtat

SEQ ID NO: 2128660 - DNA, 15 bp, Homo sapiens
caatgattattttca

SEQ ID NO: 2128661 - DNA, 20 bp, Homo sapiens
caatgattattttcattaca

SEQ ID NO: 2128662 - DNA, 19 bp, Homo sapiens
caatgattcataacaatgt

SEQ ID NO: 2128663 - DNA, 13 bp, Homo sapiens
caatgcaaagtaa

SEQ ID NO: 2128664 - DNA, 18 bp, Homo sapiens
caatgcacatccattccc

SEQ ID NO: 2128665 - DNA, 23 bp, Homo sapiens
caatgcacctaaagaaaaacaaa

SEQ ID NO: 2128666 - DNA, 14 bp, Homo sapiens
caatgcactgacat

SEQ ID NO: 2128667 - DNA, 20 bp, Homo sapiens
caatgcatgcagccactgtg

SEQ ID NO: 2128668 - DNA, 16 bp, Homo sapiens
caatgcctataaaatg

SEQ ID NO: 2128669 - DNA, 16 bp, Homo sapiens
caatgcctctcccacg

SEQ ID NO: 2128670 - DNA, 17 bp, Homo sapiens
caatgcctctcccacga

SEQ ID NO: 2128671 - DNA, 23 bp, Homo sapiens
caatgccttgacaacagactgaa

SEQ ID NO: 2128672 - DNA, 14 bp, Homo sapiens
caatgcgtgttgta

SEQ ID NO: 2128673 - DNA, 13 bp, Homo sapiens
caatgctggctgt

SEQ ID NO: 2128674 - DNA, 20 bp, Homo sapiens
caatgctggctgttggctgg

SEQ ID NO: 2128675 - DNA, 13 bp, Homo sapiens
caatgctttggga

SEQ ID NO: 2128676 - DNA, 19 bp, Homo sapiens
caatgctttgggaggccaa

SEQ ID NO: 2128677 - DNA, 13 bp, Homo sapiens
caatggaaacaat

SEQ ID NO: 2128678 - DNA, 19 bp, Homo sapiens
caatggaaacagggcagtg

SEQ ID NO: 2128679 - DNA, 17 bp, Homo sapiens
caatggagttcagagat

SEQ ID NO: 2128680 - DNA, 14 bp, Homo sapiens
caatggcagctaga

SEQ ID NO: 2128681 - DNA, 19 bp, Homo sapiens
caatggcagctagactgga

SEQ ID NO: 2128682 - DNA, 16 bp, Homo sapiens
caatggctaattccca

SEQ ID NO: 2128683 - DNA, 18 bp, Homo sapiens
caatggcttactccagga

SEQ ID NO: 2128684 - DNA, 23 bp, Homo sapiens
caatgggagggggctccatggag

SEQ ID NO: 2128685 - DNA, 15 bp, Homo sapiens
caatgggcaatgaca

SEQ ID NO: 2128686 - DNA, 17 bp, Homo sapiens
caatgggcactgggatg

SEQ ID NO: 2128687 - DNA, 19 bp, Homo sapiens
caatggggagaggcaaatg

SEQ ID NO: 2128688 - DNA, 18 bp, Homo sapiens
caatggtttacatgaaca

SEQ ID NO: 2128689 - DNA, 13 bp, Homo sapiens
caatggtttgcaa

SEQ ID NO: 2128690 - DNA, 17 bp, Homo sapiens
caatggtttgcaaggaa

SEQ ID NO: 2128691 - DNA, 17 bp, Homo sapiens
caatgtaaatattttaa

SEQ ID NO: 2128692 - DNA, 23 bp, Homo sapiens
caatgtaacattaattctactaa

SEQ ID NO: 2128693 - DNA, 19 bp, Homo sapiens
caatgtacccaccgggcca

SEQ ID NO: 2128694 - DNA, 22 bp, Homo sapiens
caatgtacccaccgggccactc

SEQ ID NO: 2128695 - DNA, 22 bp, Homo sapiens
caatgtatgtgaaagtgtaaaa

SEQ ID NO: 2128696 - DNA, 15 bp, Homo sapiens
caatgtcagaaactc

SEQ ID NO: 2128697 - DNA, 16 bp, Homo sapiens
caatgtcaggaacaga

SEQ ID NO: 2128698 - DNA, 19 bp, Homo sapiens
caatgtcaggaacagaagg

SEQ ID NO: 2128699 - DNA, 21 bp, Homo sapiens
caatgtgggcgtttgtaaatt

SEQ ID NO: 2128700 - DNA, 20 bp, Homo sapiens
caatgttctgttgtaaagag

SEQ ID NO: 2128701 - DNA, 13 bp, Homo sapiens
caatgttgtgatt

SEQ ID NO: 2128702 - DNA, 21 bp, Homo sapiens
caatgtttatttcataaagaa

SEQ ID NO: 2128703 - DNA, 22 bp, Homo sapiens
caatgttttcctttgtcatcat

SEQ ID NO: 2128704 - DNA, 15 bp, Homo sapiens
caattaaaatatata

SEQ ID NO: 2128705 - DNA, 22 bp, Homo sapiens
caattaaaatatatataaatat

SEQ ID NO: 2128706 - DNA, 20 bp, Homo sapiens
caattaaaattaaggtctgg

SEQ ID NO: 2128707 - DNA, 16 bp, Homo sapiens
caattaaacagccaaa

SEQ ID NO: 2128708 - DNA, 14 bp, Homo sapiens
caattaaaggcaaa

SEQ ID NO: 2128709 - DNA, 13 bp, Homo sapiens
caattaaatgtag

SEQ ID NO: 2128710 - DNA, 19 bp, Homo sapiens
caattactaaattgtatac

SEQ ID NO: 2128711 - DNA, 13 bp, Homo sapiens
caattatattgtc

SEQ ID NO: 2128712 - DNA, 18 bp, Homo sapiens
caattatcttatttaatt

SEQ ID NO: 2128713 - DNA, 13 bp, Homo sapiens
caattatgtgaca

SEQ ID NO: 2128714 - DNA, 14 bp, Homo sapiens
caattatgtgacaa

SEQ ID NO: 2128715 - DNA, 23 bp, Homo sapiens
caattatgtgacaacctttgtgt

SEQ ID NO: 2128716 - DNA, 15 bp, Homo sapiens
caattattacattta

SEQ ID NO: 2128717 - DNA, 18 bp, Homo sapiens
caattattgtacactaac

SEQ ID NO: 2128718 - DNA, 19 bp, Homo sapiens
caattattgtacactaaca

SEQ ID NO: 2128719 - DNA, 12 bp, Homo sapiens
caattatttcaa

SEQ ID NO: 2128720 - DNA, 12 bp, Homo sapiens
caattcaaaaca

SEQ ID NO: 2128721 - DNA, 19 bp, Homo sapiens
caattcaaaagctctcttt

SEQ ID NO: 2128722 - DNA, 13 bp, Homo sapiens
caattcaaagctg

SEQ ID NO: 2128723 - DNA, 23 bp, Homo sapiens
caattcaacacattacttgcaca

SEQ ID NO: 2128724 - DNA, 17 bp, Homo sapiens
caattcaggactggctc

SEQ ID NO: 2128725 - DNA, 21 bp, Homo sapiens
caattcagtgctgtacttgat

SEQ ID NO: 2128726 - DNA, 19 bp, Homo sapiens
caattccacagtctctggg

SEQ ID NO: 2128727 - DNA, 14 bp, Homo sapiens
caattccatcaccc

SEQ ID NO: 2128728 - DNA, 15 bp, Homo sapiens
attagactggaactt

SEQ ID NO: 2128729 - DNA, 21 bp, Homo sapiens
attagagggaggagaatgagc

SEQ ID NO: 2128730 - DNA, 15 bp, Homo sapiens
attagagtcagcctt

SEQ ID NO: 2128731 - DNA, 16 bp, Homo sapiens
attagatgttttacaa

SEQ ID NO: 2128732 - DNA, 22 bp, Homo sapiens
attagattcatctatggagggc

SEQ ID NO: 2128733 - DNA, 17 bp, Homo sapiens
attagcaactgtgctac

SEQ ID NO: 2128734 - DNA, 22 bp, Homo sapiens
attagcaattgactgtcactgt

SEQ ID NO: 2128735 - DNA, 18 bp, Homo sapiens
attagccgggcatggtgg

SEQ ID NO: 2128736 - DNA, 17 bp, Homo sapiens
attagctagaatgcaca

SEQ ID NO: 2128737 - DNA, 12 bp, Homo sapiens
attagctctgga

SEQ ID NO: 2128738 - DNA, 13 bp, Homo sapiens
attagctgtaaat

SEQ ID NO: 2128739 - DNA, 16 bp, Homo sapiens
attagctgtaaataca

SEQ ID NO: 2128740 - DNA, 18 bp, Homo sapiens
attaggaacagagtatat

SEQ ID NO: 2128741 - DNA, 21 bp, Homo sapiens
attaggaacagagtatatatg

SEQ ID NO: 2128742 - DNA, 22 bp, Homo sapiens
attaggaggctcaacaataaaa

SEQ ID NO: 2128743 - DNA, 16 bp, Homo sapiens
attagggagagaagat

SEQ ID NO: 2128744 - DNA, 15 bp, Homo sapiens
attaggggttgctaa

SEQ ID NO: 2128745 - DNA, 18 bp, Homo sapiens
attaggtactatctgtga

SEQ ID NO: 2128746 - DNA, 15 bp, Homo sapiens
attagtaattgtcaa

SEQ ID NO: 2128747 - DNA, 22 bp, Homo sapiens
attagtacagtagcttaaataa

SEQ ID NO: 2128748 - DNA, 15 bp, Homo sapiens
attagtatcctgtta

SEQ ID NO: 2128749 - DNA, 15 bp, Homo sapiens
attagtattcaggca

SEQ ID NO: 2128750 - DNA, 23 bp, Homo sapiens
attagtatttatttaatgttatg

SEQ ID NO: 2128751 - DNA, 23 bp, Homo sapiens
attagtccaaatgtgatcaactg

SEQ ID NO: 2128752 - DNA, 20 bp, Homo sapiens
attagtgagatttgtattta

SEQ ID NO: 2128753 - DNA, 12 bp, Homo sapiens
attataaaacca

SEQ ID NO: 2128754 - DNA, 16 bp, Homo sapiens
attataaaattatttt

SEQ ID NO: 2128755 - DNA, 13 bp, Homo sapiens
attataaataaat

SEQ ID NO: 2128756 - DNA, 16 bp, Homo sapiens
attataataatgttct

SEQ ID NO: 2128757 - DNA, 22 bp, Homo sapiens
attataatttttttcaatattt

SEQ ID NO: 2128758 - DNA, 23 bp, Homo sapiens
attatataggttgtgcaaattaa

SEQ ID NO: 2128759 - DNA, 13 bp, Homo sapiens
attatatctaatt

SEQ ID NO: 2128760 - DNA, 20 bp, Homo sapiens
attatatctaatttatacaa

SEQ ID NO: 2128761 - DNA, 14 bp, Homo sapiens
attatattaaaata

SEQ ID NO: 2128762 - DNA, 17 bp, Homo sapiens
attatcattcaaaacaa

SEQ ID NO: 2128763 - DNA, 17 bp, Homo sapiens
attatcgggaacagtgt

SEQ ID NO: 2128764 - DNA, 19 bp, Homo sapiens
attatcgggaacagtgttt

SEQ ID NO: 2128765 - DNA, 22 bp, Homo sapiens
attatcgggaacagtgtttccc

SEQ ID NO: 2128766 - DNA, 20 bp, Homo sapiens
attatcgggagcagtgtctt

SEQ ID NO: 2128767 - DNA, 18 bp, Homo sapiens
attatctcaaaactgcac

SEQ ID NO: 2128768 - DNA, 19 bp, Homo sapiens
attatgacagttatactgt

SEQ ID NO: 2128769 - DNA, 16 bp, Homo sapiens
attatggaagatttta

SEQ ID NO: 2128770 - DNA, 15 bp, Homo sapiens
attatgggtcctgca

SEQ ID NO: 2128771 - DNA, 16 bp, Homo sapiens
attatggtgtaatgca

SEQ ID NO: 2128772 - DNA, 20 bp, Homo sapiens
attatggtgtaatgcacaat

SEQ ID NO: 2128773 - DNA, 22 bp, Homo sapiens
attatggtgtaatgcacaattt

SEQ ID NO: 2128774 - DNA, 18 bp, Homo sapiens
attatgtaacatccagaa

SEQ ID NO: 2128775 - DNA, 19 bp, Homo sapiens
attatgtaacatccagaag

SEQ ID NO: 2128776 - DNA, 12 bp, Homo sapiens
attatgtagaaa

SEQ ID NO: 2128777 - DNA, 15 bp, Homo sapiens
attatgtagaaatat

SEQ ID NO: 2128778 - DNA, 17 bp, Homo sapiens
attatgtctcaaaataa

SEQ ID NO: 2128779 - DNA, 12 bp, Homo sapiens
attatgtgacaa

SEQ ID NO: 2128780 - DNA, 21 bp, Homo sapiens
attatgtgacaacctttgtgt

SEQ ID NO: 2128781 - DNA, 22 bp, Homo sapiens
attatgtgacaacctttgtgta

SEQ ID NO: 2128782 - DNA, 20 bp, Homo sapiens
attattacttatttttgaca

SEQ ID NO: 2128783 - DNA, 17 bp, Homo sapiens
attattcaagtgcctct

SEQ ID NO: 2128784 - DNA, 22 bp, Homo sapiens
caattgctttgtcatatagctg

SEQ ID NO: 2128785 - DNA, 13 bp, Homo sapiens
caattggctcctc

SEQ ID NO: 2128786 - DNA, 14 bp, Homo sapiens
caattgtaaaaaaa

SEQ ID NO: 2128787 - DNA, 18 bp, Homo sapiens
caattgtacattccctgc

SEQ ID NO: 2128788 - DNA, 14 bp, Homo sapiens
caattgtattttat

SEQ ID NO: 2128789 - DNA, 24 bp, Homo sapiens
caattgtattttatatgagagaat

SEQ ID NO: 2128790 - DNA, 14 bp, Homo sapiens
caattgtcatttat

SEQ ID NO: 2128791 - DNA, 16 bp, Homo sapiens
caatttaattcttatt

SEQ ID NO: 2128792 - DNA, 21 bp, Homo sapiens
caatttaattcttatttctgt

SEQ ID NO: 2128793 - DNA, 15 bp, Homo sapiens
caatttagaaaacat

SEQ ID NO: 2128794 - DNA, 22 bp, Homo sapiens
caatttagaaaacattcatcca

SEQ ID NO: 2128795 - DNA, 22 bp, Homo sapiens
caatttattaaaatgattgtaa

SEQ ID NO: 2128796 - DNA, 17 bp, Homo sapiens
caatttccaagagctga

SEQ ID NO: 2128797 - DNA, 15 bp, Homo sapiens
caatttcccagaagg

SEQ ID NO: 2128798 - DNA, 19 bp, Homo sapiens
caatttcctttatatttag

SEQ ID NO: 2128799 - DNA, 13 bp, Homo sapiens
caatttctgaaca

SEQ ID NO: 2128800 - DNA, 15 bp, Homo sapiens
caatttgagcaattc

SEQ ID NO: 2128801 - DNA, 20 bp, Homo sapiens
caattttctggaatacatga

SEQ ID NO: 2128802 - DNA, 12 bp, Homo sapiens
caattttgtaac

SEQ ID NO: 2128803 - DNA, 14 bp, Homo sapiens
caatttttaaacta

SEQ ID NO: 2128804 - DNA, 23 bp, Homo sapiens
caatttttatacatatcagaaaa

SEQ ID NO: 2128805 - DNA, 14 bp, Homo sapiens
caatttttttatac

SEQ ID NO: 2128806 - DNA, 16 bp, Homo sapiens
cacaaaagtttctctt

SEQ ID NO: 2128807 - DNA, 16 bp, Homo sapiens
cacaaaatgtcacaat

SEQ ID NO: 2128808 - DNA, 18 bp, Homo sapiens
cacaaaatgtcacacttg

SEQ ID NO: 2128809 - DNA, 15 bp, Homo sapiens
cacaaagccgtgcct

SEQ ID NO: 2128810 - DNA, 19 bp, Homo sapiens
cacaaagctcaagatgaca

SEQ ID NO: 2128811 - DNA, 12 bp, Homo sapiens
cacaaaggggag

SEQ ID NO: 2128812 - DNA, 16 bp, Homo sapiens
cacaaaggtataattt

SEQ ID NO: 2128813 - DNA, 21 bp, Homo sapiens
cacaaatatttattttctttc

SEQ ID NO: 2128814 - DNA, 18 bp, Homo sapiens
cacaaatcaaagcaaggg

SEQ ID NO: 2128815 - DNA, 23 bp, Homo sapiens
cacaacagcctgacaacatttct

SEQ ID NO: 2128816 - DNA, 14 bp, Homo sapiens
cacaaccagccaca

SEQ ID NO: 2128817 - DNA, 17 bp, Homo sapiens
cacaaccagccacacag

SEQ ID NO: 2128818 - DNA, 17 bp, Homo sapiens
cacaaccttctgtggct

SEQ ID NO: 2128819 - DNA, 15 bp, Homo sapiens
cacaactgacacagg

SEQ ID NO: 2128820 - DNA, 18 bp, Homo sapiens
cacaactgtttttgaaga

SEQ ID NO: 2128821 - DNA, 17 bp, Homo sapiens
cacaagaggaagagaga

SEQ ID NO: 2128822 - DNA, 16 bp, Homo sapiens
cacaagattcccagag

SEQ ID NO: 2128823 - DNA, 21 bp, Homo sapiens
cacaagcaataattaggatct

SEQ ID NO: 2128824 - DNA, 13 bp, Homo sapiens
cacaagcacaaag

SEQ ID NO: 2128825 - DNA, 15 bp, Homo sapiens
cacaagccacagaag

SEQ ID NO: 2128826 - DNA, 13 bp, Homo sapiens
cacaagcccaggc

SEQ ID NO: 2128827 - DNA, 18 bp, Homo sapiens
cacaagccttactcacct

SEQ ID NO: 2128828 - DNA, 22 bp, Homo sapiens
cacaagccttactcacctctct

SEQ ID NO: 2128829 - DNA, 15 bp, Homo sapiens
cacaagctggaagca

SEQ ID NO: 2128830 - DNA, 16 bp, Homo sapiens
cacaagctggaagcac

SEQ ID NO: 2128831 - DNA, 19 bp, Homo sapiens
cacaagcttgtatatacat

SEQ ID NO: 2128832 - DNA, 22 bp, Homo sapiens
cacaagcttgtatatacatatt

SEQ ID NO: 2128833 - DNA, 14 bp, Homo sapiens
cacaaggcagcaag

SEQ ID NO: 2128834 - DNA, 18 bp, Homo sapiens
cacaaggcagcaaggccc

SEQ ID NO: 2128835 - DNA, 18 bp, Homo sapiens
cacaaggctgaccaagag

SEQ ID NO: 2128836 - DNA, 20 bp, Homo sapiens
cacaagtcctgtgaatttct

SEQ ID NO: 2128837 - DNA, 17 bp, Homo sapiens
cacaagttccagctggt

SEQ ID NO: 2128838 - DNA, 15 bp, Homo sapiens
cacaataattttcta

SEQ ID NO: 2128839 - DNA, 12 bp, Homo sapiens
cacaatatgaat

SEQ ID NO: 2128840 - DNA, 20 bp, Homo sapiens
cacaatcctaacacattatc

SEQ ID NO: 2128841 - DNA, 18 bp, Homo sapiens
cacaatctgggactttca

SEQ ID NO: 2128842 - DNA, 22 bp, Homo sapiens
cacaatctttccttgtctctca

SEQ ID NO: 2128843 - DNA, 23 bp, Homo sapiens
cacaatctttccttgtctctcat

SEQ ID NO: 2128844 - DNA, 22 bp, Homo sapiens
cacaatgaaatgctctcctttc

SEQ ID NO: 2128845 - DNA, 16 bp, Homo sapiens
cacaatgcctctccca

SEQ ID NO: 2128846 - DNA, 16 bp, Homo sapiens
cacaatgctattgaaa

SEQ ID NO: 2128847 - DNA, 22 bp, Homo sapiens
cacaattccatttccagttcat

SEQ ID NO: 2128848 - DNA, 23 bp, Homo sapiens
cacaattccatttccagttcatc

SEQ ID NO: 2128849 - DNA, 21 bp, Homo sapiens
cacaattgatacttcaggtgc

SEQ ID NO: 2128850 - DNA, 13 bp, Homo sapiens
cacaattgtaaag

SEQ ID NO: 2128851 - DNA, 12 bp, Homo sapiens
cacaatttagaa

SEQ ID NO: 2128852 - DNA, 13 bp, Homo sapiens
cacaatttatatt

SEQ ID NO: 2128853 - DNA, 18 bp, Homo sapiens
cacaatttgagcaattca

SEQ ID NO: 2128854 - DNA, 13 bp, Homo sapiens
cacacaaaggtat

SEQ ID NO: 2128855 - DNA, 16 bp, Homo sapiens
cacacaagtttgtgct

SEQ ID NO: 2128856 - DNA, 21 bp, Homo sapiens
cacacaagtttgtgctatcta

SEQ ID NO: 2128857 - DNA, 9 bp, Homo sapiens
cacacacac

SEQ ID NO: 2128858 - DNA, 10 bp, Homo sapiens
cacacacaca

SEQ ID NO: 2128859 - DNA, 13 bp, Homo sapiens
cacacacacacac

SEQ ID NO: 2128860 - DNA, 14 bp, Homo sapiens
cacacacacacaca

SEQ ID NO: 2128861 - DNA, 16 bp, Homo sapiens
cacacacacacacaca

SEQ ID NO: 2128862 - DNA, 13 bp, Homo sapiens
cacacacagagat

SEQ ID NO: 2128863 - DNA, 19 bp, Homo sapiens
cacacacagatatgcacac

SEQ ID NO: 2128864 - DNA, 13 bp, Homo sapiens
cacacacagctcc

SEQ ID NO: 2128865 - DNA, 11 bp, Homo sapiens
cacacacatac

SEQ ID NO: 2128866 - DNA, 14 bp, Homo sapiens
cacacaccagagcc

SEQ ID NO: 2128867 - DNA, 15 bp, Homo sapiens
cacacaccagagccc

SEQ ID NO: 2128868 - DNA, 14 bp, Homo sapiens
cacacacctcacca

SEQ ID NO: 2128869 - DNA, 24 bp, Homo sapiens
cacacacggatgcacacacagatg

SEQ ID NO: 2128870 - DNA, 12 bp, Homo sapiens
cacacagaaata

SEQ ID NO: 2128871 - DNA, 21 bp, Homo sapiens
cacacagaaatatatatacat

SEQ ID NO: 2128872 - DNA, 12 bp, Homo sapiens
cacacagacaca

SEQ ID NO: 2128873 - DNA, 14 bp, Homo sapiens
cacacagacacaca

SEQ ID NO: 2128874 - DNA, 16 bp, Homo sapiens
cacacagagcctgcct

SEQ ID NO: 2128875 - DNA, 12 bp, Homo sapiens
cacacagaggaa

SEQ ID NO: 2128876 - DNA, 18 bp, Homo sapiens
cacacagaggaagagcag

SEQ ID NO: 2128877 - DNA, 20 bp, Homo sapiens
cacacagatatgcacacaca

SEQ ID NO: 2128878 - DNA, 13 bp, Homo sapiens
cacacagatgcac

SEQ ID NO: 2128879 - DNA, 19 bp, Homo sapiens
cacacagatggtcacacag

SEQ ID NO: 2128880 - DNA, 13 bp, Homo sapiens
cacacagcagccc

SEQ ID NO: 2128881 - DNA, 14 bp, Homo sapiens
cacacagcagcccc

SEQ ID NO: 2128882 - DNA, 21 bp, Homo sapiens
cacacagcagccccccagcac

SEQ ID NO: 2128883 - DNA, 23 bp, Homo sapiens
cacacagcagccccccagcacta

SEQ ID NO: 2128884 - DNA, 18 bp, Homo sapiens
cacacagccacttagcag

SEQ ID NO: 2128885 - DNA, 13 bp, Homo sapiens
cacacaggcaact

SEQ ID NO: 2128886 - DNA, 16 bp, Homo sapiens
cacacaggcatttcct

SEQ ID NO: 2128887 - DNA, 18 bp, Homo sapiens
cacacaggcatttcctgg

SEQ ID NO: 2128888 - DNA, 23 bp, Homo sapiens
cacacagggtctgcaaggtcttt

SEQ ID NO: 2128889 - DNA, 17 bp, Homo sapiens
cacacaggtacagcaac

SEQ ID NO: 2128890 - DNA, 17 bp, Homo sapiens
cacacagtattaagtga

SEQ ID NO: 2128891 - DNA, 20 bp, Homo sapiens
cacacagtattacttctgct

SEQ ID NO: 2128892 - DNA, 22 bp, Homo sapiens
cacacatagattaatggcactg

SEQ ID NO: 2128893 - DNA, 15 bp, Homo sapiens
cacaggcatttcctg

SEQ ID NO: 2128894 - DNA, 11 bp, Homo sapiens
cacaggccagc

SEQ ID NO: 2128895 - DNA, 16 bp, Homo sapiens
cacaggccagccccat

SEQ ID NO: 2128896 - DNA, 17 bp, Homo sapiens
cacaggcccggctccag

SEQ ID NO: 2128897 - DNA, 18 bp, Homo sapiens
cacaggcccggctccagg

SEQ ID NO: 2128898 - DNA, 23 bp, Homo sapiens
cacaggcccggctccaggctcct

SEQ ID NO: 2128899 - DNA, 17 bp, Homo sapiens
cacaggcccttcctctc

SEQ ID NO: 2128900 - DNA, 23 bp, Homo sapiens
cacaggcccttcctctccactgc

SEQ ID NO: 2128901 - DNA, 13 bp, Homo sapiens
cacaggcctgtgt

SEQ ID NO: 2128902 - DNA, 14 bp, Homo sapiens
cacagggcagagcc

SEQ ID NO: 2128903 - DNA, 22 bp, Homo sapiens
cacagggccccagaaggcaggg

SEQ ID NO: 2128904 - DNA, 18 bp, Homo sapiens
cacaggggcaggcctggg

SEQ ID NO: 2128905 - DNA, 14 bp, Homo sapiens
cacaggggccccag

SEQ ID NO: 2128906 - DNA, 19 bp, Homo sapiens
cacaggggccccagatctg

SEQ ID NO: 2128907 - DNA, 18 bp, Homo sapiens
cacaggggcggggcagga

SEQ ID NO: 2128908 - DNA, 15 bp, Homo sapiens
cacagggttttgtat

SEQ ID NO: 2128909 - DNA, 13 bp, Homo sapiens
cacagtcctcaca

SEQ ID NO: 2128910 - DNA, 17 bp, Homo sapiens
cacagtcctcacagcct

SEQ ID NO: 2128911 - DNA, 20 bp, Homo sapiens
cacagtcctcacagcctctc

SEQ ID NO: 2128912 - DNA, 13 bp, Homo sapiens
cacagtctcagtc

SEQ ID NO: 2128913 - DNA, 20 bp, Homo sapiens
cacagtctcagtccagatgc

SEQ ID NO: 2128914 - DNA, 21 bp, Homo sapiens
cacagtctcagtccagatgcc

SEQ ID NO: 2128915 - DNA, 12 bp, Homo sapiens
cacagtctctgg

SEQ ID NO: 2128916 - DNA, 22 bp, Homo sapiens
cacagtctctttaatcttcagt

SEQ ID NO: 2128917 - DNA, 18 bp, Homo sapiens
cacagtgagtcgaggaca

SEQ ID NO: 2128918 - DNA, 20 bp, Homo sapiens
cacagtgagtcgaggacagg

SEQ ID NO: 2128919 - DNA, 22 bp, Homo sapiens
cacagtgagtcgaggacaggga

SEQ ID NO: 2128920 - DNA, 14 bp, Homo sapiens
cacagtgcatctca

SEQ ID NO: 2128921 - DNA, 18 bp, Homo sapiens
cacagtgcccagctaatt

SEQ ID NO: 2128922 - DNA, 12 bp, Homo sapiens
cacagtgctgct

SEQ ID NO: 2128923 - DNA, 13 bp, Homo sapiens
cacagtgggaact

SEQ ID NO: 2128924 - DNA, 19 bp, Homo sapiens
cacagtgggaactctgaca

SEQ ID NO: 2128925 - DNA, 20 bp, Homo sapiens
cacagtgggtggcacctcct

SEQ ID NO: 2128926 - DNA, 22 bp, Homo sapiens
cacagtgggtggcacctcctga

SEQ ID NO: 2128927 - DNA, 17 bp, Homo sapiens
cacagttcaattctcat

SEQ ID NO: 2128928 - DNA, 20 bp, Homo sapiens
cacagttcctcgccctgggt

SEQ ID NO: 2128929 - DNA, 22 bp, Homo sapiens
cacagttcctcgccctgggtct

SEQ ID NO: 2128930 - DNA, 19 bp, Homo sapiens
cacagttcgacctgcggct

SEQ ID NO: 2128931 - DNA, 17 bp, Homo sapiens
cacagttggctggatga

SEQ ID NO: 2128932 - DNA, 21 bp, Homo sapiens
cacagttgtctattctgagcc

SEQ ID NO: 2128933 - DNA, 13 bp, Homo sapiens
cacagtttagaac

SEQ ID NO: 2128934 - DNA, 16 bp, Homo sapiens
cacagtttagaacaga

SEQ ID NO: 2128935 - DNA, 20 bp, Homo sapiens
cacagtttagtgctttacat

SEQ ID NO: 2128936 - DNA, 14 bp, Homo sapiens
cacagttttctgag

SEQ ID NO: 2128937 - DNA, 17 bp, Homo sapiens
cacagttttctgagaaa

SEQ ID NO: 2128938 - DNA, 17 bp, Homo sapiens
cacagttttgaaagaaa

SEQ ID NO: 2128939 - DNA, 10 bp, Homo sapiens
cacataaagg

SEQ ID NO: 2128940 - DNA, 13 bp, Homo sapiens
cacataaaggtat

SEQ ID NO: 2128941 - DNA, 20 bp, Homo sapiens
cacataaaggtatttagaat

SEQ ID NO: 2128942 - DNA, 13 bp, Homo sapiens
cacataatgaatg

SEQ ID NO: 2128943 - DNA, 22 bp, Homo sapiens
cacatacaacacaaagagaaaa

SEQ ID NO: 2128944 - DNA, 15 bp, Homo sapiens
cacatacaatttgca

SEQ ID NO: 2128945 - DNA, 16 bp, Homo sapiens
cacatacaatttgcac

SEQ ID NO: 2128946 - DNA, 17 bp, Homo sapiens
cacatacaatttgcact

SEQ ID NO: 2128947 - DNA, 17 bp, Homo sapiens
cacatacacacacacgc

SEQ ID NO: 2128948 - DNA, 13 bp, Homo sapiens
cacatacatacac

SEQ ID NO: 2128949 - DNA, 13 bp, Homo sapiens
cacataccctccc

SEQ ID NO: 2128950 - DNA, 15 bp, Homo sapiens
cacataccctccccc

SEQ ID NO: 2128951 - DNA, 20 bp, Homo sapiens
cacatacgtgttaggaggct

SEQ ID NO: 2128952 - DNA, 18 bp, Homo sapiens
cacatactcatttttcat

SEQ ID NO: 2128953 - DNA, 18 bp, Homo sapiens
cacatagagatatgcaca

SEQ ID NO: 2128954 - DNA, 13 bp, Homo sapiens
cacatagattaat

SEQ ID NO: 2128955 - DNA, 23 bp, Homo sapiens
cacatagctacccaaaagagaaa

SEQ ID NO: 2128956 - DNA, 20 bp, Homo sapiens
cacatagttctccagttgta

SEQ ID NO: 2128957 - DNA, 20 bp, Homo sapiens
cacatataaaagttaaacta

SEQ ID NO: 2128958 - DNA, 12 bp, Homo sapiens
cacatatacata

SEQ ID NO: 2128959 - DNA, 23 bp, Homo sapiens
cacatatacctataatgtgtgta

SEQ ID NO: 2128960 - DNA, 17 bp, Homo sapiens
cacatatgtctgtatct

SEQ ID NO: 2128961 - DNA, 15 bp, Homo sapiens
cacatatttgatagt

SEQ ID NO: 2128962 - DNA, 24 bp, Homo sapiens
cacatcagctccactttcagtgaa

SEQ ID NO: 2128963 - DNA, 21 bp, Homo sapiens
cacatccattcccaagaaatg

SEQ ID NO: 2128964 - DNA, 21 bp, Homo sapiens
cacatccatttcatctatttc

SEQ ID NO: 2128965 - DNA, 15 bp, Homo sapiens
cacatcccggcctct

SEQ ID NO: 2128966 - DNA, 19 bp, Homo sapiens
cacatcccggcctcttcca

SEQ ID NO: 2128967 - DNA, 19 bp, Homo sapiens
cacatccctgccctcctac

SEQ ID NO: 2128968 - DNA, 13 bp, Homo sapiens
cacatccctgggc

SEQ ID NO: 2128969 - DNA, 17 bp, Homo sapiens
cacatccctgggcctgc

SEQ ID NO: 2128970 - DNA, 21 bp, Homo sapiens
cacatctctgaaagcacagga

SEQ ID NO: 2128971 - DNA, 12 bp, Homo sapiens
cacatcttctca

SEQ ID NO: 2128972 - DNA, 20 bp, Homo sapiens
cacatcttgctctgctgaca

SEQ ID NO: 2128973 - DNA, 13 bp, Homo sapiens
cacatgaggaggg

SEQ ID NO: 2128974 - DNA, 23 bp, Homo sapiens
cacatggaaggcggcacagaggc

SEQ ID NO: 2128975 - DNA, 21 bp, Homo sapiens
cacatggctatcctagagagg

SEQ ID NO: 2128976 - DNA, 19 bp, Homo sapiens
cacatgtaacatagattta

SEQ ID NO: 2128977 - DNA, 17 bp, Homo sapiens
cacatgtatctatgcat

SEQ ID NO: 2128978 - DNA, 12 bp, Homo sapiens
cacatgtcaccg

SEQ ID NO: 2128979 - DNA, 19 bp, Homo sapiens
cacatgtcaccgtggacct

SEQ ID NO: 2128980 - DNA, 22 bp, Homo sapiens
cacatgtcaccgtggaccttcc

SEQ ID NO: 2128981 - DNA, 12 bp, Homo sapiens
cacatgtccagt

SEQ ID NO: 2128982 - DNA, 17 bp, Homo sapiens
cacatgtccttgtgtgt

SEQ ID NO: 2128983 - DNA, 14 bp, Homo sapiens
cacatgtgcacatg

SEQ ID NO: 2128984 - DNA, 19 bp, Homo sapiens
cacatgtgtctgtgtggta

SEQ ID NO: 2128985 - DNA, 23 bp, Homo sapiens
cacatgtgttctctattttgcct

SEQ ID NO: 2128986 - DNA, 14 bp, Homo sapiens
cacattacttgcac

SEQ ID NO: 2128987 - DNA, 17 bp, Homo sapiens
cacattatcgggagcag

SEQ ID NO: 2128988 - DNA, 17 bp, Homo sapiens
cacattcaggaagatga

SEQ ID NO: 2128989 - DNA, 15 bp, Homo sapiens
cacattcctggcccc

SEQ ID NO: 2128990 - DNA, 23 bp, Homo sapiens
cacattcggaccctgcccatacc

SEQ ID NO: 2128991 - DNA, 12 bp, Homo sapiens
cacattctcaca

SEQ ID NO: 2128992 - DNA, 20 bp, Homo sapiens
cacattctcacaattgtaaa

SEQ ID NO: 2128993 - DNA, 17 bp, Homo sapiens
cacattctcctgtgccc

SEQ ID NO: 2128994 - DNA, 14 bp, Homo sapiens
cacattggacttcc

SEQ ID NO: 2128995 - DNA, 20 bp, Homo sapiens
cacattggcagtgtgtcaca

SEQ ID NO: 2128996 - DNA, 18 bp, Homo sapiens
cacattgtgcttggcccc

SEQ ID NO: 2128997 - DNA, 18 bp, Homo sapiens
cacatttacctcgaggct

SEQ ID NO: 2128998 - DNA, 15 bp, Homo sapiens
cacatttatatatat

SEQ ID NO: 2128999 - DNA, 17 bp, Homo sapiens
cacatttattctgctca

SEQ ID NO: 2129000 - DNA, 13 bp, Homo sapiens
cacatttgatgta

SEQ ID NO: 2129001 - DNA, 17 bp, Homo sapiens
cacatttgatgtacatg

SEQ ID NO: 2129002 - DNA, 18 bp, Homo sapiens
cacatttgatgtacatgt

SEQ ID NO: 2129003 - DNA, 18 bp, Homo sapiens
cacccccagcctgggcct

SEQ ID NO: 2129004 - DNA, 19 bp, Homo sapiens
cacccccgctgggggtggg

SEQ ID NO: 2129005 - DNA, 12 bp, Homo sapiens
caccccctcatt

SEQ ID NO: 2129006 - DNA, 14 bp, Homo sapiens
caccccctccagct

SEQ ID NO: 2129007 - DNA, 11 bp, Homo sapiens
caccccctccc

SEQ ID NO: 2129008 - DNA, 14 bp, Homo sapiens
caccccctcccacc

SEQ ID NO: 2129009 - DNA, 19 bp, Homo sapiens
caccccctcccacccccag

SEQ ID NO: 2129010 - DNA, 17 bp, Homo sapiens
caccccctccccagggg

SEQ ID NO: 2129011 - DNA, 14 bp, Homo sapiens
caccccggcctcca

SEQ ID NO: 2129012 - DNA, 16 bp, Homo sapiens
caccccggcctccact

SEQ ID NO: 2129013 - DNA, 14 bp, Homo sapiens
cacccctaaagaga

SEQ ID NO: 2129014 - DNA, 17 bp, Homo sapiens
cacccctcactctggcc

SEQ ID NO: 2129015 - DNA, 13 bp, Homo sapiens
cacccctccaaag

SEQ ID NO: 2129016 - DNA, 22 bp, Homo sapiens
cacccctcccctgccctagagc

SEQ ID NO: 2129017 - DNA, 11 bp, Homo sapiens
cacccctgcac

SEQ ID NO: 2129018 - DNA, 13 bp, Homo sapiens
cacccctgcactt

SEQ ID NO: 2129019 - DNA, 20 bp, Homo sapiens
caccccttatccaggactct

SEQ ID NO: 2129020 - DNA, 16 bp, Homo sapiens
cacccgactcctcaaa

SEQ ID NO: 2129021 - DNA, 12 bp, Homo sapiens
cacccgaggctg

SEQ ID NO: 2129022 - DNA, 16 bp, Homo sapiens
cacccgaggctgccca

SEQ ID NO: 2129023 - DNA, 18 bp, Homo sapiens
cacccgaggctgcccact

SEQ ID NO: 2129024 - DNA, 15 bp, Homo sapiens
cacccgcttcctgtt

SEQ ID NO: 2129025 - DNA, 21 bp, Homo sapiens
cacccggcccctgctggttca

SEQ ID NO: 2129026 - DNA, 22 bp, Homo sapiens
cacccgtaggcagcctctctgc

SEQ ID NO: 2129027 - DNA, 20 bp, Homo sapiens
cacccgtcttggggctcgcc

SEQ ID NO: 2129028 - DNA, 16 bp, Homo sapiens
cacccgttcaccttct

SEQ ID NO: 2129029 - DNA, 19 bp, Homo sapiens
cacccgttctgctggcctg

SEQ ID NO: 2129030 - DNA, 18 bp, Homo sapiens
caccctatccctgtacag

SEQ ID NO: 2129031 - DNA, 22 bp, Homo sapiens
caccctcataccatctgctgcc

SEQ ID NO: 2129032 - DNA, 17 bp, Homo sapiens
caccctccacctcttca

SEQ ID NO: 2129033 - DNA, 20 bp, Homo sapiens
caccctcccctgtcttctct

SEQ ID NO: 2129034 - DNA, 11 bp, Homo sapiens
caccctccttc

SEQ ID NO: 2129035 - DNA, 15 bp, Homo sapiens
caccctccttcccgc

SEQ ID NO: 2129036 - DNA, 17 bp, Homo sapiens
caccctcgtggacacct

SEQ ID NO: 2129037 - DNA, 22 bp, Homo sapiens
caccctctccatgcccaaccta

SEQ ID NO: 2129038 - DNA, 15 bp, Homo sapiens
caccctgagcctgac

SEQ ID NO: 2129039 - DNA, 16 bp, Homo sapiens
caccctgaggagtctg

SEQ ID NO: 2129040 - DNA, 11 bp, Homo sapiens
caccctgcaga

SEQ ID NO: 2129041 - DNA, 13 bp, Homo sapiens
caccctgcagagc

SEQ ID NO: 2129042 - DNA, 17 bp, Homo sapiens
caccctgcagagcacac

SEQ ID NO: 2129043 - DNA, 19 bp, Homo sapiens
caccctgcagagcacacag

SEQ ID NO: 2129044 - DNA, 20 bp, Homo sapiens
caccctgcagagcacacagg

SEQ ID NO: 2129045 - DNA, 14 bp, Homo sapiens
caccctgcagagct

SEQ ID NO: 2129046 - DNA, 19 bp, Homo sapiens
caccctgcagagctatggt

SEQ ID NO: 2129047 - DNA, 21 bp, Homo sapiens
caccctggattgatcggagcc

SEQ ID NO: 2129048 - DNA, 15 bp, Homo sapiens
caccctggccccaac

SEQ ID NO: 2129049 - DNA, 16 bp, Homo sapiens
caccctggccccaact

SEQ ID NO: 2129050 - DNA, 12 bp, Homo sapiens
caccctggcccg

SEQ ID NO: 2129051 - DNA, 17 bp, Homo sapiens
caccctggggagaaagt

SEQ ID NO: 2129052 - DNA, 12 bp, Homo sapiens
caccctgggtgc

SEQ ID NO: 2129053 - DNA, 18 bp, Homo sapiens
caccctgggtgccattcc

SEQ ID NO: 2129054 - DNA, 20 bp, Homo sapiens
cacccttcacataccctccc

SEQ ID NO: 2129055 - DNA, 15 bp, Homo sapiens
caccgaagagccctg

SEQ ID NO: 2129056 - DNA, 20 bp, Homo sapiens
caccgaagagccctgagctc

SEQ ID NO: 2129057 - DNA, 19 bp, Homo sapiens
caccgagacggctggacct

SEQ ID NO: 2129058 - DNA, 16 bp, Homo sapiens
caccgatgcacacgca

SEQ ID NO: 2129059 - DNA, 17 bp, Homo sapiens
caccgccagaggacaag

SEQ ID NO: 2129060 - DNA, 19 bp, Homo sapiens
caccgccccttctccaaca

SEQ ID NO: 2129061 - DNA, 23 bp, Homo sapiens
caccgccctccctccccagctcc

SEQ ID NO: 2129062 - DNA, 22 bp, Homo sapiens
caccggagctttcaaagaagga

SEQ ID NO: 2129063 - DNA, 19 bp, Homo sapiens
caccggcatgctggcctgt

SEQ ID NO: 2129064 - DNA, 15 bp, Homo sapiens
caccggcgctgcagg

SEQ ID NO: 2129065 - DNA, 19 bp, Homo sapiens
caccgggacagacctggac

SEQ ID NO: 2129066 - DNA, 15 bp, Homo sapiens
caccgggagcctccc

SEQ ID NO: 2129067 - DNA, 12 bp, Homo sapiens
caccgggccact

SEQ ID NO: 2129068 - DNA, 14 bp, Homo sapiens
caccgggccactcc

SEQ ID NO: 2129069 - DNA, 19 bp, Homo sapiens
caccgtcatggcttaatgt

SEQ ID NO: 2129070 - DNA, 14 bp, Homo sapiens
caccgtccctcagt

SEQ ID NO: 2129071 - DNA, 24 bp, Homo sapiens
caccgtgcccagccctaaacatca

SEQ ID NO: 2129072 - DNA, 19 bp, Homo sapiens
cacctacatccccaggtct

SEQ ID NO: 2129073 - DNA, 13 bp, Homo sapiens
cacctaccatgct

SEQ ID NO: 2129074 - DNA, 17 bp, Homo sapiens
cacctaggccactcctc

SEQ ID NO: 2129075 - DNA, 16 bp, Homo sapiens
cacctatagtcccagc

SEQ ID NO: 2129076 - DNA, 23 bp, Homo sapiens
cacctatgtcatttcatttccta

SEQ ID NO: 2129077 - DNA, 14 bp, Homo sapiens
cacctcacgctctg

SEQ ID NO: 2129078 - DNA, 16 bp, Homo sapiens
cacctcacgctctgga

SEQ ID NO: 2129079 - DNA, 18 bp, Homo sapiens
cacctcacgctctggaca

SEQ ID NO: 2129080 - DNA, 13 bp, Homo sapiens
cacctcactcctg

SEQ ID NO: 2129081 - DNA, 14 bp, Homo sapiens
cacctcactgagga

SEQ ID NO: 2129082 - DNA, 20 bp, Homo sapiens
cacctcagagacatacacct

SEQ ID NO: 2129083 - DNA, 11 bp, Homo sapiens
cacctcagcct

SEQ ID NO: 2129084 - DNA, 14 bp, Homo sapiens
cacctcagcctccc

SEQ ID NO: 2129085 - DNA, 17 bp, Homo sapiens
cacctcagcctcccaga

SEQ ID NO: 2129086 - DNA, 23 bp, Homo sapiens
cacctcagcctcccagagtgcta

SEQ ID NO: 2129087 - DNA, 13 bp, Homo sapiens
cacctcatgagtc

SEQ ID NO: 2129088 - DNA, 19 bp, Homo sapiens
cacctcatgcctggccccc

SEQ ID NO: 2129089 - DNA, 19 bp, Homo sapiens
cacctccacccccgccacg

SEQ ID NO: 2129090 - DNA, 21 bp, Homo sapiens
cacctccacccccgccacggc

SEQ ID NO: 2129091 - DNA, 22 bp, Homo sapiens
cacctccacccccgccacggcc

SEQ ID NO: 2129092 - DNA, 13 bp, Homo sapiens
cacctcccacccc

SEQ ID NO: 2129093 - DNA, 17 bp, Homo sapiens
cacctcccaccccactc

SEQ ID NO: 2129094 - DNA, 20 bp, Homo sapiens
cacctcccaccccactccag

SEQ ID NO: 2129095 - DNA, 21 bp, Homo sapiens
cacctcccaggggctccacct

SEQ ID NO: 2129096 - DNA, 15 bp, Homo sapiens
cacctccccccactg

SEQ ID NO: 2129097 - DNA, 16 bp, Homo sapiens
cacctccccccactgc

SEQ ID NO: 2129098 - DNA, 17 bp, Homo sapiens
cacctccccccactgca

SEQ ID NO: 2129099 - DNA, 22 bp, Homo sapiens
cacctccccccactgcaggccc

SEQ ID NO: 2129100 - DNA, 14 bp, Homo sapiens
cacctcccctatcc

SEQ ID NO: 2129101 - DNA, 19 bp, Homo sapiens
cacctcccctatccaccca

SEQ ID NO: 2129102 - DNA, 21 bp, Homo sapiens
cacctccctgccctgtcctcc

SEQ ID NO: 2129103 - DNA, 15 bp, Homo sapiens
cacctccgccccaga

SEQ ID NO: 2129104 - DNA, 18 bp, Homo sapiens
cacctccgccccagacac

SEQ ID NO: 2129105 - DNA, 19 bp, Homo sapiens
cacctccgccccagacaca

SEQ ID NO: 2129106 - DNA, 20 bp, Homo sapiens
cacctccgccccagacacac

SEQ ID NO: 2129107 - DNA, 23 bp, Homo sapiens
cacctcctagaggtgggcagctg

SEQ ID NO: 2129108 - DNA, 23 bp, Homo sapiens
cacctcctccactcactccagcc

SEQ ID NO: 2129109 - DNA, 23 bp, Homo sapiens
cacctcctgagaaggcgaggaga

SEQ ID NO: 2129110 - DNA, 11 bp, Homo sapiens
cacctcctgcc

SEQ ID NO: 2129111 - DNA, 14 bp, Homo sapiens
cacctcctgcctcg

SEQ ID NO: 2129112 - DNA, 15 bp, Homo sapiens
cacctctagtgctac

SEQ ID NO: 2129113 - DNA, 12 bp, Homo sapiens
cacctctgctgc

SEQ ID NO: 2129114 - DNA, 17 bp, Homo sapiens
cacctctggctttgtct

SEQ ID NO: 2129115 - DNA, 14 bp, Homo sapiens
cagaggtgagcaga

SEQ ID NO: 2129116 - DNA, 14 bp, Homo sapiens
cagaggtggccaga

SEQ ID NO: 2129117 - DNA, 19 bp, Homo sapiens
cagaggtggccagagctgg

SEQ ID NO: 2129118 - DNA, 18 bp, Homo sapiens
cagaggttatctgcctgg

SEQ ID NO: 2129119 - DNA, 20 bp, Homo sapiens
cagaggttatctgcctggcc

SEQ ID NO: 2129120 - DNA, 22 bp, Homo sapiens
cagaggttatctgcctggcctg

SEQ ID NO: 2129121 - DNA, 23 bp, Homo sapiens
cagaggttatctgcctggcctgg

SEQ ID NO: 2129122 - DNA, 17 bp, Homo sapiens
cagagtatatatgtaca

SEQ ID NO: 2129123 - DNA, 13 bp, Homo sapiens
cagagtatgacga

SEQ ID NO: 2129124 - DNA, 19 bp, Homo sapiens
cagagtcagaggagaagag

SEQ ID NO: 2129125 - DNA, 17 bp, Homo sapiens
cagagtctcactgttgc

SEQ ID NO: 2129126 - DNA, 20 bp, Homo sapiens
cagagtctcactgttgccca

SEQ ID NO: 2129127 - DNA, 12 bp, Homo sapiens
cagagtctgagc

SEQ ID NO: 2129128 - DNA, 14 bp, Homo sapiens
cagagtctgagccc

SEQ ID NO: 2129129 - DNA, 15 bp, Homo sapiens
cagagtctgagcccc

SEQ ID NO: 2129130 - DNA, 23 bp, Homo sapiens
cagagtgaaagggctatggcaag

SEQ ID NO: 2129131 - DNA, 15 bp, Homo sapiens
cagagtgagaccctg

SEQ ID NO: 2129132 - DNA, 17 bp, Homo sapiens
cagagtgagactctgtc

SEQ ID NO: 2129133 - DNA, 18 bp, Homo sapiens
cagagtgagactctgtct

SEQ ID NO: 2129134 - DNA, 17 bp, Homo sapiens
cagagtgaggatgtgtt

SEQ ID NO: 2129135 - DNA, 17 bp, Homo sapiens
cagagtggagtctgagt

SEQ ID NO: 2129136 - DNA, 17 bp, Homo sapiens
cagagtggcccctcacc

SEQ ID NO: 2129137 - DNA, 14 bp, Homo sapiens
cagagtgggctgcc

SEQ ID NO: 2129138 - DNA, 16 bp, Homo sapiens
cagagtgtagaataat

SEQ ID NO: 2129139 - DNA, 20 bp, Homo sapiens
cagagtgtgggaagggagag

SEQ ID NO: 2129140 - DNA, 12 bp, Homo sapiens
cagagttcacta

SEQ ID NO: 2129141 - DNA, 15 bp, Homo sapiens
cagagtttctgcagt

SEQ ID NO: 2129142 - DNA, 16 bp, Homo sapiens
cagataaagacagctg

SEQ ID NO: 2129143 - DNA, 17 bp, Homo sapiens
cagataaccagctgtaa

SEQ ID NO: 2129144 - DNA, 19 bp, Homo sapiens
cagataagaatgctggttt

SEQ ID NO: 2129145 - DNA, 15 bp, Homo sapiens
cagataatcagcctc

SEQ ID NO: 2129146 - DNA, 16 bp, Homo sapiens
cagataatcagcctct

SEQ ID NO: 2129147 - DNA, 17 bp, Homo sapiens
cagataatcagcctctt

SEQ ID NO: 2129148 - DNA, 22 bp, Homo sapiens
cagatacagccccaaaccaggg

SEQ ID NO: 2129149 - DNA, 21 bp, Homo sapiens
cagatacaggaaaagctgctg

SEQ ID NO: 2129150 - DNA, 20 bp, Homo sapiens
cagatacatagatggaccag

SEQ ID NO: 2129151 - DNA, 14 bp, Homo sapiens
cagatacatgggga

SEQ ID NO: 2129152 - DNA, 22 bp, Homo sapiens
cagatactggaagttttgcatt

SEQ ID NO: 2129153 - DNA, 16 bp, Homo sapiens
cagatagccagacaca

SEQ ID NO: 2129154 - DNA, 17 bp, Homo sapiens
cagatagccagacacat

SEQ ID NO: 2129155 - DNA, 22 bp, Homo sapiens
cagatatgcacacacatggatg

SEQ ID NO: 2129156 - DNA, 12 bp, Homo sapiens
cagatatttcca

SEQ ID NO: 2129157 - DNA, 17 bp, Homo sapiens
cagatatttccatttct

SEQ ID NO: 2129158 - DNA, 21 bp, Homo sapiens
cagatatttccatttcttcct

SEQ ID NO: 2129159 - DNA, 23 bp, Homo sapiens
cagatatttccatttcttcctca

SEQ ID NO: 2129160 - DNA, 22 bp, Homo sapiens
cagatcaccagcccggcctgct

SEQ ID NO: 2129161 - DNA, 15 bp, Homo sapiens
cagatcatccagaag

SEQ ID NO: 2129162 - DNA, 13 bp, Homo sapiens
cagatcatctggg

SEQ ID NO: 2129163 - DNA, 20 bp, Homo sapiens
cagatccaccctatccctgt

SEQ ID NO: 2129164 - DNA, 17 bp, Homo sapiens
cagatcccatccatcag

SEQ ID NO: 2129165 - DNA, 22 bp, Homo sapiens
cagatcccatccatcagctccc

SEQ ID NO: 2129166 - DNA, 23 bp, Homo sapiens
cagatcccatccatcagctccct

SEQ ID NO: 2129167 - DNA, 12 bp, Homo sapiens
cagatctgcctg

SEQ ID NO: 2129168 - DNA, 14 bp, Homo sapiens
cagatctgcctggg

SEQ ID NO: 2129169 - DNA, 15 bp, Homo sapiens
cagatctgcctgggc

SEQ ID NO: 2129170 - DNA, 19 bp, Homo sapiens
cagatctgcctgggcctgt

SEQ ID NO: 2129171 - DNA, 23 bp, Homo sapiens
cagatctgcctgggcctgtgcag

SEQ ID NO: 2129172 - DNA, 13 bp, Homo sapiens
cagatcttgacag

SEQ ID NO: 2129173 - DNA, 23 bp, Homo sapiens
cagatcttgacagtatatttgaa

SEQ ID NO: 2129174 - DNA, 15 bp, Homo sapiens
cagatctttttgtga

SEQ ID NO: 2129175 - DNA, 12 bp, Homo sapiens
cagatgagaagt

SEQ ID NO: 2129176 - DNA, 22 bp, Homo sapiens
cagatgagaagttaagcagcct

SEQ ID NO: 2129177 - DNA, 20 bp, Homo sapiens
cagatgagcagtcacactgt

SEQ ID NO: 2129178 - DNA, 22 bp, Homo sapiens
cagatgagcagtcacactgtta

SEQ ID NO: 2129179 - DNA, 23 bp, Homo sapiens
cagatgagcagtcacactgttac

SEQ ID NO: 2129180 - DNA, 16 bp, Homo sapiens
cagatgataaatattt

SEQ ID NO: 2129181 - DNA, 15 bp, Homo sapiens
cagatgatctctcca

SEQ ID NO: 2129182 - DNA, 15 bp, Homo sapiens
cagatgcccagaggg

SEQ ID NO: 2129183 - DNA, 15 bp, Homo sapiens
cagatgggggactga

SEQ ID NO: 2129184 - DNA, 18 bp, Homo sapiens
cagatggtcacacagaga

SEQ ID NO: 2129185 - DNA, 17 bp, Homo sapiens
cagatgtaggagggact

SEQ ID NO: 2129186 - DNA, 23 bp, Homo sapiens
cagatgttgaatgcccacaggca

SEQ ID NO: 2129187 - DNA, 16 bp, Homo sapiens
cagattacttcagggc

SEQ ID NO: 2129188 - DNA, 18 bp, Homo sapiens
cagattccacacaaaatg

SEQ ID NO: 2129189 - DNA, 19 bp, Homo sapiens
cagattcccagagcaaaat

SEQ ID NO: 2129190 - DNA, 20 bp, Homo sapiens
cagattcctgggcctgtccc

SEQ ID NO: 2129191 - DNA, 21 bp, Homo sapiens
cagattcctgggcctgtcccc

SEQ ID NO: 2129192 - DNA, 11 bp, Homo sapiens
cagattcttcc

SEQ ID NO: 2129193 - DNA, 16 bp, Homo sapiens
cagattcttccactgg

SEQ ID NO: 2129194 - DNA, 20 bp, Homo sapiens
cagattgcaacaggctgggc

SEQ ID NO: 2129195 - DNA, 15 bp, Homo sapiens
cagatttcctgtgtg

SEQ ID NO: 2129196 - DNA, 15 bp, Homo sapiens
cagattttaattttg

SEQ ID NO: 2129197 - DNA, 23 bp, Homo sapiens
cagattttaattttgaataaata

SEQ ID NO: 2129198 - DNA, 16 bp, Homo sapiens
cagatttttgggctcc

SEQ ID NO: 2129199 - DNA, 17 bp, Homo sapiens
cagatttttgtaataaa

SEQ ID NO: 2129200 - DNA, 19 bp, Homo sapiens
cagattttttacagctgcc

SEQ ID NO: 2129201 - DNA, 14 bp, Homo sapiens
cagcaaaaatataa

SEQ ID NO: 2129202 - DNA, 18 bp, Homo sapiens
cagcaaaaatataaaata

SEQ ID NO: 2129203 - DNA, 15 bp, Homo sapiens
cagcaaaactccatc

SEQ ID NO: 2129204 - DNA, 16 bp, Homo sapiens
cagcaaaccaggactc

SEQ ID NO: 2129205 - DNA, 17 bp, Homo sapiens
cagcaaagtgtcagtgt

SEQ ID NO: 2129206 - DNA, 17 bp, Homo sapiens
cagcaacacaagctgga

SEQ ID NO: 2129207 - DNA, 13 bp, Homo sapiens
cagcaacacagag

SEQ ID NO: 2129208 - DNA, 14 bp, Homo sapiens
cagcaacagaaaaa

SEQ ID NO: 2129209 - DNA, 20 bp, Homo sapiens
cagcaacaggaatctcagag

SEQ ID NO: 2129210 - DNA, 18 bp, Homo sapiens
cagcaacatctcgagccc

SEQ ID NO: 2129211 - DNA, 10 bp, Homo sapiens
cagcaactcc

SEQ ID NO: 2129212 - DNA, 11 bp, Homo sapiens
cagcaactccc

SEQ ID NO: 2129213 - DNA, 14 bp, Homo sapiens
cagcaaggcccgag

SEQ ID NO: 2129214 - DNA, 15 bp, Homo sapiens
cagcaaggcccgagc

SEQ ID NO: 2129215 - DNA, 21 bp, Homo sapiens
cagcaaggcccgagcagctga

SEQ ID NO: 2129216 - DNA, 22 bp, Homo sapiens
cagcaaggcccgagcagctgag

SEQ ID NO: 2129217 - DNA, 15 bp, Homo sapiens
cagcaagtgagagct

SEQ ID NO: 2129218 - DNA, 22 bp, Homo sapiens
cagcaatgatgtccagaagaat

SEQ ID NO: 2129219 - DNA, 16 bp, Homo sapiens
cagcacaccccaaggg

SEQ ID NO: 2129220 - DNA, 16 bp, Homo sapiens
cagcacaggggcccca

SEQ ID NO: 2129221 - DNA, 18 bp, Homo sapiens
cagcacaggggccccaga

SEQ ID NO: 2129222 - DNA, 20 bp, Homo sapiens
cagcacaggggccccagatc

SEQ ID NO: 2129223 - DNA, 14 bp, Homo sapiens
cagcacccaggctc

SEQ ID NO: 2129224 - DNA, 19 bp, Homo sapiens
cagcacccaggctccatgg

SEQ ID NO: 2129225 - DNA, 12 bp, Homo sapiens
cagcaccctccc

SEQ ID NO: 2129226 - DNA, 19 bp, Homo sapiens
cagcaccctctcctggggg

SEQ ID NO: 2129227 - DNA, 15 bp, Homo sapiens
cagcaccctgcagag

SEQ ID NO: 2129228 - DNA, 12 bp, Homo sapiens
cagcaccctggg

SEQ ID NO: 2129229 - DNA, 17 bp, Homo sapiens
cagcactaaagcagtgg

SEQ ID NO: 2129230 - DNA, 18 bp, Homo sapiens
cagcactaaggccgtgtc

SEQ ID NO: 2129231 - DNA, 17 bp, Homo sapiens
cagcactcctctgtctc

SEQ ID NO: 2129232 - DNA, 18 bp, Homo sapiens
cagcactcctctgtctct

SEQ ID NO: 2129233 - DNA, 19 bp, Homo sapiens
cagcactcctctgtctctg

SEQ ID NO: 2129234 - DNA, 14 bp, Homo sapiens
cagcactgatttca

SEQ ID NO: 2129235 - DNA, 22 bp, Homo sapiens
cagcactgtgaagacccagcag

SEQ ID NO: 2129236 - DNA, 15 bp, Homo sapiens
cagcacttggctcct

SEQ ID NO: 2129237 - DNA, 21 bp, Homo sapiens
cagcactttaaccctctcttc

SEQ ID NO: 2129238 - DNA, 15 bp, Homo sapiens
cagcactttgggagg

SEQ ID NO: 2129239 - DNA, 23 bp, Homo sapiens
cagcactttgggaggctgaagtg

SEQ ID NO: 2129240 - DNA, 23 bp, Homo sapiens
cagcactttgggaggctgaggcg

SEQ ID NO: 2129241 - DNA, 12 bp, Homo sapiens
cagcagaaaagt

SEQ ID NO: 2129242 - DNA, 18 bp, Homo sapiens
cagcagaaaagtgcttag

SEQ ID NO: 2129243 - DNA, 15 bp, Homo sapiens
cagcagaaagactgg

SEQ ID NO: 2129244 - DNA, 15 bp, Homo sapiens
cagcagaagagggag

SEQ ID NO: 2129245 - DNA, 17 bp, Homo sapiens
cagcagactcagctctg

SEQ ID NO: 2129246 - DNA, 20 bp, Homo sapiens
cagcagagttattgaatctt

SEQ ID NO: 2129247 - DNA, 15 bp, Homo sapiens
cagcagcagagagcc

SEQ ID NO: 2129248 - DNA, 21 bp, Homo sapiens
cagcagccagccctgcctgga

SEQ ID NO: 2129249 - DNA, 17 bp, Homo sapiens
cagcagccagctctcag

SEQ ID NO: 2129250 - DNA, 16 bp, Homo sapiens
cagcagcccagcttcc

SEQ ID NO: 2129251 - DNA, 18 bp, Homo sapiens
cagcagcccagcttcctg

SEQ ID NO: 2129252 - DNA, 15 bp, Homo sapiens
cagcagccccccagc

SEQ ID NO: 2129253 - DNA, 23 bp, Homo sapiens
cagcagcccctctttaacctcat

SEQ ID NO: 2129254 - DNA, 13 bp, Homo sapiens
cagcagcccctgc

SEQ ID NO: 2129255 - DNA, 13 bp, Homo sapiens
cagcagccctcct

SEQ ID NO: 2129256 - DNA, 18 bp, Homo sapiens
cagcagccctcctcaccc

SEQ ID NO: 2129257 - DNA, 17 bp, Homo sapiens
cagcagctaggactgag

SEQ ID NO: 2129258 - DNA, 22 bp, Homo sapiens
cagcagctaggactgaggagtg

SEQ ID NO: 2129259 - DNA, 16 bp, Homo sapiens
cagcagctcagcctcc

SEQ ID NO: 2129260 - DNA, 21 bp, Homo sapiens
cagcagctcagcctccccccg

SEQ ID NO: 2129261 - DNA, 22 bp, Homo sapiens
cagcagctgggacccctcccaa

SEQ ID NO: 2129262 - DNA, 19 bp, Homo sapiens
cagcagctgggccggccag

SEQ ID NO: 2129263 - DNA, 18 bp, Homo sapiens
cagcaggaacctgtactg

SEQ ID NO: 2129264 - DNA, 20 bp, Homo sapiens
cagcaggaagccaggctgag

SEQ ID NO: 2129265 - DNA, 17 bp, Homo sapiens
cagcaggaggctagcaa

SEQ ID NO: 2129266 - DNA, 19 bp, Homo sapiens
cagcaggccagggactcag

SEQ ID NO: 2129267 - DNA, 16 bp, Homo sapiens
cagcaggtgcaagaga

SEQ ID NO: 2129268 - DNA, 17 bp, Homo sapiens
cagcaggtgcaagagac

SEQ ID NO: 2129269 - DNA, 23 bp, Homo sapiens
cagcaggtgcaagagacagagcc

SEQ ID NO: 2129270 - DNA, 18 bp, Homo sapiens
cagcaggtgtggtggctc

SEQ ID NO: 2129271 - DNA, 21 bp, Homo sapiens
cagcaggtgtggtggctcatg

SEQ ID NO: 2129272 - DNA, 22 bp, Homo sapiens
cagcaggtgtggtggctcatgg

SEQ ID NO: 2129273 - DNA, 21 bp, Homo sapiens
cagcagtcttcttcacccgct

SEQ ID NO: 2129274 - DNA, 21 bp, Homo sapiens
cagcagtgagtctcttcagaa

SEQ ID NO: 2129275 - DNA, 22 bp, Homo sapiens
cacttcattcttgaaagctgtg

SEQ ID NO: 2129276 - DNA, 19 bp, Homo sapiens
cacttccaggagcccagag

SEQ ID NO: 2129277 - DNA, 20 bp, Homo sapiens
cacttccagtgttggctgtg

SEQ ID NO: 2129278 - DNA, 18 bp, Homo sapiens
cacttccctgggaactca

SEQ ID NO: 2129279 - DNA, 21 bp, Homo sapiens
cacttctcacatcttatgcta

SEQ ID NO: 2129280 - DNA, 13 bp, Homo sapiens
cacttctcaggac

SEQ ID NO: 2129281 - DNA, 16 bp, Homo sapiens
cacttctctactctgg

SEQ ID NO: 2129282 - DNA, 21 bp, Homo sapiens
cacttcttaaaggcctggaac

SEQ ID NO: 2129283 - DNA, 17 bp, Homo sapiens
cacttcttaatgctttc

SEQ ID NO: 2129284 - DNA, 19 bp, Homo sapiens
cacttcttacaataattct

SEQ ID NO: 2129285 - DNA, 14 bp, Homo sapiens
cacttctttcctct

SEQ ID NO: 2129286 - DNA, 18 bp, Homo sapiens
cacttctttgcagagcct

SEQ ID NO: 2129287 - DNA, 15 bp, Homo sapiens
cacttcttttataac

SEQ ID NO: 2129288 - DNA, 18 bp, Homo sapiens
cacttgaggtcaggagtt

SEQ ID NO: 2129289 - DNA, 19 bp, Homo sapiens
cacttgatgacccccaacc

SEQ ID NO: 2129290 - DNA, 14 bp, Homo sapiens
cacttgcagactct

SEQ ID NO: 2129291 - DNA, 22 bp, Homo sapiens
cacttgcagactctacagaggc

SEQ ID NO: 2129292 - DNA, 20 bp, Homo sapiens
cacttgcgtcctgcagagga

SEQ ID NO: 2129293 - DNA, 23 bp, Homo sapiens
cacttgcgtcctgcagaggacca

SEQ ID NO: 2129294 - DNA, 18 bp, Homo sapiens
cacttggagcccgtgcag

SEQ ID NO: 2129295 - DNA, 21 bp, Homo sapiens
cacttggggtcaccaccctcc

SEQ ID NO: 2129296 - DNA, 23 bp, Homo sapiens
cacttggggtcaccaccctcccc

SEQ ID NO: 2129297 - DNA, 16 bp, Homo sapiens
cacttgggtcttccct

SEQ ID NO: 2129298 - DNA, 18 bp, Homo sapiens
cacttggtttttggctct

SEQ ID NO: 2129299 - DNA, 17 bp, Homo sapiens
cacttgtacaaaataaa

SEQ ID NO: 2129300 - DNA, 15 bp, Homo sapiens
cacttgtataaatgt

SEQ ID NO: 2129301 - DNA, 18 bp, Homo sapiens
cacttgtgttatgaagca

SEQ ID NO: 2129302 - DNA, 19 bp, Homo sapiens
cactttaaccctctcttcc

SEQ ID NO: 2129303 - DNA, 19 bp, Homo sapiens
cactttcctacaaaatgga

SEQ ID NO: 2129304 - DNA, 14 bp, Homo sapiens
cactttgcacagct

SEQ ID NO: 2129305 - DNA, 22 bp, Homo sapiens
cactttggcttctcctgtgacc

SEQ ID NO: 2129306 - DNA, 20 bp, Homo sapiens
cactttggtacatggccagt

SEQ ID NO: 2129307 - DNA, 13 bp, Homo sapiens
cacttttcagtga

SEQ ID NO: 2129308 - DNA, 13 bp, Homo sapiens
cagccaggggctg

SEQ ID NO: 2129309 - DNA, 18 bp, Homo sapiens
cagccaggggctgctcat

SEQ ID NO: 2129310 - DNA, 20 bp, Homo sapiens
cagccaggggctgctcatca

SEQ ID NO: 2129311 - DNA, 15 bp, Homo sapiens
cagccagtcttgcct

SEQ ID NO: 2129312 - DNA, 19 bp, Homo sapiens
cagccagtcttgcctaggc

SEQ ID NO: 2129313 - DNA, 20 bp, Homo sapiens
cagccagtcttgcctaggcc

SEQ ID NO: 2129314 - DNA, 18 bp, Homo sapiens
cagccatcatgtgcctgg

SEQ ID NO: 2129315 - DNA, 20 bp, Homo sapiens
cagccatcatgtgcctggaa

SEQ ID NO: 2129316 - DNA, 18 bp, Homo sapiens
cagccatgaggagttgct

SEQ ID NO: 2129317 - DNA, 22 bp, Homo sapiens
cagccatgaggagttgctgttt

SEQ ID NO: 2129318 - DNA, 12 bp, Homo sapiens
cagccatgcctc

SEQ ID NO: 2129319 - DNA, 13 bp, Homo sapiens
cagccatgcctca

SEQ ID NO: 2129320 - DNA, 15 bp, Homo sapiens
cagcccacacccctc

SEQ ID NO: 2129321 - DNA, 19 bp, Homo sapiens
cagcccacatagtgatggt

SEQ ID NO: 2129322 - DNA, 15 bp, Homo sapiens
cagcccacttctgcc

SEQ ID NO: 2129323 - DNA, 15 bp, Homo sapiens
cagcccagcccagct

SEQ ID NO: 2129324 - DNA, 12 bp, Homo sapiens
cagcccagccta

SEQ ID NO: 2129325 - DNA, 15 bp, Homo sapiens
cagcccagcctagcc

SEQ ID NO: 2129326 - DNA, 14 bp, Homo sapiens
cagcccagcctctg

SEQ ID NO: 2129327 - DNA, 21 bp, Homo sapiens
cagcccagcctctgtccctct

SEQ ID NO: 2129328 - DNA, 22 bp, Homo sapiens
cagcccagcctctgtccctctt

SEQ ID NO: 2129329 - DNA, 15 bp, Homo sapiens
cagcccagcttcctg

SEQ ID NO: 2129330 - DNA, 12 bp, Homo sapiens
cagcccagggca

SEQ ID NO: 2129331 - DNA, 19 bp, Homo sapiens
cagcccaggtcctcccggg

SEQ ID NO: 2129332 - DNA, 16 bp, Homo sapiens
cagccccaaaccaggg

SEQ ID NO: 2129333 - DNA, 18 bp, Homo sapiens
cagccccaaaccagggtg

SEQ ID NO: 2129334 - DNA, 12 bp, Homo sapiens
cagccccacagc

SEQ ID NO: 2129335 - DNA, 13 bp, Homo sapiens
cagccccacagca

SEQ ID NO: 2129336 - DNA, 18 bp, Homo sapiens
cagccccacagcacccag

SEQ ID NO: 2129337 - DNA, 21 bp, Homo sapiens
cagccccacagcacccaggct

SEQ ID NO: 2129338 - DNA, 13 bp, Homo sapiens
cagccccagggcc

SEQ ID NO: 2129339 - DNA, 14 bp, Homo sapiens
cagccccaggggtg

SEQ ID NO: 2129340 - DNA, 13 bp, Homo sapiens
cagccccagtgcc

SEQ ID NO: 2129341 - DNA, 18 bp, Homo sapiens
cagccccatcttggtcct

SEQ ID NO: 2129342 - DNA, 13 bp, Homo sapiens
cagccccattctg

SEQ ID NO: 2129343 - DNA, 14 bp, Homo sapiens
cagccccattctgc

SEQ ID NO: 2129344 - DNA, 19 bp, Homo sapiens
cagccccattctgcctgcc

SEQ ID NO: 2129345 - DNA, 19 bp, Homo sapiens
cagccccctaagagagcac

SEQ ID NO: 2129346 - DNA, 18 bp, Homo sapiens
cagccccgactccagcca

SEQ ID NO: 2129347 - DNA, 19 bp, Homo sapiens
cagccccgactccagccag

SEQ ID NO: 2129348 - DNA, 16 bp, Homo sapiens
cagccccgccctctgc

SEQ ID NO: 2129349 - DNA, 21 bp, Homo sapiens
cagccccgccctctgcgtccc

SEQ ID NO: 2129350 - DNA, 14 bp, Homo sapiens
cagcccctcctccc

SEQ ID NO: 2129351 - DNA, 16 bp, Homo sapiens
cagcccctcctcccct

SEQ ID NO: 2129352 - DNA, 17 bp, Homo sapiens
cagcccctcctcccctt

SEQ ID NO: 2129353 - DNA, 15 bp, Homo sapiens
cagcccctcctctgc

SEQ ID NO: 2129354 - DNA, 20 bp, Homo sapiens
cagcccctcctctgccacct

SEQ ID NO: 2129355 - DNA, 21 bp, Homo sapiens
cagcccctcctctgccacctc

SEQ ID NO: 2129356 - DNA, 22 bp, Homo sapiens
cagcccctcctctgccacctcc

SEQ ID NO: 2129357 - DNA, 13 bp, Homo sapiens
cagcccctgcaca

SEQ ID NO: 2129358 - DNA, 13 bp, Homo sapiens
cagcccgaagccc

SEQ ID NO: 2129359 - DNA, 15 bp, Homo sapiens
cagcccgaagcccag

SEQ ID NO: 2129360 - DNA, 16 bp, Homo sapiens
cagcccgaagcccagt

SEQ ID NO: 2129361 - DNA, 17 bp, Homo sapiens
cagcccgaagcccagtt

SEQ ID NO: 2129362 - DNA, 16 bp, Homo sapiens
cagcccgaatgcctgt

SEQ ID NO: 2129363 - DNA, 22 bp, Homo sapiens
cagcctacccttgtaccccatc

SEQ ID NO: 2129364 - DNA, 19 bp, Homo sapiens
cagcctagccgacctcagc

SEQ ID NO: 2129365 - DNA, 18 bp, Homo sapiens
cagcctcaacctcctggg

SEQ ID NO: 2129366 - DNA, 20 bp, Homo sapiens
cagcctcaacctcctgggct

SEQ ID NO: 2129367 - DNA, 13 bp, Homo sapiens
cagcctcacagaa

SEQ ID NO: 2129368 - DNA, 18 bp, Homo sapiens
cagcctcagctcagcctc

SEQ ID NO: 2129369 - DNA, 16 bp, Homo sapiens
cagcctcagtgccact

SEQ ID NO: 2129370 - DNA, 18 bp, Homo sapiens
cagcctccaccttgctct

SEQ ID NO: 2129371 - DNA, 19 bp, Homo sapiens
cagcctccaccttgctctt

SEQ ID NO: 2129372 - DNA, 13 bp, Homo sapiens
cagcctccagagc

SEQ ID NO: 2129373 - DNA, 19 bp, Homo sapiens
cagcctccagagccagcct

SEQ ID NO: 2129374 - DNA, 15 bp, Homo sapiens
cagcctccatgctgc

SEQ ID NO: 2129375 - DNA, 17 bp, Homo sapiens
cagcctccatgctgcct

SEQ ID NO: 2129376 - DNA, 19 bp, Homo sapiens
cagcctcccaaagtgctgg

SEQ ID NO: 2129377 - DNA, 20 bp, Homo sapiens
cagcctcccaaagtgctggg

SEQ ID NO: 2129378 - DNA, 23 bp, Homo sapiens
cagcctcccaaagtgctgggatt

SEQ ID NO: 2129379 - DNA, 13 bp, Homo sapiens
cagcctcccagag

SEQ ID NO: 2129380 - DNA, 13 bp, Homo sapiens
cagcctcccccac

SEQ ID NO: 2129381 - DNA, 22 bp, Homo sapiens
cagcctccccccgctggggagc

SEQ ID NO: 2129382 - DNA, 21 bp, Homo sapiens
cagcctccccctgctgctcat

SEQ ID NO: 2129383 - DNA, 20 bp, Homo sapiens
cagcctcccgagtagctggg

SEQ ID NO: 2129384 - DNA, 14 bp, Homo sapiens
cagcctccctctga

SEQ ID NO: 2129385 - DNA, 21 bp, Homo sapiens
cagcctccctctgacctgcag

SEQ ID NO: 2129386 - DNA, 17 bp, Homo sapiens
cagcctccgccattcca

SEQ ID NO: 2129387 - DNA, 12 bp, Homo sapiens
cagcctcctggg

SEQ ID NO: 2129388 - DNA, 16 bp, Homo sapiens
cagcctcctgggcagt

SEQ ID NO: 2129389 - DNA, 21 bp, Homo sapiens
cagcctcgcatgccagagcct

SEQ ID NO: 2129390 - DNA, 20 bp, Homo sapiens
cagcctctcccggctgcctg

SEQ ID NO: 2129391 - DNA, 22 bp, Homo sapiens
cagcctctcccggctgcctgcc

SEQ ID NO: 2129392 - DNA, 23 bp, Homo sapiens
cagcctctcccggctgcctgccg

SEQ ID NO: 2129393 - DNA, 11 bp, Homo sapiens
cagcctcttaa

SEQ ID NO: 2129394 - DNA, 15 bp, Homo sapiens
cagcctcttaaagct

SEQ ID NO: 2129395 - DNA, 21 bp, Homo sapiens
cagcctcttaaagctgcctgt

SEQ ID NO: 2129396 - DNA, 15 bp, Homo sapiens
cagcctgaggctgag

SEQ ID NO: 2129397 - DNA, 20 bp, Homo sapiens
cagcctgccgccgtctctgt

SEQ ID NO: 2129398 - DNA, 10 bp, Homo sapiens
cagcctggca

SEQ ID NO: 2129399 - DNA, 12 bp, Homo sapiens
cagcctggcctc

SEQ ID NO: 2129400 - DNA, 18 bp, Homo sapiens
cagcctggcctcctgcct

SEQ ID NO: 2129401 - DNA, 21 bp, Homo sapiens
cagcctggcctcctgcctcta

SEQ ID NO: 2129402 - DNA, 18 bp, Homo sapiens
cagcctggcggggcagga

SEQ ID NO: 2129403 - DNA, 16 bp, Homo sapiens
cagcctgggactccca

SEQ ID NO: 2129404 - DNA, 18 bp, Homo sapiens
cagcctgggactcccagt

SEQ ID NO: 2129405 - DNA, 11 bp, Homo sapiens
cagcctgggcc

SEQ ID NO: 2129406 - DNA, 15 bp, Homo sapiens
cagcctgggcgacag

SEQ ID NO: 2129407 - DNA, 20 bp, Homo sapiens
cagcctggtcaacatggtga

SEQ ID NO: 2129408 - DNA, 15 bp, Homo sapiens
cagcctggtgggcct

SEQ ID NO: 2129409 - DNA, 16 bp, Homo sapiens
cagcctggttttcaca

SEQ ID NO: 2129410 - DNA, 14 bp, Homo sapiens
cagcctgtcctggt

SEQ ID NO: 2129411 - DNA, 17 bp, Homo sapiens
cagcctgtcctggtaca

SEQ ID NO: 2129412 - DNA, 18 bp, Homo sapiens
cagcctgtcctggtacag

SEQ ID NO: 2129413 - DNA, 18 bp, Homo sapiens
cagcctgtggcggtgcct

SEQ ID NO: 2129414 - DNA, 16 bp, Homo sapiens
cagcctgttggacccg

SEQ ID NO: 2129415 - DNA, 21 bp, Homo sapiens
cagccttccccctcccagggc

SEQ ID NO: 2129416 - DNA, 23 bp, Homo sapiens
cagccttccccttgcccagggct

SEQ ID NO: 2129417 - DNA, 16 bp, Homo sapiens
cagccttctctctctg

SEQ ID NO: 2129418 - DNA, 18 bp, Homo sapiens
cagccttctctctctggt

SEQ ID NO: 2129419 - DNA, 21 bp, Homo sapiens
cagccttggataatgctgttg

SEQ ID NO: 2129420 - DNA, 15 bp, Homo sapiens
cagcctttctgtgga

SEQ ID NO: 2129421 - DNA, 18 bp, Homo sapiens
cagcgagaggcagagaaa

SEQ ID NO: 2129422 - DNA, 22 bp, Homo sapiens
cagcgagttgtggaaagcctct

SEQ ID NO: 2129423 - DNA, 21 bp, Homo sapiens
cagcgattccctctcccaggc

SEQ ID NO: 2129424 - DNA, 16 bp, Homo sapiens
caggcctgcgtgccgg

SEQ ID NO: 2129425 - DNA, 17 bp, Homo sapiens
caggcctgggacccagc

SEQ ID NO: 2129426 - DNA, 18 bp, Homo sapiens
caggcctgggacccagct

SEQ ID NO: 2129427 - DNA, 18 bp, Homo sapiens
caggcctgtgtagctgtg

SEQ ID NO: 2129428 - DNA, 17 bp, Homo sapiens
caggcgccccttccccc

SEQ ID NO: 2129429 - DNA, 23 bp, Homo sapiens
caggcgggagatggacccctccc

SEQ ID NO: 2129430 - DNA, 13 bp, Homo sapiens
caggcggggagga

SEQ ID NO: 2129431 - DNA, 20 bp, Homo sapiens
caggcggggaggaggagctg

SEQ ID NO: 2129432 - DNA, 22 bp, Homo sapiens
caggcggggaggaggagctgcc

SEQ ID NO: 2129433 - DNA, 17 bp, Homo sapiens
caggcggggtgctgtgg

SEQ ID NO: 2129434 - DNA, 18 bp, Homo sapiens
caggcggggtgctgtggt

SEQ ID NO: 2129435 - DNA, 15 bp, Homo sapiens
caggcgttggtgcca

SEQ ID NO: 2129436 - DNA, 16 bp, Homo sapiens
caggcgttggtgccac

SEQ ID NO: 2129437 - DNA, 17 bp, Homo sapiens
caggcgttggtgccact

SEQ ID NO: 2129438 - DNA, 19 bp, Homo sapiens
caggcgttggtgccacttc

SEQ ID NO: 2129439 - DNA, 22 bp, Homo sapiens
caggctaatttttttgtatttt

SEQ ID NO: 2129440 - DNA, 14 bp, Homo sapiens
caggctaccccttc

SEQ ID NO: 2129441 - DNA, 19 bp, Homo sapiens
caggctatttgttcagaga

SEQ ID NO: 2129442 - DNA, 20 bp, Homo sapiens
caggctatttgttcagagag

SEQ ID NO: 2129443 - DNA, 15 bp, Homo sapiens
caggctcagactctg

SEQ ID NO: 2129444 - DNA, 13 bp, Homo sapiens
caggctccatggg

SEQ ID NO: 2129445 - DNA, 17 bp, Homo sapiens
caggctccatggggaag

SEQ ID NO: 2129446 - DNA, 18 bp, Homo sapiens
caggctccatggggaagt

SEQ ID NO: 2129447 - DNA, 13 bp, Homo sapiens
caggctccccctg

SEQ ID NO: 2129448 - DNA, 18 bp, Homo sapiens
caggctctggagccagag

SEQ ID NO: 2129449 - DNA, 16 bp, Homo sapiens
caggctctgggaaggg

SEQ ID NO: 2129450 - DNA, 23 bp, Homo sapiens
caggctctgggaaggggtgccct

SEQ ID NO: 2129451 - DNA, 14 bp, Homo sapiens
caggctctgggctc

SEQ ID NO: 2129452 - DNA, 19 bp, Homo sapiens
caggctctgggctcagggc

SEQ ID NO: 2129453 - DNA, 20 bp, Homo sapiens
caggctctgggctcagggct

SEQ ID NO: 2129454 - DNA, 23 bp, Homo sapiens
caggctctgggctcagggctgga

SEQ ID NO: 2129455 - DNA, 16 bp, Homo sapiens
caggctcttcctggac

SEQ ID NO: 2129456 - DNA, 20 bp, Homo sapiens
caggctcttcctggacctga

SEQ ID NO: 2129457 - DNA, 22 bp, Homo sapiens
caggctcttcctggacctgagt

SEQ ID NO: 2129458 - DNA, 22 bp, Homo sapiens
caggctcttctcctttcacaac

SEQ ID NO: 2129459 - DNA, 23 bp, Homo sapiens
caggctctttggggtcagccagg

SEQ ID NO: 2129460 - DNA, 12 bp, Homo sapiens
caggctgagccc

SEQ ID NO: 2129461 - DNA, 19 bp, Homo sapiens
caggctgagcccagccacc

SEQ ID NO: 2129462 - DNA, 22 bp, Homo sapiens
caggctgagcccagccacctcc

SEQ ID NO: 2129463 - DNA, 21 bp, Homo sapiens
caggctgagtccctccatgca

SEQ ID NO: 2129464 - DNA, 20 bp, Homo sapiens
caggctgagtgagccacaga

SEQ ID NO: 2129465 - DNA, 16 bp, Homo sapiens
caggctgatttctagg

SEQ ID NO: 2129466 - DNA, 17 bp, Homo sapiens
caggctgatttctaggt

SEQ ID NO: 2129467 - DNA, 15 bp, Homo sapiens
caggctgcactgcag

SEQ ID NO: 2129468 - DNA, 16 bp, Homo sapiens
caggctgcactgcagt

SEQ ID NO: 2129469 - DNA, 18 bp, Homo sapiens
caggctgcactgcagtga

SEQ ID NO: 2129470 - DNA, 19 bp, Homo sapiens
caggctgcctcatgaccct

SEQ ID NO: 2129471 - DNA, 12 bp, Homo sapiens
caggctggcctg

SEQ ID NO: 2129472 - DNA, 20 bp, Homo sapiens
caggctggtctcgaactcct

SEQ ID NO: 2129473 - DNA, 15 bp, Homo sapiens
caggctgtaagcatt

SEQ ID NO: 2129474 - DNA, 21 bp, Homo sapiens
caggctgttctgcactgaaaa

SEQ ID NO: 2129475 - DNA, 22 bp, Homo sapiens
caggctgttctgcactgaaaag

SEQ ID NO: 2129476 - DNA, 14 bp, Homo sapiens
caggcttccttggc

SEQ ID NO: 2129477 - DNA, 18 bp, Homo sapiens
caggcttggaatgaattc

SEQ ID NO: 2129478 - DNA, 21 bp, Homo sapiens
cagggaaatggagggtggggc

SEQ ID NO: 2129479 - DNA, 12 bp, Homo sapiens
cagggaagaggg

SEQ ID NO: 2129480 - DNA, 15 bp, Homo sapiens
cagggaagagggcag

SEQ ID NO: 2129481 - DNA, 12 bp, Homo sapiens
cagggaagcagg

SEQ ID NO: 2129482 - DNA, 13 bp, Homo sapiens
cagggaaggcagg

SEQ ID NO: 2129483 - DNA, 14 bp, Homo sapiens
cagggaaggcaggc

SEQ ID NO: 2129484 - DNA, 16 bp, Homo sapiens
cagggaaggcaggcag

SEQ ID NO: 2129485 - DNA, 17 bp, Homo sapiens
cagggaaggcaggcagg

SEQ ID NO: 2129486 - DNA, 18 bp, Homo sapiens
cagggaaggcaggcaggg

SEQ ID NO: 2129487 - DNA, 21 bp, Homo sapiens
cagggaaggcaggcagggctc

SEQ ID NO: 2129488 - DNA, 22 bp, Homo sapiens
cagggaatccgcctgcagagga

SEQ ID NO: 2129489 - DNA, 18 bp, Homo sapiens
cagggacagagacacctg

SEQ ID NO: 2129490 - DNA, 21 bp, Homo sapiens
cagggacagagacacctgcac

SEQ ID NO: 2129491 - DNA, 23 bp, Homo sapiens
cagggacagagacacctgcacct

SEQ ID NO: 2129492 - DNA, 13 bp, Homo sapiens
cagggacagagat

SEQ ID NO: 2129493 - DNA, 17 bp, Homo sapiens
cagggacggggactggc

SEQ ID NO: 2129494 - DNA, 23 bp, Homo sapiens
cagggactgttcctgtctcagca

SEQ ID NO: 2129495 - DNA, 19 bp, Homo sapiens
cagggagaccgagcgcttt

SEQ ID NO: 2129496 - DNA, 22 bp, Homo sapiens
cagggagaccgagcgctttctg

SEQ ID NO: 2129497 - DNA, 19 bp, Homo sapiens
cagggagcccctaggaaag

SEQ ID NO: 2129498 - DNA, 23 bp, Homo sapiens
cagggaggagaggggaagggcca

SEQ ID NO: 2129499 - DNA, 18 bp, Homo sapiens
cagggaggaggtggcagc

SEQ ID NO: 2129500 - DNA, 20 bp, Homo sapiens
cagggaggaggtggcagccc

SEQ ID NO: 2129501 - DNA, 21 bp, Homo sapiens
cagggaggaggtggcagccct

SEQ ID NO: 2129502 - DNA, 12 bp, Homo sapiens
cagggaggatgc

SEQ ID NO: 2129503 - DNA, 14 bp, Homo sapiens
cagggaggatgcca

SEQ ID NO: 2129504 - DNA, 19 bp, Homo sapiens
cagggaggggactatttat

SEQ ID NO: 2129505 - DNA, 16 bp, Homo sapiens
cagggaggtcattttg

SEQ ID NO: 2129506 - DNA, 18 bp, Homo sapiens
cagggaggtgaccccagg

SEQ ID NO: 2129507 - DNA, 23 bp, Homo sapiens
cagggatgggggatgggccaggg

SEQ ID NO: 2129508 - DNA, 20 bp, Homo sapiens
cagggcaaatgacatgcact

SEQ ID NO: 2129509 - DNA, 21 bp, Homo sapiens
cagggcaaatgacatgcactg

SEQ ID NO: 2129510 - DNA, 20 bp, Homo sapiens
cagggcaatcttgtccacag

SEQ ID NO: 2129511 - DNA, 15 bp, Homo sapiens
cagggcacaccgggc

SEQ ID NO: 2129512 - DNA, 14 bp, Homo sapiens
cagggcacaggagc

SEQ ID NO: 2129513 - DNA, 16 bp, Homo sapiens
cagggcacaggagcta

SEQ ID NO: 2129514 - DNA, 18 bp, Homo sapiens
cagggcacaggagctacc

SEQ ID NO: 2129515 - DNA, 21 bp, Homo sapiens
cagggcacaggagctacctgt

SEQ ID NO: 2129516 - DNA, 15 bp, Homo sapiens
cagggcactgtctgc

SEQ ID NO: 2129517 - DNA, 18 bp, Homo sapiens
cagggcactgtctgcgtg

SEQ ID NO: 2129518 - DNA, 13 bp, Homo sapiens
cagggcagaggga

SEQ ID NO: 2129519 - DNA, 17 bp, Homo sapiens
cagggcagcctccacct

SEQ ID NO: 2129520 - DNA, 20 bp, Homo sapiens
cagggcatccgcagcccagg

SEQ ID NO: 2129521 - DNA, 20 bp, Homo sapiens
cagggccacgtgccaggccc

SEQ ID NO: 2129522 - DNA, 11 bp, Homo sapiens
cagggccagaa

SEQ ID NO: 2129523 - DNA, 13 bp, Homo sapiens
cagggccagggcc

SEQ ID NO: 2129524 - DNA, 15 bp, Homo sapiens
cagggccagggccct

SEQ ID NO: 2129525 - DNA, 16 bp, Homo sapiens
cagggccagggccctg

SEQ ID NO: 2129526 - DNA, 19 bp, Homo sapiens
cagggccagggccctgcag

SEQ ID NO: 2129527 - DNA, 21 bp, Homo sapiens
cagggccccagaaggcaggga

SEQ ID NO: 2129528 - DNA, 14 bp, Homo sapiens
cagggccccagcac

SEQ ID NO: 2129529 - DNA, 22 bp, Homo sapiens
cagggccccagcactaaagcag

SEQ ID NO: 2129530 - DNA, 15 bp, Homo sapiens
cagggcccccacagg

SEQ ID NO: 2129531 - DNA, 11 bp, Homo sapiens
cagggcccctc

SEQ ID NO: 2129532 - DNA, 15 bp, Homo sapiens
cagggcccctccctc

SEQ ID NO: 2129533 - DNA, 19 bp, Homo sapiens
cagggcccctccctctgcc

SEQ ID NO: 2129534 - DNA, 17 bp, Homo sapiens
cagttaatacttaacat

SEQ ID NO: 2129535 - DNA, 14 bp, Homo sapiens
cagttacaaaaata

SEQ ID NO: 2129536 - DNA, 18 bp, Homo sapiens
cagttacagggcccaggt

SEQ ID NO: 2129537 - DNA, 20 bp, Homo sapiens
cagttacagggcccaggtga

SEQ ID NO: 2129538 - DNA, 14 bp, Homo sapiens
cagttactcagccc

SEQ ID NO: 2129539 - DNA, 18 bp, Homo sapiens
cagttactcagccctggg

SEQ ID NO: 2129540 - DNA, 12 bp, Homo sapiens
cagttataatta

SEQ ID NO: 2129541 - DNA, 16 bp, Homo sapiens
cagttatctaagttaa

SEQ ID NO: 2129542 - DNA, 18 bp, Homo sapiens
cagttatgtgaatgatct

SEQ ID NO: 2129543 - DNA, 20 bp, Homo sapiens
cagttatgtgaatgatctct

SEQ ID NO: 2129544 - DNA, 16 bp, Homo sapiens
cagttattcagattga

SEQ ID NO: 2129545 - DNA, 16 bp, Homo sapiens
cagttcaacctggtgg

SEQ ID NO: 2129546 - DNA, 21 bp, Homo sapiens
cagttcaacctggtggcacca

SEQ ID NO: 2129547 - DNA, 14 bp, Homo sapiens
cagttcaagaaagc

SEQ ID NO: 2129548 - DNA, 23 bp, Homo sapiens
cagttcacttctttgcagagcct

SEQ ID NO: 2129549 - DNA, 23 bp, Homo sapiens
cagtctggtttatataaggcagt

SEQ ID NO: 2129550 - DNA, 21 bp, Homo sapiens
cagtctgttccccatggccac

SEQ ID NO: 2129551 - DNA, 15 bp, Homo sapiens
cagtcttgaatttct

SEQ ID NO: 2129552 - DNA, 13 bp, Homo sapiens
cagtcttgcctag

SEQ ID NO: 2129553 - DNA, 16 bp, Homo sapiens
cagtcttgcctaggcc

SEQ ID NO: 2129554 - DNA, 17 bp, Homo sapiens
cagtgaaaaactattaa

SEQ ID NO: 2129555 - DNA, 14 bp, Homo sapiens
cagtgaaccaaaga

SEQ ID NO: 2129556 - DNA, 20 bp, Homo sapiens
cagtgaaccaaagagactgg

SEQ ID NO: 2129557 - DNA, 17 bp, Homo sapiens
cagtgaagacttcttgg

SEQ ID NO: 2129558 - DNA, 18 bp, Homo sapiens
cagtgacaaattgtaact

SEQ ID NO: 2129559 - DNA, 15 bp, Homo sapiens
cagtgacaagtggag

SEQ ID NO: 2129560 - DNA, 16 bp, Homo sapiens
cagtgacaagtggagg

SEQ ID NO: 2129561 - DNA, 16 bp, Homo sapiens
cagtgacagagttcac

SEQ ID NO: 2129562 - DNA, 19 bp, Homo sapiens
cagtgacctgctgggtaaa

SEQ ID NO: 2129563 - DNA, 22 bp, Homo sapiens
cagtgacgtgcacctgtactca

SEQ ID NO: 2129564 - DNA, 14 bp, Homo sapiens
cagtgactggcagg

SEQ ID NO: 2129565 - DNA, 20 bp, Homo sapiens
cagtgactttttctgagctt

SEQ ID NO: 2129566 - DNA, 22 bp, Homo sapiens
cagtgactttttctgagctttt

SEQ ID NO: 2129567 - DNA, 14 bp, Homo sapiens
catcttgctctgct

SEQ ID NO: 2129568 - DNA, 19 bp, Homo sapiens
catcttgctctgctgacag

SEQ ID NO: 2129569 - DNA, 15 bp, Homo sapiens
catcttggtcctgtc

SEQ ID NO: 2129570 - DNA, 13 bp, Homo sapiens
catgtgtgtataa

SEQ ID NO: 2129571 - DNA, 14 bp, Homo sapiens
catgtgtgtatata

SEQ ID NO: 2129572 - DNA, 11 bp, Homo sapiens
catgtgtgtgt

SEQ ID NO: 2129573 - DNA, 13 bp, Homo sapiens
catgtgtgtgtct

SEQ ID NO: 2129574 - DNA, 16 bp, Homo sapiens
catgtgtgtgtctgtc

SEQ ID NO: 2129575 - DNA, 21 bp, Homo sapiens
cccagagatgcctccaccgct

SEQ ID NO: 2129576 - DNA, 18 bp, Homo sapiens
cccagagccactaccttt

SEQ ID NO: 2129577 - DNA, 14 bp, Homo sapiens
cccagagccccact

SEQ ID NO: 2129578 - DNA, 15 bp, Homo sapiens
cccagagccccactc

SEQ ID NO: 2129579 - DNA, 14 bp, Homo sapiens
cccagagccttctc

SEQ ID NO: 2129580 - DNA, 17 bp, Homo sapiens
cccagagcttcccagga

SEQ ID NO: 2129581 - DNA, 13 bp, Homo sapiens
cccagaggaggca

SEQ ID NO: 2129582 - DNA, 22 bp, Homo sapiens
cccagaggccaggaatctgcca

SEQ ID NO: 2129583 - DNA, 17 bp, Homo sapiens
cccagagggtagggcag

SEQ ID NO: 2129584 - DNA, 20 bp, Homo sapiens
cccagagggtagggcagcag

SEQ ID NO: 2129585 - DNA, 22 bp, Homo sapiens
cccagaggttatctgcctggcc

SEQ ID NO: 2129586 - DNA, 23 bp, Homo sapiens
cccagaggttatctgcctggcct

SEQ ID NO: 2129587 - DNA, 20 bp, Homo sapiens
cccagagtcagaggagaaga

SEQ ID NO: 2129588 - DNA, 21 bp, Homo sapiens
cccagatcctctgctgactcc

SEQ ID NO: 2129589 - DNA, 14 bp, Homo sapiens
cccagatctgcctg

SEQ ID NO: 2129590 - DNA, 16 bp, Homo sapiens
cccagatctgcctggg

SEQ ID NO: 2129591 - DNA, 17 bp, Homo sapiens
cccagatctgcctgggc

SEQ ID NO: 2129592 - DNA, 18 bp, Homo sapiens
cccagatctgcctgggcc

SEQ ID NO: 2129593 - DNA, 20 bp, Homo sapiens
cccagatctgcctgggcctg

SEQ ID NO: 2129594 - DNA, 22 bp, Homo sapiens
cccagattgcaacaggctgggc

SEQ ID NO: 2129595 - DNA, 20 bp, Homo sapiens
cccagcaacacaagctggaa

SEQ ID NO: 2129596 - DNA, 21 bp, Homo sapiens
cccagcaagtttcaccttggg

SEQ ID NO: 2129597 - DNA, 19 bp, Homo sapiens
cccagcactcctctgtctc

SEQ ID NO: 2129598 - DNA, 11 bp, Homo sapiens
cccagcactgt

SEQ ID NO: 2129599 - DNA, 18 bp, Homo sapiens
cccagcacttgtgttgtc

SEQ ID NO: 2129600 - DNA, 22 bp, Homo sapiens
cccagcactttgggaggccaag

SEQ ID NO: 2129601 - DNA, 23 bp, Homo sapiens
cccagcacttttggaggccaagg

SEQ ID NO: 2129602 - DNA, 17 bp, Homo sapiens
cccagcagccctaagga

SEQ ID NO: 2129603 - DNA, 21 bp, Homo sapiens
cccagcagccctggcctgtgg

SEQ ID NO: 2129604 - DNA, 16 bp, Homo sapiens
cccagcagctgggccg

SEQ ID NO: 2129605 - DNA, 22 bp, Homo sapiens
cccagcagctgggccggccagc

SEQ ID NO: 2129606 - DNA, 13 bp, Homo sapiens
cccagcaggaagc

SEQ ID NO: 2129607 - DNA, 15 bp, Homo sapiens
cccagcaggaagcca

SEQ ID NO: 2129608 - DNA, 19 bp, Homo sapiens
cccagcaggaagccaggct

SEQ ID NO: 2129609 - DNA, 21 bp, Homo sapiens
cccagcatccttttctgcaga

SEQ ID NO: 2129610 - DNA, 18 bp, Homo sapiens
cccagccattaccatgga

SEQ ID NO: 2129611 - DNA, 19 bp, Homo sapiens
cccagccattaccatggag

SEQ ID NO: 2129612 - DNA, 22 bp, Homo sapiens
cccagccattaccatggagaca

SEQ ID NO: 2129613 - DNA, 15 bp, Homo sapiens
cccagcccacagagc

SEQ ID NO: 2129614 - DNA, 17 bp, Homo sapiens
cccagcccacttctgcc

SEQ ID NO: 2129615 - DNA, 18 bp, Homo sapiens
cccagcccagctggtggg

SEQ ID NO: 2129616 - DNA, 16 bp, Homo sapiens
cccagccccaggggtg

SEQ ID NO: 2129617 - DNA, 12 bp, Homo sapiens
cccagcccccac

SEQ ID NO: 2129618 - DNA, 18 bp, Homo sapiens
cccagccccgactccagc

SEQ ID NO: 2129619 - DNA, 22 bp, Homo sapiens
cccagccccgactccagccagc

SEQ ID NO: 2129620 - DNA, 19 bp, Homo sapiens
cccagcccctcctcccctt

SEQ ID NO: 2129621 - DNA, 22 bp, Homo sapiens
cccagcccctcctccccttcct

SEQ ID NO: 2129622 - DNA, 18 bp, Homo sapiens
cccagccctatggatgtg

SEQ ID NO: 2129623 - DNA, 12 bp, Homo sapiens
cccagccctcag

SEQ ID NO: 2129624 - DNA, 21 bp, Homo sapiens
cccagccctcaggccagtgcc

SEQ ID NO: 2129625 - DNA, 12 bp, Homo sapiens
cccagccctggc

SEQ ID NO: 2129626 - DNA, 15 bp, Homo sapiens
cccagccctggctct

SEQ ID NO: 2129627 - DNA, 16 bp, Homo sapiens
cccagcccttctgcct

SEQ ID NO: 2129628 - DNA, 17 bp, Homo sapiens
cccagcccttctgcctt

SEQ ID NO: 2129629 - DNA, 21 bp, Homo sapiens
cccagccctttgggaggctga

SEQ ID NO: 2129630 - DNA, 16 bp, Homo sapiens
cccagcctagcccact

SEQ ID NO: 2129631 - DNA, 17 bp, Homo sapiens
cccagcctcctcccacc

SEQ ID NO: 2129632 - DNA, 17 bp, Homo sapiens
cccagcctcgcatgcca

SEQ ID NO: 2129633 - DNA, 18 bp, Homo sapiens
cccagcctcgcatgccag

SEQ ID NO: 2129634 - DNA, 16 bp, Homo sapiens
cccagcctctgtccct

SEQ ID NO: 2129635 - DNA, 16 bp, Homo sapiens
cccagcctgggcctat

SEQ ID NO: 2129636 - DNA, 13 bp, Homo sapiens
cccagcctgtcct

SEQ ID NO: 2129637 - DNA, 22 bp, Homo sapiens
ccccagctgtcatcaattaaag

SEQ ID NO: 2129638 - DNA, 17 bp, Homo sapiens
ccccaggactcaccctc

SEQ ID NO: 2129639 - DNA, 23 bp, Homo sapiens
ccccagggacaaaacactgtgtc

SEQ ID NO: 2129640 - DNA, 14 bp, Homo sapiens
ccccagggcacagg

SEQ ID NO: 2129641 - DNA, 22 bp, Homo sapiens
ccccagggcagggaaactggct

SEQ ID NO: 2129642 - DNA, 17 bp, Homo sapiens
ccccagggcccccacag

SEQ ID NO: 2129643 - DNA, 19 bp, Homo sapiens
ccccagggcccccacaggc

SEQ ID NO: 2129644 - DNA, 13 bp, Homo sapiens
ccccagggcctgg

SEQ ID NO: 2129645 - DNA, 23 bp, Homo sapiens
ccccagggggcggggtgcagaag

SEQ ID NO: 2129646 - DNA, 20 bp, Homo sapiens
ccccaggggtgcctgtgggg

SEQ ID NO: 2129647 - DNA, 21 bp, Homo sapiens
ccccaggtgccaccaataaaa

SEQ ID NO: 2129648 - DNA, 21 bp, Homo sapiens
ccccaggtggctgacccagtc

SEQ ID NO: 2129649 - DNA, 20 bp, Homo sapiens
ccccagtcgagccctgcagc

SEQ ID NO: 2129650 - DNA, 22 bp, Homo sapiens
ccccagtcgagccctgcagcca

SEQ ID NO: 2129651 - DNA, 15 bp, Homo sapiens
ccccagtgacagcta

SEQ ID NO: 2129652 - DNA, 14 bp, Homo sapiens
ccccagtgccacag

SEQ ID NO: 2129653 - DNA, 14 bp, Homo sapiens
ccccagtgcccaca

SEQ ID NO: 2129654 - DNA, 20 bp, Homo sapiens
ccccagtgcccacaggatca

SEQ ID NO: 2129655 - DNA, 18 bp, Homo sapiens
ccccagttacaaaaatag

SEQ ID NO: 2129656 - DNA, 14 bp, Homo sapiens
ccccagttctgctc

SEQ ID NO: 2129657 - DNA, 19 bp, Homo sapiens
ccccagttctgctcctctc

SEQ ID NO: 2129658 - DNA, 21 bp, Homo sapiens
ccccagttctgctcctctcca

SEQ ID NO: 2129659 - DNA, 14 bp, Homo sapiens
ccccatcagaggct

SEQ ID NO: 2129660 - DNA, 16 bp, Homo sapiens
ccccatcagcaccatg

SEQ ID NO: 2129661 - DNA, 17 bp, Homo sapiens
ccccatctccccaggcc

SEQ ID NO: 2129662 - DNA, 18 bp, Homo sapiens
ccccatctccccaggcct

SEQ ID NO: 2129663 - DNA, 16 bp, Homo sapiens
ccccatgacctccagc

SEQ ID NO: 2129664 - DNA, 13 bp, Homo sapiens
ccccatgctctgc

SEQ ID NO: 2129665 - DNA, 17 bp, Homo sapiens
ccccatgctctgcccca

SEQ ID NO: 2129666 - DNA, 12 bp, Homo sapiens
ccccatgggctt

SEQ ID NO: 2129667 - DNA, 17 bp, Homo sapiens
ccccatgggcttggact

SEQ ID NO: 2129668 - DNA, 18 bp, Homo sapiens
ccccatggggctgcggga

SEQ ID NO: 2129669 - DNA, 15 bp, Homo sapiens
ccccatgtctctcag

SEQ ID NO: 2129670 - DNA, 20 bp, Homo sapiens
ccccattagtatcctgttag

SEQ ID NO: 2129671 - DNA, 18 bp, Homo sapiens
cccccaaggttttggagt

SEQ ID NO: 2129672 - DNA, 15 bp, Homo sapiens
cccccaccacactga

SEQ ID NO: 2129673 - DNA, 23 bp, Homo sapiens
cccccacccctaacctggcttat

SEQ ID NO: 2129674 - DNA, 20 bp, Homo sapiens
cccccacctctgctgcctcc

SEQ ID NO: 2129675 - DNA, 14 bp, Homo sapiens
cccccactgccaca

SEQ ID NO: 2129676 - DNA, 13 bp, Homo sapiens
cccccacttggga

SEQ ID NO: 2129677 - DNA, 18 bp, Homo sapiens
ccccttgaatctgcaggg

SEQ ID NO: 2129678 - DNA, 20 bp, Homo sapiens
ccccttgcccagggctcagc

SEQ ID NO: 2129679 - DNA, 21 bp, Homo sapiens
ccccttgcccagggctcagcc

SEQ ID NO: 2129680 - DNA, 23 bp, Homo sapiens
ccccttgcccttgccctgacctc

SEQ ID NO: 2129681 - DNA, 19 bp, Homo sapiens
ccccttggaggagggctgt

SEQ ID NO: 2129682 - DNA, 13 bp, Homo sapiens
ccccttgggcatc

SEQ ID NO: 2129683 - DNA, 15 bp, Homo sapiens
ccccttgggcctccc

SEQ ID NO: 2129684 - DNA, 12 bp, Homo sapiens
cccctttccccc

SEQ ID NO: 2129685 - DNA, 20 bp, Homo sapiens
cccctttgatgattaattca

SEQ ID NO: 2129686 - DNA, 14 bp, Homo sapiens
ccccttttgcctgg

SEQ ID NO: 2129687 - DNA, 16 bp, Homo sapiens
ccccttttgcctggct

SEQ ID NO: 2129688 - DNA, 18 bp, Homo sapiens
ccccttttgcctggctgt

SEQ ID NO: 2129689 - DNA, 12 bp, Homo sapiens
cccgaagcccag

SEQ ID NO: 2129690 - DNA, 21 bp, Homo sapiens
cccgaagcccaggctgaagag

SEQ ID NO: 2129691 - DNA, 14 bp, Homo sapiens
cccgaatagctggg

SEQ ID NO: 2129692 - DNA, 17 bp, Homo sapiens
cccgaatttagtcacac

SEQ ID NO: 2129693 - DNA, 15 bp, Homo sapiens
cccgacactgctgca

SEQ ID NO: 2129694 - DNA, 22 bp, Homo sapiens
cccgacactgctgcaccagagt

SEQ ID NO: 2129695 - DNA, 18 bp, Homo sapiens
cccgacagcctggcacag

SEQ ID NO: 2129696 - DNA, 12 bp, Homo sapiens
cccgactcctca

SEQ ID NO: 2129697 - DNA, 23 bp, Homo sapiens
cccgagctactctcttgccagca

SEQ ID NO: 2129698 - DNA, 21 bp, Homo sapiens
cccgaggccttctctgaagga

SEQ ID NO: 2129699 - DNA, 19 bp, Homo sapiens
cccgagtttggtccctggg

SEQ ID NO: 2129700 - DNA, 12 bp, Homo sapiens
cccgcagcaccc

SEQ ID NO: 2129701 - DNA, 22 bp, Homo sapiens
cccgcagcccgtgaagcagtgc

SEQ ID NO: 2129702 - DNA, 14 bp, Homo sapiens
cccgccagcctcag

SEQ ID NO: 2129703 - DNA, 14 bp, Homo sapiens
cccgcccctcgctg

SEQ ID NO: 2129704 - DNA, 16 bp, Homo sapiens
cccgcccctcgctgct

SEQ ID NO: 2129705 - DNA, 13 bp, Homo sapiens
cccgcctgtcctg

SEQ ID NO: 2129706 - DNA, 20 bp, Homo sapiens
cccgccttcctcctccacag

SEQ ID NO: 2129707 - DNA, 15 bp, Homo sapiens
cccgcgggtagatgc

SEQ ID NO: 2129708 - DNA, 19 bp, Homo sapiens
cccgcggtgctctggcggc

SEQ ID NO: 2129709 - DNA, 14 bp, Homo sapiens
cccgctcagccctc

SEQ ID NO: 2129710 - DNA, 16 bp, Homo sapiens
cccgctcctgctgaaa

SEQ ID NO: 2129711 - DNA, 12 bp, Homo sapiens
cccgctctggac

SEQ ID NO: 2129712 - DNA, 12 bp, Homo sapiens
cccgctgcccaa

SEQ ID NO: 2129713 - DNA, 17 bp, Homo sapiens
cccgcttattctcctcc

SEQ ID NO: 2129714 - DNA, 18 bp, Homo sapiens
cccgcttccccacagaac

SEQ ID NO: 2129715 - DNA, 15 bp, Homo sapiens
cccgctttgcctgct

SEQ ID NO: 2129716 - DNA, 22 bp, Homo sapiens
cccggagaaggccgctgcccca

SEQ ID NO: 2129717 - DNA, 13 bp, Homo sapiens
cccggagcacagc

SEQ ID NO: 2129718 - DNA, 16 bp, Homo sapiens
cccggagcacagccct

SEQ ID NO: 2129719 - DNA, 22 bp, Homo sapiens
cccggagcacagccctgggagg

SEQ ID NO: 2129720 - DNA, 18 bp, Homo sapiens
cccggagcaggggtctga

SEQ ID NO: 2129721 - DNA, 16 bp, Homo sapiens
cccggattctgggagg

SEQ ID NO: 2129722 - DNA, 11 bp, Homo sapiens
cccggcacccc

SEQ ID NO: 2129723 - DNA, 15 bp, Homo sapiens
cccggcaccccctgc

SEQ ID NO: 2129724 - DNA, 16 bp, Homo sapiens
cccggcaccccctgca

SEQ ID NO: 2129725 - DNA, 17 bp, Homo sapiens
cccggcaccccctgcag

SEQ ID NO: 2129726 - DNA, 18 bp, Homo sapiens
cccggcaccccctgcagc

SEQ ID NO: 2129727 - DNA, 14 bp, Homo sapiens
cccggccagggcct

SEQ ID NO: 2129728 - DNA, 17 bp, Homo sapiens
cccggccagggcctggt

SEQ ID NO: 2129729 - DNA, 13 bp, Homo sapiens
cccggcccagcct

SEQ ID NO: 2129730 - DNA, 19 bp, Homo sapiens
cccggcctccactccccca

SEQ ID NO: 2129731 - DNA, 14 bp, Homo sapiens
cccggcctcttcca

SEQ ID NO: 2129732 - DNA, 17 bp, Homo sapiens
cccggcctcttccaccc

SEQ ID NO: 2129733 - DNA, 19 bp, Homo sapiens
cccggcctcttccacccat

SEQ ID NO: 2129734 - DNA, 20 bp, Homo sapiens
cccggcctgctcccagcagc

SEQ ID NO: 2129735 - DNA, 16 bp, Homo sapiens
cccggctccaggctcc

SEQ ID NO: 2129736 - DNA, 13 bp, Homo sapiens
cccggctgcctgc

SEQ ID NO: 2129737 - DNA, 23 bp, Homo sapiens
cccgggaggcggaggttccagtg

SEQ ID NO: 2129738 - DNA, 16 bp, Homo sapiens
cccgggctctggccac

SEQ ID NO: 2129739 - DNA, 17 bp, Homo sapiens
cccggggcaaggtctcc

SEQ ID NO: 2129740 - DNA, 23 bp, Homo sapiens
cccggggctggcaagcagggaaa

SEQ ID NO: 2129741 - DNA, 17 bp, Homo sapiens
cccgggtccccagctcc

SEQ ID NO: 2129742 - DNA, 18 bp, Homo sapiens
cccgggtccccagctccc

SEQ ID NO: 2129743 - DNA, 19 bp, Homo sapiens
cccgggtgcctcagagcag

SEQ ID NO: 2129744 - DNA, 18 bp, Homo sapiens
cccgggtgtgcctgccct

SEQ ID NO: 2129745 - DNA, 20 bp, Homo sapiens
cccgggtgtgcctgccctgg

SEQ ID NO: 2129746 - DNA, 15 bp, Homo sapiens
cccggtcctggcccc

SEQ ID NO: 2129747 - DNA, 19 bp, Homo sapiens
cccgtaggcagcctctctg

SEQ ID NO: 2129748 - DNA, 18 bp, Homo sapiens
cccgtcagccacacctgt

SEQ ID NO: 2129749 - DNA, 20 bp, Homo sapiens
cccgtctggggttcagcccc

SEQ ID NO: 2129750 - DNA, 13 bp, Homo sapiens
cccgtcttcagcc

SEQ ID NO: 2129751 - DNA, 20 bp, Homo sapiens
cccgtgaaagaattattttt

SEQ ID NO: 2129752 - DNA, 17 bp, Homo sapiens
cccgtgcagtacaggca

SEQ ID NO: 2129753 - DNA, 22 bp, Homo sapiens
cccgtgccaagtccaggtcctg

SEQ ID NO: 2129754 - DNA, 18 bp, Homo sapiens
cccgtggtctccttgcac

SEQ ID NO: 2129755 - DNA, 12 bp, Homo sapiens
cccgtggtcttt

SEQ ID NO: 2129756 - DNA, 14 bp, Homo sapiens
cccgtggtctttga

SEQ ID NO: 2129757 - DNA, 15 bp, Homo sapiens
cccgtggtctttgaa

SEQ ID NO: 2129758 - DNA, 17 bp, Homo sapiens
cccgtggtctttgaata

SEQ ID NO: 2129759 - DNA, 16 bp, Homo sapiens
cccgtgtcctgccttg

SEQ ID NO: 2129760 - DNA, 16 bp, Homo sapiens
cccgtgtggcttacaa

SEQ ID NO: 2129761 - DNA, 14 bp, Homo sapiens
cccgttcaccttct

SEQ ID NO: 2129762 - DNA, 16 bp, Homo sapiens
cccgttccctgtcaga

SEQ ID NO: 2129763 - DNA, 20 bp, Homo sapiens
cccgttccctgtcagaggct

SEQ ID NO: 2129764 - DNA, 11 bp, Homo sapiens
ccctaaaataa

SEQ ID NO: 2129765 - DNA, 13 bp, Homo sapiens
ccctaaaataaaa

SEQ ID NO: 2129766 - DNA, 12 bp, Homo sapiens
ccctaaactgta

SEQ ID NO: 2129767 - DNA, 20 bp, Homo sapiens
ccctacatcttcagctccca

SEQ ID NO: 2129768 - DNA, 19 bp, Homo sapiens
ccctactagagacctctca

SEQ ID NO: 2129769 - DNA, 22 bp, Homo sapiens
ccctacttcattttcagagtga

SEQ ID NO: 2129770 - DNA, 18 bp, Homo sapiens
ccctacttcttttgctct

SEQ ID NO: 2129771 - DNA, 20 bp, Homo sapiens
ccctagaggcaaacatttct

SEQ ID NO: 2129772 - DNA, 13 bp, Homo sapiens
ccctagcagtgaa

SEQ ID NO: 2129773 - DNA, 14 bp, Homo sapiens
ccctaggctgagct

SEQ ID NO: 2129774 - DNA, 22 bp, Homo sapiens
ccctagtggcttcctccgtctg

SEQ ID NO: 2129775 - DNA, 11 bp, Homo sapiens
ccctatcaaaa

SEQ ID NO: 2129776 - DNA, 14 bp, Homo sapiens
ccctatctgtgatt

SEQ ID NO: 2129777 - DNA, 13 bp, Homo sapiens
ccctatgctccag

SEQ ID NO: 2129778 - DNA, 13 bp, Homo sapiens
ccctattaaccta

SEQ ID NO: 2129779 - DNA, 17 bp, Homo sapiens
ccctcaaaaaaagcctt

SEQ ID NO: 2129780 - DNA, 20 bp, Homo sapiens
ccctcaaatgacccaaagac

SEQ ID NO: 2129781 - DNA, 18 bp, Homo sapiens
ccctcaaatgtcagagct

SEQ ID NO: 2129782 - DNA, 14 bp, Homo sapiens
ccctcacctgggcc

SEQ ID NO: 2129783 - DNA, 16 bp, Homo sapiens
ccctcacctgggcctt

SEQ ID NO: 2129784 - DNA, 19 bp, Homo sapiens
ccctcacctgggcctttcc

SEQ ID NO: 2129785 - DNA, 15 bp, Homo sapiens
ccctcactctgtcag

SEQ ID NO: 2129786 - DNA, 17 bp, Homo sapiens
ccctcactctgtcagcc

SEQ ID NO: 2129787 - DNA, 18 bp, Homo sapiens
ccctcactctgtcagcca

SEQ ID NO: 2129788 - DNA, 12 bp, Homo sapiens
ccctcactgcct

SEQ ID NO: 2129789 - DNA, 16 bp, Homo sapiens
ccctcactgccttcca

SEQ ID NO: 2129790 - DNA, 18 bp, Homo sapiens
ccctcagatgatctctcc

SEQ ID NO: 2129791 - DNA, 22 bp, Homo sapiens
ccctcagatgatctctccacgg

SEQ ID NO: 2129792 - DNA, 12 bp, Homo sapiens
ccctcagccctt

SEQ ID NO: 2129793 - DNA, 18 bp, Homo sapiens
ccctgggggaagccctgg

SEQ ID NO: 2129794 - DNA, 19 bp, Homo sapiens
ccctgggggaagccctgga

SEQ ID NO: 2129795 - DNA, 20 bp, Homo sapiens
ccctgggggaagccctggat

SEQ ID NO: 2129796 - DNA, 23 bp, Homo sapiens
ccctgggggccagctggtgctgc

SEQ ID NO: 2129797 - DNA, 13 bp, Homo sapiens
ccctgggtgccat

SEQ ID NO: 2129798 - DNA, 19 bp, Homo sapiens
ccctgggtgccattcccag

SEQ ID NO: 2129799 - DNA, 15 bp, Homo sapiens
ccctggtaagcagag

SEQ ID NO: 2129800 - DNA, 16 bp, Homo sapiens
ccctggtaggaaagca

SEQ ID NO: 2129801 - DNA, 13 bp, Homo sapiens
ccctggtccttcc

SEQ ID NO: 2129802 - DNA, 16 bp, Homo sapiens
ccctggtctgccctgg

SEQ ID NO: 2129803 - DNA, 21 bp, Homo sapiens
ccctggtgcactggccccacc

SEQ ID NO: 2129804 - DNA, 19 bp, Homo sapiens
ccctggtgcagaggtgagc

SEQ ID NO: 2129805 - DNA, 21 bp, Homo sapiens
ccctggtgctgccacacttca

SEQ ID NO: 2129806 - DNA, 18 bp, Homo sapiens
ccctggtggacagtcctg

SEQ ID NO: 2129807 - DNA, 18 bp, Homo sapiens
ccctggttatattctcac

SEQ ID NO: 2129808 - DNA, 20 bp, Homo sapiens
ccctgtaaacacagtgctgc

SEQ ID NO: 2129809 - DNA, 20 bp, Homo sapiens
ccctgtaaagggtcagggtg

SEQ ID NO: 2129810 - DNA, 14 bp, Homo sapiens
ccctgtaggttgct

SEQ ID NO: 2129811 - DNA, 13 bp, Homo sapiens
ccctgtcagaggc

SEQ ID NO: 2129812 - DNA, 18 bp, Homo sapiens
ccctgtcccaccaactct

SEQ ID NO: 2129813 - DNA, 24 bp, Homo sapiens
ccctgtcccaccaactctgcactc

SEQ ID NO: 2129814 - DNA, 15 bp, Homo sapiens
ccctgtcccagcaga

SEQ ID NO: 2129815 - DNA, 18 bp, Homo sapiens
ccctgtcccctgaaaaac

SEQ ID NO: 2129816 - DNA, 14 bp, Homo sapiens
ccctgtcctcctcg

SEQ ID NO: 2129817 - DNA, 20 bp, Homo sapiens
ccctgtcgagacacttgcct

SEQ ID NO: 2129818 - DNA, 16 bp, Homo sapiens
ccgagattgcgccact

SEQ ID NO: 2129819 - DNA, 20 bp, Homo sapiens
ccgagcaaagtctaaagttt

SEQ ID NO: 2129820 - DNA, 18 bp, Homo sapiens
ccgagcagctgagcaggg

SEQ ID NO: 2129821 - DNA, 21 bp, Homo sapiens
ccgagcagctgagcagggccg

SEQ ID NO: 2129822 - DNA, 20 bp, Homo sapiens
ccgagcccagctacattcct

SEQ ID NO: 2129823 - DNA, 16 bp, Homo sapiens
ccgagccgggcctggg

SEQ ID NO: 2129824 - DNA, 19 bp, Homo sapiens
ccgagccgggcctggggct

SEQ ID NO: 2129825 - DNA, 14 bp, Homo sapiens
ccgagcctaatgaa

SEQ ID NO: 2129826 - DNA, 17 bp, Homo sapiens
ccgaggccttctctgaa

SEQ ID NO: 2129827 - DNA, 12 bp, Homo sapiens
ccgagggaaatg

SEQ ID NO: 2129828 - DNA, 14 bp, Homo sapiens
ccgagtagctggga

SEQ ID NO: 2129829 - DNA, 16 bp, Homo sapiens
ccgagtctcttctcca

SEQ ID NO: 2129830 - DNA, 18 bp, Homo sapiens
ccgagtctcttctccact

SEQ ID NO: 2129831 - DNA, 20 bp, Homo sapiens
ccgagtctcttctccactgg

SEQ ID NO: 2129832 - DNA, 21 bp, Homo sapiens
ccgagtctcttctccactgga

SEQ ID NO: 2129833 - DNA, 17 bp, Homo sapiens
ccgagtttgggccactg

SEQ ID NO: 2129834 - DNA, 21 bp, Homo sapiens
ccgagtttgggccactgcact

SEQ ID NO: 2129835 - DNA, 15 bp, Homo sapiens
ccgattaatttatgg

SEQ ID NO: 2129836 - DNA, 16 bp, Homo sapiens
ccgcaaggccctgtcc

SEQ ID NO: 2129837 - DNA, 18 bp, Homo sapiens
ccgcaaggccctgtccca

SEQ ID NO: 2129838 - DNA, 14 bp, Homo sapiens
ccgcaccagctgct

SEQ ID NO: 2129839 - DNA, 19 bp, Homo sapiens
ccgcaccagctgctctgcc

SEQ ID NO: 2129840 - DNA, 17 bp, Homo sapiens
ccgcaccaggccgggct

SEQ ID NO: 2129841 - DNA, 11 bp, Homo sapiens
ccgcaccccag

SEQ ID NO: 2129842 - DNA, 13 bp, Homo sapiens
ccgcaccccccaa

SEQ ID NO: 2129843 - DNA, 14 bp, Homo sapiens
ccgcactcacccat

SEQ ID NO: 2129844 - DNA, 15 bp, Homo sapiens
ccgcacttggaaagg

SEQ ID NO: 2129845 - DNA, 15 bp, Homo sapiens
ccgcagagcccacgc

SEQ ID NO: 2129846 - DNA, 20 bp, Homo sapiens
ccgcagccagccggtgcctg

SEQ ID NO: 2129847 - DNA, 23 bp, Homo sapiens
ccgcagccagccggtgcctggcg

SEQ ID NO: 2129848 - DNA, 12 bp, Homo sapiens
ccgcagcccagg

SEQ ID NO: 2129849 - DNA, 22 bp, Homo sapiens
ccgcagcccgtgaagcagtgcc

SEQ ID NO: 2129850 - DNA, 15 bp, Homo sapiens
ccgcagtccccagcc

SEQ ID NO: 2129851 - DNA, 17 bp, Homo sapiens
ccgcagtccccagccct

SEQ ID NO: 2129852 - DNA, 18 bp, Homo sapiens
ccgcagtccccagccctt

SEQ ID NO: 2129853 - DNA, 15 bp, Homo sapiens
ccgcatcttctccat

SEQ ID NO: 2129854 - DNA, 20 bp, Homo sapiens
ccgcatcttctccatctggc

SEQ ID NO: 2129855 - DNA, 22 bp, Homo sapiens
ccgcatcttctccatctggcag

SEQ ID NO: 2129856 - DNA, 16 bp, Homo sapiens
ccgccaaacactccac

SEQ ID NO: 2129857 - DNA, 19 bp, Homo sapiens
ccgccacgaggagcttcca

SEQ ID NO: 2129858 - DNA, 21 bp, Homo sapiens
ccgccacgaggagcttccagt

SEQ ID NO: 2129859 - DNA, 13 bp, Homo sapiens
ccgccacggccac

SEQ ID NO: 2129860 - DNA, 19 bp, Homo sapiens
ccgccacggccaccctcct

SEQ ID NO: 2129861 - DNA, 17 bp, Homo sapiens
ccgccagaggacaagga

SEQ ID NO: 2129862 - DNA, 14 bp, Homo sapiens
ccgccagcctcagt

SEQ ID NO: 2129863 - DNA, 16 bp, Homo sapiens
ccgccagcctcagtgc

SEQ ID NO: 2129864 - DNA, 22 bp, Homo sapiens
ccgccatccgggacgcttccag

SEQ ID NO: 2129865 - DNA, 19 bp, Homo sapiens
ccgcccaaggggacttgtg

SEQ ID NO: 2129866 - DNA, 17 bp, Homo sapiens
ccgcccagctgcacctg

SEQ ID NO: 2129867 - DNA, 21 bp, Homo sapiens
ccgcccctcgctgctgctact

SEQ ID NO: 2129868 - DNA, 18 bp, Homo sapiens
ccgcccctctccaaacac

SEQ ID NO: 2129869 - DNA, 13 bp, Homo sapiens
ccgcccgaccagg

SEQ ID NO: 2129870 - DNA, 22 bp, Homo sapiens
ccgccctctgcgtcccccagcc

SEQ ID NO: 2129871 - DNA, 14 bp, Homo sapiens
ccgccctgcccctg

SEQ ID NO: 2129872 - DNA, 13 bp, Homo sapiens
ccgccgcccgacc

SEQ ID NO: 2129873 - DNA, 13 bp, Homo sapiens
ccgcctccaggag

SEQ ID NO: 2129874 - DNA, 14 bp, Homo sapiens
ccgcctccaggagc

SEQ ID NO: 2129875 - DNA, 16 bp, Homo sapiens
ccgcctctgcccgcag

SEQ ID NO: 2129876 - DNA, 14 bp, Homo sapiens
ccgcctgcagagga

SEQ ID NO: 2129877 - DNA, 15 bp, Homo sapiens
ccgcctgcagaggac

SEQ ID NO: 2129878 - DNA, 21 bp, Homo sapiens
ccgcctgcagaggacagagct

SEQ ID NO: 2129879 - DNA, 16 bp, Homo sapiens
ccgcctgtcctgcctc

SEQ ID NO: 2129880 - DNA, 18 bp, Homo sapiens
ccgcgagactgagaggca

SEQ ID NO: 2129881 - DNA, 13 bp, Homo sapiens
ccgcgcatctctt

SEQ ID NO: 2129882 - DNA, 14 bp, Homo sapiens
ccgcggtgctctgg

SEQ ID NO: 2129883 - DNA, 13 bp, Homo sapiens
ccgcgtagagagc

SEQ ID NO: 2129884 - DNA, 20 bp, Homo sapiens
ccgcgtagctgggactacag

SEQ ID NO: 2129885 - DNA, 14 bp, Homo sapiens
ccgctaaaagaaac

SEQ ID NO: 2129886 - DNA, 20 bp, Homo sapiens
ccgctacaccactctggcag

SEQ ID NO: 2129887 - DNA, 20 bp, Homo sapiens
ccgctagagcagcccaaatt

SEQ ID NO: 2129888 - DNA, 11 bp, Homo sapiens
ccgctcagccc

SEQ ID NO: 2129889 - DNA, 13 bp, Homo sapiens
ccgctcagccctc

SEQ ID NO: 2129890 - DNA, 22 bp, Homo sapiens
ccgctcagccctccctgcccct

SEQ ID NO: 2129891 - DNA, 15 bp, Homo sapiens
ccgctcctgtctgcc

SEQ ID NO: 2129892 - DNA, 14 bp, Homo sapiens
ccgctctggaccaa

SEQ ID NO: 2129893 - DNA, 12 bp, Homo sapiens
ccgctgccacca

SEQ ID NO: 2129894 - DNA, 24 bp, Homo sapiens
ccgctgccaccacgtctgccaggc

SEQ ID NO: 2129895 - DNA, 20 bp, Homo sapiens
ccgctgcctaagtggctgct

SEQ ID NO: 2129896 - DNA, 17 bp, Homo sapiens
ccgctgccttttgctgc

SEQ ID NO: 2129897 - DNA, 21 bp, Homo sapiens
ccgctgccttttgctgctgct

SEQ ID NO: 2129898 - DNA, 14 bp, Homo sapiens
ccgctggctcctcc

SEQ ID NO: 2129899 - DNA, 15 bp, Homo sapiens
ccgctggctcctcca

SEQ ID NO: 2129900 - DNA, 19 bp, Homo sapiens
ccgctggctcctccaggca

SEQ ID NO: 2129901 - DNA, 12 bp, Homo sapiens
ccgctggggaac

SEQ ID NO: 2129902 - DNA, 14 bp, Homo sapiens
ccgctggggaacag

SEQ ID NO: 2129903 - DNA, 23 bp, Homo sapiens
ccgctggggagcgaaagtttctt

SEQ ID NO: 2129904 - DNA, 15 bp, Homo sapiens
ccgctgtcgccccag

SEQ ID NO: 2129905 - DNA, 19 bp, Homo sapiens
ccgctgtcgccccaggccc

SEQ ID NO: 2129906 - DNA, 20 bp, Homo sapiens
ccgctgtcgccccaggccct

SEQ ID NO: 2129907 - DNA, 16 bp, Homo sapiens
ccgctgttcacccaca

SEQ ID NO: 2129908 - DNA, 19 bp, Homo sapiens
ccgctgttcacccacaggg

SEQ ID NO: 2129909 - DNA, 21 bp, Homo sapiens
ccgctgttcacccacagggct

SEQ ID NO: 2129910 - DNA, 12 bp, Homo sapiens
ccgcttcccaga

SEQ ID NO: 2129911 - DNA, 16 bp, Homo sapiens
ccgcttcccagaggcc

SEQ ID NO: 2129912 - DNA, 15 bp, Homo sapiens
ccgcttccccacaga

SEQ ID NO: 2129913 - DNA, 17 bp, Homo sapiens
ccgcttccccacagaac

SEQ ID NO: 2129914 - DNA, 12 bp, Homo sapiens
cctcaaatacat

SEQ ID NO: 2129915 - DNA, 16 bp, Homo sapiens
cctcaaatgacccaaa

SEQ ID NO: 2129916 - DNA, 13 bp, Homo sapiens
cctcaaatgtcag

SEQ ID NO: 2129917 - DNA, 16 bp, Homo sapiens
cctcaacctcctgggc

SEQ ID NO: 2129918 - DNA, 16 bp, Homo sapiens
cctcaactaaccctta

SEQ ID NO: 2129919 - DNA, 15 bp, Homo sapiens
cctcaatgccctgcc

SEQ ID NO: 2129920 - DNA, 16 bp, Homo sapiens
cctcaatgccctgcca

SEQ ID NO: 2129921 - DNA, 17 bp, Homo sapiens
cctcaatgccctgccat

SEQ ID NO: 2129922 - DNA, 21 bp, Homo sapiens
cctcaatgtgaatcagaccct

SEQ ID NO: 2129923 - DNA, 16 bp, Homo sapiens
cctcaatgtgaccagg

SEQ ID NO: 2129924 - DNA, 15 bp, Homo sapiens
cctcacacccagagg

SEQ ID NO: 2129925 - DNA, 18 bp, Homo sapiens
cctcacagcctctccctt

SEQ ID NO: 2129926 - DNA, 13 bp, Homo sapiens
cctcacaggagca

SEQ ID NO: 2129927 - DNA, 18 bp, Homo sapiens
cctcacaggagcagacag

SEQ ID NO: 2129928 - DNA, 19 bp, Homo sapiens
cctcacagtgacccttccc

SEQ ID NO: 2129929 - DNA, 24 bp, Homo sapiens
cctcacagtgacccttcccaatca

SEQ ID NO: 2129930 - DNA, 21 bp, Homo sapiens
cctcacatagctacccaaaag

SEQ ID NO: 2129931 - DNA, 15 bp, Homo sapiens
cctcaccaataactt

SEQ ID NO: 2129932 - DNA, 20 bp, Homo sapiens
cctcaccccctcccaccccc

SEQ ID NO: 2129933 - DNA, 17 bp, Homo sapiens
cctcaccccgtctgggg

SEQ ID NO: 2129934 - DNA, 16 bp, Homo sapiens
cctcaccggcatgctg

SEQ ID NO: 2129935 - DNA, 19 bp, Homo sapiens
cctcaccggcatgctggcc

SEQ ID NO: 2129936 - DNA, 16 bp, Homo sapiens
cctcacctgagagcca

SEQ ID NO: 2129937 - DNA, 18 bp, Homo sapiens
cctcacctgcctgccctc

SEQ ID NO: 2129938 - DNA, 17 bp, Homo sapiens
cctcacctgggcctttc

SEQ ID NO: 2129939 - DNA, 21 bp, Homo sapiens
cctcacctttgcaaagttaca

SEQ ID NO: 2129940 - DNA, 14 bp, Homo sapiens
cctcacgcccagcc

SEQ ID NO: 2129941 - DNA, 17 bp, Homo sapiens
cctcacgcccagcctcc

SEQ ID NO: 2129942 - DNA, 18 bp, Homo sapiens
cctcacgcccagcctcct

SEQ ID NO: 2129943 - DNA, 15 bp, Homo sapiens
cctcacgctctggac

SEQ ID NO: 2129944 - DNA, 20 bp, Homo sapiens
cctcactatggtatgctggc

SEQ ID NO: 2129945 - DNA, 22 bp, Homo sapiens
cctcactatggtatgctggcca

SEQ ID NO: 2129946 - DNA, 23 bp, Homo sapiens
cctcactatggtatgctggccag

SEQ ID NO: 2129947 - DNA, 24 bp, Homo sapiens
cctcactatggtatgctggccagc

SEQ ID NO: 2129948 - DNA, 12 bp, Homo sapiens
cctcactcctgt

SEQ ID NO: 2129949 - DNA, 17 bp, Homo sapiens
cctcactctgtcagcca

SEQ ID NO: 2129950 - DNA, 19 bp, Homo sapiens
cctcactctgtcagccagc

SEQ ID NO: 2129951 - DNA, 12 bp, Homo sapiens
cctcactgagga

SEQ ID NO: 2129952 - DNA, 12 bp, Homo sapiens
cctcactgcccc

SEQ ID NO: 2129953 - DNA, 14 bp, Homo sapiens
cctcactgccttcc

SEQ ID NO: 2129954 - DNA, 17 bp, Homo sapiens
cctcactgctggggagt

SEQ ID NO: 2129955 - DNA, 20 bp, Homo sapiens
cctcactgctggggagtccc

SEQ ID NO: 2129956 - DNA, 21 bp, Homo sapiens
cctcactgctggggagtccct

SEQ ID NO: 2129957 - DNA, 16 bp, Homo sapiens
cctcactggctggggc

SEQ ID NO: 2129958 - DNA, 19 bp, Homo sapiens
cctcactggggtcctgggg

SEQ ID NO: 2129959 - DNA, 13 bp, Homo sapiens
cctcacttccctg

SEQ ID NO: 2129960 - DNA, 14 bp, Homo sapiens
cctcacttccctgg

SEQ ID NO: 2129961 - DNA, 16 bp, Homo sapiens
cctcacttccctggga

SEQ ID NO: 2129962 - DNA, 18 bp, Homo sapiens
cctcacttttaatgaaca

SEQ ID NO: 2129963 - DNA, 22 bp, Homo sapiens
cctcagacaatccactctcagg

SEQ ID NO: 2129964 - DNA, 12 bp, Homo sapiens
cctcagagctct

SEQ ID NO: 2129965 - DNA, 14 bp, Homo sapiens
cctcagatgatctc

SEQ ID NO: 2129966 - DNA, 21 bp, Homo sapiens
cctcagatgatctctccacgg

SEQ ID NO: 2129967 - DNA, 19 bp, Homo sapiens
cctcagcacccctgtctct

SEQ ID NO: 2129968 - DNA, 12 bp, Homo sapiens
cctcagccctca

SEQ ID NO: 2129969 - DNA, 13 bp, Homo sapiens
cctcagccctcag

SEQ ID NO: 2129970 - DNA, 22 bp, Homo sapiens
cctcagcccttgcccccatccc

SEQ ID NO: 2129971 - DNA, 11 bp, Homo sapiens
cctcagcctgt

SEQ ID NO: 2129972 - DNA, 20 bp, Homo sapiens
cctcagccttgaaaaacaag

SEQ ID NO: 2129973 - DNA, 12 bp, Homo sapiens
cctcagctcagc

SEQ ID NO: 2129974 - DNA, 11 bp, Homo sapiens
cctcagctgca

SEQ ID NO: 2129975 - DNA, 13 bp, Homo sapiens
cctcagctgcaca

SEQ ID NO: 2129976 - DNA, 12 bp, Homo sapiens
cctcagctgcca

SEQ ID NO: 2129977 - DNA, 15 bp, Homo sapiens
cctcagctgccaagc

SEQ ID NO: 2129978 - DNA, 19 bp, Homo sapiens
cctcagctgctcgcacaga

SEQ ID NO: 2129979 - DNA, 14 bp, Homo sapiens
cctcaggccagtgc

SEQ ID NO: 2129980 - DNA, 15 bp, Homo sapiens
cctcaggcggggagg

SEQ ID NO: 2129981 - DNA, 16 bp, Homo sapiens
cctcaggcggggagga

SEQ ID NO: 2129982 - DNA, 18 bp, Homo sapiens
cctcaggcggggaggagg

SEQ ID NO: 2129983 - DNA, 24 bp, Homo sapiens
cctcaggcggggaggaggagctgc

SEQ ID NO: 2129984 - DNA, 17 bp, Homo sapiens
cctcaggcttccttggc

SEQ ID NO: 2129985 - DNA, 20 bp, Homo sapiens
cctcagggacagagacacct

SEQ ID NO: 2129986 - DNA, 21 bp, Homo sapiens
cctcagggacagagacacctg

SEQ ID NO: 2129987 - DNA, 22 bp, Homo sapiens
cctcaggttcctaagacttcag

SEQ ID NO: 2129988 - DNA, 21 bp, Homo sapiens
cctcagtaagtatctggagga

SEQ ID NO: 2129989 - DNA, 11 bp, Homo sapiens
cctcagtgcca

SEQ ID NO: 2129990 - DNA, 19 bp, Homo sapiens
cctcagtgctcggcagtca

SEQ ID NO: 2129991 - DNA, 11 bp, Homo sapiens
cctcagtgtca

SEQ ID NO: 2129992 - DNA, 12 bp, Homo sapiens
cctcagtttccc

SEQ ID NO: 2129993 - DNA, 16 bp, Homo sapiens
cctcagtttcctcatc

SEQ ID NO: 2129994 - DNA, 12 bp, Homo sapiens
cctcagtttctc

SEQ ID NO: 2129995 - DNA, 19 bp, Homo sapiens
cctcagtttctccatcagc

SEQ ID NO: 2129996 - DNA, 19 bp, Homo sapiens
cctcagttttatcattttc

SEQ ID NO: 2129997 - DNA, 18 bp, Homo sapiens
cctcataccatctgctgc

SEQ ID NO: 2129998 - DNA, 15 bp, Homo sapiens
cctcatccgaggcag

SEQ ID NO: 2129999 - DNA, 17 bp, Homo sapiens
cctcatcctccttcttc

SEQ ID NO: 2130000 - DNA, 18 bp, Homo sapiens
cctcatcttgccccctca

SEQ ID NO: 2130001 - DNA, 24 bp, Homo sapiens
cctcatcttgccccctcatctcac

SEQ ID NO: 2130002 - DNA, 15 bp, Homo sapiens
cctcatgaccctcct

SEQ ID NO: 2130003 - DNA, 20 bp, Homo sapiens
cctcatgaccctcctgtcca

SEQ ID NO: 2130004 - DNA, 18 bp, Homo sapiens
cctcatgataatctgggc

SEQ ID NO: 2130005 - DNA, 14 bp, Homo sapiens
cctcatgcctggcc

SEQ ID NO: 2130006 - DNA, 15 bp, Homo sapiens
cctcatgcctggccc

SEQ ID NO: 2130007 - DNA, 15 bp, Homo sapiens
cctcattacccaggt

SEQ ID NO: 2130008 - DNA, 16 bp, Homo sapiens
cctcattcaggaaaac

SEQ ID NO: 2130009 - DNA, 13 bp, Homo sapiens
cctcattcccctc

SEQ ID NO: 2130010 - DNA, 17 bp, Homo sapiens
cctcattcgcctgtggg

SEQ ID NO: 2130011 - DNA, 15 bp, Homo sapiens
cctccaaactcctgc

SEQ ID NO: 2130012 - DNA, 20 bp, Homo sapiens
cctccaacaataaagagctc

SEQ ID NO: 2130013 - DNA, 17 bp, Homo sapiens
cctccacagccgcagcc

SEQ ID NO: 2130014 - DNA, 18 bp, Homo sapiens
cctccacagtagcatttc

SEQ ID NO: 2130015 - DNA, 18 bp, Homo sapiens
cctccacagtgctgcttc

SEQ ID NO: 2130016 - DNA, 19 bp, Homo sapiens
cctccacccccgccacggc

SEQ ID NO: 2130017 - DNA, 20 bp, Homo sapiens
cctccacccccgccacggcc

SEQ ID NO: 2130018 - DNA, 14 bp, Homo sapiens
cctccacgcctcct

SEQ ID NO: 2130019 - DNA, 19 bp, Homo sapiens
cctccacgcctcctggcca

SEQ ID NO: 2130020 - DNA, 21 bp, Homo sapiens
cctccacgcctcctggccaga

SEQ ID NO: 2130021 - DNA, 15 bp, Homo sapiens
cctccactcactcca

SEQ ID NO: 2130022 - DNA, 16 bp, Homo sapiens
cctccactcactccag

SEQ ID NO: 2130023 - DNA, 21 bp, Homo sapiens
cctccactcccccacctgaca

SEQ ID NO: 2130024 - DNA, 13 bp, Homo sapiens
cctccactgtcac

SEQ ID NO: 2130025 - DNA, 15 bp, Homo sapiens
cctccagaccctgcc

SEQ ID NO: 2130026 - DNA, 16 bp, Homo sapiens
cctccagaccctgcct

SEQ ID NO: 2130027 - DNA, 16 bp, Homo sapiens
cctccagagccagcct

SEQ ID NO: 2130028 - DNA, 17 bp, Homo sapiens
cctccagagccagcctg

SEQ ID NO: 2130029 - DNA, 19 bp, Homo sapiens
cctccagagccagcctggg

SEQ ID NO: 2130030 - DNA, 20 bp, Homo sapiens
cctccagagccagcctggga

SEQ ID NO: 2130031 - DNA, 20 bp, Homo sapiens
cctggcatgaccatcctgtc

SEQ ID NO: 2130032 - DNA, 22 bp, Homo sapiens
cctggcatgaccatcctgtcct

SEQ ID NO: 2130033 - DNA, 14 bp, Homo sapiens
cctggcatgtcaga

SEQ ID NO: 2130034 - DNA, 21 bp, Homo sapiens
cctggccagatgcaccagccc

SEQ ID NO: 2130035 - DNA, 21 bp, Homo sapiens
cctggccaggcaccccctgga

SEQ ID NO: 2130036 - DNA, 24 bp, Homo sapiens
cctggcccatagaaacatgacact

SEQ ID NO: 2130037 - DNA, 12 bp, Homo sapiens
cctggccccatg

SEQ ID NO: 2130038 - DNA, 21 bp, Homo sapiens
cctggccccatgtctctcaga

SEQ ID NO: 2130039 - DNA, 14 bp, Homo sapiens
cctggcccctccag

SEQ ID NO: 2130040 - DNA, 14 bp, Homo sapiens
cctggccctcttct

SEQ ID NO: 2130041 - DNA, 20 bp, Homo sapiens
cctcctgagaaggcgaggag

SEQ ID NO: 2130042 - DNA, 19 bp, Homo sapiens
cctcctgcccaggagagcc

SEQ ID NO: 2130043 - DNA, 12 bp, Homo sapiens
cctcctgccctc

SEQ ID NO: 2130044 - DNA, 16 bp, Homo sapiens
cctgatgctcatatca

SEQ ID NO: 2130045 - DNA, 15 bp, Homo sapiens
cctgatgctgccccg

SEQ ID NO: 2130046 - DNA, 18 bp, Homo sapiens
cctgtgtggggaggcagc

SEQ ID NO: 2130047 - DNA, 22 bp, Homo sapiens
cctgtgtggggaggcagctcca

SEQ ID NO: 2130048 - DNA, 21 bp, Homo sapiens
cctgtgtgtgaaaggaagctc

SEQ ID NO: 2130049 - DNA, 21 bp, Homo sapiens
cctgtgtgtgcgcctacagga

SEQ ID NO: 2130050 - DNA, 15 bp, Homo sapiens
cctgtgttcttgctg

SEQ ID NO: 2130051 - DNA, 18 bp, Homo sapiens
cctgtgtttcttgcctca

SEQ ID NO: 2130052 - DNA, 17 bp, Homo sapiens
cctgttaaaatgtacac

SEQ ID NO: 2130053 - DNA, 22 bp, Homo sapiens
cctgttacttaaatagcatctg

SEQ ID NO: 2130054 - DNA, 23 bp, Homo sapiens
cctgttattttttatttccacat

SEQ ID NO: 2130055 - DNA, 21 bp, Homo sapiens
cctgttcactctacttagcat

SEQ ID NO: 2130056 - DNA, 14 bp, Homo sapiens
cctgttcagctcca

SEQ ID NO: 2130057 - DNA, 15 bp, Homo sapiens
cctgttctcagctcc

SEQ ID NO: 2130058 - DNA, 14 bp, Homo sapiens
cctgttgcacctca

SEQ ID NO: 2130059 - DNA, 23 bp, Homo sapiens
cctgttggacccgctctggacca

SEQ ID NO: 2130060 - DNA, 17 bp, Homo sapiens
cctgtttaaaaaaagta

SEQ ID NO: 2130061 - DNA, 12 bp, Homo sapiens
cctgtttcctga

SEQ ID NO: 2130062 - DNA, 15 bp, Homo sapiens
cctgttttaaattat

SEQ ID NO: 2130063 - DNA, 20 bp, Homo sapiens
ccttctccaacaagttgcct

SEQ ID NO: 2130064 - DNA, 14 bp, Homo sapiens
ccttctcctgccta

SEQ ID NO: 2130065 - DNA, 20 bp, Homo sapiens
ccttctcgcattttctctag

SEQ ID NO: 2130066 - DNA, 19 bp, Homo sapiens
ccttctctacccatctccc

SEQ ID NO: 2130067 - DNA, 15 bp, Homo sapiens
ccttctctccttccc

SEQ ID NO: 2130068 - DNA, 16 bp, Homo sapiens
ccttctctccttccct

SEQ ID NO: 2130069 - DNA, 13 bp, Homo sapiens
ccttctctgttca

SEQ ID NO: 2130070 - DNA, 18 bp, Homo sapiens
ccttctctgttcatttcc

SEQ ID NO: 2130071 - DNA, 12 bp, Homo sapiens
ccttctgcaccc

SEQ ID NO: 2130072 - DNA, 13 bp, Homo sapiens
ccttctgcaccca

SEQ ID NO: 2130073 - DNA, 18 bp, Homo sapiens
ccttctgcacccagaaat

SEQ ID NO: 2130074 - DNA, 11 bp, Homo sapiens
ccttctgggca

SEQ ID NO: 2130075 - DNA, 14 bp, Homo sapiens
ccttctggttgctt

SEQ ID NO: 2130076 - DNA, 22 bp, Homo sapiens
ccttcttattctcactccacca

SEQ ID NO: 2130077 - DNA, 13 bp, Homo sapiens
ccttcttcgctgc

SEQ ID NO: 2130078 - DNA, 14 bp, Homo sapiens
ccttcttcgctgct

SEQ ID NO: 2130079 - DNA, 17 bp, Homo sapiens
ccttcttggcttctggg

SEQ ID NO: 2130080 - DNA, 15 bp, Homo sapiens
ccttctttaaatcaa

SEQ ID NO: 2130081 - DNA, 18 bp, Homo sapiens
ccttctttaaatcaaaag

SEQ ID NO: 2130082 - DNA, 21 bp, Homo sapiens
ccttctttaaatcaaaagctg

SEQ ID NO: 2130083 - DNA, 17 bp, Homo sapiens
ccttcttttttgtctca

SEQ ID NO: 2130084 - DNA, 16 bp, Homo sapiens
cggaggggcctggcag

SEQ ID NO: 2130085 - DNA, 18 bp, Homo sapiens
cggaggggcctggcagcc

SEQ ID NO: 2130086 - DNA, 20 bp, Homo sapiens
cggaggggttgcgggggagc

SEQ ID NO: 2130087 - DNA, 13 bp, Homo sapiens
cggagtagaaatt

SEQ ID NO: 2130088 - DNA, 20 bp, Homo sapiens
cggagtcccaccttggctgc

SEQ ID NO: 2130089 - DNA, 18 bp, Homo sapiens
cggatcaccgagagtagc

SEQ ID NO: 2130090 - DNA, 16 bp, Homo sapiens
cggatctcactcagcc

SEQ ID NO: 2130091 - DNA, 18 bp, Homo sapiens
cggatgcacacacagatg

SEQ ID NO: 2130092 - DNA, 14 bp, Homo sapiens
cggatggcagattg

SEQ ID NO: 2130093 - DNA, 20 bp, Homo sapiens
cggcaaccccagttctgctc

SEQ ID NO: 2130094 - DNA, 23 bp, Homo sapiens
cggcaaccccagttctgctcctc

SEQ ID NO: 2130095 - DNA, 15 bp, Homo sapiens
cggcaccccctgcag

SEQ ID NO: 2130096 - DNA, 22 bp, Homo sapiens
cggcacctacatccccaggtct

SEQ ID NO: 2130097 - DNA, 13 bp, Homo sapiens
cggcacctgggcc

SEQ ID NO: 2130098 - DNA, 22 bp, Homo sapiens
cggcacctgggccctggggcct

SEQ ID NO: 2130099 - DNA, 23 bp, Homo sapiens
cggcacgccaacagcccccccct

SEQ ID NO: 2130100 - DNA, 16 bp, Homo sapiens
cggcacgtcccatgtg

SEQ ID NO: 2130101 - DNA, 17 bp, Homo sapiens
cggcagagaccccagga

SEQ ID NO: 2130102 - DNA, 18 bp, Homo sapiens
cggcagagaccccaggat

SEQ ID NO: 2130103 - DNA, 17 bp, Homo sapiens
cggcagcttgagcctgt

SEQ ID NO: 2130104 - DNA, 17 bp, Homo sapiens
cggcaggagcaggaaca

SEQ ID NO: 2130105 - DNA, 19 bp, Homo sapiens
cggcatattattccatatc

SEQ ID NO: 2130106 - DNA, 12 bp, Homo sapiens
cggcatgtttcc

SEQ ID NO: 2130107 - DNA, 14 bp, Homo sapiens
cggcattcctgctt

SEQ ID NO: 2130108 - DNA, 20 bp, Homo sapiens
cggccaggccagagggagtg

SEQ ID NO: 2130109 - DNA, 12 bp, Homo sapiens
cggcccacagct

SEQ ID NO: 2130110 - DNA, 22 bp, Homo sapiens
cggcccacagctcccaccccac

SEQ ID NO: 2130111 - DNA, 18 bp, Homo sapiens
cggcccagaagtttccct

SEQ ID NO: 2130112 - DNA, 12 bp, Homo sapiens
cggcccagagac

SEQ ID NO: 2130113 - DNA, 20 bp, Homo sapiens
cggcccagagaccccttcct

SEQ ID NO: 2130114 - DNA, 14 bp, Homo sapiens
cggccccatcagag

SEQ ID NO: 2130115 - DNA, 19 bp, Homo sapiens
cggccccatcagaggctgg

SEQ ID NO: 2130116 - DNA, 13 bp, Homo sapiens
cggcccctgctgg

SEQ ID NO: 2130117 - DNA, 19 bp, Homo sapiens
cggcccctgctggttcagg

SEQ ID NO: 2130118 - DNA, 17 bp, Homo sapiens
cggccctgccccatcct

SEQ ID NO: 2130119 - DNA, 15 bp, Homo sapiens
cggccgcattccctg

SEQ ID NO: 2130120 - DNA, 18 bp, Homo sapiens
cggccgcattccctgagt

SEQ ID NO: 2130121 - DNA, 14 bp, Homo sapiens
cggccgggctgccc

SEQ ID NO: 2130122 - DNA, 24 bp, Homo sapiens
cggccgggctgcccttcgctgcca

SEQ ID NO: 2130123 - DNA, 14 bp, Homo sapiens
cggcctccactccc

SEQ ID NO: 2130124 - DNA, 12 bp, Homo sapiens
cggcctcttcca

SEQ ID NO: 2130125 - DNA, 18 bp, Homo sapiens
cggcctgctcccagcagc

SEQ ID NO: 2130126 - DNA, 19 bp, Homo sapiens
cggcctgctcccagcagcc

SEQ ID NO: 2130127 - DNA, 15 bp, Homo sapiens
cggccttccaccggg

SEQ ID NO: 2130128 - DNA, 19 bp, Homo sapiens
cggctactcagcagccctc

SEQ ID NO: 2130129 - DNA, 15 bp, Homo sapiens
cggctccaggctcct

SEQ ID NO: 2130130 - DNA, 16 bp, Homo sapiens
cggctccaggctcctt

SEQ ID NO: 2130131 - DNA, 16 bp, Homo sapiens
cggctccaggtccgga

SEQ ID NO: 2130132 - DNA, 18 bp, Homo sapiens
cggctccaggtccggagg

SEQ ID NO: 2130133 - DNA, 15 bp, Homo sapiens
cggctccccctgctt

SEQ ID NO: 2130134 - DNA, 14 bp, Homo sapiens
cggctctcctgaga

SEQ ID NO: 2130135 - DNA, 22 bp, Homo sapiens
cggctgagtcatgatctccctg

SEQ ID NO: 2130136 - DNA, 17 bp, Homo sapiens
cggctgcttccttctgc

SEQ ID NO: 2130137 - DNA, 20 bp, Homo sapiens
cggctgtgggggaggtccct

SEQ ID NO: 2130138 - DNA, 19 bp, Homo sapiens
cggcttattagtgaaactg

SEQ ID NO: 2130139 - DNA, 15 bp, Homo sapiens
cgggaacagacaaca

SEQ ID NO: 2130140 - DNA, 15 bp, Homo sapiens
cgggacagacctgga

SEQ ID NO: 2130141 - DNA, 12 bp, Homo sapiens
cgggacagagag

SEQ ID NO: 2130142 - DNA, 20 bp, Homo sapiens
cgggacgcttccagaccacc

SEQ ID NO: 2130143 - DNA, 21 bp, Homo sapiens
cgggacgcttccagaccacct

SEQ ID NO: 2130144 - DNA, 15 bp, Homo sapiens
cgggagaggactctg

SEQ ID NO: 2130145 - DNA, 19 bp, Homo sapiens
cgggagaggagatcagggc

SEQ ID NO: 2130146 - DNA, 22 bp, Homo sapiens
cgggagatggacccctcccttg

SEQ ID NO: 2130147 - DNA, 12 bp, Homo sapiens
cgggagcctccc

SEQ ID NO: 2130148 - DNA, 18 bp, Homo sapiens
cgggagcctccccctcag

SEQ ID NO: 2130149 - DNA, 20 bp, Homo sapiens
cgggaggcaccagctctgtg

SEQ ID NO: 2130150 - DNA, 19 bp, Homo sapiens
cgggaggctgagacaggag

SEQ ID NO: 2130151 - DNA, 19 bp, Homo sapiens
cgggcacctatagtcccag

SEQ ID NO: 2130152 - DNA, 21 bp, Homo sapiens
cgggcacctatagtcccagct

SEQ ID NO: 2130153 - DNA, 20 bp, Homo sapiens
cgggcagcccagcctctgtc

SEQ ID NO: 2130154 - DNA, 21 bp, Homo sapiens
cgggcagcccagcctctgtcc

SEQ ID NO: 2130155 - DNA, 21 bp, Homo sapiens
cgggccactccttcctgcccc

SEQ ID NO: 2130156 - DNA, 11 bp, Homo sapiens
cgggcctcagt

SEQ ID NO: 2130157 - DNA, 14 bp, Homo sapiens
cgggcctcagtttc

SEQ ID NO: 2130158 - DNA, 16 bp, Homo sapiens
cgggcctcagtttccc

SEQ ID NO: 2130159 - DNA, 19 bp, Homo sapiens
cgggcctcagtttccccat

SEQ ID NO: 2130160 - DNA, 15 bp, Homo sapiens
cgggcctgcctctga

SEQ ID NO: 2130161 - DNA, 17 bp, Homo sapiens
cgggcctgcctctgact

SEQ ID NO: 2130162 - DNA, 13 bp, Homo sapiens
cgggctctggcca

SEQ ID NO: 2130163 - DNA, 14 bp, Homo sapiens
cgggctctggccac

SEQ ID NO: 2130164 - DNA, 18 bp, Homo sapiens
cgggctctggccaccctg

SEQ ID NO: 2130165 - DNA, 20 bp, Homo sapiens
cgggctgggagctctgcaga

SEQ ID NO: 2130166 - DNA, 16 bp, Homo sapiens
cgggcttgggccctgc

SEQ ID NO: 2130167 - DNA, 15 bp, Homo sapiens
cggggaaacctatca

SEQ ID NO: 2130168 - DNA, 16 bp, Homo sapiens
cggggaactcctggaa

SEQ ID NO: 2130169 - DNA, 15 bp, Homo sapiens
cggggaactggccaa

SEQ ID NO: 2130170 - DNA, 20 bp, Homo sapiens
cggggaagctggcagcactc

SEQ ID NO: 2130171 - DNA, 22 bp, Homo sapiens
cggggaaggtttttatgtgcct

SEQ ID NO: 2130172 - DNA, 14 bp, Homo sapiens
cggggacagctcct

SEQ ID NO: 2130173 - DNA, 20 bp, Homo sapiens
cggggaggaggagctgccgc

SEQ ID NO: 2130174 - DNA, 16 bp, Homo sapiens
cggggcaaggtctcct

SEQ ID NO: 2130175 - DNA, 14 bp, Homo sapiens
cggggcaggaggcc

SEQ ID NO: 2130176 - DNA, 15 bp, Homo sapiens
cggggcaggaggcct

SEQ ID NO: 2130177 - DNA, 16 bp, Homo sapiens
cggggcaggaggcctg

SEQ ID NO: 2130178 - DNA, 19 bp, Homo sapiens
cggggcatgctggggcaag

SEQ ID NO: 2130179 - DNA, 19 bp, Homo sapiens
cggggcccttggggcctgg

SEQ ID NO: 2130180 - DNA, 20 bp, Homo sapiens
cggggcccttggggcctggc

SEQ ID NO: 2130181 - DNA, 23 bp, Homo sapiens
cggggcgggggcccgaaagctga

SEQ ID NO: 2130182 - DNA, 12 bp, Homo sapiens
cggggctggcaa

SEQ ID NO: 2130183 - DNA, 16 bp, Homo sapiens
cggggctggcaagcag

SEQ ID NO: 2130184 - DNA, 20 bp, Homo sapiens
cggggcttctgggtggctcc

SEQ ID NO: 2130185 - DNA, 13 bp, Homo sapiens
cgggggagctgga

SEQ ID NO: 2130186 - DNA, 16 bp, Homo sapiens
cgggggagctggaaat

SEQ ID NO: 2130187 - DNA, 19 bp, Homo sapiens
cgggggtgcggcaggagca

SEQ ID NO: 2130188 - DNA, 20 bp, Homo sapiens
cgggggtgcggcaggagcag

SEQ ID NO: 2130189 - DNA, 16 bp, Homo sapiens
cggggtattttaggca

SEQ ID NO: 2130190 - DNA, 14 bp, Homo sapiens
cggggtctgtgctg

SEQ ID NO: 2130191 - DNA, 19 bp, Homo sapiens
cggggtctgtgctgtgcct

SEQ ID NO: 2130192 - DNA, 21 bp, Homo sapiens
cggggtctgtgctgtgcctgc

SEQ ID NO: 2130193 - DNA, 15 bp, Homo sapiens
cggggtgcacaggag

SEQ ID NO: 2130194 - DNA, 16 bp, Homo sapiens
cgggtccccagctccc

SEQ ID NO: 2130195 - DNA, 17 bp, Homo sapiens
cgggtccgattaattta

SEQ ID NO: 2130196 - DNA, 23 bp, Homo sapiens
cgggtgcatttgagagaagccac

SEQ ID NO: 2130197 - DNA, 20 bp, Homo sapiens
cgggtgcctcagagcaggct

SEQ ID NO: 2130198 - DNA, 18 bp, Homo sapiens
cgggtggctagtcagaga

SEQ ID NO: 2130199 - DNA, 13 bp, Homo sapiens
cgggtgggcctgg

SEQ ID NO: 2130200 - DNA, 16 bp, Homo sapiens
cgggtgggcctggcct

SEQ ID NO: 2130201 - DNA, 18 bp, Homo sapiens
cgggtgggcctggcctga

SEQ ID NO: 2130202 - DNA, 22 bp, Homo sapiens
cgggtgggcctggcctgagctg

SEQ ID NO: 2130203 - DNA, 20 bp, Homo sapiens
cgggtgtgcctgccctggag

SEQ ID NO: 2130204 - DNA, 14 bp, Homo sapiens
cgggtgtggcctca

SEQ ID NO: 2130205 - DNA, 15 bp, Homo sapiens
cgggtgtggcctcag

SEQ ID NO: 2130206 - DNA, 17 bp, Homo sapiens
cgggttgtgtgtctgtt

SEQ ID NO: 2130207 - DNA, 16 bp, Homo sapiens
cggtccacccaggagc

SEQ ID NO: 2130208 - DNA, 16 bp, Homo sapiens
cggtcccccctcactc

SEQ ID NO: 2130209 - DNA, 23 bp, Homo sapiens
cggtcccttgagacctcagccat

SEQ ID NO: 2130210 - DNA, 12 bp, Homo sapiens
cggtcctggccc

SEQ ID NO: 2130211 - DNA, 18 bp, Homo sapiens
cggtcctttaggcagcct

SEQ ID NO: 2130212 - DNA, 19 bp, Homo sapiens
cggtcctttaggcagcctg

SEQ ID NO: 2130213 - DNA, 14 bp, Homo sapiens
cggtgaaatccagg

SEQ ID NO: 2130214 - DNA, 20 bp, Homo sapiens
cggtgagaggggaacagact

SEQ ID NO: 2130215 - DNA, 11 bp, Homo sapiens
cggtgcctggc

SEQ ID NO: 2130216 - DNA, 19 bp, Homo sapiens
cggtgcgtggctgtggcac

SEQ ID NO: 2130217 - DNA, 20 bp, Homo sapiens
cggtgctcgcttctcctcca

SEQ ID NO: 2130218 - DNA, 22 bp, Homo sapiens
cggtgctcgcttctcctccagg

SEQ ID NO: 2130219 - DNA, 11 bp, Homo sapiens
cggtgctctgg

SEQ ID NO: 2130220 - DNA, 12 bp, Homo sapiens
cggtgctctggc

SEQ ID NO: 2130221 - DNA, 14 bp, Homo sapiens
cggtgctctggcgg

SEQ ID NO: 2130222 - DNA, 21 bp, Homo sapiens
cggtggccatgcttcttgccc

SEQ ID NO: 2130223 - DNA, 16 bp, Homo sapiens
cggtgtgggctgtgtc

SEQ ID NO: 2130224 - DNA, 17 bp, Homo sapiens
cggttaacttgtatatt

SEQ ID NO: 2130225 - DNA, 20 bp, Homo sapiens
cggttccacgtccccctggg

SEQ ID NO: 2130226 - DNA, 21 bp, Homo sapiens
cggttgagttttgactgcttg

SEQ ID NO: 2130227 - DNA, 14 bp, Homo sapiens
cggttgcttcacct

SEQ ID NO: 2130228 - DNA, 19 bp, Homo sapiens
cggtttcaaaccaggattt

SEQ ID NO: 2130229 - DNA, 20 bp, Homo sapiens
cggtttctgagcataatgct

SEQ ID NO: 2130230 - DNA, 22 bp, Homo sapiens
cggtttggtttgttgtaaataa

SEQ ID NO: 2130231 - DNA, 17 bp, Homo sapiens
cgtaatgggcctgccca

SEQ ID NO: 2130232 - DNA, 19 bp, Homo sapiens
cgtacccccgtggtctttg

SEQ ID NO: 2130233 - DNA, 22 bp, Homo sapiens
cgtacccccgtggtctttgaat

SEQ ID NO: 2130234 - DNA, 23 bp, Homo sapiens
cgtacccccgtggtctttgaata

SEQ ID NO: 2130235 - DNA, 23 bp, Homo sapiens
cgtacttaactgtgtgaagaaat

SEQ ID NO: 2130236 - DNA, 19 bp, Homo sapiens
cgtataggatgtcagacaa

SEQ ID NO: 2130237 - DNA, 22 bp, Homo sapiens
cgtatatgtctcaggtccctgc

SEQ ID NO: 2130238 - DNA, 22 bp, Homo sapiens
cgtatgtcggcacgtcccatgt

SEQ ID NO: 2130239 - DNA, 21 bp, Homo sapiens
cgtatttaatagcaaagaatt

SEQ ID NO: 2130240 - DNA, 23 bp, Homo sapiens
cgtatttaatagcaaagaattga

SEQ ID NO: 2130241 - DNA, 18 bp, Homo sapiens
cgtatttatatttggaaa

SEQ ID NO: 2130242 - DNA, 19 bp, Homo sapiens
cgtatttatatttggaaag

SEQ ID NO: 2130243 - DNA, 20 bp, Homo sapiens
cgtattttaaaagccacata

SEQ ID NO: 2130244 - DNA, 23 bp, Homo sapiens
cgtcaagttgcagatctttttgt

SEQ ID NO: 2130245 - DNA, 13 bp, Homo sapiens
cgtcatctcaggg

SEQ ID NO: 2130246 - DNA, 16 bp, Homo sapiens
cgtcatctcagggtcc

SEQ ID NO: 2130247 - DNA, 15 bp, Homo sapiens
cgtccacaggggcag

SEQ ID NO: 2130248 - DNA, 17 bp, Homo sapiens
cgtccacaggggcaggc

SEQ ID NO: 2130249 - DNA, 20 bp, Homo sapiens
cgtccacaggggcaggcctg

SEQ ID NO: 2130250 - DNA, 17 bp, Homo sapiens
cgtccacccaggctgca

SEQ ID NO: 2130251 - DNA, 19 bp, Homo sapiens
cgtccacccaggctgcact

SEQ ID NO: 2130252 - DNA, 20 bp, Homo sapiens
cgtccacccaggctgcactg

SEQ ID NO: 2130253 - DNA, 23 bp, Homo sapiens
cgtccacccaggctgcactgcag

SEQ ID NO: 2130254 - DNA, 13 bp, Homo sapiens
cgtcccccagccc

SEQ ID NO: 2130255 - DNA, 15 bp, Homo sapiens
cgtcccccagccctc

SEQ ID NO: 2130256 - DNA, 17 bp, Homo sapiens
cgtcccccagccctcag

SEQ ID NO: 2130257 - DNA, 22 bp, Homo sapiens
cgtcccccagccctcaggccag

SEQ ID NO: 2130258 - DNA, 17 bp, Homo sapiens
cgtccccccccaacctt

SEQ ID NO: 2130259 - DNA, 13 bp, Homo sapiens
cgtccccctgggg

SEQ ID NO: 2130260 - DNA, 13 bp, Homo sapiens
cgtcccctgctac

SEQ ID NO: 2130261 - DNA, 15 bp, Homo sapiens
cgtcctccccctgcc

SEQ ID NO: 2130262 - DNA, 17 bp, Homo sapiens
cgtcctccccctgccag

SEQ ID NO: 2130263 - DNA, 22 bp, Homo sapiens
cgtcctccccctgccagtgcct

SEQ ID NO: 2130264 - DNA, 20 bp, Homo sapiens
cgtcctgacgccctgcgttg

SEQ ID NO: 2130265 - DNA, 19 bp, Homo sapiens
cgtcctgcacgccgtggag

SEQ ID NO: 2130266 - DNA, 19 bp, Homo sapiens
cgtcctgcagaggaccaca

SEQ ID NO: 2130267 - DNA, 22 bp, Homo sapiens
cgtcctgcccccgacagcccag

SEQ ID NO: 2130268 - DNA, 13 bp, Homo sapiens
cgtcctggaatga

SEQ ID NO: 2130269 - DNA, 14 bp, Homo sapiens
cgtcctggaatgaa

SEQ ID NO: 2130270 - DNA, 21 bp, Homo sapiens
cgtcctggaatgaagcatgta

SEQ ID NO: 2130271 - DNA, 20 bp, Homo sapiens
cgtccttactcctgtgggag

SEQ ID NO: 2130272 - DNA, 21 bp, Homo sapiens
cgtccttactcctgtgggagc

SEQ ID NO: 2130273 - DNA, 15 bp, Homo sapiens
cgtctaccctgggat

SEQ ID NO: 2130274 - DNA, 16 bp, Homo sapiens
cgtctccctaaaataa

SEQ ID NO: 2130275 - DNA, 13 bp, Homo sapiens
cgtctctgtcccg

SEQ ID NO: 2130276 - DNA, 22 bp, Homo sapiens
cgtctgacaggcaatgctggct

SEQ ID NO: 2130277 - DNA, 18 bp, Homo sapiens
cgtctgccaggcccatct

SEQ ID NO: 2130278 - DNA, 18 bp, Homo sapiens
cgtctggggttcagcccc

SEQ ID NO: 2130279 - DNA, 19 bp, Homo sapiens
cgtctggggttcagcccct

SEQ ID NO: 2130280 - DNA, 13 bp, Homo sapiens
cgtcttctccaac

SEQ ID NO: 2130281 - DNA, 18 bp, Homo sapiens
cgtcttgctatttgagca

SEQ ID NO: 2130282 - DNA, 16 bp, Homo sapiens
cgtcttgggtcgccct

SEQ ID NO: 2130283 - DNA, 13 bp, Homo sapiens
cgtcttgtatttt

SEQ ID NO: 2130284 - DNA, 19 bp, Homo sapiens
cgtgaaagaattatttttg

SEQ ID NO: 2130285 - DNA, 20 bp, Homo sapiens
cgtgaagcagtgcctcgagg

SEQ ID NO: 2130286 - DNA, 16 bp, Homo sapiens
cgtgaatgtctcagcg

SEQ ID NO: 2130287 - DNA, 17 bp, Homo sapiens
cgtgacccttcagggcc

SEQ ID NO: 2130288 - DNA, 13 bp, Homo sapiens
cgtgactcaccca

SEQ ID NO: 2130289 - DNA, 14 bp, Homo sapiens
cgtgactcacccaa

SEQ ID NO: 2130290 - DNA, 18 bp, Homo sapiens
cgtgactcacccaagcat

SEQ ID NO: 2130291 - DNA, 22 bp, Homo sapiens
cgtgagccactgcaccgggcca

SEQ ID NO: 2130292 - DNA, 16 bp, Homo sapiens
cgtgcacacaccagag

SEQ ID NO: 2130293 - DNA, 18 bp, Homo sapiens
cgtgcacacaccagagcc

SEQ ID NO: 2130294 - DNA, 21 bp, Homo sapiens
cgtgcacacaccagagcccac

SEQ ID NO: 2130295 - DNA, 20 bp, Homo sapiens
cgtgcacagcgcgggcggag

SEQ ID NO: 2130296 - DNA, 22 bp, Homo sapiens
cgtgcactccctaagaaacccc

SEQ ID NO: 2130297 - DNA, 16 bp, Homo sapiens
cgtgcagtacaggcaa

SEQ ID NO: 2130298 - DNA, 21 bp, Homo sapiens
cgtgcagtggtgcgatctggg

SEQ ID NO: 2130299 - DNA, 22 bp, Homo sapiens
cgtgcagtggtgcgatctgggt

SEQ ID NO: 2130300 - DNA, 20 bp, Homo sapiens
cgtgccaagtccaggtcctg

SEQ ID NO: 2130301 - DNA, 17 bp, Homo sapiens
cgtgccagctctagttt

SEQ ID NO: 2130302 - DNA, 16 bp, Homo sapiens
cgtgccatgatctgta

SEQ ID NO: 2130303 - DNA, 20 bp, Homo sapiens
cgtgccctgacccctgcacc

SEQ ID NO: 2130304 - DNA, 18 bp, Homo sapiens
cgtgccttcagctctaca

SEQ ID NO: 2130305 - DNA, 15 bp, Homo sapiens
cgtgcctttctctgg

SEQ ID NO: 2130306 - DNA, 19 bp, Homo sapiens
cgtgcgtgtgtgtgtgttt

SEQ ID NO: 2130307 - DNA, 13 bp, Homo sapiens
cgtgctacctgca

SEQ ID NO: 2130308 - DNA, 15 bp, Homo sapiens
cgtgctcgcagcctg

SEQ ID NO: 2130309 - DNA, 13 bp, Homo sapiens
cgtggacacctgc

SEQ ID NO: 2130310 - DNA, 13 bp, Homo sapiens
cgtggactctgca

SEQ ID NO: 2130311 - DNA, 16 bp, Homo sapiens
cgtggactctgcacat

SEQ ID NO: 2130312 - DNA, 19 bp, Homo sapiens
cgtggagagctaggagcaa

SEQ ID NO: 2130313 - DNA, 23 bp, Homo sapiens
cgtggaggtgaagtccctgttct

SEQ ID NO: 2130314 - DNA, 13 bp, Homo sapiens
cgtggcaaatata

SEQ ID NO: 2130315 - DNA, 17 bp, Homo sapiens
cgtggcccttcctggac

SEQ ID NO: 2130316 - DNA, 13 bp, Homo sapiens
cgtggcctgcacc

SEQ ID NO: 2130317 - DNA, 14 bp, Homo sapiens
cgcctcctggccag

SEQ ID NO: 2130318 - DNA, 22 bp, Homo sapiens
cgcctcctggccagacgctgcc

SEQ ID NO: 2130319 - DNA, 16 bp, Homo sapiens
cgcctcttttccctct

SEQ ID NO: 2130320 - DNA, 11 bp, Homo sapiens
cgcctgagccc

SEQ ID NO: 2130321 - DNA, 14 bp, Homo sapiens
cgcctgagcccagg

SEQ ID NO: 2130322 - DNA, 20 bp, Homo sapiens
cgcctgagcccagggaggcc

SEQ ID NO: 2130323 - DNA, 21 bp, Homo sapiens
cgcctgagcccagggaggccg

SEQ ID NO: 2130324 - DNA, 13 bp, Homo sapiens
cgcctgcccagcc

SEQ ID NO: 2130325 - DNA, 15 bp, Homo sapiens
cgcctgcccagcctc

SEQ ID NO: 2130326 - DNA, 21 bp, Homo sapiens
cgcctgcccccagcactcctc

SEQ ID NO: 2130327 - DNA, 15 bp, Homo sapiens
cgcctgccctccctg

SEQ ID NO: 2130328 - DNA, 14 bp, Homo sapiens
cgcctggccggctc

SEQ ID NO: 2130329 - DNA, 14 bp, Homo sapiens
cgcctgggcccagg

SEQ ID NO: 2130330 - DNA, 17 bp, Homo sapiens
cgcctgggcccaggctc

SEQ ID NO: 2130331 - DNA, 17 bp, Homo sapiens
cgcctgtaatcccagca

SEQ ID NO: 2130332 - DNA, 19 bp, Homo sapiens
cgcctgtaatcccagcact

SEQ ID NO: 2130333 - DNA, 11 bp, Homo sapiens
cgcctgtgccc

SEQ ID NO: 2130334 - DNA, 18 bp, Homo sapiens
cgcctgtgcccacgtgtg

SEQ ID NO: 2130335 - DNA, 15 bp, Homo sapiens
cgccttcctcctcca

SEQ ID NO: 2130336 - DNA, 19 bp, Homo sapiens
cgccttgaccttcccaagg

SEQ ID NO: 2130337 - DNA, 15 bp, Homo sapiens
cgcgagactgagagg

SEQ ID NO: 2130338 - DNA, 18 bp, Homo sapiens
cgcgagactgagaggcag

SEQ ID NO: 2130339 - DNA, 12 bp, Homo sapiens
cgcgcatctctt

SEQ ID NO: 2130340 - DNA, 13 bp, Homo sapiens
cgcggcttggccg

SEQ ID NO: 2130341 - DNA, 21 bp, Homo sapiens
cgcggcttggccgccatccgg

SEQ ID NO: 2130342 - DNA, 15 bp, Homo sapiens
cgcgggaggcaccag

SEQ ID NO: 2130343 - DNA, 16 bp, Homo sapiens
cgcggtggctcacacc

SEQ ID NO: 2130344 - DNA, 12 bp, Homo sapiens
cgcgtagagagc

SEQ ID NO: 2130345 - DNA, 14 bp, Homo sapiens
cgcgtctaccctgg

SEQ ID NO: 2130346 - DNA, 15 bp, Homo sapiens
cgcgtctaccctggg

SEQ ID NO: 2130347 - DNA, 16 bp, Homo sapiens
cgcgtctaccctggga

SEQ ID NO: 2130348 - DNA, 12 bp, Homo sapiens
cgcgtctcctgt

SEQ ID NO: 2130349 - DNA, 17 bp, Homo sapiens
cgcgtctgccccaccct

SEQ ID NO: 2130350 - DNA, 15 bp, Homo sapiens
cgctaggagagactg

SEQ ID NO: 2130351 - DNA, 18 bp, Homo sapiens
cgctcaagaatcctctgg

SEQ ID NO: 2130352 - DNA, 16 bp, Homo sapiens
cgctcagccctccctg

SEQ ID NO: 2130353 - DNA, 21 bp, Homo sapiens
cgctcagccctccctgcccct

SEQ ID NO: 2130354 - DNA, 14 bp, Homo sapiens
cgctcaggacccag

SEQ ID NO: 2130355 - DNA, 17 bp, Homo sapiens
cgctcaggacccaggcc

SEQ ID NO: 2130356 - DNA, 18 bp, Homo sapiens
cgctcaggacccaggccc

SEQ ID NO: 2130357 - DNA, 19 bp, Homo sapiens
cgctcaggacccaggccct

SEQ ID NO: 2130358 - DNA, 19 bp, Homo sapiens
cgctccccactctgctctg

SEQ ID NO: 2130359 - DNA, 18 bp, Homo sapiens
cgctcccccgcagtcccc

SEQ ID NO: 2130360 - DNA, 19 bp, Homo sapiens
cgctcccccgcagtcccca

SEQ ID NO: 2130361 - DNA, 16 bp, Homo sapiens
cgctcctgtctgccag

SEQ ID NO: 2130362 - DNA, 21 bp, Homo sapiens
cgctcctttacctaccacctt

SEQ ID NO: 2130363 - DNA, 15 bp, Homo sapiens
cgctctgccctccct

SEQ ID NO: 2130364 - DNA, 16 bp, Homo sapiens
cgctctgccctccctg

SEQ ID NO: 2130365 - DNA, 18 bp, Homo sapiens
cgctctgccctccctggc

SEQ ID NO: 2130366 - DNA, 20 bp, Homo sapiens
cgctctgctggcctggccgg

SEQ ID NO: 2130367 - DNA, 12 bp, Homo sapiens
cgctctggacat

SEQ ID NO: 2130368 - DNA, 14 bp, Homo sapiens
cgctcttgggagtc

SEQ ID NO: 2130369 - DNA, 17 bp, Homo sapiens
cgctgccaccacgtctg

SEQ ID NO: 2130370 - DNA, 11 bp, Homo sapiens
cgctgccagga

SEQ ID NO: 2130371 - DNA, 13 bp, Homo sapiens
cgctgccaggaca

SEQ ID NO: 2130372 - DNA, 14 bp, Homo sapiens
cgctgccaggacac

SEQ ID NO: 2130373 - DNA, 16 bp, Homo sapiens
cgctgccaggacacct

SEQ ID NO: 2130374 - DNA, 18 bp, Homo sapiens
cgctgccaggacacctgc

SEQ ID NO: 2130375 - DNA, 22 bp, Homo sapiens
cgctgccaggacacctgcccca

SEQ ID NO: 2130376 - DNA, 15 bp, Homo sapiens
cgctgccccagcccc

SEQ ID NO: 2130377 - DNA, 15 bp, Homo sapiens
cgctgccgctgccgc

SEQ ID NO: 2130378 - DNA, 17 bp, Homo sapiens
cgctgcctaagtggctg

SEQ ID NO: 2130379 - DNA, 20 bp, Homo sapiens
cgctgccttttgctgctgct

SEQ ID NO: 2130380 - DNA, 12 bp, Homo sapiens
cgctggaatcaa

SEQ ID NO: 2130381 - DNA, 17 bp, Homo sapiens
cgctggacaacccagaa

SEQ ID NO: 2130382 - DNA, 14 bp, Homo sapiens
cgctggcagagaag

SEQ ID NO: 2130383 - DNA, 11 bp, Homo sapiens
cgctggcccag

SEQ ID NO: 2130384 - DNA, 18 bp, Homo sapiens
cgctggcccagggtaggg

SEQ ID NO: 2130385 - DNA, 23 bp, Homo sapiens
cgctggcccagggtaggggaggg

SEQ ID NO: 2130386 - DNA, 17 bp, Homo sapiens
cgctggctcaggaagaa

SEQ ID NO: 2130387 - DNA, 15 bp, Homo sapiens
cgctggctcctccag

SEQ ID NO: 2130388 - DNA, 14 bp, Homo sapiens
cgctgggggtgggg

SEQ ID NO: 2130389 - DNA, 13 bp, Homo sapiens
cgctggtggacca

SEQ ID NO: 2130390 - DNA, 17 bp, Homo sapiens
cgctgtcgccccaggcc

SEQ ID NO: 2130391 - DNA, 23 bp, Homo sapiens
cgctgtcgccccaggccctccct

SEQ ID NO: 2130392 - DNA, 18 bp, Homo sapiens
cgctgtgaaaatgaggag

SEQ ID NO: 2130393 - DNA, 20 bp, Homo sapiens
cgctgtgaaaatgaggagga

SEQ ID NO: 2130394 - DNA, 13 bp, Homo sapiens
cgctgtggctcct

SEQ ID NO: 2130395 - DNA, 17 bp, Homo sapiens
cgctgtggctcctgcct

SEQ ID NO: 2130396 - DNA, 19 bp, Homo sapiens
cgctgtggctcctgccttg

SEQ ID NO: 2130397 - DNA, 15 bp, Homo sapiens
ctaaatagttctatc

SEQ ID NO: 2130398 - DNA, 16 bp, Homo sapiens
ctaaatatatgtctgt

SEQ ID NO: 2130399 - DNA, 15 bp, Homo sapiens
ctaaatctctaatat

SEQ ID NO: 2130400 - DNA, 13 bp, Homo sapiens
ctaaatcttcctt

SEQ ID NO: 2130401 - DNA, 17 bp, Homo sapiens
ctaaatcttccttgtga

SEQ ID NO: 2130402 - DNA, 18 bp, Homo sapiens
ctaaatcttccttgtgag

SEQ ID NO: 2130403 - DNA, 22 bp, Homo sapiens
ctaaatgaaaatcgtgacaaca

SEQ ID NO: 2130404 - DNA, 13 bp, Homo sapiens
ctaaatgaagaga

SEQ ID NO: 2130405 - DNA, 14 bp, Homo sapiens
ctaaatgaatgttt

SEQ ID NO: 2130406 - DNA, 14 bp, Homo sapiens
ctaaatgacctcag

SEQ ID NO: 2130407 - DNA, 23 bp, Homo sapiens
ctaaatgagctcctgcgggagta

SEQ ID NO: 2130408 - DNA, 15 bp, Homo sapiens
ctaaatgcccagttc

SEQ ID NO: 2130409 - DNA, 18 bp, Homo sapiens
ctaaatgcccagttcact

SEQ ID NO: 2130410 - DNA, 14 bp, Homo sapiens
ctaaatgctggtct

SEQ ID NO: 2130411 - DNA, 16 bp, Homo sapiens
ctaaatggctttaatt

SEQ ID NO: 2130412 - DNA, 18 bp, Homo sapiens
ctaaatggtcgcccagga

SEQ ID NO: 2130413 - DNA, 20 bp, Homo sapiens
ctaaatggtcgcccaggaga

SEQ ID NO: 2130414 - DNA, 21 bp, Homo sapiens
ctaaatggtcgcccaggagac

SEQ ID NO: 2130415 - DNA, 21 bp, Homo sapiens
ctaaattctttatttctgtca

SEQ ID NO: 2130416 - DNA, 21 bp, Homo sapiens
ctaaattgtatacattttgtt

SEQ ID NO: 2130417 - DNA, 17 bp, Homo sapiens
ctaacacattatcggga

SEQ ID NO: 2130418 - DNA, 23 bp, Homo sapiens
ctaacactcagaagcctgggggc

SEQ ID NO: 2130419 - DNA, 17 bp, Homo sapiens
ctaacagggaaggcagg

SEQ ID NO: 2130420 - DNA, 13 bp, Homo sapiens
ctaacatatgtat

SEQ ID NO: 2130421 - DNA, 15 bp, Homo sapiens
ctaacatcatgcatt

SEQ ID NO: 2130422 - DNA, 16 bp, Homo sapiens
ctaacccatgggtcca

SEQ ID NO: 2130423 - DNA, 22 bp, Homo sapiens
ctaaccccaacgcacaggaaaa

SEQ ID NO: 2130424 - DNA, 22 bp, Homo sapiens
ctaacccccagcccacagagcc

SEQ ID NO: 2130425 - DNA, 16 bp, Homo sapiens
ctaacccccagtgcca

SEQ ID NO: 2130426 - DNA, 18 bp, Homo sapiens
ctaacccccagtgccaca

SEQ ID NO: 2130427 - DNA, 14 bp, Homo sapiens
ctaacctaagcaaa

SEQ ID NO: 2130428 - DNA, 18 bp, Homo sapiens
ctaacgcctgagcccagg

SEQ ID NO: 2130429 - DNA, 14 bp, Homo sapiens
ctaactccagtgaa

SEQ ID NO: 2130430 - DNA, 15 bp, Homo sapiens
ctaactgaagagaca

SEQ ID NO: 2130431 - DNA, 20 bp, Homo sapiens
ctaactgctacaaatactct

SEQ ID NO: 2130432 - DNA, 15 bp, Homo sapiens
ctaactgtaaatcac

SEQ ID NO: 2130433 - DNA, 20 bp, Homo sapiens
ctaactgtaaatcacttgta

SEQ ID NO: 2130434 - DNA, 15 bp, Homo sapiens
ctaagaaaccccagg

SEQ ID NO: 2130435 - DNA, 13 bp, Homo sapiens
ctaagaagctctg

SEQ ID NO: 2130436 - DNA, 19 bp, Homo sapiens
ctaagaagtccccaggtca

SEQ ID NO: 2130437 - DNA, 23 bp, Homo sapiens
ctaagacctccccacccccgctg

SEQ ID NO: 2130438 - DNA, 15 bp, Homo sapiens
ctaagagaatgaatt

SEQ ID NO: 2130439 - DNA, 16 bp, Homo sapiens
ctaagagagcacctgg

SEQ ID NO: 2130440 - DNA, 18 bp, Homo sapiens
ctaagagctagcgctgcc

SEQ ID NO: 2130441 - DNA, 20 bp, Homo sapiens
ctaagagctagcgctgccgc

SEQ ID NO: 2130442 - DNA, 23 bp, Homo sapiens
ctaagaggcgacttcctctccag

SEQ ID NO: 2130443 - DNA, 13 bp, Homo sapiens
ctaagcagctggg

SEQ ID NO: 2130444 - DNA, 14 bp, Homo sapiens
ctaagcagctggga

SEQ ID NO: 2130445 - DNA, 16 bp, Homo sapiens
ctaagcagctgggact

SEQ ID NO: 2130446 - DNA, 13 bp, Homo sapiens
ctaagccacagct

SEQ ID NO: 2130447 - DNA, 16 bp, Homo sapiens
ctacaataaatgctga

SEQ ID NO: 2130448 - DNA, 20 bp, Homo sapiens
ctacaataaatgctgaatga

SEQ ID NO: 2130449 - DNA, 22 bp, Homo sapiens
ctacaataaatgctgaatgaat

SEQ ID NO: 2130450 - DNA, 16 bp, Homo sapiens
ctacacagcctggact

SEQ ID NO: 2130451 - DNA, 15 bp, Homo sapiens
ctacacagtaaaaac

SEQ ID NO: 2130452 - DNA, 23 bp, Homo sapiens
ctacacagtgggaactctgacaa

SEQ ID NO: 2130453 - DNA, 14 bp, Homo sapiens
ctacaccactctgg

SEQ ID NO: 2130454 - DNA, 20 bp, Homo sapiens
ctacaccactctggcagcca

SEQ ID NO: 2130455 - DNA, 13 bp, Homo sapiens
ctacacctgaggc

SEQ ID NO: 2130456 - DNA, 15 bp, Homo sapiens
ctacactaataaatg

SEQ ID NO: 2130457 - DNA, 17 bp, Homo sapiens
ctacactccagcctgag

SEQ ID NO: 2130458 - DNA, 18 bp, Homo sapiens
ctacactccagcctgagc

SEQ ID NO: 2130459 - DNA, 17 bp, Homo sapiens
ctacagaaatactgctc

SEQ ID NO: 2130460 - DNA, 19 bp, Homo sapiens
ctacagaaatactgctctg

SEQ ID NO: 2130461 - DNA, 15 bp, Homo sapiens
ctacagaacaaagaa

SEQ ID NO: 2130462 - DNA, 15 bp, Homo sapiens
ctacagaggccatgg

SEQ ID NO: 2130463 - DNA, 17 bp, Homo sapiens
ctacagaggccatgggc

SEQ ID NO: 2130464 - DNA, 21 bp, Homo sapiens
ctacagataatttattttgta

SEQ ID NO: 2130465 - DNA, 14 bp, Homo sapiens
ctacagatagtcaa

SEQ ID NO: 2130466 - DNA, 15 bp, Homo sapiens
ctacagatagtcaaa

SEQ ID NO: 2130467 - DNA, 13 bp, Homo sapiens
ctacagccagaag

SEQ ID NO: 2130468 - DNA, 15 bp, Homo sapiens
ctacagccagaagcc

SEQ ID NO: 2130469 - DNA, 16 bp, Homo sapiens
ctacagccagaagccc

SEQ ID NO: 2130470 - DNA, 18 bp, Homo sapiens
ctacagcctcagaaacca

SEQ ID NO: 2130471 - DNA, 21 bp, Homo sapiens
ctacagctaatcagcattctc

SEQ ID NO: 2130472 - DNA, 21 bp, Homo sapiens
ctacaggagagggaagagtgc

SEQ ID NO: 2130473 - DNA, 15 bp, Homo sapiens
ctacaggcacccacc

SEQ ID NO: 2130474 - DNA, 20 bp, Homo sapiens
ctacaggcccggcccagcct

SEQ ID NO: 2130475 - DNA, 16 bp, Homo sapiens
ctacaggtgcaagcca

SEQ ID NO: 2130476 - DNA, 17 bp, Homo sapiens
ctacagtactatgtaaa

SEQ ID NO: 2130477 - DNA, 15 bp, Homo sapiens
ctacagtgttttcct

SEQ ID NO: 2130478 - DNA, 14 bp, Homo sapiens
ctacatagttattc

SEQ ID NO: 2130479 - DNA, 13 bp, Homo sapiens
ctacatccccagg

SEQ ID NO: 2130480 - DNA, 16 bp, Homo sapiens
ctacatcttcagctcc

SEQ ID NO: 2130481 - DNA, 17 bp, Homo sapiens
ctacatcttcagctccc

SEQ ID NO: 2130482 - DNA, 13 bp, Homo sapiens
ctacatgaaacag

SEQ ID NO: 2130483 - DNA, 16 bp, Homo sapiens
ctacatgaaacagaaa

SEQ ID NO: 2130484 - DNA, 17 bp, Homo sapiens
ctacattccctggcctg

SEQ ID NO: 2130485 - DNA, 10 bp, Homo sapiens
ctacattcct

SEQ ID NO: 2130486 - DNA, 15 bp, Homo sapiens
ctacattcctcagct

SEQ ID NO: 2130487 - DNA, 19 bp, Homo sapiens
ctacattcctcagctgcca

SEQ ID NO: 2130488 - DNA, 13 bp, Homo sapiens
ctaccaatgcatg

SEQ ID NO: 2130489 - DNA, 19 bp, Homo sapiens
ctaccaatgccaagataat

SEQ ID NO: 2130490 - DNA, 13 bp, Homo sapiens
ctaccacagtgtc

SEQ ID NO: 2130491 - DNA, 15 bp, Homo sapiens
ctaccacagtgtctg

SEQ ID NO: 2130492 - DNA, 16 bp, Homo sapiens
ctaccaccccttcctg

SEQ ID NO: 2130493 - DNA, 13 bp, Homo sapiens
ctaccaccttccc

SEQ ID NO: 2130494 - DNA, 18 bp, Homo sapiens
ctaccaccttccctcttt

SEQ ID NO: 2130495 - DNA, 20 bp, Homo sapiens
ctaccaccttccctctttct

SEQ ID NO: 2130496 - DNA, 11 bp, Homo sapiens
ctaccagaggg

SEQ ID NO: 2130497 - DNA, 14 bp, Homo sapiens
ctaccatgctgctt

SEQ ID NO: 2130498 - DNA, 15 bp, Homo sapiens
ctacccaaccactca

SEQ ID NO: 2130499 - DNA, 22 bp, Homo sapiens
ctacccaccctcctttcaccac

SEQ ID NO: 2130500 - DNA, 12 bp, Homo sapiens
ctacccactctt

SEQ ID NO: 2130501 - DNA, 13 bp, Homo sapiens
ctatacccattct

SEQ ID NO: 2130502 - DNA, 14 bp, Homo sapiens
ctatacccattctt

SEQ ID NO: 2130503 - DNA, 23 bp, Homo sapiens
ctatacctgtgtttcttgcctca

SEQ ID NO: 2130504 - DNA, 17 bp, Homo sapiens
ctatagcctaggtgaca

SEQ ID NO: 2130505 - DNA, 20 bp, Homo sapiens
ctatagcctaggtgacagag

SEQ ID NO: 2130506 - DNA, 22 bp, Homo sapiens
ctatagctcttctatttaaaaa

SEQ ID NO: 2130507 - DNA, 16 bp, Homo sapiens
ctataggcagacgtgg

SEQ ID NO: 2130508 - DNA, 11 bp, Homo sapiens
ctatatacatg

SEQ ID NO: 2130509 - DNA, 22 bp, Homo sapiens
ctatatacatgtgtgtatatat

SEQ ID NO: 2130510 - DNA, 16 bp, Homo sapiens
ctatatagtttattga

SEQ ID NO: 2130511 - DNA, 15 bp, Homo sapiens
ctatatatacatgta

SEQ ID NO: 2130512 - DNA, 15 bp, Homo sapiens
ctatatatataaata

SEQ ID NO: 2130513 - DNA, 14 bp, Homo sapiens
ctatatcatgcttt

SEQ ID NO: 2130514 - DNA, 15 bp, Homo sapiens
ctatatgaaaaacaa

SEQ ID NO: 2130515 - DNA, 19 bp, Homo sapiens
ctatatgatttatagtttg

SEQ ID NO: 2130516 - DNA, 16 bp, Homo sapiens
ctatatgcatttaatt

SEQ ID NO: 2130517 - DNA, 20 bp, Homo sapiens
ctatatgcatttaattctga

SEQ ID NO: 2130518 - DNA, 13 bp, Homo sapiens
ctatatggcaaga

SEQ ID NO: 2130519 - DNA, 20 bp, Homo sapiens
ctatattccgggtgccattc

SEQ ID NO: 2130520 - DNA, 14 bp, Homo sapiens
ctatattgtacaca

SEQ ID NO: 2130521 - DNA, 15 bp, Homo sapiens
ctatattgtacacac

SEQ ID NO: 2130522 - DNA, 18 bp, Homo sapiens
ctatcaaaacatatcaat

SEQ ID NO: 2130523 - DNA, 21 bp, Homo sapiens
ctatcaaaacatatcaattca

SEQ ID NO: 2130524 - DNA, 22 bp, Homo sapiens
ctatcaaaacatatcaattcaa

SEQ ID NO: 2130525 - DNA, 20 bp, Homo sapiens
ctatcaaactgaagccagaa

SEQ ID NO: 2130526 - DNA, 19 bp, Homo sapiens
ctatcaaccccagacactg

SEQ ID NO: 2130527 - DNA, 16 bp, Homo sapiens
ctatcaatagtcaaga

SEQ ID NO: 2130528 - DNA, 13 bp, Homo sapiens
ctatcaatattta

SEQ ID NO: 2130529 - DNA, 18 bp, Homo sapiens
ctatcaatatttaagttt

SEQ ID NO: 2130530 - DNA, 14 bp, Homo sapiens
ctatcacccaggct

SEQ ID NO: 2130531 - DNA, 15 bp, Homo sapiens
ctatccaaaggaatc

SEQ ID NO: 2130532 - DNA, 17 bp, Homo sapiens
ctatccacccagcccat

SEQ ID NO: 2130533 - DNA, 15 bp, Homo sapiens
ctatcctagagaggc

SEQ ID NO: 2130534 - DNA, 16 bp, Homo sapiens
ctatcctagagaggct

SEQ ID NO: 2130535 - DNA, 20 bp, Homo sapiens
ctatcctagagaggctggca

SEQ ID NO: 2130536 - DNA, 19 bp, Homo sapiens
ctatcctgaaaattctgta

SEQ ID NO: 2130537 - DNA, 16 bp, Homo sapiens
ctatccttccagtggc

SEQ ID NO: 2130538 - DNA, 16 bp, Homo sapiens
ctatctatataatgta

SEQ ID NO: 2130539 - DNA, 23 bp, Homo sapiens
ctatctccaaatgagacacatta

SEQ ID NO: 2130540 - DNA, 18 bp, Homo sapiens
ctatctctagagtgagaa

SEQ ID NO: 2130541 - DNA, 17 bp, Homo sapiens
ctatctctgtgtgcaca

SEQ ID NO: 2130542 - DNA, 21 bp, Homo sapiens
ctatctcttgtcatataaacc

SEQ ID NO: 2130543 - DNA, 17 bp, Homo sapiens
ctatctgtatgtctgcc

SEQ ID NO: 2130544 - DNA, 22 bp, Homo sapiens
ctatctgtcatctctctggggc

SEQ ID NO: 2130545 - DNA, 19 bp, Homo sapiens
ctatctgtgaagttacact

SEQ ID NO: 2130546 - DNA, 14 bp, Homo sapiens
ctatctgtgattcc

SEQ ID NO: 2130547 - DNA, 16 bp, Homo sapiens
ctatgaaaagctagaa

SEQ ID NO: 2130548 - DNA, 21 bp, Homo sapiens
ctatgaaaagctagaattgag

SEQ ID NO: 2130549 - DNA, 14 bp, Homo sapiens
ctatgacactgagc

SEQ ID NO: 2130550 - DNA, 16 bp, Homo sapiens
ctatgacactgagcaa

SEQ ID NO: 2130551 - DNA, 15 bp, Homo sapiens
ctatgactgctcccc

SEQ ID NO: 2130552 - DNA, 23 bp, Homo sapiens
ctatgagaacaagtcacagctgc

SEQ ID NO: 2130553 - DNA, 23 bp, Homo sapiens
ctatgaggaataattatttattt

SEQ ID NO: 2130554 - DNA, 22 bp, Homo sapiens
ctatgagggtccccgggagcac

SEQ ID NO: 2130555 - DNA, 20 bp, Homo sapiens
ctatgatatggtaaaagtta

SEQ ID NO: 2130556 - DNA, 21 bp, Homo sapiens
ctatgatcccagcactttggg

SEQ ID NO: 2130557 - DNA, 14 bp, Homo sapiens
ctatgatctcagga

SEQ ID NO: 2130558 - DNA, 16 bp, Homo sapiens
ctatgatctcaggagc

SEQ ID NO: 2130559 - DNA, 13 bp, Homo sapiens
ctatgcaattttt

SEQ ID NO: 2130560 - DNA, 17 bp, Homo sapiens
ctatgcaatttttaaac

SEQ ID NO: 2130561 - DNA, 18 bp, Homo sapiens
ctatgcaatttttaaact

SEQ ID NO: 2130562 - DNA, 19 bp, Homo sapiens
ctatgcaatttttaaacta

SEQ ID NO: 2130563 - DNA, 20 bp, Homo sapiens
ctatgcaatttttaaactag

SEQ ID NO: 2130564 - DNA, 22 bp, Homo sapiens
ctatgcaatttttaaactagta

SEQ ID NO: 2130565 - DNA, 12 bp, Homo sapiens
ctatgcacatat

SEQ ID NO: 2130566 - DNA, 18 bp, Homo sapiens
ctatgcacatatggactc

SEQ ID NO: 2130567 - DNA, 21 bp, Homo sapiens
ctatgcacatatggactctgc

SEQ ID NO: 2130568 - DNA, 18 bp, Homo sapiens
ctatgcagtattgccaca

SEQ ID NO: 2130569 - DNA, 24 bp, Homo sapiens
ctatgcagtattgccacaatgcct

SEQ ID NO: 2130570 - DNA, 18 bp, Homo sapiens
ctatgctatttctggcct

SEQ ID NO: 2130571 - DNA, 21 bp, Homo sapiens
ctatgctatttctggcctcag

SEQ ID NO: 2130572 - DNA, 13 bp, Homo sapiens
ctatgctgaagag

SEQ ID NO: 2130573 - DNA, 21 bp, Homo sapiens
ctatggaaaagggtcttcttg

SEQ ID NO: 2130574 - DNA, 22 bp, Homo sapiens
ctatggagggcagagtgggctg

SEQ ID NO: 2130575 - DNA, 14 bp, Homo sapiens
ctatggcagtccag

SEQ ID NO: 2130576 - DNA, 21 bp, Homo sapiens
ctatggcagtccagccagctc

SEQ ID NO: 2130577 - DNA, 15 bp, Homo sapiens
ctatggccccagggt

SEQ ID NO: 2130578 - DNA, 16 bp, Homo sapiens
ctatggccctgcaaaa

SEQ ID NO: 2130579 - DNA, 18 bp, Homo sapiens
ctatggccctgcaaaaat

SEQ ID NO: 2130580 - DNA, 17 bp, Homo sapiens
ctatggctgcctgcatc

SEQ ID NO: 2130581 - DNA, 18 bp, Homo sapiens
ctatggtatgctggccag

SEQ ID NO: 2130582 - DNA, 20 bp, Homo sapiens
ctatggtatgctggccagca

SEQ ID NO: 2130583 - DNA, 15 bp, Homo sapiens
ctatggtgaggtgtg

SEQ ID NO: 2130584 - DNA, 18 bp, Homo sapiens
ctatggttcccaataaaa

SEQ ID NO: 2130585 - DNA, 14 bp, Homo sapiens
ctatgtatggaata

SEQ ID NO: 2130586 - DNA, 19 bp, Homo sapiens
ctatgtcaatttgtatatc

SEQ ID NO: 2130587 - DNA, 13 bp, Homo sapiens
ctatgtcttgttt

SEQ ID NO: 2130588 - DNA, 19 bp, Homo sapiens
ctatgtggatctaaataat

SEQ ID NO: 2130589 - DNA, 16 bp, Homo sapiens
ctatgtggattagcta

SEQ ID NO: 2130590 - DNA, 19 bp, Homo sapiens
ctatgttccaataaaactt

SEQ ID NO: 2130591 - DNA, 21 bp, Homo sapiens
ctatgttgcccaggctgctct

SEQ ID NO: 2130592 - DNA, 14 bp, Homo sapiens
ctatgtttttaatg

SEQ ID NO: 2130593 - DNA, 16 bp, Homo sapiens
ctatgtttttaatgta

SEQ ID NO: 2130594 - DNA, 14 bp, Homo sapiens
ctattaaagtgcca

SEQ ID NO: 2130595 - DNA, 20 bp, Homo sapiens
ctattaagataaatagagtt

SEQ ID NO: 2130596 - DNA, 16 bp, Homo sapiens
ctattaagatttccaa

SEQ ID NO: 2130597 - DNA, 17 bp, Homo sapiens
ctattaagatttccaag

SEQ ID NO: 2130598 - DNA, 23 bp, Homo sapiens
ctattaagatttccaagtgccaa

SEQ ID NO: 2130599 - DNA, 23 bp, Homo sapiens
ctattactgtctggttttaacaa

SEQ ID NO: 2130600 - DNA, 15 bp, Homo sapiens
ctattacttgaactt

SEQ ID NO: 2130601 - DNA, 14 bp, Homo sapiens
ctattagcaactgt

SEQ ID NO: 2130602 - DNA, 14 bp, Homo sapiens
ctattataaaacca

SEQ ID NO: 2130603 - DNA, 16 bp, Homo sapiens
ctattataactgcata

SEQ ID NO: 2130604 - DNA, 16 bp, Homo sapiens
ctattataatttaatg

SEQ ID NO: 2130605 - DNA, 14 bp, Homo sapiens
ctattatagccaca

SEQ ID NO: 2130606 - DNA, 18 bp, Homo sapiens
ctattatagccacatccc

SEQ ID NO: 2130607 - DNA, 14 bp, Homo sapiens
ctattatattaaaa

SEQ ID NO: 2130608 - DNA, 16 bp, Homo sapiens
ctattatccccatttc

SEQ ID NO: 2130609 - DNA, 17 bp, Homo sapiens
ctattatccccatttct

SEQ ID NO: 2130610 - DNA, 15 bp, Homo sapiens
ctattatctgtgctt

SEQ ID NO: 2130611 - DNA, 21 bp, Homo sapiens
ctattatctgtgcttttgagg

SEQ ID NO: 2130612 - DNA, 13 bp, Homo sapiens
ctattatgtaaca

SEQ ID NO: 2130613 - DNA, 20 bp, Homo sapiens
ctattatgtaacatccagaa

SEQ ID NO: 2130614 - DNA, 20 bp, Homo sapiens
ctattattttcactgtagaa

SEQ ID NO: 2130615 - DNA, 16 bp, Homo sapiens
ctattcaaacagtctc

SEQ ID NO: 2130616 - DNA, 15 bp, Homo sapiens
ctattcctgaccctc

SEQ ID NO: 2130617 - DNA, 21 bp, Homo sapiens
ctattcctgaccctccctacc

SEQ ID NO: 2130618 - DNA, 16 bp, Homo sapiens
ctattctctcctcaga

SEQ ID NO: 2130619 - DNA, 13 bp, Homo sapiens
ctattctgagcct

SEQ ID NO: 2130620 - DNA, 16 bp, Homo sapiens
ctattgaacctaggac

SEQ ID NO: 2130621 - DNA, 13 bp, Homo sapiens
ctattgaactgag

SEQ ID NO: 2130622 - DNA, 17 bp, Homo sapiens
ctattgacaagtcattt

SEQ ID NO: 2130623 - DNA, 12 bp, Homo sapiens
ctattgatgttt

SEQ ID NO: 2130624 - DNA, 20 bp, Homo sapiens
ctattgcatgtaaaatgcag

SEQ ID NO: 2130625 - DNA, 22 bp, Homo sapiens
ctattgtttaaaaacaggaaaa

SEQ ID NO: 2130626 - DNA, 15 bp, Homo sapiens
ctatttaaaaaataa

SEQ ID NO: 2130627 - DNA, 23 bp, Homo sapiens
ctatttaaaaaataaaaaaatac

SEQ ID NO: 2130628 - DNA, 21 bp, Homo sapiens
ctatttaaaagtataaaactg

SEQ ID NO: 2130629 - DNA, 14 bp, Homo sapiens
ctatttaacttgag

SEQ ID NO: 2130630 - DNA, 15 bp, Homo sapiens
ctatttaacttgagg

SEQ ID NO: 2130631 - DNA, 12 bp, Homo sapiens
ctatttattggg

SEQ ID NO: 2130632 - DNA, 15 bp, Homo sapiens
ctatttatttactga

SEQ ID NO: 2130633 - DNA, 13 bp, Homo sapiens
ctatttcattttt

SEQ ID NO: 2130634 - DNA, 22 bp, Homo sapiens
ctatttccccaggggaaaatga

SEQ ID NO: 2130635 - DNA, 23 bp, Homo sapiens
ctatttccccaggggaaaatgaa

SEQ ID NO: 2130636 - DNA, 16 bp, Homo sapiens
ctatttctctccccac

SEQ ID NO: 2130637 - DNA, 13 bp, Homo sapiens
ctatttctgagaa

SEQ ID NO: 2130638 - DNA, 23 bp, Homo sapiens
ctatttctgagaaggtccttaat

SEQ ID NO: 2130639 - DNA, 15 bp, Homo sapiens
ctatttgttcagaga

SEQ ID NO: 2130640 - DNA, 23 bp, Homo sapiens
ctatttgttgtttttaacaacta

SEQ ID NO: 2130641 - DNA, 18 bp, Homo sapiens
ctatttgtttacatgcag

SEQ ID NO: 2130642 - DNA, 13 bp, Homo sapiens
ctattttaaaacc

SEQ ID NO: 2130643 - DNA, 14 bp, Homo sapiens
ctatttttgtagaa

SEQ ID NO: 2130644 - DNA, 15 bp, Homo sapiens
ctatttttgtagaag

SEQ ID NO: 2130645 - DNA, 13 bp, Homo sapiens
ctattttttaata

SEQ ID NO: 2130646 - DNA, 17 bp, Homo sapiens
ctattttttaataaaag

SEQ ID NO: 2130647 - DNA, 21 bp, Homo sapiens
ctcaaaaaaagggcaataaat

SEQ ID NO: 2130648 - DNA, 23 bp, Homo sapiens
ctcaaaataaggggcacctggga

SEQ ID NO: 2130649 - DNA, 23 bp, Homo sapiens
ctcaaaataccatgccatttaaa

SEQ ID NO: 2130650 - DNA, 13 bp, Homo sapiens
ctcaaactcaagg

SEQ ID NO: 2130651 - DNA, 20 bp, Homo sapiens
ctcaaactcttgacctcagg

SEQ ID NO: 2130652 - DNA, 23 bp, Homo sapiens
ctcaaagcccccacttctctcca

SEQ ID NO: 2130653 - DNA, 17 bp, Homo sapiens
ctcaaatgacccaaaga

SEQ ID NO: 2130654 - DNA, 23 bp, Homo sapiens
ctcaacaacaaaccaaaacagaa

SEQ ID NO: 2130655 - DNA, 14 bp, Homo sapiens
ctcaacaataaaga

SEQ ID NO: 2130656 - DNA, 14 bp, Homo sapiens
ctcaacagatctgt

SEQ ID NO: 2130657 - DNA, 13 bp, Homo sapiens
ctcaaccactgtg

SEQ ID NO: 2130658 - DNA, 14 bp, Homo sapiens
ctcaaccactgtgg

SEQ ID NO: 2130659 - DNA, 19 bp, Homo sapiens
ctcaacccccatttctatt

SEQ ID NO: 2130660 - DNA, 22 bp, Homo sapiens
ctcaacctaccaccccttcctg

SEQ ID NO: 2130661 - DNA, 18 bp, Homo sapiens
ctcaacgttgctccccat

SEQ ID NO: 2130662 - DNA, 14 bp, Homo sapiens
ctcaactactcagc

SEQ ID NO: 2130663 - DNA, 22 bp, Homo sapiens
ctcaactggacatcacagcaga

SEQ ID NO: 2130664 - DNA, 24 bp, Homo sapiens
ctcaactggacatcacagcagaat

SEQ ID NO: 2130665 - DNA, 22 bp, Homo sapiens
ctcaagaagacatggagactcc

SEQ ID NO: 2130666 - DNA, 23 bp, Homo sapiens
ctcagagaatttctaccatttca

SEQ ID NO: 2130667 - DNA, 22 bp, Homo sapiens
ctcagagacaggtggcctagca

SEQ ID NO: 2130668 - DNA, 17 bp, Homo sapiens
ctcagagcccctccctg

SEQ ID NO: 2130669 - DNA, 20 bp, Homo sapiens
ctcagagcccctccctgcta

SEQ ID NO: 2130670 - DNA, 10 bp, Homo sapiens
ctcagagctc

SEQ ID NO: 2130671 - DNA, 13 bp, Homo sapiens
ctcagaggcccag

SEQ ID NO: 2130672 - DNA, 18 bp, Homo sapiens
ctcagaggcccaggaatc

SEQ ID NO: 2130673 - DNA, 18 bp, Homo sapiens
ctcagatagaatgacagt

SEQ ID NO: 2130674 - DNA, 12 bp, Homo sapiens
ctcagatctgaa

SEQ ID NO: 2130675 - DNA, 13 bp, Homo sapiens
ctcagatgatctc

SEQ ID NO: 2130676 - DNA, 17 bp, Homo sapiens
ctcagatgatctctcca

SEQ ID NO: 2130677 - DNA, 20 bp, Homo sapiens
ctcagatgatctctccacgg

SEQ ID NO: 2130678 - DNA, 21 bp, Homo sapiens
ctcagatggagacattggatg

SEQ ID NO: 2130679 - DNA, 19 bp, Homo sapiens
ctcagcaatagggtgcagt

SEQ ID NO: 2130680 - DNA, 19 bp, Homo sapiens
ctcagcagcagagagccct

SEQ ID NO: 2130681 - DNA, 19 bp, Homo sapiens
ctcagcagccccctgcccg

SEQ ID NO: 2130682 - DNA, 13 bp, Homo sapiens
ctcagcagccctc

SEQ ID NO: 2130683 - DNA, 14 bp, Homo sapiens
ctcagcagccctcc

SEQ ID NO: 2130684 - DNA, 17 bp, Homo sapiens
ctcagcagccctcctca

SEQ ID NO: 2130685 - DNA, 21 bp, Homo sapiens
ctcagcagccctcctcacccc

SEQ ID NO: 2130686 - DNA, 13 bp, Homo sapiens
ctcagcaggaacc

SEQ ID NO: 2130687 - DNA, 14 bp, Homo sapiens
ctcagcaggaacct

SEQ ID NO: 2130688 - DNA, 16 bp, Homo sapiens
ctcagcaggaacctgt

SEQ ID NO: 2130689 - DNA, 13 bp, Homo sapiens
ctcagcaggccct

SEQ ID NO: 2130690 - DNA, 13 bp, Homo sapiens
ctcagcatcctgg

SEQ ID NO: 2130691 - DNA, 18 bp, Homo sapiens
ctcagcatcctggcaccc

SEQ ID NO: 2130692 - DNA, 16 bp, Homo sapiens
ctcagccaaacacaga

SEQ ID NO: 2130693 - DNA, 13 bp, Homo sapiens
ctcagccacaccc

SEQ ID NO: 2130694 - DNA, 19 bp, Homo sapiens
ctcagccataaagtgccag

SEQ ID NO: 2130695 - DNA, 20 bp, Homo sapiens
ctcagccccgggcctgcctc

SEQ ID NO: 2130696 - DNA, 16 bp, Homo sapiens
ctcagccctcagaaca

SEQ ID NO: 2130697 - DNA, 21 bp, Homo sapiens
ctcagccctccctgcccctcc

SEQ ID NO: 2130698 - DNA, 13 bp, Homo sapiens
ctcagccctgggc

SEQ ID NO: 2130699 - DNA, 18 bp, Homo sapiens
ctcagcccttgcccccat

SEQ ID NO: 2130700 - DNA, 16 bp, Homo sapiens
ctcagccgcagacaag

SEQ ID NO: 2130701 - DNA, 19 bp, Homo sapiens
ctcagccgcagacaagtaa

SEQ ID NO: 2130702 - DNA, 14 bp, Homo sapiens
ctcagcctcccaaa

SEQ ID NO: 2130703 - DNA, 16 bp, Homo sapiens
ctcagcctcccaaagt

SEQ ID NO: 2130704 - DNA, 14 bp, Homo sapiens
ctcagcctccccct

SEQ ID NO: 2130705 - DNA, 20 bp, Homo sapiens
ctcagcctccccctgctgct

SEQ ID NO: 2130706 - DNA, 22 bp, Homo sapiens
ctcagcctccccctgctgctca

SEQ ID NO: 2130707 - DNA, 13 bp, Homo sapiens
ctcagcctcccga

SEQ ID NO: 2130708 - DNA, 19 bp, Homo sapiens
ctcagcctcccgaatagct

SEQ ID NO: 2130709 - DNA, 23 bp, Homo sapiens
ctcagcctcccgaatagctggga

SEQ ID NO: 2130710 - DNA, 15 bp, Homo sapiens
ctcagcctcctaagc

SEQ ID NO: 2130711 - DNA, 20 bp, Homo sapiens
ctcagcctcctaagcagctg

SEQ ID NO: 2130712 - DNA, 16 bp, Homo sapiens
ctcagcctggtgggcc

SEQ ID NO: 2130713 - DNA, 13 bp, Homo sapiens
ctcagcctgtgct

SEQ ID NO: 2130714 - DNA, 11 bp, Homo sapiens
ctcagccttgg

SEQ ID NO: 2130715 - DNA, 14 bp, Homo sapiens
ctcagcgaatgaat

SEQ ID NO: 2130716 - DNA, 15 bp, Homo sapiens
ctcagcggggacagc

SEQ ID NO: 2130717 - DNA, 18 bp, Homo sapiens
ctcagcggggacagctcc

SEQ ID NO: 2130718 - DNA, 21 bp, Homo sapiens
ctcagcggggacagctccttc

SEQ ID NO: 2130719 - DNA, 14 bp, Homo sapiens
ctcagctcagcctc

SEQ ID NO: 2130720 - DNA, 16 bp, Homo sapiens
ctcagctcagcctccc

SEQ ID NO: 2130721 - DNA, 15 bp, Homo sapiens
ctcagctcccaaggc

SEQ ID NO: 2130722 - DNA, 16 bp, Homo sapiens
ctcagctctcctgctg

SEQ ID NO: 2130723 - DNA, 19 bp, Homo sapiens
ctcagctctcctgctgcag

SEQ ID NO: 2130724 - DNA, 17 bp, Homo sapiens
ctcagctgcacattcct

SEQ ID NO: 2130725 - DNA, 21 bp, Homo sapiens
ctcagctgcacattcctggcc

SEQ ID NO: 2130726 - DNA, 22 bp, Homo sapiens
ctcagctgcacattcctggccc

SEQ ID NO: 2130727 - DNA, 14 bp, Homo sapiens
ctcagcttcatttc

SEQ ID NO: 2130728 - DNA, 21 bp, Homo sapiens
ctcagctttttgtcttttctg

SEQ ID NO: 2130729 - DNA, 14 bp, Homo sapiens
ctcagcttttttct

SEQ ID NO: 2130730 - DNA, 22 bp, Homo sapiens
ctcaggaaatcaaatatgcaaa

SEQ ID NO: 2130731 - DNA, 14 bp, Homo sapiens
ctcaggaagaaacc

SEQ ID NO: 2130732 - DNA, 21 bp, Homo sapiens
ctcaggaagaaaccccaagca

SEQ ID NO: 2130733 - DNA, 15 bp, Homo sapiens
ctcaggacacaggcc

SEQ ID NO: 2130734 - DNA, 17 bp, Homo sapiens
ctcaggacacaggcctg

SEQ ID NO: 2130735 - DNA, 20 bp, Homo sapiens
ctcaggacacaggcctgtgt

SEQ ID NO: 2130736 - DNA, 21 bp, Homo sapiens
ctcaggacacaggcctgtgta

SEQ ID NO: 2130737 - DNA, 15 bp, Homo sapiens
ctcaggacccaggcc

SEQ ID NO: 2130738 - DNA, 19 bp, Homo sapiens
ctcaggacccaggccctcc

SEQ ID NO: 2130739 - DNA, 22 bp, Homo sapiens
ctcaggagcttgcaagaagcag

SEQ ID NO: 2130740 - DNA, 22 bp, Homo sapiens
ctcaggaggcgaataaatgttc

SEQ ID NO: 2130741 - DNA, 16 bp, Homo sapiens
ctcaggaggcgcagcc

SEQ ID NO: 2130742 - DNA, 15 bp, Homo sapiens
ctcaggatttcattg

SEQ ID NO: 2130743 - DNA, 20 bp, Homo sapiens
ctcaggatttcattgactga

SEQ ID NO: 2130744 - DNA, 21 bp, Homo sapiens
ctcaggatttcattgactgaa

SEQ ID NO: 2130745 - DNA, 21 bp, Homo sapiens
ctcaggcaagcccctcagccc

SEQ ID NO: 2130746 - DNA, 22 bp, Homo sapiens
ctcaggcaagcccctcagccct

SEQ ID NO: 2130747 - DNA, 18 bp, Homo sapiens
ctcaggcagacaagagct

SEQ ID NO: 2130748 - DNA, 21 bp, Homo sapiens
ctcaggcagacaagagctgct

SEQ ID NO: 2130749 - DNA, 21 bp, Homo sapiens
ctcaggcagaggatgttctgg

SEQ ID NO: 2130750 - DNA, 15 bp, Homo sapiens
ctcaggccaggtgca

SEQ ID NO: 2130751 - DNA, 14 bp, Homo sapiens
ctcaggccagtgcc

SEQ ID NO: 2130752 - DNA, 22 bp, Homo sapiens
ctcaggccagtgccaggacagc

SEQ ID NO: 2130753 - DNA, 21 bp, Homo sapiens
ctcaggcccccacctggctca

SEQ ID NO: 2130754 - DNA, 15 bp, Homo sapiens
ctcaggctgagccca

SEQ ID NO: 2130755 - DNA, 18 bp, Homo sapiens
ctcaggctgagcccagcc

SEQ ID NO: 2130756 - DNA, 19 bp, Homo sapiens
ctcaggctgagcccagcca

SEQ ID NO: 2130757 - DNA, 15 bp, Homo sapiens
ctcaggcttgaaatg

SEQ ID NO: 2130758 - DNA, 14 bp, Homo sapiens
ctcagggctgccac

SEQ ID NO: 2130759 - DNA, 12 bp, Homo sapiens
ctcagggctgga

SEQ ID NO: 2130760 - DNA, 15 bp, Homo sapiens
ctcagggctggagtg

SEQ ID NO: 2130761 - DNA, 22 bp, Homo sapiens
ctcaggggccagtgagggctgg

SEQ ID NO: 2130762 - DNA, 17 bp, Homo sapiens
ctcaggggcctgcccag

SEQ ID NO: 2130763 - DNA, 16 bp, Homo sapiens
ctcaggggtggagaag

SEQ ID NO: 2130764 - DNA, 16 bp, Homo sapiens
ctcaggtagtactggg

SEQ ID NO: 2130765 - DNA, 18 bp, Homo sapiens
ctcaggtagtactgggaa

SEQ ID NO: 2130766 - DNA, 15 bp, Homo sapiens
ctcaggtcactccag

SEQ ID NO: 2130767 - DNA, 17 bp, Homo sapiens
ctcaggtccctgcaggg

SEQ ID NO: 2130768 - DNA, 18 bp, Homo sapiens
ctcaggtccctgcagggc

SEQ ID NO: 2130769 - DNA, 22 bp, Homo sapiens
ctcaggtgactggagcccgagg

SEQ ID NO: 2130770 - DNA, 20 bp, Homo sapiens
ctcaggtgatccacccacct

SEQ ID NO: 2130771 - DNA, 18 bp, Homo sapiens
ctcaggtgccactccctg

SEQ ID NO: 2130772 - DNA, 17 bp, Homo sapiens
ctcaggtgtccctgcac

SEQ ID NO: 2130773 - DNA, 17 bp, Homo sapiens
ctcaggttcctaagact

SEQ ID NO: 2130774 - DNA, 13 bp, Homo sapiens
ctcagtaatttag

SEQ ID NO: 2130775 - DNA, 14 bp, Homo sapiens
ctcagtatagcatt

SEQ ID NO: 2130776 - DNA, 22 bp, Homo sapiens
ctcagtcagttcccggagcaca

SEQ ID NO: 2130777 - DNA, 20 bp, Homo sapiens
ctccactgctctcagcctcc

SEQ ID NO: 2130778 - DNA, 12 bp, Homo sapiens
ctccactgtcac

SEQ ID NO: 2130779 - DNA, 16 bp, Homo sapiens
ctccactgtcacattg

SEQ ID NO: 2130780 - DNA, 22 bp, Homo sapiens
ctccagaacaaacctctatatg

SEQ ID NO: 2130781 - DNA, 16 bp, Homo sapiens
ctccagaagtggggct

SEQ ID NO: 2130782 - DNA, 22 bp, Homo sapiens
ctccagaagtggggctctggga

SEQ ID NO: 2130783 - DNA, 21 bp, Homo sapiens
ctccagaataccttcttcgct

SEQ ID NO: 2130784 - DNA, 17 bp, Homo sapiens
ctccagaatctgctgtt

SEQ ID NO: 2130785 - DNA, 21 bp, Homo sapiens
ctccagaatctgctgttgcca

SEQ ID NO: 2130786 - DNA, 15 bp, Homo sapiens
ctccagacagataca

SEQ ID NO: 2130787 - DNA, 22 bp, Homo sapiens
ctccagacagatacagccccaa

SEQ ID NO: 2130788 - DNA, 15 bp, Homo sapiens
ctccagacccctggc

SEQ ID NO: 2130789 - DNA, 17 bp, Homo sapiens
ctccagacccctgtggc

SEQ ID NO: 2130790 - DNA, 17 bp, Homo sapiens
ctccagaccctgcctga

SEQ ID NO: 2130791 - DNA, 18 bp, Homo sapiens
ctccagaccctgcctgag

SEQ ID NO: 2130792 - DNA, 19 bp, Homo sapiens
ctccagaccctgcctgagc

SEQ ID NO: 2130793 - DNA, 19 bp, Homo sapiens
ctccagagacaggaaagaa

SEQ ID NO: 2130794 - DNA, 11 bp, Homo sapiens
ctccagagcca

SEQ ID NO: 2130795 - DNA, 14 bp, Homo sapiens
ctccagagccagcc

SEQ ID NO: 2130796 - DNA, 18 bp, Homo sapiens
ctccagagtctgagcccc

SEQ ID NO: 2130797 - DNA, 19 bp, Homo sapiens
ctccagagtctgagccccc

SEQ ID NO: 2130798 - DNA, 13 bp, Homo sapiens
ctccagatctgca

SEQ ID NO: 2130799 - DNA, 18 bp, Homo sapiens
ctccagatctgcactggg

SEQ ID NO: 2130800 - DNA, 16 bp, Homo sapiens
ctccagcatccagcct

SEQ ID NO: 2130801 - DNA, 18 bp, Homo sapiens
ctccagcatccagcctgt

SEQ ID NO: 2130802 - DNA, 19 bp, Homo sapiens
ctccagcatccagcctgtg

SEQ ID NO: 2130803 - DNA, 21 bp, Homo sapiens
ctccagcatccagcctgtgtg

SEQ ID NO: 2130804 - DNA, 13 bp, Homo sapiens
ctccagcatcctg

SEQ ID NO: 2130805 - DNA, 13 bp, Homo sapiens
ctccagccagcgc

SEQ ID NO: 2130806 - DNA, 23 bp, Homo sapiens
ctccagccatcaagagactgagt

SEQ ID NO: 2130807 - DNA, 16 bp, Homo sapiens
ctccagcccacacccc

SEQ ID NO: 2130808 - DNA, 17 bp, Homo sapiens
ctccagcccacacccct

SEQ ID NO: 2130809 - DNA, 14 bp, Homo sapiens
ctccagccctgtcc

SEQ ID NO: 2130810 - DNA, 21 bp, Homo sapiens
ctccagcctctcccggctgcc

SEQ ID NO: 2130811 - DNA, 12 bp, Homo sapiens
ctccagcctggg

SEQ ID NO: 2130812 - DNA, 14 bp, Homo sapiens
ctccagcctgggca

SEQ ID NO: 2130813 - DNA, 15 bp, Homo sapiens
ctccagctcaccagc

SEQ ID NO: 2130814 - DNA, 19 bp, Homo sapiens
ctccagctccagtttccaa

SEQ ID NO: 2130815 - DNA, 21 bp, Homo sapiens
ctccagctggaattgctgctc

SEQ ID NO: 2130816 - DNA, 14 bp, Homo sapiens
ctccagcttcccct

SEQ ID NO: 2130817 - DNA, 15 bp, Homo sapiens
ctccagctttcctgt

SEQ ID NO: 2130818 - DNA, 16 bp, Homo sapiens
ctccaggaaaactgtt

SEQ ID NO: 2130819 - DNA, 19 bp, Homo sapiens
ctccaggaaggtagcccag

SEQ ID NO: 2130820 - DNA, 18 bp, Homo sapiens
ctccagggccacgtgcca

SEQ ID NO: 2130821 - DNA, 14 bp, Homo sapiens
ctccagggctgccc

SEQ ID NO: 2130822 - DNA, 16 bp, Homo sapiens
ctccagggtcttgggc

SEQ ID NO: 2130823 - DNA, 16 bp, Homo sapiens
ctccagtagtggacaa

SEQ ID NO: 2130824 - DNA, 16 bp, Homo sapiens
ctccagtatggaagaa

SEQ ID NO: 2130825 - DNA, 16 bp, Homo sapiens
ctccagtctcctgaca

SEQ ID NO: 2130826 - DNA, 23 bp, Homo sapiens
ctccagtgtgaatatatggtctg

SEQ ID NO: 2130827 - DNA, 17 bp, Homo sapiens
ctccataatgccactgg

SEQ ID NO: 2130828 - DNA, 14 bp, Homo sapiens
ctccatatctcctt

SEQ ID NO: 2130829 - DNA, 15 bp, Homo sapiens
ctccatccggctcct

SEQ ID NO: 2130830 - DNA, 17 bp, Homo sapiens
ctccatccggctcctgt

SEQ ID NO: 2130831 - DNA, 14 bp, Homo sapiens
ctccatgcccaacc

SEQ ID NO: 2130832 - DNA, 14 bp, Homo sapiens
ctccatgctgcctc

SEQ ID NO: 2130833 - DNA, 12 bp, Homo sapiens
ctccatggccac

SEQ ID NO: 2130834 - DNA, 22 bp, Homo sapiens
ctccatgtggccccaggtgcca

SEQ ID NO: 2130835 - DNA, 14 bp, Homo sapiens
ctccatgtgggcta

SEQ ID NO: 2130836 - DNA, 13 bp, Homo sapiens
ctccatgtgtgct

SEQ ID NO: 2130837 - DNA, 14 bp, Homo sapiens
ctccattctgacca

SEQ ID NO: 2130838 - DNA, 16 bp, Homo sapiens
ctccattgctgttgtt

SEQ ID NO: 2130839 - DNA, 17 bp, Homo sapiens
ctccatttctctccagg

SEQ ID NO: 2130840 - DNA, 14 bp, Homo sapiens
ctccatttctggct

SEQ ID NO: 2130841 - DNA, 17 bp, Homo sapiens
ctcccaaagtgctggga

SEQ ID NO: 2130842 - DNA, 23 bp, Homo sapiens
ctcccaaagtgctgggattacag

SEQ ID NO: 2130843 - DNA, 16 bp, Homo sapiens
ctcccaacctcaatgc

SEQ ID NO: 2130844 - DNA, 21 bp, Homo sapiens
ctcccaaggactttccagtga

SEQ ID NO: 2130845 - DNA, 18 bp, Homo sapiens
ctcccaataaagctggac

SEQ ID NO: 2130846 - DNA, 15 bp, Homo sapiens
ctcccacaggccctt

SEQ ID NO: 2130847 - DNA, 16 bp, Homo sapiens
ctcccacaggcccttc

SEQ ID NO: 2130848 - DNA, 14 bp, Homo sapiens
ctcccaccaccctc

SEQ ID NO: 2130849 - DNA, 20 bp, Homo sapiens
ctcccaccaccctcccacca

SEQ ID NO: 2130850 - DNA, 19 bp, Homo sapiens
ctcccaccccacccccttc

SEQ ID NO: 2130851 - DNA, 21 bp, Homo sapiens
ctcccaccccactccagccct

SEQ ID NO: 2130852 - DNA, 23 bp, Homo sapiens
ctcccaccccactccagccctgt

SEQ ID NO: 2130853 - DNA, 13 bp, Homo sapiens
ctcccacctcagc

SEQ ID NO: 2130854 - DNA, 14 bp, Homo sapiens
ctcccacctcagcc

SEQ ID NO: 2130855 - DNA, 15 bp, Homo sapiens
ctcccacctccgctg

SEQ ID NO: 2130856 - DNA, 19 bp, Homo sapiens
ctcccacgatgtcaaggac

SEQ ID NO: 2130857 - DNA, 23 bp, Homo sapiens
ctcccacgatgtcaaggactcct

SEQ ID NO: 2130858 - DNA, 14 bp, Homo sapiens
ctgagactgcggga

SEQ ID NO: 2130859 - DNA, 15 bp, Homo sapiens
ctgagagacccaagg

SEQ ID NO: 2130860 - DNA, 19 bp, Homo sapiens
ctgagagacccaaggagga

SEQ ID NO: 2130861 - DNA, 13 bp, Homo sapiens
ctgagagactttt

SEQ ID NO: 2130862 - DNA, 16 bp, Homo sapiens
ctgagagacttttaat

SEQ ID NO: 2130863 - DNA, 21 bp, Homo sapiens
ctgagaggacttttctttgtg

SEQ ID NO: 2130864 - DNA, 17 bp, Homo sapiens
ctgagaggtgctgcagg

SEQ ID NO: 2130865 - DNA, 22 bp, Homo sapiens
ctgagagtctgaaagacagaat

SEQ ID NO: 2130866 - DNA, 19 bp, Homo sapiens
ctgagagttggctcaggca

SEQ ID NO: 2130867 - DNA, 20 bp, Homo sapiens
ctgagagttggctcaggcag

SEQ ID NO: 2130868 - DNA, 21 bp, Homo sapiens
ctgagatgtgaacacatcagc

SEQ ID NO: 2130869 - DNA, 15 bp, Homo sapiens
ctgagcaaatgtggc

SEQ ID NO: 2130870 - DNA, 20 bp, Homo sapiens
ctgagcaaatgtggctcctg

SEQ ID NO: 2130871 - DNA, 24 bp, Homo sapiens
ctgagcaacagagtgagaccctgt

SEQ ID NO: 2130872 - DNA, 21 bp, Homo sapiens
ctgagcaccccctcattcccc

SEQ ID NO: 2130873 - DNA, 16 bp, Homo sapiens
ctgagcaccctctccg

SEQ ID NO: 2130874 - DNA, 23 bp, Homo sapiens
ctgagcaggcccgacagagagat

SEQ ID NO: 2130875 - DNA, 21 bp, Homo sapiens
ctgagcagggccggggaactg

SEQ ID NO: 2130876 - DNA, 18 bp, Homo sapiens
ctgagccacagccgtgct

SEQ ID NO: 2130877 - DNA, 15 bp, Homo sapiens
ctgagccactcgcag

SEQ ID NO: 2130878 - DNA, 14 bp, Homo sapiens
ctgagcccagccac

SEQ ID NO: 2130879 - DNA, 17 bp, Homo sapiens
ctgagcccagccacctc

SEQ ID NO: 2130880 - DNA, 18 bp, Homo sapiens
ctgagcccagccacctcc

SEQ ID NO: 2130881 - DNA, 21 bp, Homo sapiens
ctgagcccagccacctcccaa

SEQ ID NO: 2130882 - DNA, 14 bp, Homo sapiens
ctgagcccaggccg

SEQ ID NO: 2130883 - DNA, 19 bp, Homo sapiens
ctgagcccagggaggccga

SEQ ID NO: 2130884 - DNA, 22 bp, Homo sapiens
ctgagcccagggaggccgaagc

SEQ ID NO: 2130885 - DNA, 16 bp, Homo sapiens
ctgagcccccggctag

SEQ ID NO: 2130886 - DNA, 12 bp, Homo sapiens
ctgagccctggc

SEQ ID NO: 2130887 - DNA, 13 bp, Homo sapiens
ctgagccctggca

SEQ ID NO: 2130888 - DNA, 13 bp, Homo sapiens
ctgagccctggtg

SEQ ID NO: 2130889 - DNA, 18 bp, Homo sapiens
ctgagccctggtgtgttt

SEQ ID NO: 2130890 - DNA, 19 bp, Homo sapiens
ctgagcctaaatctaatca

SEQ ID NO: 2130891 - DNA, 13 bp, Homo sapiens
ctgagcctctttt

SEQ ID NO: 2130892 - DNA, 16 bp, Homo sapiens
ctgagcctgccgagca

SEQ ID NO: 2130893 - DNA, 19 bp, Homo sapiens
ctgagctcacaaggcagca

SEQ ID NO: 2130894 - DNA, 15 bp, Homo sapiens
ctgagctcaggctga

SEQ ID NO: 2130895 - DNA, 19 bp, Homo sapiens
ctgagctcaggctgagccc

SEQ ID NO: 2130896 - DNA, 23 bp, Homo sapiens
ctgagctcaggctgagcccagcc

SEQ ID NO: 2130897 - DNA, 22 bp, Homo sapiens
ctgagctcggtggacccaggga

SEQ ID NO: 2130898 - DNA, 19 bp, Homo sapiens
ctgagctggggcctggaga

SEQ ID NO: 2130899 - DNA, 21 bp, Homo sapiens
ctgagctggggcctggagagg

SEQ ID NO: 2130900 - DNA, 22 bp, Homo sapiens
ctgagctggggcctggagaggg

SEQ ID NO: 2130901 - DNA, 23 bp, Homo sapiens
ctgagctggggcctggagagggg

SEQ ID NO: 2130902 - DNA, 19 bp, Homo sapiens
ctgagcttagccttgtgcc

SEQ ID NO: 2130903 - DNA, 24 bp, Homo sapiens
ctgagcttagccttgtgccctgcc

SEQ ID NO: 2130904 - DNA, 15 bp, Homo sapiens
ctgagcttctctgtg

SEQ ID NO: 2130905 - DNA, 21 bp, Homo sapiens
ctgagctttggggacagttgg

SEQ ID NO: 2130906 - DNA, 21 bp, Homo sapiens
ctgaggaatccagacccggct

SEQ ID NO: 2130907 - DNA, 16 bp, Homo sapiens
ctgaggaattttcttt

SEQ ID NO: 2130908 - DNA, 23 bp, Homo sapiens
ctgaggacactaaccacgctgga

SEQ ID NO: 2130909 - DNA, 15 bp, Homo sapiens
ctgaggactccctcc

SEQ ID NO: 2130910 - DNA, 22 bp, Homo sapiens
ctgaggacttaaaatattcctg

SEQ ID NO: 2130911 - DNA, 18 bp, Homo sapiens
ctgaggagtagctgagag

SEQ ID NO: 2130912 - DNA, 16 bp, Homo sapiens
ctgaggatctagcttc

SEQ ID NO: 2130913 - DNA, 17 bp, Homo sapiens
ctgaggatttcaagcct

SEQ ID NO: 2130914 - DNA, 12 bp, Homo sapiens
ctgaggcaagag

SEQ ID NO: 2130915 - DNA, 22 bp, Homo sapiens
ctgaggcagacagcagctcagg

SEQ ID NO: 2130916 - DNA, 12 bp, Homo sapiens
ctgaggccagcc

SEQ ID NO: 2130917 - DNA, 13 bp, Homo sapiens
ctgaggccagcct

SEQ ID NO: 2130918 - DNA, 15 bp, Homo sapiens
ctgaggccagcctgg

SEQ ID NO: 2130919 - DNA, 16 bp, Homo sapiens
ctgaggccagcctggc

SEQ ID NO: 2130920 - DNA, 20 bp, Homo sapiens
ctgaggccagcctggcctcc

SEQ ID NO: 2130921 - DNA, 22 bp, Homo sapiens
ctgaggccagcctggcctcctg

SEQ ID NO: 2130922 - DNA, 23 bp, Homo sapiens
ctgaggccccttaactcatctgt

SEQ ID NO: 2130923 - DNA, 21 bp, Homo sapiens
ctgaggcctaaaagtaaacat

SEQ ID NO: 2130924 - DNA, 14 bp, Homo sapiens
ctgaggcctcatcc

SEQ ID NO: 2130925 - DNA, 17 bp, Homo sapiens
ctgaggctcctgtgcta

SEQ ID NO: 2130926 - DNA, 18 bp, Homo sapiens
ctgaggctctttctgggc

SEQ ID NO: 2130927 - DNA, 15 bp, Homo sapiens
ctgaggctgagactg

SEQ ID NO: 2130928 - DNA, 18 bp, Homo sapiens
ctgaggcttccagagagt

SEQ ID NO: 2130929 - DNA, 21 bp, Homo sapiens
ctgagggcagttcgcagccac

SEQ ID NO: 2130930 - DNA, 13 bp, Homo sapiens
ctgagggccacac

SEQ ID NO: 2130931 - DNA, 21 bp, Homo sapiens
ctgaggggaggatcactggag

SEQ ID NO: 2130932 - DNA, 22 bp, Homo sapiens
ctgaggggaggatcactggagc

SEQ ID NO: 2130933 - DNA, 20 bp, Homo sapiens
ctgaggggggccgtgcccag

SEQ ID NO: 2130934 - DNA, 22 bp, Homo sapiens
ctgaggggggccgtgcccaggg

SEQ ID NO: 2130935 - DNA, 21 bp, Homo sapiens
ctgagggtccccacctgggac

SEQ ID NO: 2130936 - DNA, 14 bp, Homo sapiens
ctgaggtcactggg

SEQ ID NO: 2130937 - DNA, 13 bp, Homo sapiens
ctgaggtcctgag

SEQ ID NO: 2130938 - DNA, 21 bp, Homo sapiens
ctgaggtcctgagcactgcca

SEQ ID NO: 2130939 - DNA, 13 bp, Homo sapiens
ctgaggtgcccag

SEQ ID NO: 2130940 - DNA, 14 bp, Homo sapiens
ctgaggtgcccagg

SEQ ID NO: 2130941 - DNA, 16 bp, Homo sapiens
ctgaggtgcccaggag

SEQ ID NO: 2130942 - DNA, 19 bp, Homo sapiens
ctgaggtgcccaggagaag

SEQ ID NO: 2130943 - DNA, 20 bp, Homo sapiens
ctgaggtgcccaggagaaga

SEQ ID NO: 2130944 - DNA, 15 bp, Homo sapiens
ctgagtaccttctac

SEQ ID NO: 2130945 - DNA, 21 bp, Homo sapiens
ctgagtaccttctacaggccc

SEQ ID NO: 2130946 - DNA, 19 bp, Homo sapiens
ctgagtacttgatttcagg

SEQ ID NO: 2130947 - DNA, 20 bp, Homo sapiens
ctgagtatgttaagctcttt

SEQ ID NO: 2130948 - DNA, 16 bp, Homo sapiens
ctgagtcaactggagc

SEQ ID NO: 2130949 - DNA, 23 bp, Homo sapiens
ctgagtcaccctacctgtgcctg

SEQ ID NO: 2130950 - DNA, 15 bp, Homo sapiens
ctgagtcacctcctc

SEQ ID NO: 2130951 - DNA, 18 bp, Homo sapiens
ctgagtcacctcctccac

SEQ ID NO: 2130952 - DNA, 18 bp, Homo sapiens
ctgagtcatgatctccct

SEQ ID NO: 2130953 - DNA, 13 bp, Homo sapiens
ctgagtcctgtct

SEQ ID NO: 2130954 - DNA, 19 bp, Homo sapiens
ctgagtcctgtctctgcct

SEQ ID NO: 2130955 - DNA, 20 bp, Homo sapiens
ctgagtcctgtctctgcctg

SEQ ID NO: 2130956 - DNA, 20 bp, Homo sapiens
ctgagtcggccccacatggg

SEQ ID NO: 2130957 - DNA, 21 bp, Homo sapiens
ctgagtcggccccacatggga

SEQ ID NO: 2130958 - DNA, 13 bp, Homo sapiens
ctgagtctcctgt

SEQ ID NO: 2130959 - DNA, 14 bp, Homo sapiens
ctgagtctcctgtg

SEQ ID NO: 2130960 - DNA, 16 bp, Homo sapiens
ctgagtctcctgtgcc

SEQ ID NO: 2130961 - DNA, 16 bp, Homo sapiens
ctgagtctgagtcctg

SEQ ID NO: 2130962 - DNA, 14 bp, Homo sapiens
ctgagtcttggcct

SEQ ID NO: 2130963 - DNA, 18 bp, Homo sapiens
ctgagtcttggcctgcct

SEQ ID NO: 2130964 - DNA, 22 bp, Homo sapiens
ctgagtgactgtaggcagggaa

SEQ ID NO: 2130965 - DNA, 23 bp, Homo sapiens
ctgagtgagccacagaccacctg

SEQ ID NO: 2130966 - DNA, 23 bp, Homo sapiens
ctgcagaggacagagctggctgt

SEQ ID NO: 2130967 - DNA, 12 bp, Homo sapiens
ctgcagaggacg

SEQ ID NO: 2130968 - DNA, 19 bp, Homo sapiens
ctgcagatagccagacaca

SEQ ID NO: 2130969 - DNA, 13 bp, Homo sapiens
ctgcagcaactcc

SEQ ID NO: 2130970 - DNA, 16 bp, Homo sapiens
ctgcagcaactcccac

SEQ ID NO: 2130971 - DNA, 18 bp, Homo sapiens
ctgcagcaactcccacga

SEQ ID NO: 2130972 - DNA, 17 bp, Homo sapiens
ctgcagccagcccagcc

SEQ ID NO: 2130973 - DNA, 18 bp, Homo sapiens
ctgcagccagcccagccc

SEQ ID NO: 2130974 - DNA, 23 bp, Homo sapiens
ctgcagcctcaacctcctgggct

SEQ ID NO: 2130975 - DNA, 20 bp, Homo sapiens
ctgcagcctggtagaattgg

SEQ ID NO: 2130976 - DNA, 15 bp, Homo sapiens
ctgcagctgctgaag

SEQ ID NO: 2130977 - DNA, 14 bp, Homo sapiens
ctgcagctgggccc

SEQ ID NO: 2130978 - DNA, 16 bp, Homo sapiens
ctgcagcttgtagcca

SEQ ID NO: 2130979 - DNA, 22 bp, Homo sapiens
ctggaaataaacctggagatga

SEQ ID NO: 2130980 - DNA, 23 bp, Homo sapiens
ctggaaataaacctggagatgat

SEQ ID NO: 2130981 - DNA, 12 bp, Homo sapiens
ctggaaatgtct

SEQ ID NO: 2130982 - DNA, 14 bp, Homo sapiens
ctggaaatgtcttt

SEQ ID NO: 2130983 - DNA, 20 bp, Homo sapiens
ctggaacagcccattttatc

SEQ ID NO: 2130984 - DNA, 19 bp, Homo sapiens
ctggaactgtctctcatga

SEQ ID NO: 2130985 - DNA, 15 bp, Homo sapiens
ctggaagcacatgtt

SEQ ID NO: 2130986 - DNA, 15 bp, Homo sapiens
ctggaagcactgctg

SEQ ID NO: 2130987 - DNA, 22 bp, Homo sapiens
ctggaagcatttgtttctactt

SEQ ID NO: 2130988 - DNA, 17 bp, Homo sapiens
ctggaagccccccacct

SEQ ID NO: 2130989 - DNA, 21 bp, Homo sapiens
ctggaagccggccggctggga

SEQ ID NO: 2130990 - DNA, 12 bp, Homo sapiens
ctggaagctgag

SEQ ID NO: 2130991 - DNA, 21 bp, Homo sapiens
ctggaaggcagggcagaggga

SEQ ID NO: 2130992 - DNA, 14 bp, Homo sapiens
ctggaaggctggct

SEQ ID NO: 2130993 - DNA, 22 bp, Homo sapiens
ctggaagggaagtgagaaacca

SEQ ID NO: 2130994 - DNA, 20 bp, Homo sapiens
ctggaagttttgcatttatg

SEQ ID NO: 2130995 - DNA, 23 bp, Homo sapiens
ctggaatcaagatgtcagactgg

SEQ ID NO: 2130996 - DNA, 20 bp, Homo sapiens
ctggaatcaatttcccagaa

SEQ ID NO: 2130997 - DNA, 22 bp, Homo sapiens
ctggaatcaatttcccagaagg

SEQ ID NO: 2130998 - DNA, 19 bp, Homo sapiens
ctggaatctggagagctag

SEQ ID NO: 2130999 - DNA, 14 bp, Homo sapiens
ctggaatgaagcat

SEQ ID NO: 2131000 - DNA, 17 bp, Homo sapiens
ctggaatgaagcatgta

SEQ ID NO: 2131001 - DNA, 20 bp, Homo sapiens
ctggaatgaagcatgtagct

SEQ ID NO: 2131002 - DNA, 14 bp, Homo sapiens
ctggaatgcagtgg

SEQ ID NO: 2131003 - DNA, 14 bp, Homo sapiens
ctggaatgtaatca

SEQ ID NO: 2131004 - DNA, 18 bp, Homo sapiens
ctggaattcagcaccctg

SEQ ID NO: 2131005 - DNA, 15 bp, Homo sapiens
ctggaattgctgctc

SEQ ID NO: 2131006 - DNA, 15 bp, Homo sapiens
ctggacaacccagaa

SEQ ID NO: 2131007 - DNA, 17 bp, Homo sapiens
ctggacaagaagctgct

SEQ ID NO: 2131008 - DNA, 15 bp, Homo sapiens
ctggacagctgtgcc

SEQ ID NO: 2131009 - DNA, 18 bp, Homo sapiens
ctggacagctgtgcctcg

SEQ ID NO: 2131010 - DNA, 14 bp, Homo sapiens
ctggacagcttgtg

SEQ ID NO: 2131011 - DNA, 14 bp, Homo sapiens
ctggacaggcatgt

SEQ ID NO: 2131012 - DNA, 23 bp, Homo sapiens
ctggacaggcatgttctctgagg

SEQ ID NO: 2131013 - DNA, 17 bp, Homo sapiens
ctggaccaccagcccca

SEQ ID NO: 2131014 - DNA, 18 bp, Homo sapiens
ctggaccaccagccccag

SEQ ID NO: 2131015 - DNA, 14 bp, Homo sapiens
ctggaccccgcctc

SEQ ID NO: 2131016 - DNA, 18 bp, Homo sapiens
ctggaccccgcctcccag

SEQ ID NO: 2131017 - DNA, 17 bp, Homo sapiens
ctggaccgcttcccaga

SEQ ID NO: 2131018 - DNA, 20 bp, Homo sapiens
ctggaccgcttcccagaggc

SEQ ID NO: 2131019 - DNA, 20 bp, Homo sapiens
ctggacctatgtcctaagga

SEQ ID NO: 2131020 - DNA, 16 bp, Homo sapiens
ctggaccttgaactgg

SEQ ID NO: 2131021 - DNA, 17 bp, Homo sapiens
ctggaccttgaactggg

SEQ ID NO: 2131022 - DNA, 19 bp, Homo sapiens
ctggacgatagcttggagg

SEQ ID NO: 2131023 - DNA, 19 bp, Homo sapiens
ctggacgcccagctgaggc

SEQ ID NO: 2131024 - DNA, 22 bp, Homo sapiens
ctggacgcccagctgaggctgg

SEQ ID NO: 2131025 - DNA, 15 bp, Homo sapiens
ctggacggcattcct

SEQ ID NO: 2131026 - DNA, 16 bp, Homo sapiens
ctggccccatgtctct

SEQ ID NO: 2131027 - DNA, 16 bp, Homo sapiens
ctggcccccctccagg

SEQ ID NO: 2131028 - DNA, 18 bp, Homo sapiens
ctggcccccctccaggca

SEQ ID NO: 2131029 - DNA, 22 bp, Homo sapiens
ctggccccgggctctggccacc

SEQ ID NO: 2131030 - DNA, 20 bp, Homo sapiens
ctggcccctccagaccctgc

SEQ ID NO: 2131031 - DNA, 11 bp, Homo sapiens
ctggccctgcc

SEQ ID NO: 2131032 - DNA, 12 bp, Homo sapiens
ctggccctggct

SEQ ID NO: 2131033 - DNA, 18 bp, Homo sapiens
ctggccctttctggacca

SEQ ID NO: 2131034 - DNA, 18 bp, Homo sapiens
ctggccgcctccaggagc

SEQ ID NO: 2131035 - DNA, 18 bp, Homo sapiens
ctggccggcaaccccagt

SEQ ID NO: 2131036 - DNA, 19 bp, Homo sapiens
ctggccggcccaggcctcc

SEQ ID NO: 2131037 - DNA, 15 bp, Homo sapiens
ctggccggctccagt

SEQ ID NO: 2131038 - DNA, 16 bp, Homo sapiens
ctggcctcaaagcaag

SEQ ID NO: 2131039 - DNA, 23 bp, Homo sapiens
ctggcctcacgcccagcctcctc

SEQ ID NO: 2131040 - DNA, 14 bp, Homo sapiens
ctggcctcactggc

SEQ ID NO: 2131041 - DNA, 21 bp, Homo sapiens
ctggcctcactggctggggca

SEQ ID NO: 2131042 - DNA, 13 bp, Homo sapiens
ctggcctcagcag

SEQ ID NO: 2131043 - DNA, 19 bp, Homo sapiens
ctggcctcccaataaagct

SEQ ID NO: 2131044 - DNA, 13 bp, Homo sapiens
ctggcctcctgcc

SEQ ID NO: 2131045 - DNA, 17 bp, Homo sapiens
ctggcctccttttgctg

SEQ ID NO: 2131046 - DNA, 23 bp, Homo sapiens
ctggcctctagaacacccactgg

SEQ ID NO: 2131047 - DNA, 15 bp, Homo sapiens
ctggcctgagctggg

SEQ ID NO: 2131048 - DNA, 19 bp, Homo sapiens
ctggcctgagctggggcca

SEQ ID NO: 2131049 - DNA, 15 bp, Homo sapiens
ctggcctgatcttgg

SEQ ID NO: 2131050 - DNA, 12 bp, Homo sapiens
ctggcctggatc

SEQ ID NO: 2131051 - DNA, 15 bp, Homo sapiens
ctggcctggatctcc

SEQ ID NO: 2131052 - DNA, 22 bp, Homo sapiens
ctggcctggatctccccactct

SEQ ID NO: 2131053 - DNA, 13 bp, Homo sapiens
ctggcctggcaca

SEQ ID NO: 2131054 - DNA, 16 bp, Homo sapiens
ctggcctggcacacat

SEQ ID NO: 2131055 - DNA, 16 bp, Homo sapiens
ctggcctggctctcct

SEQ ID NO: 2131056 - DNA, 17 bp, Homo sapiens
ctggcctggctctcctg

SEQ ID NO: 2131057 - DNA, 16 bp, Homo sapiens
ctggcctgtggcaggc

SEQ ID NO: 2131058 - DNA, 19 bp, Homo sapiens
ctggccttgtcaggaccca

SEQ ID NO: 2131059 - DNA, 13 bp, Homo sapiens
ctggccttttcct

SEQ ID NO: 2131060 - DNA, 18 bp, Homo sapiens
ctggcgactgcagctgca

SEQ ID NO: 2131061 - DNA, 18 bp, Homo sapiens
ctggcggctactcagcag

SEQ ID NO: 2131062 - DNA, 17 bp, Homo sapiens
ctggcggggcaggaggc

SEQ ID NO: 2131063 - DNA, 16 bp, Homo sapiens
ctggctcacccctctc

SEQ ID NO: 2131064 - DNA, 23 bp, Homo sapiens
ctggctcacccctctcccccgcc

SEQ ID NO: 2131065 - DNA, 12 bp, Homo sapiens
ctggctccagaa

SEQ ID NO: 2131066 - DNA, 23 bp, Homo sapiens
ctggctccccacgagtcacctgc

SEQ ID NO: 2131067 - DNA, 15 bp, Homo sapiens
ctggctcctccttcc

SEQ ID NO: 2131068 - DNA, 20 bp, Homo sapiens
ctggctcctccttcccctgt

SEQ ID NO: 2131069 - DNA, 24 bp, Homo sapiens
ctggctctgcaatgggcactggga

SEQ ID NO: 2131070 - DNA, 13 bp, Homo sapiens
ctggctcttctct

SEQ ID NO: 2131071 - DNA, 12 bp, Homo sapiens
ctgggggcctgg

SEQ ID NO: 2131072 - DNA, 17 bp, Homo sapiens
ctgggggcctggctggc

SEQ ID NO: 2131073 - DNA, 14 bp, Homo sapiens
ctgggggtggcagg

SEQ ID NO: 2131074 - DNA, 16 bp, Homo sapiens
ctgggggtggcaggca

SEQ ID NO: 2131075 - DNA, 19 bp, Homo sapiens
ctgggggtgggggcgggtg

SEQ ID NO: 2131076 - DNA, 16 bp, Homo sapiens
ctggggtacaggtttg

SEQ ID NO: 2131077 - DNA, 13 bp, Homo sapiens
ctggggtgcgaga

SEQ ID NO: 2131078 - DNA, 13 bp, Homo sapiens
ctggggttcagcc

SEQ ID NO: 2131079 - DNA, 22 bp, Homo sapiens
ctggggttcagcccctcctctg

SEQ ID NO: 2131080 - DNA, 14 bp, Homo sapiens
ctgggtacttgtgg

SEQ ID NO: 2131081 - DNA, 21 bp, Homo sapiens
ctgggtacttgtggacacagc

SEQ ID NO: 2131082 - DNA, 23 bp, Homo sapiens
ctgggtacttgtggacacagctc

SEQ ID NO: 2131083 - DNA, 14 bp, Homo sapiens
ctgggtccctcgga

SEQ ID NO: 2131084 - DNA, 18 bp, Homo sapiens
ctgggtcctgttccctac

SEQ ID NO: 2131085 - DNA, 16 bp, Homo sapiens
ctgggtctcactcctg

SEQ ID NO: 2131086 - DNA, 23 bp, Homo sapiens
ctgggtgacagagcaagactctg

SEQ ID NO: 2131087 - DNA, 20 bp, Homo sapiens
ctgggtgagaatcctgcctc

SEQ ID NO: 2131088 - DNA, 19 bp, Homo sapiens
ctgggtgccattcccagcg

SEQ ID NO: 2131089 - DNA, 13 bp, Homo sapiens
ctgggtggcctcg

SEQ ID NO: 2131090 - DNA, 19 bp, Homo sapiens
ctgggtggcctcgggacac

SEQ ID NO: 2131091 - DNA, 15 bp, Homo sapiens
ctgggtggctactct

SEQ ID NO: 2131092 - DNA, 14 bp, Homo sapiens
ctgggtggctcctg

SEQ ID NO: 2131093 - DNA, 16 bp, Homo sapiens
ctgggtggctcctgcc

SEQ ID NO: 2131094 - DNA, 21 bp, Homo sapiens
ctgggtggctcctgccactga

SEQ ID NO: 2131095 - DNA, 22 bp, Homo sapiens
ctgggtggggctgctcctccag

SEQ ID NO: 2131096 - DNA, 15 bp, Homo sapiens
ctgggtgttgaccac

SEQ ID NO: 2131097 - DNA, 13 bp, Homo sapiens
ctgggttggaggg

SEQ ID NO: 2131098 - DNA, 18 bp, Homo sapiens
ctgggttttctaactgta

SEQ ID NO: 2131099 - DNA, 23 bp, Homo sapiens
ctgggttttgtctctgcatctca

SEQ ID NO: 2131100 - DNA, 14 bp, Homo sapiens
ctggtaagcagagg

SEQ ID NO: 2131101 - DNA, 18 bp, Homo sapiens
ctgtcctactctgtgtca

SEQ ID NO: 2131102 - DNA, 21 bp, Homo sapiens
ctgtcctactctgtgtcaggt

SEQ ID NO: 2131103 - DNA, 15 bp, Homo sapiens
ctgtcctaggccaca

SEQ ID NO: 2131104 - DNA, 21 bp, Homo sapiens
ctgtcctcaaaataaggggca

SEQ ID NO: 2131105 - DNA, 19 bp, Homo sapiens
ctgtcctcccatcccctgg

SEQ ID NO: 2131106 - DNA, 12 bp, Homo sapiens
ctgtcctcctcg

SEQ ID NO: 2131107 - DNA, 22 bp, Homo sapiens
ctgtcctgcctctctgctccag

SEQ ID NO: 2131108 - DNA, 13 bp, Homo sapiens
ctgtcctgctgtg

SEQ ID NO: 2131109 - DNA, 19 bp, Homo sapiens
ctgtcctggtacagcaggg

SEQ ID NO: 2131110 - DNA, 20 bp, Homo sapiens
ctgtcctgttttactggacc

SEQ ID NO: 2131111 - DNA, 19 bp, Homo sapiens
ctgtccttttaggaatatg

SEQ ID NO: 2131112 - DNA, 13 bp, Homo sapiens
ctgtcgccccagg

SEQ ID NO: 2131113 - DNA, 15 bp, Homo sapiens
ctgtcgccccaggcc

SEQ ID NO: 2131114 - DNA, 16 bp, Homo sapiens
ctgtcgccccaggccc

SEQ ID NO: 2131115 - DNA, 17 bp, Homo sapiens
ctgtcgccccaggccct

SEQ ID NO: 2131116 - DNA, 18 bp, Homo sapiens
ctgtcgccccaggccctc

SEQ ID NO: 2131117 - DNA, 14 bp, Homo sapiens
ctgtggcctgggca

SEQ ID NO: 2131118 - DNA, 16 bp, Homo sapiens
ctgtggcctgggcaag

SEQ ID NO: 2131119 - DNA, 15 bp, Homo sapiens
ctgtggcctgtgtcc

SEQ ID NO: 2131120 - DNA, 19 bp, Homo sapiens
ctgtggcgttctgctgccc

SEQ ID NO: 2131121 - DNA, 23 bp, Homo sapiens
ctgtggcgttctgctgcccctgc

SEQ ID NO: 2131122 - DNA, 15 bp, Homo sapiens
ctgtggctcctgcct

SEQ ID NO: 2131123 - DNA, 24 bp, Homo sapiens
ctgtggctgcagagaccttgcgac

SEQ ID NO: 2131124 - DNA, 12 bp, Homo sapiens
ctgtgggaagag

SEQ ID NO: 2131125 - DNA, 15 bp, Homo sapiens
ctgtttccttttatg

SEQ ID NO: 2131126 - DNA, 20 bp, Homo sapiens
ctgtttctattctctcctca

SEQ ID NO: 2131127 - DNA, 23 bp, Homo sapiens
ctgtttctttttttatgactgta

SEQ ID NO: 2131128 - DNA, 16 bp, Homo sapiens
ctgtttgagatgtgat

SEQ ID NO: 2131129 - DNA, 15 bp, Homo sapiens
ctggacggggactgg

SEQ ID NO: 2131130 - DNA, 14 bp, Homo sapiens
ctggactcctctgt

SEQ ID NO: 2131131 - DNA, 20 bp, Homo sapiens
ctggactcctctgtccaggc

SEQ ID NO: 2131132 - DNA, 16 bp, Homo sapiens
ctggactgaggaccac

SEQ ID NO: 2131133 - DNA, 14 bp, Homo sapiens
ctggactgggaggt

SEQ ID NO: 2131134 - DNA, 20 bp, Homo sapiens
ctggactgtcatagaaatta

SEQ ID NO: 2131135 - DNA, 18 bp, Homo sapiens
ctggacttgagcttggca

SEQ ID NO: 2131136 - DNA, 22 bp, Homo sapiens
ctggactttggttctctccagg

SEQ ID NO: 2131137 - DNA, 23 bp, Homo sapiens
ctggactttggttctctccagga

SEQ ID NO: 2131138 - DNA, 19 bp, Homo sapiens
ctggagaactagaacctgg

SEQ ID NO: 2131139 - DNA, 22 bp, Homo sapiens
ctggagaactagaacctggagg

SEQ ID NO: 2131140 - DNA, 19 bp, Homo sapiens
ctggagaagaccctccccg

SEQ ID NO: 2131141 - DNA, 14 bp, Homo sapiens
ctggagaagcagtg

SEQ ID NO: 2131142 - DNA, 20 bp, Homo sapiens
ctggagagctagaacctgga

SEQ ID NO: 2131143 - DNA, 22 bp, Homo sapiens
ctggagagctagaacctggagg

SEQ ID NO: 2131144 - DNA, 22 bp, Homo sapiens
ctggagaggggcctgggaaagg

SEQ ID NO: 2131145 - DNA, 20 bp, Homo sapiens
ctggagatcctaactgagaa

SEQ ID NO: 2131146 - DNA, 15 bp, Homo sapiens
ctggagatgatgatg

SEQ ID NO: 2131147 - DNA, 20 bp, Homo sapiens
ctggagcaagaaggaaggag

SEQ ID NO: 2131148 - DNA, 14 bp, Homo sapiens
ctggagccagagag

SEQ ID NO: 2131149 - DNA, 21 bp, Homo sapiens
ctggagcctcggtggccatgc

SEQ ID NO: 2131150 - DNA, 18 bp, Homo sapiens
ctggagcggctctcctga

SEQ ID NO: 2131151 - DNA, 18 bp, Homo sapiens
ctggagctcttggaagag

SEQ ID NO: 2131152 - DNA, 16 bp, Homo sapiens
ctggagctgctgttcc

SEQ ID NO: 2131153 - DNA, 13 bp, Homo sapiens
ctggagctggctt

SEQ ID NO: 2131154 - DNA, 15 bp, Homo sapiens
ctggaggaagaagac

SEQ ID NO: 2131155 - DNA, 17 bp, Homo sapiens
ctggaggacctgagcct

SEQ ID NO: 2131156 - DNA, 19 bp, Homo sapiens
ctggaggacctgagcctgc

SEQ ID NO: 2131157 - DNA, 19 bp, Homo sapiens
ctggaggactagaacctgg

SEQ ID NO: 2131158 - DNA, 22 bp, Homo sapiens
ctggaggactagaacctggagg

SEQ ID NO: 2131159 - DNA, 14 bp, Homo sapiens
ctggaggcagggcc

SEQ ID NO: 2131160 - DNA, 19 bp, Homo sapiens
ctggaggcagggccttgcc

SEQ ID NO: 2131161 - DNA, 20 bp, Homo sapiens
ctggaggcagggccttgccc

SEQ ID NO: 2131162 - DNA, 22 bp, Homo sapiens
ctggaggcagggccttgcccag

SEQ ID NO: 2131163 - DNA, 23 bp, Homo sapiens
ctggaggcagggccttgcccaga

SEQ ID NO: 2131164 - DNA, 19 bp, Homo sapiens
ctggagggaatgaacctgg

SEQ ID NO: 2131165 - DNA, 15 bp, Homo sapiens
ctggagggatgccac

SEQ ID NO: 2131166 - DNA, 21 bp, Homo sapiens
ctggagggctagaactggaga

SEQ ID NO: 2131167 - DNA, 22 bp, Homo sapiens
ctggaggtcacattcaggaaga

SEQ ID NO: 2131168 - DNA, 22 bp, Homo sapiens
ctggagtcccctgggcctggac

SEQ ID NO: 2131169 - DNA, 22 bp, Homo sapiens
ctggagtcccgtccctgcccag

SEQ ID NO: 2131170 - DNA, 14 bp, Homo sapiens
ctggagtctccagt

SEQ ID NO: 2131171 - DNA, 13 bp, Homo sapiens
ctggagtgaggct

SEQ ID NO: 2131172 - DNA, 21 bp, Homo sapiens
ctggagtgaggcttccaggct

SEQ ID NO: 2131173 - DNA, 23 bp, Homo sapiens
ctggagtgaggcttccaggctct

SEQ ID NO: 2131174 - DNA, 24 bp, Homo sapiens
ctggagtgaggcttccaggctctt

SEQ ID NO: 2131175 - DNA, 14 bp, Homo sapiens
ctggagtgcagtga

SEQ ID NO: 2131176 - DNA, 16 bp, Homo sapiens
ctggagtgcagtgagc

SEQ ID NO: 2131177 - DNA, 20 bp, Homo sapiens
ctggagtgcagtgagccgag

SEQ ID NO: 2131178 - DNA, 18 bp, Homo sapiens
ctggagtgcgctcttggt

SEQ ID NO: 2131179 - DNA, 13 bp, Homo sapiens
ctggataaaatga

SEQ ID NO: 2131180 - DNA, 17 bp, Homo sapiens
ctggatactatatgata

SEQ ID NO: 2131181 - DNA, 23 bp, Homo sapiens
ctggatactatatgataaagagg

SEQ ID NO: 2131182 - DNA, 17 bp, Homo sapiens
ctggatcagcgtggcct

SEQ ID NO: 2131183 - DNA, 22 bp, Homo sapiens
ctggatctttcggactgaggcc

SEQ ID NO: 2131184 - DNA, 13 bp, Homo sapiens
ctggatgaaattt

SEQ ID NO: 2131185 - DNA, 14 bp, Homo sapiens
cttgtgtctgtaca

SEQ ID NO: 2131186 - DNA, 18 bp, Homo sapiens
cttgttaatgctttctga

SEQ ID NO: 2131187 - DNA, 23 bp, Homo sapiens
cttgttacctttcccatgctgaa

SEQ ID NO: 2131188 - DNA, 13 bp, Homo sapiens
cttgttatttata

SEQ ID NO: 2131189 - DNA, 20 bp, Homo sapiens
cttgttcatccaaggaacct

SEQ ID NO: 2131190 - DNA, 16 bp, Homo sapiens
cttgttccttctgctt

SEQ ID NO: 2131191 - DNA, 13 bp, Homo sapiens
cttgttctactca

SEQ ID NO: 2131192 - DNA, 13 bp, Homo sapiens
cttgttctgtcac

SEQ ID NO: 2131193 - DNA, 16 bp, Homo sapiens
cttgttgtcaagtata

SEQ ID NO: 2131194 - DNA, 15 bp, Homo sapiens
cttgttgtttttaag

SEQ ID NO: 2131195 - DNA, 21 bp, Homo sapiens
cttgttgtttttaagtcctgt

SEQ ID NO: 2131196 - DNA, 22 bp, Homo sapiens
cttgttgtttttaagtcctgta

SEQ ID NO: 2131197 - DNA, 12 bp, Homo sapiens
cttgtttcaatt

SEQ ID NO: 2131198 - DNA, 22 bp, Homo sapiens
cttgtttcaattccacctgcaa

SEQ ID NO: 2131199 - DNA, 20 bp, Homo sapiens
cttgtttgattttagctgca

SEQ ID NO: 2131200 - DNA, 23 bp, Homo sapiens
cttgtttgattttagctgcagaa

SEQ ID NO: 2131201 - DNA, 18 bp, Homo sapiens
cttgtttggggcaggagt

SEQ ID NO: 2131202 - DNA, 21 bp, Homo sapiens
cttgttttaagattgtaattc

SEQ ID NO: 2131203 - DNA, 19 bp, Homo sapiens
cttgttttttttttccact

SEQ ID NO: 2131204 - DNA, 12 bp, Homo sapiens
ctttaaaaaagc

SEQ ID NO: 2131205 - DNA, 18 bp, Homo sapiens
ctttaaaaagcagtcctc

SEQ ID NO: 2131206 - DNA, 22 bp, Homo sapiens
ctttaaaataaggataataatc

SEQ ID NO: 2131207 - DNA, 18 bp, Homo sapiens
ctttaaagacttaagatt

SEQ ID NO: 2131208 - DNA, 18 bp, Homo sapiens
ctttaaagggatggcaag

SEQ ID NO: 2131209 - DNA, 20 bp, Homo sapiens
ctttaaagggatggcaagat

SEQ ID NO: 2131210 - DNA, 17 bp, Homo sapiens
ctttaaagtaaaggcct

SEQ ID NO: 2131211 - DNA, 21 bp, Homo sapiens
ctttaaatcaaaagctgcttg

SEQ ID NO: 2131212 - DNA, 18 bp, Homo sapiens
ctttaaccctctcttccc

SEQ ID NO: 2131213 - DNA, 18 bp, Homo sapiens
ctttaaccgtttttcaag

SEQ ID NO: 2131214 - DNA, 17 bp, Homo sapiens
ctttaatagtttctgat

SEQ ID NO: 2131215 - DNA, 12 bp, Homo sapiens
ctttaatataaa

SEQ ID NO: 2131216 - DNA, 23 bp, Homo sapiens
ctttaatatagctatcatttctt

SEQ ID NO: 2131217 - DNA, 13 bp, Homo sapiens
ctttaatcccagt

SEQ ID NO: 2131218 - DNA, 22 bp, Homo sapiens
ctttaatgtcacaggcaggtcc

SEQ ID NO: 2131219 - DNA, 14 bp, Homo sapiens
ctttacacacacag

SEQ ID NO: 2131220 - DNA, 21 bp, Homo sapiens
ctttacaggtatttataatat

SEQ ID NO: 2131221 - DNA, 19 bp, Homo sapiens
ctttcctccccaccttccc

SEQ ID NO: 2131222 - DNA, 18 bp, Homo sapiens
ctttcctctccaattgta

SEQ ID NO: 2131223 - DNA, 19 bp, Homo sapiens
ctttcctcttccccttgcc

SEQ ID NO: 2131224 - DNA, 17 bp, Homo sapiens
ctttccttgtctctcat

SEQ ID NO: 2131225 - DNA, 16 bp, Homo sapiens
ctttccttttcttcct

SEQ ID NO: 2131226 - DNA, 18 bp, Homo sapiens
ctttccttttcttccttc

SEQ ID NO: 2131227 - DNA, 22 bp, Homo sapiens
ctttcggggagaggctgaggac

SEQ ID NO: 2131228 - DNA, 21 bp, Homo sapiens
ctttctacacctgttgcacct

SEQ ID NO: 2131229 - DNA, 16 bp, Homo sapiens
ctttctacccagcgag

SEQ ID NO: 2131230 - DNA, 14 bp, Homo sapiens
ctttctagttgaaa

SEQ ID NO: 2131231 - DNA, 18 bp, Homo sapiens
ctttctagttgaaaataa

SEQ ID NO: 2131232 - DNA, 21 bp, Homo sapiens
ctttctagttgaaaataaagt

SEQ ID NO: 2131233 - DNA, 15 bp, Homo sapiens
ctttctattccaaag

SEQ ID NO: 2131234 - DNA, 16 bp, Homo sapiens
ctttctattgaaaaat

SEQ ID NO: 2131235 - DNA, 21 bp, Homo sapiens
ctttctcagccgcttctgact

SEQ ID NO: 2131236 - DNA, 22 bp, Homo sapiens
ctttctcagccgcttctgactg

SEQ ID NO: 2131237 - DNA, 14 bp, Homo sapiens
ctttctccagccag

SEQ ID NO: 2131238 - DNA, 15 bp, Homo sapiens
ctttctccagccagc

SEQ ID NO: 2131239 - DNA, 16 bp, Homo sapiens
ctttctccagccagca

SEQ ID NO: 2131240 - DNA, 21 bp, Homo sapiens
ctttctcccccgacactgctg

SEQ ID NO: 2131241 - DNA, 21 bp, Homo sapiens
ctttctccggggtctgtgctg

SEQ ID NO: 2131242 - DNA, 19 bp, Homo sapiens
ctttctcttccctccttcc

SEQ ID NO: 2131243 - DNA, 22 bp, Homo sapiens
ctttctgagagttggctcaggc

SEQ ID NO: 2131244 - DNA, 17 bp, Homo sapiens
ctttctgagtgacatgg

SEQ ID NO: 2131245 - DNA, 20 bp, Homo sapiens
ctttctgagtgacatgggtg

SEQ ID NO: 2131246 - DNA, 17 bp, Homo sapiens
ctttctggaccagatcc

SEQ ID NO: 2131247 - DNA, 13 bp, Homo sapiens
ctttctgtaaact

SEQ ID NO: 2131248 - DNA, 21 bp, Homo sapiens
ctttctgtgtgcaccttacca

SEQ ID NO: 2131249 - DNA, 16 bp, Homo sapiens
ctttcttattttgtaa

SEQ ID NO: 2131250 - DNA, 15 bp, Homo sapiens
ctttcttcctctgct

SEQ ID NO: 2131251 - DNA, 15 bp, Homo sapiens
ctttcttctatttta

SEQ ID NO: 2131252 - DNA, 17 bp, Homo sapiens
ctttctttacctgagac

SEQ ID NO: 2131253 - DNA, 18 bp, Homo sapiens
ctttctttacctgagacc

SEQ ID NO: 2131254 - DNA, 18 bp, Homo sapiens
ctttctttttctggaaat

SEQ ID NO: 2131255 - DNA, 20 bp, Homo sapiens
ctttctttttctggaaattt

SEQ ID NO: 2131256 - DNA, 22 bp, Homo sapiens
ctttctttttctggaaattttg

SEQ ID NO: 2131257 - DNA, 14 bp, Homo sapiens
ctttctttttctgt

SEQ ID NO: 2131258 - DNA, 21 bp, Homo sapiens
ctttctttttctgtctctctt

SEQ ID NO: 2131259 - DNA, 19 bp, Homo sapiens
ctttgaataaagtctgagt

SEQ ID NO: 2131260 - DNA, 21 bp, Homo sapiens
ctttgaatacccccagagacc

SEQ ID NO: 2131261 - DNA, 22 bp, Homo sapiens
ctttgaatacccccagagacct

SEQ ID NO: 2131262 - DNA, 23 bp, Homo sapiens
ctttgaatcctctctctgtgtta

SEQ ID NO: 2131263 - DNA, 13 bp, Homo sapiens
ctttgaatgcttt

SEQ ID NO: 2131264 - DNA, 23 bp, Homo sapiens
ctttgaatgctttttgaatgtta

SEQ ID NO: 2131265 - DNA, 19 bp, Homo sapiens
ctttgacgggaggcctcag

SEQ ID NO: 2131266 - DNA, 21 bp, Homo sapiens
ctttgactcttttgccattaa

SEQ ID NO: 2131267 - DNA, 16 bp, Homo sapiens
ctttgagaaagaaata

SEQ ID NO: 2131268 - DNA, 18 bp, Homo sapiens
ctttgagaaaggattaag

SEQ ID NO: 2131269 - DNA, 20 bp, Homo sapiens
ctttgagaatgtgattcctt

SEQ ID NO: 2131270 - DNA, 18 bp, Homo sapiens
ctttgagagagtttatca

SEQ ID NO: 2131271 - DNA, 17 bp, Homo sapiens
ctttgaggacaaagaga

SEQ ID NO: 2131272 - DNA, 15 bp, Homo sapiens
ctttgatatttcaat

SEQ ID NO: 2131273 - DNA, 21 bp, Homo sapiens
ctttgatgattaattcacctt

SEQ ID NO: 2131274 - DNA, 13 bp, Homo sapiens
ctttgattccatt

SEQ ID NO: 2131275 - DNA, 12 bp, Homo sapiens
ctttgatttcca

SEQ ID NO: 2131276 - DNA, 20 bp, Homo sapiens
ctttgatttccaagtaatat

SEQ ID NO: 2131277 - DNA, 15 bp, Homo sapiens
ctttgcactgagggc

SEQ ID NO: 2131278 - DNA, 16 bp, Homo sapiens
ctttgcagacaggcaa

SEQ ID NO: 2131279 - DNA, 20 bp, Homo sapiens
ctttgcaggctctgggctca

SEQ ID NO: 2131280 - DNA, 21 bp, Homo sapiens
ctttgcattccatgattttac

SEQ ID NO: 2131281 - DNA, 19 bp, Homo sapiens
ctttgccatgggcctgctg

SEQ ID NO: 2131282 - DNA, 20 bp, Homo sapiens
ctttgccatgggcctgctgc

SEQ ID NO: 2131283 - DNA, 11 bp, Homo sapiens
ctttgcctcaa

SEQ ID NO: 2131284 - DNA, 20 bp, Homo sapiens
ctttgcctgtgtgagcatct

SEQ ID NO: 2131285 - DNA, 21 bp, Homo sapiens
ctttgcctgtgtgagcatctc

SEQ ID NO: 2131286 - DNA, 13 bp, Homo sapiens
ctttgctacaata

SEQ ID NO: 2131287 - DNA, 19 bp, Homo sapiens
ctttgctacaataaatgct

SEQ ID NO: 2131288 - DNA, 17 bp, Homo sapiens
ctttggaaacaggacca

SEQ ID NO: 2131289 - DNA, 13 bp, Homo sapiens
ctttggaatgaac

SEQ ID NO: 2131290 - DNA, 18 bp, Homo sapiens
ctttggcagaccatctcc

SEQ ID NO: 2131291 - DNA, 19 bp, Homo sapiens
ctttggcagaccatctcca

SEQ ID NO: 2131292 - DNA, 21 bp, Homo sapiens
ctttggcagaccatctccagc

SEQ ID NO: 2131293 - DNA, 11 bp, Homo sapiens
ctttggcccaa

SEQ ID NO: 2131294 - DNA, 12 bp, Homo sapiens
ctttggcttttt

SEQ ID NO: 2131295 - DNA, 13 bp, Homo sapiens
ctttgggaagggg

SEQ ID NO: 2131296 - DNA, 15 bp, Homo sapiens
ctttgggaggccaag

SEQ ID NO: 2131297 - DNA, 17 bp, Homo sapiens
ctttgggaggccaaggc

SEQ ID NO: 2131298 - DNA, 23 bp, Homo sapiens
ctttgggaggccaaggcaggtag

SEQ ID NO: 2131299 - DNA, 18 bp, Homo sapiens
ctttgggaggctgaggcg

SEQ ID NO: 2131300 - DNA, 16 bp, Homo sapiens
ctttgggatcagcctc

SEQ ID NO: 2131301 - DNA, 15 bp, Homo sapiens
ctttgggctgccctg

SEQ ID NO: 2131302 - DNA, 20 bp, Homo sapiens
ctttgggctgccctggtgct

SEQ ID NO: 2131303 - DNA, 21 bp, Homo sapiens
ctttgggctttgcaggctctg

SEQ ID NO: 2131304 - DNA, 21 bp, Homo sapiens
ctttggggacagttggcagag

SEQ ID NO: 2131305 - DNA, 23 bp, Homo sapiens
ctttggggagacggtgttgcaga

SEQ ID NO: 2131306 - DNA, 17 bp, Homo sapiens
ctttggggtcagccagg

SEQ ID NO: 2131307 - DNA, 23 bp, Homo sapiens
ctttgggtactactgctgcaaag

SEQ ID NO: 2131308 - DNA, 20 bp, Homo sapiens
ctttgggttggagctgttcc

SEQ ID NO: 2131309 - DNA, 16 bp, Homo sapiens
ctttggtgaaagggag

SEQ ID NO: 2131310 - DNA, 19 bp, Homo sapiens
ctttggtgttacacagccc

SEQ ID NO: 2131311 - DNA, 21 bp, Homo sapiens
ctttgtaatcgttatgtgtgt

SEQ ID NO: 2131312 - DNA, 13 bp, Homo sapiens
ctttgtaatggga

SEQ ID NO: 2131313 - DNA, 22 bp, Homo sapiens
ctttgtacagtggagaaatatt

SEQ ID NO: 2131314 - DNA, 12 bp, Homo sapiens
ctttgtatgcac

SEQ ID NO: 2131315 - DNA, 22 bp, Homo sapiens
ctttgtgtaataaaaatttgtt

SEQ ID NO: 2131316 - DNA, 15 bp, Homo sapiens
ctttgtgtgattgaa

SEQ ID NO: 2131317 - DNA, 20 bp, Homo sapiens
ctttgttgccttatcttgaa

SEQ ID NO: 2131318 - DNA, 16 bp, Homo sapiens
ctttgttttgcactga

SEQ ID NO: 2131319 - DNA, 18 bp, Homo sapiens
ctttgtttttatgaagaa

SEQ ID NO: 2131320 - DNA, 17 bp, Homo sapiens
cttttaaaaaggcagta

SEQ ID NO: 2131321 - DNA, 19 bp, Homo sapiens
cttttaaaagaaaaagtat

SEQ ID NO: 2131322 - DNA, 11 bp, Homo sapiens
cttttaaaatg

SEQ ID NO: 2131323 - DNA, 17 bp, Homo sapiens
cttttaaaccattttct

SEQ ID NO: 2131324 - DNA, 14 bp, Homo sapiens
cttttaagaaacac

SEQ ID NO: 2131325 - DNA, 21 bp, Homo sapiens
cttttaagcaaagttgggtgt

SEQ ID NO: 2131326 - DNA, 14 bp, Homo sapiens
cttttaataaaatt

SEQ ID NO: 2131327 - DNA, 23 bp, Homo sapiens
gaaaatctaatattaaaaatatg

SEQ ID NO: 2131328 - DNA, 14 bp, Homo sapiens
gaaaatgaggagga

SEQ ID NO: 2131329 - DNA, 16 bp, Homo sapiens
gaaaatgtaacttttc

SEQ ID NO: 2131330 - DNA, 13 bp, Homo sapiens
gaaaatgtcctgt

SEQ ID NO: 2131331 - DNA, 13 bp, Homo sapiens
gaaaattatttaa

SEQ ID NO: 2131332 - DNA, 17 bp, Homo sapiens
gaaaattattttaaaca

SEQ ID NO: 2131333 - DNA, 17 bp, Homo sapiens
gaaaattcaaaaagtgt

SEQ ID NO: 2131334 - DNA, 19 bp, Homo sapiens
gaaaattcaaaaagtgttt

SEQ ID NO: 2131335 - DNA, 21 bp, Homo sapiens
gaaaattcaaaaagtgtttat

SEQ ID NO: 2131336 - DNA, 22 bp, Homo sapiens
gaaaattcaaaaagtgtttatt

SEQ ID NO: 2131337 - DNA, 22 bp, Homo sapiens
gaaaattcatttcacattaatg

SEQ ID NO: 2131338 - DNA, 21 bp, Homo sapiens
gaaaattcctattgattttct

SEQ ID NO: 2131339 - DNA, 14 bp, Homo sapiens
gaaacacagggttt

SEQ ID NO: 2131340 - DNA, 18 bp, Homo sapiens
gaaacaccgagtctctgt

SEQ ID NO: 2131341 - DNA, 21 bp, Homo sapiens
gaaacactcaacaataaagac

SEQ ID NO: 2131342 - DNA, 20 bp, Homo sapiens
gaaacagagaaccctgtggg

SEQ ID NO: 2131343 - DNA, 17 bp, Homo sapiens
gaaacagagacaggccc

SEQ ID NO: 2131344 - DNA, 13 bp, Homo sapiens
gaaacagagagag

SEQ ID NO: 2131345 - DNA, 14 bp, Homo sapiens
gaaacagagagaga

SEQ ID NO: 2131346 - DNA, 15 bp, Homo sapiens
gaaacagagagagac

SEQ ID NO: 2131347 - DNA, 16 bp, Homo sapiens
gaaacagagagagaca

SEQ ID NO: 2131348 - DNA, 15 bp, Homo sapiens
gaaacagataccata

SEQ ID NO: 2131349 - DNA, 21 bp, Homo sapiens
gaaacagataccatactcatt

SEQ ID NO: 2131350 - DNA, 15 bp, Homo sapiens
gaaacagatgataaa

SEQ ID NO: 2131351 - DNA, 22 bp, Homo sapiens
gaaacaggaccacaaaaatgaa

SEQ ID NO: 2131352 - DNA, 22 bp, Homo sapiens
gaaacagggagcccctaggaaa

SEQ ID NO: 2131353 - DNA, 18 bp, Homo sapiens
gaaacaggggatcaaagt

SEQ ID NO: 2131354 - DNA, 17 bp, Homo sapiens
gaaacatgacactgacc

SEQ ID NO: 2131355 - DNA, 14 bp, Homo sapiens
gaaaccaaagccag

SEQ ID NO: 2131356 - DNA, 13 bp, Homo sapiens
gaaaccacacttc

SEQ ID NO: 2131357 - DNA, 17 bp, Homo sapiens
gaaaccacacttcttga

SEQ ID NO: 2131358 - DNA, 21 bp, Homo sapiens
gaaaccacaggcccttggggt

SEQ ID NO: 2131359 - DNA, 22 bp, Homo sapiens
gaaaccacaggcccttggggtt

SEQ ID NO: 2131360 - DNA, 15 bp, Homo sapiens
gaaaccagtatggaa

SEQ ID NO: 2131361 - DNA, 22 bp, Homo sapiens
gaaaccagtatggaagggaggg

SEQ ID NO: 2131362 - DNA, 14 bp, Homo sapiens
gaaacccaaggaac

SEQ ID NO: 2131363 - DNA, 22 bp, Homo sapiens
gaaacccattaggcatgcctaa

SEQ ID NO: 2131364 - DNA, 15 bp, Homo sapiens
gaaaccccagggcag

SEQ ID NO: 2131365 - DNA, 18 bp, Homo sapiens
gaaacctgtccataaagt

SEQ ID NO: 2131366 - DNA, 17 bp, Homo sapiens
gaaaccttattgtacct

SEQ ID NO: 2131367 - DNA, 19 bp, Homo sapiens
gaaaccttattgtacctct

SEQ ID NO: 2131368 - DNA, 13 bp, Homo sapiens
gaaaccttgcagc

SEQ ID NO: 2131369 - DNA, 20 bp, Homo sapiens
gaaacgaagccatctttctt

SEQ ID NO: 2131370 - DNA, 17 bp, Homo sapiens
gaaactcaccatgtaaa

SEQ ID NO: 2131371 - DNA, 22 bp, Homo sapiens
gaaactccgtcttagaagtgga

SEQ ID NO: 2131372 - DNA, 22 bp, Homo sapiens
gaaactcctgattttgtagtta

SEQ ID NO: 2131373 - DNA, 20 bp, Homo sapiens
gaaactccttttgctgtctt

SEQ ID NO: 2131374 - DNA, 23 bp, Homo sapiens
gaaactgaaaactgtaaatacaa

SEQ ID NO: 2131375 - DNA, 23 bp, Homo sapiens
gaaactgaggagtagctgagagg

SEQ ID NO: 2131376 - DNA, 13 bp, Homo sapiens
gaaactggccagg

SEQ ID NO: 2131377 - DNA, 16 bp, Homo sapiens
gaaactggccaggggt

SEQ ID NO: 2131378 - DNA, 16 bp, Homo sapiens
gaaactgtatgattaa

SEQ ID NO: 2131379 - DNA, 17 bp, Homo sapiens
gaaagaaaattagtaat

SEQ ID NO: 2131380 - DNA, 11 bp, Homo sapiens
gaaagaaggaa

SEQ ID NO: 2131381 - DNA, 18 bp, Homo sapiens
gaaagaaggacacttgta

SEQ ID NO: 2131382 - DNA, 17 bp, Homo sapiens
gaaagaatataaagtta

SEQ ID NO: 2131383 - DNA, 21 bp, Homo sapiens
gaaagacggattgcattagaa

SEQ ID NO: 2131384 - DNA, 19 bp, Homo sapiens
gaaagactattcaaacagt

SEQ ID NO: 2131385 - DNA, 20 bp, Homo sapiens
gaaagaggtgaccccagggc

SEQ ID NO: 2131386 - DNA, 21 bp, Homo sapiens
gaaagaggtgaccccagggca

SEQ ID NO: 2131387 - DNA, 22 bp, Homo sapiens
gaaagatggctgtgcctctgcc

SEQ ID NO: 2131388 - DNA, 23 bp, Homo sapiens
gaaagatggctgtgcctctgcct

SEQ ID NO: 2131389 - DNA, 14 bp, Homo sapiens
gaaagcagcagcta

SEQ ID NO: 2131390 - DNA, 16 bp, Homo sapiens
gaaagcagcagcttgt

SEQ ID NO: 2131391 - DNA, 16 bp, Homo sapiens
gaaagcatcacctcag

SEQ ID NO: 2131392 - DNA, 14 bp, Homo sapiens
gaaagccatttgtt

SEQ ID NO: 2131393 - DNA, 18 bp, Homo sapiens
gaaagccccagcactaac

SEQ ID NO: 2131394 - DNA, 18 bp, Homo sapiens
gaaagccctcccccttcc

SEQ ID NO: 2131395 - DNA, 14 bp, Homo sapiens
gaaagcctctggaa

SEQ ID NO: 2131396 - DNA, 22 bp, Homo sapiens
gaaagctgatgatgtctcttgt

SEQ ID NO: 2131397 - DNA, 15 bp, Homo sapiens
gaaaggaaaaccagg

SEQ ID NO: 2131398 - DNA, 16 bp, Homo sapiens
gaaaggaaaaccaggg

SEQ ID NO: 2131399 - DNA, 17 bp, Homo sapiens
gaaaggaaaaccaggga

SEQ ID NO: 2131400 - DNA, 13 bp, Homo sapiens
gaaaggaaaagaa

SEQ ID NO: 2131401 - DNA, 18 bp, Homo sapiens
gaaaggaagctccactgt

SEQ ID NO: 2131402 - DNA, 22 bp, Homo sapiens
gaaaggaagctccactgtcacc

SEQ ID NO: 2131403 - DNA, 13 bp, Homo sapiens
gaaaggacccacc

SEQ ID NO: 2131404 - DNA, 18 bp, Homo sapiens
gaaaggaggcatgcctct

SEQ ID NO: 2131405 - DNA, 19 bp, Homo sapiens
gaaaggaggcatgcctctg

SEQ ID NO: 2131406 - DNA, 14 bp, Homo sapiens
gaaaggattaagat

SEQ ID NO: 2131407 - DNA, 22 bp, Homo sapiens
gaaaggattaagatacactcct

SEQ ID NO: 2131408 - DNA, 14 bp, Homo sapiens
gaaaggattcatgt

SEQ ID NO: 2131409 - DNA, 14 bp, Homo sapiens
gaaaggctcagtct

SEQ ID NO: 2131410 - DNA, 15 bp, Homo sapiens
gaaaggctctgaaag

SEQ ID NO: 2131411 - DNA, 19 bp, Homo sapiens
gaaaggctctgaaagccag

SEQ ID NO: 2131412 - DNA, 16 bp, Homo sapiens
gaaagggaaactggct

SEQ ID NO: 2131413 - DNA, 19 bp, Homo sapiens
gaaagggagggcccctcat

SEQ ID NO: 2131414 - DNA, 17 bp, Homo sapiens
gaaagggagggctctga

SEQ ID NO: 2131415 - DNA, 23 bp, Homo sapiens
gaaagggtcaacggccctgttta

SEQ ID NO: 2131416 - DNA, 23 bp, Homo sapiens
gaaagggtctgataaacacagag

SEQ ID NO: 2131417 - DNA, 18 bp, Homo sapiens
gaaaggttaccctgtaac

SEQ ID NO: 2131418 - DNA, 20 bp, Homo sapiens
gaaagtatattttcctccca

SEQ ID NO: 2131419 - DNA, 18 bp, Homo sapiens
gaaagtatgtgatatctg

SEQ ID NO: 2131420 - DNA, 20 bp, Homo sapiens
gaaagtcagatgcccagagg

SEQ ID NO: 2131421 - DNA, 19 bp, Homo sapiens
gaaagtcagctttcagagc

SEQ ID NO: 2131422 - DNA, 18 bp, Homo sapiens
gaaagtgaataaacttca

SEQ ID NO: 2131423 - DNA, 22 bp, Homo sapiens
gaaagtgaataaacttcagcac

SEQ ID NO: 2131424 - DNA, 12 bp, Homo sapiens
gaaagtgcagaa

SEQ ID NO: 2131425 - DNA, 15 bp, Homo sapiens
gaaagtgcagaatca

SEQ ID NO: 2131426 - DNA, 23 bp, Homo sapiens
gaaagtgggttcactagagctgg

SEQ ID NO: 2131427 - DNA, 24 bp, Homo sapiens
gaaagtgggttcactagagctggg

SEQ ID NO: 2131428 - DNA, 16 bp, Homo sapiens
gaaagtgtaaaataga

SEQ ID NO: 2131429 - DNA, 15 bp, Homo sapiens
gaaagttattgtgtt

SEQ ID NO: 2131430 - DNA, 20 bp, Homo sapiens
gaaagttattgtgttgcctt

SEQ ID NO: 2131431 - DNA, 15 bp, Homo sapiens
gaaagttcagccaga

SEQ ID NO: 2131432 - DNA, 15 bp, Homo sapiens
gaaataaaacctttc

SEQ ID NO: 2131433 - DNA, 20 bp, Homo sapiens
gaaataaaatgaaatgtctt

SEQ ID NO: 2131434 - DNA, 18 bp, Homo sapiens
gaaataaacctggagatg

SEQ ID NO: 2131435 - DNA, 20 bp, Homo sapiens
gaaataaacctggagatgat

SEQ ID NO: 2131436 - DNA, 19 bp, Homo sapiens
gaaataaacttattcctcc

SEQ ID NO: 2131437 - DNA, 14 bp, Homo sapiens
gaaataaattggtg

SEQ ID NO: 2131438 - DNA, 24 bp, Homo sapiens
gaaataagaaacacaaatgtaaaa

SEQ ID NO: 2131439 - DNA, 18 bp, Homo sapiens
gaaatacacaagtaaaca

SEQ ID NO: 2131440 - DNA, 19 bp, Homo sapiens
gaaatacacaagtaaacat

SEQ ID NO: 2131441 - DNA, 13 bp, Homo sapiens
gaaatactgctct

SEQ ID NO: 2131442 - DNA, 15 bp, Homo sapiens
gaaatactgctctga

SEQ ID NO: 2131443 - DNA, 16 bp, Homo sapiens
gaaatactgctctgaa

SEQ ID NO: 2131444 - DNA, 22 bp, Homo sapiens
gaaatactgctctgaatatttt

SEQ ID NO: 2131445 - DNA, 18 bp, Homo sapiens
gaaatagacagtatattt

SEQ ID NO: 2131446 - DNA, 15 bp, Homo sapiens
gaaatagtgttcttt

SEQ ID NO: 2131447 - DNA, 15 bp, Homo sapiens
gaaatatatatacat

SEQ ID NO: 2131448 - DNA, 14 bp, Homo sapiens
gaaatatgatttta

SEQ ID NO: 2131449 - DNA, 17 bp, Homo sapiens
gaaatatgcacaatagc

SEQ ID NO: 2131450 - DNA, 15 bp, Homo sapiens
gaaatatttgcttat

SEQ ID NO: 2131451 - DNA, 18 bp, Homo sapiens
gaaatatttgcttattta

SEQ ID NO: 2131452 - DNA, 18 bp, Homo sapiens
gaaatcaaatatgcaaag

SEQ ID NO: 2131453 - DNA, 21 bp, Homo sapiens
gaaatcaaatatgcaaagcac

SEQ ID NO: 2131454 - DNA, 15 bp, Homo sapiens
gaaatcacaggggcg

SEQ ID NO: 2131455 - DNA, 16 bp, Homo sapiens
gaaatcagttgtgttt

SEQ ID NO: 2131456 - DNA, 18 bp, Homo sapiens
gaaatcatcgaaaattca

SEQ ID NO: 2131457 - DNA, 15 bp, Homo sapiens
gaaatcattgtagaa

SEQ ID NO: 2131458 - DNA, 20 bp, Homo sapiens
gaaatccagtttcccaccac

SEQ ID NO: 2131459 - DNA, 18 bp, Homo sapiens
gaaatccccccttcagaa

SEQ ID NO: 2131460 - DNA, 18 bp, Homo sapiens
gaaatccctgtttaatat

SEQ ID NO: 2131461 - DNA, 19 bp, Homo sapiens
gaaatccctgtttaatatt

SEQ ID NO: 2131462 - DNA, 13 bp, Homo sapiens
gaaatcctgttac

SEQ ID NO: 2131463 - DNA, 14 bp, Homo sapiens
gaaatcttaaaaac

SEQ ID NO: 2131464 - DNA, 15 bp, Homo sapiens
gaaatcttaaaaacc

SEQ ID NO: 2131465 - DNA, 22 bp, Homo sapiens
gaaatgacagaatgctgtttta

SEQ ID NO: 2131466 - DNA, 14 bp, Homo sapiens
gaaatgcaaaaatc

SEQ ID NO: 2131467 - DNA, 21 bp, Homo sapiens
gaaatgctattgttgtgggct

SEQ ID NO: 2131468 - DNA, 14 bp, Homo sapiens
gaaatgctgttggt

SEQ ID NO: 2131469 - DNA, 22 bp, Homo sapiens
gaaatgcttgtggattgagggt

SEQ ID NO: 2131470 - DNA, 20 bp, Homo sapiens
gaaatggaatcagcttttaa

SEQ ID NO: 2131471 - DNA, 12 bp, Homo sapiens
gaaatggagggt

SEQ ID NO: 2131472 - DNA, 19 bp, Homo sapiens
gaaatggagggtggggccg

SEQ ID NO: 2131473 - DNA, 17 bp, Homo sapiens
gaaatgggctttaacaa

SEQ ID NO: 2131474 - DNA, 16 bp, Homo sapiens
gaaatggtatgagctg

SEQ ID NO: 2131475 - DNA, 17 bp, Homo sapiens
gaaatgtgaagggtggg

SEQ ID NO: 2131476 - DNA, 22 bp, Homo sapiens
gaaatgttattttttaattatt

SEQ ID NO: 2131477 - DNA, 14 bp, Homo sapiens
gaaatgtttcacta

SEQ ID NO: 2131478 - DNA, 13 bp, Homo sapiens
gaaattagccggg

SEQ ID NO: 2131479 - DNA, 16 bp, Homo sapiens
gaaattagctgtgtga

SEQ ID NO: 2131480 - DNA, 16 bp, Homo sapiens
gaaattcacactgtgc

SEQ ID NO: 2131481 - DNA, 19 bp, Homo sapiens
gaaattcccccacttggga

SEQ ID NO: 2131482 - DNA, 12 bp, Homo sapiens
gaaattcctgta

SEQ ID NO: 2131483 - DNA, 19 bp, Homo sapiens
gaaattgcatttcctgaca

SEQ ID NO: 2131484 - DNA, 14 bp, Homo sapiens
gaaatttaaactat

SEQ ID NO: 2131485 - DNA, 22 bp, Homo sapiens
gaaatttaatatagctattttt

SEQ ID NO: 2131486 - DNA, 21 bp, Homo sapiens
gaaatttattagttaatatat

SEQ ID NO: 2131487 - DNA, 21 bp, Homo sapiens
gaaatttcagattcccagagc

SEQ ID NO: 2131488 - DNA, 14 bp, Homo sapiens
gaaatttgatttct

SEQ ID NO: 2131489 - DNA, 19 bp, Homo sapiens
gaaattttactgacagaaa

SEQ ID NO: 2131490 - DNA, 18 bp, Homo sapiens
gaaattttctagactttc

SEQ ID NO: 2131491 - DNA, 21 bp, Homo sapiens
gaaattttctagactttctgt

SEQ ID NO: 2131492 - DNA, 17 bp, Homo sapiens
gaaatttttatttttct

SEQ ID NO: 2131493 - DNA, 21 bp, Homo sapiens
gaacaaaagttcgaaagaaaa

SEQ ID NO: 2131494 - DNA, 23 bp, Homo sapiens
gaacaaacactgaatcatgttaa

SEQ ID NO: 2131495 - DNA, 13 bp, Homo sapiens
gaacaaactgatg

SEQ ID NO: 2131496 - DNA, 21 bp, Homo sapiens
gaacaaagaacggcatgtgaa

SEQ ID NO: 2131497 - DNA, 20 bp, Homo sapiens
gaacaaagggattctccagg

SEQ ID NO: 2131498 - DNA, 20 bp, Homo sapiens
gaacaaatcacacctctggg

SEQ ID NO: 2131499 - DNA, 13 bp, Homo sapiens
gaacaacaacaac

SEQ ID NO: 2131500 - DNA, 15 bp, Homo sapiens
gaacaacaacaacaa

SEQ ID NO: 2131501 - DNA, 20 bp, Homo sapiens
gaacaacaacaacaataaca

SEQ ID NO: 2131502 - DNA, 13 bp, Homo sapiens
gaacaagagaaaa

SEQ ID NO: 2131503 - DNA, 20 bp, Homo sapiens
gaacaagtcacagctgcagc

SEQ ID NO: 2131504 - DNA, 21 bp, Homo sapiens
gaacaagttgtttcattgact

SEQ ID NO: 2131505 - DNA, 19 bp, Homo sapiens
gaacaatagctattgcatg

SEQ ID NO: 2131506 - DNA, 15 bp, Homo sapiens
ggggagcaggtctct

SEQ ID NO: 2131507 - DNA, 22 bp, Homo sapiens
ggggagcaggtctctggcagag

SEQ ID NO: 2131508 - DNA, 14 bp, Homo sapiens
ggggagctggaaat

SEQ ID NO: 2131509 - DNA, 13 bp, Homo sapiens
ggggaggcagctc

SEQ ID NO: 2131510 - DNA, 12 bp, Homo sapiens
ggggagggaggt

SEQ ID NO: 2131511 - DNA, 11 bp, Homo sapiens
ggggaggggga

SEQ ID NO: 2131512 - DNA, 16 bp, Homo sapiens
ggggagggggacgcgc

SEQ ID NO: 2131513 - DNA, 19 bp, Homo sapiens
ggggaggtgcctgagctgg

SEQ ID NO: 2131514 - DNA, 21 bp, Homo sapiens
ggggagttgagtcacaagagg

SEQ ID NO: 2131515 - DNA, 14 bp, Homo sapiens
ggggatttttttgt

SEQ ID NO: 2131516 - DNA, 14 bp, Homo sapiens
ggggcaagcctgta

SEQ ID NO: 2131517 - DNA, 14 bp, Homo sapiens
ggggcaatggggag

SEQ ID NO: 2131518 - DNA, 17 bp, Homo sapiens
ggggcactgcaggggcc

SEQ ID NO: 2131519 - DNA, 16 bp, Homo sapiens
ggggcagaggggcagc

SEQ ID NO: 2131520 - DNA, 11 bp, Homo sapiens
ggggcaggagt

SEQ ID NO: 2131521 - DNA, 11 bp, Homo sapiens
ggggcaggcct

SEQ ID NO: 2131522 - DNA, 13 bp, Homo sapiens
ggggcagtggcaa

SEQ ID NO: 2131523 - DNA, 19 bp, Homo sapiens
ggggcatagaaactgagga

SEQ ID NO: 2131524 - DNA, 20 bp, Homo sapiens
ggggcatagaaactgaggag

SEQ ID NO: 2131525 - DNA, 23 bp, Homo sapiens
ggggcatagaaactgaggagtag

SEQ ID NO: 2131526 - DNA, 17 bp, Homo sapiens
ggggccagctggtgctg

SEQ ID NO: 2131527 - DNA, 19 bp, Homo sapiens
ggggcccacaaaggggaga

SEQ ID NO: 2131528 - DNA, 17 bp, Homo sapiens
ggggccccagatctgcc

SEQ ID NO: 2131529 - DNA, 20 bp, Homo sapiens
ggggccccagatctgcctgg

SEQ ID NO: 2131530 - DNA, 14 bp, Homo sapiens
ggggccccagggct

SEQ ID NO: 2131531 - DNA, 16 bp, Homo sapiens
ggggccccggggctgg

SEQ ID NO: 2131532 - DNA, 18 bp, Homo sapiens
ggggccccggggctggca

SEQ ID NO: 2131533 - DNA, 18 bp, Homo sapiens
ggggccccggtcctggcc

SEQ ID NO: 2131534 - DNA, 12 bp, Homo sapiens
ggggccctggtc

SEQ ID NO: 2131535 - DNA, 13 bp, Homo sapiens
ggggccgctggcc

SEQ ID NO: 2131536 - DNA, 15 bp, Homo sapiens
ggggccgctggccca

SEQ ID NO: 2131537 - DNA, 16 bp, Homo sapiens
ggggccgggcaggtcc

SEQ ID NO: 2131538 - DNA, 21 bp, Homo sapiens
ggggccgggcaggtcctgccc

SEQ ID NO: 2131539 - DNA, 13 bp, Homo sapiens
ggggcctagggag

SEQ ID NO: 2131540 - DNA, 12 bp, Homo sapiens
ggggcctggcag

SEQ ID NO: 2131541 - DNA, 11 bp, Homo sapiens
ggggcctggct

SEQ ID NO: 2131542 - DNA, 19 bp, Homo sapiens
ggggcctggcttgctccag

SEQ ID NO: 2131543 - DNA, 21 bp, Homo sapiens
ggggcctggcttgctccaggg

SEQ ID NO: 2131544 - DNA, 16 bp, Homo sapiens
ggggcctgggaaagga

SEQ ID NO: 2131545 - DNA, 18 bp, Homo sapiens
ggggcctgggaaaggaaa

SEQ ID NO: 2131546 - DNA, 18 bp, Homo sapiens
ggggcctgtactgcctgc

SEQ ID NO: 2131547 - DNA, 19 bp, Homo sapiens
ggggcgatcaagtccagag

SEQ ID NO: 2131548 - DNA, 20 bp, Homo sapiens
ggggcgctcaggacccaggc

SEQ ID NO: 2131549 - DNA, 11 bp, Homo sapiens
ggggctcctgg

SEQ ID NO: 2131550 - DNA, 21 bp, Homo sapiens
ggggctcctttctccagccag

SEQ ID NO: 2131551 - DNA, 18 bp, Homo sapiens
ggggctgaacggggagaa

SEQ ID NO: 2131552 - DNA, 12 bp, Homo sapiens
ggggctgctggg

SEQ ID NO: 2131553 - DNA, 14 bp, Homo sapiens
ggggctggtccttc

SEQ ID NO: 2131554 - DNA, 21 bp, Homo sapiens
ggggcttctgggtggctcctg

SEQ ID NO: 2131555 - DNA, 17 bp, Homo sapiens
gggggagccaacagcag

SEQ ID NO: 2131556 - DNA, 12 bp, Homo sapiens
gggggccagctg

SEQ ID NO: 2131557 - DNA, 17 bp, Homo sapiens
gggggccagctggtgct

SEQ ID NO: 2131558 - DNA, 18 bp, Homo sapiens
gggggccagctggtgctg

SEQ ID NO: 2131559 - DNA, 23 bp, Homo sapiens
gggggccgctggcccagggtagg

SEQ ID NO: 2131560 - DNA, 14 bp, Homo sapiens
gggggccgggcagg

SEQ ID NO: 2131561 - DNA, 15 bp, Homo sapiens
gggggcctcagtgcc

SEQ ID NO: 2131562 - DNA, 12 bp, Homo sapiens
gggggcctggct

SEQ ID NO: 2131563 - DNA, 15 bp, Homo sapiens
gggggcctggctggc

SEQ ID NO: 2131564 - DNA, 19 bp, Homo sapiens
gggggcctttaaagactta

SEQ ID NO: 2131565 - DNA, 23 bp, Homo sapiens
gggggcgctcaggacccaggccc

SEQ ID NO: 2131566 - DNA, 21 bp, Homo sapiens
gggggctatttctctccccac

SEQ ID NO: 2131567 - DNA, 16 bp, Homo sapiens
gggggtccacccagca

SEQ ID NO: 2131568 - DNA, 12 bp, Homo sapiens
gggggtggcagg

SEQ ID NO: 2131569 - DNA, 12 bp, Homo sapiens
gggggtggccat

SEQ ID NO: 2131570 - DNA, 19 bp, Homo sapiens
ggggtacatttctctgagc

SEQ ID NO: 2131571 - DNA, 14 bp, Homo sapiens
ggggtcaaaggaag

SEQ ID NO: 2131572 - DNA, 15 bp, Homo sapiens
ggggtcctagcccag

SEQ ID NO: 2131573 - DNA, 22 bp, Homo sapiens
ggggtctccctctcctgcctac

SEQ ID NO: 2131574 - DNA, 13 bp, Homo sapiens
ggggtctgtgctg

SEQ ID NO: 2131575 - DNA, 20 bp, Homo sapiens
ggggtctgtgctgtgcctgc

SEQ ID NO: 2131576 - DNA, 23 bp, Homo sapiens
ggggtgacccggcaccccctgca

SEQ ID NO: 2131577 - DNA, 17 bp, Homo sapiens
ggggtgatttcagagag

SEQ ID NO: 2131578 - DNA, 16 bp, Homo sapiens
ggggtgcacaggaggg

SEQ ID NO: 2131579 - DNA, 14 bp, Homo sapiens
ggggtgccctctgg

SEQ ID NO: 2131580 - DNA, 18 bp, Homo sapiens
ggggtgcggcaggagcag

SEQ ID NO: 2131581 - DNA, 17 bp, Homo sapiens
ggggtggggcaggatct

SEQ ID NO: 2131582 - DNA, 15 bp, Homo sapiens
ggggtgtctggaagc

SEQ ID NO: 2131583 - DNA, 16 bp, Homo sapiens
ggggttcagcccctcc

SEQ ID NO: 2131584 - DNA, 23 bp, Homo sapiens
ggggttcagcccctcctctgcca

SEQ ID NO: 2131585 - DNA, 20 bp, Homo sapiens
ggggttctttcttcctctgc

SEQ ID NO: 2131586 - DNA, 17 bp, Homo sapiens
ggggttgcgggggagct

SEQ ID NO: 2131587 - DNA, 21 bp, Homo sapiens
gggtaaaccctcacatcagag

SEQ ID NO: 2131588 - DNA, 12 bp, Homo sapiens
gggtaagacaat

SEQ ID NO: 2131589 - DNA, 19 bp, Homo sapiens
gggtacttgtggacacagc

SEQ ID NO: 2131590 - DNA, 16 bp, Homo sapiens
gggtagggcagcagat

SEQ ID NO: 2131591 - DNA, 12 bp, Homo sapiens
gggtcagccagg

SEQ ID NO: 2131592 - DNA, 14 bp, Homo sapiens
gggtcaggagaggg

SEQ ID NO: 2131593 - DNA, 21 bp, Homo sapiens
gggtcaggcggggtgctgtgg

SEQ ID NO: 2131594 - DNA, 11 bp, Homo sapiens
gggtccaggaa

SEQ ID NO: 2131595 - DNA, 15 bp, Homo sapiens
ggtgccagttatggc

SEQ ID NO: 2131596 - DNA, 15 bp, Homo sapiens
ggtgccatgtggagt

SEQ ID NO: 2131597 - DNA, 12 bp, Homo sapiens
ggtgcccaggag

SEQ ID NO: 2131598 - DNA, 22 bp, Homo sapiens
ggtgccccccttgccagacatg

SEQ ID NO: 2131599 - DNA, 13 bp, Homo sapiens
ggtgccctctgga

SEQ ID NO: 2131600 - DNA, 18 bp, Homo sapiens
ggtgcctcagagcaggct

SEQ ID NO: 2131601 - DNA, 20 bp, Homo sapiens
ggtgcctcagagcaggctca

SEQ ID NO: 2131602 - DNA, 14 bp, Homo sapiens
ggtgcctgagctgg

SEQ ID NO: 2131603 - DNA, 16 bp, Homo sapiens
ggtgcctgcctctgcc

SEQ ID NO: 2131604 - DNA, 18 bp, Homo sapiens
ggtgcctgcctctgccat

SEQ ID NO: 2131605 - DNA, 18 bp, Homo sapiens
ggtgcctgggtggggctg

SEQ ID NO: 2131606 - DNA, 23 bp, Homo sapiens
ggtgcctgggtggggctgctcct

SEQ ID NO: 2131607 - DNA, 17 bp, Homo sapiens
ggtgcctggtgggccac

SEQ ID NO: 2131608 - DNA, 18 bp, Homo sapiens
ggtgcctgtgaggcaggg

SEQ ID NO: 2131609 - DNA, 15 bp, Homo sapiens
ggtgcggcaggagca

SEQ ID NO: 2131610 - DNA, 15 bp, Homo sapiens
ggtgcgtggctgtgg

SEQ ID NO: 2131611 - DNA, 21 bp, Homo sapiens
ggtgctaaatggtcgcccagg

SEQ ID NO: 2131612 - DNA, 23 bp, Homo sapiens
ggtgctaaatggtcgcccaggag

SEQ ID NO: 2131613 - DNA, 19 bp, Homo sapiens
ggtgctacaaaaacacagc

SEQ ID NO: 2131614 - DNA, 21 bp, Homo sapiens
ggtgctacaaaaacacagcaa

SEQ ID NO: 2131615 - DNA, 21 bp, Homo sapiens
ggtgctataggctggagaagc

SEQ ID NO: 2131616 - DNA, 18 bp, Homo sapiens
ggtgctcgcttctcctcc

SEQ ID NO: 2131617 - DNA, 19 bp, Homo sapiens
ggtgctctggcggcttcct

SEQ ID NO: 2131618 - DNA, 14 bp, Homo sapiens
ggtgctgcaaggaa

SEQ ID NO: 2131619 - DNA, 20 bp, Homo sapiens
ggtgctgcaaggaagggtgg

SEQ ID NO: 2131620 - DNA, 21 bp, Homo sapiens
ggtgctgccatccaggttcag

SEQ ID NO: 2131621 - DNA, 16 bp, Homo sapiens
ggtgctgtggccaggg

SEQ ID NO: 2131622 - DNA, 17 bp, Homo sapiens
ggtgctgtggtggggag

SEQ ID NO: 2131623 - DNA, 14 bp, Homo sapiens
ggtgcttctcctct

SEQ ID NO: 2131624 - DNA, 21 bp, Homo sapiens
ggtgctttcaggtctggggct

SEQ ID NO: 2131625 - DNA, 16 bp, Homo sapiens
ggtggacagtcctggg

SEQ ID NO: 2131626 - DNA, 14 bp, Homo sapiens
ggtggacccaggga

SEQ ID NO: 2131627 - DNA, 12 bp, Homo sapiens
ggtggaggagga

SEQ ID NO: 2131628 - DNA, 15 bp, Homo sapiens
ggtggaggaggagga

SEQ ID NO: 2131629 - DNA, 20 bp, Homo sapiens
ggtggaggttgcagtgagct

SEQ ID NO: 2131630 - DNA, 16 bp, Homo sapiens
ggtggatcacctgagg

SEQ ID NO: 2131631 - DNA, 22 bp, Homo sapiens
ggtggatccactgtgcaggagt

SEQ ID NO: 2131632 - DNA, 22 bp, Homo sapiens
ggtggattcctgggcaagaacc

SEQ ID NO: 2131633 - DNA, 20 bp, Homo sapiens
ggtggcacacgcctgtaatc

SEQ ID NO: 2131634 - DNA, 21 bp, Homo sapiens
ggtggcaccagatgcaacctc

SEQ ID NO: 2131635 - DNA, 16 bp, Homo sapiens
ggtggcagagtgagac

SEQ ID NO: 2131636 - DNA, 15 bp, Homo sapiens
ggtggcagccctgta

SEQ ID NO: 2131637 - DNA, 13 bp, Homo sapiens
ggtggcagctgcg

SEQ ID NO: 2131638 - DNA, 15 bp, Homo sapiens
ggtggcagctgcggt

SEQ ID NO: 2131639 - DNA, 22 bp, Homo sapiens
ggtggcaggcacacagcagccc

SEQ ID NO: 2131640 - DNA, 16 bp, Homo sapiens
ggtggcagtgggagct

SEQ ID NO: 2131641 - DNA, 19 bp, Homo sapiens
ggtggcagtgggagctgcc

SEQ ID NO: 2131642 - DNA, 14 bp, Homo sapiens
ggtggccatccctg

SEQ ID NO: 2131643 - DNA, 18 bp, Homo sapiens
ggtggccatccctgggcc

SEQ ID NO: 2131644 - DNA, 19 bp, Homo sapiens
ggtggccatgcttcttgcc

SEQ ID NO: 2131645 - DNA, 18 bp, Homo sapiens
ggtggccccctgtgccag

SEQ ID NO: 2131646 - DNA, 22 bp, Homo sapiens
ggtggcctcgggacacctgccc

SEQ ID NO: 2131647 - DNA, 21 bp, Homo sapiens
ggtggcgactctatagactct

SEQ ID NO: 2131648 - DNA, 16 bp, Homo sapiens
ggtggctactctgtgc

SEQ ID NO: 2131649 - DNA, 23 bp, Homo sapiens
ggtggctactctgtgccagagcc

SEQ ID NO: 2131650 - DNA, 17 bp, Homo sapiens
ggtggctagtcagagag

SEQ ID NO: 2131651 - DNA, 14 bp, Homo sapiens
ggtggctcacacct

SEQ ID NO: 2131652 - DNA, 17 bp, Homo sapiens
ggtggctcttgcctgta

SEQ ID NO: 2131653 - DNA, 14 bp, Homo sapiens
ggtggctgtctctg

SEQ ID NO: 2131654 - DNA, 22 bp, Homo sapiens
ggtgggaaatggtatgagctga

SEQ ID NO: 2131655 - DNA, 15 bp, Homo sapiens
ggtgggaagaaagaa

SEQ ID NO: 2131656 - DNA, 17 bp, Homo sapiens
ggtgggaagcttgctgg

SEQ ID NO: 2131657 - DNA, 18 bp, Homo sapiens
ggtgggacagccccaggg

SEQ ID NO: 2131658 - DNA, 20 bp, Homo sapiens
ggtgggacagccccagggcc

SEQ ID NO: 2131659 - DNA, 21 bp, Homo sapiens
ggtgggacagccccagggccc

SEQ ID NO: 2131660 - DNA, 15 bp, Homo sapiens
ggtgggagagcccag

SEQ ID NO: 2131661 - DNA, 17 bp, Homo sapiens
ggtgggatggaggagaa

SEQ ID NO: 2131662 - DNA, 15 bp, Homo sapiens
ggtgggccactctcc

SEQ ID NO: 2131663 - DNA, 17 bp, Homo sapiens
ggtgggcctggcctgag

SEQ ID NO: 2131664 - DNA, 13 bp, Homo sapiens
ggtggggaatgtt

SEQ ID NO: 2131665 - DNA, 18 bp, Homo sapiens
ggtggggcaatggggaga

SEQ ID NO: 2131666 - DNA, 21 bp, Homo sapiens
ggtggggcaatggggagaggc

SEQ ID NO: 2131667 - DNA, 13 bp, Homo sapiens
ggtggggcagctt

SEQ ID NO: 2131668 - DNA, 18 bp, Homo sapiens
ggtggggctgctcctcca

SEQ ID NO: 2131669 - DNA, 19 bp, Homo sapiens
ggtgggggagaggggagac

SEQ ID NO: 2131670 - DNA, 23 bp, Homo sapiens
ggtgggtccaggaaggcagctgc

SEQ ID NO: 2131671 - DNA, 14 bp, Homo sapiens
ggtggtatgtgtgt

SEQ ID NO: 2131672 - DNA, 18 bp, Homo sapiens
ggtggtcctgagacctga

SEQ ID NO: 2131673 - DNA, 13 bp, Homo sapiens
ggtggtgccagag

SEQ ID NO: 2131674 - DNA, 15 bp, Homo sapiens
ggtggtgccagaggt

SEQ ID NO: 2131675 - DNA, 12 bp, Homo sapiens
ggtggtggagga

SEQ ID NO: 2131676 - DNA, 15 bp, Homo sapiens
ggtgtaatgcacaat

SEQ ID NO: 2131677 - DNA, 21 bp, Homo sapiens
ggtgtaattaataaacgaaga

SEQ ID NO: 2131678 - DNA, 23 bp, Homo sapiens
ggtgtagctcctctgctgctccc

SEQ ID NO: 2131679 - DNA, 18 bp, Homo sapiens
ggtgtaggtaaatctagt

SEQ ID NO: 2131680 - DNA, 19 bp, Homo sapiens
ggtgtcaccctgcagagct

SEQ ID NO: 2131681 - DNA, 12 bp, Homo sapiens
ggtgtcaggcag

SEQ ID NO: 2131682 - DNA, 18 bp, Homo sapiens
ggtgtcattgctgtagga

SEQ ID NO: 2131683 - DNA, 21 bp, Homo sapiens
ggtgtcgctctgctggcctgg

SEQ ID NO: 2131684 - DNA, 20 bp, Homo sapiens
ggtgtctggaagctgagcag

SEQ ID NO: 2131685 - DNA, 20 bp, Homo sapiens
ggtgtgaaagtcagatgccc

SEQ ID NO: 2131686 - DNA, 14 bp, Homo sapiens
ggtgtgcctgccct

SEQ ID NO: 2131687 - DNA, 19 bp, Homo sapiens
ggtgtgcctgccctggagg

SEQ ID NO: 2131688 - DNA, 15 bp, Homo sapiens
ggtgtgcgtgcgtgt

SEQ ID NO: 2131689 - DNA, 20 bp, Homo sapiens
ggtgtgcgtgcgtgtgcgtg

SEQ ID NO: 2131690 - DNA, 13 bp, Homo sapiens
ggtgtgctctgat

SEQ ID NO: 2131691 - DNA, 12 bp, Homo sapiens
ggtgtggcctca

SEQ ID NO: 2131692 - DNA, 14 bp, Homo sapiens
ggtgtggcctcagc

SEQ ID NO: 2131693 - DNA, 18 bp, Homo sapiens
ggtgtggcctcagccctc

SEQ ID NO: 2131694 - DNA, 18 bp, Homo sapiens
ggtgtgtggagatgcaga

SEQ ID NO: 2131695 - DNA, 20 bp, Homo sapiens
ggtgttacacagcccaagag

SEQ ID NO: 2131696 - DNA, 17 bp, Homo sapiens
ggtgttgacatgtgctt

SEQ ID NO: 2131697 - DNA, 22 bp, Homo sapiens
ggtgttgccatttctctgctta

SEQ ID NO: 2131698 - DNA, 17 bp, Homo sapiens
ggttactcagcagcaga

SEQ ID NO: 2131699 - DNA, 16 bp, Homo sapiens
ggttatgcctcatgct

SEQ ID NO: 2131700 - DNA, 22 bp, Homo sapiens
ggttatttttgtccctgctcct

SEQ ID NO: 2131701 - DNA, 19 bp, Homo sapiens
ggttcaagagacactgctt

SEQ ID NO: 2131702 - DNA, 23 bp, Homo sapiens
ggttcaagcgattcttctgcttc

SEQ ID NO: 2131703 - DNA, 13 bp, Homo sapiens
ggttcaccttgcc

SEQ ID NO: 2131704 - DNA, 13 bp, Homo sapiens
ggttcactagagc

SEQ ID NO: 2131705 - DNA, 17 bp, Homo sapiens
ggttcagcccctcctct

SEQ ID NO: 2131706 - DNA, 18 bp, Homo sapiens
ggttccatgcctgagggt

SEQ ID NO: 2131707 - DNA, 14 bp, Homo sapiens
ggttcccaataaaa

SEQ ID NO: 2131708 - DNA, 14 bp, Homo sapiens
ggttcccagcagct

SEQ ID NO: 2131709 - DNA, 19 bp, Homo sapiens
ggttcccccagacagagcc

SEQ ID NO: 2131710 - DNA, 23 bp, Homo sapiens
gtctgcttctgtccaggacatga

SEQ ID NO: 2131711 - DNA, 17 bp, Homo sapiens
gtctgcttttgctgggg

SEQ ID NO: 2131712 - DNA, 19 bp, Homo sapiens
gtctgcttttgctggggta

SEQ ID NO: 2131713 - DNA, 20 bp, Homo sapiens
gtctggaagctgagcaggcc

SEQ ID NO: 2131714 - DNA, 15 bp, Homo sapiens
gtctggaatgcagtg

SEQ ID NO: 2131715 - DNA, 16 bp, Homo sapiens
gtctggaatgcagtgg

SEQ ID NO: 2131716 - DNA, 18 bp, Homo sapiens
gtctggaatgcagtggta

SEQ ID NO: 2131717 - DNA, 14 bp, Homo sapiens
gtctggagaagcag

SEQ ID NO: 2131718 - DNA, 16 bp, Homo sapiens
gtctgggagtgttctg

SEQ ID NO: 2131719 - DNA, 19 bp, Homo sapiens
gtctgggatgtagaacttc

SEQ ID NO: 2131720 - DNA, 15 bp, Homo sapiens
gtctgggcccccact

SEQ ID NO: 2131721 - DNA, 23 bp, Homo sapiens
gtctggggttcagcccctcctct

SEQ ID NO: 2131722 - DNA, 16 bp, Homo sapiens
gtctggttttaacaat

SEQ ID NO: 2131723 - DNA, 18 bp, Homo sapiens
gtctggttttaacaattt

SEQ ID NO: 2131724 - DNA, 14 bp, Homo sapiens
gtctgtaagagaat

SEQ ID NO: 2131725 - DNA, 21 bp, Homo sapiens
gtctgtacacgtgtcctgtag

SEQ ID NO: 2131726 - DNA, 16 bp, Homo sapiens
gtctgtctgtctgtcc

SEQ ID NO: 2131727 - DNA, 12 bp, Homo sapiens
gtctgtgcagct

SEQ ID NO: 2131728 - DNA, 14 bp, Homo sapiens
gtctgtgctgtgcc

SEQ ID NO: 2131729 - DNA, 15 bp, Homo sapiens
gtctgtgctgtgcct

SEQ ID NO: 2131730 - DNA, 16 bp, Homo sapiens
gtctgtgctgtgcctg

SEQ ID NO: 2131731 - DNA, 18 bp, Homo sapiens
gtctgtgctgtgcctgct

SEQ ID NO: 2131732 - DNA, 13 bp, Homo sapiens
gtctgtggatttt

SEQ ID NO: 2131733 - DNA, 21 bp, Homo sapiens
gtcttaattaaaagaatattt

SEQ ID NO: 2131734 - DNA, 22 bp, Homo sapiens
gtcttaattaaaagaatatttt

SEQ ID NO: 2131735 - DNA, 19 bp, Homo sapiens
gtcttagaagtggaccagg

SEQ ID NO: 2131736 - DNA, 22 bp, Homo sapiens
gtcttagaagtggaccaggaca

SEQ ID NO: 2131737 - DNA, 14 bp, Homo sapiens
gtcttatttattat

SEQ ID NO: 2131738 - DNA, 17 bp, Homo sapiens
gtcttcaaattgtcttt

SEQ ID NO: 2131739 - DNA, 13 bp, Homo sapiens
gtcttcacaacag

SEQ ID NO: 2131740 - DNA, 13 bp, Homo sapiens
gtcttcacaacct

SEQ ID NO: 2131741 - DNA, 17 bp, Homo sapiens
gtcttcagcgagaccct

SEQ ID NO: 2131742 - DNA, 13 bp, Homo sapiens
gtcttccaacccc

SEQ ID NO: 2131743 - DNA, 14 bp, Homo sapiens
gtcttccaacccca

SEQ ID NO: 2131744 - DNA, 16 bp, Homo sapiens
gtcttccaaccccagc

SEQ ID NO: 2131745 - DNA, 17 bp, Homo sapiens
gtcttccaaccccagct

SEQ ID NO: 2131746 - DNA, 19 bp, Homo sapiens
gtcttccaaccccagctgg

SEQ ID NO: 2131747 - DNA, 13 bp, Homo sapiens
gtcttccagagcc

SEQ ID NO: 2131748 - DNA, 11 bp, Homo sapiens
gtcttcctcac

SEQ ID NO: 2131749 - DNA, 20 bp, Homo sapiens
gtcttctccaacaccacctc

SEQ ID NO: 2131750 - DNA, 16 bp, Homo sapiens
gtcttcttgtgtcctg

SEQ ID NO: 2131751 - DNA, 19 bp, Homo sapiens
gtcttcttgtgtcctgatg

SEQ ID NO: 2131752 - DNA, 20 bp, Homo sapiens
gtcttgaactcctggcctca

SEQ ID NO: 2131753 - DNA, 18 bp, Homo sapiens
gtcttgcaatggcagcct

SEQ ID NO: 2131754 - DNA, 16 bp, Homo sapiens
gtcttgccagccagaa

SEQ ID NO: 2131755 - DNA, 19 bp, Homo sapiens
gtcttgccagccagaagcc

SEQ ID NO: 2131756 - DNA, 22 bp, Homo sapiens
gtcttgcctgccagggcccctg

SEQ ID NO: 2131757 - DNA, 19 bp, Homo sapiens
gtcttgctatttgagcatg

SEQ ID NO: 2131758 - DNA, 16 bp, Homo sapiens
gtcttgctttgctgtc

SEQ ID NO: 2131759 - DNA, 14 bp, Homo sapiens
gtcttggacactgt

SEQ ID NO: 2131760 - DNA, 21 bp, Homo sapiens
gtcttggccgactcagggacc

SEQ ID NO: 2131761 - DNA, 16 bp, Homo sapiens
gtcttgggctactggc

SEQ ID NO: 2131762 - DNA, 24 bp, Homo sapiens
gtcttgggctactggcagctcctc

SEQ ID NO: 2131763 - DNA, 15 bp, Homo sapiens
gtcttgtacatgtgt

SEQ ID NO: 2131764 - DNA, 16 bp, Homo sapiens
gtctttaatcccagtt

SEQ ID NO: 2131765 - DNA, 16 bp, Homo sapiens
gtctttctccaaagtt

SEQ ID NO: 2131766 - DNA, 15 bp, Homo sapiens
gtctttgaataaagt

SEQ ID NO: 2131767 - DNA, 16 bp, Homo sapiens
gtctttgaataaagtc

SEQ ID NO: 2131768 - DNA, 16 bp, Homo sapiens
gtctttgcacatgtga

SEQ ID NO: 2131769 - DNA, 18 bp, Homo sapiens
gtctttgtaatgtcacca

SEQ ID NO: 2131770 - DNA, 20 bp, Homo sapiens
gtctttgtaatgtcaccacc

SEQ ID NO: 2131771 - DNA, 21 bp, Homo sapiens
gtctttgtaatgtcaccacct

SEQ ID NO: 2131772 - DNA, 16 bp, Homo sapiens
gtctttgttgcaccat

SEQ ID NO: 2131773 - DNA, 20 bp, Homo sapiens
gtcttttccactcctatgga

SEQ ID NO: 2131774 - DNA, 21 bp, Homo sapiens
gtcttttgggagtggcccctg

SEQ ID NO: 2131775 - DNA, 15 bp, Homo sapiens
gtctttttaagctta

SEQ ID NO: 2131776 - DNA, 18 bp, Homo sapiens
gtgaaacaattattgtac

SEQ ID NO: 2131777 - DNA, 20 bp, Homo sapiens
gtgaaacaattattgtacac

SEQ ID NO: 2131778 - DNA, 23 bp, Homo sapiens
gtgaaaccacaggcccttggggt

SEQ ID NO: 2131779 - DNA, 15 bp, Homo sapiens
gtgaaagaattattt

SEQ ID NO: 2131780 - DNA, 15 bp, Homo sapiens
gtgaaagtgtaaaat

SEQ ID NO: 2131781 - DNA, 20 bp, Homo sapiens
gtgaaagtgtaaaatagaat

SEQ ID NO: 2131782 - DNA, 15 bp, Homo sapiens
gtgaaagtgtaatac

SEQ ID NO: 2131783 - DNA, 17 bp, Homo sapiens
gtgaaataccagtgtgg

SEQ ID NO: 2131784 - DNA, 11 bp, Homo sapiens
gtgaaatccag

SEQ ID NO: 2131785 - DNA, 18 bp, Homo sapiens
gtgaaattgatgccagtg

SEQ ID NO: 2131786 - DNA, 13 bp, Homo sapiens
gtgaacacatcag

SEQ ID NO: 2131787 - DNA, 23 bp, Homo sapiens
gtgaaccaaagagactggagcat

SEQ ID NO: 2131788 - DNA, 15 bp, Homo sapiens
gtgaacccaggacaa

SEQ ID NO: 2131789 - DNA, 16 bp, Homo sapiens
gtgaacgatttagaaa

SEQ ID NO: 2131790 - DNA, 18 bp, Homo sapiens
gtgaactgcgtgccagtg

SEQ ID NO: 2131791 - DNA, 18 bp, Homo sapiens
gtgaacttcctttgactt

SEQ ID NO: 2131792 - DNA, 14 bp, Homo sapiens
gtgaagaatacttc

SEQ ID NO: 2131793 - DNA, 23 bp, Homo sapiens
gtgaagaatgaagtggaggaagt

SEQ ID NO: 2131794 - DNA, 16 bp, Homo sapiens
gtgaagacccagcagg

SEQ ID NO: 2131795 - DNA, 15 bp, Homo sapiens
gtgaagacttcttgg

SEQ ID NO: 2131796 - DNA, 19 bp, Homo sapiens
gtgaaggaccctggctctt

SEQ ID NO: 2131797 - DNA, 21 bp, Homo sapiens
gtgaaggagaaaggagccgga

SEQ ID NO: 2131798 - DNA, 14 bp, Homo sapiens
gtgaagggtggggt

SEQ ID NO: 2131799 - DNA, 22 bp, Homo sapiens
gtgaagtccctgttctcagctc

SEQ ID NO: 2131800 - DNA, 20 bp, Homo sapiens
gtgaataaacttcagcacca

SEQ ID NO: 2131801 - DNA, 14 bp, Homo sapiens
gtgaatcagagcac

SEQ ID NO: 2131802 - DNA, 19 bp, Homo sapiens
gtgaattgtgaccaagtta

SEQ ID NO: 2131803 - DNA, 19 bp, Homo sapiens
gtgaatttcttcactgttg

SEQ ID NO: 2131804 - DNA, 18 bp, Homo sapiens
gtgacaaaattggccaga

SEQ ID NO: 2131805 - DNA, 20 bp, Homo sapiens
gtgacaaaattttataagca

SEQ ID NO: 2131806 - DNA, 21 bp, Homo sapiens
gtgacaaattgtaactacact

SEQ ID NO: 2131807 - DNA, 16 bp, Homo sapiens
gtgacaacacttgtgt

SEQ ID NO: 2131808 - DNA, 23 bp, Homo sapiens
gtgacaagctcctggtcttgaga

SEQ ID NO: 2131809 - DNA, 20 bp, Homo sapiens
gtgacacaatcctcaaacat

SEQ ID NO: 2131810 - DNA, 16 bp, Homo sapiens
gtgacacccaagaggg

SEQ ID NO: 2131811 - DNA, 18 bp, Homo sapiens
gtgacacccaagagggct

SEQ ID NO: 2131812 - DNA, 12 bp, Homo sapiens
gtgacagaggca

SEQ ID NO: 2131813 - DNA, 14 bp, Homo sapiens
gtgacagaggcagc

SEQ ID NO: 2131814 - DNA, 18 bp, Homo sapiens
gtgacagaggcagcccca

SEQ ID NO: 2131815 - DNA, 17 bp, Homo sapiens
gtgacaggaaagccctc

SEQ ID NO: 2131816 - DNA, 22 bp, Homo sapiens
gtgacatgggtgtgccaggcta

SEQ ID NO: 2131817 - DNA, 18 bp, Homo sapiens
gtgaccacacgctgtctc

SEQ ID NO: 2131818 - DNA, 15 bp, Homo sapiens
gtgaccccagggcac

SEQ ID NO: 2131819 - DNA, 22 bp, Homo sapiens
gtgaccccagggcacaggagct

SEQ ID NO: 2131820 - DNA, 23 bp, Homo sapiens
gtgaccccagggcacaggagcta

SEQ ID NO: 2131821 - DNA, 12 bp, Homo sapiens
gtgaccccaggt

SEQ ID NO: 2131822 - DNA, 17 bp, Homo sapiens
gtgacccggcaccccct

SEQ ID NO: 2131823 - DNA, 22 bp, Homo sapiens
gtgacccggcaccccctgcagc

SEQ ID NO: 2131824 - DNA, 13 bp, Homo sapiens
gtgaccctctgaa

SEQ ID NO: 2131825 - DNA, 21 bp, Homo sapiens
gtgcacctgtactcaggaggc

SEQ ID NO: 2131826 - DNA, 17 bp, Homo sapiens
gtgcaccttacattcct

SEQ ID NO: 2131827 - DNA, 17 bp, Homo sapiens
gtgcactccctaagaaa

SEQ ID NO: 2131828 - DNA, 18 bp, Homo sapiens
gtgcactggccccaccct

SEQ ID NO: 2131829 - DNA, 15 bp, Homo sapiens
gtgcacttttctgtg

SEQ ID NO: 2131830 - DNA, 22 bp, Homo sapiens
gtgcagaaaaaaaaaaagaaac

SEQ ID NO: 2131831 - DNA, 17 bp, Homo sapiens
gtgcagaggtgagcaga

SEQ ID NO: 2131832 - DNA, 20 bp, Homo sapiens
gtgcagaggtgagcagagga

SEQ ID NO: 2131833 - DNA, 21 bp, Homo sapiens
gtgcagaggtgagcagaggag

SEQ ID NO: 2131834 - DNA, 23 bp, Homo sapiens
gtgcagatgagcagtcacactgt

SEQ ID NO: 2131835 - DNA, 14 bp, Homo sapiens
gtgcagcagcccag

SEQ ID NO: 2131836 - DNA, 19 bp, Homo sapiens
gtgcagcagcccagcttcc

SEQ ID NO: 2131837 - DNA, 13 bp, Homo sapiens
gtgcagcccttcc

SEQ ID NO: 2131838 - DNA, 14 bp, Homo sapiens
gtgcagcccttcct

SEQ ID NO: 2131839 - DNA, 18 bp, Homo sapiens
gtgcagcccttcctcctg

SEQ ID NO: 2131840 - DNA, 21 bp, Homo sapiens
gtgcaggagtggccggggaag

SEQ ID NO: 2131841 - DNA, 19 bp, Homo sapiens
gtgcagtgatacatgtact

SEQ ID NO: 2131842 - DNA, 23 bp, Homo sapiens
gtgcagtggtgcgatctgggttc

SEQ ID NO: 2131843 - DNA, 15 bp, Homo sapiens
gtgcatctcagccca

SEQ ID NO: 2131844 - DNA, 18 bp, Homo sapiens
gtgcatctcagcccacat

SEQ ID NO: 2131845 - DNA, 18 bp, Homo sapiens
gtgcatgctctctgcagc

SEQ ID NO: 2131846 - DNA, 20 bp, Homo sapiens
gtgcatggcttggggagcag

SEQ ID NO: 2131847 - DNA, 18 bp, Homo sapiens
gtgcatgtgtgtgtctgt

SEQ ID NO: 2131848 - DNA, 17 bp, Homo sapiens
gtgcatttatgagctct

SEQ ID NO: 2131849 - DNA, 22 bp, Homo sapiens
gtgccaagtccaggtcctggtg

SEQ ID NO: 2131850 - DNA, 15 bp, Homo sapiens
gtgccaatatgtatt

SEQ ID NO: 2131851 - DNA, 20 bp, Homo sapiens
gtgccaatatgtattgtaaa

SEQ ID NO: 2131852 - DNA, 21 bp, Homo sapiens
gtgccaatatgtattgtaaac

SEQ ID NO: 2131853 - DNA, 15 bp, Homo sapiens
gtgccacagagaaga

SEQ ID NO: 2131854 - DNA, 15 bp, Homo sapiens
gtgccaccaataaaa

SEQ ID NO: 2131855 - DNA, 21 bp, Homo sapiens
gtgccacttcttaaaggcctg

SEQ ID NO: 2131856 - DNA, 23 bp, Homo sapiens
gtgccacttcttaaaggcctgga

SEQ ID NO: 2131857 - DNA, 19 bp, Homo sapiens
gtgccacttgacattcctt

SEQ ID NO: 2131858 - DNA, 12 bp, Homo sapiens
gtgccagagcct

SEQ ID NO: 2131859 - DNA, 15 bp, Homo sapiens
gtgccaggacagctg

SEQ ID NO: 2131860 - DNA, 18 bp, Homo sapiens
gtgccaggacagctggct

SEQ ID NO: 2131861 - DNA, 12 bp, Homo sapiens
gtgccaggcccg

SEQ ID NO: 2131862 - DNA, 19 bp, Homo sapiens
gtgccaggcccggggctgg

SEQ ID NO: 2131863 - DNA, 17 bp, Homo sapiens
gtgccatagtcacatgg

SEQ ID NO: 2131864 - DNA, 19 bp, Homo sapiens
gtgccatgtcaaacaaata

SEQ ID NO: 2131865 - DNA, 16 bp, Homo sapiens
gtgccatgtggagtgg

SEQ ID NO: 2131866 - DNA, 13 bp, Homo sapiens
gtgccattcccag

SEQ ID NO: 2131867 - DNA, 18 bp, Homo sapiens
gtgccatttcctgtctgg

SEQ ID NO: 2131868 - DNA, 20 bp, Homo sapiens
gtgcccaagaatagatgctg

SEQ ID NO: 2131869 - DNA, 20 bp, Homo sapiens
gtgcccacaggatcagtctg

SEQ ID NO: 2131870 - DNA, 13 bp, Homo sapiens
gtgcccgccctgc

SEQ ID NO: 2131871 - DNA, 15 bp, Homo sapiens
gtgcccgccctgccc

SEQ ID NO: 2131872 - DNA, 17 bp, Homo sapiens
gtgcccgccctgcccct

SEQ ID NO: 2131873 - DNA, 19 bp, Homo sapiens
gtgcccgccctgcccctgc

SEQ ID NO: 2131874 - DNA, 22 bp, Homo sapiens
gtgccctctggatcctgctgtg

SEQ ID NO: 2131875 - DNA, 14 bp, Homo sapiens
gtgccctgccccca

SEQ ID NO: 2131876 - DNA, 18 bp, Homo sapiens
gtgccctgcccccatctc

SEQ ID NO: 2131877 - DNA, 18 bp, Homo sapiens
gtgcccttaaaataatga

SEQ ID NO: 2131878 - DNA, 21 bp, Homo sapiens
gtgccgttactctccaacctg

SEQ ID NO: 2131879 - DNA, 20 bp, Homo sapiens
gtgcctaatggagaagaccc

SEQ ID NO: 2131880 - DNA, 14 bp, Homo sapiens
gtgcctcagagcag

SEQ ID NO: 2131881 - DNA, 13 bp, Homo sapiens
gtgcctcctggga

SEQ ID NO: 2131882 - DNA, 22 bp, Homo sapiens
gtgcctcctgggaccatggaca

SEQ ID NO: 2131883 - DNA, 12 bp, Homo sapiens
gtgcctcctgtc

SEQ ID NO: 2131884 - DNA, 15 bp, Homo sapiens
gtgcctcgaggcacc

SEQ ID NO: 2131885 - DNA, 21 bp, Homo sapiens
gtgcctcgctccccactctgc

SEQ ID NO: 2131886 - DNA, 23 bp, Homo sapiens
gtgcctgagctggggcctggaga

SEQ ID NO: 2131887 - DNA, 11 bp, Homo sapiens
gtgcctgcagc

SEQ ID NO: 2131888 - DNA, 14 bp, Homo sapiens
gtgcctgccctgga

SEQ ID NO: 2131889 - DNA, 16 bp, Homo sapiens
gtgcctgctagagcaa

SEQ ID NO: 2131890 - DNA, 18 bp, Homo sapiens
gtgcctgctagagcaacc

SEQ ID NO: 2131891 - DNA, 19 bp, Homo sapiens
gtgcctgctagagcaaccc

SEQ ID NO: 2131892 - DNA, 22 bp, Homo sapiens
gtgcctggacatttgccttgct

SEQ ID NO: 2131893 - DNA, 12 bp, Homo sapiens
gtgcctggcctg

SEQ ID NO: 2131894 - DNA, 17 bp, Homo sapiens
gtgcctgggtggggctg

SEQ ID NO: 2131895 - DNA, 17 bp, Homo sapiens
gtgcctgtgaggcaggg

SEQ ID NO: 2131896 - DNA, 12 bp, Homo sapiens
gtgcctgtggca

SEQ ID NO: 2131897 - DNA, 17 bp, Homo sapiens
gtgccttacctcctgcc

SEQ ID NO: 2131898 - DNA, 18 bp, Homo sapiens
gtgccttacctcctgccc

SEQ ID NO: 2131899 - DNA, 19 bp, Homo sapiens
gtgccttacttaagtcggg

SEQ ID NO: 2131900 - DNA, 12 bp, Homo sapiens
gtgccttcattt

SEQ ID NO: 2131901 - DNA, 12 bp, Homo sapiens
gtgccttccata

SEQ ID NO: 2131902 - DNA, 20 bp, Homo sapiens
gtgccttcgcggtggaaggc

SEQ ID NO: 2131903 - DNA, 19 bp, Homo sapiens
gtgccttcttattctcact

SEQ ID NO: 2131904 - DNA, 16 bp, Homo sapiens
gtgcctttctctggct

SEQ ID NO: 2131905 - DNA, 21 bp, Homo sapiens
gtgcctttctctggctccaga

SEQ ID NO: 2131906 - DNA, 15 bp, Homo sapiens
gtgcgacttcacaaa

SEQ ID NO: 2131907 - DNA, 21 bp, Homo sapiens
gtgcgagagaggtgggcagca

SEQ ID NO: 2131908 - DNA, 14 bp, Homo sapiens
gtgcgcctacagga

SEQ ID NO: 2131909 - DNA, 18 bp, Homo sapiens
gtgcgctcttggtccctg

SEQ ID NO: 2131910 - DNA, 20 bp, Homo sapiens
gtgcggcaggagcaggaaca

SEQ ID NO: 2131911 - DNA, 23 bp, Homo sapiens
gtgcgtgttagtgtgtgtgcatg

SEQ ID NO: 2131912 - DNA, 22 bp, Homo sapiens
gtgcgttggaatcacctggagg

SEQ ID NO: 2131913 - DNA, 13 bp, Homo sapiens
gtgctaaattttc

SEQ ID NO: 2131914 - DNA, 20 bp, Homo sapiens
gtgctaagggtaagggagag

SEQ ID NO: 2131915 - DNA, 19 bp, Homo sapiens
gtgctacctctctcttccc

SEQ ID NO: 2131916 - DNA, 18 bp, Homo sapiens
gtgctataggctggagaa

SEQ ID NO: 2131917 - DNA, 19 bp, Homo sapiens
gtgctataggctggagaag

SEQ ID NO: 2131918 - DNA, 15 bp, Homo sapiens
gtgctattctgtgtt

SEQ ID NO: 2131919 - DNA, 14 bp, Homo sapiens
gtgctattgaactg

SEQ ID NO: 2131920 - DNA, 18 bp, Homo sapiens
gtgctattgaactgagcc

SEQ ID NO: 2131921 - DNA, 13 bp, Homo sapiens
gtgctccccacac

SEQ ID NO: 2131922 - DNA, 14 bp, Homo sapiens
gtgctcgcagcctg

SEQ ID NO: 2131923 - DNA, 15 bp, Homo sapiens
gtgctcgcagcctgg

SEQ ID NO: 2131924 - DNA, 16 bp, Homo sapiens
gtgctcgcagcctggc

SEQ ID NO: 2131925 - DNA, 16 bp, Homo sapiens
gtgctctaggctgccc

SEQ ID NO: 2131926 - DNA, 17 bp, Homo sapiens
gtgctctaggctgcccc

SEQ ID NO: 2131927 - DNA, 13 bp, Homo sapiens
gtgctctggcggc

SEQ ID NO: 2131928 - DNA, 19 bp, Homo sapiens
gtgctctggcggcttcctg

SEQ ID NO: 2131929 - DNA, 11 bp, Homo sapiens
gtgctctgtga

SEQ ID NO: 2131930 - DNA, 18 bp, Homo sapiens
gtgctcttctgttctcaa

SEQ ID NO: 2131931 - DNA, 15 bp, Homo sapiens
gtgctgacctctggt

SEQ ID NO: 2131932 - DNA, 11 bp, Homo sapiens
gtgctgagctt

SEQ ID NO: 2131933 - DNA, 13 bp, Homo sapiens
gtgctgcagccag

SEQ ID NO: 2131934 - DNA, 12 bp, Homo sapiens
gtgctgccatgc

SEQ ID NO: 2131935 - DNA, 21 bp, Homo sapiens
gtgctgccatgccactgccag

SEQ ID NO: 2131936 - DNA, 22 bp, Homo sapiens
gtgctgccatgccactgccagg

SEQ ID NO: 2131937 - DNA, 19 bp, Homo sapiens
gtgctgcccgtcttcagcc

SEQ ID NO: 2131938 - DNA, 13 bp, Homo sapiens
gtgctgccctgct

SEQ ID NO: 2131939 - DNA, 14 bp, Homo sapiens
gtgctgccctgctc

SEQ ID NO: 2131940 - DNA, 19 bp, Homo sapiens
gtggctgacccagtccctg

SEQ ID NO: 2131941 - DNA, 16 bp, Homo sapiens
gtggctgagcttggcc

SEQ ID NO: 2131942 - DNA, 19 bp, Homo sapiens
gtggctgctagcacttgga

SEQ ID NO: 2131943 - DNA, 19 bp, Homo sapiens
gtggcttcccgctcagccc

SEQ ID NO: 2131944 - DNA, 17 bp, Homo sapiens
gtggcttcctccgtctg

SEQ ID NO: 2131945 - DNA, 16 bp, Homo sapiens
gtgggaaagggacccg

SEQ ID NO: 2131946 - DNA, 21 bp, Homo sapiens
gtgggaaagggacccgaagcc

SEQ ID NO: 2131947 - DNA, 12 bp, Homo sapiens
gtgggaacattc

SEQ ID NO: 2131948 - DNA, 14 bp, Homo sapiens
gtgggaaccctccc

SEQ ID NO: 2131949 - DNA, 23 bp, Homo sapiens
gtgggaacgactgggcactgcca

SEQ ID NO: 2131950 - DNA, 17 bp, Homo sapiens
gtgggaacgtgactgcc

SEQ ID NO: 2131951 - DNA, 12 bp, Homo sapiens
gtgggaagagaa

SEQ ID NO: 2131952 - DNA, 14 bp, Homo sapiens
gtgggaagagaagg

SEQ ID NO: 2131953 - DNA, 21 bp, Homo sapiens
gtgggacaaaccagagcagag

SEQ ID NO: 2131954 - DNA, 14 bp, Homo sapiens
gtgggacagcccca

SEQ ID NO: 2131955 - DNA, 19 bp, Homo sapiens
gtgggacagccccagggcc

SEQ ID NO: 2131956 - DNA, 21 bp, Homo sapiens
gtgggagagacactcccaggg

SEQ ID NO: 2131957 - DNA, 14 bp, Homo sapiens
gtgggagcctcgca

SEQ ID NO: 2131958 - DNA, 14 bp, Homo sapiens
gtgggagctgcctg

SEQ ID NO: 2131959 - DNA, 15 bp, Homo sapiens
gtgggagctgcctgt

SEQ ID NO: 2131960 - DNA, 12 bp, Homo sapiens
gtgggaggaaga

SEQ ID NO: 2131961 - DNA, 15 bp, Homo sapiens
gtgggagggagcaga

SEQ ID NO: 2131962 - DNA, 13 bp, Homo sapiens
gtgggagggggag

SEQ ID NO: 2131963 - DNA, 15 bp, Homo sapiens
gtgggagggtaccag

SEQ ID NO: 2131964 - DNA, 16 bp, Homo sapiens
gtgggagggtaccagc

SEQ ID NO: 2131965 - DNA, 17 bp, Homo sapiens
gtgggaggtgagaccac

SEQ ID NO: 2131966 - DNA, 19 bp, Homo sapiens
gtgggatggatgctgggga

SEQ ID NO: 2131967 - DNA, 15 bp, Homo sapiens
gtgggcagcagctca

SEQ ID NO: 2131968 - DNA, 15 bp, Homo sapiens
gtgggcagctgggcc

SEQ ID NO: 2131969 - DNA, 17 bp, Homo sapiens
gtgggcagctgggcccc

SEQ ID NO: 2131970 - DNA, 15 bp, Homo sapiens
gtgggcagggctggg

SEQ ID NO: 2131971 - DNA, 17 bp, Homo sapiens
gtgggccactctcccct

SEQ ID NO: 2131972 - DNA, 20 bp, Homo sapiens
gtgggcctcctctgtccagg

SEQ ID NO: 2131973 - DNA, 23 bp, Homo sapiens
gtgggcctcctctgtccagggcc

SEQ ID NO: 2131974 - DNA, 12 bp, Homo sapiens
gtgggcctggcc

SEQ ID NO: 2131975 - DNA, 13 bp, Homo sapiens
gtgggcctggcct

SEQ ID NO: 2131976 - DNA, 14 bp, Homo sapiens
gtgggctggcccag

SEQ ID NO: 2131977 - DNA, 17 bp, Homo sapiens
gtgggctggcccagcca

SEQ ID NO: 2131978 - DNA, 15 bp, Homo sapiens
gtgggcttggccttg

SEQ ID NO: 2131979 - DNA, 21 bp, Homo sapiens
gtggggaagcaagacgtcctg

SEQ ID NO: 2131980 - DNA, 17 bp, Homo sapiens
gtggggagacctggttg

SEQ ID NO: 2131981 - DNA, 22 bp, Homo sapiens
gtggggagcacttgcgtcctgc

SEQ ID NO: 2131982 - DNA, 17 bp, Homo sapiens
gtggggaggcagctcca

SEQ ID NO: 2131983 - DNA, 17 bp, Homo sapiens
gtggggccccagagagg

SEQ ID NO: 2131984 - DNA, 14 bp, Homo sapiens
gtggggcctgatgg

SEQ ID NO: 2131985 - DNA, 15 bp, Homo sapiens
gtgggggaggtccct

SEQ ID NO: 2131986 - DNA, 18 bp, Homo sapiens
gtgggggcagagggcaga

SEQ ID NO: 2131987 - DNA, 17 bp, Homo sapiens
gtgggggccgctggccc

SEQ ID NO: 2131988 - DNA, 16 bp, Homo sapiens
gtgggggcggctgtgg

SEQ ID NO: 2131989 - DNA, 17 bp, Homo sapiens
gtgggggctgtgccgtg

SEQ ID NO: 2131990 - DNA, 17 bp, Homo sapiens
gtggggtctccctctcc

SEQ ID NO: 2131991 - DNA, 19 bp, Homo sapiens
gtggggtctccctctcctg

SEQ ID NO: 2131992 - DNA, 21 bp, Homo sapiens
gtggggtctccctctcctgcc

SEQ ID NO: 2131993 - DNA, 22 bp, Homo sapiens
gtggggtctccctctcctgcct

SEQ ID NO: 2131994 - DNA, 16 bp, Homo sapiens
gtgggtatttcctgct

SEQ ID NO: 2131995 - DNA, 16 bp, Homo sapiens
gtgggtccaggaaggc

SEQ ID NO: 2131996 - DNA, 19 bp, Homo sapiens
gtgggtctggggagggaga

SEQ ID NO: 2131997 - DNA, 17 bp, Homo sapiens
gtgggtgatcagaaggc

SEQ ID NO: 2131998 - DNA, 18 bp, Homo sapiens
gtgggtggcacctcctga

SEQ ID NO: 2131999 - DNA, 12 bp, Homo sapiens
gtgggtggtgga

SEQ ID NO: 2132000 - DNA, 20 bp, Homo sapiens
gtgggtgtagattacctgcc

SEQ ID NO: 2132001 - DNA, 22 bp, Homo sapiens
gtggtaccagctcactccctgg

SEQ ID NO: 2132002 - DNA, 15 bp, Homo sapiens
gtggtatgtgtgtgt

SEQ ID NO: 2132003 - DNA, 22 bp, Homo sapiens
gtggtcaaaccgcactcaccca

SEQ ID NO: 2132004 - DNA, 14 bp, Homo sapiens
gtggtccagctctt

SEQ ID NO: 2132005 - DNA, 16 bp, Homo sapiens
gtggtccagctcttgg

SEQ ID NO: 2132006 - DNA, 21 bp, Homo sapiens
gtggtctgcttttgctggggt

SEQ ID NO: 2132007 - DNA, 16 bp, Homo sapiens
gtggtctttgaataaa

SEQ ID NO: 2132008 - DNA, 22 bp, Homo sapiens
gtggtctttgaataaagtctga

SEQ ID NO: 2132009 - DNA, 21 bp, Homo sapiens
gtggtgaaggaccctggctct

SEQ ID NO: 2132010 - DNA, 17 bp, Homo sapiens
gtggtgacctctgcctg

SEQ ID NO: 2132011 - DNA, 14 bp, Homo sapiens
gtggtgccagaggt

SEQ ID NO: 2132012 - DNA, 13 bp, Homo sapiens
gtggtggaggagg

SEQ ID NO: 2132013 - DNA, 14 bp, Homo sapiens
gtggttatttctca

SEQ ID NO: 2132014 - DNA, 22 bp, Homo sapiens
gtggttccaagaaagatccacc

SEQ ID NO: 2132015 - DNA, 21 bp, Homo sapiens
gtggtttgatggtgacttcct

SEQ ID NO: 2132016 - DNA, 15 bp, Homo sapiens
gtgtaaagaataaat

SEQ ID NO: 2132017 - DNA, 16 bp, Homo sapiens
gtgtaaagaataaatg

SEQ ID NO: 2132018 - DNA, 15 bp, Homo sapiens
gtgtaagcacttctg

SEQ ID NO: 2132019 - DNA, 17 bp, Homo sapiens
gtgtaatttataaaatt

SEQ ID NO: 2132020 - DNA, 19 bp, Homo sapiens
gtgtacaaagtagagaagt

SEQ ID NO: 2132021 - DNA, 21 bp, Homo sapiens
gtgtacccactcctcactgcc

SEQ ID NO: 2132022 - DNA, 16 bp, Homo sapiens
gtgtacgtatcatttc

SEQ ID NO: 2132023 - DNA, 14 bp, Homo sapiens
gtgtagctcctctg

SEQ ID NO: 2132024 - DNA, 16 bp, Homo sapiens
gtgtagctgtgacctg

SEQ ID NO: 2132025 - DNA, 22 bp, Homo sapiens
gtgtagctgtgacctgctgagc

SEQ ID NO: 2132026 - DNA, 14 bp, Homo sapiens
gtgtagctttgctc

SEQ ID NO: 2132027 - DNA, 21 bp, Homo sapiens
gtgtagtggaagagcagcctg

SEQ ID NO: 2132028 - DNA, 23 bp, Homo sapiens
gtgtagtggaagagcagcctgat

SEQ ID NO: 2132029 - DNA, 14 bp, Homo sapiens
gtgtatatatacat

SEQ ID NO: 2132030 - DNA, 22 bp, Homo sapiens
gtgtatgggtgtgtgtttgtgt

SEQ ID NO: 2132031 - DNA, 12 bp, Homo sapiens
gtgtatgtgtat

SEQ ID NO: 2132032 - DNA, 17 bp, Homo sapiens
gtgtatttgtatgtact

SEQ ID NO: 2132033 - DNA, 23 bp, Homo sapiens
gtgtcacagttcttggtgactgt

SEQ ID NO: 2132034 - DNA, 15 bp, Homo sapiens
gtgtcaccctgcaga

SEQ ID NO: 2132035 - DNA, 18 bp, Homo sapiens
gtgtcaccctgcagagct

SEQ ID NO: 2132036 - DNA, 22 bp, Homo sapiens
gtgtcacctgaagactcattct

SEQ ID NO: 2132037 - DNA, 23 bp, Homo sapiens
gtgtcactttttaaaccactgta

SEQ ID NO: 2132038 - DNA, 20 bp, Homo sapiens
gtgtcagagtaacatgccag

SEQ ID NO: 2132039 - DNA, 18 bp, Homo sapiens
gtgtcaggtggggcagct

SEQ ID NO: 2132040 - DNA, 19 bp, Homo sapiens
gtgtcaggtggggcagctt

SEQ ID NO: 2132041 - DNA, 16 bp, Homo sapiens
gtgtcatcagaagata

SEQ ID NO: 2132042 - DNA, 20 bp, Homo sapiens
gtgtcatctaattaagggaa

SEQ ID NO: 2132043 - DNA, 22 bp, Homo sapiens
gtgtccaattatgcactggcca

SEQ ID NO: 2132044 - DNA, 23 bp, Homo sapiens
gtgtccagaccattgtcttccaa

SEQ ID NO: 2132045 - DNA, 22 bp, Homo sapiens
gtgtccagcagctgcgggtctg

SEQ ID NO: 2132046 - DNA, 12 bp, Homo sapiens
gtgtcccaagct

SEQ ID NO: 2132047 - DNA, 21 bp, Homo sapiens
gtgtcccctcactctgtcagc

SEQ ID NO: 2132048 - DNA, 13 bp, Homo sapiens
gtgtcccctccac

SEQ ID NO: 2132049 - DNA, 13 bp, Homo sapiens
gtgtcctctcccc

SEQ ID NO: 2132050 - DNA, 21 bp, Homo sapiens
gtgtcctgtagttgcgtggac

SEQ ID NO: 2132051 - DNA, 17 bp, Homo sapiens
gtgtccttggggcacag

SEQ ID NO: 2132052 - DNA, 18 bp, Homo sapiens
gtgtccttggggcacagt

SEQ ID NO: 2132053 - DNA, 17 bp, Homo sapiens
gtgtcgagtcaaaatgt

SEQ ID NO: 2132054 - DNA, 23 bp, Homo sapiens
gtgtcgctctgctggcctggccg

SEQ ID NO: 2132055 - DNA, 23 bp, Homo sapiens
gtgtctcaatctgatctgagtga

SEQ ID NO: 2132056 - DNA, 12 bp, Homo sapiens
gtgtctctccca

SEQ ID NO: 2132057 - DNA, 14 bp, Homo sapiens
gtgtctctcccacc

SEQ ID NO: 2132058 - DNA, 20 bp, Homo sapiens
gtgtctctggaacccaggac

SEQ ID NO: 2132059 - DNA, 21 bp, Homo sapiens
gtgtctgcacccaggggtggg

SEQ ID NO: 2132060 - DNA, 15 bp, Homo sapiens
gtgtctgctcagtaa

SEQ ID NO: 2132061 - DNA, 19 bp, Homo sapiens
gtgtctggaagctgagcag

SEQ ID NO: 2132062 - DNA, 12 bp, Homo sapiens
gtgtctgtacac

SEQ ID NO: 2132063 - DNA, 13 bp, Homo sapiens
gtgtctgtacacg

SEQ ID NO: 2132064 - DNA, 11 bp, Homo sapiens
gtgtctgtgtg

SEQ ID NO: 2132065 - DNA, 17 bp, Homo sapiens
gtgtcttgcaatggcag

SEQ ID NO: 2132066 - DNA, 13 bp, Homo sapiens
gtgtgaagaaatg

SEQ ID NO: 2132067 - DNA, 13 bp, Homo sapiens
gtgtgaaggtctt

SEQ ID NO: 2132068 - DNA, 19 bp, Homo sapiens
gtgtgaaggtcttgcctga

SEQ ID NO: 2132069 - DNA, 14 bp, Homo sapiens
gtgtgaataaagtt

SEQ ID NO: 2132070 - DNA, 16 bp, Homo sapiens
gtgtgagtggcagcca

SEQ ID NO: 2132071 - DNA, 18 bp, Homo sapiens
gtgtgagtggcagccatg

SEQ ID NO: 2132072 - DNA, 19 bp, Homo sapiens
gtgtgagtggcagccatgc

SEQ ID NO: 2132073 - DNA, 21 bp, Homo sapiens
gtgtgatgaatagcgaatcat

SEQ ID NO: 2132074 - DNA, 16 bp, Homo sapiens
gtgtgattgaatctga

SEQ ID NO: 2132075 - DNA, 20 bp, Homo sapiens
gtgtgcacaaatatttattt

SEQ ID NO: 2132076 - DNA, 13 bp, Homo sapiens
gtgtgcagactgt

SEQ ID NO: 2132077 - DNA, 13 bp, Homo sapiens
gtgtgcatgtatg

SEQ ID NO: 2132078 - DNA, 14 bp, Homo sapiens
gtgtgcatgtgtgt

SEQ ID NO: 2132079 - DNA, 16 bp, Homo sapiens
gtgtgcatgtgtgtat

SEQ ID NO: 2132080 - DNA, 21 bp, Homo sapiens
gtgtgccatagagtttaacac

SEQ ID NO: 2132081 - DNA, 14 bp, Homo sapiens
gtgtgcctgccctg

SEQ ID NO: 2132082 - DNA, 18 bp, Homo sapiens
gtgtgctgtgctgtgtct

SEQ ID NO: 2132083 - DNA, 13 bp, Homo sapiens
gtgtggcctcagc

SEQ ID NO: 2132084 - DNA, 21 bp, Homo sapiens
gtgtggcctcagccctcagaa

SEQ ID NO: 2132085 - DNA, 22 bp, Homo sapiens
gtgtgggtgatcagaaggctgg

SEQ ID NO: 2132086 - DNA, 23 bp, Homo sapiens
gtgtgggtgatcagaaggctggg

SEQ ID NO: 2132087 - DNA, 15 bp, Homo sapiens
gtgtggtgtgtgtgc

SEQ ID NO: 2132088 - DNA, 14 bp, Homo sapiens
gtgtgtagccaagg

SEQ ID NO: 2132089 - DNA, 22 bp, Homo sapiens
gtgtgtataagtgcacacagaa

SEQ ID NO: 2132090 - DNA, 15 bp, Homo sapiens
gtgtgtctgaagact

SEQ ID NO: 2132091 - DNA, 16 bp, Homo sapiens
gtgtgtctgctcagta

SEQ ID NO: 2132092 - DNA, 18 bp, Homo sapiens
gtgtgtcttttataaaaa

SEQ ID NO: 2132093 - DNA, 14 bp, Homo sapiens
gtgtgtgtgcatgt

SEQ ID NO: 2132094 - DNA, 21 bp, Homo sapiens
gtgtgttctgtaatggaactg

SEQ ID NO: 2132095 - DNA, 15 bp, Homo sapiens
gtgtgtttaaataaa

SEQ ID NO: 2132096 - DNA, 22 bp, Homo sapiens
gtgtgtttaaataaagtatcat

SEQ ID NO: 2132097 - DNA, 22 bp, Homo sapiens
gtgtgtttccagatcgatcctg

SEQ ID NO: 2132098 - DNA, 23 bp, Homo sapiens
gtgtgtttccagatcgatcctgg

SEQ ID NO: 2132099 - DNA, 23 bp, Homo sapiens
gtgttacacagcccaagaggact

SEQ ID NO: 2132100 - DNA, 16 bp, Homo sapiens
gtgttaggaggctgca

SEQ ID NO: 2132101 - DNA, 20 bp, Homo sapiens
gtgttataatgggtaatata

SEQ ID NO: 2132102 - DNA, 14 bp, Homo sapiens
gtgttctattaatc

SEQ ID NO: 2132103 - DNA, 17 bp, Homo sapiens
gtgttctcaatgctttt

SEQ ID NO: 2132104 - DNA, 14 bp, Homo sapiens
gtgttctctcttat

SEQ ID NO: 2132105 - DNA, 22 bp, Homo sapiens
gtgttctgagtacttgatttca

SEQ ID NO: 2132106 - DNA, 12 bp, Homo sapiens
gtgttctgtatt

SEQ ID NO: 2132107 - DNA, 12 bp, Homo sapiens
gtgttctgtttc

SEQ ID NO: 2132108 - DNA, 20 bp, Homo sapiens
gtgttgaagaagagtttgca

SEQ ID NO: 2132109 - DNA, 21 bp, Homo sapiens
gtgttggctaatgaagggaaa

SEQ ID NO: 2132110 - DNA, 21 bp, Homo sapiens
gtgttggctctgctggtcact

SEQ ID NO: 2132111 - DNA, 17 bp, Homo sapiens
gtgttgggaattgcatg

SEQ ID NO: 2132112 - DNA, 15 bp, Homo sapiens
gtgttgtatacttca

SEQ ID NO: 2132113 - DNA, 14 bp, Homo sapiens
gtgttgtctgtgca

SEQ ID NO: 2132114 - DNA, 21 bp, Homo sapiens
gtgtttaaagttcaacatgtt

SEQ ID NO: 2132115 - DNA, 16 bp, Homo sapiens
gtgtttatttttcata

SEQ ID NO: 2132116 - DNA, 20 bp, Homo sapiens
gtgtttatttttcatattgt

SEQ ID NO: 2132117 - DNA, 12 bp, Homo sapiens
gtgtttgtgtga

SEQ ID NO: 2132118 - DNA, 21 bp, Homo sapiens
gttaaaagactgcagctgctg

SEQ ID NO: 2132119 - DNA, 20 bp, Homo sapiens
gttaaaagatgaaaatattt

SEQ ID NO: 2132120 - DNA, 15 bp, Homo sapiens
gttaaaataaagcct

SEQ ID NO: 2132121 - DNA, 22 bp, Homo sapiens
gttaaaataaagcctatttttc

SEQ ID NO: 2132122 - DNA, 19 bp, Homo sapiens
gttaaaatataaattaaga

SEQ ID NO: 2132123 - DNA, 15 bp, Homo sapiens
gttaaaatgtacact

SEQ ID NO: 2132124 - DNA, 15 bp, Homo sapiens
gttaaagctgccggc

SEQ ID NO: 2132125 - DNA, 15 bp, Homo sapiens
gttaaatatttacat

SEQ ID NO: 2132126 - DNA, 16 bp, Homo sapiens
gttaaatatttacata

SEQ ID NO: 2132127 - DNA, 15 bp, Homo sapiens
gttaaatgaaattgt

SEQ ID NO: 2132128 - DNA, 20 bp, Homo sapiens
gttaaatgaaattgtaaaac

SEQ ID NO: 2132129 - DNA, 17 bp, Homo sapiens
gttaaatggagtatttt

SEQ ID NO: 2132130 - DNA, 23 bp, Homo sapiens
gttaacagagacagataactctc

SEQ ID NO: 2132131 - DNA, 20 bp, Homo sapiens
gttaaccagaataaagttct

SEQ ID NO: 2132132 - DNA, 14 bp, Homo sapiens
gttaacttgtatat

SEQ ID NO: 2132133 - DNA, 23 bp, Homo sapiens
gttaactttaagactgagcacct

SEQ ID NO: 2132134 - DNA, 15 bp, Homo sapiens
gttaagacttgacag

SEQ ID NO: 2132135 - DNA, 17 bp, Homo sapiens
gttaagacttgacagtg

SEQ ID NO: 2132136 - DNA, 19 bp, Homo sapiens
gttaagacttgacagtgga

SEQ ID NO: 2132137 - DNA, 20 bp, Homo sapiens
gttaagcaaaggaaaccaaa

SEQ ID NO: 2132138 - DNA, 22 bp, Homo sapiens
gttaaggaccgtggccctgccc

SEQ ID NO: 2132139 - DNA, 13 bp, Homo sapiens
gttaagggaagga

SEQ ID NO: 2132140 - DNA, 17 bp, Homo sapiens
gttaatacttaacattg

SEQ ID NO: 2132141 - DNA, 13 bp, Homo sapiens
gttaatgctttct

SEQ ID NO: 2132142 - DNA, 13 bp, Homo sapiens
gttacagaagctg

SEQ ID NO: 2132143 - DNA, 21 bp, Homo sapiens
gttacagcgagaggcagagaa

SEQ ID NO: 2132144 - DNA, 14 bp, Homo sapiens
gttacatgtttgca

SEQ ID NO: 2132145 - DNA, 13 bp, Homo sapiens
gttacattaatgt

SEQ ID NO: 2132146 - DNA, 16 bp, Homo sapiens
gttacattaatgttaa

SEQ ID NO: 2132147 - DNA, 17 bp, Homo sapiens
gttaccaaagcaatatt

SEQ ID NO: 2132148 - DNA, 18 bp, Homo sapiens
gttaccaaagcaatattt

SEQ ID NO: 2132149 - DNA, 13 bp, Homo sapiens
gttaccatgaaga

SEQ ID NO: 2132150 - DNA, 23 bp, Homo sapiens
gttacctttcccatgctgaatta

SEQ ID NO: 2132151 - DNA, 23 bp, Homo sapiens
gttactaattggcctctttaaga

SEQ ID NO: 2132152 - DNA, 13 bp, Homo sapiens
gttactcagccct

SEQ ID NO: 2132153 - DNA, 16 bp, Homo sapiens
gttactcagccctggg

SEQ ID NO: 2132154 - DNA, 17 bp, Homo sapiens
gttactcagccctgggc

SEQ ID NO: 2132155 - DNA, 22 bp, Homo sapiens
gttactctccaacctggacaac

SEQ ID NO: 2132156 - DNA, 14 bp, Homo sapiens
gttactgattctcc

SEQ ID NO: 2132157 - DNA, 16 bp, Homo sapiens
gttacttcactttaat

SEQ ID NO: 2132158 - DNA, 23 bp, Homo sapiens
gttacttcactttaattctcatg

SEQ ID NO: 2132159 - DNA, 16 bp, Homo sapiens
gttacttgaaatacca

SEQ ID NO: 2132160 - DNA, 19 bp, Homo sapiens
gttacttgaaataccagtg

SEQ ID NO: 2132161 - DNA, 20 bp, Homo sapiens
gttactttttagtcttttac

SEQ ID NO: 2132162 - DNA, 19 bp, Homo sapiens
gttagaaatgcagaatcct

SEQ ID NO: 2132163 - DNA, 20 bp, Homo sapiens
gttagaattttcctaaaaat

SEQ ID NO: 2132164 - DNA, 20 bp, Homo sapiens
gttagagaatatatttttga

SEQ ID NO: 2132165 - DNA, 22 bp, Homo sapiens
gttagagaggtagcgagctgct

SEQ ID NO: 2132166 - DNA, 12 bp, Homo sapiens
gttagctggaca

SEQ ID NO: 2132167 - DNA, 14 bp, Homo sapiens
gttaggaaataaaa

SEQ ID NO: 2132168 - DNA, 21 bp, Homo sapiens
gttaggaaataaaacctttca

SEQ ID NO: 2132169 - DNA, 22 bp, Homo sapiens
gttaggaaataaaacctttcaa

SEQ ID NO: 2132170 - DNA, 20 bp, Homo sapiens
gttctgctgcccctgcagtt

SEQ ID NO: 2132171 - DNA, 13 bp, Homo sapiens
gttctgctggcct

SEQ ID NO: 2132172 - DNA, 16 bp, Homo sapiens
gttctgctggcctgga

SEQ ID NO: 2132173 - DNA, 13 bp, Homo sapiens
gttctggagctgc

SEQ ID NO: 2132174 - DNA, 11 bp, Homo sapiens
gttctgggaca

SEQ ID NO: 2132175 - DNA, 18 bp, Homo sapiens
gttctggggaggaagggc

SEQ ID NO: 2132176 - DNA, 16 bp, Homo sapiens
gttctgtataaaatgc

SEQ ID NO: 2132177 - DNA, 20 bp, Homo sapiens
gttctgtgggcttggccttg

SEQ ID NO: 2132178 - DNA, 15 bp, Homo sapiens
gttctgtgtgggtct

SEQ ID NO: 2132179 - DNA, 17 bp, Homo sapiens
gttctgtgtgggtctgg

SEQ ID NO: 2132180 - DNA, 18 bp, Homo sapiens
gttctgttgtaaagagtg

SEQ ID NO: 2132181 - DNA, 22 bp, Homo sapiens
gttcttacctgtatgtctccag

SEQ ID NO: 2132182 - DNA, 13 bp, Homo sapiens
gttcttgatgtca

SEQ ID NO: 2132183 - DNA, 14 bp, Homo sapiens
gttcttggtgactg

SEQ ID NO: 2132184 - DNA, 18 bp, Homo sapiens
gttcttgtgcatgtttac

SEQ ID NO: 2132185 - DNA, 17 bp, Homo sapiens
gttctttaggtgcctcc

SEQ ID NO: 2132186 - DNA, 21 bp, Homo sapiens
gttctttaggtgcctcctgtc

SEQ ID NO: 2132187 - DNA, 15 bp, Homo sapiens
gttctttctggagtc

SEQ ID NO: 2132188 - DNA, 15 bp, Homo sapiens
gttctttcttcctct

SEQ ID NO: 2132189 - DNA, 13 bp, Homo sapiens
gttgaaaaatcta

SEQ ID NO: 2132190 - DNA, 17 bp, Homo sapiens
gttgaaaagactccaaa

SEQ ID NO: 2132191 - DNA, 17 bp, Homo sapiens
gttgaaaatgagcctgt

SEQ ID NO: 2132192 - DNA, 22 bp, Homo sapiens
gttgaaaatgagcctgtaatcc

SEQ ID NO: 2132193 - DNA, 18 bp, Homo sapiens
gttgaaaattcaaaaagt

SEQ ID NO: 2132194 - DNA, 20 bp, Homo sapiens
gttgaaattatgtatgttta

SEQ ID NO: 2132195 - DNA, 19 bp, Homo sapiens
gttgaacatctcactttgc

SEQ ID NO: 2132196 - DNA, 12 bp, Homo sapiens
gttgaagaagag

SEQ ID NO: 2132197 - DNA, 18 bp, Homo sapiens
gttgaagcaaatcgaatg

SEQ ID NO: 2132198 - DNA, 22 bp, Homo sapiens
gttgaagctaagatttagagat

SEQ ID NO: 2132199 - DNA, 21 bp, Homo sapiens
gttgaaggcagtctgaaccct

SEQ ID NO: 2132200 - DNA, 12 bp, Homo sapiens
gttgacagcagg

SEQ ID NO: 2132201 - DNA, 22 bp, Homo sapiens
gttgacccaaaaatgttccctt

SEQ ID NO: 2132202 - DNA, 17 bp, Homo sapiens
gttgacccctttccccc

SEQ ID NO: 2132203 - DNA, 21 bp, Homo sapiens
gttgacccctttcccccaccc

SEQ ID NO: 2132204 - DNA, 19 bp, Homo sapiens
gttgaccgttttcatcctg

SEQ ID NO: 2132205 - DNA, 19 bp, Homo sapiens
gttgacttgacagaacact

SEQ ID NO: 2132206 - DNA, 14 bp, Homo sapiens
gttgactttcaggt

SEQ ID NO: 2132207 - DNA, 12 bp, Homo sapiens
gttgagacagag

SEQ ID NO: 2132208 - DNA, 19 bp, Homo sapiens
gttgagggaacagacagga

SEQ ID NO: 2132209 - DNA, 20 bp, Homo sapiens
gttgaggtggaagccctcct

SEQ ID NO: 2132210 - DNA, 23 bp, Homo sapiens
gttgagtctcctctctgagactg

SEQ ID NO: 2132211 - DNA, 16 bp, Homo sapiens
gttgagttggacacac

SEQ ID NO: 2132212 - DNA, 20 bp, Homo sapiens
gttgatcactggcaatgaaa

SEQ ID NO: 2132213 - DNA, 12 bp, Homo sapiens
gttgatgaccaa

SEQ ID NO: 2132214 - DNA, 14 bp, Homo sapiens
gttgatgaccaatc

SEQ ID NO: 2132215 - DNA, 14 bp, Homo sapiens
gttgattcccagca

SEQ ID NO: 2132216 - DNA, 23 bp, Homo sapiens
gttgcaaggccgctgttcaccca

SEQ ID NO: 2132217 - DNA, 13 bp, Homo sapiens
gttgcaataaaat

SEQ ID NO: 2132218 - DNA, 14 bp, Homo sapiens
gttgcaataaaata

SEQ ID NO: 2132219 - DNA, 15 bp, Homo sapiens
gttgcaataaaatag

SEQ ID NO: 2132220 - DNA, 23 bp, Homo sapiens
gttgcaataaaatagtattgaaa

SEQ ID NO: 2132221 - DNA, 15 bp, Homo sapiens
gttgcagtctcagaa

SEQ ID NO: 2132222 - DNA, 19 bp, Homo sapiens
gttgcagtctcagaaagcc

SEQ ID NO: 2132223 - DNA, 15 bp, Homo sapiens
gttgcagtgagctga

SEQ ID NO: 2132224 - DNA, 20 bp, Homo sapiens
gttgcattaaaaatgcatat

SEQ ID NO: 2132225 - DNA, 18 bp, Homo sapiens
gttgccacctgttaaaat

SEQ ID NO: 2132226 - DNA, 18 bp, Homo sapiens
gttgccatttctctgctt

SEQ ID NO: 2132227 - DNA, 15 bp, Homo sapiens
gttgcccaggcaggt

SEQ ID NO: 2132228 - DNA, 23 bp, Homo sapiens
gttgcccaggcaggtcttgaact

SEQ ID NO: 2132229 - DNA, 18 bp, Homo sapiens
gttgccttaaagaaagtc

SEQ ID NO: 2132230 - DNA, 18 bp, Homo sapiens
gttgccttagcacttctt

SEQ ID NO: 2132231 - DNA, 18 bp, Homo sapiens
gttgcgggggagctggaa

SEQ ID NO: 2132232 - DNA, 23 bp, Homo sapiens
gttgctgatgaactcttaatcaa

SEQ ID NO: 2132233 - DNA, 20 bp, Homo sapiens
gttgctgattcaagaaacag

SEQ ID NO: 2132234 - DNA, 16 bp, Homo sapiens
gttgctggactgagga

SEQ ID NO: 2132235 - DNA, 12 bp, Homo sapiens
gttgcttcagac

SEQ ID NO: 2132236 - DNA, 14 bp, Homo sapiens
gttgcttctggctc

SEQ ID NO: 2132237 - DNA, 23 bp, Homo sapiens
gttgcttcttctacttcagtctt

SEQ ID NO: 2132238 - DNA, 22 bp, Homo sapiens
gttggaaaagaatacagaaaga

SEQ ID NO: 2132239 - DNA, 14 bp, Homo sapiens
gttggaaccgtgtc

SEQ ID NO: 2132240 - DNA, 21 bp, Homo sapiens
gttggaatcacctggagggct

SEQ ID NO: 2132241 - DNA, 15 bp, Homo sapiens
gttggacagctgctt

SEQ ID NO: 2132242 - DNA, 14 bp, Homo sapiens
gttggatgggaaga

SEQ ID NO: 2132243 - DNA, 16 bp, Homo sapiens
gttggatgggaagatg

SEQ ID NO: 2132244 - DNA, 13 bp, Homo sapiens
gttggcagagaag

SEQ ID NO: 2132245 - DNA, 18 bp, Homo sapiens
gttggcagagaaggcctc

SEQ ID NO: 2132246 - DNA, 19 bp, Homo sapiens
gttggccaggctggtctca

SEQ ID NO: 2132247 - DNA, 14 bp, Homo sapiens
gttggccagtgtga

SEQ ID NO: 2132248 - DNA, 13 bp, Homo sapiens
gttggcctcgcct

SEQ ID NO: 2132249 - DNA, 16 bp, Homo sapiens
gttggcctcgcctggg

SEQ ID NO: 2132250 - DNA, 17 bp, Homo sapiens
gttggcctcgcctgggc

SEQ ID NO: 2132251 - DNA, 18 bp, Homo sapiens
gttggcctcgcctgggcc

SEQ ID NO: 2132252 - DNA, 17 bp, Homo sapiens
gttggggtggggcagga

SEQ ID NO: 2132253 - DNA, 11 bp, Homo sapiens
gttggtgactg

SEQ ID NO: 2132254 - DNA, 12 bp, Homo sapiens
gttggtgactga

SEQ ID NO: 2132255 - DNA, 15 bp, Homo sapiens
gttggttctgcacta

SEQ ID NO: 2132256 - DNA, 16 bp, Homo sapiens
gttggttggggtgggg

SEQ ID NO: 2132257 - DNA, 19 bp, Homo sapiens
gttggttggggtggggcag

SEQ ID NO: 2132258 - DNA, 19 bp, Homo sapiens
gttggtttccaaaaaggaa

SEQ ID NO: 2132259 - DNA, 16 bp, Homo sapiens
gttgtaaacaggaagc

SEQ ID NO: 2132260 - DNA, 21 bp, Homo sapiens
gttgtaaatgaccaagaaaaa

SEQ ID NO: 2132261 - DNA, 21 bp, Homo sapiens
gttgtactattgtttaaaaac

SEQ ID NO: 2132262 - DNA, 19 bp, Homo sapiens
gttgtactttttattcaat

SEQ ID NO: 2132263 - DNA, 19 bp, Homo sapiens
gttgtcaatattaaataca

SEQ ID NO: 2132264 - DNA, 21 bp, Homo sapiens
gttgtcaatattaaatacaga

SEQ ID NO: 2132265 - DNA, 18 bp, Homo sapiens
gttgtccatattttcaca

SEQ ID NO: 2132266 - DNA, 18 bp, Homo sapiens
gttgtctattctgagcct

SEQ ID NO: 2132267 - DNA, 20 bp, Homo sapiens
gttgtctattctgagccttg

SEQ ID NO: 2132268 - DNA, 14 bp, Homo sapiens
gttgtctgtgcagc

SEQ ID NO: 2132269 - DNA, 16 bp, Homo sapiens
gttgtgattttgtaca

SEQ ID NO: 2132270 - DNA, 17 bp, Homo sapiens
gttgtgattttgtacag

SEQ ID NO: 2132271 - DNA, 19 bp, Homo sapiens
gttgtgattttgtacagaa

SEQ ID NO: 2132272 - DNA, 17 bp, Homo sapiens
gttgtggatgctccagg

SEQ ID NO: 2132273 - DNA, 14 bp, Homo sapiens
gttgtgtatagatg

SEQ ID NO: 2132274 - DNA, 20 bp, Homo sapiens
gttgtgttaacaatgcagta

SEQ ID NO: 2132275 - DNA, 14 bp, Homo sapiens
gttgttaatgttgg

SEQ ID NO: 2132276 - DNA, 16 bp, Homo sapiens
gttgttactgattctc

SEQ ID NO: 2132277 - DNA, 13 bp, Homo sapiens
gttgttatgctat

SEQ ID NO: 2132278 - DNA, 15 bp, Homo sapiens
gttgttcccacacac

SEQ ID NO: 2132279 - DNA, 16 bp, Homo sapiens
gttgttcttgatgaca

SEQ ID NO: 2132280 - DNA, 14 bp, Homo sapiens
gtttaaaaaaagta

SEQ ID NO: 2132281 - DNA, 18 bp, Homo sapiens
gtttaaaaaaagtatata

SEQ ID NO: 2132282 - DNA, 20 bp, Homo sapiens
gtttaaaaaaagtatatatt

SEQ ID NO: 2132283 - DNA, 13 bp, Homo sapiens
gtttaaaaaatac

SEQ ID NO: 2132284 - DNA, 16 bp, Homo sapiens
gtttaaaaacaggaaa

SEQ ID NO: 2132285 - DNA, 21 bp, Homo sapiens
gtttttaagggtttgtggaaa

SEQ ID NO: 2132286 - DNA, 15 bp, Homo sapiens
gtttttaagtcctgt

SEQ ID NO: 2132287 - DNA, 17 bp, Homo sapiens
gtttttactttctgttg

SEQ ID NO: 2132288 - DNA, 21 bp, Homo sapiens
gtttttatgaagaaaaaatac

SEQ ID NO: 2132289 - DNA, 16 bp, Homo sapiens
gtttttatggggctga

SEQ ID NO: 2132290 - DNA, 19 bp, Homo sapiens
gtttttctacttttaaaga

SEQ ID NO: 2132291 - DNA, 16 bp, Homo sapiens
gtttttgaaaagctaa

SEQ ID NO: 2132292 - DNA, 12 bp, Homo sapiens
gtttttgaagaa

SEQ ID NO: 2132293 - DNA, 21 bp, Homo sapiens
gtttttgaagaagggaaattc

SEQ ID NO: 2132294 - DNA, 18 bp, Homo sapiens
gttttttttaaataaaag

SEQ ID NO: 2132295 - DNA, 18 bp, Homo sapiens
taaaaaaagtatatattc

SEQ ID NO: 2132296 - DNA, 12 bp, Homo sapiens
taaaaaaataca

SEQ ID NO: 2132297 - DNA, 14 bp, Homo sapiens
taaaaaaatacagt

SEQ ID NO: 2132298 - DNA, 16 bp, Homo sapiens
taaaaaaatacagtaa

SEQ ID NO: 2132299 - DNA, 20 bp, Homo sapiens
taaaaaaatacagtaaagtt

SEQ ID NO: 2132300 - DNA, 15 bp, Homo sapiens
taaaaaacttgtaaa

SEQ ID NO: 2132301 - DNA, 17 bp, Homo sapiens
taaaaaagcttaaaact

SEQ ID NO: 2132302 - DNA, 13 bp, Homo sapiens
taaaaaatgtcca

SEQ ID NO: 2132303 - DNA, 21 bp, Homo sapiens
taaaaacaaaaacaaaaccag

SEQ ID NO: 2132304 - DNA, 18 bp, Homo sapiens
taaaaacaaagaaataaa

SEQ ID NO: 2132305 - DNA, 13 bp, Homo sapiens
taaaaacataaaa

SEQ ID NO: 2132306 - DNA, 17 bp, Homo sapiens
taaaaacataaaatata

SEQ ID NO: 2132307 - DNA, 12 bp, Homo sapiens
taaaaacatgag

SEQ ID NO: 2132308 - DNA, 18 bp, Homo sapiens
taaaaacatgagaaatgt

SEQ ID NO: 2132309 - DNA, 11 bp, Homo sapiens
taaaaacattc

SEQ ID NO: 2132310 - DNA, 17 bp, Homo sapiens
taaaaaccaatcatttt

SEQ ID NO: 2132311 - DNA, 17 bp, Homo sapiens
taaaaaccagaatcata

SEQ ID NO: 2132312 - DNA, 19 bp, Homo sapiens
taaaaaccagaatcataat

SEQ ID NO: 2132313 - DNA, 21 bp, Homo sapiens
taaaaaccagaatcataattt

SEQ ID NO: 2132314 - DNA, 13 bp, Homo sapiens
taaaaaccctgta

SEQ ID NO: 2132315 - DNA, 17 bp, Homo sapiens
taaaaactgactcctta

SEQ ID NO: 2132316 - DNA, 16 bp, Homo sapiens
taaaaactgagtgact

SEQ ID NO: 2132317 - DNA, 23 bp, Homo sapiens
taaaaagaaaagataaagatgat

SEQ ID NO: 2132318 - DNA, 20 bp, Homo sapiens
taaaaagagagaaaacttat

SEQ ID NO: 2132319 - DNA, 21 bp, Homo sapiens
taaaaagaggatgatttcaga

SEQ ID NO: 2132320 - DNA, 23 bp, Homo sapiens
taaaaaggatgaaagtctgagaa

SEQ ID NO: 2132321 - DNA, 14 bp, Homo sapiens
taaaaataaagcta

SEQ ID NO: 2132322 - DNA, 17 bp, Homo sapiens
taaaaataaagctactg

SEQ ID NO: 2132323 - DNA, 19 bp, Homo sapiens
taaaaataaagctactgaa

SEQ ID NO: 2132324 - DNA, 22 bp, Homo sapiens
taaaaataaagctactgaattt

SEQ ID NO: 2132325 - DNA, 11 bp, Homo sapiens
taaaaatcata

SEQ ID NO: 2132326 - DNA, 20 bp, Homo sapiens
taaaaatcataaactgtgtg

SEQ ID NO: 2132327 - DNA, 24 bp, Homo sapiens
taaaacaaggcttaaaagagtaga

SEQ ID NO: 2132328 - DNA, 23 bp, Homo sapiens
taaaacacagatttttgggctcc

SEQ ID NO: 2132329 - DNA, 11 bp, Homo sapiens
taaaacattcc

SEQ ID NO: 2132330 - DNA, 20 bp, Homo sapiens
taaaacatttattttgacat

SEQ ID NO: 2132331 - DNA, 14 bp, Homo sapiens
taaaaccacagcag

SEQ ID NO: 2132332 - DNA, 12 bp, Homo sapiens
taaaaccatgca

SEQ ID NO: 2132333 - DNA, 19 bp, Homo sapiens
taaaaccatgcagcttcat

SEQ ID NO: 2132334 - DNA, 19 bp, Homo sapiens
taaaaccccatctctacta

SEQ ID NO: 2132335 - DNA, 18 bp, Homo sapiens
taaaacctagaacttcaa

SEQ ID NO: 2132336 - DNA, 23 bp, Homo sapiens
taaaacctcagggacaacatttt

SEQ ID NO: 2132337 - DNA, 14 bp, Homo sapiens
taaaaccttactta

SEQ ID NO: 2132338 - DNA, 18 bp, Homo sapiens
taaaaccttacttaaagc

SEQ ID NO: 2132339 - DNA, 11 bp, Homo sapiens
taaaacctttc

SEQ ID NO: 2132340 - DNA, 13 bp, Homo sapiens
taaaacctttcaa

SEQ ID NO: 2132341 - DNA, 20 bp, Homo sapiens
taaaactggtttagcacaat

SEQ ID NO: 2132342 - DNA, 14 bp, Homo sapiens
taaaacttaaaact

SEQ ID NO: 2132343 - DNA, 18 bp, Homo sapiens
taaaacttatgctagttt

SEQ ID NO: 2132344 - DNA, 13 bp, Homo sapiens
taaaacttgctgc

SEQ ID NO: 2132345 - DNA, 14 bp, Homo sapiens
taaaactttgaagt

SEQ ID NO: 2132346 - DNA, 17 bp, Homo sapiens
taaaagaaactttcttt

SEQ ID NO: 2132347 - DNA, 15 bp, Homo sapiens
taaaagaaatttatt

SEQ ID NO: 2132348 - DNA, 23 bp, Homo sapiens
taaaagaatattttaacttcctt

SEQ ID NO: 2132349 - DNA, 17 bp, Homo sapiens
taaaagcaaaaaagaaa

SEQ ID NO: 2132350 - DNA, 11 bp, Homo sapiens
taaaagcagca

SEQ ID NO: 2132351 - DNA, 20 bp, Homo sapiens
taaaagcagcatctgctaat

SEQ ID NO: 2132352 - DNA, 21 bp, Homo sapiens
taaaagcagcatctgctaata

SEQ ID NO: 2132353 - DNA, 16 bp, Homo sapiens
taaaaggagagaagaa

SEQ ID NO: 2132354 - DNA, 19 bp, Homo sapiens
taaaagtgttgattacata

SEQ ID NO: 2132355 - DNA, 22 bp, Homo sapiens
taaaagttaaactacttgtaaa

SEQ ID NO: 2132356 - DNA, 12 bp, Homo sapiens
taaaagttactt

SEQ ID NO: 2132357 - DNA, 19 bp, Homo sapiens
taaaagttgggaaaagtgt

SEQ ID NO: 2132358 - DNA, 14 bp, Homo sapiens
taaaagttgtgatt

SEQ ID NO: 2132359 - DNA, 14 bp, Homo sapiens
taaaataaaaacca

SEQ ID NO: 2132360 - DNA, 23 bp, Homo sapiens
taaaataaagcctatttttcaaa

SEQ ID NO: 2132361 - DNA, 13 bp, Homo sapiens
taaaataaagtat

SEQ ID NO: 2132362 - DNA, 13 bp, Homo sapiens
taaaataaataaa

SEQ ID NO: 2132363 - DNA, 24 bp, Homo sapiens
taaaataactagtgttgcttggac

SEQ ID NO: 2132364 - DNA, 14 bp, Homo sapiens
taaaataatgattt

SEQ ID NO: 2132365 - DNA, 22 bp, Homo sapiens
taaaataatgatttaagcattt

SEQ ID NO: 2132366 - DNA, 21 bp, Homo sapiens
taaaatacacactcaaatcaa

SEQ ID NO: 2132367 - DNA, 23 bp, Homo sapiens
taaaatagatcctaggtgctgga

SEQ ID NO: 2132368 - DNA, 16 bp, Homo sapiens
taaaatagcaaaagaa

SEQ ID NO: 2132369 - DNA, 15 bp, Homo sapiens
taaaatagccactta

SEQ ID NO: 2132370 - DNA, 18 bp, Homo sapiens
taaaatagcttgtatagt

SEQ ID NO: 2132371 - DNA, 19 bp, Homo sapiens
taaaatagtattgaaagtg

SEQ ID NO: 2132372 - DNA, 20 bp, Homo sapiens
taaaatatacaaacatgtgg

SEQ ID NO: 2132373 - DNA, 18 bp, Homo sapiens
taaaatatatataaatat

SEQ ID NO: 2132374 - DNA, 19 bp, Homo sapiens
taaaatatatataaatata

SEQ ID NO: 2132375 - DNA, 20 bp, Homo sapiens
taaaatcaggattttagtgc

SEQ ID NO: 2132376 - DNA, 20 bp, Homo sapiens
taaaatcattcaatatctga

SEQ ID NO: 2132377 - DNA, 21 bp, Homo sapiens
taaaatctgatttaatgtttt

SEQ ID NO: 2132378 - DNA, 16 bp, Homo sapiens
taaaatctggaaatct

SEQ ID NO: 2132379 - DNA, 21 bp, Homo sapiens
taaaatctggcaaagttatat

SEQ ID NO: 2132380 - DNA, 16 bp, Homo sapiens
taaaatgaaagggtca

SEQ ID NO: 2132381 - DNA, 14 bp, Homo sapiens
taaaatgaaattac

SEQ ID NO: 2132382 - DNA, 17 bp, Homo sapiens
taaaatgattgtaaaat

SEQ ID NO: 2132383 - DNA, 18 bp, Homo sapiens
taaaatgattgtaaaata

SEQ ID NO: 2132384 - DNA, 20 bp, Homo sapiens
taaaatgattgtaaaatagc

SEQ ID NO: 2132385 - DNA, 22 bp, Homo sapiens
taaaatgattgtaaaatagctt

SEQ ID NO: 2132386 - DNA, 19 bp, Homo sapiens
taaaatgcagtccagaata

SEQ ID NO: 2132387 - DNA, 20 bp, Homo sapiens
taaaatgcagtccagaataa

SEQ ID NO: 2132388 - DNA, 20 bp, Homo sapiens
taaaatgcccatttcgaaga

SEQ ID NO: 2132389 - DNA, 20 bp, Homo sapiens
taaaattagtgagatttgta

SEQ ID NO: 2132390 - DNA, 21 bp, Homo sapiens
taaaattagtgagatttgtat

SEQ ID NO: 2132391 - DNA, 19 bp, Homo sapiens
taaaattatttttattaaa

SEQ ID NO: 2132392 - DNA, 17 bp, Homo sapiens
taaaattcttgggagtg

SEQ ID NO: 2132393 - DNA, 17 bp, Homo sapiens
taaaattgctagtgatt

SEQ ID NO: 2132394 - DNA, 22 bp, Homo sapiens
taaaattggtaattgaatggaa

SEQ ID NO: 2132395 - DNA, 14 bp, Homo sapiens
taaaattgtaaaat

SEQ ID NO: 2132396 - DNA, 16 bp, Homo sapiens
taaaattgtaaaattg

SEQ ID NO: 2132397 - DNA, 19 bp, Homo sapiens
taaaattgtaaaattgtat

SEQ ID NO: 2132398 - DNA, 23 bp, Homo sapiens
taaaattgtgatgttttgttcaa

SEQ ID NO: 2132399 - DNA, 13 bp, Homo sapiens
taaataaattgtt

SEQ ID NO: 2132400 - DNA, 13 bp, Homo sapiens
taaataagaaact

SEQ ID NO: 2132401 - DNA, 16 bp, Homo sapiens
taaataagaaactttt

SEQ ID NO: 2132402 - DNA, 18 bp, Homo sapiens
taaatacacaacacacac

SEQ ID NO: 2132403 - DNA, 23 bp, Homo sapiens
taaatacaccacctcactcctgt

SEQ ID NO: 2132404 - DNA, 22 bp, Homo sapiens
taaatacagacactaagttata

SEQ ID NO: 2132405 - DNA, 13 bp, Homo sapiens
taaatacatgtgt

SEQ ID NO: 2132406 - DNA, 17 bp, Homo sapiens
taaatactgatatttca

SEQ ID NO: 2132407 - DNA, 22 bp, Homo sapiens
taaatagagttccaaataagga

SEQ ID NO: 2132408 - DNA, 18 bp, Homo sapiens
taaatagatttgattatt

SEQ ID NO: 2132409 - DNA, 22 bp, Homo sapiens
taaatagatttgattatttcct

SEQ ID NO: 2132410 - DNA, 18 bp, Homo sapiens
taaatagtaggaccaatg

SEQ ID NO: 2132411 - DNA, 21 bp, Homo sapiens
taaatagtaggaccaatgttg

SEQ ID NO: 2132412 - DNA, 12 bp, Homo sapiens
taaatagtattt

SEQ ID NO: 2132413 - DNA, 21 bp, Homo sapiens
taaatagttcagtataaattg

SEQ ID NO: 2132414 - DNA, 18 bp, Homo sapiens
taaatataattgggattt

SEQ ID NO: 2132415 - DNA, 18 bp, Homo sapiens
taaatatatatttttcaa

SEQ ID NO: 2132416 - DNA, 21 bp, Homo sapiens
taaatatatatttttcaacca

SEQ ID NO: 2132417 - DNA, 11 bp, Homo sapiens
taaatatatgt

SEQ ID NO: 2132418 - DNA, 22 bp, Homo sapiens
taaatatatttaagataattat

SEQ ID NO: 2132419 - DNA, 14 bp, Homo sapiens
taaatatgaaatga

SEQ ID NO: 2132420 - DNA, 21 bp, Homo sapiens
taaatatgaaatgataaagat

SEQ ID NO: 2132421 - DNA, 14 bp, Homo sapiens
taaatatgaacaaa

SEQ ID NO: 2132422 - DNA, 21 bp, Homo sapiens
taaatatttacatatgaaatt

SEQ ID NO: 2132423 - DNA, 14 bp, Homo sapiens
taaatatttatgct

SEQ ID NO: 2132424 - DNA, 14 bp, Homo sapiens
taaatatttcatga

SEQ ID NO: 2132425 - DNA, 10 bp, Homo sapiens
taaatatttt

SEQ ID NO: 2132426 - DNA, 19 bp, Homo sapiens
taaatcaaaagctgcttga

SEQ ID NO: 2132427 - DNA, 14 bp, Homo sapiens
taaatcaatgtcac

SEQ ID NO: 2132428 - DNA, 18 bp, Homo sapiens
taaatcacgctttttgaa

SEQ ID NO: 2132429 - DNA, 17 bp, Homo sapiens
taaatcactgaggcatt

SEQ ID NO: 2132430 - DNA, 23 bp, Homo sapiens
taaatcacttgtaaataaataga

SEQ ID NO: 2132431 - DNA, 13 bp, Homo sapiens
taaatccaaagaa

SEQ ID NO: 2132432 - DNA, 14 bp, Homo sapiens
taaatccaaagtaa

SEQ ID NO: 2132433 - DNA, 11 bp, Homo sapiens
taaatccacag

SEQ ID NO: 2132434 - DNA, 15 bp, Homo sapiens
taaatccacagccaa

SEQ ID NO: 2132435 - DNA, 13 bp, Homo sapiens
taaatccttattt

SEQ ID NO: 2132436 - DNA, 13 bp, Homo sapiens
taaatcttttata

SEQ ID NO: 2132437 - DNA, 18 bp, Homo sapiens
taaatgaaaatcgtgaca

SEQ ID NO: 2132438 - DNA, 14 bp, Homo sapiens
taaatgaaattgta

SEQ ID NO: 2132439 - DNA, 16 bp, Homo sapiens
taaatgaaattgtaaa

SEQ ID NO: 2132440 - DNA, 23 bp, Homo sapiens
taaatgaagaaagggaggcccag

SEQ ID NO: 2132441 - DNA, 20 bp, Homo sapiens
taaatgaagagacttaagaa

SEQ ID NO: 2132442 - DNA, 15 bp, Homo sapiens
taaatgaccaagaaa

SEQ ID NO: 2132443 - DNA, 12 bp, Homo sapiens
taaatgacctca

SEQ ID NO: 2132444 - DNA, 16 bp, Homo sapiens
taaatgacctcagcaa

SEQ ID NO: 2132445 - DNA, 19 bp, Homo sapiens
taaatgacctcagcaaatc

SEQ ID NO: 2132446 - DNA, 14 bp, Homo sapiens
taaatgagctcctg

SEQ ID NO: 2132447 - DNA, 16 bp, Homo sapiens
taaatgcaaacactgt

SEQ ID NO: 2132448 - DNA, 11 bp, Homo sapiens
taaatgcaata

SEQ ID NO: 2132449 - DNA, 14 bp, Homo sapiens
taaatgcaatatgt

SEQ ID NO: 2132450 - DNA, 15 bp, Homo sapiens
taaatgcaatatgta

SEQ ID NO: 2132451 - DNA, 22 bp, Homo sapiens
taaatgcagcgaaccaatattt

SEQ ID NO: 2132452 - DNA, 16 bp, Homo sapiens
taaatgcataaatgca

SEQ ID NO: 2132453 - DNA, 20 bp, Homo sapiens
taaatgcatgattttataca

SEQ ID NO: 2132454 - DNA, 19 bp, Homo sapiens
taaatgccaacataccctt

SEQ ID NO: 2132455 - DNA, 14 bp, Homo sapiens
taaatgcccagttc

SEQ ID NO: 2132456 - DNA, 17 bp, Homo sapiens
taaatgcccagttcact

SEQ ID NO: 2132457 - DNA, 16 bp, Homo sapiens
taaatggagcttgtac

SEQ ID NO: 2132458 - DNA, 22 bp, Homo sapiens
taaatggtgggaaccctcccca

SEQ ID NO: 2132459 - DNA, 16 bp, Homo sapiens
taaatgtaggtatgaa

SEQ ID NO: 2132460 - DNA, 14 bp, Homo sapiens
taaatgtcttatat

SEQ ID NO: 2132461 - DNA, 16 bp, Homo sapiens
taaatgtgccttcatt

SEQ ID NO: 2132462 - DNA, 16 bp, Homo sapiens
taaatgtgcttttaaa

SEQ ID NO: 2132463 - DNA, 12 bp, Homo sapiens
taaatgtgtaaa

SEQ ID NO: 2132464 - DNA, 14 bp, Homo sapiens
taaatgtgtaaatg

SEQ ID NO: 2132465 - DNA, 17 bp, Homo sapiens
taaatgtgtaaatgtgg

SEQ ID NO: 2132466 - DNA, 18 bp, Homo sapiens
taaatgtgtattctggct

SEQ ID NO: 2132467 - DNA, 12 bp, Homo sapiens
taaatgtgtggt

SEQ ID NO: 2132468 - DNA, 19 bp, Homo sapiens
taaatgttggaattttcaa

SEQ ID NO: 2132469 - DNA, 20 bp, Homo sapiens
taaatgttggaattttcaaa

SEQ ID NO: 2132470 - DNA, 13 bp, Homo sapiens
taaatgttttaca

SEQ ID NO: 2132471 - DNA, 13 bp, Homo sapiens
taaattaagactt

SEQ ID NO: 2132472 - DNA, 19 bp, Homo sapiens
taaattaatacttcatttg

SEQ ID NO: 2132473 - DNA, 22 bp, Homo sapiens
taaattacattaaaacaaaaaa

SEQ ID NO: 2132474 - DNA, 16 bp, Homo sapiens
taaattataagatgtc

SEQ ID NO: 2132475 - DNA, 17 bp, Homo sapiens
taaattataagatgtca

SEQ ID NO: 2132476 - DNA, 13 bp, Homo sapiens
taaattatttcat

SEQ ID NO: 2132477 - DNA, 23 bp, Homo sapiens
taaattcaaccactgtaaaatga

SEQ ID NO: 2132478 - DNA, 18 bp, Homo sapiens
taaattcagatatatttt

SEQ ID NO: 2132479 - DNA, 20 bp, Homo sapiens
taaattcagatatatttttc

SEQ ID NO: 2132480 - DNA, 13 bp, Homo sapiens
taaattccactgg

SEQ ID NO: 2132481 - DNA, 16 bp, Homo sapiens
taaattccactggact

SEQ ID NO: 2132482 - DNA, 13 bp, Homo sapiens
taaattctttatt

SEQ ID NO: 2132483 - DNA, 13 bp, Homo sapiens
taaattgaaatat

SEQ ID NO: 2132484 - DNA, 20 bp, Homo sapiens
taaattgaaatataatgcaa

SEQ ID NO: 2132485 - DNA, 16 bp, Homo sapiens
taaattgcttattcta

SEQ ID NO: 2132486 - DNA, 23 bp, Homo sapiens
taaattgcttttgttgtgacttt

SEQ ID NO: 2132487 - DNA, 22 bp, Homo sapiens
taaattggtgataagtggaaaa

SEQ ID NO: 2132488 - DNA, 17 bp, Homo sapiens
taaattgtaaattttag

SEQ ID NO: 2132489 - DNA, 20 bp, Homo sapiens
taaatttaataaaaacttca

SEQ ID NO: 2132490 - DNA, 14 bp, Homo sapiens
taaatttgtaccta

SEQ ID NO: 2132491 - DNA, 15 bp, Homo sapiens
taaatttgtccaatg

SEQ ID NO: 2132492 - DNA, 18 bp, Homo sapiens
taaattttagagcatacc

SEQ ID NO: 2132493 - DNA, 16 bp, Homo sapiens
taaattttgaatgttt

SEQ ID NO: 2132494 - DNA, 17 bp, Homo sapiens
taacaaaacaagaaaga

SEQ ID NO: 2132495 - DNA, 17 bp, Homo sapiens
taacaaccaaccaacca

SEQ ID NO: 2132496 - DNA, 14 bp, Homo sapiens
taacaacctggaga

SEQ ID NO: 2132497 - DNA, 14 bp, Homo sapiens
taacaactccctga

SEQ ID NO: 2132498 - DNA, 22 bp, Homo sapiens
taacaagcaaggatatcagagc

SEQ ID NO: 2132499 - DNA, 16 bp, Homo sapiens
taacacaagccacaga

SEQ ID NO: 2132500 - DNA, 17 bp, Homo sapiens
taacacaagccacagaa

SEQ ID NO: 2132501 - DNA, 17 bp, Homo sapiens
taacacaagtcctgtga

SEQ ID NO: 2132502 - DNA, 23 bp, Homo sapiens
taacacaagtcctgtgaatttct

SEQ ID NO: 2132503 - DNA, 11 bp, Homo sapiens
taacacattat

SEQ ID NO: 2132504 - DNA, 22 bp, Homo sapiens
taacacattatcgggagcagtg

SEQ ID NO: 2132505 - DNA, 16 bp, Homo sapiens
taacactagaaaacat

SEQ ID NO: 2132506 - DNA, 18 bp, Homo sapiens
taacactcagaagcctgg

SEQ ID NO: 2132507 - DNA, 21 bp, Homo sapiens
taacactcagaagcctggggg

SEQ ID NO: 2132508 - DNA, 15 bp, Homo sapiens
taacactgcaagaag

SEQ ID NO: 2132509 - DNA, 17 bp, Homo sapiens
taacagggaaggcaggc

SEQ ID NO: 2132510 - DNA, 20 bp, Homo sapiens
taacagggaaggcaggcagg

SEQ ID NO: 2132511 - DNA, 22 bp, Homo sapiens
taacagggagactgcatctcaa

SEQ ID NO: 2132512 - DNA, 14 bp, Homo sapiens
taacaggtctcctc

SEQ ID NO: 2132513 - DNA, 18 bp, Homo sapiens
taacaggtctcctcttaa

SEQ ID NO: 2132514 - DNA, 19 bp, Homo sapiens
taacaggtctcctcttaaa

SEQ ID NO: 2132515 - DNA, 20 bp, Homo sapiens
taagccctcgaaccaaggca

SEQ ID NO: 2132516 - DNA, 21 bp, Homo sapiens
taagccctcgaaccaaggcag

SEQ ID NO: 2132517 - DNA, 16 bp, Homo sapiens
taagcctcatatttaa

SEQ ID NO: 2132518 - DNA, 14 bp, Homo sapiens
taagcctccattta

SEQ ID NO: 2132519 - DNA, 17 bp, Homo sapiens
taagcctccatttagtt

SEQ ID NO: 2132520 - DNA, 21 bp, Homo sapiens
taagcctccatttagttcttt

SEQ ID NO: 2132521 - DNA, 13 bp, Homo sapiens
taagcctgttgct

SEQ ID NO: 2132522 - DNA, 22 bp, Homo sapiens
taagctaacccccttctactga

SEQ ID NO: 2132523 - DNA, 13 bp, Homo sapiens
taagctctggctt

SEQ ID NO: 2132524 - DNA, 16 bp, Homo sapiens
taagctgcagcttcct

SEQ ID NO: 2132525 - DNA, 18 bp, Homo sapiens
taagctggagctcttgga

SEQ ID NO: 2132526 - DNA, 12 bp, Homo sapiens
taagctgtaaaa

SEQ ID NO: 2132527 - DNA, 16 bp, Homo sapiens
taagctgtttccatag

SEQ ID NO: 2132528 - DNA, 15 bp, Homo sapiens
taaggaagggaaagg

SEQ ID NO: 2132529 - DNA, 19 bp, Homo sapiens
taaggaatgtagctggttt

SEQ ID NO: 2132530 - DNA, 21 bp, Homo sapiens
taaggaccgtggccctgccct

SEQ ID NO: 2132531 - DNA, 16 bp, Homo sapiens
taaggagatgggcctt

SEQ ID NO: 2132532 - DNA, 16 bp, Homo sapiens
taaggagggacaagaa

SEQ ID NO: 2132533 - DNA, 19 bp, Homo sapiens
taaggaggtagctcccagc

SEQ ID NO: 2132534 - DNA, 16 bp, Homo sapiens
taaggatttgttcaca

SEQ ID NO: 2132535 - DNA, 20 bp, Homo sapiens
taaggcaacatttccgaaga

SEQ ID NO: 2132536 - DNA, 14 bp, Homo sapiens
taaggcctgccctc

SEQ ID NO: 2132537 - DNA, 18 bp, Homo sapiens
taaggcttaggtgccagg

SEQ ID NO: 2132538 - DNA, 17 bp, Homo sapiens
taagggaaaaatatata

SEQ ID NO: 2132539 - DNA, 21 bp, Homo sapiens
taagggaaggaactctggctt

SEQ ID NO: 2132540 - DNA, 12 bp, Homo sapiens
taagggactgtg

SEQ ID NO: 2132541 - DNA, 19 bp, Homo sapiens
taagggagagggagggagc

SEQ ID NO: 2132542 - DNA, 16 bp, Homo sapiens
taagggccgccggacc

SEQ ID NO: 2132543 - DNA, 18 bp, Homo sapiens
taagggttgaaggcagtc

SEQ ID NO: 2132544 - DNA, 20 bp, Homo sapiens
taaggtcttcttgtgtcctg

SEQ ID NO: 2132545 - DNA, 16 bp, Homo sapiens
taaggtgggtccagga

SEQ ID NO: 2132546 - DNA, 22 bp, Homo sapiens
taaggtgtacgtatcatttcta

SEQ ID NO: 2132547 - DNA, 15 bp, Homo sapiens
taaggtgtgctctga

SEQ ID NO: 2132548 - DNA, 18 bp, Homo sapiens
taagtaccactcaggcca

SEQ ID NO: 2132549 - DNA, 20 bp, Homo sapiens
taagtagaataaagaaaaac

SEQ ID NO: 2132550 - DNA, 20 bp, Homo sapiens
taagtagatagaaagcaata

SEQ ID NO: 2132551 - DNA, 13 bp, Homo sapiens
taagtatatagta

SEQ ID NO: 2132552 - DNA, 14 bp, Homo sapiens
taagtatatagtat

SEQ ID NO: 2132553 - DNA, 23 bp, Homo sapiens
taagtatatagtatatttatact

SEQ ID NO: 2132554 - DNA, 12 bp, Homo sapiens
taagtatttagg

SEQ ID NO: 2132555 - DNA, 14 bp, Homo sapiens
taagtatttatata

SEQ ID NO: 2132556 - DNA, 19 bp, Homo sapiens
taagtatttatatatttat

SEQ ID NO: 2132557 - DNA, 13 bp, Homo sapiens
taagtcagaacag

SEQ ID NO: 2132558 - DNA, 14 bp, Homo sapiens
taagtcagaacagc

SEQ ID NO: 2132559 - DNA, 19 bp, Homo sapiens
taagtgaaaataatttgtt

SEQ ID NO: 2132560 - DNA, 18 bp, Homo sapiens
taagtgatttttttgtcc

SEQ ID NO: 2132561 - DNA, 19 bp, Homo sapiens
taagtgcacacagaaatat

SEQ ID NO: 2132562 - DNA, 13 bp, Homo sapiens
taagtggaaaaaa

SEQ ID NO: 2132563 - DNA, 16 bp, Homo sapiens
taagtggaaaaaagag

SEQ ID NO: 2132564 - DNA, 14 bp, Homo sapiens
taagttaatttaaa

SEQ ID NO: 2132565 - DNA, 14 bp, Homo sapiens
taagttacttcact

SEQ ID NO: 2132566 - DNA, 19 bp, Homo sapiens
taagttagagaatatattt

SEQ ID NO: 2132567 - DNA, 22 bp, Homo sapiens
taagttattgatttttgtaata

SEQ ID NO: 2132568 - DNA, 18 bp, Homo sapiens
taagttcatgtttgtaaa

SEQ ID NO: 2132569 - DNA, 17 bp, Homo sapiens
taagttgaatggcctgc

SEQ ID NO: 2132570 - DNA, 20 bp, Homo sapiens
taagtttatgtctaaagagc

SEQ ID NO: 2132571 - DNA, 12 bp, Homo sapiens
taagtttgatca

SEQ ID NO: 2132572 - DNA, 14 bp, Homo sapiens
taataaaaaatgga

SEQ ID NO: 2132573 - DNA, 19 bp, Homo sapiens
taataaaaaatggaaagaa

SEQ ID NO: 2132574 - DNA, 15 bp, Homo sapiens
taataaaaacttcag

SEQ ID NO: 2132575 - DNA, 16 bp, Homo sapiens
taataaaaatttgttt

SEQ ID NO: 2132576 - DNA, 19 bp, Homo sapiens
taataaaagtactgaagac

SEQ ID NO: 2132577 - DNA, 12 bp, Homo sapiens
taataaactctc

SEQ ID NO: 2132578 - DNA, 15 bp, Homo sapiens
taataaactctctag

SEQ ID NO: 2132579 - DNA, 18 bp, Homo sapiens
taataaacttagaataaa

SEQ ID NO: 2132580 - DNA, 19 bp, Homo sapiens
taataaaggctatttcctg

SEQ ID NO: 2132581 - DNA, 23 bp, Homo sapiens
taataaatctgagcctaaatcta

SEQ ID NO: 2132582 - DNA, 19 bp, Homo sapiens
taataaatgtacattaatt

SEQ ID NO: 2132583 - DNA, 19 bp, Homo sapiens
taataaattttaacatttt

SEQ ID NO: 2132584 - DNA, 16 bp, Homo sapiens
taataactagatctcc

SEQ ID NO: 2132585 - DNA, 20 bp, Homo sapiens
taataactagatctcctgta

SEQ ID NO: 2132586 - DNA, 12 bp, Homo sapiens
taataagaaagt

SEQ ID NO: 2132587 - DNA, 17 bp, Homo sapiens
taataagaaggaaaaat

SEQ ID NO: 2132588 - DNA, 19 bp, Homo sapiens
taataagaatggttgcctt

SEQ ID NO: 2132589 - DNA, 21 bp, Homo sapiens
taataagtccacatcttctca

SEQ ID NO: 2132590 - DNA, 19 bp, Homo sapiens
taataattatgtgccattt

SEQ ID NO: 2132591 - DNA, 22 bp, Homo sapiens
taatacaacatgtagctgagtt

SEQ ID NO: 2132592 - DNA, 20 bp, Homo sapiens
taatacactaattcctttct

SEQ ID NO: 2132593 - DNA, 23 bp, Homo sapiens
taatacagcagtgtcatcagaag

SEQ ID NO: 2132594 - DNA, 16 bp, Homo sapiens
taataccaaatatttt

SEQ ID NO: 2132595 - DNA, 15 bp, Homo sapiens
taatacctctgtgtg

SEQ ID NO: 2132596 - DNA, 15 bp, Homo sapiens
taatactcacctcct

SEQ ID NO: 2132597 - DNA, 19 bp, Homo sapiens
taatagaaaactgaaaatc

SEQ ID NO: 2132598 - DNA, 21 bp, Homo sapiens
taatagaatataattatcgga

SEQ ID NO: 2132599 - DNA, 14 bp, Homo sapiens
taatagagacacag

SEQ ID NO: 2132600 - DNA, 22 bp, Homo sapiens
taatagcgggttactttcacat

SEQ ID NO: 2132601 - DNA, 18 bp, Homo sapiens
taatagcttttattgtat

SEQ ID NO: 2132602 - DNA, 17 bp, Homo sapiens
taatagtccaatatttg

SEQ ID NO: 2132603 - DNA, 19 bp, Homo sapiens
taatagttagccctcagtc

SEQ ID NO: 2132604 - DNA, 15 bp, Homo sapiens
taatataagaatcat

SEQ ID NO: 2132605 - DNA, 19 bp, Homo sapiens
taatataatggaagagaaa

SEQ ID NO: 2132606 - DNA, 20 bp, Homo sapiens
taatataatggaagagaaat

SEQ ID NO: 2132607 - DNA, 18 bp, Homo sapiens
taatatagctatcatttc

SEQ ID NO: 2132608 - DNA, 14 bp, Homo sapiens
taatatattgctgc

SEQ ID NO: 2132609 - DNA, 14 bp, Homo sapiens
taatatcctaaaca

SEQ ID NO: 2132610 - DNA, 15 bp, Homo sapiens
taatatcctaaacat

SEQ ID NO: 2132611 - DNA, 17 bp, Homo sapiens
taatatcctaaacatca

SEQ ID NO: 2132612 - DNA, 19 bp, Homo sapiens
taatatctgagaagtgtat

SEQ ID NO: 2132613 - DNA, 13 bp, Homo sapiens
taatatctgtgag

SEQ ID NO: 2132614 - DNA, 12 bp, Homo sapiens
taatatcttgaa

SEQ ID NO: 2132615 - DNA, 18 bp, Homo sapiens
taatatgctgccaaattt

SEQ ID NO: 2132616 - DNA, 16 bp, Homo sapiens
taatatggggatgcag

SEQ ID NO: 2132617 - DNA, 20 bp, Homo sapiens
taatatgttaacctcagtgt

SEQ ID NO: 2132618 - DNA, 23 bp, Homo sapiens
taatatgttaacctcagtgtcat

SEQ ID NO: 2132619 - DNA, 16 bp, Homo sapiens
taatatgttcattaaa

SEQ ID NO: 2132620 - DNA, 14 bp, Homo sapiens
taatatgtttgagg

SEQ ID NO: 2132621 - DNA, 14 bp, Homo sapiens
taatattaaaaata

SEQ ID NO: 2132622 - DNA, 22 bp, Homo sapiens
taatattaaaaatatggaactt

SEQ ID NO: 2132623 - DNA, 16 bp, Homo sapiens
taatattcattgtata

SEQ ID NO: 2132624 - DNA, 15 bp, Homo sapiens
taatatttaggcaag

SEQ ID NO: 2132625 - DNA, 21 bp, Homo sapiens
taatatttatgtctatttaag

SEQ ID NO: 2132626 - DNA, 14 bp, Homo sapiens
taatatttgctgac

SEQ ID NO: 2132627 - DNA, 19 bp, Homo sapiens
taatattttgtattttcaa

SEQ ID NO: 2132628 - DNA, 23 bp, Homo sapiens
taatatttttagctctgttcttt

SEQ ID NO: 2132629 - DNA, 21 bp, Homo sapiens
taatcaagaatattcaaatgt

SEQ ID NO: 2132630 - DNA, 12 bp, Homo sapiens
tacagccagaag

SEQ ID NO: 2132631 - DNA, 19 bp, Homo sapiens
tacagccccaaaccagggt

SEQ ID NO: 2132632 - DNA, 21 bp, Homo sapiens
tacagcctcagaggcagcagg

SEQ ID NO: 2132633 - DNA, 14 bp, Homo sapiens
tacagcgagaggca

SEQ ID NO: 2132634 - DNA, 16 bp, Homo sapiens
tacagctaatcagcat

SEQ ID NO: 2132635 - DNA, 17 bp, Homo sapiens
tacagctcttggcattt

SEQ ID NO: 2132636 - DNA, 13 bp, Homo sapiens
tacagctgcctgc

SEQ ID NO: 2132637 - DNA, 14 bp, Homo sapiens
tacagctgtttaag

SEQ ID NO: 2132638 - DNA, 15 bp, Homo sapiens
tacaggagtgagcac

SEQ ID NO: 2132639 - DNA, 21 bp, Homo sapiens
tacagggcatgcattttgcag

SEQ ID NO: 2132640 - DNA, 15 bp, Homo sapiens
tacagggcccaggtg

SEQ ID NO: 2132641 - DNA, 18 bp, Homo sapiens
tacagggtagcaggtacc

SEQ ID NO: 2132642 - DNA, 13 bp, Homo sapiens
tacaggtgtacta

SEQ ID NO: 2132643 - DNA, 11 bp, Homo sapiens
tacagtaaagt

SEQ ID NO: 2132644 - DNA, 17 bp, Homo sapiens
tacagtaaataaattgt

SEQ ID NO: 2132645 - DNA, 18 bp, Homo sapiens
tacagtaaataaattgtt

SEQ ID NO: 2132646 - DNA, 14 bp, Homo sapiens
tacagtaagctgct

SEQ ID NO: 2132647 - DNA, 15 bp, Homo sapiens
tacagtactatgtaa

SEQ ID NO: 2132648 - DNA, 17 bp, Homo sapiens
tacagtactatgtaaat

SEQ ID NO: 2132649 - DNA, 16 bp, Homo sapiens
tacagtagcttaaata

SEQ ID NO: 2132650 - DNA, 15 bp, Homo sapiens
tacagtcaattttac

SEQ ID NO: 2132651 - DNA, 22 bp, Homo sapiens
tacagtgactgtcgtgtttaca

SEQ ID NO: 2132652 - DNA, 19 bp, Homo sapiens
tacagtgttattttctttg

SEQ ID NO: 2132653 - DNA, 16 bp, Homo sapiens
tacagttaactctccc

SEQ ID NO: 2132654 - DNA, 14 bp, Homo sapiens
tacagttatacata

SEQ ID NO: 2132655 - DNA, 18 bp, Homo sapiens
tacataacttgatataga

SEQ ID NO: 2132656 - DNA, 22 bp, Homo sapiens
tacataacttgatatagaaagc

SEQ ID NO: 2132657 - DNA, 15 bp, Homo sapiens
tacatacacatacat

SEQ ID NO: 2132658 - DNA, 16 bp, Homo sapiens
tacatacacatacata

SEQ ID NO: 2132659 - DNA, 22 bp, Homo sapiens
tacatacacttgtataaatgta

SEQ ID NO: 2132660 - DNA, 13 bp, Homo sapiens
tacatacagaggt

SEQ ID NO: 2132661 - DNA, 18 bp, Homo sapiens
tacatacagaggtaacta

SEQ ID NO: 2132662 - DNA, 12 bp, Homo sapiens
tacatacataca

SEQ ID NO: 2132663 - DNA, 13 bp, Homo sapiens
tacatacatacat

SEQ ID NO: 2132664 - DNA, 14 bp, Homo sapiens
tacatacatacata

SEQ ID NO: 2132665 - DNA, 16 bp, Homo sapiens
tacatacatacataca

SEQ ID NO: 2132666 - DNA, 13 bp, Homo sapiens
tacatacatatat

SEQ ID NO: 2132667 - DNA, 11 bp, Homo sapiens
tacatatatat

SEQ ID NO: 2132668 - DNA, 23 bp, Homo sapiens
tacatatatatatacacatacat

SEQ ID NO: 2132669 - DNA, 15 bp, Homo sapiens
tacatatatatctga

SEQ ID NO: 2132670 - DNA, 18 bp, Homo sapiens
tacatatcacctcatggc

SEQ ID NO: 2132671 - DNA, 12 bp, Homo sapiens
tacatatcagaa

SEQ ID NO: 2132672 - DNA, 13 bp, Homo sapiens
tacatatcagaaa

SEQ ID NO: 2132673 - DNA, 18 bp, Homo sapiens
tacatatggaaatcctgt

SEQ ID NO: 2132674 - DNA, 19 bp, Homo sapiens
tacatatggaaatcctgtt

SEQ ID NO: 2132675 - DNA, 16 bp, Homo sapiens
tacatatgtaaaataa

SEQ ID NO: 2132676 - DNA, 18 bp, Homo sapiens
tacatattataaataaat

SEQ ID NO: 2132677 - DNA, 20 bp, Homo sapiens
tacatattataaataaatgc

SEQ ID NO: 2132678 - DNA, 21 bp, Homo sapiens
tacatattataaataaatgcc

SEQ ID NO: 2132679 - DNA, 14 bp, Homo sapiens
tacatattggaaag

SEQ ID NO: 2132680 - DNA, 20 bp, Homo sapiens
tacatcctgctttccctccc

SEQ ID NO: 2132681 - DNA, 15 bp, Homo sapiens
tacatctaatgcttc

SEQ ID NO: 2132682 - DNA, 22 bp, Homo sapiens
tacatctgcagctctttcttct

SEQ ID NO: 2132683 - DNA, 21 bp, Homo sapiens
tacatgaaacagaaacaaaaa

SEQ ID NO: 2132684 - DNA, 11 bp, Homo sapiens
tacatgaacac

SEQ ID NO: 2132685 - DNA, 21 bp, Homo sapiens
tacatgaagagcagctggtca

SEQ ID NO: 2132686 - DNA, 16 bp, Homo sapiens
tacatgcaatttatta

SEQ ID NO: 2132687 - DNA, 17 bp, Homo sapiens
tacatgctaagagaagt

SEQ ID NO: 2132688 - DNA, 13 bp, Homo sapiens
tacatggtattgt

SEQ ID NO: 2132689 - DNA, 21 bp, Homo sapiens
tacatggtattgtaatgaata

SEQ ID NO: 2132690 - DNA, 14 bp, Homo sapiens
tacatgtgtgtata

SEQ ID NO: 2132691 - DNA, 21 bp, Homo sapiens
tacatgtgtgtatatatgtgt

SEQ ID NO: 2132692 - DNA, 22 bp, Homo sapiens
tacatgtttaaattgtaaattt

SEQ ID NO: 2132693 - DNA, 13 bp, Homo sapiens
tacatgtttgcac

SEQ ID NO: 2132694 - DNA, 15 bp, Homo sapiens
tacattaatgttaat

SEQ ID NO: 2132695 - DNA, 20 bp, Homo sapiens
tacattaatgttaattcagc

SEQ ID NO: 2132696 - DNA, 20 bp, Homo sapiens
tacattagcagtttgctttg

SEQ ID NO: 2132697 - DNA, 17 bp, Homo sapiens
tacattccctatcaaaa

SEQ ID NO: 2132698 - DNA, 21 bp, Homo sapiens
tacattcctagagagcagaaa

SEQ ID NO: 2132699 - DNA, 13 bp, Homo sapiens
tacattcctcagc

SEQ ID NO: 2132700 - DNA, 14 bp, Homo sapiens
tacattcctcagct

SEQ ID NO: 2132701 - DNA, 15 bp, Homo sapiens
tacatttaatacagc

SEQ ID NO: 2132702 - DNA, 23 bp, Homo sapiens
tacatttcataaggcctgccctc

SEQ ID NO: 2132703 - DNA, 16 bp, Homo sapiens
tacatttccaaatgaa

SEQ ID NO: 2132704 - DNA, 16 bp, Homo sapiens
tacatttccctgtgct

SEQ ID NO: 2132705 - DNA, 16 bp, Homo sapiens
tacatttctctgagca

SEQ ID NO: 2132706 - DNA, 14 bp, Homo sapiens
tacatttctgaaat

SEQ ID NO: 2132707 - DNA, 14 bp, Homo sapiens
tacattttatttat

SEQ ID NO: 2132708 - DNA, 16 bp, Homo sapiens
tacatttttacaataa

SEQ ID NO: 2132709 - DNA, 16 bp, Homo sapiens
taccaaatataaactt

SEQ ID NO: 2132710 - DNA, 18 bp, Homo sapiens
taccaaatataaacttgt

SEQ ID NO: 2132711 - DNA, 13 bp, Homo sapiens
taccaaatatttt

SEQ ID NO: 2132712 - DNA, 16 bp, Homo sapiens
taccaaatattttagc

SEQ ID NO: 2132713 - DNA, 16 bp, Homo sapiens
taccaacacgagcagg

SEQ ID NO: 2132714 - DNA, 12 bp, Homo sapiens
taccaatgcatg

SEQ ID NO: 2132715 - DNA, 16 bp, Homo sapiens
taccaccccttcctgt

SEQ ID NO: 2132716 - DNA, 18 bp, Homo sapiens
taccaccccttcctgtcc

SEQ ID NO: 2132717 - DNA, 12 bp, Homo sapiens
taccaccttccc

SEQ ID NO: 2132718 - DNA, 20 bp, Homo sapiens
taccaccttccctctttcta

SEQ ID NO: 2132719 - DNA, 16 bp, Homo sapiens
taccacgccttgacct

SEQ ID NO: 2132720 - DNA, 15 bp, Homo sapiens
taccagaaagtgagg

SEQ ID NO: 2132721 - DNA, 17 bp, Homo sapiens
taccagagggaacacgg

SEQ ID NO: 2132722 - DNA, 22 bp, Homo sapiens
taccagctaactccagtctcct

SEQ ID NO: 2132723 - DNA, 15 bp, Homo sapiens
taccagctcactccc

SEQ ID NO: 2132724 - DNA, 19 bp, Homo sapiens
taccagctcactccctggg

SEQ ID NO: 2132725 - DNA, 17 bp, Homo sapiens
taccaggcaccaaaaga

SEQ ID NO: 2132726 - DNA, 17 bp, Homo sapiens
taccagggatgtagatt

SEQ ID NO: 2132727 - DNA, 17 bp, Homo sapiens
taccataagggactgtg

SEQ ID NO: 2132728 - DNA, 17 bp, Homo sapiens
taccatagaacagaact

SEQ ID NO: 2132729 - DNA, 22 bp, Homo sapiens
taccatctgtcttgccagccag

SEQ ID NO: 2132730 - DNA, 15 bp, Homo sapiens
tacccaaaagagaaa

SEQ ID NO: 2132731 - DNA, 17 bp, Homo sapiens
tacccaaaagagaaaaa

SEQ ID NO: 2132732 - DNA, 20 bp, Homo sapiens
tacccaccgggccactcctt

SEQ ID NO: 2132733 - DNA, 19 bp, Homo sapiens
tacccactcctcactgccc

SEQ ID NO: 2132734 - DNA, 18 bp, Homo sapiens
tacccactctttgctaca

SEQ ID NO: 2132735 - DNA, 11 bp, Homo sapiens
tacccactgct

SEQ ID NO: 2132736 - DNA, 12 bp, Homo sapiens
tacccactgctc

SEQ ID NO: 2132737 - DNA, 19 bp, Homo sapiens
tacccagactctaaatatt

SEQ ID NO: 2132738 - DNA, 13 bp, Homo sapiens
tacccagagcatt

SEQ ID NO: 2132739 - DNA, 20 bp, Homo sapiens
tacccagagccttctcctgc

SEQ ID NO: 2132740 - DNA, 21 bp, Homo sapiens
tacccagagccttctcctgcc

SEQ ID NO: 2132741 - DNA, 16 bp, Homo sapiens
taccccatcccttcct

SEQ ID NO: 2132742 - DNA, 12 bp, Homo sapiens
tacccccagaga

SEQ ID NO: 2132743 - DNA, 16 bp, Homo sapiens
tacccccgtggtcttt

SEQ ID NO: 2132744 - DNA, 20 bp, Homo sapiens
tacccccgtggtctttgaat

SEQ ID NO: 2132745 - DNA, 12 bp, Homo sapiens
tacccctgcctg

SEQ ID NO: 2132746 - DNA, 17 bp, Homo sapiens
tactctgtgccagagcc

SEQ ID NO: 2132747 - DNA, 21 bp, Homo sapiens
tactctttatttctagcagag

SEQ ID NO: 2132748 - DNA, 18 bp, Homo sapiens
tactgaaaacaaaatatc

SEQ ID NO: 2132749 - DNA, 14 bp, Homo sapiens
tactgaatttattg

SEQ ID NO: 2132750 - DNA, 23 bp, Homo sapiens
tactgacactttgccagaaagca

SEQ ID NO: 2132751 - DNA, 18 bp, Homo sapiens
tactgagcttctctgtga

SEQ ID NO: 2132752 - DNA, 16 bp, Homo sapiens
tactgagtaaacccta

SEQ ID NO: 2132753 - DNA, 14 bp, Homo sapiens
tactgatccctttc

SEQ ID NO: 2132754 - DNA, 18 bp, Homo sapiens
tactgatgttcctttgga

SEQ ID NO: 2132755 - DNA, 13 bp, Homo sapiens
tactgattctcct

SEQ ID NO: 2132756 - DNA, 23 bp, Homo sapiens
tactgattctcctgtcagagatc

SEQ ID NO: 2132757 - DNA, 13 bp, Homo sapiens
tactgatttttgt

SEQ ID NO: 2132758 - DNA, 17 bp, Homo sapiens
tactgatttttgtgatt

SEQ ID NO: 2132759 - DNA, 17 bp, Homo sapiens
tactgcagaatacagta

SEQ ID NO: 2132760 - DNA, 22 bp, Homo sapiens
tactgcagaatacagtaagctg

SEQ ID NO: 2132761 - DNA, 19 bp, Homo sapiens
tactgcagctttacatgca

SEQ ID NO: 2132762 - DNA, 21 bp, Homo sapiens
tactgcccaggcctgcctgtt

SEQ ID NO: 2132763 - DNA, 14 bp, Homo sapiens
tactgcctgcttgg

SEQ ID NO: 2132764 - DNA, 22 bp, Homo sapiens
tactgcctttggaagaaacagg

SEQ ID NO: 2132765 - DNA, 21 bp, Homo sapiens
tactgctgaagggcttcttct

SEQ ID NO: 2132766 - DNA, 16 bp, Homo sapiens
tactgctgcaaagtgc

SEQ ID NO: 2132767 - DNA, 17 bp, Homo sapiens
tactgctttcaacttaa

SEQ ID NO: 2132768 - DNA, 23 bp, Homo sapiens
tactggaagttttgcatttatgg

SEQ ID NO: 2132769 - DNA, 17 bp, Homo sapiens
tactggaccccgcctcc

SEQ ID NO: 2132770 - DNA, 19 bp, Homo sapiens
tactggcagctcctctcct

SEQ ID NO: 2132771 - DNA, 13 bp, Homo sapiens
tactgggaaggct

SEQ ID NO: 2132772 - DNA, 18 bp, Homo sapiens
tactgggtacaagagcca

SEQ ID NO: 2132773 - DNA, 18 bp, Homo sapiens
tactggtcttgtggaatt

SEQ ID NO: 2132774 - DNA, 14 bp, Homo sapiens
tactgtaattaagt

SEQ ID NO: 2132775 - DNA, 22 bp, Homo sapiens
tactgtaattggtgacaatgtc

SEQ ID NO: 2132776 - DNA, 19 bp, Homo sapiens
tactgtaattttgtttgta

SEQ ID NO: 2132777 - DNA, 14 bp, Homo sapiens
tactgtacttaata

SEQ ID NO: 2132778 - DNA, 16 bp, Homo sapiens
tactgtcctacccacc

SEQ ID NO: 2132779 - DNA, 16 bp, Homo sapiens
tactgtctggttttaa

SEQ ID NO: 2132780 - DNA, 19 bp, Homo sapiens
tactgtctggttttaacaa

SEQ ID NO: 2132781 - DNA, 22 bp, Homo sapiens
tactgtctggttttaacaattt

SEQ ID NO: 2132782 - DNA, 20 bp, Homo sapiens
tactgtggaaaaatatttaa

SEQ ID NO: 2132783 - DNA, 16 bp, Homo sapiens
tactgttttgtatcaa

SEQ ID NO: 2132784 - DNA, 13 bp, Homo sapiens
tacttaaagcttg

SEQ ID NO: 2132785 - DNA, 17 bp, Homo sapiens
tacttaactgtgtgaag

SEQ ID NO: 2132786 - DNA, 20 bp, Homo sapiens
tacttaactgtgtgaagaaa

SEQ ID NO: 2132787 - DNA, 14 bp, Homo sapiens
tacttaagagaaat

SEQ ID NO: 2132788 - DNA, 16 bp, Homo sapiens
tacttaagagaaatgg

SEQ ID NO: 2132789 - DNA, 18 bp, Homo sapiens
tacttaagagaaatggca

SEQ ID NO: 2132790 - DNA, 19 bp, Homo sapiens
tacttaagagaaatggcaa

SEQ ID NO: 2132791 - DNA, 14 bp, Homo sapiens
tacttaataaattc

SEQ ID NO: 2132792 - DNA, 19 bp, Homo sapiens
tacttaataaattcagata

SEQ ID NO: 2132793 - DNA, 23 bp, Homo sapiens
tacttacatgcattactgcatgc

SEQ ID NO: 2132794 - DNA, 16 bp, Homo sapiens
tacttatatggaaatt

SEQ ID NO: 2132795 - DNA, 20 bp, Homo sapiens
tacttatttttgacagtgtt

SEQ ID NO: 2132796 - DNA, 15 bp, Homo sapiens
tacttcactttaatt

SEQ ID NO: 2132797 - DNA, 22 bp, Homo sapiens
tacttcactttaattctcatgt

SEQ ID NO: 2132798 - DNA, 15 bp, Homo sapiens
tacttcagtcttgga

SEQ ID NO: 2132799 - DNA, 16 bp, Homo sapiens
tacttcattttcagag

SEQ ID NO: 2132800 - DNA, 19 bp, Homo sapiens
tacttcctatcaagccagt

SEQ ID NO: 2132801 - DNA, 13 bp, Homo sapiens
tacttcctcctga

SEQ ID NO: 2132802 - DNA, 16 bp, Homo sapiens
tacttcctcctgatgg

SEQ ID NO: 2132803 - DNA, 17 bp, Homo sapiens
tacttcctcctgatggc

SEQ ID NO: 2132804 - DNA, 22 bp, Homo sapiens
tacttcgtgtccgactcttctg

SEQ ID NO: 2132805 - DNA, 12 bp, Homo sapiens
tacttctaagag

SEQ ID NO: 2132806 - DNA, 20 bp, Homo sapiens
tacttctcattttttaaaaa

SEQ ID NO: 2132807 - DNA, 16 bp, Homo sapiens
tacttctctctatctg

SEQ ID NO: 2132808 - DNA, 13 bp, Homo sapiens
tacttcttggaaa

SEQ ID NO: 2132809 - DNA, 12 bp, Homo sapiens
tacttgaaagat

SEQ ID NO: 2132810 - DNA, 16 bp, Homo sapiens
tacttgaactttccaa

SEQ ID NO: 2132811 - DNA, 11 bp, Homo sapiens
tacttgcacaa

SEQ ID NO: 2132812 - DNA, 23 bp, Homo sapiens
tacttgggagacctgtaatcata

SEQ ID NO: 2132813 - DNA, 21 bp, Homo sapiens
tacttgtaatttctaactcct

SEQ ID NO: 2132814 - DNA, 18 bp, Homo sapiens
tacttgtctgaggcctca

SEQ ID NO: 2132815 - DNA, 17 bp, Homo sapiens
tacttgtgactgaaggg

SEQ ID NO: 2132816 - DNA, 18 bp, Homo sapiens
tacttgtggacacagctc

SEQ ID NO: 2132817 - DNA, 18 bp, Homo sapiens
tactttatccaatcctca

SEQ ID NO: 2132818 - DNA, 17 bp, Homo sapiens
tactttatgttactaca

SEQ ID NO: 2132819 - DNA, 23 bp, Homo sapiens
tactttgatattttcaacgcagc

SEQ ID NO: 2132820 - DNA, 20 bp, Homo sapiens
tactttgccttttgcaaact

SEQ ID NO: 2132821 - DNA, 22 bp, Homo sapiens
tactttggtggccacataagcc

SEQ ID NO: 2132822 - DNA, 17 bp, Homo sapiens
tacttttgtaccagtgt

SEQ ID NO: 2132823 - DNA, 19 bp, Homo sapiens
tacttttgttctgtatttt

SEQ ID NO: 2132824 - DNA, 19 bp, Homo sapiens
tacttttttctagtttcag

SEQ ID NO: 2132825 - DNA, 17 bp, Homo sapiens
tagaaaaatctcattcc

SEQ ID NO: 2132826 - DNA, 15 bp, Homo sapiens
tagaaaactgaaaat

SEQ ID NO: 2132827 - DNA, 16 bp, Homo sapiens
tagaaaactgaaaatc

SEQ ID NO: 2132828 - DNA, 22 bp, Homo sapiens
tagaaaactgaaaatctaatat

SEQ ID NO: 2132829 - DNA, 16 bp, Homo sapiens
tagaaaactttaaagc

SEQ ID NO: 2132830 - DNA, 17 bp, Homo sapiens
tagaaaagatttaagta

SEQ ID NO: 2132831 - DNA, 19 bp, Homo sapiens
tagaaaatgcaaaatgaaa

SEQ ID NO: 2132832 - DNA, 19 bp, Homo sapiens
tagaaacatgacactgacc

SEQ ID NO: 2132833 - DNA, 17 bp, Homo sapiens
tagaaaccagtatggaa

SEQ ID NO: 2132834 - DNA, 14 bp, Homo sapiens
tagaaaccttaata

SEQ ID NO: 2132835 - DNA, 21 bp, Homo sapiens
tagaaactgaaaactgtaaat

SEQ ID NO: 2132836 - DNA, 19 bp, Homo sapiens
tagaaagaaaagaccctga

SEQ ID NO: 2132837 - DNA, 18 bp, Homo sapiens
tagaaagtgccagaaagt

SEQ ID NO: 2132838 - DNA, 15 bp, Homo sapiens
tagaaagttattgtg

SEQ ID NO: 2132839 - DNA, 15 bp, Homo sapiens
tagaaatacctcatt

SEQ ID NO: 2132840 - DNA, 21 bp, Homo sapiens
tagaaatagctccgtggagca

SEQ ID NO: 2132841 - DNA, 14 bp, Homo sapiens
tagaaatatgattt

SEQ ID NO: 2132842 - DNA, 16 bp, Homo sapiens
tagaaattgttcctga

SEQ ID NO: 2132843 - DNA, 13 bp, Homo sapiens
tagaacaatagct

SEQ ID NO: 2132844 - DNA, 15 bp, Homo sapiens
tagaacacaggcaaa

SEQ ID NO: 2132845 - DNA, 20 bp, Homo sapiens
tagaacacccactggccagt

SEQ ID NO: 2132846 - DNA, 19 bp, Homo sapiens
tagaacatgcacatttata

SEQ ID NO: 2132847 - DNA, 16 bp, Homo sapiens
tagaaccaagaagggc

SEQ ID NO: 2132848 - DNA, 17 bp, Homo sapiens
tagaaccaagcttcaga

SEQ ID NO: 2132849 - DNA, 22 bp, Homo sapiens
tagaaccaagcttcagagccta

SEQ ID NO: 2132850 - DNA, 14 bp, Homo sapiens
tagaacctagaagg

SEQ ID NO: 2132851 - DNA, 17 bp, Homo sapiens
tagaacctagaagggct

SEQ ID NO: 2132852 - DNA, 23 bp, Homo sapiens
tagaacctagaagggctagaacc

SEQ ID NO: 2132853 - DNA, 23 bp, Homo sapiens
tagaacctggaagggctagaacc

SEQ ID NO: 2132854 - DNA, 13 bp, Homo sapiens
tagaacctggaga

SEQ ID NO: 2132855 - DNA, 22 bp, Homo sapiens
tagaacctggagggctagaacc

SEQ ID NO: 2132856 - DNA, 22 bp, Homo sapiens
tagaactcagttttaactagaa

SEQ ID NO: 2132857 - DNA, 23 bp, Homo sapiens
tagaactctccatcttattttca

SEQ ID NO: 2132858 - DNA, 19 bp, Homo sapiens
tagaactgtatgtcagaca

SEQ ID NO: 2132859 - DNA, 18 bp, Homo sapiens
tagaagaacatccaagga

SEQ ID NO: 2132860 - DNA, 21 bp, Homo sapiens
tagtaactactttttatactc

SEQ ID NO: 2132861 - DNA, 22 bp, Homo sapiens
tagtaactactttttatactcc

SEQ ID NO: 2132862 - DNA, 18 bp, Homo sapiens
tagtaatagtccaatatt

SEQ ID NO: 2132863 - DNA, 23 bp, Homo sapiens
tagtaatagtccaatatttggcg

SEQ ID NO: 2132864 - DNA, 14 bp, Homo sapiens
tagtaatgcactct

SEQ ID NO: 2132865 - DNA, 18 bp, Homo sapiens
tagtaatgggccaattaa

SEQ ID NO: 2132866 - DNA, 20 bp, Homo sapiens
tagtaatgggccaattaaaa

SEQ ID NO: 2132867 - DNA, 13 bp, Homo sapiens
tagtaattgtaag

SEQ ID NO: 2132868 - DNA, 21 bp, Homo sapiens
tagtacagtagcttaaataaa

SEQ ID NO: 2132869 - DNA, 21 bp, Homo sapiens
tagtacataaaggtggtatgt

SEQ ID NO: 2132870 - DNA, 22 bp, Homo sapiens
tagtagcagagtcattgttaca

SEQ ID NO: 2132871 - DNA, 17 bp, Homo sapiens
tagtagccctttctgtg

SEQ ID NO: 2132872 - DNA, 18 bp, Homo sapiens
tagtagccctttctgtgt

SEQ ID NO: 2132873 - DNA, 16 bp, Homo sapiens
tagtagtcaattagta

SEQ ID NO: 2132874 - DNA, 20 bp, Homo sapiens
tagtagtcaattagtacagt

SEQ ID NO: 2132875 - DNA, 22 bp, Homo sapiens
tagtagtcaattagtacagtag

SEQ ID NO: 2132876 - DNA, 16 bp, Homo sapiens
tagtatatctggacaa

SEQ ID NO: 2132877 - DNA, 20 bp, Homo sapiens
tagtatattagtttgattta

SEQ ID NO: 2132878 - DNA, 18 bp, Homo sapiens
tagtatcatcagatagca

SEQ ID NO: 2132879 - DNA, 15 bp, Homo sapiens
tagtatcttttaaaa

SEQ ID NO: 2132880 - DNA, 21 bp, Homo sapiens
tagtatgatttttacaataat

SEQ ID NO: 2132881 - DNA, 17 bp, Homo sapiens
tagtatggcctgtgtca

SEQ ID NO: 2132882 - DNA, 19 bp, Homo sapiens
tagtattcaggcactgaga

SEQ ID NO: 2132883 - DNA, 16 bp, Homo sapiens
tagtatttatttaatg

SEQ ID NO: 2132884 - DNA, 13 bp, Homo sapiens
tagtcacaaaaat

SEQ ID NO: 2132885 - DNA, 16 bp, Homo sapiens
tagtcacaaaaatggt

SEQ ID NO: 2132886 - DNA, 21 bp, Homo sapiens
tagtcacatggcctatgcaca

SEQ ID NO: 2132887 - DNA, 19 bp, Homo sapiens
tagtcagaagcaggttctt

SEQ ID NO: 2132888 - DNA, 23 bp, Homo sapiens
tagtccatggacaatataaactg

SEQ ID NO: 2132889 - DNA, 17 bp, Homo sapiens
tagtctcctttgcactg

SEQ ID NO: 2132890 - DNA, 19 bp, Homo sapiens
tagtctcctttgcactgag

SEQ ID NO: 2132891 - DNA, 20 bp, Homo sapiens
tagtctcctttgcactgagg

SEQ ID NO: 2132892 - DNA, 19 bp, Homo sapiens
tagtctggtgttctgagta

SEQ ID NO: 2132893 - DNA, 20 bp, Homo sapiens
tagtctggtgttctgagtac

SEQ ID NO: 2132894 - DNA, 14 bp, Homo sapiens
tagtctgtcatcca

SEQ ID NO: 2132895 - DNA, 18 bp, Homo sapiens
tagtctgtgtgcacaatg

SEQ ID NO: 2132896 - DNA, 13 bp, Homo sapiens
tagtgaagatgtt

SEQ ID NO: 2132897 - DNA, 14 bp, Homo sapiens
tagtgacttcctgg

SEQ ID NO: 2132898 - DNA, 15 bp, Homo sapiens
tagtgagatttgtat

SEQ ID NO: 2132899 - DNA, 22 bp, Homo sapiens
tagtgagtgtggcttagtaata

SEQ ID NO: 2132900 - DNA, 18 bp, Homo sapiens
tagtgatggttcccctgt

SEQ ID NO: 2132901 - DNA, 15 bp, Homo sapiens
tagtgatttcattac

SEQ ID NO: 2132902 - DNA, 16 bp, Homo sapiens
tagtgatttcctgtat

SEQ ID NO: 2132903 - DNA, 16 bp, Homo sapiens
tagtgcacacttgtat

SEQ ID NO: 2132904 - DNA, 23 bp, Homo sapiens
tagtgccctccacagccgcagcc

SEQ ID NO: 2132905 - DNA, 22 bp, Homo sapiens
tagtgctatatatataaatatt

SEQ ID NO: 2132906 - DNA, 23 bp, Homo sapiens
tagtgctttacctttattaatga

SEQ ID NO: 2132907 - DNA, 21 bp, Homo sapiens
tagtggggtctccctctcctg

SEQ ID NO: 2132908 - DNA, 23 bp, Homo sapiens
tagtggggtctccctctcctgcc

SEQ ID NO: 2132909 - DNA, 19 bp, Homo sapiens
tagtgtaaaataagaatga

SEQ ID NO: 2132910 - DNA, 22 bp, Homo sapiens
tagtgtaaaataagaatgattt

SEQ ID NO: 2132911 - DNA, 20 bp, Homo sapiens
tagtgtaggtcagcgtgctt

SEQ ID NO: 2132912 - DNA, 12 bp, Homo sapiens
tagtgtgtgtgc

SEQ ID NO: 2132913 - DNA, 14 bp, Homo sapiens
tagtgtgtgtgcat

SEQ ID NO: 2132914 - DNA, 17 bp, Homo sapiens
tagtgtgtgtgcatgtg

SEQ ID NO: 2132915 - DNA, 16 bp, Homo sapiens
tagtgtgttgtctgtg

SEQ ID NO: 2132916 - DNA, 23 bp, Homo sapiens
tagttaaaagactgcagctgctg

SEQ ID NO: 2132917 - DNA, 15 bp, Homo sapiens
tagttaagtcatcca

SEQ ID NO: 2132918 - DNA, 20 bp, Homo sapiens
tagttaagtcatccacagcc

SEQ ID NO: 2132919 - DNA, 13 bp, Homo sapiens
tagttaatttatt

SEQ ID NO: 2132920 - DNA, 16 bp, Homo sapiens
tagttagcaggaaata

SEQ ID NO: 2132921 - DNA, 23 bp, Homo sapiens
tagttaggaaataaaacctttca

SEQ ID NO: 2132922 - DNA, 15 bp, Homo sapiens
tagttatagtttcag

SEQ ID NO: 2132923 - DNA, 18 bp, Homo sapiens
tagttatttacttgaaag

SEQ ID NO: 2132924 - DNA, 18 bp, Homo sapiens
tagttcaggtaacaggca

SEQ ID NO: 2132925 - DNA, 22 bp, Homo sapiens
tagttctatcaggaaaacaaat

SEQ ID NO: 2132926 - DNA, 19 bp, Homo sapiens
tagttcttgtgcatgttta

SEQ ID NO: 2132927 - DNA, 15 bp, Homo sapiens
tagttgaaaaatcta

SEQ ID NO: 2132928 - DNA, 21 bp, Homo sapiens
tagttgatgaccaatctctgt

SEQ ID NO: 2132929 - DNA, 23 bp, Homo sapiens
tagtttaattaactatgtgatgt

SEQ ID NO: 2132930 - DNA, 15 bp, Homo sapiens
tagtttattggaagt

SEQ ID NO: 2132931 - DNA, 14 bp, Homo sapiens
tagtttattttgtt

SEQ ID NO: 2132932 - DNA, 13 bp, Homo sapiens
tagtttccagtgg

SEQ ID NO: 2132933 - DNA, 17 bp, Homo sapiens
tagtttctagaggcctc

SEQ ID NO: 2132934 - DNA, 20 bp, Homo sapiens
tagtttgacctcacagtgac

SEQ ID NO: 2132935 - DNA, 21 bp, Homo sapiens
tagtttgacctcacagtgacc

SEQ ID NO: 2132936 - DNA, 17 bp, Homo sapiens
tagtttgtacatgcatt

SEQ ID NO: 2132937 - DNA, 17 bp, Homo sapiens
tagtttgtataacttct

SEQ ID NO: 2132938 - DNA, 18 bp, Homo sapiens
tagtttgtataacttctt

SEQ ID NO: 2132939 - DNA, 14 bp, Homo sapiens
tagttttaacagaa

SEQ ID NO: 2132940 - DNA, 20 bp, Homo sapiens
tagttttaacagaaccagag

SEQ ID NO: 2132941 - DNA, 18 bp, Homo sapiens
tagttttttttgtaaact

SEQ ID NO: 2132942 - DNA, 21 bp, Homo sapiens
tataaaaagaaaagataaaga

SEQ ID NO: 2132943 - DNA, 14 bp, Homo sapiens
tataaaaatacaac

SEQ ID NO: 2132944 - DNA, 19 bp, Homo sapiens
tataaaatgcaaaataaat

SEQ ID NO: 2132945 - DNA, 21 bp, Homo sapiens
tataaaatgcccatttcgaag

SEQ ID NO: 2132946 - DNA, 15 bp, Homo sapiens
tataaaattagaaag

SEQ ID NO: 2132947 - DNA, 18 bp, Homo sapiens
tataaaattagaaagcaa

SEQ ID NO: 2132948 - DNA, 17 bp, Homo sapiens
tataaacattaaaagaa

SEQ ID NO: 2132949 - DNA, 16 bp, Homo sapiens
tataaacattaaatgt

SEQ ID NO: 2132950 - DNA, 16 bp, Homo sapiens
tataaactagatctcc

SEQ ID NO: 2132951 - DNA, 16 bp, Homo sapiens
tataaaggttgacaat

SEQ ID NO: 2132952 - DNA, 22 bp, Homo sapiens
tataaatacacttcctgcttaa

SEQ ID NO: 2132953 - DNA, 14 bp, Homo sapiens
tataaatatatatt

SEQ ID NO: 2132954 - DNA, 20 bp, Homo sapiens
tataaatatatatttttcaa

SEQ ID NO: 2132955 - DNA, 20 bp, Homo sapiens
tataaatcaatgtcacttaa

SEQ ID NO: 2132956 - DNA, 13 bp, Homo sapiens
tataaatgcatga

SEQ ID NO: 2132957 - DNA, 15 bp, Homo sapiens
tataaatgcatgatt

SEQ ID NO: 2132958 - DNA, 16 bp, Homo sapiens
tataaatggtgttttt

SEQ ID NO: 2132959 - DNA, 16 bp, Homo sapiens
tataaatgtatataca

SEQ ID NO: 2132960 - DNA, 20 bp, Homo sapiens
tataaatgtatatacacata

SEQ ID NO: 2132961 - DNA, 19 bp, Homo sapiens
tataacaaggttcttctaa

SEQ ID NO: 2132962 - DNA, 16 bp, Homo sapiens
tataaccagacacata

SEQ ID NO: 2132963 - DNA, 16 bp, Homo sapiens
tataaccattacatgt

SEQ ID NO: 2132964 - DNA, 12 bp, Homo sapiens
tataaccccacc

SEQ ID NO: 2132965 - DNA, 16 bp, Homo sapiens
tataactagctagaag

SEQ ID NO: 2132966 - DNA, 19 bp, Homo sapiens
tataactcatcataaaata

SEQ ID NO: 2132967 - DNA, 21 bp, Homo sapiens
tataactcatcataaaataaa

SEQ ID NO: 2132968 - DNA, 17 bp, Homo sapiens
tataactgcatagtaat

SEQ ID NO: 2132969 - DNA, 18 bp, Homo sapiens
tataacttaaaaaaatga

SEQ ID NO: 2132970 - DNA, 13 bp, Homo sapiens
tataactttagaa

SEQ ID NO: 2132971 - DNA, 15 bp, Homo sapiens
tataactttagaaat

SEQ ID NO: 2132972 - DNA, 16 bp, Homo sapiens
tataactttagaaata

SEQ ID NO: 2132973 - DNA, 14 bp, Homo sapiens
tataagaagaggaa

SEQ ID NO: 2132974 - DNA, 21 bp, Homo sapiens
tatcagttactcagccctggg

SEQ ID NO: 2132975 - DNA, 14 bp, Homo sapiens
tatcataaagtatg

SEQ ID NO: 2132976 - DNA, 18 bp, Homo sapiens
tatcatagaaatgtaact

SEQ ID NO: 2132977 - DNA, 15 bp, Homo sapiens
tatcatattggtatt

SEQ ID NO: 2132978 - DNA, 18 bp, Homo sapiens
tatcatcagatagcatct

SEQ ID NO: 2132979 - DNA, 16 bp, Homo sapiens
tatcattaaattggaa

SEQ ID NO: 2132980 - DNA, 13 bp, Homo sapiens
tatccaatcctca

SEQ ID NO: 2132981 - DNA, 14 bp, Homo sapiens
tatccaattatgtg

SEQ ID NO: 2132982 - DNA, 18 bp, Homo sapiens
tatccaattatgtgacaa

SEQ ID NO: 2132983 - DNA, 19 bp, Homo sapiens
tatccaattatgtgacaac

SEQ ID NO: 2132984 - DNA, 13 bp, Homo sapiens
tatccacccagcc

SEQ ID NO: 2132985 - DNA, 15 bp, Homo sapiens
tatccacccagccca

SEQ ID NO: 2132986 - DNA, 19 bp, Homo sapiens
tatccacccagcccattct

SEQ ID NO: 2132987 - DNA, 11 bp, Homo sapiens
tatccagtcta

SEQ ID NO: 2132988 - DNA, 20 bp, Homo sapiens
tatccagtgatgtgctggag

SEQ ID NO: 2132989 - DNA, 17 bp, Homo sapiens
tatcccaaacttcggaa

SEQ ID NO: 2132990 - DNA, 16 bp, Homo sapiens
tatccccatttctttt

SEQ ID NO: 2132991 - DNA, 20 bp, Homo sapiens
tatcctagagaggctggcaa

SEQ ID NO: 2132992 - DNA, 16 bp, Homo sapiens
tatcctataggcagac

SEQ ID NO: 2132993 - DNA, 18 bp, Homo sapiens
tatccttaggaaaatgct

SEQ ID NO: 2132994 - DNA, 17 bp, Homo sapiens
tatcctttgccccaagg

SEQ ID NO: 2132995 - DNA, 15 bp, Homo sapiens
tatcggaagcagtgc

SEQ ID NO: 2132996 - DNA, 16 bp, Homo sapiens
tatcgggaacagtgtt

SEQ ID NO: 2132997 - DNA, 17 bp, Homo sapiens
tatcgggagcagtgtct

SEQ ID NO: 2132998 - DNA, 22 bp, Homo sapiens
tatctaagttaatttaaagttg

SEQ ID NO: 2132999 - DNA, 16 bp, Homo sapiens
tatctaatacctctgt

SEQ ID NO: 2133000 - DNA, 16 bp, Homo sapiens
tatctaatttatacaa

SEQ ID NO: 2133001 - DNA, 20 bp, Homo sapiens
tatctaatttatacaaaata

SEQ ID NO: 2133002 - DNA, 21 bp, Homo sapiens
tatctaatttatacaaaataa

SEQ ID NO: 2133003 - DNA, 14 bp, Homo sapiens
tatctacctgccct

SEQ ID NO: 2133004 - DNA, 16 bp, Homo sapiens
tatctacctgccctct

SEQ ID NO: 2133005 - DNA, 19 bp, Homo sapiens
tatctacctgccctctctc

SEQ ID NO: 2133006 - DNA, 15 bp, Homo sapiens
tatctagaaagaaaa

SEQ ID NO: 2133007 - DNA, 22 bp, Homo sapiens
tatctatagtagtcaattagta

SEQ ID NO: 2133008 - DNA, 13 bp, Homo sapiens
tatctatcttata

SEQ ID NO: 2133009 - DNA, 19 bp, Homo sapiens
tatctatggccctgcaaaa

SEQ ID NO: 2133010 - DNA, 21 bp, Homo sapiens
tatctatggccctgcaaaaat

SEQ ID NO: 2133011 - DNA, 23 bp, Homo sapiens
tatctccaggattgaagagcatt

SEQ ID NO: 2133012 - DNA, 13 bp, Homo sapiens
tatctcctcctat

SEQ ID NO: 2133013 - DNA, 17 bp, Homo sapiens
tatctctaggctgtttt

SEQ ID NO: 2133014 - DNA, 23 bp, Homo sapiens
tatctctgtgtgcacaaatattt

SEQ ID NO: 2133015 - DNA, 22 bp, Homo sapiens
tatctcttttgaatccatgctt

SEQ ID NO: 2133016 - DNA, 12 bp, Homo sapiens
tatctgaaaact

SEQ ID NO: 2133017 - DNA, 16 bp, Homo sapiens
tatctgaaaactggaa

SEQ ID NO: 2133018 - DNA, 22 bp, Homo sapiens
tatctgaacacatactagaaag

SEQ ID NO: 2133019 - DNA, 22 bp, Homo sapiens
tatctgagaagtgtatatagtt

SEQ ID NO: 2133020 - DNA, 23 bp, Homo sapiens
tatctgaggcactgataatatgt

SEQ ID NO: 2133021 - DNA, 13 bp, Homo sapiens
tatctgaggtcac

SEQ ID NO: 2133022 - DNA, 15 bp, Homo sapiens
tatctgataaaattg

SEQ ID NO: 2133023 - DNA, 23 bp, Homo sapiens
tatctgataaaattgtgatgttt

SEQ ID NO: 2133024 - DNA, 21 bp, Homo sapiens
tatctgatcgggataacaaaa

SEQ ID NO: 2133025 - DNA, 20 bp, Homo sapiens
tatctgcatttataaatgtg

SEQ ID NO: 2133026 - DNA, 11 bp, Homo sapiens
tatctgcctgg

SEQ ID NO: 2133027 - DNA, 14 bp, Homo sapiens
tatctgcctggcct

SEQ ID NO: 2133028 - DNA, 15 bp, Homo sapiens
tatctgcctggcctg

SEQ ID NO: 2133029 - DNA, 18 bp, Homo sapiens
tatctggacaagccaact

SEQ ID NO: 2133030 - DNA, 20 bp, Homo sapiens
tatctgtcacacaaggctgg

SEQ ID NO: 2133031 - DNA, 15 bp, Homo sapiens
tatctgtcatctctc

SEQ ID NO: 2133032 - DNA, 20 bp, Homo sapiens
tatcttacctgtaaagtcta

SEQ ID NO: 2133033 - DNA, 18 bp, Homo sapiens
tatcttactatttcacaa

SEQ ID NO: 2133034 - DNA, 14 bp, Homo sapiens
tatcttatgttaaa

SEQ ID NO: 2133035 - DNA, 21 bp, Homo sapiens
tatcttatttaatttttgcaa

SEQ ID NO: 2133036 - DNA, 12 bp, Homo sapiens
tatcttgaagaa

SEQ ID NO: 2133037 - DNA, 13 bp, Homo sapiens
tatcttgaagaat

SEQ ID NO: 2133038 - DNA, 22 bp, Homo sapiens
tatctttttgcttacagtttta

SEQ ID NO: 2133039 - DNA, 14 bp, Homo sapiens
tatgaaaagctaga

SEQ ID NO: 2133040 - DNA, 19 bp, Homo sapiens
tatgaaaagctagaattga

SEQ ID NO: 2133041 - DNA, 12 bp, Homo sapiens
tatgaaatgata

SEQ ID NO: 2133042 - DNA, 20 bp, Homo sapiens
tatgaaatgataaagatgtc

SEQ ID NO: 2133043 - DNA, 14 bp, Homo sapiens
tatgaaatgtttca

SEQ ID NO: 2133044 - DNA, 23 bp, Homo sapiens
tatgaacaaagaaaaaaatatat

SEQ ID NO: 2133045 - DNA, 20 bp, Homo sapiens
tatgaacttgaggacacatg

SEQ ID NO: 2133046 - DNA, 21 bp, Homo sapiens
tatgaacttgaggacacatgt

SEQ ID NO: 2133047 - DNA, 15 bp, Homo sapiens
tatgaagaaaaaata

SEQ ID NO: 2133048 - DNA, 12 bp, Homo sapiens
tatgaatacagg

SEQ ID NO: 2133049 - DNA, 19 bp, Homo sapiens
tatgaatgtgcatttcttg

SEQ ID NO: 2133050 - DNA, 13 bp, Homo sapiens
tatgacactgagc

SEQ ID NO: 2133051 - DNA, 16 bp, Homo sapiens
tatgacagctgtccct

SEQ ID NO: 2133052 - DNA, 20 bp, Homo sapiens
tatgacagctgtccctgtca

SEQ ID NO: 2133053 - DNA, 19 bp, Homo sapiens
tatgacatcacttgtacaa

SEQ ID NO: 2133054 - DNA, 22 bp, Homo sapiens
tatgacatgccaccctctccat

SEQ ID NO: 2133055 - DNA, 14 bp, Homo sapiens
tatgaggcattgag

SEQ ID NO: 2133056 - DNA, 14 bp, Homo sapiens
tatgaggtgaaatg

SEQ ID NO: 2133057 - DNA, 15 bp, Homo sapiens
tatgagtatacaata

SEQ ID NO: 2133058 - DNA, 16 bp, Homo sapiens
tatgagtatacaatat

SEQ ID NO: 2133059 - DNA, 20 bp, Homo sapiens
tatgagtatacaatatataa

SEQ ID NO: 2133060 - DNA, 23 bp, Homo sapiens
tatgagtatacaatatataaaaa

SEQ ID NO: 2133061 - DNA, 17 bp, Homo sapiens
tatgagtcagtctctct

SEQ ID NO: 2133062 - DNA, 18 bp, Homo sapiens
tatgagttgttttcagac

SEQ ID NO: 2133063 - DNA, 22 bp, Homo sapiens
tatgagttgttttcagactcag

SEQ ID NO: 2133064 - DNA, 22 bp, Homo sapiens
tatgagtttttgatagctttat

SEQ ID NO: 2133065 - DNA, 13 bp, Homo sapiens
tatgatatccctg

SEQ ID NO: 2133066 - DNA, 21 bp, Homo sapiens
tatgatattttgtctcctacc

SEQ ID NO: 2133067 - DNA, 13 bp, Homo sapiens
tatgatctaatac

SEQ ID NO: 2133068 - DNA, 15 bp, Homo sapiens
tatgatgtgttgtga

SEQ ID NO: 2133069 - DNA, 17 bp, Homo sapiens
tatgatttaaaaaataa

SEQ ID NO: 2133070 - DNA, 15 bp, Homo sapiens
tatgatttatagttt

SEQ ID NO: 2133071 - DNA, 18 bp, Homo sapiens
tatgatttatagtttgta

SEQ ID NO: 2133072 - DNA, 17 bp, Homo sapiens
tatgattttttaaaaga

SEQ ID NO: 2133073 - DNA, 20 bp, Homo sapiens
tatgcaaatgcctccaagcc

SEQ ID NO: 2133074 - DNA, 14 bp, Homo sapiens
tatgcaccttgtgt

SEQ ID NO: 2133075 - DNA, 19 bp, Homo sapiens
tatgcaccttgtgtctgta

SEQ ID NO: 2133076 - DNA, 12 bp, Homo sapiens
tatgcactggcc

SEQ ID NO: 2133077 - DNA, 14 bp, Homo sapiens
tatgcagaatgttt

SEQ ID NO: 2133078 - DNA, 19 bp, Homo sapiens
tatgcatttaattctgaaa

SEQ ID NO: 2133079 - DNA, 15 bp, Homo sapiens
tatgccccaaatata

SEQ ID NO: 2133080 - DNA, 14 bp, Homo sapiens
tatgcctgctattt

SEQ ID NO: 2133081 - DNA, 18 bp, Homo sapiens
tatgcctgctatttgaag

SEQ ID NO: 2133082 - DNA, 19 bp, Homo sapiens
tatgcgtcccaagcagccg

SEQ ID NO: 2133083 - DNA, 13 bp, Homo sapiens
tatgctaatcagg

SEQ ID NO: 2133084 - DNA, 20 bp, Homo sapiens
tatgctagtttattggaagt

SEQ ID NO: 2133085 - DNA, 21 bp, Homo sapiens
tatgctagtttattggaagtg

SEQ ID NO: 2133086 - DNA, 22 bp, Homo sapiens
tatgctgagtatgttaagctct

SEQ ID NO: 2133087 - DNA, 12 bp, Homo sapiens
tatgctggccag

SEQ ID NO: 2133088 - DNA, 20 bp, Homo sapiens
tatgctggccagcaccctct

SEQ ID NO: 2133089 - DNA, 21 bp, Homo sapiens
tcataaacaacttaatgttct

SEQ ID NO: 2133090 - DNA, 15 bp, Homo sapiens
tcataaactgagcct

SEQ ID NO: 2133091 - DNA, 14 bp, Homo sapiens
tcataaagaattgt

SEQ ID NO: 2133092 - DNA, 13 bp, Homo sapiens
tcataacatcttt

SEQ ID NO: 2133093 - DNA, 15 bp, Homo sapiens
tcataacatctttga

SEQ ID NO: 2133094 - DNA, 21 bp, Homo sapiens
tcataacttgctgaatttcag

SEQ ID NO: 2133095 - DNA, 17 bp, Homo sapiens
tcataactttcattaaa

SEQ ID NO: 2133096 - DNA, 19 bp, Homo sapiens
tcataaggaagttattaac

SEQ ID NO: 2133097 - DNA, 13 bp, Homo sapiens
tcataattttcaa

SEQ ID NO: 2133098 - DNA, 19 bp, Homo sapiens
tcatacaaaactgttcacg

SEQ ID NO: 2133099 - DNA, 23 bp, Homo sapiens
tcatacaatgacaagtatgatga

SEQ ID NO: 2133100 - DNA, 14 bp, Homo sapiens
tcataccatctgct

SEQ ID NO: 2133101 - DNA, 16 bp, Homo sapiens
tcatacgcatggtcct

SEQ ID NO: 2133102 - DNA, 19 bp, Homo sapiens
tcatagaaagtgccagaaa

SEQ ID NO: 2133103 - DNA, 18 bp, Homo sapiens
tcatagcagattttaatt

SEQ ID NO: 2133104 - DNA, 18 bp, Homo sapiens
tcataggcggtcatgtgt

SEQ ID NO: 2133105 - DNA, 21 bp, Homo sapiens
tcataggcggtcatgtgtgca

SEQ ID NO: 2133106 - DNA, 23 bp, Homo sapiens
tcataggcggtcatgtgtgcatg

SEQ ID NO: 2133107 - DNA, 18 bp, Homo sapiens
tcatagggtctcttcagg

SEQ ID NO: 2133108 - DNA, 20 bp, Homo sapiens
tcatagggtctcttcaggtt

SEQ ID NO: 2133109 - DNA, 16 bp, Homo sapiens
tcataggtatttcaaa

SEQ ID NO: 2133110 - DNA, 15 bp, Homo sapiens
tcatagtatggtggc

SEQ ID NO: 2133111 - DNA, 16 bp, Homo sapiens
tcatataaagtatcat

SEQ ID NO: 2133112 - DNA, 16 bp, Homo sapiens
tcatataataaatgta

SEQ ID NO: 2133113 - DNA, 13 bp, Homo sapiens
tcatatatttaag

SEQ ID NO: 2133114 - DNA, 15 bp, Homo sapiens
tcatatccagctgag

SEQ ID NO: 2133115 - DNA, 18 bp, Homo sapiens
tcatatccagctgagtga

SEQ ID NO: 2133116 - DNA, 17 bp, Homo sapiens
tcatatcctttgcccca

SEQ ID NO: 2133117 - DNA, 11 bp, Homo sapiens
tcatatgaaaa

SEQ ID NO: 2133118 - DNA, 15 bp, Homo sapiens
tcatatgtagccctc

SEQ ID NO: 2133119 - DNA, 14 bp, Homo sapiens
tcatattgtttcct

SEQ ID NO: 2133120 - DNA, 19 bp, Homo sapiens
tcatatttaaagacaggga

SEQ ID NO: 2133121 - DNA, 13 bp, Homo sapiens
tcatcaattaaag

SEQ ID NO: 2133122 - DNA, 13 bp, Homo sapiens
tcatcaattttta

SEQ ID NO: 2133123 - DNA, 19 bp, Homo sapiens
tcatcaatttttatacata

SEQ ID NO: 2133124 - DNA, 20 bp, Homo sapiens
tcatcaatttttatacatat

SEQ ID NO: 2133125 - DNA, 22 bp, Homo sapiens
tcatcaatttttatacatatca

SEQ ID NO: 2133126 - DNA, 15 bp, Homo sapiens
tcatcactggatgaa

SEQ ID NO: 2133127 - DNA, 15 bp, Homo sapiens
tcatcacttttcagt

SEQ ID NO: 2133128 - DNA, 22 bp, Homo sapiens
tcatcagaagtggtaggaaagc

SEQ ID NO: 2133129 - DNA, 21 bp, Homo sapiens
tcatcagcatacctttattgt

SEQ ID NO: 2133130 - DNA, 18 bp, Homo sapiens
tcatcagtagatggtacg

SEQ ID NO: 2133131 - DNA, 13 bp, Homo sapiens
tcatcataaaata

SEQ ID NO: 2133132 - DNA, 14 bp, Homo sapiens
tcatcatattgtat

SEQ ID NO: 2133133 - DNA, 14 bp, Homo sapiens
tcatcattccttga

SEQ ID NO: 2133134 - DNA, 17 bp, Homo sapiens
tcatcattccttgagaa

SEQ ID NO: 2133135 - DNA, 23 bp, Homo sapiens
tcatccaaggaacctaattgaaa

SEQ ID NO: 2133136 - DNA, 14 bp, Homo sapiens
tcatccagttgcaa

SEQ ID NO: 2133137 - DNA, 19 bp, Homo sapiens
tcatccagttgcaataaaa

SEQ ID NO: 2133138 - DNA, 21 bp, Homo sapiens
tcatccagttgcaataaaata

SEQ ID NO: 2133139 - DNA, 21 bp, Homo sapiens
tcatccagtttgttctccggg

SEQ ID NO: 2133140 - DNA, 20 bp, Homo sapiens
tcatccataaagcaagctca

SEQ ID NO: 2133141 - DNA, 23 bp, Homo sapiens
tcatcccaaaggacagccgcctg

SEQ ID NO: 2133142 - DNA, 20 bp, Homo sapiens
tcatcccctcgtcctgtccc

SEQ ID NO: 2133143 - DNA, 13 bp, Homo sapiens
tcatccccttgtg

SEQ ID NO: 2133144 - DNA, 14 bp, Homo sapiens
tcatccccttgtgt

SEQ ID NO: 2133145 - DNA, 17 bp, Homo sapiens
tcatcccgctcctgctg

SEQ ID NO: 2133146 - DNA, 19 bp, Homo sapiens
tcatcctgtgtggggaggc

SEQ ID NO: 2133147 - DNA, 22 bp, Homo sapiens
tcatcctgtgtggggaggcagc

SEQ ID NO: 2133148 - DNA, 19 bp, Homo sapiens
tcatcgaaaattcatttca

SEQ ID NO: 2133149 - DNA, 21 bp, Homo sapiens
tcatcgaaaattcatttcaca

SEQ ID NO: 2133150 - DNA, 22 bp, Homo sapiens
tcatcgaaaattcatttcacat

SEQ ID NO: 2133151 - DNA, 18 bp, Homo sapiens
tcatcgaacaaactgatg

SEQ ID NO: 2133152 - DNA, 17 bp, Homo sapiens
tcatcgccagacaactg

SEQ ID NO: 2133153 - DNA, 19 bp, Homo sapiens
tcatcggaggctgggcccc

SEQ ID NO: 2133154 - DNA, 23 bp, Homo sapiens
tcatcggaggctgggcccctggg

SEQ ID NO: 2133155 - DNA, 22 bp, Homo sapiens
tcatctatggcagtccagccag

SEQ ID NO: 2133156 - DNA, 23 bp, Homo sapiens
tcatctatggcagtccagccagc

SEQ ID NO: 2133157 - DNA, 11 bp, Homo sapiens
tcatctatttc

SEQ ID NO: 2133158 - DNA, 15 bp, Homo sapiens
tcatctatttctgag

SEQ ID NO: 2133159 - DNA, 17 bp, Homo sapiens
tcatctatttctgagaa

SEQ ID NO: 2133160 - DNA, 16 bp, Homo sapiens
tcatctcatttaaggg

SEQ ID NO: 2133161 - DNA, 20 bp, Homo sapiens
tcatctcatttaagggaaaa

SEQ ID NO: 2133162 - DNA, 21 bp, Homo sapiens
tcatctcatttaatcctccct

SEQ ID NO: 2133163 - DNA, 14 bp, Homo sapiens
tcatctctctgggg

SEQ ID NO: 2133164 - DNA, 15 bp, Homo sapiens
tcatctctctggggc

SEQ ID NO: 2133165 - DNA, 16 bp, Homo sapiens
tcatctctctggggcc

SEQ ID NO: 2133166 - DNA, 20 bp, Homo sapiens
tcatctctctggggccctgg

SEQ ID NO: 2133167 - DNA, 21 bp, Homo sapiens
tcatctctctggggccctggg

SEQ ID NO: 2133168 - DNA, 22 bp, Homo sapiens
tcatctctctggggccctgggc

SEQ ID NO: 2133169 - DNA, 14 bp, Homo sapiens
tcatctgcagaatg

SEQ ID NO: 2133170 - DNA, 18 bp, Homo sapiens
tcatctgcggggcttctg

SEQ ID NO: 2133171 - DNA, 20 bp, Homo sapiens
tcatctgcggggcttctggg

SEQ ID NO: 2133172 - DNA, 17 bp, Homo sapiens
tcatctggattccagag

SEQ ID NO: 2133173 - DNA, 14 bp, Homo sapiens
tcatcttgccccct

SEQ ID NO: 2133174 - DNA, 15 bp, Homo sapiens
tcatcttgccccctc

SEQ ID NO: 2133175 - DNA, 15 bp, Homo sapiens
tcatgaacacagcct

SEQ ID NO: 2133176 - DNA, 22 bp, Homo sapiens
tcatgaacctcaagctgcatct

SEQ ID NO: 2133177 - DNA, 13 bp, Homo sapiens
tcatgacagccag

SEQ ID NO: 2133178 - DNA, 15 bp, Homo sapiens
tcatgacagccagag

SEQ ID NO: 2133179 - DNA, 19 bp, Homo sapiens
tcatgacagccagagcctg

SEQ ID NO: 2133180 - DNA, 13 bp, Homo sapiens
tcatgagctgagt

SEQ ID NO: 2133181 - DNA, 21 bp, Homo sapiens
tcatgaggggagaggcgccct

SEQ ID NO: 2133182 - DNA, 12 bp, Homo sapiens
tcatgagtggat

SEQ ID NO: 2133183 - DNA, 14 bp, Homo sapiens
tcatgagtggatgg

SEQ ID NO: 2133184 - DNA, 15 bp, Homo sapiens
tcatgagtggatgga

SEQ ID NO: 2133185 - DNA, 17 bp, Homo sapiens
tcatgatctccctgccg

SEQ ID NO: 2133186 - DNA, 11 bp, Homo sapiens
tcatgattttt

SEQ ID NO: 2133187 - DNA, 13 bp, Homo sapiens
tcatgcaatgaca

SEQ ID NO: 2133188 - DNA, 14 bp, Homo sapiens
tcatgcattcacaa

SEQ ID NO: 2133189 - DNA, 18 bp, Homo sapiens
tcatgccatctgttttca

SEQ ID NO: 2133190 - DNA, 19 bp, Homo sapiens
tcatgccatctgttttcaa

SEQ ID NO: 2133191 - DNA, 19 bp, Homo sapiens
tcatgcctcagtttcccca

SEQ ID NO: 2133192 - DNA, 16 bp, Homo sapiens
tcatgcctctgaggcc

SEQ ID NO: 2133193 - DNA, 22 bp, Homo sapiens
tcatgcctggcccccctccagg

SEQ ID NO: 2133194 - DNA, 23 bp, Homo sapiens
tcatgcctggcccccctccaggc

SEQ ID NO: 2133195 - DNA, 13 bp, Homo sapiens
tcatgctgacttg

SEQ ID NO: 2133196 - DNA, 17 bp, Homo sapiens
tcatgctgacttgcaga

SEQ ID NO: 2133197 - DNA, 19 bp, Homo sapiens
tcatgctgacttgcagagt

SEQ ID NO: 2133198 - DNA, 19 bp, Homo sapiens
tcatgctttaaagtgtaat

SEQ ID NO: 2133199 - DNA, 23 bp, Homo sapiens
tcatgctttcctaaagtctctgc

SEQ ID NO: 2133200 - DNA, 16 bp, Homo sapiens
tcatggaaaagcccag

SEQ ID NO: 2133201 - DNA, 22 bp, Homo sapiens
tcatggaaaagcccagtgacct

SEQ ID NO: 2133202 - DNA, 18 bp, Homo sapiens
tcatggcagatgtaggag

SEQ ID NO: 2133203 - DNA, 18 bp, Homo sapiens
tcatggtcagctcacacc

SEQ ID NO: 2133204 - DNA, 20 bp, Homo sapiens
tcccagttctacaagcatat

SEQ ID NO: 2133205 - DNA, 21 bp, Homo sapiens
tcccagttctacaagcatatt

SEQ ID NO: 2133206 - DNA, 22 bp, Homo sapiens
tcccataattttcttcatgcaa

SEQ ID NO: 2133207 - DNA, 17 bp, Homo sapiens
tcccatagccaggaaac

SEQ ID NO: 2133208 - DNA, 14 bp, Homo sapiens
tcccatagcgctgg

SEQ ID NO: 2133209 - DNA, 19 bp, Homo sapiens
tcccatagcgctggctcag

SEQ ID NO: 2133210 - DNA, 21 bp, Homo sapiens
tcccatattggcatggatttc

SEQ ID NO: 2133211 - DNA, 13 bp, Homo sapiens
tcccatcccctgg

SEQ ID NO: 2133212 - DNA, 15 bp, Homo sapiens
tcccatcccctggac

SEQ ID NO: 2133213 - DNA, 19 bp, Homo sapiens
tcccatctaagctgcagct

SEQ ID NO: 2133214 - DNA, 18 bp, Homo sapiens
tcccatctcctgatttct

SEQ ID NO: 2133215 - DNA, 23 bp, Homo sapiens
tcccatctcctgatttctctgaa

SEQ ID NO: 2133216 - DNA, 14 bp, Homo sapiens
tcccatctcttcct

SEQ ID NO: 2133217 - DNA, 17 bp, Homo sapiens
tcccatctgctcctccc

SEQ ID NO: 2133218 - DNA, 18 bp, Homo sapiens
tcccatgagcctcagcat

SEQ ID NO: 2133219 - DNA, 22 bp, Homo sapiens
tcccatgagcctcagcatcctg

SEQ ID NO: 2133220 - DNA, 17 bp, Homo sapiens
tcccatgatccagaact

SEQ ID NO: 2133221 - DNA, 23 bp, Homo sapiens
tcccatgatgccgctcttctgtc

SEQ ID NO: 2133222 - DNA, 12 bp, Homo sapiens
tcccatgctgaa

SEQ ID NO: 2133223 - DNA, 17 bp, Homo sapiens
tcccatgctgaattatt

SEQ ID NO: 2133224 - DNA, 15 bp, Homo sapiens
tcccatgtcacctca

SEQ ID NO: 2133225 - DNA, 20 bp, Homo sapiens
tcccatgtcacctcagctga

SEQ ID NO: 2133226 - DNA, 13 bp, Homo sapiens
tcccatgtgcatg

SEQ ID NO: 2133227 - DNA, 16 bp, Homo sapiens
tcccatgtgtgactcc

SEQ ID NO: 2133228 - DNA, 22 bp, Homo sapiens
tcccatgtgtgactccagcctg

SEQ ID NO: 2133229 - DNA, 15 bp, Homo sapiens
tcccattgccctggt

SEQ ID NO: 2133230 - DNA, 16 bp, Homo sapiens
tcccatttatcgcaga

SEQ ID NO: 2133231 - DNA, 13 bp, Homo sapiens
tcccatttccttg

SEQ ID NO: 2133232 - DNA, 14 bp, Homo sapiens
tcccatttccttgg

SEQ ID NO: 2133233 - DNA, 20 bp, Homo sapiens
tcccatttccttggaggcca

SEQ ID NO: 2133234 - DNA, 21 bp, Homo sapiens
tcccatttccttggaggccac

SEQ ID NO: 2133235 - DNA, 17 bp, Homo sapiens
tcccatttgtaatgtat

SEQ ID NO: 2133236 - DNA, 13 bp, Homo sapiens
tcccattttgcaa

SEQ ID NO: 2133237 - DNA, 19 bp, Homo sapiens
tcccattttggaagttttc

SEQ ID NO: 2133238 - DNA, 20 bp, Homo sapiens
tccccaaactgtgccctgcc

SEQ ID NO: 2133239 - DNA, 14 bp, Homo sapiens
tccccaattatctt

SEQ ID NO: 2133240 - DNA, 20 bp, Homo sapiens
tccccacacgtgctcgcagc

SEQ ID NO: 2133241 - DNA, 22 bp, Homo sapiens
tccccacacgtgctcgcagcct

SEQ ID NO: 2133242 - DNA, 23 bp, Homo sapiens
tccccacacgtgctcgcagcctg

SEQ ID NO: 2133243 - DNA, 12 bp, Homo sapiens
tccccacagcct

SEQ ID NO: 2133244 - DNA, 17 bp, Homo sapiens
tccccacatatggcaca

SEQ ID NO: 2133245 - DNA, 13 bp, Homo sapiens
tccccaccccact

SEQ ID NO: 2133246 - DNA, 13 bp, Homo sapiens
tccccacctggga

SEQ ID NO: 2133247 - DNA, 14 bp, Homo sapiens
tccccacctgggac

SEQ ID NO: 2133248 - DNA, 18 bp, Homo sapiens
tccccaccttcaattcct

SEQ ID NO: 2133249 - DNA, 15 bp, Homo sapiens
tccccaccttcccca

SEQ ID NO: 2133250 - DNA, 20 bp, Homo sapiens
tccccaccttcttcagccac

SEQ ID NO: 2133251 - DNA, 23 bp, Homo sapiens
tccccacgagtcacctgcaagcc

SEQ ID NO: 2133252 - DNA, 17 bp, Homo sapiens
tccccactctgctctga

SEQ ID NO: 2133253 - DNA, 20 bp, Homo sapiens
tccccactctgctctgatgc

SEQ ID NO: 2133254 - DNA, 13 bp, Homo sapiens
tccccagacacat

SEQ ID NO: 2133255 - DNA, 14 bp, Homo sapiens
tccccagacacatt

SEQ ID NO: 2133256 - DNA, 20 bp, Homo sapiens
tccccagacttctctttctt

SEQ ID NO: 2133257 - DNA, 23 bp, Homo sapiens
tccccagacttctctttcttatt

SEQ ID NO: 2133258 - DNA, 22 bp, Homo sapiens
tccccagattgcaacaggctgg

SEQ ID NO: 2133259 - DNA, 23 bp, Homo sapiens
tccccagattgcaacaggctggg

SEQ ID NO: 2133260 - DNA, 12 bp, Homo sapiens
tccccagccaga

SEQ ID NO: 2133261 - DNA, 15 bp, Homo sapiens
tccccagccagaagt

SEQ ID NO: 2133262 - DNA, 11 bp, Homo sapiens
tccccagctcc

SEQ ID NO: 2133263 - DNA, 12 bp, Homo sapiens
tccccagctccc

SEQ ID NO: 2133264 - DNA, 14 bp, Homo sapiens
tccccagctcccca

SEQ ID NO: 2133265 - DNA, 20 bp, Homo sapiens
tccccagctccccaggactc

SEQ ID NO: 2133266 - DNA, 18 bp, Homo sapiens
tccccaggactcaccctc

SEQ ID NO: 2133267 - DNA, 19 bp, Homo sapiens
tccccaggactcaccctca

SEQ ID NO: 2133268 - DNA, 23 bp, Homo sapiens
tccccaggactcaccctcatacc

SEQ ID NO: 2133269 - DNA, 16 bp, Homo sapiens
tccccaggccaggcca

SEQ ID NO: 2133270 - DNA, 15 bp, Homo sapiens
tccccaggcctccag

SEQ ID NO: 2133271 - DNA, 16 bp, Homo sapiens
tccccaggcctccagc

SEQ ID NO: 2133272 - DNA, 17 bp, Homo sapiens
tccccaggcctccagcc

SEQ ID NO: 2133273 - DNA, 19 bp, Homo sapiens
tccccaggcctccagcctc

SEQ ID NO: 2133274 - DNA, 11 bp, Homo sapiens
tccccagggcc

SEQ ID NO: 2133275 - DNA, 22 bp, Homo sapiens
tccccagggcccctccctctgc

SEQ ID NO: 2133276 - DNA, 14 bp, Homo sapiens
tccccaggtctctc

SEQ ID NO: 2133277 - DNA, 17 bp, Homo sapiens
tccccaggtctctccac

SEQ ID NO: 2133278 - DNA, 15 bp, Homo sapiens
tccccaggtggctga

SEQ ID NO: 2133279 - DNA, 22 bp, Homo sapiens
tccccaggtggctgacccagtc

SEQ ID NO: 2133280 - DNA, 22 bp, Homo sapiens
tccccagtctacgttctccagc

SEQ ID NO: 2133281 - DNA, 17 bp, Homo sapiens
tccccagtttgcagaaa

SEQ ID NO: 2133282 - DNA, 12 bp, Homo sapiens
tccccatctcca

SEQ ID NO: 2133283 - DNA, 22 bp, Homo sapiens
tccccatctccatttcacacag

SEQ ID NO: 2133284 - DNA, 22 bp, Homo sapiens
tccccatgcatgggaaagtgca

SEQ ID NO: 2133285 - DNA, 14 bp, Homo sapiens
tccccattcacaga

SEQ ID NO: 2133286 - DNA, 16 bp, Homo sapiens
tccccattcagacact

SEQ ID NO: 2133287 - DNA, 19 bp, Homo sapiens
tccccattcagacacttca

SEQ ID NO: 2133288 - DNA, 14 bp, Homo sapiens
tccccattcttcct

SEQ ID NO: 2133289 - DNA, 17 bp, Homo sapiens
tccccattcttcctagt

SEQ ID NO: 2133290 - DNA, 16 bp, Homo sapiens
tcccccaccccagagt

SEQ ID NO: 2133291 - DNA, 12 bp, Homo sapiens
tcccccacctga

SEQ ID NO: 2133292 - DNA, 14 bp, Homo sapiens
tcccccactgccac

SEQ ID NO: 2133293 - DNA, 20 bp, Homo sapiens
tcccccactgccacaccctc

SEQ ID NO: 2133294 - DNA, 14 bp, Homo sapiens
tcccccacttggga

SEQ ID NO: 2133295 - DNA, 13 bp, Homo sapiens
tcccccagacaga

SEQ ID NO: 2133296 - DNA, 13 bp, Homo sapiens
tcccccagccctc

SEQ ID NO: 2133297 - DNA, 23 bp, Homo sapiens
tcccccagccctcaggccagtgc

SEQ ID NO: 2133298 - DNA, 12 bp, Homo sapiens
tcccccagcctc

SEQ ID NO: 2133299 - DNA, 13 bp, Homo sapiens
tcccccatccccc

SEQ ID NO: 2133300 - DNA, 18 bp, Homo sapiens
tccccccactgcaggccc

SEQ ID NO: 2133301 - DNA, 14 bp, Homo sapiens
tccccccagcccct

SEQ ID NO: 2133302 - DNA, 22 bp, Homo sapiens
tccccccagcccctcctcccct

SEQ ID NO: 2133303 - DNA, 18 bp, Homo sapiens
tccccccccaacctttcc

SEQ ID NO: 2133304 - DNA, 16 bp, Homo sapiens
tcccccccctgtatag

SEQ ID NO: 2133305 - DNA, 17 bp, Homo sapiens
tcccccccctgtatagt

SEQ ID NO: 2133306 - DNA, 16 bp, Homo sapiens
tcccccggggcaaggt

SEQ ID NO: 2133307 - DNA, 13 bp, Homo sapiens
tccccctatgctc

SEQ ID NO: 2133308 - DNA, 19 bp, Homo sapiens
tccccctcccagggccagg

SEQ ID NO: 2133309 - DNA, 17 bp, Homo sapiens
tccccctgccagtgcct

SEQ ID NO: 2133310 - DNA, 13 bp, Homo sapiens
tccccctgcccca

SEQ ID NO: 2133311 - DNA, 13 bp, Homo sapiens
tccccctgctgct

SEQ ID NO: 2133312 - DNA, 20 bp, Homo sapiens
tccccctggggcttctcctg

SEQ ID NO: 2133313 - DNA, 14 bp, Homo sapiens
tcccccttcccagt

SEQ ID NO: 2133314 - DNA, 16 bp, Homo sapiens
tccccctttcaaggaa

SEQ ID NO: 2133315 - DNA, 24 bp, Homo sapiens
tccccgaaacaggctactctcctc

SEQ ID NO: 2133316 - DNA, 13 bp, Homo sapiens
tccccgcctgtcc

SEQ ID NO: 2133317 - DNA, 18 bp, Homo sapiens
tccccgcctgtcctgcct

SEQ ID NO: 2133318 - DNA, 12 bp, Homo sapiens
tccccggcctca

SEQ ID NO: 2133319 - DNA, 16 bp, Homo sapiens
tccctggcatgtcaga

SEQ ID NO: 2133320 - DNA, 18 bp, Homo sapiens
tccctggcatgtcagagc

SEQ ID NO: 2133321 - DNA, 19 bp, Homo sapiens
tccctggcctggctctcct

SEQ ID NO: 2133322 - DNA, 20 bp, Homo sapiens
tccctggctctcagaaggta

SEQ ID NO: 2133323 - DNA, 18 bp, Homo sapiens
tccctggcttgtaactcc

SEQ ID NO: 2133324 - DNA, 19 bp, Homo sapiens
tccctggcttgtaactcca

SEQ ID NO: 2133325 - DNA, 18 bp, Homo sapiens
tccctgggaactcatcct

SEQ ID NO: 2133326 - DNA, 19 bp, Homo sapiens
tccctgggaactcatcctg

SEQ ID NO: 2133327 - DNA, 16 bp, Homo sapiens
tccctgggcagaaagt

SEQ ID NO: 2133328 - DNA, 19 bp, Homo sapiens
tccctgggcctgctgctga

SEQ ID NO: 2133329 - DNA, 22 bp, Homo sapiens
tccctggggatatgcaaccctt

SEQ ID NO: 2133330 - DNA, 18 bp, Homo sapiens
tccctgggggaagccctg

SEQ ID NO: 2133331 - DNA, 21 bp, Homo sapiens
tccctgggggaagccctggat

SEQ ID NO: 2133332 - DNA, 17 bp, Homo sapiens
tccctggtccctcgtcc

SEQ ID NO: 2133333 - DNA, 22 bp, Homo sapiens
tccctggtccctcgtccacagg

SEQ ID NO: 2133334 - DNA, 16 bp, Homo sapiens
tccctggtgcagaggt

SEQ ID NO: 2133335 - DNA, 17 bp, Homo sapiens
tccctgtagctctgcct

SEQ ID NO: 2133336 - DNA, 14 bp, Homo sapiens
tccctgtcctcctc

SEQ ID NO: 2133337 - DNA, 20 bp, Homo sapiens
tccctgtgctgacggaagcc

SEQ ID NO: 2133338 - DNA, 16 bp, Homo sapiens
tccctgtgggggtggc

SEQ ID NO: 2133339 - DNA, 19 bp, Homo sapiens
tccctgttctcagctccgt

SEQ ID NO: 2133340 - DNA, 11 bp, Homo sapiens
tccctgtttaa

SEQ ID NO: 2133341 - DNA, 16 bp, Homo sapiens
tccctgtttaatattt

SEQ ID NO: 2133342 - DNA, 18 bp, Homo sapiens
tccctgtttaatatttaa

SEQ ID NO: 2133343 - DNA, 16 bp, Homo sapiens
tccctgttttaaatta

SEQ ID NO: 2133344 - DNA, 14 bp, Homo sapiens
tcccttaatatcct

SEQ ID NO: 2133345 - DNA, 17 bp, Homo sapiens
tcccttaatatcctaaa

SEQ ID NO: 2133346 - DNA, 21 bp, Homo sapiens
tcccttaatatcctaaacatc

SEQ ID NO: 2133347 - DNA, 22 bp, Homo sapiens
tcccttagtaatcccccttgcc

SEQ ID NO: 2133348 - DNA, 22 bp, Homo sapiens
tcccttcaaccattccccatgg

SEQ ID NO: 2133349 - DNA, 17 bp, Homo sapiens
tcccttcccccataagc

SEQ ID NO: 2133350 - DNA, 15 bp, Homo sapiens
tcccttctctccttc

SEQ ID NO: 2133351 - DNA, 23 bp, Homo sapiens
tcccttgaactgttctggcctca

SEQ ID NO: 2133352 - DNA, 17 bp, Homo sapiens
tcccttgagacctcagc

SEQ ID NO: 2133353 - DNA, 23 bp, Homo sapiens
tcccttgctgacatggctttgct

SEQ ID NO: 2133354 - DNA, 22 bp, Homo sapiens
tcccttggaaagttcagccaga

SEQ ID NO: 2133355 - DNA, 13 bp, Homo sapiens
tcccttgtgtgtg

SEQ ID NO: 2133356 - DNA, 18 bp, Homo sapiens
tccctttaaaattaaaaa

SEQ ID NO: 2133357 - DNA, 13 bp, Homo sapiens
tccctttctggga

SEQ ID NO: 2133358 - DNA, 18 bp, Homo sapiens
tccgaaaccagttaagaa

SEQ ID NO: 2133359 - DNA, 13 bp, Homo sapiens
tccgaccagacac

SEQ ID NO: 2133360 - DNA, 16 bp, Homo sapiens
tccgattaatttatgg

SEQ ID NO: 2133361 - DNA, 23 bp, Homo sapiens
tccgcaccagctgctctgcccct

SEQ ID NO: 2133362 - DNA, 13 bp, Homo sapiens
tccgcagcccagg

SEQ ID NO: 2133363 - DNA, 16 bp, Homo sapiens
tccgccccagacacac

SEQ ID NO: 2133364 - DNA, 14 bp, Homo sapiens
tccgcctcttgggt

SEQ ID NO: 2133365 - DNA, 21 bp, Homo sapiens
tccgcctgcagaggacagagc

SEQ ID NO: 2133366 - DNA, 18 bp, Homo sapiens
tccgcctggccggctcca

SEQ ID NO: 2133367 - DNA, 19 bp, Homo sapiens
tccgcctggccggctccag

SEQ ID NO: 2133368 - DNA, 16 bp, Homo sapiens
tccgctaagacctccc

SEQ ID NO: 2133369 - DNA, 19 bp, Homo sapiens
tccgctaagacctccccac

SEQ ID NO: 2133370 - DNA, 21 bp, Homo sapiens
tccgctcctttacctaccacc

SEQ ID NO: 2133371 - DNA, 16 bp, Homo sapiens
tccgctgtcgccccag

SEQ ID NO: 2133372 - DNA, 18 bp, Homo sapiens
tccgctgtcgccccaggc

SEQ ID NO: 2133373 - DNA, 18 bp, Homo sapiens
tccgctttctacccagcg

SEQ ID NO: 2133374 - DNA, 21 bp, Homo sapiens
tccgctttctacccagcgagc

SEQ ID NO: 2133375 - DNA, 14 bp, Homo sapiens
tccggaatgaccag

SEQ ID NO: 2133376 - DNA, 21 bp, Homo sapiens
tccggcctgatgacagagcga

SEQ ID NO: 2133377 - DNA, 19 bp, Homo sapiens
tccggcggcgagctctggc

SEQ ID NO: 2133378 - DNA, 23 bp, Homo sapiens
tccgggaccattgacctcagctg

SEQ ID NO: 2133379 - DNA, 18 bp, Homo sapiens
tccgggacgcttccagac

SEQ ID NO: 2133380 - DNA, 19 bp, Homo sapiens
tccgggacgcttccagacc

SEQ ID NO: 2133381 - DNA, 19 bp, Homo sapiens
tccgggagagcggctgccc

SEQ ID NO: 2133382 - DNA, 14 bp, Homo sapiens
tccgggtgccattc

SEQ ID NO: 2133383 - DNA, 16 bp, Homo sapiens
tccgggtgtggcctca

SEQ ID NO: 2133384 - DNA, 17 bp, Homo sapiens
tccgggtgtggcctcag

SEQ ID NO: 2133385 - DNA, 18 bp, Homo sapiens
tccgggtgtggcctcagc

SEQ ID NO: 2133386 - DNA, 20 bp, Homo sapiens
tccgggtgtggcctcagccc

SEQ ID NO: 2133387 - DNA, 15 bp, Homo sapiens
tccggtgtgcctgca

SEQ ID NO: 2133388 - DNA, 17 bp, Homo sapiens
tccggtgtgcctgcagc

SEQ ID NO: 2133389 - DNA, 15 bp, Homo sapiens
tccgtaaaaatgatt

SEQ ID NO: 2133390 - DNA, 22 bp, Homo sapiens
tccgtcacatatacaaaagcaa

SEQ ID NO: 2133391 - DNA, 17 bp, Homo sapiens
tccgtcatctgcggggc

SEQ ID NO: 2133392 - DNA, 17 bp, Homo sapiens
tccgtccacccaggctg

SEQ ID NO: 2133393 - DNA, 22 bp, Homo sapiens
tccgtccacccaggctgcactg

SEQ ID NO: 2133394 - DNA, 17 bp, Homo sapiens
tccgtctccctaaaata

SEQ ID NO: 2133395 - DNA, 23 bp, Homo sapiens
tccgtgaagggcaccgagaactc

SEQ ID NO: 2133396 - DNA, 20 bp, Homo sapiens
tccgtgagtgaaccatcatt

SEQ ID NO: 2133397 - DNA, 12 bp, Homo sapiens
tccgtgctgggc

SEQ ID NO: 2133398 - DNA, 12 bp, Homo sapiens
tccgttccagga

SEQ ID NO: 2133399 - DNA, 20 bp, Homo sapiens
tcctaaaaataagctttatt

SEQ ID NO: 2133400 - DNA, 23 bp, Homo sapiens
tcctaaacccccgctccagatct

SEQ ID NO: 2133401 - DNA, 15 bp, Homo sapiens
tcctaaagtctctgc

SEQ ID NO: 2133402 - DNA, 15 bp, Homo sapiens
tcctaagacttcagt

SEQ ID NO: 2133403 - DNA, 20 bp, Homo sapiens
tcctaagacttcagtcctgg

SEQ ID NO: 2133404 - DNA, 13 bp, Homo sapiens
tcctaagcagctg

SEQ ID NO: 2133405 - DNA, 16 bp, Homo sapiens
tcctaaggacacacta

SEQ ID NO: 2133406 - DNA, 23 bp, Homo sapiens
tcctaagtgggaagtgaagcccc

SEQ ID NO: 2133407 - DNA, 20 bp, Homo sapiens
tcctacagaaatactgctct

SEQ ID NO: 2133408 - DNA, 21 bp, Homo sapiens
tcctacagaaatactgctctg

SEQ ID NO: 2133409 - DNA, 16 bp, Homo sapiens
tcctacagatagtcaa

SEQ ID NO: 2133410 - DNA, 16 bp, Homo sapiens
tcctaccaaatataaa

SEQ ID NO: 2133411 - DNA, 16 bp, Homo sapiens
tcctacctatattaca

SEQ ID NO: 2133412 - DNA, 13 bp, Homo sapiens
tcctacctcagcc

SEQ ID NO: 2133413 - DNA, 14 bp, Homo sapiens
tcctacctcagcct

SEQ ID NO: 2133414 - DNA, 17 bp, Homo sapiens
tcctacctcagcctaga

SEQ ID NO: 2133415 - DNA, 14 bp, Homo sapiens
tcctacctgctgct

SEQ ID NO: 2133416 - DNA, 20 bp, Homo sapiens
tcctacgtcaaacatgaagt

SEQ ID NO: 2133417 - DNA, 12 bp, Homo sapiens
tcctactctgtg

SEQ ID NO: 2133418 - DNA, 14 bp, Homo sapiens
tcctactctgtgtc

SEQ ID NO: 2133419 - DNA, 22 bp, Homo sapiens
tcctagaagagtcaggaaggga

SEQ ID NO: 2133420 - DNA, 19 bp, Homo sapiens
tcctagagctcctgtccct

SEQ ID NO: 2133421 - DNA, 19 bp, Homo sapiens
tcctagaggtgggcagctg

SEQ ID NO: 2133422 - DNA, 20 bp, Homo sapiens
tcctagaggtgggcagctgg

SEQ ID NO: 2133423 - DNA, 17 bp, Homo sapiens
tcctagccactcaggag

SEQ ID NO: 2133424 - DNA, 14 bp, Homo sapiens
tcctaggagaagca

SEQ ID NO: 2133425 - DNA, 22 bp, Homo sapiens
tcctaggagaagcagcctccta

SEQ ID NO: 2133426 - DNA, 16 bp, Homo sapiens
tcctaggccccagagc

SEQ ID NO: 2133427 - DNA, 20 bp, Homo sapiens
tcctaggctccaccccatcc

SEQ ID NO: 2133428 - DNA, 22 bp, Homo sapiens
tcctaggctccaccccatccag

SEQ ID NO: 2133429 - DNA, 17 bp, Homo sapiens
tcctaggcttaaatgca

SEQ ID NO: 2133430 - DNA, 20 bp, Homo sapiens
tcctaggcttaaatgcaata

SEQ ID NO: 2133431 - DNA, 20 bp, Homo sapiens
tcctagggaaaagttcatag

SEQ ID NO: 2133432 - DNA, 22 bp, Homo sapiens
tcctaggggccgagggaaatgc

SEQ ID NO: 2133433 - DNA, 18 bp, Homo sapiens
tctaagttcatgtttgta

SEQ ID NO: 2133434 - DNA, 20 bp, Homo sapiens
tctaagttcatgtttgtaaa

SEQ ID NO: 2133435 - DNA, 13 bp, Homo sapiens
tctaagttctatt

SEQ ID NO: 2133436 - DNA, 21 bp, Homo sapiens
tctaagtttagaagcgctcat

SEQ ID NO: 2133437 - DNA, 24 bp, Homo sapiens
tctaagtttggttagccttagttt

SEQ ID NO: 2133438 - DNA, 14 bp, Homo sapiens
tctaatacctctgt

SEQ ID NO: 2133439 - DNA, 20 bp, Homo sapiens
tctaatacctctgtgtgctc

SEQ ID NO: 2133440 - DNA, 22 bp, Homo sapiens
tctaatagaactcagttttaac

SEQ ID NO: 2133441 - DNA, 15 bp, Homo sapiens
tctaatatattttta

SEQ ID NO: 2133442 - DNA, 19 bp, Homo sapiens
tctaatcaggttgttaatg

SEQ ID NO: 2133443 - DNA, 20 bp, Homo sapiens
tctaatcaggttgttaatgt

SEQ ID NO: 2133444 - DNA, 17 bp, Homo sapiens
tctaatcttgttaaatt

SEQ ID NO: 2133445 - DNA, 19 bp, Homo sapiens
tctaattcccattttgcaa

SEQ ID NO: 2133446 - DNA, 15 bp, Homo sapiens
tctaatttatacaaa

SEQ ID NO: 2133447 - DNA, 19 bp, Homo sapiens
tctaatttatacaaaataa

SEQ ID NO: 2133448 - DNA, 16 bp, Homo sapiens
tctacaaccagagccc

SEQ ID NO: 2133449 - DNA, 23 bp, Homo sapiens
tctacaaccagagccccccacaa

SEQ ID NO: 2133450 - DNA, 17 bp, Homo sapiens
tctacaagcatatttga

SEQ ID NO: 2133451 - DNA, 20 bp, Homo sapiens
tctacaagcatttgccctgt

SEQ ID NO: 2133452 - DNA, 23 bp, Homo sapiens
tctacaagcatttgccctgtgga

SEQ ID NO: 2133453 - DNA, 21 bp, Homo sapiens
tctacacagcctggactttgg

SEQ ID NO: 2133454 - DNA, 16 bp, Homo sapiens
tctacacagtaaaaac

SEQ ID NO: 2133455 - DNA, 15 bp, Homo sapiens
tctacagaggccatg

SEQ ID NO: 2133456 - DNA, 21 bp, Homo sapiens
tctacagaggccatgggcctc

SEQ ID NO: 2133457 - DNA, 16 bp, Homo sapiens
tctacagcatacagag

SEQ ID NO: 2133458 - DNA, 22 bp, Homo sapiens
tctacccagagccttctcctgc

SEQ ID NO: 2133459 - DNA, 20 bp, Homo sapiens
tctacccagcgagccctggt

SEQ ID NO: 2133460 - DNA, 15 bp, Homo sapiens
tctacccatattaca

SEQ ID NO: 2133461 - DNA, 16 bp, Homo sapiens
tctacccggcccagag

SEQ ID NO: 2133462 - DNA, 14 bp, Homo sapiens
tctacctgagcatt

SEQ ID NO: 2133463 - DNA, 20 bp, Homo sapiens
tctacctgagcattcaggca

SEQ ID NO: 2133464 - DNA, 22 bp, Homo sapiens
tctacctgagcattcaggcagc

SEQ ID NO: 2133465 - DNA, 19 bp, Homo sapiens
tctacctgccctctctcag

SEQ ID NO: 2133466 - DNA, 11 bp, Homo sapiens
tctacctgtgg

SEQ ID NO: 2133467 - DNA, 20 bp, Homo sapiens
tctacctgtgttcattctta

SEQ ID NO: 2133468 - DNA, 20 bp, Homo sapiens
tctacgccaaagtgcagccc

SEQ ID NO: 2133469 - DNA, 16 bp, Homo sapiens
tctacgctctcctttc

SEQ ID NO: 2133470 - DNA, 17 bp, Homo sapiens
tctacgctctcctttct

SEQ ID NO: 2133471 - DNA, 20 bp, Homo sapiens
tctacgtataaatatgaaat

SEQ ID NO: 2133472 - DNA, 22 bp, Homo sapiens
tctacgtataaatatgaaatga

SEQ ID NO: 2133473 - DNA, 22 bp, Homo sapiens
tctactcctacctcagcctaga

SEQ ID NO: 2133474 - DNA, 20 bp, Homo sapiens
tctactgggaaggctacttc

SEQ ID NO: 2133475 - DNA, 16 bp, Homo sapiens
tctactggtcttgtgg

SEQ ID NO: 2133476 - DNA, 21 bp, Homo sapiens
tctagaaagaaaagaccctga

SEQ ID NO: 2133477 - DNA, 17 bp, Homo sapiens
tctagaaagtgggttca

SEQ ID NO: 2133478 - DNA, 16 bp, Homo sapiens
tctagaacacaggcaa

SEQ ID NO: 2133479 - DNA, 16 bp, Homo sapiens
tctagaacacccactg

SEQ ID NO: 2133480 - DNA, 19 bp, Homo sapiens
tctagaacacccactggcc

SEQ ID NO: 2133481 - DNA, 17 bp, Homo sapiens
tctagaacatgcacatt

SEQ ID NO: 2133482 - DNA, 19 bp, Homo sapiens
tctagaacatgcacattta

SEQ ID NO: 2133483 - DNA, 20 bp, Homo sapiens
tctagaatgtgttttctgaa

SEQ ID NO: 2133484 - DNA, 19 bp, Homo sapiens
tctagaattttaagtgctt

SEQ ID NO: 2133485 - DNA, 14 bp, Homo sapiens
tctagactttctca

SEQ ID NO: 2133486 - DNA, 16 bp, Homo sapiens
tctagagatagtacat

SEQ ID NO: 2133487 - DNA, 20 bp, Homo sapiens
tctagagatagtacataaag

SEQ ID NO: 2133488 - DNA, 20 bp, Homo sapiens
tctagagtgagaatctggct

SEQ ID NO: 2133489 - DNA, 13 bp, Homo sapiens
tctagatcaatta

SEQ ID NO: 2133490 - DNA, 21 bp, Homo sapiens
tctagatcaattaattcttaa

SEQ ID NO: 2133491 - DNA, 21 bp, Homo sapiens
tctagattaccccctcattgt

SEQ ID NO: 2133492 - DNA, 21 bp, Homo sapiens
tctagccaggagtctgtgctc

SEQ ID NO: 2133493 - DNA, 21 bp, Homo sapiens
tctagctagaaatatgatttt

SEQ ID NO: 2133494 - DNA, 23 bp, Homo sapiens
tctagctagaaatatgattttat

SEQ ID NO: 2133495 - DNA, 11 bp, Homo sapiens
tctagctgttg

SEQ ID NO: 2133496 - DNA, 17 bp, Homo sapiens
tctaggagctgggagga

SEQ ID NO: 2133497 - DNA, 21 bp, Homo sapiens
tctaggagctgggaggaaaag

SEQ ID NO: 2133498 - DNA, 17 bp, Homo sapiens
tctaggagctgtctcca

SEQ ID NO: 2133499 - DNA, 18 bp, Homo sapiens
tctaggagtcaactggct

SEQ ID NO: 2133500 - DNA, 13 bp, Homo sapiens
tctaggctgcccc

SEQ ID NO: 2133501 - DNA, 17 bp, Homo sapiens
tctagggagagaccctt

SEQ ID NO: 2133502 - DNA, 19 bp, Homo sapiens
tctaggtctgtaatttatt

SEQ ID NO: 2133503 - DNA, 14 bp, Homo sapiens
tctaggttctaaaa

SEQ ID NO: 2133504 - DNA, 20 bp, Homo sapiens
tctagtccttggtctgctgg

SEQ ID NO: 2133505 - DNA, 22 bp, Homo sapiens
tctagtctcctttgcactgagg

SEQ ID NO: 2133506 - DNA, 15 bp, Homo sapiens
tctagtgacttcctg

SEQ ID NO: 2133507 - DNA, 20 bp, Homo sapiens
tctagtgccctccacagccg

SEQ ID NO: 2133508 - DNA, 18 bp, Homo sapiens
tctagttagcaggaaata

SEQ ID NO: 2133509 - DNA, 15 bp, Homo sapiens
tctagtttctttctg

SEQ ID NO: 2133510 - DNA, 13 bp, Homo sapiens
tctataaataacc

SEQ ID NO: 2133511 - DNA, 15 bp, Homo sapiens
tctataacatgcatt

SEQ ID NO: 2133512 - DNA, 13 bp, Homo sapiens
tctatagagaaaa

SEQ ID NO: 2133513 - DNA, 17 bp, Homo sapiens
tctatagccaaaaatag

SEQ ID NO: 2133514 - DNA, 12 bp, Homo sapiens
tctatagctctt

SEQ ID NO: 2133515 - DNA, 13 bp, Homo sapiens
tctatagctcttc

SEQ ID NO: 2133516 - DNA, 19 bp, Homo sapiens
tctatagtagtcaattagt

SEQ ID NO: 2133517 - DNA, 15 bp, Homo sapiens
tctatataatgtagt

SEQ ID NO: 2133518 - DNA, 22 bp, Homo sapiens
tctatatatacatgtatagtga

SEQ ID NO: 2133519 - DNA, 22 bp, Homo sapiens
tctatattccgggtgccattcc

SEQ ID NO: 2133520 - DNA, 19 bp, Homo sapiens
tctatcaaccccagacact

SEQ ID NO: 2133521 - DNA, 14 bp, Homo sapiens
tctatcaccaggat

SEQ ID NO: 2133522 - DNA, 15 bp, Homo sapiens
tctatctatttgagg

SEQ ID NO: 2133523 - DNA, 20 bp, Homo sapiens
tctatctgcctttacctaca

SEQ ID NO: 2133524 - DNA, 17 bp, Homo sapiens
tctatctggaatttaat

SEQ ID NO: 2133525 - DNA, 22 bp, Homo sapiens
tctatgagaacaagtcacagct

SEQ ID NO: 2133526 - DNA, 23 bp, Homo sapiens
tctatgagaacaagtcacagctg

SEQ ID NO: 2133527 - DNA, 14 bp, Homo sapiens
tctatgcaattttt

SEQ ID NO: 2133528 - DNA, 20 bp, Homo sapiens
tctatgcaatttttaaacta

SEQ ID NO: 2133529 - DNA, 23 bp, Homo sapiens
tctatgcaatttttaaactagta

SEQ ID NO: 2133530 - DNA, 19 bp, Homo sapiens
tctatgcagtattgccaca

SEQ ID NO: 2133531 - DNA, 14 bp, Homo sapiens
tctatggcagtcca

SEQ ID NO: 2133532 - DNA, 16 bp, Homo sapiens
tctatggcagtccagc

SEQ ID NO: 2133533 - DNA, 21 bp, Homo sapiens
tctatggcagtccagccagct

SEQ ID NO: 2133534 - DNA, 13 bp, Homo sapiens
tctatgggactca

SEQ ID NO: 2133535 - DNA, 16 bp, Homo sapiens
tctattaagatttcca

SEQ ID NO: 2133536 - DNA, 18 bp, Homo sapiens
tctattaagatttccaag

SEQ ID NO: 2133537 - DNA, 12 bp, Homo sapiens
tctattcataat

SEQ ID NO: 2133538 - DNA, 18 bp, Homo sapiens
tctattcctgaccctccc

SEQ ID NO: 2133539 - DNA, 13 bp, Homo sapiens
tctattctgagcc

SEQ ID NO: 2133540 - DNA, 23 bp, Homo sapiens
tctattgcagttatagaaaatct

SEQ ID NO: 2133541 - DNA, 14 bp, Homo sapiens
tctattgtagcatt

SEQ ID NO: 2133542 - DNA, 15 bp, Homo sapiens
tctattgtagcattt

SEQ ID NO: 2133543 - DNA, 19 bp, Homo sapiens
tctattgtagcatttcttg

SEQ ID NO: 2133544 - DNA, 15 bp, Homo sapiens
tctattgtgcctatg

SEQ ID NO: 2133545 - DNA, 16 bp, Homo sapiens
tctattgtttattctt

SEQ ID NO: 2133546 - DNA, 13 bp, Homo sapiens
tctatttaaaaaa

SEQ ID NO: 2133547 - DNA, 20 bp, Homo sapiens
tctctggcagagaaggatgt

SEQ ID NO: 2133548 - DNA, 16 bp, Homo sapiens
tctctggctccagaat

SEQ ID NO: 2133549 - DNA, 14 bp, Homo sapiens
tctctggggccctg

SEQ ID NO: 2133550 - DNA, 20 bp, Homo sapiens
tctctggggccctgggcctc

SEQ ID NO: 2133551 - DNA, 22 bp, Homo sapiens
tctctgtataatctatttacat

SEQ ID NO: 2133552 - DNA, 22 bp, Homo sapiens
tctctgtccctcactgccttcc

SEQ ID NO: 2133553 - DNA, 22 bp, Homo sapiens
tctctgtgctttgactcacctg

SEQ ID NO: 2133554 - DNA, 14 bp, Homo sapiens
tctctgttcatttc

SEQ ID NO: 2133555 - DNA, 18 bp, Homo sapiens
tctctgttcatttcctca

SEQ ID NO: 2133556 - DNA, 14 bp, Homo sapiens
tctcttacccagaa

SEQ ID NO: 2133557 - DNA, 21 bp, Homo sapiens
tctcttaccgcgagactgaga

SEQ ID NO: 2133558 - DNA, 20 bp, Homo sapiens
tctcttatagaatatttatt

SEQ ID NO: 2133559 - DNA, 14 bp, Homo sapiens
tctcttcaggttct

SEQ ID NO: 2133560 - DNA, 14 bp, Homo sapiens
tctcttcatacttt

SEQ ID NO: 2133561 - DNA, 21 bp, Homo sapiens
tctcttccagaagatgccctc

SEQ ID NO: 2133562 - DNA, 15 bp, Homo sapiens
tctcttccctccttc

SEQ ID NO: 2133563 - DNA, 18 bp, Homo sapiens
tctcttccctccttccct

SEQ ID NO: 2133564 - DNA, 11 bp, Homo sapiens
tctcttcctgt

SEQ ID NO: 2133565 - DNA, 12 bp, Homo sapiens
tctcttcctgta

SEQ ID NO: 2133566 - DNA, 22 bp, Homo sapiens
tctcttctctattcctgaccct

SEQ ID NO: 2133567 - DNA, 20 bp, Homo sapiens
tctctttaatcttcagtttt

SEQ ID NO: 2133568 - DNA, 21 bp, Homo sapiens
tctctttctttttctgtctct

SEQ ID NO: 2133569 - DNA, 13 bp, Homo sapiens
tctctttgcctca

SEQ ID NO: 2133570 - DNA, 14 bp, Homo sapiens
tctctttgcctcaa

SEQ ID NO: 2133571 - DNA, 16 bp, Homo sapiens
tctctttggaatgaac

SEQ ID NO: 2133572 - DNA, 15 bp, Homo sapiens
tctcttttcaaaaca

SEQ ID NO: 2133573 - DNA, 13 bp, Homo sapiens
tctctttttcagt

SEQ ID NO: 2133574 - DNA, 22 bp, Homo sapiens
tctcttttttcaactggctggg

SEQ ID NO: 2133575 - DNA, 14 bp, Homo sapiens
tctgaaaactgttt

SEQ ID NO: 2133576 - DNA, 22 bp, Homo sapiens
tctgaaaagcaattgccctgta

SEQ ID NO: 2133577 - DNA, 19 bp, Homo sapiens
tctgaaagacagaatgtca

SEQ ID NO: 2133578 - DNA, 16 bp, Homo sapiens
tctgaaagtatatttt

SEQ ID NO: 2133579 - DNA, 16 bp, Homo sapiens
tctgaaatttcccaca

SEQ ID NO: 2133580 - DNA, 15 bp, Homo sapiens
tctgaacaattctct

SEQ ID NO: 2133581 - DNA, 13 bp, Homo sapiens
tctgaagcatgtt

SEQ ID NO: 2133582 - DNA, 18 bp, Homo sapiens
tctgaaggaatagccaga

SEQ ID NO: 2133583 - DNA, 21 bp, Homo sapiens
tctgaaggaatagccagagag

SEQ ID NO: 2133584 - DNA, 22 bp, Homo sapiens
tctgaaggacattgcggacagc

SEQ ID NO: 2133585 - DNA, 12 bp, Homo sapiens
tctgaaggagat

SEQ ID NO: 2133586 - DNA, 19 bp, Homo sapiens
tctgaaggagattttcctt

SEQ ID NO: 2133587 - DNA, 18 bp, Homo sapiens
tctgaaggcaaatataag

SEQ ID NO: 2133588 - DNA, 23 bp, Homo sapiens
tctgaaggcgtcaacgtgcattt

SEQ ID NO: 2133589 - DNA, 15 bp, Homo sapiens
tctgaagtcactgca

SEQ ID NO: 2133590 - DNA, 16 bp, Homo sapiens
tctgaagtcactgcac

SEQ ID NO: 2133591 - DNA, 16 bp, Homo sapiens
tctgaataacatttgt

SEQ ID NO: 2133592 - DNA, 16 bp, Homo sapiens
tctgaataatttctta

SEQ ID NO: 2133593 - DNA, 19 bp, Homo sapiens
tctgaatttttaaacaagt

SEQ ID NO: 2133594 - DNA, 12 bp, Homo sapiens
tctgacaagggc

SEQ ID NO: 2133595 - DNA, 23 bp, Homo sapiens
tctgacaagggctgacctgcctc

SEQ ID NO: 2133596 - DNA, 17 bp, Homo sapiens
tctgacacacagctctg

SEQ ID NO: 2133597 - DNA, 12 bp, Homo sapiens
tctgacaggcaa

SEQ ID NO: 2133598 - DNA, 21 bp, Homo sapiens
tctgacaggcaatgctggctg

SEQ ID NO: 2133599 - DNA, 22 bp, Homo sapiens
tctgacaggcaatgctggctgt

SEQ ID NO: 2133600 - DNA, 22 bp, Homo sapiens
tctgacagttactcttcagttt

SEQ ID NO: 2133601 - DNA, 13 bp, Homo sapiens
tctgacattcatt

SEQ ID NO: 2133602 - DNA, 14 bp, Homo sapiens
tctgacccagtgag

SEQ ID NO: 2133603 - DNA, 15 bp, Homo sapiens
tctgacccagtgaga

SEQ ID NO: 2133604 - DNA, 15 bp, Homo sapiens
tctgacctgcaggcc

SEQ ID NO: 2133605 - DNA, 17 bp, Homo sapiens
tctgacctgcaggccaa

SEQ ID NO: 2133606 - DNA, 21 bp, Homo sapiens
tctgacctgcaggccaagagc

SEQ ID NO: 2133607 - DNA, 16 bp, Homo sapiens
tctgactcacaagaag

SEQ ID NO: 2133608 - DNA, 16 bp, Homo sapiens
tctgactccagagtct

SEQ ID NO: 2133609 - DNA, 22 bp, Homo sapiens
tctgactccagagtctgagccc

SEQ ID NO: 2133610 - DNA, 14 bp, Homo sapiens
tctgactcttgcct

SEQ ID NO: 2133611 - DNA, 22 bp, Homo sapiens
tctgactcttgcctttccacct

SEQ ID NO: 2133612 - DNA, 15 bp, Homo sapiens
tctgacttcctctga

SEQ ID NO: 2133613 - DNA, 9 bp, Homo sapiens
tctgagaaa

SEQ ID NO: 2133614 - DNA, 15 bp, Homo sapiens
tctgagaaagactat

SEQ ID NO: 2133615 - DNA, 20 bp, Homo sapiens
tctgagaaagactattcaaa

SEQ ID NO: 2133616 - DNA, 21 bp, Homo sapiens
tctgagaaagactattcaaac

SEQ ID NO: 2133617 - DNA, 23 bp, Homo sapiens
tctgagaaagactattcaaacag

SEQ ID NO: 2133618 - DNA, 14 bp, Homo sapiens
tctgagaagtgtat

SEQ ID NO: 2133619 - DNA, 15 bp, Homo sapiens
tctgagagagatgat

SEQ ID NO: 2133620 - DNA, 13 bp, Homo sapiens
tctgagaggccct

SEQ ID NO: 2133621 - DNA, 18 bp, Homo sapiens
tctgagaggccctggatc

SEQ ID NO: 2133622 - DNA, 21 bp, Homo sapiens
tctgagagttggctcaggcag

SEQ ID NO: 2133623 - DNA, 21 bp, Homo sapiens
tctgagatctccctccaggga

SEQ ID NO: 2133624 - DNA, 15 bp, Homo sapiens
tctgagcaagagctg

SEQ ID NO: 2133625 - DNA, 16 bp, Homo sapiens
tctgagcaccccctca

SEQ ID NO: 2133626 - DNA, 12 bp, Homo sapiens
tctgagcccagg

SEQ ID NO: 2133627 - DNA, 23 bp, Homo sapiens
tctgagcccccggctagtaccct

SEQ ID NO: 2133628 - DNA, 11 bp, Homo sapiens
tctgagccctg

SEQ ID NO: 2133629 - DNA, 20 bp, Homo sapiens
tctgagcctaaatctaatca

SEQ ID NO: 2133630 - DNA, 17 bp, Homo sapiens
tctgagccttgagagaa

SEQ ID NO: 2133631 - DNA, 20 bp, Homo sapiens
tctgagctggccctttccag

SEQ ID NO: 2133632 - DNA, 12 bp, Homo sapiens
tctgagctgggc

SEQ ID NO: 2133633 - DNA, 16 bp, Homo sapiens
tctgaggaatccagac

SEQ ID NO: 2133634 - DNA, 17 bp, Homo sapiens
tctgaggaatccagacc

SEQ ID NO: 2133635 - DNA, 21 bp, Homo sapiens
tctgaggaatccagacccggc

SEQ ID NO: 2133636 - DNA, 22 bp, Homo sapiens
tctgaggaatccagacccggct

SEQ ID NO: 2133637 - DNA, 20 bp, Homo sapiens
tctgaggacactaaccacgc

SEQ ID NO: 2133638 - DNA, 23 bp, Homo sapiens
tctgaggacactaaccacgctgg

SEQ ID NO: 2133639 - DNA, 23 bp, Homo sapiens
tctgaggacatggagagagactc

SEQ ID NO: 2133640 - DNA, 15 bp, Homo sapiens
tctgaggccagcctg

SEQ ID NO: 2133641 - DNA, 17 bp, Homo sapiens
tctgaggccagcctggc

SEQ ID NO: 2133642 - DNA, 19 bp, Homo sapiens
tctgaggctctttctgggc

SEQ ID NO: 2133643 - DNA, 14 bp, Homo sapiens
tctgaggcttccag

SEQ ID NO: 2133644 - DNA, 16 bp, Homo sapiens
tctgaggtcctgagca

SEQ ID NO: 2133645 - DNA, 21 bp, Homo sapiens
tctgaggtcctgagcactgcc

SEQ ID NO: 2133646 - DNA, 12 bp, Homo sapiens
tctgagtcctgt

SEQ ID NO: 2133647 - DNA, 12 bp, Homo sapiens
tctgagttatgt

SEQ ID NO: 2133648 - DNA, 20 bp, Homo sapiens
tctgagtttcattctcctgc

SEQ ID NO: 2133649 - DNA, 12 bp, Homo sapiens
tctgataaacac

SEQ ID NO: 2133650 - DNA, 13 bp, Homo sapiens
tctgataaacaca

SEQ ID NO: 2133651 - DNA, 16 bp, Homo sapiens
tctgatacccagagca

SEQ ID NO: 2133652 - DNA, 16 bp, Homo sapiens
tctgataggaaaagaa

SEQ ID NO: 2133653 - DNA, 14 bp, Homo sapiens
tctgatatgggact

SEQ ID NO: 2133654 - DNA, 23 bp, Homo sapiens
tctgatccctcgcccccacaccc

SEQ ID NO: 2133655 - DNA, 20 bp, Homo sapiens
tctgatcgggataacaaaat

SEQ ID NO: 2133656 - DNA, 13 bp, Homo sapiens
tctgatgtttgtt

SEQ ID NO: 2133657 - DNA, 13 bp, Homo sapiens
tctgattccatat

SEQ ID NO: 2133658 - DNA, 18 bp, Homo sapiens
tctgattcccaagctctg

SEQ ID NO: 2133659 - DNA, 20 bp, Homo sapiens
tctgattcccaagctctgct

SEQ ID NO: 2133660 - DNA, 16 bp, Homo sapiens
tctgattggacatttt

SEQ ID NO: 2133661 - DNA, 20 bp, Homo sapiens
tctgattggacattttcttc

SEQ ID NO: 2133662 - DNA, 23 bp, Homo sapiens
tctgtggcctgtgtccagcagct

SEQ ID NO: 2133663 - DNA, 15 bp, Homo sapiens
tctgtgggcttggcc

SEQ ID NO: 2133664 - DNA, 18 bp, Homo sapiens
tctgtgggcttggccttg

SEQ ID NO: 2133665 - DNA, 23 bp, Homo sapiens
tctgtgtaaatctaactacaagg

SEQ ID NO: 2133666 - DNA, 15 bp, Homo sapiens
tctgtgtcagcctgt

SEQ ID NO: 2133667 - DNA, 22 bp, Homo sapiens
tctgtgtccaattatgcactgg

SEQ ID NO: 2133668 - DNA, 11 bp, Homo sapiens
tctgtgtcctt

SEQ ID NO: 2133669 - DNA, 20 bp, Homo sapiens
tctgtgtgatgaactttctc

SEQ ID NO: 2133670 - DNA, 18 bp, Homo sapiens
tctgtgtgcaccttacca

SEQ ID NO: 2133671 - DNA, 18 bp, Homo sapiens
tctgtgtgggtctgggga

SEQ ID NO: 2133672 - DNA, 16 bp, Homo sapiens
tctgtgtgtctgatgt

SEQ ID NO: 2133673 - DNA, 14 bp, Homo sapiens
tctgttactgaaat

SEQ ID NO: 2133674 - DNA, 15 bp, Homo sapiens
tctgttactgaaatg

SEQ ID NO: 2133675 - DNA, 21 bp, Homo sapiens
tctgttcacttttcctccctc

SEQ ID NO: 2133676 - DNA, 22 bp, Homo sapiens
tctgttcacttttcctccctca

SEQ ID NO: 2133677 - DNA, 12 bp, Homo sapiens
tctgttctcaaa

SEQ ID NO: 2133678 - DNA, 22 bp, Homo sapiens
tctgttgatcccacttcactgt

SEQ ID NO: 2133679 - DNA, 16 bp, Homo sapiens
tctgttgtaaagagtg

SEQ ID NO: 2133680 - DNA, 12 bp, Homo sapiens
tctgttgtaaat

SEQ ID NO: 2133681 - DNA, 12 bp, Homo sapiens
tctgtttccata

SEQ ID NO: 2133682 - DNA, 11 bp, Homo sapiens
tctgttttctt

SEQ ID NO: 2133683 - DNA, 17 bp, Homo sapiens
tctgttttgtatatgat

SEQ ID NO: 2133684 - DNA, 14 bp, Homo sapiens
tctgtttttctttt

SEQ ID NO: 2133685 - DNA, 19 bp, Homo sapiens
tcttaaaatatatttcaga

SEQ ID NO: 2133686 - DNA, 16 bp, Homo sapiens
tcttaaagctgcctgt

SEQ ID NO: 2133687 - DNA, 20 bp, Homo sapiens
tcttaaagctgcctgtagtt

SEQ ID NO: 2133688 - DNA, 18 bp, Homo sapiens
tcttaaatgacagtgaat

SEQ ID NO: 2133689 - DNA, 15 bp, Homo sapiens
tcttaagacttttgg

SEQ ID NO: 2133690 - DNA, 21 bp, Homo sapiens
tcttaatgctttcctccctgg

SEQ ID NO: 2133691 - DNA, 17 bp, Homo sapiens
tcttacaaccaagaaca

SEQ ID NO: 2133692 - DNA, 19 bp, Homo sapiens
tcttacagtggagtgagat

SEQ ID NO: 2133693 - DNA, 18 bp, Homo sapiens
tcttaccttaaaaagtaa

SEQ ID NO: 2133694 - DNA, 15 bp, Homo sapiens
tcttacgctctctgt

SEQ ID NO: 2133695 - DNA, 20 bp, Homo sapiens
tcttacttatcaaaagacag

SEQ ID NO: 2133696 - DNA, 15 bp, Homo sapiens
tcttacttggaactg

SEQ ID NO: 2133697 - DNA, 18 bp, Homo sapiens
tcttagctgtctgctcag

SEQ ID NO: 2133698 - DNA, 15 bp, Homo sapiens
tcttaggaagagaaa

SEQ ID NO: 2133699 - DNA, 17 bp, Homo sapiens
tcttaggggagagcttt

SEQ ID NO: 2133700 - DNA, 15 bp, Homo sapiens
tcttagtgcccgcct

SEQ ID NO: 2133701 - DNA, 22 bp, Homo sapiens
tcttatagtcaatgtttctttt

SEQ ID NO: 2133702 - DNA, 12 bp, Homo sapiens
tcttatatagca

SEQ ID NO: 2133703 - DNA, 17 bp, Homo sapiens
tcttatgcttataatat

SEQ ID NO: 2133704 - DNA, 17 bp, Homo sapiens
tcttattcagtaaaaaa

SEQ ID NO: 2133705 - DNA, 21 bp, Homo sapiens
tcttattcatgctttctcctt

SEQ ID NO: 2133706 - DNA, 14 bp, Homo sapiens
tcttatttaactta

SEQ ID NO: 2133707 - DNA, 16 bp, Homo sapiens
tcttatttatatatga

SEQ ID NO: 2133708 - DNA, 17 bp, Homo sapiens
tcttatttatatatgaa

SEQ ID NO: 2133709 - DNA, 16 bp, Homo sapiens
tcttatttcatttctt

SEQ ID NO: 2133710 - DNA, 14 bp, Homo sapiens
tcttatttgcaata

SEQ ID NO: 2133711 - DNA, 18 bp, Homo sapiens
tcttattttgtaataaac

SEQ ID NO: 2133712 - DNA, 21 bp, Homo sapiens
tcttattttgtaataaactct

SEQ ID NO: 2133713 - DNA, 22 bp, Homo sapiens
tcttattttgtaataaactctc

SEQ ID NO: 2133714 - DNA, 19 bp, Homo sapiens
tcttcaactgaccagcctc

SEQ ID NO: 2133715 - DNA, 17 bp, Homo sapiens
tcttcaagcacctgcag

SEQ ID NO: 2133716 - DNA, 22 bp, Homo sapiens
tcttcaagctgtcccctctgtc

SEQ ID NO: 2133717 - DNA, 14 bp, Homo sapiens
tcttcacaacctcc

SEQ ID NO: 2133718 - DNA, 16 bp, Homo sapiens
tcttcacccgctgcag

SEQ ID NO: 2133719 - DNA, 20 bp, Homo sapiens
tcttcactgccatgcctcaa

SEQ ID NO: 2133720 - DNA, 16 bp, Homo sapiens
tcttcagccacctctc

SEQ ID NO: 2133721 - DNA, 16 bp, Homo sapiens
tcttcagccatcaaca

SEQ ID NO: 2133722 - DNA, 12 bp, Homo sapiens
tcttcagcctag

SEQ ID NO: 2133723 - DNA, 22 bp, Homo sapiens
tcttcagcctagccgacctcag

SEQ ID NO: 2133724 - DNA, 12 bp, Homo sapiens
tcttcagctccc

SEQ ID NO: 2133725 - DNA, 15 bp, Homo sapiens
tcttcagctcccata

SEQ ID NO: 2133726 - DNA, 16 bp, Homo sapiens
tcttcagggtgagtga

SEQ ID NO: 2133727 - DNA, 23 bp, Homo sapiens
tcttcaggtggaaaaacatctga

SEQ ID NO: 2133728 - DNA, 18 bp, Homo sapiens
tcttcagttttatcttta

SEQ ID NO: 2133729 - DNA, 20 bp, Homo sapiens
tcttcataacaattttagga

SEQ ID NO: 2133730 - DNA, 17 bp, Homo sapiens
tcttcatgcaatgacat

SEQ ID NO: 2133731 - DNA, 16 bp, Homo sapiens
tcttcatttcattgta

SEQ ID NO: 2133732 - DNA, 19 bp, Homo sapiens
tcttcattttgagtctcag

SEQ ID NO: 2133733 - DNA, 16 bp, Homo sapiens
tcttccaaccccagct

SEQ ID NO: 2133734 - DNA, 18 bp, Homo sapiens
tcttccaaccccagctgg

SEQ ID NO: 2133735 - DNA, 18 bp, Homo sapiens
tcttccaagcaaaggtga

SEQ ID NO: 2133736 - DNA, 24 bp, Homo sapiens
tcttccaagcaaaggtgaagagac

SEQ ID NO: 2133737 - DNA, 17 bp, Homo sapiens
tcttccagtgcaacaaa

SEQ ID NO: 2133738 - DNA, 18 bp, Homo sapiens
tcttccagtgcaacaaaa

SEQ ID NO: 2133739 - DNA, 15 bp, Homo sapiens
tcttccatttattgc

SEQ ID NO: 2133740 - DNA, 17 bp, Homo sapiens
tcttcccatcactggag

SEQ ID NO: 2133741 - DNA, 14 bp, Homo sapiens
tcttcccatttgta

SEQ ID NO: 2133742 - DNA, 19 bp, Homo sapiens
tcttcccatttgtaatgta

SEQ ID NO: 2133743 - DNA, 19 bp, Homo sapiens
tcttccccactccccacct

SEQ ID NO: 2133744 - DNA, 20 bp, Homo sapiens
tcttcccccacccctaacct

SEQ ID NO: 2133745 - DNA, 22 bp, Homo sapiens
tcttcccccacccctaacctgg

SEQ ID NO: 2133746 - DNA, 15 bp, Homo sapiens
tcttccccttgccct

SEQ ID NO: 2133747 - DNA, 16 bp, Homo sapiens
tcttccccttgccctt

SEQ ID NO: 2133748 - DNA, 13 bp, Homo sapiens
tcttcccctttcc

SEQ ID NO: 2133749 - DNA, 15 bp, Homo sapiens
tcttccctccttccc

SEQ ID NO: 2133750 - DNA, 18 bp, Homo sapiens
tcttcctaccaaatataa

SEQ ID NO: 2133751 - DNA, 19 bp, Homo sapiens
tcttcctagttttctcctc

SEQ ID NO: 2133752 - DNA, 23 bp, Homo sapiens
tcttcctagttttctcctcccag

SEQ ID NO: 2133753 - DNA, 12 bp, Homo sapiens
tcttcctctgct

SEQ ID NO: 2133754 - DNA, 15 bp, Homo sapiens
tcttcctctgttcta

SEQ ID NO: 2133755 - DNA, 16 bp, Homo sapiens
tcttcctgattcccca

SEQ ID NO: 2133756 - DNA, 15 bp, Homo sapiens
tcttccttcccccat

SEQ ID NO: 2133757 - DNA, 15 bp, Homo sapiens
tcttccttctttctc

SEQ ID NO: 2133758 - DNA, 13 bp, Homo sapiens
tcttcgaggtgga

SEQ ID NO: 2133759 - DNA, 22 bp, Homo sapiens
tcttcgctgctctagctggcag

SEQ ID NO: 2133760 - DNA, 17 bp, Homo sapiens
tcttcggggtgtgatga

SEQ ID NO: 2133761 - DNA, 15 bp, Homo sapiens
tcttcggtttctgag

SEQ ID NO: 2133762 - DNA, 14 bp, Homo sapiens
tcttctaaaatgct

SEQ ID NO: 2133763 - DNA, 22 bp, Homo sapiens
tcttctaaaattgaagagattt

SEQ ID NO: 2133764 - DNA, 16 bp, Homo sapiens
tcttctaacctcagcc

SEQ ID NO: 2133765 - DNA, 16 bp, Homo sapiens
tcttctactttcatct

SEQ ID NO: 2133766 - DNA, 14 bp, Homo sapiens
tcttctatttaaaa

SEQ ID NO: 2133767 - DNA, 22 bp, Homo sapiens
tcttctatttaaaaaataaaaa

SEQ ID NO: 2133768 - DNA, 16 bp, Homo sapiens
tcttctattttattcc

SEQ ID NO: 2133769 - DNA, 13 bp, Homo sapiens
tcttctccactgg

SEQ ID NO: 2133770 - DNA, 16 bp, Homo sapiens
tcttctccactggatg

SEQ ID NO: 2133771 - DNA, 12 bp, Homo sapiens
tcttctccatct

SEQ ID NO: 2133772 - DNA, 15 bp, Homo sapiens
tcttctccttggagg

SEQ ID NO: 2133773 - DNA, 12 bp, Homo sapiens
tcttctctccat

SEQ ID NO: 2133774 - DNA, 20 bp, Homo sapiens
tcttctcttacgctctctgt

SEQ ID NO: 2133775 - DNA, 15 bp, Homo sapiens
tcttctcttcctgta

SEQ ID NO: 2133776 - DNA, 15 bp, Homo sapiens
tcttctgccagccca

SEQ ID NO: 2133777 - DNA, 15 bp, Homo sapiens
tgaagcccaataaac

SEQ ID NO: 2133778 - DNA, 18 bp, Homo sapiens
tgaagcccgtgtcctgcc

SEQ ID NO: 2133779 - DNA, 13 bp, Homo sapiens
tgaagcctctgcc

SEQ ID NO: 2133780 - DNA, 15 bp, Homo sapiens
tgaagctattgatgt

SEQ ID NO: 2133781 - DNA, 19 bp, Homo sapiens
tgaagctggaagcactgct

SEQ ID NO: 2133782 - DNA, 20 bp, Homo sapiens
tgaaggaatagccagagagg

SEQ ID NO: 2133783 - DNA, 19 bp, Homo sapiens
tgaaggacattgcggacag

SEQ ID NO: 2133784 - DNA, 22 bp, Homo sapiens
tgaaggacattgcggacagcca

SEQ ID NO: 2133785 - DNA, 21 bp, Homo sapiens
tgaaggaccctggctcttctc

SEQ ID NO: 2133786 - DNA, 19 bp, Homo sapiens
tgaaggactattaattcca

SEQ ID NO: 2133787 - DNA, 20 bp, Homo sapiens
tgaaggagagcccttcattt

SEQ ID NO: 2133788 - DNA, 20 bp, Homo sapiens
tgaaggccttcaacccgaga

SEQ ID NO: 2133789 - DNA, 15 bp, Homo sapiens
tgaaggcgtgcaagg

SEQ ID NO: 2133790 - DNA, 14 bp, Homo sapiens
tgaagggcccgaga

SEQ ID NO: 2133791 - DNA, 18 bp, Homo sapiens
tgaagggggcggcctatg

SEQ ID NO: 2133792 - DNA, 19 bp, Homo sapiens
tgaagggtgacatcccagg

SEQ ID NO: 2133793 - DNA, 16 bp, Homo sapiens
tgaaggtcttgcctga

SEQ ID NO: 2133794 - DNA, 13 bp, Homo sapiens
tgaaggtttctga

SEQ ID NO: 2133795 - DNA, 14 bp, Homo sapiens
tgaagtagtttgta

SEQ ID NO: 2133796 - DNA, 14 bp, Homo sapiens
tgaagtcactgcac

SEQ ID NO: 2133797 - DNA, 15 bp, Homo sapiens
tgaagtcactgcaca

SEQ ID NO: 2133798 - DNA, 16 bp, Homo sapiens
tgaagtcactgcacag

SEQ ID NO: 2133799 - DNA, 18 bp, Homo sapiens
tgaagtcatcttagcttt

SEQ ID NO: 2133800 - DNA, 13 bp, Homo sapiens
tgaagtccctgtt

SEQ ID NO: 2133801 - DNA, 20 bp, Homo sapiens
tgaagtccctgttctcagct

SEQ ID NO: 2133802 - DNA, 14 bp, Homo sapiens
tgaagtgaaggaga

SEQ ID NO: 2133803 - DNA, 15 bp, Homo sapiens
tgaagtgaaggagaa

SEQ ID NO: 2133804 - DNA, 18 bp, Homo sapiens
tgaagtgaaggagaaagg

SEQ ID NO: 2133805 - DNA, 16 bp, Homo sapiens
tgaagtgtgtttcctt

SEQ ID NO: 2133806 - DNA, 18 bp, Homo sapiens
tgaagtgtgtttccttca

SEQ ID NO: 2133807 - DNA, 22 bp, Homo sapiens
tgaagtgtgtttccttcagtgc

SEQ ID NO: 2133808 - DNA, 20 bp, Homo sapiens
tgaagtgttttgttctttct

SEQ ID NO: 2133809 - DNA, 20 bp, Homo sapiens
tgaagttacacaattaattg

SEQ ID NO: 2133810 - DNA, 18 bp, Homo sapiens
tgaagttagctttaactt

SEQ ID NO: 2133811 - DNA, 23 bp, Homo sapiens
tgaagttagctttaacttaaata

SEQ ID NO: 2133812 - DNA, 19 bp, Homo sapiens
tgaagttcatggtgatcag

SEQ ID NO: 2133813 - DNA, 20 bp, Homo sapiens
tgaagttcatggtgatcagt

SEQ ID NO: 2133814 - DNA, 21 bp, Homo sapiens
tgaataaaaaacatttgtaca

SEQ ID NO: 2133815 - DNA, 14 bp, Homo sapiens
tgaataaacttcag

SEQ ID NO: 2133816 - DNA, 14 bp, Homo sapiens
tgaataaagacacc

SEQ ID NO: 2133817 - DNA, 20 bp, Homo sapiens
tgaataaagcctgcttttta

SEQ ID NO: 2133818 - DNA, 12 bp, Homo sapiens
tgaataaagtct

SEQ ID NO: 2133819 - DNA, 17 bp, Homo sapiens
tgaataagtattcttca

SEQ ID NO: 2133820 - DNA, 18 bp, Homo sapiens
tgaataatggaatctata

SEQ ID NO: 2133821 - DNA, 13 bp, Homo sapiens
tgaataatttctt

SEQ ID NO: 2133822 - DNA, 14 bp, Homo sapiens
tgaatacccccaga

SEQ ID NO: 2133823 - DNA, 16 bp, Homo sapiens
tgaatacccttttctg

SEQ ID NO: 2133824 - DNA, 16 bp, Homo sapiens
tgaatagatgtgatca

SEQ ID NO: 2133825 - DNA, 17 bp, Homo sapiens
tgaatattaatcccagc

SEQ ID NO: 2133826 - DNA, 18 bp, Homo sapiens
tgaatatttcaaaataaa

SEQ ID NO: 2133827 - DNA, 13 bp, Homo sapiens
tgaatatttgctt

SEQ ID NO: 2133828 - DNA, 21 bp, Homo sapiens
tgaatattttcattaaaagct

SEQ ID NO: 2133829 - DNA, 16 bp, Homo sapiens
tgaatattttgtaata

SEQ ID NO: 2133830 - DNA, 21 bp, Homo sapiens
tgaatcagaccctaccccacc

SEQ ID NO: 2133831 - DNA, 19 bp, Homo sapiens
tgaatcatgttaatagaca

SEQ ID NO: 2133832 - DNA, 17 bp, Homo sapiens
tgaatccatcaggactt

SEQ ID NO: 2133833 - DNA, 18 bp, Homo sapiens
tgaatccatcaggacttg

SEQ ID NO: 2133834 - DNA, 14 bp, Homo sapiens
tgaatccatgcttg

SEQ ID NO: 2133835 - DNA, 13 bp, Homo sapiens
tgaatctgcaggg

SEQ ID NO: 2133836 - DNA, 15 bp, Homo sapiens
tgaatctgttactga

SEQ ID NO: 2133837 - DNA, 15 bp, Homo sapiens
tgaatgacatcaaca

SEQ ID NO: 2133838 - DNA, 19 bp, Homo sapiens
tgaatgaggtcccaggcag

SEQ ID NO: 2133839 - DNA, 17 bp, Homo sapiens
tgaatgataagcaggaa

SEQ ID NO: 2133840 - DNA, 19 bp, Homo sapiens
tgaatgatgttttagaatg

SEQ ID NO: 2133841 - DNA, 19 bp, Homo sapiens
tgaatgcaaaccatagcac

SEQ ID NO: 2133842 - DNA, 19 bp, Homo sapiens
tgaatgcacactagcctct

SEQ ID NO: 2133843 - DNA, 23 bp, Homo sapiens
tgaatgcccacaggcaaatgcat

SEQ ID NO: 2133844 - DNA, 17 bp, Homo sapiens
tgaatgccggggacaga

SEQ ID NO: 2133845 - DNA, 14 bp, Homo sapiens
tgaatgctgagacc

SEQ ID NO: 2133846 - DNA, 19 bp, Homo sapiens
tgaatgctttttgaatgtt

SEQ ID NO: 2133847 - DNA, 18 bp, Homo sapiens
tgaatggccctagaactg

SEQ ID NO: 2133848 - DNA, 12 bp, Homo sapiens
tgaatggcctgc

SEQ ID NO: 2133849 - DNA, 20 bp, Homo sapiens
tgaatggtatggaactctct

SEQ ID NO: 2133850 - DNA, 14 bp, Homo sapiens
tgaatggtccaggg

SEQ ID NO: 2133851 - DNA, 19 bp, Homo sapiens
tgaatggttccatgcctga

SEQ ID NO: 2133852 - DNA, 22 bp, Homo sapiens
tgaatggttccatgcctgaggg

SEQ ID NO: 2133853 - DNA, 16 bp, Homo sapiens
tgaatgtattgaactt

SEQ ID NO: 2133854 - DNA, 14 bp, Homo sapiens
tgaatgttatttgt

SEQ ID NO: 2133855 - DNA, 23 bp, Homo sapiens
tgaatgttatttgttattttcag

SEQ ID NO: 2133856 - DNA, 21 bp, Homo sapiens
tgaatgttgtctgtttgttct

SEQ ID NO: 2133857 - DNA, 19 bp, Homo sapiens
tgaatgtttattccttgat

SEQ ID NO: 2133858 - DNA, 11 bp, Homo sapiens
tgaattaaaac

SEQ ID NO: 2133859 - DNA, 20 bp, Homo sapiens
tgaattattttgttgtgatt

SEQ ID NO: 2133860 - DNA, 14 bp, Homo sapiens
tgaattctggagga

SEQ ID NO: 2133861 - DNA, 20 bp, Homo sapiens
tgaattctggaggaagaaga

SEQ ID NO: 2133862 - DNA, 14 bp, Homo sapiens
tgaattctgtgaag

SEQ ID NO: 2133863 - DNA, 17 bp, Homo sapiens
tgaattctgtgaagaat

SEQ ID NO: 2133864 - DNA, 18 bp, Homo sapiens
tgaattgagctgcagaaa

SEQ ID NO: 2133865 - DNA, 17 bp, Homo sapiens
tgaattgtgaccaagtt

SEQ ID NO: 2133866 - DNA, 14 bp, Homo sapiens
tgaatttatctgaa

SEQ ID NO: 2133867 - DNA, 16 bp, Homo sapiens
tgaatttatctgaata

SEQ ID NO: 2133868 - DNA, 20 bp, Homo sapiens
tgaatttggagactctgtgg

SEQ ID NO: 2133869 - DNA, 17 bp, Homo sapiens
tgaatttgggcctcttg

SEQ ID NO: 2133870 - DNA, 19 bp, Homo sapiens
tgaatttttaaacaagtat

SEQ ID NO: 2133871 - DNA, 16 bp, Homo sapiens
tgaatttttttttcct

SEQ ID NO: 2133872 - DNA, 19 bp, Homo sapiens
tgaatttttttttcctagc

SEQ ID NO: 2133873 - DNA, 17 bp, Homo sapiens
tgacaaaataacatttg

SEQ ID NO: 2133874 - DNA, 19 bp, Homo sapiens
tgacaaagaaacccaagtg

SEQ ID NO: 2133875 - DNA, 13 bp, Homo sapiens
tgacaacagactg

SEQ ID NO: 2133876 - DNA, 14 bp, Homo sapiens
tgacaacagactga

SEQ ID NO: 2133877 - DNA, 18 bp, Homo sapiens
tgacaacatcccacagtg

SEQ ID NO: 2133878 - DNA, 19 bp, Homo sapiens
tgacaaccatgagaccact

SEQ ID NO: 2133879 - DNA, 17 bp, Homo sapiens
tgacaacctttgtgtaa

SEQ ID NO: 2133880 - DNA, 20 bp, Homo sapiens
tgacaacctttgtgtaataa

SEQ ID NO: 2133881 - DNA, 23 bp, Homo sapiens
tgacaagaatggaatagaaatgt

SEQ ID NO: 2133882 - DNA, 16 bp, Homo sapiens
tgacaagggctgacct

SEQ ID NO: 2133883 - DNA, 14 bp, Homo sapiens
tgacaagtcatttt

SEQ ID NO: 2133884 - DNA, 14 bp, Homo sapiens
tgacaataatttca

SEQ ID NO: 2133885 - DNA, 14 bp, Homo sapiens
tgacaatatgattt

SEQ ID NO: 2133886 - DNA, 15 bp, Homo sapiens
tgacaatatgatttt

SEQ ID NO: 2133887 - DNA, 15 bp, Homo sapiens
tgacaatggcagcta

SEQ ID NO: 2133888 - DNA, 20 bp, Homo sapiens
tgacacacagactacagcca

SEQ ID NO: 2133889 - DNA, 13 bp, Homo sapiens
tgacacacagcac

SEQ ID NO: 2133890 - DNA, 16 bp, Homo sapiens
tgacacacagcactct

SEQ ID NO: 2133891 - DNA, 15 bp, Homo sapiens
tgacacacagctctg

SEQ ID NO: 2133892 - DNA, 19 bp, Homo sapiens
tgaggaatatgactgtttt

SEQ ID NO: 2133893 - DNA, 21 bp, Homo sapiens
tgaggaatccagacccggctg

SEQ ID NO: 2133894 - DNA, 13 bp, Homo sapiens
tgaggaattttct

SEQ ID NO: 2133895 - DNA, 20 bp, Homo sapiens
tgaggacaaccattccagac

SEQ ID NO: 2133896 - DNA, 15 bp, Homo sapiens
tgaggacacatgtcc

SEQ ID NO: 2133897 - DNA, 21 bp, Homo sapiens
tgaggaccacactttgagaac

SEQ ID NO: 2133898 - DNA, 21 bp, Homo sapiens
tgaggactcatatatttaagc

SEQ ID NO: 2133899 - DNA, 14 bp, Homo sapiens
tgaggactgggggc

SEQ ID NO: 2133900 - DNA, 16 bp, Homo sapiens
tgaggagagaaggaca

SEQ ID NO: 2133901 - DNA, 20 bp, Homo sapiens
tgaggagctgttggcctggg

SEQ ID NO: 2133902 - DNA, 12 bp, Homo sapiens
tgaggaggggca

SEQ ID NO: 2133903 - DNA, 16 bp, Homo sapiens
tgaggaggggcacctg

SEQ ID NO: 2133904 - DNA, 17 bp, Homo sapiens
tgaggaggggcacctgc

SEQ ID NO: 2133905 - DNA, 18 bp, Homo sapiens
tgaggaggggcacctgcc

SEQ ID NO: 2133906 - DNA, 13 bp, Homo sapiens
tgaggagggtgga

SEQ ID NO: 2133907 - DNA, 15 bp, Homo sapiens
tgaggagtagctgag

SEQ ID NO: 2133908 - DNA, 14 bp, Homo sapiens
tgaggagtctgagg

SEQ ID NO: 2133909 - DNA, 19 bp, Homo sapiens
tgaggatcctcacaggagc

SEQ ID NO: 2133910 - DNA, 24 bp, Homo sapiens
tgaggatcctcacaggagcagaca

SEQ ID NO: 2133911 - DNA, 13 bp, Homo sapiens
tgaggatgacaga

SEQ ID NO: 2133912 - DNA, 17 bp, Homo sapiens
tgaggatgcaacaaata

SEQ ID NO: 2133913 - DNA, 17 bp, Homo sapiens
tgaggatgtgagcctga

SEQ ID NO: 2133914 - DNA, 20 bp, Homo sapiens
tgaggcaatgtcaggaacag

SEQ ID NO: 2133915 - DNA, 20 bp, Homo sapiens
tgaggcagacagcagctcag

SEQ ID NO: 2133916 - DNA, 23 bp, Homo sapiens
tgaggcagacagcagctcaggca

SEQ ID NO: 2133917 - DNA, 15 bp, Homo sapiens
tgaggcaggggcgga

SEQ ID NO: 2133918 - DNA, 12 bp, Homo sapiens
tgaggccagcct

SEQ ID NO: 2133919 - DNA, 20 bp, Homo sapiens
tgaggccagcctggcctcct

SEQ ID NO: 2133920 - DNA, 21 bp, Homo sapiens
tgaggccagcctggcctcctg

SEQ ID NO: 2133921 - DNA, 13 bp, Homo sapiens
tgaggccaggagt

SEQ ID NO: 2133922 - DNA, 15 bp, Homo sapiens
tgaggccattatttc

SEQ ID NO: 2133923 - DNA, 16 bp, Homo sapiens
tgaggccattatttca

SEQ ID NO: 2133924 - DNA, 15 bp, Homo sapiens
tgaggcccagcctgt

SEQ ID NO: 2133925 - DNA, 19 bp, Homo sapiens
tgaggcccagcctgtcctg

SEQ ID NO: 2133926 - DNA, 12 bp, Homo sapiens
tgaggccgcccg

SEQ ID NO: 2133927 - DNA, 14 bp, Homo sapiens
tgaggcctcatccc

SEQ ID NO: 2133928 - DNA, 15 bp, Homo sapiens
tgaggcctcttggac

SEQ ID NO: 2133929 - DNA, 18 bp, Homo sapiens
tgaggcctgccctcaggg

SEQ ID NO: 2133930 - DNA, 19 bp, Homo sapiens
tgaggcctgccctcaggga

SEQ ID NO: 2133931 - DNA, 21 bp, Homo sapiens
tgaggcctttccccagtgtgg

SEQ ID NO: 2133932 - DNA, 15 bp, Homo sapiens
tgaggctcaagaggc

SEQ ID NO: 2133933 - DNA, 17 bp, Homo sapiens
tgaggctctttctgggc

SEQ ID NO: 2133934 - DNA, 18 bp, Homo sapiens
tgaggctctttctgggcc

SEQ ID NO: 2133935 - DNA, 15 bp, Homo sapiens
tgaggctggcactcc

SEQ ID NO: 2133936 - DNA, 22 bp, Homo sapiens
tgaggctgggccagcctcagct

SEQ ID NO: 2133937 - DNA, 14 bp, Homo sapiens
tgagggaaaacata

SEQ ID NO: 2133938 - DNA, 22 bp, Homo sapiens
tgagggaacagacaggagaaat

SEQ ID NO: 2133939 - DNA, 13 bp, Homo sapiens
tgagggagagact

SEQ ID NO: 2133940 - DNA, 15 bp, Homo sapiens
tgagggcagcagcca

SEQ ID NO: 2133941 - DNA, 22 bp, Homo sapiens
tgagggcagcagccagccctgc

SEQ ID NO: 2133942 - DNA, 23 bp, Homo sapiens
tgagggcagcagccagccctgcc

SEQ ID NO: 2133943 - DNA, 21 bp, Homo sapiens
tgagggcagttcgcagccacc

SEQ ID NO: 2133944 - DNA, 21 bp, Homo sapiens
tgagggcattaaaaatagtaa

SEQ ID NO: 2133945 - DNA, 18 bp, Homo sapiens
tgaggggagaggcgccct

SEQ ID NO: 2133946 - DNA, 20 bp, Homo sapiens
tgaggggggccgtgcccagg

SEQ ID NO: 2133947 - DNA, 22 bp, Homo sapiens
tgagggtaataaacttagaata

SEQ ID NO: 2133948 - DNA, 15 bp, Homo sapiens
tgagggtccccacct

SEQ ID NO: 2133949 - DNA, 13 bp, Homo sapiens
tgagggtgactgt

SEQ ID NO: 2133950 - DNA, 15 bp, Homo sapiens
tgaggtcactgggtt

SEQ ID NO: 2133951 - DNA, 18 bp, Homo sapiens
tgaggtcactgggttcta

SEQ ID NO: 2133952 - DNA, 13 bp, Homo sapiens
tgaggtcagagcc

SEQ ID NO: 2133953 - DNA, 17 bp, Homo sapiens
tgaggtcagagcctgca

SEQ ID NO: 2133954 - DNA, 18 bp, Homo sapiens
tgaggtcagagcctgcag

SEQ ID NO: 2133955 - DNA, 19 bp, Homo sapiens
tgaggtcccaggcagagaa

SEQ ID NO: 2133956 - DNA, 17 bp, Homo sapiens
tgaggtcctgagcactg

SEQ ID NO: 2133957 - DNA, 19 bp, Homo sapiens
tgaggtcctgagcactgcc

SEQ ID NO: 2133958 - DNA, 20 bp, Homo sapiens
tgaggtcctgagcactgcca

SEQ ID NO: 2133959 - DNA, 21 bp, Homo sapiens
tgaggtcctgagcactgccag

SEQ ID NO: 2133960 - DNA, 14 bp, Homo sapiens
tgaggtgcccagga

SEQ ID NO: 2133961 - DNA, 15 bp, Homo sapiens
tgaggtggaagccct

SEQ ID NO: 2133962 - DNA, 16 bp, Homo sapiens
tgaggtggaagccctc

SEQ ID NO: 2133963 - DNA, 22 bp, Homo sapiens
tgagtaaaccctatctgtgatt

SEQ ID NO: 2133964 - DNA, 15 bp, Homo sapiens
tgagtacagcagaaa

SEQ ID NO: 2133965 - DNA, 21 bp, Homo sapiens
tgagtacagtgaggagggtgg

SEQ ID NO: 2133966 - DNA, 19 bp, Homo sapiens
tgagtactagaatttgtat

SEQ ID NO: 2133967 - DNA, 15 bp, Homo sapiens
tgagtatacaatata

SEQ ID NO: 2133968 - DNA, 16 bp, Homo sapiens
tgagtcaaaagcctgg

SEQ ID NO: 2133969 - DNA, 18 bp, Homo sapiens
tgagtcaagttgttcctt

SEQ ID NO: 2133970 - DNA, 14 bp, Homo sapiens
tgagtcaattggaa

SEQ ID NO: 2133971 - DNA, 13 bp, Homo sapiens
tgagtcaccagga

SEQ ID NO: 2133972 - DNA, 15 bp, Homo sapiens
tgagtcacctcctcc

SEQ ID NO: 2133973 - DNA, 23 bp, Homo sapiens
tgagtcacctcctccactcactc

SEQ ID NO: 2133974 - DNA, 20 bp, Homo sapiens
tgagtcagtctctctctccc

SEQ ID NO: 2133975 - DNA, 21 bp, Homo sapiens
tgagtcatgatctccctgccg

SEQ ID NO: 2133976 - DNA, 14 bp, Homo sapiens
tgagtcgaggacag

SEQ ID NO: 2133977 - DNA, 16 bp, Homo sapiens
tgagtctacctgagca

SEQ ID NO: 2133978 - DNA, 19 bp, Homo sapiens
tgagtctcctctctgagac

SEQ ID NO: 2133979 - DNA, 14 bp, Homo sapiens
tgagtctcttcaga

SEQ ID NO: 2133980 - DNA, 20 bp, Homo sapiens
tgagtctcttttttattctg

SEQ ID NO: 2133981 - DNA, 21 bp, Homo sapiens
tgagtctgagtcctgtctctg

SEQ ID NO: 2133982 - DNA, 19 bp, Homo sapiens
tgagtctgcataaacttca

SEQ ID NO: 2133983 - DNA, 15 bp, Homo sapiens
tgagtgagccacaga

SEQ ID NO: 2133984 - DNA, 20 bp, Homo sapiens
tgagtgattatttgttattt

SEQ ID NO: 2133985 - DNA, 21 bp, Homo sapiens
tgagtgattgacacacagcac

SEQ ID NO: 2133986 - DNA, 12 bp, Homo sapiens
tgagtggatgga

SEQ ID NO: 2133987 - DNA, 23 bp, Homo sapiens
tgagtggatggaggagaaataaa

SEQ ID NO: 2133988 - DNA, 16 bp, Homo sapiens
tgagtggcagccatgc

SEQ ID NO: 2133989 - DNA, 23 bp, Homo sapiens
tgagtgtgtgtgatgggatctgt

SEQ ID NO: 2133990 - DNA, 15 bp, Homo sapiens
tgagttacttcctat

SEQ ID NO: 2133991 - DNA, 21 bp, Homo sapiens
tgagttacttgtctgaggcct

SEQ ID NO: 2133992 - DNA, 16 bp, Homo sapiens
tgagttatgttaaaat

SEQ ID NO: 2133993 - DNA, 17 bp, Homo sapiens
tgagttattttaattat

SEQ ID NO: 2133994 - DNA, 18 bp, Homo sapiens
tgagttcataccctgtta

SEQ ID NO: 2133995 - DNA, 19 bp, Homo sapiens
tgagttccttataagaatt

SEQ ID NO: 2133996 - DNA, 16 bp, Homo sapiens
tgagttggacacactg

SEQ ID NO: 2133997 - DNA, 18 bp, Homo sapiens
tgagttgttgccctgggt

SEQ ID NO: 2133998 - DNA, 22 bp, Homo sapiens
tgagttgttttggtgcctgcct

SEQ ID NO: 2133999 - DNA, 22 bp, Homo sapiens
tgagtttaagtctctgactctt

SEQ ID NO: 2134000 - DNA, 12 bp, Homo sapiens
tgagtttatggg

SEQ ID NO: 2134001 - DNA, 22 bp, Homo sapiens
tgagtttatgggaatgcctttt

SEQ ID NO: 2134002 - DNA, 22 bp, Homo sapiens
tgagtttgcttatgtaatctca

SEQ ID NO: 2134003 - DNA, 13 bp, Homo sapiens
tgataaaattgtg

SEQ ID NO: 2134004 - DNA, 18 bp, Homo sapiens
tgataaaattgtgatgtt

SEQ ID NO: 2134005 - DNA, 13 bp, Homo sapiens
tgataaacacaga

SEQ ID NO: 2134006 - DNA, 14 bp, Homo sapiens
tgattaaacacctg

SEQ ID NO: 2134007 - DNA, 21 bp, Homo sapiens
tgattaattcaccttccagtg

SEQ ID NO: 2134008 - DNA, 13 bp, Homo sapiens
tgattaatttgag

SEQ ID NO: 2134009 - DNA, 21 bp, Homo sapiens
tgattagaaggcaagtttcta

SEQ ID NO: 2134010 - DNA, 21 bp, Homo sapiens
tgattattttcattacaatgg

SEQ ID NO: 2134011 - DNA, 16 bp, Homo sapiens
tgattcaagaaacaga

SEQ ID NO: 2134012 - DNA, 16 bp, Homo sapiens
tgattcacatctcatt

SEQ ID NO: 2134013 - DNA, 19 bp, Homo sapiens
tgattcactattagagaaa

SEQ ID NO: 2134014 - DNA, 23 bp, Homo sapiens
tgattcataacaatgtatgtgaa

SEQ ID NO: 2134015 - DNA, 16 bp, Homo sapiens
tgattcccaagctctg

SEQ ID NO: 2134016 - DNA, 18 bp, Homo sapiens
tgattcccaagctctgct

SEQ ID NO: 2134017 - DNA, 19 bp, Homo sapiens
tgattcccaagctctgctc

SEQ ID NO: 2134018 - DNA, 12 bp, Homo sapiens
tgattcccagca

SEQ ID NO: 2134019 - DNA, 11 bp, Homo sapiens
tgattccccac

SEQ ID NO: 2134020 - DNA, 15 bp, Homo sapiens
tgattccttttgatg

SEQ ID NO: 2134021 - DNA, 20 bp, Homo sapiens
tgattccttttgatggggag

SEQ ID NO: 2134022 - DNA, 20 bp, Homo sapiens
tgattcggatttgacaaaat

SEQ ID NO: 2134023 - DNA, 13 bp, Homo sapiens
tgattctcctgcc

SEQ ID NO: 2134024 - DNA, 20 bp, Homo sapiens
tgattctcctgcctcagcct

SEQ ID NO: 2134025 - DNA, 21 bp, Homo sapiens
tgattctcctgcctcagcctc

SEQ ID NO: 2134026 - DNA, 15 bp, Homo sapiens
tgattctcctgtcag

SEQ ID NO: 2134027 - DNA, 23 bp, Homo sapiens
tgattctcctgtcagagatctgg

SEQ ID NO: 2134028 - DNA, 12 bp, Homo sapiens
tgattctgggat

SEQ ID NO: 2134029 - DNA, 19 bp, Homo sapiens
tgattctgggatggaccct

SEQ ID NO: 2134030 - DNA, 19 bp, Homo sapiens
tgattggagtgtgtccgga

SEQ ID NO: 2134031 - DNA, 14 bp, Homo sapiens
tgattggattattc

SEQ ID NO: 2134032 - DNA, 15 bp, Homo sapiens
tgattggattattca

SEQ ID NO: 2134033 - DNA, 21 bp, Homo sapiens
tgattggattattcatttaaa

SEQ ID NO: 2134034 - DNA, 13 bp, Homo sapiens
tgattgtcttaat

SEQ ID NO: 2134035 - DNA, 12 bp, Homo sapiens
tgatttaaaaaa

SEQ ID NO: 2134036 - DNA, 17 bp, Homo sapiens
tgatttaaaaaataaat

SEQ ID NO: 2134037 - DNA, 20 bp, Homo sapiens
tgatttaaaaaataaatata

SEQ ID NO: 2134038 - DNA, 15 bp, Homo sapiens
tgatttaagcatttt

SEQ ID NO: 2134039 - DNA, 16 bp, Homo sapiens
tgatttaagcatttta

SEQ ID NO: 2134040 - DNA, 18 bp, Homo sapiens
tgatttaagcattttact

SEQ ID NO: 2134041 - DNA, 13 bp, Homo sapiens
tgatttaatatct

SEQ ID NO: 2134042 - DNA, 16 bp, Homo sapiens
tgatttaatgttttct

SEQ ID NO: 2134043 - DNA, 16 bp, Homo sapiens
tgatttacgctcattg

SEQ ID NO: 2134044 - DNA, 16 bp, Homo sapiens
tgatttatagtttgta

SEQ ID NO: 2134045 - DNA, 18 bp, Homo sapiens
tgatttatatatggcata

SEQ ID NO: 2134046 - DNA, 21 bp, Homo sapiens
tgatttatatatggcatattt

SEQ ID NO: 2134047 - DNA, 16 bp, Homo sapiens
tgatttcacaacagat

SEQ ID NO: 2134048 - DNA, 18 bp, Homo sapiens
tgatttcaggatactctg

SEQ ID NO: 2134049 - DNA, 17 bp, Homo sapiens
tgatttcatttcaactg

SEQ ID NO: 2134050 - DNA, 14 bp, Homo sapiens
tgatttccaggccc

SEQ ID NO: 2134051 - DNA, 20 bp, Homo sapiens
tgatttccaggcccctgagg

SEQ ID NO: 2134052 - DNA, 21 bp, Homo sapiens
tgatttctacgttatgaaaac

SEQ ID NO: 2134053 - DNA, 14 bp, Homo sapiens
tgatttctattcaa

SEQ ID NO: 2134054 - DNA, 15 bp, Homo sapiens
tgatttctctgaaca

SEQ ID NO: 2134055 - DNA, 14 bp, Homo sapiens
tgattttaaatttg

SEQ ID NO: 2134056 - DNA, 18 bp, Homo sapiens
tgattttagctgcagaac

SEQ ID NO: 2134057 - DNA, 14 bp, Homo sapiens
tgattttgtacaga

SEQ ID NO: 2134058 - DNA, 17 bp, Homo sapiens
tgattttgtacagaatt

SEQ ID NO: 2134059 - DNA, 20 bp, Homo sapiens
tgatttttagatgagattgt

SEQ ID NO: 2134060 - DNA, 19 bp, Homo sapiens
tgatttttgttgattaaaa

SEQ ID NO: 2134061 - DNA, 16 bp, Homo sapiens
tgattttttaaaagaa

SEQ ID NO: 2134062 - DNA, 17 bp, Homo sapiens
tgatttttttgttgttg

SEQ ID NO: 2134063 - DNA, 23 bp, Homo sapiens
tgcaaaagtggggctaaatgaag

SEQ ID NO: 2134064 - DNA, 15 bp, Homo sapiens
tgcaaaataaatgtt

SEQ ID NO: 2134065 - DNA, 21 bp, Homo sapiens
tgcaaaatttccagtaccttt

SEQ ID NO: 2134066 - DNA, 17 bp, Homo sapiens
tgcaaacagttcttgga

SEQ ID NO: 2134067 - DNA, 20 bp, Homo sapiens
tgcaaacttgtatctgaaga

SEQ ID NO: 2134068 - DNA, 12 bp, Homo sapiens
tgcaaactttat

SEQ ID NO: 2134069 - DNA, 17 bp, Homo sapiens
tgcaaactttattttca

SEQ ID NO: 2134070 - DNA, 22 bp, Homo sapiens
tgcaaagcactgacttctaagt

SEQ ID NO: 2134071 - DNA, 15 bp, Homo sapiens
tgcaaagtgcaaata

SEQ ID NO: 2134072 - DNA, 18 bp, Homo sapiens
tgcaaagtgcaaatactc

SEQ ID NO: 2134073 - DNA, 15 bp, Homo sapiens
tgcaaagtgccctca

SEQ ID NO: 2134074 - DNA, 22 bp, Homo sapiens
tgcaaagtgttttctcagaaca

SEQ ID NO: 2134075 - DNA, 18 bp, Homo sapiens
tgcaaagttattccccat

SEQ ID NO: 2134076 - DNA, 22 bp, Homo sapiens
tgcaacaagacaaagcaaagcc

SEQ ID NO: 2134077 - DNA, 14 bp, Homo sapiens
tgcaacaggctggg

SEQ ID NO: 2134078 - DNA, 16 bp, Homo sapiens
tgcaacaggctgggct

SEQ ID NO: 2134079 - DNA, 20 bp, Homo sapiens
tgcaacaggctgggcttcag

SEQ ID NO: 2134080 - DNA, 15 bp, Homo sapiens
tgcaaccactgcaac

SEQ ID NO: 2134081 - DNA, 13 bp, Homo sapiens
tgcaacctcacta

SEQ ID NO: 2134082 - DNA, 20 bp, Homo sapiens
tgcaacctccgcctcttggg

SEQ ID NO: 2134083 - DNA, 21 bp, Homo sapiens
tgcaacctccgcctcttgggt

SEQ ID NO: 2134084 - DNA, 20 bp, Homo sapiens
tgcaacctcttcctcctggt

SEQ ID NO: 2134085 - DNA, 23 bp, Homo sapiens
tgcaacctcttcctcctggttca

SEQ ID NO: 2134086 - DNA, 20 bp, Homo sapiens
tgcaacgctttttgggagaa

SEQ ID NO: 2134087 - DNA, 16 bp, Homo sapiens
tgcaacggcttagact

SEQ ID NO: 2134088 - DNA, 13 bp, Homo sapiens
tgcaagaagaata

SEQ ID NO: 2134089 - DNA, 14 bp, Homo sapiens
tgcaagaagaatat

SEQ ID NO: 2134090 - DNA, 15 bp, Homo sapiens
tgcaagaagaatata

SEQ ID NO: 2134091 - DNA, 23 bp, Homo sapiens
tgcaagagacagagcccccaagc

SEQ ID NO: 2134092 - DNA, 17 bp, Homo sapiens
tgcaagatttaacacta

SEQ ID NO: 2134093 - DNA, 16 bp, Homo sapiens
tgcaagcagcctcctg

SEQ ID NO: 2134094 - DNA, 14 bp, Homo sapiens
tgcaagccactatg

SEQ ID NO: 2134095 - DNA, 15 bp, Homo sapiens
tgcaagccccagggc

SEQ ID NO: 2134096 - DNA, 18 bp, Homo sapiens
tgcaagccccagggcctg

SEQ ID NO: 2134097 - DNA, 13 bp, Homo sapiens
tgcaaggggctca

SEQ ID NO: 2134098 - DNA, 16 bp, Homo sapiens
tgcaaggtctttggtt

SEQ ID NO: 2134099 - DNA, 18 bp, Homo sapiens
tgcaagtcatacttagga

SEQ ID NO: 2134100 - DNA, 16 bp, Homo sapiens
tgcaagtgacatctct

SEQ ID NO: 2134101 - DNA, 16 bp, Homo sapiens
tgcaagtgagaagctg

SEQ ID NO: 2134102 - DNA, 18 bp, Homo sapiens
tgcaagtgcccgccctgc

SEQ ID NO: 2134103 - DNA, 21 bp, Homo sapiens
tgcaagtgcccgccctgcccc

SEQ ID NO: 2134104 - DNA, 20 bp, Homo sapiens
tgcaagtttcccgccaggag

SEQ ID NO: 2134105 - DNA, 19 bp, Homo sapiens
tgcaatattcctggtatta

SEQ ID NO: 2134106 - DNA, 16 bp, Homo sapiens
tgcaatctccagggct

SEQ ID NO: 2134107 - DNA, 17 bp, Homo sapiens
tgcaatgacatcttcaa

SEQ ID NO: 2134108 - DNA, 14 bp, Homo sapiens
tgcaatggcagcct

SEQ ID NO: 2134109 - DNA, 15 bp, Homo sapiens
tgcaatggcagcctt

SEQ ID NO: 2134110 - DNA, 16 bp, Homo sapiens
tgcaatggcagccttg

SEQ ID NO: 2134111 - DNA, 14 bp, Homo sapiens
tgcaatttattaaa

SEQ ID NO: 2134112 - DNA, 20 bp, Homo sapiens
tgcaattttaattgattatt

SEQ ID NO: 2134113 - DNA, 15 bp, Homo sapiens
tgcaatttttaaact

SEQ ID NO: 2134114 - DNA, 19 bp, Homo sapiens
tgcaatttttaaactagta

SEQ ID NO: 2134115 - DNA, 13 bp, Homo sapiens
tgcacaagctcag

SEQ ID NO: 2134116 - DNA, 18 bp, Homo sapiens
tgcacaagcttgtatata

SEQ ID NO: 2134117 - DNA, 20 bp, Homo sapiens
tgcacaagcttgtatataca

SEQ ID NO: 2134118 - DNA, 9 bp, Homo sapiens
tgcacaatt

SEQ ID NO: 2134119 - DNA, 22 bp, Homo sapiens
tgcacaatttgagcaattcatt

SEQ ID NO: 2134120 - DNA, 15 bp, Homo sapiens
tgcacacaaacacct

SEQ ID NO: 2134121 - DNA, 22 bp, Homo sapiens
tgcccaccaccgtgtcatgaga

SEQ ID NO: 2134122 - DNA, 17 bp, Homo sapiens
tgcccactgtctctcct

SEQ ID NO: 2134123 - DNA, 17 bp, Homo sapiens
tgcccacttcagcccag

SEQ ID NO: 2134124 - DNA, 11 bp, Homo sapiens
tgcccagagat

SEQ ID NO: 2134125 - DNA, 16 bp, Homo sapiens
tgcccagagatgcctc

SEQ ID NO: 2134126 - DNA, 19 bp, Homo sapiens
tgcccagagggcccaggca

SEQ ID NO: 2134127 - DNA, 13 bp, Homo sapiens
tgcccagctctcg

SEQ ID NO: 2134128 - DNA, 12 bp, Homo sapiens
tgcccaggagaa

SEQ ID NO: 2134129 - DNA, 18 bp, Homo sapiens
tgcccaggagagccagcc

SEQ ID NO: 2134130 - DNA, 23 bp, Homo sapiens
tgcccaggagagccagccctccc

SEQ ID NO: 2134131 - DNA, 12 bp, Homo sapiens
tgcccaggcccc

SEQ ID NO: 2134132 - DNA, 22 bp, Homo sapiens
tgcccaggcccctgccaccctg

SEQ ID NO: 2134133 - DNA, 20 bp, Homo sapiens
tgcccaggctggagtgcagt

SEQ ID NO: 2134134 - DNA, 15 bp, Homo sapiens
tgcccaggctggcct

SEQ ID NO: 2134135 - DNA, 18 bp, Homo sapiens
tgcccaggctggcgtgca

SEQ ID NO: 2134136 - DNA, 20 bp, Homo sapiens
tgcccaggctggcgtgcagt

SEQ ID NO: 2134137 - DNA, 20 bp, Homo sapiens
tgcccaggctggtcttgaac

SEQ ID NO: 2134138 - DNA, 11 bp, Homo sapiens
tgcccagggct

SEQ ID NO: 2134139 - DNA, 17 bp, Homo sapiens
tgcccagggctcagcct

SEQ ID NO: 2134140 - DNA, 22 bp, Homo sapiens
tgcccatacccctgcctgggtt

SEQ ID NO: 2134141 - DNA, 23 bp, Homo sapiens
tgcccatcatacgcatggtcctg

SEQ ID NO: 2134142 - DNA, 14 bp, Homo sapiens
tgcccatgtgtccc

SEQ ID NO: 2134143 - DNA, 19 bp, Homo sapiens
tgcccatgtgtcccctcac

SEQ ID NO: 2134144 - DNA, 11 bp, Homo sapiens
tgccccaaccc

SEQ ID NO: 2134145 - DNA, 13 bp, Homo sapiens
tgccccaactcct

SEQ ID NO: 2134146 - DNA, 15 bp, Homo sapiens
tgccccaagcagcca

SEQ ID NO: 2134147 - DNA, 15 bp, Homo sapiens
tgccccaaggctgct

SEQ ID NO: 2134148 - DNA, 21 bp, Homo sapiens
tgccccaaggctgctcagagg

SEQ ID NO: 2134149 - DNA, 19 bp, Homo sapiens
tgccccaaggggcccacaa

SEQ ID NO: 2134150 - DNA, 12 bp, Homo sapiens
tgccccaccagc

SEQ ID NO: 2134151 - DNA, 17 bp, Homo sapiens
tgccccaccagccacct

SEQ ID NO: 2134152 - DNA, 13 bp, Homo sapiens
tgccccagagccc

SEQ ID NO: 2134153 - DNA, 11 bp, Homo sapiens
tgccccagcgc

SEQ ID NO: 2134154 - DNA, 13 bp, Homo sapiens
tgccccagcgcgg

SEQ ID NO: 2134155 - DNA, 14 bp, Homo sapiens
tgccccagctctgg

SEQ ID NO: 2134156 - DNA, 16 bp, Homo sapiens
tgccccagctctggct

SEQ ID NO: 2134157 - DNA, 18 bp, Homo sapiens
tgccccagctctggcttc

SEQ ID NO: 2134158 - DNA, 15 bp, Homo sapiens
tgccccatcctgggc

SEQ ID NO: 2134159 - DNA, 21 bp, Homo sapiens
tgccccatctcctcccatggc

SEQ ID NO: 2134160 - DNA, 22 bp, Homo sapiens
tgccccatctcctcccatggcc

SEQ ID NO: 2134161 - DNA, 23 bp, Homo sapiens
tgcccccaaaggtggtctgcttt

SEQ ID NO: 2134162 - DNA, 20 bp, Homo sapiens
tgcccccagcactcctctgt

SEQ ID NO: 2134163 - DNA, 14 bp, Homo sapiens
tgcccccatcccac

SEQ ID NO: 2134164 - DNA, 18 bp, Homo sapiens
tgcccccatctccccagg

SEQ ID NO: 2134165 - DNA, 19 bp, Homo sapiens
tgcccccatctccccaggc

SEQ ID NO: 2134166 - DNA, 22 bp, Homo sapiens
tgcccccatctccccaggcctc

SEQ ID NO: 2134167 - DNA, 18 bp, Homo sapiens
tgcccccgacagcccagc

SEQ ID NO: 2134168 - DNA, 16 bp, Homo sapiens
tgccccctcatctcac

SEQ ID NO: 2134169 - DNA, 17 bp, Homo sapiens
tgccccctcatctcact

SEQ ID NO: 2134170 - DNA, 18 bp, Homo sapiens
tgccccgggtccccagct

SEQ ID NO: 2134171 - DNA, 19 bp, Homo sapiens
tgccccgggtccccagctc

SEQ ID NO: 2134172 - DNA, 23 bp, Homo sapiens
tgccccgttccctgtcagaggct

SEQ ID NO: 2134173 - DNA, 18 bp, Homo sapiens
tgcccctccagagacagg

SEQ ID NO: 2134174 - DNA, 17 bp, Homo sapiens
tgcccctccccagccct

SEQ ID NO: 2134175 - DNA, 16 bp, Homo sapiens
tgcccctcccttcaac

SEQ ID NO: 2134176 - DNA, 17 bp, Homo sapiens
tgcccctcttcccggga

SEQ ID NO: 2134177 - DNA, 13 bp, Homo sapiens
tgcccctgcagtt

SEQ ID NO: 2134178 - DNA, 23 bp, Homo sapiens
tgcccctgcagttggcagaaagg

SEQ ID NO: 2134179 - DNA, 22 bp, Homo sapiens
tgccccttaagggttgaaggca

SEQ ID NO: 2134180 - DNA, 12 bp, Homo sapiens
tgccccttccac

SEQ ID NO: 2134181 - DNA, 21 bp, Homo sapiens
tgccccttcccatctcttcct

SEQ ID NO: 2134182 - DNA, 21 bp, Homo sapiens
tgccccttgggcatccaccca

SEQ ID NO: 2134183 - DNA, 13 bp, Homo sapiens
tgcccgcagagcc

SEQ ID NO: 2134184 - DNA, 13 bp, Homo sapiens
tgcccgccagcct

SEQ ID NO: 2134185 - DNA, 18 bp, Homo sapiens
tgcccgccagcctcagtg

SEQ ID NO: 2134186 - DNA, 22 bp, Homo sapiens
tgcccgccagcctcagtgccac

SEQ ID NO: 2134187 - DNA, 13 bp, Homo sapiens
tgcccgccctgcc

SEQ ID NO: 2134188 - DNA, 14 bp, Homo sapiens
tgcccgccctgccc

SEQ ID NO: 2134189 - DNA, 18 bp, Homo sapiens
tgcccgccctgcccctgc

SEQ ID NO: 2134190 - DNA, 15 bp, Homo sapiens
tgcccggattctggg

SEQ ID NO: 2134191 - DNA, 17 bp, Homo sapiens
tgcccggattctgggag

SEQ ID NO: 2134192 - DNA, 22 bp, Homo sapiens
tgcccggattctgggaggaagc

SEQ ID NO: 2134193 - DNA, 14 bp, Homo sapiens
tgcccggctgcgga

SEQ ID NO: 2134194 - DNA, 17 bp, Homo sapiens
tgccctagagcacactg

SEQ ID NO: 2134195 - DNA, 23 bp, Homo sapiens
tgccctagagcacactgtagcat

SEQ ID NO: 2134196 - DNA, 14 bp, Homo sapiens
tgccctcatttgtg

SEQ ID NO: 2134197 - DNA, 12 bp, Homo sapiens
tgccctccctgg

SEQ ID NO: 2134198 - DNA, 17 bp, Homo sapiens
tgccctctccttcctta

SEQ ID NO: 2134199 - DNA, 21 bp, Homo sapiens
tgccctctccttccttaccca

SEQ ID NO: 2134200 - DNA, 14 bp, Homo sapiens
tgccctctctcagt

SEQ ID NO: 2134201 - DNA, 12 bp, Homo sapiens
tgccctctggat

SEQ ID NO: 2134202 - DNA, 15 bp, Homo sapiens
tgccctctggatcct

SEQ ID NO: 2134203 - DNA, 14 bp, Homo sapiens
tgccctgacctccc

SEQ ID NO: 2134204 - DNA, 16 bp, Homo sapiens
tgccctgacctcccag

SEQ ID NO: 2134205 - DNA, 17 bp, Homo sapiens
tgccctgacctcccagc

SEQ ID NO: 2134206 - DNA, 18 bp, Homo sapiens
tgccctgacctcccagcc

SEQ ID NO: 2134207 - DNA, 22 bp, Homo sapiens
tgccctgacctcccagccctat

SEQ ID NO: 2134208 - DNA, 15 bp, Homo sapiens
tgccctgccacctgt

SEQ ID NO: 2134209 - DNA, 13 bp, Homo sapiens
tgccctgccccca

SEQ ID NO: 2134210 - DNA, 15 bp, Homo sapiens
tgccctgccctgcca

SEQ ID NO: 2134211 - DNA, 14 bp, Homo sapiens
tgccctgcctccct

SEQ ID NO: 2134212 - DNA, 12 bp, Homo sapiens
tgccctgcctgc

SEQ ID NO: 2134213 - DNA, 13 bp, Homo sapiens
tgccctgcctgcc

SEQ ID NO: 2134214 - DNA, 14 bp, Homo sapiens
tgccctgcctgccc

SEQ ID NO: 2134215 - DNA, 15 bp, Homo sapiens
tgccctgctctgggg

SEQ ID NO: 2134216 - DNA, 23 bp, Homo sapiens
tgccctgctgccgcctcccagcc

SEQ ID NO: 2134217 - DNA, 13 bp, Homo sapiens
tgccctggaggga

SEQ ID NO: 2134218 - DNA, 17 bp, Homo sapiens
tgccctgtaacttatct

SEQ ID NO: 2134219 - DNA, 23 bp, Homo sapiens
tgccctgtatataatactaaagt

SEQ ID NO: 2134220 - DNA, 13 bp, Homo sapiens
tgccctgtcctcc

SEQ ID NO: 2134221 - DNA, 14 bp, Homo sapiens
tgccctgtcctcca

SEQ ID NO: 2134222 - DNA, 14 bp, Homo sapiens
tgccctgtggattc

SEQ ID NO: 2134223 - DNA, 20 bp, Homo sapiens
tgccctgtggattccagcat

SEQ ID NO: 2134224 - DNA, 19 bp, Homo sapiens
tgcccttaaaataatgatt

SEQ ID NO: 2134225 - DNA, 16 bp, Homo sapiens
tgcccttcgctgccag

SEQ ID NO: 2134226 - DNA, 18 bp, Homo sapiens
tgcccttcgctgccagga

SEQ ID NO: 2134227 - DNA, 20 bp, Homo sapiens
tgcccttcgctgccaggaca

SEQ ID NO: 2134228 - DNA, 21 bp, Homo sapiens
tgcccttctttctaccctgct

SEQ ID NO: 2134229 - DNA, 21 bp, Homo sapiens
tgcccttttcatctccagtgt

SEQ ID NO: 2134230 - DNA, 13 bp, Homo sapiens
tgccgagagaggc

SEQ ID NO: 2134231 - DNA, 16 bp, Homo sapiens
tgccgagagaggcgcg

SEQ ID NO: 2134232 - DNA, 15 bp, Homo sapiens
tgccgagcaaccgtg

SEQ ID NO: 2134233 - DNA, 17 bp, Homo sapiens
tgccgagcaaccgtggc

SEQ ID NO: 2134234 - DNA, 17 bp, Homo sapiens
tgccgagcctaatgaaa

SEQ ID NO: 2134235 - DNA, 21 bp, Homo sapiens
tgccgcaaggccctgtcccag

SEQ ID NO: 2134236 - DNA, 24 bp, Homo sapiens
tgctggcctgtggcaggcctagga

SEQ ID NO: 2134237 - DNA, 20 bp, Homo sapiens
tgctggcggcgcagagggaa

SEQ ID NO: 2134238 - DNA, 13 bp, Homo sapiens
tgctggctgcctt

SEQ ID NO: 2134239 - DNA, 14 bp, Homo sapiens
tgctggctgcctta

SEQ ID NO: 2134240 - DNA, 21 bp, Homo sapiens
tgctggctgccttagaacctt

SEQ ID NO: 2134241 - DNA, 17 bp, Homo sapiens
tgctgggactggccagg

SEQ ID NO: 2134242 - DNA, 20 bp, Homo sapiens
tgctgggctctccacctcag

SEQ ID NO: 2134243 - DNA, 22 bp, Homo sapiens
tgctgggcttgtagaccactgt

SEQ ID NO: 2134244 - DNA, 19 bp, Homo sapiens
tgctggggcatgtgtgcct

SEQ ID NO: 2134245 - DNA, 22 bp, Homo sapiens
tgctggggcatgtgtgcctgtg

SEQ ID NO: 2134246 - DNA, 20 bp, Homo sapiens
tgctggtctaggagctgtct

SEQ ID NO: 2134247 - DNA, 18 bp, Homo sapiens
tgctggtgtcattgctgt

SEQ ID NO: 2134248 - DNA, 20 bp, Homo sapiens
tgctgtaaataaatgcttta

SEQ ID NO: 2134249 - DNA, 15 bp, Homo sapiens
tgctgtacccttcca

SEQ ID NO: 2134250 - DNA, 14 bp, Homo sapiens
tgctgtcctaggcc

SEQ ID NO: 2134251 - DNA, 23 bp, Homo sapiens
tgctgtcctaggccacaccatct

SEQ ID NO: 2134252 - DNA, 18 bp, Homo sapiens
tgctgtcctgttttactg

SEQ ID NO: 2134253 - DNA, 11 bp, Homo sapiens
tgctgtgcctg

SEQ ID NO: 2134254 - DNA, 12 bp, Homo sapiens
tgctgtgcctgc

SEQ ID NO: 2134255 - DNA, 19 bp, Homo sapiens
tgctgtgcctgctagagca

SEQ ID NO: 2134256 - DNA, 14 bp, Homo sapiens
tgctgtggccaggg

SEQ ID NO: 2134257 - DNA, 12 bp, Homo sapiens
tgctgtggcctc

SEQ ID NO: 2134258 - DNA, 14 bp, Homo sapiens
tgctgtggcctcac

SEQ ID NO: 2134259 - DNA, 22 bp, Homo sapiens
tgctgtggcctcacttccctgg

SEQ ID NO: 2134260 - DNA, 13 bp, Homo sapiens
tgctgtgggcagc

SEQ ID NO: 2134261 - DNA, 14 bp, Homo sapiens
tgctgtgggcagca

SEQ ID NO: 2134262 - DNA, 16 bp, Homo sapiens
tgctgtgggcagcacc

SEQ ID NO: 2134263 - DNA, 19 bp, Homo sapiens
tgctgtgggcagcaccctc

SEQ ID NO: 2134264 - DNA, 16 bp, Homo sapiens
tgctgtggtggggaga

SEQ ID NO: 2134265 - DNA, 16 bp, Homo sapiens
tgctgtgtagctctgt

SEQ ID NO: 2134266 - DNA, 19 bp, Homo sapiens
tgctgtgtagctctgtcca

SEQ ID NO: 2134267 - DNA, 15 bp, Homo sapiens
tgctgtgtttgagct

SEQ ID NO: 2134268 - DNA, 13 bp, Homo sapiens
tgctgttctggag

SEQ ID NO: 2134269 - DNA, 16 bp, Homo sapiens
tgctgttctggagctg

SEQ ID NO: 2134270 - DNA, 14 bp, Homo sapiens
tgctgttgcctcat

SEQ ID NO: 2134271 - DNA, 11 bp, Homo sapiens
tgctgtttcct

SEQ ID NO: 2134272 - DNA, 12 bp, Homo sapiens
tgcttaaaacaa

SEQ ID NO: 2134273 - DNA, 14 bp, Homo sapiens
tgcttaaaagacat

SEQ ID NO: 2134274 - DNA, 23 bp, Homo sapiens
tgcttaaaatatgtatgtctaat

SEQ ID NO: 2134275 - DNA, 12 bp, Homo sapiens
tgcttacatttt

SEQ ID NO: 2134276 - DNA, 18 bp, Homo sapiens
tgcttacatttttacaat

SEQ ID NO: 2134277 - DNA, 19 bp, Homo sapiens
tgcttagcctcctgacctg

SEQ ID NO: 2134278 - DNA, 21 bp, Homo sapiens
tgcttatgacatcacttgtac

SEQ ID NO: 2134279 - DNA, 14 bp, Homo sapiens
tgcttatttatatt

SEQ ID NO: 2134280 - DNA, 18 bp, Homo sapiens
tgcttatttccctcatct

SEQ ID NO: 2134281 - DNA, 16 bp, Homo sapiens
tgcttcaattaataaa

SEQ ID NO: 2134282 - DNA, 15 bp, Homo sapiens
tgcttcagcctgagg

SEQ ID NO: 2134283 - DNA, 22 bp, Homo sapiens
tgcttcagcctgaggctgagac

SEQ ID NO: 2134284 - DNA, 17 bp, Homo sapiens
tgcttcatgctcagccc

SEQ ID NO: 2134285 - DNA, 15 bp, Homo sapiens
tgcttccaattttct

SEQ ID NO: 2134286 - DNA, 16 bp, Homo sapiens
tgcttcccagagaagc

SEQ ID NO: 2134287 - DNA, 13 bp, Homo sapiens
tgcttccttctgc

SEQ ID NO: 2134288 - DNA, 14 bp, Homo sapiens
tgcttctcagcccc

SEQ ID NO: 2134289 - DNA, 14 bp, Homo sapiens
tgcttctcatcccc

SEQ ID NO: 2134290 - DNA, 22 bp, Homo sapiens
tgcttctgaactcaagctgcgt

SEQ ID NO: 2134291 - DNA, 13 bp, Homo sapiens
tgcttcttgcccc

SEQ ID NO: 2134292 - DNA, 15 bp, Homo sapiens
tgcttcttgcccctt

SEQ ID NO: 2134293 - DNA, 21 bp, Homo sapiens
tgcttgactatcacatacaat

SEQ ID NO: 2134294 - DNA, 16 bp, Homo sapiens
tgcttgagcccaggag

SEQ ID NO: 2134295 - DNA, 22 bp, Homo sapiens
tgcttgcactttgtaacatgtt

SEQ ID NO: 2134296 - DNA, 20 bp, Homo sapiens
tgcttgcatcacttggggtc

SEQ ID NO: 2134297 - DNA, 13 bp, Homo sapiens
tgcttggcagaga

SEQ ID NO: 2134298 - DNA, 14 bp, Homo sapiens
tgcttgggttcctt

SEQ ID NO: 2134299 - DNA, 20 bp, Homo sapiens
tgcttggtggggctcgtggc

SEQ ID NO: 2134300 - DNA, 18 bp, Homo sapiens
tgcttggttggctggcag

SEQ ID NO: 2134301 - DNA, 18 bp, Homo sapiens
tgcttgtcctgctctctt

SEQ ID NO: 2134302 - DNA, 21 bp, Homo sapiens
tgcttgtgatttttgaacaat

SEQ ID NO: 2134303 - DNA, 12 bp, Homo sapiens
tgcttgtgggcc

SEQ ID NO: 2134304 - DNA, 15 bp, Homo sapiens
tgctttaaagtgtaa

SEQ ID NO: 2134305 - DNA, 14 bp, Homo sapiens
tgctttatttatgg

SEQ ID NO: 2134306 - DNA, 23 bp, Homo sapiens
tgctttcccaccagcatgtcact

SEQ ID NO: 2134307 - DNA, 15 bp, Homo sapiens
tgctttccctcccca

SEQ ID NO: 2134308 - DNA, 22 bp, Homo sapiens
tgctttcctaaagtctctgctg

SEQ ID NO: 2134309 - DNA, 12 bp, Homo sapiens
tgctttctcctg

SEQ ID NO: 2134310 - DNA, 13 bp, Homo sapiens
tgctttctcctgg

SEQ ID NO: 2134311 - DNA, 21 bp, Homo sapiens
tgctttctgaagctttaccag

SEQ ID NO: 2134312 - DNA, 23 bp, Homo sapiens
tgctttctgaagctttaccagct

SEQ ID NO: 2134313 - DNA, 15 bp, Homo sapiens
tgctttgaagcagtt

SEQ ID NO: 2134314 - DNA, 22 bp, Homo sapiens
tgctttgactcacctgttactt

SEQ ID NO: 2134315 - DNA, 22 bp, Homo sapiens
tgctttgcccttctttctaccc

SEQ ID NO: 2134316 - DNA, 13 bp, Homo sapiens
tgctttgcttttt

SEQ ID NO: 2134317 - DNA, 15 bp, Homo sapiens
tgctttgggctgccc

SEQ ID NO: 2134318 - DNA, 17 bp, Homo sapiens
tgctttgggctgccctg

SEQ ID NO: 2134319 - DNA, 20 bp, Homo sapiens
tgctttgggctgccctggtg

SEQ ID NO: 2134320 - DNA, 19 bp, Homo sapiens
tgctttgggctttgcaggc

SEQ ID NO: 2134321 - DNA, 23 bp, Homo sapiens
tgctttgggctttgcaggctctg

SEQ ID NO: 2134322 - DNA, 18 bp, Homo sapiens
tgctttgttttgtttgtg

SEQ ID NO: 2134323 - DNA, 21 bp, Homo sapiens
tgcttttccaggatcctgcag

SEQ ID NO: 2134324 - DNA, 18 bp, Homo sapiens
tgcttttggtctgtgtga

SEQ ID NO: 2134325 - DNA, 16 bp, Homo sapiens
tgcttttgttgtgact

SEQ ID NO: 2134326 - DNA, 17 bp, Homo sapiens
tgctttttaagtgttaa

SEQ ID NO: 2134327 - DNA, 14 bp, Homo sapiens
tgctttttccagat

SEQ ID NO: 2134328 - DNA, 21 bp, Homo sapiens
tggaaaaaagagaaaaaccaa

SEQ ID NO: 2134329 - DNA, 23 bp, Homo sapiens
tggaaaaacatctgaaagccacg

SEQ ID NO: 2134330 - DNA, 16 bp, Homo sapiens
tggaaaaagaaagaaa

SEQ ID NO: 2134331 - DNA, 21 bp, Homo sapiens
tggaaaaagaaagaaacactc

SEQ ID NO: 2134332 - DNA, 16 bp, Homo sapiens
tggaaaagtcacacag

SEQ ID NO: 2134333 - DNA, 16 bp, Homo sapiens
tggaaaatgtcctgtg

SEQ ID NO: 2134334 - DNA, 15 bp, Homo sapiens
tggaaacagggcagt

SEQ ID NO: 2134335 - DNA, 12 bp, Homo sapiens
tggaaagcaaag

SEQ ID NO: 2134336 - DNA, 16 bp, Homo sapiens
tggaaagcatcacctc

SEQ ID NO: 2134337 - DNA, 13 bp, Homo sapiens
tggaaaggctcag

SEQ ID NO: 2134338 - DNA, 16 bp, Homo sapiens
tggaaagttcagccag

SEQ ID NO: 2134339 - DNA, 23 bp, Homo sapiens
tggaaataaacctggagatgatg

SEQ ID NO: 2134340 - DNA, 13 bp, Homo sapiens
tggaaataaatgt

SEQ ID NO: 2134341 - DNA, 20 bp, Homo sapiens
tggaaatgtcctccaacaat

SEQ ID NO: 2134342 - DNA, 21 bp, Homo sapiens
tggaaattcaggtgaaaatgt

SEQ ID NO: 2134343 - DNA, 13 bp, Homo sapiens
tggaaattttgtc

SEQ ID NO: 2134344 - DNA, 22 bp, Homo sapiens
tggaacacctaccaaaaaataa

SEQ ID NO: 2134345 - DNA, 21 bp, Homo sapiens
tggaacagtcacccttctggg

SEQ ID NO: 2134346 - DNA, 20 bp, Homo sapiens
tggaacataaaatacaatgt

SEQ ID NO: 2134347 - DNA, 21 bp, Homo sapiens
tggaacataaaatacaatgtt

SEQ ID NO: 2134348 - DNA, 17 bp, Homo sapiens
tggaaccagggaggaga

SEQ ID NO: 2134349 - DNA, 21 bp, Homo sapiens
tggaaccagggaggagaggaa

SEQ ID NO: 2134350 - DNA, 14 bp, Homo sapiens
tggaaccttccctc

SEQ ID NO: 2134351 - DNA, 16 bp, Homo sapiens
tggcttctgggacctg

SEQ ID NO: 2134352 - DNA, 12 bp, Homo sapiens
tggcttctgtgc

SEQ ID NO: 2134353 - DNA, 13 bp, Homo sapiens
tggcttctgtgca

SEQ ID NO: 2134354 - DNA, 14 bp, Homo sapiens
tggcttgctccagg

SEQ ID NO: 2134355 - DNA, 16 bp, Homo sapiens
tggcttgctccagggt

SEQ ID NO: 2134356 - DNA, 18 bp, Homo sapiens
tggcttgctccagggtct

SEQ ID NO: 2134357 - DNA, 15 bp, Homo sapiens
tggcttggggagcag

SEQ ID NO: 2134358 - DNA, 16 bp, Homo sapiens
tggcttggggagcaga

SEQ ID NO: 2134359 - DNA, 17 bp, Homo sapiens
tggcttgtgattctggg

SEQ ID NO: 2134360 - DNA, 17 bp, Homo sapiens
tggctttacattttatt

SEQ ID NO: 2134361 - DNA, 22 bp, Homo sapiens
tggctttctccgactgctaggg

SEQ ID NO: 2134362 - DNA, 13 bp, Homo sapiens
tggctttgtctct

SEQ ID NO: 2134363 - DNA, 18 bp, Homo sapiens
tggcttttcactgctggc

SEQ ID NO: 2134364 - DNA, 21 bp, Homo sapiens
tggcttttcgcttgcttctgc

SEQ ID NO: 2134365 - DNA, 18 bp, Homo sapiens
tgggaaaagaccagggct

SEQ ID NO: 2134366 - DNA, 15 bp, Homo sapiens
tgggaaacagggagc

SEQ ID NO: 2134367 - DNA, 16 bp, Homo sapiens
tgggaaagcattgtaa

SEQ ID NO: 2134368 - DNA, 18 bp, Homo sapiens
tgggaaagcattgtaaat

SEQ ID NO: 2134369 - DNA, 20 bp, Homo sapiens
tgggaaaggaaaaccaggga

SEQ ID NO: 2134370 - DNA, 13 bp, Homo sapiens
tgggaaagggacc

SEQ ID NO: 2134371 - DNA, 16 bp, Homo sapiens
tgggaaccatgaagct

SEQ ID NO: 2134372 - DNA, 22 bp, Homo sapiens
tgggaaccccttcatcctctga

SEQ ID NO: 2134373 - DNA, 18 bp, Homo sapiens
tgggaacccgactgtgaa

SEQ ID NO: 2134374 - DNA, 15 bp, Homo sapiens
tgggaaccctcccca

SEQ ID NO: 2134375 - DNA, 13 bp, Homo sapiens
tgggaactctgac

SEQ ID NO: 2134376 - DNA, 17 bp, Homo sapiens
tgggaactggagggtga

SEQ ID NO: 2134377 - DNA, 13 bp, Homo sapiens
tgggaagacatga

SEQ ID NO: 2134378 - DNA, 20 bp, Homo sapiens
tgggaagagaagggaagcct

SEQ ID NO: 2134379 - DNA, 21 bp, Homo sapiens
tgggaagccatattcacacct

SEQ ID NO: 2134380 - DNA, 13 bp, Homo sapiens
tgggaagggagag

SEQ ID NO: 2134381 - DNA, 18 bp, Homo sapiens
tgggacagaggagcaagg

SEQ ID NO: 2134382 - DNA, 14 bp, Homo sapiens
tgggacagccccag

SEQ ID NO: 2134383 - DNA, 15 bp, Homo sapiens
tgggacagccccagg

SEQ ID NO: 2134384 - DNA, 20 bp, Homo sapiens
tgggacagccccagggccct

SEQ ID NO: 2134385 - DNA, 13 bp, Homo sapiens
tgggacccagcta

SEQ ID NO: 2134386 - DNA, 22 bp, Homo sapiens
tgggacccagctactctgtcca

SEQ ID NO: 2134387 - DNA, 22 bp, Homo sapiens
tgggaccccagctagggctgga

SEQ ID NO: 2134388 - DNA, 17 bp, Homo sapiens
tgggaccctttccttcc

SEQ ID NO: 2134389 - DNA, 20 bp, Homo sapiens
tgggaccgctacaccactct

SEQ ID NO: 2134390 - DNA, 23 bp, Homo sapiens
tgggacctcagttttatcatttt

SEQ ID NO: 2134391 - DNA, 18 bp, Homo sapiens
tgggactagagctttctt

SEQ ID NO: 2134392 - DNA, 14 bp, Homo sapiens
tgggagaacctcag

SEQ ID NO: 2134393 - DNA, 18 bp, Homo sapiens
tgggagaatgtcagttca

SEQ ID NO: 2134394 - DNA, 21 bp, Homo sapiens
tgggagacaagaaatccctgt

SEQ ID NO: 2134395 - DNA, 21 bp, Homo sapiens
tgggagagacactcccaggga

SEQ ID NO: 2134396 - DNA, 17 bp, Homo sapiens
tgggagagccagctctc

SEQ ID NO: 2134397 - DNA, 13 bp, Homo sapiens
tgggagcactgga

SEQ ID NO: 2134398 - DNA, 18 bp, Homo sapiens
tgggagcctgaggcatga

SEQ ID NO: 2134399 - DNA, 12 bp, Homo sapiens
tgggagctgcct

SEQ ID NO: 2134400 - DNA, 24 bp, Homo sapiens
tgggagctgcctgttcagctccag

SEQ ID NO: 2134401 - DNA, 18 bp, Homo sapiens
tgggagctggttagaaat

SEQ ID NO: 2134402 - DNA, 19 bp, Homo sapiens
tgggagctggttagaaatg

SEQ ID NO: 2134403 - DNA, 14 bp, Homo sapiens
tgggaggaacctga

SEQ ID NO: 2134404 - DNA, 13 bp, Homo sapiens
tgggaggaagcag

SEQ ID NO: 2134405 - DNA, 13 bp, Homo sapiens
tgggaggcagcat

SEQ ID NO: 2134406 - DNA, 14 bp, Homo sapiens
tgggaggccaaggc

SEQ ID NO: 2134407 - DNA, 16 bp, Homo sapiens
tgggaggccaaggcag

SEQ ID NO: 2134408 - DNA, 17 bp, Homo sapiens
tgggaggccaaggcagg

SEQ ID NO: 2134409 - DNA, 18 bp, Homo sapiens
tgggaggccaaggcaggt

SEQ ID NO: 2134410 - DNA, 23 bp, Homo sapiens
tgggaggcctcgtaccagccagg

SEQ ID NO: 2134411 - DNA, 22 bp, Homo sapiens
tgggaggcggagagtacagtga

SEQ ID NO: 2134412 - DNA, 14 bp, Homo sapiens
tgggaggctgaagt

SEQ ID NO: 2134413 - DNA, 17 bp, Homo sapiens
tgggaggctgaagtggg

SEQ ID NO: 2134414 - DNA, 13 bp, Homo sapiens
tgggaggctgagg

SEQ ID NO: 2134415 - DNA, 14 bp, Homo sapiens
tgggaggctgaggc

SEQ ID NO: 2134416 - DNA, 15 bp, Homo sapiens
tgggagggacagggc

SEQ ID NO: 2134417 - DNA, 17 bp, Homo sapiens
tgggagggagcagacag

SEQ ID NO: 2134418 - DNA, 14 bp, Homo sapiens
tgggagggatgaga

SEQ ID NO: 2134419 - DNA, 20 bp, Homo sapiens
tgggagggggctccatggag

SEQ ID NO: 2134420 - DNA, 22 bp, Homo sapiens
tgggagggggctccatggagga

SEQ ID NO: 2134421 - DNA, 13 bp, Homo sapiens
tgggaggtcgagg

SEQ ID NO: 2134422 - DNA, 20 bp, Homo sapiens
tgggaggtctccactgagga

SEQ ID NO: 2134423 - DNA, 23 bp, Homo sapiens
tgggaggtcttggccgactcagg

SEQ ID NO: 2134424 - DNA, 16 bp, Homo sapiens
tgggagtgcagagaaa

SEQ ID NO: 2134425 - DNA, 15 bp, Homo sapiens
tgggagtggcccctg

SEQ ID NO: 2134426 - DNA, 14 bp, Homo sapiens
tgggagtgttctgt

SEQ ID NO: 2134427 - DNA, 15 bp, Homo sapiens
tgggagtgttctgtg

SEQ ID NO: 2134428 - DNA, 21 bp, Homo sapiens
tgggagtgttctgtgggcttg

SEQ ID NO: 2134429 - DNA, 13 bp, Homo sapiens
tgggatatgacaa

SEQ ID NO: 2134430 - DNA, 13 bp, Homo sapiens
tgggatcagcctc

SEQ ID NO: 2134431 - DNA, 14 bp, Homo sapiens
tgggatcagcctcc

SEQ ID NO: 2134432 - DNA, 23 bp, Homo sapiens
tgggatctgtaaggaactggaac

SEQ ID NO: 2134433 - DNA, 16 bp, Homo sapiens
tgggatgagccgctgt

SEQ ID NO: 2134434 - DNA, 12 bp, Homo sapiens
tgggatgctcct

SEQ ID NO: 2134435 - DNA, 18 bp, Homo sapiens
tgggatggaccctcgcag

SEQ ID NO: 2134436 - DNA, 13 bp, Homo sapiens
tgggatggaggag

SEQ ID NO: 2134437 - DNA, 22 bp, Homo sapiens
tgggatgtcctctttactccct

SEQ ID NO: 2134438 - DNA, 14 bp, Homo sapiens
tgggatgtttctgt

SEQ ID NO: 2134439 - DNA, 22 bp, Homo sapiens
tgggattacaagcgtgagccac

SEQ ID NO: 2134440 - DNA, 23 bp, Homo sapiens
tgggattcccaccaaggtcttca

SEQ ID NO: 2134441 - DNA, 18 bp, Homo sapiens
tgggatttatatctatag

SEQ ID NO: 2134442 - DNA, 15 bp, Homo sapiens
tgggatttcttcgct

SEQ ID NO: 2134443 - DNA, 21 bp, Homo sapiens
tgggatttcttcgctgctcta

SEQ ID NO: 2134444 - DNA, 21 bp, Homo sapiens
tgggcaaacccttctcttctc

SEQ ID NO: 2134445 - DNA, 17 bp, Homo sapiens
tgggcaatgaaaccaaa

SEQ ID NO: 2134446 - DNA, 15 bp, Homo sapiens
tgggcacatgaggag

SEQ ID NO: 2134447 - DNA, 18 bp, Homo sapiens
tgggcacatgaggagggt

SEQ ID NO: 2134448 - DNA, 19 bp, Homo sapiens
tgggcaccacaggctgcct

SEQ ID NO: 2134449 - DNA, 16 bp, Homo sapiens
tgggcactgggatgag

SEQ ID NO: 2134450 - DNA, 22 bp, Homo sapiens
tgggcactgggatgagccgctg

SEQ ID NO: 2134451 - DNA, 14 bp, Homo sapiens
tgggcactggtatt

SEQ ID NO: 2134452 - DNA, 15 bp, Homo sapiens
tgggcagaagggaga

SEQ ID NO: 2134453 - DNA, 17 bp, Homo sapiens
tgggcagaagggagaag

SEQ ID NO: 2134454 - DNA, 18 bp, Homo sapiens
tgggcagaagggagaagg

SEQ ID NO: 2134455 - DNA, 22 bp, Homo sapiens
tgggcagcaccctcccccgcag

SEQ ID NO: 2134456 - DNA, 14 bp, Homo sapiens
tgggcagcagctca

SEQ ID NO: 2134457 - DNA, 19 bp, Homo sapiens
tgggcagcagctcagcctc

SEQ ID NO: 2134458 - DNA, 16 bp, Homo sapiens
tgggcagcatagcaag

SEQ ID NO: 2134459 - DNA, 12 bp, Homo sapiens
tgggcagctggg

SEQ ID NO: 2134460 - DNA, 14 bp, Homo sapiens
tgggcagctgggcc

SEQ ID NO: 2134461 - DNA, 15 bp, Homo sapiens
tgggcagctgggccc

SEQ ID NO: 2134462 - DNA, 16 bp, Homo sapiens
tgggcagcttgagagg

SEQ ID NO: 2134463 - DNA, 19 bp, Homo sapiens
tgggcagcttgagagggca

SEQ ID NO: 2134464 - DNA, 10 bp, Homo sapiens
tgggcagggc

SEQ ID NO: 2134465 - DNA, 14 bp, Homo sapiens
tgggcagtgcctcc

SEQ ID NO: 2134466 - DNA, 18 bp, Homo sapiens
tgtagctgtgacctgctg

SEQ ID NO: 2134467 - DNA, 23 bp, Homo sapiens
tgtagctgtgacctgctgagctc

SEQ ID NO: 2134468 - DNA, 13 bp, Homo sapiens
tgtagctttgctc

SEQ ID NO: 2134469 - DNA, 19 bp, Homo sapiens
tgtaggagggactgtcgct

SEQ ID NO: 2134470 - DNA, 21 bp, Homo sapiens
tgtaggcccctggtctgccct

SEQ ID NO: 2134471 - DNA, 19 bp, Homo sapiens
tgtagtaatctgcattatt

SEQ ID NO: 2134472 - DNA, 15 bp, Homo sapiens
tgtagtataaagaaa

SEQ ID NO: 2134473 - DNA, 15 bp, Homo sapiens
tgtagtctaagacct

SEQ ID NO: 2134474 - DNA, 23 bp, Homo sapiens
tgtagtgatgttgtttgggagag

SEQ ID NO: 2134475 - DNA, 14 bp, Homo sapiens
tgtagttaggaaat

SEQ ID NO: 2134476 - DNA, 15 bp, Homo sapiens
tgtagttaggaaata

SEQ ID NO: 2134477 - DNA, 19 bp, Homo sapiens
tgtagttcttgtgcatgtt

SEQ ID NO: 2134478 - DNA, 15 bp, Homo sapiens
tgtagttgcgtggac

SEQ ID NO: 2134479 - DNA, 20 bp, Homo sapiens
tgtagttgcgtggactctgc

SEQ ID NO: 2134480 - DNA, 21 bp, Homo sapiens
tgtagttgcgtggactctgca

SEQ ID NO: 2134481 - DNA, 14 bp, Homo sapiens
tgtataaatgtata

SEQ ID NO: 2134482 - DNA, 16 bp, Homo sapiens
tgtataaatgtatata

SEQ ID NO: 2134483 - DNA, 20 bp, Homo sapiens
tgtataaatgtatatacaca

SEQ ID NO: 2134484 - DNA, 18 bp, Homo sapiens
tgtataagctactcactt

SEQ ID NO: 2134485 - DNA, 18 bp, Homo sapiens
tgtataagtgcacacaga

SEQ ID NO: 2134486 - DNA, 22 bp, Homo sapiens
tgtataatttaacagtgccctt

SEQ ID NO: 2134487 - DNA, 13 bp, Homo sapiens
tgtatacacacat

SEQ ID NO: 2134488 - DNA, 18 bp, Homo sapiens
tgtatacattttgttata

SEQ ID NO: 2134489 - DNA, 23 bp, Homo sapiens
tgtatagcaccaaaaaatggagg

SEQ ID NO: 2134490 - DNA, 15 bp, Homo sapiens
tgtatagtactggca

SEQ ID NO: 2134491 - DNA, 15 bp, Homo sapiens
tgtatagtgtaaaat

SEQ ID NO: 2134492 - DNA, 16 bp, Homo sapiens
tgtatagtgtaaaata

SEQ ID NO: 2134493 - DNA, 19 bp, Homo sapiens
tgtatataatactaaagtg

SEQ ID NO: 2134494 - DNA, 16 bp, Homo sapiens
tgtatatacaataaca

SEQ ID NO: 2134495 - DNA, 14 bp, Homo sapiens
tgtatatacacata

SEQ ID NO: 2134496 - DNA, 20 bp, Homo sapiens
tgtatatacacatataccta

SEQ ID NO: 2134497 - DNA, 14 bp, Homo sapiens
tgtatatacatatt

SEQ ID NO: 2134498 - DNA, 12 bp, Homo sapiens
tgtatatacatt

SEQ ID NO: 2134499 - DNA, 14 bp, Homo sapiens
tgtatatacatttc

SEQ ID NO: 2134500 - DNA, 14 bp, Homo sapiens
tgtatatatacata

SEQ ID NO: 2134501 - DNA, 18 bp, Homo sapiens
tgtatatatacatacact

SEQ ID NO: 2134502 - DNA, 20 bp, Homo sapiens
tgtatatatacatacacttg

SEQ ID NO: 2134503 - DNA, 15 bp, Homo sapiens
tgtatatatatatat

SEQ ID NO: 2134504 - DNA, 19 bp, Homo sapiens
tgtatatatatatgtgtgt

SEQ ID NO: 2134505 - DNA, 17 bp, Homo sapiens
tgtatatatctgcttca

SEQ ID NO: 2134506 - DNA, 16 bp, Homo sapiens
tgtatatatgtgtata

SEQ ID NO: 2134507 - DNA, 18 bp, Homo sapiens
tgtatatatgtgtatata

SEQ ID NO: 2134508 - DNA, 21 bp, Homo sapiens
tgtatatatgtgtatatatac

SEQ ID NO: 2134509 - DNA, 14 bp, Homo sapiens
tgtatatatgtgtg

SEQ ID NO: 2134510 - DNA, 18 bp, Homo sapiens
tgtatatatgtgtgttta

SEQ ID NO: 2134511 - DNA, 18 bp, Homo sapiens
tgtatatcagaaaaggga

SEQ ID NO: 2134512 - DNA, 14 bp, Homo sapiens
tgtatatgtatata

SEQ ID NO: 2134513 - DNA, 16 bp, Homo sapiens
tgtatattaaggtgtg

SEQ ID NO: 2134514 - DNA, 23 bp, Homo sapiens
tgtatattatggtgtaatgcaca

SEQ ID NO: 2134515 - DNA, 16 bp, Homo sapiens
tgtatattccaccatt

SEQ ID NO: 2134516 - DNA, 19 bp, Homo sapiens
tgtatattgtcagatattt

SEQ ID NO: 2134517 - DNA, 17 bp, Homo sapiens
tgtatcaaatctgtata

SEQ ID NO: 2134518 - DNA, 18 bp, Homo sapiens
tgtatcacaaatcttaac

SEQ ID NO: 2134519 - DNA, 21 bp, Homo sapiens
tgtatcagagttgcttttcta

SEQ ID NO: 2134520 - DNA, 17 bp, Homo sapiens
tgtatcatagaaatgta

SEQ ID NO: 2134521 - DNA, 15 bp, Homo sapiens
tgtatcggagacagt

SEQ ID NO: 2134522 - DNA, 18 bp, Homo sapiens
tgtatcggagacagtgat

SEQ ID NO: 2134523 - DNA, 15 bp, Homo sapiens
tgtatctacctcact

SEQ ID NO: 2134524 - DNA, 19 bp, Homo sapiens
tgtatctatgcattttctg

SEQ ID NO: 2134525 - DNA, 17 bp, Homo sapiens
tgtatctctgaagcatg

SEQ ID NO: 2134526 - DNA, 19 bp, Homo sapiens
tgtatctctgaagcatgtt

SEQ ID NO: 2134527 - DNA, 22 bp, Homo sapiens
tgtatctgaaggagattttcct

SEQ ID NO: 2134528 - DNA, 23 bp, Homo sapiens
tgtatctgtagtcttttattttt

SEQ ID NO: 2134529 - DNA, 18 bp, Homo sapiens
tgtatcttatttatatat

SEQ ID NO: 2134530 - DNA, 18 bp, Homo sapiens
tgtatgatgtgttgtgat

SEQ ID NO: 2134531 - DNA, 14 bp, Homo sapiens
tgtatgcactttgt

SEQ ID NO: 2134532 - DNA, 20 bp, Homo sapiens
tgtatgcagttttgtaaata

SEQ ID NO: 2134533 - DNA, 22 bp, Homo sapiens
tgtatgcagttttgtaaataag

SEQ ID NO: 2134534 - DNA, 17 bp, Homo sapiens
tgtatggaatacagtgt

SEQ ID NO: 2134535 - DNA, 12 bp, Homo sapiens
tgtatgtctgcc

SEQ ID NO: 2134536 - DNA, 13 bp, Homo sapiens
tgtatgtgaaagt

SEQ ID NO: 2134537 - DNA, 18 bp, Homo sapiens
tgtatgtgtctttatcag

SEQ ID NO: 2134538 - DNA, 14 bp, Homo sapiens
tgtatgtgtgtatg

SEQ ID NO: 2134539 - DNA, 19 bp, Homo sapiens
tgtattaagccaaacatga

SEQ ID NO: 2134540 - DNA, 21 bp, Homo sapiens
tgtattaagccaaacatgagt

SEQ ID NO: 2134541 - DNA, 21 bp, Homo sapiens
tgtattaatattcattgtata

SEQ ID NO: 2134542 - DNA, 19 bp, Homo sapiens
tgtattacatctaatgctt

SEQ ID NO: 2134543 - DNA, 17 bp, Homo sapiens
tgtattattttctatag

SEQ ID NO: 2134544 - DNA, 21 bp, Homo sapiens
tgtattcagatcgtattaatt

SEQ ID NO: 2134545 - DNA, 20 bp, Homo sapiens
tgtattcatgaacttggctg

SEQ ID NO: 2134546 - DNA, 20 bp, Homo sapiens
tgtattcccttttatttcca

SEQ ID NO: 2134547 - DNA, 13 bp, Homo sapiens
tgtattctggctg

SEQ ID NO: 2134548 - DNA, 15 bp, Homo sapiens
tgtattgtaaacatg

SEQ ID NO: 2134549 - DNA, 19 bp, Homo sapiens
tgtattgtaaacatgtgtt

SEQ ID NO: 2134550 - DNA, 16 bp, Homo sapiens
tgtatttaaaaaaatc

SEQ ID NO: 2134551 - DNA, 22 bp, Homo sapiens
tgtatttaaaaccttgatttaa

SEQ ID NO: 2134552 - DNA, 13 bp, Homo sapiens
tgtatttaaatat

SEQ ID NO: 2134553 - DNA, 15 bp, Homo sapiens
tgtatttatattaga

SEQ ID NO: 2134554 - DNA, 23 bp, Homo sapiens
tgtatttattgaagaaacagata

SEQ ID NO: 2134555 - DNA, 14 bp, Homo sapiens
tgtatttattgtca

SEQ ID NO: 2134556 - DNA, 19 bp, Homo sapiens
tgtatttattgtcattact

SEQ ID NO: 2134557 - DNA, 17 bp, Homo sapiens
tgtatttgtatgtactg

SEQ ID NO: 2134558 - DNA, 14 bp, Homo sapiens
tgtatttgtattcc

SEQ ID NO: 2134559 - DNA, 11 bp, Homo sapiens
tgtattttcca

SEQ ID NO: 2134560 - DNA, 21 bp, Homo sapiens
tgtattttcttcccatttgta

SEQ ID NO: 2134561 - DNA, 22 bp, Homo sapiens
tgtattttcttcccatttgtaa

SEQ ID NO: 2134562 - DNA, 16 bp, Homo sapiens
tgtattttgagataat

SEQ ID NO: 2134563 - DNA, 16 bp, Homo sapiens
tgtatttttgaataaa

SEQ ID NO: 2134564 - DNA, 14 bp, Homo sapiens
tgtattttttaaag

SEQ ID NO: 2134565 - DNA, 13 bp, Homo sapiens
tgtcaaaatcatg

SEQ ID NO: 2134566 - DNA, 18 bp, Homo sapiens
tgtcaaagattttacctg

SEQ ID NO: 2134567 - DNA, 16 bp, Homo sapiens
tgtcaaatatctcaga

SEQ ID NO: 2134568 - DNA, 23 bp, Homo sapiens
tgtcaaatgtcattatgtagaaa

SEQ ID NO: 2134569 - DNA, 18 bp, Homo sapiens
tgtcaagagagagtcaaa

SEQ ID NO: 2134570 - DNA, 19 bp, Homo sapiens
tgtcaagtacaagcaagac

SEQ ID NO: 2134571 - DNA, 17 bp, Homo sapiens
tgtcaatattaaataca

SEQ ID NO: 2134572 - DNA, 23 bp, Homo sapiens
tgtcaatattaaatacagacact

SEQ ID NO: 2134573 - DNA, 19 bp, Homo sapiens
tgtcacaatcctaacacat

SEQ ID NO: 2134574 - DNA, 13 bp, Homo sapiens
tgtcacagctctg

SEQ ID NO: 2134575 - DNA, 12 bp, Homo sapiens
tgtcacaggcag

SEQ ID NO: 2134576 - DNA, 23 bp, Homo sapiens
tgtcaccaatgtacccaccgggc

SEQ ID NO: 2134577 - DNA, 21 bp, Homo sapiens
tgtcaccaccttcccagctct

SEQ ID NO: 2134578 - DNA, 19 bp, Homo sapiens
tgtcaccagctatctgtca

SEQ ID NO: 2134579 - DNA, 18 bp, Homo sapiens
tgtcaccagctgccaaaa

SEQ ID NO: 2134580 - DNA, 22 bp, Homo sapiens
tgtgggacacctcaaatacata

SEQ ID NO: 2134581 - DNA, 12 bp, Homo sapiens
tgtgggagcctc

SEQ ID NO: 2134582 - DNA, 13 bp, Homo sapiens
tgtgggaggaaga

SEQ ID NO: 2134583 - DNA, 13 bp, Homo sapiens
tgtgggcagcacc

SEQ ID NO: 2134584 - DNA, 14 bp, Homo sapiens
tgtgggcagcaccc

SEQ ID NO: 2134585 - DNA, 17 bp, Homo sapiens
tgtgggcagcaccctcc

SEQ ID NO: 2134586 - DNA, 13 bp, Homo sapiens
tgtgggccaggag

SEQ ID NO: 2134587 - DNA, 20 bp, Homo sapiens
tgtggggaggcagctccaac

SEQ ID NO: 2134588 - DNA, 17 bp, Homo sapiens
tgtgggggtggccatcc

SEQ ID NO: 2134589 - DNA, 13 bp, Homo sapiens
tgtgggtgggaga

SEQ ID NO: 2134590 - DNA, 21 bp, Homo sapiens
tgtggtatatttgtgtatgtg

SEQ ID NO: 2134591 - DNA, 18 bp, Homo sapiens
tgtggtatgtagcccggc

SEQ ID NO: 2134592 - DNA, 13 bp, Homo sapiens
tgtggtcatgtaa

SEQ ID NO: 2134593 - DNA, 15 bp, Homo sapiens
tgtggtgacaggccc

SEQ ID NO: 2134594 - DNA, 16 bp, Homo sapiens
tgtggtggctgtctct

SEQ ID NO: 2134595 - DNA, 20 bp, Homo sapiens
tgtggtgtaatttataaaat

SEQ ID NO: 2134596 - DNA, 23 bp, Homo sapiens
tgtggttcctaagcctgttgctg

SEQ ID NO: 2134597 - DNA, 21 bp, Homo sapiens
tgtgtaaagtgtaaatccttt

SEQ ID NO: 2134598 - DNA, 10 bp, Homo sapiens
tgtgtaaatg

SEQ ID NO: 2134599 - DNA, 14 bp, Homo sapiens
tgtgtaataagaaa

SEQ ID NO: 2134600 - DNA, 16 bp, Homo sapiens
tgtgtaatagaaaact

SEQ ID NO: 2134601 - DNA, 21 bp, Homo sapiens
tgtgtaatagaaaactgaaaa

SEQ ID NO: 2134602 - DNA, 22 bp, Homo sapiens
tgtgtacaaagtagagaagtat

SEQ ID NO: 2134603 - DNA, 21 bp, Homo sapiens
tgtgtacagaattctgctacc

SEQ ID NO: 2134604 - DNA, 23 bp, Homo sapiens
tgtgtacagaattctgctacctc

SEQ ID NO: 2134605 - DNA, 23 bp, Homo sapiens
tgtgtacccactcctcactgccc

SEQ ID NO: 2134606 - DNA, 16 bp, Homo sapiens
tgtgtactgataaaat

SEQ ID NO: 2134607 - DNA, 19 bp, Homo sapiens
tgtgtagactcctgcttct

SEQ ID NO: 2134608 - DNA, 14 bp, Homo sapiens
tgtgtagctttgct

SEQ ID NO: 2134609 - DNA, 17 bp, Homo sapiens
tgtgtagctttgctctt

SEQ ID NO: 2134610 - DNA, 12 bp, Homo sapiens
tgtgtagggcgg

SEQ ID NO: 2134611 - DNA, 21 bp, Homo sapiens
tgtgtatagatgcaagatatt

SEQ ID NO: 2134612 - DNA, 15 bp, Homo sapiens
tgtgtatatatacat

SEQ ID NO: 2134613 - DNA, 16 bp, Homo sapiens
tgtgtatatatacata

SEQ ID NO: 2134614 - DNA, 14 bp, Homo sapiens
tgtgtatgatccaa

SEQ ID NO: 2134615 - DNA, 16 bp, Homo sapiens
tgtgtcaatgggcaat

SEQ ID NO: 2134616 - DNA, 15 bp, Homo sapiens
tgtgtcacactgagc

SEQ ID NO: 2134617 - DNA, 22 bp, Homo sapiens
tgtgtcacactgagctgggcac

SEQ ID NO: 2134618 - DNA, 14 bp, Homo sapiens
tgtgtcccctcact

SEQ ID NO: 2134619 - DNA, 18 bp, Homo sapiens
tgtgtcccctcactctgt

SEQ ID NO: 2134620 - DNA, 19 bp, Homo sapiens
tgtgtcccctcactctgtc

SEQ ID NO: 2134621 - DNA, 22 bp, Homo sapiens
tgtgtcccctcactctgtcagc

SEQ ID NO: 2134622 - DNA, 16 bp, Homo sapiens
tgtgtccttccctgca

SEQ ID NO: 2134623 - DNA, 18 bp, Homo sapiens
tgtgtccttgcacctgca

SEQ ID NO: 2134624 - DNA, 19 bp, Homo sapiens
tgtgtccttgcacctgcat

SEQ ID NO: 2134625 - DNA, 14 bp, Homo sapiens
tgtgtctgtacacg

SEQ ID NO: 2134626 - DNA, 19 bp, Homo sapiens
tgtgtctgtctttgtggga

SEQ ID NO: 2134627 - DNA, 21 bp, Homo sapiens
tgtgtcttgcaatggcagcct

SEQ ID NO: 2134628 - DNA, 15 bp, Homo sapiens
tgtgtcttttataaa

SEQ ID NO: 2134629 - DNA, 21 bp, Homo sapiens
tgtgtgaaggtcttgcctgaa

SEQ ID NO: 2134630 - DNA, 13 bp, Homo sapiens
tgtgtgagcatct

SEQ ID NO: 2134631 - DNA, 16 bp, Homo sapiens
tgtgtgagcatctctg

SEQ ID NO: 2134632 - DNA, 14 bp, Homo sapiens
tgtgtgagttgagt

SEQ ID NO: 2134633 - DNA, 16 bp, Homo sapiens
tgtgtgattgaatctg

SEQ ID NO: 2134634 - DNA, 22 bp, Homo sapiens
tgtgtgcaccttaccaactttc

SEQ ID NO: 2134635 - DNA, 13 bp, Homo sapiens
tgtgtgcatgtga

SEQ ID NO: 2134636 - DNA, 14 bp, Homo sapiens
tgtgtgcatgtgag

SEQ ID NO: 2134637 - DNA, 14 bp, Homo sapiens
tgtgtgcatgtgtg

SEQ ID NO: 2134638 - DNA, 24 bp, Homo sapiens
tgtgtgcatgtgtgtgtctgtctt

SEQ ID NO: 2134639 - DNA, 21 bp, Homo sapiens
tgtgtgccatagagtttaaca

SEQ ID NO: 2134640 - DNA, 24 bp, Homo sapiens
tgtgtgccatagagtttaacacaa

SEQ ID NO: 2134641 - DNA, 17 bp, Homo sapiens
tgtgtgcctgtggcaga

SEQ ID NO: 2134642 - DNA, 23 bp, Homo sapiens
tgtgtggaaggcagggacagaga

SEQ ID NO: 2134643 - DNA, 13 bp, Homo sapiens
tgtgtggggaggc

SEQ ID NO: 2134644 - DNA, 15 bp, Homo sapiens
tgtgtggggaggcag

SEQ ID NO: 2134645 - DNA, 16 bp, Homo sapiens
tgtgtggggaggcagc

SEQ ID NO: 2134646 - DNA, 20 bp, Homo sapiens
tgtgtggtgggttctttgga

SEQ ID NO: 2134647 - DNA, 22 bp, Homo sapiens
tgtgtgtatatatgtgtatata

SEQ ID NO: 2134648 - DNA, 12 bp, Homo sapiens
tgtgtgtctcac

SEQ ID NO: 2134649 - DNA, 16 bp, Homo sapiens
tgtgtgtctcacccct

SEQ ID NO: 2134650 - DNA, 13 bp, Homo sapiens
tgtgtgtctgtct

SEQ ID NO: 2134651 - DNA, 15 bp, Homo sapiens
tgtgtgtctgtcttt

SEQ ID NO: 2134652 - DNA, 11 bp, Homo sapiens
tgtgtgtgtgt

SEQ ID NO: 2134653 - DNA, 12 bp, Homo sapiens
tgtgtgtgtgtg

SEQ ID NO: 2134654 - DNA, 16 bp, Homo sapiens
tgtgtgtgtgtgcatg

SEQ ID NO: 2134655 - DNA, 14 bp, Homo sapiens
tgtgtgtgtgtgtg

SEQ ID NO: 2134656 - DNA, 17 bp, Homo sapiens
tgtgttaaacatgctaa

SEQ ID NO: 2134657 - DNA, 14 bp, Homo sapiens
tgtgttatgaagca

SEQ ID NO: 2134658 - DNA, 13 bp, Homo sapiens
tgtgttatttaaa

SEQ ID NO: 2134659 - DNA, 16 bp, Homo sapiens
tgtgttatttaaatga

SEQ ID NO: 2134660 - DNA, 22 bp, Homo sapiens
tgtgttcagtgccttggagcag

SEQ ID NO: 2134661 - DNA, 13 bp, Homo sapiens
tgtgttgaacaca

SEQ ID NO: 2134662 - DNA, 17 bp, Homo sapiens
tgtgttgcctcctacct

SEQ ID NO: 2134663 - DNA, 13 bp, Homo sapiens
tgtgttgtgatag

SEQ ID NO: 2134664 - DNA, 13 bp, Homo sapiens
tgtgtttaaataa

SEQ ID NO: 2134665 - DNA, 15 bp, Homo sapiens
tgtgtttaaataaag

SEQ ID NO: 2134666 - DNA, 14 bp, Homo sapiens
tgtgtttagatttt

SEQ ID NO: 2134667 - DNA, 15 bp, Homo sapiens
tgtgtttctaaaact

SEQ ID NO: 2134668 - DNA, 13 bp, Homo sapiens
tgtgtttgatttt

SEQ ID NO: 2134669 - DNA, 11 bp, Homo sapiens
tgtgtttgtgt

SEQ ID NO: 2134670 - DNA, 20 bp, Homo sapiens
tgttaaaaaaataagaagaa

SEQ ID NO: 2134671 - DNA, 14 bp, Homo sapiens
tgttaaaataacta

SEQ ID NO: 2134672 - DNA, 17 bp, Homo sapiens
tgttaaaatagacaact

SEQ ID NO: 2134673 - DNA, 15 bp, Homo sapiens
tgttaaaatattgat

SEQ ID NO: 2134674 - DNA, 15 bp, Homo sapiens
tgttaaaatgtacac

SEQ ID NO: 2134675 - DNA, 18 bp, Homo sapiens
tgttaaaatgtacactgg

SEQ ID NO: 2134676 - DNA, 20 bp, Homo sapiens
tgttaaagaggcgtcttgta

SEQ ID NO: 2134677 - DNA, 16 bp, Homo sapiens
tgttaaccagaataaa

SEQ ID NO: 2134678 - DNA, 15 bp, Homo sapiens
tgttaacctcagtgt

SEQ ID NO: 2134679 - DNA, 20 bp, Homo sapiens
tgttaaggacttctgcagct

SEQ ID NO: 2134680 - DNA, 15 bp, Homo sapiens
tgttaatgctttctg

SEQ ID NO: 2134681 - DNA, 17 bp, Homo sapiens
tgttaatggtttgaata

SEQ ID NO: 2134682 - DNA, 21 bp, Homo sapiens
tgttaattactatattttaga

SEQ ID NO: 2134683 - DNA, 20 bp, Homo sapiens
tgttaattcagcactgattt

SEQ ID NO: 2134684 - DNA, 18 bp, Homo sapiens
tgttaattgattaaaatc

SEQ ID NO: 2134685 - DNA, 20 bp, Homo sapiens
tgttaatttagaaaacttta

SEQ ID NO: 2134686 - DNA, 16 bp, Homo sapiens
tgttaatttgttatgt

SEQ ID NO: 2134687 - DNA, 15 bp, Homo sapiens
tgttaatttttgata

SEQ ID NO: 2134688 - DNA, 16 bp, Homo sapiens
tgttacaaggcacttg

SEQ ID NO: 2134689 - DNA, 17 bp, Homo sapiens
tgttacacagcccaaga

SEQ ID NO: 2134690 - DNA, 18 bp, Homo sapiens
tgttacaggtgtactatg

SEQ ID NO: 2134691 - DNA, 22 bp, Homo sapiens
tgttacataacaagaaaatcaa

SEQ ID NO: 2134692 - DNA, 12 bp, Homo sapiens
tgttacatcaca

SEQ ID NO: 2134693 - DNA, 15 bp, Homo sapiens
tgttacattattatc

SEQ ID NO: 2134694 - DNA, 16 bp, Homo sapiens
tgttaccatgaagata

SEQ ID NO: 2134695 - DNA, 21 bp, Homo sapiens
tgttacccagtaactcatctg

SEQ ID NO: 2134696 - DNA, 16 bp, Homo sapiens
ttagcctttgccctgt

SEQ ID NO: 2134697 - DNA, 19 bp, Homo sapiens
ttagctctggaccagcctg

SEQ ID NO: 2134698 - DNA, 15 bp, Homo sapiens
ttagctggacatgct

SEQ ID NO: 2134699 - DNA, 13 bp, Homo sapiens
ttagctgtaaata

SEQ ID NO: 2134700 - DNA, 20 bp, Homo sapiens
ttagctgtaaatacatgtgt

SEQ ID NO: 2134701 - DNA, 17 bp, Homo sapiens
ttagctgtctgctcaga

SEQ ID NO: 2134702 - DNA, 16 bp, Homo sapiens
ttagctgttatttcta

SEQ ID NO: 2134703 - DNA, 19 bp, Homo sapiens
ttagctgttatttctattt

SEQ ID NO: 2134704 - DNA, 18 bp, Homo sapiens
ttagcttagacctcagcc

SEQ ID NO: 2134705 - DNA, 13 bp, Homo sapiens
ttagctttctcag

SEQ ID NO: 2134706 - DNA, 15 bp, Homo sapiens
ttaggaaataaaacc

SEQ ID NO: 2134707 - DNA, 21 bp, Homo sapiens
ttaggaacagagtatatatgt

SEQ ID NO: 2134708 - DNA, 18 bp, Homo sapiens
ttaggaagcaagcttaat

SEQ ID NO: 2134709 - DNA, 18 bp, Homo sapiens
ttaggaaggcagcattcc

SEQ ID NO: 2134710 - DNA, 19 bp, Homo sapiens
ttaggaggctgcatgctct

SEQ ID NO: 2134711 - DNA, 21 bp, Homo sapiens
ttaggaggctgcatgctctgg

SEQ ID NO: 2134712 - DNA, 19 bp, Homo sapiens
ttaggatctatgcaatttt

SEQ ID NO: 2134713 - DNA, 21 bp, Homo sapiens
ttaggatttaacagtcattta

SEQ ID NO: 2134714 - DNA, 23 bp, Homo sapiens
ttaggcagcagcttttaatacag

SEQ ID NO: 2134715 - DNA, 18 bp, Homo sapiens
ttaggcagggatttgagg

SEQ ID NO: 2134716 - DNA, 19 bp, Homo sapiens
ttaggcagggatttgagga

SEQ ID NO: 2134717 - DNA, 18 bp, Homo sapiens
ttaggcattatttaatgt

SEQ ID NO: 2134718 - DNA, 16 bp, Homo sapiens
ttaggcttttaagaaa

SEQ ID NO: 2134719 - DNA, 14 bp, Homo sapiens
ttaggggaaaatag

SEQ ID NO: 2134720 - DNA, 17 bp, Homo sapiens
ttaggggaaaatagtag

SEQ ID NO: 2134721 - DNA, 13 bp, Homo sapiens
ttaggtgccaggc

SEQ ID NO: 2134722 - DNA, 13 bp, Homo sapiens
ttaggtgcctcct

SEQ ID NO: 2134723 - DNA, 12 bp, Homo sapiens
ttaggttataag

SEQ ID NO: 2134724 - DNA, 22 bp, Homo sapiens
ttaggttttgtacaattgaact

SEQ ID NO: 2134725 - DNA, 12 bp, Homo sapiens
ttagtaatagat

SEQ ID NO: 2134726 - DNA, 19 bp, Homo sapiens
ttagtaatagtccaatatt

SEQ ID NO: 2134727 - DNA, 14 bp, Homo sapiens
ttagtacagtagct

SEQ ID NO: 2134728 - DNA, 17 bp, Homo sapiens
ttagtagagacagggtt

SEQ ID NO: 2134729 - DNA, 21 bp, Homo sapiens
ttagtatggttctcagatctt

SEQ ID NO: 2134730 - DNA, 22 bp, Homo sapiens
ttagtatttatttaatgttatg

SEQ ID NO: 2134731 - DNA, 14 bp, Homo sapiens
ttagtatttttact

SEQ ID NO: 2134732 - DNA, 13 bp, Homo sapiens
ttagtgagatttg

SEQ ID NO: 2134733 - DNA, 17 bp, Homo sapiens
ttagtgcggacaagttt

SEQ ID NO: 2134734 - DNA, 19 bp, Homo sapiens
ttagtgcggacaagtttta

SEQ ID NO: 2134735 - DNA, 12 bp, Homo sapiens
ttagtggctttt

SEQ ID NO: 2134736 - DNA, 14 bp, Homo sapiens
ttagtgtcacttac

SEQ ID NO: 2134737 - DNA, 17 bp, Homo sapiens
ttagtgtgtgtgcatgt

SEQ ID NO: 2134738 - DNA, 22 bp, Homo sapiens
ttagtgtgttgtctgtgcagct

SEQ ID NO: 2134739 - DNA, 12 bp, Homo sapiens
ttagttaatatt

SEQ ID NO: 2134740 - DNA, 19 bp, Homo sapiens
ttagttgaaaaatctagtt

SEQ ID NO: 2134741 - DNA, 21 bp, Homo sapiens
ttagttttatggcatgattta

SEQ ID NO: 2134742 - DNA, 17 bp, Homo sapiens
ttataaaaacaaaaaca

SEQ ID NO: 2134743 - DNA, 23 bp, Homo sapiens
ttataaaagaataaaattgcact

SEQ ID NO: 2134744 - DNA, 10 bp, Homo sapiens
ttataaaatt

SEQ ID NO: 2134745 - DNA, 23 bp, Homo sapiens
ttataaagataaaatatcctcag

SEQ ID NO: 2134746 - DNA, 15 bp, Homo sapiens
ttataaataaatgcc

SEQ ID NO: 2134747 - DNA, 11 bp, Homo sapiens
ttataaatgtg

SEQ ID NO: 2134748 - DNA, 22 bp, Homo sapiens
ttataactcatcataaaataaa

SEQ ID NO: 2134749 - DNA, 15 bp, Homo sapiens
ttataacttaaaaaa

SEQ ID NO: 2134750 - DNA, 12 bp, Homo sapiens
ttataagaaaca

SEQ ID NO: 2134751 - DNA, 14 bp, Homo sapiens
ttataagaagagga

SEQ ID NO: 2134752 - DNA, 14 bp, Homo sapiens
ttataagcagattt

SEQ ID NO: 2134753 - DNA, 18 bp, Homo sapiens
ttataagtagcaggccaa

SEQ ID NO: 2134754 - DNA, 20 bp, Homo sapiens
ttataatcttccatacttct

SEQ ID NO: 2134755 - DNA, 22 bp, Homo sapiens
ttataatgtggatttcctattt

SEQ ID NO: 2134756 - DNA, 17 bp, Homo sapiens
ttatacaaaataattta

SEQ ID NO: 2134757 - DNA, 18 bp, Homo sapiens
ttatacagctcagctttt

SEQ ID NO: 2134758 - DNA, 22 bp, Homo sapiens
ttatacatagtcacaaaaatgg

SEQ ID NO: 2134759 - DNA, 16 bp, Homo sapiens
ttataccaaagggaaa

SEQ ID NO: 2134760 - DNA, 20 bp, Homo sapiens
ttatacgagtaatatgcctg

SEQ ID NO: 2134761 - DNA, 18 bp, Homo sapiens
ttatactaccaagtgacc

SEQ ID NO: 2134762 - DNA, 23 bp, Homo sapiens
ttatagaatatttattacctctg

SEQ ID NO: 2134763 - DNA, 12 bp, Homo sapiens
ttatagaatgct

SEQ ID NO: 2134764 - DNA, 15 bp, Homo sapiens
ttatagacaaataat

SEQ ID NO: 2134765 - DNA, 21 bp, Homo sapiens
ttatagcacaaactttaaatt

SEQ ID NO: 2134766 - DNA, 20 bp, Homo sapiens
ttatagttgtgggtgggaga

SEQ ID NO: 2134767 - DNA, 18 bp, Homo sapiens
ttatatagtttactattt

SEQ ID NO: 2134768 - DNA, 12 bp, Homo sapiens
ttatatatcata

SEQ ID NO: 2134769 - DNA, 12 bp, Homo sapiens
ttatatatgaag

SEQ ID NO: 2134770 - DNA, 22 bp, Homo sapiens
ttatatattggtaacatccttt

SEQ ID NO: 2134771 - DNA, 13 bp, Homo sapiens
ttatatattgtat

SEQ ID NO: 2134772 - DNA, 14 bp, Homo sapiens
ttatatatttataa

SEQ ID NO: 2134773 - DNA, 23 bp, Homo sapiens
ttatatatttataactcatcata

SEQ ID NO: 2134774 - DNA, 21 bp, Homo sapiens
ttatatcatcagcataccttt

SEQ ID NO: 2134775 - DNA, 14 bp, Homo sapiens
ttatatctaattta

SEQ ID NO: 2134776 - DNA, 23 bp, Homo sapiens
ttatatctaatttatacaaaata

SEQ ID NO: 2134777 - DNA, 19 bp, Homo sapiens
ttatatgaaatgtttcact

SEQ ID NO: 2134778 - DNA, 14 bp, Homo sapiens
ttatatgtgtaatt

SEQ ID NO: 2134779 - DNA, 15 bp, Homo sapiens
ttatatgttaatttg

SEQ ID NO: 2134780 - DNA, 14 bp, Homo sapiens
ttatattaatttgt

SEQ ID NO: 2134781 - DNA, 16 bp, Homo sapiens
ttatattccatatatt

SEQ ID NO: 2134782 - DNA, 14 bp, Homo sapiens
ttatattctttaaa

SEQ ID NO: 2134783 - DNA, 16 bp, Homo sapiens
ttatattctttaaatt

SEQ ID NO: 2134784 - DNA, 21 bp, Homo sapiens
ttatattgtatattctggaaa

SEQ ID NO: 2134785 - DNA, 13 bp, Homo sapiens
ttatatttaactc

SEQ ID NO: 2134786 - DNA, 22 bp, Homo sapiens
ttatatttagttatagtttcag

SEQ ID NO: 2134787 - DNA, 14 bp, Homo sapiens
ttatatttggaaag

SEQ ID NO: 2134788 - DNA, 17 bp, Homo sapiens
ttatatttggaaagaga

SEQ ID NO: 2134789 - DNA, 19 bp, Homo sapiens
ttatattttactactgtgg

SEQ ID NO: 2134790 - DNA, 13 bp, Homo sapiens
ttatcaaaagaca

SEQ ID NO: 2134791 - DNA, 12 bp, Homo sapiens
ttatcaaaatct

SEQ ID NO: 2134792 - DNA, 18 bp, Homo sapiens
ttatcacattatttgcat

SEQ ID NO: 2134793 - DNA, 23 bp, Homo sapiens
ttatcagtcataactaaataaag

SEQ ID NO: 2134794 - DNA, 23 bp, Homo sapiens
ttatcagtgatggtctcacagag

SEQ ID NO: 2134795 - DNA, 16 bp, Homo sapiens
ttatcattttcaaaat

SEQ ID NO: 2134796 - DNA, 15 bp, Homo sapiens
ttatccaatcctcag

SEQ ID NO: 2134797 - DNA, 19 bp, Homo sapiens
ttatccacagaaacatttt

SEQ ID NO: 2134798 - DNA, 22 bp, Homo sapiens
ttatccttaggaaaatgcttct

SEQ ID NO: 2134799 - DNA, 14 bp, Homo sapiens
ttatcggaagcagt

SEQ ID NO: 2134800 - DNA, 15 bp, Homo sapiens
ttatcggaagcagtg

SEQ ID NO: 2134801 - DNA, 16 bp, Homo sapiens
ttatcggaagcagtgc

SEQ ID NO: 2134802 - DNA, 14 bp, Homo sapiens
ttatcgggaacagt

SEQ ID NO: 2134803 - DNA, 23 bp, Homo sapiens
ttatcgggaacagtgtttcccat

SEQ ID NO: 2134804 - DNA, 18 bp, Homo sapiens
ttatcgggagcagtgtct

SEQ ID NO: 2134805 - DNA, 21 bp, Homo sapiens
ttatcgggagcagtgtcttcc

SEQ ID NO: 2134806 - DNA, 19 bp, Homo sapiens
ttatctaatacctctgtgt

SEQ ID NO: 2134807 - DNA, 23 bp, Homo sapiens
ttatctagaaagaaaagaccctg

SEQ ID NO: 2134808 - DNA, 11 bp, Homo sapiens
ttatctcaaaa

SEQ ID NO: 2134809 - DNA, 14 bp, Homo sapiens
ttatctctatttaa

SEQ ID NO: 2134810 - DNA, 19 bp, Homo sapiens
ttatctctatttaatattt

SEQ ID NO: 2134811 - DNA, 22 bp, Homo sapiens
ttccaagttcctgcactccaga

SEQ ID NO: 2134812 - DNA, 13 bp, Homo sapiens
ttccaataaaatt

SEQ ID NO: 2134813 - DNA, 20 bp, Homo sapiens
ttccacaaatctatattaaa

SEQ ID NO: 2134814 - DNA, 19 bp, Homo sapiens
ttccacaagattcccagag

SEQ ID NO: 2134815 - DNA, 21 bp, Homo sapiens
ttccacaagattcccagagac

SEQ ID NO: 2134816 - DNA, 19 bp, Homo sapiens
ttccacactgtcagagctg

SEQ ID NO: 2134817 - DNA, 23 bp, Homo sapiens
ttccacaggagggagagaactta

SEQ ID NO: 2134818 - DNA, 13 bp, Homo sapiens
ttccacattaatt

SEQ ID NO: 2134819 - DNA, 11 bp, Homo sapiens
ttccaccctgg

SEQ ID NO: 2134820 - DNA, 13 bp, Homo sapiens
ttccaccctggaa

SEQ ID NO: 2134821 - DNA, 14 bp, Homo sapiens
ttccacctgctttc

SEQ ID NO: 2134822 - DNA, 14 bp, Homo sapiens
ttccacgatgaaaa

SEQ ID NO: 2134823 - DNA, 23 bp, Homo sapiens
ttccacgggtctcacttatacca

SEQ ID NO: 2134824 - DNA, 20 bp, Homo sapiens
ttccactgcaaatttcaaaa

SEQ ID NO: 2134825 - DNA, 12 bp, Homo sapiens
ttccactggact

SEQ ID NO: 2134826 - DNA, 17 bp, Homo sapiens
ttccactggctccacat

SEQ ID NO: 2134827 - DNA, 14 bp, Homo sapiens
ttccacttctctag

SEQ ID NO: 2134828 - DNA, 15 bp, Homo sapiens
ttccagaaaatataa

SEQ ID NO: 2134829 - DNA, 19 bp, Homo sapiens
ttccagaaaatataaatgc

SEQ ID NO: 2134830 - DNA, 12 bp, Homo sapiens
ttccagaccacc

SEQ ID NO: 2134831 - DNA, 14 bp, Homo sapiens
ttccagaccacctg

SEQ ID NO: 2134832 - DNA, 15 bp, Homo sapiens
ttccagaccacctgc

SEQ ID NO: 2134833 - DNA, 18 bp, Homo sapiens
ttccagaccacctgccag

SEQ ID NO: 2134834 - DNA, 19 bp, Homo sapiens
ttccagaccacctgccagc

SEQ ID NO: 2134835 - DNA, 21 bp, Homo sapiens
ttccagaccacctgccagcca

SEQ ID NO: 2134836 - DNA, 21 bp, Homo sapiens
ttccagagagtggctcctccc

SEQ ID NO: 2134837 - DNA, 19 bp, Homo sapiens
ttccagaggctattatttt

SEQ ID NO: 2134838 - DNA, 17 bp, Homo sapiens
ttccagattcttccact

SEQ ID NO: 2134839 - DNA, 14 bp, Homo sapiens
ttccagattgttct

SEQ ID NO: 2134840 - DNA, 23 bp, Homo sapiens
ttccagctagtgacccacatgcc

SEQ ID NO: 2134841 - DNA, 15 bp, Homo sapiens
ttccagctgcctggg

SEQ ID NO: 2134842 - DNA, 21 bp, Homo sapiens
ttccaggagcacacggccctg

SEQ ID NO: 2134843 - DNA, 22 bp, Homo sapiens
ttccaggagcacacggccctgc

SEQ ID NO: 2134844 - DNA, 18 bp, Homo sapiens
ttccaggatcctgcagga

SEQ ID NO: 2134845 - DNA, 12 bp, Homo sapiens
ttccaggcccct

SEQ ID NO: 2134846 - DNA, 11 bp, Homo sapiens
ttccaggctct

SEQ ID NO: 2134847 - DNA, 20 bp, Homo sapiens
ttccaggctcttcctggacc

SEQ ID NO: 2134848 - DNA, 14 bp, Homo sapiens
ttccagggcaatca

SEQ ID NO: 2134849 - DNA, 23 bp, Homo sapiens
ttccagggcatccgcagcccagg

SEQ ID NO: 2134850 - DNA, 18 bp, Homo sapiens
ttccaggtatctccagga

SEQ ID NO: 2134851 - DNA, 19 bp, Homo sapiens
ttccagtacacctttcagc

SEQ ID NO: 2134852 - DNA, 17 bp, Homo sapiens
ttccagtacctttgtca

SEQ ID NO: 2134853 - DNA, 19 bp, Homo sapiens
ttccagtacctttgtcaca

SEQ ID NO: 2134854 - DNA, 15 bp, Homo sapiens
ttccagtagttgaac

SEQ ID NO: 2134855 - DNA, 13 bp, Homo sapiens
ttccagtgaggaa

SEQ ID NO: 2134856 - DNA, 20 bp, Homo sapiens
ttccagtgttggctgtgtga

SEQ ID NO: 2134857 - DNA, 22 bp, Homo sapiens
ttccataatctggactcctctg

SEQ ID NO: 2134858 - DNA, 16 bp, Homo sapiens
ttccataatgtataaa

SEQ ID NO: 2134859 - DNA, 16 bp, Homo sapiens
ttccataattatgaca

SEQ ID NO: 2134860 - DNA, 18 bp, Homo sapiens
ttccatatattagcattt

SEQ ID NO: 2134861 - DNA, 19 bp, Homo sapiens
ttccatcaggttccatccc

SEQ ID NO: 2134862 - DNA, 15 bp, Homo sapiens
ttccatgaaaatgca

SEQ ID NO: 2134863 - DNA, 14 bp, Homo sapiens
ttccatgattttac

SEQ ID NO: 2134864 - DNA, 15 bp, Homo sapiens
ttccatgattttaca

SEQ ID NO: 2134865 - DNA, 16 bp, Homo sapiens
ttccatgtcgcctctg

SEQ ID NO: 2134866 - DNA, 18 bp, Homo sapiens
ttccatgtcgcctctgca

SEQ ID NO: 2134867 - DNA, 21 bp, Homo sapiens
ttccatttccagttcatctat

SEQ ID NO: 2134868 - DNA, 14 bp, Homo sapiens
ttccatttctcaat

SEQ ID NO: 2134869 - DNA, 19 bp, Homo sapiens
ttccatttcttcctcacta

SEQ ID NO: 2134870 - DNA, 16 bp, Homo sapiens
ttccatttggtgacca

SEQ ID NO: 2134871 - DNA, 21 bp, Homo sapiens
ttccatttttactaaagcagt

SEQ ID NO: 2134872 - DNA, 22 bp, Homo sapiens
ttccatttttactaaagcagtg

SEQ ID NO: 2134873 - DNA, 19 bp, Homo sapiens
ttcccaaaatgttgaaata

SEQ ID NO: 2134874 - DNA, 12 bp, Homo sapiens
ttcccaaatttc

SEQ ID NO: 2134875 - DNA, 22 bp, Homo sapiens
ttcccaagagcatcatgcctct

SEQ ID NO: 2134876 - DNA, 13 bp, Homo sapiens
ttcccaagctctg

SEQ ID NO: 2134877 - DNA, 14 bp, Homo sapiens
ttcccaagctctgc

SEQ ID NO: 2134878 - DNA, 16 bp, Homo sapiens
ttcccaagctctgctc

SEQ ID NO: 2134879 - DNA, 18 bp, Homo sapiens
ttcccaagctctgctcct

SEQ ID NO: 2134880 - DNA, 14 bp, Homo sapiens
ttcccaataaaagt

SEQ ID NO: 2134881 - DNA, 19 bp, Homo sapiens
ttcccacagcattcctcca

SEQ ID NO: 2134882 - DNA, 21 bp, Homo sapiens
ttcccacccaattcaaaacat

SEQ ID NO: 2134883 - DNA, 22 bp, Homo sapiens
ttcccaccgccctccctcccca

SEQ ID NO: 2134884 - DNA, 21 bp, Homo sapiens
ttcccactaagctttctcctt

SEQ ID NO: 2134885 - DNA, 15 bp, Homo sapiens
ttcccagaagggagt

SEQ ID NO: 2134886 - DNA, 20 bp, Homo sapiens
ttcccagagaagctcattta

SEQ ID NO: 2134887 - DNA, 15 bp, Homo sapiens
ttcccagagacagga

SEQ ID NO: 2134888 - DNA, 23 bp, Homo sapiens
ttcccagagcaaaataattttaa

SEQ ID NO: 2134889 - DNA, 16 bp, Homo sapiens
ttcccagctctccctc

SEQ ID NO: 2134890 - DNA, 18 bp, Homo sapiens
ttcccagctctccctctg

SEQ ID NO: 2134891 - DNA, 20 bp, Homo sapiens
ttcccagctctccctctggc

SEQ ID NO: 2134892 - DNA, 13 bp, Homo sapiens
ttcccagctgtct

SEQ ID NO: 2134893 - DNA, 11 bp, Homo sapiens
ttcccataatt

SEQ ID NO: 2134894 - DNA, 15 bp, Homo sapiens
ttcccataattttct

SEQ ID NO: 2134895 - DNA, 16 bp, Homo sapiens
ttcccataattttctt

SEQ ID NO: 2134896 - DNA, 17 bp, Homo sapiens
ttcccatccccagcgat

SEQ ID NO: 2134897 - DNA, 15 bp, Homo sapiens
ttcccatgatccaga

SEQ ID NO: 2134898 - DNA, 16 bp, Homo sapiens
ttcccatgctgaatta

SEQ ID NO: 2134899 - DNA, 23 bp, Homo sapiens
ttcccattactttaatactcacc

SEQ ID NO: 2134900 - DNA, 23 bp, Homo sapiens
ttcccattgcatcacctctgtaa

SEQ ID NO: 2134901 - DNA, 20 bp, Homo sapiens
ttcccatttgtaatgtatct

SEQ ID NO: 2134902 - DNA, 19 bp, Homo sapiens
ttcccattttgcaaaattt

SEQ ID NO: 2134903 - DNA, 15 bp, Homo sapiens
ttccccacctcttcc

SEQ ID NO: 2134904 - DNA, 19 bp, Homo sapiens
ttccccacctcttccttcc

SEQ ID NO: 2134905 - DNA, 21 bp, Homo sapiens
ttccccacctcttccttccgc

SEQ ID NO: 2134906 - DNA, 13 bp, Homo sapiens
ttccccagacaca

SEQ ID NO: 2134907 - DNA, 22 bp, Homo sapiens
ttccccagacttctctttctta

SEQ ID NO: 2134908 - DNA, 11 bp, Homo sapiens
ttccccagtgt

SEQ ID NO: 2134909 - DNA, 22 bp, Homo sapiens
ttccccagtgtggccccagccc

SEQ ID NO: 2134910 - DNA, 15 bp, Homo sapiens
ttccccatctgggtc

SEQ ID NO: 2134911 - DNA, 12 bp, Homo sapiens
ttcccccacttg

SEQ ID NO: 2134912 - DNA, 14 bp, Homo sapiens
ttcccccagacaga

SEQ ID NO: 2134913 - DNA, 21 bp, Homo sapiens
ttcccccatcccctttcctcc

SEQ ID NO: 2134914 - DNA, 23 bp, Homo sapiens
ttcccccatcccctttcctcccc

SEQ ID NO: 2134915 - DNA, 17 bp, Homo sapiens
ttcccccatgtggctga

SEQ ID NO: 2134916 - DNA, 16 bp, Homo sapiens
ttccccgctgcccaat

SEQ ID NO: 2134917 - DNA, 17 bp, Homo sapiens
ttccccggtcccttgag

SEQ ID NO: 2134918 - DNA, 15 bp, Homo sapiens
ttcccctcagagctc

SEQ ID NO: 2134919 - DNA, 16 bp, Homo sapiens
ttcccctcagagctct

SEQ ID NO: 2134920 - DNA, 23 bp, Homo sapiens
ttcccctctgtgtcctctcccct

SEQ ID NO: 2134921 - DNA, 12 bp, Homo sapiens
ttcccctgaaga

SEQ ID NO: 2134922 - DNA, 17 bp, Homo sapiens
ttcccctgttcactcta

SEQ ID NO: 2134923 - DNA, 13 bp, Homo sapiens
ttccccttgccct

SEQ ID NO: 2134924 - DNA, 12 bp, Homo sapiens
ttcccctttcct

SEQ ID NO: 2134925 - DNA, 22 bp, Homo sapiens
ttccccttttgcctggctgtgg

SEQ ID NO: 2134926 - DNA, 16 bp, Homo sapiens
ttctgaagatctcaga

SEQ ID NO: 2134927 - DNA, 23 bp, Homo sapiens
ttctgacaagataaaggaagtca

SEQ ID NO: 2134928 - DNA, 21 bp, Homo sapiens
ttctgagaaagactattcaaa

SEQ ID NO: 2134929 - DNA, 20 bp, Homo sapiens
ttctgagcttttcatggaag

SEQ ID NO: 2134930 - DNA, 15 bp, Homo sapiens
ttctgagttcctgca

SEQ ID NO: 2134931 - DNA, 20 bp, Homo sapiens
ttctgagtttcattctcctg

SEQ ID NO: 2134932 - DNA, 23 bp, Homo sapiens
ttctgagtttcattctcctgcct

SEQ ID NO: 2134933 - DNA, 16 bp, Homo sapiens
ttctgataatgaaaat

SEQ ID NO: 2134934 - DNA, 18 bp, Homo sapiens
ttctgatgggtcccaaaa

SEQ ID NO: 2134935 - DNA, 21 bp, Homo sapiens
ttctgattcgaatgacactgt

SEQ ID NO: 2134936 - DNA, 20 bp, Homo sapiens
ttctgcaactagccaaggct

SEQ ID NO: 2134937 - DNA, 12 bp, Homo sapiens
ttctgcactgaa

SEQ ID NO: 2134938 - DNA, 13 bp, Homo sapiens
ttctgcactgaaa

SEQ ID NO: 2134939 - DNA, 15 bp, Homo sapiens
ttctgcactgaaaag

SEQ ID NO: 2134940 - DNA, 14 bp, Homo sapiens
ttctgcagcaactc

SEQ ID NO: 2134941 - DNA, 19 bp, Homo sapiens
ttctgcagtagtctctgtg

SEQ ID NO: 2134942 - DNA, 16 bp, Homo sapiens
ttctgcatcagctgct

SEQ ID NO: 2134943 - DNA, 23 bp, Homo sapiens
ttctgcatcagctgctgaaacaa

SEQ ID NO: 2134944 - DNA, 19 bp, Homo sapiens
ttctgcccacattggaccc

SEQ ID NO: 2134945 - DNA, 18 bp, Homo sapiens
ttctgccccagctttatc

SEQ ID NO: 2134946 - DNA, 15 bp, Homo sapiens
ttctgcctgcccagg

SEQ ID NO: 2134947 - DNA, 21 bp, Homo sapiens
ttctgcctgcccaggcccctg

SEQ ID NO: 2134948 - DNA, 15 bp, Homo sapiens
ttctgccttttttat

SEQ ID NO: 2134949 - DNA, 18 bp, Homo sapiens
ttctgcgtgctttattta

SEQ ID NO: 2134950 - DNA, 21 bp, Homo sapiens
ttctgctacctcactggggtc

SEQ ID NO: 2134951 - DNA, 11 bp, Homo sapiens
ttctgctcctc

SEQ ID NO: 2134952 - DNA, 18 bp, Homo sapiens
ttctgctcttccaaagct

SEQ ID NO: 2134953 - DNA, 13 bp, Homo sapiens
ttctgctggcctg

SEQ ID NO: 2134954 - DNA, 18 bp, Homo sapiens
ttctgctggcctggatct

SEQ ID NO: 2134955 - DNA, 15 bp, Homo sapiens
ttctgcttcagcctc

SEQ ID NO: 2134956 - DNA, 19 bp, Homo sapiens
ttctggaaaaaaaatatat

SEQ ID NO: 2134957 - DNA, 22 bp, Homo sapiens
ttctggaaaaaaaatatatata

SEQ ID NO: 2134958 - DNA, 15 bp, Homo sapiens
ttctggaaattttgt

SEQ ID NO: 2134959 - DNA, 18 bp, Homo sapiens
ttctggaaggctggctga

SEQ ID NO: 2134960 - DNA, 19 bp, Homo sapiens
ttctggaatacatgaaata

SEQ ID NO: 2134961 - DNA, 16 bp, Homo sapiens
ttctggaatgtaatca

SEQ ID NO: 2134962 - DNA, 15 bp, Homo sapiens
ttctggaggaagaag

SEQ ID NO: 2134963 - DNA, 14 bp, Homo sapiens
ttctggcctcagca

SEQ ID NO: 2134964 - DNA, 12 bp, Homo sapiens
ttctggctgcaa

SEQ ID NO: 2134965 - DNA, 22 bp, Homo sapiens
ttctgggacacagttcaattct

SEQ ID NO: 2134966 - DNA, 21 bp, Homo sapiens
ttctggggaggaagggccagg

SEQ ID NO: 2134967 - DNA, 14 bp, Homo sapiens
ttctgggtggcctc

SEQ ID NO: 2134968 - DNA, 18 bp, Homo sapiens
ttctgggtggcctcggga

SEQ ID NO: 2134969 - DNA, 17 bp, Homo sapiens
ttctgggtggctcctgc

SEQ ID NO: 2134970 - DNA, 17 bp, Homo sapiens
ttctgggtgttgaccac

SEQ ID NO: 2134971 - DNA, 21 bp, Homo sapiens
ttctgtcatcccgctcctgct

SEQ ID NO: 2134972 - DNA, 22 bp, Homo sapiens
ttctgtcatcccgctcctgctg

SEQ ID NO: 2134973 - DNA, 14 bp, Homo sapiens
ttctgtccaaggca

SEQ ID NO: 2134974 - DNA, 19 bp, Homo sapiens
ttctgtcctactctgtgtc

SEQ ID NO: 2134975 - DNA, 13 bp, Homo sapiens
ttctgtctctctt

SEQ ID NO: 2134976 - DNA, 21 bp, Homo sapiens
ttctgtgggcttggccttgtg

SEQ ID NO: 2134977 - DNA, 23 bp, Homo sapiens
ttctgtgtgcaccttaccaactt

SEQ ID NO: 2134978 - DNA, 20 bp, Homo sapiens
ttctgtgtgggtctggggag

SEQ ID NO: 2134979 - DNA, 15 bp, Homo sapiens
ttctgttaaaatcag

SEQ ID NO: 2134980 - DNA, 17 bp, Homo sapiens
ttctgttaaaatcagga

SEQ ID NO: 2134981 - DNA, 22 bp, Homo sapiens
ttctgttgcccaggctggcctg

SEQ ID NO: 2134982 - DNA, 19 bp, Homo sapiens
ttctgttgtaatagtccat

SEQ ID NO: 2134983 - DNA, 15 bp, Homo sapiens
ttcttaaaatatatt

SEQ ID NO: 2134984 - DNA, 19 bp, Homo sapiens
ttcttaaaatgtttcattt

SEQ ID NO: 2134985 - DNA, 11 bp, Homo sapiens
ttcttaaataa

SEQ ID NO: 2134986 - DNA, 18 bp, Homo sapiens
ttcttaaataagaaactt

SEQ ID NO: 2134987 - DNA, 13 bp, Homo sapiens
ttcttacagactg

SEQ ID NO: 2134988 - DNA, 22 bp, Homo sapiens
ttcttaccgagaaaaggagaaa

SEQ ID NO: 2134989 - DNA, 15 bp, Homo sapiens
ttcttacctgtatgt

SEQ ID NO: 2134990 - DNA, 19 bp, Homo sapiens
ttcttactgttttgtatca

SEQ ID NO: 2134991 - DNA, 16 bp, Homo sapiens
ttcttatcttctgcaa

SEQ ID NO: 2134992 - DNA, 13 bp, Homo sapiens
ttcttatttgcaa

SEQ ID NO: 2134993 - DNA, 13 bp, Homo sapiens
ttcttatttgttt

SEQ ID NO: 2134994 - DNA, 16 bp, Homo sapiens
ttcttcaccaaatctt

SEQ ID NO: 2134995 - DNA, 21 bp, Homo sapiens
ttcttcataacaattttagga

SEQ ID NO: 2134996 - DNA, 18 bp, Homo sapiens
ttcttcatgcaatgacat

SEQ ID NO: 2134997 - DNA, 20 bp, Homo sapiens
ttcttcccatttgtaatgta

SEQ ID NO: 2134998 - DNA, 16 bp, Homo sapiens
ttcttcctcactatga

SEQ ID NO: 2134999 - DNA, 13 bp, Homo sapiens
ttcttcctctgct

SEQ ID NO: 2135000 - DNA, 23 bp, Homo sapiens
ttcttcgaggtggatcacagagg

SEQ ID NO: 2135001 - DNA, 18 bp, Homo sapiens
ttcttcgctgctagagaa

SEQ ID NO: 2135002 - DNA, 14 bp, Homo sapiens
ttcttcgctgctct

SEQ ID NO: 2135003 - DNA, 17 bp, Homo sapiens
ttcttctaaaattgaag

SEQ ID NO: 2135004 - DNA, 19 bp, Homo sapiens
ttcttctacaaccagagcc

SEQ ID NO: 2135005 - DNA, 18 bp, Homo sapiens
ttcttctaggttctaaaa

SEQ ID NO: 2135006 - DNA, 20 bp, Homo sapiens
ttcttctgcttcagcctccc

SEQ ID NO: 2135007 - DNA, 15 bp, Homo sapiens
ttcttcttcagaaga

SEQ ID NO: 2135008 - DNA, 14 bp, Homo sapiens
ttcttgaaagctgt

SEQ ID NO: 2135009 - DNA, 15 bp, Homo sapiens
ttcttgagtagatct

SEQ ID NO: 2135010 - DNA, 16 bp, Homo sapiens
ttcttgatgttgctta

SEQ ID NO: 2135011 - DNA, 19 bp, Homo sapiens
ttcttgcagtcatcagaag

SEQ ID NO: 2135012 - DNA, 16 bp, Homo sapiens
ttcttgccaatgaggt

SEQ ID NO: 2135013 - DNA, 14 bp, Homo sapiens
ttcttgccccttgg

SEQ ID NO: 2135014 - DNA, 21 bp, Homo sapiens
ttcttgcctactatgccagat

SEQ ID NO: 2135015 - DNA, 12 bp, Homo sapiens
ttcttggaaaaa

SEQ ID NO: 2135016 - DNA, 20 bp, Homo sapiens
ttcttggaaaaaaattacaa

SEQ ID NO: 2135017 - DNA, 14 bp, Homo sapiens
ttcttggagaactt

SEQ ID NO: 2135018 - DNA, 17 bp, Homo sapiens
ttcttggtttggggaga

SEQ ID NO: 2135019 - DNA, 16 bp, Homo sapiens
ttcttgttcatccaag

SEQ ID NO: 2135020 - DNA, 15 bp, Homo sapiens
ttctttaaatcaaaa

SEQ ID NO: 2135021 - DNA, 14 bp, Homo sapiens
ttctttacctgaga

SEQ ID NO: 2135022 - DNA, 23 bp, Homo sapiens
ttctttaggtgcctcctgtctta

SEQ ID NO: 2135023 - DNA, 13 bp, Homo sapiens
ttctttataaact

SEQ ID NO: 2135024 - DNA, 19 bp, Homo sapiens
ttctttcacaaaaaagaag

SEQ ID NO: 2135025 - DNA, 22 bp, Homo sapiens
ttctttcctcttccccttgccc

SEQ ID NO: 2135026 - DNA, 13 bp, Homo sapiens
ttctttcttcctc

SEQ ID NO: 2135027 - DNA, 11 bp, Homo sapiens
ttctttgaatg

SEQ ID NO: 2135028 - DNA, 16 bp, Homo sapiens
ttctttgtaaaggtca

SEQ ID NO: 2135029 - DNA, 12 bp, Homo sapiens
ttcttttgtaaa

SEQ ID NO: 2135030 - DNA, 19 bp, Homo sapiens
ttcttttgtgttggatttg

SEQ ID NO: 2135031 - DNA, 22 bp, Homo sapiens
ttctttttaaaaagttgcacat

SEQ ID NO: 2135032 - DNA, 16 bp, Homo sapiens
ttctttttctgtctct

SEQ ID NO: 2135033 - DNA, 14 bp, Homo sapiens
ttctttttttgtga

SEQ ID NO: 2135034 - DNA, 16 bp, Homo sapiens
ttgaaaaaatgttcta

SEQ ID NO: 2135035 - DNA, 14 bp, Homo sapiens
ttgaaaatgaaatg

SEQ ID NO: 2135036 - DNA, 11 bp, Homo sapiens
ttgaaaatgag

SEQ ID NO: 2135037 - DNA, 19 bp, Homo sapiens
ttgaaaattattttaaaca

SEQ ID NO: 2135038 - DNA, 20 bp, Homo sapiens
ttgaaaattattttaaacaa

SEQ ID NO: 2135039 - DNA, 17 bp, Homo sapiens
ttgaaactagaagtcaa

SEQ ID NO: 2135040 - DNA, 22 bp, Homo sapiens
ttgaaactgtaaatatgtttgt

SEQ ID NO: 2135041 - DNA, 12 bp, Homo sapiens
ttgtaaatacac

SEQ ID NO: 2135042 - DNA, 13 bp, Homo sapiens
ttgtaaatattgt

SEQ ID NO: 2135043 - DNA, 22 bp, Homo sapiens
ttgtaaatgaccaagaaaaaga

SEQ ID NO: 2135044 - DNA, 18 bp, Homo sapiens
ttgtaaatgctcgtgtga

SEQ ID NO: 2135045 - DNA, 23 bp, Homo sapiens
ttgtaaattaatacttcatttgg

SEQ ID NO: 2135046 - DNA, 20 bp, Homo sapiens
ttgtaaattaggaggctcaa

SEQ ID NO: 2135047 - DNA, 19 bp, Homo sapiens
ttgtaaattctggaaatgt

SEQ ID NO: 2135048 - DNA, 21 bp, Homo sapiens
ttgtaaatttggatttacgac

SEQ ID NO: 2135049 - DNA, 12 bp, Homo sapiens
ttgtaaatttta

SEQ ID NO: 2135050 - DNA, 14 bp, Homo sapiens
ttgtaaattttaga

SEQ ID NO: 2135051 - DNA, 18 bp, Homo sapiens
ttgtaagacaaaggtttt

SEQ ID NO: 2135052 - DNA, 21 bp, Homo sapiens
ttgtaagacaaaggttttcct

SEQ ID NO: 2135053 - DNA, 17 bp, Homo sapiens
ttgtaataaactctcta

SEQ ID NO: 2135054 - DNA, 15 bp, Homo sapiens
ttgtaatgtatctta

SEQ ID NO: 2135055 - DNA, 18 bp, Homo sapiens
ttgtaatgtatcttattt

SEQ ID NO: 2135056 - DNA, 18 bp, Homo sapiens
ttgtaattgcttacattt

SEQ ID NO: 2135057 - DNA, 23 bp, Homo sapiens
ttgtacaaaataaacaaataaca

SEQ ID NO: 2135058 - DNA, 16 bp, Homo sapiens
ttgtacaaagatatgc

SEQ ID NO: 2135059 - DNA, 19 bp, Homo sapiens
ttgtacaattactaaattg

SEQ ID NO: 2135060 - DNA, 13 bp, Homo sapiens
ttgtacactatct

SEQ ID NO: 2135061 - DNA, 16 bp, Homo sapiens
ttgtacagtggagaaa

SEQ ID NO: 2135062 - DNA, 16 bp, Homo sapiens
ttgtacagttcagttc

SEQ ID NO: 2135063 - DNA, 14 bp, Homo sapiens
ttgtaccagtgtga

SEQ ID NO: 2135064 - DNA, 18 bp, Homo sapiens
ttgtaccccatcccttcc

SEQ ID NO: 2135065 - DNA, 17 bp, Homo sapiens
ttgtacgtaaagcttaa

SEQ ID NO: 2135066 - DNA, 16 bp, Homo sapiens
ttgtacgtaatgtatt

SEQ ID NO: 2135067 - DNA, 15 bp, Homo sapiens
ttgtacgttatatat

SEQ ID NO: 2135068 - DNA, 16 bp, Homo sapiens
ttgtacgttatatatt

SEQ ID NO: 2135069 - DNA, 18 bp, Homo sapiens
ttgtacgttatatattgt

SEQ ID NO: 2135070 - DNA, 14 bp, Homo sapiens
ttgtactatgttaa

SEQ ID NO: 2135071 - DNA, 21 bp, Homo sapiens
ttgtactattgtttaaaaaca

SEQ ID NO: 2135072 - DNA, 14 bp, Homo sapiens
ttgtagaaatctgt

SEQ ID NO: 2135073 - DNA, 16 bp, Homo sapiens
ttgtagaaatctgtaa

SEQ ID NO: 2135074 - DNA, 20 bp, Homo sapiens
ttgtagaagatggactctga

SEQ ID NO: 2135075 - DNA, 16 bp, Homo sapiens
ttgtagaccactgtcc

SEQ ID NO: 2135076 - DNA, 19 bp, Homo sapiens
ttgtaggtcaatgaaatat

SEQ ID NO: 2135077 - DNA, 20 bp, Homo sapiens
ttgtagtagttgatgaccaa

SEQ ID NO: 2135078 - DNA, 18 bp, Homo sapiens
ttgtagttcttgtgcatg

SEQ ID NO: 2135079 - DNA, 13 bp, Homo sapiens
ttgtataaatgta

SEQ ID NO: 2135080 - DNA, 15 bp, Homo sapiens
ttgtatagtgtaaaa

SEQ ID NO: 2135081 - DNA, 21 bp, Homo sapiens
ttgtatagttatatttgctga

SEQ ID NO: 2135082 - DNA, 14 bp, Homo sapiens
ttgtatatacatat

SEQ ID NO: 2135083 - DNA, 16 bp, Homo sapiens
ttgtatatacatatta

SEQ ID NO: 2135084 - DNA, 20 bp, Homo sapiens
ttgtatatacttcactcact

SEQ ID NO: 2135085 - DNA, 16 bp, Homo sapiens
ttgtatatatgtgtgt

SEQ ID NO: 2135086 - DNA, 20 bp, Homo sapiens
ttgtatattatggaagattt

SEQ ID NO: 2135087 - DNA, 21 bp, Homo sapiens
ttgtatattatggaagatttt

SEQ ID NO: 2135088 - DNA, 22 bp, Homo sapiens
ttgtatattccaccattcacat

SEQ ID NO: 2135089 - DNA, 15 bp, Homo sapiens
ttgtatattctggaa

SEQ ID NO: 2135090 - DNA, 17 bp, Homo sapiens
ttgtatattctggaaaa

SEQ ID NO: 2135091 - DNA, 16 bp, Homo sapiens
ttgtatattgtcagat

SEQ ID NO: 2135092 - DNA, 19 bp, Homo sapiens
ttgtatattgtcagatatt

SEQ ID NO: 2135093 - DNA, 19 bp, Homo sapiens
ttgtatcatttgaacaact

SEQ ID NO: 2135094 - DNA, 15 bp, Homo sapiens
ttgtatccagtgatg

SEQ ID NO: 2135095 - DNA, 20 bp, Homo sapiens
ttgtatctcttttgaatcca

SEQ ID NO: 2135096 - DNA, 13 bp, Homo sapiens
ttgtatgatgtgt

SEQ ID NO: 2135097 - DNA, 18 bp, Homo sapiens
ttgtatgatgtgttgtga

SEQ ID NO: 2135098 - DNA, 21 bp, Homo sapiens
ttgtatgatgtgttgtgatag

SEQ ID NO: 2135099 - DNA, 13 bp, Homo sapiens
ttgtatgtactgt

SEQ ID NO: 2135100 - DNA, 15 bp, Homo sapiens
ttgtatgtatctatt

SEQ ID NO: 2135101 - DNA, 14 bp, Homo sapiens
ttgtattacatcta

SEQ ID NO: 2135102 - DNA, 16 bp, Homo sapiens
ttgtattttaaatgtt

SEQ ID NO: 2135103 - DNA, 21 bp, Homo sapiens
ttgtattttaaatgttttaca

SEQ ID NO: 2135104 - DNA, 13 bp, Homo sapiens
ttgtattttccat

SEQ ID NO: 2135105 - DNA, 13 bp, Homo sapiens
ttgtatttttgaa

SEQ ID NO: 2135106 - DNA, 13 bp, Homo sapiens
ttgtcaaatgtca

SEQ ID NO: 2135107 - DNA, 14 bp, Homo sapiens
ttgtcaatattaaa

SEQ ID NO: 2135108 - DNA, 18 bp, Homo sapiens
ttgtcaatattaaataca

SEQ ID NO: 2135109 - DNA, 18 bp, Homo sapiens
ttgtcacacactttggct

SEQ ID NO: 2135110 - DNA, 17 bp, Homo sapiens
ttgtcactagcagctgc

SEQ ID NO: 2135111 - DNA, 18 bp, Homo sapiens
ttgtcactgtcttcacaa

SEQ ID NO: 2135112 - DNA, 20 bp, Homo sapiens
ttgtcatatattcatgtaat

SEQ ID NO: 2135113 - DNA, 21 bp, Homo sapiens
ttgtcatatattcatgtaata

SEQ ID NO: 2135114 - DNA, 21 bp, Homo sapiens
ttgtcatcattgtatatatgt

SEQ ID NO: 2135115 - DNA, 21 bp, Homo sapiens
ttgtcatctttcttctatttt

SEQ ID NO: 2135116 - DNA, 20 bp, Homo sapiens
ttgtcattcaagcctgtgaa

SEQ ID NO: 2135117 - DNA, 21 bp, Homo sapiens
ttgtcattcaagcctgtgaat

SEQ ID NO: 2135118 - DNA, 19 bp, Homo sapiens
ttgtccaatggctgtaaac

SEQ ID NO: 2135119 - DNA, 22 bp, Homo sapiens
ttgtccacagtctcccattctc

SEQ ID NO: 2135120 - DNA, 18 bp, Homo sapiens
ttgtccatatcagacctc

SEQ ID NO: 2135121 - DNA, 21 bp, Homo sapiens
ttgtccatgcctacagataat

SEQ ID NO: 2135122 - DNA, 15 bp, Homo sapiens
ttgtccatgtgcttc

SEQ ID NO: 2135123 - DNA, 14 bp, Homo sapiens
ttgtcccatttcct

SEQ ID NO: 2135124 - DNA, 15 bp, Homo sapiens
ttgtcccatttcctt

SEQ ID NO: 2135125 - DNA, 17 bp, Homo sapiens
ttgtcccatttccttgg

SEQ ID NO: 2135126 - DNA, 15 bp, Homo sapiens
ttgtccccagggccc

SEQ ID NO: 2135127 - DNA, 14 bp, Homo sapiens
ttgtccctgctcct

SEQ ID NO: 2135128 - DNA, 18 bp, Homo sapiens
ttgtccctggtgcagagg

SEQ ID NO: 2135129 - DNA, 14 bp, Homo sapiens
ttgtcctgccagct

SEQ ID NO: 2135130 - DNA, 17 bp, Homo sapiens
ttgtcctgccagctgcc

SEQ ID NO: 2135131 - DNA, 20 bp, Homo sapiens
ttgtcctttgagaaagaaat

SEQ ID NO: 2135132 - DNA, 15 bp, Homo sapiens
ttgtcgggacagaga

SEQ ID NO: 2135133 - DNA, 14 bp, Homo sapiens
ttgtctatgggact

SEQ ID NO: 2135134 - DNA, 20 bp, Homo sapiens
ttgtctatgggactcaatgc

SEQ ID NO: 2135135 - DNA, 23 bp, Homo sapiens
ttgtctccactaaatgagctcct

SEQ ID NO: 2135136 - DNA, 20 bp, Homo sapiens
ttgtctctcattctctttct

SEQ ID NO: 2135137 - DNA, 12 bp, Homo sapiens
ttgtctctgggc

SEQ ID NO: 2135138 - DNA, 17 bp, Homo sapiens
ttgtctgaagtcactgc

SEQ ID NO: 2135139 - DNA, 23 bp, Homo sapiens
ttgtctggataccagatatttga

SEQ ID NO: 2135140 - DNA, 11 bp, Homo sapiens
ttgtctgtgca

SEQ ID NO: 2135141 - DNA, 14 bp, Homo sapiens
ttgtctgtgcagct

SEQ ID NO: 2135142 - DNA, 17 bp, Homo sapiens
ttgtcttaatattgtgg

SEQ ID NO: 2135143 - DNA, 12 bp, Homo sapiens
ttgtcttccaac

SEQ ID NO: 2135144 - DNA, 17 bp, Homo sapiens
ttgtcttccaaccccag

SEQ ID NO: 2135145 - DNA, 18 bp, Homo sapiens
ttgtcttccaaccccagc

SEQ ID NO: 2135146 - DNA, 13 bp, Homo sapiens
ttgtctttcagga

SEQ ID NO: 2135147 - DNA, 14 bp, Homo sapiens
ttgtgaaaccacag

SEQ ID NO: 2135148 - DNA, 15 bp, Homo sapiens
ttgtgaaaccacagg

SEQ ID NO: 2135149 - DNA, 14 bp, Homo sapiens
ttgtgaaatgatgg

SEQ ID NO: 2135150 - DNA, 11 bp, Homo sapiens
ttgtgaagagg

SEQ ID NO: 2135151 - DNA, 16 bp, Homo sapiens
ttgtgaccaagttata

SEQ ID NO: 2135152 - DNA, 15 bp, Homo sapiens
ttgtgactatataga

SEQ ID NO: 2135153 - DNA, 21 bp, Homo sapiens
ttgtgagtgactcggtgtaaa

SEQ ID NO: 2135154 - DNA, 22 bp, Homo sapiens
ttgtgagtgactcggtgtaaaa

SEQ ID NO: 2135155 - DNA, 23 bp, Homo sapiens
ttgtgatcagaccataatgttac

SEQ ID NO: 2135156 - DNA, 17 bp, Homo sapiens
tttcccatgatccagaa

SEQ ID NO: 2135157 - DNA, 19 bp, Homo sapiens
tttcccatgctgaattatt

SEQ ID NO: 2135158 - DNA, 20 bp, Homo sapiens
tttccccacctcttccttcc

SEQ ID NO: 2135159 - DNA, 23 bp, Homo sapiens
tttccccatttaggtttctgagt

SEQ ID NO: 2135160 - DNA, 20 bp, Homo sapiens
tttcccccaccccagagttg

SEQ ID NO: 2135161 - DNA, 20 bp, Homo sapiens
tttccccgggggaggaaggg

SEQ ID NO: 2135162 - DNA, 18 bp, Homo sapiens
tttccccggtcccttgag

SEQ ID NO: 2135163 - DNA, 20 bp, Homo sapiens
tttcccctgcccccagacct

SEQ ID NO: 2135164 - DNA, 21 bp, Homo sapiens
tttcccgagcaaagtctaaag

SEQ ID NO: 2135165 - DNA, 22 bp, Homo sapiens
tttcccgagcaaagtctaaagt

SEQ ID NO: 2135166 - DNA, 13 bp, Homo sapiens
tttccctctctag

SEQ ID NO: 2135167 - DNA, 18 bp, Homo sapiens
tttccgaagaccttctga

SEQ ID NO: 2135168 - DNA, 19 bp, Homo sapiens
tttccgtctccctaaaata

SEQ ID NO: 2135169 - DNA, 22 bp, Homo sapiens
tttcctaaaaataagctttatt

SEQ ID NO: 2135170 - DNA, 13 bp, Homo sapiens
tttcctaaatgtt

SEQ ID NO: 2135171 - DNA, 23 bp, Homo sapiens
tttcctacagaaatactgctctg

SEQ ID NO: 2135172 - DNA, 16 bp, Homo sapiens
tttcctattttaaaac

SEQ ID NO: 2135173 - DNA, 22 bp, Homo sapiens
tttcctattttaaaaccatgca

SEQ ID NO: 2135174 - DNA, 16 bp, Homo sapiens
tttcctcatctgcaga

SEQ ID NO: 2135175 - DNA, 14 bp, Homo sapiens
tttcctccccacct

SEQ ID NO: 2135176 - DNA, 13 bp, Homo sapiens
tttcctccctcag

SEQ ID NO: 2135177 - DNA, 23 bp, Homo sapiens
tttcctccctcctcccacagcct

SEQ ID NO: 2135178 - DNA, 12 bp, Homo sapiens
tttcctccctgg

SEQ ID NO: 2135179 - DNA, 16 bp, Homo sapiens
tttcctcctaaacaaa

SEQ ID NO: 2135180 - DNA, 23 bp, Homo sapiens
tttcctgacagaaggactcaggt

SEQ ID NO: 2135181 - DNA, 16 bp, Homo sapiens
tttcctggaaagactg

SEQ ID NO: 2135182 - DNA, 16 bp, Homo sapiens
tttcctgtaagacaat

SEQ ID NO: 2135183 - DNA, 23 bp, Homo sapiens
tttcctgtatttgttcccaagag

SEQ ID NO: 2135184 - DNA, 18 bp, Homo sapiens
tttccttccttccctggc

SEQ ID NO: 2135185 - DNA, 19 bp, Homo sapiens
tttcctttatatttagtga

SEQ ID NO: 2135186 - DNA, 16 bp, Homo sapiens
tttcctttgtcatcat

SEQ ID NO: 2135187 - DNA, 21 bp, Homo sapiens
tttccttttgcaacaagacaa

SEQ ID NO: 2135188 - DNA, 17 bp, Homo sapiens
tttcggtgggacagccc

SEQ ID NO: 2135189 - DNA, 14 bp, Homo sapiens
tttcgtgcatttgt

SEQ ID NO: 2135190 - DNA, 15 bp, Homo sapiens
tttcgtgcatttgtg

SEQ ID NO: 2135191 - DNA, 19 bp, Homo sapiens
tttcgtgtagtggaagagc

SEQ ID NO: 2135192 - DNA, 14 bp, Homo sapiens
tttctaaaaaacag

SEQ ID NO: 2135193 - DNA, 12 bp, Homo sapiens
tttctaactgta

SEQ ID NO: 2135194 - DNA, 13 bp, Homo sapiens
tttctaactgtaa

SEQ ID NO: 2135195 - DNA, 15 bp, Homo sapiens
tttctaactgtaaat

SEQ ID NO: 2135196 - DNA, 18 bp, Homo sapiens
tttctaactgtaaatcac

SEQ ID NO: 2135197 - DNA, 19 bp, Homo sapiens
tttctaactgtaaatcact

SEQ ID NO: 2135198 - DNA, 21 bp, Homo sapiens
tttctaactgtaaatcacttg

SEQ ID NO: 2135199 - DNA, 15 bp, Homo sapiens
tttctaatgtgtgaa

SEQ ID NO: 2135200 - DNA, 23 bp, Homo sapiens
tttctaattttaagttattttaa

SEQ ID NO: 2135201 - DNA, 19 bp, Homo sapiens
tttctacatagttattcta

SEQ ID NO: 2135202 - DNA, 21 bp, Homo sapiens
tttctacatagttattctatc

SEQ ID NO: 2135203 - DNA, 18 bp, Homo sapiens
tttctacccagcgagccc

SEQ ID NO: 2135204 - DNA, 16 bp, Homo sapiens
tttctacttttaaaga

SEQ ID NO: 2135205 - DNA, 20 bp, Homo sapiens
tttctagctagaaatatgat

SEQ ID NO: 2135206 - DNA, 17 bp, Homo sapiens
tttctaggtaggaaatg

SEQ ID NO: 2135207 - DNA, 21 bp, Homo sapiens
tttctagtttcagtaaataat

SEQ ID NO: 2135208 - DNA, 14 bp, Homo sapiens
tttctatcacatat

SEQ ID NO: 2135209 - DNA, 17 bp, Homo sapiens
tttctattgaaaaatca

SEQ ID NO: 2135210 - DNA, 17 bp, Homo sapiens
tttctcaatcagtgcag

SEQ ID NO: 2135211 - DNA, 20 bp, Homo sapiens
tttctcaatcagtgcagtga

SEQ ID NO: 2135212 - DNA, 16 bp, Homo sapiens
tttctcactaaatctt

SEQ ID NO: 2135213 - DNA, 19 bp, Homo sapiens
tttctcagaatccaaagat

SEQ ID NO: 2135214 - DNA, 20 bp, Homo sapiens
tttctcagaatccaaagatc

SEQ ID NO: 2135215 - DNA, 21 bp, Homo sapiens
tttctccaagagctacataat

SEQ ID NO: 2135216 - DNA, 18 bp, Homo sapiens
tttctcccagtcatttaa

SEQ ID NO: 2135217 - DNA, 14 bp, Homo sapiens
tttctccccctggg

SEQ ID NO: 2135218 - DNA, 17 bp, Homo sapiens
tttctccctaaactgta

SEQ ID NO: 2135219 - DNA, 13 bp, Homo sapiens
tttctccctcacc

SEQ ID NO: 2135220 - DNA, 18 bp, Homo sapiens
tttctccggggtctgtgc

SEQ ID NO: 2135221 - DNA, 20 bp, Homo sapiens
tttctccggggtctgtgctg

SEQ ID NO: 2135222 - DNA, 19 bp, Homo sapiens
tttctcctactttacactc

SEQ ID NO: 2135223 - DNA, 19 bp, Homo sapiens
tttctcgtggtagaagcca

SEQ ID NO: 2135224 - DNA, 13 bp, Homo sapiens
tttctctcccata

SEQ ID NO: 2135225 - DNA, 21 bp, Homo sapiens
tttctctccttcttccctgtt

SEQ ID NO: 2135226 - DNA, 17 bp, Homo sapiens
tttctctgcttaccctt

SEQ ID NO: 2135227 - DNA, 11 bp, Homo sapiens
tttctcttccc

SEQ ID NO: 2135228 - DNA, 15 bp, Homo sapiens
tttctctttaaaaga

SEQ ID NO: 2135229 - DNA, 16 bp, Homo sapiens
tttctgagaaggtcct

SEQ ID NO: 2135230 - DNA, 16 bp, Homo sapiens
tttctgaggagaaaca

SEQ ID NO: 2135231 - DNA, 18 bp, Homo sapiens
tttctgaggagaaacaaa

SEQ ID NO: 2135232 - DNA, 18 bp, Homo sapiens
tttctgagtgacatgggt

SEQ ID NO: 2135233 - DNA, 19 bp, Homo sapiens
tttctgcagtagtctctgt

SEQ ID NO: 2135234 - DNA, 11 bp, Homo sapiens
tttctggaaat

SEQ ID NO: 2135235 - DNA, 14 bp, Homo sapiens
tttctggaaatttt

SEQ ID NO: 2135236 - DNA, 11 bp, Homo sapiens
tttctggagtc

SEQ ID NO: 2135237 - DNA, 17 bp, Homo sapiens
tttctgtctctcttgct

SEQ ID NO: 2135238 - DNA, 20 bp, Homo sapiens
tttctgtgtgcaccttacca

SEQ ID NO: 2135239 - DNA, 20 bp, Homo sapiens
tttcttaaataagaaacttt

SEQ ID NO: 2135240 - DNA, 22 bp, Homo sapiens
tttcttacccatatatcttatg

SEQ ID NO: 2135241 - DNA, 23 bp, Homo sapiens
tttcttaccttaaaaagtaattg

SEQ ID NO: 2135242 - DNA, 16 bp, Homo sapiens
tttcttacttatcaaa

SEQ ID NO: 2135243 - DNA, 12 bp, Homo sapiens
tttcttatccaa

SEQ ID NO: 2135244 - DNA, 18 bp, Homo sapiens
tttcttatttaacttaac

SEQ ID NO: 2135245 - DNA, 20 bp, Homo sapiens
tttcttattttgtaataaac

SEQ ID NO: 2135246 - DNA, 18 bp, Homo sapiens
tttcttcatgcaatgaca

SEQ ID NO: 2135247 - DNA, 19 bp, Homo sapiens
tttcttcatgcaatgacat

SEQ ID NO: 2135248 - DNA, 22 bp, Homo sapiens
tttcttcatgcaatgacatctt

SEQ ID NO: 2135249 - DNA, 14 bp, Homo sapiens
tttcttcccatcac

SEQ ID NO: 2135250 - DNA, 20 bp, Homo sapiens
tttcttcccatttgtaatgt

SEQ ID NO: 2135251 - DNA, 14 bp, Homo sapiens
tttcttcctctgct

SEQ ID NO: 2135252 - DNA, 16 bp, Homo sapiens
tttcttcctctgctga

SEQ ID NO: 2135253 - DNA, 12 bp, Homo sapiens
tttcttccttct

SEQ ID NO: 2135254 - DNA, 11 bp, Homo sapiens
tttcttctttg

SEQ ID NO: 2135255 - DNA, 21 bp, Homo sapiens
tttcttggtctcagcttcatt

SEQ ID NO: 2135256 - DNA, 20 bp, Homo sapiens
tttcttgttcatccaaggaa

SEQ ID NO: 2135257 - DNA, 15 bp, Homo sapiens
tttctttaagaaagt

SEQ ID NO: 2135258 - DNA, 13 bp, Homo sapiens
tttctttgtggct

SEQ ID NO: 2135259 - DNA, 20 bp, Homo sapiens
tttcttttaaagaagtaaat

SEQ ID NO: 2135260 - DNA, 16 bp, Homo sapiens
tttcttttgtaaatgt

SEQ ID NO: 2135261 - DNA, 16 bp, Homo sapiens
tttctttttctggaaa

SEQ ID NO: 2135262 - DNA, 15 bp, Homo sapiens
tttgaaaaagcgaaa

SEQ ID NO: 2135263 - DNA, 15 bp, Homo sapiens
tttgaaaagaaaaat

SEQ ID NO: 2135264 - DNA, 20 bp, Homo sapiens
tttgaacccccgccatcctt

SEQ ID NO: 2135265 - DNA, 15 bp, Homo sapiens
tttgaacccctgtgt

SEQ ID NO: 2135266 - DNA, 15 bp, Homo sapiens
tttgaactaataaaa

SEQ ID NO: 2135267 - DNA, 21 bp, Homo sapiens
tttgaagaagggaaattcaca

SEQ ID NO: 2135268 - DNA, 16 bp, Homo sapiens
tttgaagcagttgtgt

SEQ ID NO: 2135269 - DNA, 18 bp, Homo sapiens
tttgaagcagttgtgtca

SEQ ID NO: 2135270 - DNA, 20 bp, Homo sapiens
tttgaagcctgctaaatgaa

SEQ ID NO: 2135271 - DNA, 19 bp, Homo sapiens
ttttgttgattaaaacatt

SEQ ID NO: 2135272 - DNA, 19 bp, Homo sapiens
ttttgttgtttcttaaata

SEQ ID NO: 2135273 - DNA, 15 bp, Homo sapiens
ttttgtttcttccaa

SEQ ID NO: 2135274 - DNA, 23 bp, Homo sapiens
tttttaaaaaagcttaaaacttt

SEQ ID NO: 2135275 - DNA, 16 bp, Homo sapiens
tttttaaacaagtatt

SEQ ID NO: 2135276 - DNA, 16 bp, Homo sapiens
tttttaaataaaagca

SEQ ID NO: 2135277 - DNA, 20 bp, Homo sapiens
tttttaaatgaaaatgtaac

SEQ ID NO: 2135278 - DNA, 16 bp, Homo sapiens
tttttaagtatttata

SEQ ID NO: 2135279 - DNA, 14 bp, Homo sapiens
tttttaataattta

SEQ ID NO: 2135280 - DNA, 13 bp, Homo sapiens
tttttacaataaa

SEQ ID NO: 2135281 - DNA, 17 bp, Homo sapiens
tttttactaaagcagtg

SEQ ID NO: 2135282 - DNA, 17 bp, Homo sapiens
tttttagtcttttactc

SEQ ID NO: 2135283 - DNA, 13 bp, Homo sapiens
tttttatacatat

SEQ ID NO: 2135284 - DNA, 17 bp, Homo sapiens
tttttatacatatcaga

SEQ ID NO: 2135285 - DNA, 18 bp, Homo sapiens
tttttatacatatcagaa

SEQ ID NO: 2135286 - DNA, 20 bp, Homo sapiens
tttttatacatatcagaaaa

SEQ ID NO: 2135287 - DNA, 12 bp, Homo sapiens
tttttattaaat

SEQ ID NO: 2135288 - DNA, 19 bp, Homo sapiens
tttttattcaattctgtat

SEQ ID NO: 2135289 - DNA, 15 bp, Homo sapiens
tttttatttccacat

SEQ ID NO: 2135290 - DNA, 21 bp, Homo sapiens
tttttcaaaacgccatgtcct

SEQ ID NO: 2135291 - DNA, 19 bp, Homo sapiens
tttttcaaagatgtgttgc

SEQ ID NO: 2135292 - DNA, 21 bp, Homo sapiens
tttttcaaccagcattttact

SEQ ID NO: 2135293 - DNA, 15 bp, Homo sapiens
tttttcaagaaaact

SEQ ID NO: 2135294 - DNA, 14 bp, Homo sapiens
tttttccaactgtg

SEQ ID NO: 2135295 - DNA, 13 bp, Homo sapiens
tttttccagattc

SEQ ID NO: 2135296 - DNA, 16 bp, Homo sapiens
tttttccccaaagtct

SEQ ID NO: 2135297 - DNA, 14 bp, Homo sapiens
tttttccgtaaaaa

SEQ ID NO: 2135298 - DNA, 17 bp, Homo sapiens
tttttccttgtatttaa

SEQ ID NO: 2135299 - DNA, 21 bp, Homo sapiens
tttttctagtttcagtaaata

SEQ ID NO: 2135300 - DNA, 13 bp, Homo sapiens
tttttctgtctct

SEQ ID NO: 2135301 - DNA, 22 bp, Homo sapiens
tttttcttgagtactagaattt

SEQ ID NO: 2135302 - DNA, 13 bp, Homo sapiens
tttttctttataa

SEQ ID NO: 2135303 - DNA, 16 bp, Homo sapiens
tttttctttataaact

SEQ ID NO: 2135304 - DNA, 23 bp, Homo sapiens
tttttgaataaaaaacatttgta

SEQ ID NO: 2135305 - DNA, 13 bp, Homo sapiens
tttttgatactaa

SEQ ID NO: 2135306 - DNA, 14 bp, Homo sapiens
tttttgatagcttt

SEQ ID NO: 2135307 - DNA, 16 bp, Homo sapiens
tttttggtgtatttga

SEQ ID NO: 2135308 - DNA, 18 bp, Homo sapiens
tttttgtaacttcaaata

SEQ ID NO: 2135309 - DNA, 19 bp, Homo sapiens
tttttgtagagccagggtc

SEQ ID NO: 2135310 - DNA, 20 bp, Homo sapiens
tttttgtgaaaatgtcaaag

SEQ ID NO: 2135311 - DNA, 14 bp, Homo sapiens
tttttgtgaaattc

SEQ ID NO: 2135312 - DNA, 13 bp, Homo sapiens
ttttttaaaaaag

SEQ ID NO: 2135313 - DNA, 13 bp, Homo sapiens
ttttttaaaagaa

SEQ ID NO: 2135314 - DNA, 17 bp, Homo sapiens
ttttttaagtatttata

SEQ ID NO: 2135315 - DNA, 18 bp, Homo sapiens
ttttttcaatatttatta

SEQ ID NO: 2135316 - DNA, 12 bp, Homo sapiens
ttttttgaaaac

SEQ ID NO: 2135317 - DNA, 13 bp, Homo sapiens
ttttttgtaactt

SEQ ID NO: 2135318 - DNA, 13 bp, Homo sapiens
tttttttgctggt

SEQ ID NO: 2135319 - DNA, 12 bp, Homo sapiens
aaaaaaaataca

SEQ ID NO: 2135320 - DNA, 11 bp, Homo sapiens
aaaaaaaatgg

SEQ ID NO: 2135321 - DNA, 11 bp, Homo sapiens
aaaaaaagaaa

SEQ ID NO: 2135322 - DNA, 10 bp, Homo sapiens
aaaaaaagag

SEQ ID NO: 2135323 - DNA, 21 bp, Homo sapiens
aaaaaagagaaaaaccaatga

SEQ ID NO: 2135324 - DNA, 12 bp, Homo sapiens
aaaaaagccttt

SEQ ID NO: 2135325 - DNA, 17 bp, Homo sapiens
aaaaaatacaccacgaa

SEQ ID NO: 2135326 - DNA, 12 bp, Homo sapiens
aaaaaatacagt

SEQ ID NO: 2135327 - DNA, 12 bp, Homo sapiens
aaaaaattgcac

SEQ ID NO: 2135328 - DNA, 15 bp, Homo sapiens
aaaaaattgcacaat

SEQ ID NO: 2135329 - DNA, 18 bp, Homo sapiens
aaaaacacggcagctgta

SEQ ID NO: 2135330 - DNA, 13 bp, Homo sapiens
aaaaacatttgta

SEQ ID NO: 2135331 - DNA, 16 bp, Homo sapiens
aaaaaccaatcatttt

SEQ ID NO: 2135332 - DNA, 17 bp, Homo sapiens
aaaaaccaatgattcat

SEQ ID NO: 2135333 - DNA, 22 bp, Homo sapiens
aaaaaccagaatcataattttc

SEQ ID NO: 2135334 - DNA, 15 bp, Homo sapiens
aaaaactgagtgact

SEQ ID NO: 2135335 - DNA, 14 bp, Homo sapiens
aaaaagaaaagata

SEQ ID NO: 2135336 - DNA, 15 bp, Homo sapiens
aaaaagaaaggaggg

SEQ ID NO: 2135337 - DNA, 14 bp, Homo sapiens
aaaaagaagtaggg

SEQ ID NO: 2135338 - DNA, 17 bp, Homo sapiens
aaaaagcatgactattt

SEQ ID NO: 2135339 - DNA, 19 bp, Homo sapiens
aaaaagctcaatgcattgt

SEQ ID NO: 2135340 - DNA, 12 bp, Homo sapiens
aaaaagcttaaa

SEQ ID NO: 2135341 - DNA, 20 bp, Homo sapiens
aaaaagcttaaaactttgaa

SEQ ID NO: 2135342 - DNA, 23 bp, Homo sapiens
aaaaaggctggctgaaaatcact

SEQ ID NO: 2135343 - DNA, 21 bp, Homo sapiens
aaaaagggatccgtacattca

SEQ ID NO: 2135344 - DNA, 17 bp, Homo sapiens
aaaaaggtgtgtcaaag

SEQ ID NO: 2135345 - DNA, 21 bp, Homo sapiens
aaaaagtaagtaccactcagg

SEQ ID NO: 2135346 - DNA, 21 bp, Homo sapiens
aaaaagtaattgtagatggaa

SEQ ID NO: 2135347 - DNA, 17 bp, Homo sapiens
aaaaagtatatattcta

SEQ ID NO: 2135348 - DNA, 15 bp, Homo sapiens
aaaaagttgcacatt

SEQ ID NO: 2135349 - DNA, 17 bp, Homo sapiens
aaaaagtttacaagtgt

SEQ ID NO: 2135350 - DNA, 15 bp, Homo sapiens
aaaaataaactagtt

SEQ ID NO: 2135351 - DNA, 19 bp, Homo sapiens
aaaaataaactagtttcca

SEQ ID NO: 2135352 - DNA, 21 bp, Homo sapiens
aaaaataaactagtttccagt

SEQ ID NO: 2135353 - DNA, 13 bp, Homo sapiens
aaaatacaaacaa

SEQ ID NO: 2135354 - DNA, 11 bp, Homo sapiens
aaaatacaact

SEQ ID NO: 2135355 - DNA, 16 bp, Homo sapiens
aaaatacaactagaga

SEQ ID NO: 2135356 - DNA, 14 bp, Homo sapiens
aaaatacagtaaag

SEQ ID NO: 2135357 - DNA, 22 bp, Homo sapiens
aaaatacagtaaagtttaaaaa

SEQ ID NO: 2135358 - DNA, 12 bp, Homo sapiens
aaaatacatttt

SEQ ID NO: 2135359 - DNA, 13 bp, Homo sapiens
aaaatagcttgta

SEQ ID NO: 2135360 - DNA, 21 bp, Homo sapiens
aaaatagcttgtatagtgtaa

SEQ ID NO: 2135361 - DNA, 18 bp, Homo sapiens
aaaatagtaaatgctttg

SEQ ID NO: 2135362 - DNA, 15 bp, Homo sapiens
aaaatagtagaacaa

SEQ ID NO: 2135363 - DNA, 18 bp, Homo sapiens
aaaatagtattgaaagtg

SEQ ID NO: 2135364 - DNA, 18 bp, Homo sapiens
aaaatataaattaagact

SEQ ID NO: 2135365 - DNA, 10 bp, Homo sapiens
aaaatatata

SEQ ID NO: 2135366 - DNA, 14 bp, Homo sapiens
aaaatatatataaa

SEQ ID NO: 2135367 - DNA, 16 bp, Homo sapiens
aaaatatatataaata

SEQ ID NO: 2135368 - DNA, 21 bp, Homo sapiens
aaaatatatataaatatatat

SEQ ID NO: 2135369 - DNA, 22 bp, Homo sapiens
aaaatatatataaatatatatt

SEQ ID NO: 2135370 - DNA, 23 bp, Homo sapiens
aaaatatatataaatatatattt

SEQ ID NO: 2135371 - DNA, 13 bp, Homo sapiens
aaaatatatatag

SEQ ID NO: 2135372 - DNA, 13 bp, Homo sapiens
aaaatatatatat

SEQ ID NO: 2135373 - DNA, 13 bp, Homo sapiens
aaaatatatatct

SEQ ID NO: 2135374 - DNA, 14 bp, Homo sapiens
aaaatatatatcta

SEQ ID NO: 2135375 - DNA, 21 bp, Homo sapiens
aaaatatatttaatacctttg

SEQ ID NO: 2135376 - DNA, 13 bp, Homo sapiens
aaaatatgatatt

SEQ ID NO: 2135377 - DNA, 21 bp, Homo sapiens
aaaatatggaacttctaatat

SEQ ID NO: 2135378 - DNA, 12 bp, Homo sapiens
aaaatatgtatg

SEQ ID NO: 2135379 - DNA, 17 bp, Homo sapiens
aaaatattctgtaagaa

SEQ ID NO: 2135380 - DNA, 13 bp, Homo sapiens
aaaatattttata

SEQ ID NO: 2135381 - DNA, 15 bp, Homo sapiens
aaaatcaaaacaaaa

SEQ ID NO: 2135382 - DNA, 19 bp, Homo sapiens
aaaatcacaagcaataatt

SEQ ID NO: 2135383 - DNA, 20 bp, Homo sapiens
aaaatcacaagcaataatta

SEQ ID NO: 2135384 - DNA, 21 bp, Homo sapiens
aaaatcacaagcaataattag

SEQ ID NO: 2135385 - DNA, 11 bp, Homo sapiens
aaaatcaggat

SEQ ID NO: 2135386 - DNA, 13 bp, Homo sapiens
aaaatcataaact

SEQ ID NO: 2135387 - DNA, 19 bp, Homo sapiens
aaaatcatgaaaagaggaa

SEQ ID NO: 2135388 - DNA, 11 bp, Homo sapiens
aaaatcatttc

SEQ ID NO: 2135389 - DNA, 12 bp, Homo sapiens
aaaatcatttct

SEQ ID NO: 2135390 - DNA, 14 bp, Homo sapiens
aaaatccctattta

SEQ ID NO: 2135391 - DNA, 22 bp, Homo sapiens
aaaatccctatttaattttcct

SEQ ID NO: 2135392 - DNA, 23 bp, Homo sapiens
aaaatctaatattaaaaatatgg

SEQ ID NO: 2135393 - DNA, 14 bp, Homo sapiens
aaaatctgatttaa

SEQ ID NO: 2135394 - DNA, 20 bp, Homo sapiens
aaaatctgatttaatgtttt

SEQ ID NO: 2135395 - DNA, 22 bp, Homo sapiens
aaaatctgatttaatgttttct

SEQ ID NO: 2135396 - DNA, 14 bp, Homo sapiens
aaaatctggaaatc

SEQ ID NO: 2135397 - DNA, 16 bp, Homo sapiens
aaaatctggaaatctg

SEQ ID NO: 2135398 - DNA, 17 bp, Homo sapiens
aaaatctggaaatctgt

SEQ ID NO: 2135399 - DNA, 17 bp, Homo sapiens
aaaatcttggcacagaa

SEQ ID NO: 2135400 - DNA, 12 bp, Homo sapiens
aaaatctttcag

SEQ ID NO: 2135401 - DNA, 22 bp, Homo sapiens
aaaatgaaagcatgtctcaata

SEQ ID NO: 2135402 - DNA, 21 bp, Homo sapiens
aaaatgaaagccaaatttata

SEQ ID NO: 2135403 - DNA, 15 bp, Homo sapiens
aaaatgacagatgtt

SEQ ID NO: 2135404 - DNA, 23 bp, Homo sapiens
aaaatgagtttttatggggctga

SEQ ID NO: 2135405 - DNA, 19 bp, Homo sapiens
aaaatgattgtaaaatagc

SEQ ID NO: 2135406 - DNA, 16 bp, Homo sapiens
aaaatgcagtccagaa

SEQ ID NO: 2135407 - DNA, 21 bp, Homo sapiens
aaaatgcagtccagaataagt

SEQ ID NO: 2135408 - DNA, 16 bp, Homo sapiens
aaaatgcttctgttgt

SEQ ID NO: 2135409 - DNA, 13 bp, Homo sapiens
aaaatggaaagaa

SEQ ID NO: 2135410 - DNA, 20 bp, Homo sapiens
aaaatgttcccttgaccatt

SEQ ID NO: 2135411 - DNA, 14 bp, Homo sapiens
aaaattaacactgc

SEQ ID NO: 2135412 - DNA, 20 bp, Homo sapiens
aaaattaagacaagcctggc

SEQ ID NO: 2135413 - DNA, 19 bp, Homo sapiens
aaaattacactacaagttt

SEQ ID NO: 2135414 - DNA, 23 bp, Homo sapiens
aaaattacttctctctatctgga

SEQ ID NO: 2135415 - DNA, 14 bp, Homo sapiens
aaaattagaaattg

SEQ ID NO: 2135416 - DNA, 12 bp, Homo sapiens
aaaattagtaat

SEQ ID NO: 2135417 - DNA, 22 bp, Homo sapiens
aaaattagtgagatttgtattt

SEQ ID NO: 2135418 - DNA, 13 bp, Homo sapiens
aaaattatttaaa

SEQ ID NO: 2135419 - DNA, 17 bp, Homo sapiens
aaaattattttaaacaa

SEQ ID NO: 2135420 - DNA, 17 bp, Homo sapiens
aaaattcaaaaagtgtt

SEQ ID NO: 2135421 - DNA, 22 bp, Homo sapiens
aaaattgaagagagatatatct

SEQ ID NO: 2135422 - DNA, 23 bp, Homo sapiens
aaaattgatatacttttttctta

SEQ ID NO: 2135423 - DNA, 12 bp, Homo sapiens
aaaattgcacaa

SEQ ID NO: 2135424 - DNA, 21 bp, Homo sapiens
aaaattgctagtgatttcatt

SEQ ID NO: 2135425 - DNA, 20 bp, Homo sapiens
aaaattggtaattgaatgga

SEQ ID NO: 2135426 - DNA, 15 bp, Homo sapiens
aaaattgtaaaattg

SEQ ID NO: 2135427 - DNA, 16 bp, Homo sapiens
aaaattgtatagagat

SEQ ID NO: 2135428 - DNA, 21 bp, Homo sapiens
aaaattgtcaaatgtcattat

SEQ ID NO: 2135429 - DNA, 22 bp, Homo sapiens
aaaattgtgatgttttgttcaa

SEQ ID NO: 2135430 - DNA, 23 bp, Homo sapiens
aaaattgtgatgttttgttcaaa

SEQ ID NO: 2135431 - DNA, 13 bp, Homo sapiens
aaaattgtgttta

SEQ ID NO: 2135432 - DNA, 19 bp, Homo sapiens
aaaattgtgtttagatttt

SEQ ID NO: 2135433 - DNA, 16 bp, Homo sapiens
aaaatttcaaaagtga

SEQ ID NO: 2135434 - DNA, 18 bp, Homo sapiens
aaaatttcaaaagtgatc

SEQ ID NO: 2135435 - DNA, 20 bp, Homo sapiens
aaaatttcacattaatattt

SEQ ID NO: 2135436 - DNA, 16 bp, Homo sapiens
aaaatttgttttgacg

SEQ ID NO: 2135437 - DNA, 22 bp, Homo sapiens
aaaatttgttttgacggatgat

SEQ ID NO: 2135438 - DNA, 19 bp, Homo sapiens
aaaattttacttttgttct

SEQ ID NO: 2135439 - DNA, 16 bp, Homo sapiens
aaaattttcaaacttt

SEQ ID NO: 2135440 - DNA, 19 bp, Homo sapiens
aaaattttcaaactttgta

SEQ ID NO: 2135441 - DNA, 12 bp, Homo sapiens
aaacaaaaagac

SEQ ID NO: 2135442 - DNA, 14 bp, Homo sapiens
aaacaaaatatctg

SEQ ID NO: 2135443 - DNA, 18 bp, Homo sapiens
aaacaaagagttcaagaa

SEQ ID NO: 2135444 - DNA, 17 bp, Homo sapiens
aaacaaccatcctgctc

SEQ ID NO: 2135445 - DNA, 19 bp, Homo sapiens
aaacaagacacccaagtcc

SEQ ID NO: 2135446 - DNA, 19 bp, Homo sapiens
aaacaaggcttaaaagagt

SEQ ID NO: 2135447 - DNA, 16 bp, Homo sapiens
aaacaaggttttcagt

SEQ ID NO: 2135448 - DNA, 20 bp, Homo sapiens
aaacacaaatgtaaaataag

SEQ ID NO: 2135449 - DNA, 14 bp, Homo sapiens
aaacacaatatttt

SEQ ID NO: 2135450 - DNA, 16 bp, Homo sapiens
aaacacaccgatgcac

SEQ ID NO: 2135451 - DNA, 22 bp, Homo sapiens
aaacacactgtaaatatccaca

SEQ ID NO: 2135452 - DNA, 12 bp, Homo sapiens
aaacacagcaag

SEQ ID NO: 2135453 - DNA, 14 bp, Homo sapiens
aaacacagcaaggg

SEQ ID NO: 2135454 - DNA, 17 bp, Homo sapiens
aaacacagggttttgta

SEQ ID NO: 2135455 - DNA, 20 bp, Homo sapiens
aaacaccaccaaatgacaag

SEQ ID NO: 2135456 - DNA, 14 bp, Homo sapiens
aaacacctcccagg

SEQ ID NO: 2135457 - DNA, 11 bp, Homo sapiens
aaacactccac

SEQ ID NO: 2135458 - DNA, 15 bp, Homo sapiens
aaacactgtaatctt

SEQ ID NO: 2135459 - DNA, 21 bp, Homo sapiens
aaacactgtaatcttaaaagt

SEQ ID NO: 2135460 - DNA, 18 bp, Homo sapiens
aaacacttctcatcatat

SEQ ID NO: 2135461 - DNA, 22 bp, Homo sapiens
aaacagacaaaaacagcctcac

SEQ ID NO: 2135462 - DNA, 17 bp, Homo sapiens
aaacagagaaccctgtg

SEQ ID NO: 2135463 - DNA, 16 bp, Homo sapiens
aaacagagacaggccc

SEQ ID NO: 2135464 - DNA, 22 bp, Homo sapiens
aaacagagacaggcccaagaga

SEQ ID NO: 2135465 - DNA, 18 bp, Homo sapiens
aaacagagagagacagag

SEQ ID NO: 2135466 - DNA, 12 bp, Homo sapiens
aaacagagggcc

SEQ ID NO: 2135467 - DNA, 18 bp, Homo sapiens
aaacagcatttattacct

SEQ ID NO: 2135468 - DNA, 17 bp, Homo sapiens
aaatacaaaataaaatt

SEQ ID NO: 2135469 - DNA, 17 bp, Homo sapiens
aaatacacaagtaaaca

SEQ ID NO: 2135470 - DNA, 21 bp, Homo sapiens
aaatacaccacgaatttggtg

SEQ ID NO: 2135471 - DNA, 17 bp, Homo sapiens
aaatacagacactaagt

SEQ ID NO: 2135472 - DNA, 18 bp, Homo sapiens
aaatacatgctaagagaa

SEQ ID NO: 2135473 - DNA, 12 bp, Homo sapiens
aaatacatgtgt

SEQ ID NO: 2135474 - DNA, 17 bp, Homo sapiens
aaataccagtgtggttt

SEQ ID NO: 2135475 - DNA, 21 bp, Homo sapiens
aaataccatgccatttaaagc

SEQ ID NO: 2135476 - DNA, 23 bp, Homo sapiens
aaatactatgaaatgaaagaact

SEQ ID NO: 2135477 - DNA, 18 bp, Homo sapiens
aaatactgcctagaaaat

SEQ ID NO: 2135478 - DNA, 23 bp, Homo sapiens
aaatactgctctgaatattttgt

SEQ ID NO: 2135479 - DNA, 16 bp, Homo sapiens
aaatactgtacataga

SEQ ID NO: 2135480 - DNA, 20 bp, Homo sapiens
aaatacttgagctgtatata

SEQ ID NO: 2135481 - DNA, 21 bp, Homo sapiens
aaatagaatgttactttggaa

SEQ ID NO: 2135482 - DNA, 19 bp, Homo sapiens
aaatagagattaattttaa

SEQ ID NO: 2135483 - DNA, 20 bp, Homo sapiens
aaatagagattaattttaac

SEQ ID NO: 2135484 - DNA, 21 bp, Homo sapiens
aaatagatcctaggtgctgga

SEQ ID NO: 2135485 - DNA, 20 bp, Homo sapiens
aaatagatggatttgtatca

SEQ ID NO: 2135486 - DNA, 16 bp, Homo sapiens
aaatagcaaaagaaga

SEQ ID NO: 2135487 - DNA, 21 bp, Homo sapiens
aaatagccacttaccttcaat

SEQ ID NO: 2135488 - DNA, 23 bp, Homo sapiens
aaatagccacttaccttcaataa

SEQ ID NO: 2135489 - DNA, 24 bp, Homo sapiens
aaatagctcaggtgtccctgcact

SEQ ID NO: 2135490 - DNA, 19 bp, Homo sapiens
aaatagctccgtggagcag

SEQ ID NO: 2135491 - DNA, 20 bp, Homo sapiens
aaatagtaggaccaatgttg

SEQ ID NO: 2135492 - DNA, 12 bp, Homo sapiens
aaatagtatttc

SEQ ID NO: 2135493 - DNA, 15 bp, Homo sapiens
aaatagtgttctttt

SEQ ID NO: 2135494 - DNA, 23 bp, Homo sapiens
aaatagttttaaatatgaacaaa

SEQ ID NO: 2135495 - DNA, 11 bp, Homo sapiens
aaatataaact

SEQ ID NO: 2135496 - DNA, 13 bp, Homo sapiens
aaatataaatgca

SEQ ID NO: 2135497 - DNA, 20 bp, Homo sapiens
aaatataaattaagacttta

SEQ ID NO: 2135498 - DNA, 19 bp, Homo sapiens
aaatataagctgggaaaaa

SEQ ID NO: 2135499 - DNA, 22 bp, Homo sapiens
aaatataattgggattttaaaa

SEQ ID NO: 2135500 - DNA, 13 bp, Homo sapiens
aaatatagtagca

SEQ ID NO: 2135501 - DNA, 16 bp, Homo sapiens
aaatatatataaatat

SEQ ID NO: 2135502 - DNA, 18 bp, Homo sapiens
aaatatatataaatatat

SEQ ID NO: 2135503 - DNA, 13 bp, Homo sapiens
aaatatatatata

SEQ ID NO: 2135504 - DNA, 22 bp, Homo sapiens
aaatatatatctatctatttga

SEQ ID NO: 2135505 - DNA, 15 bp, Homo sapiens
aaatatatattgtat

SEQ ID NO: 2135506 - DNA, 16 bp, Homo sapiens
aaatatattttatgat

SEQ ID NO: 2135507 - DNA, 21 bp, Homo sapiens
aaatatattttatgatttaaa

SEQ ID NO: 2135508 - DNA, 22 bp, Homo sapiens
aaatatattttatgatttaaaa

SEQ ID NO: 2135509 - DNA, 15 bp, Homo sapiens
aaatatcagactagt

SEQ ID NO: 2135510 - DNA, 20 bp, Homo sapiens
aaatatcagttactcagccc

SEQ ID NO: 2135511 - DNA, 18 bp, Homo sapiens
aaatatccaccactttaa

SEQ ID NO: 2135512 - DNA, 15 bp, Homo sapiens
aaatatcttgaaagg

SEQ ID NO: 2135513 - DNA, 13 bp, Homo sapiens
aaatatgaaatga

SEQ ID NO: 2135514 - DNA, 24 bp, Homo sapiens
aaatatgaaatgataaagatgtca

SEQ ID NO: 2135515 - DNA, 13 bp, Homo sapiens
aaatatgaacaaa

SEQ ID NO: 2135516 - DNA, 17 bp, Homo sapiens
aaatatggaacttctaa

SEQ ID NO: 2135517 - DNA, 18 bp, Homo sapiens
aaatatggaacttctaat

SEQ ID NO: 2135518 - DNA, 20 bp, Homo sapiens
aaatatggaacttctaatat

SEQ ID NO: 2135519 - DNA, 15 bp, Homo sapiens
aaatattagcaaaga

SEQ ID NO: 2135520 - DNA, 20 bp, Homo sapiens
aaatattgttaccatgaaga

SEQ ID NO: 2135521 - DNA, 20 bp, Homo sapiens
aaatatttaagtatatagta

SEQ ID NO: 2135522 - DNA, 15 bp, Homo sapiens
aaatatttacatatg

SEQ ID NO: 2135523 - DNA, 13 bp, Homo sapiens
aaatatttatgct

SEQ ID NO: 2135524 - DNA, 23 bp, Homo sapiens
aaatatttatgcttaaaatatgt

SEQ ID NO: 2135525 - DNA, 16 bp, Homo sapiens
aaatatttgcttattt

SEQ ID NO: 2135526 - DNA, 21 bp, Homo sapiens
aaatatttggtctctatttca

SEQ ID NO: 2135527 - DNA, 14 bp, Homo sapiens
aaatatttgtacat

SEQ ID NO: 2135528 - DNA, 22 bp, Homo sapiens
aaatatttgtacatagttattt

SEQ ID NO: 2135529 - DNA, 17 bp, Homo sapiens
aaatattttaaagaatt

SEQ ID NO: 2135530 - DNA, 12 bp, Homo sapiens
aaatattttagc

SEQ ID NO: 2135531 - DNA, 16 bp, Homo sapiens
aaatcaaaagctgctt

SEQ ID NO: 2135532 - DNA, 12 bp, Homo sapiens
aaatcaaatatg

SEQ ID NO: 2135533 - DNA, 14 bp, Homo sapiens
aaatcaaatatgca

SEQ ID NO: 2135534 - DNA, 18 bp, Homo sapiens
aaatcaaatatgcaaagc

SEQ ID NO: 2135535 - DNA, 17 bp, Homo sapiens
aaatcaactccagctcc

SEQ ID NO: 2135536 - DNA, 19 bp, Homo sapiens
aaatcaacttgtgtactga

SEQ ID NO: 2135537 - DNA, 16 bp, Homo sapiens
aaatcacacctctggg

SEQ ID NO: 2135538 - DNA, 22 bp, Homo sapiens
aaatcaccacaccaaacctctc

SEQ ID NO: 2135539 - DNA, 23 bp, Homo sapiens
aaatcaccatgtaacaaccagag

SEQ ID NO: 2135540 - DNA, 18 bp, Homo sapiens
aaatcactatctttctga

SEQ ID NO: 2135541 - DNA, 12 bp, Homo sapiens
aaatcacttgta

SEQ ID NO: 2135542 - DNA, 15 bp, Homo sapiens
aaatcacttgtaaat

SEQ ID NO: 2135543 - DNA, 19 bp, Homo sapiens
aaatcattaatactcttct

SEQ ID NO: 2135544 - DNA, 15 bp, Homo sapiens
aaatcattgtagaaa

SEQ ID NO: 2135545 - DNA, 14 bp, Homo sapiens
aaatcattttgcaa

SEQ ID NO: 2135546 - DNA, 20 bp, Homo sapiens
aaatccagtgtgcacccctc

SEQ ID NO: 2135547 - DNA, 16 bp, Homo sapiens
aaatccttatttatat

SEQ ID NO: 2135548 - DNA, 17 bp, Homo sapiens
aaatcctttttctttat

SEQ ID NO: 2135549 - DNA, 17 bp, Homo sapiens
aaatctaatattaaaaa

SEQ ID NO: 2135550 - DNA, 19 bp, Homo sapiens
aaatctaatattaaaaata

SEQ ID NO: 2135551 - DNA, 21 bp, Homo sapiens
aaatctaatcaggttgttaat

SEQ ID NO: 2135552 - DNA, 21 bp, Homo sapiens
aaatctagatcaattaattct

SEQ ID NO: 2135553 - DNA, 18 bp, Homo sapiens
aaatctatattaaagtgt

SEQ ID NO: 2135554 - DNA, 19 bp, Homo sapiens
aaatctatattaaagtgtt

SEQ ID NO: 2135555 - DNA, 19 bp, Homo sapiens
aaatctattcagacaagca

SEQ ID NO: 2135556 - DNA, 22 bp, Homo sapiens
aaatctcagaattccttttcta

SEQ ID NO: 2135557 - DNA, 23 bp, Homo sapiens
aaatctcatactcccccacagtt

SEQ ID NO: 2135558 - DNA, 23 bp, Homo sapiens
aaatctgagatctccctccaggg

SEQ ID NO: 2135559 - DNA, 21 bp, Homo sapiens
aaatctgagcctaaatctaat

SEQ ID NO: 2135560 - DNA, 13 bp, Homo sapiens
aaatctggaaatc

SEQ ID NO: 2135561 - DNA, 15 bp, Homo sapiens
aaatctggaaatctg

SEQ ID NO: 2135562 - DNA, 16 bp, Homo sapiens
aaatctggaaatctgt

SEQ ID NO: 2135563 - DNA, 16 bp, Homo sapiens
aaatctgtatatgttg

SEQ ID NO: 2135564 - DNA, 19 bp, Homo sapiens
aaatctgtatatgttgtaa

SEQ ID NO: 2135565 - DNA, 18 bp, Homo sapiens
aaatctgtttgatccctg

SEQ ID NO: 2135566 - DNA, 14 bp, Homo sapiens
aaatcttaacttga

SEQ ID NO: 2135567 - DNA, 23 bp, Homo sapiens
aaatctttttttaatggaatgtg

SEQ ID NO: 2135568 - DNA, 18 bp, Homo sapiens
aaatgaaagcatgtctca

SEQ ID NO: 2135569 - DNA, 20 bp, Homo sapiens
aaatgaaagccaaatttata

SEQ ID NO: 2135570 - DNA, 12 bp, Homo sapiens
aaatgaaattgt

SEQ ID NO: 2135571 - DNA, 22 bp, Homo sapiens
aaatgaacgatatgtagcagaa

SEQ ID NO: 2135572 - DNA, 14 bp, Homo sapiens
aaatgaagaaaaag

SEQ ID NO: 2135573 - DNA, 22 bp, Homo sapiens
aaatgaaggttaggatttaaca

SEQ ID NO: 2135574 - DNA, 14 bp, Homo sapiens
aaatgaatagagag

SEQ ID NO: 2135575 - DNA, 19 bp, Homo sapiens
aaatgacatgcactgaccc

SEQ ID NO: 2135576 - DNA, 14 bp, Homo sapiens
aaatgacatttttg

SEQ ID NO: 2135577 - DNA, 14 bp, Homo sapiens
aaatgacccaaaga

SEQ ID NO: 2135578 - DNA, 16 bp, Homo sapiens
aaatgacccaaagacc

SEQ ID NO: 2135579 - DNA, 17 bp, Homo sapiens
aaatgacccaaagacca

SEQ ID NO: 2135580 - DNA, 17 bp, Homo sapiens
aaatgactaaaaatatt

SEQ ID NO: 2135581 - DNA, 15 bp, Homo sapiens
aaatgagcattagct

SEQ ID NO: 2135582 - DNA, 14 bp, Homo sapiens
aaccagtgtagcct

SEQ ID NO: 2135583 - DNA, 18 bp, Homo sapiens
aaccataacaacttcata

SEQ ID NO: 2135584 - DNA, 22 bp, Homo sapiens
aaccatagcacaggctaatttt

SEQ ID NO: 2135585 - DNA, 19 bp, Homo sapiens
aaccatcagttactggttt

SEQ ID NO: 2135586 - DNA, 22 bp, Homo sapiens
aaccatgagaccactgttatca

SEQ ID NO: 2135587 - DNA, 15 bp, Homo sapiens
aaccattacatgttt

SEQ ID NO: 2135588 - DNA, 14 bp, Homo sapiens
aaccatttaattca

SEQ ID NO: 2135589 - DNA, 16 bp, Homo sapiens
aaccatttaattcata

SEQ ID NO: 2135590 - DNA, 17 bp, Homo sapiens
aaccatttaattcataa

SEQ ID NO: 2135591 - DNA, 22 bp, Homo sapiens
aaccatttaattcataattaga

SEQ ID NO: 2135592 - DNA, 21 bp, Homo sapiens
aaccattttagttcctttatt

SEQ ID NO: 2135593 - DNA, 16 bp, Homo sapiens
aacccaaataaatgtg

SEQ ID NO: 2135594 - DNA, 16 bp, Homo sapiens
aacccaagtgggggca

SEQ ID NO: 2135595 - DNA, 13 bp, Homo sapiens
aacccactgtgct

SEQ ID NO: 2135596 - DNA, 12 bp, Homo sapiens
aacccagagagg

SEQ ID NO: 2135597 - DNA, 15 bp, Homo sapiens
aacccagcatgtaca

SEQ ID NO: 2135598 - DNA, 16 bp, Homo sapiens
aacccagcatgtacaa

SEQ ID NO: 2135599 - DNA, 20 bp, Homo sapiens
aacccagcatgtacaaaagt

SEQ ID NO: 2135600 - DNA, 16 bp, Homo sapiens
aacccagccctggggt

SEQ ID NO: 2135601 - DNA, 11 bp, Homo sapiens
aacccaggagg

SEQ ID NO: 2135602 - DNA, 20 bp, Homo sapiens
aacccaggttggcgactgca

SEQ ID NO: 2135603 - DNA, 15 bp, Homo sapiens
aacccatcagaagga

SEQ ID NO: 2135604 - DNA, 17 bp, Homo sapiens
aacccatcagaaggaga

SEQ ID NO: 2135605 - DNA, 17 bp, Homo sapiens
aacccatttttgagcca

SEQ ID NO: 2135606 - DNA, 19 bp, Homo sapiens
aacccatttttgagccaag

SEQ ID NO: 2135607 - DNA, 19 bp, Homo sapiens
aaccccaccttgccaagct

SEQ ID NO: 2135608 - DNA, 14 bp, Homo sapiens
aaccccagcatcct

SEQ ID NO: 2135609 - DNA, 12 bp, Homo sapiens
aaccccagctcc

SEQ ID NO: 2135610 - DNA, 12 bp, Homo sapiens
aaccccagctgg

SEQ ID NO: 2135611 - DNA, 16 bp, Homo sapiens
aaccccagctggcctc

SEQ ID NO: 2135612 - DNA, 19 bp, Homo sapiens
aaccccagttctgctcctc

SEQ ID NO: 2135613 - DNA, 21 bp, Homo sapiens
aacccccacatttacctcgag

SEQ ID NO: 2135614 - DNA, 22 bp, Homo sapiens
aacccccaccgaagagccctga

SEQ ID NO: 2135615 - DNA, 13 bp, Homo sapiens
aacccccagcctg

SEQ ID NO: 2135616 - DNA, 19 bp, Homo sapiens
aacccccagtgccacagag

SEQ ID NO: 2135617 - DNA, 20 bp, Homo sapiens
aacccccagtgccacagaga

SEQ ID NO: 2135618 - DNA, 13 bp, Homo sapiens
aacccccatcttt

SEQ ID NO: 2135619 - DNA, 15 bp, Homo sapiens
aacccccgctccaga

SEQ ID NO: 2135620 - DNA, 16 bp, Homo sapiens
aacccccgctccagat

SEQ ID NO: 2135621 - DNA, 18 bp, Homo sapiens
aacccccgctccagatct

SEQ ID NO: 2135622 - DNA, 22 bp, Homo sapiens
aacccccgctccagatctgcac

SEQ ID NO: 2135623 - DNA, 19 bp, Homo sapiens
aaccccgcggtgctctggc

SEQ ID NO: 2135624 - DNA, 21 bp, Homo sapiens
aaccccgcggtgctctggcgg

SEQ ID NO: 2135625 - DNA, 10 bp, Homo sapiens
aacccctgtg

SEQ ID NO: 2135626 - DNA, 17 bp, Homo sapiens
aacccgtggaggctgct

SEQ ID NO: 2135627 - DNA, 19 bp, Homo sapiens
aaccctcagagccacccct

SEQ ID NO: 2135628 - DNA, 23 bp, Homo sapiens
aaccctgcccacttcagcccagc

SEQ ID NO: 2135629 - DNA, 22 bp, Homo sapiens
aaccctggcttgcttgccgagc

SEQ ID NO: 2135630 - DNA, 21 bp, Homo sapiens
aaccctgtgggggcggctgtg

SEQ ID NO: 2135631 - DNA, 23 bp, Homo sapiens
aacccttccctatagaagttcaa

SEQ ID NO: 2135632 - DNA, 14 bp, Homo sapiens
aacccttctcttct

SEQ ID NO: 2135633 - DNA, 21 bp, Homo sapiens
aacccttttcctccagacaga

SEQ ID NO: 2135634 - DNA, 23 bp, Homo sapiens
aacccttttcctccagacagata

SEQ ID NO: 2135635 - DNA, 12 bp, Homo sapiens
aaccgacttttc

SEQ ID NO: 2135636 - DNA, 20 bp, Homo sapiens
aaccgtttttcaagaaaact

SEQ ID NO: 2135637 - DNA, 22 bp, Homo sapiens
aacctaaggcaacatttccgaa

SEQ ID NO: 2135638 - DNA, 19 bp, Homo sapiens
aacctaccaccccttcctg

SEQ ID NO: 2135639 - DNA, 22 bp, Homo sapiens
aacctactagacaatgatgtga

SEQ ID NO: 2135640 - DNA, 14 bp, Homo sapiens
aacctagaagggct

SEQ ID NO: 2135641 - DNA, 13 bp, Homo sapiens
aacctagtactct

SEQ ID NO: 2135642 - DNA, 15 bp, Homo sapiens
aacctatcaatcctg

SEQ ID NO: 2135643 - DNA, 21 bp, Homo sapiens
aacctcacccgaggctgccca

SEQ ID NO: 2135644 - DNA, 18 bp, Homo sapiens
aacctcaggcttccttgg

SEQ ID NO: 2135645 - DNA, 16 bp, Homo sapiens
aacctcagtttcctca

SEQ ID NO: 2135646 - DNA, 20 bp, Homo sapiens
aacctcatcctccttcttca

SEQ ID NO: 2135647 - DNA, 18 bp, Homo sapiens
aacctcatgacagccaga

SEQ ID NO: 2135648 - DNA, 20 bp, Homo sapiens
aacctcatgacagccagagc

SEQ ID NO: 2135649 - DNA, 16 bp, Homo sapiens
aacctcatttaccata

SEQ ID NO: 2135650 - DNA, 15 bp, Homo sapiens
aacctctctaagcca

SEQ ID NO: 2135651 - DNA, 20 bp, Homo sapiens
aacctctctaagccacagct

SEQ ID NO: 2135652 - DNA, 16 bp, Homo sapiens
aacctctctccttctg

SEQ ID NO: 2135653 - DNA, 15 bp, Homo sapiens
aacctcttcctcctg

SEQ ID NO: 2135654 - DNA, 14 bp, Homo sapiens
aacctgaattattc

SEQ ID NO: 2135655 - DNA, 17 bp, Homo sapiens
aacctgatgttaaaatt

SEQ ID NO: 2135656 - DNA, 18 bp, Homo sapiens
aacctgatgttaaaattc

SEQ ID NO: 2135657 - DNA, 22 bp, Homo sapiens
aacctgcctccaagatttcaga

SEQ ID NO: 2135658 - DNA, 11 bp, Homo sapiens
aacctgctctc

SEQ ID NO: 2135659 - DNA, 19 bp, Homo sapiens
aacctggagagctagaacc

SEQ ID NO: 2135660 - DNA, 15 bp, Homo sapiens
aacctggagatgatg

SEQ ID NO: 2135661 - DNA, 16 bp, Homo sapiens
aacctggagatgatga

SEQ ID NO: 2135662 - DNA, 17 bp, Homo sapiens
aacctggagatgatgat

SEQ ID NO: 2135663 - DNA, 19 bp, Homo sapiens
aacctggagatgatgatga

SEQ ID NO: 2135664 - DNA, 10 bp, Homo sapiens
aacctggagg

SEQ ID NO: 2135665 - DNA, 20 bp, Homo sapiens
aacctggaggggctagaacc

SEQ ID NO: 2135666 - DNA, 12 bp, Homo sapiens
aacctggccttc

SEQ ID NO: 2135667 - DNA, 10 bp, Homo sapiens
aacctggctt

SEQ ID NO: 2135668 - DNA, 16 bp, Homo sapiens
aacctggtggcaccag

SEQ ID NO: 2135669 - DNA, 21 bp, Homo sapiens
aacctggtggcaccagatgca

SEQ ID NO: 2135670 - DNA, 15 bp, Homo sapiens
aacctgtacttcaag

SEQ ID NO: 2135671 - DNA, 17 bp, Homo sapiens
aacctgtccataaagta

SEQ ID NO: 2135672 - DNA, 23 bp, Homo sapiens
aacctgtgcagtcccgtggaggg

SEQ ID NO: 2135673 - DNA, 19 bp, Homo sapiens
aaccttagagcttggacag

SEQ ID NO: 2135674 - DNA, 15 bp, Homo sapiens
aaccttattgtacct

SEQ ID NO: 2135675 - DNA, 14 bp, Homo sapiens
aaccttgcagcatt

SEQ ID NO: 2135676 - DNA, 14 bp, Homo sapiens
aacctttcaaattt

SEQ ID NO: 2135677 - DNA, 18 bp, Homo sapiens
aacctttcaaatttcaca

SEQ ID NO: 2135678 - DNA, 18 bp, Homo sapiens
aacctttccccagacaca

SEQ ID NO: 2135679 - DNA, 20 bp, Homo sapiens
aacctttccccagacacatt

SEQ ID NO: 2135680 - DNA, 13 bp, Homo sapiens
aacctttccctca

SEQ ID NO: 2135681 - DNA, 14 bp, Homo sapiens
aacctttccctcac

SEQ ID NO: 2135682 - DNA, 16 bp, Homo sapiens
aacctttgtgtaataa

SEQ ID NO: 2135683 - DNA, 17 bp, Homo sapiens
aacgaacccactgtgct

SEQ ID NO: 2135684 - DNA, 17 bp, Homo sapiens
aacgactccgagaacaa

SEQ ID NO: 2135685 - DNA, 14 bp, Homo sapiens
aacgagcactggcc

SEQ ID NO: 2135686 - DNA, 16 bp, Homo sapiens
aacgagtcaatcccct

SEQ ID NO: 2135687 - DNA, 11 bp, Homo sapiens
aacgcctgagc

SEQ ID NO: 2135688 - DNA, 17 bp, Homo sapiens
aacgcctgagcccaggg

SEQ ID NO: 2135689 - DNA, 20 bp, Homo sapiens
aacgctcttagctttctcag

SEQ ID NO: 2135690 - DNA, 14 bp, Homo sapiens
aacggaagggttgg

SEQ ID NO: 2135691 - DNA, 23 bp, Homo sapiens
aacggaagggttggtgggctggc

SEQ ID NO: 2135692 - DNA, 20 bp, Homo sapiens
aacggagccccaggcctctg

SEQ ID NO: 2135693 - DNA, 14 bp, Homo sapiens
aacggctccaggat

SEQ ID NO: 2135694 - DNA, 18 bp, Homo sapiens
aacgggaaagaatataaa

SEQ ID NO: 2135695 - DNA, 15 bp, Homo sapiens
aacgggctgccctgc

SEQ ID NO: 2135696 - DNA, 17 bp, Homo sapiens
aacgggctgccctgcca

SEQ ID NO: 2135697 - DNA, 21 bp, Homo sapiens
aagcctgggggcctggctggc

SEQ ID NO: 2135698 - DNA, 23 bp, Homo sapiens
aagcctgtgaataaaaaccctgt

SEQ ID NO: 2135699 - DNA, 11 bp, Homo sapiens
aagcctgtgcc

SEQ ID NO: 2135700 - DNA, 16 bp, Homo sapiens
aagcctttttccccaa

SEQ ID NO: 2135701 - DNA, 15 bp, Homo sapiens
aagcctttttttagt

SEQ ID NO: 2135702 - DNA, 17 bp, Homo sapiens
aagcgattcttctgctt

SEQ ID NO: 2135703 - DNA, 15 bp, Homo sapiens
aagcgcagggaggat

SEQ ID NO: 2135704 - DNA, 22 bp, Homo sapiens
aagcgctcatctggcttttcgc

SEQ ID NO: 2135705 - DNA, 15 bp, Homo sapiens
aagcgtgagccactg

SEQ ID NO: 2135706 - DNA, 17 bp, Homo sapiens
aagcgtgagccactgca

SEQ ID NO: 2135707 - DNA, 22 bp, Homo sapiens
aagctaacagggaaggcaggca

SEQ ID NO: 2135708 - DNA, 17 bp, Homo sapiens
aagctacaatctgttca

SEQ ID NO: 2135709 - DNA, 17 bp, Homo sapiens
aagctagaacctggagg

SEQ ID NO: 2135710 - DNA, 19 bp, Homo sapiens
aagctagaattgagtgttt

SEQ ID NO: 2135711 - DNA, 14 bp, Homo sapiens
aagctagagatatg

SEQ ID NO: 2135712 - DNA, 22 bp, Homo sapiens
aagctaggcctggccagatgca

SEQ ID NO: 2135713 - DNA, 16 bp, Homo sapiens
aagctattgatgtttc

SEQ ID NO: 2135714 - DNA, 22 bp, Homo sapiens
aagctattgatgtttccagaaa

SEQ ID NO: 2135715 - DNA, 11 bp, Homo sapiens
aagctcacagt

SEQ ID NO: 2135716 - DNA, 15 bp, Homo sapiens
aagctcacagttcct

SEQ ID NO: 2135717 - DNA, 20 bp, Homo sapiens
aagctcacagttcctcgccc

SEQ ID NO: 2135718 - DNA, 17 bp, Homo sapiens
aagctcagctactgatt

SEQ ID NO: 2135719 - DNA, 22 bp, Homo sapiens
aagctcatattttgtatatatc

SEQ ID NO: 2135720 - DNA, 21 bp, Homo sapiens
aagctccacggtgcgtggctg

SEQ ID NO: 2135721 - DNA, 14 bp, Homo sapiens
aagctccatctcca

SEQ ID NO: 2135722 - DNA, 19 bp, Homo sapiens
aagctcccagatgctgggg

SEQ ID NO: 2135723 - DNA, 15 bp, Homo sapiens
aagctcccagggcct

SEQ ID NO: 2135724 - DNA, 19 bp, Homo sapiens
aagctcctggtcttgagat

SEQ ID NO: 2135725 - DNA, 13 bp, Homo sapiens
aagctcctgtcct

SEQ ID NO: 2135726 - DNA, 15 bp, Homo sapiens
aagctctattaagat

SEQ ID NO: 2135727 - DNA, 12 bp, Homo sapiens
aagctctgaagt

SEQ ID NO: 2135728 - DNA, 16 bp, Homo sapiens
aagctctgaagtcaca

SEQ ID NO: 2135729 - DNA, 13 bp, Homo sapiens
aagctctgctcct

SEQ ID NO: 2135730 - DNA, 14 bp, Homo sapiens
aagctgaagaaaat

SEQ ID NO: 2135731 - DNA, 12 bp, Homo sapiens
aagctgaagtga

SEQ ID NO: 2135732 - DNA, 20 bp, Homo sapiens
aagctgagaagaagctgagg

SEQ ID NO: 2135733 - DNA, 12 bp, Homo sapiens
aagctgagcagg

SEQ ID NO: 2135734 - DNA, 13 bp, Homo sapiens
aagctgagcaggc

SEQ ID NO: 2135735 - DNA, 16 bp, Homo sapiens
aagctgagcaggcccg

SEQ ID NO: 2135736 - DNA, 18 bp, Homo sapiens
aagctgaggtgcccagga

SEQ ID NO: 2135737 - DNA, 19 bp, Homo sapiens
aagctgaggtgcccaggag

SEQ ID NO: 2135738 - DNA, 20 bp, Homo sapiens
aagctgaggtgcccaggaga

SEQ ID NO: 2135739 - DNA, 17 bp, Homo sapiens
aagctgcagcttcctgt

SEQ ID NO: 2135740 - DNA, 18 bp, Homo sapiens
aagctgcagcttcctgtc

SEQ ID NO: 2135741 - DNA, 15 bp, Homo sapiens
aagctgccctgccca

SEQ ID NO: 2135742 - DNA, 14 bp, Homo sapiens
aagctgcctgtagt

SEQ ID NO: 2135743 - DNA, 16 bp, Homo sapiens
aagctgcctgtagtta

SEQ ID NO: 2135744 - DNA, 16 bp, Homo sapiens
aagctgctgacagtgt

SEQ ID NO: 2135745 - DNA, 13 bp, Homo sapiens
aagctgcttgact

SEQ ID NO: 2135746 - DNA, 20 bp, Homo sapiens
aagctggacaagaagctgct

SEQ ID NO: 2135747 - DNA, 19 bp, Homo sapiens
aagctgggcatgaacgcac

SEQ ID NO: 2135748 - DNA, 17 bp, Homo sapiens
aagctggtaaactattt

SEQ ID NO: 2135749 - DNA, 11 bp, Homo sapiens
aagctgtaccc

SEQ ID NO: 2135750 - DNA, 18 bp, Homo sapiens
aagctgtactcagagcag

SEQ ID NO: 2135751 - DNA, 22 bp, Homo sapiens
aagctgtagtagccctttctgt

SEQ ID NO: 2135752 - DNA, 12 bp, Homo sapiens
aagctgtgtcct

SEQ ID NO: 2135753 - DNA, 22 bp, Homo sapiens
aagctgtgtccttgcacctgca

SEQ ID NO: 2135754 - DNA, 17 bp, Homo sapiens
aagcttaaaactttgaa

SEQ ID NO: 2135755 - DNA, 14 bp, Homo sapiens
aagcttatttaatt

SEQ ID NO: 2135756 - DNA, 18 bp, Homo sapiens
aagcttcaaactgcatga

SEQ ID NO: 2135757 - DNA, 18 bp, Homo sapiens
aagcttcaaccctcagcc

SEQ ID NO: 2135758 - DNA, 22 bp, Homo sapiens
aagcttcaaccctcagccttga

SEQ ID NO: 2135759 - DNA, 15 bp, Homo sapiens
aagcttcagagccta

SEQ ID NO: 2135760 - DNA, 16 bp, Homo sapiens
aagcttcagagcctag

SEQ ID NO: 2135761 - DNA, 13 bp, Homo sapiens
aagcttgtgagag

SEQ ID NO: 2135762 - DNA, 19 bp, Homo sapiens
aagctttctgacaagataa

SEQ ID NO: 2135763 - DNA, 23 bp, Homo sapiens
aagctttcttctacaaccagagc

SEQ ID NO: 2135764 - DNA, 23 bp, Homo sapiens
aagctttgcttatggtaataaaa

SEQ ID NO: 2135765 - DNA, 14 bp, Homo sapiens
aaggaacaagagaa

SEQ ID NO: 2135766 - DNA, 21 bp, Homo sapiens
aaggaacactggaaaataaat

SEQ ID NO: 2135767 - DNA, 19 bp, Homo sapiens
aaggaacctaattgaaatt

SEQ ID NO: 2135768 - DNA, 22 bp, Homo sapiens
aaggaagccacagctggtggta

SEQ ID NO: 2135769 - DNA, 12 bp, Homo sapiens
aaggaaggaaag

SEQ ID NO: 2135770 - DNA, 13 bp, Homo sapiens
aaggaaggaaaga

SEQ ID NO: 2135771 - DNA, 13 bp, Homo sapiens
aaggaaggaggca

SEQ ID NO: 2135772 - DNA, 17 bp, Homo sapiens
aaggaaggttttctcca

SEQ ID NO: 2135773 - DNA, 14 bp, Homo sapiens
aaggaagtgaagag

SEQ ID NO: 2135774 - DNA, 23 bp, Homo sapiens
aaggaagttattaacgggcatgt

SEQ ID NO: 2135775 - DNA, 18 bp, Homo sapiens
aaggaatagccagagagg

SEQ ID NO: 2135776 - DNA, 21 bp, Homo sapiens
aaggaatagccagagaggagc

SEQ ID NO: 2135777 - DNA, 20 bp, Homo sapiens
aaggaatctgaaagtatatt

SEQ ID NO: 2135778 - DNA, 20 bp, Homo sapiens
aaggaattctaggcatccca

SEQ ID NO: 2135779 - DNA, 20 bp, Homo sapiens
aaggacaatgccttgggaga

SEQ ID NO: 2135780 - DNA, 22 bp, Homo sapiens
aaggaccaactggcttctgtgc

SEQ ID NO: 2135781 - DNA, 23 bp, Homo sapiens
aaggacccacccatcttcctgct

SEQ ID NO: 2135782 - DNA, 21 bp, Homo sapiens
aaggacccggaggggcctggc

SEQ ID NO: 2135783 - DNA, 15 bp, Homo sapiens
aaggaccctggctct

SEQ ID NO: 2135784 - DNA, 19 bp, Homo sapiens
aaggaccgtggccctgccc

SEQ ID NO: 2135785 - DNA, 21 bp, Homo sapiens
aaggactatgaaaagctagaa

SEQ ID NO: 2135786 - DNA, 16 bp, Homo sapiens
aaggactctggcctct

SEQ ID NO: 2135787 - DNA, 23 bp, Homo sapiens
aaggacttagctggccacagtga

SEQ ID NO: 2135788 - DNA, 19 bp, Homo sapiens
aaggagaaacagagacagg

SEQ ID NO: 2135789 - DNA, 18 bp, Homo sapiens
aaggagaaggaaaaagaa

SEQ ID NO: 2135790 - DNA, 23 bp, Homo sapiens
aaggagactcacctctgcctcaa

SEQ ID NO: 2135791 - DNA, 19 bp, Homo sapiens
aaggagctgatttccaggc

SEQ ID NO: 2135792 - DNA, 21 bp, Homo sapiens
aaggagctgatttccaggccc

SEQ ID NO: 2135793 - DNA, 24 bp, Homo sapiens
aaggagctgatttccaggcccctg

SEQ ID NO: 2135794 - DNA, 12 bp, Homo sapiens
aaggaggaaaac

SEQ ID NO: 2135795 - DNA, 18 bp, Homo sapiens
aaggaggcatgcctctga

SEQ ID NO: 2135796 - DNA, 18 bp, Homo sapiens
aaggaggtagctcccagc

SEQ ID NO: 2135797 - DNA, 16 bp, Homo sapiens
aaggatatcagagctg

SEQ ID NO: 2135798 - DNA, 22 bp, Homo sapiens
aaggatcagaacagcagaggtt

SEQ ID NO: 2135799 - DNA, 16 bp, Homo sapiens
aaggatctctcaggag

SEQ ID NO: 2135800 - DNA, 20 bp, Homo sapiens
aaggatctctcaggagcaca

SEQ ID NO: 2135801 - DNA, 22 bp, Homo sapiens
aaggatggcaagcacgggacag

SEQ ID NO: 2135802 - DNA, 18 bp, Homo sapiens
aaggatgttctggcttta

SEQ ID NO: 2135803 - DNA, 21 bp, Homo sapiens
aaggatgttctggctttacat

SEQ ID NO: 2135804 - DNA, 22 bp, Homo sapiens
aaggatgttctggctttacatt

SEQ ID NO: 2135805 - DNA, 14 bp, Homo sapiens
aaggattgtgatat

SEQ ID NO: 2135806 - DNA, 12 bp, Homo sapiens
aaggatttgttc

SEQ ID NO: 2135807 - DNA, 18 bp, Homo sapiens
aaggcaacatttccgaag

SEQ ID NO: 2135808 - DNA, 19 bp, Homo sapiens
aaggcagcaaggcccgagc

SEQ ID NO: 2135809 - DNA, 14 bp, Homo sapiens
aaggcagcattcca

SEQ ID NO: 2135810 - DNA, 18 bp, Homo sapiens
aaggcagcctccagagcc

SEQ ID NO: 2135811 - DNA, 18 bp, Homo sapiens
aatatagagatatttttg

SEQ ID NO: 2135812 - DNA, 20 bp, Homo sapiens
aatatagagatatttttgta

SEQ ID NO: 2135813 - DNA, 12 bp, Homo sapiens
aatatataaaaa

SEQ ID NO: 2135814 - DNA, 16 bp, Homo sapiens
aatatatagcttgaaa

SEQ ID NO: 2135815 - DNA, 13 bp, Homo sapiens
aatatatataaat

SEQ ID NO: 2135816 - DNA, 14 bp, Homo sapiens
aatatatataaata

SEQ ID NO: 2135817 - DNA, 20 bp, Homo sapiens
aatatatataaatatatatt

SEQ ID NO: 2135818 - DNA, 12 bp, Homo sapiens
aatatatataca

SEQ ID NO: 2135819 - DNA, 13 bp, Homo sapiens
aatatatatacat

SEQ ID NO: 2135820 - DNA, 19 bp, Homo sapiens
aatatatatacatatgtag

SEQ ID NO: 2135821 - DNA, 13 bp, Homo sapiens
aatatatatatat

SEQ ID NO: 2135822 - DNA, 20 bp, Homo sapiens
aatatatatctatctatttg

SEQ ID NO: 2135823 - DNA, 16 bp, Homo sapiens
aatatatcagaatctg

SEQ ID NO: 2135824 - DNA, 22 bp, Homo sapiens
aatatatcccagaaattagaaa

SEQ ID NO: 2135825 - DNA, 12 bp, Homo sapiens
aatatatgtctg

SEQ ID NO: 2135826 - DNA, 21 bp, Homo sapiens
aatatattgctgctggtaatt

SEQ ID NO: 2135827 - DNA, 15 bp, Homo sapiens
aatatatttaattgt

SEQ ID NO: 2135828 - DNA, 16 bp, Homo sapiens
aatatattttatgatt

SEQ ID NO: 2135829 - DNA, 21 bp, Homo sapiens
aatatcagttactcagccctg

SEQ ID NO: 2135830 - DNA, 20 bp, Homo sapiens
aatatccaccactttaacct

SEQ ID NO: 2135831 - DNA, 16 bp, Homo sapiens
aatatcctaaacatca

SEQ ID NO: 2135832 - DNA, 19 bp, Homo sapiens
aatatctacctgccctctc

SEQ ID NO: 2135833 - DNA, 14 bp, Homo sapiens
aatatctgctttaa

SEQ ID NO: 2135834 - DNA, 21 bp, Homo sapiens
aatatctgtgaggtgctgatg

SEQ ID NO: 2135835 - DNA, 17 bp, Homo sapiens
aatatcttgaagaatat

SEQ ID NO: 2135836 - DNA, 14 bp, Homo sapiens
aatatgaacaaaga

SEQ ID NO: 2135837 - DNA, 18 bp, Homo sapiens
aatatgaatacagggcat

SEQ ID NO: 2135838 - DNA, 22 bp, Homo sapiens
aatatgacagctgtccctgtca

SEQ ID NO: 2135839 - DNA, 15 bp, Homo sapiens
aatatgactcctttc

SEQ ID NO: 2135840 - DNA, 16 bp, Homo sapiens
aatatgatcatgtaaa

SEQ ID NO: 2135841 - DNA, 21 bp, Homo sapiens
aatatgattttttaaaagaaa

SEQ ID NO: 2135842 - DNA, 17 bp, Homo sapiens
aatatgcaaagcactga

SEQ ID NO: 2135843 - DNA, 21 bp, Homo sapiens
aatatgcctgctatttgaagt

SEQ ID NO: 2135844 - DNA, 14 bp, Homo sapiens
aatatgctgccaaa

SEQ ID NO: 2135845 - DNA, 19 bp, Homo sapiens
aatatgctgccaaattttg

SEQ ID NO: 2135846 - DNA, 10 bp, Homo sapiens
aatatgctta

SEQ ID NO: 2135847 - DNA, 14 bp, Homo sapiens
aatatggaacttct

SEQ ID NO: 2135848 - DNA, 18 bp, Homo sapiens
aatatggaacttctaata

SEQ ID NO: 2135849 - DNA, 18 bp, Homo sapiens
aatatgtaagtcaggagt

SEQ ID NO: 2135850 - DNA, 16 bp, Homo sapiens
aatattaaatacagac

SEQ ID NO: 2135851 - DNA, 17 bp, Homo sapiens
aatattaaatacagaca

SEQ ID NO: 2135852 - DNA, 19 bp, Homo sapiens
aatattaaatacagacact

SEQ ID NO: 2135853 - DNA, 12 bp, Homo sapiens
aatattaatccc

SEQ ID NO: 2135854 - DNA, 14 bp, Homo sapiens
aatattaccaaaaa

SEQ ID NO: 2135855 - DNA, 16 bp, Homo sapiens
aatattattcaagtgc

SEQ ID NO: 2135856 - DNA, 13 bp, Homo sapiens
aatattattgggg

SEQ ID NO: 2135857 - DNA, 22 bp, Homo sapiens
aatattgaataagtattcttca

SEQ ID NO: 2135858 - DNA, 12 bp, Homo sapiens
aatattgatttc

SEQ ID NO: 2135859 - DNA, 9 bp, Homo sapiens
aatattgtg

SEQ ID NO: 2135860 - DNA, 12 bp, Homo sapiens
aatattgttaaa

SEQ ID NO: 2135861 - DNA, 22 bp, Homo sapiens
aatattgttaaaaccttactta

SEQ ID NO: 2135862 - DNA, 19 bp, Homo sapiens
aatattgttaccatgaaga

SEQ ID NO: 2135863 - DNA, 20 bp, Homo sapiens
aatatttaaaatttattgct

SEQ ID NO: 2135864 - DNA, 16 bp, Homo sapiens
aatatttaaacagcag

SEQ ID NO: 2135865 - DNA, 19 bp, Homo sapiens
aatatttaagtatatagta

SEQ ID NO: 2135866 - DNA, 23 bp, Homo sapiens
aatatttaagtatatagtatatt

SEQ ID NO: 2135867 - DNA, 12 bp, Homo sapiens
aatatttattac

SEQ ID NO: 2135868 - DNA, 15 bp, Homo sapiens
aatatttattacctc

SEQ ID NO: 2135869 - DNA, 17 bp, Homo sapiens
aatatttattacctctg

SEQ ID NO: 2135870 - DNA, 20 bp, Homo sapiens
aatatttattattttcacct

SEQ ID NO: 2135871 - DNA, 15 bp, Homo sapiens
aatatttgcttattt

SEQ ID NO: 2135872 - DNA, 11 bp, Homo sapiens
aatattttaaa

SEQ ID NO: 2135873 - DNA, 23 bp, Homo sapiens
aatattttatatgaaatgtttca

SEQ ID NO: 2135874 - DNA, 12 bp, Homo sapiens
aatattttgtaa

SEQ ID NO: 2135875 - DNA, 12 bp, Homo sapiens
aatattttgtat

SEQ ID NO: 2135876 - DNA, 17 bp, Homo sapiens
aatcaaaaattgaagag

SEQ ID NO: 2135877 - DNA, 18 bp, Homo sapiens
aatcaaaactctcctaca

SEQ ID NO: 2135878 - DNA, 14 bp, Homo sapiens
aatcaaaagctgct

SEQ ID NO: 2135879 - DNA, 16 bp, Homo sapiens
aatcaaaagctgcttg

SEQ ID NO: 2135880 - DNA, 19 bp, Homo sapiens
aatcaaaagctgcttgact

SEQ ID NO: 2135881 - DNA, 16 bp, Homo sapiens
aatcaaagacatggaa

SEQ ID NO: 2135882 - DNA, 19 bp, Homo sapiens
aatcaaagcaagggctcca

SEQ ID NO: 2135883 - DNA, 22 bp, Homo sapiens
aatcaaatatgcaaagcactga

SEQ ID NO: 2135884 - DNA, 23 bp, Homo sapiens
aatcaaccccagactcaaactca

SEQ ID NO: 2135885 - DNA, 18 bp, Homo sapiens
aatcaagaatattcaaat

SEQ ID NO: 2135886 - DNA, 13 bp, Homo sapiens
aatcaagtattta

SEQ ID NO: 2135887 - DNA, 16 bp, Homo sapiens
aatcaatttcccagaa

SEQ ID NO: 2135888 - DNA, 18 bp, Homo sapiens
aatcacaagcaataatta

SEQ ID NO: 2135889 - DNA, 21 bp, Homo sapiens
aatcaccatgtaacaaccaga

SEQ ID NO: 2135890 - DNA, 14 bp, Homo sapiens
aatcacgctttttg

SEQ ID NO: 2135891 - DNA, 17 bp, Homo sapiens
aatcacgctttttgaaa

SEQ ID NO: 2135892 - DNA, 21 bp, Homo sapiens
aatcactataaccatcagtta

SEQ ID NO: 2135893 - DNA, 18 bp, Homo sapiens
aatcactatctttctgat

SEQ ID NO: 2135894 - DNA, 13 bp, Homo sapiens
aatcactgctccc

SEQ ID NO: 2135895 - DNA, 17 bp, Homo sapiens
aatcactgtattttcat

SEQ ID NO: 2135896 - DNA, 21 bp, Homo sapiens
aatcacttgtaaataaataga

SEQ ID NO: 2135897 - DNA, 14 bp, Homo sapiens
aatcagaagtgcaa

SEQ ID NO: 2135898 - DNA, 17 bp, Homo sapiens
aatcagaagtgcaaagg

SEQ ID NO: 2135899 - DNA, 21 bp, Homo sapiens
aatcagatagatattcctatt

SEQ ID NO: 2135900 - DNA, 12 bp, Homo sapiens
aatcagcactga

SEQ ID NO: 2135901 - DNA, 14 bp, Homo sapiens
aatcagcactgaaa

SEQ ID NO: 2135902 - DNA, 17 bp, Homo sapiens
aatcagcactgaaaata

SEQ ID NO: 2135903 - DNA, 12 bp, Homo sapiens
aatcagcattct

SEQ ID NO: 2135904 - DNA, 18 bp, Homo sapiens
aatcagcattctcactcc

SEQ ID NO: 2135905 - DNA, 19 bp, Homo sapiens
aatcagcattctcactcct

SEQ ID NO: 2135906 - DNA, 20 bp, Homo sapiens
aatcagcttttaataaaatt

SEQ ID NO: 2135907 - DNA, 18 bp, Homo sapiens
aatcaggattttagtgct

SEQ ID NO: 2135908 - DNA, 23 bp, Homo sapiens
aatcaggattttagtgcttgcca

SEQ ID NO: 2135909 - DNA, 14 bp, Homo sapiens
aatcaggcagcctt

SEQ ID NO: 2135910 - DNA, 16 bp, Homo sapiens
aatcaggtggcttttg

SEQ ID NO: 2135911 - DNA, 19 bp, Homo sapiens
aatcaggttgttaatgttg

SEQ ID NO: 2135912 - DNA, 17 bp, Homo sapiens
aatcagtctcagaatgt

SEQ ID NO: 2135913 - DNA, 17 bp, Homo sapiens
aatcagtgcagtgatac

SEQ ID NO: 2135914 - DNA, 20 bp, Homo sapiens
aatcatagctggttcacact

SEQ ID NO: 2135915 - DNA, 16 bp, Homo sapiens
aatcatcgaaaattca

SEQ ID NO: 2135916 - DNA, 23 bp, Homo sapiens
aatcatcgaaaattcatttcaca

SEQ ID NO: 2135917 - DNA, 21 bp, Homo sapiens
aatcatgaaaagaggaacagg

SEQ ID NO: 2135918 - DNA, 22 bp, Homo sapiens
aatcatgatctgactttaattg

SEQ ID NO: 2135919 - DNA, 16 bp, Homo sapiens
aatcatgtacatttct

SEQ ID NO: 2135920 - DNA, 16 bp, Homo sapiens
aatcatgtcaggcctg

SEQ ID NO: 2135921 - DNA, 15 bp, Homo sapiens
aatcattttaattat

SEQ ID NO: 2135922 - DNA, 19 bp, Homo sapiens
aatcattttaattattatt

SEQ ID NO: 2135923 - DNA, 20 bp, Homo sapiens
aatcattttaattattattc

SEQ ID NO: 2135924 - DNA, 20 bp, Homo sapiens
aatcattttacccttggctc

SEQ ID NO: 2135925 - DNA, 18 bp, Homo sapiens
aatccacaaagccgtgcc

SEQ ID NO: 2135926 - DNA, 20 bp, Homo sapiens
aatttgtaagcaacttgctt

SEQ ID NO: 2135927 - DNA, 14 bp, Homo sapiens
aatttgtaagttta

SEQ ID NO: 2135928 - DNA, 15 bp, Homo sapiens
aatttgtaattgctt

SEQ ID NO: 2135929 - DNA, 14 bp, Homo sapiens
aatttgtatatcat

SEQ ID NO: 2135930 - DNA, 14 bp, Homo sapiens
aattttaaacaaag

SEQ ID NO: 2135931 - DNA, 17 bp, Homo sapiens
aattttaaagtggttct

SEQ ID NO: 2135932 - DNA, 22 bp, Homo sapiens
aattttaaggtagaacctcacc

SEQ ID NO: 2135933 - DNA, 21 bp, Homo sapiens
aattttataagcaaatttcaa

SEQ ID NO: 2135934 - DNA, 16 bp, Homo sapiens
aattttatctcttatt

SEQ ID NO: 2135935 - DNA, 12 bp, Homo sapiens
aattttatgaat

SEQ ID NO: 2135936 - DNA, 19 bp, Homo sapiens
aattttcaggtttcttaaa

SEQ ID NO: 2135937 - DNA, 13 bp, Homo sapiens
aattttcctccta

SEQ ID NO: 2135938 - DNA, 19 bp, Homo sapiens
aattttcctcctaaacaaa

SEQ ID NO: 2135939 - DNA, 15 bp, Homo sapiens
aattttctagacttt

SEQ ID NO: 2135940 - DNA, 17 bp, Homo sapiens
aattttctagactttct

SEQ ID NO: 2135941 - DNA, 22 bp, Homo sapiens
aattttctggaatacatgaaat

SEQ ID NO: 2135942 - DNA, 21 bp, Homo sapiens
aattttctgtgttctgaagtc

SEQ ID NO: 2135943 - DNA, 20 bp, Homo sapiens
aattttcttacccatatatc

SEQ ID NO: 2135944 - DNA, 19 bp, Homo sapiens
aattttcttcatgcaatga

SEQ ID NO: 2135945 - DNA, 20 bp, Homo sapiens
aattttgcagattattttag

SEQ ID NO: 2135946 - DNA, 18 bp, Homo sapiens
aattttgcagcagaagcc

SEQ ID NO: 2135947 - DNA, 15 bp, Homo sapiens
aattttgcatttagt

SEQ ID NO: 2135948 - DNA, 22 bp, Homo sapiens
aattttggccaaagtgttaatc

SEQ ID NO: 2135949 - DNA, 16 bp, Homo sapiens
aattttgtatgaaaaa

SEQ ID NO: 2135950 - DNA, 13 bp, Homo sapiens
aattttgttgctg

SEQ ID NO: 2135951 - DNA, 21 bp, Homo sapiens
aattttgtttcagaattttgt

SEQ ID NO: 2135952 - DNA, 18 bp, Homo sapiens
aattttgtttgtaatcct

SEQ ID NO: 2135953 - DNA, 15 bp, Homo sapiens
aatttttaaacaagt

SEQ ID NO: 2135954 - DNA, 13 bp, Homo sapiens
aatttttaaacta

SEQ ID NO: 2135955 - DNA, 18 bp, Homo sapiens
aatttttaaactagtaat

SEQ ID NO: 2135956 - DNA, 19 bp, Homo sapiens
aatttttaatgacttttta

SEQ ID NO: 2135957 - DNA, 16 bp, Homo sapiens
aatttttacatgacca

SEQ ID NO: 2135958 - DNA, 14 bp, Homo sapiens
aatttttatacata

SEQ ID NO: 2135959 - DNA, 16 bp, Homo sapiens
aatttttatacatatc

SEQ ID NO: 2135960 - DNA, 19 bp, Homo sapiens
aatttttatacatatcaga

SEQ ID NO: 2135961 - DNA, 15 bp, Homo sapiens
aatttttatttttga

SEQ ID NO: 2135962 - DNA, 20 bp, Homo sapiens
aatttttcagctctctgtat

SEQ ID NO: 2135963 - DNA, 19 bp, Homo sapiens
aattttttgagtaattcta

SEQ ID NO: 2135964 - DNA, 21 bp, Homo sapiens
aattttttgatgtcagccttg

SEQ ID NO: 2135965 - DNA, 14 bp, Homo sapiens
aattttttgtatat

SEQ ID NO: 2135966 - DNA, 19 bp, Homo sapiens
aatttttttcaatatttat

SEQ ID NO: 2135967 - DNA, 18 bp, Homo sapiens
aatttttttgtattttag

SEQ ID NO: 2135968 - DNA, 15 bp, Homo sapiens
aattttttttaatgt

SEQ ID NO: 2135969 - DNA, 19 bp, Homo sapiens
aattttttttaatgtacaa

SEQ ID NO: 2135970 - DNA, 20 bp, Homo sapiens
aattttttttaatgtacaag

SEQ ID NO: 2135971 - DNA, 19 bp, Homo sapiens
aatttttttttcctagccc

SEQ ID NO: 2135972 - DNA, 15 bp, Homo sapiens
acaaaaaacttttaa

SEQ ID NO: 2135973 - DNA, 24 bp, Homo sapiens
acaaaaaacttttaatgccttcca

SEQ ID NO: 2135974 - DNA, 14 bp, Homo sapiens
acaaaaacaaaaca

SEQ ID NO: 2135975 - DNA, 16 bp, Homo sapiens
acaaaaacaaaaccag

SEQ ID NO: 2135976 - DNA, 12 bp, Homo sapiens
acaaaaataaca

SEQ ID NO: 2135977 - DNA, 22 bp, Homo sapiens
acaaaaatgaaagcatgtctca

SEQ ID NO: 2135978 - DNA, 14 bp, Homo sapiens
acaaaacaacaaca

SEQ ID NO: 2135979 - DNA, 20 bp, Homo sapiens
acaaaacaacaacaatacaa

SEQ ID NO: 2135980 - DNA, 21 bp, Homo sapiens
acaaaaccagctgctactcat

SEQ ID NO: 2135981 - DNA, 16 bp, Homo sapiens
acaaaactagagactc

SEQ ID NO: 2135982 - DNA, 17 bp, Homo sapiens
acaaaaggcagcccttt

SEQ ID NO: 2135983 - DNA, 16 bp, Homo sapiens
acaaaagtaccataga

SEQ ID NO: 2135984 - DNA, 17 bp, Homo sapiens
acaaaagtaccatagaa

SEQ ID NO: 2135985 - DNA, 12 bp, Homo sapiens
acaaaataaaca

SEQ ID NO: 2135986 - DNA, 14 bp, Homo sapiens
acaaaataaacaaa

SEQ ID NO: 2135987 - DNA, 12 bp, Homo sapiens
acaaaataacat

SEQ ID NO: 2135988 - DNA, 16 bp, Homo sapiens
acaaaataacatttga

SEQ ID NO: 2135989 - DNA, 15 bp, Homo sapiens
acaaaataatttaac

SEQ ID NO: 2135990 - DNA, 17 bp, Homo sapiens
acaaaataatttaacta

SEQ ID NO: 2135991 - DNA, 19 bp, Homo sapiens
acaaaataatttaactaat

SEQ ID NO: 2135992 - DNA, 19 bp, Homo sapiens
acaaaatactatgtgggac

SEQ ID NO: 2135993 - DNA, 18 bp, Homo sapiens
acaaaatagaagctgtag

SEQ ID NO: 2135994 - DNA, 15 bp, Homo sapiens
acaaaatatttaatt

SEQ ID NO: 2135995 - DNA, 13 bp, Homo sapiens
acaaaatgaagtt

SEQ ID NO: 2135996 - DNA, 11 bp, Homo sapiens
acaaaatgcaa

SEQ ID NO: 2135997 - DNA, 14 bp, Homo sapiens
acaaacactgaatc

SEQ ID NO: 2135998 - DNA, 15 bp, Homo sapiens
acaaacactgaatca

SEQ ID NO: 2135999 - DNA, 23 bp, Homo sapiens
acaaacactgaatcatgttaata

SEQ ID NO: 2136000 - DNA, 19 bp, Homo sapiens
acaaacatatttgttaaat

SEQ ID NO: 2136001 - DNA, 22 bp, Homo sapiens
acaaacatatttgttaaatatt

SEQ ID NO: 2136002 - DNA, 21 bp, Homo sapiens
acaaaccaccctaaaatgaca

SEQ ID NO: 2136003 - DNA, 13 bp, Homo sapiens
acaaaccactgta

SEQ ID NO: 2136004 - DNA, 14 bp, Homo sapiens
acaaaccatgcaaa

SEQ ID NO: 2136005 - DNA, 22 bp, Homo sapiens
acaaacctctatatgttgctga

SEQ ID NO: 2136006 - DNA, 14 bp, Homo sapiens
acaaacctgcttgt

SEQ ID NO: 2136007 - DNA, 21 bp, Homo sapiens
acaaactgatgcgaaaacttg

SEQ ID NO: 2136008 - DNA, 22 bp, Homo sapiens
acaaagaaatccccccttcaga

SEQ ID NO: 2136009 - DNA, 20 bp, Homo sapiens
acaaagagaaaaagaaatgc

SEQ ID NO: 2136010 - DNA, 23 bp, Homo sapiens
acaaagagaataaagacttcatg

SEQ ID NO: 2136011 - DNA, 19 bp, Homo sapiens
acaaagagttcaagaaata

SEQ ID NO: 2136012 - DNA, 22 bp, Homo sapiens
acaaagagttcaagaaataagt

SEQ ID NO: 2136013 - DNA, 21 bp, Homo sapiens
acaaagatgtttgtcagatat

SEQ ID NO: 2136014 - DNA, 14 bp, Homo sapiens
acaaagcacagtgt

SEQ ID NO: 2136015 - DNA, 15 bp, Homo sapiens
acaaagcccttttat

SEQ ID NO: 2136016 - DNA, 21 bp, Homo sapiens
acaaagcttctatcccaggag

SEQ ID NO: 2136017 - DNA, 22 bp, Homo sapiens
acaaagcttctatcccaggagg

SEQ ID NO: 2136018 - DNA, 13 bp, Homo sapiens
acaaaggggagaa

SEQ ID NO: 2136019 - DNA, 23 bp, Homo sapiens
acaaaggggagaagggccagccc

SEQ ID NO: 2136020 - DNA, 24 bp, Homo sapiens
acaaaggttgagatgtaaaaggta

SEQ ID NO: 2136021 - DNA, 14 bp, Homo sapiens
acaaagtagagaag

SEQ ID NO: 2136022 - DNA, 15 bp, Homo sapiens
acaaagtagagaagt

SEQ ID NO: 2136023 - DNA, 17 bp, Homo sapiens
acaaagtagagaagtat

SEQ ID NO: 2136024 - DNA, 16 bp, Homo sapiens
acaaataacaatgtgc

SEQ ID NO: 2136025 - DNA, 16 bp, Homo sapiens
acaaataataagcaaa

SEQ ID NO: 2136026 - DNA, 12 bp, Homo sapiens
acaaataatcac

SEQ ID NO: 2136027 - DNA, 17 bp, Homo sapiens
acaaatactcttaggaa

SEQ ID NO: 2136028 - DNA, 16 bp, Homo sapiens
acaaatatatttaatt

SEQ ID NO: 2136029 - DNA, 12 bp, Homo sapiens
acaaatatttat

SEQ ID NO: 2136030 - DNA, 13 bp, Homo sapiens
acaaatctatatt

SEQ ID NO: 2136031 - DNA, 15 bp, Homo sapiens
acaaatcttcaaggt

SEQ ID NO: 2136032 - DNA, 18 bp, Homo sapiens
acaaatcttcaaggtgta

SEQ ID NO: 2136033 - DNA, 13 bp, Homo sapiens
acaaatgtatgat

SEQ ID NO: 2136034 - DNA, 22 bp, Homo sapiens
acaaattcaaggagatataaaa

SEQ ID NO: 2136035 - DNA, 18 bp, Homo sapiens
acaaattgtaactacact

SEQ ID NO: 2136036 - DNA, 16 bp, Homo sapiens
acaaattgttcatgtt

SEQ ID NO: 2136037 - DNA, 17 bp, Homo sapiens
acaaatttaattttgca

SEQ ID NO: 2136038 - DNA, 21 bp, Homo sapiens
acaaatttttatttctaaaat

SEQ ID NO: 2136039 - DNA, 22 bp, Homo sapiens
acaacaaaccaaaacagaacaa

SEQ ID NO: 2136040 - DNA, 15 bp, Homo sapiens
acaacaacaacaata

SEQ ID NO: 2136041 - DNA, 20 bp, Homo sapiens
acagaggaatctacctgtgg

SEQ ID NO: 2136042 - DNA, 14 bp, Homo sapiens
acagaggcagcccc

SEQ ID NO: 2136043 - DNA, 15 bp, Homo sapiens
acagaggcaggagtg

SEQ ID NO: 2136044 - DNA, 17 bp, Homo sapiens
acagaggccatggcaga

SEQ ID NO: 2136045 - DNA, 21 bp, Homo sapiens
acagaggccatgggcctcctg

SEQ ID NO: 2136046 - DNA, 23 bp, Homo sapiens
acagaggccatgggcctcctgtg

SEQ ID NO: 2136047 - DNA, 23 bp, Homo sapiens
acagagggatggcgaatacctca

SEQ ID NO: 2136048 - DNA, 13 bp, Homo sapiens
acagaggggcagg

SEQ ID NO: 2136049 - DNA, 14 bp, Homo sapiens
acagaggtaactat

SEQ ID NO: 2136050 - DNA, 23 bp, Homo sapiens
acagagtacttggctgttagccc

SEQ ID NO: 2136051 - DNA, 13 bp, Homo sapiens
acagagtatatat

SEQ ID NO: 2136052 - DNA, 18 bp, Homo sapiens
acagagtatatatgtaca

SEQ ID NO: 2136053 - DNA, 20 bp, Homo sapiens
acagagtatatatgtacagt

SEQ ID NO: 2136054 - DNA, 17 bp, Homo sapiens
acagagtctcactgttg

SEQ ID NO: 2136055 - DNA, 23 bp, Homo sapiens
acagagtctcactgttgcccagg

SEQ ID NO: 2136056 - DNA, 15 bp, Homo sapiens
acagagtgagactct

SEQ ID NO: 2136057 - DNA, 21 bp, Homo sapiens
acagagtgagactctgtctca

SEQ ID NO: 2136058 - DNA, 14 bp, Homo sapiens
acagataatttatt

SEQ ID NO: 2136059 - DNA, 19 bp, Homo sapiens
acagatagacagtgctgcc

SEQ ID NO: 2136060 - DNA, 20 bp, Homo sapiens
acagatatttccatttcttc

SEQ ID NO: 2136061 - DNA, 20 bp, Homo sapiens
acagatgagattccctctcc

SEQ ID NO: 2136062 - DNA, 16 bp, Homo sapiens
acagatgcacacacag

SEQ ID NO: 2136063 - DNA, 21 bp, Homo sapiens
acagcaacaggaatctcagag

SEQ ID NO: 2136064 - DNA, 22 bp, Homo sapiens
acagcaagccggccccccctct

SEQ ID NO: 2136065 - DNA, 13 bp, Homo sapiens
acagcacccaggc

SEQ ID NO: 2136066 - DNA, 21 bp, Homo sapiens
acagcacccaggctccatggg

SEQ ID NO: 2136067 - DNA, 18 bp, Homo sapiens
acagcactacagatatca

SEQ ID NO: 2136068 - DNA, 13 bp, Homo sapiens
acagcagactcag

SEQ ID NO: 2136069 - DNA, 19 bp, Homo sapiens
acagcagactcagctctga

SEQ ID NO: 2136070 - DNA, 15 bp, Homo sapiens
acagcagaggttctt

SEQ ID NO: 2136071 - DNA, 16 bp, Homo sapiens
acagcagctcaggcac

SEQ ID NO: 2136072 - DNA, 17 bp, Homo sapiens
acagcagctcaggcaca

SEQ ID NO: 2136073 - DNA, 22 bp, Homo sapiens
acagcagggtagtctggtttct

SEQ ID NO: 2136074 - DNA, 22 bp, Homo sapiens
acagcagttgaaaagactccaa

SEQ ID NO: 2136075 - DNA, 15 bp, Homo sapiens
acagcattcctccat

SEQ ID NO: 2136076 - DNA, 16 bp, Homo sapiens
acagcattcctccatc

SEQ ID NO: 2136077 - DNA, 17 bp, Homo sapiens
acagcattcctccatct

SEQ ID NO: 2136078 - DNA, 18 bp, Homo sapiens
acagcattcctccatctt

SEQ ID NO: 2136079 - DNA, 16 bp, Homo sapiens
acagcatttattacct

SEQ ID NO: 2136080 - DNA, 23 bp, Homo sapiens
acagccaacaggtggcaggacca

SEQ ID NO: 2136081 - DNA, 16 bp, Homo sapiens
acagccacggccaggc

SEQ ID NO: 2136082 - DNA, 17 bp, Homo sapiens
acagccacggccaggcc

SEQ ID NO: 2136083 - DNA, 13 bp, Homo sapiens
acagccagaagcc

SEQ ID NO: 2136084 - DNA, 16 bp, Homo sapiens
acagcccaaagaagga

SEQ ID NO: 2136085 - DNA, 18 bp, Homo sapiens
acagcccaaagaaggaaa

SEQ ID NO: 2136086 - DNA, 19 bp, Homo sapiens
acagcccaaagaaggaaaa

SEQ ID NO: 2136087 - DNA, 13 bp, Homo sapiens
acagcccagccta

SEQ ID NO: 2136088 - DNA, 14 bp, Homo sapiens
acagccccacagca

SEQ ID NO: 2136089 - DNA, 17 bp, Homo sapiens
acagccccacagcaccc

SEQ ID NO: 2136090 - DNA, 21 bp, Homo sapiens
acagccccacagcacccaggc

SEQ ID NO: 2136091 - DNA, 13 bp, Homo sapiens
acagccccagggc

SEQ ID NO: 2136092 - DNA, 24 bp, Homo sapiens
acagccgctcctgtctgccagcca

SEQ ID NO: 2136093 - DNA, 21 bp, Homo sapiens
acagcctgacaacatttctat

SEQ ID NO: 2136094 - DNA, 15 bp, Homo sapiens
acagcctggcacagg

SEQ ID NO: 2136095 - DNA, 16 bp, Homo sapiens
acagcctggttttcac

SEQ ID NO: 2136096 - DNA, 21 bp, Homo sapiens
acagcctgtggcggtgcctgg

SEQ ID NO: 2136097 - DNA, 22 bp, Homo sapiens
acagcctgtggcggtgcctggg

SEQ ID NO: 2136098 - DNA, 19 bp, Homo sapiens
acagcgagaggcagagaaa

SEQ ID NO: 2136099 - DNA, 13 bp, Homo sapiens
acagcgctatgca

SEQ ID NO: 2136100 - DNA, 15 bp, Homo sapiens
acagcggaggagacc

SEQ ID NO: 2136101 - DNA, 13 bp, Homo sapiens
acagcggcccctg

SEQ ID NO: 2136102 - DNA, 15 bp, Homo sapiens
acagcggcccctgca

SEQ ID NO: 2136103 - DNA, 16 bp, Homo sapiens
acagcggcccctgcat

SEQ ID NO: 2136104 - DNA, 19 bp, Homo sapiens
acagcggcccctgcatccc

SEQ ID NO: 2136105 - DNA, 19 bp, Homo sapiens
acagcgtccctagcagtga

SEQ ID NO: 2136106 - DNA, 21 bp, Homo sapiens
acagcgtccctagcagtgaac

SEQ ID NO: 2136107 - DNA, 20 bp, Homo sapiens
acagctaatcagcattctca

SEQ ID NO: 2136108 - DNA, 17 bp, Homo sapiens
acagctaatgggacact

SEQ ID NO: 2136109 - DNA, 19 bp, Homo sapiens
acagctaatgggacactaa

SEQ ID NO: 2136110 - DNA, 15 bp, Homo sapiens
acagctatatttctg

SEQ ID NO: 2136111 - DNA, 23 bp, Homo sapiens
acagctcaagtcttccctgatca

SEQ ID NO: 2136112 - DNA, 20 bp, Homo sapiens
acagctcacctctgaaggca

SEQ ID NO: 2136113 - DNA, 18 bp, Homo sapiens
acagctcagaagtttctt

SEQ ID NO: 2136114 - DNA, 15 bp, Homo sapiens
acagctccttctgtc

SEQ ID NO: 2136115 - DNA, 18 bp, Homo sapiens
acagctccttctgtccta

SEQ ID NO: 2136116 - DNA, 23 bp, Homo sapiens
acagctccttctgtcctactctg

SEQ ID NO: 2136117 - DNA, 13 bp, Homo sapiens
acagctctagaca

SEQ ID NO: 2136118 - DNA, 19 bp, Homo sapiens
acagctcttcactcagcca

SEQ ID NO: 2136119 - DNA, 23 bp, Homo sapiens
acagctcttcactcagccacacc

SEQ ID NO: 2136120 - DNA, 16 bp, Homo sapiens
acagctcttctccagg

SEQ ID NO: 2136121 - DNA, 19 bp, Homo sapiens
acagctcttctccaggctg

SEQ ID NO: 2136122 - DNA, 12 bp, Homo sapiens
acagctgacaga

SEQ ID NO: 2136123 - DNA, 15 bp, Homo sapiens
acagctgagagactt

SEQ ID NO: 2136124 - DNA, 16 bp, Homo sapiens
acagctgagagacttt

SEQ ID NO: 2136125 - DNA, 12 bp, Homo sapiens
acagctgcagct

SEQ ID NO: 2136126 - DNA, 13 bp, Homo sapiens
acagctgcagctg

SEQ ID NO: 2136127 - DNA, 14 bp, Homo sapiens
acagctgcagctgg

SEQ ID NO: 2136128 - DNA, 16 bp, Homo sapiens
acagctgcctgcagta

SEQ ID NO: 2136129 - DNA, 19 bp, Homo sapiens
acagctgcttgtcctgctc

SEQ ID NO: 2136130 - DNA, 21 bp, Homo sapiens
acagctgcttgtcctgctctc

SEQ ID NO: 2136131 - DNA, 22 bp, Homo sapiens
acagctgcttgtcctgctctct

SEQ ID NO: 2136132 - DNA, 12 bp, Homo sapiens
acagctggctgc

SEQ ID NO: 2136133 - DNA, 23 bp, Homo sapiens
acagctggctgctgacaggatgt

SEQ ID NO: 2136134 - DNA, 16 bp, Homo sapiens
acagctgtccctgtca

SEQ ID NO: 2136135 - DNA, 15 bp, Homo sapiens
acagctgtgcctcgc

SEQ ID NO: 2136136 - DNA, 19 bp, Homo sapiens
acagctgtttaagatgggc

SEQ ID NO: 2136137 - DNA, 20 bp, Homo sapiens
acagcttatggggtatttta

SEQ ID NO: 2136138 - DNA, 17 bp, Homo sapiens
acagcttcatttcctgt

SEQ ID NO: 2136139 - DNA, 16 bp, Homo sapiens
acagcttcttcatctt

SEQ ID NO: 2136140 - DNA, 16 bp, Homo sapiens
acagcttgaccagacc

SEQ ID NO: 2136141 - DNA, 17 bp, Homo sapiens
acagcttttcccaggag

SEQ ID NO: 2136142 - DNA, 15 bp, Homo sapiens
acaggaatctcagag

SEQ ID NO: 2136143 - DNA, 17 bp, Homo sapiens
acaggacacctggccgc

SEQ ID NO: 2136144 - DNA, 17 bp, Homo sapiens
acaggacagtgcttcag

SEQ ID NO: 2136145 - DNA, 23 bp, Homo sapiens
acaggactgattctgggatgctc

SEQ ID NO: 2136146 - DNA, 18 bp, Homo sapiens
acaggagcagacagagaa

SEQ ID NO: 2136147 - DNA, 23 bp, Homo sapiens
acaggagggggtcgtggagagct

SEQ ID NO: 2136148 - DNA, 14 bp, Homo sapiens
acaggatcagtctg

SEQ ID NO: 2136149 - DNA, 16 bp, Homo sapiens
acaggatgtggcactg

SEQ ID NO: 2136150 - DNA, 18 bp, Homo sapiens
acaggatgtggcactgct

SEQ ID NO: 2136151 - DNA, 19 bp, Homo sapiens
acaggcaaaatccttgctt

SEQ ID NO: 2136152 - DNA, 14 bp, Homo sapiens
acaggcaaatgcat

SEQ ID NO: 2136153 - DNA, 15 bp, Homo sapiens
acaggcaagcacctc

SEQ ID NO: 2136154 - DNA, 23 bp, Homo sapiens
acaggcaagcacctcctgcctcg

SEQ ID NO: 2136155 - DNA, 23 bp, Homo sapiens
accccagctccctaggagaccaa

SEQ ID NO: 2136156 - DNA, 11 bp, Homo sapiens
accccagctgg

SEQ ID NO: 2136157 - DNA, 17 bp, Homo sapiens
accccaggacgccactc

SEQ ID NO: 2136158 - DNA, 20 bp, Homo sapiens
accccaggacgccactcatt

SEQ ID NO: 2136159 - DNA, 15 bp, Homo sapiens
accccaggcatccca

SEQ ID NO: 2136160 - DNA, 21 bp, Homo sapiens
accccaggcatcccatccctt

SEQ ID NO: 2136161 - DNA, 18 bp, Homo sapiens
accccagggcacaggagc

SEQ ID NO: 2136162 - DNA, 19 bp, Homo sapiens
accccagggcacaggagct

SEQ ID NO: 2136163 - DNA, 16 bp, Homo sapiens
accccagttctgctcc

SEQ ID NO: 2136164 - DNA, 17 bp, Homo sapiens
accccatccagttcatg

SEQ ID NO: 2136165 - DNA, 11 bp, Homo sapiens
accccatccct

SEQ ID NO: 2136166 - DNA, 14 bp, Homo sapiens
accccatctctctt

SEQ ID NO: 2136167 - DNA, 15 bp, Homo sapiens
accccatctctcttc

SEQ ID NO: 2136168 - DNA, 21 bp, Homo sapiens
acccccaagacagcagtcttc

SEQ ID NO: 2136169 - DNA, 24 bp, Homo sapiens
acccccaccgaagagccctgagct

SEQ ID NO: 2136170 - DNA, 17 bp, Homo sapiens
acccccactctcattcc

SEQ ID NO: 2136171 - DNA, 21 bp, Homo sapiens
acccccactctcattccccag

SEQ ID NO: 2136172 - DNA, 12 bp, Homo sapiens
acccccagagac

SEQ ID NO: 2136173 - DNA, 19 bp, Homo sapiens
acccccagagaccttttct

SEQ ID NO: 2136174 - DNA, 11 bp, Homo sapiens
acccccagccc

SEQ ID NO: 2136175 - DNA, 13 bp, Homo sapiens
acccccagcccac

SEQ ID NO: 2136176 - DNA, 13 bp, Homo sapiens
acccccagccccg

SEQ ID NO: 2136177 - DNA, 14 bp, Homo sapiens
acccccagccccga

SEQ ID NO: 2136178 - DNA, 14 bp, Homo sapiens
acccccagctttgc

SEQ ID NO: 2136179 - DNA, 15 bp, Homo sapiens
acccccagtgccaca

SEQ ID NO: 2136180 - DNA, 21 bp, Homo sapiens
acccccagtgccacagagaag

SEQ ID NO: 2136181 - DNA, 12 bp, Homo sapiens
accccccacctg

SEQ ID NO: 2136182 - DNA, 13 bp, Homo sapiens
accccccacctgc

SEQ ID NO: 2136183 - DNA, 20 bp, Homo sapiens
accccccctcctgctgccta

SEQ ID NO: 2136184 - DNA, 23 bp, Homo sapiens
acccccgccacggccaccctcct

SEQ ID NO: 2136185 - DNA, 14 bp, Homo sapiens
acccccgctccaga

SEQ ID NO: 2136186 - DNA, 17 bp, Homo sapiens
acccccgctccagatct

SEQ ID NO: 2136187 - DNA, 19 bp, Homo sapiens
acccccgtggtctttgaat

SEQ ID NO: 2136188 - DNA, 22 bp, Homo sapiens
acccccgtggtctttgaataaa

SEQ ID NO: 2136189 - DNA, 13 bp, Homo sapiens
accccctccccag

SEQ ID NO: 2136190 - DNA, 12 bp, Homo sapiens
accccctgcagc

SEQ ID NO: 2136191 - DNA, 13 bp, Homo sapiens
accccctggccct

SEQ ID NO: 2136192 - DNA, 15 bp, Homo sapiens
accccctggccctgc

SEQ ID NO: 2136193 - DNA, 16 bp, Homo sapiens
acccccttcagtgccc

SEQ ID NO: 2136194 - DNA, 20 bp, Homo sapiens
acccccttcagtgcccacca

SEQ ID NO: 2136195 - DNA, 19 bp, Homo sapiens
acccccttctactgagcct

SEQ ID NO: 2136196 - DNA, 23 bp, Homo sapiens
accccgcctcccagccccagggg

SEQ ID NO: 2136197 - DNA, 17 bp, Homo sapiens
accccgcggtgctctgg

SEQ ID NO: 2136198 - DNA, 19 bp, Homo sapiens
accccgcggtgctctggcg

SEQ ID NO: 2136199 - DNA, 23 bp, Homo sapiens
accccgtctggggttcagcccct

SEQ ID NO: 2136200 - DNA, 16 bp, Homo sapiens
acccctacatgaaaca

SEQ ID NO: 2136201 - DNA, 12 bp, Homo sapiens
acccctcagtgc

SEQ ID NO: 2136202 - DNA, 15 bp, Homo sapiens
acccctcagtgctcg

SEQ ID NO: 2136203 - DNA, 17 bp, Homo sapiens
acccctcagtgctcggc

SEQ ID NO: 2136204 - DNA, 18 bp, Homo sapiens
acccctccaaagccccac

SEQ ID NO: 2136205 - DNA, 19 bp, Homo sapiens
acccctccatgtgggctag

SEQ ID NO: 2136206 - DNA, 12 bp, Homo sapiens
acccctccccat

SEQ ID NO: 2136207 - DNA, 21 bp, Homo sapiens
acccctccccattcacagagc

SEQ ID NO: 2136208 - DNA, 11 bp, Homo sapiens
acccctccctt

SEQ ID NO: 2136209 - DNA, 13 bp, Homo sapiens
acccctgcctggg

SEQ ID NO: 2136210 - DNA, 15 bp, Homo sapiens
acccctgcctgggtt

SEQ ID NO: 2136211 - DNA, 12 bp, Homo sapiens
acccctggcttt

SEQ ID NO: 2136212 - DNA, 15 bp, Homo sapiens
acccctggcttttca

SEQ ID NO: 2136213 - DNA, 21 bp, Homo sapiens
acccctggcttttcactgctg

SEQ ID NO: 2136214 - DNA, 16 bp, Homo sapiens
acccctgtacccagct

SEQ ID NO: 2136215 - DNA, 17 bp, Homo sapiens
acccctgtacccagctc

SEQ ID NO: 2136216 - DNA, 19 bp, Homo sapiens
acccctgtacccagctcct

SEQ ID NO: 2136217 - DNA, 17 bp, Homo sapiens
acccctgtctctagcca

SEQ ID NO: 2136218 - DNA, 10 bp, Homo sapiens
acccctgtgt

SEQ ID NO: 2136219 - DNA, 16 bp, Homo sapiens
accccttcctttcctc

SEQ ID NO: 2136220 - DNA, 22 bp, Homo sapiens
accccttcctttcctctgcagc

SEQ ID NO: 2136221 - DNA, 24 bp, Homo sapiens
accccttcctttcctctgcagcac

SEQ ID NO: 2136222 - DNA, 16 bp, Homo sapiens
accccttcgctcctgt

SEQ ID NO: 2136223 - DNA, 23 bp, Homo sapiens
accccttggcttttgcttggcag

SEQ ID NO: 2136224 - DNA, 23 bp, Homo sapiens
acccctttcccccaccccagagt

SEQ ID NO: 2136225 - DNA, 14 bp, Homo sapiens
acccgaagcccagg

SEQ ID NO: 2136226 - DNA, 21 bp, Homo sapiens
acccgagcccagctacattcc

SEQ ID NO: 2136227 - DNA, 17 bp, Homo sapiens
acccgaggctgcccact

SEQ ID NO: 2136228 - DNA, 15 bp, Homo sapiens
acccgccccactccc

SEQ ID NO: 2136229 - DNA, 18 bp, Homo sapiens
acccgctcatcactggat

SEQ ID NO: 2136230 - DNA, 18 bp, Homo sapiens
acccggaggggcctggca

SEQ ID NO: 2136231 - DNA, 20 bp, Homo sapiens
acccggcaccccctgcagct

SEQ ID NO: 2136232 - DNA, 22 bp, Homo sapiens
acccggcaccccctgcagcttg

SEQ ID NO: 2136233 - DNA, 14 bp, Homo sapiens
acccggcccagaga

SEQ ID NO: 2136234 - DNA, 22 bp, Homo sapiens
acccggcccagagaccccttcc

SEQ ID NO: 2136235 - DNA, 20 bp, Homo sapiens
acccggcccctgctggttca

SEQ ID NO: 2136236 - DNA, 16 bp, Homo sapiens
acccggccggagccgc

SEQ ID NO: 2136237 - DNA, 17 bp, Homo sapiens
acccggctccccctgct

SEQ ID NO: 2136238 - DNA, 15 bp, Homo sapiens
acccgtacccccgtg

SEQ ID NO: 2136239 - DNA, 21 bp, Homo sapiens
acccgtacccccgtggtcttt

SEQ ID NO: 2136240 - DNA, 22 bp, Homo sapiens
acccgtacccccgtggtctttg

SEQ ID NO: 2136241 - DNA, 20 bp, Homo sapiens
acccgtaggcagcctctctg

SEQ ID NO: 2136242 - DNA, 21 bp, Homo sapiens
acccgtaggcagcctctctgc

SEQ ID NO: 2136243 - DNA, 23 bp, Homo sapiens
acccgtaggcagcctctctgcta

SEQ ID NO: 2136244 - DNA, 15 bp, Homo sapiens
acccgtggaggctgc

SEQ ID NO: 2136245 - DNA, 15 bp, Homo sapiens
accctaaaatgacag

SEQ ID NO: 2136246 - DNA, 14 bp, Homo sapiens
accctaccccacca

SEQ ID NO: 2136247 - DNA, 13 bp, Homo sapiens
accctacctgtgc

SEQ ID NO: 2136248 - DNA, 17 bp, Homo sapiens
accctacctgtgcctga

SEQ ID NO: 2136249 - DNA, 23 bp, Homo sapiens
accctacttcattttcagagtga

SEQ ID NO: 2136250 - DNA, 15 bp, Homo sapiens
accctatctgtgatt

SEQ ID NO: 2136251 - DNA, 18 bp, Homo sapiens
accctcaaaccctgtggg

SEQ ID NO: 2136252 - DNA, 19 bp, Homo sapiens
accctcaaatgtcagagct

SEQ ID NO: 2136253 - DNA, 22 bp, Homo sapiens
accctcaaatgtcagagctatg

SEQ ID NO: 2136254 - DNA, 22 bp, Homo sapiens
accctcactgctggggagtccc

SEQ ID NO: 2136255 - DNA, 19 bp, Homo sapiens
accctcataccatctgctg

SEQ ID NO: 2136256 - DNA, 13 bp, Homo sapiens
accctccagagtg

SEQ ID NO: 2136257 - DNA, 23 bp, Homo sapiens
accctccccaaaacctttcccca

SEQ ID NO: 2136258 - DNA, 14 bp, Homo sapiens
accctcccccgcag

SEQ ID NO: 2136259 - DNA, 23 bp, Homo sapiens
accctcccctgtcttctctcaaa

SEQ ID NO: 2136260 - DNA, 14 bp, Homo sapiens
accctcgcagcagg

SEQ ID NO: 2136261 - DNA, 22 bp, Homo sapiens
accctcgtggacacctgccctg

SEQ ID NO: 2136262 - DNA, 23 bp, Homo sapiens
accctcgtggacacctgccctgc

SEQ ID NO: 2136263 - DNA, 16 bp, Homo sapiens
accctctccatgccca

SEQ ID NO: 2136264 - DNA, 23 bp, Homo sapiens
accctctccggtttgggttggga

SEQ ID NO: 2136265 - DNA, 20 bp, Homo sapiens
accctctcctgggggtggca

SEQ ID NO: 2136266 - DNA, 22 bp, Homo sapiens
accctctcctgggggtggcagg

SEQ ID NO: 2136267 - DNA, 13 bp, Homo sapiens
accctctcttccc

SEQ ID NO: 2136268 - DNA, 19 bp, Homo sapiens
accctctgaatggtccagg

SEQ ID NO: 2136269 - DNA, 12 bp, Homo sapiens
acgcctgagccc

SEQ ID NO: 2136270 - DNA, 13 bp, Homo sapiens
acgcctgagccca

SEQ ID NO: 2136271 - DNA, 17 bp, Homo sapiens
acgcctgagcccaggga

SEQ ID NO: 2136272 - DNA, 14 bp, Homo sapiens
acgcctgcccagcc

SEQ ID NO: 2136273 - DNA, 18 bp, Homo sapiens
acgcctgtaatcccagca

SEQ ID NO: 2136274 - DNA, 21 bp, Homo sapiens
acgcctgtaatcccagcactt

SEQ ID NO: 2136275 - DNA, 16 bp, Homo sapiens
acgcctgtagtcctag

SEQ ID NO: 2136276 - DNA, 14 bp, Homo sapiens
acgcgcacacacac

SEQ ID NO: 2136277 - DNA, 15 bp, Homo sapiens
acgcgcacacacacc

SEQ ID NO: 2136278 - DNA, 18 bp, Homo sapiens
acgcgggctgtgccttac

SEQ ID NO: 2136279 - DNA, 15 bp, Homo sapiens
acgcgtctcctgttt

SEQ ID NO: 2136280 - DNA, 20 bp, Homo sapiens
acgctcaagaatcctctggg

SEQ ID NO: 2136281 - DNA, 23 bp, Homo sapiens
acgctgccgctgccgctgcacca

SEQ ID NO: 2136282 - DNA, 20 bp, Homo sapiens
acgctggaccttgaactggg

SEQ ID NO: 2136283 - DNA, 16 bp, Homo sapiens
acgctggagtgcagtg

SEQ ID NO: 2136284 - DNA, 19 bp, Homo sapiens
acgctggagtgcagtgagc

SEQ ID NO: 2136285 - DNA, 12 bp, Homo sapiens
acgcttccagac

SEQ ID NO: 2136286 - DNA, 13 bp, Homo sapiens
acgcttccagacc

SEQ ID NO: 2136287 - DNA, 16 bp, Homo sapiens
acgcttccagaccacc

SEQ ID NO: 2136288 - DNA, 21 bp, Homo sapiens
acgcttccagaccacctgcca

SEQ ID NO: 2136289 - DNA, 15 bp, Homo sapiens
acgcttgctcatttt

SEQ ID NO: 2136290 - DNA, 17 bp, Homo sapiens
acgctttgggagaatgt

SEQ ID NO: 2136291 - DNA, 22 bp, Homo sapiens
acggaagaagagatcaggaaga

SEQ ID NO: 2136292 - DNA, 22 bp, Homo sapiens
acggacgtcctgctggcacctc

SEQ ID NO: 2136293 - DNA, 22 bp, Homo sapiens
acggagagtgcttgggtggtgg

SEQ ID NO: 2136294 - DNA, 14 bp, Homo sapiens
acggagatgtttca

SEQ ID NO: 2136295 - DNA, 18 bp, Homo sapiens
acggagccccaggcctct

SEQ ID NO: 2136296 - DNA, 20 bp, Homo sapiens
acggatccatgtagcaggac

SEQ ID NO: 2136297 - DNA, 21 bp, Homo sapiens
acggatccatgtagcaggact

SEQ ID NO: 2136298 - DNA, 17 bp, Homo sapiens
acggcagcttgagcctg

SEQ ID NO: 2136299 - DNA, 22 bp, Homo sapiens
acggcatgtgaattctgtgaag

SEQ ID NO: 2136300 - DNA, 23 bp, Homo sapiens
acggcatgtgaattctgtgaaga

SEQ ID NO: 2136301 - DNA, 12 bp, Homo sapiens
acggccaccctc

SEQ ID NO: 2136302 - DNA, 21 bp, Homo sapiens
acggccttcaactgaaaagac

SEQ ID NO: 2136303 - DNA, 23 bp, Homo sapiens
acggcgcacctatcacccaggct

SEQ ID NO: 2136304 - DNA, 14 bp, Homo sapiens
acggctcactgcag

SEQ ID NO: 2136305 - DNA, 17 bp, Homo sapiens
acggctcactgcagcct

SEQ ID NO: 2136306 - DNA, 14 bp, Homo sapiens
acggctggacctgc

SEQ ID NO: 2136307 - DNA, 23 bp, Homo sapiens
acggcttagacttcgactcagga

SEQ ID NO: 2136308 - DNA, 21 bp, Homo sapiens
acgggaagcctccgtcaggag

SEQ ID NO: 2136309 - DNA, 22 bp, Homo sapiens
acgggaagcctccgtcaggaga

SEQ ID NO: 2136310 - DNA, 22 bp, Homo sapiens
acgggagcctcctctgcttgca

SEQ ID NO: 2136311 - DNA, 14 bp, Homo sapiens
acgggaggcctcag

SEQ ID NO: 2136312 - DNA, 14 bp, Homo sapiens
acgggcatgtatta

SEQ ID NO: 2136313 - DNA, 19 bp, Homo sapiens
acgggcctcagtttcccca

SEQ ID NO: 2136314 - DNA, 15 bp, Homo sapiens
acgggtggaggggaa

SEQ ID NO: 2136315 - DNA, 15 bp, Homo sapiens
acggtgcgtggctgt

SEQ ID NO: 2136316 - DNA, 19 bp, Homo sapiens
acggtgcgtggctgtggca

SEQ ID NO: 2136317 - DNA, 20 bp, Homo sapiens
acggtgcgtggctgtggcac

SEQ ID NO: 2136318 - DNA, 15 bp, Homo sapiens
acggttaacttgtat

SEQ ID NO: 2136319 - DNA, 17 bp, Homo sapiens
acggttaacttgtatat

SEQ ID NO: 2136320 - DNA, 16 bp, Homo sapiens
acggtttcaaaccagg

SEQ ID NO: 2136321 - DNA, 21 bp, Homo sapiens
acgtaatgattatatgacaat

SEQ ID NO: 2136322 - DNA, 16 bp, Homo sapiens
acgtaatgtatttata

SEQ ID NO: 2136323 - DNA, 18 bp, Homo sapiens
acgtataaatatgaaatg

SEQ ID NO: 2136324 - DNA, 14 bp, Homo sapiens
acgtattttaaaag

SEQ ID NO: 2136325 - DNA, 16 bp, Homo sapiens
acgtcaaacatgaagt

SEQ ID NO: 2136326 - DNA, 13 bp, Homo sapiens
acgtcatctcagg

SEQ ID NO: 2136327 - DNA, 14 bp, Homo sapiens
acgtcatctcaggg

SEQ ID NO: 2136328 - DNA, 21 bp, Homo sapiens
acgtcctgctggcacctcaga

SEQ ID NO: 2136329 - DNA, 22 bp, Homo sapiens
acgtcctggaatgaagcatgta

SEQ ID NO: 2136330 - DNA, 15 bp, Homo sapiens
acgtctcaagactga

SEQ ID NO: 2136331 - DNA, 14 bp, Homo sapiens
acgtctgccaggcc

SEQ ID NO: 2136332 - DNA, 17 bp, Homo sapiens
acgtctgccaggcccat

SEQ ID NO: 2136333 - DNA, 20 bp, Homo sapiens
acgtctgccaggcccatctc

SEQ ID NO: 2136334 - DNA, 15 bp, Homo sapiens
acgtgaaatatttaa

SEQ ID NO: 2136335 - DNA, 14 bp, Homo sapiens
acgtgagccaggta

SEQ ID NO: 2136336 - DNA, 15 bp, Homo sapiens
acgtgagccaggtaa

SEQ ID NO: 2136337 - DNA, 23 bp, Homo sapiens
acgtgagccaggtaatgagggac

SEQ ID NO: 2136338 - DNA, 13 bp, Homo sapiens
acgtgccaggccc

SEQ ID NO: 2136339 - DNA, 19 bp, Homo sapiens
acgtgccaggcccggggct

SEQ ID NO: 2136340 - DNA, 21 bp, Homo sapiens
acgtgccaggcccggggctgg

SEQ ID NO: 2136341 - DNA, 19 bp, Homo sapiens
acgtgggtatttcctgcta

SEQ ID NO: 2136342 - DNA, 15 bp, Homo sapiens
acgtggtcaaggccc

SEQ ID NO: 2136343 - DNA, 18 bp, Homo sapiens
acgtgtactacaatttaa

SEQ ID NO: 2136344 - DNA, 17 bp, Homo sapiens
acgtgtctttagaactc

SEQ ID NO: 2136345 - DNA, 20 bp, Homo sapiens
acgtgttaggaggctgcatg

SEQ ID NO: 2136346 - DNA, 23 bp, Homo sapiens
acgtgttaggaggctgcatgctc

SEQ ID NO: 2136347 - DNA, 14 bp, Homo sapiens
acgttatatattgt

SEQ ID NO: 2136348 - DNA, 15 bp, Homo sapiens
acgttctccagccca

SEQ ID NO: 2136349 - DNA, 17 bp, Homo sapiens
acgttctccagcccaca

SEQ ID NO: 2136350 - DNA, 21 bp, Homo sapiens
acgttgacccctttcccccac

SEQ ID NO: 2136351 - DNA, 23 bp, Homo sapiens
acgttgacccctttcccccaccc

SEQ ID NO: 2136352 - DNA, 18 bp, Homo sapiens
acgtttggcatttctctt

SEQ ID NO: 2136353 - DNA, 14 bp, Homo sapiens
actaaaaagtggct

SEQ ID NO: 2136354 - DNA, 13 bp, Homo sapiens
actaaaaatatta

SEQ ID NO: 2136355 - DNA, 14 bp, Homo sapiens
actaaaatatttat

SEQ ID NO: 2136356 - DNA, 12 bp, Homo sapiens
actaaagagaca

SEQ ID NO: 2136357 - DNA, 12 bp, Homo sapiens
actaaagcagtg

SEQ ID NO: 2136358 - DNA, 14 bp, Homo sapiens
actaaagcagtgtt

SEQ ID NO: 2136359 - DNA, 22 bp, Homo sapiens
actaaagggcaggtggttctaa

SEQ ID NO: 2136360 - DNA, 14 bp, Homo sapiens
actaaagtgtctat

SEQ ID NO: 2136361 - DNA, 13 bp, Homo sapiens
actaaatatatgt

SEQ ID NO: 2136362 - DNA, 17 bp, Homo sapiens
actaaatatatgtctgt

SEQ ID NO: 2136363 - DNA, 17 bp, Homo sapiens
actaaatctctaatatg

SEQ ID NO: 2136364 - DNA, 15 bp, Homo sapiens
actaaatcttttata

SEQ ID NO: 2136365 - DNA, 20 bp, Homo sapiens
actaaattgtatacattttg

SEQ ID NO: 2136366 - DNA, 21 bp, Homo sapiens
actaaattgtatacattttgt

SEQ ID NO: 2136367 - DNA, 15 bp, Homo sapiens
actaacatataatgt

SEQ ID NO: 2136368 - DNA, 21 bp, Homo sapiens
actaaccccaacgcacaggaa

SEQ ID NO: 2136369 - DNA, 14 bp, Homo sapiens
actaacttgtcttt

SEQ ID NO: 2136370 - DNA, 18 bp, Homo sapiens
actaagaggctatttaaa

SEQ ID NO: 2136371 - DNA, 15 bp, Homo sapiens
actaagccacaagaa

SEQ ID NO: 2136372 - DNA, 13 bp, Homo sapiens
actaagccctgtc

SEQ ID NO: 2136373 - DNA, 17 bp, Homo sapiens
actaagctttctccttt

SEQ ID NO: 2136374 - DNA, 18 bp, Homo sapiens
actaagctttctcctttg

SEQ ID NO: 2136375 - DNA, 18 bp, Homo sapiens
actaagtagaataaagaa

SEQ ID NO: 2136376 - DNA, 15 bp, Homo sapiens
actaataccttgtgt

SEQ ID NO: 2136377 - DNA, 23 bp, Homo sapiens
actaatgaagatacggttgcttc

SEQ ID NO: 2136378 - DNA, 20 bp, Homo sapiens
actaattggcctctttaaga

SEQ ID NO: 2136379 - DNA, 15 bp, Homo sapiens
actaatttaaaaaat

SEQ ID NO: 2136380 - DNA, 21 bp, Homo sapiens
actaatttaaaccagcagaaa

SEQ ID NO: 2136381 - DNA, 22 bp, Homo sapiens
actaatttaaaccagcagaaaa

SEQ ID NO: 2136382 - DNA, 23 bp, Homo sapiens
actaatttaaaccagcagaaaag

SEQ ID NO: 2136383 - DNA, 23 bp, Homo sapiens
actacacatccctaatgtgtgcc

SEQ ID NO: 2136384 - DNA, 19 bp, Homo sapiens
actgaggtcactgggttct

SEQ ID NO: 2136385 - DNA, 23 bp, Homo sapiens
actgagtgactctatatagctga

SEQ ID NO: 2136386 - DNA, 15 bp, Homo sapiens
actgataaagaaaga

SEQ ID NO: 2136387 - DNA, 16 bp, Homo sapiens
actgatagtgtccaaa

SEQ ID NO: 2136388 - DNA, 14 bp, Homo sapiens
actgatatattttc

SEQ ID NO: 2136389 - DNA, 13 bp, Homo sapiens
actgatcaaaaat

SEQ ID NO: 2136390 - DNA, 15 bp, Homo sapiens
actgatcaaaaataa

SEQ ID NO: 2136391 - DNA, 18 bp, Homo sapiens
actgatgacaaacccagg

SEQ ID NO: 2136392 - DNA, 23 bp, Homo sapiens
actgatgcgaaaacttgaatctg

SEQ ID NO: 2136393 - DNA, 20 bp, Homo sapiens
actgatggaccgggtgggcc

SEQ ID NO: 2136394 - DNA, 22 bp, Homo sapiens
actgatggaccgggtgggcctg

SEQ ID NO: 2136395 - DNA, 16 bp, Homo sapiens
actgatgggacatcaa

SEQ ID NO: 2136396 - DNA, 17 bp, Homo sapiens
actgatgggacatcaaa

SEQ ID NO: 2136397 - DNA, 17 bp, Homo sapiens
actgattagtattcagg

SEQ ID NO: 2136398 - DNA, 19 bp, Homo sapiens
actgattcacatctcattt

SEQ ID NO: 2136399 - DNA, 20 bp, Homo sapiens
actgattcacatctcatttt

SEQ ID NO: 2136400 - DNA, 13 bp, Homo sapiens
actgattctcctg

SEQ ID NO: 2136401 - DNA, 18 bp, Homo sapiens
actgattctcctgtcaga

SEQ ID NO: 2136402 - DNA, 13 bp, Homo sapiens
actgatttcacaa

SEQ ID NO: 2136403 - DNA, 17 bp, Homo sapiens
actgatttcacaacaga

SEQ ID NO: 2136404 - DNA, 15 bp, Homo sapiens
actgatttttgtgat

SEQ ID NO: 2136405 - DNA, 20 bp, Homo sapiens
actgcaacctcttcctcctg

SEQ ID NO: 2136406 - DNA, 19 bp, Homo sapiens
actgcaacttctacctccg

SEQ ID NO: 2136407 - DNA, 22 bp, Homo sapiens
actgcaagacttaaatagttca

SEQ ID NO: 2136408 - DNA, 23 bp, Homo sapiens
actgcacagtgcatctcagccca

SEQ ID NO: 2136409 - DNA, 16 bp, Homo sapiens
actgcaccgggccaca

SEQ ID NO: 2136410 - DNA, 20 bp, Homo sapiens
actgcactatagcctaggtg

SEQ ID NO: 2136411 - DNA, 21 bp, Homo sapiens
actgcactatagcctaggtga

SEQ ID NO: 2136412 - DNA, 15 bp, Homo sapiens
actgcactccagcct

SEQ ID NO: 2136413 - DNA, 17 bp, Homo sapiens
actgcactccagcctgg

SEQ ID NO: 2136414 - DNA, 20 bp, Homo sapiens
actgcactccagcctgggca

SEQ ID NO: 2136415 - DNA, 23 bp, Homo sapiens
actgcagcctcaacctcctgggc

SEQ ID NO: 2136416 - DNA, 21 bp, Homo sapiens
actgcaggccccgcttgtcca

SEQ ID NO: 2136417 - DNA, 23 bp, Homo sapiens
actgcaggccccgcttgtccagc

SEQ ID NO: 2136418 - DNA, 18 bp, Homo sapiens
actgcagggactgccagt

SEQ ID NO: 2136419 - DNA, 15 bp, Homo sapiens
actgcatactgatcc

SEQ ID NO: 2136420 - DNA, 19 bp, Homo sapiens
actgcatatcggaggtggt

SEQ ID NO: 2136421 - DNA, 15 bp, Homo sapiens
actgcatctcaaaaa

SEQ ID NO: 2136422 - DNA, 15 bp, Homo sapiens
actgccacaccctcc

SEQ ID NO: 2136423 - DNA, 12 bp, Homo sapiens
actgccaggcac

SEQ ID NO: 2136424 - DNA, 13 bp, Homo sapiens
actgccaggcacc

SEQ ID NO: 2136425 - DNA, 14 bp, Homo sapiens
actgccaggcacct

SEQ ID NO: 2136426 - DNA, 15 bp, Homo sapiens
actgccaggcacctg

SEQ ID NO: 2136427 - DNA, 21 bp, Homo sapiens
actgccaggcacctggcctgc

SEQ ID NO: 2136428 - DNA, 21 bp, Homo sapiens
actgccccaactcctggaagc

SEQ ID NO: 2136429 - DNA, 14 bp, Homo sapiens
actgccccaccagc

SEQ ID NO: 2136430 - DNA, 19 bp, Homo sapiens
actgccccaccagccacct

SEQ ID NO: 2136431 - DNA, 22 bp, Homo sapiens
actgccccaccagccacctctt

SEQ ID NO: 2136432 - DNA, 22 bp, Homo sapiens
actgccccgggtgcctcagagc

SEQ ID NO: 2136433 - DNA, 12 bp, Homo sapiens
actgccctgcct

SEQ ID NO: 2136434 - DNA, 23 bp, Homo sapiens
actgccctgcctgcccacttagc

SEQ ID NO: 2136435 - DNA, 22 bp, Homo sapiens
actgccgcaagtctgcagcccg

SEQ ID NO: 2136436 - DNA, 13 bp, Homo sapiens
actgcctagtgta

SEQ ID NO: 2136437 - DNA, 14 bp, Homo sapiens
actgcctcttcctc

SEQ ID NO: 2136438 - DNA, 18 bp, Homo sapiens
actgcgatcttcagagca

SEQ ID NO: 2136439 - DNA, 19 bp, Homo sapiens
actgcgatcttcagagcag

SEQ ID NO: 2136440 - DNA, 20 bp, Homo sapiens
actgcgggatggtcctgggg

SEQ ID NO: 2136441 - DNA, 17 bp, Homo sapiens
actgctaaatactgtac

SEQ ID NO: 2136442 - DNA, 18 bp, Homo sapiens
actgctaggcgagtgcca

SEQ ID NO: 2136443 - DNA, 20 bp, Homo sapiens
actgctaggcgagtgccagg

SEQ ID NO: 2136444 - DNA, 18 bp, Homo sapiens
actgctcaagaagacatg

SEQ ID NO: 2136445 - DNA, 21 bp, Homo sapiens
actgctccccagccctggctc

SEQ ID NO: 2136446 - DNA, 12 bp, Homo sapiens
actgctctcagc

SEQ ID NO: 2136447 - DNA, 15 bp, Homo sapiens
actgctctcagcctc

SEQ ID NO: 2136448 - DNA, 17 bp, Homo sapiens
actgctctcagcctccc

SEQ ID NO: 2136449 - DNA, 12 bp, Homo sapiens
actgctctgaat

SEQ ID NO: 2136450 - DNA, 13 bp, Homo sapiens
actgctgagccac

SEQ ID NO: 2136451 - DNA, 18 bp, Homo sapiens
actgctgatcaatgaaat

SEQ ID NO: 2136452 - DNA, 17 bp, Homo sapiens
actgctgcaaagtgcaa

SEQ ID NO: 2136453 - DNA, 21 bp, Homo sapiens
actgctgcaaagtgcaaatac

SEQ ID NO: 2136454 - DNA, 18 bp, Homo sapiens
actgctgcccagcctcca

SEQ ID NO: 2136455 - DNA, 13 bp, Homo sapiens
actgctggctgcc

SEQ ID NO: 2136456 - DNA, 17 bp, Homo sapiens
actgctggggagtccct

SEQ ID NO: 2136457 - DNA, 16 bp, Homo sapiens
actgctgtcattgtcc

SEQ ID NO: 2136458 - DNA, 17 bp, Homo sapiens
actgctgtgtccgcttt

SEQ ID NO: 2136459 - DNA, 22 bp, Homo sapiens
actgctgtgtccgctttcatga

SEQ ID NO: 2136460 - DNA, 22 bp, Homo sapiens
actgcttgaggaggggcacctg

SEQ ID NO: 2136461 - DNA, 23 bp, Homo sapiens
actgcttgaggaggggcacctgc

SEQ ID NO: 2136462 - DNA, 16 bp, Homo sapiens
actgcttgtgttttta

SEQ ID NO: 2136463 - DNA, 23 bp, Homo sapiens
actgctttcaacttaaatcactg

SEQ ID NO: 2136464 - DNA, 17 bp, Homo sapiens
actgctttccagcctgg

SEQ ID NO: 2136465 - DNA, 20 bp, Homo sapiens
actgcttttggtctgtgtga

SEQ ID NO: 2136466 - DNA, 16 bp, Homo sapiens
actggaaccagggaga

SEQ ID NO: 2136467 - DNA, 14 bp, Homo sapiens
actggaagcacagc

SEQ ID NO: 2136468 - DNA, 16 bp, Homo sapiens
actggaagcacagctt

SEQ ID NO: 2136469 - DNA, 21 bp, Homo sapiens
actggaagcatgtaggagaat

SEQ ID NO: 2136470 - DNA, 13 bp, Homo sapiens
actggaagttttg

SEQ ID NO: 2136471 - DNA, 17 bp, Homo sapiens
actggaagttttgcatt

SEQ ID NO: 2136472 - DNA, 13 bp, Homo sapiens
actggacagcttg

SEQ ID NO: 2136473 - DNA, 17 bp, Homo sapiens
actggacatcacagcag

SEQ ID NO: 2136474 - DNA, 21 bp, Homo sapiens
actggaccccgcctcccagcc

SEQ ID NO: 2136475 - DNA, 23 bp, Homo sapiens
actggagaccgcttcacccctgc

SEQ ID NO: 2136476 - DNA, 21 bp, Homo sapiens
actggagacttggaagagttg

SEQ ID NO: 2136477 - DNA, 16 bp, Homo sapiens
actggagcaccaggca

SEQ ID NO: 2136478 - DNA, 13 bp, Homo sapiens
actggagcatctg

SEQ ID NO: 2136479 - DNA, 13 bp, Homo sapiens
actggagcccagg

SEQ ID NO: 2136480 - DNA, 14 bp, Homo sapiens
actggaggtcacat

SEQ ID NO: 2136481 - DNA, 13 bp, Homo sapiens
actggagtagttg

SEQ ID NO: 2136482 - DNA, 21 bp, Homo sapiens
actggagtgaggcttccaggc

SEQ ID NO: 2136483 - DNA, 13 bp, Homo sapiens
actggagtgcagg

SEQ ID NO: 2136484 - DNA, 12 bp, Homo sapiens
actggatatgtt

SEQ ID NO: 2136485 - DNA, 13 bp, Homo sapiens
actggatgaagat

SEQ ID NO: 2136486 - DNA, 14 bp, Homo sapiens
actggcaatatttg

SEQ ID NO: 2136487 - DNA, 13 bp, Homo sapiens
actggcagctcct

SEQ ID NO: 2136488 - DNA, 12 bp, Homo sapiens
actggcaggtgc

SEQ ID NO: 2136489 - DNA, 22 bp, Homo sapiens
actggcaggtgcagatgggctg

SEQ ID NO: 2136490 - DNA, 23 bp, Homo sapiens
actggcaggtgcagatgggctgt

SEQ ID NO: 2136491 - DNA, 13 bp, Homo sapiens
actggccacccaa

SEQ ID NO: 2136492 - DNA, 20 bp, Homo sapiens
actggccagagagggcccag

SEQ ID NO: 2136493 - DNA, 13 bp, Homo sapiens
actggccagtcct

SEQ ID NO: 2136494 - DNA, 15 bp, Homo sapiens
actggcctcaaagca

SEQ ID NO: 2136495 - DNA, 19 bp, Homo sapiens
actggcgaaccatctcaat

SEQ ID NO: 2136496 - DNA, 22 bp, Homo sapiens
actggctgcaaagggtatcagg

SEQ ID NO: 2136497 - DNA, 16 bp, Homo sapiens
actggctggctgcagt

SEQ ID NO: 2136498 - DNA, 15 bp, Homo sapiens
actggcttctgtgca

SEQ ID NO: 2136499 - DNA, 12 bp, Homo sapiens
acttttggtttt

SEQ ID NO: 2136500 - DNA, 21 bp, Homo sapiens
acttttgtaccagtgtgaata

SEQ ID NO: 2136501 - DNA, 12 bp, Homo sapiens
actttttataat

SEQ ID NO: 2136502 - DNA, 12 bp, Homo sapiens
actttttatact

SEQ ID NO: 2136503 - DNA, 14 bp, Homo sapiens
actttttatactcc

SEQ ID NO: 2136504 - DNA, 18 bp, Homo sapiens
actttttatactccatac

SEQ ID NO: 2136505 - DNA, 21 bp, Homo sapiens
actttttcagagttgctttaa

SEQ ID NO: 2136506 - DNA, 19 bp, Homo sapiens
agaaaaaaatatattttat

SEQ ID NO: 2136507 - DNA, 20 bp, Homo sapiens
agaaaaaaatatattttatg

SEQ ID NO: 2136508 - DNA, 23 bp, Homo sapiens
agaaaaaaatatattttatgatt

SEQ ID NO: 2136509 - DNA, 16 bp, Homo sapiens
agaaaaaatacatttt

SEQ ID NO: 2136510 - DNA, 19 bp, Homo sapiens
agaaaaaccaatgattcat

SEQ ID NO: 2136511 - DNA, 20 bp, Homo sapiens
agaaaaaccaatgattcata

SEQ ID NO: 2136512 - DNA, 13 bp, Homo sapiens
agaaaaagaaaaa

SEQ ID NO: 2136513 - DNA, 14 bp, Homo sapiens
agaaaaagaaatgc

SEQ ID NO: 2136514 - DNA, 15 bp, Homo sapiens
agaaaaagaaatgca

SEQ ID NO: 2136515 - DNA, 17 bp, Homo sapiens
agaaaacaaatcttcaa

SEQ ID NO: 2136516 - DNA, 16 bp, Homo sapiens
agaaaacccttttcta

SEQ ID NO: 2136517 - DNA, 16 bp, Homo sapiens
agaaaacgcacctcca

SEQ ID NO: 2136518 - DNA, 12 bp, Homo sapiens
agaaaactggaa

SEQ ID NO: 2136519 - DNA, 15 bp, Homo sapiens
agaaaactggaaatc

SEQ ID NO: 2136520 - DNA, 16 bp, Homo sapiens
agaaaagaccctgaga

SEQ ID NO: 2136521 - DNA, 18 bp, Homo sapiens
agaaaagaggagaccctg

SEQ ID NO: 2136522 - DNA, 15 bp, Homo sapiens
agaaaagataaagat

SEQ ID NO: 2136523 - DNA, 17 bp, Homo sapiens
agaaaagataaagatga

SEQ ID NO: 2136524 - DNA, 18 bp, Homo sapiens
agaaaagcacctgccgac

SEQ ID NO: 2136525 - DNA, 13 bp, Homo sapiens
agaaaagctataa

SEQ ID NO: 2136526 - DNA, 21 bp, Homo sapiens
agaaaagctataaaatgaata

SEQ ID NO: 2136527 - DNA, 13 bp, Homo sapiens
agaaaaggcatgg

SEQ ID NO: 2136528 - DNA, 23 bp, Homo sapiens
agaaaagggaagttgtgcctttt

SEQ ID NO: 2136529 - DNA, 23 bp, Homo sapiens
agaaaagtagaattatatctaat

SEQ ID NO: 2136530 - DNA, 18 bp, Homo sapiens
agaaaagtgcaaagttat

SEQ ID NO: 2136531 - DNA, 22 bp, Homo sapiens
agaaaagtgcttagaaagttat

SEQ ID NO: 2136532 - DNA, 13 bp, Homo sapiens
agaaaatataaat

SEQ ID NO: 2136533 - DNA, 18 bp, Homo sapiens
agaaaatgcaaaatgaaa

SEQ ID NO: 2136534 - DNA, 18 bp, Homo sapiens
agaaacaaggttttcagt

SEQ ID NO: 2136535 - DNA, 16 bp, Homo sapiens
agaaacagaagtagaa

SEQ ID NO: 2136536 - DNA, 15 bp, Homo sapiens
agaaacagagagaga

SEQ ID NO: 2136537 - DNA, 16 bp, Homo sapiens
agaaacagataccata

SEQ ID NO: 2136538 - DNA, 19 bp, Homo sapiens
agaaacagggacaaagaaa

SEQ ID NO: 2136539 - DNA, 18 bp, Homo sapiens
agaaacaggggatcaaag

SEQ ID NO: 2136540 - DNA, 21 bp, Homo sapiens
agaaacaggggatcaaagttc

SEQ ID NO: 2136541 - DNA, 22 bp, Homo sapiens
agaaacaggggatcaaagttcc

SEQ ID NO: 2136542 - DNA, 15 bp, Homo sapiens
agaaacatgacactg

SEQ ID NO: 2136543 - DNA, 18 bp, Homo sapiens
agaaacatgacactgacc

SEQ ID NO: 2136544 - DNA, 14 bp, Homo sapiens
agaaacatggtttt

SEQ ID NO: 2136545 - DNA, 18 bp, Homo sapiens
agaaaccagtatggaagg

SEQ ID NO: 2136546 - DNA, 21 bp, Homo sapiens
agaaaccagttatgtgaatga

SEQ ID NO: 2136547 - DNA, 16 bp, Homo sapiens
agaaacccaccagcct

SEQ ID NO: 2136548 - DNA, 14 bp, Homo sapiens
agaaaccccaagca

SEQ ID NO: 2136549 - DNA, 15 bp, Homo sapiens
agaaaccccaagcag

SEQ ID NO: 2136550 - DNA, 13 bp, Homo sapiens
agaaaccccaggg

SEQ ID NO: 2136551 - DNA, 13 bp, Homo sapiens
agaaaccctgtct

SEQ ID NO: 2136552 - DNA, 18 bp, Homo sapiens
agaaactgaggaattttc

SEQ ID NO: 2136553 - DNA, 23 bp, Homo sapiens
agaaacttaaggttacctttgtt

SEQ ID NO: 2136554 - DNA, 15 bp, Homo sapiens
agaaacttttttatt

SEQ ID NO: 2136555 - DNA, 16 bp, Homo sapiens
agaaagaatgcaagag

SEQ ID NO: 2136556 - DNA, 14 bp, Homo sapiens
agaaagaatgtgtt

SEQ ID NO: 2136557 - DNA, 20 bp, Homo sapiens
agaaagactattcaaacagt

SEQ ID NO: 2136558 - DNA, 18 bp, Homo sapiens
agaaagactggacgggga

SEQ ID NO: 2136559 - DNA, 22 bp, Homo sapiens
agaaagatccaccctcaaatgt

SEQ ID NO: 2136560 - DNA, 12 bp, Homo sapiens
agaaagcaataa

SEQ ID NO: 2136561 - DNA, 16 bp, Homo sapiens
agaaagctggtaaact

SEQ ID NO: 2136562 - DNA, 20 bp, Homo sapiens
agaaagctggtaaactattt

SEQ ID NO: 2136563 - DNA, 14 bp, Homo sapiens
agaaagggagggct

SEQ ID NO: 2136564 - DNA, 16 bp, Homo sapiens
agaaagggagggctct

SEQ ID NO: 2136565 - DNA, 17 bp, Homo sapiens
agaaagggagggctctg

SEQ ID NO: 2136566 - DNA, 21 bp, Homo sapiens
agaaagggagggctctgaggc

SEQ ID NO: 2136567 - DNA, 17 bp, Homo sapiens
agaaagggcaaattatt

SEQ ID NO: 2136568 - DNA, 20 bp, Homo sapiens
agaaaggggcagtttaaagc

SEQ ID NO: 2136569 - DNA, 15 bp, Homo sapiens
agaaagggtctgata

SEQ ID NO: 2136570 - DNA, 23 bp, Homo sapiens
agaaagtacttctccaccctgct

SEQ ID NO: 2136571 - DNA, 13 bp, Homo sapiens
agaaagtgcagaa

SEQ ID NO: 2136572 - DNA, 21 bp, Homo sapiens
agaaataaacttattcctcct

SEQ ID NO: 2136573 - DNA, 19 bp, Homo sapiens
agaaataaagttggtgaca

SEQ ID NO: 2136574 - DNA, 21 bp, Homo sapiens
agaaataaagttggtgacaga

SEQ ID NO: 2136575 - DNA, 13 bp, Homo sapiens
agaaataagtttt

SEQ ID NO: 2136576 - DNA, 23 bp, Homo sapiens
agaaataagtttttgtttcacag

SEQ ID NO: 2136577 - DNA, 13 bp, Homo sapiens
agaaataattgtt

SEQ ID NO: 2136578 - DNA, 16 bp, Homo sapiens
agaaataattgttgat

SEQ ID NO: 2136579 - DNA, 14 bp, Homo sapiens
agaaatactgctct

SEQ ID NO: 2136580 - DNA, 17 bp, Homo sapiens
agaaataggacaattca

SEQ ID NO: 2136581 - DNA, 19 bp, Homo sapiens
agaaatatatatacatatg

SEQ ID NO: 2136582 - DNA, 15 bp, Homo sapiens
agaaatatgatttta

SEQ ID NO: 2136583 - DNA, 16 bp, Homo sapiens
agaaatatgattttat

SEQ ID NO: 2136584 - DNA, 22 bp, Homo sapiens
agaaatatgattttatttgaca

SEQ ID NO: 2136585 - DNA, 22 bp, Homo sapiens
agaaatcacaggggcggggcag

SEQ ID NO: 2136586 - DNA, 17 bp, Homo sapiens
agaaatcattgtagaaa

SEQ ID NO: 2136587 - DNA, 22 bp, Homo sapiens
agaaatcattttgcaatccctt

SEQ ID NO: 2136588 - DNA, 17 bp, Homo sapiens
agaaatctccagtgtgc

SEQ ID NO: 2136589 - DNA, 19 bp, Homo sapiens
agaaatctgtaattctatt

SEQ ID NO: 2136590 - DNA, 16 bp, Homo sapiens
agaaatgcaaaaatct

SEQ ID NO: 2136591 - DNA, 12 bp, Homo sapiens
agaaatgcagaa

SEQ ID NO: 2136592 - DNA, 18 bp, Homo sapiens
agaaatgcatccattcct

SEQ ID NO: 2136593 - DNA, 18 bp, Homo sapiens
agaaatgtgaagggtggg

SEQ ID NO: 2136594 - DNA, 15 bp, Homo sapiens
agaaattagccgggc

SEQ ID NO: 2136595 - DNA, 15 bp, Homo sapiens
agaaattagctgtgt

SEQ ID NO: 2136596 - DNA, 17 bp, Homo sapiens
agaaattagctgtgtga

SEQ ID NO: 2136597 - DNA, 14 bp, Homo sapiens
agaaattatttaat

SEQ ID NO: 2136598 - DNA, 14 bp, Homo sapiens
agaaattggctgga

SEQ ID NO: 2136599 - DNA, 15 bp, Homo sapiens
agaaattggctggat

SEQ ID NO: 2136600 - DNA, 16 bp, Homo sapiens
agaaatttaaactata

SEQ ID NO: 2136601 - DNA, 20 bp, Homo sapiens
agaaatttaaactataagca

SEQ ID NO: 2136602 - DNA, 15 bp, Homo sapiens
agaaatttgatttct

SEQ ID NO: 2136603 - DNA, 20 bp, Homo sapiens
agaaatttgatttctattca

SEQ ID NO: 2136604 - DNA, 18 bp, Homo sapiens
agaaatttttatttttga

SEQ ID NO: 2136605 - DNA, 15 bp, Homo sapiens
agaacaaacctctat

SEQ ID NO: 2136606 - DNA, 22 bp, Homo sapiens
agaacaacaacaacaataacaa

SEQ ID NO: 2136607 - DNA, 17 bp, Homo sapiens
agaacaagtcacagctg

SEQ ID NO: 2136608 - DNA, 23 bp, Homo sapiens
agaacaagtcacagctgcagctg

SEQ ID NO: 2136609 - DNA, 21 bp, Homo sapiens
agaacaatagctattgcatgt

SEQ ID NO: 2136610 - DNA, 17 bp, Homo sapiens
agaacaatgtcagaaac

SEQ ID NO: 2136611 - DNA, 22 bp, Homo sapiens
agaacacagtgcctggcaaggc

SEQ ID NO: 2136612 - DNA, 13 bp, Homo sapiens
agaacacccactg

SEQ ID NO: 2136613 - DNA, 14 bp, Homo sapiens
agaacacccactgg

SEQ ID NO: 2136614 - DNA, 21 bp, Homo sapiens
agactccttcaacaattctaa

SEQ ID NO: 2136615 - DNA, 14 bp, Homo sapiens
agactctaaatatt

SEQ ID NO: 2136616 - DNA, 18 bp, Homo sapiens
agactctaaatatttcat

SEQ ID NO: 2136617 - DNA, 20 bp, Homo sapiens
agactctaaatatttcatga

SEQ ID NO: 2136618 - DNA, 19 bp, Homo sapiens
agactctacccatattaca

SEQ ID NO: 2136619 - DNA, 12 bp, Homo sapiens
agactctggaag

SEQ ID NO: 2136620 - DNA, 13 bp, Homo sapiens
agactctggaagc

SEQ ID NO: 2136621 - DNA, 16 bp, Homo sapiens
agactgaaagcagcag

SEQ ID NO: 2136622 - DNA, 21 bp, Homo sapiens
agactgaaagcagcagctagg

SEQ ID NO: 2136623 - DNA, 18 bp, Homo sapiens
agactgacacctcactga

SEQ ID NO: 2136624 - DNA, 15 bp, Homo sapiens
agactgagaggcaga

SEQ ID NO: 2136625 - DNA, 15 bp, Homo sapiens
agactgagggagaga

SEQ ID NO: 2136626 - DNA, 16 bp, Homo sapiens
agactgagggagagac

SEQ ID NO: 2136627 - DNA, 21 bp, Homo sapiens
agactgcaagaggctcctgtc

SEQ ID NO: 2136628 - DNA, 12 bp, Homo sapiens
agactgcatctc

SEQ ID NO: 2136629 - DNA, 14 bp, Homo sapiens
agactgctgggact

SEQ ID NO: 2136630 - DNA, 19 bp, Homo sapiens
agactgcttccaattttct

SEQ ID NO: 2136631 - DNA, 13 bp, Homo sapiens
agactggaacttg

SEQ ID NO: 2136632 - DNA, 23 bp, Homo sapiens
agactggaacttgaactgattca

SEQ ID NO: 2136633 - DNA, 16 bp, Homo sapiens
agactggaagcacagc

SEQ ID NO: 2136634 - DNA, 11 bp, Homo sapiens
agactggacag

SEQ ID NO: 2136635 - DNA, 23 bp, Homo sapiens
agactggagtgaggcttccaggc

SEQ ID NO: 2136636 - DNA, 15 bp, Homo sapiens
agactggcacagttt

SEQ ID NO: 2136637 - DNA, 18 bp, Homo sapiens
agactggcacagttttct

SEQ ID NO: 2136638 - DNA, 21 bp, Homo sapiens
agactggcacagttttctgag

SEQ ID NO: 2136639 - DNA, 15 bp, Homo sapiens
agactggtcctgtgt

SEQ ID NO: 2136640 - DNA, 17 bp, Homo sapiens
agactggtcctgtgtgc

SEQ ID NO: 2136641 - DNA, 17 bp, Homo sapiens
agactgtaattaagtaa

SEQ ID NO: 2136642 - DNA, 14 bp, Homo sapiens
agactgtctcaaga

SEQ ID NO: 2136643 - DNA, 14 bp, Homo sapiens
agactgtggctgct

SEQ ID NO: 2136644 - DNA, 15 bp, Homo sapiens
agactgttgctcaaa

SEQ ID NO: 2136645 - DNA, 14 bp, Homo sapiens
agacttaagattaa

SEQ ID NO: 2136646 - DNA, 15 bp, Homo sapiens
agacttaagattaaa

SEQ ID NO: 2136647 - DNA, 19 bp, Homo sapiens
agacttaagattaaattat

SEQ ID NO: 2136648 - DNA, 12 bp, Homo sapiens
agacttactttc

SEQ ID NO: 2136649 - DNA, 21 bp, Homo sapiens
agacttcacactgcaagagcc

SEQ ID NO: 2136650 - DNA, 19 bp, Homo sapiens
agacttcaggttgttctgt

SEQ ID NO: 2136651 - DNA, 18 bp, Homo sapiens
agacttcagtcctggtct

SEQ ID NO: 2136652 - DNA, 20 bp, Homo sapiens
agacttcgactcaggatcca

SEQ ID NO: 2136653 - DNA, 19 bp, Homo sapiens
agacttctggaaggctggc

SEQ ID NO: 2136654 - DNA, 20 bp, Homo sapiens
agacttctggaaggctggct

SEQ ID NO: 2136655 - DNA, 18 bp, Homo sapiens
agacttgacaacatccca

SEQ ID NO: 2136656 - DNA, 22 bp, Homo sapiens
agacttgacaacatcccacagt

SEQ ID NO: 2136657 - DNA, 23 bp, Homo sapiens
agacttgacaacatcccacagtg

SEQ ID NO: 2136658 - DNA, 13 bp, Homo sapiens
agacttgacagtg

SEQ ID NO: 2136659 - DNA, 17 bp, Homo sapiens
agacttggcaacagaag

SEQ ID NO: 2136660 - DNA, 18 bp, Homo sapiens
agacttggcaacagaagc

SEQ ID NO: 2136661 - DNA, 12 bp, Homo sapiens
agactttctgtt

SEQ ID NO: 2136662 - DNA, 16 bp, Homo sapiens
agagaaaaaccaatga

SEQ ID NO: 2136663 - DNA, 16 bp, Homo sapiens
agagaaaaagaaatgc

SEQ ID NO: 2136664 - DNA, 21 bp, Homo sapiens
agagaaaaagaaatgcaaaaa

SEQ ID NO: 2136665 - DNA, 17 bp, Homo sapiens
agagaaaaagtgcccct

SEQ ID NO: 2136666 - DNA, 19 bp, Homo sapiens
agagaaaacttatttgagt

SEQ ID NO: 2136667 - DNA, 22 bp, Homo sapiens
agagaaaagattaaaattagtg

SEQ ID NO: 2136668 - DNA, 17 bp, Homo sapiens
agagaaagaagagacag

SEQ ID NO: 2136669 - DNA, 11 bp, Homo sapiens
agagaaatctc

SEQ ID NO: 2136670 - DNA, 20 bp, Homo sapiens
agagaaatgtgaagggtggg

SEQ ID NO: 2136671 - DNA, 21 bp, Homo sapiens
agagaaatttttatttttgaa

SEQ ID NO: 2136672 - DNA, 22 bp, Homo sapiens
agagaaatttttatttttgaac

SEQ ID NO: 2136673 - DNA, 13 bp, Homo sapiens
agagaagaaagtg

SEQ ID NO: 2136674 - DNA, 14 bp, Homo sapiens
agagaagaaagtgt

SEQ ID NO: 2136675 - DNA, 19 bp, Homo sapiens
agagaagatgtgatttatt

SEQ ID NO: 2136676 - DNA, 20 bp, Homo sapiens
agagaagatgtgatttattt

SEQ ID NO: 2136677 - DNA, 15 bp, Homo sapiens
agagaagccacgctg

SEQ ID NO: 2136678 - DNA, 17 bp, Homo sapiens
agagaagccacgctgtc

SEQ ID NO: 2136679 - DNA, 14 bp, Homo sapiens
agagaagctgagaa

SEQ ID NO: 2136680 - DNA, 15 bp, Homo sapiens
agagaaggagatcag

SEQ ID NO: 2136681 - DNA, 12 bp, Homo sapiens
agagaaggagcc

SEQ ID NO: 2136682 - DNA, 13 bp, Homo sapiens
agagaaggagcca

SEQ ID NO: 2136683 - DNA, 13 bp, Homo sapiens
agagaagggaagc

SEQ ID NO: 2136684 - DNA, 20 bp, Homo sapiens
agagaagggaagcctcttca

SEQ ID NO: 2136685 - DNA, 22 bp, Homo sapiens
agagaagggggattggagggaa

SEQ ID NO: 2136686 - DNA, 19 bp, Homo sapiens
agagaataaagacttcatg

SEQ ID NO: 2136687 - DNA, 18 bp, Homo sapiens
agagaatatatttttgat

SEQ ID NO: 2136688 - DNA, 17 bp, Homo sapiens
agagaatatttcaaatg

SEQ ID NO: 2136689 - DNA, 13 bp, Homo sapiens
agagaatctgcct

SEQ ID NO: 2136690 - DNA, 17 bp, Homo sapiens
agagaatgggtttactc

SEQ ID NO: 2136691 - DNA, 20 bp, Homo sapiens
agagaatgggtttactctca

SEQ ID NO: 2136692 - DNA, 21 bp, Homo sapiens
agagaatgggtttactctcaa

SEQ ID NO: 2136693 - DNA, 21 bp, Homo sapiens
agagaattctaagattgtaca

SEQ ID NO: 2136694 - DNA, 22 bp, Homo sapiens
agagaattctaagattgtacat

SEQ ID NO: 2136695 - DNA, 13 bp, Homo sapiens
agagacacagaga

SEQ ID NO: 2136696 - DNA, 15 bp, Homo sapiens
agagacacagagatg

SEQ ID NO: 2136697 - DNA, 16 bp, Homo sapiens
agagacactcccaggg

SEQ ID NO: 2136698 - DNA, 21 bp, Homo sapiens
agagacactcccagggacaag

SEQ ID NO: 2136699 - DNA, 18 bp, Homo sapiens
agagacagaaacagagag

SEQ ID NO: 2136700 - DNA, 19 bp, Homo sapiens
agagacagagcccccaagc

SEQ ID NO: 2136701 - DNA, 13 bp, Homo sapiens
agagacaggaaaa

SEQ ID NO: 2136702 - DNA, 14 bp, Homo sapiens
agagaccacagcaa

SEQ ID NO: 2136703 - DNA, 17 bp, Homo sapiens
agagacccagatctcat

SEQ ID NO: 2136704 - DNA, 15 bp, Homo sapiens
agagaccccaggatc

SEQ ID NO: 2136705 - DNA, 19 bp, Homo sapiens
agagaccttttctctccca

SEQ ID NO: 2136706 - DNA, 18 bp, Homo sapiens
agagactatggagcctgg

SEQ ID NO: 2136707 - DNA, 14 bp, Homo sapiens
agagactctggaag

SEQ ID NO: 2136708 - DNA, 21 bp, Homo sapiens
agagactctggaagcccccca

SEQ ID NO: 2136709 - DNA, 24 bp, Homo sapiens
agagactgaaagcagcagctagga

SEQ ID NO: 2136710 - DNA, 16 bp, Homo sapiens
agagacttggggacca

SEQ ID NO: 2136711 - DNA, 12 bp, Homo sapiens
agagagaaatct

SEQ ID NO: 2136712 - DNA, 20 bp, Homo sapiens
agagagaacaactactgtga

SEQ ID NO: 2136713 - DNA, 11 bp, Homo sapiens
agagagaagcc

SEQ ID NO: 2136714 - DNA, 23 bp, Homo sapiens
agagagaccctcactgctgggga

SEQ ID NO: 2136715 - DNA, 14 bp, Homo sapiens
agagagagaccctc

SEQ ID NO: 2136716 - DNA, 14 bp, Homo sapiens
agagagaggcagaa

SEQ ID NO: 2136717 - DNA, 23 bp, Homo sapiens
agagagagggcctgctggagagc

SEQ ID NO: 2136718 - DNA, 19 bp, Homo sapiens
agagagaggttctggggag

SEQ ID NO: 2136719 - DNA, 16 bp, Homo sapiens
agagagcagaaataaa

SEQ ID NO: 2136720 - DNA, 21 bp, Homo sapiens
agagagccctgggtgacttca

SEQ ID NO: 2136721 - DNA, 22 bp, Homo sapiens
agagagccctgggtgacttcag

SEQ ID NO: 2136722 - DNA, 17 bp, Homo sapiens
agagagcttagcctgga

SEQ ID NO: 2136723 - DNA, 18 bp, Homo sapiens
agagaggaccccactgga

SEQ ID NO: 2136724 - DNA, 17 bp, Homo sapiens
agagaggatgcagaggg

SEQ ID NO: 2136725 - DNA, 15 bp, Homo sapiens
agagaggcacctgct

SEQ ID NO: 2136726 - DNA, 18 bp, Homo sapiens
agagaggcacctgctgga

SEQ ID NO: 2136727 - DNA, 20 bp, Homo sapiens
agagaggcgcgtctgcccca

SEQ ID NO: 2136728 - DNA, 13 bp, Homo sapiens
agagaggctggca

SEQ ID NO: 2136729 - DNA, 15 bp, Homo sapiens
agatggtgaaattta

SEQ ID NO: 2136730 - DNA, 17 bp, Homo sapiens
agatgtaaaaggtatta

SEQ ID NO: 2136731 - DNA, 20 bp, Homo sapiens
agatgtaccatgttaaagag

SEQ ID NO: 2136732 - DNA, 14 bp, Homo sapiens
agatgtaggaggga

SEQ ID NO: 2136733 - DNA, 15 bp, Homo sapiens
agatgtaggagggac

SEQ ID NO: 2136734 - DNA, 16 bp, Homo sapiens
agatgtaggagggact

SEQ ID NO: 2136735 - DNA, 15 bp, Homo sapiens
agatgtcaaatatct

SEQ ID NO: 2136736 - DNA, 15 bp, Homo sapiens
agatgtcagactggc

SEQ ID NO: 2136737 - DNA, 18 bp, Homo sapiens
agatgtcagccgagccgg

SEQ ID NO: 2136738 - DNA, 19 bp, Homo sapiens
agatgtgcaagtcttgtca

SEQ ID NO: 2136739 - DNA, 19 bp, Homo sapiens
agatgtgttgctatcctga

SEQ ID NO: 2136740 - DNA, 15 bp, Homo sapiens
agatgttgtcattat

SEQ ID NO: 2136741 - DNA, 17 bp, Homo sapiens
agatgtttgtcagatat

SEQ ID NO: 2136742 - DNA, 13 bp, Homo sapiens
agatgttttacaa

SEQ ID NO: 2136743 - DNA, 19 bp, Homo sapiens
agatgttttacaaatttaa

SEQ ID NO: 2136744 - DNA, 18 bp, Homo sapiens
agatgtttttaaaagttt

SEQ ID NO: 2136745 - DNA, 20 bp, Homo sapiens
agatgtttttaaaagtttca

SEQ ID NO: 2136746 - DNA, 22 bp, Homo sapiens
agatgtttttaaaagtttcaat

SEQ ID NO: 2136747 - DNA, 18 bp, Homo sapiens
agattaaaaagtaaaaga

SEQ ID NO: 2136748 - DNA, 12 bp, Homo sapiens
agattaaaggaa

SEQ ID NO: 2136749 - DNA, 18 bp, Homo sapiens
agattaaaggaaggaaaa

SEQ ID NO: 2136750 - DNA, 15 bp, Homo sapiens
agattaatggcactg

SEQ ID NO: 2136751 - DNA, 13 bp, Homo sapiens
agattacctgcca

SEQ ID NO: 2136752 - DNA, 15 bp, Homo sapiens
agattacctgccact

SEQ ID NO: 2136753 - DNA, 15 bp, Homo sapiens
agattactttgtccc

SEQ ID NO: 2136754 - DNA, 17 bp, Homo sapiens
agattagaagtgtttta

SEQ ID NO: 2136755 - DNA, 14 bp, Homo sapiens
agattagctctgga

SEQ ID NO: 2136756 - DNA, 12 bp, Homo sapiens
agattcattttt

SEQ ID NO: 2136757 - DNA, 18 bp, Homo sapiens
agattccacacaaaatgt

SEQ ID NO: 2136758 - DNA, 22 bp, Homo sapiens
agattccacacaaaatgtcaca

SEQ ID NO: 2136759 - DNA, 22 bp, Homo sapiens
agattccagagagtggctcctc

SEQ ID NO: 2136760 - DNA, 12 bp, Homo sapiens
agattcccagag

SEQ ID NO: 2136761 - DNA, 21 bp, Homo sapiens
agattcctcttgcctctctca

SEQ ID NO: 2136762 - DNA, 13 bp, Homo sapiens
agattcctgggcc

SEQ ID NO: 2136763 - DNA, 17 bp, Homo sapiens
agattcctgggcctgtc

SEQ ID NO: 2136764 - DNA, 14 bp, Homo sapiens
agattctgattcag

SEQ ID NO: 2136765 - DNA, 14 bp, Homo sapiens
agattgacaaggta

SEQ ID NO: 2136766 - DNA, 19 bp, Homo sapiens
agattgagagaagagacaa

SEQ ID NO: 2136767 - DNA, 19 bp, Homo sapiens
agattgaggcctgccctca

SEQ ID NO: 2136768 - DNA, 18 bp, Homo sapiens
agattgcaaagtcgacat

SEQ ID NO: 2136769 - DNA, 16 bp, Homo sapiens
agattgcaacaggctg

SEQ ID NO: 2136770 - DNA, 15 bp, Homo sapiens
agattgcttaaaata

SEQ ID NO: 2136771 - DNA, 16 bp, Homo sapiens
agattgcttaaaatag

SEQ ID NO: 2136772 - DNA, 13 bp, Homo sapiens
agattgtgtaaat

SEQ ID NO: 2136773 - DNA, 21 bp, Homo sapiens
agattgtgtaacaattttaat

SEQ ID NO: 2136774 - DNA, 23 bp, Homo sapiens
agattgttttatcatgacatgtt

SEQ ID NO: 2136775 - DNA, 20 bp, Homo sapiens
agatttaccagggatgtaga

SEQ ID NO: 2136776 - DNA, 20 bp, Homo sapiens
agatttatgtaatgctttat

SEQ ID NO: 2136777 - DNA, 18 bp, Homo sapiens
agatttcaagaaaaaata

SEQ ID NO: 2136778 - DNA, 13 bp, Homo sapiens
agatttcttttaa

SEQ ID NO: 2136779 - DNA, 16 bp, Homo sapiens
agattttctgctactt

SEQ ID NO: 2136780 - DNA, 19 bp, Homo sapiens
agattttctgctactttgc

SEQ ID NO: 2136781 - DNA, 18 bp, Homo sapiens
agattttgtcgggacaga

SEQ ID NO: 2136782 - DNA, 16 bp, Homo sapiens
agatttttaacgaatg

SEQ ID NO: 2136783 - DNA, 14 bp, Homo sapiens
agcaaaaaagaaaa

SEQ ID NO: 2136784 - DNA, 16 bp, Homo sapiens
agcaaaaatataaaat

SEQ ID NO: 2136785 - DNA, 21 bp, Homo sapiens
agcaaaataattttaaacaaa

SEQ ID NO: 2136786 - DNA, 16 bp, Homo sapiens
agcaaaattataagaa

SEQ ID NO: 2136787 - DNA, 19 bp, Homo sapiens
agcaaaattataagaagag

SEQ ID NO: 2136788 - DNA, 22 bp, Homo sapiens
agcaaaattataagaagaggaa

SEQ ID NO: 2136789 - DNA, 22 bp, Homo sapiens
agcaaacctcagtcatattctt

SEQ ID NO: 2136790 - DNA, 20 bp, Homo sapiens
agcaaagatatctcatctct

SEQ ID NO: 2136791 - DNA, 22 bp, Homo sapiens
agcaaagcaccagcttctccag

SEQ ID NO: 2136792 - DNA, 19 bp, Homo sapiens
agcaaagccacattttgca

SEQ ID NO: 2136793 - DNA, 12 bp, Homo sapiens
agcaaagcctgt

SEQ ID NO: 2136794 - DNA, 14 bp, Homo sapiens
agcaaaggaaacca

SEQ ID NO: 2136795 - DNA, 16 bp, Homo sapiens
agcaaaggaaaccaaa

SEQ ID NO: 2136796 - DNA, 23 bp, Homo sapiens
agcaaaggagtagaaagacagag

SEQ ID NO: 2136797 - DNA, 20 bp, Homo sapiens
agcaaagtctaaagtttaca

SEQ ID NO: 2136798 - DNA, 22 bp, Homo sapiens
agcaaagtctaaagtttacagt

SEQ ID NO: 2136799 - DNA, 16 bp, Homo sapiens
agcaaagtgtcagtgt

SEQ ID NO: 2136800 - DNA, 17 bp, Homo sapiens
agcaaatcgaatgaaat

SEQ ID NO: 2136801 - DNA, 24 bp, Homo sapiens
agcaaatttcaaaagacatgttgt

SEQ ID NO: 2136802 - DNA, 13 bp, Homo sapiens
agcaacagaaaaa

SEQ ID NO: 2136803 - DNA, 18 bp, Homo sapiens
agcaacaggaatctcaga

SEQ ID NO: 2136804 - DNA, 13 bp, Homo sapiens
agcaacattttat

SEQ ID NO: 2136805 - DNA, 20 bp, Homo sapiens
agcaaccgtggcccttcctg

SEQ ID NO: 2136806 - DNA, 23 bp, Homo sapiens
agcaaccgtggcccttcctggac

SEQ ID NO: 2136807 - DNA, 15 bp, Homo sapiens
agcaacctcagtaat

SEQ ID NO: 2136808 - DNA, 14 bp, Homo sapiens
agcaacgcaggccc

SEQ ID NO: 2136809 - DNA, 11 bp, Homo sapiens
agcaactccca

SEQ ID NO: 2136810 - DNA, 12 bp, Homo sapiens
agcaactcccac

SEQ ID NO: 2136811 - DNA, 18 bp, Homo sapiens
agcaactctccactccat

SEQ ID NO: 2136812 - DNA, 20 bp, Homo sapiens
agcaactgttggataataac

SEQ ID NO: 2136813 - DNA, 12 bp, Homo sapiens
agcaagaaagcc

SEQ ID NO: 2136814 - DNA, 19 bp, Homo sapiens
agcaagaaggcaaaaatag

SEQ ID NO: 2136815 - DNA, 22 bp, Homo sapiens
agcaagactccgtctcaaaaaa

SEQ ID NO: 2136816 - DNA, 17 bp, Homo sapiens
agcaagagctggcaaag

SEQ ID NO: 2136817 - DNA, 23 bp, Homo sapiens
agcaagagctggcaaaggtggct

SEQ ID NO: 2136818 - DNA, 16 bp, Homo sapiens
agcaagatcttgtctc

SEQ ID NO: 2136819 - DNA, 17 bp, Homo sapiens
agcaagatcttgtctcc

SEQ ID NO: 2136820 - DNA, 19 bp, Homo sapiens
agcaaggcccgagcagctg

SEQ ID NO: 2136821 - DNA, 20 bp, Homo sapiens
agcaagggtgatgggaaagc

SEQ ID NO: 2136822 - DNA, 13 bp, Homo sapiens
agcaagtgagagc

SEQ ID NO: 2136823 - DNA, 14 bp, Homo sapiens
agcaagtgagagct

SEQ ID NO: 2136824 - DNA, 15 bp, Homo sapiens
agcaagtgagagctg

SEQ ID NO: 2136825 - DNA, 18 bp, Homo sapiens
agcaagtgagagctgggt

SEQ ID NO: 2136826 - DNA, 18 bp, Homo sapiens
agcaataattaggatcta

SEQ ID NO: 2136827 - DNA, 19 bp, Homo sapiens
agcaataattaggatctat

SEQ ID NO: 2136828 - DNA, 17 bp, Homo sapiens
agcaatccatgttagtt

SEQ ID NO: 2136829 - DNA, 20 bp, Homo sapiens
agcaatccatgttagttttt

SEQ ID NO: 2136830 - DNA, 22 bp, Homo sapiens
agcaatccatgttagtttttac

SEQ ID NO: 2136831 - DNA, 20 bp, Homo sapiens
agcaatgatgtccagaagaa

SEQ ID NO: 2136832 - DNA, 23 bp, Homo sapiens
agcaatgatgtccagaagaatat

SEQ ID NO: 2136833 - DNA, 20 bp, Homo sapiens
agcaatgcccgtaatgctta

SEQ ID NO: 2136834 - DNA, 16 bp, Homo sapiens
agcaatgggagggggc

SEQ ID NO: 2136835 - DNA, 19 bp, Homo sapiens
agcaatgggagggggctcc

SEQ ID NO: 2136836 - DNA, 14 bp, Homo sapiens
agcaattatattgt

SEQ ID NO: 2136837 - DNA, 23 bp, Homo sapiens
agcaattctacccagagccttct

SEQ ID NO: 2136838 - DNA, 14 bp, Homo sapiens
agcaattgccctgt

SEQ ID NO: 2136839 - DNA, 21 bp, Homo sapiens
agcaatttcgccgttgaagag

SEQ ID NO: 2136840 - DNA, 14 bp, Homo sapiens
agcaatttgcacat

SEQ ID NO: 2136841 - DNA, 18 bp, Homo sapiens
agcacaagttatttaaat

SEQ ID NO: 2136842 - DNA, 19 bp, Homo sapiens
agcacaagttccagctggt

SEQ ID NO: 2136843 - DNA, 20 bp, Homo sapiens
agcacaagttccagctggtc

SEQ ID NO: 2136844 - DNA, 14 bp, Homo sapiens
agccccagggcctg

SEQ ID NO: 2136845 - DNA, 15 bp, Homo sapiens
agccccagggcctgg

SEQ ID NO: 2136846 - DNA, 16 bp, Homo sapiens
agccccagggcctggg

SEQ ID NO: 2136847 - DNA, 20 bp, Homo sapiens
agccccagggcctgggggca

SEQ ID NO: 2136848 - DNA, 11 bp, Homo sapiens
agccccagggg

SEQ ID NO: 2136849 - DNA, 16 bp, Homo sapiens
agccccattctgcctg

SEQ ID NO: 2136850 - DNA, 20 bp, Homo sapiens
agccccattctgcctgccca

SEQ ID NO: 2136851 - DNA, 21 bp, Homo sapiens
agccccattctgcctgcccag

SEQ ID NO: 2136852 - DNA, 21 bp, Homo sapiens
agcccccaaccccgcggtgct

SEQ ID NO: 2136853 - DNA, 13 bp, Homo sapiens
agcccccacccca

SEQ ID NO: 2136854 - DNA, 23 bp, Homo sapiens
agcccccacctccgccccagaca

SEQ ID NO: 2136855 - DNA, 16 bp, Homo sapiens
agcccccacttctctc

SEQ ID NO: 2136856 - DNA, 17 bp, Homo sapiens
agcccccacttctctcc

SEQ ID NO: 2136857 - DNA, 16 bp, Homo sapiens
agccccccacaatgat

SEQ ID NO: 2136858 - DNA, 14 bp, Homo sapiens
agccccccagcact

SEQ ID NO: 2136859 - DNA, 19 bp, Homo sapiens
agccccctaagagagcacc

SEQ ID NO: 2136860 - DNA, 20 bp, Homo sapiens
agccccctggatgggcattg

SEQ ID NO: 2136861 - DNA, 23 bp, Homo sapiens
agccccctggatgtcccctgtcc

SEQ ID NO: 2136862 - DNA, 15 bp, Homo sapiens
agccccgactccagc

SEQ ID NO: 2136863 - DNA, 18 bp, Homo sapiens
agccccgactccagccag

SEQ ID NO: 2136864 - DNA, 22 bp, Homo sapiens
agccccgactccagccagcgcc

SEQ ID NO: 2136865 - DNA, 23 bp, Homo sapiens
agccccgactccagccagcgcct

SEQ ID NO: 2136866 - DNA, 14 bp, Homo sapiens
agccccgaggcctt

SEQ ID NO: 2136867 - DNA, 21 bp, Homo sapiens
agccccgctcctcccctcttg

SEQ ID NO: 2136868 - DNA, 19 bp, Homo sapiens
agcccctaggaaagcagtg

SEQ ID NO: 2136869 - DNA, 13 bp, Homo sapiens
agcccctcagccc

SEQ ID NO: 2136870 - DNA, 14 bp, Homo sapiens
agcccctcagccct

SEQ ID NO: 2136871 - DNA, 17 bp, Homo sapiens
agcccctcagcccttgc

SEQ ID NO: 2136872 - DNA, 21 bp, Homo sapiens
agcccctcctccccttcctgc

SEQ ID NO: 2136873 - DNA, 22 bp, Homo sapiens
agcccctcctccccttcctgca

SEQ ID NO: 2136874 - DNA, 13 bp, Homo sapiens
agcccctcctctg

SEQ ID NO: 2136875 - DNA, 19 bp, Homo sapiens
agcccctcctctgccacct

SEQ ID NO: 2136876 - DNA, 23 bp, Homo sapiens
agcccctcctctgccacctcccc

SEQ ID NO: 2136877 - DNA, 15 bp, Homo sapiens
agcccctgtcatggt

SEQ ID NO: 2136878 - DNA, 21 bp, Homo sapiens
agccccttactatgatctcag

SEQ ID NO: 2136879 - DNA, 20 bp, Homo sapiens
agccccttcgaggttgcccc

SEQ ID NO: 2136880 - DNA, 18 bp, Homo sapiens
agccccttgtcctctccc

SEQ ID NO: 2136881 - DNA, 18 bp, Homo sapiens
agcccgaagcccagtttc

SEQ ID NO: 2136882 - DNA, 18 bp, Homo sapiens
agcccgagggcctgacag

SEQ ID NO: 2136883 - DNA, 13 bp, Homo sapiens
agcccggccaggg

SEQ ID NO: 2136884 - DNA, 17 bp, Homo sapiens
agcccggccagggcctg

SEQ ID NO: 2136885 - DNA, 18 bp, Homo sapiens
agcccggccagggcctgg

SEQ ID NO: 2136886 - DNA, 20 bp, Homo sapiens
agcccggcctgctcccagca

SEQ ID NO: 2136887 - DNA, 21 bp, Homo sapiens
agcccggcctgctcccagcag

SEQ ID NO: 2136888 - DNA, 21 bp, Homo sapiens
agcccggcgccaccatcctgc

SEQ ID NO: 2136889 - DNA, 21 bp, Homo sapiens
agcccgggtgtgcctgccctg

SEQ ID NO: 2136890 - DNA, 22 bp, Homo sapiens
agcccgggtgtgcctgccctgg

SEQ ID NO: 2136891 - DNA, 14 bp, Homo sapiens
agcccgtgtcctgc

SEQ ID NO: 2136892 - DNA, 19 bp, Homo sapiens
agcccgtgtcctgccttga

SEQ ID NO: 2136893 - DNA, 22 bp, Homo sapiens
agccctacatcttcagctccca

SEQ ID NO: 2136894 - DNA, 13 bp, Homo sapiens
agccctatggatg

SEQ ID NO: 2136895 - DNA, 15 bp, Homo sapiens
agccctatggatgtg

SEQ ID NO: 2136896 - DNA, 13 bp, Homo sapiens
agccctcaggcca

SEQ ID NO: 2136897 - DNA, 16 bp, Homo sapiens
agccctcaggccagtg

SEQ ID NO: 2136898 - DNA, 21 bp, Homo sapiens
agccctcaggccagtgccagg

SEQ ID NO: 2136899 - DNA, 22 bp, Homo sapiens
agccctcaggccagtgccagga

SEQ ID NO: 2136900 - DNA, 23 bp, Homo sapiens
agccctcaggccagtgccaggac

SEQ ID NO: 2136901 - DNA, 17 bp, Homo sapiens
agccctcagtcagttcc

SEQ ID NO: 2136902 - DNA, 16 bp, Homo sapiens
agccctcccccttccc

SEQ ID NO: 2136903 - DNA, 20 bp, Homo sapiens
agccctcccccttccccttc

SEQ ID NO: 2136904 - DNA, 12 bp, Homo sapiens
agccctccctgc

SEQ ID NO: 2136905 - DNA, 16 bp, Homo sapiens
agccctccctgcccct

SEQ ID NO: 2136906 - DNA, 23 bp, Homo sapiens
agccctccctggcatgtcagagc

SEQ ID NO: 2136907 - DNA, 22 bp, Homo sapiens
agccctccctgtcctcctcgga

SEQ ID NO: 2136908 - DNA, 13 bp, Homo sapiens
agccctcctcacc

SEQ ID NO: 2136909 - DNA, 18 bp, Homo sapiens
agccctcgaaccaaggca

SEQ ID NO: 2136910 - DNA, 17 bp, Homo sapiens
agccctgactggtgcta

SEQ ID NO: 2136911 - DNA, 17 bp, Homo sapiens
agccctgagctcaggct

SEQ ID NO: 2136912 - DNA, 22 bp, Homo sapiens
agccctgagctcaggctgagcc

SEQ ID NO: 2136913 - DNA, 13 bp, Homo sapiens
agccctgccagga

SEQ ID NO: 2136914 - DNA, 16 bp, Homo sapiens
agccctgccaggaggc

SEQ ID NO: 2136915 - DNA, 17 bp, Homo sapiens
agccctgccaggaggct

SEQ ID NO: 2136916 - DNA, 17 bp, Homo sapiens
agccctgcctggaggac

SEQ ID NO: 2136917 - DNA, 19 bp, Homo sapiens
agccctgcggagccggcac

SEQ ID NO: 2136918 - DNA, 21 bp, Homo sapiens
agccctgctgggcccatgtga

SEQ ID NO: 2136919 - DNA, 19 bp, Homo sapiens
agccctgctttgggctgcc

SEQ ID NO: 2136920 - DNA, 18 bp, Homo sapiens
agccctggcccagagctg

SEQ ID NO: 2136921 - DNA, 15 bp, Homo sapiens
agccctggctctgca

SEQ ID NO: 2136922 - DNA, 15 bp, Homo sapiens
agccctgggggccag

SEQ ID NO: 2136923 - DNA, 21 bp, Homo sapiens
agccctgggggccagctggtg

SEQ ID NO: 2136924 - DNA, 21 bp, Homo sapiens
agccctgggtgacttcaggtg

SEQ ID NO: 2136925 - DNA, 21 bp, Homo sapiens
agccctggtggcagtgggagc

SEQ ID NO: 2136926 - DNA, 16 bp, Homo sapiens
agccctggtgtgtttc

SEQ ID NO: 2136927 - DNA, 13 bp, Homo sapiens
agccctgtcccct

SEQ ID NO: 2136928 - DNA, 18 bp, Homo sapiens
agccctgtcgagacactt

SEQ ID NO: 2136929 - DNA, 21 bp, Homo sapiens
agcccttagcagggaaacagc

SEQ ID NO: 2136930 - DNA, 23 bp, Homo sapiens
agcccttccatgtcgcctctgca

SEQ ID NO: 2136931 - DNA, 11 bp, Homo sapiens
agcccttccct

SEQ ID NO: 2136932 - DNA, 15 bp, Homo sapiens
agcccttcctcctga

SEQ ID NO: 2136933 - DNA, 17 bp, Homo sapiens
agcccttctgcctttct

SEQ ID NO: 2136934 - DNA, 17 bp, Homo sapiens
agcccttgagctcccca

SEQ ID NO: 2136935 - DNA, 20 bp, Homo sapiens
agcccttgagctccccaaaa

SEQ ID NO: 2136936 - DNA, 14 bp, Homo sapiens
agcccttgccccca

SEQ ID NO: 2136937 - DNA, 19 bp, Homo sapiens
agcccttgcccccatccct

SEQ ID NO: 2136938 - DNA, 12 bp, Homo sapiens
agcccttgggtt

SEQ ID NO: 2136939 - DNA, 18 bp, Homo sapiens
agccctttctgtgtgcac

SEQ ID NO: 2136940 - DNA, 21 bp, Homo sapiens
agcccttttacagctcttggc

SEQ ID NO: 2136941 - DNA, 22 bp, Homo sapiens
agcccttttacagctcttggca

SEQ ID NO: 2136942 - DNA, 13 bp, Homo sapiens
agccgacctcagc

SEQ ID NO: 2136943 - DNA, 15 bp, Homo sapiens
agccgacctcagcct

SEQ ID NO: 2136944 - DNA, 18 bp, Homo sapiens
agccgagatcacgccact

SEQ ID NO: 2136945 - DNA, 18 bp, Homo sapiens
agccgagattgcgccact

SEQ ID NO: 2136946 - DNA, 19 bp, Homo sapiens
agccgagattgcgccactg

SEQ ID NO: 2136947 - DNA, 21 bp, Homo sapiens
agccgagattgcgccactgca

SEQ ID NO: 2136948 - DNA, 16 bp, Homo sapiens
agccgagccgggcctg

SEQ ID NO: 2136949 - DNA, 17 bp, Homo sapiens
agccgagccgggcctgg

SEQ ID NO: 2136950 - DNA, 15 bp, Homo sapiens
agccgcagcgcagcc

SEQ ID NO: 2136951 - DNA, 19 bp, Homo sapiens
agccgcagggacagaactg

SEQ ID NO: 2136952 - DNA, 12 bp, Homo sapiens
agccgccctggg

SEQ ID NO: 2136953 - DNA, 13 bp, Homo sapiens
agccgccctgggc

SEQ ID NO: 2136954 - DNA, 21 bp, Homo sapiens
agccgctcctgtctgccagcc

SEQ ID NO: 2136955 - DNA, 22 bp, Homo sapiens
agccgctcctgtctgccagcca

SEQ ID NO: 2136956 - DNA, 19 bp, Homo sapiens
agccgctgtgagcccctgg

SEQ ID NO: 2136957 - DNA, 22 bp, Homo sapiens
agccggcacctacatccccagg

SEQ ID NO: 2136958 - DNA, 20 bp, Homo sapiens
agctgagttacttgtctgag

SEQ ID NO: 2136959 - DNA, 20 bp, Homo sapiens
agctgagttccttataagaa

SEQ ID NO: 2136960 - DNA, 23 bp, Homo sapiens
agctgagttccttataagaatta

SEQ ID NO: 2136961 - DNA, 14 bp, Homo sapiens
agctgatcagaatt

SEQ ID NO: 2136962 - DNA, 13 bp, Homo sapiens
agctgatcagttt

SEQ ID NO: 2136963 - DNA, 22 bp, Homo sapiens
agctgatgaaactcctgatttt

SEQ ID NO: 2136964 - DNA, 15 bp, Homo sapiens
agctgatgatgtctc

SEQ ID NO: 2136965 - DNA, 14 bp, Homo sapiens
agctgatggagaag

SEQ ID NO: 2136966 - DNA, 15 bp, Homo sapiens
agctgatggagaagg

SEQ ID NO: 2136967 - DNA, 14 bp, Homo sapiens
agctgatttccagg

SEQ ID NO: 2136968 - DNA, 15 bp, Homo sapiens
agctgatttccaggc

SEQ ID NO: 2136969 - DNA, 19 bp, Homo sapiens
agctgatttccaggcccct

SEQ ID NO: 2136970 - DNA, 20 bp, Homo sapiens
agctgatttccaggcccctg

SEQ ID NO: 2136971 - DNA, 23 bp, Homo sapiens
agctgatttccaggcccctgagg

SEQ ID NO: 2136972 - DNA, 16 bp, Homo sapiens
agctgcacctgccagc

SEQ ID NO: 2136973 - DNA, 21 bp, Homo sapiens
agctgcacctgccagcctggc

SEQ ID NO: 2136974 - DNA, 17 bp, Homo sapiens
agctgcagctgggcccc

SEQ ID NO: 2136975 - DNA, 11 bp, Homo sapiens
agctgcagctt

SEQ ID NO: 2136976 - DNA, 17 bp, Homo sapiens
agctgcagcttcctgtc

SEQ ID NO: 2136977 - DNA, 16 bp, Homo sapiens
agctgcaggaatcaaa

SEQ ID NO: 2136978 - DNA, 22 bp, Homo sapiens
agctgcaggaatcaaaaattga

SEQ ID NO: 2136979 - DNA, 18 bp, Homo sapiens
agctgccgaccagagccc

SEQ ID NO: 2136980 - DNA, 18 bp, Homo sapiens
agctgcctgtagttagga

SEQ ID NO: 2136981 - DNA, 19 bp, Homo sapiens
agctgcctgtagttaggaa

SEQ ID NO: 2136982 - DNA, 19 bp, Homo sapiens
agctgcctgttcagctcca

SEQ ID NO: 2136983 - DNA, 22 bp, Homo sapiens
agctgcctgttcagctccagct

SEQ ID NO: 2136984 - DNA, 18 bp, Homo sapiens
agctgccttcctcatccc

SEQ ID NO: 2136985 - DNA, 19 bp, Homo sapiens
agctgcggtccacccagga

SEQ ID NO: 2136986 - DNA, 22 bp, Homo sapiens
agctgcgtttattaatgcctct

SEQ ID NO: 2136987 - DNA, 23 bp, Homo sapiens
agctgctcctggctgaggggctt

SEQ ID NO: 2136988 - DNA, 15 bp, Homo sapiens
agctgctctgcccct

SEQ ID NO: 2136989 - DNA, 17 bp, Homo sapiens
agctgctctgccccttg

SEQ ID NO: 2136990 - DNA, 13 bp, Homo sapiens
agctgctctgcta

SEQ ID NO: 2136991 - DNA, 14 bp, Homo sapiens
agctgctctggaaa

SEQ ID NO: 2136992 - DNA, 20 bp, Homo sapiens
agctgctgaaacaacaaata

SEQ ID NO: 2136993 - DNA, 12 bp, Homo sapiens
agctgctgaaga

SEQ ID NO: 2136994 - DNA, 13 bp, Homo sapiens
agctgctgaagag

SEQ ID NO: 2136995 - DNA, 19 bp, Homo sapiens
agctgctgaagttctgagc

SEQ ID NO: 2136996 - DNA, 12 bp, Homo sapiens
agctgctgacag

SEQ ID NO: 2136997 - DNA, 21 bp, Homo sapiens
agctgctgttccaacagacag

SEQ ID NO: 2136998 - DNA, 19 bp, Homo sapiens
agctgcttgtcctgctctc

SEQ ID NO: 2136999 - DNA, 14 bp, Homo sapiens
agctgctttaaatc

SEQ ID NO: 2137000 - DNA, 23 bp, Homo sapiens
agctgcttttgtctatgggactc

SEQ ID NO: 2137001 - DNA, 15 bp, Homo sapiens
agctggaaagcagcc

SEQ ID NO: 2137002 - DNA, 12 bp, Homo sapiens
agctggaaataa

SEQ ID NO: 2137003 - DNA, 18 bp, Homo sapiens
agctggaaataaacctgg

SEQ ID NO: 2137004 - DNA, 12 bp, Homo sapiens
agctggaagcac

SEQ ID NO: 2137005 - DNA, 18 bp, Homo sapiens
agctggaaggcagggcag

SEQ ID NO: 2137006 - DNA, 14 bp, Homo sapiens
agctggacaagaag

SEQ ID NO: 2137007 - DNA, 18 bp, Homo sapiens
agctggacaagaagctgc

SEQ ID NO: 2137008 - DNA, 13 bp, Homo sapiens
agctggaggacta

SEQ ID NO: 2137009 - DNA, 20 bp, Homo sapiens
agctggaggactagaacctg

SEQ ID NO: 2137010 - DNA, 22 bp, Homo sapiens
agctggaggactagaacctgga

SEQ ID NO: 2137011 - DNA, 21 bp, Homo sapiens
agctggcattacagctggaga

SEQ ID NO: 2137012 - DNA, 20 bp, Homo sapiens
agctggccacagtgagctga

SEQ ID NO: 2137013 - DNA, 15 bp, Homo sapiens
agctggccctttcca

SEQ ID NO: 2137014 - DNA, 11 bp, Homo sapiens
agctggcctct

SEQ ID NO: 2137015 - DNA, 18 bp, Homo sapiens
agctggcctctagaacac

SEQ ID NO: 2137016 - DNA, 23 bp, Homo sapiens
agctggcctctagaacacccact

SEQ ID NO: 2137017 - DNA, 12 bp, Homo sapiens
agctggctgctg

SEQ ID NO: 2137018 - DNA, 20 bp, Homo sapiens
agctgggaaaaaagttttga

SEQ ID NO: 2137019 - DNA, 18 bp, Homo sapiens
agctgggaaacagggagc

SEQ ID NO: 2137020 - DNA, 20 bp, Homo sapiens
agctgggaaacagggagccc

SEQ ID NO: 2137021 - DNA, 22 bp, Homo sapiens
agctgggaacccgactgtgaaa

SEQ ID NO: 2137022 - DNA, 14 bp, Homo sapiens
agctgggacccctc

SEQ ID NO: 2137023 - DNA, 14 bp, Homo sapiens
agctgggaggcatg

SEQ ID NO: 2137024 - DNA, 22 bp, Homo sapiens
agctgggaggcatggccctggg

SEQ ID NO: 2137025 - DNA, 19 bp, Homo sapiens
agctgggcaccacaggctg

SEQ ID NO: 2137026 - DNA, 23 bp, Homo sapiens
agctgggcaggtctcctctggga

SEQ ID NO: 2137027 - DNA, 16 bp, Homo sapiens
agctgggccccatgct

SEQ ID NO: 2137028 - DNA, 21 bp, Homo sapiens
agctgggccccatgctctgcc

SEQ ID NO: 2137029 - DNA, 12 bp, Homo sapiens
agctgggccggc

SEQ ID NO: 2137030 - DNA, 21 bp, Homo sapiens
agctggggcctggagaggggc

SEQ ID NO: 2137031 - DNA, 22 bp, Homo sapiens
agctggggcctggagaggggcc

SEQ ID NO: 2137032 - DNA, 23 bp, Homo sapiens
agctggggcctggagaggggcct

SEQ ID NO: 2137033 - DNA, 17 bp, Homo sapiens
agctgggtgtcaagagg

SEQ ID NO: 2137034 - DNA, 16 bp, Homo sapiens
agctggtcccactcag

SEQ ID NO: 2137035 - DNA, 19 bp, Homo sapiens
agctggtcccactcagtcc

SEQ ID NO: 2137036 - DNA, 18 bp, Homo sapiens
agctggtgctgcaaggaa

SEQ ID NO: 2137037 - DNA, 15 bp, Homo sapiens
agctggttagaaatg

SEQ ID NO: 2137038 - DNA, 23 bp, Homo sapiens
agctggttgctacattttcagga

SEQ ID NO: 2137039 - DNA, 20 bp, Homo sapiens
agctggtttaatgttttggc

SEQ ID NO: 2137040 - DNA, 15 bp, Homo sapiens
agctgtaaaaagaga

SEQ ID NO: 2137041 - DNA, 19 bp, Homo sapiens
agctgtaaaaagagagaaa

SEQ ID NO: 2137042 - DNA, 21 bp, Homo sapiens
agctgtactcagagcagagca

SEQ ID NO: 2137043 - DNA, 15 bp, Homo sapiens
agctgtagaaatgta

SEQ ID NO: 2137044 - DNA, 20 bp, Homo sapiens
agctgtagccatggctcagg

SEQ ID NO: 2137045 - DNA, 22 bp, Homo sapiens
agctgtagccatggctcaggca

SEQ ID NO: 2137046 - DNA, 16 bp, Homo sapiens
agctgtagctcccgag

SEQ ID NO: 2137047 - DNA, 17 bp, Homo sapiens
agctgtagctcccgagc

SEQ ID NO: 2137048 - DNA, 23 bp, Homo sapiens
agctgtagtagccctttctgtgt

SEQ ID NO: 2137049 - DNA, 20 bp, Homo sapiens
agctgtatatatatatgtgt

SEQ ID NO: 2137050 - DNA, 15 bp, Homo sapiens
agctgtccctgtcac

SEQ ID NO: 2137051 - DNA, 18 bp, Homo sapiens
agctgtccctgtcaccaa

SEQ ID NO: 2137052 - DNA, 22 bp, Homo sapiens
agctgtccctgtcaccaagctc

SEQ ID NO: 2137053 - DNA, 13 bp, Homo sapiens
agctgtcgcatct

SEQ ID NO: 2137054 - DNA, 13 bp, Homo sapiens
agctgtctccagg

SEQ ID NO: 2137055 - DNA, 17 bp, Homo sapiens
agctgtgaacatggact

SEQ ID NO: 2137056 - DNA, 15 bp, Homo sapiens
agctgtgacctgctg

SEQ ID NO: 2137057 - DNA, 19 bp, Homo sapiens
agctgtgacctgctgagct

SEQ ID NO: 2137058 - DNA, 22 bp, Homo sapiens
agctgtgacctgctgagctctg

SEQ ID NO: 2137059 - DNA, 12 bp, Homo sapiens
agctgtgatttt

SEQ ID NO: 2137060 - DNA, 18 bp, Homo sapiens
agctgtgctctggacagg

SEQ ID NO: 2137061 - DNA, 20 bp, Homo sapiens
agctgtgctctggacaggca

SEQ ID NO: 2137062 - DNA, 15 bp, Homo sapiens
agctgtgtccttgca

SEQ ID NO: 2137063 - DNA, 14 bp, Homo sapiens
agctgtgtgaaata

SEQ ID NO: 2137064 - DNA, 23 bp, Homo sapiens
agctgtgtgaaataccagtgtgg

SEQ ID NO: 2137065 - DNA, 19 bp, Homo sapiens
agctgttcacagccagact

SEQ ID NO: 2137066 - DNA, 19 bp, Homo sapiens
agctgttccacttctctag

SEQ ID NO: 2137067 - DNA, 15 bp, Homo sapiens
agctgttgagctgtt

SEQ ID NO: 2137068 - DNA, 16 bp, Homo sapiens
agctgttgagctgttt

SEQ ID NO: 2137069 - DNA, 14 bp, Homo sapiens
agctgttggcctcg

SEQ ID NO: 2137070 - DNA, 22 bp, Homo sapiens
agctgttggcctcgcctgggcc

SEQ ID NO: 2137071 - DNA, 23 bp, Homo sapiens
agctgttggcctcgcctgggccc

SEQ ID NO: 2137072 - DNA, 12 bp, Homo sapiens
aggatttaacag

SEQ ID NO: 2137073 - DNA, 12 bp, Homo sapiens
aggatttcaagc

SEQ ID NO: 2137074 - DNA, 14 bp, Homo sapiens
aggatttcaagcct

SEQ ID NO: 2137075 - DNA, 15 bp, Homo sapiens
aggcaaagcccctgg

SEQ ID NO: 2137076 - DNA, 20 bp, Homo sapiens
aggcaaaggccagcagcaga

SEQ ID NO: 2137077 - DNA, 16 bp, Homo sapiens
aggcaactgaggcaga

SEQ ID NO: 2137078 - DNA, 17 bp, Homo sapiens
aggcaactgaggcagac

SEQ ID NO: 2137079 - DNA, 15 bp, Homo sapiens
aggcaagagacagaa

SEQ ID NO: 2137080 - DNA, 17 bp, Homo sapiens
aggcaagagacagaatg

SEQ ID NO: 2137081 - DNA, 17 bp, Homo sapiens
aggcaagcccctcagcc

SEQ ID NO: 2137082 - DNA, 18 bp, Homo sapiens
aggcaagcccctcagccc

SEQ ID NO: 2137083 - DNA, 15 bp, Homo sapiens
aggcaagtttctagc

SEQ ID NO: 2137084 - DNA, 22 bp, Homo sapiens
aggcaatgtcaggaacagaagg

SEQ ID NO: 2137085 - DNA, 17 bp, Homo sapiens
aggcacacagcagcccc

SEQ ID NO: 2137086 - DNA, 21 bp, Homo sapiens
aggcacacagcagccccccag

SEQ ID NO: 2137087 - DNA, 15 bp, Homo sapiens
aggcacacttcttct

SEQ ID NO: 2137088 - DNA, 17 bp, Homo sapiens
aggcacaggtgtaaata

SEQ ID NO: 2137089 - DNA, 17 bp, Homo sapiens
aggcacatggaggagct

SEQ ID NO: 2137090 - DNA, 17 bp, Homo sapiens
aggcaccaaaagaagta

SEQ ID NO: 2137091 - DNA, 14 bp, Homo sapiens
aggcaccagctctg

SEQ ID NO: 2137092 - DNA, 16 bp, Homo sapiens
aggcaccagctctgtg

SEQ ID NO: 2137093 - DNA, 20 bp, Homo sapiens
aggcacccaccatcatgtct

SEQ ID NO: 2137094 - DNA, 21 bp, Homo sapiens
aggcacccaccatcatgtctg

SEQ ID NO: 2137095 - DNA, 22 bp, Homo sapiens
aggcacccaccatcatgtctgg

SEQ ID NO: 2137096 - DNA, 17 bp, Homo sapiens
aggcaccccctggagag

SEQ ID NO: 2137097 - DNA, 20 bp, Homo sapiens
aggcaccccctggagagaag

SEQ ID NO: 2137098 - DNA, 16 bp, Homo sapiens
aggcaccggcgctgca

SEQ ID NO: 2137099 - DNA, 19 bp, Homo sapiens
aggcaccggcgctgcaggt

SEQ ID NO: 2137100 - DNA, 16 bp, Homo sapiens
aggcacctggcctgct

SEQ ID NO: 2137101 - DNA, 20 bp, Homo sapiens
aggcacctggcctgctggga

SEQ ID NO: 2137102 - DNA, 22 bp, Homo sapiens
aggcacctggcctgctgggaac

SEQ ID NO: 2137103 - DNA, 20 bp, Homo sapiens
aggcacgaacccacctgctg

SEQ ID NO: 2137104 - DNA, 22 bp, Homo sapiens
aggcacgccagtttcaccattt

SEQ ID NO: 2137105 - DNA, 23 bp, Homo sapiens
aggcacgccagtttcaccatttc

SEQ ID NO: 2137106 - DNA, 20 bp, Homo sapiens
aggcacgtttggcatttctc

SEQ ID NO: 2137107 - DNA, 16 bp, Homo sapiens
aggcactgagaatgat

SEQ ID NO: 2137108 - DNA, 14 bp, Homo sapiens
aggcactgctgccc

SEQ ID NO: 2137109 - DNA, 22 bp, Homo sapiens
aggcactgctgcccagcctcca

SEQ ID NO: 2137110 - DNA, 16 bp, Homo sapiens
aggcactggtggcatc

SEQ ID NO: 2137111 - DNA, 21 bp, Homo sapiens
aggcagaagaattgaacccag

SEQ ID NO: 2137112 - DNA, 22 bp, Homo sapiens
aggcagaagaattgaacccagg

SEQ ID NO: 2137113 - DNA, 23 bp, Homo sapiens
aggcagaagaattgaacccagga

SEQ ID NO: 2137114 - DNA, 15 bp, Homo sapiens
aggcagacaagagct

SEQ ID NO: 2137115 - DNA, 17 bp, Homo sapiens
aggcagacaagagctgc

SEQ ID NO: 2137116 - DNA, 20 bp, Homo sapiens
aggcagacaagagctgctgt

SEQ ID NO: 2137117 - DNA, 13 bp, Homo sapiens
aggcagacagcag

SEQ ID NO: 2137118 - DNA, 14 bp, Homo sapiens
aggcagacagcagc

SEQ ID NO: 2137119 - DNA, 15 bp, Homo sapiens
aggcagacagcagct

SEQ ID NO: 2137120 - DNA, 17 bp, Homo sapiens
aggcagagaaagaagag

SEQ ID NO: 2137121 - DNA, 14 bp, Homo sapiens
aggcagagaagaaa

SEQ ID NO: 2137122 - DNA, 14 bp, Homo sapiens
aggcagagacaata

SEQ ID NO: 2137123 - DNA, 16 bp, Homo sapiens
aggcagagcggggagg

SEQ ID NO: 2137124 - DNA, 19 bp, Homo sapiens
aggcagagcggggaggtgc

SEQ ID NO: 2137125 - DNA, 21 bp, Homo sapiens
aggcagagcggggaggtgcct

SEQ ID NO: 2137126 - DNA, 23 bp, Homo sapiens
aggcagagcggggaggtgcctga

SEQ ID NO: 2137127 - DNA, 17 bp, Homo sapiens
aggcagaggcagacagg

SEQ ID NO: 2137128 - DNA, 16 bp, Homo sapiens
aggcagccccattctg

SEQ ID NO: 2137129 - DNA, 17 bp, Homo sapiens
aggcagccccattctgc

SEQ ID NO: 2137130 - DNA, 21 bp, Homo sapiens
aggcagccccattctgcctgc

SEQ ID NO: 2137131 - DNA, 15 bp, Homo sapiens
aggcagccctttggg

SEQ ID NO: 2137132 - DNA, 11 bp, Homo sapiens
aggcagcctcc

SEQ ID NO: 2137133 - DNA, 15 bp, Homo sapiens
aggcagcctccagag

SEQ ID NO: 2137134 - DNA, 12 bp, Homo sapiens
aggcagcctgcc

SEQ ID NO: 2137135 - DNA, 14 bp, Homo sapiens
aggcagcgggatct

SEQ ID NO: 2137136 - DNA, 11 bp, Homo sapiens
aggcagctcca

SEQ ID NO: 2137137 - DNA, 13 bp, Homo sapiens
aggcagctccaac

SEQ ID NO: 2137138 - DNA, 16 bp, Homo sapiens
aggcagctccaacagc

SEQ ID NO: 2137139 - DNA, 23 bp, Homo sapiens
aggcagctgctcttagtgcccgc

SEQ ID NO: 2137140 - DNA, 18 bp, Homo sapiens
aggcagctggatgagact

SEQ ID NO: 2137141 - DNA, 15 bp, Homo sapiens
aggcaggaagagaga

SEQ ID NO: 2137142 - DNA, 16 bp, Homo sapiens
aggcaggcagggctct

SEQ ID NO: 2137143 - DNA, 12 bp, Homo sapiens
aggcagggaggg

SEQ ID NO: 2137144 - DNA, 13 bp, Homo sapiens
aggcagggagggg

SEQ ID NO: 2137145 - DNA, 14 bp, Homo sapiens
aggcagggagggga

SEQ ID NO: 2137146 - DNA, 14 bp, Homo sapiens
aggcagggatttga

SEQ ID NO: 2137147 - DNA, 15 bp, Homo sapiens
aggcagggatttgag

SEQ ID NO: 2137148 - DNA, 24 bp, Homo sapiens
aggcagggcaaatgacatgcactg

SEQ ID NO: 2137149 - DNA, 13 bp, Homo sapiens
aggcagggcagag

SEQ ID NO: 2137150 - DNA, 12 bp, Homo sapiens
aggcagggctct

SEQ ID NO: 2137151 - DNA, 17 bp, Homo sapiens
aggcagggctctcctgg

SEQ ID NO: 2137152 - DNA, 23 bp, Homo sapiens
aggcagggctctcctggcttccc

SEQ ID NO: 2137153 - DNA, 23 bp, Homo sapiens
aggcaggggtgggagagccagct

SEQ ID NO: 2137154 - DNA, 23 bp, Homo sapiens
aggcagggtcaggagaggggcag

SEQ ID NO: 2137155 - DNA, 18 bp, Homo sapiens
aggcagggtctcactctg

SEQ ID NO: 2137156 - DNA, 19 bp, Homo sapiens
aggcagggtctcactctgt

SEQ ID NO: 2137157 - DNA, 20 bp, Homo sapiens
aggcagggtctcactctgtc

SEQ ID NO: 2137158 - DNA, 21 bp, Homo sapiens
aggcagggtctcactctgtcg

SEQ ID NO: 2137159 - DNA, 14 bp, Homo sapiens
aggcaggtccaggg

SEQ ID NO: 2137160 - DNA, 21 bp, Homo sapiens
aggcaggtttgccagtgaaga

SEQ ID NO: 2137161 - DNA, 22 bp, Homo sapiens
aggcaggtttgccagtgaagac

SEQ ID NO: 2137162 - DNA, 11 bp, Homo sapiens
aggcagtctga

SEQ ID NO: 2137163 - DNA, 15 bp, Homo sapiens
aggcagtctgaaccc

SEQ ID NO: 2137164 - DNA, 21 bp, Homo sapiens
aggcagtgaacacactcagca

SEQ ID NO: 2137165 - DNA, 22 bp, Homo sapiens
aggcagtgcaagagactctggc

SEQ ID NO: 2137166 - DNA, 19 bp, Homo sapiens
aggcagttcaaagcaggat

SEQ ID NO: 2137167 - DNA, 21 bp, Homo sapiens
aggcatccatagtgcactagc

SEQ ID NO: 2137168 - DNA, 18 bp, Homo sapiens
aggcatcccaggggacca

SEQ ID NO: 2137169 - DNA, 13 bp, Homo sapiens
aggcatcccatcc

SEQ ID NO: 2137170 - DNA, 23 bp, Homo sapiens
aggcatgagggatcacagggccc

SEQ ID NO: 2137171 - DNA, 13 bp, Homo sapiens
aggcatgcctctg

SEQ ID NO: 2137172 - DNA, 13 bp, Homo sapiens
aggcatggagaca

SEQ ID NO: 2137173 - DNA, 15 bp, Homo sapiens
aggcatggagacagc

SEQ ID NO: 2137174 - DNA, 12 bp, Homo sapiens
aggcatggccct

SEQ ID NO: 2137175 - DNA, 13 bp, Homo sapiens
aggcatggctggg

SEQ ID NO: 2137176 - DNA, 17 bp, Homo sapiens
aggcatgttctctgagg

SEQ ID NO: 2137177 - DNA, 18 bp, Homo sapiens
aggcatgttctctgagga

SEQ ID NO: 2137178 - DNA, 22 bp, Homo sapiens
aggcatgttctctgaggacact

SEQ ID NO: 2137179 - DNA, 16 bp, Homo sapiens
aggcattatttaatgt

SEQ ID NO: 2137180 - DNA, 17 bp, Homo sapiens
aggcatttaaaatggaa

SEQ ID NO: 2137181 - DNA, 15 bp, Homo sapiens
aggcatttcctgggt

SEQ ID NO: 2137182 - DNA, 16 bp, Homo sapiens
aggcatttcctgggtg

SEQ ID NO: 2137183 - DNA, 21 bp, Homo sapiens
aggcatttgcctaattcctgg

SEQ ID NO: 2137184 - DNA, 23 bp, Homo sapiens
aggcatttttactactattctgt

SEQ ID NO: 2137185 - DNA, 14 bp, Homo sapiens
aggccaaatgcaca

SEQ ID NO: 2137186 - DNA, 17 bp, Homo sapiens
aggccaaatgcacaagc

SEQ ID NO: 2137187 - DNA, 15 bp, Homo sapiens
aggggagaagggcca

SEQ ID NO: 2137188 - DNA, 17 bp, Homo sapiens
aggggagacagggcaat

SEQ ID NO: 2137189 - DNA, 16 bp, Homo sapiens
aggggagaggaaaagt

SEQ ID NO: 2137190 - DNA, 14 bp, Homo sapiens
aggggaggggccta

SEQ ID NO: 2137191 - DNA, 22 bp, Homo sapiens
aggggagggtgtatctagctct

SEQ ID NO: 2137192 - DNA, 16 bp, Homo sapiens
aggggatagagagaga

SEQ ID NO: 2137193 - DNA, 20 bp, Homo sapiens
aggggatcaaagttcctgtt

SEQ ID NO: 2137194 - DNA, 16 bp, Homo sapiens
aggggcacaccactgc

SEQ ID NO: 2137195 - DNA, 21 bp, Homo sapiens
aggggcacaccactgccctgc

SEQ ID NO: 2137196 - DNA, 17 bp, Homo sapiens
aggggcacctgccaccg

SEQ ID NO: 2137197 - DNA, 20 bp, Homo sapiens
aggggcacctgggaaaacag

SEQ ID NO: 2137198 - DNA, 17 bp, Homo sapiens
aggggcacgcctgccca

SEQ ID NO: 2137199 - DNA, 17 bp, Homo sapiens
aggggcagaaaaactct

SEQ ID NO: 2137200 - DNA, 13 bp, Homo sapiens
aggggcaggcctg

SEQ ID NO: 2137201 - DNA, 18 bp, Homo sapiens
aggggcaggcctgggacc

SEQ ID NO: 2137202 - DNA, 21 bp, Homo sapiens
aggggccagtgagggctgggc

SEQ ID NO: 2137203 - DNA, 13 bp, Homo sapiens
aggggcccacaaa

SEQ ID NO: 2137204 - DNA, 20 bp, Homo sapiens
aggggcccacaaaggggaga

SEQ ID NO: 2137205 - DNA, 14 bp, Homo sapiens
aggggcccacaggg

SEQ ID NO: 2137206 - DNA, 20 bp, Homo sapiens
aggggccccagatctgcctg

SEQ ID NO: 2137207 - DNA, 16 bp, Homo sapiens
aggggccccggggctg

SEQ ID NO: 2137208 - DNA, 21 bp, Homo sapiens
aggggccccggggctggcaag

SEQ ID NO: 2137209 - DNA, 22 bp, Homo sapiens
aggggccccggggctggcaagc

SEQ ID NO: 2137210 - DNA, 20 bp, Homo sapiens
aggggccccggtcctggccc

SEQ ID NO: 2137211 - DNA, 15 bp, Homo sapiens
aggggcctagggagc

SEQ ID NO: 2137212 - DNA, 13 bp, Homo sapiens
aggggcctctgaa

SEQ ID NO: 2137213 - DNA, 23 bp, Homo sapiens
aggggcctctgaaatttcccaca

SEQ ID NO: 2137214 - DNA, 15 bp, Homo sapiens
aggggcctggcagcc

SEQ ID NO: 2137215 - DNA, 23 bp, Homo sapiens
aggggcctggcagccgtgccttc

SEQ ID NO: 2137216 - DNA, 19 bp, Homo sapiens
aggggcctgggaaaggaaa

SEQ ID NO: 2137217 - DNA, 13 bp, Homo sapiens
aggggcggggcag

SEQ ID NO: 2137218 - DNA, 14 bp, Homo sapiens
aggggcggggcagg

SEQ ID NO: 2137219 - DNA, 18 bp, Homo sapiens
aggggctccacctgttca

SEQ ID NO: 2137220 - DNA, 14 bp, Homo sapiens
aggggctcctggaa

SEQ ID NO: 2137221 - DNA, 14 bp, Homo sapiens
aggggctgctgggg

SEQ ID NO: 2137222 - DNA, 18 bp, Homo sapiens
aggggctgctggggcatg

SEQ ID NO: 2137223 - DNA, 20 bp, Homo sapiens
aggggctgctggggcatgtg

SEQ ID NO: 2137224 - DNA, 15 bp, Homo sapiens
aggggcttcctgggt

SEQ ID NO: 2137225 - DNA, 16 bp, Homo sapiens
aggggctttctggaga

SEQ ID NO: 2137226 - DNA, 17 bp, Homo sapiens
agggggaagagaaattt

SEQ ID NO: 2137227 - DNA, 21 bp, Homo sapiens
agggggacgcgcacacacacc

SEQ ID NO: 2137228 - DNA, 19 bp, Homo sapiens
agggggcctttaaagactt

SEQ ID NO: 2137229 - DNA, 20 bp, Homo sapiens
agggggcctttaaagactta

SEQ ID NO: 2137230 - DNA, 19 bp, Homo sapiens
agggggcgctcaggaccca

SEQ ID NO: 2137231 - DNA, 23 bp, Homo sapiens
agggggcgctcaggacccaggcc

SEQ ID NO: 2137232 - DNA, 12 bp, Homo sapiens
agggggcggcct

SEQ ID NO: 2137233 - DNA, 17 bp, Homo sapiens
agggggctccatggagg

SEQ ID NO: 2137234 - DNA, 18 bp, Homo sapiens
agggggctccatggagga

SEQ ID NO: 2137235 - DNA, 11 bp, Homo sapiens
agggggctctc

SEQ ID NO: 2137236 - DNA, 22 bp, Homo sapiens
agggggctctccaaaggggctg

SEQ ID NO: 2137237 - DNA, 21 bp, Homo sapiens
aggggggttgtgaggcctggc

SEQ ID NO: 2137238 - DNA, 16 bp, Homo sapiens
agggggtccacccagc

SEQ ID NO: 2137239 - DNA, 19 bp, Homo sapiens
agggggtgtcatctgagga

SEQ ID NO: 2137240 - DNA, 19 bp, Homo sapiens
agggggtgtgcgtgcgtgt

SEQ ID NO: 2137241 - DNA, 16 bp, Homo sapiens
aggggtcaaagaaatg

SEQ ID NO: 2137242 - DNA, 16 bp, Homo sapiens
aggggtcaggctccat

SEQ ID NO: 2137243 - DNA, 22 bp, Homo sapiens
aggggtcctgatttcagggaaa

SEQ ID NO: 2137244 - DNA, 17 bp, Homo sapiens
aggggtctccctggagt

SEQ ID NO: 2137245 - DNA, 13 bp, Homo sapiens
aggggtgatttca

SEQ ID NO: 2137246 - DNA, 22 bp, Homo sapiens
aggggtgcacccactcaccagg

SEQ ID NO: 2137247 - DNA, 15 bp, Homo sapiens
aggggtgccctctgg

SEQ ID NO: 2137248 - DNA, 14 bp, Homo sapiens
aggggtggagaagt

SEQ ID NO: 2137249 - DNA, 16 bp, Homo sapiens
aggggttgtcaagaga

SEQ ID NO: 2137250 - DNA, 15 bp, Homo sapiens
agggtaaggtgcctt

SEQ ID NO: 2137251 - DNA, 22 bp, Homo sapiens
agggtaataaacttagaataaa

SEQ ID NO: 2137252 - DNA, 14 bp, Homo sapiens
agggtaccagcaga

SEQ ID NO: 2137253 - DNA, 19 bp, Homo sapiens
agggtaccttgaacactgg

SEQ ID NO: 2137254 - DNA, 21 bp, Homo sapiens
agggtaggaggtttggatggg

SEQ ID NO: 2137255 - DNA, 14 bp, Homo sapiens
agggtagggcagca

SEQ ID NO: 2137256 - DNA, 19 bp, Homo sapiens
agggtaggggagtgtgggt

SEQ ID NO: 2137257 - DNA, 16 bp, Homo sapiens
agggtatcccagaccc

SEQ ID NO: 2137258 - DNA, 14 bp, Homo sapiens
agggtcaggagagg

SEQ ID NO: 2137259 - DNA, 18 bp, Homo sapiens
agggtcaggagaggggca

SEQ ID NO: 2137260 - DNA, 22 bp, Homo sapiens
agggtccccgggagcacacgaa

SEQ ID NO: 2137261 - DNA, 18 bp, Homo sapiens
agggtccgcaccagctgc

SEQ ID NO: 2137262 - DNA, 20 bp, Homo sapiens
agggtccgcaccagctgctc

SEQ ID NO: 2137263 - DNA, 22 bp, Homo sapiens
agggtccgcaccagctgctctg

SEQ ID NO: 2137264 - DNA, 23 bp, Homo sapiens
agggtccgcaccagctgctctgc

SEQ ID NO: 2137265 - DNA, 24 bp, Homo sapiens
agggtccgcaccagctgctctgcc

SEQ ID NO: 2137266 - DNA, 18 bp, Homo sapiens
agggtcgccacacccggc

SEQ ID NO: 2137267 - DNA, 23 bp, Homo sapiens
agggtctagggagagacccttgt

SEQ ID NO: 2137268 - DNA, 15 bp, Homo sapiens
agggtctcactctgt

SEQ ID NO: 2137269 - DNA, 21 bp, Homo sapiens
agggtctcactctgtcgccca

SEQ ID NO: 2137270 - DNA, 19 bp, Homo sapiens
agggtctgttgtaaatgac

SEQ ID NO: 2137271 - DNA, 21 bp, Homo sapiens
agggtctgttgtaaatgacca

SEQ ID NO: 2137272 - DNA, 13 bp, Homo sapiens
agggtcttcttgg

SEQ ID NO: 2137273 - DNA, 16 bp, Homo sapiens
agggtcttcttggcag

SEQ ID NO: 2137274 - DNA, 13 bp, Homo sapiens
agggtcttgctgt

SEQ ID NO: 2137275 - DNA, 18 bp, Homo sapiens
agggtcttgggctactgg

SEQ ID NO: 2137276 - DNA, 15 bp, Homo sapiens
agggtgacatcccag

SEQ ID NO: 2137277 - DNA, 17 bp, Homo sapiens
agggtgacatcccagga

SEQ ID NO: 2137278 - DNA, 23 bp, Homo sapiens
agggtgacatcccaggaggggcc

SEQ ID NO: 2137279 - DNA, 21 bp, Homo sapiens
agggtgagtgaatggcaaagc

SEQ ID NO: 2137280 - DNA, 21 bp, Homo sapiens
agggtgccctcctagctccac

SEQ ID NO: 2137281 - DNA, 21 bp, Homo sapiens
agggtggagactaagccctgt

SEQ ID NO: 2137282 - DNA, 21 bp, Homo sapiens
agggtggccccctgtgccagc

SEQ ID NO: 2137283 - DNA, 21 bp, Homo sapiens
agggtgggaagcttgctggct

SEQ ID NO: 2137284 - DNA, 17 bp, Homo sapiens
agggtgggagagcccag

SEQ ID NO: 2137285 - DNA, 18 bp, Homo sapiens
agggtgggatggaggaga

SEQ ID NO: 2137286 - DNA, 18 bp, Homo sapiens
agggtgggggagggaggt

SEQ ID NO: 2137287 - DNA, 17 bp, Homo sapiens
agggtggtctgagcacc

SEQ ID NO: 2137288 - DNA, 21 bp, Homo sapiens
agggtggtgacctctgcctga

SEQ ID NO: 2137289 - DNA, 17 bp, Homo sapiens
agggtgtatctagctct

SEQ ID NO: 2137290 - DNA, 13 bp, Homo sapiens
agggttagggagg

SEQ ID NO: 2137291 - DNA, 16 bp, Homo sapiens
agggttcagagactca

SEQ ID NO: 2137292 - DNA, 14 bp, Homo sapiens
agggttgatcacac

SEQ ID NO: 2137293 - DNA, 14 bp, Homo sapiens
agggttggcccctg

SEQ ID NO: 2137294 - DNA, 18 bp, Homo sapiens
agggttggcccctgcccg

SEQ ID NO: 2137295 - DNA, 16 bp, Homo sapiens
agggttggtgggctgg

SEQ ID NO: 2137296 - DNA, 22 bp, Homo sapiens
agggttggtgggctggcccagc

SEQ ID NO: 2137297 - DNA, 18 bp, Homo sapiens
agggtttacccagtggga

SEQ ID NO: 2137298 - DNA, 19 bp, Homo sapiens
agggttttccaccctggaa

SEQ ID NO: 2137299 - DNA, 23 bp, Homo sapiens
agggttttgccatgttggccagg

SEQ ID NO: 2137300 - DNA, 11 bp, Homo sapiens
agggttttgta

SEQ ID NO: 2137301 - DNA, 14 bp, Homo sapiens
agtataaaagacaa

SEQ ID NO: 2137302 - DNA, 16 bp, Homo sapiens
agtatacaatatataa

SEQ ID NO: 2137303 - DNA, 17 bp, Homo sapiens
agtatacaatatataaa

SEQ ID NO: 2137304 - DNA, 21 bp, Homo sapiens
agtatacaatatataaaaata

SEQ ID NO: 2137305 - DNA, 16 bp, Homo sapiens
agtatagcattgaaca

SEQ ID NO: 2137306 - DNA, 14 bp, Homo sapiens
agtataggatggat

SEQ ID NO: 2137307 - DNA, 15 bp, Homo sapiens
agtatatagtatatt

SEQ ID NO: 2137308 - DNA, 12 bp, Homo sapiens
agtatatatgta

SEQ ID NO: 2137309 - DNA, 16 bp, Homo sapiens
agtatatatgtacagt

SEQ ID NO: 2137310 - DNA, 16 bp, Homo sapiens
agtatatctggacaag

SEQ ID NO: 2137311 - DNA, 13 bp, Homo sapiens
agtatatttatac

SEQ ID NO: 2137312 - DNA, 16 bp, Homo sapiens
agtatatttatactct

SEQ ID NO: 2137313 - DNA, 18 bp, Homo sapiens
agtatatttatagtcaca

SEQ ID NO: 2137314 - DNA, 15 bp, Homo sapiens
agtatatttctgaaa

SEQ ID NO: 2137315 - DNA, 18 bp, Homo sapiens
agtatattttcttttcct

SEQ ID NO: 2137316 - DNA, 18 bp, Homo sapiens
agtatcaggtctcccacg

SEQ ID NO: 2137317 - DNA, 20 bp, Homo sapiens
agtatcatcagatagcatct

SEQ ID NO: 2137318 - DNA, 11 bp, Homo sapiens
agtatcatgca

SEQ ID NO: 2137319 - DNA, 14 bp, Homo sapiens
agtatcatgcattc

SEQ ID NO: 2137320 - DNA, 20 bp, Homo sapiens
agtatccaattatgtgacaa

SEQ ID NO: 2137321 - DNA, 14 bp, Homo sapiens
agtatccactttgc

SEQ ID NO: 2137322 - DNA, 21 bp, Homo sapiens
agtatctcatcaacaaagaaa

SEQ ID NO: 2137323 - DNA, 22 bp, Homo sapiens
agtatctcggacctttcagctg

SEQ ID NO: 2137324 - DNA, 23 bp, Homo sapiens
agtatctcggacctttcagctgt

SEQ ID NO: 2137325 - DNA, 19 bp, Homo sapiens
agtatcttacctgtaaagt

SEQ ID NO: 2137326 - DNA, 14 bp, Homo sapiens
agtatcttttaaaa

SEQ ID NO: 2137327 - DNA, 15 bp, Homo sapiens
agtatcttttaaaat

SEQ ID NO: 2137328 - DNA, 23 bp, Homo sapiens
agtatgcaagaagaatataaata

SEQ ID NO: 2137329 - DNA, 21 bp, Homo sapiens
agtatgccttcctgtttaaaa

SEQ ID NO: 2137330 - DNA, 18 bp, Homo sapiens
agtatggaagggaggggt

SEQ ID NO: 2137331 - DNA, 16 bp, Homo sapiens
agtatggcctgtgtca

SEQ ID NO: 2137332 - DNA, 14 bp, Homo sapiens
agtatgtgatatct

SEQ ID NO: 2137333 - DNA, 14 bp, Homo sapiens
agtattaaatattt

SEQ ID NO: 2137334 - DNA, 15 bp, Homo sapiens
agtattacttctgct

SEQ ID NO: 2137335 - DNA, 21 bp, Homo sapiens
agtattgccacaatgcctctc

SEQ ID NO: 2137336 - DNA, 17 bp, Homo sapiens
agtattgcgaatgtgca

SEQ ID NO: 2137337 - DNA, 12 bp, Homo sapiens
agtattggggcc

SEQ ID NO: 2137338 - DNA, 14 bp, Homo sapiens
agtatttatatatt

SEQ ID NO: 2137339 - DNA, 15 bp, Homo sapiens
agtatttatatattt

SEQ ID NO: 2137340 - DNA, 20 bp, Homo sapiens
agtatttatatatttataac

SEQ ID NO: 2137341 - DNA, 15 bp, Homo sapiens
agtatttatttaatg

SEQ ID NO: 2137342 - DNA, 19 bp, Homo sapiens
agtatttgtacaaatactg

SEQ ID NO: 2137343 - DNA, 15 bp, Homo sapiens
agtatttgttaattt

SEQ ID NO: 2137344 - DNA, 21 bp, Homo sapiens
agtatttttttaagttagaga

SEQ ID NO: 2137345 - DNA, 14 bp, Homo sapiens
agtcaaaacagaga

SEQ ID NO: 2137346 - DNA, 14 bp, Homo sapiens
agtcaaaagcctgg

SEQ ID NO: 2137347 - DNA, 17 bp, Homo sapiens
agtcaaaaggtgcctgt

SEQ ID NO: 2137348 - DNA, 21 bp, Homo sapiens
agtcaaaaggtgcctgtgagg

SEQ ID NO: 2137349 - DNA, 21 bp, Homo sapiens
agtcaaagtaaaacttgctgc

SEQ ID NO: 2137350 - DNA, 19 bp, Homo sapiens
agtcaacaaccatgccagg

SEQ ID NO: 2137351 - DNA, 18 bp, Homo sapiens
agtcaacagttcaaagaa

SEQ ID NO: 2137352 - DNA, 14 bp, Homo sapiens
agtcaactggctgg

SEQ ID NO: 2137353 - DNA, 15 bp, Homo sapiens
agtcaattagtacag

SEQ ID NO: 2137354 - DNA, 18 bp, Homo sapiens
agtcaattagtacagtag

SEQ ID NO: 2137355 - DNA, 13 bp, Homo sapiens
agtcacacagaca

SEQ ID NO: 2137356 - DNA, 17 bp, Homo sapiens
agtcacagctgcagctg

SEQ ID NO: 2137357 - DNA, 18 bp, Homo sapiens
agtcaccactccattccc

SEQ ID NO: 2137358 - DNA, 13 bp, Homo sapiens
agtcaccaggaat

SEQ ID NO: 2137359 - DNA, 20 bp, Homo sapiens
agtcacccatgaagacagga

SEQ ID NO: 2137360 - DNA, 16 bp, Homo sapiens
agtcacccttctgggc

SEQ ID NO: 2137361 - DNA, 13 bp, Homo sapiens
agtcacctcctcc

SEQ ID NO: 2137362 - DNA, 17 bp, Homo sapiens
agtcacctcctccactc

SEQ ID NO: 2137363 - DNA, 20 bp, Homo sapiens
agtcacctcctccactcact

SEQ ID NO: 2137364 - DNA, 22 bp, Homo sapiens
agtcacctcctccactcactcc

SEQ ID NO: 2137365 - DNA, 15 bp, Homo sapiens
agtcacctgcaagcc

SEQ ID NO: 2137366 - DNA, 18 bp, Homo sapiens
agtcacctgcaagcccca

SEQ ID NO: 2137367 - DNA, 22 bp, Homo sapiens
agtcacctgcaagccccagggc

SEQ ID NO: 2137368 - DNA, 15 bp, Homo sapiens
agtcagaacagcaga

SEQ ID NO: 2137369 - DNA, 17 bp, Homo sapiens
agtcagaacagcagact

SEQ ID NO: 2137370 - DNA, 13 bp, Homo sapiens
agtcagaggagaa

SEQ ID NO: 2137371 - DNA, 16 bp, Homo sapiens
agtcagaggagaagag

SEQ ID NO: 2137372 - DNA, 20 bp, Homo sapiens
agtcagaggagaagagacat

SEQ ID NO: 2137373 - DNA, 23 bp, Homo sapiens
agtcagatgcccagagggcccag

SEQ ID NO: 2137374 - DNA, 18 bp, Homo sapiens
agtcagcccgaatgcctg

SEQ ID NO: 2137375 - DNA, 22 bp, Homo sapiens
agtcagccttccccctcccagg

SEQ ID NO: 2137376 - DNA, 16 bp, Homo sapiens
agtcaggacctggctt

SEQ ID NO: 2137377 - DNA, 21 bp, Homo sapiens
agtcagtaggtccaagggcca

SEQ ID NO: 2137378 - DNA, 20 bp, Homo sapiens
agtcagttcccggagcacag

SEQ ID NO: 2137379 - DNA, 21 bp, Homo sapiens
agtcagttcccggagcacagc

SEQ ID NO: 2137380 - DNA, 15 bp, Homo sapiens
agtcataaacagcat

SEQ ID NO: 2137381 - DNA, 13 bp, Homo sapiens
agtcatccacagc

SEQ ID NO: 2137382 - DNA, 16 bp, Homo sapiens
agtcatccacagccca

SEQ ID NO: 2137383 - DNA, 18 bp, Homo sapiens
agtcatgatctccctgcc

SEQ ID NO: 2137384 - DNA, 21 bp, Homo sapiens
agtcatgatctccctgccgcc

SEQ ID NO: 2137385 - DNA, 19 bp, Homo sapiens
agtcatttgctgagcatgt

SEQ ID NO: 2137386 - DNA, 16 bp, Homo sapiens
agtccaacctgcctgt

SEQ ID NO: 2137387 - DNA, 17 bp, Homo sapiens
agtccaaggagaagaag

SEQ ID NO: 2137388 - DNA, 12 bp, Homo sapiens
agtccaatattt

SEQ ID NO: 2137389 - DNA, 17 bp, Homo sapiens
agtccaatgtcttttta

SEQ ID NO: 2137390 - DNA, 18 bp, Homo sapiens
agtccaatgtctttttaa

SEQ ID NO: 2137391 - DNA, 20 bp, Homo sapiens
agtccacatcttctcagtgt

SEQ ID NO: 2137392 - DNA, 22 bp, Homo sapiens
agtccacctgcctatccatcct

SEQ ID NO: 2137393 - DNA, 17 bp, Homo sapiens
agtccagatgccttcct

SEQ ID NO: 2137394 - DNA, 14 bp, Homo sapiens
agtccagccagctc

SEQ ID NO: 2137395 - DNA, 17 bp, Homo sapiens
agtccagccagctcctg

SEQ ID NO: 2137396 - DNA, 15 bp, Homo sapiens
agtccaggtcctggt

SEQ ID NO: 2137397 - DNA, 23 bp, Homo sapiens
agtcccaccttggctgcagggag

SEQ ID NO: 2137398 - DNA, 22 bp, Homo sapiens
agtcccagctactcagaagcct

SEQ ID NO: 2137399 - DNA, 13 bp, Homo sapiens
agtccccagccct

SEQ ID NO: 2137400 - DNA, 20 bp, Homo sapiens
agtccccagcccttctgcct

SEQ ID NO: 2137401 - DNA, 18 bp, Homo sapiens
agtcccccaccacactga

SEQ ID NO: 2137402 - DNA, 18 bp, Homo sapiens
agtccccgtcccccagaa

SEQ ID NO: 2137403 - DNA, 18 bp, Homo sapiens
agtccccgtgccccgcct

SEQ ID NO: 2137404 - DNA, 14 bp, Homo sapiens
agtcccctgggcct

SEQ ID NO: 2137405 - DNA, 15 bp, Homo sapiens
agtcccgtggagggt

SEQ ID NO: 2137406 - DNA, 14 bp, Homo sapiens
agtccctgggggaa

SEQ ID NO: 2137407 - DNA, 20 bp, Homo sapiens
agtccctgggggaagccctg

SEQ ID NO: 2137408 - DNA, 20 bp, Homo sapiens
agtccgcaagttcagggaag

SEQ ID NO: 2137409 - DNA, 17 bp, Homo sapiens
agtccgcagtctggcct

SEQ ID NO: 2137410 - DNA, 18 bp, Homo sapiens
agtccgcctggccggctc

SEQ ID NO: 2137411 - DNA, 15 bp, Homo sapiens
agtccgtcaaaacag

SEQ ID NO: 2137412 - DNA, 20 bp, Homo sapiens
agtcctacaagctaaaatta

SEQ ID NO: 2137413 - DNA, 13 bp, Homo sapiens
agtcctagagctc

SEQ ID NO: 2137414 - DNA, 22 bp, Homo sapiens
agtcctagagctcctgtcccta

SEQ ID NO: 2137415 - DNA, 18 bp, Homo sapiens
agtcctatcgactttata

SEQ ID NO: 2137416 - DNA, 13 bp, Homo sapiens
agtttgccagaag

SEQ ID NO: 2137417 - DNA, 14 bp, Homo sapiens
agtttggatatgta

SEQ ID NO: 2137418 - DNA, 18 bp, Homo sapiens
agtttgtacatgcattca

SEQ ID NO: 2137419 - DNA, 14 bp, Homo sapiens
agtttgtcagactt

SEQ ID NO: 2137420 - DNA, 16 bp, Homo sapiens
agtttgtcctgtagag

SEQ ID NO: 2137421 - DNA, 17 bp, Homo sapiens
agtttgtggtaaaaaga

SEQ ID NO: 2137422 - DNA, 17 bp, Homo sapiens
agtttgttgctgtcaag

SEQ ID NO: 2137423 - DNA, 20 bp, Homo sapiens
agtttgttttacaaattttt

SEQ ID NO: 2137424 - DNA, 20 bp, Homo sapiens
agttttaacagaaccagagg

SEQ ID NO: 2137425 - DNA, 16 bp, Homo sapiens
agttttaatccagaat

SEQ ID NO: 2137426 - DNA, 13 bp, Homo sapiens
agttttatcattt

SEQ ID NO: 2137427 - DNA, 19 bp, Homo sapiens
agttttatggcatgattta

SEQ ID NO: 2137428 - DNA, 16 bp, Homo sapiens
agttttattgagaatt

SEQ ID NO: 2137429 - DNA, 16 bp, Homo sapiens
agttttcagccttggg

SEQ ID NO: 2137430 - DNA, 11 bp, Homo sapiens
agttttcctga

SEQ ID NO: 2137431 - DNA, 12 bp, Homo sapiens
agttttctgaga

SEQ ID NO: 2137432 - DNA, 17 bp, Homo sapiens
agttttctgagaaagac

SEQ ID NO: 2137433 - DNA, 18 bp, Homo sapiens
agttttctgagaaagact

SEQ ID NO: 2137434 - DNA, 23 bp, Homo sapiens
agttttctgagaaagactattca

SEQ ID NO: 2137435 - DNA, 13 bp, Homo sapiens
agttttctttgta

SEQ ID NO: 2137436 - DNA, 17 bp, Homo sapiens
agttttgaaagaaaaat

SEQ ID NO: 2137437 - DNA, 17 bp, Homo sapiens
agttttgtataaataat

SEQ ID NO: 2137438 - DNA, 12 bp, Homo sapiens
agtttttacaaa

SEQ ID NO: 2137439 - DNA, 21 bp, Homo sapiens
agtttttacctaccacagtgt

SEQ ID NO: 2137440 - DNA, 22 bp, Homo sapiens
agtttttacctaccacagtgtc

SEQ ID NO: 2137441 - DNA, 16 bp, Homo sapiens
agtttttgatagcttt

SEQ ID NO: 2137442 - DNA, 21 bp, Homo sapiens
agttttttttaacctgtttat

SEQ ID NO: 2137443 - DNA, 13 bp, Homo sapiens
ataaaaaaaagaa

SEQ ID NO: 2137444 - DNA, 12 bp, Homo sapiens
ataaaaaaatac

SEQ ID NO: 2137445 - DNA, 16 bp, Homo sapiens
ataaaaaaatacagta

SEQ ID NO: 2137446 - DNA, 16 bp, Homo sapiens
ataaaaacataaaata

SEQ ID NO: 2137447 - DNA, 18 bp, Homo sapiens
ataaaaaccagaatcata

SEQ ID NO: 2137448 - DNA, 22 bp, Homo sapiens
ataaaaagaaaagataaagatg

SEQ ID NO: 2137449 - DNA, 21 bp, Homo sapiens
ataaaaagactattaagagca

SEQ ID NO: 2137450 - DNA, 17 bp, Homo sapiens
ataaaaatgatctaaac

SEQ ID NO: 2137451 - DNA, 22 bp, Homo sapiens
ataaaacattatgctccagaaa

SEQ ID NO: 2137452 - DNA, 16 bp, Homo sapiens
ataaaacccagcatgt

SEQ ID NO: 2137453 - DNA, 17 bp, Homo sapiens
ataaaacccagcatgta

SEQ ID NO: 2137454 - DNA, 20 bp, Homo sapiens
ataaaacccagcatgtacaa

SEQ ID NO: 2137455 - DNA, 13 bp, Homo sapiens
ataaaacctttca

SEQ ID NO: 2137456 - DNA, 15 bp, Homo sapiens
ataaaacctttcaaa

SEQ ID NO: 2137457 - DNA, 15 bp, Homo sapiens
ataaaactaaatata

SEQ ID NO: 2137458 - DNA, 17 bp, Homo sapiens
ataaaactaaatatatg

SEQ ID NO: 2137459 - DNA, 16 bp, Homo sapiens
ataaaagcagcatctg

SEQ ID NO: 2137460 - DNA, 18 bp, Homo sapiens
ataaaagcataaatgcaa

SEQ ID NO: 2137461 - DNA, 20 bp, Homo sapiens
ataaaagcataaatgcaaac

SEQ ID NO: 2137462 - DNA, 13 bp, Homo sapiens
ataaaagtgactc

SEQ ID NO: 2137463 - DNA, 14 bp, Homo sapiens
ataaaataatttta

SEQ ID NO: 2137464 - DNA, 18 bp, Homo sapiens
ataaaatcatgtacattt

SEQ ID NO: 2137465 - DNA, 13 bp, Homo sapiens
ataaaatgaaaaa

SEQ ID NO: 2137466 - DNA, 18 bp, Homo sapiens
ataaaatgcccatttcga

SEQ ID NO: 2137467 - DNA, 15 bp, Homo sapiens
ataaaattatggtga

SEQ ID NO: 2137468 - DNA, 17 bp, Homo sapiens
ataaaattatttttatt

SEQ ID NO: 2137469 - DNA, 11 bp, Homo sapiens
ataaaattgta

SEQ ID NO: 2137470 - DNA, 23 bp, Homo sapiens
ataaaattgtaaaattgtataga

SEQ ID NO: 2137471 - DNA, 19 bp, Homo sapiens
ataaaattgtgatgttttg

SEQ ID NO: 2137472 - DNA, 16 bp, Homo sapiens
ataaacaacttaatgt

SEQ ID NO: 2137473 - DNA, 17 bp, Homo sapiens
ataaacacccatgaatc

SEQ ID NO: 2137474 - DNA, 12 bp, Homo sapiens
ataaacagcatt

SEQ ID NO: 2137475 - DNA, 13 bp, Homo sapiens
ataaacattaaac

SEQ ID NO: 2137476 - DNA, 18 bp, Homo sapiens
ataaacattaaacactgt

SEQ ID NO: 2137477 - DNA, 17 bp, Homo sapiens
ataaacattaaatgtct

SEQ ID NO: 2137478 - DNA, 21 bp, Homo sapiens
ataaacattaaatgtcttata

SEQ ID NO: 2137479 - DNA, 16 bp, Homo sapiens
ataaaccaaaggacat

SEQ ID NO: 2137480 - DNA, 17 bp, Homo sapiens
ataaacctggagatgat

SEQ ID NO: 2137481 - DNA, 20 bp, Homo sapiens
ataaacgcgggaaaaaagat

SEQ ID NO: 2137482 - DNA, 15 bp, Homo sapiens
ataaactactgtaat

SEQ ID NO: 2137483 - DNA, 21 bp, Homo sapiens
ataaactactgtaattaagtg

SEQ ID NO: 2137484 - DNA, 15 bp, Homo sapiens
ataaactagtttcca

SEQ ID NO: 2137485 - DNA, 17 bp, Homo sapiens
ataaactagtttccagt

SEQ ID NO: 2137486 - DNA, 17 bp, Homo sapiens
ataaactgaaaaatgtc

SEQ ID NO: 2137487 - DNA, 12 bp, Homo sapiens
ataaactgtgtg

SEQ ID NO: 2137488 - DNA, 15 bp, Homo sapiens
ataaacttagaataa

SEQ ID NO: 2137489 - DNA, 16 bp, Homo sapiens
ataaacttcagcacca

SEQ ID NO: 2137490 - DNA, 12 bp, Homo sapiens
ataaacttcatc

SEQ ID NO: 2137491 - DNA, 14 bp, Homo sapiens
ataaacttcatctt

SEQ ID NO: 2137492 - DNA, 18 bp, Homo sapiens
ataaacttcatcttcaac

SEQ ID NO: 2137493 - DNA, 12 bp, Homo sapiens
ataaagaaaaac

SEQ ID NO: 2137494 - DNA, 21 bp, Homo sapiens
ataaagaacaaggtagttttt

SEQ ID NO: 2137495 - DNA, 23 bp, Homo sapiens
ataaagaactccttattttgtat

SEQ ID NO: 2137496 - DNA, 18 bp, Homo sapiens
ataaagacagctgacaga

SEQ ID NO: 2137497 - DNA, 13 bp, Homo sapiens
ataaagagttaga

SEQ ID NO: 2137498 - DNA, 19 bp, Homo sapiens
ataaagatgatctactcag

SEQ ID NO: 2137499 - DNA, 19 bp, Homo sapiens
ataaagatgtcaaatatct

SEQ ID NO: 2137500 - DNA, 17 bp, Homo sapiens
ataaagattttttaata

SEQ ID NO: 2137501 - DNA, 14 bp, Homo sapiens
ataaagcaaataga

SEQ ID NO: 2137502 - DNA, 15 bp, Homo sapiens
ataaagcaagctcaa

SEQ ID NO: 2137503 - DNA, 14 bp, Homo sapiens
ataaagcctgcttt

SEQ ID NO: 2137504 - DNA, 21 bp, Homo sapiens
ataaagctactgaatttattg

SEQ ID NO: 2137505 - DNA, 22 bp, Homo sapiens
ataaagctggacaagaagctgc

SEQ ID NO: 2137506 - DNA, 19 bp, Homo sapiens
ataaaggaagtcaccaaaa

SEQ ID NO: 2137507 - DNA, 14 bp, Homo sapiens
ataaaggtatttag

SEQ ID NO: 2137508 - DNA, 16 bp, Homo sapiens
ataaaggttgacaata

SEQ ID NO: 2137509 - DNA, 18 bp, Homo sapiens
ataaagtatcatgcattc

SEQ ID NO: 2137510 - DNA, 18 bp, Homo sapiens
ataaagttggtgacagat

SEQ ID NO: 2137511 - DNA, 15 bp, Homo sapiens
ataaataaatgccaa

SEQ ID NO: 2137512 - DNA, 12 bp, Homo sapiens
ataaataaatgt

SEQ ID NO: 2137513 - DNA, 19 bp, Homo sapiens
ataaatatatatttttcaa

SEQ ID NO: 2137514 - DNA, 22 bp, Homo sapiens
ataaatatatatttttcaacca

SEQ ID NO: 2137515 - DNA, 16 bp, Homo sapiens
ataaatatttatgctt

SEQ ID NO: 2137516 - DNA, 14 bp, Homo sapiens
ataaatcaatgtca

SEQ ID NO: 2137517 - DNA, 21 bp, Homo sapiens
ataaatctgagcctaaatcta

SEQ ID NO: 2137518 - DNA, 23 bp, Homo sapiens
ataaatctgagcctaaatctaat

SEQ ID NO: 2137519 - DNA, 14 bp, Homo sapiens
ataaatgcatgatt

SEQ ID NO: 2137520 - DNA, 17 bp, Homo sapiens
ataaatgccaacatacc

SEQ ID NO: 2137521 - DNA, 21 bp, Homo sapiens
ataaatgccctctctgaatgt

SEQ ID NO: 2137522 - DNA, 12 bp, Homo sapiens
ataaatgctgaa

SEQ ID NO: 2137523 - DNA, 18 bp, Homo sapiens
ataaatgctgaatgaatc

SEQ ID NO: 2137524 - DNA, 13 bp, Homo sapiens
ataaatggaaatc

SEQ ID NO: 2137525 - DNA, 15 bp, Homo sapiens
ataaatgtatataca

SEQ ID NO: 2137526 - DNA, 16 bp, Homo sapiens
ataaatgtatatacac

SEQ ID NO: 2137527 - DNA, 21 bp, Homo sapiens
ataaatgtatatacacatata

SEQ ID NO: 2137528 - DNA, 13 bp, Homo sapiens
ataaatgtatcat

SEQ ID NO: 2137529 - DNA, 18 bp, Homo sapiens
ataaatgtatcttattca

SEQ ID NO: 2137530 - DNA, 14 bp, Homo sapiens
ataaatgtgtaaat

SEQ ID NO: 2137531 - DNA, 15 bp, Homo sapiens
ataaatgtgtaaatg

SEQ ID NO: 2137532 - DNA, 11 bp, Homo sapiens
atatctgcttt

SEQ ID NO: 2137533 - DNA, 15 bp, Homo sapiens
atatcttgaagaata

SEQ ID NO: 2137534 - DNA, 22 bp, Homo sapiens
atatcttgctggattaatgttt

SEQ ID NO: 2137535 - DNA, 20 bp, Homo sapiens
atatgaaaaaaatgcatttt

SEQ ID NO: 2137536 - DNA, 17 bp, Homo sapiens
atatgaaaaatatgata

SEQ ID NO: 2137537 - DNA, 22 bp, Homo sapiens
atatgaacaaagaaaaaaatat

SEQ ID NO: 2137538 - DNA, 18 bp, Homo sapiens
atatgaagtaagttctga

SEQ ID NO: 2137539 - DNA, 19 bp, Homo sapiens
atatgaagtaagttctgaa

SEQ ID NO: 2137540 - DNA, 19 bp, Homo sapiens
atatgacaatcctgaagaa

SEQ ID NO: 2137541 - DNA, 22 bp, Homo sapiens
atatgactgtttttcggacagt

SEQ ID NO: 2137542 - DNA, 20 bp, Homo sapiens
atatgagagaatcacacaag

SEQ ID NO: 2137543 - DNA, 14 bp, Homo sapiens
atatgagtatacaa

SEQ ID NO: 2137544 - DNA, 15 bp, Homo sapiens
atatgagtatacaat

SEQ ID NO: 2137545 - DNA, 18 bp, Homo sapiens
atatgataaagagggatg

SEQ ID NO: 2137546 - DNA, 13 bp, Homo sapiens
atatgatctaata

SEQ ID NO: 2137547 - DNA, 15 bp, Homo sapiens
atatgatctaataca

SEQ ID NO: 2137548 - DNA, 16 bp, Homo sapiens
atatgatctaatacaa

SEQ ID NO: 2137549 - DNA, 18 bp, Homo sapiens
atatgatctaatacaaag

SEQ ID NO: 2137550 - DNA, 15 bp, Homo sapiens
atatgatgttaaaaa

SEQ ID NO: 2137551 - DNA, 17 bp, Homo sapiens
atatgattttttaaaag

SEQ ID NO: 2137552 - DNA, 13 bp, Homo sapiens
atatgcaaagcac

SEQ ID NO: 2137553 - DNA, 15 bp, Homo sapiens
atatgcacaatagca

SEQ ID NO: 2137554 - DNA, 17 bp, Homo sapiens
atatgcaccttgtgtct

SEQ ID NO: 2137555 - DNA, 20 bp, Homo sapiens
atatgcatttaattctgaaa

SEQ ID NO: 2137556 - DNA, 21 bp, Homo sapiens
atatgcctacttgtaatttct

SEQ ID NO: 2137557 - DNA, 12 bp, Homo sapiens
atatggaacctt

SEQ ID NO: 2137558 - DNA, 20 bp, Homo sapiens
atatggaacttctaatatat

SEQ ID NO: 2137559 - DNA, 15 bp, Homo sapiens
atatggactctgcac

SEQ ID NO: 2137560 - DNA, 17 bp, Homo sapiens
atatggcaagaaagctg

SEQ ID NO: 2137561 - DNA, 15 bp, Homo sapiens
atatggctataaata

SEQ ID NO: 2137562 - DNA, 18 bp, Homo sapiens
atatgtaaaacatttatt

SEQ ID NO: 2137563 - DNA, 13 bp, Homo sapiens
atatgtaaaataa

SEQ ID NO: 2137564 - DNA, 20 bp, Homo sapiens
atatgtaaaataaaattatg

SEQ ID NO: 2137565 - DNA, 12 bp, Homo sapiens
atatgtacagtt

SEQ ID NO: 2137566 - DNA, 14 bp, Homo sapiens
atatgtacagttat

SEQ ID NO: 2137567 - DNA, 19 bp, Homo sapiens
atatgtaccatgtacatga

SEQ ID NO: 2137568 - DNA, 18 bp, Homo sapiens
atatgtagactatataca

SEQ ID NO: 2137569 - DNA, 20 bp, Homo sapiens
atatgtagactatatacatg

SEQ ID NO: 2137570 - DNA, 17 bp, Homo sapiens
atatgtagcagaaaggc

SEQ ID NO: 2137571 - DNA, 17 bp, Homo sapiens
atatgtaggtgtctgca

SEQ ID NO: 2137572 - DNA, 13 bp, Homo sapiens
atatgtatatata

SEQ ID NO: 2137573 - DNA, 13 bp, Homo sapiens
atatgtatatgta

SEQ ID NO: 2137574 - DNA, 14 bp, Homo sapiens
atatgtatatgtat

SEQ ID NO: 2137575 - DNA, 15 bp, Homo sapiens
atatgtatatgtata

SEQ ID NO: 2137576 - DNA, 16 bp, Homo sapiens
atatgtatatgtatat

SEQ ID NO: 2137577 - DNA, 17 bp, Homo sapiens
atatgtatatgtatata

SEQ ID NO: 2137578 - DNA, 13 bp, Homo sapiens
atatgtatgtcta

SEQ ID NO: 2137579 - DNA, 14 bp, Homo sapiens
atatgtatgtctaa

SEQ ID NO: 2137580 - DNA, 15 bp, Homo sapiens
atatgtatgtgtgta

SEQ ID NO: 2137581 - DNA, 17 bp, Homo sapiens
atatgtattaagccaaa

SEQ ID NO: 2137582 - DNA, 18 bp, Homo sapiens
atatgtctgccacagaga

SEQ ID NO: 2137583 - DNA, 15 bp, Homo sapiens
atatgtgtaattttt

SEQ ID NO: 2137584 - DNA, 13 bp, Homo sapiens
atatgtgtatata

SEQ ID NO: 2137585 - DNA, 20 bp, Homo sapiens
atatgtgtatatatacatac

SEQ ID NO: 2137586 - DNA, 19 bp, Homo sapiens
atatgtgtgtttaaataaa

SEQ ID NO: 2137587 - DNA, 20 bp, Homo sapiens
atatgtgtgtttaaataaag

SEQ ID NO: 2137588 - DNA, 19 bp, Homo sapiens
atatgttcattaaattttc

SEQ ID NO: 2137589 - DNA, 16 bp, Homo sapiens
atatgttgctgaaaca

SEQ ID NO: 2137590 - DNA, 17 bp, Homo sapiens
atattaaagtgttatac

SEQ ID NO: 2137591 - DNA, 12 bp, Homo sapiens
atattaaataca

SEQ ID NO: 2137592 - DNA, 19 bp, Homo sapiens
atattaaatacagacacta

SEQ ID NO: 2137593 - DNA, 15 bp, Homo sapiens
atattacactacaca

SEQ ID NO: 2137594 - DNA, 15 bp, Homo sapiens
atattacctcaaatt

SEQ ID NO: 2137595 - DNA, 14 bp, Homo sapiens
atattagaagtgtt

SEQ ID NO: 2137596 - DNA, 20 bp, Homo sapiens
atattagagtgcccttaaaa

SEQ ID NO: 2137597 - DNA, 17 bp, Homo sapiens
atattagcaaagaagct

SEQ ID NO: 2137598 - DNA, 20 bp, Homo sapiens
atattataaataaatgccaa

SEQ ID NO: 2137599 - DNA, 14 bp, Homo sapiens
atattataaatcca

SEQ ID NO: 2137600 - DNA, 20 bp, Homo sapiens
atattataaatccaaagtaa

SEQ ID NO: 2137601 - DNA, 17 bp, Homo sapiens
atattataacttaaaaa

SEQ ID NO: 2137602 - DNA, 22 bp, Homo sapiens
atattataatttttttcaatat

SEQ ID NO: 2137603 - DNA, 21 bp, Homo sapiens
atattatggcaagtgatatca

SEQ ID NO: 2137604 - DNA, 16 bp, Homo sapiens
atattatggtgtaatg

SEQ ID NO: 2137605 - DNA, 20 bp, Homo sapiens
atattatggtgtaatgcaca

SEQ ID NO: 2137606 - DNA, 23 bp, Homo sapiens
atattatggtgtaatgcacaatt

SEQ ID NO: 2137607 - DNA, 21 bp, Homo sapiens
atattatgtatttatattttg

SEQ ID NO: 2137608 - DNA, 12 bp, Homo sapiens
atattattgggg

SEQ ID NO: 2137609 - DNA, 14 bp, Homo sapiens
atattattggggtt

SEQ ID NO: 2137610 - DNA, 16 bp, Homo sapiens
atattatttaaatgtt

SEQ ID NO: 2137611 - DNA, 13 bp, Homo sapiens
atattcaataaag

SEQ ID NO: 2137612 - DNA, 14 bp, Homo sapiens
atattcagagaata

SEQ ID NO: 2137613 - DNA, 23 bp, Homo sapiens
atattcagtgctgtggcctgggc

SEQ ID NO: 2137614 - DNA, 20 bp, Homo sapiens
atattcatgcttcttcctta

SEQ ID NO: 2137615 - DNA, 16 bp, Homo sapiens
atattcatgtaataaa

SEQ ID NO: 2137616 - DNA, 15 bp, Homo sapiens
atattcattgtataa

SEQ ID NO: 2137617 - DNA, 21 bp, Homo sapiens
atattcattgtataaaaatag

SEQ ID NO: 2137618 - DNA, 17 bp, Homo sapiens
atattccaccattcaca

SEQ ID NO: 2137619 - DNA, 20 bp, Homo sapiens
atattccaccattcacattt

SEQ ID NO: 2137620 - DNA, 23 bp, Homo sapiens
atattcctattgtgcaatgtaaa

SEQ ID NO: 2137621 - DNA, 17 bp, Homo sapiens
atattcctgaatgaaat

SEQ ID NO: 2137622 - DNA, 23 bp, Homo sapiens
atattcctgaatgaaatatcaga

SEQ ID NO: 2137623 - DNA, 17 bp, Homo sapiens
atattctctaagatata

SEQ ID NO: 2137624 - DNA, 16 bp, Homo sapiens
atattctgttggccag

SEQ ID NO: 2137625 - DNA, 19 bp, Homo sapiens
atattgaataagtattctt

SEQ ID NO: 2137626 - DNA, 13 bp, Homo sapiens
atattgaatatat

SEQ ID NO: 2137627 - DNA, 15 bp, Homo sapiens
atattggtattcact

SEQ ID NO: 2137628 - DNA, 14 bp, Homo sapiens
atattgtatattct

SEQ ID NO: 2137629 - DNA, 20 bp, Homo sapiens
atattgtatattctggaaaa

SEQ ID NO: 2137630 - DNA, 13 bp, Homo sapiens
atattgtatgtaa

SEQ ID NO: 2137631 - DNA, 16 bp, Homo sapiens
atattgtattaagggc

SEQ ID NO: 2137632 - DNA, 12 bp, Homo sapiens
atattgtcagat

SEQ ID NO: 2137633 - DNA, 15 bp, Homo sapiens
atattgtcagatatt

SEQ ID NO: 2137634 - DNA, 13 bp, Homo sapiens
atattgtgccaag

SEQ ID NO: 2137635 - DNA, 20 bp, Homo sapiens
atattgtgccaatatgtatt

SEQ ID NO: 2137636 - DNA, 22 bp, Homo sapiens
atatttaaaggggagatactct

SEQ ID NO: 2137637 - DNA, 20 bp, Homo sapiens
atatttaagtatatagtata

SEQ ID NO: 2137638 - DNA, 14 bp, Homo sapiens
atatttaagtttgt

SEQ ID NO: 2137639 - DNA, 17 bp, Homo sapiens
atatttaatacctttgg

SEQ ID NO: 2137640 - DNA, 13 bp, Homo sapiens
atatttaattgtg

SEQ ID NO: 2137641 - DNA, 15 bp, Homo sapiens
atatttaattgtgtc

SEQ ID NO: 2137642 - DNA, 16 bp, Homo sapiens
atatttacatatgaaa

SEQ ID NO: 2137643 - DNA, 18 bp, Homo sapiens
atatttacatatgaaatt

SEQ ID NO: 2137644 - DNA, 14 bp, Homo sapiens
atatttactttaaa

SEQ ID NO: 2137645 - DNA, 16 bp, Homo sapiens
atatttaggcaagaga

SEQ ID NO: 2137646 - DNA, 17 bp, Homo sapiens
atatttataactcatca

SEQ ID NO: 2137647 - DNA, 20 bp, Homo sapiens
atatttataactcatcataa

SEQ ID NO: 2137648 - DNA, 17 bp, Homo sapiens
atctaatacctctgtgt

SEQ ID NO: 2137649 - DNA, 19 bp, Homo sapiens
atctaatacctctgtgtgc

SEQ ID NO: 2137650 - DNA, 22 bp, Homo sapiens
atctaatagcgggttactttca

SEQ ID NO: 2137651 - DNA, 18 bp, Homo sapiens
atctaatatgtaacaagc

SEQ ID NO: 2137652 - DNA, 20 bp, Homo sapiens
atctaatcaggttgttaatg

SEQ ID NO: 2137653 - DNA, 16 bp, Homo sapiens
atctaatttatacaaa

SEQ ID NO: 2137654 - DNA, 19 bp, Homo sapiens
atctaatttatacaaaata

SEQ ID NO: 2137655 - DNA, 17 bp, Homo sapiens
atctacacagcctggac

SEQ ID NO: 2137656 - DNA, 18 bp, Homo sapiens
atctacacagcctggact

SEQ ID NO: 2137657 - DNA, 21 bp, Homo sapiens
atctacctcactattcaagta

SEQ ID NO: 2137658 - DNA, 14 bp, Homo sapiens
atctacctgccctc

SEQ ID NO: 2137659 - DNA, 17 bp, Homo sapiens
atctacctgccctctct

SEQ ID NO: 2137660 - DNA, 20 bp, Homo sapiens
atctactaaaaatacaaaaa

SEQ ID NO: 2137661 - DNA, 16 bp, Homo sapiens
atctacttagccagat

SEQ ID NO: 2137662 - DNA, 17 bp, Homo sapiens
atctagaggcttccttc

SEQ ID NO: 2137663 - DNA, 19 bp, Homo sapiens
atctagatcaattaattct

SEQ ID NO: 2137664 - DNA, 22 bp, Homo sapiens
atctagcttcatgcctcagttt

SEQ ID NO: 2137665 - DNA, 17 bp, Homo sapiens
atctagttttttttgta

SEQ ID NO: 2137666 - DNA, 18 bp, Homo sapiens
atctatagtagtcaatta

SEQ ID NO: 2137667 - DNA, 22 bp, Homo sapiens
atctatagtagtcaattagtac

SEQ ID NO: 2137668 - DNA, 23 bp, Homo sapiens
atctatagtagtcaattagtaca

SEQ ID NO: 2137669 - DNA, 18 bp, Homo sapiens
atctatatctctaaactg

SEQ ID NO: 2137670 - DNA, 15 bp, Homo sapiens
atctatatttaacaa

SEQ ID NO: 2137671 - DNA, 22 bp, Homo sapiens
atctatcaatagtcaagaaaaa

SEQ ID NO: 2137672 - DNA, 17 bp, Homo sapiens
atctatctatataatgt

SEQ ID NO: 2137673 - DNA, 14 bp, Homo sapiens
atctatctgccttt

SEQ ID NO: 2137674 - DNA, 19 bp, Homo sapiens
atctatctgtattttcatt

SEQ ID NO: 2137675 - DNA, 12 bp, Homo sapiens
atctatgcaatt

SEQ ID NO: 2137676 - DNA, 14 bp, Homo sapiens
atctatgcaatttt

SEQ ID NO: 2137677 - DNA, 17 bp, Homo sapiens
atctatgcaatttttaa

SEQ ID NO: 2137678 - DNA, 22 bp, Homo sapiens
atctatgcaatttttaaactag

SEQ ID NO: 2137679 - DNA, 22 bp, Homo sapiens
atctatggccctgcaaaaatat

SEQ ID NO: 2137680 - DNA, 22 bp, Homo sapiens
atctattcagacaagcaacagg

SEQ ID NO: 2137681 - DNA, 15 bp, Homo sapiens
atctatttctgagaa

SEQ ID NO: 2137682 - DNA, 14 bp, Homo sapiens
atctcaaaaaataa

SEQ ID NO: 2137683 - DNA, 19 bp, Homo sapiens
atctcaaaactgcactgtc

SEQ ID NO: 2137684 - DNA, 20 bp, Homo sapiens
atctcaaaactgcactgtca

SEQ ID NO: 2137685 - DNA, 19 bp, Homo sapiens
atctcaaattctcaaccta

SEQ ID NO: 2137686 - DNA, 22 bp, Homo sapiens
atctcaatcttcggggtgtgat

SEQ ID NO: 2137687 - DNA, 12 bp, Homo sapiens
atctcactgccc

SEQ ID NO: 2137688 - DNA, 19 bp, Homo sapiens
atctcagagacaggtggcc

SEQ ID NO: 2137689 - DNA, 15 bp, Homo sapiens
atctcaggtgccact

SEQ ID NO: 2137690 - DNA, 17 bp, Homo sapiens
atctcaggtgccactcc

SEQ ID NO: 2137691 - DNA, 14 bp, Homo sapiens
atctcagtgaagaa

SEQ ID NO: 2137692 - DNA, 17 bp, Homo sapiens
atctcagtgaagaatac

SEQ ID NO: 2137693 - DNA, 17 bp, Homo sapiens
atctcataggttgccaa

SEQ ID NO: 2137694 - DNA, 19 bp, Homo sapiens
atctcataggttgccaata

SEQ ID NO: 2137695 - DNA, 23 bp, Homo sapiens
atctcataggttgccaataatac

SEQ ID NO: 2137696 - DNA, 22 bp, Homo sapiens
atctcattcaggtgttctcttc

SEQ ID NO: 2137697 - DNA, 18 bp, Homo sapiens
atctcatttaagggaaaa

SEQ ID NO: 2137698 - DNA, 20 bp, Homo sapiens
atctcatttaagggaaaaat

SEQ ID NO: 2137699 - DNA, 21 bp, Homo sapiens
atctcatttttccgtaaaaat

SEQ ID NO: 2137700 - DNA, 19 bp, Homo sapiens
atctccacagtcaaagaag

SEQ ID NO: 2137701 - DNA, 19 bp, Homo sapiens
atctccaccctgagcctga

SEQ ID NO: 2137702 - DNA, 21 bp, Homo sapiens
atctccaccctgagcctgacc

SEQ ID NO: 2137703 - DNA, 17 bp, Homo sapiens
atctccatttcacacag

SEQ ID NO: 2137704 - DNA, 14 bp, Homo sapiens
atctccccactcta

SEQ ID NO: 2137705 - DNA, 14 bp, Homo sapiens
atctccccaggcct

SEQ ID NO: 2137706 - DNA, 15 bp, Homo sapiens
atctccccaggcctc

SEQ ID NO: 2137707 - DNA, 21 bp, Homo sapiens
atctccccaggcctccagcct

SEQ ID NO: 2137708 - DNA, 23 bp, Homo sapiens
atctcccccatcccccactgcca

SEQ ID NO: 2137709 - DNA, 18 bp, Homo sapiens
atctcctatttttcagaa

SEQ ID NO: 2137710 - DNA, 20 bp, Homo sapiens
atctcctatttttcagaatg

SEQ ID NO: 2137711 - DNA, 17 bp, Homo sapiens
atctcctcccatggcct

SEQ ID NO: 2137712 - DNA, 19 bp, Homo sapiens
atctcctgtaattttgtag

SEQ ID NO: 2137713 - DNA, 17 bp, Homo sapiens
atctccttcccctacac

SEQ ID NO: 2137714 - DNA, 15 bp, Homo sapiens
atctcctttcaggga

SEQ ID NO: 2137715 - DNA, 17 bp, Homo sapiens
atctcgagccccctgga

SEQ ID NO: 2137716 - DNA, 18 bp, Homo sapiens
atctcgagccccctggat

SEQ ID NO: 2137717 - DNA, 15 bp, Homo sapiens
atctctaaactgctg

SEQ ID NO: 2137718 - DNA, 16 bp, Homo sapiens
atctctaaactgctgt

SEQ ID NO: 2137719 - DNA, 22 bp, Homo sapiens
atctctaatatggcaaaaatgg

SEQ ID NO: 2137720 - DNA, 23 bp, Homo sapiens
atctctaattggaagaaattcct

SEQ ID NO: 2137721 - DNA, 15 bp, Homo sapiens
atctctatttaatat

SEQ ID NO: 2137722 - DNA, 13 bp, Homo sapiens
atctctcaggagc

SEQ ID NO: 2137723 - DNA, 16 bp, Homo sapiens
atctctcaggagcaca

SEQ ID NO: 2137724 - DNA, 17 bp, Homo sapiens
atctctcaggagcacag

SEQ ID NO: 2137725 - DNA, 20 bp, Homo sapiens
atctctcggttccacgtccc

SEQ ID NO: 2137726 - DNA, 21 bp, Homo sapiens
atctctctactcctacctcag

SEQ ID NO: 2137727 - DNA, 22 bp, Homo sapiens
atctctctactcctacctcagc

SEQ ID NO: 2137728 - DNA, 23 bp, Homo sapiens
atctctctactcctacctcagcc

SEQ ID NO: 2137729 - DNA, 22 bp, Homo sapiens
atctctctgaatcctaagggct

SEQ ID NO: 2137730 - DNA, 13 bp, Homo sapiens
atctctctggggc

SEQ ID NO: 2137731 - DNA, 11 bp, Homo sapiens
atctctgaaag

SEQ ID NO: 2137732 - DNA, 20 bp, Homo sapiens
atctctgaagcatgtttcat

SEQ ID NO: 2137733 - DNA, 17 bp, Homo sapiens
atctctgtgtacccact

SEQ ID NO: 2137734 - DNA, 17 bp, Homo sapiens
atctctgtgtgcacaaa

SEQ ID NO: 2137735 - DNA, 19 bp, Homo sapiens
atctctgtgtgcacaaata

SEQ ID NO: 2137736 - DNA, 22 bp, Homo sapiens
atctcttcctacccaaccactc

SEQ ID NO: 2137737 - DNA, 14 bp, Homo sapiens
atctcttcttttaa

SEQ ID NO: 2137738 - DNA, 15 bp, Homo sapiens
atctcttgtcatata

SEQ ID NO: 2137739 - DNA, 19 bp, Homo sapiens
atctgaaaaatacttttgg

SEQ ID NO: 2137740 - DNA, 14 bp, Homo sapiens
atctgaaaactgga

SEQ ID NO: 2137741 - DNA, 14 bp, Homo sapiens
atctgaaaggcaca

SEQ ID NO: 2137742 - DNA, 19 bp, Homo sapiens
atctgaacacatactagaa

SEQ ID NO: 2137743 - DNA, 15 bp, Homo sapiens
atctgaagctattga

SEQ ID NO: 2137744 - DNA, 17 bp, Homo sapiens
atctgaagctattgatg

SEQ ID NO: 2137745 - DNA, 23 bp, Homo sapiens
atctgaagcttcactcactgtca

SEQ ID NO: 2137746 - DNA, 14 bp, Homo sapiens
atctgaatttttaa

SEQ ID NO: 2137747 - DNA, 20 bp, Homo sapiens
atctgaatttttaaacaagt

SEQ ID NO: 2137748 - DNA, 21 bp, Homo sapiens
atctgacactaccttatcagg

SEQ ID NO: 2137749 - DNA, 22 bp, Homo sapiens
atctgacactaccttatcaggc

SEQ ID NO: 2137750 - DNA, 19 bp, Homo sapiens
atctgacagttactcttca

SEQ ID NO: 2137751 - DNA, 18 bp, Homo sapiens
atctgactcacaagaaga

SEQ ID NO: 2137752 - DNA, 18 bp, Homo sapiens
atctgagaagtgtatata

SEQ ID NO: 2137753 - DNA, 17 bp, Homo sapiens
atctgagcaagagctgg

SEQ ID NO: 2137754 - DNA, 18 bp, Homo sapiens
atctgagcctaaatctaa

SEQ ID NO: 2137755 - DNA, 21 bp, Homo sapiens
atctgagcctaaatctaatca

SEQ ID NO: 2137756 - DNA, 16 bp, Homo sapiens
atctgatggtgagctg

SEQ ID NO: 2137757 - DNA, 13 bp, Homo sapiens
atctgatttaatg

SEQ ID NO: 2137758 - DNA, 17 bp, Homo sapiens
atctgatttaatgtttt

SEQ ID NO: 2137759 - DNA, 19 bp, Homo sapiens
atctgatttaatgttttct

SEQ ID NO: 2137760 - DNA, 21 bp, Homo sapiens
atctgcaccctcgatgaagcc

SEQ ID NO: 2137761 - DNA, 12 bp, Homo sapiens
atctgcagggag

SEQ ID NO: 2137762 - DNA, 13 bp, Homo sapiens
atgcatgatttta

SEQ ID NO: 2137763 - DNA, 18 bp, Homo sapiens
atgcatgattttatacat

SEQ ID NO: 2137764 - DNA, 20 bp, Homo sapiens
atgcatgattttatacatag

SEQ ID NO: 2137765 - DNA, 20 bp, Homo sapiens
atgcatgcagccactgtgct

SEQ ID NO: 2137766 - DNA, 17 bp, Homo sapiens
atgcatgcgcaggctca

SEQ ID NO: 2137767 - DNA, 18 bp, Homo sapiens
atgcatgcgcaggctcat

SEQ ID NO: 2137768 - DNA, 14 bp, Homo sapiens
atgcatgtaaggtc

SEQ ID NO: 2137769 - DNA, 13 bp, Homo sapiens
atgcatttccaca

SEQ ID NO: 2137770 - DNA, 16 bp, Homo sapiens
atgcatttccacactg

SEQ ID NO: 2137771 - DNA, 20 bp, Homo sapiens
atgcatttccacactgtcag

SEQ ID NO: 2137772 - DNA, 15 bp, Homo sapiens
atgcattttcaagat

SEQ ID NO: 2137773 - DNA, 22 bp, Homo sapiens
atgcatttttgatgggaagaaa

SEQ ID NO: 2137774 - DNA, 18 bp, Homo sapiens
atgccaaaaaaaaataca

SEQ ID NO: 2137775 - DNA, 19 bp, Homo sapiens
atgccaaaaaaaaatacat

SEQ ID NO: 2137776 - DNA, 18 bp, Homo sapiens
atgccaaaatattgctta

SEQ ID NO: 2137777 - DNA, 18 bp, Homo sapiens
atgccaaagcaaaagaag

SEQ ID NO: 2137778 - DNA, 18 bp, Homo sapiens
atgccaacaccttcttgg

SEQ ID NO: 2137779 - DNA, 11 bp, Homo sapiens
atgccacagcc

SEQ ID NO: 2137780 - DNA, 12 bp, Homo sapiens
atgccacagccc

SEQ ID NO: 2137781 - DNA, 13 bp, Homo sapiens
atgccacagcccc

SEQ ID NO: 2137782 - DNA, 14 bp, Homo sapiens
atgccacagcccca

SEQ ID NO: 2137783 - DNA, 15 bp, Homo sapiens
atgccacagccccac

SEQ ID NO: 2137784 - DNA, 17 bp, Homo sapiens
atgccacagccccacag

SEQ ID NO: 2137785 - DNA, 18 bp, Homo sapiens
atgccacagccccacagc

SEQ ID NO: 2137786 - DNA, 21 bp, Homo sapiens
atgccaccctctccatgccca

SEQ ID NO: 2137787 - DNA, 23 bp, Homo sapiens
atgccaggttaggaaggcagcat

SEQ ID NO: 2137788 - DNA, 22 bp, Homo sapiens
atgccatctccaccctgagcct

SEQ ID NO: 2137789 - DNA, 17 bp, Homo sapiens
atgccatggacagaaga

SEQ ID NO: 2137790 - DNA, 22 bp, Homo sapiens
atgccatgtttagattccagga

SEQ ID NO: 2137791 - DNA, 16 bp, Homo sapiens
atgccatttgtactga

SEQ ID NO: 2137792 - DNA, 20 bp, Homo sapiens
atgcccagagggcccaggca

SEQ ID NO: 2137793 - DNA, 21 bp, Homo sapiens
atgcccagagggcccaggcag

SEQ ID NO: 2137794 - DNA, 22 bp, Homo sapiens
atgcccagagggcccaggcagg

SEQ ID NO: 2137795 - DNA, 14 bp, Homo sapiens
atgccccaaatata

SEQ ID NO: 2137796 - DNA, 18 bp, Homo sapiens
atgcccctctgcctgggc

SEQ ID NO: 2137797 - DNA, 13 bp, Homo sapiens
atgccctctctga

SEQ ID NO: 2137798 - DNA, 14 bp, Homo sapiens
atgccctggatcca

SEQ ID NO: 2137799 - DNA, 20 bp, Homo sapiens
atgccgctcttctgtcatcc

SEQ ID NO: 2137800 - DNA, 22 bp, Homo sapiens
atgccgtgtgtctcgtctcctg

SEQ ID NO: 2137801 - DNA, 18 bp, Homo sapiens
atgcctaatatttaggca

SEQ ID NO: 2137802 - DNA, 15 bp, Homo sapiens
atgcctacagataat

SEQ ID NO: 2137803 - DNA, 16 bp, Homo sapiens
atgcctacagataatt

SEQ ID NO: 2137804 - DNA, 17 bp, Homo sapiens
atgcctacagataattt

SEQ ID NO: 2137805 - DNA, 18 bp, Homo sapiens
atgcctacttgtaatttc

SEQ ID NO: 2137806 - DNA, 14 bp, Homo sapiens
atgcctccaagcca

SEQ ID NO: 2137807 - DNA, 16 bp, Homo sapiens
atgcctctcccacgat

SEQ ID NO: 2137808 - DNA, 14 bp, Homo sapiens
atgcctctcccgca

SEQ ID NO: 2137809 - DNA, 20 bp, Homo sapiens
atgcctctcccgcaccaggc

SEQ ID NO: 2137810 - DNA, 23 bp, Homo sapiens
atgcctctcccgcaccaggccgg

SEQ ID NO: 2137811 - DNA, 13 bp, Homo sapiens
atgcctctgaggc

SEQ ID NO: 2137812 - DNA, 23 bp, Homo sapiens
atgcctctgaggccagcctggcc

SEQ ID NO: 2137813 - DNA, 21 bp, Homo sapiens
atgcctctgatatgggactga

SEQ ID NO: 2137814 - DNA, 15 bp, Homo sapiens
atgcctgagggtgga

SEQ ID NO: 2137815 - DNA, 20 bp, Homo sapiens
atgcctggcccccctccagg

SEQ ID NO: 2137816 - DNA, 21 bp, Homo sapiens
atgcctggcccccctccaggc

SEQ ID NO: 2137817 - DNA, 18 bp, Homo sapiens
atgcctggtctttcctct

SEQ ID NO: 2137818 - DNA, 15 bp, Homo sapiens
atgccttatgtaatt

SEQ ID NO: 2137819 - DNA, 11 bp, Homo sapiens
atgccttccac

SEQ ID NO: 2137820 - DNA, 21 bp, Homo sapiens
atgcctttctagtcctattct

SEQ ID NO: 2137821 - DNA, 23 bp, Homo sapiens
atgccttttcccaaaatgttgaa

SEQ ID NO: 2137822 - DNA, 13 bp, Homo sapiens
atgcgctgctcaa

SEQ ID NO: 2137823 - DNA, 18 bp, Homo sapiens
atgcgctgctcaacctct

SEQ ID NO: 2137824 - DNA, 21 bp, Homo sapiens
atgcgctgctcaacctctctc

SEQ ID NO: 2137825 - DNA, 16 bp, Homo sapiens
atgcggggcagagcca

SEQ ID NO: 2137826 - DNA, 18 bp, Homo sapiens
atgcgtatatgtgcgtct

SEQ ID NO: 2137827 - DNA, 13 bp, Homo sapiens
atgctaagaaatg

SEQ ID NO: 2137828 - DNA, 20 bp, Homo sapiens
atgctacagtactatgtaaa

SEQ ID NO: 2137829 - DNA, 18 bp, Homo sapiens
atgctattgttgtgggct

SEQ ID NO: 2137830 - DNA, 16 bp, Homo sapiens
atgctatttctggcct

SEQ ID NO: 2137831 - DNA, 18 bp, Homo sapiens
atgctatttctggcctca

SEQ ID NO: 2137832 - DNA, 16 bp, Homo sapiens
atgctcaaccactgtg

SEQ ID NO: 2137833 - DNA, 14 bp, Homo sapiens
atgctcaagttttt

SEQ ID NO: 2137834 - DNA, 21 bp, Homo sapiens
atgctcatacttggacagtta

SEQ ID NO: 2137835 - DNA, 11 bp, Homo sapiens
atgctccaggg

SEQ ID NO: 2137836 - DNA, 13 bp, Homo sapiens
atgctcctagttt

SEQ ID NO: 2137837 - DNA, 22 bp, Homo sapiens
atgctcctagtttgacctcaca

SEQ ID NO: 2137838 - DNA, 14 bp, Homo sapiens
atgctcgtgtgatt

SEQ ID NO: 2137839 - DNA, 21 bp, Homo sapiens
atgctcgtgtgatttcctaca

SEQ ID NO: 2137840 - DNA, 15 bp, Homo sapiens
atgctctacttcttt

SEQ ID NO: 2137841 - DNA, 16 bp, Homo sapiens
atgctctacttctttt

SEQ ID NO: 2137842 - DNA, 14 bp, Homo sapiens
atgctctcctttcc

SEQ ID NO: 2137843 - DNA, 19 bp, Homo sapiens
atgctctctgcagccagcc

SEQ ID NO: 2137844 - DNA, 21 bp, Homo sapiens
atgctctctgcagccagccca

SEQ ID NO: 2137845 - DNA, 16 bp, Homo sapiens
atgctctggaagcctg

SEQ ID NO: 2137846 - DNA, 23 bp, Homo sapiens
atgctctgtgcgagggttactat

SEQ ID NO: 2137847 - DNA, 12 bp, Homo sapiens
atgctgaaggga

SEQ ID NO: 2137848 - DNA, 14 bp, Homo sapiens
atgctgaatgaatc

SEQ ID NO: 2137849 - DNA, 17 bp, Homo sapiens
atgctgaattattttgt

SEQ ID NO: 2137850 - DNA, 18 bp, Homo sapiens
atgctgaattattttgtt

SEQ ID NO: 2137851 - DNA, 19 bp, Homo sapiens
atgctgactgtactcctcc

SEQ ID NO: 2137852 - DNA, 20 bp, Homo sapiens
atgctgactgtactcctccc

SEQ ID NO: 2137853 - DNA, 22 bp, Homo sapiens
atgctgagtatgttaagctctt

SEQ ID NO: 2137854 - DNA, 24 bp, Homo sapiens
atgctgccccgttccctgtcagag

SEQ ID NO: 2137855 - DNA, 19 bp, Homo sapiens
atgctgctttttggcacag

SEQ ID NO: 2137856 - DNA, 20 bp, Homo sapiens
atgctgctttttggcacagt

SEQ ID NO: 2137857 - DNA, 21 bp, Homo sapiens
atgctggacggcattcctgct

SEQ ID NO: 2137858 - DNA, 12 bp, Homo sapiens
atgctggccagc

SEQ ID NO: 2137859 - DNA, 14 bp, Homo sapiens
atgctggccagcac

SEQ ID NO: 2137860 - DNA, 22 bp, Homo sapiens
atgctggcctcccaataaagct

SEQ ID NO: 2137861 - DNA, 18 bp, Homo sapiens
atgctggcctgtggcagg

SEQ ID NO: 2137862 - DNA, 21 bp, Homo sapiens
atgctggcggcgcagagggaa

SEQ ID NO: 2137863 - DNA, 20 bp, Homo sapiens
atgctggctgttggctgggg

SEQ ID NO: 2137864 - DNA, 19 bp, Homo sapiens
atgctgggtgttgcatttc

SEQ ID NO: 2137865 - DNA, 19 bp, Homo sapiens
atgctggtctaggagctgt

SEQ ID NO: 2137866 - DNA, 20 bp, Homo sapiens
atgctgtcaactatgatatg

SEQ ID NO: 2137867 - DNA, 21 bp, Homo sapiens
atgctgtctccataatgccac

SEQ ID NO: 2137868 - DNA, 23 bp, Homo sapiens
atgctgtctccataatgccactg

SEQ ID NO: 2137869 - DNA, 15 bp, Homo sapiens
atgctgttgcctcat

SEQ ID NO: 2137870 - DNA, 16 bp, Homo sapiens
atgctgttgcctcatc

SEQ ID NO: 2137871 - DNA, 17 bp, Homo sapiens
atgctgttggtgagaat

SEQ ID NO: 2137872 - DNA, 14 bp, Homo sapiens
atgctgttttaata

SEQ ID NO: 2137873 - DNA, 20 bp, Homo sapiens
atgctgttttaataattatg

SEQ ID NO: 2137874 - DNA, 17 bp, Homo sapiens
atgcttaaaatatgtat

SEQ ID NO: 2137875 - DNA, 20 bp, Homo sapiens
atgcttaaaatatgtatgtc

SEQ ID NO: 2137876 - DNA, 15 bp, Homo sapiens
atgtgctattgaact

SEQ ID NO: 2137877 - DNA, 17 bp, Homo sapiens
atgtgctattgaactga

SEQ ID NO: 2137878 - DNA, 21 bp, Homo sapiens
atgtgctattgaactgagcca

SEQ ID NO: 2137879 - DNA, 15 bp, Homo sapiens
atgtggaatataaag

SEQ ID NO: 2137880 - DNA, 14 bp, Homo sapiens
atgtggatctgggg

SEQ ID NO: 2137881 - DNA, 22 bp, Homo sapiens
atgtggattagctagaatgcac

SEQ ID NO: 2137882 - DNA, 17 bp, Homo sapiens
atgtggcaaagtgctgt

SEQ ID NO: 2137883 - DNA, 13 bp, Homo sapiens
atgtggcactgct

SEQ ID NO: 2137884 - DNA, 22 bp, Homo sapiens
atgtggcattggggggccgggc

SEQ ID NO: 2137885 - DNA, 15 bp, Homo sapiens
atgtggccctggcct

SEQ ID NO: 2137886 - DNA, 20 bp, Homo sapiens
atgtggccctggcctgctgg

SEQ ID NO: 2137887 - DNA, 10 bp, Homo sapiens
atgtgggagg

SEQ ID NO: 2137888 - DNA, 16 bp, Homo sapiens
atgtgggcgtttgtaa

SEQ ID NO: 2137889 - DNA, 19 bp, Homo sapiens
atgtgggcgtttgtaaatt

SEQ ID NO: 2137890 - DNA, 15 bp, Homo sapiens
atgtggtgggacagg

SEQ ID NO: 2137891 - DNA, 19 bp, Homo sapiens
atgtggtttatagagggcc

SEQ ID NO: 2137892 - DNA, 17 bp, Homo sapiens
atgtgtagcctgtgcat

SEQ ID NO: 2137893 - DNA, 19 bp, Homo sapiens
atgtgtatatatacataca

SEQ ID NO: 2137894 - DNA, 15 bp, Homo sapiens
atgtgtattctggct

SEQ ID NO: 2137895 - DNA, 19 bp, Homo sapiens
atgtgtattctggctgcaa

SEQ ID NO: 2137896 - DNA, 15 bp, Homo sapiens
atgtgtcagcatgca

SEQ ID NO: 2137897 - DNA, 15 bp, Homo sapiens
atgtgtcatgatttc

SEQ ID NO: 2137898 - DNA, 17 bp, Homo sapiens
atgtgtcatgatttcaa

SEQ ID NO: 2137899 - DNA, 23 bp, Homo sapiens
atgtgtcatgatttcaatgattg

SEQ ID NO: 2137900 - DNA, 13 bp, Homo sapiens
atgtgtcccctca

SEQ ID NO: 2137901 - DNA, 19 bp, Homo sapiens
atgtgtcccctcactctgt

SEQ ID NO: 2137902 - DNA, 24 bp, Homo sapiens
atgtgtcccctcactctgtcagcc

SEQ ID NO: 2137903 - DNA, 18 bp, Homo sapiens
atgtgtgaaggtcttgcc

SEQ ID NO: 2137904 - DNA, 18 bp, Homo sapiens
atgtgtgaattctgcaac

SEQ ID NO: 2137905 - DNA, 17 bp, Homo sapiens
atgtgtgcatgtgtgta

SEQ ID NO: 2137906 - DNA, 18 bp, Homo sapiens
atgtgtgcatgtgtgtat

SEQ ID NO: 2137907 - DNA, 20 bp, Homo sapiens
atgtgtgcatgtgtgtataa

SEQ ID NO: 2137908 - DNA, 14 bp, Homo sapiens
atgtgtgctgtgct

SEQ ID NO: 2137909 - DNA, 15 bp, Homo sapiens
atgtgtggcagattt

SEQ ID NO: 2137910 - DNA, 16 bp, Homo sapiens
atgtgtgggaaaggga

SEQ ID NO: 2137911 - DNA, 13 bp, Homo sapiens
atgtgtgtataag

SEQ ID NO: 2137912 - DNA, 21 bp, Homo sapiens
atgtgtgtataagtgcacaca

SEQ ID NO: 2137913 - DNA, 23 bp, Homo sapiens
atgtgtgtataagtgcacacaga

SEQ ID NO: 2137914 - DNA, 12 bp, Homo sapiens
atgtgtgtatat

SEQ ID NO: 2137915 - DNA, 15 bp, Homo sapiens
atgtgtgtatatatg

SEQ ID NO: 2137916 - DNA, 18 bp, Homo sapiens
atgtgtgtatatatgtgt

SEQ ID NO: 2137917 - DNA, 14 bp, Homo sapiens
atgtgtgtatgtgt

SEQ ID NO: 2137918 - DNA, 17 bp, Homo sapiens
atgtgtgtggtgtgtgt

SEQ ID NO: 2137919 - DNA, 19 bp, Homo sapiens
atgtgtgtggtgtgtgtgc

SEQ ID NO: 2137920 - DNA, 16 bp, Homo sapiens
atgtgtgtttaaataa

SEQ ID NO: 2137921 - DNA, 17 bp, Homo sapiens
atgtgtgtttaaataaa

SEQ ID NO: 2137922 - DNA, 14 bp, Homo sapiens
atgtgttgaaaaaa

SEQ ID NO: 2137923 - DNA, 14 bp, Homo sapiens
atgtgttgtgatag

SEQ ID NO: 2137924 - DNA, 20 bp, Homo sapiens
atgtgtttaaaacatgcacg

SEQ ID NO: 2137925 - DNA, 15 bp, Homo sapiens
atgtgttttctgaat

SEQ ID NO: 2137926 - DNA, 22 bp, Homo sapiens
atgtgttttgcacgtcttgcta

SEQ ID NO: 2137927 - DNA, 23 bp, Homo sapiens
atgtgttttgcacgtcttgctat

SEQ ID NO: 2137928 - DNA, 22 bp, Homo sapiens
atgttaaaaaaataagaagaat

SEQ ID NO: 2137929 - DNA, 23 bp, Homo sapiens
atgttaaccagaataaagttctg

SEQ ID NO: 2137930 - DNA, 16 bp, Homo sapiens
atgttaagacttgaca

SEQ ID NO: 2137931 - DNA, 20 bp, Homo sapiens
atgttaattaaactgaagaa

SEQ ID NO: 2137932 - DNA, 14 bp, Homo sapiens
atgttacattatta

SEQ ID NO: 2137933 - DNA, 20 bp, Homo sapiens
atgttaccaaagcaatattt

SEQ ID NO: 2137934 - DNA, 17 bp, Homo sapiens
atgttactacatgcact

SEQ ID NO: 2137935 - DNA, 15 bp, Homo sapiens
atgttagcaaagagt

SEQ ID NO: 2137936 - DNA, 18 bp, Homo sapiens
atgttaggaaaatttcac

SEQ ID NO: 2137937 - DNA, 16 bp, Homo sapiens
atgttaggagaactac

SEQ ID NO: 2137938 - DNA, 15 bp, Homo sapiens
atgttattgcataat

SEQ ID NO: 2137939 - DNA, 12 bp, Homo sapiens
atgttatttata

SEQ ID NO: 2137940 - DNA, 17 bp, Homo sapiens
atgttattttttaatta

SEQ ID NO: 2137941 - DNA, 19 bp, Homo sapiens
atgttattttttaattatt

SEQ ID NO: 2137942 - DNA, 20 bp, Homo sapiens
atgttattttttaattatta

SEQ ID NO: 2137943 - DNA, 22 bp, Homo sapiens
atgttcaactggagacactatt

SEQ ID NO: 2137944 - DNA, 13 bp, Homo sapiens
atgttccctgcac

SEQ ID NO: 2137945 - DNA, 18 bp, Homo sapiens
atgttccctgcaccctgg

SEQ ID NO: 2137946 - DNA, 22 bp, Homo sapiens
atgttcccttgaccattggctg

SEQ ID NO: 2137947 - DNA, 16 bp, Homo sapiens
atgttcctagtgaaag

SEQ ID NO: 2137948 - DNA, 17 bp, Homo sapiens
atgttctaacagcatct

SEQ ID NO: 2137949 - DNA, 16 bp, Homo sapiens
atgttctcagaatcag

SEQ ID NO: 2137950 - DNA, 17 bp, Homo sapiens
atgttctctgaggacac

SEQ ID NO: 2137951 - DNA, 16 bp, Homo sapiens
atgttctggacctccc

SEQ ID NO: 2137952 - DNA, 16 bp, Homo sapiens
atgttctggctttaca

SEQ ID NO: 2137953 - DNA, 11 bp, Homo sapiens
atgttctggga

SEQ ID NO: 2137954 - DNA, 12 bp, Homo sapiens
atgttctgggac

SEQ ID NO: 2137955 - DNA, 15 bp, Homo sapiens
atgttctgggacaca

SEQ ID NO: 2137956 - DNA, 14 bp, Homo sapiens
atgttctgttgtaa

SEQ ID NO: 2137957 - DNA, 18 bp, Homo sapiens
atgttctgttgtaaagag

SEQ ID NO: 2137958 - DNA, 22 bp, Homo sapiens
atgttcttggttcccattgtga

SEQ ID NO: 2137959 - DNA, 22 bp, Homo sapiens
atgttgaaatatgatgttaaaa

SEQ ID NO: 2137960 - DNA, 12 bp, Homo sapiens
atgttgaaatct

SEQ ID NO: 2137961 - DNA, 19 bp, Homo sapiens
atgttgccacctgttaaaa

SEQ ID NO: 2137962 - DNA, 22 bp, Homo sapiens
atgttgccacctgttaaaatgt

SEQ ID NO: 2137963 - DNA, 18 bp, Homo sapiens
atgttgccatgaggcctt

SEQ ID NO: 2137964 - DNA, 19 bp, Homo sapiens
atgttgccatgaggccttt

SEQ ID NO: 2137965 - DNA, 13 bp, Homo sapiens
atgttgcccaggc

SEQ ID NO: 2137966 - DNA, 16 bp, Homo sapiens
atgttgcccaggcagg

SEQ ID NO: 2137967 - DNA, 17 bp, Homo sapiens
atgttgcccaggcaggt

SEQ ID NO: 2137968 - DNA, 13 bp, Homo sapiens
atgttgctgaaac

SEQ ID NO: 2137969 - DNA, 19 bp, Homo sapiens
atgttgggatttatatcta

SEQ ID NO: 2137970 - DNA, 23 bp, Homo sapiens
atgttgggatttatatctatagt

SEQ ID NO: 2137971 - DNA, 22 bp, Homo sapiens
atgttgtaaattaggaggctca

SEQ ID NO: 2137972 - DNA, 15 bp, Homo sapiens
atgttgttaaacacg

SEQ ID NO: 2137973 - DNA, 23 bp, Homo sapiens
atgttgttaaacacgtgtctata

SEQ ID NO: 2137974 - DNA, 13 bp, Homo sapiens
atgttgttattta

SEQ ID NO: 2137975 - DNA, 15 bp, Homo sapiens
atgttgttatttaaa

SEQ ID NO: 2137976 - DNA, 23 bp, Homo sapiens
atgttgttcccacacacaaacca

SEQ ID NO: 2137977 - DNA, 16 bp, Homo sapiens
atgttgtttgggagag

SEQ ID NO: 2137978 - DNA, 14 bp, Homo sapiens
atgtttaaaccttt

SEQ ID NO: 2137979 - DNA, 20 bp, Homo sapiens
atgtttaaactttgtgcctt

SEQ ID NO: 2137980 - DNA, 18 bp, Homo sapiens
atgtttatgcaaggaagg

SEQ ID NO: 2137981 - DNA, 18 bp, Homo sapiens
atgtttcacaacaggcat

SEQ ID NO: 2137982 - DNA, 18 bp, Homo sapiens
atgtttcactatgatttt

SEQ ID NO: 2137983 - DNA, 22 bp, Homo sapiens
atgtttcactatgattttctat

SEQ ID NO: 2137984 - DNA, 22 bp, Homo sapiens
atgtttcatgttttgtgactat

SEQ ID NO: 2137985 - DNA, 16 bp, Homo sapiens
atgtttccagaaaata

SEQ ID NO: 2137986 - DNA, 22 bp, Homo sapiens
atgtttcttctaggttctaaaa

SEQ ID NO: 2137987 - DNA, 14 bp, Homo sapiens
atgtttgcctctgc

SEQ ID NO: 2137988 - DNA, 19 bp, Homo sapiens
atgtttgcctctgcctctg

SEQ ID NO: 2137989 - DNA, 23 bp, Homo sapiens
atgtttgggcagaagggagaagg

SEQ ID NO: 2137990 - DNA, 18 bp, Homo sapiens
atgttttaagaggcaggg

SEQ ID NO: 2137991 - DNA, 19 bp, Homo sapiens
attctggaggaagaagaca

SEQ ID NO: 2137992 - DNA, 22 bp, Homo sapiens
attctggatggatttgaagcaa

SEQ ID NO: 2137993 - DNA, 21 bp, Homo sapiens
attctgggctcctggaaccaa

SEQ ID NO: 2137994 - DNA, 18 bp, Homo sapiens
attctgtcatagaaagtg

SEQ ID NO: 2137995 - DNA, 13 bp, Homo sapiens
attctgtgttgaa

SEQ ID NO: 2137996 - DNA, 22 bp, Homo sapiens
attctgtgttgaacacaattga

SEQ ID NO: 2137997 - DNA, 23 bp, Homo sapiens
attctgttgcccaggctggcctg

SEQ ID NO: 2137998 - DNA, 14 bp, Homo sapiens
attctgttggccag

SEQ ID NO: 2137999 - DNA, 19 bp, Homo sapiens
attctgttggccagtgtga

SEQ ID NO: 2138000 - DNA, 21 bp, Homo sapiens
attctgttggccagtgtgaca

SEQ ID NO: 2138001 - DNA, 14 bp, Homo sapiens
attcttatttctgt

SEQ ID NO: 2138002 - DNA, 16 bp, Homo sapiens
attcttattttttaaa

SEQ ID NO: 2138003 - DNA, 13 bp, Homo sapiens
attcttctgcagt

SEQ ID NO: 2138004 - DNA, 22 bp, Homo sapiens
attcttctgtacgtctgacagg

SEQ ID NO: 2138005 - DNA, 16 bp, Homo sapiens
attcttggagaacttt

SEQ ID NO: 2138006 - DNA, 12 bp, Homo sapiens
attcttgtatat

SEQ ID NO: 2138007 - DNA, 14 bp, Homo sapiens
attcttgtcaaaaa

SEQ ID NO: 2138008 - DNA, 13 bp, Homo sapiens
attcttgtcctgg

SEQ ID NO: 2138009 - DNA, 17 bp, Homo sapiens
attctttaaatttcatc

SEQ ID NO: 2138010 - DNA, 17 bp, Homo sapiens
attctttatcttgacat

SEQ ID NO: 2138011 - DNA, 21 bp, Homo sapiens
attctttcccctcagagctct

SEQ ID NO: 2138012 - DNA, 13 bp, Homo sapiens
attctttccctag

SEQ ID NO: 2138013 - DNA, 13 bp, Homo sapiens
attctttgtacca

SEQ ID NO: 2138014 - DNA, 14 bp, Homo sapiens
attctttttaaagt

SEQ ID NO: 2138015 - DNA, 16 bp, Homo sapiens
attctttttaaagtat

SEQ ID NO: 2138016 - DNA, 15 bp, Homo sapiens
attgaaaaatcacca

SEQ ID NO: 2138017 - DNA, 14 bp, Homo sapiens
attgaaaatgaatg

SEQ ID NO: 2138018 - DNA, 14 bp, Homo sapiens
attgaacagcaaag

SEQ ID NO: 2138019 - DNA, 15 bp, Homo sapiens
attgaacccaggagg

SEQ ID NO: 2138020 - DNA, 12 bp, Homo sapiens
attgaacctggt

SEQ ID NO: 2138021 - DNA, 19 bp, Homo sapiens
attgaagagagatatatct

SEQ ID NO: 2138022 - DNA, 23 bp, Homo sapiens
attgaagagagatatatctgaaa

SEQ ID NO: 2138023 - DNA, 20 bp, Homo sapiens
attgaagagatttcaacata

SEQ ID NO: 2138024 - DNA, 19 bp, Homo sapiens
attgaagatgtaaggaatt

SEQ ID NO: 2138025 - DNA, 16 bp, Homo sapiens
attgaaggagaaaatg

SEQ ID NO: 2138026 - DNA, 19 bp, Homo sapiens
attgaaggagaaaatgcat

SEQ ID NO: 2138027 - DNA, 19 bp, Homo sapiens
attgaataaagttgaagct

SEQ ID NO: 2138028 - DNA, 19 bp, Homo sapiens
attgaataagtattcttca

SEQ ID NO: 2138029 - DNA, 15 bp, Homo sapiens
attgaatatatcaga

SEQ ID NO: 2138030 - DNA, 14 bp, Homo sapiens
attgaatctgattg

SEQ ID NO: 2138031 - DNA, 22 bp, Homo sapiens
attgaatggaagcaaaattata

SEQ ID NO: 2138032 - DNA, 23 bp, Homo sapiens
attgaatggctatgtttttaatg

SEQ ID NO: 2138033 - DNA, 16 bp, Homo sapiens
attgacaacattttat

SEQ ID NO: 2138034 - DNA, 15 bp, Homo sapiens
attgacaagtcattt

SEQ ID NO: 2138035 - DNA, 17 bp, Homo sapiens
attgacaataatttcag

SEQ ID NO: 2138036 - DNA, 17 bp, Homo sapiens
attgacacacagcactc

SEQ ID NO: 2138037 - DNA, 20 bp, Homo sapiens
attgacacacagcactctct

SEQ ID NO: 2138038 - DNA, 20 bp, Homo sapiens
attgaccaagatgatcacat

SEQ ID NO: 2138039 - DNA, 22 bp, Homo sapiens
attgactcaaatctccagtatt

SEQ ID NO: 2138040 - DNA, 21 bp, Homo sapiens
attgagataatatctgtgagg

SEQ ID NO: 2138041 - DNA, 19 bp, Homo sapiens
attgagctgcagaaacgaa

SEQ ID NO: 2138042 - DNA, 15 bp, Homo sapiens
attgagtttaagtct

SEQ ID NO: 2138043 - DNA, 16 bp, Homo sapiens
attgatacttcaggtg

SEQ ID NO: 2138044 - DNA, 20 bp, Homo sapiens
attgatacttcaggtgcttt

SEQ ID NO: 2138045 - DNA, 16 bp, Homo sapiens
attgatatgaaaaata

SEQ ID NO: 2138046 - DNA, 19 bp, Homo sapiens
attgatcggagcctcctct

SEQ ID NO: 2138047 - DNA, 17 bp, Homo sapiens
attgatgtttccagaaa

SEQ ID NO: 2138048 - DNA, 13 bp, Homo sapiens
attgatttcaaga

SEQ ID NO: 2138049 - DNA, 16 bp, Homo sapiens
attgatttgacccact

SEQ ID NO: 2138050 - DNA, 15 bp, Homo sapiens
attgcaacaggctgg

SEQ ID NO: 2138051 - DNA, 19 bp, Homo sapiens
attgcaacaggctgggctt

SEQ ID NO: 2138052 - DNA, 12 bp, Homo sapiens
attgcaatattt

SEQ ID NO: 2138053 - DNA, 13 bp, Homo sapiens
attgcactatgaa

SEQ ID NO: 2138054 - DNA, 13 bp, Homo sapiens
attgcactccagt

SEQ ID NO: 2138055 - DNA, 19 bp, Homo sapiens
attgcagttcaaatcctca

SEQ ID NO: 2138056 - DNA, 20 bp, Homo sapiens
attgcagttcaaatcctcac

SEQ ID NO: 2138057 - DNA, 18 bp, Homo sapiens
attgcatgtattgtaaac

SEQ ID NO: 2138058 - DNA, 16 bp, Homo sapiens
attgcatttcctgaca

SEQ ID NO: 2138059 - DNA, 21 bp, Homo sapiens
attgcccacgctggagtgcag

SEQ ID NO: 2138060 - DNA, 15 bp, Homo sapiens
attgcctgcagagag

SEQ ID NO: 2138061 - DNA, 19 bp, Homo sapiens
attgcggacagccacggcc

SEQ ID NO: 2138062 - DNA, 17 bp, Homo sapiens
attgctagtgatttcat

SEQ ID NO: 2138063 - DNA, 18 bp, Homo sapiens
attgctagtgatttcatt

SEQ ID NO: 2138064 - DNA, 15 bp, Homo sapiens
attgctgctctctga

SEQ ID NO: 2138065 - DNA, 18 bp, Homo sapiens
attgctgctctctgaggg

SEQ ID NO: 2138066 - DNA, 23 bp, Homo sapiens
attgctggagacagtagaggcat

SEQ ID NO: 2138067 - DNA, 20 bp, Homo sapiens
attgcttaaaagacattttt

SEQ ID NO: 2138068 - DNA, 16 bp, Homo sapiens
attgcttacattttta

SEQ ID NO: 2138069 - DNA, 20 bp, Homo sapiens
attgcttacatttttacaat

SEQ ID NO: 2138070 - DNA, 21 bp, Homo sapiens
attgcttacatttttacaata

SEQ ID NO: 2138071 - DNA, 17 bp, Homo sapiens
attgcttatgtctctac

SEQ ID NO: 2138072 - DNA, 15 bp, Homo sapiens
attgcttgatacttt

SEQ ID NO: 2138073 - DNA, 21 bp, Homo sapiens
attgctttgaagcagttgtgt

SEQ ID NO: 2138074 - DNA, 19 bp, Homo sapiens
attggaagaaattcctgta

SEQ ID NO: 2138075 - DNA, 19 bp, Homo sapiens
attggacatggtctcctct

SEQ ID NO: 2138076 - DNA, 17 bp, Homo sapiens
attggacattttcttca

SEQ ID NO: 2138077 - DNA, 19 bp, Homo sapiens
attggacttccttggtttg

SEQ ID NO: 2138078 - DNA, 13 bp, Homo sapiens
attggagggaaga

SEQ ID NO: 2138079 - DNA, 22 bp, Homo sapiens
attggatacaaggatcagaatg

SEQ ID NO: 2138080 - DNA, 22 bp, Homo sapiens
attggattattcatttaaaatg

SEQ ID NO: 2138081 - DNA, 20 bp, Homo sapiens
attggctcccaactcctccc

SEQ ID NO: 2138082 - DNA, 19 bp, Homo sapiens
attggctcccatctgaacc

SEQ ID NO: 2138083 - DNA, 21 bp, Homo sapiens
attggcttattttttaaaata

SEQ ID NO: 2138084 - DNA, 17 bp, Homo sapiens
attgggaagctggggga

SEQ ID NO: 2138085 - DNA, 21 bp, Homo sapiens
attgggagcttgggaatggat

SEQ ID NO: 2138086 - DNA, 15 bp, Homo sapiens
attgggattttaaaa

SEQ ID NO: 2138087 - DNA, 18 bp, Homo sapiens
attgggtgggtaaattca

SEQ ID NO: 2138088 - DNA, 17 bp, Homo sapiens
attggtatcaagaaagt

SEQ ID NO: 2138089 - DNA, 22 bp, Homo sapiens
attggttctcctaaaacatgaa

SEQ ID NO: 2138090 - DNA, 20 bp, Homo sapiens
attgtaaaacctgtcaatga

SEQ ID NO: 2138091 - DNA, 17 bp, Homo sapiens
attgtaaacagaaggag

SEQ ID NO: 2138092 - DNA, 14 bp, Homo sapiens
attgtaaatattgt

SEQ ID NO: 2138093 - DNA, 18 bp, Homo sapiens
attgtaaattatttcata

SEQ ID NO: 2138094 - DNA, 20 bp, Homo sapiens
attgtaaattttagagcata

SEQ ID NO: 2138095 - DNA, 19 bp, Homo sapiens
attgtacactaacatattt

SEQ ID NO: 2138096 - DNA, 22 bp, Homo sapiens
attgtacactaacatatttaga

SEQ ID NO: 2138097 - DNA, 20 bp, Homo sapiens
attgtacagctgtttaagat

SEQ ID NO: 2138098 - DNA, 15 bp, Homo sapiens
attgtacatatggaa

SEQ ID NO: 2138099 - DNA, 19 bp, Homo sapiens
attgtagaaacacagtttt

SEQ ID NO: 2138100 - DNA, 15 bp, Homo sapiens
attgtataaaaatag

SEQ ID NO: 2138101 - DNA, 13 bp, Homo sapiens
attgtataaacta

SEQ ID NO: 2138102 - DNA, 22 bp, Homo sapiens
attgtataaactatcagtttgt

SEQ ID NO: 2138103 - DNA, 21 bp, Homo sapiens
attgtataagattagaatgaa

SEQ ID NO: 2138104 - DNA, 22 bp, Homo sapiens
attgtataagattagaatgaaa

SEQ ID NO: 2138105 - DNA, 16 bp, Homo sapiens
attttctagactttct

SEQ ID NO: 2138106 - DNA, 19 bp, Homo sapiens
attttctagactttctgtt

SEQ ID NO: 2138107 - DNA, 14 bp, Homo sapiens
attttcttcatgca

SEQ ID NO: 2138108 - DNA, 18 bp, Homo sapiens
attttcttcccatttgta

SEQ ID NO: 2138109 - DNA, 15 bp, Homo sapiens
attttcttgcctgag

SEQ ID NO: 2138110 - DNA, 18 bp, Homo sapiens
attttcttgcctgaggct

SEQ ID NO: 2138111 - DNA, 23 bp, Homo sapiens
attttctttgtgtagctttgctc

SEQ ID NO: 2138112 - DNA, 21 bp, Homo sapiens
attttctttttgtaattagta

SEQ ID NO: 2138113 - DNA, 14 bp, Homo sapiens
attttgcaaaattt

SEQ ID NO: 2138114 - DNA, 12 bp, Homo sapiens
attttgcagatt

SEQ ID NO: 2138115 - DNA, 12 bp, Homo sapiens
attttgcattta

SEQ ID NO: 2138116 - DNA, 15 bp, Homo sapiens
attttgcatttagtt

SEQ ID NO: 2138117 - DNA, 16 bp, Homo sapiens
attttgcatttgaata

SEQ ID NO: 2138118 - DNA, 15 bp, Homo sapiens
attttgccagactta

SEQ ID NO: 2138119 - DNA, 13 bp, Homo sapiens
attttgcctgtgt

SEQ ID NO: 2138120 - DNA, 20 bp, Homo sapiens
attttggaagttttcaggac

SEQ ID NO: 2138121 - DNA, 22 bp, Homo sapiens
attttgggggtttttaatcttt

SEQ ID NO: 2138122 - DNA, 20 bp, Homo sapiens
attttggtattacactgtat

SEQ ID NO: 2138123 - DNA, 20 bp, Homo sapiens
attttgtaaactcaaaatat

SEQ ID NO: 2138124 - DNA, 17 bp, Homo sapiens
attttgtaacaaatgaa

SEQ ID NO: 2138125 - DNA, 12 bp, Homo sapiens
attttgtaataa

SEQ ID NO: 2138126 - DNA, 19 bp, Homo sapiens
attttgtaataaactctct

SEQ ID NO: 2138127 - DNA, 17 bp, Homo sapiens
attttgtacaaagatat

SEQ ID NO: 2138128 - DNA, 13 bp, Homo sapiens
attttgtacagaa

SEQ ID NO: 2138129 - DNA, 14 bp, Homo sapiens
attttgtacagaat

SEQ ID NO: 2138130 - DNA, 17 bp, Homo sapiens
attttgtacagaatttt

SEQ ID NO: 2138131 - DNA, 18 bp, Homo sapiens
attttgtacagaattttt

SEQ ID NO: 2138132 - DNA, 14 bp, Homo sapiens
attttgtatattgt

SEQ ID NO: 2138133 - DNA, 20 bp, Homo sapiens
attttgtattacatctaatg

SEQ ID NO: 2138134 - DNA, 24 bp, Homo sapiens
attttgtattacatctaatgcttc

SEQ ID NO: 2138135 - DNA, 18 bp, Homo sapiens
attttgtattttcaactt

SEQ ID NO: 2138136 - DNA, 22 bp, Homo sapiens
attttgtctcctacctgctgct

SEQ ID NO: 2138137 - DNA, 20 bp, Homo sapiens
attttgtctgcttagtatct

SEQ ID NO: 2138138 - DNA, 20 bp, Homo sapiens
attttgtggctttctttctt

SEQ ID NO: 2138139 - DNA, 16 bp, Homo sapiens
attttgttatagaata

SEQ ID NO: 2138140 - DNA, 18 bp, Homo sapiens
attttgttatagaatact

SEQ ID NO: 2138141 - DNA, 22 bp, Homo sapiens
attttgttatagaatacttttt

SEQ ID NO: 2138142 - DNA, 13 bp, Homo sapiens
attttgttgtgat

SEQ ID NO: 2138143 - DNA, 14 bp, Homo sapiens
attttgttgtgatt

SEQ ID NO: 2138144 - DNA, 19 bp, Homo sapiens
attttgttgtgattttgta

SEQ ID NO: 2138145 - DNA, 21 bp, Homo sapiens
attttgttgtgattttgtaca

SEQ ID NO: 2138146 - DNA, 14 bp, Homo sapiens
attttgtttgtaat

SEQ ID NO: 2138147 - DNA, 14 bp, Homo sapiens
atttttaaaagttg

SEQ ID NO: 2138148 - DNA, 15 bp, Homo sapiens
atttttaaacaagta

SEQ ID NO: 2138149 - DNA, 12 bp, Homo sapiens
atttttaaacta

SEQ ID NO: 2138150 - DNA, 13 bp, Homo sapiens
atttttaatgact

SEQ ID NO: 2138151 - DNA, 18 bp, Homo sapiens
atttttacaaataaagat

SEQ ID NO: 2138152 - DNA, 14 bp, Homo sapiens
atttttacaataat

SEQ ID NO: 2138153 - DNA, 16 bp, Homo sapiens
atttttactaaagcag

SEQ ID NO: 2138154 - DNA, 21 bp, Homo sapiens
atttttactactattctgtta

SEQ ID NO: 2138155 - DNA, 14 bp, Homo sapiens
atttttagacagag

SEQ ID NO: 2138156 - DNA, 20 bp, Homo sapiens
atttttagagattaatttgt

SEQ ID NO: 2138157 - DNA, 23 bp, Homo sapiens
atttttagctctgttctttataa

SEQ ID NO: 2138158 - DNA, 13 bp, Homo sapiens
atttttatacata

SEQ ID NO: 2138159 - DNA, 14 bp, Homo sapiens
atttttatacatat

SEQ ID NO: 2138160 - DNA, 20 bp, Homo sapiens
atttttatacatatcagaaa

SEQ ID NO: 2138161 - DNA, 21 bp, Homo sapiens
atttttatacatatcagaaaa

SEQ ID NO: 2138162 - DNA, 22 bp, Homo sapiens
atttttatacatatcagaaaag

SEQ ID NO: 2138163 - DNA, 18 bp, Homo sapiens
atttttatatcagcctga

SEQ ID NO: 2138164 - DNA, 16 bp, Homo sapiens
atttttatcttacttt

SEQ ID NO: 2138165 - DNA, 15 bp, Homo sapiens
atttttatggaattt

SEQ ID NO: 2138166 - DNA, 19 bp, Homo sapiens
atttttattaaataaatat

SEQ ID NO: 2138167 - DNA, 16 bp, Homo sapiens
atttttatttttctaa

SEQ ID NO: 2138168 - DNA, 17 bp, Homo sapiens
atttttcaaccagcatt

SEQ ID NO: 2138169 - DNA, 20 bp, Homo sapiens
atttttcaaccagcatttta

SEQ ID NO: 2138170 - DNA, 22 bp, Homo sapiens
atttttcaaccagcattttact

SEQ ID NO: 2138171 - DNA, 20 bp, Homo sapiens
atttttcagctctctgtata

SEQ ID NO: 2138172 - DNA, 13 bp, Homo sapiens
atttttcatattg

SEQ ID NO: 2138173 - DNA, 18 bp, Homo sapiens
atttttcatgataatgaa

SEQ ID NO: 2138174 - DNA, 22 bp, Homo sapiens
atttttcattgatatgaaaaat

SEQ ID NO: 2138175 - DNA, 19 bp, Homo sapiens
atttttctcagtttgtata

SEQ ID NO: 2138176 - DNA, 15 bp, Homo sapiens
atttttcttatttca

SEQ ID NO: 2138177 - DNA, 19 bp, Homo sapiens
atttttcttatttcatttc

SEQ ID NO: 2138178 - DNA, 16 bp, Homo sapiens
atttttgaaacccatt

SEQ ID NO: 2138179 - DNA, 21 bp, Homo sapiens
atttttgaaacccattaggca

SEQ ID NO: 2138180 - DNA, 19 bp, Homo sapiens
atttttgaggaattatcat

SEQ ID NO: 2138181 - DNA, 13 bp, Homo sapiens
atttttgataaat

SEQ ID NO: 2138182 - DNA, 19 bp, Homo sapiens
atttttgataaattatgtt

SEQ ID NO: 2138183 - DNA, 13 bp, Homo sapiens
atttttgatttat

SEQ ID NO: 2138184 - DNA, 23 bp, Homo sapiens
atttttgatttatgcatggaaac

SEQ ID NO: 2138185 - DNA, 23 bp, Homo sapiens
atttttggaagaggactccttaa

SEQ ID NO: 2138186 - DNA, 19 bp, Homo sapiens
atttttggttgtcaatatt

SEQ ID NO: 2138187 - DNA, 13 bp, Homo sapiens
atttttgtaataa

SEQ ID NO: 2138188 - DNA, 20 bp, Homo sapiens
atttttgtacgttatatatt

SEQ ID NO: 2138189 - DNA, 19 bp, Homo sapiens
atttttgtagagccagggt

SEQ ID NO: 2138190 - DNA, 13 bp, Homo sapiens
atttttgtccctg

SEQ ID NO: 2138191 - DNA, 16 bp, Homo sapiens
atttttgtccctgctc

SEQ ID NO: 2138192 - DNA, 17 bp, Homo sapiens
atttttgtttcttccaa

SEQ ID NO: 2138193 - DNA, 12 bp, Homo sapiens
attttttaaagc

SEQ ID NO: 2138194 - DNA, 18 bp, Homo sapiens
attttttaaatgaaaatg

SEQ ID NO: 2138195 - DNA, 11 bp, Homo sapiens
attttttaagt

SEQ ID NO: 2138196 - DNA, 16 bp, Homo sapiens
attttttaagtattta

SEQ ID NO: 2138197 - DNA, 19 bp, Homo sapiens
attttttaagtatttatat

SEQ ID NO: 2138198 - DNA, 14 bp, Homo sapiens
attttttaataaaa

SEQ ID NO: 2138199 - DNA, 13 bp, Homo sapiens
attttttattgtt

SEQ ID NO: 2138200 - DNA, 13 bp, Homo sapiens
attttttcagaaa

SEQ ID NO: 2138201 - DNA, 22 bp, Homo sapiens
attttttcagaaatatgtggtt

SEQ ID NO: 2138202 - DNA, 23 bp, Homo sapiens
attttttccttcaaagtttaata

SEQ ID NO: 2138203 - DNA, 14 bp, Homo sapiens
atttttttaagtta

SEQ ID NO: 2138204 - DNA, 14 bp, Homo sapiens
atttttttatacta

SEQ ID NO: 2138205 - DNA, 21 bp, Homo sapiens
atttttttcactggagttaca

SEQ ID NO: 2138206 - DNA, 16 bp, Homo sapiens
atttttttccttgcaa

SEQ ID NO: 2138207 - DNA, 16 bp, Homo sapiens
atttttttgagacaga

SEQ ID NO: 2138208 - DNA, 16 bp, Homo sapiens
attttttttgtaactt

SEQ ID NO: 2138209 - DNA, 18 bp, Homo sapiens
attttttttttaaaacta

SEQ ID NO: 2138210 - DNA, 14 bp, Homo sapiens
caaaaaaagccttt

SEQ ID NO: 2138211 - DNA, 22 bp, Homo sapiens
caaaaaacttttaatgccttcc

SEQ ID NO: 2138212 - DNA, 15 bp, Homo sapiens
caaaaaagtattttt

SEQ ID NO: 2138213 - DNA, 16 bp, Homo sapiens
caaaaaattagccggg

SEQ ID NO: 2138214 - DNA, 17 bp, Homo sapiens
caaaaacacagcaaggg

SEQ ID NO: 2138215 - DNA, 13 bp, Homo sapiens
caaaaacagcctc

SEQ ID NO: 2138216 - DNA, 15 bp, Homo sapiens
caaaaacagcctcac

SEQ ID NO: 2138217 - DNA, 22 bp, Homo sapiens
caaaaacagcctcacagaagaa

SEQ ID NO: 2138218 - DNA, 18 bp, Homo sapiens
caaaaacatacttcaaaa

SEQ ID NO: 2138219 - DNA, 19 bp, Homo sapiens
caaaaacatacttcaaaaa

SEQ ID NO: 2138220 - DNA, 16 bp, Homo sapiens
caactgacacaggaaa

SEQ ID NO: 2138221 - DNA, 13 bp, Homo sapiens
caactgaggcaga

SEQ ID NO: 2138222 - DNA, 17 bp, Homo sapiens
caactgaggcagacagc

SEQ ID NO: 2138223 - DNA, 22 bp, Homo sapiens
caactgaggcagacagcagctc

SEQ ID NO: 2138224 - DNA, 12 bp, Homo sapiens
caactgctctgc

SEQ ID NO: 2138225 - DNA, 13 bp, Homo sapiens
caactgctctgcc

SEQ ID NO: 2138226 - DNA, 13 bp, Homo sapiens
caactggctggga

SEQ ID NO: 2138227 - DNA, 15 bp, Homo sapiens
caactggctgggaca

SEQ ID NO: 2138228 - DNA, 12 bp, Homo sapiens
caactggcttct

SEQ ID NO: 2138229 - DNA, 16 bp, Homo sapiens
caactggcttctgtgc

SEQ ID NO: 2138230 - DNA, 19 bp, Homo sapiens
caactgttggataataact

SEQ ID NO: 2138231 - DNA, 17 bp, Homo sapiens
caactgtttttgaagaa

SEQ ID NO: 2138232 - DNA, 15 bp, Homo sapiens
caacttaaatcactg

SEQ ID NO: 2138233 - DNA, 15 bp, Homo sapiens
caacttaacatgaaa

SEQ ID NO: 2138234 - DNA, 18 bp, Homo sapiens
caacttcaagtgcatgct

SEQ ID NO: 2138235 - DNA, 22 bp, Homo sapiens
caacttcaagtgcatgctctct

SEQ ID NO: 2138236 - DNA, 24 bp, Homo sapiens
caacttgaaattatatctgtggtc

SEQ ID NO: 2138237 - DNA, 23 bp, Homo sapiens
caacttgcttctaaatgcccagt

SEQ ID NO: 2138238 - DNA, 19 bp, Homo sapiens
caacttggaaaaagaaaga

SEQ ID NO: 2138239 - DNA, 14 bp, Homo sapiens
caacttgtgttcta

SEQ ID NO: 2138240 - DNA, 16 bp, Homo sapiens
caacttgtgttctatt

SEQ ID NO: 2138241 - DNA, 16 bp, Homo sapiens
caactttctgtaaact

SEQ ID NO: 2138242 - DNA, 23 bp, Homo sapiens
caagaaaaagaaaaaaaaagcat

SEQ ID NO: 2138243 - DNA, 14 bp, Homo sapiens
caagaaaactggaa

SEQ ID NO: 2138244 - DNA, 13 bp, Homo sapiens
caagaaacagaag

SEQ ID NO: 2138245 - DNA, 18 bp, Homo sapiens
caagaaataagtttttgt

SEQ ID NO: 2138246 - DNA, 15 bp, Homo sapiens
caagaaatccctgtt

SEQ ID NO: 2138247 - DNA, 17 bp, Homo sapiens
caagaaattgcctcctt

SEQ ID NO: 2138248 - DNA, 13 bp, Homo sapiens
caagaaatttgat

SEQ ID NO: 2138249 - DNA, 22 bp, Homo sapiens
caagaacaacaacaacaataac

SEQ ID NO: 2138250 - DNA, 22 bp, Homo sapiens
caagaagaaatgctttccaaaa

SEQ ID NO: 2138251 - DNA, 17 bp, Homo sapiens
caagaagaatataaata

SEQ ID NO: 2138252 - DNA, 12 bp, Homo sapiens
caagaagacatg

SEQ ID NO: 2138253 - DNA, 13 bp, Homo sapiens
caagaagaccaga

SEQ ID NO: 2138254 - DNA, 17 bp, Homo sapiens
caagaagcattttgtaa

SEQ ID NO: 2138255 - DNA, 20 bp, Homo sapiens
caagaagctcccagatgctg

SEQ ID NO: 2138256 - DNA, 12 bp, Homo sapiens
caagaagctgct

SEQ ID NO: 2138257 - DNA, 22 bp, Homo sapiens
caagaagctttaatatttaaat

SEQ ID NO: 2138258 - DNA, 23 bp, Homo sapiens
caagaagggctagaacctggagg

SEQ ID NO: 2138259 - DNA, 22 bp, Homo sapiens
caagaagggttttccaccctgg

SEQ ID NO: 2138260 - DNA, 16 bp, Homo sapiens
caagaaggtgagtgct

SEQ ID NO: 2138261 - DNA, 14 bp, Homo sapiens
caagaatacagaaa

SEQ ID NO: 2138262 - DNA, 17 bp, Homo sapiens
caagaatacagaaaatg

SEQ ID NO: 2138263 - DNA, 19 bp, Homo sapiens
caagaattctagaaaattt

SEQ ID NO: 2138264 - DNA, 21 bp, Homo sapiens
caagaattggaagctgccctg

SEQ ID NO: 2138265 - DNA, 20 bp, Homo sapiens
caagaattgtccatgtgctt

SEQ ID NO: 2138266 - DNA, 23 bp, Homo sapiens
caagaatttcttggtaagaagcc

SEQ ID NO: 2138267 - DNA, 17 bp, Homo sapiens
caagacaaagcaaagcc

SEQ ID NO: 2138268 - DNA, 13 bp, Homo sapiens
caagacacccaag

SEQ ID NO: 2138269 - DNA, 19 bp, Homo sapiens
caagacaccttttgtattt

SEQ ID NO: 2138270 - DNA, 21 bp, Homo sapiens
caagactccgtctcaaaaaaa

SEQ ID NO: 2138271 - DNA, 15 bp, Homo sapiens
caagactctgtctca

SEQ ID NO: 2138272 - DNA, 20 bp, Homo sapiens
caagacttggcaacagaagc

SEQ ID NO: 2138273 - DNA, 16 bp, Homo sapiens
caagagaacatttcta

SEQ ID NO: 2138274 - DNA, 17 bp, Homo sapiens
caagagaagaaaaaatt

SEQ ID NO: 2138275 - DNA, 18 bp, Homo sapiens
caagagaagaaaaaatta

SEQ ID NO: 2138276 - DNA, 15 bp, Homo sapiens
caagagacagagccc

SEQ ID NO: 2138277 - DNA, 13 bp, Homo sapiens
caagagactgagt

SEQ ID NO: 2138278 - DNA, 20 bp, Homo sapiens
caagagagacattgcctcca

SEQ ID NO: 2138279 - DNA, 20 bp, Homo sapiens
caagagagggccatgcaatt

SEQ ID NO: 2138280 - DNA, 18 bp, Homo sapiens
caagagcaatcaaagcag

SEQ ID NO: 2138281 - DNA, 19 bp, Homo sapiens
caagagcaatcaaagcagc

SEQ ID NO: 2138282 - DNA, 22 bp, Homo sapiens
caagagcacattcttaaaggaa

SEQ ID NO: 2138283 - DNA, 22 bp, Homo sapiens
caagagcatcgtgacccttcag

SEQ ID NO: 2138284 - DNA, 17 bp, Homo sapiens
caagagccatgtaccag

SEQ ID NO: 2138285 - DNA, 13 bp, Homo sapiens
caagagcccagca

SEQ ID NO: 2138286 - DNA, 12 bp, Homo sapiens
caagagccttgg

SEQ ID NO: 2138287 - DNA, 21 bp, Homo sapiens
caagagccttggtgtccacct

SEQ ID NO: 2138288 - DNA, 14 bp, Homo sapiens
caagagctgctgtc

SEQ ID NO: 2138289 - DNA, 15 bp, Homo sapiens
caagaggcccaggga

SEQ ID NO: 2138290 - DNA, 17 bp, Homo sapiens
caagagggcactggtgg

SEQ ID NO: 2138291 - DNA, 12 bp, Homo sapiens
caagagggctgc

SEQ ID NO: 2138292 - DNA, 13 bp, Homo sapiens
caagagggctgct

SEQ ID NO: 2138293 - DNA, 16 bp, Homo sapiens
caagagggtctgagga

SEQ ID NO: 2138294 - DNA, 17 bp, Homo sapiens
caagagggtctgaggaa

SEQ ID NO: 2138295 - DNA, 12 bp, Homo sapiens
caagaggtctga

SEQ ID NO: 2138296 - DNA, 15 bp, Homo sapiens
caagaggtctgagcc

SEQ ID NO: 2138297 - DNA, 20 bp, Homo sapiens
caagaggtctgagccctggt

SEQ ID NO: 2138298 - DNA, 16 bp, Homo sapiens
caagagtattccattt

SEQ ID NO: 2138299 - DNA, 24 bp, Homo sapiens
caagagttctttaggtgcctcctg

SEQ ID NO: 2138300 - DNA, 15 bp, Homo sapiens
caagataactgagaa

SEQ ID NO: 2138301 - DNA, 16 bp, Homo sapiens
caagataactgagaat

SEQ ID NO: 2138302 - DNA, 18 bp, Homo sapiens
caagatacatttcatctg

SEQ ID NO: 2138303 - DNA, 22 bp, Homo sapiens
caagatcctgtctttaaggaaa

SEQ ID NO: 2138304 - DNA, 16 bp, Homo sapiens
caagatcgcgccactg

SEQ ID NO: 2138305 - DNA, 15 bp, Homo sapiens
caagatgacagctct

SEQ ID NO: 2138306 - DNA, 16 bp, Homo sapiens
caagatgacagctctt

SEQ ID NO: 2138307 - DNA, 19 bp, Homo sapiens
caagatgagagaactggag

SEQ ID NO: 2138308 - DNA, 15 bp, Homo sapiens
caagatggaaaataa

SEQ ID NO: 2138309 - DNA, 17 bp, Homo sapiens
caagatgggcacatgag

SEQ ID NO: 2138310 - DNA, 19 bp, Homo sapiens
caagatgtcctccttgttc

SEQ ID NO: 2138311 - DNA, 23 bp, Homo sapiens
caagattcccagagacaggaaaa

SEQ ID NO: 2138312 - DNA, 18 bp, Homo sapiens
caagattttccacaagat

SEQ ID NO: 2138313 - DNA, 17 bp, Homo sapiens
caagattttctactttt

SEQ ID NO: 2138314 - DNA, 17 bp, Homo sapiens
caagcaaggatatcaga

SEQ ID NO: 2138315 - DNA, 13 bp, Homo sapiens
caagcaataatta

SEQ ID NO: 2138316 - DNA, 18 bp, Homo sapiens
caagcaataattaggatc

SEQ ID NO: 2138317 - DNA, 18 bp, Homo sapiens
caagcaatggacctttgg

SEQ ID NO: 2138318 - DNA, 14 bp, Homo sapiens
caagcacagacatt

SEQ ID NO: 2138319 - DNA, 19 bp, Homo sapiens
caagcaccctgttccctct

SEQ ID NO: 2138320 - DNA, 14 bp, Homo sapiens
caagcacctcctgc

SEQ ID NO: 2138321 - DNA, 19 bp, Homo sapiens
caagcacctgcagattctg

SEQ ID NO: 2138322 - DNA, 18 bp, Homo sapiens
caagcactcgagaccatc

SEQ ID NO: 2138323 - DNA, 18 bp, Homo sapiens
caagcactgctaggcgag

SEQ ID NO: 2138324 - DNA, 16 bp, Homo sapiens
caagcagccagccagt

SEQ ID NO: 2138325 - DNA, 16 bp, Homo sapiens
caagcagcctcctggg

SEQ ID NO: 2138326 - DNA, 17 bp, Homo sapiens
caagcagggaaagctcc

SEQ ID NO: 2138327 - DNA, 16 bp, Homo sapiens
caagcataccaacacg

SEQ ID NO: 2138328 - DNA, 18 bp, Homo sapiens
caagcatggctattttat

SEQ ID NO: 2138329 - DNA, 16 bp, Homo sapiens
caagcattcagaagaa

SEQ ID NO: 2138330 - DNA, 17 bp, Homo sapiens
caagcattcagaagaaa

SEQ ID NO: 2138331 - DNA, 15 bp, Homo sapiens
caagcattctcctgt

SEQ ID NO: 2138332 - DNA, 20 bp, Homo sapiens
caagccaacttgtaaataca

SEQ ID NO: 2138333 - DNA, 14 bp, Homo sapiens
caagccacagaagc

SEQ ID NO: 2138334 - DNA, 15 bp, Homo sapiens
caagccactatgtcc

SEQ ID NO: 2138335 - DNA, 17 bp, Homo sapiens
cacagactacagccaga

SEQ ID NO: 2138336 - DNA, 15 bp, Homo sapiens
cacagactccctccc

SEQ ID NO: 2138337 - DNA, 19 bp, Homo sapiens
cacagactccctcccctgc

SEQ ID NO: 2138338 - DNA, 22 bp, Homo sapiens
cacagacttctggaaggctggc

SEQ ID NO: 2138339 - DNA, 21 bp, Homo sapiens
cacagagaaagtacttctcca

SEQ ID NO: 2138340 - DNA, 20 bp, Homo sapiens
cacagagaagacgggatttg

SEQ ID NO: 2138341 - DNA, 12 bp, Homo sapiens
cacagagatatg

SEQ ID NO: 2138342 - DNA, 19 bp, Homo sapiens
cacagagcctgaatttgta

SEQ ID NO: 2138343 - DNA, 21 bp, Homo sapiens
cacagagctggcgactgcagc

SEQ ID NO: 2138344 - DNA, 16 bp, Homo sapiens
cacagaggaagagcag
